United States Patent 10,706,955 (BIOINFORMATIC PROCESSES FOR DETERMINATION OF PEPTIDE BINDING) - sequence listing, part 49

SEQ ID NO: 1865395 - protein, 13 aa, Staphylococcus
STWNSLSRGTRSI

SEQ ID NO: 1865396 - protein, 49 aa, Staphylococcus
STYGYRQKQRYKKMNEDKQNEAEKEQHAQAAVEKKKQESEAKARQERSD

SEQ ID NO: 1865397 - protein, 6 aa, Staphylococcus
STYITK

SEQ ID NO: 1865398 - protein, 14 aa, Staphylococcus
STYLRSATSYSQSN

SEQ ID NO: 1865399 - protein, 7 aa, Staphylococcus
STYQSDI

SEQ ID NO: 1865400 - protein, 7 aa, Staphylococcus
STYRTGI

SEQ ID NO: 1865401 - protein, 8 aa, Staphylococcus
STYRTGVD

SEQ ID NO: 1865402 - protein, 7 aa, Staphylococcus
SVAGQNA

SEQ ID NO: 1865403 - protein, 7 aa, Staphylococcus
SVATNSS

SEQ ID NO: 1865404 - protein, 5 aa, Staphylococcus
SVDGI

SEQ ID NO: 1865405 - protein, 28 aa, Staphylococcus
SVDKPINSDSVEISGGFNGEEGVEKAKQ

SEQ ID NO: 1865406 - protein, 6 aa, Staphylococcus
SVDKTG

SEQ ID NO: 1865407 - protein, 28 aa, Staphylococcus
SVDQPINSDSVEISGGFNGEKGVQKAKQ

SEQ ID NO: 1865408 - protein, 12 aa, Staphylococcus
SVDRTTNGHGKI

SEQ ID NO: 1865409 - protein, 7 aa, Staphylococcus
SVDTSQD

SEQ ID NO: 1865410 - protein, 7 aa, Staphylococcus
SVDTSQS

SEQ ID NO: 1865411 - protein, 7 aa, Staphylococcus
SVDTTEG

SEQ ID NO: 1865412 - protein, 6 aa, Staphylococcus
SVEEKE

SEQ ID NO: 1865413 - protein, 6 aa, Staphylococcus
SVEEQE

SEQ ID NO: 1865414 - protein, 5 aa, Staphylococcus
SVEER

SEQ ID NO: 1865415 - protein, 4 aa, Staphylococcus
SVEG

SEQ ID NO: 1865416 - protein, 5 aa, Staphylococcus
SVEGV

SEQ ID NO: 1865417 - protein, 6 aa, Staphylococcus
SVENAE

SEQ ID NO: 1865418 - protein, 4 aa, Staphylococcus
SVEQ

SEQ ID NO: 1865419 - protein, 10 aa, Staphylococcus
SVGDKYHGNE

SEQ ID NO: 1865420 - protein, 16 aa, Staphylococcus
SVGGPTPNDPTGNSNS

SEQ ID NO: 1865421 - protein, 16 aa, Staphylococcus
SVGGPTPSDPTGSTNS

SEQ ID NO: 1865422 - protein, 5 aa, Staphylococcus
SVGGT

SEQ ID NO: 1865423 - protein, 10 aa, Staphylococcus
SVGTANMDNR

SEQ ID NO: 1865424 - protein, 8 aa, Staphylococcus
SVGTIDKS

SEQ ID NO: 1865425 - protein, 24 aa, Staphylococcus
SVHARKDITENEEEHHTSNASQSK

SEQ ID NO: 1865426 - protein, 13 aa, Staphylococcus
SVKKGNLKIDTGK

SEQ ID NO: 1865427 - protein, 10 aa, Staphylococcus
SVKNRDSSGV

SEQ ID NO: 1865428 - protein, 4 aa, Staphylococcus
SVKS

SEQ ID NO: 1865429 - protein, 5 aa, Staphylococcus
SVKTN

SEQ ID NO: 1865430 - protein, 9 aa, Staphylococcus
SVKTPNSNT

SEQ ID NO: 1865431 - protein, 11 aa, Staphylococcus
SVNPGNSGGAV

SEQ ID NO: 1865432 - protein, 17 aa, Staphylococcus
SVNPGNSGGAVVNKDGE

SEQ ID NO: 1865433 - protein, 7 aa, Staphylococcus
SVNPHDS

SEQ ID NO: 1865434 - protein, 7 aa, Staphylococcus
SVNPYDS

SEQ ID NO: 1865435 - protein, 4 aa, Staphylococcus
SVNS

SEQ ID NO: 1865436 - protein, 11 aa, Staphylococcus
SVPNPLKKEEI

SEQ ID NO: 1865437 - protein, 6 aa, Staphylococcus
SVPSDI

SEQ ID NO: 1865438 - protein, 11 aa, Staphylococcus
SVQADKPSLWQ

SEQ ID NO: 1865439 - protein, 17 aa, Staphylococcus
SVQPDADGNTEVTFSDG

SEQ ID NO: 1865440 - protein, 5 aa, Staphylococcus
SVQPS

SEQ ID NO: 1865441 - protein, 8 aa, Staphylococcus
SVRQHENE

SEQ ID NO: 1865442 - protein, 61 aa, Staphylococcus
SVRSSSISATQTLKEKREANKSNKEQRAKDKAERIDKRHRTNDKDEVKDVSDLPEVPQDSD

SEQ ID NO: 1865443 - protein, 7 aa, Staphylococcus
SVSEINQ

SEQ ID NO: 1865444 - protein, 13 aa, Staphylococcus
SVSHSNPGEVSKA

SEQ ID NO: 1865445 - protein, 7 aa, Staphylococcus
SVSKKEA

SEQ ID NO: 1865446 - protein, 6 aa, Staphylococcus
SVSNHN

SEQ ID NO: 1865447 - protein, 7 aa, Staphylococcus
SVSQSKF

SEQ ID NO: 1865448 - protein, 12 aa, Staphylococcus
SVSTDDIDKDIR

SEQ ID NO: 1865449 - protein, 14 aa, Staphylococcus
SVSTQITDSIESNN

SEQ ID NO: 1865450 - protein, 43 aa, Staphylococcus
SVSTSDSAKESTSISTRLSDSTSASIATSDANSESLSTSMSNS

SEQ ID NO: 1865451 - protein, 11 aa, Staphylococcus
SVTDAGSKVDA

SEQ ID NO: 1865452 - protein, 7 aa, Staphylococcus
SVTELDQ

SEQ ID NO: 1865453 - protein, 4 aa, Staphylococcus
SVTG

SEQ ID NO: 1865454 - protein, 5 aa, Staphylococcus
SVTGL

SEQ ID NO: 1865455 - protein, 5 aa, Staphylococcus
SVTIK

SEQ ID NO: 1865456 - protein, 30 aa, Staphylococcus
SVTIKDKDGNIQDRPTYTAQIDASDAEKGI

SEQ ID NO: 1865457 - protein, 6 aa, Staphylococcus
SVTNNN

SEQ ID NO: 1865458 - protein, 11 aa, Staphylococcus
SVTPQDNGDTK

SEQ ID NO: 1865459 - protein, 19 aa, Staphylococcus
SVTSNDRDGTTFTVTLPET

SEQ ID NO: 1865460 - protein, 7 aa, Staphylococcus
SVTSNNI

SEQ ID NO: 1865461 - protein, 4 aa, Staphylococcus
SVVE

SEQ ID NO: 1865462 - protein, 6 aa, Staphylococcus
SVYSTG

SEQ ID NO: 1865463 - protein, 7 aa, Staphylococcus
SWGGSGL

SEQ ID NO: 1865464 - protein, 6 aa, Staphylococcus
SWNETG

SEQ ID NO: 1865465 - protein, 5 aa, Staphylococcus
SWNPV

SEQ ID NO: 1865466 - protein, 5 aa, Staphylococcus
SWPAP

SEQ ID NO: 1865467 - protein, 25 aa, Staphylococcus
SYAKSRSEISSEDSGARAKGDINNA

SEQ ID NO: 1865468 - protein, 10 aa, Staphylococcus
SYAPKAMTIK

SEQ ID NO: 1865469 - protein, 5 aa, Staphylococcus
SYDEE

SEQ ID NO: 1865470 - protein, 6 aa, Staphylococcus
SYDEER

SEQ ID NO: 1865471 - protein, 8 aa, Staphylococcus
SYDGETDV

SEQ ID NO: 1865472 - protein, 5 aa, Staphylococcus
SYDNE

SEQ ID NO: 1865473 - protein, 6 aa, Staphylococcus
SYDPHR

SEQ ID NO: 1865474 - protein, 12 aa, Staphylococcus
SYDSATNTAKYT

SEQ ID NO: 1865475 - protein, 18 aa, Staphylococcus
SYEDARDKKENYFDDEYD

SEQ ID NO: 1865476 - protein, 5 aa, Staphylococcus
SYEQQ

SEQ ID NO: 1865477 - protein, 7 aa, Staphylococcus
SYEQVQQ

SEQ ID NO: 1865478 - protein, 5 aa, Staphylococcus
SYGEA

SEQ ID NO: 1865479 - protein, 7 aa, Staphylococcus
SYGGTGL

SEQ ID NO: 1865480 - protein, 5 aa, Staphylococcus
SYGIN

SEQ ID NO: 1865481 - protein, 6 aa, Staphylococcus
SYGSTS

SEQ ID NO: 1865482 - protein, 6 aa, Staphylococcus
SYHDIT

SEQ ID NO: 1865483 - protein, 8 aa, Staphylococcus
SYKDNGVG

SEQ ID NO: 1865484 - protein, 5 aa, Staphylococcus
SYKEA

SEQ ID NO: 1865485 - protein, 8 aa, Staphylococcus
SYKMDGLS

SEQ ID NO: 1865486 - protein, 9 aa, Staphylococcus
SYKNNAEPV

SEQ ID NO: 1865487 - protein, 8 aa, Staphylococcus
SYLDDNEA

SEQ ID NO: 1865488 - protein, 15 aa, Staphylococcus
SYLNNAAKQVGPRLG

SEQ ID NO: 1865489 - protein, 16 aa, Staphylococcus
SYLREQAKHPGEVSGN

SEQ ID NO: 1865490 - protein, 10 aa, Staphylococcus
SYNDGGALQS

SEQ ID NO: 1865491 - protein, 5 aa, Staphylococcus
SYNDT

SEQ ID NO: 1865492 - protein, 13 aa, Staphylococcus
SYNETKDSKLDKR

SEQ ID NO: 1865493 - protein, 7 aa, Staphylococcus
SYNSELT

SEQ ID NO: 1865494 - protein, 10 aa, Staphylococcus
SYNSGEINQT

SEQ ID NO: 1865495 - protein, 7 aa, Staphylococcus
SYNSTDQ

SEQ ID NO: 1865496 - protein, 12 aa, Staphylococcus
SYNYKQGDKIGV

SEQ ID NO: 1865497 - protein, 6 aa, Staphylococcus
SYPRER

SEQ ID NO: 1865498 - protein, 6 aa, Staphylococcus
SYQAEQ

SEQ ID NO: 1865499 - protein, 8 aa, Staphylococcus
SYQAEQAP

SEQ ID NO: 1865500 - protein, 35 aa, Staphylococcus
SYQDITTNNDGSALQIDKEKNKKAIQDFFDDKNNK

SEQ ID NO: 1865501 - protein, 14 aa, Staphylococcus
SYQSKSHKNKYSSK

SEQ ID NO: 1865502 - protein, 8 aa, Staphylococcus
SYQSRQQM

SEQ ID NO: 1865503 - protein, 8 aa, Staphylococcus
SYRSNYAH

SEQ ID NO: 1865504 - protein, 10 aa, Staphylococcus
SYSAGDGYHL

SEQ ID NO: 1865505 - protein, 6 aa, Staphylococcus
SYSEAL

SEQ ID NO: 1865506 - protein, 7 aa, Staphylococcus
SYSETDV

SEQ ID NO: 1865507 - protein, 7 aa, Staphylococcus
SYSGLKK

SEQ ID NO: 1865508 - protein, 12 aa, Staphylococcus
SYSGLKKGIQKL

SEQ ID NO: 1865509 - protein, 7 aa, Staphylococcus
SYSKLSY

SEQ ID NO: 1865510 - protein, 7 aa, Staphylococcus
SYSKNVA

SEQ ID NO: 1865511 - protein, 5 aa, Staphylococcus
SYSNY

SEQ ID NO: 1865512 - protein, 8 aa, Staphylococcus
SYTGESED

SEQ ID NO: 1865513 - protein, 12 aa, Staphylococcus
SYTSKANKAQHG

SEQ ID NO: 1865514 - protein, 14 aa, Staphylococcus
SYTVSGSSMYPTFQ

SEQ ID NO: 1865515 - protein, 9 aa, Staphylococcus
SYVGSGAAQ

SEQ ID NO: 1865516 - protein, 10 aa, Staphylococcus
SYVGSGAAQF

SEQ ID NO: 1865517 - protein, 12 aa, Staphylococcus
SYVGSGAAQFKN

SEQ ID NO: 1865518 - protein, 14 aa, Staphylococcus
SYVSTDNAKVDGDQ

SEQ ID NO: 1865519 - protein, 6 aa, Staphylococcus
SYVTGN

SEQ ID NO: 1865520 - protein, 26 aa, Staphylococcus
SYVTTDNAKVDGDQIKISSPASGQIK

SEQ ID NO: 1865521 - protein, 14 aa, Staphylococcus
SYVTTDNAKVDGNQ

SEQ ID NO: 1865522 - protein, 13 aa, Staphylococcus
TAAMGGVSKSAYT

SEQ ID NO: 1865523 - protein, 10 aa, Staphylococcus
TAANDSAADI

SEQ ID NO: 1865524 - protein, 7 aa, Staphylococcus
TADDDTI

SEQ ID NO: 1865525 - protein, 19 aa, Staphylococcus
TADGETIEYDHSSHKAMKD

SEQ ID NO: 1865526 - protein, 15 aa, Staphylococcus
TADGRTEEGKEDEVY

SEQ ID NO: 1865527 - protein, 4 aa, Staphylococcus
TADI

SEQ ID NO: 1865528 - protein, 7 aa, Staphylococcus
TADKIGD

SEQ ID NO: 1865529 - protein, 11 aa, Staphylococcus
TADSKDKTLDA

SEQ ID NO: 1865530 - protein, 16 aa, Staphylococcus
TAEETQKRKKKELDKQ

SEQ ID NO: 1865531 - protein, 5 aa, Staphylococcus
TAEQL

SEQ ID NO: 1865532 - protein, 9 aa, Staphylococcus
TAESKQKKR

SEQ ID NO: 1865533 - protein, 4 aa, Staphylococcus
TAFK

SEQ ID NO: 1865534 - protein, 12 aa, Staphylococcus
TAFSDAENEYKI

SEQ ID NO: 1865535 - protein, 8 aa, Staphylococcus
TAFSNEQT

SEQ ID NO: 1865536 - protein, 4 aa, Staphylococcus
TAGA

SEQ ID NO: 1865537 - protein, 30 aa, Staphylococcus
TAGANEASQSHDSQPEVNQDHSDSNITEQT

SEQ ID NO: 1865538 - protein, 32 aa, Staphylococcus
TAGANEATTTEPAPSDEEVSAKESSNSINEQT

SEQ ID NO: 1865539 - protein, 32 aa, Staphylococcus
TAGANETTTTESAPSDEEVSAKNSSNSINEQT

SEQ ID NO: 1865540 - protein, 15 aa, Staphylococcus
TAGESDNPEKSMPNA

SEQ ID NO: 1865541 - protein, 15 aa, Staphylococcus
TAGESDNPEKTMPKA

SEQ ID NO: 1865542 - protein, 14 aa, Staphylococcus
TAGESDNPEKTMPR

SEQ ID NO: 1865543 - protein, 15 aa, Staphylococcus
TAGESDNPSKTMPKA

SEQ ID NO: 1865544 - protein, 14 aa, Staphylococcus
TAGESSDPSKSMPR

SEQ ID NO: 1865545 - protein, 14 aa, Staphylococcus
TAGESSNPDRSMPK

SEQ ID NO: 1865546 - protein, 15 aa, Staphylococcus
TAGETKDPEKTIPKA

SEQ ID NO: 1865547 - protein, 15 aa, Staphylococcus
TAGETKDPQKTIPKA

SEQ ID NO: 1865548 - protein, 11 aa, Staphylococcus
TAGETKDPRNV

SEQ ID NO: 1865549 - protein, 11 aa, Staphylococcus
TAGETKDPRTV

SEQ ID NO: 1865550 - protein, 20 aa, Staphylococcus
TAGETKDPTKTLPKAVNSVP

SEQ ID NO: 1865551 - protein, 15 aa, Staphylococcus
TAGETKDREKTIPKA

SEQ ID NO: 1865552 - protein, 4 aa, Staphylococcus
TAGG

SEQ ID NO: 1865553 - protein, 6 aa, Staphylococcus
TAGGEC

SEQ ID NO: 1865554 - protein, 6 aa, Staphylococcus
TAGGVS

SEQ ID NO: 1865555 - protein, 21 aa, Staphylococcus
TAGKSLKGSYPNVDNEEDRAY

SEQ ID NO: 1865556 - protein, 18 aa, Staphylococcus
TAGKSLKGSYPNVDNKKD

SEQ ID NO: 1865557 - protein, 6 aa, Staphylococcus
TAGNPA

SEQ ID NO: 1865558 - protein, 5 aa, Staphylococcus
TAGSV

SEQ ID NO: 1865559 - protein, 4 aa, Staphylococcus
TAGY

SEQ ID NO: 1865560 - protein, 4 aa, Staphylococcus
TAHH

SEQ ID NO: 1865561 - protein, 8 aa, Staphylococcus
TAHSKTES

SEQ ID NO: 1865562 - protein, 15 aa, Staphylococcus
TAHTKKQVYEDSTQF

SEQ ID NO: 1865563 - protein, 9 aa, Staphylococcus
TAINDTSSV

SEQ ID NO: 1865564 - protein, 6 aa, Staphylococcus
TAIPSK

SEQ ID NO: 1865565 - protein, 20 aa, Staphylococcus
TAKATDDAETLNSSYSDPVN

SEQ ID NO: 1865566 - protein, 4 aa, Staphylococcus
TAKE

SEQ ID NO: 1865567 - protein, 5 aa, Staphylococcus
TAKEL

SEQ ID NO: 1865568 - protein, 9 aa, Staphylococcus
TAKKENKKV

SEQ ID NO: 1865569 - protein, 16 aa, Staphylococcus
TAKNEASTSSKSHKES

SEQ ID NO: 1865570 - protein, 8 aa, Staphylococcus
TAKNGENV

SEQ ID NO: 1865571 - protein, 13 aa, Staphylococcus
TAKNVDTSDSFYE

SEQ ID NO: 1865572 - protein, 7 aa, Staphylococcus
TAKPIED

SEQ ID NO: 1865573 - protein, 7 aa, Staphylococcus
TAKPIQD

SEQ ID NO: 1865574 - protein, 5 aa, Staphylococcus
TALKQ

SEQ ID NO: 1865575 - protein, 4 aa, Staphylococcus
TALN

SEQ ID NO: 1865576 - protein, 4 aa, Staphylococcus
TALQ

SEQ ID NO: 1865577 - protein, 11 aa, Staphylococcus
TALQDSSKKII

SEQ ID NO: 1865578 - protein, 26 aa, Staphylococcus
TALTAANKSKFQTEAKNGDKRSQKLS

SEQ ID NO: 1865579 - protein, 6 aa, Staphylococcus
TANAEK

SEQ ID NO: 1865580 - protein, 9 aa, Staphylococcus
TANAVATAV

SEQ ID NO: 1865581 - protein, 17 aa, Staphylococcus
TANGQSELANGIKENNH

SEQ ID NO: 1865582 - protein, 15 aa, Staphylococcus
TANIDSETEEQIQQS

SEQ ID NO: 1865583 - protein, 15 aa, Staphylococcus
TANLDSESEKKIQEA

SEQ ID NO: 1865584 - protein, 11 aa, Staphylococcus
TANLDSESELK

SEQ ID NO: 1865585 - protein, 14 aa, Staphylococcus
TANLDSESERKIQD

SEQ ID NO: 1865586 - protein, 12 aa, Staphylococcus
TANLDSESEVKI

SEQ ID NO: 1865587 - protein, 34 aa, Staphylococcus
TANNYKAKKVEAEQVSRDAQKVIENDDATSGEIA

SEQ ID NO: 1865588 - protein, 7 aa, Staphylococcus
TANQEEL

SEQ ID NO: 1865589 - protein, 11 aa, Staphylococcus
TANQFDNETLN

SEQ ID NO: 1865590 - protein, 8 aa, Staphylococcus
TAPAIGPT

SEQ ID NO: 1865591 - protein, 12 aa, Staphylococcus
TAPFGLSQNPLS

SEQ ID NO: 1865592 - protein, 5 aa, Staphylococcus
TAPGI

SEQ ID NO: 1865593 - protein, 11 aa, Staphylococcus
TAPKKTGTYGG

SEQ ID NO: 1865594 - protein, 10 aa, Staphylococcus
TAPNKTGTYG

SEQ ID NO: 1865595 - protein, 7 aa, Staphylococcus
TAPTKEA

SEQ ID NO: 1865596 - protein, 28 aa, Staphylococcus
TAPTKQPIIKPKEETKYEFKTGGKRKTV

SEQ ID NO: 1865597 - protein, 6 aa, Staphylococcus
TAQAIN

SEQ ID NO: 1865598 - protein, 8 aa, Staphylococcus
TAQDYEVD

SEQ ID NO: 1865599 - protein, 18 aa, Staphylococcus
TAQEVTTEIRDNYSSYTS

SEQ ID NO: 1865600 - protein, 10 aa, Staphylococcus
TAQQQAFNEQ

SEQ ID NO: 1865601 - protein, 5 aa, Staphylococcus
TAQRE

SEQ ID NO: 1865602 - protein, 6 aa, Staphylococcus
TAQREQ

SEQ ID NO: 1865603 - protein, 15 aa, Staphylococcus
TAQSEINSEKERALA

SEQ ID NO: 1865604 - protein, 15 aa, Staphylococcus
TAQSEINSQKERALA

SEQ ID NO: 1865605 - protein, 9 aa, Staphylococcus
TARESNMKH

SEQ ID NO: 1865606 - protein, 11 aa, Staphylococcus
TARESNPKHQD

SEQ ID NO: 1865607 - protein, 11 aa, Staphylococcus
TARESNPKHQE

SEQ ID NO: 1865608 - protein, 11 aa, Staphylococcus
TARETNPKHQQ

SEQ ID NO: 1865609 - protein, 7 aa, Staphylococcus
TARTITD

SEQ ID NO: 1865610 - protein, 9 aa, Staphylococcus
TARTMGASE

SEQ ID NO: 1865611 - protein, 4 aa, Staphylococcus
TASA

SEQ ID NO: 1865612 - protein, 5 aa, Staphylococcus
TASED

SEQ ID NO: 1865613 - protein, 24 aa, Staphylococcus
TASGNAKAAKEKAKLIENDNTVAA

SEQ ID NO: 1865614 - protein, 9 aa, Staphylococcus
TASIDPENE

SEQ ID NO: 1865615 - protein, 14 aa, Staphylococcus
TASIGHDDKNTKSL

SEQ ID NO: 1865616 - protein, 8 aa, Staphylococcus
TASKNGQL

SEQ ID NO: 1865617 - protein, 6 aa, Staphylococcus
TASPGD

SEQ ID NO: 1865618 - protein, 5 aa, Staphylococcus
TASQF

SEQ ID NO: 1865619 - protein, 8 aa, Staphylococcus
TASQHDDA

SEQ ID NO: 1865620 - protein, 28 aa, Staphylococcus
TASRSLKGSYPNVDSDEDFKKAAENPKK

SEQ ID NO: 1865621 - protein, 7 aa, Staphylococcus
TASSEAV

SEQ ID NO: 1865622 - protein, 6 aa, Staphylococcus
TASSML

SEQ ID NO: 1865623 - protein, 7 aa, Staphylococcus
TASSVPP

SEQ ID NO: 1865624 - protein, 9 aa, Staphylococcus
TASTSSIAT

SEQ ID NO: 1865625 - protein, 6 aa, Staphylococcus
TATATT

SEQ ID NO: 1865626 - protein, 12 aa, Staphylococcus
TATEEEVDSPEF

SEQ ID NO: 1865627 - protein, 16 aa, Staphylococcus
TATKSDKNKETIGQGV

SEQ ID NO: 1865628 - protein, 11 aa, Staphylococcus
TATKSSKAEAM

SEQ ID NO: 1865629 - protein, 13 aa, Staphylococcus
TATMKGTDSADNL

SEQ ID NO: 1865630 - protein, 6 aa, Staphylococcus
TATTNN

SEQ ID NO: 1865631 - protein, 8 aa, Staphylococcus
TATTNNKR

SEQ ID NO: 1865632 - protein, 7 aa, Staphylococcus
TAVGPSG

SEQ ID NO: 1865633 - protein, 16 aa, Staphylococcus
TAVGQKEEVAKKTEKI

SEQ ID NO: 1865634 - protein, 4 aa, Staphylococcus
TAVP

SEQ ID NO: 1865635 - protein, 14 aa, Staphylococcus
TAVQPDGSTKLTFS

SEQ ID NO: 1865636 - protein, 4 aa, Staphylococcus
TAVT

SEQ ID NO: 1865637 - protein, 9 aa, Staphylococcus
TAYTTTDLR

SEQ ID NO: 1865638 - protein, 6 aa, Staphylococcus
TCQKTN

SEQ ID NO: 1865639 - protein, 12 aa, Staphylococcus
TDAATGGSTITQ

SEQ ID NO: 1865640 - protein, 9 aa, Staphylococcus
TDADGNSVE

SEQ ID NO: 1865641 - protein, 10 aa, Staphylococcus
TDAEGNNVET

SEQ ID NO: 1865642 - protein, 9 aa, Staphylococcus
TDAEGNSVE

SEQ ID NO: 1865643 - protein, 5 aa, Staphylococcus
TDAES

SEQ ID NO: 1865644 - protein, 7 aa, Staphylococcus
TDAGGRD

SEQ ID NO: 1865645 - protein, 8 aa, Staphylococcus
TDAITNPQ

SEQ ID NO: 1865646 - protein, 9 aa, Staphylococcus
TDAPAVQAI

SEQ ID NO: 1865647 - protein, 14 aa, Staphylococcus
TDAQHGNKKAGKLA

SEQ ID NO: 1865648 - protein, 10 aa, Staphylococcus
TDAQKEGLKR

SEQ ID NO: 1865649 - protein, 12 aa, Staphylococcus
TDASGNQTVTNT

SEQ ID NO: 1865650 - protein, 13 aa, Staphylococcus
TDDGQGMSAETQA

SEQ ID NO: 1865651 - protein, 15 aa, Staphylococcus
TDDIKDNNESYRSNR

SEQ ID NO: 1865652 - protein, 15 aa, Staphylococcus
TDDKKRKVIAEPNET

SEQ ID NO: 1865653 - protein, 10 aa, Staphylococcus
TDDNFKPKKG

SEQ ID NO: 1865654 - protein, 7 aa, Staphylococcus
TDDRVHK

SEQ ID NO: 1865655 - protein, 36 aa, Staphylococcus
TDDSGLPVNNTVSGLPDGVTFDSTTNTISGIPTTLG

SEQ ID NO: 1865656 - protein, 9 aa, Staphylococcus
TDDTSEVEN

SEQ ID NO: 1865657 - protein, 9 aa, Staphylococcus
TDDYKSQRK

SEQ ID NO: 1865658 - protein, 11 aa, Staphylococcus
TDEADEKSTSL

SEQ ID NO: 1865659 - protein, 7 aa, Staphylococcus
TDEEVTS

SEQ ID NO: 1865660 - protein, 20 aa, Staphylococcus
TDEKEKIDKRIDNEANPSQL

SEQ ID NO: 1865661 - protein, 10 aa, Staphylococcus
TDENLNENHP

SEQ ID NO: 1865662 - protein, 11 aa, Staphylococcus
TDEQKNKAKNM

SEQ ID NO: 1865663 - protein, 14 aa, Staphylococcus
TDERSVTTRQREYA

SEQ ID NO: 1865664 - protein, 4 aa, Staphylococcus
TDEV

SEQ ID NO: 1865665 - protein, 10 aa, Staphylococcus
TDFGGPDSLR

SEQ ID NO: 1865666 - protein, 14 aa, Staphylococcus
TDGAPAEKDSQNAL

SEQ ID NO: 1865667 - protein, 4 aa, Staphylococcus
TDGK

SEQ ID NO: 1865668 - protein, 14 aa, Staphylococcus
TDGLKTGSSDVADY

SEQ ID NO: 1865669 - protein, 10 aa, Staphylococcus
TDGLTSEEIK

SEQ ID NO: 1865670 - protein, 7 aa, Staphylococcus
TDGQQKF

SEQ ID NO: 1865671 - protein, 14 aa, Staphylococcus
TDGSEVKAIENIDQ

SEQ ID NO: 1865672 - protein, 11 aa, Staphylococcus
TDGSTVKSDLN

SEQ ID NO: 1865673 - protein, 8 aa, Staphylococcus
TDGVNQGM

SEQ ID NO: 1865674 - protein, 10 aa, Staphylococcus
TDHSQSKSWA

SEQ ID NO: 1865675 - protein, 65 aa, Staphylococcus
TDHTKINNKTRNSDEAVNTSLKNEEASSKSHSYTTTNYKNVDTNDKSKHQNEHIDNKTANSNYQT

SEQ ID NO: 1865676 - protein, 4 aa, Staphylococcus
TDIA

SEQ ID NO: 1865677 - protein, 9 aa, Staphylococcus
TDIEGTPQI

SEQ ID NO: 1865678 - protein, 4 aa, Staphylococcus
TDIP

SEQ ID NO: 1865679 - protein, 6 aa, Staphylococcus
TDISSG

SEQ ID NO: 1865680 - protein, 10 aa, Staphylococcus
TDITNVNGGA

SEQ ID NO: 1865681 - protein, 12 aa, Staphylococcus
TDKADNQSLNTE

SEQ ID NO: 1865682 - protein, 18 aa, Staphylococcus
TDKDGDLAGSYKIDSDGY

SEQ ID NO: 1865683 - protein, 21 aa, Staphylococcus
TDKDIDEKDIEKLKAEASAME

SEQ ID NO: 1865684 - protein, 6 aa, Staphylococcus
TDKDLA

SEQ ID NO: 1865685 - protein, 14 aa, Staphylococcus
TDKDNDLKSVTKKL

SEQ ID NO: 1865686 - protein, 10 aa, Staphylococcus
TDKEYADAKK

SEQ ID NO: 1865687 - protein, 8 aa, Staphylococcus
TDKFTTKD

SEQ ID NO: 1865688 - protein, 10 aa, Staphylococcus
TDKKTYSRKA

SEQ ID NO: 1865689 - protein, 8 aa, Staphylococcus
TDKNSTYR

SEQ ID NO: 1865690 - protein, 13 aa, Staphylococcus
TDKPKDFKETLDN

SEQ ID NO: 1865691 - protein, 5 aa, Staphylococcus
TDKQV

SEQ ID NO: 1865692 - protein, 19 aa, Staphylococcus
TDKTFKPQLQAGTYPKKAH

SEQ ID NO: 1865693 - protein, 6 aa, Staphylococcus
TDKTLS

SEQ ID NO: 1865694 - protein, 11 aa, Staphylococcus
TDLGRNFSGSV

SEQ ID NO: 1865695 - protein, 4 aa, Staphylococcus
TDLQ

SEQ ID NO: 1865696 - protein, 23 aa, Staphylococcus
TDLTGKAGTQTPITVTTDPNTTV

SEQ ID NO: 1865697 - protein, 83 aa, Staphylococcus
TDLTKSKPVAAAKKQDQPDPSRTNATSTSHAETQSETQHHSQSLKHPNIETHTNHTQQEQHTNYNHTGQPATSNQQPTFNSEK

SEQ ID NO: 1865698 - protein, 14 aa, Staphylococcus
TDLTTTWSSTRNSI

SEQ ID NO: 1865699 - protein, 8 aa, Staphylococcus
TDMQANDS

SEQ ID NO: 1865700 - protein, 15 aa, Staphylococcus
TDNAQPPNSSFSDPI

SEQ ID NO: 1865701 - protein, 7 aa, Staphylococcus
TDNEELA

SEQ ID NO: 1865702 - protein, 8 aa, Staphylococcus
TDNEVEQM

SEQ ID NO: 1865703 - protein, 10 aa, Staphylococcus
TDNGQGIPKE

SEQ ID NO: 1865704 - protein, 8 aa, Staphylococcus
TDNHNGQL

SEQ ID NO: 1865705 - protein, 23 aa, Staphylococcus
TDNHSEQLTRSLKDNKKSANIKA

SEQ ID NO: 1865706 - protein, 8 aa, Staphylococcus
TDNKHKEL

SEQ ID NO: 1865707 - protein, 12 aa, Staphylococcus
TDNKHKSLEPHL

SEQ ID NO: 1865708 - protein, 9 aa, Staphylococcus
TDNKTGKLT

SEQ ID NO: 1865709 - protein, 8 aa, Staphylococcus
TDNNTEQD

SEQ ID NO: 1865710 - protein, 31 aa, Staphylococcus
TDNSGQPVTNTVSGLPSGVTFDPTTNTISGI

SEQ ID NO: 1865711 - protein, 8 aa, Staphylococcus
TDNSSGEL

SEQ ID NO: 1865712 - protein, 22 aa, Staphylococcus
TDNTKALKQAGLSQSEIDKQNQ

SEQ ID NO: 1865713 - protein, 9 aa, Staphylococcus
TDPARRNDA

SEQ ID NO: 1865714 - protein, 12 aa, Staphylococcus
TDPLDNSSDISV

SEQ ID NO: 1865715 - protein, 9 aa, Staphylococcus
TDPNRRTDA

SEQ ID NO: 1865716 - protein, 32 aa, Staphylococcus
TDPRYINNRSQSSNETINKNESPHSTSNFTEI

SEQ ID NO: 1865717 - protein, 37 aa, Staphylococcus
TDQAHASENTNAAVEKAQQNTESQTSRDKNSNPNDAI

SEQ ID NO: 1865718 - protein, 60 aa, Staphylococcus
TDQANSKKAEIDQTPNATDEEKAAAKAKVDEAVTTAKNAIDQATNNDGVDTAKTNGVDTI

SEQ ID NO: 1865719 - protein, 8 aa, Staphylococcus
TDQATGDY

SEQ ID NO: 1865720 - protein, 8 aa, Staphylococcus
TDQKQVTK

SEQ ID NO: 1865721 - protein, 12 aa, Staphylococcus
TDQSLDEVDPNN

SEQ ID NO: 1865722 - protein, 7 aa, Staphylococcus
TDRFNGK

SEQ ID NO: 1865723 - protein, 9 aa, Staphylococcus
TDRLENSEA

SEQ ID NO: 1865724 - protein, 5 aa, Staphylococcus
TDRPD

SEQ ID NO: 1865725 - protein, 15 aa, Staphylococcus
TDRPDLAERFKNTYP

SEQ ID NO: 1865726 - protein, 14 aa, Staphylococcus
TDRPDLAQQFKETL

SEQ ID NO: 1865727 - protein, 16 aa, Staphylococcus
TDRPDLGKQFKDSLTI

SEQ ID NO: 1865728 - protein, 15 aa, Staphylococcus
TDSDNNYISSGVYEG

SEQ ID NO: 1865729 - protein, 5 aa, Staphylococcus
TDSET

SEQ ID NO: 1865730 - protein, 7 aa, Staphylococcus
TDSFSEN

SEQ ID NO: 1865731 - protein, 6 aa, Staphylococcus
TDSGLS

SEQ ID NO: 1865732 - protein, 4 aa, Staphylococcus
TDSI

SEQ ID NO: 1865733 - protein, 5 aa, Staphylococcus
TDSIN

SEQ ID NO: 1865734 - protein, 5 aa, Staphylococcus
TDSKQ

SEQ ID NO: 1865735 - protein, 6 aa, Staphylococcus
TDSNID

SEQ ID NO: 1865736 - protein, 16 aa, Staphylococcus
TDSYQPEGAINVSQTG

SEQ ID NO: 1865737 - protein, 19 aa, Staphylococcus
TDTDVRNGVYNSNPTDLTK

SEQ ID NO: 1865738 - protein, 11 aa, Staphylococcus
TDTEGNSVETK

SEQ ID NO: 1865739 - protein, 7 aa, Staphylococcus
TDTFPGS

SEQ ID NO: 1865740 - protein, 11 aa, Staphylococcus
TDTVSAGASGA

SEQ ID NO: 1865741 - protein, 7 aa, Staphylococcus
TDVTKPK

SEQ ID NO: 1865742 - protein, 7 aa, Staphylococcus
TDVVKPE

SEQ ID NO: 1865743 - protein, 5 aa, Staphylococcus
TDYGT

SEQ ID NO: 1865744 - protein, 9 aa, Staphylococcus
TDYKRIGEE

SEQ ID NO: 1865745 - protein, 10 aa, Staphylococcus
TDYPLTPLSA

SEQ ID NO: 1865746 - protein, 5 aa, Staphylococcus
TEAAR

SEQ ID NO: 1865747 - protein, 6 aa, Staphylococcus
TEAKSP

SEQ ID NO: 1865748 - protein, 4 aa, Staphylococcus
TEAN

SEQ ID NO: 1865749 - protein, 12 aa, Staphylococcus
TEATQEEKDEAI

SEQ ID NO: 1865750 - protein, 6 aa, Staphylococcus
TECSGN

SEQ ID NO: 1865751 - protein, 5 aa, Staphylococcus
TEDDD

SEQ ID NO: 1865752 - protein, 26 aa, Staphylococcus
TEDDLNNVGSNVEQSAKEIKDNRYNN

SEQ ID NO: 1865753 - protein, 8 aa, Staphylococcus
TEDDQINS

SEQ ID NO: 1865754 - protein, 10 aa, Staphylococcus
TEDGEKQTTL

SEQ ID NO: 1865755 - protein, 10 aa, Staphylococcus
TEDGKKQTTL

SEQ ID NO: 1865756 - protein, 9 aa, Staphylococcus
TEDIQGKVD

SEQ ID NO: 1865757 - protein, 9 aa, Staphylococcus
TEDIQGKVE

SEQ ID NO: 1865758 - protein, 6 aa, Staphylococcus
TEDNPI

SEQ ID NO: 1865759 - protein, 6 aa, Staphylococcus
TEDQGA

SEQ ID NO: 1865760 - protein, 10 aa, Staphylococcus
TEDQSVNNTE

SEQ ID NO: 1865761 - protein, 5 aa, Staphylococcus
TEEEY

SEQ ID NO: 1865762 - protein, 22 aa, Staphylococcus
TEEGTPETVHSKRQEQHDTTTY

SEQ ID NO: 1865763 - protein, 5 aa, Staphylococcus
TEEHD

SEQ ID NO: 1865764 - protein, 6 aa, Staphylococcus
TEEPDV

SEQ ID NO: 1865765 - protein, 6 aa, Staphylococcus
TEEQGI

SEQ ID NO: 1865766 - protein, 5 aa, Staphylococcus
TEFRT

SEQ ID NO: 1865767 - protein, 15 aa, Staphylococcus
TEGEPVEKDRSHNTL

SEQ ID NO: 1865768 - protein, 9 aa, Staphylococcus
TEGNAAPIT

SEQ ID NO: 1865769 - protein, 8 aa, Staphylococcus
TEGVNPTI

SEQ ID NO: 1865770 - protein, 6 aa, Staphylococcus
TEHTVS

SEQ ID NO: 1865771 - protein, 6 aa, Staphylococcus
TEIERQ

SEQ ID NO: 1865772 - protein, 6 aa, Staphylococcus
TEIGTT

SEQ ID NO: 1865773 - protein, 8 aa, Staphylococcus
TEISKKER

SEQ ID NO: 1865774 - protein, 8 aa, Staphylococcus
TEISKRER

SEQ ID NO: 1865775 - protein, 7 aa, Staphylococcus
TEITKRE

SEQ ID NO: 1865776 - protein, 5 aa, Staphylococcus
TEITN

SEQ ID NO: 1865777 - protein, 5 aa, Staphylococcus
TEIYA

SEQ ID NO: 1865778 - protein, 8 aa, Staphylococcus
TEKAGDAI

SEQ ID NO: 1865779 - protein, 9 aa, Staphylococcus
TEKANDSIT

SEQ ID NO: 1865780 - protein, 9 aa, Staphylococcus
TEKDQLNQE

SEQ ID NO: 1865781 - protein, 8 aa, Staphylococcus
TEKDVSDR

SEQ ID NO: 1865782 - protein, 13 aa, Staphylococcus
TEKEAERGSDRYG

SEQ ID NO: 1865783 - protein, 8 aa, Staphylococcus
TEKGMKQQ

SEQ ID NO: 1865784 - protein, 17 aa, Staphylococcus
TEKIKTEKTLYSAKKGL

SEQ ID NO: 1865785 - protein, 12 aa, Staphylococcus
TEKKASDRYQSV

SEQ ID NO: 1865786 - protein, 7 aa, Staphylococcus
TEKKRDS

SEQ ID NO: 1865787 - protein, 9 aa, Staphylococcus
TEKLGNNKD

SEQ ID NO: 1865788 - protein, 4 aa, Staphylococcus
TEKM

SEQ ID NO: 1865789 - protein, 19 aa, Staphylococcus
TEKNRSDRYQDTESMKKDL

SEQ ID NO: 1865790 - protein, 6 aa, Staphylococcus
TEKPLH

SEQ ID NO: 1865791 - protein, 6 aa, Staphylococcus
TEKPLY

SEQ ID NO: 1865792 - protein, 8 aa, Staphylococcus
TEKPSSQD

SEQ ID NO: 1865793 - protein, 6 aa, Staphylococcus
TEKSMY

SEQ ID NO: 1865794 - protein, 10 aa, Staphylococcus
TEKSSSGSIE

SEQ ID NO: 1865795 - protein, 7 aa, Staphylococcus
TEKTINE

SEQ ID NO: 1865796 - protein, 29 aa, Staphylococcus
TEKVNSTKNDLNGNNKLAEAKTNAKNAID

SEQ ID NO: 1865797 - protein, 5 aa, Staphylococcus
TEKYD

SEQ ID NO: 1865798 - protein, 10 aa, Staphylococcus
TELDKTNPVV

SEQ ID NO: 1865799 - protein, 6 aa, Staphylococcus
TELDQN

SEQ ID NO: 1865800 - protein, 4 aa, Staphylococcus
TELN

SEQ ID NO: 1865801 - protein, 9 aa, Staphylococcus
TELNNGAGC

SEQ ID NO: 1865802 - protein, 10 aa, Staphylococcus
TELQSKVNEV

SEQ ID NO: 1865803 - protein, 10 aa, Staphylococcus
TELSNEYIDN

SEQ ID NO: 1865804 - protein, 8 aa, Staphylococcus
TELTRDNA

SEQ ID NO: 1865805 - protein, 11 aa, Staphylococcus
TENKASGKFKT

SEQ ID NO: 1865806 - protein, 10 aa, Staphylococcus
TENPETGNLQ

SEQ ID NO: 1865807 - protein, 8 aa, Staphylococcus
TENPKADI

SEQ ID NO: 1865808 - protein, 13 aa, Staphylococcus
TENQSAPKENPFK

SEQ ID NO: 1865809 - protein, 9 aa, Staphylococcus
TENSKTRRY

SEQ ID NO: 1865810 - protein, 7 aa, Staphylococcus
TENSRLS

SEQ ID NO: 1865811 - protein, 4 aa, Staphylococcus
TENY

SEQ ID NO: 1865812 - protein, 8 aa, Staphylococcus
TEPDEIRD

SEQ ID NO: 1865813 - protein, 8 aa, Staphylococcus
TEPEEIKE

SEQ ID NO: 1865814 - protein, 7 aa, Staphylococcus
TEPEEIR

SEQ ID NO: 1865815 - protein, 5 aa, Staphylococcus
TEPEQ

SEQ ID NO: 1865816 - protein, 4 aa, Staphylococcus
TEPF

SEQ ID NO: 1865817 - protein, 13 aa, Staphylococcus
TEPHSSGLGGGGA

SEQ ID NO: 1865818 - protein, 26 aa, Staphylococcus
TEPHSSGLGGGGASLTYNGKDGEVPK

SEQ ID NO: 1865819 - protein, 26 aa, Staphylococcus
TEPHSSGLGGGGATLTYDGKDGQVPN

SEQ ID NO: 1865820 - protein, 27 aa, Staphylococcus
TEPHSSGLGGGGATLTYDGKNGEEPRM

SEQ ID NO: 1865821 - protein, 26 aa, Staphylococcus
TEPHSSGLGGGGATLTYNGKDGEVPK

SEQ ID NO: 1865822 - protein, 27 aa, Staphylococcus
TEPHSSGLGGGGATLTYNGNEGEEPKV

SEQ ID NO: 1865823 - protein, 8 aa, Staphylococcus
TEPNEIKE

SEQ ID NO: 1865824 - protein, 4 aa, Staphylococcus
TEPQ

SEQ ID NO: 1865825 - protein, 31 aa, Staphylococcus
TEPSQEQHSNQTHTQDKKYTTTMKNANNTVR

SEQ ID NO: 1865826 - protein, 8 aa, Staphylococcus
TEQAGDAI

SEQ ID NO: 1865827 - protein, 8 aa, Staphylococcus
TEQGIKAP

SEQ ID NO: 1865828 - protein, 5 aa, Staphylococcus
TEQGK

SEQ ID NO: 1865829 - protein, 4 aa, Staphylococcus
TEQN

SEQ ID NO: 1865830 - protein, 11 aa, Staphylococcus
TEQQQNERDRR

SEQ ID NO: 1865831 - protein, 5 aa, Staphylococcus
TEQSI

SEQ ID NO: 1865832 - protein, 14 aa, Staphylococcus
TEQTEKSIRDDAKR

SEQ ID NO: 1865833 - protein, 6 aa, Staphylococcus
TEQTKP

SEQ ID NO: 1865834 - protein, 9 aa, Staphylococcus
TEQTYQASK

SEQ ID NO: 1865835 - protein, 48 aa, Staphylococcus
TEQVSTEGKTPASIKKYQDAKAKIQNQINAAQNEAKQVLDNENPSVEQ

SEQ ID NO: 1865836 - protein, 4 aa, Staphylococcus
TERT

SEQ ID NO: 1865837 - protein, 8 aa, Staphylococcus
TESEDDKV

SEQ ID NO: 1865838 - protein, 5 aa, Staphylococcus
TESGQ

SEQ ID NO: 1865839 - protein, 14 aa, Staphylococcus
TESGQTAAKLSGMA

SEQ ID NO: 1865840 - protein, 4 aa, Staphylococcus
TESH

SEQ ID NO: 1865841 - protein, 14 aa, Staphylococcus
TESNSGEVTITPGA

SEQ ID NO: 1865842 - protein, 5 aa, Staphylococcus
TETDY

SEQ ID NO: 1865843 - protein, 8 aa, Staphylococcus
TETGIKAP

SEQ ID NO: 1865844 - protein, 5 aa, Staphylococcus
TETHD

SEQ ID NO: 1865845 - protein, 15 aa, Staphylococcus
TETIEYKNQERVAGD

SEQ ID NO: 1865846 - protein, 9 aa, Staphylococcus
TETLTGYQK

SEQ ID NO: 1865847 - protein, 6 aa, Staphylococcus
TETPIR

SEQ ID NO: 1865848 - protein, 19 aa, Staphylococcus
TETQNTKNDYNEQQPTQQI

SEQ ID NO: 1865849 - protein, 8 aa, Staphylococcus
TETSHPKL

SEQ ID NO: 1865850 - protein, 7 aa, Staphylococcus
TETSVKK

SEQ ID NO: 1865851 - protein, 4 aa, Staphylococcus
TETV

SEQ ID NO: 1865852 - protein, 5 aa, Staphylococcus
TETVW

SEQ ID NO: 1865853 - protein, 7 aa, Staphylococcus
TETYPPV

SEQ ID NO: 1865854 - protein, 6 aa, Staphylococcus
TEVGYT

SEQ ID NO: 1865855 - protein, 9 aa, Staphylococcus
TEVKPQAKA

SEQ ID NO: 1865856 - protein, 8 aa, Staphylococcus
TEVTGSTS

SEQ ID NO: 1865857 - protein, 4 aa, Staphylococcus
TEYD

SEQ ID NO: 1865858 - protein, 10 aa, Staphylococcus
TEYDQAPMSE

SEQ ID NO: 1865859 - protein, 4 aa, Staphylococcus
TEYK

SEQ ID NO: 1865860 - protein, 9 aa, Staphylococcus
TEYKRKGVS

SEQ ID NO: 1865861 - protein, 6 aa, Staphylococcus
TEYPKE

SEQ ID NO: 1865862 - protein, 6 aa, Staphylococcus
TEYPKI

SEQ ID NO: 1865863 - protein, 6 aa, Staphylococcus
TEYPSK

SEQ ID NO: 1865864 - protein, 20 aa, Staphylococcus
TFANTPGATVDELNEANQQV

SEQ ID NO: 1865865 - protein, 10 aa, Staphylococcus
TFDPRTNTIS

SEQ ID NO: 1865866 - protein, 18 aa, Staphylococcus
TFDPRTSTISGVATKVGT

SEQ ID NO: 1865867 - protein, 5 aa, Staphylococcus
TFEER

SEQ ID NO: 1865868 - protein, 14 aa, Staphylococcus
TFGGASRIDANSGT

SEQ ID NO: 1865869 - protein, 6 aa, Staphylococcus
TFGGGA

SEQ ID NO: 1865870 - protein, 5 aa, Staphylococcus
TFKDS

SEQ ID NO: 1865871 - protein, 4 aa, Staphylococcus
TFKP

SEQ ID NO: 1865872 - protein, 5 aa, Staphylococcus
TFKSQ

SEQ ID NO: 1865873 - protein, 13 aa, Staphylococcus
TFKTEEKKPVSTK

SEQ ID NO: 1865874 - protein, 29 aa, Staphylococcus
TFKTESKEPVSTTYKNNKIYSASNPLGGT

SEQ ID NO: 1865875 - protein, 4 aa, Staphylococcus
TFNK

SEQ ID NO: 1865876 - protein, 6 aa, Staphylococcus
TFPGGT

SEQ ID NO: 1865877 - protein, 6 aa, Staphylococcus
TFPKNE

SEQ ID NO: 1865878 - protein, 7 aa, Staphylococcus
TFQPRAN

SEQ ID NO: 1865879 - protein, 44 aa, Staphylococcus
TFSDGKKVTIPKGAKGDKGDAGAKGADATPLTVQSTDKDQDGNT

SEQ ID NO: 1865880 - protein, 6 aa, Staphylococcus
TFSGNQ

SEQ ID NO: 1865881 - protein, 10 aa, Staphylococcus
TFSNSDESES

SEQ ID NO: 1865882 - protein, 7 aa, Staphylococcus
TFTPQAD

SEQ ID NO: 1865883 - protein, 12 aa, Staphylococcus
TFTQTAELKPTN

SEQ ID NO: 1865884 - protein, 5 aa, Staphylococcus
TFTTG

SEQ ID NO: 1865885 - protein, 16 aa, Staphylococcus
TGAAKSELSKGVEIDG

SEQ ID NO: 1865886 - protein, 4 aa, Staphylococcus
TGAF

SEQ ID NO: 1865887 - protein, 5 aa, Staphylococcus
TGAFG

SEQ ID NO: 1865888 - protein, 6 aa, Staphylococcus
TGAITA

SEQ ID NO: 1865889 - protein, 7 aa, Staphylococcus
TGAITPG

SEQ ID NO: 1865890 - protein, 6 aa, Staphylococcus
TGAPPL

SEQ ID NO: 1865891 - protein, 8 aa, Staphylococcus
TGDADNQW

SEQ ID NO: 1865892 - protein, 8 aa, Staphylococcus
TGDAPFGS

SEQ ID NO: 1865893 - protein, 9 aa, Staphylococcus
TGDATYGSD

SEQ ID NO: 1865894 - protein, 4 aa, Staphylococcus
TGDF

SEQ ID NO: 1865895 - protein, 4 aa, Staphylococcus
TGDI

SEQ ID NO: 1865896 - protein, 7 aa, Staphylococcus
TGDSSRV

SEQ ID NO: 1865897 - protein, 6 aa, Staphylococcus
TGDSTR

SEQ ID NO: 1865898 - protein, 4 aa, Staphylococcus
TGDT

SEQ ID NO: 1865899 - protein, 7 aa, Staphylococcus
TGEAVTS

SEQ ID NO: 1865900 - protein, 5 aa, Staphylococcus
TGEKN

SEQ ID NO: 1865901 - protein, 9 aa, Staphylococcus
TGENDNKYR

SEQ ID NO: 1865902 - protein, 10 aa, Staphylococcus
TGENGLGEKG

SEQ ID NO: 1865903 - protein, 10 aa, Staphylococcus
TGENSKKYRV

SEQ ID NO: 1865904 - protein, 9 aa, Staphylococcus
TGENTKNYR

SEQ ID NO: 1865905 - protein, 10 aa, Staphylococcus
TGEQIPNDGK

SEQ ID NO: 1865906 - protein, 9 aa, Staphylococcus
TGERASTTT

SEQ ID NO: 1865907 - protein, 7 aa, Staphylococcus
TGESASK

SEQ ID NO: 1865908 - protein, 5 aa, Staphylococcus
TGESI

SEQ ID NO: 1865909 - protein, 5 aa, Staphylococcus
TGESM

SEQ ID NO: 1865910 - protein, 4 aa, Staphylococcus
TGFG

SEQ ID NO: 1865911 - protein, 6 aa, Staphylococcus
TGFSNG

SEQ ID NO: 1865912 - protein, 14 aa, Staphylococcus
TGFVSGKPKETPRN

SEQ ID NO: 1865913 - protein, 6 aa, Staphylococcus
TGGAGA

SEQ ID NO: 1865914 - protein, 6 aa, Staphylococcus
TGGECD

SEQ ID NO: 1865915 - protein, 9 aa, Staphylococcus
TGGHISESK

SEQ ID NO: 1865916 - protein, 10 aa, Staphylococcus
TGGKADKEGD

SEQ ID NO: 1865917 - protein, 7 aa, Staphylococcus
TGGKDNM

SEQ ID NO: 1865918 - protein, 8 aa, Staphylococcus
TGGKEIKI

SEQ ID NO: 1865919 - protein, 11 aa, Staphylococcus
TGGKRAENHKL

SEQ ID NO: 1865920 - protein, 13 aa, Staphylococcus
TGGKTAQNHSTIT

SEQ ID NO: 1865921 - protein, 7 aa, Staphylococcus
TGGLEKG

SEQ ID NO: 1865922 - protein, 7 aa, Staphylococcus
TGGNTDL

SEQ ID NO: 1865923 - protein, 7 aa, Staphylococcus
TGGTDEV

SEQ ID NO: 1865924 - protein, 7 aa, Staphylococcus
TGHEEQG

SEQ ID NO: 1865925 - protein, 7 aa, Staphylococcus
TGHENQG

SEQ ID NO: 1865926 - protein, 7 aa, Staphylococcus
TGHESQG

SEQ ID NO: 1865927 - protein, 23 aa, Staphylococcus
TGHGKTNKVTKQEMKDMKDELQS

SEQ ID NO: 1865928 - protein, 6 aa, Staphylococcus
TGHSQT

SEQ ID NO: 1865929 - protein, 4 aa, Staphylococcus
TGID

SEQ ID NO: 1865930 - protein, 5 aa, Staphylococcus
TGIDG

SEQ ID NO: 1865931 - protein, 6 aa, Staphylococcus
TGIDGE

SEQ ID NO: 1865932 - protein, 6 aa, Staphylococcus
TGINEV

SEQ ID NO: 1865933 - protein, 5 aa, Staphylococcus
TGINQ

SEQ ID NO: 1865934 - protein, 16 aa, Staphylococcus
TGISPEYTDLNESNTV

SEQ ID NO: 1865935 - protein, 4 aa, Staphylococcus
TGIT

SEQ ID NO: 1865936 - protein, 10 aa, Staphylococcus
TGITTTATGT

SEQ ID NO: 1865937 - protein, 5 aa, Staphylococcus
TGKAN

SEQ ID NO: 1865938 - protein, 21 aa, Staphylococcus
TGKEASTTSEVKDKSTKNMNP

SEQ ID NO: 1865939 - protein, 36 aa, Staphylococcus
TGKENSEHPAPTTTVKKGASSNDNKSEASTSNGGGS

SEQ ID NO: 1865940 - protein, 13 aa, Staphylococcus
TGKFEKLDPNKTY

SEQ ID NO: 1865941 - protein, 6 aa, Staphylococcus
TGKKHP

SEQ ID NO: 1865942 - protein, 9 aa, Staphylococcus
TGKKLGQVN

SEQ ID NO: 1865943 - protein, 12 aa, Staphylococcus
TGKNGLGEKGTV

SEQ ID NO: 1865944 - protein, 45 aa, Staphylococcus
TGKPKSSDKEAKTDRKQQDYDSKVTQFNSPTLEEKRAQRRQRQKR

SEQ ID NO: 1865945 - protein, 7 aa, Staphylococcus
TGKRDWE

SEQ ID NO: 1865946 - protein, 17 aa, Staphylococcus
TGKRLERKDFRKGYTAE

SEQ ID NO: 1865947 - protein, 9 aa, Staphylococcus
TGKSGPLRQ

SEQ ID NO: 1865948 - protein, 9 aa, Staphylococcus
TGKVTEKDG

SEQ ID NO: 1865949 - protein, 11 aa, Staphylococcus
TGKVTEKDSIT

SEQ ID NO: 1865950 - protein, 4 aa, Staphylococcus
TGLG

SEQ ID NO: 1865951 - protein, 8 aa, Staphylococcus
TGLGPTKA

SEQ ID NO: 1865952 - protein, 9 aa, Staphylococcus
TGLGSGAAN

SEQ ID NO: 1865953 - protein, 4 aa, Staphylococcus
TGLK

SEQ ID NO: 1865954 - protein, 12 aa, Staphylococcus
TGLTDSQKHALD

SEQ ID NO: 1865955 - protein, 8 aa, Staphylococcus
TGNADEQW

SEQ ID NO: 1865956 - protein, 13 aa, Staphylococcus
TGNDKNIKSDATK

SEQ ID NO: 1865957 - protein, 22 aa, Staphylococcus
TGNGSNPINSKTVQQTIKNKKI

SEQ ID NO: 1865958 - protein, 5 aa, Staphylococcus
TGNKI

SEQ ID NO: 1865959 - protein, 7 aa, Staphylococcus
TGNMSQK

SEQ ID NO: 1865960 - protein, 146 aa, Staphylococcus
TGNNDDKGSDDDKKVADNKDKDSDKAKDADSDKDSKSDKDKDKAKDDDNNQATTDSDSSDSSDNANSDSDQGNNDSQDQANSDQNQGTQDEQNSQNNQDQQSDQSQQNGQANSNQNGSSDQSQNASNDSNQQNNQSSNSNSGQRTH

SEQ ID NO: 1865961 - protein, 32 aa, Staphylococcus
TGNPLKDAYEPSTKPINKPFGTPTTADEVKKA

SEQ ID NO: 1865962 - protein, 6 aa, Staphylococcus
TGNQHQ

SEQ ID NO: 1865963 - protein, 12 aa, Staphylococcus
TGNTSGSNLGSN

SEQ ID NO: 1865964 - protein, 21 aa, Staphylococcus
TGPFQNNGADTSTGPHDSEKV

SEQ ID NO: 1865965 - protein, 7 aa, Staphylococcus
TGPNDGI

SEQ ID NO: 1865966 - protein, 8 aa, Staphylococcus
TGPNDGME

SEQ ID NO: 1865967 - protein, 6 aa, Staphylococcus
TGPNGF

SEQ ID NO: 1865968 - protein, 10 aa, Staphylococcus
TGPNGLGEQG

SEQ ID NO: 1865969 - protein, 6 aa, Staphylococcus
TGPSKT

SEQ ID NO: 1865970 - protein, 7 aa, Staphylococcus
TGQAEPH

SEQ ID NO: 1865971 - protein, 12 aa, Staphylococcus
TGQGKTSDAELT

SEQ ID NO: 1865972 - protein, 10 aa, Staphylococcus
TGQGKTSDSE

SEQ ID NO: 1865973 - protein, 12 aa, Staphylococcus
TGQGKTSDSEFT

SEQ ID NO: 1865974 - protein, 9 aa, Staphylococcus
TGQTSQDPF

SEQ ID NO: 1865975 - protein, 7 aa, Staphylococcus
TGRAAEE

SEQ ID NO: 1865976 - protein, 7 aa, Staphylococcus
TGRAAEK

SEQ ID NO: 1865977 - protein, 5 aa, Staphylococcus
TGRSY

SEQ ID NO: 1865978 - protein, 17 aa, Staphylococcus
TGSAEDTEQAYQKTEDY

SEQ ID NO: 1865979 - protein, 6 aa, Staphylococcus
TGSAYT

SEQ ID NO: 1865980 - protein, 6 aa, Staphylococcus
TGSGIT

SEQ ID NO: 1865981 - protein, 10 aa, Staphylococcus
TGSGQSENDK

SEQ ID NO: 1865982 - protein, 5 aa, Staphylococcus
TGSKI

SEQ ID NO: 1865983 - protein, 7 aa, Staphylococcus
TGSPFAF

SEQ ID NO: 1865984 - protein, 4 aa, Staphylococcus
TGSQ

SEQ ID NO: 1865985 - protein, 7 aa, Staphylococcus
TGSRTFD

SEQ ID NO: 1865986 - protein, 6 aa, Staphylococcus
TGSSGF

SEQ ID NO: 1865987 - protein, 9 aa, Staphylococcus
TGSTLGGTS

SEQ ID NO: 1865988 - protein, 9 aa, Staphylococcus
TGSVDGGKN

SEQ ID NO: 1865989 - protein, 16 aa, Staphylococcus
TGSVKSELANGVEIDG

SEQ ID NO: 1865990 - protein, 17 aa, Staphylococcus
TGSVKSELANGVNIDGK

SEQ ID NO: 1865991 - protein, 10 aa, Staphylococcus
TGTESTHTQN

SEQ ID NO: 1865992 - protein, 6 aa, Staphylococcus
TGTGTT

SEQ ID NO: 1865993 - protein, 8 aa, Staphylococcus
TGTIDEEG

SEQ ID NO: 1865994 - protein, 14 aa, Staphylococcus
TGTITHGKPQVTDY

SEQ ID NO: 1865995 - protein, 20 aa, Staphylococcus
TGTITNGKPKVTDYVGDQDT

SEQ ID NO: 1865996 - protein, 9 aa, Staphylococcus
TGTLTEGHP

SEQ ID NO: 1865997 - protein, 11 aa, Staphylococcus
TGTLTHGKPEV

SEQ ID NO: 1865998 - protein, 10 aa, Staphylococcus
TGTLTHGTPE

SEQ ID NO: 1865999 - protein, 6 aa, Staphylococcus
TGTLTK

SEQ ID NO: 1866000 - protein, 10 aa, Staphylococcus
TGTNGKTTVT

SEQ ID NO: 1866001 - protein, 4 aa, Staphylococcus
TGTP

SEQ ID NO: 1866002 - protein, 5 aa, Staphylococcus
TGTPI

SEQ ID NO: 1866003 - protein, 4 aa, Staphylococcus
TGTR

SEQ ID NO: 1866004 - protein, 9 aa, Staphylococcus
TGTRNIEGY

SEQ ID NO: 1866005 - protein, 123 aa, Staphylococcus
TGTSYAAESQATQSTNITATEEASQTASKEASSANIESTNKPLSLESSNVSHNEQATPSSETTTHPSVETSTTQNTTSEKHSNSSQGSAFSQEKATPEPATNDDNTSSQEKASSESTSNENNT

SEQ ID NO: 1866006 - protein, 8 aa, Staphylococcus
TGTTNWES

SEQ ID NO: 1866007 - protein, 11 aa, Staphylococcus
TGTTSTHTQNV

SEQ ID NO: 1866008 - protein, 23 aa, Staphylococcus
TGVEEASKDEAKQVAAKKGNPLQ

SEQ ID NO: 1866009 - protein, 23 aa, Staphylococcus
TGVEESSKDDAKAAASKKGNPLQ

SEQ ID NO: 1866010 - protein, 7 aa, Staphylococcus
TGVGSGV

SEQ ID NO: 1866011 - protein, 6 aa, Staphylococcus
TGVKEV

SEQ ID NO: 1866012 - protein, 4 aa, Staphylococcus
TGVP

SEQ ID NO: 1866013 - protein, 17 aa, Staphylococcus
TGWGPTGRRKKYATGGL

SEQ ID NO: 1866014 - protein, 4 aa, Staphylococcus
TGYA

SEQ ID NO: 1866015 - protein, 6 aa, Staphylococcus
TGYAES

SEQ ID NO: 1866016 - protein, 15 aa, Staphylococcus
TGYIKTDNAKVDGEQ

SEQ ID NO: 1866017 - protein, 15 aa, Staphylococcus
THAGNGISGEINGQK

SEQ ID NO: 1866018 - protein, 15 aa, Staphylococcus
THAKTLTESVRKDIK

SEQ ID NO: 1866019 - protein, 5 aa, Staphylococcus
THDAI

SEQ ID NO: 1866020 - protein, 6 aa, Staphylococcus
THDETM

SEQ ID NO: 1866021 - protein, 7 aa, Staphylococcus
THDNEED

SEQ ID NO: 1866022 - protein, 5 aa, Staphylococcus
THEKH

SEQ ID NO: 1866023 - protein, 7 aa, Staphylococcus
THGREAD

SEQ ID NO: 1866024 - protein, 7 aa, Staphylococcus
THKLEDE

SEQ ID NO: 1866025 - protein, 7 aa, Staphylococcus
THKNSSW

SEQ ID NO: 1866026 - protein, 6 aa, Staphylococcus
THLGPQ

SEQ ID NO: 1866027 - protein, 13 aa, Staphylococcus
THLNVEKNNGGIT

SEQ ID NO: 1866028 - protein, 10 aa, Staphylococcus
THNPREREEV

SEQ ID NO: 1866029 - protein, 8 aa, Staphylococcus
THNPTMSS

SEQ ID NO: 1866030 - protein, 4 aa, Staphylococcus
THNV

SEQ ID NO: 1866031 - protein, 19 aa, Staphylococcus
THPDGTVETTTTDSNGKYQ

SEQ ID NO: 1866032 - protein, 6 aa, Staphylococcus
THPELH

SEQ ID NO: 1866033 - protein, 9 aa, Staphylococcus
THPNLERPY

SEQ ID NO: 1866034 - protein, 13 aa, Staphylococcus
THPSLQQRLNHLN

SEQ ID NO: 1866035 - protein, 7 aa, Staphylococcus
THPTNHS

SEQ ID NO: 1866036 - protein, 7 aa, Staphylococcus
THQESSG

SEQ ID NO: 1866037 - protein, 13 aa, Staphylococcus
THQHTNHQSYNHQ

SEQ ID NO: 1866038 - protein, 6 aa, Staphylococcus
THRKPG

SEQ ID NO: 1866039 - protein, 17 aa, Staphylococcus
THSHSETSNHKPSDSTK

SEQ ID NO: 1866040 - protein, 4 aa, Staphylococcus
THSI

SEQ ID NO: 1866041 - protein, 6 aa, Staphylococcus
THSNSN

SEQ ID NO: 1866042 - protein, 15 aa, Staphylococcus
THTNATASDAKKAIE

SEQ ID NO: 1866043 - protein, 4 aa, Staphylococcus
THVN

SEQ ID NO: 1866044 - protein, 4 aa, Staphylococcus
THYD

SEQ ID NO: 1866045 - protein, 5 aa, Staphylococcus
THYTS

SEQ ID NO: 1866046 - protein, 6 aa, Staphylococcus
TIAEGT

SEQ ID NO: 1866047 - protein, 7 aa, Staphylococcus
TIAKSTW

SEQ ID NO: 1866048 - protein, 6 aa, Staphylococcus
TIAQTT

SEQ ID NO: 1866049 - protein, 11 aa, Staphylococcus
TIATKSSKNPL

SEQ ID NO: 1866050 - protein, 10 aa, Staphylococcus
TIATSGSKEM

SEQ ID NO: 1866051 - protein, 8 aa, Staphylococcus
TIDEVNNK

SEQ ID NO: 1866052 - protein, 9 aa, Staphylococcus
TIDPSQNYD

SEQ ID NO: 1866053 - protein, 4 aa, Staphylococcus
TIDS

SEQ ID NO: 1866054 - protein, 27 aa, Staphylococcus
TIDSGGNETKLPGAETVRSELANNPEI

SEQ ID NO: 1866055 - protein, 10 aa, Staphylococcus
TIDTDSTGNK

SEQ ID NO: 1866056 - protein, 12 aa, Staphylococcus
TIEAKGKQYQEI

SEQ ID NO: 1866057 - protein, 199 aa, Staphylococcus
TIEDPEPTATQNQAKQNDTTNVEQPDAGNNQAKNEKPSAPVNHTDTNNQNTKIDSQDKKDDASTDQQPVAENNQDTAQKPSAPVSDTVTNNQNAKTDNQAKKDDASKNQQTATDKKQDTKKPEAQVSDTTKKQDVKTIKKDDTSKDKQPDDDKKQDTAKKPSAPVSDTTKKQDVKTKKQDKKDDTPKDKQLDAAKHSEK

SEQ ID NO: 1866058 - protein, 6 aa, Staphylococcus
TIEDTN

SEQ ID NO: 1866059 - protein, 7 aa, Staphylococcus
TIEDTNN

SEQ ID NO: 1866060 - protein, 12 aa, Staphylococcus
TIEETNAPGLEV

SEQ ID NO: 1866061 - protein, 16 aa, Staphylococcus
TIEKINPALSSDKTNA

SEQ ID NO: 1866062 - protein, 16 aa, Staphylococcus
TIENNQQKALASEDDL

SEQ ID NO: 1866063 - protein, 7 aa, Staphylococcus
TIEPGPM

SEQ ID NO: 1866064 - protein, 8 aa, Staphylococcus
TIEPNGDR

SEQ ID NO: 1866065 - protein, 12 aa, Staphylococcus
TIEPSNPNIEEA

SEQ ID NO: 1866066 - protein, 9 aa, Staphylococcus
TIGDKDERE

SEQ ID NO: 1866067 - protein, 5 aa, Staphylococcus
TIGES

SEQ ID NO: 1866068 - protein, 7 aa, Staphylococcus
TIGNGTP

SEQ ID NO: 1866069 - protein, 9 aa, Staphylococcus
TIGNNGYRV

SEQ ID NO: 1866070 - protein, 7 aa, Staphylococcus
TIGRGDN

SEQ ID NO: 1866071 - protein, 7 aa, Staphylococcus
TIGSSEH

SEQ ID NO: 1866072 - protein, 10 aa, Staphylococcus
TIGSSKHHTE

SEQ ID NO: 1866073 - protein, 20 aa, Staphylococcus
TIHESEKRIYSAANSKSPAQ

SEQ ID NO: 1866074 - protein, 4 aa, Staphylococcus
TIIT

SEQ ID NO: 1866075 - protein, 8 aa, Staphylococcus
TIKEQEHP

SEQ ID NO: 1866076 - protein, 5 aa, Staphylococcus
TIKLT

SEQ ID NO: 1866077 - protein, 5 aa, Staphylococcus
TIKNA

SEQ ID NO: 1866078 - protein, 12 aa, Staphylococcus
TIKNEVEELLEQ

SEQ ID NO: 1866079 - protein, 6 aa, Staphylococcus
TIKNGH

SEQ ID NO: 1866080 - protein, 4 aa, Staphylococcus
TIKQ

SEQ ID NO: 1866081 - protein, 4 aa, Staphylococcus
TIKT

SEQ ID NO: 1866082 - protein, 9 aa, Staphylococcus
TIKTRNEQK

SEQ ID NO: 1866083 - protein, 19 aa, Staphylococcus
TINDNGENSSNQASNEATI

SEQ ID NO: 1866084 - protein, 23 aa, Staphylococcus
TINKGEKGDTGTVGTDGTSVTIT

SEQ ID NO: 1866085 - protein, 26 aa, Staphylococcus
TINKGGNTSLPGKTIVPRDGKTPNLE

SEQ ID NO: 1866086 - protein, 8 aa, Staphylococcus
TINPKADY

SEQ ID NO: 1866087 - protein, 6 aa, Staphylococcus
TINQNG

SEQ ID NO: 1866088 - protein, 23 aa, Staphylococcus
TINSDDNDYKNLKKELDQSNESR

SEQ ID NO: 1866089 - protein, 10 aa, Staphylococcus
TIPEPSQNDS

SEQ ID NO: 1866090 - protein, 17 aa, Staphylococcus
TIPGDGVNVNNTEIGSV

SEQ ID NO: 1866091 - protein, 68 aa, Staphylococcus
TIPGGPKGDKGDQGVAGPKGDKGDTGETGATGAQGPKGDKGDQGVAGPKGEQGDSIRITSTEPQANGD

SEQ ID NO: 1866092 - protein, 22 aa, Staphylococcus
TIPKAQDGKSITIDKTEPDADG

SEQ ID NO: 1866093 - protein, 9 aa, Staphylococcus
TIPKQDLKQ

SEQ ID NO: 1866094 - protein, 22 aa, Staphylococcus
TIPPTVPTVDTDLTGKATTLTP

SEQ ID NO: 1866095 - protein, 4 aa, Staphylococcus
TIQD

SEQ ID NO: 1866096 - protein, 16 aa, Staphylococcus
TIQNNQEKALASEDDL

SEQ ID NO: 1866097 - protein, 16 aa, Staphylococcus
TIQNNQQKALANEDDL

SEQ ID NO: 1866098 - protein, 34 aa, Staphylococcus
TIRDANDKVKLTGKDIVQGSAKQEFKQGTNEPAV

SEQ ID NO: 1866099 - protein, 26 aa, Staphylococcus
TIRLPKGPKGDKGDTGAQGPAGRSIT

SEQ ID NO: 1866100 - protein, 6 aa, Staphylococcus
TISEQA

SEQ ID NO: 1866101 - protein, 9 aa, Staphylococcus
TISKSQSIE

SEQ ID NO: 1866102 - protein, 4 aa, Staphylococcus
TISN

SEQ ID NO: 1866103 - protein, 10 aa, Staphylococcus
TISNANYKRH

SEQ ID NO: 1866104 - protein, 9 aa, Staphylococcus
TISNKAKNI

SEQ ID NO: 1866105 - protein, 7 aa, Staphylococcus
TISPETS

SEQ ID NO: 1866106 - protein, 6 aa, Staphylococcus
TISRAS

SEQ ID NO: 1866107 - protein, 8 aa, Staphylococcus
TISSETSG

SEQ ID NO: 1866108 - protein, 7 aa, Staphylococcus
TISVGAS

SEQ ID NO: 1866109 - protein, 6 aa, Staphylococcus
TISYPS

SEQ ID NO: 1866110 - protein, 12 aa, Staphylococcus
TITDGKNIERIE

SEQ ID NO: 1866111 - protein, 12 aa, Staphylococcus
TITGENSKKYRV

SEQ ID NO: 1866112 - protein, 4 aa, Staphylococcus
TITK

SEQ ID NO: 1866113 - protein, 9 aa, Staphylococcus
TITKSQSQM

SEQ ID NO: 1866114 - protein, 9 aa, Staphylococcus
TITTKRGKF

SEQ ID NO: 1866115 - protein, 5 aa, Staphylococcus
TITTS

SEQ ID NO: 1866116 - protein, 4 aa, Staphylococcus
TIYP

SEQ ID NO: 1866117 - protein, 6 aa, Staphylococcus
TKAAEH

SEQ ID NO: 1866118 - protein, 8 aa, Staphylococcus
TKAENTMT

SEQ ID NO: 1866119 - protein, 11 aa, Staphylococcus
TKAEQSKLNDI

SEQ ID NO: 1866120 - protein, 10 aa, Staphylococcus
TKAGSKKESY

SEQ ID NO: 1866121 - protein, 13 aa, Staphylococcus
TKAISSADNHTNK

SEQ ID NO: 1866122 - protein, 10 aa, Staphylococcus
TKAKGRKSAE

SEQ ID NO: 1866123 - protein, 6 aa, Staphylococcus
TKAKNI

SEQ ID NO: 1866124 - protein, 8 aa, Staphylococcus
TKAKYGLD

SEQ ID NO: 1866125 - protein, 8 aa, Staphylococcus
TKANEKDI

SEQ ID NO: 1866126 - protein, 7 aa, Staphylococcus
TKANEQD

SEQ ID NO: 1866127 - protein, 20 aa, Staphylococcus
TKAQDANTVQVAKDTKKEID

SEQ ID NO: 1866128 - protein, 8 aa, Staphylococcus
TKAQRGSI

SEQ ID NO: 1866129 - protein, 8 aa, Staphylococcus
TKASDDGT

SEQ ID NO: 1866130 - protein, 8 aa, Staphylococcus
TKDDTRMD

SEQ ID NO: 1866131 - protein, 7 aa, Staphylococcus
TKDERIQ

SEQ ID NO: 1866132 - protein, 19 aa, Staphylococcus
TKDGGSKKDIESDLNSMRK

SEQ ID NO: 1866133 - protein, 13 aa, Staphylococcus
TKDGGSKKDIQQD

SEQ ID NO: 1866134 - protein, 14 aa, Staphylococcus
TKDGGSKTSIENDL

SEQ ID NO: 1866135 - protein, 7 aa, Staphylococcus
TKDGSFK

SEQ ID NO: 1866136 - protein, 10 aa, Staphylococcus
TKDHQHDDET

SEQ ID NO: 1866137 - protein, 30 aa, Staphylococcus
TKDKHNIEDTKSSQEYDNSIGYNGEKKTAL

SEQ ID NO: 1866138 - protein, 8 aa, Staphylococcus
TKDKRVTG

SEQ ID NO: 1866139 - protein, 5 aa, Staphylococcus
TKDLE

SEQ ID NO: 1866140 - protein, 5 aa, Staphylococcus
TKDPI

SEQ ID NO: 1866141 - protein, 13 aa, Staphylococcus
TKDPNFSKYPNEM

SEQ ID NO: 1866142 - protein, 11 aa, Staphylococcus
TKDSAQKIDTD

SEQ ID NO: 1866143 - protein, 17 aa, Staphylococcus
TKDSGAISNPLADNGLP

SEQ ID NO: 1866144 - protein, 40 aa, Staphylococcus
TKDSGSEKTVERNLDNTRKDLEDYDNVDTVSSPQLSSNKN

SEQ ID NO: 1866145 - protein, 26 aa, Staphylococcus
TKDSIEHSYGKPEGTMDINGNEAHQY

SEQ ID NO: 1866146 - protein, 8 aa, Staphylococcus
TKDTQSID

SEQ ID NO: 1866147 - protein, 7 aa, Staphylococcus
TKDYPPT

SEQ ID NO: 1866148 - protein, 8 aa, Staphylococcus
TKDYPSTY

SEQ ID NO: 1866149 - protein, 4 aa, Staphylococcus
TKEA

SEQ ID NO: 1866150 - protein, 4 aa, Staphylococcus
TKED

SEQ ID NO: 1866151 - protein, 6 aa, Staphylococcus
TKEDEI

SEQ ID NO: 1866152 - protein, 25 aa, Staphylococcus
TKEDLKSKKEAAVYQQAKDSLQSKY

SEQ ID NO: 1866153 - protein, 14 aa, Staphylococcus
TKEDLKSKKEADVY

SEQ ID NO: 1866154 - protein, 24 aa, Staphylococcus
TKEDLKSKKEAQVYQQAKSSLEDK

SEQ ID NO: 1866155 - protein, 24 aa, Staphylococcus
TKEDLKSKKEDAVYQQAKQSLEKK

SEQ ID NO: 1866156 - protein, 15 aa, Staphylococcus
TKEDLKSKKEPAVYQ

SEQ ID NO: 1866157 - protein, 14 aa, Staphylococcus
TKEDLKSKQEPRVY

SEQ ID NO: 1866158 - protein, 9 aa, Staphylococcus
TKEEEIEGI

SEQ ID NO: 1866159 - protein, 154 aa, Staphylococcus
TKEEIQQQQNQVSNQNDKTNKTQQDQENDKSKLTLPEEQQLKRTQNRKNQSSNDSKQEDHEKSTYGEHQSDRLASKASQENHLNNGSEIESEKKNNKTESSKKLNKQSTSVENRDFDTEKKHQHHSKQSAKQNQFETKKDNASSTQNKVENKTD

SEQ ID NO: 1866160 - protein, 25 aa, Staphylococcus
TKEELGEEEPELSRTNKGNVSNQTK

SEQ ID NO: 1866161 - protein, 25 aa, Staphylococcus
TKEELGEEEPELSRTQKGNVSTQSK

SEQ ID NO: 1866162 - protein, 25 aa, Staphylococcus
TKEELGEEEPELSRTSKGNVSNQSK

SEQ ID NO: 1866163 - protein, 24 aa, Staphylococcus
TKEELGEEYDLSRTSKGNVSNQTK

SEQ ID NO: 1866164 - protein, 8 aa, Staphylococcus
TKEESLHA

SEQ ID NO: 1866165 - protein, 8 aa, Staphylococcus
TKEGRDWK

SEQ ID NO: 1866166 - protein, 9 aa, Staphylococcus
TKEGSKRVQ

SEQ ID NO: 1866167 - protein, 10 aa, Staphylococcus
TKEKVATTTQ

SEQ ID NO: 1866168 - protein, 26 aa, Staphylococcus
TKEPLKSKEEHKVYEQAKTSLEKKDK

SEQ ID NO: 1866169 - protein, 9 aa, Staphylococcus
TKEQKGSIV

SEQ ID NO: 1866170 - protein, 6 aa, Staphylococcus
TKETDY

SEQ ID NO: 1866171 - protein, 5 aa, Staphylococcus
TKETI

SEQ ID NO: 1866172 - protein, 6 aa, Staphylococcus
TKFDSL

SEQ ID NO: 1866173 - protein, 6 aa, Staphylococcus
TKFRDY

SEQ ID NO: 1866174 - protein, 8 aa, Staphylococcus
TKGAPYRQ

SEQ ID NO: 1866175 - protein, 5 aa, Staphylococcus
TKGAS

SEQ ID NO: 1866176 - protein, 12 aa, Staphylococcus
TKGDGPILGGNL

SEQ ID NO: 1866177 - protein, 9 aa, Staphylococcus
TKGEGPILG

SEQ ID NO: 1866178 - protein, 11 aa, Staphylococcus
TKGFKDGPRTY

SEQ ID NO: 1866179 - protein, 13 aa, Staphylococcus
TKGGGPILGDGLG

SEQ ID NO: 1866180 - protein, 12 aa, Staphylococcus
TKGGGPILGGNL

SEQ ID NO: 1866181 - protein, 9 aa, Staphylococcus
TKGKPFSRN

SEQ ID NO: 1866182 - protein, 6 aa, Staphylococcus
TKGLYD

SEQ ID NO: 1866183 - protein, 4 aa, Staphylococcus
TKGN

SEQ ID NO: 1866184 - protein, 8 aa, Staphylococcus
TKGNAPFV

SEQ ID NO: 1866185 - protein, 5 aa, Staphylococcus
TKGRT

SEQ ID NO: 1866186 - protein, 6 aa, Staphylococcus
TKGSGQ

SEQ ID NO: 1866187 - protein, 15 aa, Staphylococcus
TKHDDLKKATKDIET

SEQ ID NO: 1866188 - protein, 12 aa, Staphylococcus
TKHRDKDRTRDY

SEQ ID NO: 1866189 - protein, 6 aa, Staphylococcus
TKHVKN

SEQ ID NO: 1866190 - protein, 4 aa, Staphylococcus
TKIA

SEQ ID NO: 1866191 - protein, 10 aa, Staphylococcus
TKIDANNPHG

SEQ ID NO: 1866192 - protein, 24 aa, Staphylococcus
TKIETQTTLQRQTYEAQKETNYNI

SEQ ID NO: 1866193 - protein, 16 aa, Staphylococcus
TKIKSEKKKFNAKDGV

SEQ ID NO: 1866194 - protein, 12 aa, Staphylococcus
TKINSASSLSVT

SEQ ID NO: 1866195 - protein, 12 aa, Staphylococcus
TKKADKDGYIVF

SEQ ID NO: 1866196 - protein, 15 aa, Staphylococcus
TKKEELYKKNGRNPI

SEQ ID NO: 1866197 - protein, 19 aa, Staphylococcus
TKKEKEPRLEPRMGNQYGG

SEQ ID NO: 1866198 - protein, 19 aa, Staphylococcus
TKKENEPRLEPRLGNQYGG

SEQ ID NO: 1866199 - protein, 10 aa, Staphylococcus
TKKESKKESY

SEQ ID NO: 1866200 - protein, 12 aa, Staphylococcus
TKKETANGQFDG

SEQ ID NO: 1866201 - protein, 9 aa, Staphylococcus
TKKGQNLKS

SEQ ID NO: 1866202 - protein, 6 aa, Staphylococcus
TKKIPL

SEQ ID NO: 1866203 - protein, 9 aa, Staphylococcus
TKKKSEIQT

SEQ ID NO: 1866204 - protein, 8 aa, Staphylococcus
TKKMPHYE

SEQ ID NO: 1866205 - protein, 9 aa, Staphylococcus
TKKNETPRN

SEQ ID NO: 1866206 - protein, 5 aa, Staphylococcus
TKKNL

SEQ ID NO: 1866207 - protein, 7 aa, Staphylococcus
TKKPDID

SEQ ID NO: 1866208 - protein, 8 aa, Staphylococcus
TKKPGTFV

SEQ ID NO: 1866209 - protein, 8 aa, Staphylococcus
TKKPQIDV

SEQ ID NO: 1866210 - protein, 7 aa, Staphylococcus
TKKQSEF

SEQ ID NO: 1866211 - protein, 19 aa, Staphylococcus
TKKSKEPRLEPRLGNQYGG

SEQ ID NO: 1866212 - protein, 19 aa, Staphylococcus
TKKSREPRLEPRLGNQYGG

SEQ ID NO: 1866213 - protein, 7 aa, Staphylococcus
TKKTKGH

SEQ ID NO: 1866214 - protein, 7 aa, Staphylococcus
TKKTSEI

SEQ ID NO: 1866215 - protein, 8 aa, Staphylococcus
TKLEAPLD

SEQ ID NO: 1866216 - protein, 35 aa, Staphylococcus
TKLERQSKSVTAAENDIQKADSNSQSHHSTHASSH

SEQ ID NO: 1866217 - protein, 4 aa, Staphylococcus
TKLP

SEQ ID NO: 1866218 - protein, 9 aa, Staphylococcus
TKLPGIERD

SEQ ID NO: 1866219 - protein, 6 aa, Staphylococcus
TKLYPG

SEQ ID NO: 1866220 - protein, 9 aa, Staphylococcus
TKLYPGETY

SEQ ID NO: 1866221 - protein, 8 aa, Staphylococcus
TKLYPGQK

SEQ ID NO: 1866222 - protein, 9 aa, Staphylococcus
TKNAQGETV

SEQ ID NO: 1866223 - protein, 8 aa, Staphylococcus
TKNASGSI

SEQ ID NO: 1866224 - protein, 7 aa, Staphylococcus
TKNEQID

SEQ ID NO: 1866225 - protein, 8 aa, Staphylococcus
TKNFDTKN

SEQ ID NO: 1866226 - protein, 7 aa, Staphylococcus
TKNIKRP

SEQ ID NO: 1866227 - protein, 21 aa, Staphylococcus
TKNIQPDTKIEKQVNKANDDF

SEQ ID NO: 1866228 - protein, 10 aa, Staphylococcus
TKNKTKTTRI

SEQ ID NO: 1866229 - protein, 5 aa, Staphylococcus
TKNKV

SEQ ID NO: 1866230 - protein, 8 aa, Staphylococcus
TKNNESMS

SEQ ID NO: 1866231 - protein, 11 aa, Staphylococcus
TKNQQKNNKHR

SEQ ID NO: 1866232 - protein, 7 aa, Staphylococcus
TKNRGGM

SEQ ID NO: 1866233 - protein, 6 aa, Staphylococcus
TKNSDI

SEQ ID NO: 1866234 - protein, 9 aa, Staphylococcus
TKNSLADPS

SEQ ID NO: 1866235 - protein, 7 aa, Staphylococcus
TKPETYQ

SEQ ID NO: 1866236 - protein, 9 aa, Staphylococcus
TKPGTYTYT

SEQ ID NO: 1866237 - protein, 9 aa, Staphylococcus
TKPIPEGNV

SEQ ID NO: 1866238 - protein, 57 aa, Staphylococcus
TKPIPEGNVTAKAYDNAEHPNSSTSQPKKATDNAEHPNSSTSQPKKATDTTPPTAPL

SEQ ID NO: 1866239 - protein, 41 aa, Staphylococcus
TKPIPEGNVTAKAYDNAEHPNSSTSQPKKATDTTPPTAPVV

SEQ ID NO: 1866240 - protein, 7 aa, Staphylococcus
TKPNNYG

SEQ ID NO: 1866241 - protein, 17 aa, Staphylococcus
TKPVNTSDKTPASIKEY

SEQ ID NO: 1866242 - protein, 25 aa, Staphylococcus
TKQELGEEEPELSRTSKGNVSNQTK

SEQ ID NO: 1866243 - protein, 5 aa, Staphylococcus
TKQET

SEQ ID NO: 1866244 - protein, 4 aa, Staphylococcus
TKQG

SEQ ID NO: 1866245 - protein, 10 aa, Staphylococcus
TKQIEAAQTV

SEQ ID NO: 1866246 - protein, 13 aa, Staphylococcus
TKQKNTEPNPEYY

SEQ ID NO: 1866247 - protein, 15 aa, Staphylococcus
TKQKNTTPNSEYFGA

SEQ ID NO: 1866248 - protein, 20 aa, Staphylococcus
TKQKQTEPNKEYFGAAKKKN

SEQ ID NO: 1866249 - protein, 13 aa, Staphylococcus
TKQKQTQPNPEYY

SEQ ID NO: 1866250 - protein, 20 aa, Staphylococcus
TKQKRTEPNPEYYGAAKKKN

SEQ ID NO: 1866251 - protein, 14 aa, Staphylococcus
TKQKRTEPNQEYYG

SEQ ID NO: 1866252 - protein, 13 aa, Staphylococcus
TKQKRTKANPEYF

SEQ ID NO: 1866253 - protein, 7 aa, Staphylococcus
TKQLSEG

SEQ ID NO: 1866254 - protein, 7 aa, Staphylococcus
TKQNSDQ

SEQ ID NO: 1866255 - protein, 4 aa, Staphylococcus
TKQS

SEQ ID NO: 1866256 - protein, 8 aa, Staphylococcus
TKQSNRDL

SEQ ID NO: 1866257 - protein, 8 aa, Staphylococcus
TKQSNRSL

SEQ ID NO: 1866258 - protein, 8 aa, Staphylococcus
TKQYPKEY

SEQ ID NO: 1866259 - protein, 4 aa, Staphylococcus
TKRE

SEQ ID NO: 1866260 - protein, 11 aa, Staphylococcus
TKRENEPRFEP

SEQ ID NO: 1866261 - protein, 4 aa, Staphylococcus
TKRL

SEQ ID NO: 1866262 - protein, 9 aa, Staphylococcus
TKRSYFNKN

SEQ ID NO: 1866263 - protein, 6 aa, Staphylococcus
TKRTAN

SEQ ID NO: 1866264 - protein, 7 aa, Staphylococcus
TKSETYA

SEQ ID NO: 1866265 - protein, 12 aa, Staphylococcus
TKSEYHASDSVA

SEQ ID NO: 1866266 - protein, 7 aa, Staphylococcus
TKSGNTV

SEQ ID NO: 1866267 - protein, 5 aa, Staphylococcus
TKSGQ

SEQ ID NO: 1866268 - protein, 6 aa, Staphylococcus
TKSGQF

SEQ ID NO: 1866269 - protein, 8 aa, Staphylococcus
TKSGYDSV

SEQ ID NO: 1866270 - protein, 12 aa, Staphylococcus
TKSKKQILNKRY

SEQ ID NO: 1866271 - protein, 9 aa, Staphylococcus
TKSKWSTSI

SEQ ID NO: 1866272 - protein, 9 aa, Staphylococcus
TKSLTDNRN

SEQ ID NO: 1866273 - protein, 38 aa, Staphylococcus
TKSNARNEITQAADQRKATFPNDNNATTEEKEAATNNV

SEQ ID NO: 1866274 - protein, 10 aa, Staphylococcus
TKSPNVYPGM

SEQ ID NO: 1866275 - protein, 17 aa, Staphylococcus
TKSQINEIESDNEVNFQ

SEQ ID NO: 1866276 - protein, 16 aa, Staphylococcus
TKSQINESESDNEVKF

SEQ ID NO: 1866277 - protein, 14 aa, Staphylococcus
TKSSDIKDDTGKIV

SEQ ID NO: 1866278 - protein, 9 aa, Staphylococcus
TKSSNRGYS

SEQ ID NO: 1866279 - protein, 31 aa, Staphylococcus
TKSSTNETKGNNVSQTTNQQPSKKQNKAQFD

SEQ ID NO: 1866280 - protein, 4 aa, Staphylococcus
TKTG

SEQ ID NO: 1866281 - protein, 12 aa, Staphylococcus
TKTGAPKKAYKP

SEQ ID NO: 1866282 - protein, 6 aa, Staphylococcus
TKTGQF

SEQ ID NO: 1866283 - protein, 12 aa, Staphylococcus
TKTGSADGCGSD

SEQ ID NO: 1866284 - protein, 11 aa, Staphylococcus
TKTGSENGCGA

SEQ ID NO: 1866285 - protein, 7 aa, Staphylococcus
TKTHSDI

SEQ ID NO: 1866286 - protein, 8 aa, Staphylococcus
TKTLRDTE

SEQ ID NO: 1866287 - protein, 9 aa, Staphylococcus
TKTMPDEQR

SEQ ID NO: 1866288 - protein, 9 aa, Staphylococcus
TKTNSNGVP

SEQ ID NO: 1866289 - protein, 6 aa, Staphylococcus
TKTSAT

SEQ ID NO: 1866290 - protein, 6 aa, Staphylococcus
TKTTDN

SEQ ID NO: 1866291 - protein, 4 aa, Staphylococcus
TKTY

SEQ ID NO: 1866292 - protein, 13 aa, Staphylococcus
TKVDGKSVVGKPL

SEQ ID NO: 1866293 - protein, 8 aa, Staphylococcus
TKVGEDTA

SEQ ID NO: 1866294 - protein, 12 aa, Staphylococcus
TKVGHSEAFSTE

SEQ ID NO: 1866295 - protein, 9 aa, Staphylococcus
TKVGQDTAL

SEQ ID NO: 1866296 - protein, 12 aa, Staphylococcus
TKVKTNAASPLS

SEQ ID NO: 1866297 - protein, 17 aa, Staphylococcus
TKVNENNATEADKYGET

SEQ ID NO: 1866298 - protein, 13 aa, Staphylococcus
TKVNGKSIKGQPL

SEQ ID NO: 1866299 - protein, 14 aa, Staphylococcus
TKVNGKSVEGKPLD

SEQ ID NO: 1866300 - protein, 8 aa, Staphylococcus
TKVNKTEL

SEQ ID NO: 1866301 - protein, 14 aa, Staphylococcus
TKVPSAGKTGTAEV

SEQ ID NO: 1866302 - protein, 19 aa, Staphylococcus
TKVQNDNHHNNKDYADKRL

SEQ ID NO: 1866303 - protein, 5 aa, Staphylococcus
TKVSP

SEQ ID NO: 1866304 - protein, 9 aa, Staphylococcus
TKYRQQASD

SEQ ID NO: 1866305 - protein, 8 aa, Staphylococcus
TKYSTNRK

SEQ ID NO: 1866306 - protein, 6 aa, Staphylococcus
TLADKL

SEQ ID NO: 1866307 - protein, 5 aa, Staphylococcus
TLANQ

SEQ ID NO: 1866308 - protein, 4 aa, Staphylococcus
TLAT

SEQ ID NO: 1866309 - protein, 9 aa, Staphylococcus
TLDGKGNIT

SEQ ID NO: 1866310 - protein, 11 aa, Staphylococcus
TLDGTRSISQK

SEQ ID NO: 1866311 - protein, 51 aa, Staphylococcus
TLDKAAKKQIHNYTSQQVSNKNNDSWRDASDAEIKTAMDSSEFIDNDKQKY

SEQ ID NO: 1866312 - protein, 10 aa, Staphylococcus
TLDNGARREH

SEQ ID NO: 1866313 - protein, 9 aa, Staphylococcus
TLDSNGFRN

SEQ ID NO: 1866314 - protein, 8 aa, Staphylococcus
TLDTSYKY

SEQ ID NO: 1866315 - protein, 5 aa, Staphylococcus
TLDYT

SEQ ID NO: 1866316 - protein, 6 aa, Staphylococcus
TLEDSS

SEQ ID NO: 1866317 - protein, 20 aa, Staphylococcus
TLEEQKIEQANVQEEQEDVK

SEQ ID NO: 1866318 - protein, 5 aa, Staphylococcus
TLENY

SEQ ID NO: 1866319 - protein, 14 aa, Staphylococcus
TLEYKRKREGHSPI

SEQ ID NO: 1866320 - protein, 7 aa, Staphylococcus
TLGASKT

SEQ ID NO: 1866321 - protein, 12 aa, Staphylococcus
TLGRASDKPEFN

SEQ ID NO: 1866322 - protein, 7 aa, Staphylococcus
TLHTTNS

SEQ ID NO: 1866323 - protein, 11 aa, Staphylococcus
TLNGDSNTKVP

SEQ ID NO: 1866324 - protein, 16 aa, Staphylococcus
TLNGERAQARTQETNL

SEQ ID NO: 1866325 - protein, 4 aa, Staphylococcus
TLNI

SEQ ID NO: 1866326 - protein, 9 aa, Staphylococcus
TLNIKTKER

SEQ ID NO: 1866327 - protein, 4 aa, Staphylococcus
TLNN

SEQ ID NO: 1866328 - protein, 5 aa, Staphylococcus
TLPGH

SEQ ID NO: 1866329 - protein, 88 aa, Staphylococcus
TLPTGATKVTFSDGKTFEIPKGKDGTSVTITETKTLPNGNKQVTFSDGKTLEVPKGDKGDKGETGAKGADATPLTVTGETKDGNGNTV

SEQ ID NO: 1866330 - protein, 8 aa, Staphylococcus
TLPTTGGM

SEQ ID NO: 1866331 - protein, 12 aa, Staphylococcus
TLPYTGENENSL

SEQ ID NO: 1866332 - protein, 5 aa, Staphylococcus
TLQNP

SEQ ID NO: 1866333 - protein, 9 aa, Staphylococcus
TLQQAGPLG

SEQ ID NO: 1866334 - protein, 11 aa, Staphylococcus
TLQTDVQPEVA

SEQ ID NO: 1866335 - protein, 10 aa, Staphylococcus
TLRHSNGSKV

SEQ ID NO: 1866336 - protein, 13 aa, Staphylococcus
TLRKQPQKANVEY

SEQ ID NO: 1866337 - protein, 11 aa, Staphylococcus
TLRSQGAKDMD

SEQ ID NO: 1866338 - protein, 11 aa, Staphylococcus
TLRSQGATNMD

SEQ ID NO: 1866339 - protein, 11 aa, Staphylococcus
TLSDAKPSTLP

SEQ ID NO: 1866340 - protein, 68 aa, Staphylococcus
TLSNKVDSGQQKDATTSNESSSSESNTSENTTDEVTKEEPTTEESPKEVPTTEKPSNQTTSSKSETSI

SEQ ID NO: 1866341 - protein, 12 aa, Staphylococcus
TLSPEANKDDKL

SEQ ID NO: 1866342 - protein, 7 aa, Staphylococcus
TLSQSDE

SEQ ID NO: 1866343 - protein, 12 aa, Staphylococcus
TLSRSKHSTIHS

SEQ ID NO: 1866344 - protein, 11 aa, Staphylococcus
TLTDKDNKKVK

SEQ ID NO: 1866345 - protein, 5 aa, Staphylococcus
TLTHK

SEQ ID NO: 1866346 - protein, 23 aa, Staphylococcus
TLTIPKGDKGDRGDNGHDGTSIT

SEQ ID NO: 1866347 - protein, 5 aa, Staphylococcus
TLTPI

SEQ ID NO: 1866348 - protein, 7 aa, Staphylococcus
TLTSPRA

SEQ ID NO: 1866349 - protein, 12 aa, Staphylococcus
TLTTDSLDETYP

SEQ ID NO: 1866350 - protein, 7 aa, Staphylococcus
TLVPEKD

SEQ ID NO: 1866351 - protein, 9 aa, Staphylococcus
TLVPNKDSR

SEQ ID NO: 1866352 - protein, 4 aa, Staphylococcus
TLYQ

SEQ ID NO: 1866353 - protein, 18 aa, Staphylococcus
TMGYEKSDQKDFKDISDD

SEQ ID NO: 1866354 - protein, 10 aa, Staphylococcus
TMKGSTKNGV

SEQ ID NO: 1866355 - protein, 8 aa, Staphylococcus
TMNPETRP

SEQ ID NO: 1866356 - protein, 5 aa, Staphylococcus
TMNTN

SEQ ID NO: 1866357 - protein, 21 aa, Staphylococcus
TMPGATPQSTEDEISRKIDNQ

SEQ ID NO: 1866358 - protein, 22 aa, Staphylococcus
TMPGATPQTTQDEISSKIDNQV

SEQ ID NO: 1866359 - protein, 22 aa, Staphylococcus
TMPGATPQTTQDEISSKIDSQV

SEQ ID NO: 1866360 - protein, 5 aa, Staphylococcus
TMPGT

SEQ ID NO: 1866361 - protein, 5 aa, Staphylococcus
TMPIS

SEQ ID NO: 1866362 - protein, 13 aa, Staphylococcus
TMQKEAGSVSAKG

SEQ ID NO: 1866363 - protein, 22 aa, Staphylococcus
TMSGATPQTTQGEISSKIDKQV

SEQ ID NO: 1866364 - protein, 6 aa, Staphylococcus
TMSGDH

SEQ ID NO: 1866365 - protein, 6 aa, Staphylococcus
TNAAGQ

SEQ ID NO: 1866366 - protein, 10 aa, Staphylococcus
TNADTGEKIG

SEQ ID NO: 1866367 - protein, 5 aa, Staphylococcus
TNALN

SEQ ID NO: 1866368 - protein, 8 aa, Staphylococcus
TNANYKRH

SEQ ID NO: 1866369 - protein, 6 aa, Staphylococcus
TNAPVD

SEQ ID NO: 1866370 - protein, 13 aa, Staphylococcus
TNAPVSADYDKSP

SEQ ID NO: 1866371 - protein, 8 aa, Staphylococcus
TNATDGTT

SEQ ID NO: 1866372 - protein, 9 aa, Staphylococcus
TNAVGGNHN

SEQ ID NO: 1866373 - protein, 6 aa, Staphylococcus
TNDDDI

SEQ ID NO: 1866374 - protein, 8 aa, Staphylococcus
TNDDEINR

SEQ ID NO: 1866375 - protein, 17 aa, Staphylococcus
TNDGDTIEYDHTSHKAM

SEQ ID NO: 1866376 - protein, 5 aa, Staphylococcus
TNDGH

SEQ ID NO: 1866377 - protein, 5 aa, Staphylococcus
TNDLG

SEQ ID NO: 1866378 - protein, 11 aa, Staphylococcus
TNEDPSKSASI

SEQ ID NO: 1866379 - protein, 24 aa, Staphylococcus
TNEHAKKDTDEPNDDFKHHKNSNG

SEQ ID NO: 1866380 - protein, 21 aa, Staphylococcus
TNEISNDSDIDVNASTNKDRL

SEQ ID NO: 1866381 - protein, 11 aa, Staphylococcus
TNEKTYSRKAN

SEQ ID NO: 1866382 - protein, 15 aa, Staphylococcus
TNEPFTDDSDEEEFE

SEQ ID NO: 1866383 - protein, 9 aa, Staphylococcus
TNEQSGIAS

SEQ ID NO: 1866384 - protein, 10 aa, Staphylococcus
TNERPDLDGG

SEQ ID NO: 1866385 - protein, 10 aa, Staphylococcus
TNERQDLDGG

SEQ ID NO: 1866386 - protein, 24 aa, Staphylococcus
TNESGNTIQNSLTSKGKKNTEYNV

SEQ ID NO: 1866387 - protein, 16 aa, Staphylococcus
TNESNDLRTTTKEINE

SEQ ID NO: 1866388 - protein, 6 aa, Staphylococcus
TNFNGT

SEQ ID NO: 1866389 - protein, 6 aa, Staphylococcus
TNFPNF

SEQ ID NO: 1866390 - protein, 6 aa, Staphylococcus
TNFSGS

SEQ ID NO: 1866391 - protein, 26 aa, Staphylococcus
TNFSSDPNSPNFGEKHKAPRSYTSPS

SEQ ID NO: 1866392 - protein, 26 aa, Staphylococcus
TNFSSDPNSPNYGGKHKAPRSYTSPS

SEQ ID NO: 1866393 - protein, 25 aa, Staphylococcus
TNFSTDPNSPNYGEKHKAPRSYTSP

SEQ ID NO: 1866394 - protein, 51 aa, Staphylococcus
TNFTTQEKNQGKDKLQRLNTNKSTYLASSNPLVPQDNGNIKDGSQGTVNAG

SEQ ID NO: 1866395 - protein, 4 aa, Staphylococcus
TNGD

SEQ ID NO: 1866396 - protein, 10 aa, Staphylococcus
TNGDFDKNQL

SEQ ID NO: 1866397 - protein, 9 aa, Staphylococcus
TNGDFNKKQ

SEQ ID NO: 1866398 - protein, 9 aa, Staphylococcus
TNGDFSEAQ

SEQ ID NO: 1866399 - protein, 9 aa, Staphylococcus
TNGDFTEDQ

SEQ ID NO: 1866400 - protein, 9 aa, Staphylococcus
TNGDFTEEE

SEQ ID NO: 1866401 - protein, 9 aa, Staphylococcus
TNGDFTQDE

SEQ ID NO: 1866402 - protein, 9 aa, Staphylococcus
TNGEFTKDQ

SEQ ID NO: 1866403 - protein, 18 aa, Staphylococcus
TNGGGIRASIDKGKVTQN

SEQ ID NO: 1866404 - protein, 18 aa, Staphylococcus
TNGGGIRASIEKGEVTEN

SEQ ID NO: 1866405 - protein, 25 aa, Staphylococcus
TNGKINRDTLATVGDKGRGNGPGGF

SEQ ID NO: 1866406 - protein, 7 aa, Staphylococcus
TNGLPTE

SEQ ID NO: 1866407 - protein, 9 aa, Staphylococcus
TNGNATDSL

SEQ ID NO: 1866408 - protein, 4 aa, Staphylococcus
TNGS

SEQ ID NO: 1866409 - protein, 5 aa, Staphylococcus
TNGTS

SEQ ID NO: 1866410 - protein, 8 aa, Staphylococcus
TNHESSGI

SEQ ID NO: 1866411 - protein, 19 aa, Staphylococcus
TNHKDTEYNKVNDNKTYLQ

SEQ ID NO: 1866412 - protein, 6 aa, Staphylococcus
TNHSSL

SEQ ID NO: 1866413 - protein, 5 aa, Staphylococcus
TNIKS

SEQ ID NO: 1866414 - protein, 4 aa, Staphylococcus
TNIN

SEQ ID NO: 1866415 - protein, 8 aa, Staphylococcus
TNISKERH

SEQ ID NO: 1866416 - protein, 7 aa, Staphylococcus
TNISKNR

SEQ ID NO: 1866417 - protein, 14 aa, Staphylococcus
TNKDGNLKETTNAI

SEQ ID NO: 1866418 - protein, 8 aa, Staphylococcus
TNKDTIDK

SEQ ID NO: 1866419 - protein, 15 aa, Staphylococcus
TNKNDDLKTTTKEIN

SEQ ID NO: 1866420 - protein, 8 aa, Staphylococcus
TNKQERQP

SEQ ID NO: 1866421 - protein, 12 aa, Staphylococcus
TNKSGSRVKQAL

SEQ ID NO: 1866422 - protein, 8 aa, Staphylococcus
TNKSLRKE

SEQ ID NO: 1866423 - protein, 6 aa, Staphylococcus
TNKYGV

SEQ ID NO: 1866424 - protein, 6 aa, Staphylococcus
TNLDKH

SEQ ID NO: 1866425 - protein, 6 aa, Staphylococcus
TNLDSL

SEQ ID NO: 1866426 - protein, 7 aa, Staphylococcus
TNLGSSV

SEQ ID NO: 1866427 - protein, 6 aa, Staphylococcus
TNLNPT

SEQ ID NO: 1866428 - protein, 5 aa, Staphylococcus
TNLPK

SEQ ID NO: 1866429 - protein, 5 aa, Staphylococcus
TNLRK

SEQ ID NO: 1866430 - protein, 4 aa, Staphylococcus
TNMP

SEQ ID NO: 1866431 - protein, 7 aa, Staphylococcus
TNNANFN

SEQ ID NO: 1866432 - protein, 7 aa, Staphylococcus
TNNASLN

SEQ ID NO: 1866433 - protein, 35 aa, Staphylococcus
TNNEPNRTYVTAPKNEIRSKEVSNVTNTNNNSSVT

SEQ ID NO: 1866434 - protein, 6 aa, Staphylococcus
TNNEQY

SEQ ID NO: 1866435 - protein, 7 aa, Staphylococcus
TNNFPYS

SEQ ID NO: 1866436 - protein, 13 aa, Staphylococcus
TNNGRDRSVNDAK

SEQ ID NO: 1866437 - protein, 5 aa, Staphylococcus
TNNNI

SEQ ID NO: 1866438 - protein, 8 aa, Staphylococcus
TNNPDTQW

SEQ ID NO: 1866439 - protein, 5 aa, Staphylococcus
TNNPL

SEQ ID NO: 1866440 - protein, 8 aa, Staphylococcus
TNNPLAEP

SEQ ID NO: 1866441 - protein, 9 aa, Staphylococcus
TNNPREREE

SEQ ID NO: 1866442 - protein, 6 aa, Staphylococcus
TNNSDL

SEQ ID NO: 1866443 - protein, 8 aa, Staphylococcus
TNNSENQW

SEQ ID NO: 1866444 - protein, 17 aa, Staphylococcus
TNNSLSTSGGSQVGPGA

SEQ ID NO: 1866445 - protein, 6 aa, Staphylococcus
TNNTSP

SEQ ID NO: 1866446 - protein, 7 aa, Staphylococcus
TNNYGHS

SEQ ID NO: 1866447 - protein, 7 aa, Staphylococcus
TNPAIQS

SEQ ID NO: 1866448 - protein, 7 aa, Staphylococcus
TNPEDQR

SEQ ID NO: 1866449 - protein, 5 aa, Staphylococcus
TNPEV

SEQ ID NO: 1866450 - protein, 13 aa, Staphylococcus
TNPFGQESGTGYH

SEQ ID NO: 1866451 - protein, 13 aa, Staphylococcus
TNPFSQESGTGYH

SEQ ID NO: 1866452 - protein, 9 aa, Staphylococcus
TNPKEALGS

SEQ ID NO: 1866453 - protein, 7 aa, Staphylococcus
TNPNLGR

SEQ ID NO: 1866454 - protein, 12 aa, Staphylococcus
TNPNTKGLSDAG

SEQ ID NO: 1866455 - protein, 12 aa, Staphylococcus
TNPNTKGVSDAG

SEQ ID NO: 1866456 - protein, 13 aa, Staphylococcus
TNPNTKGVSDAGL

SEQ ID NO: 1866457 - protein, 5 aa, Staphylococcus
TNPSI

SEQ ID NO: 1866458 - protein, 12 aa, Staphylococcus
TNPTGAENTQLQ

SEQ ID NO: 1866459 - protein, 5 aa, Staphylococcus
TNPVK

SEQ ID NO: 1866460 - protein, 18 aa, Staphylococcus
TNPYESKQINEDKDTAIA

SEQ ID NO: 1866461 - protein, 129 aa, Staphylococcus
TNQGDHKDDSDNKTADHSKTNKNKDDAKDKSSASKDKDSKSKDNAKNSQDNNAQSDDTANNDNNNENADSNDSANQNDANNSDNANNQNGYNQDQQGVQNQQNDQYNQNNQNQNQNTQAQQGGQTHTVY

SEQ ID NO: 1866462 - protein, 20 aa, Staphylococcus
TNQGTQINEDIKNEANPSRL

SEQ ID NO: 1866463 - protein, 4 aa, Staphylococcus
TNQI

SEQ ID NO: 1866464 - protein, 8 aa, Staphylococcus
TNQKSLNG

SEQ ID NO: 1866465 - protein, 10 aa, Staphylococcus
TNQPRAKESL

SEQ ID NO: 1866466 - protein, 21 aa, Staphylococcus
TNQQTISEKPNHQSNDDRIGL

SEQ ID NO: 1866467 - protein, 12 aa, Staphylococcus
TNQSLDEVEPNN

SEQ ID NO: 1866468 - protein, 7 aa, Staphylococcus
TNQSLRD

SEQ ID NO: 1866469 - protein, 8 aa, Staphylococcus
TNQSNESI

SEQ ID NO: 1866470 - protein, 6 aa, Staphylococcus
TNQSSL

SEQ ID NO: 1866471 - protein, 5 aa, Staphylococcus
TNRAY

SEQ ID NO: 1866472 - protein, 8 aa, Staphylococcus
TNRGETLA

SEQ ID NO: 1866473 - protein, 7 aa, Staphylococcus
TNRNGVP

SEQ ID NO: 1866474 - protein, 4 aa, Staphylococcus
TNRP

SEQ ID NO: 1866475 - protein, 12 aa, Staphylococcus
TNRSLDEVEPNN

SEQ ID NO: 1866476 - protein, 7 aa, Staphylococcus
TNSETSI

SEQ ID NO: 1866477 - protein, 4 aa, Staphylococcus
TNSI

SEQ ID NO: 1866478 - protein, 8 aa, Staphylococcus
TNSPGQLS

SEQ ID NO: 1866479 - protein, 8 aa, Staphylococcus
TNSSLRSE

SEQ ID NO: 1866480 - protein, 9 aa, Staphylococcus
TNTEGQSDT

SEQ ID NO: 1866481 - protein, 17 aa, Staphylococcus
TNTETTPEGNTKVTFSD

SEQ ID NO: 1866482 - protein, 9 aa, Staphylococcus
TNTKNTPGI

SEQ ID NO: 1866483 - protein, 5 aa, Staphylococcus
TNTNN

SEQ ID NO: 1866484 - protein, 5 aa, Staphylococcus
TNTPV

SEQ ID NO: 1866485 - protein, 12 aa, Staphylococcus
TNTRTNRKGMNG

SEQ ID NO: 1866486 - protein, 4 aa, Staphylococcus
TNTT

SEQ ID NO: 1866487 - protein, 6 aa, Staphylococcus
TNTYKD

SEQ ID NO: 1866488 - protein, 10 aa, Staphylococcus
TNTYSHDEEK

SEQ ID NO: 1866489 - protein, 16 aa, Staphylococcus
TNTYSSKNKESRGQGI

SEQ ID NO: 1866490 - protein, 12 aa, Staphylococcus
TNVNQEPNSDAR

SEQ ID NO: 1866491 - protein, 9 aa, Staphylococcus
TNVNSNDYT

SEQ ID NO: 1866492 - protein, 12 aa, Staphylococcus
TNYDTKPVKEQL

SEQ ID NO: 1866493 - protein, 7 aa, Staphylococcus
TNYGNID

SEQ ID NO: 1866494 - protein, 5 aa, Staphylococcus
TNYKK

SEQ ID NO: 1866495 - protein, 4 aa, Staphylococcus
TNYR

SEQ ID NO: 1866496 - protein, 5 aa, Staphylococcus
TNYRE

SEQ ID NO: 1866497 - protein, 6 aa, Staphylococcus
TNYREM

SEQ ID NO: 1866498 - protein, 4 aa, Staphylococcus
TNYS

SEQ ID NO: 1866499 - protein, 8 aa, Staphylococcus
TPAEANVV

SEQ ID NO: 1866500 - protein, 9 aa, Staphylococcus
TPAEKSNKA

SEQ ID NO: 1866501 - protein, 20 aa, Staphylococcus
TPAKQKTTSRAEVQKKGRLL

SEQ ID NO: 1866502 - protein, 48 aa, Staphylococcus
TPANEVNAHETDPTLENDSTSANDTTTQSNVATTAPQSEPTNESKEHE

SEQ ID NO: 1866503 - protein, 9 aa, Staphylococcus
TPANGGTPI

SEQ ID NO: 1866504 - protein, 9 aa, Staphylococcus
TPANKADKL

SEQ ID NO: 1866505 - protein, 11 aa, Staphylococcus
TPAQKSAEKAL

SEQ ID NO: 1866506 - protein, 4 aa, Staphylococcus
TPDI

SEQ ID NO: 1866507 - protein, 9 aa, Staphylococcus
TPDKEHSIG

SEQ ID NO: 1866508 - protein, 9 aa, Staphylococcus
TPDKNHEVG

SEQ ID NO: 1866509 - protein, 4 aa, Staphylococcus
TPDM

SEQ ID NO: 1866510 - protein, 4 aa, Staphylococcus
TPDY

SEQ ID NO: 1866511 - protein, 14 aa, Staphylococcus
TPEERAQKKLLSTE

SEQ ID NO: 1866512 - protein, 13 aa, Staphylococcus
TPEERGILNEKEA

SEQ ID NO: 1866513 - protein, 24 aa, Staphylococcus
TPEGYTPTKSYQGMNTEVDSNGLS

SEQ ID NO: 1866514 - protein, 4 aa, Staphylococcus
TPEI

SEQ ID NO: 1866515 - protein, 15 aa, Staphylococcus
TPELNAHGSSMTNTI

SEQ ID NO: 1866516 - protein, 12 aa, Staphylococcus
TPENQSGTVVGK

SEQ ID NO: 1866517 - protein, 4 aa, Staphylococcus
TPET

SEQ ID NO: 1866518 - protein, 16 aa, Staphylococcus
TPETKADSDSDVQRGK

SEQ ID NO: 1866519 - protein, 17 aa, Staphylococcus
TPETKAEPIGNKPLEPK

SEQ ID NO: 1866520 - protein, 19 aa, Staphylococcus
TPETKAEPIITENGEKKKF

SEQ ID NO: 1866521 - protein, 13 aa, Staphylococcus
TPETKAETTGSEV

SEQ ID NO: 1866522 - protein, 21 aa, Staphylococcus
TPETKDPRKPVQKYGPEASRF

SEQ ID NO: 1866523 - protein, 25 aa, Staphylococcus
TPETKHPRVGKQPFGQEASDRTAEL

SEQ ID NO: 1866524 - protein, 23 aa, Staphylococcus
TPETKHPTKGVQPYGKEASAYTK

SEQ ID NO: 1866525 - protein, 19 aa, Staphylococcus
TPETKNEPDTDTDNSGSKF

SEQ ID NO: 1866526 - protein, 18 aa, Staphylococcus
TPETKVEPSVDETKTKFD

SEQ ID NO: 1866527 - protein, 5 aa, Staphylococcus
TPETN

SEQ ID NO: 1866528 - protein, 27 aa, Staphylococcus
TPETVKPNTPVQPYGKEASNYSKKELT

SEQ ID NO: 1866529 - protein, 4 aa, Staphylococcus
TPEY

SEQ ID NO: 1866530 - protein, 6 aa, Staphylococcus
TPFNRD

SEQ ID NO: 1866531 - protein, 6 aa, Staphylococcus
TPGDPI

SEQ ID NO: 1866532 - protein, 4 aa, Staphylococcus
TPGN

SEQ ID NO: 1866533 - protein, 8 aa, Staphylococcus
TPGNASVS

SEQ ID NO: 1866534 - protein, 21 aa, Staphylococcus
TPGREDKEAQHTVASTERAET

SEQ ID NO: 1866535 - protein, 5 aa, Staphylococcus
TPGSF

SEQ ID NO: 1866536 - protein, 4 aa, Staphylococcus
TPGV

SEQ ID NO: 1866537 - protein, 10 aa, Staphylococcus
TPIETNKSSP

SEQ ID NO: 1866538 - protein, 14 aa, Staphylococcus
TPIGEGGEMLSGGQ

SEQ ID NO: 1866539 - protein, 12 aa, Staphylococcus
TPIHKAGTQAAI

SEQ ID NO: 1866540 - protein, 5 aa, Staphylococcus
TPIPK

SEQ ID NO: 1866541 - protein, 6 aa, Staphylococcus
TPKDIN

SEQ ID NO: 1866542 - protein, 44 aa, Staphylococcus
TPKEYDTSEEFTDDTDEVTPDYSTGGGSLDDVPEEEQDNSSDKA

SEQ ID NO: 1866543 - protein, 9 aa, Staphylococcus
TPKGNKFNE

SEQ ID NO: 1866544 - protein, 9 aa, Staphylococcus
TPKGRKFNS

SEQ ID NO: 1866545 - protein, 8 aa, Staphylococcus
TPKGRRFN

SEQ ID NO: 1866546 - protein, 11 aa, Staphylococcus
TPKHKHDDSTL

SEQ ID NO: 1866547 - protein, 10 aa, Staphylococcus
TPKHKHDTST

SEQ ID NO: 1866548 - protein, 8 aa, Staphylococcus
TPKHQHDE

SEQ ID NO: 1866549 - protein, 9 aa, Staphylococcus
TPKKNRKKV

SEQ ID NO: 1866550 - protein, 17 aa, Staphylococcus
TPKNNTQAFESTAKPTI

SEQ ID NO: 1866551 - protein, 6 aa, Staphylococcus
TPKNRI

SEQ ID NO: 1866552 - protein, 17 aa, Staphylococcus
TPKNSEIETTDKGIIIY

SEQ ID NO: 1866553 - protein, 10 aa, Staphylococcus
TPKPGETEEA

SEQ ID NO: 1866554 - protein, 11 aa, Staphylococcus
TPKPGETQKGV

SEQ ID NO: 1866555 - protein, 10 aa, Staphylococcus
TPKTRKSEGI

SEQ ID NO: 1866556 - protein, 5 aa, Staphylococcus
TPLAT

SEQ ID NO: 1866557 - protein, 5 aa, Staphylococcus
TPLEN

SEQ ID NO: 1866558 - protein, 4 aa, Staphylococcus
TPLG

SEQ ID NO: 1866559 - protein, 4 aa, Staphylococcus
TPLS

SEQ ID NO: 1866560 - protein, 7 aa, Staphylococcus
TPLSGDD

SEQ ID NO: 1866561 - protein, 8 aa, Staphylococcus
TPLTAKQS

SEQ ID NO: 1866562 - protein, 5 aa, Staphylococcus
TPLTR

SEQ ID NO: 1866563 - protein, 6 aa, Staphylococcus
TPMTRD

SEQ ID NO: 1866564 - protein, 11 aa, Staphylococcus
TPNAPKAKIGS

SEQ ID NO: 1866565 - protein, 13 aa, Staphylococcus
TPNEVKDAASGYA

SEQ ID NO: 1866566 - protein, 4 aa, Staphylococcus
TPNF

SEQ ID NO: 1866567 - protein, 9 aa, Staphylococcus
TPNGNANLN

SEQ ID NO: 1866568 - protein, 4 aa, Staphylococcus
TPNI

SEQ ID NO: 1866569 - protein, 5 aa, Staphylococcus
TPNIS

SEQ ID NO: 1866570 - protein, 4 aa, Staphylococcus
TPPD

SEQ ID NO: 1866571 - protein, 8 aa, Staphylococcus
TPPNFNQP

SEQ ID NO: 1866572 - protein, 12 aa, Staphylococcus
TPPNFNQPFKSR

SEQ ID NO: 1866573 - protein, 7 aa, Staphylococcus
TPPPRKK

SEQ ID NO: 1866574 - protein, 10 aa, Staphylococcus
TPPQLSKNKD

SEQ ID NO: 1866575 - protein, 4 aa, Staphylococcus
TPQE

SEQ ID NO: 1866576 - protein, 12 aa, Staphylococcus
TPQNFKQPFKAK

SEQ ID NO: 1866577 - protein, 10 aa, Staphylococcus
TPQTRKSEGI

SEQ ID NO: 1866578 - protein, 13 aa, Staphylococcus
TPQVKDLPKEERI

SEQ ID NO: 1866579 - protein, 5 aa, Staphylococcus
TPQVN

SEQ ID NO: 1866580 - protein, 4 aa, Staphylococcus
TPSD

SEQ ID NO: 1866581 - protein, 7 aa, Staphylococcus
TPSDGIE

SEQ ID NO: 1866582 - protein, 10 aa, Staphylococcus
TPSDMSKDTK

SEQ ID NO: 1866583 - protein, 4 aa, Staphylococcus
TPSE

SEQ ID NO: 1866584 - protein, 13 aa, Staphylococcus
TPSEQRKASTSMS

SEQ ID NO: 1866585 - protein, 10 aa, Staphylococcus
TPSESRKQDH

SEQ ID NO: 1866586 - protein, 4 aa, Staphylococcus
TPSG

SEQ ID NO: 1866587 - protein, 5 aa, Staphylococcus
TPSGL

SEQ ID NO: 1866588 - protein, 6 aa, Staphylococcus
TPSGTF

SEQ ID NO: 1866589 - protein, 6 aa, Staphylococcus
TPSKIQ

SEQ ID NO: 1866590 - protein, 9 aa, Staphylococcus
TPSKPLVEG

SEQ ID NO: 1866591 - protein, 11 aa, Staphylococcus
TPTEETAKENF

SEQ ID NO: 1866592 - protein, 4 aa, Staphylococcus
TPTK

SEQ ID NO: 1866593 - protein, 58 aa, Staphylococcus
TPTKPIPEGNVSAKATDNAEHPNSSTSQPKKATDLTPPVKPSVVGTLDGKAGTKDPVE

SEQ ID NO: 1866594 - protein, 58 aa, Staphylococcus
TPTKPIPEGNVSAKATDNAEHPNSSTSQTKKATDLTPPVKPSVVGTLDGKAGTKDPVE

SEQ ID NO: 1866595 - protein, 66 aa, Staphylococcus
TPTKPIPEGNVSAKAYDNAEVPNVATSQPKKATDTTPPTTPTLDTDLDGKAGTQTPITVTTDPNTH

SEQ ID NO: 1866596 - protein, 66 aa, Staphylococcus
TPTKPIPEGNVSAKAYDNAEVPNVATSQPKKATDTTPPTTPTLDTDLGGKAGTQTPITVTTDPNTH

SEQ ID NO: 1866597 - protein, 43 aa, Staphylococcus
TPTKPIPEGNVTAKATDDAEHPNSSTSQPKKATDTTPPTAPVV

SEQ ID NO: 1866598 - protein, 43 aa, Staphylococcus
TPTKPIPEGNVTAKATDHAEHPNSSTSQPKKATDTTPPTAPVV

SEQ ID NO: 1866599 - protein, 58 aa, Staphylococcus
TPTKPIPEGNVTAKATDNAEHPNSSTSQPKKATDLTPPVKPSVVGTLDGKAGTKDPVE

SEQ ID NO: 1866600 - protein, 10 aa, Staphylococcus
TPTRPIPEGD

SEQ ID NO: 1866601 - protein, 5 aa, Staphylococcus
TPTSI

SEQ ID NO: 1866602 - protein, 15 aa, Staphylococcus
TPTSKAGNAAAVEES

SEQ ID NO: 1866603 - protein, 6 aa, Staphylococcus
TPVQDY

SEQ ID NO: 1866604 - protein, 32 aa, Staphylococcus
TPVYQQGSNQSHHQYQNDNNYNHHSRNDNKKT

SEQ ID NO: 1866605 - protein, 10 aa, Staphylococcus
TPYDQERHRY

SEQ ID NO: 1866606 - protein, 6 aa, Staphylococcus
TPYGTA

SEQ ID NO: 1866607 - protein, 7 aa, Staphylococcus
TPYGTAS

SEQ ID NO: 1866608 - protein, 5 aa, Staphylococcus
TQAAI

SEQ ID NO: 1866609 - protein, 14 aa, Staphylococcus
TQADPDKQAAYNQA

SEQ ID NO: 1866610 - protein, 5 aa, Staphylococcus
TQANF

SEQ ID NO: 1866611 - protein, 5 aa, Staphylococcus
TQAPQ

SEQ ID NO: 1866612 - protein, 6 aa, Staphylococcus
TQAPQQ

SEQ ID NO: 1866613 - protein, 6 aa, Staphylococcus
TQAQRR

SEQ ID NO: 1866614 - protein, 7 aa, Staphylococcus
TQAYNEK

SEQ ID NO: 1866615 - protein, 8 aa, Staphylococcus
TQDDIKDT

SEQ ID NO: 1866616 - protein, 11 aa, Staphylococcus
TQDDRKSQRKV

SEQ ID NO: 1866617 - protein, 8 aa, Staphylococcus
TQDGKEKG

SEQ ID NO: 1866618 - protein, 4 aa, Staphylococcus
TQDI

SEQ ID NO: 1866619 - protein, 4 aa, Staphylococcus
TQDQ

SEQ ID NO: 1866620 - protein, 7 aa, Staphylococcus
TQDQKID

SEQ ID NO: 1866621 - protein, 16 aa, Staphylococcus
TQDSNQGVSSDQLNQS

SEQ ID NO: 1866622 - protein, 4 aa, Staphylococcus
TQED

SEQ ID NO: 1866623 - protein, 101 aa, Staphylococcus
TQEEIQHQKQKAHENTDKNSSSDDLHSAESKNQKDKSEFATAESPKHHNQDKKEAIETGAAGIRPEDTGKDTQKEVHTAETKATENKYENESASKEDTAHM

SEQ ID NO: 1866624 - protein, 8 aa, Staphylococcus
TQEEIQQQ

SEQ ID NO: 1866625 - protein, 4 aa, Staphylococcus
TQEK

SEQ ID NO: 1866626 - protein, 9 aa, Staphylococcus
TQEKLDEAK

SEQ ID NO: 1866627 - protein, 15 aa, Staphylococcus
TQENSNNTFKSIAPQ

SEQ ID NO: 1866628 - protein, 9 aa, Staphylococcus
TQESGQFQT

SEQ ID NO: 1866629 - protein, 4 aa, Staphylococcus
TQET

SEQ ID NO: 1866630 - protein, 30 aa, Staphylococcus
TQETEDKKVKKDNVISQSPKDEEIDEGSTI

SEQ ID NO: 1866631 - protein, 9 aa, Staphylococcus
TQETEDSLL

SEQ ID NO: 1866632 - protein, 19 aa, Staphylococcus
TQEVDNQSLKESELEEDIN

SEQ ID NO: 1866633 - protein, 5 aa, Staphylococcus
TQFQH

SEQ ID NO: 1866634 - protein, 18 aa, Staphylococcus
TQGNTNPPPMRRGKKKRF

SEQ ID NO: 1866635 - protein, 20 aa, Staphylococcus
TQGPISNAAVNTKAKNTVSG

SEQ ID NO: 1866636 - protein, 6 aa, Staphylococcus
TQHAQD

SEQ ID NO: 1866637 - protein, 14 aa, Staphylococcus
TQHEQPNSNTKEPV

SEQ ID NO: 1866638 - protein, 6 aa, Staphylococcus
TQHTKM

SEQ ID NO: 1866639 - protein, 16 aa, Staphylococcus
TQHVSDDQHNKDIKYK

SEQ ID NO: 1866640 - protein, 4 aa, Staphylococcus
TQIL

SEQ ID NO: 1866641 - protein, 11 aa, Staphylococcus
TQINENDRYNE

SEQ ID NO: 1866642 - protein, 12 aa, Staphylococcus
TQKESYRKKPSL

SEQ ID NO: 1866643 - protein, 10 aa, Staphylococcus
TQKKVLGEPL

SEQ ID NO: 1866644 - protein, 9 aa, Staphylococcus
TQKPSKVEV

SEQ ID NO: 1866645 - protein, 10 aa, Staphylococcus
TQKPSKVEVV

SEQ ID NO: 1866646 - protein, 5 aa, Staphylococcus
TQKRL

SEQ ID NO: 1866647 - protein, 7 aa, Staphylococcus
TQKTHMK

SEQ ID NO: 1866648 - protein, 7 aa, Staphylococcus
TQKTKGH

SEQ ID NO: 1866649 - protein, 9 aa, Staphylococcus
TQKVPRKNI

SEQ ID NO: 1866650 - protein, 6 aa, Staphylococcus
TQLDGA

SEQ ID NO: 1866651 - protein, 6 aa, Staphylococcus
TQLEDN

SEQ ID NO: 1866652 - protein, 8 aa, Staphylococcus
TQLEPPLD

SEQ ID NO: 1866653 - protein, 5 aa, Staphylococcus
TQLKG

SEQ ID NO: 1866654 - protein, 5 aa, Staphylococcus
TQLRD

SEQ ID NO: 1866655 - protein, 4 aa, Staphylococcus
TQLS

SEQ ID NO: 1866656 - protein, 9 aa, Staphylococcus
TQLSQGQHI

SEQ ID NO: 1866657 - protein, 11 aa, Staphylococcus
TQNDRKSQRRV

SEQ ID NO: 1866658 - protein, 8 aa, Staphylococcus
TQNEIDTA

SEQ ID NO: 1866659 - protein, 7 aa, Staphylococcus
TQNEQEI

SEQ ID NO: 1866660 - protein, 11 aa, Staphylococcus
TQNKNSNGSTI

SEQ ID NO: 1866661 - protein, 12 aa, Staphylococcus
TQNLTNESYNIN

SEQ ID NO: 1866662 - protein, 69 aa, Staphylococcus
TQNNDEQDFNDDIEEDKYNQYPKRAVKSEYQQSSNDDTSGVLSRQRKYKYKSKNSMPNEVNDDENNVEK

SEQ ID NO: 1866663 - protein, 20 aa, Staphylococcus
TQNQLSEALSNGSSGKEEAV

SEQ ID NO: 1866664 - protein, 14 aa, Staphylococcus
TQNQTKELEKESRN

SEQ ID NO: 1866665 - protein, 6 aa, Staphylococcus
TQNSHS

SEQ ID NO: 1866666 - protein, 5 aa, Staphylococcus
TQNSR

SEQ ID NO: 1866667 - protein, 6 aa, Staphylococcus
TQNTGI

SEQ ID NO: 1866668 - protein, 40 aa, Staphylococcus
TQPIPEGNVTAKAYDNAEHPNSSTSQPKKATDTTPPTEPV

SEQ ID NO: 1866669 - protein, 41 aa, Staphylococcus
TQPIPEGNVTAKAYDNAEHPNVSTSEPKKATDTTPPTAPVV

SEQ ID NO: 1866670 - protein, 12 aa, Staphylococcus
TQPKKATSSYLD

SEQ ID NO: 1866671 - protein, 12 aa, Staphylococcus
TQPNSPNDNFAR

SEQ ID NO: 1866672 - protein, 5 aa, Staphylococcus
TQQGH

SEQ ID NO: 1866673 - protein, 20 aa, Staphylococcus
TQQLDENNVSYTSTSQNVGY

SEQ ID NO: 1866674 - protein, 8 aa, Staphylococcus
TQQPPPSY

SEQ ID NO: 1866675 - protein, 7 aa, Staphylococcus
TQQQYDA

SEQ ID NO: 1866676 - protein, 4 aa, Staphylococcus
TQQR

SEQ ID NO: 1866677 - protein, 5 aa, Staphylococcus
TQQTN

SEQ ID NO: 1866678 - protein, 6 aa, Staphylococcus
TQRDNE

SEQ ID NO: 1866679 - protein, 4 aa, Staphylococcus
TQRG

SEQ ID NO: 1866680 - protein, 6 aa, Staphylococcus
TQSATG

SEQ ID NO: 1866681 - protein, 8 aa, Staphylococcus
TQSDNIKQ

SEQ ID NO: 1866682 - protein, 13 aa, Staphylococcus
TQSGGGASASGRI

SEQ ID NO: 1866683 - protein, 4 aa, Staphylococcus
TQSH

SEQ ID NO: 1866684 - protein, 4 aa, Staphylococcus
TQSK

SEQ ID NO: 1866685 - protein, 15 aa, Staphylococcus
TQSKKLNELDGTPEL

SEQ ID NO: 1866686 - protein, 4 aa, Staphylococcus
TQSQ

SEQ ID NO: 1866687 - protein, 16 aa, Staphylococcus
TQSQINDSENENQVNF

SEQ ID NO: 1866688 - protein, 4 aa, Staphylococcus
TQST

SEQ ID NO: 1866689 - protein, 5 aa, Staphylococcus
TQSTQ

SEQ ID NO: 1866690 - protein, 6 aa, Staphylococcus
TQSTTH

SEQ ID NO: 1866691 - protein, 9 aa, Staphylococcus
TQSVEAHTT

SEQ ID NO: 1866692 - protein, 7 aa, Staphylococcus
TQTESIY

SEQ ID NO: 1866693 - protein, 6 aa, Staphylococcus
TQTFDE

SEQ ID NO: 1866694 - protein, 16 aa, Staphylococcus
TQTPIISRTTNKEQNG

SEQ ID NO: 1866695 - protein, 8 aa, Staphylococcus
TQTQRLGV

SEQ ID NO: 1866696 - protein, 9 aa, Staphylococcus
TQTQRLGVP

SEQ ID NO: 1866697 - protein, 5 aa, Staphylococcus
TQTTN

SEQ ID NO: 1866698 - protein, 6 aa, Staphylococcus
TQTTNH

SEQ ID NO: 1866699 - protein, 5 aa, Staphylococcus
TQTTQ

SEQ ID NO: 1866700 - protein, 20 aa, Staphylococcus
TQTTQYAAGYAQDLDKTNPF

SEQ ID NO: 1866701 - protein, 8 aa, Staphylococcus
TQTTRLGV

SEQ ID NO: 1866702 - protein, 5 aa, Staphylococcus
TQVEG

SEQ ID NO: 1866703 - protein, 12 aa, Staphylococcus
TQVEGDDSNAEN

SEQ ID NO: 1866704 - protein, 32 aa, Staphylococcus
TQVNPGSSYTGSQSAQKAIDTVTNSIKDNIRT

SEQ ID NO: 1866705 - protein, 6 aa, Staphylococcus
TQVSKA

SEQ ID NO: 1866706 - protein, 16 aa, Staphylococcus
TQVSQSQIQATEQKLG

SEQ ID NO: 1866707 - protein, 7 aa, Staphylococcus
TQVSRAK

SEQ ID NO: 1866708 - protein, 5 aa, Staphylococcus
TQVST

SEQ ID NO: 1866709 - protein, 6 aa, Staphylococcus
TQVTSG

SEQ ID NO: 1866710 - protein, 14 aa, Staphylococcus
TQYGEAHSKSNQYH

SEQ ID NO: 1866711 - protein, 9 aa, Staphylococcus
TQYGGEQGA

SEQ ID NO: 1866712 - protein, 9 aa, Staphylococcus
TQYGGQQGA

SEQ ID NO: 1866713 - protein, 11 aa, Staphylococcus
TRAKTQTTNAL

SEQ ID NO: 1866714 - protein, 13 aa, Staphylococcus
TRALNKRNRVNKS

SEQ ID NO: 1866715 - protein, 7 aa, Staphylococcus
TRALTPR

SEQ ID NO: 1866716 - protein, 10 aa, Staphylococcus
TRARGAATGI

SEQ ID NO: 1866717 - protein, 5 aa, Staphylococcus
TRDDN

SEQ ID NO: 1866718 - protein, 9 aa, Staphylococcus
TRDESKDKM

SEQ ID NO: 1866719 - protein, 9 aa, Staphylococcus
TRDESKEQM

SEQ ID NO: 1866720 - protein, 16 aa, Staphylococcus
TRDGKAALDFVQQQFE

SEQ ID NO: 1866721 - protein, 17 aa, Staphylococcus
TRDGKTHTVGDNGKVGD

SEQ ID NO: 1866722 - protein, 16 aa, Staphylococcus
TRDGQAALEFVKQQFK

SEQ ID NO: 1866723 - protein, 16 aa, Staphylococcus
TRDGQAALEFVQKQFE

SEQ ID NO: 1866724 - protein, 9 aa, Staphylococcus
TREAGESKW

SEQ ID NO: 1866725 - protein, 10 aa, Staphylococcus
TREDKQNRSL

SEQ ID NO: 1866726 - protein, 6 aa, Staphylococcus
TREDYM

SEQ ID NO: 1866727 - protein, 6 aa, Staphylococcus
TREGAI

SEQ ID NO: 1866728 - protein, 8 aa, Staphylococcus
TRERKRIG

SEQ ID NO: 1866729 - protein, 6 aa, Staphylococcus
TRFDDP

SEQ ID NO: 1866730 - protein, 4 aa, Staphylococcus
TRFN

SEQ ID NO: 1866731 - protein, 13 aa, Staphylococcus
TRGRKTSQKEMLE

SEQ ID NO: 1866732 - protein, 10 aa, Staphylococcus
TRIQSDTGEI

SEQ ID NO: 1866733 - protein, 10 aa, Staphylococcus
TRIQSDTGEV

SEQ ID NO: 1866734 - protein, 25 aa, Staphylococcus
TRKEVEAKFGKSSGKVDGGQTYYEK

SEQ ID NO: 1866735 - protein, 26 aa, Staphylococcus
TRKNKQPESESGSAHHGSGEMPRTDI

SEQ ID NO: 1866736 - protein, 9 aa, Staphylococcus
TRKRSQALA

SEQ ID NO: 1866737 - protein, 12 aa, Staphylococcus
TRNEEIREETVN

SEQ ID NO: 1866738 - protein, 5 aa, Staphylococcus
TRNNF

SEQ ID NO: 1866739 - protein, 5 aa, Staphylococcus
TRPEI

SEQ ID NO: 1866740 - protein, 20 aa, Staphylococcus
TRPNGTTETTTTDSNGKYQF

SEQ ID NO: 1866741 - protein, 4 aa, Staphylococcus
TRPY

SEQ ID NO: 1866742 - protein, 7 aa, Staphylococcus
TRQDGFN

SEQ ID NO: 1866743 - protein, 61 aa, Staphylococcus
TRQNDHTTTSTTASTIKETQQHSTKTNDDNVKSRRDNENFKQGTTSHQTKRKLSTLGENDA

SEQ ID NO: 1866744 - protein, 6 aa, Staphylococcus
TRQPKF

SEQ ID NO: 1866745 - protein, 19 aa, Staphylococcus
TRRNQQDIDEINTMLSKRK

SEQ ID NO: 1866746 - protein, 4 aa, Staphylococcus
TRRQ

SEQ ID NO: 1866747 - protein, 7 aa, Staphylococcus
TRRRGEK

SEQ ID NO: 1866748 - protein, 6 aa, Staphylococcus
TRSDAV

SEQ ID NO: 1866749 - protein, 12 aa, Staphylococcus
TRSKKTSQQEML

SEQ ID NO: 1866750 - protein, 20 aa, Staphylococcus
TRSQSGKRDPRNGQQIEKGT

SEQ ID NO: 1866751 - protein, 16 aa, Staphylococcus
TRSRKTSQKDMLDTAK

SEQ ID NO: 1866752 - protein, 12 aa, Staphylococcus
TRSRKTSQQDML

SEQ ID NO: 1866753 - protein, 15 aa, Staphylococcus
TRSRRSATSPITSEG

SEQ ID NO: 1866754 - protein, 6 aa, Staphylococcus
TRTAGF

SEQ ID NO: 1866755 - protein, 17 aa, Staphylococcus
TRTDTESSDEKTNKPSQ

SEQ ID NO: 1866756 - protein, 10 aa, Staphylococcus
TRTETDATGN

SEQ ID NO: 1866757 - protein, 6 aa, Staphylococcus
TRTGAL

SEQ ID NO: 1866758 - protein, 5 aa, Staphylococcus
TRVNP

SEQ ID NO: 1866759 - protein, 19 aa, Staphylococcus
TRVTKQDLSHEQQTRYDEV

SEQ ID NO: 1866760 - protein, 20 aa, Staphylococcus
TRYTHPGDSITITANKDSQY

SEQ ID NO: 1866761 - protein, 9 aa, Staphylococcus
TSALKDKNL

SEQ ID NO: 1866762 - protein, 5 aa, Staphylococcus
TSANE

SEQ ID NO: 1866763 - protein, 6 aa, Staphylococcus
TSANPD

SEQ ID NO: 1866764 - protein, 5 aa, Staphylococcus
TSASA

SEQ ID NO: 1866765 - protein, 11 aa, Staphylococcus
TSASAYDGSEK

SEQ ID NO: 1866766 - protein, 10 aa, Staphylococcus
TSASAYEGNN

SEQ ID NO: 1866767 - protein, 8 aa, Staphylococcus
TSDDETIE

SEQ ID NO: 1866768 - protein, 5 aa, Staphylococcus
TSDHE

SEQ ID NO: 1866769 - protein, 6 aa, Staphylococcus
TSEDKY

SEQ ID NO: 1866770 - protein, 8 aa, Staphylococcus
TSEGVQAY

SEQ ID NO: 1866771 - protein, 4 aa, Staphylococcus
TSEI

SEQ ID NO: 1866772 - protein, 17 aa, Staphylococcus
TSELNKGTQFTISFPMQ

SEQ ID NO: 1866773 - protein, 7 aa, Staphylococcus
TSEPGHS

SEQ ID NO: 1866774 - protein, 4 aa, Staphylococcus
TSEQ

SEQ ID NO: 1866775 - protein, 32 aa, Staphylococcus
TSESAMQASYDKSDSKRQSNIREGKVNPSKDA

SEQ ID NO: 1866776 - protein, 5 aa, Staphylococcus
TSESF

SEQ ID NO: 1866777 - protein, 7 aa, Staphylococcus
TSEVADG

SEQ ID NO: 1866778 - protein, 14 aa, Staphylococcus
TSEYGEKFNKEDAQ

SEQ ID NO: 1866779 - protein, 12 aa, Staphylococcus
TSFGTEKNYEEG

SEQ ID NO: 1866780 - protein, 6 aa, Staphylococcus
TSGAFE

SEQ ID NO: 1866781 - protein, 15 aa, Staphylococcus
TSGAINKPVSIPNTY

SEQ ID NO: 1866782 - protein, 9 aa, Staphylococcus
TSGAVYEGT

SEQ ID NO: 1866783 - protein, 11 aa, Staphylococcus
TSGEYEHDLPN

SEQ ID NO: 1866784 - protein, 6 aa, Staphylococcus
TSGEYK

SEQ ID NO: 1866785 - protein, 4 aa, Staphylococcus
TSGI

SEQ ID NO: 1866786 - protein, 23 aa, Staphylococcus
TSGIPGDITDNDTITSKNDSLSG

SEQ ID NO: 1866787 - protein, 19 aa, Staphylococcus
TSGIPSDITEEDHYSEDYN

SEQ ID NO: 1866788 - protein, 9 aa, Staphylococcus
TSGLTGPES

SEQ ID NO: 1866789 - protein, 10 aa, Staphylococcus
TSGMPQSLEG

SEQ ID NO: 1866790 - protein, 6 aa, Staphylococcus
TSGNNL

SEQ ID NO: 1866791 - protein, 17 aa, Staphylococcus
TSGQKETNQYGVNPKAV

SEQ ID NO: 1866792 - protein, 8 aa, Staphylococcus
TSGQTAID

SEQ ID NO: 1866793 - protein, 6 aa, Staphylococcus
TSGSFA

SEQ ID NO: 1866794 - protein, 11 aa, Staphylococcus
TSGSTSTLESS

SEQ ID NO: 1866795 - protein, 7 aa, Staphylococcus
TSGTRVD

SEQ ID NO: 1866796 - protein, 44 aa, Staphylococcus
TSGTRVDFESNNKVDENKVTNTLESKGFKPDQVSLGENDKNATV

SEQ ID NO: 1866797 - protein, 5 aa, Staphylococcus
TSGYG

SEQ ID NO: 1866798 - protein, 4 aa, Staphylococcus
TSHA

SEQ ID NO: 1866799 - protein, 5 aa, Staphylococcus
TSHDS

SEQ ID NO: 1866800 - protein, 10 aa, Staphylococcus
TSHKAMKDST

SEQ ID NO: 1866801 - protein, 13 aa, Staphylococcus
TSHKFRDKNGKYN

SEQ ID NO: 1866802 - protein, 7 aa, Staphylococcus
TSHKRSK

SEQ ID NO: 1866803 - protein, 4 aa, Staphylococcus
TSIA

SEQ ID NO: 1866804 - protein, 4 aa, Staphylococcus
TSID

SEQ ID NO: 1866805 - protein, 20 aa, Staphylococcus
TSIDTVDKKQSNTEKNQYKV

SEQ ID NO: 1866806 - protein, 4 aa, Staphylococcus
TSIG

SEQ ID NO: 1866807 - protein, 9 aa, Staphylococcus
TSIKDIKDK

SEQ ID NO: 1866808 - protein, 5 aa, Staphylococcus
TSIKS

SEQ ID NO: 1866809 - protein, 6 aa, Staphylococcus
TSIKST

SEQ ID NO: 1866810 - protein, 6 aa, Staphylococcus
TSIPSL

SEQ ID NO: 1866811 - protein, 4 aa, Staphylococcus
TSIQ

SEQ ID NO: 1866812 - protein, 37 aa, Staphylococcus
TSITNSDETQKSAKENTKNSPSNYPNDKNSHKVKTEA

SEQ ID NO: 1866813 - protein, 18 aa, Staphylococcus
TSKEDRPSLKEGRYPNHS

SEQ ID NO: 1866814 - protein, 10 aa, Staphylococcus
TSKGSVNTKQ

SEQ ID NO: 1866815 - protein, 7 aa, Staphylococcus
TSKINGS

SEQ ID NO: 1866816 - protein, 41 aa, Staphylococcus
TSKNFKSYAENKSSLETSDSGFTLSGEVDNTVNVSDRNLSD

SEQ ID NO: 1866817 - protein, 8 aa, Staphylococcus
TSKNNGNM

SEQ ID NO: 1866818 - protein, 9 aa, Staphylococcus
TSKPGFENG

SEQ ID NO: 1866819 - protein, 18 aa, Staphylococcus
TSKQSLKGSYPTVSNEKE

SEQ ID NO: 1866820 - protein, 20 aa, Staphylococcus
TSKQSSQSIVNQKANDTSVQ

SEQ ID NO: 1866821 - protein, 11 aa, Staphylococcus
TSKSLGKRQQV

SEQ ID NO: 1866822 - protein, 7 aa, Staphylococcus
TSKTTAA

SEQ ID NO: 1866823 - protein, 11 aa, Staphylococcus
TSLDEQEATFG

SEQ ID NO: 1866824 - protein, 28 aa, Staphylococcus
TSLEEQEATFGRKRASGAPLTGKKEFDN

SEQ ID NO: 1866825 - protein, 11 aa, Staphylococcus
TSLKDSSKKII

SEQ ID NO: 1866826 - protein, 5 aa, Staphylococcus
TSLKQ

SEQ ID NO: 1866827 - protein, 4 aa, Staphylococcus
TSLP

SEQ ID NO: 1866828 - protein, 4 aa, Staphylococcus
TSLQ

SEQ ID NO: 1866829 - protein, 20 aa, Staphylococcus
TSLQTDKNTVRPNDGEGFSV

SEQ ID NO: 1866830 - protein, 11 aa, Staphylococcus
TSLSAPFGANG

SEQ ID NO: 1866831 - protein, 5 aa, Staphylococcus
TSLTT

SEQ ID NO: 1866832 - protein, 4 aa, Staphylococcus
TSMG

SEQ ID NO: 1866833 - protein, 5 aa, Staphylococcus
TSMPN

SEQ ID NO: 1866834 - protein, 11 aa, Staphylococcus
TSMQDSSKKIV

SEQ ID NO: 1866835 - protein, 4 aa, Staphylococcus
TSMS

SEQ ID NO: 1866836 - protein, 5 aa, Staphylococcus
TSNEK

SEQ ID NO: 1866837 - protein, 8 aa, Staphylococcus
TSNHGTTV

SEQ ID NO: 1866838 - protein, 17 aa, Staphylococcus
TSNHQDGTTFTIILPKN

SEQ ID NO: 1866839 - protein, 7 aa, Staphylococcus
TSNHRGY

SEQ ID NO: 1866840 - protein, 14 aa, Staphylococcus
TSNKHDLKDVTKEL

SEQ ID NO: 1866841 - protein, 16 aa, Staphylococcus
TSNSDVSEEEAKAEIQ

SEQ ID NO: 1866842 - protein, 10 aa, Staphylococcus
TSNSNNISQI

SEQ ID NO: 1866843 - protein, 6 aa, Staphylococcus
TSNTKH

SEQ ID NO: 1866844 - protein, 4 aa, Staphylococcus
TSNV

SEQ ID NO: 1866845 - protein, 6 aa, Staphylococcus
TSPARK

SEQ ID NO: 1866846 - protein, 5 aa, Staphylococcus
TSPDE

SEQ ID NO: 1866847 - protein, 5 aa, Staphylococcus
TSPFE

SEQ ID NO: 1866848 - protein, 8 aa, Staphylococcus
TSPKNRGK

SEQ ID NO: 1866849 - protein, 19 aa, Staphylococcus
TSPMKGSPAEKAGLKPKDI

SEQ ID NO: 1866850 - protein, 6 aa, Staphylococcus
TSPNTD

SEQ ID NO: 1866851 - protein, 4 aa, Staphylococcus
TSQA

SEQ ID NO: 1866852 - protein, 12 aa, Staphylococcus
TSQADSEQFSKN

SEQ ID NO: 1866853 - protein, 7 aa, Staphylococcus
TSQKERV

SEQ ID NO: 1866854 - protein, 5 aa, Staphylococcus
TSQKL

SEQ ID NO: 1866855 - protein, 5 aa, Staphylococcus
TSQSP

SEQ ID NO: 1866856 - protein, 13 aa, Staphylococcus
TSRAEDHKAQASS

SEQ ID NO: 1866857 - protein, 4 aa, Staphylococcus
TSRL

SEQ ID NO: 1866858 - protein, 6 aa, Staphylococcus
TSRVAP

SEQ ID NO: 1866859 - protein, 7 aa, Staphylococcus
TSSENNV

SEQ ID NO: 1866860 - protein, 6 aa, Staphylococcus
TSSEYE

SEQ ID NO: 1866861 - protein, 12 aa, Staphylococcus
TSSGRIIFAKKL

SEQ ID NO: 1866862 - protein, 10 aa, Staphylococcus
TSSISRDGWD

SEQ ID NO: 1866863 - protein, 9 aa, Staphylococcus
TSSKHAREV

SEQ ID NO: 1866864 - protein, 10 aa, Staphylococcus
TSSLSRDGWN

SEQ ID NO: 1866865 - protein, 15 aa, Staphylococcus
TSSMTGHSHVTENAK

SEQ ID NO: 1866866 - protein, 4 aa, Staphylococcus
TSSN

SEQ ID NO: 1866867 - protein, 7 aa, Staphylococcus
TSSPKRK

SEQ ID NO: 1866868 - protein, 5 aa, Staphylococcus
TSSRI

SEQ ID NO: 1866869 - protein, 7 aa, Staphylococcus
TSSSESV

SEQ ID NO: 1866870 - protein, 12 aa, Staphylococcus
TSSSSNGKLSTR

SEQ ID NO: 1866871 - protein, 9 aa, Staphylococcus
TSSSTAQNA

SEQ ID NO: 1866872 - protein, 17 aa, Staphylococcus
TSSVSKVKSSVSSGFNS

SEQ ID NO: 1866873 - protein, 7 aa, Staphylococcus
TSTATTT

SEQ ID NO: 1866874 - protein, 6 aa, Staphylococcus
TSTDKA

SEQ ID NO: 1866875 - protein, 4 aa, Staphylococcus
TSTF

SEQ ID NO: 1866876 - protein, 7 aa, Staphylococcus
TSTGSIA

SEQ ID NO: 1866877 - protein, 8 aa, Staphylococcus
TSTNYDEP

SEQ ID NO: 1866878 - protein, 13 aa, Staphylococcus
TSTPERKKEVDFS

SEQ ID NO: 1866879 - protein, 7 aa, Staphylococcus
TSTPNTR

SEQ ID NO: 1866880 - protein, 11 aa, Staphylococcus
TSTPSDTSSWT

SEQ ID NO: 1866881 - protein, 6 aa, Staphylococcus
TSTQEI

SEQ ID NO: 1866882 - protein, 25 aa, Staphylococcus
TSTQTQEKAKNNDSSKTKSTNKNEH

SEQ ID NO: 1866883 - protein, 9 aa, Staphylococcus
TSTRGRHDI

SEQ ID NO: 1866884 - protein, 13 aa, Staphylococcus
TSTSGGNGKLSSR

SEQ ID NO: 1866885 - protein, 14 aa, Staphylococcus
TSTVNRNETTSSGI

SEQ ID NO: 1866886 - protein, 21 aa, Staphylococcus
TSVKGQDVNQSLTNLKPDMEK

SEQ ID NO: 1866887 - protein, 4 aa, Staphylococcus
TSVP

SEQ ID NO: 1866888 - protein, 12 aa, Staphylococcus
TSVSTKDEIGEL

SEQ ID NO: 1866889 - protein, 7 aa, Staphylococcus
TSYDDER

SEQ ID NO: 1866890 - protein, 7 aa, Staphylococcus
TSYGQAS

SEQ ID NO: 1866891 - protein, 5 aa, Staphylococcus
TSYKN

SEQ ID NO: 1866892 - protein, 8 aa, Staphylococcus
TSYQTGEP

SEQ ID NO: 1866893 - protein, 5 aa, Staphylococcus
TSYTN

SEQ ID NO: 1866894 - protein, 6 aa, Staphylococcus
TSYTNY

SEQ ID NO: 1866895 - protein, 15 aa, Staphylococcus
TSYVTTDNAKVDGKQ

SEQ ID NO: 1866896 - protein, 7 aa, Staphylococcus
TTAASGI

SEQ ID NO: 1866897 - protein, 5 aa, Staphylococcus
TTAKS

SEQ ID NO: 1866898 - protein, 10 aa, Staphylococcus
TTAKSLTDSF

SEQ ID NO: 1866899 - protein, 11 aa, Staphylococcus
TTAKSLTDSFN

SEQ ID NO: 1866900 - protein, 19 aa, Staphylococcus
TTAKSLTDSYNRKLDKTNQ

SEQ ID NO: 1866901 - protein, 19 aa, Staphylococcus
TTAKSLTDSYNRKLESTNQ

SEQ ID NO: 1866902 - protein, 11 aa, Staphylococcus
TTAMSEKLSSR

SEQ ID NO: 1866903 - protein, 19 aa, Staphylococcus
TTAPTVKEISNQTKEVNTA

SEQ ID NO: 1866904 - protein, 19 aa, Staphylococcus
TTAPTVKGINDQTKEVNTA

SEQ ID NO: 1866905 - protein, 20 aa, Staphylococcus
TTAPTVKGISDQTKEVNTEI

SEQ ID NO: 1866906 - protein, 19 aa, Staphylococcus
TTAPTVKGISNQTKEVNTA

SEQ ID NO: 1866907 - protein, 19 aa, Staphylococcus
TTAPTVKGISNQTKEVNTE

SEQ ID NO: 1866908 - protein, 5 aa, Staphylococcus
TTAQQ

SEQ ID NO: 1866909 - protein, 6 aa, Staphylococcus
TTASAI

SEQ ID NO: 1866910 - protein, 25 aa, Staphylococcus
TTDDDQEVALKGKSTKKDDQYKDNY

SEQ ID NO: 1866911 - protein, 68 aa, Staphylococcus
TTDDGSFSLKGKSTGKDDNYKDKYDATFDNNYNKSTLTFENKEKQDGTKRHDKGTITFDNAGTKQDFT

SEQ ID NO: 1866912 - protein, 5 aa, Staphylococcus
TTDFD

SEQ ID NO: 1866913 - protein, 11 aa, Staphylococcus
TTDKNNPNLPQ

SEQ ID NO: 1866914 - protein, 9 aa, Staphylococcus
TTDKQSVPV

SEQ ID NO: 1866915 - protein, 7 aa, Staphylococcus
TTDNHKR

SEQ ID NO: 1866916 - protein, 13 aa, Staphylococcus
TTDNQTKIYTDGH

SEQ ID NO: 1866917 - protein, 8 aa, Staphylococcus
TTDPDTKV

SEQ ID NO: 1866918 - protein, 6 aa, Staphylococcus
TTDVNS

SEQ ID NO: 1866919 - protein, 5 aa, Staphylococcus
TTDVQ

SEQ ID NO: 1866920 - protein, 10 aa, Staphylococcus
TTEEEDKAGL

SEQ ID NO: 1866921 - protein, 12 aa, Staphylococcus
TTELDEREKEEL

SEQ ID NO: 1866922 - protein, 5 aa, Staphylococcus
TTENK

SEQ ID NO: 1866923 - protein, 11 aa, Staphylococcus
TTEQESQQAKQ

SEQ ID NO: 1866924 - protein, 10 aa, Staphylococcus
TTETYPAKKR

SEQ ID NO: 1866925 - protein, 4 aa, Staphylococcus
TTEY

SEQ ID NO: 1866926 - protein, 15 aa, Staphylococcus
TTFKTEKKEPVSTDY

SEQ ID NO: 1866927 - protein, 9 aa, Staphylococcus
TTGDSVKVA

SEQ ID NO: 1866928 - protein, 6 aa, Staphylococcus
TTGEAP

SEQ ID NO: 1866929 - protein, 5 aa, Staphylococcus
TTGKQ

SEQ ID NO: 1866930 - protein, 12 aa, Staphylococcus
TTGNEKELEESY

SEQ ID NO: 1866931 - protein, 6 aa, Staphylococcus
TTGNPA

SEQ ID NO: 1866932 - protein, 7 aa, Staphylococcus
TTGNPAI

SEQ ID NO: 1866933 - protein, 7 aa, Staphylococcus
TTGNPAV

SEQ ID NO: 1866934 - protein, 7 aa, Staphylococcus
TTGQDNI

SEQ ID NO: 1866935 - protein, 7 aa, Staphylococcus
TTGREGY

SEQ ID NO: 1866936 - protein, 11 aa, Staphylococcus
TTGRLKNSEYE

SEQ ID NO: 1866937 - protein, 5 aa, Staphylococcus
TTGSF

SEQ ID NO: 1866938 - protein, 6 aa, Staphylococcus
TTGTIN

SEQ ID NO: 1866939 - protein, 5 aa, Staphylococcus
TTHAT

SEQ ID NO: 1866940 - protein, 6 aa, Staphylococcus
TTHDYN

SEQ ID NO: 1866941 - protein, 8 aa, Staphylococcus
TTHTENIE

SEQ ID NO: 1866942 - protein, 6 aa, Staphylococcus
TTIDDK

SEQ ID NO: 1866943 - protein, 10 aa, Staphylococcus
TTKDPNGNTV

SEQ ID NO: 1866944 - protein, 14 aa, Staphylococcus
TTKNIKSKGNNQLE

SEQ ID NO: 1866945 - protein, 7 aa, Staphylococcus
TTKQREQ

SEQ ID NO: 1866946 - protein, 13 aa, Staphylococcus
TTKQSLDEVQPNN

SEQ ID NO: 1866947 - protein, 5 aa, Staphylococcus
TTKTA

SEQ ID NO: 1866948 - protein, 20 aa, Staphylococcus
TTKTDAKTALDQKAQQQDTI

SEQ ID NO: 1866949 - protein, 5 aa, Staphylococcus
TTKTY

SEQ ID NO: 1866950 - protein, 4 aa, Staphylococcus
TTLD

SEQ ID NO: 1866951 - protein, 11 aa, Staphylococcus
TTLPNGSVGEI

SEQ ID NO: 1866952 - protein, 5 aa, Staphylococcus
TTLST

SEQ ID NO: 1866953 - protein, 23 aa, Staphylococcus
TTMPGATPQTTQDEISSKIDSQI

SEQ ID NO: 1866954 - protein, 8 aa, Staphylococcus
TTMSGNTI

SEQ ID NO: 1866955 - protein, 15 aa, Staphylococcus
TTNDNDLKDTTRKIN

SEQ ID NO: 1866956 - protein, 15 aa, Staphylococcus
TTNETESRNYPLGKA

SEQ ID NO: 1866957 - protein, 8 aa, Staphylococcus
TTNGSLEP

SEQ ID NO: 1866958 - protein, 5 aa, Staphylococcus
TTNGY

SEQ ID NO: 1866959 - protein, 34 aa, Staphylococcus
TTNPEKDNNAYEPKTEEVTKDYGTPTTEDDVTGA

SEQ ID NO: 1866960 - protein, 9 aa, Staphylococcus
TTNPKADVP

SEQ ID NO: 1866961 - protein, 5 aa, Staphylococcus
TTNRL

SEQ ID NO: 1866962 - protein, 71 aa, Staphylococcus
TTNSGNDLHGKGANQQDNTSQSNATKHYDRDSFATSNTGSDLHGQGANQQDSAAQSNATKHYNRDEFEKNN

SEQ ID NO: 1866963 - protein, 11 aa, Staphylococcus
TTNSNASKNSN

SEQ ID NO: 1866964 - protein, 14 aa, Staphylococcus
TTNTISGSPKEVGK

SEQ ID NO: 1866965 - protein, 9 aa, Staphylococcus
TTNYEETDN

SEQ ID NO: 1866966 - protein, 5 aa, Staphylococcus
TTPAP

SEQ ID NO: 1866967 - protein, 9 aa, Staphylococcus
TTPEKYGLA

SEQ ID NO: 1866968 - protein, 14 aa, Staphylococcus
TTPETAVKTHPDNI

SEQ ID NO: 1866969 - protein, 16 aa, Staphylococcus
TTPETKTKTSPSAVKG

SEQ ID NO: 1866970 - protein, 15 aa, Staphylococcus
TTPETKTKTSPTAVE

SEQ ID NO: 1866971 - protein, 4 aa, Staphylococcus
TTPF

SEQ ID NO: 1866972 - protein, 4 aa, Staphylococcus
TTPL

SEQ ID NO: 1866973 - protein, 10 aa, Staphylococcus
TTPNNTGTYG

SEQ ID NO: 1866974 - protein, 23 aa, Staphylococcus
TTPPMKPTVPRGLTGKANTQDPI

SEQ ID NO: 1866975 - protein, 5 aa, Staphylococcus
TTPSA

SEQ ID NO: 1866976 - protein, 5 aa, Staphylococcus
TTPYT

SEQ ID NO: 1866977 - protein, 10 aa, Staphylococcus
TTQESGQFST

SEQ ID NO: 1866978 - protein, 8 aa, Staphylococcus
TTQPMSHA

SEQ ID NO: 1866979 - protein, 7 aa, Staphylococcus
TTQPQTR

SEQ ID NO: 1866980 - protein, 8 aa, Staphylococcus
TTQQQQDV

SEQ ID NO: 1866981 - protein, 6 aa, Staphylococcus
TTQTVE

SEQ ID NO: 1866982 - protein, 5 aa, Staphylococcus
TTQYP

SEQ ID NO: 1866983 - protein, 5 aa, Staphylococcus
TTRAH

SEQ ID NO: 1866984 - protein, 14 aa, Staphylococcus
TTRDNKVDETEAQT

SEQ ID NO: 1866985 - protein, 8 aa, Staphylococcus
TTREFEDG

SEQ ID NO: 1866986 - protein, 8 aa, Staphylococcus
TTREFGDG

SEQ ID NO: 1866987 - protein, 8 aa, Staphylococcus
TTREFKDG

SEQ ID NO: 1866988 - protein, 8 aa, Staphylococcus
TTREFNDG

SEQ ID NO: 1866989 - protein, 8 aa, Staphylococcus
TTRNTNAY

SEQ ID NO: 1866990 - protein, 31 aa, Staphylococcus
TTRPNKPSESVQPVQPNEPVQPAKDATPLVD

SEQ ID NO: 1866991 - protein, 13 aa, Staphylococcus
TTSFPDGNGPNDV

SEQ ID NO: 1866992 - protein, 6 aa, Staphylococcus
TTSGMS

SEQ ID NO: 1866993 - protein, 6 aa, Staphylococcus
TTSGNT

SEQ ID NO: 1866994 - protein, 4 aa, Staphylococcus
TTSL

SEQ ID NO: 1866995 - protein, 11 aa, Staphylococcus
TTSNKTSQTFK

SEQ ID NO: 1866996 - protein, 9 aa, Staphylococcus
TTSPGSTQK

SEQ ID NO: 1866997 - protein, 5 aa, Staphylococcus
TTSPV

SEQ ID NO: 1866998 - protein, 9 aa, Staphylococcus
TTSQPPELN

SEQ ID NO: 1866999 - protein, 5 aa, Staphylococcus
TTSSF

SEQ ID NO: 1867000 - protein, 17 aa, Staphylococcus
TTSSFNYKKGDKIGTPG

SEQ ID NO: 1867001 - protein, 8 aa, Staphylococcus
TTSSGNTV

SEQ ID NO: 1867002 - protein, 9 aa, Staphylococcus
TTTELNQAN

SEQ ID NO: 1867003 - protein, 13 aa, Staphylococcus
TTTMKGTDGKTDL

SEQ ID NO: 1867004 - protein, 5 aa, Staphylococcus
TTTNI

SEQ ID NO: 1867005 - protein, 11 aa, Staphylococcus
TTTPEREKEVS

SEQ ID NO: 1867006 - protein, 12 aa, Staphylococcus
TTTPERKKEVDF

SEQ ID NO: 1867007 - protein, 13 aa, Staphylococcus
TTTPERKKEVDFS

SEQ ID NO: 1867008 - protein, 41 aa, Staphylococcus
TTTSNSKTKTGQTSTAKSTVKPTIPKTSPSKTTKKQSKEYY

SEQ ID NO: 1867009 - protein, 8 aa, Staphylococcus
TTTTDITG

SEQ ID NO: 1867010 - protein, 12 aa, Staphylococcus
TTTVKDSQNMPT

SEQ ID NO: 1867011 - protein, 19 aa, Staphylococcus
TTTVNGKETVQSPETAQTT

SEQ ID NO: 1867012 - protein, 5 aa, Staphylococcus
TTVNG

SEQ ID NO: 1867013 - protein, 14 aa, Staphylococcus
TTVPSAGKTGTAEV

SEQ ID NO: 1867014 - protein, 7 aa, Staphylococcus
TTVTASE

SEQ ID NO: 1867015 - protein, 17 aa, Staphylococcus
TTYGGLSSAMGQGIAKA

SEQ ID NO: 1867016 - protein, 4 aa, Staphylococcus
TTYN

SEQ ID NO: 1867017 - protein, 14 aa, Staphylococcus
TTYRTTSDATGKFR

SEQ ID NO: 1867018 - protein, 4 aa, Staphylococcus
TTYV

SEQ ID NO: 1867019 - protein, 4 aa, Staphylococcus
TVAG

SEQ ID NO: 1867020 - protein, 4 aa, Staphylococcus
TVAP

SEQ ID NO: 1867021 - protein, 11 aa, Staphylococcus
TVAPPAKKPQA

SEQ ID NO: 1867022 - protein, 7 aa, Staphylococcus
TVAQSDG

SEQ ID NO: 1867023 - protein, 9 aa, Staphylococcus
TVDAKQGKL

SEQ ID NO: 1867024 - protein, 7 aa, Staphylococcus
TVDEKDD

SEQ ID NO: 1867025 - protein, 12 aa, Staphylococcus
TVDKLNKSHSSV

SEQ ID NO: 1867026 - protein, 17 aa, Staphylococcus
TVDSAHPIDDVDTEKYN

SEQ ID NO: 1867027 - protein, 12 aa, Staphylococcus
TVDSEKNAGTTF

SEQ ID NO: 1867028 - protein, 45 aa, Staphylococcus
TVDTQNHAKTATNQSTLDNKHQAPAKASEQKSLPDTGQKETTNTT

SEQ ID NO: 1867029 - protein, 7 aa, Staphylococcus
TVEEDMT

SEQ ID NO: 1867030 - protein, 6 aa, Staphylococcus
TVEEKE

SEQ ID NO: 1867031 - protein, 11 aa, Staphylococcus
TVEELEKAGAF

SEQ ID NO: 1867032 - protein, 6 aa, Staphylococcus
TVEEQE

SEQ ID NO: 1867033 - protein, 14 aa, Staphylococcus
TVEGETADETNENK

SEQ ID NO: 1867034 - protein, 12 aa, Staphylococcus
TVEGKTSKPGKI

SEQ ID NO: 1867035 - protein, 9 aa, Staphylococcus
TVEKGMGST

SEQ ID NO: 1867036 - protein, 16 aa, Staphylococcus
TVERSGANGIAQGDEA

SEQ ID NO: 1867037 - protein, 4 aa, Staphylococcus
TVES

SEQ ID NO: 1867038 - protein, 18 aa, Staphylococcus
TVGDERDSISKTNGKDAV

SEQ ID NO: 1867039 - protein, 5 aa, Staphylococcus
TVGGV

SEQ ID NO: 1867040 - protein, 11 aa, Staphylococcus
TVKASAKEAIQ

SEQ ID NO: 1867041 - protein, 9 aa, Staphylococcus
TVKATAKQA

SEQ ID NO: 1867042 - protein, 32 aa, Staphylococcus
TVKATDNAEHPNSSTSDPVKATDTTPPTAPVV

SEQ ID NO: 1867043 - protein, 7 aa, Staphylococcus
TVKDIDS

SEQ ID NO: 1867044 - protein, 10 aa, Staphylococcus
TVKDSTATAI

SEQ ID NO: 1867045 - protein, 9 aa, Staphylococcus
TVKDTAKQA

SEQ ID NO: 1867046 - protein, 9 aa, Staphylococcus
TVKDTAQQA

SEQ ID NO: 1867047 - protein, 19 aa, Staphylococcus
TVKGKQQQTFKVTKEDKNK

SEQ ID NO: 1867048 - protein, 9 aa, Staphylococcus
TVKGKSEYV

SEQ ID NO: 1867049 - protein, 25 aa, Staphylococcus
TVKGKSKTTVKVTDKDDSKVYPSEL

SEQ ID NO: 1867050 - protein, 40 aa, Staphylococcus
TVKGPSTDAIRSTVTKVENKMKSIKGVADVNSDLSQTYDQ

SEQ ID NO: 1867051 - protein, 10 aa, Staphylococcus
TVKGQSQQTF

SEQ ID NO: 1867052 - protein, 38 aa, Staphylococcus
TVKKAAARKAIDDAATAKKEAINNTSDATQEEKDAAIA

SEQ ID NO: 1867053 - protein, 5 aa, Staphylococcus
TVKKG

SEQ ID NO: 1867054 - protein, 13 aa, Staphylococcus
TVKPDKGKVSRTE

SEQ ID NO: 1867055 - protein, 9 aa, Staphylococcus
TVKQNARDA

SEQ ID NO: 1867056 - protein, 11 aa, Staphylococcus
TVKRDNEDDAR

SEQ ID NO: 1867057 - protein, 8 aa, Staphylococcus
TVKSEAKV

SEQ ID NO: 1867058 - protein, 4 aa, Staphylococcus
TVND

SEQ ID NO: 1867059 - protein, 17 aa, Staphylococcus
TVNDGGDLSKDPHAKDL

SEQ ID NO: 1867060 - protein, 6 aa, Staphylococcus
TVNIDD

SEQ ID NO: 1867061 - protein, 10 aa, Staphylococcus
TVNLTTEQAT

SEQ ID NO: 1867062 - protein, 9 aa, Staphylococcus
TVNSSQEIR

SEQ ID NO: 1867063 - protein, 6 aa, Staphylococcus
TVNTTP

SEQ ID NO: 1867064 - protein, 4 aa, Staphylococcus
TVPD

SEQ ID NO: 1867065 - protein, 14 aa, Staphylococcus
TVPDYPSSKGTPIV

SEQ ID NO: 1867066 - protein, 32 aa, Staphylococcus
TVPDYPSSKGTPKVSVDNPSTLPNGQTPGTYT

SEQ ID NO: 1867067 - protein, 32 aa, Staphylococcus
TVPDYPSSKGTPTVTVDNPSTLPDGHTPGAHS

SEQ ID NO: 1867068 - protein, 33 aa, Staphylococcus
TVPDYPSSKGTPTVTVDNPSTLPNGQTPGTYTV

SEQ ID NO: 1867069 - protein, 15 aa, Staphylococcus
TVPNITEKYPNIPQS

SEQ ID NO: 1867070 - protein, 32 aa, Staphylococcus
TVPNYPSDKPAPKVSVDDPSTLPHGKTPGEYT

SEQ ID NO: 1867071 - protein, 32 aa, Staphylococcus
TVPNYPSDKPAPKVSVDDPSTLPNGKTPGEYT

SEQ ID NO: 1867072 - protein, 33 aa, Staphylococcus
TVPNYPSDKPAPKVSVDDPSTLPNGKTPGEYTV

SEQ ID NO: 1867073 - protein, 78 aa, Staphylococcus
TVQGTEKTPEGDTKVTFSDGTSVTIAKGDTGATGAAGQSITVQSTEKTPEGDTKVTFSDGTSVTIAKGEKGDKGDSVT

SEQ ID NO: 1867074 - protein, 6 aa, Staphylococcus
TVQPEL

SEQ ID NO: 1867075 - protein, 11 aa, Staphylococcus
TVRERSRSNEQ

SEQ ID NO: 1867076 - protein, 5 aa, Staphylococcus
TVSDE

SEQ ID NO: 1867077 - protein, 11 aa, Staphylococcus
TVSDKKDKKLD

SEQ ID NO: 1867078 - protein, 7 aa, Staphylococcus
TVSDQAI

SEQ ID NO: 1867079 - protein, 6 aa, Staphylococcus
TVSEQA

SEQ ID NO: 1867080 - protein, 9 aa, Staphylococcus
TVSGGDVNE

SEQ ID NO: 1867081 - protein, 12 aa, Staphylococcus
TVSPDSEAEKDI

SEQ ID NO: 1867082 - protein, 5 aa, Staphylococcus
TVTEE

SEQ ID NO: 1867083 - protein, 23 aa, Staphylococcus
TVTKTTAKADVANAINNKREQIN

SEQ ID NO: 1867084 - protein, 13 aa, Staphylococcus
TVTPNEEDKNKNH

SEQ ID NO: 1867085 - protein, 9 aa, Staphylococcus
TVTSEMGGK

SEQ ID NO: 1867086 - protein, 8 aa, Staphylococcus
TVTTANDN

SEQ ID NO: 1867087 - protein, 9 aa, Staphylococcus
TVTTEGGSM

SEQ ID NO: 1867088 - protein, 6 aa, Staphylococcus
TWNGKQ

SEQ ID NO: 1867089 - protein, 6 aa, Staphylococcus
TYADET

SEQ ID NO: 1867090 - protein, 5 aa, Staphylococcus
TYAPP

SEQ ID NO: 1867091 - protein, 9 aa, Staphylococcus
TYASRETMN

SEQ ID NO: 1867092 - protein, 22 aa, Staphylococcus
TYATPSTDTAVAEAPDDKVGVA

SEQ ID NO: 1867093 - protein, 9 aa, Staphylococcus
TYDDNGPVV

SEQ ID NO: 1867094 - protein, 23 aa, Staphylococcus
TYDNDDKVKWTGKENSEHPAPTL

SEQ ID NO: 1867095 - protein, 9 aa, Staphylococcus
TYDNNGNTW

SEQ ID NO: 1867096 - protein, 6 aa, Staphylococcus
TYEEGR

SEQ ID NO: 1867097 - protein, 5 aa, Staphylococcus
TYEKD

SEQ ID NO: 1867098 - protein, 6 aa, Staphylococcus
TYESGQ

SEQ ID NO: 1867099 - protein, 12 aa, Staphylococcus
TYESISPKSVED

SEQ ID NO: 1867100 - protein, 5 aa, Staphylococcus
TYGDI

SEQ ID NO: 1867101 - protein, 4 aa, Staphylococcus
TYGG

SEQ ID NO: 1867102 - protein, 9 aa, Staphylococcus
TYGSLEPSN

SEQ ID NO: 1867103 - protein, 6 aa, Staphylococcus
TYIPNK

SEQ ID NO: 1867104 - protein, 8 aa, Staphylococcus
TYIPNKDS

SEQ ID NO: 1867105 - protein, 5 aa, Staphylococcus
TYIRN

SEQ ID NO: 1867106 - protein, 7 aa, Staphylococcus
TYKGGEV

SEQ ID NO: 1867107 - protein, 8 aa, Staphylococcus
TYKLPGGK

SEQ ID NO: 1867108 - protein, 16 aa, Staphylococcus
TYLNETAKKVGPKMGA

SEQ ID NO: 1867109 - protein, 15 aa, Staphylococcus
TYLNETAKKVGPRMG

SEQ ID NO: 1867110 - protein, 16 aa, Staphylococcus
TYLNQTAKKIGPKMGA

SEQ ID NO: 1867111 - protein, 6 aa, Staphylococcus
TYLPNK

SEQ ID NO: 1867112 - protein, 7 aa, Staphylococcus
TYLPNKN

SEQ ID NO: 1867113 - protein, 8 aa, Staphylococcus
TYNQRVDH

SEQ ID NO: 1867114 - protein, 4 aa, Staphylococcus
TYNS

SEQ ID NO: 1867115 - protein, 15 aa, Staphylococcus
TYNTTNGDVGPGGLP

SEQ ID NO: 1867116 - protein, 8 aa, Staphylococcus
TYNYNQNE

SEQ ID NO: 1867117 - protein, 9 aa, Staphylococcus
TYPDEEKQF

SEQ ID NO: 1867118 - protein, 12 aa, Staphylococcus
TYPDGSKDHANV

SEQ ID NO: 1867119 - protein, 11 aa, Staphylococcus
TYPDGSKDHVN

SEQ ID NO: 1867120 - protein, 9 aa, Staphylococcus
TYPDGTEDH

SEQ ID NO: 1867121 - protein, 8 aa, Staphylococcus
TYPDGTQD

SEQ ID NO: 1867122 - protein, 13 aa, Staphylococcus
TYQVTGKSFSPEA

SEQ ID NO: 1867123 - protein, 7 aa, Staphylococcus
TYRKPGL

SEQ ID NO: 1867124 - protein, 6 aa, Staphylococcus
TYRYNE

SEQ ID NO: 1867125 - protein, 7 aa, Staphylococcus
TYSKKTI

SEQ ID NO: 1867126 - protein, 6 aa, Staphylococcus
TYSPHR

SEQ ID NO: 1867127 - protein, 5 aa, Staphylococcus
TYSPV

SEQ ID NO: 1867128 - protein, 10 aa, Staphylococcus
TYSSGDGYHL

SEQ ID NO: 1867129 - protein, 4 aa, Staphylococcus
TYST

SEQ ID NO: 1867130 - protein, 15 aa, Staphylococcus
TYSTTKAKNNLEDDE

SEQ ID NO: 1867131 - protein, 5 aa, Staphylococcus
TYTLT

SEQ ID NO: 1867132 - protein, 4 aa, Staphylococcus
TYTP

SEQ ID NO: 1867133 - protein, 8 aa, Staphylococcus
TYTPSLPK

SEQ ID NO: 1867134 - protein, 11 aa, Staphylococcus
VADAATADIPG

SEQ ID NO: 1867135 - protein, 5 aa, Staphylococcus
VADKF

SEQ ID NO: 1867136 - protein, 11 aa, Staphylococcus
VADSSDIDGTV

SEQ ID NO: 1867137 - protein, 4 aa, Staphylococcus
VAEA

SEQ ID NO: 1867138 - protein, 8 aa, Staphylococcus
VAEDNSKI

SEQ ID NO: 1867139 - protein, 4 aa, Staphylococcus
VAGN

SEQ ID NO: 1867140 - protein, 8 aa, Staphylococcus
VAGNNDED

SEQ ID NO: 1867141 - protein, 5 aa, Staphylococcus
VAGNT

SEQ ID NO: 1867142 - protein, 6 aa, Staphylococcus
VAGPSS

SEQ ID NO: 1867143 - protein, 7 aa, Staphylococcus
VAIPAKN

SEQ ID NO: 1867144 - protein, 254 aa, Staphylococcus
VAKAAEDTKTEEGVTSNSDESAQSSSETANTGVETTEQATAEQPTTEEKATEESTTEQPSTEEKATEESTTEQPSTEEKATEESTTEQPSTEEKATEESTTEQPSTEEKASKESTTEQPSTEEKASKESTTEQPSTEEKASKESTTEQPSTEEKASKESTTEQPSTEEKVTEESTTEQSSIEEKASKESTTEQPSTEEKVTEESTTEQSSTEEKASKESTTEQPSTEEKTSEENTTERSTVIDKDSSQSVQNIS

SEQ ID NO: 1867145 - protein, 22 aa, Staphylococcus
VAKDEASQQIDQATKQKLDEID

SEQ ID NO: 1867146 - protein, 11 aa, Staphylococcus
VAKDPNNVSGN

SEQ ID NO: 1867147 - protein, 9 aa, Staphylococcus
VAKPDIDAI

SEQ ID NO: 1867148 - protein, 38 aa, Staphylococcus
VAKQTIDELAKQKKAEIDQTPNATKEEKDAAKQKVEEA

SEQ ID NO: 1867149 - protein, 4 aa, Staphylococcus
VAKR

SEQ ID NO: 1867150 - protein, 124 aa, Staphylococcus
VAKSDTAKATEATPAASTQQNEVKTSEAPNTAKAVTDKEAITPTAAPKEDKVVSDKATTQDKKETRGYKANNTEPQKGTNAIANTGKHDPRNGQAIPGYGTSSFRDGGNTVSIDGGKITASGHV

SEQ ID NO: 1867151 - protein, 4 aa, Staphylococcus
VAKT

SEQ ID NO: 1867152 - protein, 17 aa, Staphylococcus
VAKVEQKMKSVNGITNV

SEQ ID NO: 1867153 - protein, 12 aa, Staphylococcus
VALGGGAVGAAG

SEQ ID NO: 1867154 - protein, 37 aa, Staphylococcus
VALGQAKQVSVGAPTKSISRRNSSSKASWGRHKHSKT

SEQ ID NO: 1867155 - protein, 5 aa, Staphylococcus
VANAE

SEQ ID NO: 1867156 - protein, 10 aa, Staphylococcus
VANDNGTTVF

SEQ ID NO: 1867157 - protein, 10 aa, Staphylococcus
VANEEGTKVF

SEQ ID NO: 1867158 - protein, 10 aa, Staphylococcus
VANESGTKVF

SEQ ID NO: 1867159 - protein, 18 aa, Staphylococcus
VANGSQDMQSPEKNLPKA

SEQ ID NO: 1867160 - protein, 8 aa, Staphylococcus
VANPKEVT

SEQ ID NO: 1867161 - protein, 27 aa, Staphylococcus
VANQRKHDLTQDPDMTNEERDYANDSV

SEQ ID NO: 1867162 - protein, 10 aa, Staphylococcus
VAPDKDGNTV

SEQ ID NO: 1867163 - protein, 10 aa, Staphylococcus
VAPEKPKRRV

SEQ ID NO: 1867164 - protein, 5 aa, Staphylococcus
VAPGM

SEQ ID NO: 1867165 - protein, 17 aa, Staphylococcus
VAPKDNYEKYQNNKDKL

SEQ ID NO: 1867166 - protein, 8 aa, Staphylococcus
VAPKGEVP

SEQ ID NO: 1867167 - protein, 10 aa, Staphylococcus
VAPPAKKPQA

SEQ ID NO: 1867168 - protein, 11 aa, Staphylococcus
VAPRGKKPQAI

SEQ ID NO: 1867169 - protein, 10 aa, Staphylococcus
VAPRGKQPQA

SEQ ID NO: 1867170 - protein, 9 aa, Staphylococcus
VAQAGPGGA

SEQ ID NO: 1867171 - protein, 9 aa, Staphylococcus
VAQEAKPED

SEQ ID NO: 1867172 - protein, 4 aa, Staphylococcus
VAQR

SEQ ID NO: 1867173 - protein, 21 aa, Staphylococcus
VARGGNSKSTDSESNEKQSFG

SEQ ID NO: 1867174 - protein, 12 aa, Staphylococcus
VASKNDTSNRKA

SEQ ID NO: 1867175 - protein, 8 aa, Staphylococcus
VASKRGIE

SEQ ID NO: 1867176 - protein, 10 aa, Staphylococcus
VASNDVPEAF

SEQ ID NO: 1867177 - protein, 8 aa, Staphylococcus
VASTATGT

SEQ ID NO: 1867178 - protein, 8 aa, Staphylococcus
VASTDSLT

SEQ ID NO: 1867179 - protein, 5 aa, Staphylococcus
VATEP

SEQ ID NO: 1867180 - protein, 34 aa, Staphylococcus
VATETKGNSDSSSESKLKMPRKETKPEAPDIESN

SEQ ID NO: 1867181 - protein, 28 aa, Staphylococcus
VATNDNQSSNQPRNSHLNTSTVTYNNNH

SEQ ID NO: 1867182 - protein, 17 aa, Staphylococcus
VATRKDVDHTNHQKTVD

SEQ ID NO: 1867183 - protein, 8 aa, Staphylococcus
VATTATGT

SEQ ID NO: 1867184 - protein, 5 aa, Staphylococcus
VDDAL

SEQ ID NO: 1867185 - protein, 17 aa, Staphylococcus
VDDEDQQNVNKDIKEYD

SEQ ID NO: 1867186 - protein, 17 aa, Staphylococcus
VDDGSDIDHYEKQATLD

SEQ ID NO: 1867187 - protein, 8 aa, Staphylococcus
VDDRYSKS

SEQ ID NO: 1867188 - protein, 8 aa, Staphylococcus
VDDTHSKK

SEQ ID NO: 1867189 - protein, 9 aa, Staphylococcus
VDDTQSKKI

SEQ ID NO: 1867190 - protein, 5 aa, Staphylococcus
VDDYN

SEQ ID NO: 1867191 - protein, 18 aa, Staphylococcus
VDDYNDKYLEKQTEVSEL

SEQ ID NO: 1867192 - protein, 6 aa, Staphylococcus
VDDYNE

SEQ ID NO: 1867193 - protein, 10 aa, Staphylococcus
VDEGKGDKIA

SEQ ID NO: 1867194 - protein, 39 aa, Staphylococcus
VDEKDVADIEKGNDVDVDIDGQKATVSGKVDQIGDATAA

SEQ ID NO: 1867195 - protein, 16 aa, Staphylococcus
VDEKDVSSIEKGNDVD

SEQ ID NO: 1867196 - protein, 6 aa, Staphylococcus
VDEKGN

SEQ ID NO: 1867197 - protein, 16 aa, Staphylococcus
VDEKIDKVDRKHTDAL

SEQ ID NO: 1867198 - protein, 14 aa, Staphylococcus
VDEQENQNNADRTS

SEQ ID NO: 1867199 - protein, 9 aa, Staphylococcus
VDERETVTE

SEQ ID NO: 1867200 - protein, 7 aa, Staphylococcus
VDFKGND

SEQ ID NO: 1867201 - protein, 12 aa, Staphylococcus
VDFSSNKSASQK

SEQ ID NO: 1867202 - protein, 6 aa, Staphylococcus
VDGEQV

SEQ ID NO: 1867203 - protein, 7 aa, Staphylococcus
VDGHGET

SEQ ID NO: 1867204 - protein, 5 aa, Staphylococcus
VDGNE

SEQ ID NO: 1867205 - protein, 14 aa, Staphylococcus
VDGRSDDKGPEVES

SEQ ID NO: 1867206 - protein, 22 aa, Staphylococcus
VDGSEAMKSHVSNQIKDKQEQM

SEQ ID NO: 1867207 - protein, 6 aa, Staphylococcus
VDGSNS

SEQ ID NO: 1867208 - protein, 16 aa, Staphylococcus
VDGVQNAQLNGQTTRQ

SEQ ID NO: 1867209 - protein, 16 aa, Staphylococcus
VDGVQSAQLNGQTTRQ

SEQ ID NO: 1867210 - protein, 10 aa, Staphylococcus
VDGVSENMKM

SEQ ID NO: 1867211 - protein, 6 aa, Staphylococcus
VDHDDV

SEQ ID NO: 1867212 - protein, 9 aa, Staphylococcus
VDIKDSEDI

SEQ ID NO: 1867213 - protein, 11 aa, Staphylococcus
VDIKGDNDNLK

SEQ ID NO: 1867214 - protein, 6 aa, Staphylococcus
VDKDTK

SEQ ID NO: 1867215 - protein, 9 aa, Staphylococcus
VDKGQMEAA

SEQ ID NO: 1867216 - protein, 11 aa, Staphylococcus
VDKGQTEAARS

SEQ ID NO: 1867217 - protein, 9 aa, Staphylococcus
VDKKTSDFV

SEQ ID NO: 1867218 - protein, 6 aa, Staphylococcus
VDKNAK

SEQ ID NO: 1867219 - protein, 8 aa, Staphylococcus
VDKNAVSD

SEQ ID NO: 1867220 - protein, 10 aa, Staphylococcus
VDKNNGGVTY

SEQ ID NO: 1867221 - protein, 10 aa, Staphylococcus
VDKSTQKTWR

SEQ ID NO: 1867222 - protein, 5 aa, Staphylococcus
VDKTG

SEQ ID NO: 1867223 - protein, 20 aa, Staphylococcus
VDKTINEEAYAGSINENGTL

SEQ ID NO: 1867224 - protein, 7 aa, Staphylococcus
VDKVEEK

SEQ ID NO: 1867225 - protein, 21 aa, Staphylococcus
VDLPNETPGQIEPLTNNPGNY

SEQ ID NO: 1867226 - protein, 4 aa, Staphylococcus
VDNE

SEQ ID NO: 1867227 - protein, 13 aa, Staphylococcus
VDNESKDFDDNLE

SEQ ID NO: 1867228 - protein, 9 aa, Staphylococcus
VDNGKGDKI

SEQ ID NO: 1867229 - protein, 9 aa, Staphylococcus
VDNGKGEKI

SEQ ID NO: 1867230 - protein, 6 aa, Staphylococcus
VDNPLK

SEQ ID NO: 1867231 - protein, 8 aa, Staphylococcus
VDNPQKKD

SEQ ID NO: 1867232 - protein, 7 aa, Staphylococcus
VDPDNSP

SEQ ID NO: 1867233 - protein, 21 aa, Staphylococcus
VDPEGNEVQETTEGKHQPPGI

SEQ ID NO: 1867234 - protein, 21 aa, Staphylococcus
VDPEGNEVQETTEGKHQPPSI

SEQ ID NO: 1867235 - protein, 4 aa, Staphylococcus
VDPN

SEQ ID NO: 1867236 - protein, 7 aa, Staphylococcus
VDPNESP

SEQ ID NO: 1867237 - protein, 9 aa, Staphylococcus
VDPNSNGNL

SEQ ID NO: 1867238 - protein, 12 aa, Staphylococcus
VDPNTKKEWRGD

SEQ ID NO: 1867239 - protein, 7 aa, Staphylococcus
VDPSESP

SEQ ID NO: 1867240 - protein, 12 aa, Staphylococcus
VDPSTQTAWRGD

SEQ ID NO: 1867241 - protein, 8 aa, Staphylococcus
VDQKTSDF

SEQ ID NO: 1867242 - protein, 14 aa, Staphylococcus
VDQNKAADNGISAS

SEQ ID NO: 1867243 - protein, 14 aa, Staphylococcus
VDQNKATEKGLSAG

SEQ ID NO: 1867244 - protein, 14 aa, Staphylococcus
VDQNTVEKKLSGRL

SEQ ID NO: 1867245 - protein, 14 aa, Staphylococcus
VDQPINSDSVEISG

SEQ ID NO: 1867246 - protein, 17 aa, Staphylococcus
VDQSKVEKNISTRMTKN

SEQ ID NO: 1867247 - protein, 6 aa, Staphylococcus
VDQYND

SEQ ID NO: 1867248 - protein, 13 aa, Staphylococcus
VDRKGSTLIGTKN

SEQ ID NO: 1867249 - protein, 16 aa, Staphylococcus
VDRTTNGSGKVSDHRV

SEQ ID NO: 1867250 - protein, 15 aa, Staphylococcus
VDRTTNGSGKVSEHR

SEQ ID NO: 1867251 - protein, 15 aa, Staphylococcus
VDRTTNGSGKVSEHT

SEQ ID NO: 1867252 - protein, 16 aa, Staphylococcus
VDRTTNGSGKVSEHTV

SEQ ID NO: 1867253 - protein, 21 aa, Staphylococcus
VDSDGNEVQETEEGTHQPPGI

SEQ ID NO: 1867254 - protein, 21 aa, Staphylococcus
VDSEGNEVQETEEGTHQPPSI

SEQ ID NO: 1867255 - protein, 13 aa, Staphylococcus
VDSETGTGSALEN

SEQ ID NO: 1867256 - protein, 14 aa, Staphylococcus
VDSGGFNIENSQMN

SEQ ID NO: 1867257 - protein, 20 aa, Staphylococcus
VDSGGTTGVQIASSGPDETW

SEQ ID NO: 1867258 - protein, 16 aa, Staphylococcus
VDSGNDDAKDADGETV

SEQ ID NO: 1867259 - protein, 11 aa, Staphylococcus
VDSKGQDTIEN

SEQ ID NO: 1867260 - protein, 27 aa, Staphylococcus
VDSKLDQQHEAQQRTKDDYQKSYQDAL

SEQ ID NO: 1867261 - protein, 15 aa, Staphylococcus
VDSLPESERADAAKA

SEQ ID NO: 1867262 - protein, 14 aa, Staphylococcus
VDSNGKDFNSQSKN

SEQ ID NO: 1867263 - protein, 8 aa, Staphylococcus
VDSSNYKN

SEQ ID NO: 1867264 - protein, 30 aa, Staphylococcus
VDSTVVDEPTIKPVEERQKPSEVSKDKLAE

SEQ ID NO: 1867265 - protein, 21 aa, Staphylococcus
VDTDGNEVQETEEGTHQPPGI

SEQ ID NO: 1867266 - protein, 52 aa, Staphylococcus
VDTEPKVDKREEKAQRKREKAELKAKKKEKRKAYNQRMKERRKNQPSAVSQR

SEQ ID NO: 1867267 - protein, 8 aa, Staphylococcus
VDTKQVNA

SEQ ID NO: 1867268 - protein, 4 aa, Staphylococcus
VDTP

SEQ ID NO: 1867269 - protein, 25 aa, Staphylococcus
VDVEEGHEINEQTRLTTTSDQLETE

SEQ ID NO: 1867270 - protein, 10 aa, Staphylococcus
VDVGNDQYTA

SEQ ID NO: 1867271 - protein, 5 aa, Staphylococcus
VDVNP

SEQ ID NO: 1867272 - protein, 6 aa, Staphylococcus
VDVPSE

SEQ ID NO: 1867273 - protein, 16 aa, Staphylococcus
VDWSSDDRKDNNFNQN

SEQ ID NO: 1867274 - protein, 4 aa, Staphylococcus
VDYD

SEQ ID NO: 1867275 - protein, 27 aa, Staphylococcus
VDYKENALERAKSLSKDGDTSKSDIKD

SEQ ID NO: 1867276 - protein, 10 aa, Staphylococcus
VDYQGDNDVY

SEQ ID NO: 1867277 - protein, 10 aa, Staphylococcus
VDYSKVSNES

SEQ ID NO: 1867278 - protein, 8 aa, Staphylococcus
VEADTGMR

SEQ ID NO: 1867279 - protein, 27 aa, Staphylococcus
VEATNTDNNVTQTSDISNKLSNVTATI

SEQ ID NO: 1867280 - protein, 12 aa, Staphylococcus
VEATSKNPKIIV

SEQ ID NO: 1867281 - protein, 7 aa, Staphylococcus
VEDARNP

SEQ ID NO: 1867282 - protein, 11 aa, Staphylococcus
VEDDKTPLNQR

SEQ ID NO: 1867283 - protein, 8 aa, Staphylococcus
VEDEIKPG

SEQ ID NO: 1867284 - protein, 11 aa, Staphylococcus
VEDGQKVRQGE

SEQ ID NO: 1867285 - protein, 19 aa, Staphylococcus
VEDGTNSDERVTNASSKSL

SEQ ID NO: 1867286 - protein, 8 aa, Staphylococcus
VEDKIKPG

SEQ ID NO: 1867287 - protein, 8 aa, Staphylococcus
VEDKLKPG

SEQ ID NO: 1867288 - protein, 14 aa, Staphylococcus
VEDLPNGEESLFEV

SEQ ID NO: 1867289 - protein, 12 aa, Staphylococcus
VEDNAKNSTETR

SEQ ID NO: 1867290 - protein, 12 aa, Staphylococcus
VEDNKTPASERV

SEQ ID NO: 1867291 - protein, 6 aa, Staphylococcus
VEDNRN

SEQ ID NO: 1867292 - protein, 5 aa, Staphylococcus
VEDSR

SEQ ID NO: 1867293 - protein, 6 aa, Staphylococcus
VEEDDD

SEQ ID NO: 1867294 - protein, 11 aa, Staphylococcus
VEEDQERVAQK

SEQ ID NO: 1867295 - protein, 4 aa, Staphylococcus
VEEH

SEQ ID NO: 1867296 - protein, 23 aa, Staphylococcus
VEEKNGHVEADNPDYFKGDTPAA

SEQ ID NO: 1867297 - protein, 11 aa, Staphylococcus
VEEKPKEENYN

SEQ ID NO: 1867298 - protein, 19 aa, Staphylococcus
VEEKRAIKNQKSKVDIPRQ

SEQ ID NO: 1867299 - protein, 13 aa, Staphylococcus
VEEKRNDPNFGSV

SEQ ID NO: 1867300 - protein, 11 aa, Staphylococcus
VEEKTKEDNYT

SEQ ID NO: 1867301 - protein, 11 aa, Staphylococcus
VEEKTKEENYT

SEQ ID NO: 1867302 - protein, 10 aa, Staphylococcus
VEENKRGKQM

SEQ ID NO: 1867303 - protein, 10 aa, Staphylococcus
VEENQRGKQM

SEQ ID NO: 1867304 - protein, 8 aa, Staphylococcus
VEGDTSQV

SEQ ID NO: 1867305 - protein, 7 aa, Staphylococcus
VEGEEPE

SEQ ID NO: 1867306 - protein, 15 aa, Staphylococcus
VEGNDPNNHGDFNGI

SEQ ID NO: 1867307 - protein, 6 aa, Staphylococcus
VEGPLG

SEQ ID NO: 1867308 - protein, 9 aa, Staphylococcus
VEGVGSALT

SEQ ID NO: 1867309 - protein, 8 aa, Staphylococcus
VEGVGTAL

SEQ ID NO: 1867310 - protein, 4 aa, Staphylococcus
VEHP

SEQ ID NO: 1867311 - protein, 11 aa, Staphylococcus
VEKAGNKLPDP

SEQ ID NO: 1867312 - protein, 12 aa, Staphylococcus
VEKDDENSKELE

SEQ ID NO: 1867313 - protein, 9 aa, Staphylococcus
VEKEEEKTL

SEQ ID NO: 1867314 - protein, 7 aa, Staphylococcus
VEKEKNI

SEQ ID NO: 1867315 - protein, 12 aa, Staphylococcus
VEKEKQTNWTKE

SEQ ID NO: 1867316 - protein, 5 aa, Staphylococcus
VEKGD

SEQ ID NO: 1867317 - protein, 16 aa, Staphylococcus
VEKQQNVKLSTEVKME

SEQ ID NO: 1867318 - protein, 8 aa, Staphylococcus
VEKQTDVN

SEQ ID NO: 1867319 - protein, 10 aa, Staphylococcus
VEKSSNAKAY

SEQ ID NO: 1867320 - protein, 12 aa, Staphylococcus
VEKSYKYKKEVT

SEQ ID NO: 1867321 - protein, 4 aa, Staphylococcus
VEKT

SEQ ID NO: 1867322 - protein, 6 aa, Staphylococcus
VEKTGA

SEQ ID NO: 1867323 - protein, 5 aa, Staphylococcus
VEKTV

SEQ ID NO: 1867324 - protein, 4 aa, Staphylococcus
VEKV

SEQ ID NO: 1867325 - protein, 11 aa, Staphylococcus
VELETEDNRGD

SEQ ID NO: 1867326 - protein, 13 aa, Staphylococcus
VELPSDSKANVKK

SEQ ID NO: 1867327 - protein, 5 aa, Staphylococcus
VENDQ

SEQ ID NO: 1867328 - protein, 24 aa, Staphylococcus
VENEGTKNTSVPNNTSKADNEIGS

SEQ ID NO: 1867329 - protein, 12 aa, Staphylococcus
VENKGHNQSRDT

SEQ ID NO: 1867330 - protein, 6 aa, Staphylococcus
VENPKD

SEQ ID NO: 1867331 - protein, 17 aa, Staphylococcus
VENSEYSKDESKPEGVS

SEQ ID NO: 1867332 - protein, 12 aa, Staphylococcus
VEPATTAISGMS

SEQ ID NO: 1867333 - protein, 12 aa, Staphylococcus
VEPEEDESPKRR

SEQ ID NO: 1867334 - protein, 11 aa, Staphylococcus
VEPGKTINSPN

SEQ ID NO: 1867335 - protein, 4 aa, Staphylococcus
VEPL

SEQ ID NO: 1867336 - protein, 12 aa, Staphylococcus
VEPNEDESEKRR

SEQ ID NO: 1867337 - protein, 7 aa, Staphylococcus
VEPNNAD

SEQ ID NO: 1867338 - protein, 16 aa, Staphylococcus
VEPQEFQSKDPKKSNQ

SEQ ID NO: 1867339 - protein, 16 aa, Staphylococcus
VEPQEFQSKKPKKDKQ

SEQ ID NO: 1867340 - protein, 59 aa, Staphylococcus
VEPQPNGDTKVTFSDGKEITIPKGAQGEAGQNGADAQPLTVTGSVQKPDGNTEVTFSDG

SEQ ID NO: 1867341 - protein, 92 aa, Staphylococcus
VEPQPNGDTKVTFSDGKEVTIPKGDKGDTGAQGAAGQNGADAKPLTVTGSTQTPAGDTEVTFSDGTKVTIPKAKDGKSITVQNTAPDADGNT

SEQ ID NO: 1867342 - protein, 61 aa, Staphylococcus
VEPQPNGDTKVTFSDGKEVTIPKGEKGDKGDTGANGVDGRSITVQSSEVQPDGSTKVTFSD

SEQ ID NO: 1867343 - protein, 95 aa, Staphylococcus
VEPQPNGDTKVTFSDGKEVTIPKGEKGDKGDTGAQGAAGQNGADAKPLTVTASTQTPEGNTEITFSDGTKVTVPKAKDGKSITVQSTAPDADGNT

SEQ ID NO: 1867344 - protein, 61 aa, Staphylococcus
VEPQPNGDTKVTFSDGKEVTIPKGEKGDKGDTGAQGATGQNGRDGQSITVQSTAPDADGNT

SEQ ID NO: 1867345 - protein, 8 aa, Staphylococcus
VEPQTNGD

SEQ ID NO: 1867346 - protein, 10 aa, Staphylococcus
VEPTSTSLPE

SEQ ID NO: 1867347 - protein, 10 aa, Staphylococcus
VEQATGGAVG

SEQ ID NO: 1867348 - protein, 8 aa, Staphylococcus
VEQDNNTV

SEQ ID NO: 1867349 - protein, 8 aa, Staphylococcus
VEQNDNTI

SEQ ID NO: 1867350 - protein, 7 aa, Staphylococcus
VEQPSKL

SEQ ID NO: 1867351 - protein, 20 aa, Staphylococcus
VEQQPSVHKQSNYLNEDPEI

SEQ ID NO: 1867352 - protein, 10 aa, Staphylococcus
VEREAGQSKW

SEQ ID NO: 1867353 - protein, 10 aa, Staphylococcus
VEREDGESKW

SEQ ID NO: 1867354 - protein, 10 aa, Staphylococcus
VERNGKEQNI

SEQ ID NO: 1867355 - protein, 8 aa, Staphylococcus
VERQQFKP

SEQ ID NO: 1867356 - protein, 7 aa, Staphylococcus
VERQRPY

SEQ ID NO: 1867357 - protein, 21 aa, Staphylococcus
VERSKKDRQVNANNNDSEYDS

SEQ ID NO: 1867358 - protein, 6 aa, Staphylococcus
VERSLE

SEQ ID NO: 1867359 - protein, 8 aa, Staphylococcus
VERTLSPN

SEQ ID NO: 1867360 - protein, 25 aa, Staphylococcus
VESESPKNSTLPKDTKDSESEIGSG

SEQ ID NO: 1867361 - protein, 12 aa, Staphylococcus
VESGQKVTTIGG

SEQ ID NO: 1867362 - protein, 6 aa, Staphylococcus
VESIPQ

SEQ ID NO: 1867363 - protein, 25 aa, Staphylococcus
VESKAQPRQNIEPLPDTGQDSADTT

SEQ ID NO: 1867364 - protein, 18 aa, Staphylococcus
VESNYTDTLKNTTSVSLE

SEQ ID NO: 1867365 - protein, 17 aa, Staphylococcus
VESNYTGPLKNTTSISL

SEQ ID NO: 1867366 - protein, 19 aa, Staphylococcus
VESPQGKVETHKATQQELD

SEQ ID NO: 1867367 - protein, 17 aa, Staphylococcus
VESTPEVGTKMTVSIPR

SEQ ID NO: 1867368 - protein, 20 aa, Staphylococcus
VETANGNSKLASGIKEGNNR

SEQ ID NO: 1867369 - protein, 7 aa, Staphylococcus
VETEEYA

SEQ ID NO: 1867370 - protein, 12 aa, Staphylococcus
VETGLPKGGIRR

SEQ ID NO: 1867371 - protein, 7 aa, Staphylococcus
VETGTHK

SEQ ID NO: 1867372 - protein, 7 aa, Staphylococcus
VETGTHQ

SEQ ID NO: 1867373 - protein, 8 aa, Staphylococcus
VETGTHQE

SEQ ID NO: 1867374 - protein, 6 aa, Staphylococcus
VETMKN

SEQ ID NO: 1867375 - protein, 11 aa, Staphylococcus
VETNGSGGIKN

SEQ ID NO: 1867376 - protein, 12 aa, Staphylococcus
VETNGSGGIKNH

SEQ ID NO: 1867377 - protein, 22 aa, Staphylococcus
VETNGSGGIKNRLTSEDIEKAD

SEQ ID NO: 1867378 - protein, 11 aa, Staphylococcus
VETNGSSGIKN

SEQ ID NO: 1867379 - protein, 12 aa, Staphylococcus
VETNGSSGIKNH

SEQ ID NO: 1867380 - protein, 21 aa, Staphylococcus
VETNGSSGIKNKLTQQDIDRA

SEQ ID NO: 1867381 - protein, 21 aa, Staphylococcus
VETNGSSGVKNHLTEQDIERA

SEQ ID NO: 1867382 - protein, 11 aa, Staphylococcus
VETPDVATDKI

SEQ ID NO: 1867383 - protein, 8 aa, Staphylococcus
VETQSIQN

SEQ ID NO: 1867384 - protein, 9 aa, Staphylococcus
VETQSISNA

SEQ ID NO: 1867385 - protein, 18 aa, Staphylococcus
VETSNAQKVVDEQHNTDF

SEQ ID NO: 1867386 - protein, 6 aa, Staphylococcus
VETVGD

SEQ ID NO: 1867387 - protein, 15 aa, Staphylococcus
VEVPYSGKKGKSQKV

SEQ ID NO: 1867388 - protein, 12 aa, Staphylococcus
VFDPSTTVTKNN

SEQ ID NO: 1867389 - protein, 4 aa, Staphylococcus
VFPY

SEQ ID NO: 1867390 - protein, 9 aa, Staphylococcus
VFSGSGDGF

SEQ ID NO: 1867391 - protein, 9 aa, Staphylococcus
VGAEFGQDA

SEQ ID NO: 1867392 - protein, 6 aa, Staphylococcus
VGANKT

SEQ ID NO: 1867393 - protein, 7 aa, Staphylococcus
VGANSNS

SEQ ID NO: 1867394 - protein, 4 aa, Staphylococcus
VGAR

SEQ ID NO: 1867395 - protein, 17 aa, Staphylococcus
VGDERESISKTNGKDAV

SEQ ID NO: 1867396 - protein, 9 aa, Staphylococcus
VGDETRKYK

SEQ ID NO: 1867397 - protein, 9 aa, Staphylococcus
VGDGQTRIA

SEQ ID NO: 1867398 - protein, 27 aa, Staphylococcus
VGDKDKQKVTYNNNKSVEGKVVGKDKW

SEQ ID NO: 1867399 - protein, 20 aa, Staphylococcus
VGDKKEQKITYGNNDTSIGK

SEQ ID NO: 1867400 - protein, 9 aa, Staphylococcus
VGDKSSQNI

SEQ ID NO: 1867401 - protein, 30 aa, Staphylococcus
VGDPDSSRHEPKVTPITKDFGTPTTADDVT

SEQ ID NO: 1867402 - protein, 7 aa, Staphylococcus
VGDQDIG

SEQ ID NO: 1867403 - protein, 12 aa, Staphylococcus
VGDQFDGTALTQ

SEQ ID NO: 1867404 - protein, 7 aa, Staphylococcus
VGDQQKK

SEQ ID NO: 1867405 - protein, 6 aa, Staphylococcus
VGDVSS

SEQ ID NO: 1867406 - protein, 6 aa, Staphylococcus
VGEAGW

SEQ ID NO: 1867407 - protein, 11 aa, Staphylococcus
VGEANKANKGF

SEQ ID NO: 1867408 - protein, 9 aa, Staphylococcus
VGEDIPSDY

SEQ ID NO: 1867409 - protein, 7 aa, Staphylococcus
VGEGTED

SEQ ID NO: 1867410 - protein, 13 aa, Staphylococcus
VGEGTTFTIKLPK

SEQ ID NO: 1867411 - protein, 7 aa, Staphylococcus
VGETAGK

SEQ ID NO: 1867412 - protein, 7 aa, Staphylococcus
VGGANSP

SEQ ID NO: 1867413 - protein, 11 aa, Staphylococcus
VGGATDDINSA

SEQ ID NO: 1867414 - protein, 5 aa, Staphylococcus
VGGDI

SEQ ID NO: 1867415 - protein, 7 aa, Staphylococcus
VGGGNAP

SEQ ID NO: 1867416 - protein, 7 aa, Staphylococcus
VGGKENL

SEQ ID NO: 1867417 - protein, 5 aa, Staphylococcus
VGGKL

SEQ ID NO: 1867418 - protein, 10 aa, Staphylococcus
VGGNQTTAIN

SEQ ID NO: 1867419 - protein, 4 aa, Staphylococcus
VGGP

SEQ ID NO: 1867420 - protein, 15 aa, Staphylococcus
VGGPSPADPTGSTNS

SEQ ID NO: 1867421 - protein, 15 aa, Staphylococcus
VGGPTPQDPTGSTNS

SEQ ID NO: 1867422 - protein, 9 aa, Staphylococcus
VGGSEATAI

SEQ ID NO: 1867423 - protein, 8 aa, Staphylococcus
VGGSGEET

SEQ ID NO: 1867424 - protein, 9 aa, Staphylococcus
VGGSKSQIL

SEQ ID NO: 1867425 - protein, 11 aa, Staphylococcus
VGIANNQTGLY

SEQ ID NO: 1867426 - protein, 5 aa, Staphylococcus
VGIPK

SEQ ID NO: 1867427 - protein, 7 aa, Staphylococcus
VGKDTAL

SEQ ID NO: 1867428 - protein, 6 aa, Staphylococcus
VGKGEK

SEQ ID NO: 1867429 - protein, 9 aa, Staphylococcus
VGKGSNFGK

SEQ ID NO: 1867430 - protein, 4 aa, Staphylococcus
VGKL

SEQ ID NO: 1867431 - protein, 12 aa, Staphylococcus
VGKSESGDTQSM

SEQ ID NO: 1867432 - protein, 17 aa, Staphylococcus
VGKTTRTYSDKYQENQI

SEQ ID NO: 1867433 - protein, 14 aa, Staphylococcus
VGLKSQSSINQVTQ

SEQ ID NO: 1867434 - protein, 20 aa, Staphylococcus
VGLRQEKSNQLKNENDQIDV

SEQ ID NO: 1867435 - protein, 20 aa, Staphylococcus
VGLSPDQVQINGSGHKNATV

SEQ ID NO: 1867436 - protein, 16 aa, Staphylococcus
VGMQPTNPLTAEEKKK

SEQ ID NO: 1867437 - protein, 7 aa, Staphylococcus
VGNDDTT

SEQ ID NO: 1867438 - protein, 20 aa, Staphylococcus
VGNEKKQKLTYGNNQTIQGK

SEQ ID NO: 1867439 - protein, 22 aa, Staphylococcus
VGNKDKQKITFGNNKSVQGKVI

SEQ ID NO: 1867440 - protein, 17 aa, Staphylococcus
VGNPDSGNYPPKVTPIT

SEQ ID NO: 1867441 - protein, 18 aa, Staphylococcus
VGNPDSSKYEPKVTPITK

SEQ ID NO: 1867442 - protein, 13 aa, Staphylococcus
VGNPENSTYEPHV

SEQ ID NO: 1867443 - protein, 12 aa, Staphylococcus
VGPSGAGKSTLA

SEQ ID NO: 1867444 - protein, 10 aa, Staphylococcus
VGPSGAGKTT

SEQ ID NO: 1867445 - protein, 7 aa, Staphylococcus
VGQEDTS

SEQ ID NO: 1867446 - protein, 4 aa, Staphylococcus
VGQG

SEQ ID NO: 1867447 - protein, 35 aa, Staphylococcus
VGQNLNKQITKQSLSTLQKQNVDVSPKDIQGITNP

SEQ ID NO: 1867448 - protein, 5 aa, Staphylococcus
VGQPV

SEQ ID NO: 1867449 - protein, 31 aa, Staphylococcus
VGQQDSVRKTSNYVNEDSTAQQAYNDAIAQG

SEQ ID NO: 1867450 - protein, 6 aa, Staphylococcus
VGQSHS

SEQ ID NO: 1867451 - protein, 9 aa, Staphylococcus
VGRDKAKNF

SEQ ID NO: 1867452 - protein, 4 aa, Staphylococcus
VGRL

SEQ ID NO: 1867453 - protein, 5 aa, Staphylococcus
VGRNM

SEQ ID NO: 1867454 - protein, 19 aa, Staphylococcus
VGRSEAQQLRQSLEQHKEQ

SEQ ID NO: 1867455 - protein, 10 aa, Staphylococcus
VGSFPSGDSN

SEQ ID NO: 1867456 - protein, 10 aa, Staphylococcus
VGSGAAQFKN

SEQ ID NO: 1867457 - protein, 10 aa, Staphylococcus
VGSGASTFTD

SEQ ID NO: 1867458 - protein, 8 aa, Staphylococcus
VGSKKLKR

SEQ ID NO: 1867459 - protein, 7 aa, Staphylococcus
VGSKKVR

SEQ ID NO: 1867460 - protein, 7 aa, Staphylococcus
VGSKTKS

SEQ ID NO: 1867461 - protein, 8 aa, Staphylococcus
VGSNTITH

SEQ ID NO: 1867462 - protein, 14 aa, Staphylococcus
VGSSGSKGRGQGLP

SEQ ID NO: 1867463 - protein, 13 aa, Staphylococcus
VGSSISEAGEVAN

SEQ ID NO: 1867464 - protein, 8 aa, Staphylococcus
VGSSNRIK

SEQ ID NO: 1867465 - protein, 8 aa, Staphylococcus
VGSSQEIR

SEQ ID NO: 1867466 - protein, 9 aa, Staphylococcus
VGSSVKGGT

SEQ ID NO: 1867467 - protein, 7 aa, Staphylococcus
VGSTFST

SEQ ID NO: 1867468 - protein, 6 aa, Staphylococcus
VGTAGG

SEQ ID NO: 1867469 - protein, 5 aa, Staphylococcus
VGTAN

SEQ ID NO: 1867470 - protein, 7 aa, Staphylococcus
VGTEAAS

SEQ ID NO: 1867471 - protein, 8 aa, Staphylococcus
VGTNRKAP

SEQ ID NO: 1867472 - protein, 9 aa, Staphylococcus
VGTRTPIDV

SEQ ID NO: 1867473 - protein, 4 aa, Staphylococcus
VGTS

SEQ ID NO: 1867474 - protein, 7 aa, Staphylococcus
VGTTRKV

SEQ ID NO: 1867475 - protein, 10 aa, Staphylococcus
VGVTTSGQHN

SEQ ID NO: 1867476 - protein, 9 aa, Staphylococcus
VHADSKQRI

SEQ ID NO: 1867477 - protein, 14 aa, Staphylococcus
VHHSTTSKHKVRQL

SEQ ID NO: 1867478 - protein, 14 aa, Staphylococcus
VHNDDVKVAKDKAL

SEQ ID NO: 1867479 - protein, 201 aa, Staphylococcus
VHNDNNSHHNHENDENNQRSDVDERYDEHNRHSNHRLEDDSYENDDNSDDRMNSDHRRHRDFDQDNDRHEAHHSKIGKDATIAGGAAATGAVGAKASRNKKRKNNRHDDENYRDNENRSVQHNSEDNNELDNKHHRKKGNKGKKAAAVGAGAAGAGAAGAAASKHKQHDEHNNLNHHDADKHREYEDNDGFQAHNGNKKRG

SEQ ID NO: 1867480 - protein, 9 aa, Staphylococcus
VHNSSQLSH

SEQ ID NO: 1867481 - protein, 6 aa, Staphylococcus
VHPSGD

SEQ ID NO: 1867482 - protein, 9 aa, Staphylococcus
VHSGKRNGM

SEQ ID NO: 1867483 - protein, 5 aa, Staphylococcus
VHSRS

SEQ ID NO: 1867484 - protein, 4 aa, Staphylococcus
VHTN

SEQ ID NO: 1867485 - protein, 6 aa, Staphylococcus
VHTNNK

SEQ ID NO: 1867486 - protein, 12 aa, Staphylococcus
VIEDGGNATDAA

SEQ ID NO: 1867487 - protein, 6 aa, Staphylococcus
VIGASS

SEQ ID NO: 1867488 - protein, 21 aa, Staphylococcus
VIGPQKGSKPRQILVDIDKDE

SEQ ID NO: 1867489 - protein, 21 aa, Staphylococcus
VIGPQKGSKPRQILVDLDNDE

SEQ ID NO: 1867490 - protein, 21 aa, Staphylococcus
VIGPQKGSKPRQVLVNLDDEE

SEQ ID NO: 1867491 - protein, 5 aa, Staphylococcus
VIKTT

SEQ ID NO: 1867492 - protein, 10 aa, Staphylococcus
VINTEERQQH

SEQ ID NO: 1867493 - protein, 10 aa, Staphylococcus
VISKNKDQIE

SEQ ID NO: 1867494 - protein, 5 aa, Staphylococcus
VITPG

SEQ ID NO: 1867495 - protein, 15 aa, Staphylococcus
VITSSHKKTESKSYI

SEQ ID NO: 1867496 - protein, 10 aa, Staphylococcus
VKAETPIQIE

SEQ ID NO: 1867497 - protein, 44 aa, Staphylococcus
VKAGETAKADTNKTPEELKQAAKAINDAKDALKAKADKTELEKA

SEQ ID NO: 1867498 - protein, 10 aa, Staphylococcus
VKALSNSKLS

SEQ ID NO: 1867499 - protein, 22 aa, Staphylococcus
VKANPNNSQYKNLEKELSKKSD

SEQ ID NO: 1867500 - protein, 23 aa, Staphylococcus
VKANRDEISGRLEQSSNKQATVE

SEQ ID NO: 1867501 - protein, 10 aa, Staphylococcus
VKAPTGHELA

SEQ ID NO: 1867502 - protein, 23 aa, Staphylococcus
VKDAREALSKTKGANLNERDIQG

SEQ ID NO: 1867503 - protein, 9 aa, Staphylococcus
VKDARKQNK

SEQ ID NO: 1867504 - protein, 6 aa, Staphylococcus
VKDAVD

SEQ ID NO: 1867505 - protein, 13 aa, Staphylococcus
VKDDKKIPTGEQY

SEQ ID NO: 1867506 - protein, 4 aa, Staphylococcus
VKDE

SEQ ID NO: 1867507 - protein, 89 aa, Staphylococcus
VKDEDRDDSEFSNGKYGKSYDDIREEQLEEGRKDEAEDRKEDDRIDHDRNNHRSDRNQSQNHSQRNDRDETGYEQSPNIEHPTDSNHRE

SEQ ID NO: 1867508 - protein, 106 aa, Staphylococcus
VKDEDSDYSEGKYGKSYDDIREEQLEEGKEDMREDRKEDNDMNRERRHRQRDDRDNQTGHDQLRDGSNGDNDQHRGHSNNEEDTGHEQSPNIDKPYNPNDPNNPSN

SEQ ID NO: 1867509 - protein, 90 aa, Staphylococcus
VKDEDTDYSDGKYGKSYDDIRKEQLDEGDEKEKEDRKENRDIEHERRRQHNEDHDYKGQESDQDSDSDVTGHEQSPNIDKPYDPNNPDNR

SEQ ID NO: 1867510 - protein, 30 aa, Staphylococcus
VKDEIKQSEENTEENTETNKRSPFSNNNHR

SEQ ID NO: 1867511 - protein, 5 aa, Staphylococcus
VKDGY

SEQ ID NO: 1867512 - protein, 11 aa, Staphylococcus
VKDHKGTSSVI

SEQ ID NO: 1867513 - protein, 10 aa, Staphylococcus
VKDHQGDGNA

SEQ ID NO: 1867514 - protein, 10 aa, Staphylococcus
VKDHQGGGNA

SEQ ID NO: 1867515 - protein, 8 aa, Staphylococcus
VKDKNGVP

SEQ ID NO: 1867516 - protein, 10 aa, Staphylococcus
VKDPDEARKI

SEQ ID NO: 1867517 - protein, 8 aa, Staphylococcus
VKDPSTIG

SEQ ID NO: 1867518 - protein, 11 aa, Staphylococcus
VKDQKEARKIL

SEQ ID NO: 1867519 - protein, 12 aa, Staphylococcus
VKDQKSPSSPRV

SEQ ID NO: 1867520 - protein, 11 aa, Staphylococcus
VKDTDKAEFPS

SEQ ID NO: 1867521 - protein, 7 aa, Staphylococcus
VKDYADQ

SEQ ID NO: 1867522 - protein, 6 aa, Staphylococcus
VKDYND

SEQ ID NO: 1867523 - protein, 14 aa, Staphylococcus
VKEEDNSDNGQKEI

SEQ ID NO: 1867524 - protein, 12 aa, Staphylococcus
VKEEINDINKSN

SEQ ID NO: 1867525 - protein, 4 aa, Staphylococcus
VKEG

SEQ ID NO: 1867526 - protein, 9 aa, Staphylococcus
VKEKGKVDV

SEQ ID NO: 1867527 - protein, 12 aa, Staphylococcus
VKEKRNDANFGS

SEQ ID NO: 1867528 - protein, 33 aa, Staphylococcus
VKEKSAEVTHQQDNKYVPPQEFQSKTPKKPNQT

SEQ ID NO: 1867529 - protein, 8 aa, Staphylococcus
VKELDQNE

SEQ ID NO: 1867530 - protein, 22 aa, Staphylococcus
VKEMEPDAPVEKSEMKSEDTLY

SEQ ID NO: 1867531 - protein, 205 aa, Staphylococcus
VKENQTNSETINQTKEQVQPSEQKTDSTEATKNQRSDQTTSLATPKDEVESNPENNAEATKPVTSVDKNTNDNPIVSKNQDSTASRVEAPQTDSSNPVETTVPEPFSAPVGETTKSLEEQNPVNQSEGQKALSTSQQPVDNGAETDVPNENPSFDPNSSAVTDANNPSLGNVETNADSLKAASDAVKNYSNQKDSTEVQATPPRT

SEQ ID NO: 1867532 - protein, 19 aa, Staphylococcus
VKEQPDKDKYEPKVTPITK

SEQ ID NO: 1867533 - protein, 33 aa, Staphylococcus
VKEQPDKDKYEPKVTPITKGFGTPTTADEVKKA

SEQ ID NO: 1867534 - protein, 33 aa, Staphylococcus
VKEQPDKDKYEPKVTPVTKDFGTPTTADEVKKA

SEQ ID NO: 1867535 - protein, 33 aa, Staphylococcus
VKEQPDKDKYEPSTKAITKPFGTPTTADEVKKA

SEQ ID NO: 1867536 - protein, 32 aa, Staphylococcus
VKEQPDKDKYEPSTKAITKPFGTSTTADEVKK

SEQ ID NO: 1867537 - protein, 32 aa, Staphylococcus
VKEQPDKDKYEPTTKPITKSFGTPTTADEVQK

SEQ ID NO: 1867538 - protein, 7 aa, Staphylococcus
VKESGPV

SEQ ID NO: 1867539 - protein, 27 aa, Staphylococcus
VKESPNEIDAKSSKNFVNENENDSGVQ

SEQ ID NO: 1867540 - protein, 6 aa, Staphylococcus
VKETFP

SEQ ID NO: 1867541 - protein, 5 aa, Staphylococcus
VKETW

SEQ ID NO: 1867542 - protein, 17 aa, Staphylococcus
VKGDTEKKGSTAQGYEI

SEQ ID NO: 1867543 - protein, 5 aa, Staphylococcus
VKGGL

SEQ ID NO: 1867544 - protein, 21 aa, Staphylococcus
VKGIGDSVQNLNGSVDRVTNS

SEQ ID NO: 1867545 - protein, 21 aa, Staphylococcus
VKGIGDSVQTLNSSVDRVTNS

SEQ ID NO: 1867546 - protein, 11 aa, Staphylococcus
VKGKASNGSGI

SEQ ID NO: 1867547 - protein, 13 aa, Staphylococcus
VKGKSTEAIKGTV

SEQ ID NO: 1867548 - protein, 10 aa, Staphylococcus
VKGKTDKEIA

SEQ ID NO: 1867549 - protein, 17 aa, Staphylococcus
VKGPSPEAIKDTVENIE

SEQ ID NO: 1867550 - protein, 12 aa, Staphylococcus
VKGPSTNAIKDT

SEQ ID NO: 1867551 - protein, 7 aa, Staphylococcus
VKGRYHG

SEQ ID NO: 1867552 - protein, 9 aa, Staphylococcus
VKGSAQGDV

SEQ ID NO: 1867553 - protein, 9 aa, Staphylococcus
VKGSDVKKA

SEQ ID NO: 1867554 - protein, 9 aa, Staphylococcus
VKGSDVKQA

SEQ ID NO: 1867555 - protein, 7 aa, Staphylococcus
VKGTSRA

SEQ ID NO: 1867556 - protein, 6 aa, Staphylococcus
VKGTTR

SEQ ID NO: 1867557 - protein, 7 aa, Staphylococcus
VKGVDSV

SEQ ID NO: 1867558 - protein, 7 aa, Staphylococcus
VKHDDVP

SEQ ID NO: 1867559 - protein, 9 aa, Staphylococcus
VKHDKTKSY

SEQ ID NO: 1867560 - protein, 4 aa, Staphylococcus
VKHP

SEQ ID NO: 1867561 - protein, 7 aa, Staphylococcus
VKHRNGQ

SEQ ID NO: 1867562 - protein, 8 aa, Staphylococcus
VKIKEGKT

SEQ ID NO: 1867563 - protein, 13 aa, Staphylococcus
VKIPDTNEWAAKK

SEQ ID NO: 1867564 - protein, 5 aa, Staphylococcus
VKITS

SEQ ID NO: 1867565 - protein, 26 aa, Staphylococcus
VKKDDAKGLAKQVTSDNHKLSEEEAR

SEQ ID NO: 1867566 - protein, 9 aa, Staphylococcus
VKKDKSKSI

SEQ ID NO: 1867567 - protein, 7 aa, Staphylococcus
VKKEKIN

SEQ ID NO: 1867568 - protein, 9 aa, Staphylococcus
VKKNKSKSI

SEQ ID NO: 1867569 - protein, 9 aa, Staphylococcus
VKKNSNVQP

SEQ ID NO: 1867570 - protein, 5 aa, Staphylococcus
VKKSK

SEQ ID NO: 1867571 - protein, 13 aa, Staphylococcus
VKKSKETGEKNPR

SEQ ID NO: 1867572 - protein, 7 aa, Staphylococcus
VKKSTTS

SEQ ID NO: 1867573 - protein, 6 aa, Staphylococcus
VKLDTT

SEQ ID NO: 1867574 - protein, 7 aa, Staphylococcus
VKLNDPE

SEQ ID NO: 1867575 - protein, 15 aa, Staphylococcus
VKLPSKSDFSPKKGD

SEQ ID NO: 1867576 - protein, 10 aa, Staphylococcus
VKLSGGQKQR

SEQ ID NO: 1867577 - protein, 9 aa, Staphylococcus
VKNEDPYKV

SEQ ID NO: 1867578 - protein, 9 aa, Staphylococcus
VKNEDPYQV

SEQ ID NO: 1867579 - protein, 19 aa, Staphylococcus
VKNETDATPITDRKNQAEI

SEQ ID NO: 1867580 - protein, 9 aa, Staphylococcus
VKNGKDTVG

SEQ ID NO: 1867581 - protein, 11 aa, Staphylococcus
VKNKDRSKLQS

SEQ ID NO: 1867582 - protein, 6 aa, Staphylococcus
VKNKQK

SEQ ID NO: 1867583 - protein, 28 aa, Staphylococcus
VKNNEKLNKGDKVAEIAAKGEDGQSQNM

SEQ ID NO: 1867584 - protein, 32 aa, Staphylococcus
VKNNQSALQQSNRDYKKTIDERIKNNETAVKQ

SEQ ID NO: 1867585 - protein, 10 aa, Staphylococcus
VKNPDEARKI

SEQ ID NO: 1867586 - protein, 10 aa, Staphylococcus
VKNQNEARDI

SEQ ID NO: 1867587 - protein, 51 aa, Staphylococcus
VKNQNQARDVLSSQANLTIRDANDNVKLTGKDIVQGSAKQEFKQQTNEPTV

SEQ ID NO: 1867588 - protein, 11 aa, Staphylococcus
VKNQSQARDIL

SEQ ID NO: 1867589 - protein, 7 aa, Staphylococcus
VKNRKDV

SEQ ID NO: 1867590 - protein, 17 aa, Staphylococcus
VKNSITERSSITQNTPE

SEQ ID NO: 1867591 - protein, 7 aa, Staphylococcus
VKNTGGS

SEQ ID NO: 1867592 - protein, 11 aa, Staphylococcus
VKPDAGQKAAN

SEQ ID NO: 1867593 - protein, 18 aa, Staphylococcus
VKPDDKANQIGRLQDEGK

SEQ ID NO: 1867594 - protein, 12 aa, Staphylococcus
VKPEAVTPHSGK

SEQ ID NO: 1867595 - protein, 11 aa, Staphylococcus
VKPGKANTRNA

SEQ ID NO: 1867596 - protein, 7 aa, Staphylococcus
VKPGLTG

SEQ ID NO: 1867597 - protein, 11 aa, Staphylococcus
VKPHETINSPN

SEQ ID NO: 1867598 - protein, 12 aa, Staphylococcus
VKPNKTTDRQYA

SEQ ID NO: 1867599 - protein, 6 aa, Staphylococcus
VKPNQD

SEQ ID NO: 1867600 - protein, 11 aa, Staphylococcus
VKPSDNRNNPQ

SEQ ID NO: 1867601 - protein, 12 aa, Staphylococcus
VKPSHNDSGHKG

SEQ ID NO: 1867602 - protein, 73 aa, Staphylococcus
VKQADSAVTKDDKEQTEPNNKETKSNQQQTPTVKSHEKNEDQLKPQHRDANHSTRADKAIDSAASKQNTNSTH

SEQ ID NO: 1867603 - protein, 7 aa, Staphylococcus
VKQDHTK

SEQ ID NO: 1867604 - protein, 8 aa, Staphylococcus
VKQDKTKS

SEQ ID NO: 1867605 - protein, 6 aa, Staphylococcus
VKQGET

SEQ ID NO: 1867606 - protein, 14 aa, Staphylococcus
VKQNKQTDWSQNKL

SEQ ID NO: 1867607 - protein, 7 aa, Staphylococcus
VKQPALA

SEQ ID NO: 1867608 - protein, 8 aa, Staphylococcus
VKQSKPMP

SEQ ID NO: 1867609 - protein, 8 aa, Staphylococcus
VKQSRNKR

SEQ ID NO: 1867610 - protein, 24 aa, Staphylococcus
VKQTSKSNSQQDSTKHQAEDNDMG

SEQ ID NO: 1867611 - protein, 24 aa, Staphylococcus
VKQTSKSNSQQYPTKHQAEDNDMG

SEQ ID NO: 1867612 - protein, 7 aa, Staphylococcus
VKRAKGD

SEQ ID NO: 1867613 - protein, 8 aa, Staphylococcus
VKRNPKKS

SEQ ID NO: 1867614 - protein, 15 aa, Staphylococcus
VKRQDNIDLNNKENI

SEQ ID NO: 1867615 - protein, 15 aa, Staphylococcus
VKSAQETQKQMQNTV

SEQ ID NO: 1867616 - protein, 16 aa, Staphylococcus
VKSEVNSYTTFSITFN

SEQ ID NO: 1867617 - protein, 7 aa, Staphylococcus
VKSGMGK

SEQ ID NO: 1867618 - protein, 8 aa, Staphylococcus
VKSIGDSM

SEQ ID NO: 1867619 - protein, 10 aa, Staphylococcus
VKSIQQKGID

SEQ ID NO: 1867620 - protein, 9 aa, Staphylococcus
VKSKREENE

SEQ ID NO: 1867621 - protein, 9 aa, Staphylococcus
VKSLGDGVS

SEQ ID NO: 1867622 - protein, 13 aa, Staphylococcus
VKSNDIKLPPSVL

SEQ ID NO: 1867623 - protein, 7 aa, Staphylococcus
VKSNQTG

SEQ ID NO: 1867624 - protein, 8 aa, Staphylococcus
VKSNYEKY

SEQ ID NO: 1867625 - protein, 22 aa, Staphylococcus
VKSNYEKYSQVRSTSGKTGQEV

SEQ ID NO: 1867626 - protein, 22 aa, Staphylococcus
VKSNYEKYSQVRSTSGKTGREV

SEQ ID NO: 1867627 - protein, 7 aa, Staphylococcus
VKSPAIA

SEQ ID NO: 1867628 - protein, 17 aa, Staphylococcus
VKSPDSLDIQSKENKKR

SEQ ID NO: 1867629 - protein, 11 aa, Staphylococcus
VKSPESQPDID

SEQ ID NO: 1867630 - protein, 9 aa, Staphylococcus
VKSPNEITS

SEQ ID NO: 1867631 - protein, 6 aa, Staphylococcus
VKSPQT

SEQ ID NO: 1867632 - protein, 13 aa, Staphylococcus
VKSQADSEHFSKN

SEQ ID NO: 1867633 - protein, 51 aa, Staphylococcus
VKSQDASENYKEKRKQNKIKKEANARVKAEKKAEREKQQLEASEQQDIKDV

SEQ ID NO: 1867634 - protein, 8 aa, Staphylococcus
VKSRRGAE

SEQ ID NO: 1867635 - protein, 8 aa, Staphylococcus
VKSSKNKR

SEQ ID NO: 1867636 - protein, 7 aa, Staphylococcus
VKSTDAM

SEQ ID NO: 1867637 - protein, 23 aa, Staphylococcus
VKSTYEKYSQVRSTSGKTGREVA

SEQ ID NO: 1867638 - protein, 12 aa, Staphylococcus
VKSVDPGKVIMK

SEQ ID NO: 1867639 - protein, 17 aa, Staphylococcus
VKTESNQRRGNVTVATQ

SEQ ID NO: 1867640 - protein, 10 aa, Staphylococcus
VKTKRQREGL

SEQ ID NO: 1867641 - protein, 5 aa, Staphylococcus
VKTPQ

SEQ ID NO: 1867642 - protein, 24 aa, Staphylococcus
VKTSIKRRAYNYNDGTNAKTGALE

SEQ ID NO: 1867643 - protein, 24 aa, Staphylococcus
VKTSIKRRAYNYNDGTNAKTGDLD

SEQ ID NO: 1867644 - protein, 10 aa, Staphylococcus
VKTSNDGTIG

SEQ ID NO: 1867645 - protein, 6 aa, Staphylococcus
VKTTLN

SEQ ID NO: 1867646 - protein, 12 aa, Staphylococcus
VKVKQNKQTYWS

SEQ ID NO: 1867647 - protein, 7 aa, Staphylococcus
VKVPNEM

SEQ ID NO: 1867648 - protein, 5 aa, Staphylococcus
VKVSP

SEQ ID NO: 1867649 - protein, 6 aa, Staphylococcus
VKYSEE

SEQ ID NO: 1867650 - protein, 46 aa, Staphylococcus
VLDNGDNEVTFSDGTKITIPKGAKGDKGDVGDSITVQSTQPLANGD

SEQ ID NO: 1867651 - protein, 12 aa, Staphylococcus
VLDTDNTKNIEN

SEQ ID NO: 1867652 - protein, 5 aa, Staphylococcus
VLETT

SEQ ID NO: 1867653 - protein, 5 aa, Staphylococcus
VLKQS

SEQ ID NO: 1867654 - protein, 5 aa, Staphylococcus
VLSEN

SEQ ID NO: 1867655 - protein, 42 aa, Staphylococcus
VLSESQSASLSTSTSKSTSASTAVSESHSTSDSVSEADSNSL

SEQ ID NO: 1867656 - protein, 14 aa, Staphylococcus
VMGTKNTAEAARHA

SEQ ID NO: 1867657 - protein, 15 aa, Staphylococcus
VMTSQDDSEGFSQNT

SEQ ID NO: 1867658 - protein, 10 aa, Staphylococcus
VNAADDSKIS

SEQ ID NO: 1867659 - protein, 14 aa, Staphylococcus
VNAADEPAYTPNSF

SEQ ID NO: 1867660 - protein, 8 aa, Staphylococcus
VNAEAKDW

SEQ ID NO: 1867661 - protein, 12 aa, Staphylococcus
VNALPNKDISHG

SEQ ID NO: 1867662 - protein, 6 aa, Staphylococcus
VNAPSV

SEQ ID NO: 1867663 - protein, 7 aa, Staphylococcus
VNAQITK

SEQ ID NO: 1867664 - protein, 4 aa, Staphylococcus
VNDI

SEQ ID NO: 1867665 - protein, 7 aa, Staphylococcus
VNDNSVQ

SEQ ID NO: 1867666 - protein, 5 aa, Staphylococcus
VNDRD

SEQ ID NO: 1867667 - protein, 12 aa, Staphylococcus
VNDSNISGPLPP

SEQ ID NO: 1867668 - protein, 71 aa, Staphylococcus
VNDTEDSQESSKESKATNEDDRENKDENDELNTFSTDTNDTEVEQQDDSDHEAINPNSEEAKVNEKLKEKH

SEQ ID NO: 1867669 - protein, 7 aa, Staphylococcus
VNEEDEN

SEQ ID NO: 1867670 - protein, 5 aa, Staphylococcus
VNEEE

SEQ ID NO: 1867671 - protein, 32 aa, Staphylococcus
VNEKAQAVTTAQNNLHGQQKLQEAQHNADTEI

SEQ ID NO: 1867672 - protein, 10 aa, Staphylococcus
VNEKKNAKNI

SEQ ID NO: 1867673 - protein, 12 aa, Staphylococcus
VNETSYKVENNN

SEQ ID NO: 1867674 - protein, 12 aa, Staphylococcus
VNEYSQNRNELS

SEQ ID NO: 1867675 - protein, 8 aa, Staphylococcus
VNGDMSTA

SEQ ID NO: 1867676 - protein, 7 aa, Staphylococcus
VNGEEVT

SEQ ID NO: 1867677 - protein, 7 aa, Staphylococcus
VNGHDVD

SEQ ID NO: 1867678 - protein, 4 aa, Staphylococcus
VNGI

SEQ ID NO: 1867679 - protein, 12 aa, Staphylococcus
VNGKESSSNTYL

SEQ ID NO: 1867680 - protein, 9 aa, Staphylococcus
VNGKNEYAG

SEQ ID NO: 1867681 - protein, 12 aa, Staphylococcus
VNGKSIKGKSLT

SEQ ID NO: 1867682 - protein, 11 aa, Staphylococcus
VNGKSVEKQRL

SEQ ID NO: 1867683 - protein, 11 aa, Staphylococcus
VNGKSVVGKPL

SEQ ID NO: 1867684 - protein, 6 aa, Staphylococcus
VNGLTT

SEQ ID NO: 1867685 - protein, 13 aa, Staphylococcus
VNGQEANNDSHLS

SEQ ID NO: 1867686 - protein, 12 aa, Staphylococcus
VNGQEASNEQYL

SEQ ID NO: 1867687 - protein, 14 aa, Staphylococcus
VNGSEASNDQQLSD

SEQ ID NO: 1867688 - protein, 13 aa, Staphylococcus
VNGTEPSSEEHLS

SEQ ID NO: 1867689 - protein, 6 aa, Staphylococcus
VNHDDV

SEQ ID NO: 1867690 - protein, 17 aa, Staphylococcus
VNHGDEDFAEGKFGKSY

SEQ ID NO: 1867691 - protein, 4 aa, Staphylococcus
VNIE

SEQ ID NO: 1867692 - protein, 6 aa, Staphylococcus
VNKGDK

SEQ ID NO: 1867693 - protein, 7 aa, Staphylococcus
VNKGDTH

SEQ ID NO: 1867694 - protein, 6 aa, Staphylococcus
VNKKAE

SEQ ID NO: 1867695 - protein, 10 aa, Staphylococcus
VNKKQSAINE

SEQ ID NO: 1867696 - protein, 6 aa, Staphylococcus
VNKNDQ

SEQ ID NO: 1867697 - protein, 9 aa, Staphylococcus
VNKNNQSMQ

SEQ ID NO: 1867698 - protein, 10 aa, Staphylococcus
VNKNSDSMSQ

SEQ ID NO: 1867699 - protein, 12 aa, Staphylococcus
VNKPQKKKKGKG

SEQ ID NO: 1867700 - protein, 9 aa, Staphylococcus
VNLKNGDPF

SEQ ID NO: 1867701 - protein, 15 aa, Staphylococcus
VNLQTNTANFTNSEG

SEQ ID NO: 1867702 - protein, 8 aa, Staphylococcus
VNLSPKDL

SEQ ID NO: 1867703 - protein, 6 aa, Staphylococcus
VNLTTE

SEQ ID NO: 1867704 - protein, 16 aa, Staphylococcus
VNLTTEKATIEYDTND

SEQ ID NO: 1867705 - protein, 20 aa, Staphylococcus
VNLTTENATISYNPSATSVD

SEQ ID NO: 1867706 - protein, 18 aa, Staphylococcus
VNMQSLEKEDVDINEEIQ

SEQ ID NO: 1867707 - protein, 13 aa, Staphylococcus
VNNESNQFDSELE

SEQ ID NO: 1867708 - protein, 13 aa, Staphylococcus
VNNEYGHKPTVNT

SEQ ID NO: 1867709 - protein, 9 aa, Staphylococcus
VNNKEQAVK

SEQ ID NO: 1867710 - protein, 8 aa, Staphylococcus
VNNNHSKL

SEQ ID NO: 1867711 - protein, 15 aa, Staphylococcus
VNNPSPTVESKSHDL

SEQ ID NO: 1867712 - protein, 11 aa, Staphylococcus
VNNPTSGGAST

SEQ ID NO: 1867713 - protein, 11 aa, Staphylococcus
VNNSEDEIKEV

SEQ ID NO: 1867714 - protein, 12 aa, Staphylococcus
VNNSENEIKEVQ

SEQ ID NO: 1867715 - protein, 12 aa, Staphylococcus
VNNSQDEIDEVK

SEQ ID NO: 1867716 - protein, 12 aa, Staphylococcus
VNNSQKEIDEVQ

SEQ ID NO: 1867717 - protein, 7 aa, Staphylococcus
VNNTENA

SEQ ID NO: 1867718 - protein, 12 aa, Staphylococcus
VNNTPDQVKEVQ

SEQ ID NO: 1867719 - protein, 12 aa, Staphylococcus
VNNTQDQLDEVK

SEQ ID NO: 1867720 - protein, 13 aa, Staphylococcus
VNNTQNEVNEVQE

SEQ ID NO: 1867721 - protein, 6 aa, Staphylococcus
VNNTYR

SEQ ID NO: 1867722 - protein, 57 aa, Staphylococcus
VNPEVSKGKKALASGNNNDGYRNNNSSDNYNTSSGNNKDSIKLPSTGKEGQNQSPLA

SEQ ID NO: 1867723 - protein, 7 aa, Staphylococcus
VNPHASE

SEQ ID NO: 1867724 - protein, 5 aa, Staphylococcus
VNPHD

SEQ ID NO: 1867725 - protein, 7 aa, Staphylococcus
VNPPQRL

SEQ ID NO: 1867726 - protein, 9 aa, Staphylococcus
VNPTGAENN

SEQ ID NO: 1867727 - protein, 7 aa, Staphylococcus
VNPTNLS

SEQ ID NO: 1867728 - protein, 30 aa, Staphylococcus
VNQAQEAKNQAPNDTKAQSELTKANDALNQ

SEQ ID NO: 1867729 - protein, 73 aa, Staphylococcus
VNQGQPNDQTLPNENQAGNDNPANEQTSPQNAVAQEQNQQQNDNKNAVETNNEQIANPEATEANNDANQPNAV

SEQ ID NO: 1867730 - protein, 29 aa, Staphylococcus
VNQKAQKVQQTKDALDGQQRLAEAKEQAI

SEQ ID NO: 1867731 - protein, 10 aa, Staphylococcus
VNQNGTDSGV

SEQ ID NO: 1867732 - protein, 12 aa, Staphylococcus
VNQQNQVHQQSN

SEQ ID NO: 1867733 - protein, 4 aa, Staphylococcus
VNQS

SEQ ID NO: 1867734 - protein, 9 aa, Staphylococcus
VNQSPTLEQ

SEQ ID NO: 1867735 - protein, 5 aa, Staphylococcus
VNQTI

SEQ ID NO: 1867736 - protein, 4 aa, Staphylococcus
VNSD

SEQ ID NO: 1867737 - protein, 6 aa, Staphylococcus
VNSDIT

SEQ ID NO: 1867738 - protein, 14 aa, Staphylococcus
VNSEEARRKIAETK

SEQ ID NO: 1867739 - protein, 13 aa, Staphylococcus
VNSETGTGSGLEN

SEQ ID NO: 1867740 - protein, 6 aa, Staphylococcus
VNSGAY

SEQ ID NO: 1867741 - protein, 13 aa, Staphylococcus
VNSNQKGKNHDVL

SEQ ID NO: 1867742 - protein, 11 aa, Staphylococcus
VNSQAGDNAVK

SEQ ID NO: 1867743 - protein, 25 aa, Staphylococcus
VNSSTTRTDVANQLNEAKALNNSMK

SEQ ID NO: 1867744 - protein, 10 aa, Staphylococcus
VNSVGDSSPY

SEQ ID NO: 1867745 - protein, 4 aa, Staphylococcus
VNTG

SEQ ID NO: 1867746 - protein, 8 aa, Staphylococcus
VNTNDETS

SEQ ID NO: 1867747 - protein, 4 aa, Staphylococcus
VNVN

SEQ ID NO: 1867748 - protein, 46 aa, Staphylococcus
VNVTNTQKDFNRASNQRQDAQQDSKDQSQETTKKLPQTNIKEQQTL

SEQ ID NO: 1867749 - protein, 27 aa, Staphylococcus
VNVTSNDTFTTKGTNFVKGQSTHVDGD

SEQ ID NO: 1867750 - protein, 31 aa, Staphylococcus
VNVTTEKATISYNPESTSADDLTKTIEKTGY

SEQ ID NO: 1867751 - protein, 11 aa, Staphylococcus
VNVTTEQATIE

SEQ ID NO: 1867752 - protein, 11 aa, Staphylococcus
VNYSDKQLATG

SEQ ID NO: 1867753 - protein, 19 aa, Staphylococcus
VPADAPSNATGQIAETPTR

SEQ ID NO: 1867754 - protein, 9 aa, Staphylococcus
VPAEAAKVS

SEQ ID NO: 1867755 - protein, 10 aa, Staphylococcus
VPAEAAKVSA

SEQ ID NO: 1867756 - protein, 6 aa, Staphylococcus
VPASFP

SEQ ID NO: 1867757 - protein, 8 aa, Staphylococcus
VPDANPIQ

SEQ ID NO: 1867758 - protein, 14 aa, Staphylococcus
VPDEEGGYRGGPAY

SEQ ID NO: 1867759 - protein, 9 aa, Staphylococcus
VPDGEKGPA

SEQ ID NO: 1867760 - protein, 13 aa, Staphylococcus
VPDKDGGYRGGPA

SEQ ID NO: 1867761 - protein, 6 aa, Staphylococcus
VPDSDT

SEQ ID NO: 1867762 - protein, 7 aa, Staphylococcus
VPEDAPI

SEQ ID NO: 1867763 - protein, 4 aa, Staphylococcus
VPEE

SEQ ID NO: 1867764 - protein, 12 aa, Staphylococcus
VPEKIRRKVTFL

SEQ ID NO: 1867765 - protein, 5 aa, Staphylococcus
VPESI

SEQ ID NO: 1867766 - protein, 41 aa, Staphylococcus
VPETQTKTNAKNEVDQAATNQNNTIDQNQDATTEEKDAAKQ

SEQ ID NO: 1867767 - protein, 11 aa, Staphylococcus
VPEYRTKNKEP

SEQ ID NO: 1867768 - protein, 5 aa, Staphylococcus
VPFGP

SEQ ID NO: 1867769 - protein, 27 aa, Staphylococcus
VPGDASDKQVANKGEELEQENKDEAYD

SEQ ID NO: 1867770 - protein, 9 aa, Staphylococcus
VPGDSVTYK

SEQ ID NO: 1867771 - protein, 13 aa, Staphylococcus
VPGFPSSKGTPVV

SEQ ID NO: 1867772 - protein, 6 aa, Staphylococcus
VPGGSI

SEQ ID NO: 1867773 - protein, 7 aa, Staphylococcus
VPGISGG

SEQ ID NO: 1867774 - protein, 7 aa, Staphylococcus
VPGTGYQ

SEQ ID NO: 1867775 - protein, 9 aa, Staphylococcus
VPGTQEQLD

SEQ ID NO: 1867776 - protein, 4 aa, Staphylococcus
VPHS

SEQ ID NO: 1867777 - protein, 7 aa, Staphylococcus
VPIPEGN

SEQ ID NO: 1867778 - protein, 29 aa, Staphylococcus
VPKDKSELEKAITDGQNITNLDPNKQIDQ

SEQ ID NO: 1867779 - protein, 16 aa, Staphylococcus
VPKGAKGDKGQDAAPL

SEQ ID NO: 1867780 - protein, 8 aa, Staphylococcus
VPKSYEGH

SEQ ID NO: 1867781 - protein, 13 aa, Staphylococcus
VPLEGATTSLDSL

SEQ ID NO: 1867782 - protein, 7 aa, Staphylococcus
VPLEGKS

SEQ ID NO: 1867783 - protein, 23 aa, Staphylococcus
VPLEGKTKSLDSVESVRSSLANN

SEQ ID NO: 1867784 - protein, 6 aa, Staphylococcus
VPMNED

SEQ ID NO: 1867785 - protein, 6 aa, Staphylococcus
VPMSES

SEQ ID NO: 1867786 - protein, 7 aa, Staphylococcus
VPMSKEE

SEQ ID NO: 1867787 - protein, 6 aa, Staphylococcus
VPMSKQ

SEQ ID NO: 1867788 - protein, 11 aa, Staphylococcus
VPNANIDGKVG

SEQ ID NO: 1867789 - protein, 4 aa, Staphylococcus
VPND

SEQ ID NO: 1867790 - protein, 5 aa, Staphylococcus
VPNGN

SEQ ID NO: 1867791 - protein, 4 aa, Staphylococcus
VPNN

SEQ ID NO: 1867792 - protein, 66 aa, Staphylococcus
VPNNSGDQFVPEQPNTDTKVPSVEKDNNEGNHVTDENRGYTTRKTNTDIKVEKANKTKSAQPQQKV

SEQ ID NO: 1867793 - protein, 9 aa, Staphylococcus
VPNPLRKEE

SEQ ID NO: 1867794 - protein, 5 aa, Staphylococcus
VPNSL

SEQ ID NO: 1867795 - protein, 30 aa, Staphylococcus
VPNYPSDKPAPKVTVDNPSTLPNGKTPGTV

SEQ ID NO: 1867796 - protein, 17 aa, Staphylococcus
VPPEKPVANNITTDDKA

SEQ ID NO: 1867797 - protein, 7 aa, Staphylococcus
VPPFSGF

SEQ ID NO: 1867798 - protein, 12 aa, Staphylococcus
VPPNGAKPMSDQ

SEQ ID NO: 1867799 - protein, 5 aa, Staphylococcus
VPPSI

SEQ ID NO: 1867800 - protein, 10 aa, Staphylococcus
VPPTPPTPVF

SEQ ID NO: 1867801 - protein, 4 aa, Staphylococcus
VPQG

SEQ ID NO: 1867802 - protein, 18 aa, Staphylococcus
VPRDTQAEIVGKGTTEKI

SEQ ID NO: 1867803 - protein, 18 aa, Staphylococcus
VPRDTQAKMVGKGTTEKI

SEQ ID NO: 1867804 - protein, 6 aa, Staphylococcus
VPRDYE

SEQ ID NO: 1867805 - protein, 11 aa, Staphylococcus
VPRDYQQNNNK

SEQ ID NO: 1867806 - protein, 7 aa, Staphylococcus
VPRGYED

SEQ ID NO: 1867807 - protein, 7 aa, Staphylococcus
VPRSYEG

SEQ ID NO: 1867808 - protein, 12 aa, Staphylococcus
VPSAGKTGTAEV

SEQ ID NO: 1867809 - protein, 23 aa, Staphylococcus
VPSAGKTGTAEVYQNGQSRVNST

SEQ ID NO: 1867810 - protein, 10 aa, Staphylococcus
VPSDYAPQVS

SEQ ID NO: 1867811 - protein, 5 aa, Staphylococcus
VPSGD

SEQ ID NO: 1867812 - protein, 5 aa, Staphylococcus
VPSGS

SEQ ID NO: 1867813 - protein, 4 aa, Staphylococcus
VPTD

SEQ ID NO: 1867814 - protein, 4 aa, Staphylococcus
VPTE

SEQ ID NO: 1867815 - protein, 12 aa, Staphylococcus
VPYSGKDGDSQK

SEQ ID NO: 1867816 - protein, 39 aa, Staphylococcus
VQAAEQQSSHLSQESVYTQSKPSDQEANVSSKESEIDKN

SEQ ID NO: 1867817 - protein, 5 aa, Staphylococcus
VQAES

SEQ ID NO: 1867818 - protein, 7 aa, Staphylococcus
VQARKQH

SEQ ID NO: 1867819 - protein, 30 aa, Staphylococcus
VQATQENDDKVKKGNIISQSPKNKSVDEGS

SEQ ID NO: 1867820 - protein, 5 aa, Staphylococcus
VQATS

SEQ ID NO: 1867821 - protein, 57 aa, Staphylococcus
VQDEDKKYQEEEAEVDKEEENQKEYEARKREDAQRDNDSSSDDHDNNQSDRNNDRRN

SEQ ID NO: 1867822 - protein, 8 aa, Staphylococcus
VQDKEKNL

SEQ ID NO: 1867823 - protein, 9 aa, Staphylococcus
VQDNQKHHV

SEQ ID NO: 1867824 - protein, 6 aa, Staphylococcus
VQDTPK

SEQ ID NO: 1867825 - protein, 8 aa, Staphylococcus
VQEETSPI

SEQ ID NO: 1867826 - protein, 9 aa, Staphylococcus
VQEETSPKY

SEQ ID NO: 1867827 - protein, 7 aa, Staphylococcus
VQEGDTY

SEQ ID NO: 1867828 - protein, 5 aa, Staphylococcus
VQENQ

SEQ ID NO: 1867829 - protein, 11 aa, Staphylococcus
VQERQASGHTG

SEQ ID NO: 1867830 - protein, 7 aa, Staphylococcus
VQGASPY

SEQ ID NO: 1867831 - protein, 5 aa, Staphylococcus
VQGFG

SEQ ID NO: 1867832 - protein, 12 aa, Staphylococcus
VQGPSTDAIKGT

SEQ ID NO: 1867833 - protein, 8 aa, Staphylococcus
VQGQLKPG

SEQ ID NO: 1867834 - protein, 4 aa, Staphylococcus
VQGS

SEQ ID NO: 1867835 - protein, 4 aa, Staphylococcus
VQHP

SEQ ID NO: 1867836 - protein, 14 aa, Staphylococcus
VQINGSDNKQATVQ

SEQ ID NO: 1867837 - protein, 12 aa, Staphylococcus
VQKTFGATDSTL

SEQ ID NO: 1867838 - protein, 15 aa, Staphylococcus
VQLDGSTKVTFSDGR

SEQ ID NO: 1867839 - protein, 5 aa, Staphylococcus
VQLSE

SEQ ID NO: 1867840 - protein, 7 aa, Staphylococcus
VQNAAGA

SEQ ID NO: 1867841 - protein, 6 aa, Staphylococcus
VQNTNT

SEQ ID NO: 1867842 - protein, 4 aa, Staphylococcus
VQPG

SEQ ID NO: 1867843 - protein, 9 aa, Staphylococcus
VQPKITSAN

SEQ ID NO: 1867844 - protein, 5 aa, Staphylococcus
VQPKL

SEQ ID NO: 1867845 - protein, 6 aa, Staphylococcus
VQPKLD

SEQ ID NO: 1867846 - protein, 7 aa, Staphylococcus
VQPLTQS

SEQ ID NO: 1867847 - protein, 6 aa, Staphylococcus
VQPPNV

SEQ ID NO: 1867848 - protein, 75 aa, Staphylococcus
VQPTVVKKDEAKTAIDKAAEAKKAEIDQTPDATDEEKAAAKAKVDEAVNNAKASIDQVTNNEGVDTAKSNGLDSI

SEQ ID NO: 1867849 - protein, 75 aa, Staphylococcus
VQPTVVKKDEAKTAIDKAAEAKKAEIDQTPNATDEEKAAAKAKVDEAVNNAKASIDQATNNNGVDTAKSEGTDAI

SEQ ID NO: 1867850 - protein, 53 aa, Staphylococcus
VQPTVVKKDEAKTAIENAARAKKAEIDQMPNATDEEKAAAKAKVDEAVNNAKV

SEQ ID NO: 1867851 - protein, 74 aa, Staphylococcus
VQPTVVKKDEAKTAIENAARAKKAEIDQTPNATDEEKATAKAKVDEAVTTAKNAIDQATNNNGVDTAKTNGVDA

SEQ ID NO: 1867852 - protein, 7 aa, Staphylococcus
VQQRTSV

SEQ ID NO: 1867853 - protein, 11 aa, Staphylococcus
VQQTQQALDGV

SEQ ID NO: 1867854 - protein, 9 aa, Staphylococcus
VQQVGKESE

SEQ ID NO: 1867855 - protein, 21 aa, Staphylococcus
VQRSTKERQTGTKNQDTDYDS

SEQ ID NO: 1867856 - protein, 20 aa, Staphylococcus
VQRTDKERQNTTEEKDPELA

SEQ ID NO: 1867857 - protein, 9 aa, Staphylococcus
VQSDKANAL

SEQ ID NO: 1867858 - protein, 9 aa, Staphylococcus
VQSPGAAIK

SEQ ID NO: 1867859 - protein, 8 aa, Staphylococcus
VQSQQAKI

SEQ ID NO: 1867860 - protein, 4 aa, Staphylococcus
VQTD

SEQ ID NO: 1867861 - protein, 12 aa, Staphylococcus
VQTQKNRLGVPD

SEQ ID NO: 1867862 - protein, 10 aa, Staphylococcus
VQTSKSLPPW

SEQ ID NO: 1867863 - protein, 10 aa, Staphylococcus
VQTSKSVAPW

SEQ ID NO: 1867864 - protein, 5 aa, Staphylococcus
VRADA

SEQ ID NO: 1867865 - protein, 44 aa, Staphylococcus
VRATDDAEVPNSSTSDPVKATDTTPPNAPTFDTDISEKGGTLTP

SEQ ID NO: 1867866 - protein, 18 aa, Staphylococcus
VRATDNAQHPNSSLSKPV

SEQ ID NO: 1867867 - protein, 10 aa, Staphylococcus
VREKKNGQTL

SEQ ID NO: 1867868 - protein, 10 aa, Staphylococcus
VRGDKNVDSL

SEQ ID NO: 1867869 - protein, 17 aa, Staphylococcus
VRGIGGKTFEKLKDYFT

SEQ ID NO: 1867870 - protein, 9 aa, Staphylococcus
VRGKQGTKV

SEQ ID NO: 1867871 - protein, 6 aa, Staphylococcus
VRGQDD

SEQ ID NO: 1867872 - protein, 6 aa, Staphylococcus
VRHNGN

SEQ ID NO: 1867873 - protein, 6 aa, Staphylococcus
VRHQGN

SEQ ID NO: 1867874 - protein, 4 aa, Staphylococcus
VRNE

SEQ ID NO: 1867875 - protein, 9 aa, Staphylococcus
VRNTNSGLG

SEQ ID NO: 1867876 - protein, 6 aa, Staphylococcus
VRPDLE

SEQ ID NO: 1867877 - protein, 5 aa, Staphylococcus
VRPLP

SEQ ID NO: 1867878 - protein, 12 aa, Staphylococcus
VRPSGNPDTSLT

SEQ ID NO: 1867879 - protein, 7 aa, Staphylococcus
VRQDTVS

SEQ ID NO: 1867880 - protein, 5 aa, Staphylococcus
VRQPL

SEQ ID NO: 1867881 - protein, 5 aa, Staphylococcus
VRQQE

SEQ ID NO: 1867882 - protein, 5 aa, Staphylococcus
VRRNG

SEQ ID NO: 1867883 - protein, 8 aa, Staphylococcus
VRSGVSNA

SEQ ID NO: 1867884 - protein, 26 aa, Staphylococcus
VRSNYKDANDNVNRHQLEGQGGIQDD

SEQ ID NO: 1867885 - protein, 26 aa, Staphylococcus
VRSSQSGATTYNNNTGVANYDDNSEM

SEQ ID NO: 1867886 - protein, 5 aa, Staphylococcus
VRTGA

SEQ ID NO: 1867887 - protein, 6 aa, Staphylococcus
VRTKKV

SEQ ID NO: 1867888 - protein, 6 aa, Staphylococcus
VRTRKV

SEQ ID NO: 1867889 - protein, 15 aa, Staphylococcus
VSAEGKVKGKTFKSD

SEQ ID NO: 1867890 - protein, 8 aa, Staphylococcus
VSAEGLSN

SEQ ID NO: 1867891 - protein, 14 aa, Staphylococcus
VSANFDTKKADAIL

SEQ ID NO: 1867892 - protein, 7 aa, Staphylococcus
VSANPVP

SEQ ID NO: 1867893 - protein, 4 aa, Staphylococcus
VSDA

SEQ ID NO: 1867894 - protein, 28 aa, Staphylococcus
VSDARSKLAGANSPKEKAEANDEVNSSL

SEQ ID NO: 1867895 - protein, 6 aa, Staphylococcus
VSDATA

SEQ ID NO: 1867896 - protein, 6 aa, Staphylococcus
VSDDNQ

SEQ ID NO: 1867897 - protein, 8 aa, Staphylococcus
VSDDNQVT

SEQ ID NO: 1867898 - protein, 9 aa, Staphylococcus
VSDGQSVVK

SEQ ID NO: 1867899 - protein, 9 aa, Staphylococcus
VSDKDKATL

SEQ ID NO: 1867900 - protein, 10 aa, Staphylococcus
VSDKQRAAED

SEQ ID NO: 1867901 - protein, 4 aa, Staphylococcus
VSDL

SEQ ID NO: 1867902 - protein, 7 aa, Staphylococcus
VSDNETT

SEQ ID NO: 1867903 - protein, 17 aa, Staphylococcus
VSDNGHGIAPEKLPSLG

SEQ ID NO: 1867904 - protein, 7 aa, Staphylococcus
VSDRSNA

SEQ ID NO: 1867905 - protein, 22 aa, Staphylococcus
VSDTTSESLSLSESLSTSQSLS

SEQ ID NO: 1867906 - protein, 10 aa, Staphylococcus
VSDVANPSNN

SEQ ID NO: 1867907 - protein, 10 aa, Staphylococcus
VSEAEETSMS

SEQ ID NO: 1867908 - protein, 15 aa, Staphylococcus
VSEDSLDKKKQYNQQ

SEQ ID NO: 1867909 - protein, 7 aa, Staphylococcus
VSEKDFD

SEQ ID NO: 1867910 - protein, 9 aa, Staphylococcus
VSEKDKQNL

SEQ ID NO: 1867911 - protein, 9 aa, Staphylococcus
VSEKEKESL

SEQ ID NO: 1867912 - protein, 8 aa, Staphylococcus
VSEPDEIR

SEQ ID NO: 1867913 - protein, 10 aa, Staphylococcus
VSERSLAAKA

SEQ ID NO: 1867914 - protein, 10 aa, Staphylococcus
VSERSLGAKA

SEQ ID NO: 1867915 - protein, 8 aa, Staphylococcus
VSERTREL

SEQ ID NO: 1867916 - protein, 5 aa, Staphylococcus
VSEST

SEQ ID NO: 1867917 - protein, 6 aa, Staphylococcus
VSFSTG

SEQ ID NO: 1867918 - protein, 10 aa, Staphylococcus
VSGDSMYPTF

SEQ ID NO: 1867919 - protein, 12 aa, Staphylococcus
VSGESMHPTFED

SEQ ID NO: 1867920 - protein, 11 aa, Staphylococcus
VSGKTPEEQTL

SEQ ID NO: 1867921 - protein, 8 aa, Staphylococcus
VSGLPDGI

SEQ ID NO: 1867922 - protein, 9 aa, Staphylococcus
VSGLPEGVT

SEQ ID NO: 1867923 - protein, 7 aa, Staphylococcus
VSGLPKG

SEQ ID NO: 1867924 - protein, 4 aa, Staphylococcus
VSGN

SEQ ID NO: 1867925 - protein, 8 aa, Staphylococcus
VSGNGTAT

SEQ ID NO: 1867926 - protein, 21 aa, Staphylococcus
VSGNLSDFTDKMNSKAKSLGM

SEQ ID NO: 1867927 - protein, 21 aa, Staphylococcus
VSGNTSDFTDKMNKKAKELGM

SEQ ID NO: 1867928 - protein, 7 aa, Staphylococcus
VSGNVTS

SEQ ID NO: 1867929 - protein, 12 aa, Staphylococcus
VSGPSADAIKGT

SEQ ID NO: 1867930 - protein, 7 aa, Staphylococcus
VSGQRDV

SEQ ID NO: 1867931 - protein, 9 aa, Staphylococcus
VSGQSYSSY

SEQ ID NO: 1867932 - protein, 4 aa, Staphylococcus
VSGT

SEQ ID NO: 1867933 - protein, 4 aa, Staphylococcus
VSIA

SEQ ID NO: 1867934 - protein, 8 aa, Staphylococcus
VSKKGGTP

SEQ ID NO: 1867935 - protein, 10 aa, Staphylococcus
VSKNKLYKNY

SEQ ID NO: 1867936 - protein, 5 aa, Staphylococcus
VSKTL

SEQ ID NO: 1867937 - protein, 11 aa, Staphylococcus
VSLSGGQKQRV

SEQ ID NO: 1867938 - protein, 7 aa, Staphylococcus
VSMSEEE

SEQ ID NO: 1867939 - protein, 5 aa, Staphylococcus
VSNAD

SEQ ID NO: 1867940 - protein, 8 aa, Staphylococcus
VSNAVSTA

SEQ ID NO: 1867941 - protein, 34 aa, Staphylococcus
VSNDNANDTHNANRTEDMDPDREMKQKKDNDPYI

SEQ ID NO: 1867942 - protein, 7 aa, Staphylococcus
VSNKKGT

SEQ ID NO: 1867943 - protein, 9 aa, Staphylococcus
VSNKKNKIA

SEQ ID NO: 1867944 - protein, 18 aa, Staphylococcus
VSNPYETNQVNDDNDTAI

SEQ ID NO: 1867945 - protein, 4 aa, Staphylococcus
VSNQ

SEQ ID NO: 1867946 - protein, 12 aa, Staphylococcus
VSNQNVNQTSDH

SEQ ID NO: 1867947 - protein, 6 aa, Staphylococcus
VSNVDN

SEQ ID NO: 1867948 - protein, 7 aa, Staphylococcus
VSPDDSP

SEQ ID NO: 1867949 - protein, 21 aa, Staphylococcus
VSPEDASIEKPNTGDSTVDGY

SEQ ID NO: 1867950 - protein, 29 aa, Staphylococcus
VSPEKLANQTIQRVKDDTKAHKEEKTPFY

SEQ ID NO: 1867951 - protein, 7 aa, Staphylococcus
VSPESTM

SEQ ID NO: 1867952 - protein, 49 aa, Staphylococcus
VSPFSEESTENNNTIAATKEQGEKESESTPKYSKDKKIMETRAEQENKS

SEQ ID NO: 1867953 - protein, 5 aa, Staphylococcus
VSPKM

SEQ ID NO: 1867954 - protein, 10 aa, Staphylococcus
VSPPAKYGIA

SEQ ID NO: 1867955 - protein, 10 aa, Staphylococcus
VSPPAKYGLA

SEQ ID NO: 1867956 - protein, 6 aa, Staphylococcus
VSPSSG

SEQ ID NO: 1867957 - protein, 10 aa, Staphylococcus
VSPSSKYGIA

SEQ ID NO: 1867958 - protein, 10 aa, Staphylococcus
VSPSSKYGLA

SEQ ID NO: 1867959 - protein, 10 aa, Staphylococcus
VSPSTKYGLA

SEQ ID NO: 1867960 - protein, 10 aa, Staphylococcus
VSPTNKYGIA

SEQ ID NO: 1867961 - protein, 7 aa, Staphylococcus
VSPYDEQ

SEQ ID NO: 1867962 - protein, 4 aa, Staphylococcus
VSQA

SEQ ID NO: 1867963 - protein, 9 aa, Staphylococcus
VSQAGPGGA

SEQ ID NO: 1867964 - protein, 8 aa, Staphylococcus
VSQATTDQ

SEQ ID NO: 1867965 - protein, 9 aa, Staphylococcus
VSQDKIDAV

SEQ ID NO: 1867966 - protein, 10 aa, Staphylococcus
VSQGSNLQAS

SEQ ID NO: 1867967 - protein, 13 aa, Staphylococcus
VSQGSSLQGSQLA

SEQ ID NO: 1867968 - protein, 22 aa, Staphylococcus
VSQKDKDDIVKKGQKLQDGTDA

SEQ ID NO: 1867969 - protein, 13 aa, Staphylococcus
VSQLNSRLNENSR

SEQ ID NO: 1867970 - protein, 5 aa, Staphylococcus
VSQND

SEQ ID NO: 1867971 - protein, 11 aa, Staphylococcus
VSQRTPGFSGA

SEQ ID NO: 1867972 - protein, 6 aa, Staphylococcus
VSQSDF

SEQ ID NO: 1867973 - protein, 12 aa, Staphylococcus
VSQSGQTVDTAA

SEQ ID NO: 1867974 - protein, 7 aa, Staphylococcus
VSQTSDK

SEQ ID NO: 1867975 - protein, 7 aa, Staphylococcus
VSQTSTL

SEQ ID NO: 1867976 - protein, 27 aa, Staphylococcus
VSREDQDAYAVQSHQRAAEAQQSGKFD

SEQ ID NO: 1867977 - protein, 4 aa, Staphylococcus
VSRH

SEQ ID NO: 1867978 - protein, 4 aa, Staphylococcus
VSRK

SEQ ID NO: 1867979 - protein, 8 aa, Staphylococcus
VSRQQNKG

SEQ ID NO: 1867980 - protein, 12 aa, Staphylococcus
VSSAQEGDLEHQ

SEQ ID NO: 1867981 - protein, 10 aa, Staphylococcus
VSSAQTNQNV

SEQ ID NO: 1867982 - protein, 16 aa, Staphylococcus
VSSDQIEATKAKLGLD

SEQ ID NO: 1867983 - protein, 12 aa, Staphylococcus
VSSEKKAREGMD

SEQ ID NO: 1867984 - protein, 39 aa, Staphylococcus
VSSEKVDNPQQKSGETNQVQSQSNVRDTQQTSNRNQTSV

SEQ ID NO: 1867985 - protein, 7 aa, Staphylococcus
VSSGEYK

SEQ ID NO: 1867986 - protein, 10 aa, Staphylococcus
VSSGQRVTTI

SEQ ID NO: 1867987 - protein, 11 aa, Staphylococcus
VSSNENQESMA

SEQ ID NO: 1867988 - protein, 8 aa, Staphylococcus
VSSQIGVS

SEQ ID NO: 1867989 - protein, 6 aa, Staphylococcus
VSSSQM

SEQ ID NO: 1867990 - protein, 8 aa, Staphylococcus
VSSTQEIR

SEQ ID NO: 1867991 - protein, 10 aa, Staphylococcus
VSSVGSSNMD

SEQ ID NO: 1867992 - protein, 8 aa, Staphylococcus
VSTDPNTQ

SEQ ID NO: 1867993 - protein, 14 aa, Staphylococcus
VSTDPSPGDRVAEH

SEQ ID NO: 1867994 - protein, 6 aa, Staphylococcus
VSTEGW

SEQ ID NO: 1867995 - protein, 14 aa, Staphylococcus
VSTGASNDFERATQ

SEQ ID NO: 1867996 - protein, 7 aa, Staphylococcus
VSTGEYK

SEQ ID NO: 1867997 - protein, 6 aa, Staphylococcus
VSTPGY

SEQ ID NO: 1867998 - protein, 13 aa, Staphylococcus
VSTPSEGIPKELT

SEQ ID NO: 1867999 - protein, 4 aa, Staphylococcus
VSTS

SEQ ID NO: 1868000 - protein, 153 aa, Staphylococcus
VSTSASESKSASLADSTAASTSLSEAASTSFSDSASTSIATSTSESTSHSDSLSESTSSSTAASESTSGSLSQSLSASTSVSTSDSEEVSESTSASTSTSTDNSTSVSSSLAESTSVSINDSTSVSDSASLSTVTSISESEAVSESLSDSRSL

SEQ ID NO: 1868001 - protein, 12 aa, Staphylococcus
VSTSSEGIPKEL

SEQ ID NO: 1868002 - protein, 7 aa, Staphylococcus
VSTSTAG

SEQ ID NO: 1868003 - protein, 15 aa, Staphylococcus
VSTSTEGLPKELTEQ

SEQ ID NO: 1868004 - protein, 13 aa, Staphylococcus
VSTTKEGIPKELT

SEQ ID NO: 1868005 - protein, 5 aa, Staphylococcus
VSVDP

SEQ ID NO: 1868006 - protein, 19 aa, Staphylococcus
VSVGDNRTSISKTNGKDAV

SEQ ID NO: 1868007 - protein, 4 aa, Staphylococcus
VSYA

SEQ ID NO: 1868008 - protein, 10 aa, Staphylococcus
VSYAAEGKSI

SEQ ID NO: 1868009 - protein, 9 aa, Staphylococcus
VSYSKASSE

SEQ ID NO: 1868010 - protein, 9 aa, Staphylococcus
VTADKKGPK

SEQ ID NO: 1868011 - protein, 8 aa, Staphylococcus
VTAEGDDG

SEQ ID NO: 1868012 - protein, 4 aa, Staphylococcus
VTAG

SEQ ID NO: 1868013 - protein, 12 aa, Staphylococcus
VTARESSQKHQE

SEQ ID NO: 1868014 - protein, 9 aa, Staphylococcus
VTASKDEQY

SEQ ID NO: 1868015 - protein, 12 aa, Staphylococcus
VTATEEEVTSPA

SEQ ID NO: 1868016 - protein, 8 aa, Staphylococcus
VTATGDFG

SEQ ID NO: 1868017 - protein, 9 aa, Staphylococcus
VTDAELENY

SEQ ID NO: 1868018 - protein, 9 aa, Staphylococcus
VTDAGDFGG

SEQ ID NO: 1868019 - protein, 8 aa, Staphylococcus
VTDGQNRI

SEQ ID NO: 1868020 - protein, 4 aa, Staphylococcus
VTDK

SEQ ID NO: 1868021 - protein, 9 aa, Staphylococcus
VTDKDKKNL

SEQ ID NO: 1868022 - protein, 20 aa, Staphylococcus
VTDNSGQAVTNKVSGLPQGV

SEQ ID NO: 1868023 - protein, 8 aa, Staphylococcus
VTDQLKPG

SEQ ID NO: 1868024 - protein, 14 aa, Staphylococcus
VTDSKAQLKFPEKK

SEQ ID NO: 1868025 - protein, 9 aa, Staphylococcus
VTDTGDFGG

SEQ ID NO: 1868026 - protein, 12 aa, Staphylococcus
VTDTTAPTEPKI

SEQ ID NO: 1868027 - protein, 5 aa, Staphylococcus
VTEAA

SEQ ID NO: 1868028 - protein, 12 aa, Staphylococcus
VTEDMGGVKSTV

SEQ ID NO: 1868029 - protein, 4 aa, Staphylococcus
VTEH

SEQ ID NO: 1868030 - protein, 6 aa, Staphylococcus
VTELDQ

SEQ ID NO: 1868031 - protein, 5 aa, Staphylococcus
VTELE

SEQ ID NO: 1868032 - protein, 5 aa, Staphylococcus
VTELN

SEQ ID NO: 1868033 - protein, 9 aa, Staphylococcus
VTENGDFGG

SEQ ID NO: 1868034 - protein, 6 aa, Staphylococcus
VTENGI

SEQ ID NO: 1868035 - protein, 7 aa, Staphylococcus
VTEPDEI

SEQ ID NO: 1868036 - protein, 9 aa, Staphylococcus
VTETGSFGG

SEQ ID NO: 1868037 - protein, 19 aa, Staphylococcus
VTFDPRTSTISGVATKVGT

SEQ ID NO: 1868038 - protein, 9 aa, Staphylococcus
VTGEGDPPK

SEQ ID NO: 1868039 - protein, 7 aa, Staphylococcus
VTGGAAS

SEQ ID NO: 1868040 - protein, 6 aa, Staphylococcus
VTGGAV

SEQ ID NO: 1868041 - protein, 12 aa, Staphylococcus
VTGGPANVTANN

SEQ ID NO: 1868042 - protein, 16 aa, Staphylococcus
VTGPQAEHSELHDNQT

SEQ ID NO: 1868043 - protein, 5 aa, Staphylococcus
VTGSS

SEQ ID NO: 1868044 - protein, 5 aa, Staphylococcus
VTGTG

SEQ ID NO: 1868045 - protein, 8 aa, Staphylococcus
VTGTRDVK

SEQ ID NO: 1868046 - protein, 19 aa, Staphylococcus
VTHNNNGTWSITNKPSYVS

SEQ ID NO: 1868047 - protein, 15 aa, Staphylococcus
VTHPNTIAKETFKSG

SEQ ID NO: 1868048 - protein, 23 aa, Staphylococcus
VTIDGEDSDVDGKVEEVGQATAA

SEQ ID NO: 1868049 - protein, 24 aa, Staphylococcus
VTIDGQDSKIDGKIKEIGKATANS

SEQ ID NO: 1868050 - protein, 13 aa, Staphylococcus
VTIQSQTTTMLDQ

SEQ ID NO: 1868051 - protein, 289 aa, Staphylococcus
VTKDTTEQASTEEKANTTEQASTEEKADTTEQASTEEKADTTEQASTEEKADTTEQASTEEKADTTEQASTEEKANTTEQASTEEKADTTEQASTEEKADTTEQASTEEKADTTEQASTEEKANTTEQASTEEKADTTEQASTEEKADTTEQASTEEKADTTEQASTEEKANTTEQASTEEKADTTEQASTEEKANTTEQASTEEKADTTEQASTEEKADTTEQASTEEKANTTEQASTEEKADTTEQASTEEKADTTEQASTEEKANTTEPLTDNQDESTEDESIEAK

SEQ ID NO: 1868052 - protein, 7 aa, Staphylococcus
VTKEGNT

SEQ ID NO: 1868053 - protein, 25 aa, Staphylococcus
VTKENAKQIATDALSNSGGNPNLQR

SEQ ID NO: 1868054 - protein, 6 aa, Staphylococcus
VTKESE

SEQ ID NO: 1868055 - protein, 10 aa, Staphylococcus
VTKNGLADPS

SEQ ID NO: 1868056 - protein, 9 aa, Staphylococcus
VTKNNGGIE

SEQ ID NO: 1868057 - protein, 10 aa, Staphylococcus
VTKQPNGDTV

SEQ ID NO: 1868058 - protein, 4 aa, Staphylococcus
VTKR

SEQ ID NO: 1868059 - protein, 9 aa, Staphylococcus
VTKSGDFGG

SEQ ID NO: 1868060 - protein, 15 aa, Staphylococcus
VTLGEKRSSSNNYGI

SEQ ID NO: 1868061 - protein, 13 aa, Staphylococcus
VTLGKASDKPEFN

SEQ ID NO: 1868062 - protein, 13 aa, Staphylococcus
VTLGKASDKPEFS

SEQ ID NO: 1868063 - protein, 13 aa, Staphylococcus
VTLGKASDRPEFG

SEQ ID NO: 1868064 - protein, 13 aa, Staphylococcus
VTLGKATDKPEFN

SEQ ID NO: 1868065 - protein, 161 aa, Staphylococcus
VTNEKSPAHSDNLSQDNSNQKDSDNTNQPSNSSNSDNNEGKDNRPNKPSDGTDNGGKDNKPNKPSDGTDHGGKDNKPNKPSDGTDHGGKDNKPSDGKDNGRTPSHPQPPTQNGGHGHKPTNQPNNKDNNNGQNNGNGNQGWNTSNGQQSPQNGEKTDHNIS

SEQ ID NO: 1868066 - protein, 18 aa, Staphylococcus
VTNGGGIRASIEKGKDVT

SEQ ID NO: 1868067 - protein, 19 aa, Staphylococcus
VTNGGGIRASIQTGQVTEN

SEQ ID NO: 1868068 - protein, 19 aa, Staphylococcus
VTNKSYKKNFEDRISKPQH

SEQ ID NO: 1868069 - protein, 12 aa, Staphylococcus
VTNKTNLSDNET

SEQ ID NO: 1868070 - protein, 31 aa, Staphylococcus
VTNNTGKDLHGQGENQNSNNYDVSNSQYSHN

SEQ ID NO: 1868071 - protein, 38 aa, Staphylococcus
VTPATTVKDEAKAEVNQSAEQIRNNNTNNYMDATTEEI

SEQ ID NO: 1868072 - protein, 9 aa, Staphylococcus
VTPDDKTFQ

SEQ ID NO: 1868073 - protein, 6 aa, Staphylococcus
VTPDFD

SEQ ID NO: 1868074 - protein, 9 aa, Staphylococcus
VTPDKRSSA

SEQ ID NO: 1868075 - protein, 7 aa, Staphylococcus
VTPEERR

SEQ ID NO: 1868076 - protein, 19 aa, Staphylococcus
VTPENPGHPGQPIDPNNPS

SEQ ID NO: 1868077 - protein, 9 aa, Staphylococcus
VTPKDESTK

SEQ ID NO: 1868078 - protein, 10 aa, Staphylococcus
VTPKDESTKL

SEQ ID NO: 1868079 - protein, 9 aa, Staphylococcus
VTPKGEASK

SEQ ID NO: 1868080 - protein, 11 aa, Staphylococcus
VTPNDRKSEGI

SEQ ID NO: 1868081 - protein, 11 aa, Staphylococcus
VTPPTRKSEGI

SEQ ID NO: 1868082 - protein, 7 aa, Staphylococcus
VTPSDDI

SEQ ID NO: 1868083 - protein, 25 aa, Staphylococcus
VTQAKDNLHGDQKLATDKTNAKDTL

SEQ ID NO: 1868084 - protein, 11 aa, Staphylococcus
VTQDGEKQTTL

SEQ ID NO: 1868085 - protein, 10 aa, Staphylococcus
VTQGQKVKAG

SEQ ID NO: 1868086 - protein, 9 aa, Staphylococcus
VTQQRNGYT

SEQ ID NO: 1868087 - protein, 8 aa, Staphylococcus
VTQSSGKV

SEQ ID NO: 1868088 - protein, 7 aa, Staphylococcus
VTQTGDD

SEQ ID NO: 1868089 - protein, 6 aa, Staphylococcus
VTQTTE

SEQ ID NO: 1868090 - protein, 4 aa, Staphylococcus
VTRD

SEQ ID NO: 1868091 - protein, 43 aa, Staphylococcus
VTREAQPEAPTSETTNTPNQNEIQQPNYHAPSPEAKAKPIESI

SEQ ID NO: 1868092 - protein, 58 aa, Staphylococcus
VTRQNNQSTKSNNKTKTQTKSSKQSTKTPSQNKNQKQQGKKQQKVEKTTSKIEKRTFN

SEQ ID NO: 1868093 - protein, 11 aa, Staphylococcus
VTRRRGENHNI

SEQ ID NO: 1868094 - protein, 10 aa, Staphylococcus
VTSAETSDVN

SEQ ID NO: 1868095 - protein, 11 aa, Staphylococcus
VTSKSKASIGV

SEQ ID NO: 1868096 - protein, 10 aa, Staphylococcus
VTSNGVNNVT

SEQ ID NO: 1868097 - protein, 23 aa, Staphylococcus
VTSSDIPANTQRVKQQGVLGTKE

SEQ ID NO: 1868098 - protein, 8 aa, Staphylococcus
VTSTDELK

SEQ ID NO: 1868099 - protein, 9 aa, Staphylococcus
VTTDNIGDI

SEQ ID NO: 1868100 - protein, 8 aa, Staphylococcus
VTTDPNTH

SEQ ID NO: 1868101 - protein, 8 aa, Staphylococcus
VTTDPNTR

SEQ ID NO: 1868102 - protein, 30 aa, Staphylococcus
VTTEASDSVKKGNVISQSPKDKEVDEGSTI

SEQ ID NO: 1868103 - protein, 5 aa, Staphylococcus
VTTED

SEQ ID NO: 1868104 - protein, 6 aa, Staphylococcus
VTTHEQ

SEQ ID NO: 1868105 - protein, 10 aa, Staphylococcus
VTTKDKVAKT

SEQ ID NO: 1868106 - protein, 4 aa, Staphylococcus
VTTN

SEQ ID NO: 1868107 - protein, 7 aa, Staphylococcus
VTTNNKT

SEQ ID NO: 1868108 - protein, 35 aa, Staphylococcus
VTTNPEKDNNAYEPKTEEITKDYGTPTTEDDVTGA

SEQ ID NO: 1868109 - protein, 35 aa, Staphylococcus
VTTNPEKDNNAYEPKTEEVTKDYGTPTTEDDVTGA

SEQ ID NO: 1868110 - protein, 16 aa, Staphylococcus
VTTPETKTKTSPTAVN

SEQ ID NO: 1868111 - protein, 7 aa, Staphylococcus
VTTSQEI

SEQ ID NO: 1868112 - protein, 8 aa, Staphylococcus
VTTTEKVA

SEQ ID NO: 1868113 - protein, 7 aa, Staphylococcus
VTTYGGL

SEQ ID NO: 1868114 - protein, 7 aa, Staphylococcus
VTVNPNS

SEQ ID NO: 1868115 - protein, 14 aa, Staphylococcus
VTVNSNGKKGKGKI

SEQ ID NO: 1868116 - protein, 33 aa, Staphylococcus
VTVPDYPSSKGTPEVTIDDQSKIPNGQTPGTHN

SEQ ID NO: 1868117 - protein, 33 aa, Staphylococcus
VTVPDYPSSKGTPEVTIDDQSKIPNGQTPGTYT

SEQ ID NO: 1868118 - protein, 34 aa, Staphylococcus
VTVPDYPSSKGTPTVTVDNPSTLPNGQTPGTYTV

SEQ ID NO: 1868119 - protein, 33 aa, Staphylococcus
VTVPNYPSDKPAPKVSVDDPSTLPNGKTPGEYT

SEQ ID NO: 1868120 - protein, 32 aa, Staphylococcus
VTVPNYPSNKPTPEVSVDDSSKIPDGNTTGTF

SEQ ID NO: 1868121 - protein, 6 aa, Staphylococcus
VTVPTE

SEQ ID NO: 1868122 - protein, 6 aa, Staphylococcus
VTVPTN

SEQ ID NO: 1868123 - protein, 6 aa, Staphylococcus
VTYDEA

SEQ ID NO: 1868124 - protein, 88 aa, Staphylococcus
VTYNSSGGKSVGINDTEFNNTVKPPVPPTPNKPPHNPPKTPGQPPVNPPGNPPEKPGVPPTHHVPPTPKQLNQPKHLPNTGSDDANIN

SEQ ID NO: 1868125 - protein, 63 aa, Staphylococcus
VVEGSAAVKGSKNAKDKTSKKDKKTNNITNKVSEEKEEVEEKFNKDGKKEDLKETKEEYSDST

SEQ ID NO: 1868126 - protein, 8 aa, Staphylococcus
VVEQGTHE

SEQ ID NO: 1868127 - protein, 13 aa, Staphylococcus
VVKKSEAKRAIDD

SEQ ID NO: 1868128 - protein, 5 aa, Staphylococcus
VVKPE

SEQ ID NO: 1868129 - protein, 25 aa, Staphylococcus
VVKSSSFGHPSFKNTKNMEDVEDAE

SEQ ID NO: 1868130 - protein, 11 aa, Staphylococcus
VVNQNDTHHPV

SEQ ID NO: 1868131 - protein, 5 aa, Staphylococcus
VVQPQ

SEQ ID NO: 1868132 - protein, 5 aa, Staphylococcus
VVSDT

SEQ ID NO: 1868133 - protein, 7 aa, Staphylococcus
VVSKDKK

SEQ ID NO: 1868134 - protein, 10 aa, Staphylococcus
VVTKPNAINS

SEQ ID NO: 1868135 - protein, 5 aa, Staphylococcus
VVTRG

SEQ ID NO: 1868136 - protein, 11 aa, Staphylococcus
VYATGNNANVA

SEQ ID NO: 1868137 - protein, 12 aa, Staphylococcus
VYATGSKAEISP

SEQ ID NO: 1868138 - protein, 114 aa, Staphylococcus
VYDESGEYVSKHNQEDEAAAAQRRQEEHEAEQRRQQAEYEEQQRRQQAEAEEAARLKQEKAEEKMRVKQEKKERKKREKERRKQQPSAVSQRRQNFEERKKMTSHETEKDQQDK

SEQ ID NO: 1868139 - protein, 13 aa, Staphylococcus
VYDKEQGKKYLES

SEQ ID NO: 1868140 - protein, 14 aa, Staphylococcus
VYDTEENVIETEDK

SEQ ID NO: 1868141 - protein, 10 aa, Staphylococcus
VYGLKSKKIN

SEQ ID NO: 1868142 - protein, 9 aa, Staphylococcus
VYGPYNSND

SEQ ID NO: 1868143 - protein, 43 aa, Staphylococcus
VYGPYPKNKDITVSATGKVKGKTFETETKSIKADKLTDNTDVT

SEQ ID NO: 1868144 - protein, 10 aa, Staphylococcus
VYGSKSFGKG

SEQ ID NO: 1868145 - protein, 7 aa, Staphylococcus
VYGSKTF

SEQ ID NO: 1868146 - protein, 17 aa, Staphylococcus
VYNKNDRTVEIGHDVGN

SEQ ID NO: 1868147 - protein, 12 aa, Staphylococcus
VYPGAATPEQLN

SEQ ID NO: 1868148 - protein, 7 aa, Staphylococcus
VYPNEDF

SEQ ID NO: 1868149 - protein, 29 aa, Staphylococcus
VYSNKNNELITTPPKDLEKNKKQVEKDLE

SEQ ID NO: 1868150 - protein, 29 aa, Staphylococcus
WAEEESQEEDEKNKEDDTDSEKENSEEQP

SEQ ID NO: 1868151 - protein, 5 aa, Staphylococcus
WAENG

SEQ ID NO: 1868152 - protein, 15 aa, Staphylococcus
WAKQGDAGRKKLNNV

SEQ ID NO: 1868153 - protein, 4 aa, Staphylococcus
WDGN

SEQ ID NO: 1868154 - protein, 5 aa, Staphylococcus
WDGTT

SEQ ID NO: 1868155 - protein, 4 aa, Staphylococcus
WEPG

SEQ ID NO: 1868156 - protein, 6 aa, Staphylococcus
WGGSGL

SEQ ID NO: 1868157 - protein, 4 aa, Staphylococcus
WGGT

SEQ ID NO: 1868158 - protein, 4 aa, Staphylococcus
WGSV

SEQ ID NO: 1868159 - protein, 5 aa, Staphylococcus
WNNQD

SEQ ID NO: 1868160 - protein, 10 aa, Staphylococcus
WNPTGSDPKY

SEQ ID NO: 1868161 - protein, 10 aa, Staphylococcus
WNPTGSNPEY

SEQ ID NO: 1868162 - protein, 34 aa, Staphylococcus
WNPVSSISETSDINNLNSVPETQYNQQNEPYTIE

SEQ ID NO: 1868163 - protein, 6 aa, Staphylococcus
WPKGKP

SEQ ID NO: 1868164 - protein, 8 aa, Staphylococcus
WPQGGRQT

SEQ ID NO: 1868165 - protein, 6 aa, Staphylococcus
WPTSGG

SEQ ID NO: 1868166 - protein, 32 aa, Staphylococcus
WQNRRNRRDSANYKTSSVANETNHSYTTRVDN

SEQ ID NO: 1868167 - protein, 4 aa, Staphylococcus
WQPK

SEQ ID NO: 1868168 - protein, 19 aa, Staphylococcus
WQQTKEHAGNDAPKKFASK

SEQ ID NO: 1868169 - protein, 39 aa, Staphylococcus
WRRERKKKQLEKEIRQEYANKHEQQPFDNNNEEILSRKK

SEQ ID NO: 1868170 - protein, 11 aa, Staphylococcus
WSNASNNKSVL

SEQ ID NO: 1868171 - protein, 10 aa, Staphylococcus
WSPTSSDPKY

SEQ ID NO: 1868172 - protein, 4 aa, Staphylococcus
WSTA

SEQ ID NO: 1868173 - protein, 6 aa, Staphylococcus
WTGKAS

SEQ ID NO: 1868174 - protein, 9 aa, Staphylococcus
WTPSGHAGI

SEQ ID NO: 1868175 - protein, 18 aa, Staphylococcus
WTSAQRTKNASRTGQDQL

SEQ ID NO: 1868176 - protein, 5 aa, Staphylococcus
WTSKD

SEQ ID NO: 1868177 - protein, 5 aa, Staphylococcus
YAANY

SEQ ID NO: 1868178 - protein, 14 aa, Staphylococcus
YAASKRKLTGNPYT

SEQ ID NO: 1868179 - protein, 6 aa, Staphylococcus
YADEQQ

SEQ ID NO: 1868180 - protein, 8 aa, Staphylococcus
YADNAEPV

SEQ ID NO: 1868181 - protein, 6 aa, Staphylococcus
YADNRT

SEQ ID NO: 1868182 - protein, 8 aa, Staphylococcus
YAEEHAKD

SEQ ID NO: 1868183 - protein, 4 aa, Staphylococcus
YAEG

SEQ ID NO: 1868184 - protein, 6 aa, Staphylococcus
YAEGRL

SEQ ID NO: 1868185 - protein, 4 aa, Staphylococcus
YAEM

SEQ ID NO: 1868186 - protein, 9 aa, Staphylococcus
YAENPTQGP

SEQ ID NO: 1868187 - protein, 9 aa, Staphylococcus
YAEQDGSVD

SEQ ID NO: 1868188 - protein, 12 aa, Staphylococcus
YAEQDVNRRNLP

SEQ ID NO: 1868189 - protein, 33 aa, Staphylococcus
YAEQNGLVKQTSKSNSQQDPAKHQAEDNDMGFN

SEQ ID NO: 1868190 - protein, 31 aa, Staphylococcus
YAEQNGLVKQTSKSNSQQDSAKHQAEDNDMG

SEQ ID NO: 1868191 - protein, 31 aa, Staphylococcus
YAEQNGLVKQTSKSNSQQDSTKHQAEDNDMG

SEQ ID NO: 1868192 - protein, 7 aa, Staphylococcus
YAGETGL

SEQ ID NO: 1868193 - protein, 6 aa, Staphylococcus
YAGETY

SEQ ID NO: 1868194 - protein, 9 aa, Staphylococcus
YAGTPAKAL

SEQ ID NO: 1868195 - protein, 5 aa, Staphylococcus
YAKDI

SEQ ID NO: 1868196 - protein, 8 aa, Staphylococcus
YAKGAYKY

SEQ ID NO: 1868197 - protein, 7 aa, Staphylococcus
YAKKGKH

SEQ ID NO: 1868198 - protein, 15 aa, Staphylococcus
YANEDPSKTGSTKQL

SEQ ID NO: 1868199 - protein, 9 aa, Staphylococcus
YANEQTSKY

SEQ ID NO: 1868200 - protein, 8 aa, Staphylococcus
YANNAEPV

SEQ ID NO: 1868201 - protein, 4 aa, Staphylococcus
YANP

SEQ ID NO: 1868202 - protein, 9 aa, Staphylococcus
YANQEDKGF

SEQ ID NO: 1868203 - protein, 5 aa, Staphylococcus
YAPAK

SEQ ID NO: 1868204 - protein, 10 aa, Staphylococcus
YAPDKNKQNR

SEQ ID NO: 1868205 - protein, 10 aa, Staphylococcus
YAPEKNKQNR

SEQ ID NO: 1868206 - protein, 7 aa, Staphylococcus
YAPGNGQ

SEQ ID NO: 1868207 - protein, 9 aa, Staphylococcus
YAPKEMTIK

SEQ ID NO: 1868208 - protein, 9 aa, Staphylococcus
YAPKQNSPN

SEQ ID NO: 1868209 - protein, 8 aa, Staphylococcus
YAPKTMTI

SEQ ID NO: 1868210 - protein, 8 aa, Staphylococcus
YAPQEGPG

SEQ ID NO: 1868211 - protein, 9 aa, Staphylococcus
YAPQKNPKL

SEQ ID NO: 1868212 - protein, 7 aa, Staphylococcus
YAPTKAS

SEQ ID NO: 1868213 - protein, 7 aa, Staphylococcus
YAQEHAK

SEQ ID NO: 1868214 - protein, 25 aa, Staphylococcus
YAQFPKRAVESEYKSTQQEEEEPAI

SEQ ID NO: 1868215 - protein, 17 aa, Staphylococcus
YAQNGTAEKDDEERQKE

SEQ ID NO: 1868216 - protein, 6 aa, Staphylococcus
YAQSTY

SEQ ID NO: 1868217 - protein, 15 aa, Staphylococcus
YARRAPRRHYNEDER

SEQ ID NO: 1868218 - protein, 7 aa, Staphylococcus
YASEKQV

SEQ ID NO: 1868219 - protein, 6 aa, Staphylococcus
YASGDG

SEQ ID NO: 1868220 - protein, 6 aa, Staphylococcus
YASGDS

SEQ ID NO: 1868221 - protein, 6 aa, Staphylococcus
YASGGG

SEQ ID NO: 1868222 - protein, 8 aa, Staphylococcus
YASGKQIK

SEQ ID NO: 1868223 - protein, 5 aa, Staphylococcus
YASGQ

SEQ ID NO: 1868224 - protein, 9 aa, Staphylococcus
YASKEMTIK

SEQ ID NO: 1868225 - protein, 10 aa, Staphylococcus
YASKNFSHQP

SEQ ID NO: 1868226 - protein, 9 aa, Staphylococcus
YASNNGESQ

SEQ ID NO: 1868227 - protein, 12 aa, Staphylococcus
YASQADSEKFNT

SEQ ID NO: 1868228 - protein, 8 aa, Staphylococcus
YASSRARS

SEQ ID NO: 1868229 - protein, 20 aa, Staphylococcus
YASTLTIGKDASNSFDKSQV

SEQ ID NO: 1868230 - protein, 18 aa, Staphylococcus
YATGEKAQTESLKINENA

SEQ ID NO: 1868231 - protein, 19 aa, Staphylococcus
YATGKDAKVDPLKISDNAS

SEQ ID NO: 1868232 - protein, 4 aa, Staphylococcus
YATK

SEQ ID NO: 1868233 - protein, 4 aa, Staphylococcus
YATQ

SEQ ID NO: 1868234 - protein, 13 aa, Staphylococcus
YAYDSDTDNNQAF

SEQ ID NO: 1868235 - protein, 7 aa, Staphylococcus
YDAPRYK

SEQ ID NO: 1868236 - protein, 23 aa, Staphylococcus
YDAQPKQSEEDQATRKQQELKHK

SEQ ID NO: 1868237 - protein, 8 aa, Staphylococcus
YDDGKYGQ

SEQ ID NO: 1868238 - protein, 17 aa, Staphylococcus
YDDGTDMDKAEEDLKKE

SEQ ID NO: 1868239 - protein, 4 aa, Staphylococcus
YDDI

SEQ ID NO: 1868240 - protein, 9 aa, Staphylococcus
YDDSKYGQI

SEQ ID NO: 1868241 - protein, 4 aa, Staphylococcus
YDDV

SEQ ID NO: 1868242 - protein, 53 aa, Staphylococcus
YDEDGNGTIDTTSAENAWVPENSGATTWPEQTSPKANELTEQGYHETTTPSVA

SEQ ID NO: 1868243 - protein, 13 aa, Staphylococcus
YDEDNAINAQKEV

SEQ ID NO: 1868244 - protein, 6 aa, Staphylococcus
YDEMGG

SEQ ID NO: 1868245 - protein, 7 aa, Staphylococcus
YDEMGGE

SEQ ID NO: 1868246 - protein, 4 aa, Staphylococcus
YDEQ

SEQ ID NO: 1868247 - protein, 7 aa, Staphylococcus
YDETSSC

SEQ ID NO: 1868248 - protein, 7 aa, Staphylococcus
YDEVNGN

SEQ ID NO: 1868249 - protein, 4 aa, Staphylococcus
YDGE

SEQ ID NO: 1868250 - protein, 12 aa, Staphylococcus
YDGQENVAPKQW

SEQ ID NO: 1868251 - protein, 7 aa, Staphylococcus
YDHSQNS

SEQ ID NO: 1868252 - protein, 9 aa, Staphylococcus
YDIDPRKSA

SEQ ID NO: 1868253 - protein, 7 aa, Staphylococcus
YDIKDQN

SEQ ID NO: 1868254 - protein, 12 aa, Staphylococcus
YDIKNKKGALPL

SEQ ID NO: 1868255 - protein, 13 aa, Staphylococcus
YDIKNKKGAQPIE

SEQ ID NO: 1868256 - protein, 5 aa, Staphylococcus
YDINP

SEQ ID NO: 1868257 - protein, 12 aa, Staphylococcus
YDKEKGKKYLES

SEQ ID NO: 1868258 - protein, 12 aa, Staphylococcus
YDKEKGQKYLES

SEQ ID NO: 1868259 - protein, 12 aa, Staphylococcus
YDKEKGQKYLNS

SEQ ID NO: 1868260 - protein, 13 aa, Staphylococcus
YDKGQEKQQGREH

SEQ ID NO: 1868261 - protein, 12 aa, Staphylococcus
YDKKQGQEYLKS

SEQ ID NO: 1868262 - protein, 8 aa, Staphylococcus
YDKMQSKE

SEQ ID NO: 1868263 - protein, 18 aa, Staphylococcus
YDKSATSLSDKSRDNVKD

SEQ ID NO: 1868264 - protein, 12 aa, Staphylococcus
YDNDAYTRTESV

SEQ ID NO: 1868265 - protein, 4 aa, Staphylococcus
YDNE

SEQ ID NO: 1868266 - protein, 7 aa, Staphylococcus
YDNHPEL

SEQ ID NO: 1868267 - protein, 29 aa, Staphylococcus
YDNKNNEPMTEKPKDFEKRKQQSEKDLQM

SEQ ID NO: 1868268 - protein, 6 aa, Staphylococcus
YDNNNQ

SEQ ID NO: 1868269 - protein, 10 aa, Staphylococcus
YDPQENAQSQ

SEQ ID NO: 1868270 - protein, 7 aa, Staphylococcus
YDQLKGK

SEQ ID NO: 1868271 - protein, 7 aa, Staphylococcus
YDQSQNT

SEQ ID NO: 1868272 - protein, 8 aa, Staphylococcus
YDQVRQPN

SEQ ID NO: 1868273 - protein, 6 aa, Staphylococcus
YDRAYS

SEQ ID NO: 1868274 - protein, 5 aa, Staphylococcus
YDSEE

SEQ ID NO: 1868275 - protein, 13 aa, Staphylococcus
YDSNDLKSPLDRE

SEQ ID NO: 1868276 - protein, 9 aa, Staphylococcus
YDSNNPTDL

SEQ ID NO: 1868277 - protein, 5 aa, Staphylococcus
YDSNT

SEQ ID NO: 1868278 - protein, 29 aa, Staphylococcus
YDSQNQVLGPVRKSNSYDQSQSNTSNYDS

SEQ ID NO: 1868279 - protein, 9 aa, Staphylococcus
YDSSRFPDF

SEQ ID NO: 1868280 - protein, 12 aa, Staphylococcus
YDTENVDAHDYS

SEQ ID NO: 1868281 - protein, 4 aa, Staphylococcus
YDTI

SEQ ID NO: 1868282 - protein, 10 aa, Staphylococcus
YDTKKAKKLL

SEQ ID NO: 1868283 - protein, 65 aa, Staphylococcus
YDTNNSKRQQLANKVDQAQQQVNDDYQKINQSPNNNQLQSKLTQDQSSLNEAQQQLAQHDKQMND

SEQ ID NO: 1868284 - protein, 69 aa, Staphylococcus
YDTNTSKRQSMANKVNQAQQQVNKDVTQINQTPNDQSLQTKLTEDQSALSEAQQQLAQYDKQVNDSTVA

SEQ ID NO: 1868285 - protein, 11 aa, Staphylococcus
YDTSGNSRQQL

SEQ ID NO: 1868286 - protein, 10 aa, Staphylococcus
YDVETDKSEL

SEQ ID NO: 1868287 - protein, 11 aa, Staphylococcus
YDVKDEPYAKP

SEQ ID NO: 1868288 - protein, 13 aa, Staphylococcus
YDVTTNQTAAANQ

SEQ ID NO: 1868289 - protein, 12 aa, Staphylococcus
YEAGDGKAGAQH

SEQ ID NO: 1868290 - protein, 6 aa, Staphylococcus
YEAHPK

SEQ ID NO: 1868291 - protein, 14 aa, Staphylococcus
YEATGTEDVEFTEG

SEQ ID NO: 1868292 - protein, 5 aa, Staphylococcus
YEATT

SEQ ID NO: 1868293 - protein, 11 aa, Staphylococcus
YEDEKGDLKID

SEQ ID NO: 1868294 - protein, 9 aa, Staphylococcus
YEDENGDLN

SEQ ID NO: 1868295 - protein, 43 aa, Staphylococcus
YEEEPTQYNDEEEYIESPRKTKKSERRIRRKPSSDYNEREHDY

SEQ ID NO: 1868296 - protein, 6 aa, Staphylococcus
YEEGRL

SEQ ID NO: 1868297 - protein, 11 aa, Staphylococcus
YEEKPQKEDDP

SEQ ID NO: 1868298 - protein, 6 aa, Staphylococcus
YEEMGG

SEQ ID NO: 1868299 - protein, 18 aa, Staphylococcus
YEEMPDLSGKTEKEAEQI

SEQ ID NO: 1868300 - protein, 10 aa, Staphylococcus
YEENGELKTY

SEQ ID NO: 1868301 - protein, 6 aa, Staphylococcus
YEERQK

SEQ ID NO: 1868302 - protein, 5 aa, Staphylococcus
YEEVE

SEQ ID NO: 1868303 - protein, 23 aa, Staphylococcus
YEGKIGPSEVLGGSSSEFSPTQL

SEQ ID NO: 1868304 - protein, 9 aa, Staphylococcus
YEGSSITEK

SEQ ID NO: 1868305 - protein, 8 aa, Staphylococcus
YEGSTITK

SEQ ID NO: 1868306 - protein, 8 aa, Staphylococcus
YEGSTLTE

SEQ ID NO: 1868307 - protein, 8 aa, Staphylococcus
YEGYTQAE

SEQ ID NO: 1868308 - protein, 25 aa, Staphylococcus
YEKEKNQGTKKGKNTQVVSKNNKKK

SEQ ID NO: 1868309 - protein, 11 aa, Staphylococcus
YEKGTQSYVDP

SEQ ID NO: 1868310 - protein, 5 aa, Staphylococcus
YEKKN

SEQ ID NO: 1868311 - protein, 7 aa, Staphylococcus
YEKLTGG

SEQ ID NO: 1868312 - protein, 11 aa, Staphylococcus
YEKPPASDKDP

SEQ ID NO: 1868313 - protein, 11 aa, Staphylococcus
YEKPPEKDKDP

SEQ ID NO: 1868314 - protein, 11 aa, Staphylococcus
YEKPPQKDKDP

SEQ ID NO: 1868315 - protein, 13 aa, Staphylococcus
YEKPPQKDKDPIT

SEQ ID NO: 1868316 - protein, 17 aa, Staphylococcus
YEKRSGRNSLLSESPSD

SEQ ID NO: 1868317 - protein, 7 aa, Staphylococcus
YENEDKV

SEQ ID NO: 1868318 - protein, 15 aa, Staphylococcus
YENKNYQNAKKELES

SEQ ID NO: 1868319 - protein, 17 aa, Staphylococcus
YENKNYQTAKKELEKNG

SEQ ID NO: 1868320 - protein, 17 aa, Staphylococcus
YENKSYSTAKKELESKG

SEQ ID NO: 1868321 - protein, 8 aa, Staphylococcus
YENTQSKK

SEQ ID NO: 1868322 - protein, 12 aa, Staphylococcus
YENTTSTKQLAR

SEQ ID NO: 1868323 - protein, 21 aa, Staphylococcus
YENVTNDYPISVNGDNTAPIN

SEQ ID NO: 1868324 - protein, 23 aa, Staphylococcus
YEPINPDSQEGRVNERIKKQKED

SEQ ID NO: 1868325 - protein, 11 aa, Staphylococcus
YEPQKNKQNRI

SEQ ID NO: 1868326 - protein, 6 aa, Staphylococcus
YEPVEN

SEQ ID NO: 1868327 - protein, 39 aa, Staphylococcus
YEQPRDNKEYRNTRRKRRKERQQREAYEAEHQYEPQQHD

SEQ ID NO: 1868328 - protein, 5 aa, Staphylococcus
YERDQ

SEQ ID NO: 1868329 - protein, 7 aa, Staphylococcus
YESEDRY

SEQ ID NO: 1868330 - protein, 7 aa, Staphylococcus
YESGGEA

SEQ ID NO: 1868331 - protein, 12 aa, Staphylococcus
YESKKEKKTQLR

SEQ ID NO: 1868332 - protein, 13 aa, Staphylococcus
YESNKEKKEQLKS

SEQ ID NO: 1868333 - protein, 5 aa, Staphylococcus
YESNL

SEQ ID NO: 1868334 - protein, 7 aa, Staphylococcus
YESNPKK

SEQ ID NO: 1868335 - protein, 14 aa, Staphylococcus
YESSIADDTPEGRS

SEQ ID NO: 1868336 - protein, 14 aa, Staphylococcus
YESTNNKSVGFTEG

SEQ ID NO: 1868337 - protein, 7 aa, Staphylococcus
YETGETL

SEQ ID NO: 1868338 - protein, 10 aa, Staphylococcus
YETHGKAALE

SEQ ID NO: 1868339 - protein, 4 aa, Staphylococcus
YETM

SEQ ID NO: 1868340 - protein, 9 aa, Staphylococcus
YETTPSNVL

SEQ ID NO: 1868341 - protein, 4 aa, Staphylococcus
YETY

SEQ ID NO: 1868342 - protein, 12 aa, Staphylococcus
YEVTTNNDTLSE

SEQ ID NO: 1868343 - protein, 5 aa, Staphylococcus
YEYNG

SEQ ID NO: 1868344 - protein, 13 aa, Staphylococcus
YFKTGGHKNARNT

SEQ ID NO: 1868345 - protein, 12 aa, Staphylococcus
YFNQDGKVRIDD

SEQ ID NO: 1868346 - protein, 5 aa, Staphylococcus
YFPKK

SEQ ID NO: 1868347 - protein, 13 aa, Staphylococcus
YFPKKDYGDGHTP

SEQ ID NO: 1868348 - protein, 23 aa, Staphylococcus
YFPKKRQHKGKSAIQIASSGPAF

SEQ ID NO: 1868349 - protein, 7 aa, Staphylococcus
YFSDKSK

SEQ ID NO: 1868350 - protein, 7 aa, Staphylococcus
YFSKQEK

SEQ ID NO: 1868351 - protein, 12 aa, Staphylococcus
YGADTRAEVTQA

SEQ ID NO: 1868352 - protein, 22 aa, Staphylococcus
YGAQLKQNDETQHKRKAQALAH

SEQ ID NO: 1868353 - protein, 8 aa, Staphylococcus
YGDEDSNY

SEQ ID NO: 1868354 - protein, 9 aa, Staphylococcus
YGDNPISNL

SEQ ID NO: 1868355 - protein, 5 aa, Staphylococcus
YGEAR

SEQ ID NO: 1868356 - protein, 38 aa, Staphylococcus
YGEDYSSLQQSAKDLKAVSVKENKNGYTISKSKSTSGY

SEQ ID NO: 1868357 - protein, 18 aa, Staphylococcus
YGEDYSTLKKASKELTPV

SEQ ID NO: 1868358 - protein, 9 aa, Staphylococcus
YGENISGDD

SEQ ID NO: 1868359 - protein, 10 aa, Staphylococcus
YGETDSDGRY

SEQ ID NO: 1868360 - protein, 4 aa, Staphylococcus
YGGP

SEQ ID NO: 1868361 - protein, 6 aa, Staphylococcus
YGGPNM

SEQ ID NO: 1868362 - protein, 6 aa, Staphylococcus
YGGPTM

SEQ ID NO: 1868363 - protein, 10 aa, Staphylococcus
YGGSALVGQS

SEQ ID NO: 1868364 - protein, 9 aa, Staphylococcus
YGGSKFGEY

SEQ ID NO: 1868365 - protein, 7 aa, Staphylococcus
YGGSKIS

SEQ ID NO: 1868366 - protein, 5 aa, Staphylococcus
YGGTD

SEQ ID NO: 1868367 - protein, 7 aa, Staphylococcus
YGGTDGI

SEQ ID NO: 1868368 - protein, 12 aa, Staphylococcus
YGIEENDSNQNY

SEQ ID NO: 1868369 - protein, 4 aa, Staphylococcus
YGIS

SEQ ID NO: 1868370 - protein, 17 aa, Staphylococcus
YGKDTVGDKATQFDTNS

SEQ ID NO: 1868371 - protein, 10 aa, Staphylococcus
YGKETEDAIK

SEQ ID NO: 1868372 - protein, 6 aa, Staphylococcus
YGKGKQ

SEQ ID NO: 1868373 - protein, 18 aa, Staphylococcus
YGKMKGKTYKKSYNINNR

SEQ ID NO: 1868374 - protein, 24 aa, Staphylococcus
YGKQAKKEAAKLKDQLELNQANKT

SEQ ID NO: 1868375 - protein, 4 aa, Staphylococcus
YGLD

SEQ ID NO: 1868376 - protein, 6 aa, Staphylococcus
YGNGKE

SEQ ID NO: 1868377 - protein, 6 aa, Staphylococcus
YGNINE

SEQ ID NO: 1868378 - protein, 6 aa, Staphylococcus
YGPQMS

SEQ ID NO: 1868379 - protein, 5 aa, Staphylococcus
YGPRP

SEQ ID NO: 1868380 - protein, 6 aa, Staphylococcus
YGPYPV

SEQ ID NO: 1868381 - protein, 4 aa, Staphylococcus
YGQA

SEQ ID NO: 1868382 - protein, 4 aa, Staphylococcus
YGQN

SEQ ID NO: 1868383 - protein, 66 aa, Staphylococcus
YGQNQPDAESMHTTQELEQSYSDDYHETERDIEKNESSNDINSTANKTKTDTKKHKNKDKKSKENW

SEQ ID NO: 1868384 - protein, 4 aa, Staphylococcus
YGQR

SEQ ID NO: 1868385 - protein, 9 aa, Staphylococcus
YGRGISAKD

SEQ ID NO: 1868386 - protein, 10 aa, Staphylococcus
YGRGISKKDM

SEQ ID NO: 1868387 - protein, 8 aa, Staphylococcus
YGSASTPF

SEQ ID NO: 1868388 - protein, 8 aa, Staphylococcus
YGSAYGHG

SEQ ID NO: 1868389 - protein, 6 aa, Staphylococcus
YGSGKE

SEQ ID NO: 1868390 - protein, 5 aa, Staphylococcus
YGSKL

SEQ ID NO: 1868391 - protein, 16 aa, Staphylococcus
YGSNSHSQATDAFTSN

SEQ ID NO: 1868392 - protein, 5 aa, Staphylococcus
YGSTT

SEQ ID NO: 1868393 - protein, 8 aa, Staphylococcus
YGTDYEAT

SEQ ID NO: 1868394 - protein, 7 aa, Staphylococcus
YGTLNPS

SEQ ID NO: 1868395 - protein, 5 aa, Staphylococcus
YGTNQ

SEQ ID NO: 1868396 - protein, 9 aa, Staphylococcus
YGTQALRPI

SEQ ID NO: 1868397 - protein, 28 aa, Staphylococcus
YGYANTSTKVKATPKTRYEIASNTKAFT

SEQ ID NO: 1868398 - protein, 4 aa, Staphylococcus
YGYQ

SEQ ID NO: 1868399 - protein, 129 aa, Staphylococcus
YHAGSGNGDGIDKPVIPDQPGDSDSDADSDSDADSDSDADSDSDADSDSDADSDSDADSDSDADSDSDADSDSDADSDSDADSDSDADSDSDADSDSNSGSDSNVDSDSDSENDNVSVEVDNNSNQRGI

SEQ ID NO: 1868400 - protein, 5 aa, Staphylococcus
YHDER

SEQ ID NO: 1868401 - protein, 5 aa, Staphylococcus
YHDKR

SEQ ID NO: 1868402 - protein, 4 aa, Staphylococcus
YHKT

SEQ ID NO: 1868403 - protein, 12 aa, Staphylococcus
YHLGDENKNVKT

SEQ ID NO: 1868404 - protein, 8 aa, Staphylococcus
YHSDDKEV

SEQ ID NO: 1868405 - protein, 12 aa, Staphylococcus
YHTENKQLQNHQ

SEQ ID NO: 1868406 - protein, 6 aa, Staphylococcus
YHTPNP

SEQ ID NO: 1868407 - protein, 12 aa, Staphylococcus
YHVTSSSTIQNP

SEQ ID NO: 1868408 - protein, 5 aa, Staphylococcus
YIDGS

SEQ ID NO: 1868409 - protein, 12 aa, Staphylococcus
YIDSETEEQIQD

SEQ ID NO: 1868410 - protein, 11 aa, Staphylococcus
YISEQSSASIN

SEQ ID NO: 1868411 - protein, 10 aa, Staphylococcus
YITKNGSNLE

SEQ ID NO: 1868412 - protein, 4 aa, Staphylococcus
YITS

SEQ ID NO: 1868413 - protein, 7 aa, Staphylococcus
YKAEQSP

SEQ ID NO: 1868414 - protein, 16 aa, Staphylococcus
YKASAAEAMKKDDGNF

SEQ ID NO: 1868415 - protein, 10 aa, Staphylococcus
YKDDRQVNKY

SEQ ID NO: 1868416 - protein, 13 aa, Staphylococcus
YKDEKRKESYTYS

SEQ ID NO: 1868417 - protein, 6 aa, Staphylococcus
YKDGDI

SEQ ID NO: 1868418 - protein, 10 aa, Staphylococcus
YKDNKDDTEI

SEQ ID NO: 1868419 - protein, 15 aa, Staphylococcus
YKEDIESAKNQNEIK

SEQ ID NO: 1868420 - protein, 9 aa, Staphylococcus
YKEKYSPNW

SEQ ID NO: 1868421 - protein, 14 aa, Staphylococcus
YKENDKPEQNDIEI

SEQ ID NO: 1868422 - protein, 13 aa, Staphylococcus
YKEREKERKFDNE

SEQ ID NO: 1868423 - protein, 13 aa, Staphylococcus
YKESAAQAMEDDG

SEQ ID NO: 1868424 - protein, 10 aa, Staphylococcus
YKGDTDEAIE

SEQ ID NO: 1868425 - protein, 9 aa, Staphylococcus
YKGNSDASI

SEQ ID NO: 1868426 - protein, 13 aa, Staphylococcus
YKHQNQDKLSEAA

SEQ ID NO: 1868427 - protein, 12 aa, Staphylococcus
YKKESDKAKVKM

SEQ ID NO: 1868428 - protein, 18 aa, Staphylococcus
YKKGVKDMKGRAAINDDN

SEQ ID NO: 1868429 - protein, 8 aa, Staphylococcus
YKKKSDHM

SEQ ID NO: 1868430 - protein, 4 aa, Staphylococcus
YKKP

SEQ ID NO: 1868431 - protein, 9 aa, Staphylococcus
YKKQAQAAA

SEQ ID NO: 1868432 - protein, 15 aa, Staphylococcus
YKKTDELRDKEQDLR

SEQ ID NO: 1868433 - protein, 10 aa, Staphylococcus
YKKTREPYFS

SEQ ID NO: 1868434 - protein, 7 aa, Staphylococcus
YKLPGGK

SEQ ID NO: 1868435 - protein, 7 aa, Staphylococcus
YKNDITT

SEQ ID NO: 1868436 - protein, 12 aa, Staphylococcus
YKNDNREKEEIH

SEQ ID NO: 1868437 - protein, 26 aa, Staphylococcus
YKNEETTQTAHNKEENQPEESTKNQE

SEQ ID NO: 1868438 - protein, 12 aa, Staphylococcus
YKNGKSDFEPST

SEQ ID NO: 1868439 - protein, 7 aa, Staphylococcus
YKNGMDN

SEQ ID NO: 1868440 - protein, 5 aa, Staphylococcus
YKNKP

SEQ ID NO: 1868441 - protein, 12 aa, Staphylococcus
YKNLGGEKQRNM

SEQ ID NO: 1868442 - protein, 22 aa, Staphylococcus
YKNNAKDLADKQRLSDQKHVEN

SEQ ID NO: 1868443 - protein, 10 aa, Staphylococcus
YKNNSSEYYE

SEQ ID NO: 1868444 - protein, 7 aa, Staphylococcus
YKNQTED

SEQ ID NO: 1868445 - protein, 7 aa, Staphylococcus
YKNSGRT

SEQ ID NO: 1868446 - protein, 8 aa, Staphylococcus
YKPEEGPG

SEQ ID NO: 1868447 - protein, 9 aa, Staphylococcus
YKPKKEDVV

SEQ ID NO: 1868448 - protein, 13 aa, Staphylococcus
YKPLAKRAKDTAA

SEQ ID NO: 1868449 - protein, 4 aa, Staphylococcus
YKQS

SEQ ID NO: 1868450 - protein, 10 aa, Staphylococcus
YKQYNKKSDQ

SEQ ID NO: 1868451 - protein, 9 aa, Staphylococcus
YKRETQDNV

SEQ ID NO: 1868452 - protein, 32 aa, Staphylococcus
YKRTSTLTAMSSASGKQDLNHADDEGEIDDDE

SEQ ID NO: 1868453 - protein, 6 aa, Staphylococcus
YKSKQR

SEQ ID NO: 1868454 - protein, 22 aa, Staphylococcus
YKSNAKALAEKQHLSNQKQTKN

SEQ ID NO: 1868455 - protein, 8 aa, Staphylococcus
YKSNSSQK

SEQ ID NO: 1868456 - protein, 4 aa, Staphylococcus
YKSS

SEQ ID NO: 1868457 - protein, 8 aa, Staphylococcus
YKTKPKDT

SEQ ID NO: 1868458 - protein, 24 aa, Staphylococcus
YKTKSFDDIQSAANKIKDNKTTIK

SEQ ID NO: 1868459 - protein, 8 aa, Staphylococcus
YKTKVKDG

SEQ ID NO: 1868460 - protein, 4 aa, Staphylococcus
YKTP

SEQ ID NO: 1868461 - protein, 8 aa, Staphylococcus
YKTQVKEG

SEQ ID NO: 1868462 - protein, 8 aa, Staphylococcus
YKTTDGEV

SEQ ID NO: 1868463 - protein, 10 aa, Staphylococcus
YKVGDQKHNR

SEQ ID NO: 1868464 - protein, 9 aa, Staphylococcus
YKVQRSKAS

SEQ ID NO: 1868465 - protein, 9 aa, Staphylococcus
YKYPTPIEQ

SEQ ID NO: 1868466 - protein, 9 aa, Staphylococcus
YKYPTPLEQ

SEQ ID NO: 1868467 - protein, 14 aa, Staphylococcus
YLDDEEDAGPPKRN

SEQ ID NO: 1868468 - protein, 6 aa, Staphylococcus
YLKKGG

SEQ ID NO: 1868469 - protein, 11 aa, Staphylococcus
YLNSDKGSHDI

SEQ ID NO: 1868470 - protein, 6 aa, Staphylococcus
YLPGGD

SEQ ID NO: 1868471 - protein, 20 aa, Staphylococcus
YLSNRQKLENTRKAIKNNKF

SEQ ID NO: 1868472 - protein, 12 aa, Staphylococcus
YNDGSTQEITET

SEQ ID NO: 1868473 - protein, 4 aa, Staphylococcus
YNDN

SEQ ID NO: 1868474 - protein, 15 aa, Staphylococcus
YNDNDKGTVNAQKDI

SEQ ID NO: 1868475 - protein, 6 aa, Staphylococcus
YNDNES

SEQ ID NO: 1868476 - protein, 26 aa, Staphylococcus
YNDNTSSNVYSKTTYQKDKSQNSISK

SEQ ID NO: 1868477 - protein, 15 aa, Staphylococcus
YNDRQKKRLDVRPGI

SEQ ID NO: 1868478 - protein, 4 aa, Staphylococcus
YNDT

SEQ ID NO: 1868479 - protein, 8 aa, Staphylococcus
YNEDESTI

SEQ ID NO: 1868480 - protein, 37 aa, Staphylococcus
YNEERKEEIEEDSDDDKNHKDKHHKDKKEKKDRKDKE

SEQ ID NO: 1868481 - protein, 6 aa, Staphylococcus
YNEGYD

SEQ ID NO: 1868482 - protein, 13 aa, Staphylococcus
YNEKGSVNAQKDI

SEQ ID NO: 1868483 - protein, 7 aa, Staphylococcus
YNELNTK

SEQ ID NO: 1868484 - protein, 8 aa, Staphylococcus
YNENEQEV

SEQ ID NO: 1868485 - protein, 11 aa, Staphylococcus
YNEPDDRKPNQ

SEQ ID NO: 1868486 - protein, 13 aa, Staphylococcus
YNEPDYQQQPPIY

SEQ ID NO: 1868487 - protein, 7 aa, Staphylococcus
YNEPEEF

SEQ ID NO: 1868488 - protein, 20 aa, Staphylococcus
YNETNSTIESSTKNVKPRGN

SEQ ID NO: 1868489 - protein, 7 aa, Staphylococcus
YNGADSQ

SEQ ID NO: 1868490 - protein, 12 aa, Staphylococcus
YNGDESNQFDNQ

SEQ ID NO: 1868491 - protein, 7 aa, Staphylococcus
YNGLTSE

SEQ ID NO: 1868492 - protein, 5 aa, Staphylococcus
YNIPP

SEQ ID NO: 1868493 - protein, 11 aa, Staphylococcus
YNKNDESGKMH

SEQ ID NO: 1868494 - protein, 16 aa, Staphylococcus
YNKNDKTVEIGQDVGN

SEQ ID NO: 1868495 - protein, 16 aa, Staphylococcus
YNKNDQTVEIGQDVGN

SEQ ID NO: 1868496 - protein, 18 aa, Staphylococcus
YNKQAKEKYDFNTEVTGQ

SEQ ID NO: 1868497 - protein, 10 aa, Staphylococcus
YNKQAQDNYD

SEQ ID NO: 1868498 - protein, 10 aa, Staphylococcus
YNKSSNTYGP

SEQ ID NO: 1868499 - protein, 9 aa, Staphylococcus
YNKSTNRSQ

SEQ ID NO: 1868500 - protein, 12 aa, Staphylococcus
YNKTAKEKYDFN

SEQ ID NO: 1868501 - protein, 9 aa, Staphylococcus
YNLPDNAAK

SEQ ID NO: 1868502 - protein, 13 aa, Staphylococcus
YNNGSSDKNADKG

SEQ ID NO: 1868503 - protein, 13 aa, Staphylococcus
YNNGTDMDKAEEV

SEQ ID NO: 1868504 - protein, 24 aa, Staphylococcus
YNNKTPYTKDTKIDELKDEFNNKK

SEQ ID NO: 1868505 - protein, 14 aa, Staphylococcus
YNNLGGEKERNKMG

SEQ ID NO: 1868506 - protein, 11 aa, Staphylococcus
YNNSTYRTGVD

SEQ ID NO: 1868507 - protein, 17 aa, Staphylococcus
YNPKNGYAYSVNGDKEA

SEQ ID NO: 1868508 - protein, 8 aa, Staphylococcus
YNQDSKYI

SEQ ID NO: 1868509 - protein, 6 aa, Staphylococcus
YNQGGV

SEQ ID NO: 1868510 - protein, 8 aa, Staphylococcus
YNQHRNEL

SEQ ID NO: 1868511 - protein, 19 aa, Staphylococcus
YNQLTSEADGFKEDDAQYA

SEQ ID NO: 1868512 - protein, 20 aa, Staphylococcus
YNQLTSSSGDKFNSSTAKYA

SEQ ID NO: 1868513 - protein, 8 aa, Staphylococcus
YNQNQAQK

SEQ ID NO: 1868514 - protein, 4 aa, Staphylococcus
YNQR

SEQ ID NO: 1868515 - protein, 5 aa, Staphylococcus
YNQTK

SEQ ID NO: 1868516 - protein, 10 aa, Staphylococcus
YNRHNRDEDI

SEQ ID NO: 1868517 - protein, 7 aa, Staphylococcus
YNSEEAT

SEQ ID NO: 1868518 - protein, 4 aa, Staphylococcus
YNSG

SEQ ID NO: 1868519 - protein, 14 aa, Staphylococcus
YNSGVKYAEKHAKD

SEQ ID NO: 1868520 - protein, 6 aa, Staphylococcus
YNSLSQ

SEQ ID NO: 1868521 - protein, 7 aa, Staphylococcus
YNSNEKI

SEQ ID NO: 1868522 - protein, 8 aa, Staphylococcus
YNSPDAQT

SEQ ID NO: 1868523 - protein, 16 aa, Staphylococcus
YNSRMSSFGSQREYKD

SEQ ID NO: 1868524 - protein, 6 aa, Staphylococcus
YNSRMT

SEQ ID NO: 1868525 - protein, 7 aa, Staphylococcus
YNSRMTS

SEQ ID NO: 1868526 - protein, 15 aa, Staphylococcus
YNSRMTSYGTQREYK

SEQ ID NO: 1868527 - protein, 12 aa, Staphylococcus
YNTEDVDAHDYS

SEQ ID NO: 1868528 - protein, 12 aa, Staphylococcus
YNTENVDAHDYS

SEQ ID NO: 1868529 - protein, 8 aa, Staphylococcus
YNTKPVKE

SEQ ID NO: 1868530 - protein, 9 aa, Staphylococcus
YNTKPVSEQ

SEQ ID NO: 1868531 - protein, 7 aa, Staphylococcus
YNTKTKA

SEQ ID NO: 1868532 - protein, 4 aa, Staphylococcus
YNVE

SEQ ID NO: 1868533 - protein, 15 aa, Staphylococcus
YNVTDGETNANGTPH

SEQ ID NO: 1868534 - protein, 18 aa, Staphylococcus
YNVTDGGTTSSGKPSMIK

SEQ ID NO: 1868535 - protein, 12 aa, Staphylococcus
YNYKQKSEIQED

SEQ ID NO: 1868536 - protein, 5 aa, Staphylococcus
YNYPY

SEQ ID NO: 1868537 - protein, 6 aa, Staphylococcus
YPAQSK

SEQ ID NO: 1868538 - protein, 21 aa, Staphylococcus
YPASTVAKTAGEKRGINQARE

SEQ ID NO: 1868539 - protein, 12 aa, Staphylococcus
YPDGSKDKTTVT

SEQ ID NO: 1868540 - protein, 6 aa, Staphylococcus
YPDKKA

SEQ ID NO: 1868541 - protein, 5 aa, Staphylococcus
YPDNK

SEQ ID NO: 1868542 - protein, 13 aa, Staphylococcus
YPEDNKRISEEEL

SEQ ID NO: 1868543 - protein, 6 aa, Staphylococcus
YPENYR

SEQ ID NO: 1868544 - protein, 4 aa, Staphylococcus
YPEQ

SEQ ID NO: 1868545 - protein, 8 aa, Staphylococcus
YPGDDTRH

SEQ ID NO: 1868546 - protein, 33 aa, Staphylococcus
YPGGYGPYDRDYDYGRDDYYNHGEHDRGSRRHE

SEQ ID NO: 1868547 - protein, 17 aa, Staphylococcus
YPGNNKTHLKQAKTGGA

SEQ ID NO: 1868548 - protein, 5 aa, Staphylococcus
YPHPD

SEQ ID NO: 1868549 - protein, 8 aa, Staphylococcus
YPHPDKPV

SEQ ID NO: 1868550 - protein, 8 aa, Staphylococcus
YPKDERKT

SEQ ID NO: 1868551 - protein, 50 aa, Staphylococcus
YPKDPEDDDIKTSPAAKAQTEEKEVHEKTSAEKESTETSEEAEERPTSSV

SEQ ID NO: 1868552 - protein, 9 aa, Staphylococcus
YPKGQRKTY

SEQ ID NO: 1868553 - protein, 8 aa, Staphylococcus
YPKNERRS

SEQ ID NO: 1868554 - protein, 12 aa, Staphylococcus
YPKSKRNSNIKP

SEQ ID NO: 1868555 - protein, 6 aa, Staphylococcus
YPKVTT

SEQ ID NO: 1868556 - protein, 10 aa, Staphylococcus
YPLGKGSRKR

SEQ ID NO: 1868557 - protein, 9 aa, Staphylococcus
YPNDSGDIT

SEQ ID NO: 1868558 - protein, 9 aa, Staphylococcus
YPNESGTIT

SEQ ID NO: 1868559 - protein, 5 aa, Staphylococcus
YPNKE

SEQ ID NO: 1868560 - protein, 11 aa, Staphylococcus
YPNKKKQYLTD

SEQ ID NO: 1868561 - protein, 17 aa, Staphylococcus
YPNNLGGVAGDKTVGPI

SEQ ID NO: 1868562 - protein, 5 aa, Staphylococcus
YPNTE

SEQ ID NO: 1868563 - protein, 8 aa, Staphylococcus
YPPGRYSD

SEQ ID NO: 1868564 - protein, 4 aa, Staphylococcus
YPRH

SEQ ID NO: 1868565 - protein, 9 aa, Staphylococcus
YPSSDGITK

SEQ ID NO: 1868566 - protein, 9 aa, Staphylococcus
YPSSPHTIS

SEQ ID NO: 1868567 - protein, 11 aa, Staphylococcus
YPTIKDGEQVV

SEQ ID NO: 1868568 - protein, 10 aa, Staphylococcus
YPTKKEQNRL

SEQ ID NO: 1868569 - protein, 10 aa, Staphylococcus
YPTQKEQSRL

SEQ ID NO: 1868570 - protein, 8 aa, Staphylococcus
YPTSDGIT

SEQ ID NO: 1868571 - protein, 7 aa, Staphylococcus
YPTSGGI

SEQ ID NO: 1868572 - protein, 11 aa, Staphylococcus
YPVRSKEHKQR

SEQ ID NO: 1868573 - protein, 5 aa, Staphylococcus
YPYGD

SEQ ID NO: 1868574 - protein, 5 aa, Staphylococcus
YQAEQ

SEQ ID NO: 1868575 - protein, 10 aa, Staphylococcus
YQANDALPKI

SEQ ID NO: 1868576 - protein, 12 aa, Staphylococcus
YQASDSIDETKK

SEQ ID NO: 1868577 - protein, 15 aa, Staphylococcus
YQASDSMDETKKSLW

SEQ ID NO: 1868578 - protein, 15 aa, Staphylococcus
YQASDSMEETKKSLW

SEQ ID NO: 1868579 - protein, 15 aa, Staphylococcus
YQASESMEETKKSLW

SEQ ID NO: 1868580 - protein, 12 aa, Staphylococcus
YQASESMSETKK

SEQ ID NO: 1868581 - protein, 22 aa, Staphylococcus
YQATGRGSTLLSGKGAYQQNNT

SEQ ID NO: 1868582 - protein, 10 aa, Staphylococcus
YQDEEGNLKM

SEQ ID NO: 1868583 - protein, 9 aa, Staphylococcus
YQDGQGNLK

SEQ ID NO: 1868584 - protein, 9 aa, Staphylococcus
YQDNEGNLK

SEQ ID NO: 1868585 - protein, 4 aa, Staphylococcus
YQGI

SEQ ID NO: 1868586 - protein, 8 aa, Staphylococcus
YQGKSLES

SEQ ID NO: 1868587 - protein, 7 aa, Staphylococcus
YQGLRKD

SEQ ID NO: 1868588 - protein, 8 aa, Staphylococcus
YQGSDRQR

SEQ ID NO: 1868589 - protein, 10 aa, Staphylococcus
YQHPHQHNKG

SEQ ID NO: 1868590 - protein, 11 aa, Staphylococcus
YQINETGDKQA

SEQ ID NO: 1868591 - protein, 5 aa, Staphylococcus
YQIQT

SEQ ID NO: 1868592 - protein, 7 aa, Staphylococcus
YQKDGSK

SEQ ID NO: 1868593 - protein, 5 aa, Staphylococcus
YQKHG

SEQ ID NO: 1868594 - protein, 16 aa, Staphylococcus
YQKQQEEEKKKKRKKG

SEQ ID NO: 1868595 - protein, 16 aa, Staphylococcus
YQKQQEEEKKKKRKKS

SEQ ID NO: 1868596 - protein, 10 aa, Staphylococcus
YQKQRKAGMK

SEQ ID NO: 1868597 - protein, 10 aa, Staphylococcus
YQKSNHEPTK

SEQ ID NO: 1868598 - protein, 28 aa, Staphylococcus
YQNHPPHYNQNHSNYNVQRASRGKKPTG

SEQ ID NO: 1868599 - protein, 29 aa, Staphylococcus
YQNINTNNDGSALEIDKEKNKKAVKEFLN

SEQ ID NO: 1868600 - protein, 11 aa, Staphylococcus
YQNSKVEQTYE

SEQ ID NO: 1868601 - protein, 6 aa, Staphylococcus
YQPGGG

SEQ ID NO: 1868602 - protein, 15 aa, Staphylococcus
YQPPKYKDVKALPWP

SEQ ID NO: 1868603 - protein, 18 aa, Staphylococcus
YQPPTYKNAGPLSWPKQK

SEQ ID NO: 1868604 - protein, 8 aa, Staphylococcus
YQPQEGPG

SEQ ID NO: 1868605 - protein, 9 aa, Staphylococcus
YQPQSEHSS

SEQ ID NO: 1868606 - protein, 40 aa, Staphylococcus
YQPSPSNKISIATQNNTHHHAKSLNKKRSETSNQSDDQIK

SEQ ID NO: 1868607 - protein, 7 aa, Staphylococcus
YQQIQDD

SEQ ID NO: 1868608 - protein, 4 aa, Staphylococcus
YQQN

SEQ ID NO: 1868609 - protein, 14 aa, Staphylococcus
YQQQRKEGKHPVFN

SEQ ID NO: 1868610 - protein, 15 aa, Staphylococcus
YQQQRKEGKKPVFKP

SEQ ID NO: 1868611 - protein, 6 aa, Staphylococcus
YQSAFG

SEQ ID NO: 1868612 - protein, 22 aa, Staphylococcus
YQSNGSIIQNTTQTVDSNGVAT

SEQ ID NO: 1868613 - protein, 10 aa, Staphylococcus
YQSNTSNDKL

SEQ ID NO: 1868614 - protein, 8 aa, Staphylococcus
YQTDTTGK

SEQ ID NO: 1868615 - protein, 12 aa, Staphylococcus
YQTLRKSAKQLK

SEQ ID NO: 1868616 - protein, 10 aa, Staphylococcus
YQTNEPVSQE

SEQ ID NO: 1868617 - protein, 17 aa, Staphylococcus
YQTSHTDNRKDDQGGER

SEQ ID NO: 1868618 - protein, 19 aa, Staphylococcus
YQTTSKSTLPETGKSISHS

SEQ ID NO: 1868619 - protein, 5 aa, Staphylococcus
YQTYQ

SEQ ID NO: 1868620 - protein, 10 aa, Staphylococcus
YQYPNSPSYA

SEQ ID NO: 1868621 - protein, 6 aa, Staphylococcus
YQYPNT

SEQ ID NO: 1868622 - protein, 11 aa, Staphylococcus
YQYSNSNQNAL

SEQ ID NO: 1868623 - protein, 16 aa, Staphylococcus
YRDDREVKDKFAKNRQ

SEQ ID NO: 1868624 - protein, 13 aa, Staphylococcus
YRDGKEQDIKIKL

SEQ ID NO: 1868625 - protein, 13 aa, Staphylococcus
YRDGKVINIDIKL

SEQ ID NO: 1868626 - protein, 13 aa, Staphylococcus
YRDGNIQDIEINL

SEQ ID NO: 1868627 - protein, 6 aa, Staphylococcus
YRDSSG

SEQ ID NO: 1868628 - protein, 13 aa, Staphylococcus
YREGKSQEIRIKL

SEQ ID NO: 1868629 - protein, 6 aa, Staphylococcus
YRENRT

SEQ ID NO: 1868630 - protein, 8 aa, Staphylococcus
YRGKSPAQ

SEQ ID NO: 1868631 - protein, 4 aa, Staphylococcus
YRGN

SEQ ID NO: 1868632 - protein, 8 aa, Staphylococcus
YRGYDSAG

SEQ ID NO: 1868633 - protein, 14 aa, Staphylococcus
YRKANQEDKFEQNS

SEQ ID NO: 1868634 - protein, 12 aa, Staphylococcus
YRKQQRESANYR

SEQ ID NO: 1868635 - protein, 5 aa, Staphylococcus
YRKTD

SEQ ID NO: 1868636 - protein, 14 aa, Staphylococcus
YRNDSKKFEAQKEA

SEQ ID NO: 1868637 - protein, 13 aa, Staphylococcus
YRNGTEKTIQIKL

SEQ ID NO: 1868638 - protein, 7 aa, Staphylococcus
YRNQKNR

SEQ ID NO: 1868639 - protein, 5 aa, Staphylococcus
YRNQN

SEQ ID NO: 1868640 - protein, 7 aa, Staphylococcus
YRPPTKT

SEQ ID NO: 1868641 - protein, 25 aa, Staphylococcus
YRRESAQVKSNTQANKQQDRYKEHV

SEQ ID NO: 1868642 - protein, 37 aa, Staphylococcus
YRRGSANYKANTVADDANHSYSNSEYSSDHSYTTRVN

SEQ ID NO: 1868643 - protein, 20 aa, Staphylococcus
YRRHTGTTSTPSRRRNKKRL

SEQ ID NO: 1868644 - protein, 5 aa, Staphylococcus
YRSLP

SEQ ID NO: 1868645 - protein, 11 aa, Staphylococcus
YRTNDSQLSSN

SEQ ID NO: 1868646 - protein, 11 aa, Staphylococcus
YRTQPDENGNI

SEQ ID NO: 1868647 - protein, 12 aa, Staphylococcus
YRTQPDKNGNIN

SEQ ID NO: 1868648 - protein, 11 aa, Staphylococcus
YRTQPDNKGNI

SEQ ID NO: 1868649 - protein, 11 aa, Staphylococcus
YRTTASREKWT

SEQ ID NO: 1868650 - protein, 10 aa, Staphylococcus
YSASNPLGGT

SEQ ID NO: 1868651 - protein, 7 aa, Staphylococcus
YSDDTGN

SEQ ID NO: 1868652 - protein, 6 aa, Staphylococcus
YSDEEA

SEQ ID NO: 1868653 - protein, 32 aa, Staphylococcus
YSDGGSTKSTSEQNVQKKTSEENEAKDELQSA

SEQ ID NO: 1868654 - protein, 17 aa, Staphylococcus
YSDGTDMDKAEEQLKKE

SEQ ID NO: 1868655 - protein, 11 aa, Staphylococcus
YSDKTPDIAED

SEQ ID NO: 1868656 - protein, 17 aa, Staphylococcus
YSDNLSYGRPDNNVGPI

SEQ ID NO: 1868657 - protein, 9 aa, Staphylococcus
YSDNRTVRY

SEQ ID NO: 1868658 - protein, 8 aa, Staphylococcus
YSDQESNK

SEQ ID NO: 1868659 - protein, 12 aa, Staphylococcus
YSDQHPNNRSIN

SEQ ID NO: 1868660 - protein, 8 aa, Staphylococcus
YSDTQNEM

SEQ ID NO: 1868661 - protein, 7 aa, Staphylococcus
YSEDIQN

SEQ ID NO: 1868662 - protein, 6 aa, Staphylococcus
YSEDTG

SEQ ID NO: 1868663 - protein, 7 aa, Staphylococcus
YSEDTGG

SEQ ID NO: 1868664 - protein, 8 aa, Staphylococcus
YSEGSYSD

SEQ ID NO: 1868665 - protein, 7 aa, Staphylococcus
YSEGTDQ

SEQ ID NO: 1868666 - protein, 8 aa, Staphylococcus
YSEKKQKV

SEQ ID NO: 1868667 - protein, 11 aa, Staphylococcus
YSEKVKHPQNV

SEQ ID NO: 1868668 - protein, 11 aa, Staphylococcus
YSEKVQHPQTV

SEQ ID NO: 1868669 - protein, 11 aa, Staphylococcus
YSEKVTNPQTV

SEQ ID NO: 1868670 - protein, 8 aa, Staphylococcus
YSENRTIR

SEQ ID NO: 1868671 - protein, 9 aa, Staphylococcus
YSEQKSENI

SEQ ID NO: 1868672 - protein, 4 aa, Staphylococcus
YSEV

SEQ ID NO: 1868673 - protein, 6 aa, Staphylococcus
YSGEDP

SEQ ID NO: 1868674 - protein, 6 aa, Staphylococcus
YSGLTP

SEQ ID NO: 1868675 - protein, 15 aa, Staphylococcus
YSGNAPSHGNQVDYN

SEQ ID NO: 1868676 - protein, 4 aa, Staphylococcus
YSGY

SEQ ID NO: 1868677 - protein, 8 aa, Staphylococcus
YSHKEAQH

SEQ ID NO: 1868678 - protein, 8 aa, Staphylococcus
YSHKEDQH

SEQ ID NO: 1868679 - protein, 9 aa, Staphylococcus
YSHKSGDAV

SEQ ID NO: 1868680 - protein, 4 aa, Staphylococcus
YSHS

SEQ ID NO: 1868681 - protein, 5 aa, Staphylococcus
YSIEE

SEQ ID NO: 1868682 - protein, 10 aa, Staphylococcus
YSKKAKEEVA

SEQ ID NO: 1868683 - protein, 9 aa, Staphylococcus
YSKKENQTG

SEQ ID NO: 1868684 - protein, 8 aa, Staphylococcus
YSKKKKSF

SEQ ID NO: 1868685 - protein, 10 aa, Staphylococcus
YSKKKKSYID

SEQ ID NO: 1868686 - protein, 8 aa, Staphylococcus
YSKKQHQT

SEQ ID NO: 1868687 - protein, 17 aa, Staphylococcus
YSKNKVEPLIGEGSQNF

SEQ ID NO: 1868688 - protein, 6 aa, Staphylococcus
YSKNYA

SEQ ID NO: 1868689 - protein, 8 aa, Staphylococcus
YSKPEKQD

SEQ ID NO: 1868690 - protein, 9 aa, Staphylococcus
YSKPENRDG

SEQ ID NO: 1868691 - protein, 8 aa, Staphylococcus
YSKPENRT

SEQ ID NO: 1868692 - protein, 9 aa, Staphylococcus
YSKPGARSG

SEQ ID NO: 1868693 - protein, 12 aa, Staphylococcus
YSKPRDSDNPNE

SEQ ID NO: 1868694 - protein, 9 aa, Staphylococcus
YSKQGNRTG

SEQ ID NO: 1868695 - protein, 9 aa, Staphylococcus
YSKSSNRDG

SEQ ID NO: 1868696 - protein, 9 aa, Staphylococcus
YSKSSNRNG

SEQ ID NO: 1868697 - protein, 6 aa, Staphylococcus
YSKTDH

SEQ ID NO: 1868698 - protein, 17 aa, Staphylococcus
YSLGGASPMDPTGSTNS

SEQ ID NO: 1868699 - protein, 4 aa, Staphylococcus
YSNA

SEQ ID NO: 1868700 - protein, 16 aa, Staphylococcus
YSNAALTHTTDGENAP

SEQ ID NO: 1868701 - protein, 15 aa, Staphylococcus
YSNEKQVEKNENYKG

SEQ ID NO: 1868702 - protein, 5 aa, Staphylococcus
YSNNI

SEQ ID NO: 1868703 - protein, 9 aa, Staphylococcus
YSNNRELPE

SEQ ID NO: 1868704 - protein, 6 aa, Staphylococcus
YSNPNS

SEQ ID NO: 1868705 - protein, 14 aa, Staphylococcus
YSNSVGAQFGQDAL

SEQ ID NO: 1868706 - protein, 6 aa, Staphylococcus
YSNTGH

SEQ ID NO: 1868707 - protein, 10 aa, Staphylococcus
YSNTTESGKI

SEQ ID NO: 1868708 - protein, 8 aa, Staphylococcus
YSPEEAQS

SEQ ID NO: 1868709 - protein, 5 aa, Staphylococcus
YSPGH

SEQ ID NO: 1868710 - protein, 7 aa, Staphylococcus
YSPGHKV

SEQ ID NO: 1868711 - protein, 8 aa, Staphylococcus
YSPTEGPG

SEQ ID NO: 1868712 - protein, 7 aa, Staphylococcus
YSQQDEK

SEQ ID NO: 1868713 - protein, 7 aa, Staphylococcus
YSRGEKR

SEQ ID NO: 1868714 - protein, 7 aa, Staphylococcus
YSRQDNV

SEQ ID NO: 1868715 - protein, 8 aa, Staphylococcus
YSSHTPTL

SEQ ID NO: 1868716 - protein, 10 aa, Staphylococcus
YSSLRNKSAN

SEQ ID NO: 1868717 - protein, 5 aa, Staphylococcus
YSSNI

SEQ ID NO: 1868718 - protein, 9 aa, Staphylococcus
YSTDPNPEY

SEQ ID NO: 1868719 - protein, 15 aa, Staphylococcus
YSTGREDGLGITTPS

SEQ ID NO: 1868720 - protein, 17 aa, Staphylococcus
YSTGREGGLGITTPSSN

SEQ ID NO: 1868721 - protein, 6 aa, Staphylococcus
YSTHPI

SEQ ID NO: 1868722 - protein, 11 aa, Staphylococcus
YSTKVKHPQTV

SEQ ID NO: 1868723 - protein, 6 aa, Staphylococcus
YSTTGG

SEQ ID NO: 1868724 - protein, 5 aa, Staphylococcus
YSYEN

SEQ ID NO: 1868725 - protein, 11 aa, Staphylococcus
YSYSGGDGYHL

SEQ ID NO: 1868726 - protein, 11 aa, Staphylococcus
YSYSSGDGYHL

SEQ ID NO: 1868727 - protein, 13 aa, Staphylococcus
YTAKGPQVGHETF

SEQ ID NO: 1868728 - protein, 8 aa, Staphylococcus
YTAPTKKA

SEQ ID NO: 1868729 - protein, 10 aa, Staphylococcus
YTASNSREFE

SEQ ID NO: 1868730 - protein, 6 aa, Staphylococcus
YTATHH

SEQ ID NO: 1868731 - protein, 5 aa, Staphylococcus
YTDNE

SEQ ID NO: 1868732 - protein, 15 aa, Staphylococcus
YTDQQTESTQEGIGT

SEQ ID NO: 1868733 - protein, 11 aa, Staphylococcus
YTDSSSADQQK

SEQ ID NO: 1868734 - protein, 12 aa, Staphylococcus
YTDTNGQPSSII

SEQ ID NO: 1868735 - protein, 6 aa, Staphylococcus
YTEDNK

SEQ ID NO: 1868736 - protein, 6 aa, Staphylococcus
YTEGSY

SEQ ID NO: 1868737 - protein, 14 aa, Staphylococcus
YTEHVSGSQSKTEI

SEQ ID NO: 1868738 - protein, 18 aa, Staphylococcus
YTEMPDLTGKTEKEAEKV

SEQ ID NO: 1868739 - protein, 13 aa, Staphylococcus
YTFKEPEKTGGGW

SEQ ID NO: 1868740 - protein, 17 aa, Staphylococcus
YTFTNNKNQRDTRAHAS

SEQ ID NO: 1868741 - protein, 10 aa, Staphylococcus
YTGDDESQKV

SEQ ID NO: 1868742 - protein, 35 aa, Staphylococcus
YTGESYEKASKELEEKGLKPVKEKEEKSDKIEKGK

SEQ ID NO: 1868743 - protein, 12 aa, Staphylococcus
YTGKVTEKDGIT

SEQ ID NO: 1868744 - protein, 10 aa, Staphylococcus
YTGNDGESQK

SEQ ID NO: 1868745 - protein, 11 aa, Staphylococcus
YTGQTTTADGI

SEQ ID NO: 1868746 - protein, 12 aa, Staphylococcus
YTGQTTTESGIT

SEQ ID NO: 1868747 - protein, 15 aa, Staphylococcus
YTHSQYDHGQAHANY

SEQ ID NO: 1868748 - protein, 5 aa, Staphylococcus
YTIEG

SEQ ID NO: 1868749 - protein, 15 aa, Staphylococcus
YTIKGDSMDPTLKDG

SEQ ID NO: 1868750 - protein, 16 aa, Staphylococcus
YTIKGDSMDPTLKDGE

SEQ ID NO: 1868751 - protein, 16 aa, Staphylococcus
YTIKGDSMNPTLKDGD

SEQ ID NO: 1868752 - protein, 16 aa, Staphylococcus
YTKDRKQDFLNFLNRW

SEQ ID NO: 1868753 - protein, 6 aa, Staphylococcus
YTKDTK

SEQ ID NO: 1868754 - protein, 8 aa, Staphylococcus
YTKKPGSF

SEQ ID NO: 1868755 - protein, 7 aa, Staphylococcus
YTKSDSK

SEQ ID NO: 1868756 - protein, 10 aa, Staphylococcus
YTKSRGERHT

SEQ ID NO: 1868757 - protein, 6 aa, Staphylococcus
YTLGGP

SEQ ID NO: 1868758 - protein, 14 aa, Staphylococcus
YTNDNNENTQAPST

SEQ ID NO: 1868759 - protein, 7 aa, Staphylococcus
YTNNEGA

SEQ ID NO: 1868760 - protein, 5 aa, Staphylococcus
YTNNR

SEQ ID NO: 1868761 - protein, 10 aa, Staphylococcus
YTNYNKPSNQ

SEQ ID NO: 1868762 - protein, 12 aa, Staphylococcus
YTPKDPNFYDEK

SEQ ID NO: 1868763 - protein, 11 aa, Staphylococcus
YTPKPGETEEA

SEQ ID NO: 1868764 - protein, 9 aa, Staphylococcus
YTPNESQSL

SEQ ID NO: 1868765 - protein, 12 aa, Staphylococcus
YTPSLSNKFDGS

SEQ ID NO: 1868766 - protein, 40 aa, Staphylococcus
YTQDGDHTHHDERNYNDRHYQDNYDRNDDYHDSNFDKTTN

SEQ ID NO: 1868767 - protein, 46 aa, Staphylococcus
YTQDGDHTYHDERNYNDRHYQDNYDRNDDYSHNNHDQQNDNHDYHD

SEQ ID NO: 1868768 - protein, 5 aa, Staphylococcus
YTQMT

SEQ ID NO: 1868769 - protein, 43 aa, Staphylococcus
YTQQGNHYRNEGERDRYERNPHREERYDDPQSRYEDGRYEERH

SEQ ID NO: 1868770 - protein, 17 aa, Staphylococcus
YTREHNTTKYYNLLNGG

SEQ ID NO: 1868771 - protein, 5 aa, Staphylococcus
YTRPH

SEQ ID NO: 1868772 - protein, 15 aa, Staphylococcus
YTSDKNRKRQRQQKK

SEQ ID NO: 1868773 - protein, 6 aa, Staphylococcus
YTSDRK

SEQ ID NO: 1868774 - protein, 15 aa, Staphylococcus
YTSERNRKKQRQQKR

SEQ ID NO: 1868775 - protein, 7 aa, Staphylococcus
YTSESKY

SEQ ID NO: 1868776 - protein, 13 aa, Staphylococcus
YTSITQENVEAAQ

SEQ ID NO: 1868777 - protein, 14 aa, Staphylococcus
YTSKENQKKQRQRK

SEQ ID NO: 1868778 - protein, 10 aa, Staphylococcus
YTSKETIENI

SEQ ID NO: 1868779 - protein, 14 aa, Staphylococcus
YTSQENKKKQRQKM

SEQ ID NO: 1868780 - protein, 13 aa, Staphylococcus
YTSQRNKQKQRNK

SEQ ID NO: 1868781 - protein, 15 aa, Staphylococcus
YTSTANRNETTSSGI

SEQ ID NO: 1868782 - protein, 15 aa, Staphylococcus
YTSTANRNETTSSGM

SEQ ID NO: 1868783 - protein, 6 aa, Staphylococcus
YTTDRK

SEQ ID NO: 1868784 - protein, 7 aa, Staphylococcus
YTTFKGK

SEQ ID NO: 1868785 - protein, 4 aa, Staphylococcus
YTTK

SEQ ID NO: 1868786 - protein, 11 aa, Staphylococcus
YTVGSSVKGGT

SEQ ID NO: 1868787 - protein, 6 aa, Staphylococcus
YTVRGD

SEQ ID NO: 1868788 - protein, 14 aa, Staphylococcus
YTVSGESMHPTFED

SEQ ID NO: 1868789 - protein, 12 aa, Staphylococcus
YTVSGSSMYPTF

SEQ ID NO: 1868790 - protein, 11 aa, Staphylococcus
YTYSSGDGYHL

SEQ ID NO: 1868791 - protein, 11 aa, Staphylococcus
YVAGDKQYKNP

SEQ ID NO: 1868792 - protein, 4 aa, Staphylococcus
YVEQ

SEQ ID NO: 1868793 - protein, 5 aa, Staphylococcus
YVERT

SEQ ID NO: 1868794 - protein, 17 aa, Staphylococcus
YVETNKQGLEKDKKENL

SEQ ID NO: 1868795 - protein, 11 aa, Staphylococcus
YVNPTGAENAR

SEQ ID NO: 1868796 - protein, 17 aa, Staphylococcus
YYANNPDKAMWWAKDKR

SEQ ID NO: 1868797 - protein, 24 aa, Staphylococcus
YYGQDSEPYEVSSEEWKDNPNNEV

SEQ ID NO: 1868798 - protein, 8 aa, Staphylococcus
YYPGQTDV

SEQ ID NO: 1868799 - protein, 7 aa, Staphylococcus
YYSREEK

SEQ ID NO: 1868800 - protein, 6 aa, Staphylococcus
YYTREQ

SEQ ID NO: 1868801 - protein, 22 aa, Staphylococcus
AKKNAPCIIFIDEIDAVGRQRG

SEQ ID NO: 1868802 - protein, 24 aa, Staphylococcus
EFICPNNKRLGFKRYAYRHDKYGY

SEQ ID NO: 1868803 - protein, 20 aa, Staphylococcus
FEMLGEYILDGFKVAVIVGA

SEQ ID NO: 1868804 - protein, 17 aa, Staphylococcus
GVATKVGTYPIVVTSTD

SEQ ID NO: 1868805 - protein, 23 aa, Staphylococcus
RGQAGGYAMMLPKQDRFLMTEPE

SEQ ID NO: 1868806 - protein, 27 aa, Staphylococcus
RPDILDPALLRPGRFDRQIQVGRPDVK

SEQ ID NO: 1868807 - protein, 18 aa, Staphylococcus
DPDSGKYEPKVTPITKDF

SEQ ID NO: 1868808 - protein, 23 aa, Staphylococcus
FIVNLFRAIPFIILILLLIPFTS

SEQ ID NO: 1868809 - protein, 24 aa, Staphylococcus
IEANANRYTFVWKKSIQNHESKMN

SEQ ID NO: 1868810 - protein, 25 aa, Staphylococcus
IRVFPEIVMALIFIKAVGPGSFSGV

SEQ ID NO: 1868811 - protein, 22 aa, Staphylococcus
KKDNFYIISIEIVFFSLIQELY

SEQ ID NO: 1868812 - protein, 20 aa, Staphylococcus
KKIMKNYNWEYFKSQINKKL

SEQ ID NO: 1868813 - protein, 21 aa, Staphylococcus
LAVSITDFFQGVIMLIAMVMV

SEQ ID NO: 1868814 - protein, 20 aa, Staphylococcus
LPVLGGAMIAMFGMVMAYGV

SEQ ID NO: 1868815 - protein, 21 aa, Staphylococcus
NNIPSRIAFAVSSQTDSRTII

SEQ ID NO: 1868816 - protein, 18 aa, Staphylococcus
SNGRVTITPTVPIPEGNV

SEQ ID NO: 1868817 - protein, 23 aa, Staphylococcus
ALLAEYFIAVAFVASGFSANLRG

SEQ ID NO: 1868818 - protein, 17 aa, Staphylococcus
FACLAGLIFWYPKMMGY

SEQ ID NO: 1868819 - protein, 17 aa, Staphylococcus
FIIASGFIADTTSLPLI

SEQ ID NO: 1868820 - protein, 23 aa, Staphylococcus
GFWMFKEYFGLTVKETFLTWSLL

SEQ ID NO: 1868821 - protein, 24 aa, Staphylococcus
KARTRKMGGTGLGLAISKEIVEAH

SEQ ID NO: 1868822 - protein, 23 aa, Staphylococcus
LSKDRTTLIVAHRLSTITHADKI

SEQ ID NO: 1868823 - protein, 23 aa, Staphylococcus
MGSRIPKGVLLVGPPGTGKTLLA

SEQ ID NO: 1868824 - protein, 18 aa, Staphylococcus
PKMMLKVILYAYTQSVFS

SEQ ID NO: 1868825 - protein, 22 aa, Staphylococcus
RNKIFFTLAMLVIFKIGTYIPA

SEQ ID NO: 1868826 - protein, 21 aa, Staphylococcus
RTNTISGVATKVGTYPIVVTS

SEQ ID NO: 1868827 - protein, 19 aa, Staphylococcus
SAIFFEAFLSFIGIGVPAP

SEQ ID NO: 1868828 - protein, 17 aa, Staphylococcus
SAMIVPVLMFAFFGIVL

SEQ ID NO: 1868829 - protein, 21 aa, Staphylococcus
VETKFSIKVVDTTAPTVKEIS

SEQ ID NO: 1868830 - protein, 20 aa, Staphylococcus
YIQAEGFAGGELKHGTIALI

SEQ ID NO: 1868831 - protein, 19 aa, Staphylococcus
AEVALSYALLGGFAALISY

SEQ ID NO: 1868832 - protein, 21 aa, Staphylococcus
AKIPAYLGSSFAFITPIITGL

SEQ ID NO: 1868833 - protein, 20 aa, Staphylococcus
ALAKRWSKGYTITVAVGVVT

SEQ ID NO: 1868834 - protein, 25 aa, Staphylococcus
ANVSHELRTPISLLQGYTESIVDGI

SEQ ID NO: 1868835 - protein, 23 aa, Staphylococcus
DASHELRTPLQIIQGHLNLIQRW

SEQ ID NO: 1868836 - protein, 19 aa, Staphylococcus
DKDNHVIGSGTTGANGHVI

SEQ ID NO: 1868837 - protein, 26 aa, Staphylococcus
DVSSDPNTRIELLDKDNHVIGSGTTG

SEQ ID NO: 1868838 - protein, 20 aa, Staphylococcus
DVVIGASFLIMFTAIGHFTG

SEQ ID NO: 1868839 - protein, 25 aa, Staphylococcus
FAVRLRWFPVAGWEGFSTAVLPSLA

SEQ ID NO: 1868840 - protein, 27 aa, Staphylococcus
FLFGFIKRLLIPFGLHHIFHAPFWFEF

SEQ ID NO: 1868841 - protein, 19 aa, Staphylococcus
FVWAIAYGSCIGWGAFILP

SEQ ID NO: 1868842 - protein, 18 aa, Staphylococcus
FWVWGHPEVYIVILPAFG

SEQ ID NO: 1868843 - protein, 25 aa, Staphylococcus
GFVTGWTYWLCWIITGMAEVTAVAK

SEQ ID NO: 1868844 - protein, 22 aa, Staphylococcus
GKKSLLKRRLINIKEANLKKQS

SEQ ID NO: 1868845 - protein, 25 aa, Staphylococcus
GRITFESPMLFSLAFIPNFLLGGVT

SEQ ID NO: 1868846 - protein, 24 aa, Staphylococcus
GTGLPIVLGCTFTAVAPMILIGQT

SEQ ID NO: 1868847 - protein, 17 aa, Staphylococcus
IETKFSIKVVDTTAPTV

SEQ ID NO: 1868848 - protein, 19 aa, Staphylococcus
ILAGIPTIVFGFFALTFVT

SEQ ID NO: 1868849 - protein, 20 aa, Staphylococcus
IVDFNMFINKIINRHEMAAK

SEQ ID NO: 1868850 - protein, 19 aa, Staphylococcus
IWLIAMAFFISRGFVKTGL

SEQ ID NO: 1868851 - protein, 25 aa, Staphylococcus
KLYECDDCSECPLKNQCMNFNSKTN

SEQ ID NO: 1868852 - protein, 20 aa, Staphylococcus
KNGQLKPGYNLQIATNSQFV

SEQ ID NO: 1868853 - protein, 24 aa, Staphylococcus
KSVIDKRLKYIILHEYAHAKNRDT

SEQ ID NO: 1868854 - protein, 18 aa, Staphylococcus
LGGLSYTIGAWFYAQKNR

SEQ ID NO: 1868855 - protein, 17 aa, Staphylococcus
LKEISYIQAEGFAGGEL

SEQ ID NO: 1868856 - protein, 19 aa, Staphylococcus
LVIACPCALGLATPTSIMV

SEQ ID NO: 1868857 - protein, 17 aa, Staphylococcus
NMLPLVIAGGILMAIVF

SEQ ID NO: 1868858 - protein, 21 aa, Staphylococcus
NTGLAVFLFGFIKRLLIPFGL

SEQ ID NO: 1868859 - protein, 21 aa, Staphylococcus
PDYPSEKGKPTITVDDPSKLP

SEQ ID NO: 1868860 - protein, 17 aa, Staphylococcus
PNYSGQIAYEIDKEVQR

SEQ ID NO: 1868861 - protein, 18 aa, Staphylococcus
PRAGRALFSDSLATIVGA

SEQ ID NO: 1868862 - protein, 29 aa, Staphylococcus
PSLGFALGWNYWFNWVITVAADVTIAAQV

SEQ ID NO: 1868863 - protein, 23 aa, Staphylococcus
QAELPYIVVIVDELADLMMVAGK

SEQ ID NO: 1868864 - protein, 20 aa, Staphylococcus
QFVISFGFLLPVSAPQNMLA

SEQ ID NO: 1868865 - protein, 18 aa, Staphylococcus
QRTPVYVYKWEDVQIQHG

SEQ ID NO: 1868866 - protein, 17 aa, Staphylococcus
QVPFYIWLPDAMEAPTP

SEQ ID NO: 1868867 - protein, 24 aa, Staphylococcus
QYMAKRRIGALIVFEKETGLQDYI

SEQ ID NO: 1868868 - protein, 20 aa, Staphylococcus
RAGAVVPILLGMIAAFKVSK

SEQ ID NO: 1868869 - protein, 23 aa, Staphylococcus
RMIELPLSLSVIIGGIRIALVVA

SEQ ID NO: 1868870 - protein, 22 aa, Staphylococcus
RPDVKGREAILHVHAKNKPLDE

SEQ ID NO: 1868871 - protein, 25 aa, Staphylococcus
RYYSKRLPEMLGVFQGLTFVVTISF

SEQ ID NO: 1868872 - protein, 20 aa, Staphylococcus
SALFPILLVVPLFDILMYFN

SEQ ID NO: 1868873 - protein, 17 aa, Staphylococcus
SGKSVCINGIITSILLN

SEQ ID NO: 1868874 - protein, 19 aa, Staphylococcus
SLLSILGVFLVAGFSFQGT

SEQ ID NO: 1868875 - protein, 17 aa, Staphylococcus
SPITFWYGKYIILIPSS

SEQ ID NO: 1868876 - protein, 24 aa, Staphylococcus
SVGYRAQLTLSIGVGEGTENLIDL

SEQ ID NO: 1868877 - protein, 18 aa, Staphylococcus
TGAVTIPDYPSEKGKPTI

SEQ ID NO: 1868878 - protein, 24 aa, Staphylococcus
THVDLLDKDNHVIGSGTTDSNGRV

SEQ ID NO: 1868879 - protein, 18 aa, Staphylococcus
TQHFLKDDVDTYINRSEL

SEQ ID NO: 1868880 - protein, 19 aa, Staphylococcus
TQIARSMVTEYGMSKKLGP

SEQ ID NO: 1868881 - protein, 24 aa, Staphylococcus
TRQPKFESFFGIEMMFLGNTEALA

SEQ ID NO: 1868882 - protein, 18 aa, Staphylococcus
TSTGFILASAGSAIGLGA

SEQ ID NO: 1868883 - protein, 18 aa, Staphylococcus
VCINGIITSILLNAKPHE

SEQ ID NO: 1868884 - protein, 32 aa, Staphylococcus
VGILCILYTFLGGFEGVVWSDFIQGVILLGGA

SEQ ID NO: 1868885 - protein, 17 aa, Staphylococcus
VIMAGIRTAMVLIIGTA

SEQ ID NO: 1868886 - protein, 18 aa, Staphylococcus
VIVGLKISIKPADKNHPY

SEQ ID NO: 1868887 - protein, 17 aa, Staphylococcus
VKLFNWLLTLYKGRITF

SEQ ID NO: 1868888 - protein, 20 aa, Staphylococcus
AELFHASGIIAAVVAGLVHG

SEQ ID NO: 1868889 - protein, 18 aa, Staphylococcus
AGVSMIFLAYIGFDSIAA

SEQ ID NO: 1868890 - protein, 20 aa, Staphylococcus
AIDMGGPFNKAAYVFATAAL

SEQ ID NO: 1868891 - protein, 18 aa, Staphylococcus
ALFSDSLATIVGAIFGTT

SEQ ID NO: 1868892 - protein, 23 aa, Staphylococcus
AMFILQFMLNFFIPSGSGQALTT

SEQ ID NO: 1868893 - protein, 17 aa, Staphylococcus
APVGAIISFIGVPYFLY

SEQ ID NO: 1868894 - protein, 19 aa, Staphylococcus
APWLGRTALTWIVDMSSTG

SEQ ID NO: 1868895 - protein, 18 aa, Staphylococcus
DGVSTMFASIIGGPPSTT

SEQ ID NO: 1868896 - protein, 23 aa, Staphylococcus
DKEGGFRGGPAYYITKGLNQKWL

SEQ ID NO: 1868897 - protein, 19 aa, Staphylococcus
DTGAYIFGRLMGKHKLWPV

SEQ ID NO: 1868898 - protein, 24 aa, Staphylococcus
DTIIKKLFRLPAIKRFEEDEDLLE

SEQ ID NO: 1868899 - protein, 18 aa, Staphylococcus
DTLMKLNPFWTILLSLIF

SEQ ID NO: 1868900 - protein, 23 aa, Staphylococcus
EAPIPGRSAVGIEVPNDKISLVT

SEQ ID NO: 1868901 - protein, 18 aa, Staphylococcus
EAVSAVQYISSWPWDWAK

SEQ ID NO: 1868902 - protein, 22 aa, Staphylococcus
EEKQELIEIVDFLKDNKKFKQM

SEQ ID NO: 1868903 - protein, 23 aa, Staphylococcus
EFSLPSWFAMLFSAGMGIGLVFW

SEQ ID NO: 1868904 - protein, 24 aa, Staphylococcus
EHKLIEFVGFLGISYVTFKSVQLI

SEQ ID NO: 1868905 - protein, 21 aa, Staphylococcus
EIANFSGLLGRVLTEMRLVKV

SEQ ID NO: 1868906 - protein, 21 aa, Staphylococcus
ELLDKICGLLGGRVSEDINFG

SEQ ID NO: 1868907 - protein, 18 aa, Staphylococcus
ESEYWFALIKVVTVIIFI

SEQ ID NO: 1868908 - protein, 19 aa, Staphylococcus
ESRKRYSPNSTYKIYLAMF

SEQ ID NO: 1868909 - protein, 27 aa, Staphylococcus
EWYRLITSMFLHFNFEHILMNMLSLFI

SEQ ID NO: 1868910 - protein, 17 aa, Staphylococcus
FAIAVIGTFIAAIICIP

SEQ ID NO: 1868911 - protein, 19 aa, Staphylococcus
FFGISWGPVLWVMLPELFP

SEQ ID NO: 1868912 - protein, 17 aa, Staphylococcus
FFYEYKMNWKNTKKQIG

SEQ ID NO: 1868913 - protein, 19 aa, Staphylococcus
FGETEFWLSLIKVVTIIVF

SEQ ID NO: 1868914 - protein, 25 aa, Staphylococcus
FGLTVKETFLTWSLLETIISVSGII

SEQ ID NO: 1868915 - protein, 22 aa, Staphylococcus
FIVSLYWHFLDVVWIFIFTAVY

SEQ ID NO: 1868916 - protein, 24 aa, Staphylococcus
FKEEGHKLIGIRGMPRVGKTESIV

SEQ ID NO: 1868917 - protein, 22 aa, Staphylococcus
FMQGEFPVMMFGLPAAALAIYQ

SEQ ID NO: 1868918 - protein, 19 aa, Staphylococcus
FPGYASTLFANAMVIGQLC

SEQ ID NO: 1868919 - protein, 23 aa, Staphylococcus
FVLASLAIYWAMWPTTAEVILII

SEQ ID NO: 1868920 - protein, 17 aa, Staphylococcus
FYMGIGTPGGNKIPTIL

SEQ ID NO: 1868921 - protein, 21 aa, Staphylococcus
GESFISNPLLVYMEPYASSTA

SEQ ID NO: 1868922 - protein, 30 aa, Staphylococcus; identical to SEQ ID NO: 1574161

SEQ ID NO: 1868923 - protein, 17 aa, Staphylococcus
GIATKVGTYPIVVTSTD

SEQ ID NO: 1868924 - protein, 24 aa, Staphylococcus
GIVMGTGFAFWSFVLAIVLIVVDV

SEQ ID NO: 1868925 - protein, 24 aa, Staphylococcus
GSSVKGGTLLAGYQNNAIKVGEEM

SEQ ID NO: 1868926 - protein, 18 aa, Staphylococcus
GSVYSTGLSAIWITIGLT

SEQ ID NO: 1868927 - protein, 23 aa, Staphylococcus
GTAIGGWKIIKTVGGNIMKIRPA

SEQ ID NO: 1868928 - protein, 23 aa, Staphylococcus
GTAVGGWKIIKTVGGNIMKIRPA

SEQ ID NO: 1868929 - protein, 21 aa, Staphylococcus
IFCEIAFWFVILLGLVTRYIL

SEQ ID NO: 1868930 - protein, 21 aa, Staphylococcus
IGALAAWCYNKFYNISLPSYL

SEQ ID NO: 1868931 - protein, 19 aa, Staphylococcus
IGSMFPFAFLAQLISAGTL

SEQ ID NO: 1868932 - protein, 17 aa, Staphylococcus
IGVAIGMAKKNDGAVAL

SEQ ID NO: 1868933 - protein, 18 aa, Staphylococcus
IGVSRFALMNNLEAYVVL

SEQ ID NO: 1868934 - protein, 17 aa, Staphylococcus
IIHFLGGIHEIYFPYVL

SEQ ID NO: 1868935 - protein, 25 aa, Staphylococcus
IIIVACLKTAIGLITAFSETFTELF

SEQ ID NO: 1868936 - protein, 25 aa, Staphylococcus
IIPTFARKRLFGHQSMVWATAGIAF

SEQ ID NO: 1868937 - protein, 17 aa, Staphylococcus
IITGFFIIFENQFDVGD

SEQ ID NO: 1868938 - protein, 23 aa, Staphylococcus
IKDELRIGRTLKQAYSKANKSSF

SEQ ID NO: 1868939 - protein, 22 aa, Staphylococcus
ILSFKFLKALLYLKYLKKQSLY

SEQ ID NO: 1868940 - protein, 19 aa, Staphylococcus
ILTEMPPFVGGLLIAAIFA

SEQ ID NO: 1868941 - protein, 23 aa, Staphylococcus
IQLNEMPHLLVAGSTGSGKSVCI

SEQ ID NO: 1868942 - protein, 24 aa, Staphylococcus
KAIGRASVVPTFFGVNEPILFGAP

SEQ ID NO: 1868943 - protein, 20 aa, Staphylococcus
KIHLESFQTFLINKKVNGKE

SEQ ID NO: 1868944 - protein, 23 aa, Staphylococcus
KIHLESFQTFLINKKVNGKEVTP

SEQ ID NO: 1868945 - protein, 19 aa, Staphylococcus
KKDFIANVSHELRTPISLL

SEQ ID NO: 1868946 - protein, 19 aa, Staphylococcus
KNKPFELFVTGFFDNETDN

SEQ ID NO: 1868947 - protein, 24 aa, Staphylococcus
KVLYRLTFVGSIFLAVIAILPILA

SEQ ID NO: 1868948 - protein, 27 aa, Staphylococcus
KVNSAGVIPVIFAMAFFLLPRTLTLFF

SEQ ID NO: 1868949 - protein, 21 aa, Staphylococcus
LAQGIGRWGNFMNHEAHGGPV

SEQ ID NO: 1868950 - protein, 19 aa, Staphylococcus
LESTVMYAGIIVDTRNFTL

SEQ ID NO: 1868951 - protein, 18 aa, Staphylococcus
LETFAIAVIGTFIAAIIC

SEQ ID NO: 1868952 - protein, 26 aa, Staphylococcus
LFFRYILKRYFNYMLNYKVWYLTLLA

SEQ ID NO: 1868953 - protein, 22 aa, Staphylococcus
LFGEFFGWVAGWALLAEYFIAV

SEQ ID NO: 1868954 - protein, 24 aa, Staphylococcus
LFWELTSFSSFLLISFWREKKASI

SEQ ID NO: 1868955 - protein, 17 aa, Staphylococcus
LGLIPIYLGIKVAIYDD

SEQ ID NO: 1868956 - protein, 21 aa, Staphylococcus
LIAAFIVGIALFFEVGLVLLI

SEQ ID NO: 1868957 - protein, 31 aa, Staphylococcus; identical to SEQ ID NO: 1576334

SEQ ID NO: 1868958 - protein, 18 aa, Staphylococcus
LLPSNPFLDFTGQRTTST

SEQ ID NO: 1868959 - protein, 19 aa, Staphylococcus
LLPSNPFLDFTGQRTTSTI

SEQ ID NO: 1868960 - protein, 18 aa, Staphylococcus
LNLIKMIVIPVVFCSLAL

SEQ ID NO: 1868961 - protein, 18 aa, Staphylococcus
LNYWSVKLLTSFTSLISV

SEQ ID NO: 1868962 - protein, 21 aa, Staphylococcus
LPALIIGAAPFYARLVEIAFK

SEQ ID NO: 1868963 - protein, 21 aa, Staphylococcus
LPIVLGCTFTAVAPMILIGQT

SEQ ID NO: 1868964 - protein, 23 aa, Staphylococcus
LPSFLSLILYRFELNLRSASILG

SEQ ID NO: 1868965 - protein, 19 aa, Staphylococcus
LSLVWPTFMKMGGHVIALP

SEQ ID NO: 1868966 - protein, 20 aa, Staphylococcus
LVVPFMFMWLTKSKRNKAIG

SEQ ID NO: 1868967 - protein, 17 aa, Staphylococcus
LYFAFLGILKIGAIVGP

SEQ ID NO: 1868968 - protein, 20 aa, Staphylococcus
MGNPLGLEFANSVTSGIISA

SEQ ID NO: 1868969 - protein, 18 aa, Staphylococcus
MINWADDRFRYYVMKQGS

SEQ ID NO: 1868970 - protein, 25 aa, Staphylococcus
MKDVELPLALPLIISGIRLSSVYVI

SEQ ID NO: 1868971 - protein, 17 aa, Staphylococcus
MKFNIKVVDTTAPTVKE

SEQ ID NO: 1868972 - protein, 17 aa, Staphylococcus
MKMGGHVIALPLFMETF

SEQ ID NO: 1868973 - protein, 17 aa, Staphylococcus
MLLACLLIQAATNMFNE

SEQ ID NO: 1868974 - protein, 22 aa, Staphylococcus
MPMLWANFFWVWGHPEVYIVIL

SEQ ID NO: 1868975 - protein, 22 aa, Staphylococcus
MQRTRFCLAGGFRDMYVQKNNK

SEQ ID NO: 1868976 - protein, 18 aa, Staphylococcus
NICTVIWIVLVIILSFKF

SEQ ID NO: 1868977 - protein, 20 aa, Staphylococcus
NINGSKSWINLGFMNLQASE

SEQ ID NO: 1868978 - protein, 23 aa, Staphylococcus
NYVPEKWILGLLGLIPIYLGIKV

SEQ ID NO: 1868979 - protein, 21 aa, Staphylococcus
PELRDRLAVRHGRYIEQDADD

SEQ ID NO: 1868980 - protein, 23 aa, Staphylococcus
PKLAFEIPLRYKIMGIVGSVWGI

SEQ ID NO: 1868981 - protein, 26 aa, Staphylococcus
PLKANRLFWAFALCLLPFSLMLVGGE

SEQ ID NO: 1868982 - protein, 22 aa, Staphylococcus
PRTSTISGVATKVGTYPIVVTS

SEQ ID NO: 1868983 - protein, 23 aa, Staphylococcus
PTLKRMKFGQSIREEGPQSHMKK

SEQ ID NO: 1868984 - protein, 24 aa, Staphylococcus
PTLKRMKFGQSIREEGPQSHMKKT

SEQ ID NO: 1868985 - protein, 18 aa, Staphylococcus
PTTAEVILIIILGLPIYF

SEQ ID NO: 1868986 - protein, 19 aa, Staphylococcus
PVIIGGSFSAFFITSVNSF

SEQ ID NO: 1868987 - protein, 19 aa, Staphylococcus
QKVIFPFIIASGFIADTTS

SEQ ID NO: 1868988 - protein, 19 aa, Staphylococcus
QPEIRRALEQLGRGSLFKR

SEQ ID NO: 1868989 - protein, 23 aa, Staphylococcus
QSELPYIVVIVDELADLMMVAGK

SEQ ID NO: 1868990 - protein, 21 aa, Staphylococcus
RADINLPFERGAAIDLAGRDV

SEQ ID NO: 1868991 - protein, 36 aa, Staphylococcus; identical to SEQ ID NO: 1573192

SEQ ID NO: 1868992 - protein, 25 aa, Staphylococcus
RGSIVPNYVMGLSFITEGAIPFAAA

SEQ ID NO: 1868993 - protein, 26 aa, Staphylococcus
RLIGLVIGFGLCWPYVLLPYGFGQIF

SEQ ID NO: 1868994 - protein, 18 aa, Staphylococcus
RSLIPFGLHHIFYAPFWF

SEQ ID NO: 1868995 - protein, 20 aa, Staphylococcus
RTAGALGCGIFAIVAQLIMI

SEQ ID NO: 1868996 - protein, 17 aa, Staphylococcus
SAGMGIGLVFYGAAEPM

SEQ ID NO: 1868997 - protein, 24 aa, Staphylococcus
SETTRISDALVRMQREHVHISLII

SEQ ID NO: 1868998 - protein, 18 aa, Staphylococcus
SFFSSWFLTFGYVCVVAL

SEQ ID NO: 1868999 - protein, 18 aa, Staphylococcus
SFQTFLINKKVNGKEVTP

SEQ ID NO: 1869000 - protein, 20 aa, Staphylococcus
SGLMKPNISNIVGRLYPEND

SEQ ID NO: 1869001 - protein, 18 aa, Staphylococcus
SGVATKVGTYPIVVTSTD

SEQ ID NO: 1869002 - protein, 25 aa, Staphylococcus
SIATGIACGFIFYPITMLITKKHKE

SEQ ID NO: 1869003 - protein, 17 aa, Staphylococcus
SKIFDYILVFFLFGIAV

SEQ ID NO: 1869004 - protein, 17 aa, Staphylococcus
STMPFAGSAYSWINVLF

SEQ ID NO: 1869005 - protein, 17 aa, Staphylococcus
TALTWIVDMSSTGVSIA

SEQ ID NO: 1869006 - protein, 26 aa, Staphylococcus
TFLLYANVVYFRFFSDFLTFSTLNQA

SEQ ID NO: 1869007 - protein, 17 aa, Staphylococcus
TIVFGFFALTFVTPILR

SEQ ID NO: 1869008 - protein, 18 aa, Staphylococcus
TKFSIKVVDTTAPTVKGI

SEQ ID NO: 1869009 - protein, 25 aa, Staphylococcus
TLYTIRLLPVGGYVRMAGDGLEEPP

SEQ ID NO: 1869010 - protein, 23 aa, Staphylococcus
TPGEYTVPVTVTYPDGSKDHVNV

SEQ ID NO: 1869011 - protein, 18 aa, Staphylococcus
TPPVKPSVVGTLDGKAGT

SEQ ID NO: 1869012 - protein, 25 aa, Staphylococcus
TVGIPRFVIVTAYQFGQYAMLFLAP

SEQ ID NO: 1869013 - protein, 17 aa, Staphylococcus
VDPSLGFALGWNYWFNW

SEQ ID NO: 1869014 - protein, 17 aa, Staphylococcus
VGAEYILGAFLAGVVVS

SEQ ID NO: 1869015 - protein, 26 aa, Staphylococcus
VNSAGVIPVIFAMAFFLLPRTLTLFF

SEQ ID NO: 1869016 - protein, 19 aa, Staphylococcus
VPFFKKLKVTSAYEYLEAR

SEQ ID NO: 1869017 - protein, 18 aa, Staphylococcus
WATKMFIYSLNYLVVFFV

SEQ ID NO: 1869018 - protein, 18 aa, Staphylococcus
WDSIDNICTVIWIVLVII

SEQ ID NO: 1869019 - protein, 20 aa, Staphylococcus
WHVLPLGFLFGLGFDTASEI

SEQ ID NO: 1869020 - protein, 17 aa, Staphylococcus
WTGPSVIFAYLIAGIFL

SEQ ID NO: 1869021 - protein, 20 aa, Staphylococcus
YGFFNRLLIPTGLHHALNSV

SEQ ID NO: 1869022 - protein, 17 aa, Staphylococcus
YIYLTLVAFNFISGVLT

SEQ ID NO: 1869023 - protein, 17 aa, Staphylococcus
YSQPKVGVATSFSLSQL

SEQ ID NO: 1869024 - protein, 17 aa, Staphylococcus
YTCGIAIYYMRKEKQNL

SEQ ID NO: 1869025 - protein, 17 aa, Staphylococcus
AALFAALMTKVGAYALI

SEQ ID NO: 1869026 - protein, 32 aa, Staphylococcus
AARIDGCNDWQIFWKIILPMSKPVIATITLFN

SEQ ID NO: 1869027 - protein, 22 aa, Staphylococcus
AASGYAVCIAMLRRLTGMTDVI

SEQ ID NO: 1869028 - protein, 18 aa, Staphylococcus
ADSNNLWDLFLLVTGLFG

SEQ ID NO: 1869029 - protein, 18 aa, Staphylococcus
AEKGIYDHYMLKEINEQP

SEQ ID NO: 1869030 - protein, 17 aa, Staphylococcus
AELLPNSAIKVMDNGQR

SEQ ID NO: 1869031 - protein, 17 aa, Staphylococcus
AFFLVLAFRTYKELGTD

SEQ ID NO: 1869032 - protein, 26 aa, Staphylococcus
AFITVIVYNFFIKRNITIKMPKEVPP

SEQ ID NO: 1869033 - protein, 23 aa, Staphylococcus
AFLLRPIGGIVFGIIGDKYGRKV

SEQ ID NO: 1869034 - protein, 17 aa, Staphylococcus
AGILLAFGNAMHNEQLV

SEQ ID NO: 1869035 - protein, 18 aa, Staphylococcus
AGISYIFSSQITKPIVTM

SEQ ID NO: 1869036 - protein, 19 aa, Staphylococcus
AIAMWPGFSRSGSTISTGV

SEQ ID NO: 1869037 - protein, 21 aa, Staphylococcus
AIDMGGPFNKAAYVFATAALT

SEQ ID NO: 1869038 - protein, 18 aa, Staphylococcus
AIIALVVYALLPILRNTY

SEQ ID NO: 1869039 - protein, 26 aa, Staphylococcus
AIIVILLFLRNIRTTAISIVSIPLSI

SEQ ID NO: 1869040 - protein, 20 aa, Staphylococcus
AISGDSGFIGGIIAGFLAGY

SEQ ID NO: 1869041 - protein, 24 aa, Staphylococcus
AITFVDIWHFFSLVNRYENEDKYD

SEQ ID NO: 1869042 - protein, 18 aa, Staphylococcus
AKARITVRANIARLVGGA

SEQ ID NO: 1869043 - protein, 20 aa, Staphylococcus
AKIPAYLGSSFAFITPIITG

SEQ ID NO: 1869044 - protein, 17 aa, Staphylococcus
ALGLAIPLVTARSTSIG

SEQ ID NO: 1869045 - protein, 18 aa, Staphylococcus
ALGLAIPLVTARSTSIGA

SEQ ID NO: 1869046 - protein, 18 aa, Staphylococcus
ALGLYWSVSAAFLIVQTY

SEQ ID NO: 1869047 - protein, 25 aa, Staphylococcus
ALIMFSVFIAFVFQDDSAIKSMGIA

SEQ ID NO: 1869048 - protein, 18 aa, Staphylococcus
ALIPLLFGQDSSILISKG

SEQ ID NO: 1869049 - protein, 19 aa, Staphylococcus
ALVSFVWFSVFGVLGIETG

SEQ ID NO: 1869050 - protein, 26 aa, Staphylococcus
AMEMRRYLMRFVHHIGGLADFSALKF

SEQ ID NO: 1869051 - protein, 19 aa, Staphylococcus
ANLMLLSDMIARVIIQPLE

SEQ ID NO: 1869052 - protein, 25 aa, Staphylococcus
ANVSHELRTPIALLQGYTESIVDGV

SEQ ID NO: 1869053 - protein, 20 aa, Staphylococcus
ASFSPLVLFSLYWKGLTRAG

SEQ ID NO: 1869054 - protein, 17 aa, Staphylococcus
ASLFIPFGASIGLDTMA

SEQ ID NO: 1869055 - protein, 25 aa, Staphylococcus
ATFLHFNLSIAMLIALTVCLIPTTI

SEQ ID NO: 1869056 - protein, 17 aa, Staphylococcus
ATGKGIGPNEFIEFPIV

SEQ ID NO: 1869057 - protein, 27 aa, Staphylococcus
ATIRNIRQNLFWAFGYNVAGIPIAALG

SEQ ID NO: 1869058 - protein, 23 aa, Staphylococcus
ATMPGSLPTMFYTHIRYRTLSVT

SEQ ID NO: 1869059 - protein, 25 aa, Staphylococcus
ATSKLFDIVIQWGVLALIVIFQPEI

SEQ ID NO: 1869060 - protein, 25 aa, Staphylococcus
AVFTAEFYASFAFAILISILIDIGA

SEQ ID NO: 1869061 - protein, 24 aa, Staphylococcus
AVFTAQFYASFAFAILISILIDIG

SEQ ID NO: 1869062 - protein, 18 aa, Staphylococcus
AVMVAGIYLFHRLQYSEN

SEQ ID NO: 1869063 - protein, 24 aa, Staphylococcus
AVVLTMFAVFIFKYSYNKNDESGK

SEQ ID NO: 1869064 - protein, 17 aa, Staphylococcus
AWANWVSLVTIIPIEAV

SEQ ID NO: 1869065 - protein, 25 aa, Staphylococcus
AYGSCIGWGAFILPGDWIKQSGPIA

SEQ ID NO: 1869066 - protein, 19 aa, Staphylococcus
AYLVVPIVGAFLIDLIGVI

SEQ ID NO: 1869067 - protein, 19 aa, Staphylococcus
CGTVGSLIILRGLSLMGDA

SEQ ID NO: 1869068 - protein, 17 aa, Staphylococcus
CLCRLNVVISLFISALV

SEQ ID NO: 1869069 - protein, 18 aa, Staphylococcus
DAGIRSGIFIALATFLRP

SEQ ID NO: 1869070 - protein, 18 aa, Staphylococcus
DAGIRSGVFIALATFLRP

SEQ ID NO: 1869071 - protein, 23 aa, Staphylococcus
DASHELRTPLQIIQGHLNLIKRW

SEQ ID NO: 1869072 - protein, 20 aa, Staphylococcus
DDVYWCTADPGWVTGTSYGV

SEQ ID NO: 1869073 - protein, 20 aa, Staphylococcus
DELFNRGGLESMFYTISLTL

SEQ ID NO: 1869074 - protein, 18 aa, Staphylococcus
DFALERLVTVLVIACPHA

SEQ ID NO: 1869075 - protein, 22 aa, Staphylococcus
DFGGWKAPFGIQFLGDSLSLLM

SEQ ID NO: 1869076 - protein, 19 aa, Staphylococcus
DIPNFTLTLAVMIGLAVGI

SEQ ID NO: 1869077 - protein, 20 aa, Staphylococcus
DIVARFGLKLLFGATLVSFI

SEQ ID NO: 1869078 - protein, 17 aa, Staphylococcus
DKSRARSQGGNGLGLSI

SEQ ID NO: 1869079 - protein, 23 aa, Staphylococcus
DLKYGCRDLKVEGYDLDHVKVDG

SEQ ID NO: 1869080 - protein, 22 aa, Staphylococcus
DPEYSGQIAYEIDKEVQRIIKE

SEQ ID NO: 1869081 - protein, 19 aa, Staphylococcus
DSLRAEGYIQMDSDRIAIK

SEQ ID NO: 1869082 - protein, 24 aa, Staphylococcus
DSMLNILSTLGFIFLMFLSGLEID

SEQ ID NO: 1869083 - protein, 25 aa, Staphylococcus
DTKEIEARIHIVIPELNYDHHYTTY

SEQ ID NO: 1869084 - protein, 22 aa, Staphylococcus
DVLFKALMLYARENNKGVYDRY

SEQ ID NO: 1869085 - protein, 20 aa, Staphylococcus
DVVARFGLKLLFGATLVSFI

SEQ ID NO: 1869086 - protein, 18 aa, Staphylococcus
EAVSAVQYMSSWPWEWAK

SEQ ID NO: 1869087 - protein, 17 aa, Staphylococcus
EEYSKVIGIPKWIQFLF

SEQ ID NO: 1869088 - protein, 18 aa, Staphylococcus
EHPGKFIKENGKTYFEVT

SEQ ID NO: 1869089 - protein, 22 aa, Staphylococcus
EIANFSGLLGRVLTEMRLVKVS

SEQ ID NO: 1869090 - protein, 19 aa, Staphylococcus
EIREADGIIIAADRQVDLS

SEQ ID NO: 1869091 - protein, 21 aa, Staphylococcus
EKMMGDGVGFIPEKGEIVAPF

SEQ ID NO: 1869092 - protein, 17 aa, Staphylococcus
EKRRLDSVITHMSDGIL

SEQ ID NO: 1869093 - protein, 20 aa, Staphylococcus
ELFELPLVLIMTFALLISSY

SEQ ID NO: 1869094 - protein, 21 aa, Staphylococcus
ELLDKICGLLGGRVSEDINFH

SEQ ID NO: 1869095 - protein, 21 aa, Staphylococcus
ELLDKICGLLGGRVSEDINFN

SEQ ID NO: 1869096 - protein, 25 aa, Staphylococcus
ELLNPALQIMVYWFVFGMGIRSNQP

SEQ ID NO: 1869097 - protein, 25 aa, Staphylococcus
ELLNPALQIMVYWLVFGLGIRSNNP

SEQ ID NO: 1869098 - protein, 18 aa, Staphylococcus
EMLIVFTALMIIANFYYI

SEQ ID NO: 1869099 - protein, 20 aa, Staphylococcus
EPKLRYTAVEKGDINLIDAY

SEQ ID NO: 1869100 - protein, 23 aa, Staphylococcus
EQVNKDIVGWIHLSDSTLNYPVL

SEQ ID NO: 1869101 - protein, 28 aa, Staphylococcus
ESIIKLNPVCMVKNPIMFVVEVGMMLSL

SEQ ID NO: 1869102 - protein, 17 aa, Staphylococcus
ESMGGAVGASFKWYDFV

SEQ ID NO: 1869103 - protein, 18 aa, Staphylococcus
ESSVKGFATMLLLGILMI

SEQ ID NO: 1869104 - protein, 21 aa, Staphylococcus
EVHVASEFVYNMPLLSEKPLF

SEQ ID NO: 1869105 - protein, 26 aa, Staphylococcus
EVKGNLLLELAVIFGVSSLVTAFLKT

SEQ ID NO: 1869106 - protein, 20 aa, Staphylococcus
EVKKAVTVPDYPSSKGTPEV

SEQ ID NO: 1869107 - protein, 20 aa, Staphylococcus
EVKKAVTVPDYPSSKGTPVV

SEQ ID NO: 1869108 - protein, 18 aa, Staphylococcus
FAAAWVFRERFFELLHIG

SEQ ID NO: 1869109 - protein, 18 aa, Staphylococcus
FAAAWVFRERYFEMLHIG

SEQ ID NO: 1869110 - protein, 18 aa, Staphylococcus
FADMAILLGLNWLAILLY

SEQ ID NO: 1869111 - protein, 19 aa, Staphylococcus
FALIIPILYRFFKKIHLGW

SEQ ID NO: 1869112 - protein, 26 aa, Staphylococcus
FANTVLRSMFSFGFLFGPLIGAYLIQ

SEQ ID NO: 1869113 - protein, 26 aa, Staphylococcus
FANTVLRSMFSLGFLFGPFIGSQLIE

SEQ ID NO: 1869114 - protein, 19 aa, Staphylococcus
FDAFIVRMTLIPALTKLFG

SEQ ID NO: 1869115 - protein, 19 aa, Staphylococcus
FDIPNFTLTLAVMIGLAVG

SEQ ID NO: 1869116 - protein, 24 aa, Staphylococcus
FDTIAWGSILGYFGYGYMFGSLLG

SEQ ID NO: 1869117 - protein, 18 aa, Staphylococcus
FETEALLADYNKAKTLER

SEQ ID NO: 1869118 - protein, 29 aa, Staphylococcus
FFLDVKLTFAAIFIFPFYILTVYFFFGRL

SEQ ID NO: 1869119 - protein, 17 aa, Staphylococcus
FFSSWFLTFGYVCVVAL

SEQ ID NO: 1869120 - protein, 19 aa, Staphylococcus
FGETEFWLSLIKVITIIVF

SEQ ID NO: 1869121 - protein, 17 aa, Staphylococcus
FIMYTIVKIVFKNANLT

SEQ ID NO: 1869122 - protein, 17 aa, Staphylococcus
FIPLFYIIFGLKTRDES

SEQ ID NO: 1869123 - protein, 19 aa, Staphylococcus
FIVFIGFDLIRPALTNYYS

SEQ ID NO: 1869124 - protein, 18 aa, Staphylococcus
FIVFIGFDMIRPAITNYF

SEQ ID NO: 1869125 - protein, 26 aa, Staphylococcus
FKLYECDDCSECPLKNQCMNFNSKTN

SEQ ID NO: 1869126 - protein, 18 aa, Staphylococcus
FLDGLAFMMADIFNITVG

SEQ ID NO: 1869127 - protein, 17 aa, Staphylococcus
FLFFNFHPAKIFLGDSG

SEQ ID NO: 1869128 - protein, 23 aa, Staphylococcus
FLGGFILAIAMERWNLHTRVALT

SEQ ID NO: 1869129 - protein, 19 aa, Staphylococcus
FLIICEFFYGIPFLGGSVI

SEQ ID NO: 1869130 - protein, 19 aa, Staphylococcus
FLILCIGIVVVLISVKKNL

SEQ ID NO: 1869131 - protein, 24 aa, Staphylococcus
FLPALIGWSSMRVFGGSPILGLVL

SEQ ID NO: 1869132 - protein, 17 aa, Staphylococcus
FLPQFILGLDGMPRRLY

SEQ ID NO: 1869133 - protein, 19 aa, Staphylococcus
FLVIFCWQPIHFYALAIKR

SEQ ID NO: 1869134 - protein, 20 aa, Staphylococcus
FMISILFFKLLTEFINIMIH

SEQ ID NO: 1869135 - protein, 18 aa, Staphylococcus
FMKAILGFTRMSVRGLNK

SEQ ID NO: 1869136 - protein, 22 aa, Staphylococcus
FMQGEFPVMMFGLPAAALAIYH

SEQ ID NO: 1869137 - protein, 23 aa, Staphylococcus
FNLYVMFEIMLLASFVLVTLGQS

SEQ ID NO: 1869138 - protein, 17 aa, Staphylococcus
FPFHIWLPKAMAAPTPV

SEQ ID NO: 1869139 - protein, 20 aa, Staphylococcus
FPGLYFYAPFLSFIGGVIPF

SEQ ID NO: 1869140 - protein, 21 aa, Staphylococcus
FPILRKFKVATPIFKPLFAWQ

SEQ ID NO: 1869141 - protein, 18 aa, Staphylococcus
FPKSIIFIAPMIVFLFVF

SEQ ID NO: 1869142 - protein, 24 aa, Staphylococcus
FPQDWTIFYWSWWLVYAPFIGLFI

SEQ ID NO: 1869143 - protein, 25 aa, Staphylococcus
FQIQSFKVIIVIAFLGAIIVTILVV

SEQ ID NO: 1869144 - protein, 18 aa, Staphylococcus
FQQIEAIEVKKCDFKDDL

SEQ ID NO: 1869145 - protein, 17 aa, Staphylococcus
FQVEGQRVMTIDKDTVN

SEQ ID NO: 1869146 - protein, 19 aa, Staphylococcus
FQWALTIFVFFVVTMALSL

SEQ ID NO: 1869147 - protein, 22 aa, Staphylococcus
FRRTISFFLVFTMLFSAGVVPL

SEQ ID NO: 1869148 - protein, 17 aa, Staphylococcus
FSDGSKVVIPKAKDGVN

SEQ ID NO: 1869149 - protein, 18 aa, Staphylococcus
FSLALLIGLISGVFSSVF

SEQ ID NO: 1869150 - protein, 23 aa, Staphylococcus
FVLASLAIYWAMWPTTAEVIFII

SEQ ID NO: 1869151 - protein, 18 aa, Staphylococcus
FVWAIAYGSCIGWGAFIL

SEQ ID NO: 1869152 - protein, 26 aa, Staphylococcus
FWFKFWSVIESGGWVIFNHMEIVFVV

SEQ ID NO: 1869153 - protein, 18 aa, Staphylococcus
GANGRVTITPTRPIPEGN

SEQ ID NO: 1869154 - protein, 17 aa, Staphylococcus
GASGFFMSFQMALFSFV

SEQ ID NO: 1869155 - protein, 17 aa, Staphylococcus
GCLPMLIQMPIIMGLYF

SEQ ID NO: 1869156 - protein, 21 aa, Staphylococcus
GEALSTLWIFILAPLLGAVIA

SEQ ID NO: 1869157 - protein, 19 aa, Staphylococcus
GEIPKIWHGGIAIHGGLIG

SEQ ID NO: 1869158 - protein, 17 aa, Staphylococcus
GEMFVWPAVPTIANQLA

SEQ ID NO: 1869159 - protein, 25 aa, Staphylococcus
GFMVGWTYWLTWIISGMAEVTAVAK

SEQ ID NO: 1869160 - protein, 25 aa, Staphylococcus
GFVTGWTYWFCWIITGMAEVTAVAK

SEQ ID NO: 1869161 - protein, 27 aa, Staphylococcus
GGAIKWDFQTLIGFVFAPFAFLAGVPW

SEQ ID NO: 1869162 - protein, 19 aa, Staphylococcus
GGFSDKIVPIILGIIAAIS

SEQ ID NO: 1869163 - protein, 22 aa, Staphylococcus
GGHLNPAVSLGMFLDKRLSLIN

SEQ ID NO: 1869164 - protein, 24 aa, Staphylococcus
GGIGDLALVYGYQRFDTLVIIITV

SEQ ID NO: 1869165 - protein, 17 aa, Staphylococcus
GGIRIALVVAIGIVAIG

SEQ ID NO: 1869166 - protein, 20 aa, Staphylococcus
GGYRGGPAYYITKGLNQKWL

SEQ ID NO: 1869167 - protein, 29 aa, Staphylococcus
GIAKAGNVFPVLSPILGWIGVFMTGSVVN

SEQ ID NO: 1869168 - protein, 19 aa, Staphylococcus
GIEVLIHIGIDTVKLNGEG

SEQ ID NO: 1869169 - protein, 26 aa, Staphylococcus
GIGSDILYWGVIEWAFYYQVPPNGAK

SEQ ID NO: 1869170 - protein, 21 aa, Staphylococcus
GIIAAIAFLILCIGIVVVLIS

SEQ ID NO: 1869171 - protein, 17 aa, Staphylococcus
GILSIPITIIWIVAITN

SEQ ID NO: 1869172 - protein, 24 aa, Staphylococcus
GINPEYYAVIDFTGFEKMIDELEP

SEQ ID NO: 1869173 - protein, 20 aa, Staphylococcus
GKALMLPVAILPAAGILLAF

SEQ ID NO: 1869174 - protein, 21 aa, Staphylococcus
GKSFMLPIAILPAVGLLLGIG

SEQ ID NO: 1869175 - protein, 24 aa, Staphylococcus
GKVFGCLGIALAMYSTTPKENRKK

SEQ ID NO: 1869176 - protein, 23 aa, Staphylococcus
GLAAQMTYHFVLAMFPMLIFLLT

SEQ ID NO: 1869177 - protein, 25 aa, Staphylococcus
GLDGLRAIAVLGIIIYHLNRKWLTG

SEQ ID NO: 1869178 - protein, 19 aa, Staphylococcus
GLEGAAFAIVGWVGIKLVV

SEQ ID NO: 1869179 - protein, 26 aa, Staphylococcus
GLGAMWKFPYMAGIYGGGAFLLMFLI

SEQ ID NO: 1869180 - protein, 25 aa, Staphylococcus
GLGGMGISMGMSWAAANDIGRNFAG

SEQ ID NO: 1869181 - protein, 30 aa, Staphylococcus; identical to SEQ ID NO: 1736951

SEQ ID NO: 1869182 - protein, 17 aa, Staphylococcus
GLLGGRVSEDINFGEVS

SEQ ID NO: 1869183 - protein, 17 aa, Staphylococcus
GLLGGRVSEDINFHEVS

SEQ ID NO: 1869184 - protein, 17 aa, Staphylococcus
GLLGGRVSEDINFNEVS

SEQ ID NO: 1869185 - protein, 24 aa, Staphylococcus
GLLIGMALVRFRLTLMRRGIENIN

SEQ ID NO: 1869186 - protein, 19 aa, Staphylococcus
GLMGLKGLPIIATIALITL

SEQ ID NO: 1869187 - protein, 24 aa, Staphylococcus
GMFLDKRLSLINLFIYTISQTMGA

SEQ ID NO: 1869188 - protein, 24 aa, Staphylococcus
GMVGESTFEFILHPLFSSIGIPEA

SEQ ID NO: 1869189 - protein, 18 aa, Staphylococcus
GNLLPFYFMRQTFLAHLA

SEQ ID NO: 1869190 - protein, 18 aa, Staphylococcus
GNTVVHFSDGHSITVPKG

SEQ ID NO: 1869191 - protein, 18 aa, Staphylococcus
GPIPISWTPFGELFSGLF

SEQ ID NO: 1869192 - protein, 17 aa, Staphylococcus
GQMSIWNFLFLRRALPL

SEQ ID NO: 1869193 - protein, 19 aa, Staphylococcus
GQPAHLFFMIAAPEGGAQT

SEQ ID NO: 1869194 - protein, 30 aa, Staphylococcus; identical to SEQ ID NO: 1741669

SEQ ID NO: 1869195 - protein, 32 aa, Staphylococcus
GRLFGVTFKELWLPILTICFILAISKITTYGG

SEQ ID NO: 1869196 - protein, 33 aa, Staphylococcus; identical to SEQ ID NO: 1575142

SEQ ID NO: 1869197 - protein, 19 aa, Staphylococcus
GRVPAIIALVVYALLPILR

SEQ ID NO: 1869198 - protein, 25 aa, Staphylococcus
GSASAKWGILAPIFVPMLILVGFHP

SEQ ID NO: 1869199 - protein, 19 aa, Staphylococcus
GSLFKRYTNTYSHDEEKLI

SEQ ID NO: 1869200 - protein, 21 aa, Staphylococcus
GSVFLPFLISGFLFYICLPFQ

SEQ ID NO: 1869201 - protein, 25 aa, Staphylococcus
GSVSLRNIWDMTWIIPLILILILIA

SEQ ID NO: 1869202 - protein, 17 aa, Staphylococcus
GTITFIVFMIFLITKFS

SEQ ID NO: 1869203 - protein, 22 aa, Staphylococcus
GTKESAGFGFIGMIGPISAFKF

SEQ ID NO: 1869204 - protein, 23 aa, Staphylococcus
GTYAIMFPLTFKFGPENSNVIMI

SEQ ID NO: 1869205 - protein, 19 aa, Staphylococcus
GVATKVGTYPIVVISTDAE

SEQ ID NO: 1869206 - protein, 18 aa, Staphylococcus
GVGAEYILGAFLAGVVVS

SEQ ID NO: 1869207 - protein, 26 aa, Staphylococcus
GVMYIPHFLSWVVVVGIFQKVLAPDS

SEQ ID NO: 1869208 - protein, 27 aa, Staphylococcus
GYVGVWLYHFLERVLIPTGLHHFIYAP

SEQ ID NO: 1869209 - protein, 19 aa, Staphylococcus
HEASRKGSIFMDYRNAIAQ

SEQ ID NO: 1869210 - protein, 20 aa, Staphylococcus
HGLFSSIMGMGFISAFLSSI

SEQ ID NO: 1869211 - protein, 18 aa, Staphylococcus
HIRSMMWTTIPASIIGLI

SEQ ID NO: 1869212 - protein, 35 aa, Staphylococcus
HMFFAKRAGIMCPEFAIGMGPKIFSFRKNETLYTI

SEQ ID NO: 1869213 - protein, 17 aa, Staphylococcus
HWGIHAWAVYGIVALVF

SEQ ID NO: 1869214 - protein, 18 aa, Staphylococcus
HYTTYIVLGVKHPNETDD

SEQ ID NO: 1869215 - protein, 20 aa, Staphylococcus
IAPWLGRTALTWIVDMSSTG

SEQ ID NO: 1869216 - protein, 17 aa, Staphylococcus
IEDHLFRITQEAISNTL

SEQ ID NO: 1869217 - protein, 24 aa, Staphylococcus
IFDNLPIIFALGVAIGLAGGDGVA

SEQ ID NO: 1869218 - protein, 20 aa, Staphylococcus
IGGGYLIWLWLREGQSSWLG

SEQ ID NO: 1869219 - protein, 25 aa, Staphylococcus
IGIKGTPLSAGFGYTGLVGPINALN

SEQ ID NO: 1869220 - protein, 19 aa, Staphylococcus
IGNAMEWFDFGLYSYLAVI

SEQ ID NO: 1869221 - protein, 17 aa, Staphylococcus
IGNAMEWFDFGVYAYTT

SEQ ID NO: 1869222 - protein, 25 aa, Staphylococcus
IGSDILYWGVIEWAFYYQVPPNGAK

SEQ ID NO: 1869223 - protein, 17 aa, Staphylococcus
IGSLLFVIFHLGRIAIV

SEQ ID NO: 1869224 - protein, 28 aa, Staphylococcus
IGTAISLFITVILGFFIARTITRPITDM

SEQ ID NO: 1869225 - protein, 20 aa, Staphylococcus
IGVILMRFAATWFVELLNKY

SEQ ID NO: 1869226 - protein, 17 aa, Staphylococcus
IIASLFIPFGASIGLDT

SEQ ID NO: 1869227 - protein, 20 aa, Staphylococcus
IIDASQLKKGDIVRVETGEQ

SEQ ID NO: 1869228 - protein, 28 aa, Staphylococcus
IIKDHGRLVAKINIAKHGLWKQLQVEDQ

SEQ ID NO: 1869229 - protein, 17 aa, Staphylococcus
IILPQAIRVSIPALGNT

SEQ ID NO: 1869230 - protein, 20 aa, Staphylococcus
IIVGSLLFLGNPAHAAEANT

SEQ ID NO: 1869231 - protein, 20 aa, Staphylococcus
IKEGLVARFQELRAMGIETV

SEQ ID NO: 1869232 - protein, 17 aa, Staphylococcus
IKKNSSYERIYDKAKKQ

SEQ ID NO: 1869233 - protein, 25 aa, Staphylococcus
IKQVFWRILLFYILAIFIIGMLIPY

SEQ ID NO: 1869234 - protein, 25 aa, Staphylococcus
IKQVFWRILLFYILAIFVIGMLIPY

SEQ ID NO: 1869235 - protein, 20 aa, Staphylococcus
IKRVKEAGGHIPDDLDTYVN

SEQ ID NO: 1869236 - protein, 17 aa, Staphylococcus
IKYETMSFLTLPPKEVF

SEQ ID NO: 1869237 - protein, 17 aa, Staphylococcus
ILCLIGLVMVYSASMVA

SEQ ID NO: 1869238 - protein, 17 aa, Staphylococcus
ILLAWIVAAVLRIALGS

SEQ ID NO: 1869239 - protein, 18 aa, Staphylococcus
ILTICIIGKLLYESLETI

SEQ ID NO: 1869240 - protein, 18 aa, Staphylococcus
ILVYSMLTAFLFIDKVFV

SEQ ID NO: 1869241 - protein, 17 aa, Staphylococcus
IMFVVEVGMMLSLILTM

SEQ ID NO: 1869242 - protein, 19 aa, Staphylococcus
INGSKSWINLGFMNLQASE

SEQ ID NO: 1869243 - protein, 18 aa, Staphylococcus
INSVPIRILIFYVGALAV

SEQ ID NO: 1869244 - protein, 17 aa, Staphylococcus
IPAQPTLLFAVDLDETK

SEQ ID NO: 1869245 - protein, 17 aa, Staphylococcus
IPAQPTLLFAVNLDETG

SEQ ID NO: 1869246 - protein, 18 aa, Staphylococcus
IPITIIWIVAITNAINLI

SEQ ID NO: 1869247 - protein, 22 aa, Staphylococcus
IPKELTEQYLAKGYSRNDRVGK

SEQ ID NO: 1869248 - protein, 21 aa, Staphylococcus
IPKNRGKMIGVVYTGFSGANV

SEQ ID NO: 1869249 - protein, 21 aa, Staphylococcus
IPLSFAYVIFIVFWQVGFSNA

SEQ ID NO: 1869250 - protein, 17 aa, Staphylococcus
IPLYAVGVFIPFTLAQF

SEQ ID NO: 1869251 - protein, 22 aa, Staphylococcus
IPRDTISYIPKVGYYDKITHAH

SEQ ID NO: 1869252 - protein, 23 aa, Staphylococcus
IPTFARKRLFGHQSMVWATAGIA

SEQ ID NO: 1869253 - protein, 22 aa, Staphylococcus
IPVLIIAFLFIFFLSQAQGGGG

SEQ ID NO: 1869254 - protein, 17 aa, Staphylococcus
IQAFIHSILFGFPTKKE

SEQ ID NO: 1869255 - protein, 19 aa, Staphylococcus
IQLSIAFIVNCLLLVLGAA

SEQ ID NO: 1869256 - protein, 21 aa, Staphylococcus
ISLAFGVLFDAFVVRMTLIPA

SEQ ID NO: 1869257 - protein, 17 aa, Staphylococcus
ISTGIVMLLARYIPIIL

SEQ ID NO: 1869258 - protein, 21 aa, Staphylococcus
ISTLLVSFIIMFVGIQVVIEN

SEQ ID NO: 1869259 - protein, 25 aa, Staphylococcus
ISVVGIALVFIRQRLTMVILNGIIG

SEQ ID NO: 1869260 - protein, 20 aa, Staphylococcus
ITLLLCYLGFQFGLKKRDEM

SEQ ID NO: 1869261 - protein, 19 aa, Staphylococcus
ITPMLPYALAFAAGAMIFV

SEQ ID NO: 1869262 - protein, 19 aa, Staphylococcus
ITPTRPIPVGDVSAKAYDN

SEQ ID NO: 1869263 - protein, 17 aa, Staphylococcus
IVAGSVCAHKRWLFISS

SEQ ID NO: 1869264 - protein, 23 aa, Staphylococcus
IVARICGISIFSIIKILKDELLL

SEQ ID NO: 1869265 - protein, 19 aa, Staphylococcus
IVKWFKISNPIARGLALGT

SEQ ID NO: 1869266 - protein, 25 aa, Staphylococcus
IVLGGPGAVFWMWIIAFIGAASAFI

SEQ ID NO: 1869267 - protein, 25 aa, Staphylococcus
IVLGGPGAVFWMWIIAFIGAASAFM

SEQ ID NO: 1869268 - protein, 26 aa, Staphylococcus
IVSFCFIFLLLLFFRYILKRYFNYML

SEQ ID NO: 1869269 - protein, 23 aa, Staphylococcus
IVSFCIGILLFIGYSIIGLDYGL

SEQ ID NO: 1869270 - protein, 20 aa, Staphylococcus
IVSLYWHFLDVVWIFIFTAV

SEQ ID NO: 1869271 - protein, 17 aa, Staphylococcus
IVVGGLLIAIALTLGGE

SEQ ID NO: 1869272 - protein, 19 aa, Staphylococcus
IYESAKIDGANRWQQIIHI

SEQ ID NO: 1869273 - protein, 25 aa, Staphylococcus
IYHLNRKWLTGGFIGVDTFFVISGY

SEQ ID NO: 1869274 - protein, 20 aa, Staphylococcus
IYLQNLRGFSALDSGLLMLP

SEQ ID NO: 1869275 - protein, 17 aa, Staphylococcus
IYSIGIVLYEMLVGEPP

SEQ ID NO: 1869276 - protein, 33 aa, Staphylococcus; identical to SEQ ID NO: 1658613

SEQ ID NO: 1869277 - protein, 19 aa, Staphylococcus
KALMLPVAILPAAGLLLAI

SEQ ID NO: 1869278 - protein, 27 aa, Staphylococcus
KAVEAGKAIPHWDIFGLHINQVGYQGQ

SEQ ID NO: 1869279 - protein, 20 aa, Staphylococcus
KDNFYIISIEIVFFSLIQEL

SEQ ID NO: 1869280 - protein, 26 aa, Staphylococcus
KFGPRKMITIALVWWSAFTILTGMIK

SEQ ID NO: 1869281 - protein, 21 aa, Staphylococcus
KHHGLLYFVRFLFGVGEAPMY

SEQ ID NO: 1869282 - protein, 17 aa, Staphylococcus
KHTKDYIIFGILIFISV

SEQ ID NO: 1869283 - protein, 20 aa, Staphylococcus
KHVQWAMLIAAFIVGIALFF

SEQ ID NO: 1869284 - protein, 19 aa, Staphylococcus
KIIERFPKSIIFIAPMIVF

SEQ ID NO: 1869285 - protein, 20 aa, Staphylococcus
KKLIICIGLVLFSISEFMFA

SEQ ID NO: 1869286 - protein, 19 aa, Staphylococcus
KKPLPKFLTLFAGPLFNFI

SEQ ID NO: 1869287 - protein, 21 aa, Staphylococcus
KKVIFPFIIASGFIADTTSLP

SEQ ID NO: 1869288 - protein, 19 aa, Staphylococcus
KLFTSLRSKYYLFVSDPVV

SEQ ID NO: 1869289 - protein, 17 aa, Staphylococcus
KLVCVGIASYIGSQTFV

SEQ ID NO: 1869290 - protein, 26 aa, Staphylococcus
KMIVIPVVFCSLALSISGVGESKTVG

SEQ ID NO: 1869291 - protein, 17 aa, Staphylococcus
KNGMIYFGMADIGGAII

SEQ ID NO: 1869292 - protein, 19 aa, Staphylococcus
KNGQLKPGYNLQIATNSQF

SEQ ID NO: 1869293 - protein, 27 aa, Staphylococcus
KNYAKSWLKHLLSYIIGTGILHLVVYL

SEQ ID NO: 1869294 - protein, 26 aa, Staphylococcus
KPAYVEIFCGFILFLFTFIEFNNRNA

SEQ ID NO: 1869295 - protein, 17 aa, Staphylococcus
KQNTEWVGYATPNKAAR

SEQ ID NO: 1869296 - protein, 17 aa, Staphylococcus
KQQDLKGILAFSTVSQL

SEQ ID NO: 1869297 - protein, 18 aa, Staphylococcus
KTSIKRRAYNYNDGTNAK

SEQ ID NO: 1869298 - protein, 30 aa, Staphylococcus
KTTVELGLKTASTWKKFEVYENNKKLPIEL

SEQ ID NO: 1869299 - protein, 23 aa, Staphylococcus
KYAEILDTFVIRTGIQQGDFSYS

SEQ ID NO: 1869300 - protein, 20 aa, Staphylococcus
KYFDVSCVPILSKSKKKLQG

SEQ ID NO: 1869301 - protein, 17 aa, Staphylococcus
KYIKPVMMMALGLVITT

SEQ ID NO: 1869302 - protein, 20 aa, Staphylococcus
KYRLMIGLVAVFLASGATAI

SEQ ID NO: 1869303 - protein, 18 aa, Staphylococcus
LAALFAALMTKVGAYALI

SEQ ID NO: 1869304 - protein, 21 aa, Staphylococcus
LAAQMTYHFVLALFPMLIFLL

SEQ ID NO: 1869305 - protein, 19 aa, Staphylococcus
LAAVMNFIGALTFTGVAGT

SEQ ID NO: 1869306 - protein, 18 aa, Staphylococcus
LAIAVVMGAAFNKIVTSL

SEQ ID NO: 1869307 - protein, 21 aa, Staphylococcus
LAIIICFLFGFGTFGTTPLLN

SEQ ID NO: 1869308 - protein, 24 aa, Staphylococcus
LATIEKWLRKVIPTVLDNLLTPLL

SEQ ID NO: 1869309 - protein, 23 aa, Staphylococcus
LATSLIFSWSVVTGSYSNAAMLN

SEQ ID NO: 1869310 - protein, 23 aa, Staphylococcus
LDNFKEIFKQGTILNALFISLAK

SEQ ID NO: 1869311 - protein, 23 aa, Staphylococcus
LDSGMKGKEFLPFVNRSAIAGIL

SEQ ID NO: 1869312 - protein, 18 aa, Staphylococcus
LFFMYYWIIFGIGCYFGQ

SEQ ID NO: 1869313 - protein, 18 aa, Staphylococcus
LGAMIMGPLVGWLMKKTD

SEQ ID NO: 1869314 - protein, 21 aa, Staphylococcus
LGAVIFINFFNQISIQVLPLF

SEQ ID NO: 1869315 - protein, 27 aa, Staphylococcus
LGFALGWNYWFNWVITVAADVTIAAQV

SEQ ID NO: 1869316 - protein, 20 aa, Staphylococcus
LGGIRLSSVYVISWATLASY

SEQ ID NO: 1869317 - protein, 17 aa, Staphylococcus
LGGPILIYMICKGAVSH

SEQ ID NO: 1869318 - protein, 19 aa, Staphylococcus
LGILFAIGVAIGMAKKNDG

SEQ ID NO: 1869319 - protein, 19 aa, Staphylococcus
LGLIFAIGVAIGMAKKNDG

SEQ ID NO: 1869320 - protein, 22 aa, Staphylococcus
LGNPGKAIAIIFLVLQIAGGGG

SEQ ID NO: 1869321 - protein, 20 aa, Staphylococcus
LGPRIAHAILPIAGKGKSNW

SEQ ID NO: 1869322 - protein, 17 aa, Staphylococcus
LGTAILILFGGGVCANV

SEQ ID NO: 1869323 - protein, 17 aa, Staphylococcus
LGTFILVFFGTGTAVFM

SEQ ID NO: 1869324 - protein, 19 aa, Staphylococcus
LGVIICKLLGLDNYASSAI

SEQ ID NO: 1869325 - protein, 23 aa, Staphylococcus
LGYFLKRINYLKATDSQVLSTLV

SEQ ID NO: 1869326 - protein, 20 aa, Staphylococcus
LHKYPRLFLMLIPVCLLIGV

SEQ ID NO: 1869327 - protein, 22 aa, Staphylococcus
LIDGSFGWKGLLSAVSKGIIGM

SEQ ID NO: 1869328 - protein, 17 aa, Staphylococcus
LIFWYPKMMGYKLNEKL

SEQ ID NO: 1869329 - protein, 17 aa, Staphylococcus
LIFWYPKMMGYKLNETL

SEQ ID NO: 1869330 - protein, 17 aa, Staphylococcus
LIINILLIIGGHPWIAL

SEQ ID NO: 1869331 - protein, 19 aa, Staphylococcus
LILTCIIFLGFLYQLYSKR

SEQ ID NO: 1869332 - protein, 18 aa, Staphylococcus
LIQGVTFIMLFSYISASP

SEQ ID NO: 1869333 - protein, 26 aa, Staphylococcus
LIRDEAWLKKKLNYISKKTYQGIFSF

SEQ ID NO: 1869334 - protein, 22 aa, Staphylococcus
LIRYNKCLLMTKSFIFNSLAFN

SEQ ID NO: 1869335 - protein, 22 aa, Staphylococcus
LIVFRFPPHVAVGTSMMMIFFS

SEQ ID NO: 1869336 - protein, 17 aa, Staphylococcus
LKEIYSNSVGAQFGQDA

SEQ ID NO: 1869337 - protein, 18 aa, Staphylococcus
LKGILAFSTVSQLGMIMS

SEQ ID NO: 1869338 - protein, 20 aa, Staphylococcus
LKSWFAMLFSAGMGIGLVFW

SEQ ID NO: 1869339 - protein, 18 aa, Staphylococcus
LKVTSAYEYLEARFGPSV

SEQ ID NO: 1869340 - protein, 24 aa, Staphylococcus
LLGILLFAYYAWKAPAFTESKLED

SEQ ID NO: 1869341 - protein, 24 aa, Staphylococcus
LLGILLFAYYAWKAPAFTESKLQD

SEQ ID NO: 1869342 - protein, 24 aa, Staphylococcus
LLIIPVLLLFPFVQKHFVKGVNIG

SEQ ID NO: 1869343 - protein, 27 aa, Staphylococcus
LLLICGCIPKLGALANIIPLPVLGGAM

SEQ ID NO: 1869344 - protein, 19 aa, Staphylococcus
LLNYWSVKLLTSFTSLISF

SEQ ID NO: 1869345 - protein, 17 aa, Staphylococcus
LLPLIFALIIPILYRFF

SEQ ID NO: 1869346 - protein, 18 aa, Staphylococcus
LLVLFILIMNLRGLTESA

SEQ ID NO: 1869347 - protein, 20 aa, Staphylococcus
LMIFMLWALLGWKVAVVYFI

SEQ ID NO: 1869348 - protein, 24 aa, Staphylococcus
LMLIPVCLLIGVGYYYKGLILGIM

SEQ ID NO: 1869349 - protein, 23 aa, Staphylococcus
LMLLPCLLFFLIFNYIPMAGLVL

SEQ ID NO: 1869350 - protein, 18 aa, Staphylococcus
LMNMLSLFIFGKIVESIV

SEQ ID NO: 1869351 - protein, 17 aa, Staphylococcus
LMNPLMIFMLWALLGWK

SEQ ID NO: 1869352 - protein, 22 aa, Staphylococcus
LNGKELLGYARFRHDPEGDFGR

SEQ ID NO: 1869353 - protein, 18 aa, Staphylococcus
LNKVCHVQGIQALNVNDL

SEQ ID NO: 1869354 - protein, 17 aa, Staphylococcus
LPEGVTFNPTTNTISGV

SEQ ID NO: 1869355 - protein, 19 aa, Staphylococcus
LPEKLRAQYSQKLEQLKKD

SEQ ID NO: 1869356 - protein, 19 aa, Staphylococcus
LPGDLSLSGAFLVEVILTF

SEQ ID NO: 1869357 - protein, 20 aa, Staphylococcus
LPGILTGFILALSRALGETA

SEQ ID NO: 1869358 - protein, 18 aa, Staphylococcus
LPMLIQMPIIMGLYFVLK

SEQ ID NO: 1869359 - protein, 22 aa, Staphylococcus
LPPKEVFLASVLIGSLGAVMDV

SEQ ID NO: 1869360 - protein, 20 aa, Staphylococcus
LPPLAAMLFIKIGYHPIAGL

SEQ ID NO: 1869361 - protein, 21 aa, Staphylococcus
LPRAGRALFADSLATIVGAIF

SEQ ID NO: 1869362 - protein, 20 aa, Staphylococcus
LPWGEAWIVAQQMAKKIVTN

SEQ ID NO: 1869363 - protein, 17 aa, Staphylococcus
LQAIKFQLLVVFIHTTA

SEQ ID NO: 1869364 - protein, 21 aa, Staphylococcus
LRTAGALGCGIFAIVAQLIMI

SEQ ID NO: 1869365 - protein, 20 aa, Staphylococcus
LSAAKAYTWLVGSLYGATFK

SEQ ID NO: 1869366 - protein, 23 aa, Staphylococcus
LSENRTTLIVAHRLSTITHADKI

SEQ ID NO: 1869367 - protein, 24 aa, Staphylococcus
LSKSKKKLQGMVVVLHDITNLQKL

SEQ ID NO: 1869368 - protein, 28 aa, Staphylococcus
LSLSGAFLVEVILTFVFVFIVLSVTTTK

SEQ ID NO: 1869369 - protein, 17 aa, Staphylococcus
LSLVEKWAVPKGLKVSR

SEQ ID NO: 1869370 - protein, 17 aa, Staphylococcus
LSPILGWIGVFMTGSVV

SEQ ID NO: 1869371 - protein, 21 aa, Staphylococcus
LSTMDGFVEKPFELVEVDGKK

SEQ ID NO: 1869372 - protein, 24 aa, Staphylococcus
LTAGTAFLIWLGDQITQFGVGNGI

SEQ ID NO: 1869373 - protein, 23 aa, Staphylococcus
LTKGELLPIIFFAVFFGLGLAAI

SEQ ID NO: 1869374 - protein, 18 aa, Staphylococcus
LTLGALTIAIGRVIDDSI

SEQ ID NO: 1869375 - protein, 25 aa, Staphylococcus
LTLMRRGIENINMFTFIQLLTPFVT

SEQ ID NO: 1869376 - protein, 18 aa, Staphylococcus
LTPYGIIAIMASTIATSD

SEQ ID NO: 1869377 - protein, 21 aa, Staphylococcus
LVAAFIVGIALFFEVGLVLLI

SEQ ID NO: 1869378 - protein, 19 aa, Staphylococcus
LVGGFFLARKYMMDYLKKN

SEQ ID NO: 1869379 - protein, 18 aa, Staphylococcus
LVIVYVLLIIIGMQIIGL

SEQ ID NO: 1869380 - protein, 25 aa, Staphylococcus
LVLAFKEFRFDTTIFGGQWEGFKYF

SEQ ID NO: 1869381 - protein, 25 aa, Staphylococcus
LVLALPFPIALAIMFNEISHTKKLG

SEQ ID NO: 1869382 - protein, 17 aa, Staphylococcus
LVPGILITNAIRDLLAG

SEQ ID NO: 1869383 - protein, 23 aa, Staphylococcus
LVQNVVKYIVWFIVITTILSKFG

SEQ ID NO: 1869384 - protein, 17 aa, Staphylococcus
LVYVVGLGMVMSSLDQI

SEQ ID NO: 1869385 - protein, 20 aa, Staphylococcus
LYFHKVRGLLAFWIGALLIA

SEQ ID NO: 1869386 - protein, 20 aa, Staphylococcus
LYVMFEIMLLASFVLVTLGQ

SEQ ID NO: 1869387 - protein, 19 aa, Staphylococcus
LYYLSLWYFITFGAFVAFG

SEQ ID NO: 1869388 - protein, 28 aa, Staphylococcus
LYYWGWWLSWSPFVGVFIARVSKGRSIR

SEQ ID NO: 1869389 - protein, 35 aa, Staphylococcus; identical to SEQ ID NO: 1736586

SEQ ID NO: 1869390 - protein, 18 aa, Staphylococcus
MAGLVLAFKEFRFDTTIF

SEQ ID NO: 1869391 - protein, 29 aa, Staphylococcus
MATTSFILAFPMAWIWPFIQNGLNAFSTG

SEQ ID NO: 1869392 - protein, 26 aa, Staphylococcus
MERRSAGSIWAWLLVLVFLPIIGFIL

SEQ ID NO: 1869393 - protein, 34 aa, Staphylococcus; identical to SEQ ID NO: 1574326

SEQ ID NO: 1869394 - protein, 19 aa, Staphylococcus
MFFLLAFSMIVPWRLAMLY

SEQ ID NO: 1869395 - protein, 19 aa, Staphylococcus
MFINKIINRHEMAAKDTTF

SEQ ID NO: 1869396 - protein, 17 aa, Staphylococcus
MGMGFISAFLSSIMNNM

SEQ ID NO: 1869397 - protein, 24 aa, Staphylococcus
MIISGIRLSSVYVISWATLASYVG

SEQ ID NO: 1869398 - protein, 17 aa, Staphylococcus
MLFIMDWQMTLLTFITI

SEQ ID NO: 1869399 - protein, 23 aa, Staphylococcus
MLIVFRFPPHVAVGTSMMMIFFS

SEQ ID NO: 1869400 - protein, 24 aa, Staphylococcus
MLIVFRFPPHVAVGTSMMMIFFSS

SEQ ID NO: 1869401 - protein, 17 aa, Staphylococcus
MLTAFLFIDKVFVNIIY

SEQ ID NO: 1869402 - protein, 18 aa, Staphylococcus
MPLYHNFGNQFFKLGEEA

SEQ ID NO: 1869403 - protein, 19 aa, Staphylococcus
MPLYHNFGNQFFKLGEEAI

SEQ ID NO: 1869404 - protein, 18 aa, Staphylococcus
MQPAHLFFMIAAPEGGAQ

SEQ ID NO: 1869405 - protein, 17 aa, Staphylococcus
MSPKLVMNLAIAFYIIA

SEQ ID NO: 1869406 - protein, 17 aa, Staphylococcus
MSVFFRLAGDLPVFQKS

SEQ ID NO: 1869407 - protein, 17 aa, Staphylococcus
MTGFIAWVGIAISHYRF

SEQ ID NO: 1869408 - protein, 17 aa, Staphylococcus
MTGFIAWVGIAVSHYRF

SEQ ID NO: 1869409 - protein, 23 aa, Staphylococcus
NARPNQHFSIRKFSIGAASITLG

SEQ ID NO: 1869410 - protein, 26 aa, Staphylococcus
NDESKFKTREDFETEALLADYNKAKT

SEQ ID NO: 1869411 - protein, 17 aa, Staphylococcus
NDVVKNFTANGLLSLGA

SEQ ID NO: 1869412 - protein, 18 aa, Staphylococcus
NEKRIRPEDMHIMANIFL

SEQ ID NO: 1869413 - protein, 21 aa, Staphylococcus
NGDLFRFYKNPDFKKINPSKY

SEQ ID NO: 1869414 - protein, 18 aa, Staphylococcus
NGHGFKMFVYIMLLGAIV

SEQ ID NO: 1869415 - protein, 24 aa, Staphylococcus
NGKPFKYDHHYNITYKFNGKDSGS

SEQ ID NO: 1869416 - protein, 24 aa, Staphylococcus
NISSDIFVWFKLVLNDTSEFHNIK

SEQ ID NO: 1869417 - protein, 17 aa, Staphylococcus
NKIGYVMQSNSMMSGSI

SEQ ID NO: 1869418 - protein, 18 aa, Staphylococcus
NKVSGLPEGVTFNPTTNT

SEQ ID NO: 1869419 - protein, 33 aa, Staphylococcus
NKYYFEAELNHAKWWKSFEFYDENNNKLNTVVT

SEQ ID NO: 1869420 - protein, 26 aa, Staphylococcus
NLIIVGLFVICMFVSISMGTSVGTVA

SEQ ID NO: 1869421 - protein, 25 aa, Staphylococcus
NLLLLPRLGAALTVVMTVAGQIIMG

SEQ ID NO: 1869422 - protein, 24 aa, Staphylococcus
NMLIQRLKAGKVYKKERLETAFSN

SEQ ID NO: 1869423 - protein, 21 aa, Staphylococcus
NMRERALEIGATFHIVSLPDS

SEQ ID NO: 1869424 - protein, 19 aa, Staphylococcus
NNAKFANTVLRSMFSFGFL

SEQ ID NO: 1869425 - protein, 18 aa, Staphylococcus
NNRNALFVSGEWELSQTQ

SEQ ID NO: 1869426 - protein, 19 aa, Staphylococcus
NNVPFRILIFYIGSLAVIM

SEQ ID NO: 1869427 - protein, 17 aa, Staphylococcus
NNVPIRILLFYIGGLLV

SEQ ID NO: 1869428 - protein, 22 aa, Staphylococcus
NNYQLALTFAMILLILGFIFSV

SEQ ID NO: 1869429 - protein, 24 aa, Staphylococcus
NPETDDAYIRFDVSNGTKELVIKS

SEQ ID NO: 1869430 - protein, 25 aa, Staphylococcus
NPPFFFSVLLPIVFISALIGILQYT

SEQ ID NO: 1869431 - protein, 24 aa, Staphylococcus
NRAIKRLPIGMVVLDADDHIEWIN

SEQ ID NO: 1869432 - protein, 23 aa, Staphylococcus
NSEFQMIQFIPIVAIPQVFFSGI

SEQ ID NO: 1869433 - protein, 22 aa, Staphylococcus
NVARPSVMTLSAKKPASQQAKS

SEQ ID NO: 1869434 - protein, 20 aa, Staphylococcus
NVFGFTWSKTMEGILMKPYN

SEQ ID NO: 1869435 - protein, 24 aa, Staphylococcus
NYDHEYTTQIAFAKPVPQPAKAQA

SEQ ID NO: 1869436 - protein, 23 aa, Staphylococcus
NYDYTKMVFEQPIYNDESKFKTR

SEQ ID NO: 1869437 - protein, 20 aa, Staphylococcus
NYPSEKGKPTITVDDPSKLP

SEQ ID NO: 1869438 - protein, 18 aa, Staphylococcus
PASMLAIEFGWFLTEMGR

SEQ ID NO: 1869439 - protein, 17 aa, Staphylococcus
PDFPGYASTLFANAMVI

SEQ ID NO: 1869440 - protein, 19 aa, Staphylococcus
PGFSRSGSTISTGVLMKMN

SEQ ID NO: 1869441 - protein, 17 aa, Staphylococcus
PGTYTIPVTVTYPDGSK

SEQ ID NO: 1869442 - protein, 19 aa, Staphylococcus
PHALILTAIVIAFATTAFF

SEQ ID NO: 1869443 - protein, 17 aa, Staphylococcus
PIEYLRQYLAQWTSNKI

SEQ ID NO: 1869444 - protein, 28 aa, Staphylococcus
PIILFLLCLTVFKMKGIYAAITTLVVTL

SEQ ID NO: 1869445 - protein, 21 aa, Staphylococcus
PIILIIVFYFFLIRPQQKRAK

SEQ ID NO: 1869446 - protein, 18 aa, Staphylococcus
PINEVTYATSLIADGYYH

SEQ ID NO: 1869447 - protein, 18 aa, Staphylococcus
PINEVTYATSLLADGYYH

SEQ ID NO: 1869448 - protein, 18 aa, Staphylococcus
PKIAYAFMAAIRMVPLIF

SEQ ID NO: 1869449 - protein, 23 aa, Staphylococcus
PKLAFEIPLRYKIMGIVGSVWGV

SEQ ID NO: 1869450 - protein, 20 aa, Staphylococcus
PKLVMNLAIAFYIIAALLGI

SEQ ID NO: 1869451 - protein, 18 aa, Staphylococcus
PLAGIFAVGIFTKRANTF

SEQ ID NO: 1869452 - protein, 18 aa, Staphylococcus
PLAVMFRFIPTIKEESSA

SEQ ID NO: 1869453 - protein, 18 aa, Staphylococcus
PLLSEKPLFIYISQSGET

SEQ ID NO: 1869454 - protein, 18 aa, Staphylococcus
PLQRLIKLLGDIFIPILP

SEQ ID NO: 1869455 - protein, 21 aa, Staphylococcus
PLVPGILICNAIRDLMAGELL

SEQ ID NO: 1869456 - protein, 30 aa, Staphylococcus; identical to SEQ ID NO: 1744123

SEQ ID NO: 1869457 - protein, 20 aa, Staphylococcus
PMLWANFFWVWGHPEVYIVI

SEQ ID NO: 1869458 - protein, 24 aa, Staphylococcus
PNKTPWWLVIPVGLVYAVIYYVVF

SEQ ID NO: 1869459 - protein, 18 aa, Staphylococcus
PNRMGNLAIKKGWPSMMH

SEQ ID NO: 1869460 - protein, 20 aa, Staphylococcus
PNYVMGLSFITEGAIPFAAA

SEQ ID NO: 1869461 - protein, 20 aa, Staphylococcus
PPFFFNVLLPIVFISALIGI

SEQ ID NO: 1869462 - protein, 18 aa, Staphylococcus
PQVPHWLTVLFIVLILIS

SEQ ID NO: 1869463 - protein, 20 aa, Staphylococcus
PRVKITLMLLISFVAMTGNS

SEQ ID NO: 1869464 - protein, 25 aa, Staphylococcus
PTGSSLKPFLAYGPAIENMQWATNH

SEQ ID NO: 1869465 - protein, 20 aa, Staphylococcus
PTIFNFSLALLIGLISGVFS

SEQ ID NO: 1869466 - protein, 17 aa, Staphylococcus
PTQIFFIQFTILVFCMA

SEQ ID NO: 1869467 - protein, 17 aa, Staphylococcus
PTTAEVILIIILGLPIY

SEQ ID NO: 1869468 - protein, 19 aa, Staphylococcus
PVFLVFFIYHKLRYKTKKI

SEQ ID NO: 1869469 - protein, 17 aa, Staphylococcus
QAGNTVVHFSDGHSITV

SEQ ID NO: 1869470 - protein, 18 aa, Staphylococcus
QDGVGLPLFTALPIVSGM

SEQ ID NO: 1869471 - protein, 17 aa, Staphylococcus
QDLKGILAFSTVSQLGM

SEQ ID NO: 1869472 - protein, 26 aa, Staphylococcus
QFSFMPLKHLWSLAIEEQFYLFFPFV

SEQ ID NO: 1869473 - protein, 25 aa, Staphylococcus
QFTIEVLRLPRIILAILAGMALGIS

SEQ ID NO: 1869474 - protein, 19 aa, Staphylococcus
QFVISFGFLLPVSAPQNML

SEQ ID NO: 1869475 - protein, 17 aa, Staphylococcus
QGLLFWLSGSVSLRNIW

SEQ ID NO: 1869476 - protein, 18 aa, Staphylococcus
QIARSMVTEYGMSKKLGP

SEQ ID NO: 1869477 - protein, 18 aa, Staphylococcus
QIILIAVIVISVYQIYHL

SEQ ID NO: 1869478 - protein, 17 aa, Staphylococcus
QMMFCTIAVSILSGSIA

SEQ ID NO: 1869479 - protein, 24 aa, Staphylococcus
QNIRVVKWLIILLISMLASISVAV

SEQ ID NO: 1869480 - protein, 19 aa, Staphylococcus
QPEIRRALEQLGRGSFLKR

SEQ ID NO: 1869481 - protein, 24 aa, Staphylococcus
QSFFSVRLLLSIVFINLTSPVGMH

SEQ ID NO: 1869482 - protein, 18 aa, Staphylococcus
QSMTVRLGIATGKDLAQM

SEQ ID NO: 1869483 - protein, 18 aa, Staphylococcus
QTLIKYGNVYAQVYVDQQ

SEQ ID NO: 1869484 - protein, 18 aa, Staphylococcus
QVEGIGFAIPSNEVKVTI

SEQ ID NO: 1869485 - protein, 24 aa, Staphylococcus
QVFKDIFPLSAVIIIIYALDLLSR

SEQ ID NO: 1869486 - protein, 22 aa, Staphylococcus
QVNKRAVNFYVRKKEENKLSHM

SEQ ID NO: 1869487 - protein, 24 aa, Staphylococcus
RAFIIPFSIAYFFEGAGYIVTGTF

SEQ ID NO: 1869488 - protein, 20 aa, Staphylococcus
RASPVMHHVFWISFVAIFVG

SEQ ID NO: 1869489 - protein, 22 aa, Staphylococcus
REWMSTWTLYYWGWWLSWSPFV

SEQ ID NO: 1869490 - protein, 28 aa, Staphylococcus
RISHLVLTRTGLYIIDSQLLKGHVYNGI

SEQ ID NO: 1869491 - protein, 20 aa, Staphylococcus
RITKGFKQLIILSVIIGEFS

SEQ ID NO: 1869492 - protein, 19 aa, Staphylococcus
RKEVTPESPAIEANEEHVN

SEQ ID NO: 1869493 - protein, 18 aa, Staphylococcus
RKGSIFMDYRNAIAQPDL

SEQ ID NO: 1869494 - protein, 19 aa, Staphylococcus
RLAREVKTSIKRRAYNYND

SEQ ID NO: 1869495 - protein, 22 aa, Staphylococcus
RLLPPNYKYLIPFNALAGANLM

SEQ ID NO: 1869496 - protein, 20 aa, Staphylococcus
RMQREHVHISLIIDEYGGTA

SEQ ID NO: 1869497 - protein, 22 aa, Staphylococcus
RPDVKGREAILHVHSKNKPLDE

SEQ ID NO: 1869498 - protein, 22 aa, Staphylococcus
RRIKSDGSYEIIDASQLKKGDI

SEQ ID NO: 1869499 - protein, 20 aa, Staphylococcus
RRVVLPAALPGILTGFILSL

SEQ ID NO: 1869500 - protein, 18 aa, Staphylococcus
RSIIAGIMMSFARAIGEF

SEQ ID NO: 1869501 - protein, 24 aa, Staphylococcus
RSILVPLKAVLGFILSLMATLGFT

SEQ ID NO: 1869502 - protein, 24 aa, Staphylococcus
RSILVPLKAVLGFVLSLMATLGFT

SEQ ID NO: 1869503 - protein, 17 aa, Staphylococcus
RSTFFHWGFHAWAIYGV

SEQ ID NO: 1869504 - protein, 21 aa, Staphylococcus
RTNTISGVATKVGTYPIVVIS

SEQ ID NO: 1869505 - protein, 24 aa, Staphylococcus
RTNTISGVVTKVGTYPIVVTSTDA

SEQ ID NO: 1869506 - protein, 18 aa, Staphylococcus
RVLGRPAGFVVTFLDIFK

SEQ ID NO: 1869507 - protein, 21 aa, Staphylococcus
RVRKVVQGFLWLVFPANIYAA

SEQ ID NO: 1869508 - protein, 19 aa, Staphylococcus
RYIKPVMLMALGLVITTVI

SEQ ID NO: 1869509 - protein, 19 aa, Staphylococcus
SAFTFKVVIQLGSVFAAAW

SEQ ID NO: 1869510 - protein, 24 aa, Staphylococcus
SANDGLRARCIEISDVFTTSADNA

SEQ ID NO: 1869511 - protein, 18 aa, Staphylococcus
SASILGLIGAGGIGTPLI

SEQ ID NO: 1869512 - protein, 18 aa, Staphylococcus
SDAINHVQPVVVKKDEAK

SEQ ID NO: 1869513 - protein, 17 aa, Staphylococcus
SEIKKNSSYERIYDKAK

SEQ ID NO: 1869514 - protein, 20 aa, Staphylococcus
SEIRIPRDLGAVLVGMALAV

SEQ ID NO: 1869515 - protein, 21 aa, Staphylococcus
SELSVLIASKVLRKEISEQDQ

SEQ ID NO: 1869516 - protein, 25 aa, Staphylococcus
SETTRISDALIRMQREHVHISLIID

SEQ ID NO: 1869517 - protein, 24 aa, Staphylococcus
SFFSSWFLTFGYICVVALNATAFS

SEQ ID NO: 1869518 - protein, 24 aa, Staphylococcus
SFIFLCIFSFGILSSSSAFAEGQS

SEQ ID NO: 1869519 - protein, 20 aa, Staphylococcus
SGLASLAAACFLIRDGQMDG

SEQ ID NO: 1869520 - protein, 19 aa, Staphylococcus
SGLPNGVTFDSRTNTISGV

SEQ ID NO: 1869521 - protein, 23 aa, Staphylococcus
SGMLGAISIVIADLIGRTLFLPK

SEQ ID NO: 1869522 - protein, 23 aa, Staphylococcus
SGRLPSWAVGFSIYATTLSAITF

SEQ ID NO: 1869523 - protein, 26 aa, Staphylococcus
SGSVGEMFRPFALAITFSLLASLLVS

SEQ ID NO: 1869524 - protein, 25 aa, Staphylococcus
SIATGIACGFIFYPITMLISKRHKE

SEQ ID NO: 1869525 - protein, 17 aa, Staphylococcus
SIKEIKVGKLIQFISFF

SEQ ID NO: 1869526 - protein, 23 aa, Staphylococcus
SIVVLWLYFRKSIPKTFDTENLS

SEQ ID NO: 1869527 - protein, 22 aa, Staphylococcus
SKKTYQGIFSFNVLGLQDIHRN

SEQ ID NO: 1869528 - protein, 18 aa, Staphylococcus
SKLFKLSWIVLAVLLVGY

SEQ ID NO: 1869529 - protein, 24 aa, Staphylococcus
SKLIEFVGFLGISYVTFKSVQLIM

SEQ ID NO: 1869530 - protein, 21 aa, Staphylococcus
SKLPFDVLDAMGGKENIKHLD

SEQ ID NO: 1869531 - protein, 22 aa, Staphylococcus
SKVALLAAFIPIISGMSGNSGT

SEQ ID NO: 1869532 - protein, 18 aa, Staphylococcus
SKVFDYILVFFLFGIAVT

SEQ ID NO: 1869533 - protein, 21 aa, Staphylococcus
SKVTMPRKEVTPESPAIEANE

SEQ ID NO: 1869534 - protein, 18 aa, Staphylococcus
SLGNKFAIFLMVVLVILG

SEQ ID NO: 1869535 - protein, 24 aa, Staphylococcus
SLIPFVIAQYFYKKTNGFFLLAPL

SEQ ID NO: 1869536 - protein, 22 aa, Staphylococcus
SNVKETKALFVTTNELARRLQK

SEQ ID NO: 1869537 - protein, 19 aa, Staphylococcus
SPTQLASAFAAIANGGTYN

SEQ ID NO: 1869538 - protein, 25 aa, Staphylococcus
SPVAHWVWGGGWIQQLGALDYAGGT

SEQ ID NO: 1869539 - protein, 21 aa, Staphylococcus
SRTYLFSIFFILLLTLIFANF

SEQ ID NO: 1869540 - protein, 21 aa, Staphylococcus
SSWFLTFGYVCVVALNATAFS

SEQ ID NO: 1869541 - protein, 25 aa, Staphylococcus
SVCAHKRWLFISSTLIKQTVRSSLI

SEQ ID NO: 1869542 - protein, 24 aa, Staphylococcus
SVGYRAQLTLSIGVGEGSENLIDL

SEQ ID NO: 1869543 - protein, 24 aa, Staphylococcus
SVQLLDKDGRVIGSGTTGANGRVT

SEQ ID NO: 1869544 - protein, 20 aa, Staphylococcus
SWFLTFGYVCVVALNATAFS

SEQ ID NO: 1869545 - protein, 25 aa, Staphylococcus
SWSPFIGGFVARVSRGRTIREFIMC

SEQ ID NO: 1869546 - protein, 17 aa, Staphylococcus
SYHAGLVGKEYLEKWAG

SEQ ID NO: 1869547 - protein, 17 aa, Staphylococcus
TAADGWVGVTIIFGAFA

SEQ ID NO: 1869548 - protein, 17 aa, Staphylococcus
TAKEIREADGIIIAADR

SEQ ID NO: 1869549 - protein, 17 aa, Staphylococcus
TALLLLIPIFISYKEGL

SEQ ID NO: 1869550 - protein, 17 aa, Staphylococcus
TALTWIVDMSSTGVSVA

SEQ ID NO: 1869551 - protein, 17 aa, Staphylococcus
TDMRLIGIRDRLVKEKR

SEQ ID NO: 1869552 - protein, 17 aa, Staphylococcus
TDQAGNTVVHFSDGHSI

SEQ ID NO: 1869553 - protein, 20 aa, Staphylococcus
TDTGAYIFGRLMGKHKLWPV

SEQ ID NO: 1869554 - protein, 17 aa, Staphylococcus
TGAVTIPDYPADKEQPT

SEQ ID NO: 1869555 - protein, 17 aa, Staphylococcus
TGLPIVLGCTFTAVAPM

SEQ ID NO: 1869556 - protein, 18 aa, Staphylococcus
TGLSAIWITIGLTLGAYI

SEQ ID NO: 1869557 - protein, 17 aa, Staphylococcus
TGTGFAFSSFTSGKQMD

SEQ ID NO: 1869558 - protein, 21 aa, Staphylococcus
TGVIGTFFFGFILRLLGPFGL

SEQ ID NO: 1869559 - protein, 22 aa, Staphylococcus
THCVTRLRLVLKDDNKVDKDAL

SEQ ID NO: 1869560 - protein, 19 aa, Staphylococcus
TKAIQLLKGILFIVIGQQV

SEQ ID NO: 1869561 - protein, 20 aa, Staphylococcus
TKDYIIFGILIFISVAGLIA

SEQ ID NO: 1869562 - protein, 25 aa, Staphylococcus
TKYHKYRLEVLSAYQTTTKDNYIQT

SEQ ID NO: 1869563 - protein, 26 aa, Staphylococcus
TLFLPKEVPAGIFIAAFGAPFFIYLL

SEQ ID NO: 1869564 - protein, 23 aa, Staphylococcus
TLIFGAFAFFWFVGIHGPSIVEP

SEQ ID NO: 1869565 - protein, 20 aa, Staphylococcus
TLRVKDFLALGVGTIVSTSI

SEQ ID NO: 1869566 - protein, 17 aa, Staphylococcus
TLVAFNFISGVLTLPGL

SEQ ID NO: 1869567 - protein, 18 aa, Staphylococcus
TLVAFNFISGVLTLPGLA

SEQ ID NO: 1869568 - protein, 18 aa, Staphylococcus
TMLLTCITYVILFLYSFI

SEQ ID NO: 1869569 - protein, 17 aa, Staphylococcus
TMWQMANNFSMWRLFGI

SEQ ID NO: 1869570 - protein, 19 aa, Staphylococcus
TNKFGFIANHYSIRKFSVG

SEQ ID NO: 1869571 - protein, 18 aa, Staphylococcus
TNKPAVLLELGYISNPTD

SEQ ID NO: 1869572 - protein, 19 aa, Staphylococcus
TPFCSCSTIPILAGLLNSK

SEQ ID NO: 1869573 - protein, 20 aa, Staphylococcus
TPFCSCSTIPILAGLLNSKV

SEQ ID NO: 1869574 - protein, 18 aa, Staphylococcus
TPFGELFSGVFMGMIIIL

SEQ ID NO: 1869575 - protein, 25 aa, Staphylococcus
TQIFGIPVFLFLNLVIILLCIIVGS

SEQ ID NO: 1869576 - protein, 22 aa, Staphylococcus
TQKLPRLVMFGFSINEKYIKSL

SEQ ID NO: 1869577 - protein, 23 aa, Staphylococcus
TRKSEGISLFSLSLVLGTAIGPF

SEQ ID NO: 1869578 - protein, 18 aa, Staphylococcus
TRSGKIMRRVLKAWELDL

SEQ ID NO: 1869579 - protein, 24 aa, Staphylococcus
TSKLFDIVIQWGVLALIVIFQPEI

SEQ ID NO: 1869580 - protein, 18 aa, Staphylococcus
TSTIKWTGPSVIFAYLIA

SEQ ID NO: 1869581 - protein, 18 aa, Staphylococcus
TSYGAGIIHFLGGIHEIY

SEQ ID NO: 1869582 - protein, 23 aa, Staphylococcus
TTIGGLLSAIGIAGMDRVTQFNI

SEQ ID NO: 1869583 - protein, 18 aa, Staphylococcus
TVILLIAILYKLNLAHVA

SEQ ID NO: 1869584 - protein, 19 aa, Staphylococcus
VAAVLRIALGSATVAAIST

SEQ ID NO: 1869585 - protein, 26 aa, Staphylococcus
VAELPMFSGWGLRSIIYIFILIAAIT

SEQ ID NO: 1869586 - protein, 17 aa, Staphylococcus
VAKYFAILPAMFMSAMP

SEQ ID NO: 1869587 - protein, 18 aa, Staphylococcus
VALLAAFIPIISGMSGNS

SEQ ID NO: 1869588 - protein, 22 aa, Staphylococcus
VAPEHPIKLILPIITLVGGTVG

SEQ ID NO: 1869589 - protein, 25 aa, Staphylococcus
VASSQKFLIIYSIIFMLVIVAVVLT

SEQ ID NO: 1869590 - protein, 17 aa, Staphylococcus
VAVVYFVVLAIFSILTG

SEQ ID NO: 1869591 - protein, 24 aa, Staphylococcus
VCAHKRWLFISSTLIKQTVRSSLI

SEQ ID NO: 1869592 - protein, 27 aa, Staphylococcus
VDAVIDLRFPRIFIALFVGAILAVSGA

SEQ ID NO: 1869593 - protein, 22 aa, Staphylococcus
VDGIKIMAYIGVVILTANGFAG

SEQ ID NO: 1869594 - protein, 22 aa, Staphylococcus
VDIFMCGVATFLQANKITGTGL

SEQ ID NO: 1869595 - protein, 19 aa, Staphylococcus
VDISPNMLIQRLKAGKVYK

SEQ ID NO: 1869596 - protein, 22 aa, Staphylococcus
VEGIKIMSFIGVVILSANGFAG

SEQ ID NO: 1869597 - protein, 34 aa, Staphylococcus
VEGKEIYNSIVKVDFPTIGYSGQYHVRIKNNAIS

SEQ ID NO: 1869598 - protein, 22 aa, Staphylococcus
VEGLKPTLIYPLLSVTITGLLM

SEQ ID NO: 1869599 - protein, 18 aa, Staphylococcus
VFMSCITMLIGAFGVIAY

SEQ ID NO: 1869600 - protein, 22 aa, Staphylococcus
VFNTIVYTCVSLLGNPGKAIAI

SEQ ID NO: 1869601 - protein, 25 aa, Staphylococcus
VFQNLPVIFAIGVAIGLARSDKGTA

SEQ ID NO: 1869602 - protein, 30 aa, Staphylococcus; identical to SEQ ID NO: 1745363

SEQ ID NO: 1869603 - protein, 24 aa, Staphylococcus
VGNMGGGLLDFIATNWIPLGQNHW

SEQ ID NO: 1869604 - protein, 17 aa, Staphylococcus
VILYRPLMISTFDATFS

SEQ ID NO: 1869605 - protein, 27 aa, Staphylococcus
VITWKGVEKKIPWGTIIVFGVGISLGN

SEQ ID NO: 1869606 - protein, 19 aa, Staphylococcus
VIVGLKISIKPADKNHPYG

SEQ ID NO: 1869607 - protein, 17 aa, Staphylococcus
VIVYVLLIIIGMQIIGL

SEQ ID NO: 1869608 - protein, 20 aa, Staphylococcus
VKAFIPLFILGMLFWAIQEQ

SEQ ID NO: 1869609 - protein, 21 aa, Staphylococcus
VKHPGHYVTIQGKRYFEMTLT

SEQ ID NO: 1869610 - protein, 18 aa, Staphylococcus
VKLLTSFTSLISFFKLGV

SEQ ID NO: 1869611 - protein, 26 aa, Staphylococcus
VKPGMKQLISRVHIVVPAINYDNKYQ

SEQ ID NO: 1869612 - protein, 18 aa, Staphylococcus
VLCAVFVGPWYGLAQALI

SEQ ID NO: 1869613 - protein, 19 aa, Staphylococcus
VLFFFGESSVKGFATMLLL

SEQ ID NO: 1869614 - protein, 17 aa, Staphylococcus
VLLPIVFISALIGILQY

SEQ ID NO: 1869615 - protein, 22 aa, Staphylococcus
VLMKGRTTIVIAHRLSTIKKAG

SEQ ID NO: 1869616 - protein, 25 aa, Staphylococcus
VLPGVALSFLFGIPMFIGALITGMI

SEQ ID NO: 1869617 - protein, 26 aa, Staphylococcus
VLSKGLDSGTAFEILSIDIADVDIGK

SEQ ID NO: 1869618 - protein, 25 aa, Staphylococcus
VLSKGLDSGTAFEILSIDIADVDIS

SEQ ID NO: 1869619 - protein, 23 aa, Staphylococcus
VMLFFELFILFIIVSFIVSIIQQ

SEQ ID NO: 1869620 - protein, 22 aa, Staphylococcus
VNLLGAIAFSLALVLIVLTNSE

SEQ ID NO: 1869621 - protein, 25 aa, Staphylococcus
VPRGRILDRNGKVLVDNASKMAITY

SEQ ID NO: 1869622 - protein, 17 aa, Staphylococcus
VPVIYEILFTLKGKLTR

SEQ ID NO: 1869623 - protein, 24 aa, Staphylococcus
VPVVMAASVALFFLNLAFAETDRP

SEQ ID NO: 1869624 - protein, 22 aa, Staphylococcus
VQSFKVIFAIIITLVTVIGTYW

SEQ ID NO: 1869625 - protein, 25 aa, Staphylococcus
VQYMAKRRIGALIVFEKETGLQDYI

SEQ ID NO: 1869626 - protein, 31 aa, Staphylococcus
VSGSVGEMFRPFALAIAFSLLASLLVSITVV

SEQ ID NO: 1869627 - protein, 17 aa, Staphylococcus
VSMLIYFGLATSFMSYL

SEQ ID NO: 1869628 - protein, 18 aa, Staphylococcus
VSQKFYKSSFIVMSITGV

SEQ ID NO: 1869629 - protein, 26 aa, Staphylococcus
VSQLKTARRFGISWMAISLIGAVCVG

SEQ ID NO: 1869630 - protein, 36 aa, Staphylococcus
VTIQGKRYFEMTLTHIDWWQSYQFYHQNTKLQHEVI

SEQ ID NO: 1869631 - protein, 18 aa, Staphylococcus
VVMLLTIAIILGFGALEI

SEQ ID NO: 1869632 - protein, 18 aa, Staphylococcus
VYPYEINIGLTIGVFGTV

SEQ ID NO: 1869633 - protein, 17 aa, Staphylococcus
WAGFGAAFGPLVLLSLY

SEQ ID NO: 1869634 - protein, 18 aa, Staphylococcus
WIGVTLIFGAFAFFWFVG

SEQ ID NO: 1869635 - protein, 25 aa, Staphylococcus
WIIGIPGLIVWQGFSIFVGSIQAYI

SEQ ID NO: 1869636 - protein, 24 aa, Staphylococcus
WLANRIKWPSIVVMSIVGLLVGPI

SEQ ID NO: 1869637 - protein, 19 aa, Staphylococcus
WLGLVDDVLLMIIIISTIS

SEQ ID NO: 1869638 - protein, 18 aa, Staphylococcus
WLNIIGWNGNLAVFILFG

SEQ ID NO: 1869639 - protein, 17 aa, Staphylococcus
WLQNGVWAIIVYFIVCL

SEQ ID NO: 1869640 - protein, 25 aa, Staphylococcus
WPTKEELFKYTVIVVSTVIFFLVFF

SEQ ID NO: 1869641 - protein, 18 aa, Staphylococcus
WTGPSVIFAYLIAGIFLF

SEQ ID NO: 1869642 - protein, 20 aa, Staphylococcus
WTTPGPLGIVMGTGFAFWSF

SEQ ID NO: 1869643 - protein, 18 aa, Staphylococcus
WVGVTIIFGAFAFFWFVG

SEQ ID NO: 1869644 - protein, 19 aa, Staphylococcus
YAGVSMIFLAYIGFDSIAA

SEQ ID NO: 1869645 - protein, 19 aa, Staphylococcus
YAKKHGWDTPQKAIYGGAD

SEQ ID NO: 1869646 - protein, 22 aa, Staphylococcus
YENNKKLPIELVTYNPETDDAY

SEQ ID NO: 1869647 - protein, 31 aa, Staphylococcus
YFEVTLKNADWWKSFQFFTPQNKELTTTVVK

SEQ ID NO: 1869648 - protein, 25 aa, Staphylococcus
YFHTIMFSSYLWKNVGWDSIIYFAA

SEQ ID NO: 1869649 - protein, 19 aa, Staphylococcus
YFSKMIIPNIFSLIASILV

SEQ ID NO: 1869650 - protein, 18 aa, Staphylococcus
YGLFSSIMGMGFIAAFLS

SEQ ID NO: 1869651 - protein, 17 aa, Staphylococcus
YIKLTTTIDSIWKDFQV

SEQ ID NO: 1869652 - protein, 17 aa, Staphylococcus
YILRIIDHSMIYVAISG

SEQ ID NO: 1869653 - protein, 18 aa, Staphylococcus
YKHPTWMLIFGIVAVIVT

SEQ ID NO: 1869654 - protein, 20 aa, Staphylococcus
YLARKWQLVTNMGKFLDPLA

SEQ ID NO: 1869655 - protein, 22 aa, Staphylococcus
YLARKWQLVTNMGKFLDPLADK

SEQ ID NO: 1869656 - protein, 21 aa, Staphylococcus
YLDGLSILFSLLITGIGSLVV

SEQ ID NO: 1869657 - protein, 18 aa, Staphylococcus
YLENGLIRDEAWLKKKLN

SEQ ID NO: 1869658 - protein, 21 aa, Staphylococcus
YLRRLHSLLGIIPIGAFLIVH

SEQ ID NO: 1869659 - protein, 21 aa, Staphylococcus
YLRRVHSLLGIIPIGAFLVVH

SEQ ID NO: 1869660 - protein, 17 aa, Staphylococcus
YLTLVAFNFISGVLTLP

SEQ ID NO: 1869661 - protein, 17 aa, Staphylococcus
YPFMMFGLPAAAFAIYK

SEQ ID NO: 1869662 - protein, 17 aa, Staphylococcus
YSIRKFSVGTASIIVGS

SEQ ID NO: 1869663 - protein, 20 aa, Staphylococcus
YSMLTAFLFIDKVFVNIIYF

SEQ ID NO: 1869664 - protein, 18 aa, Staphylococcus
YVFWELTSVSSFLLISYW

SEQ ID NO: 1869665 - protein, 23 aa, Staphylococcus
AAAGWTLLVYIIFAVLFFAAPIA

SEQ ID NO: 1869666 - protein, 22 aa, Staphylococcus
AAAIACGFFLFMFGGVASDCWI

SEQ ID NO: 1869667 - protein, 23 aa, Staphylococcus
AAAIACGFFLFMFGGVASDCWIA

SEQ ID NO: 1869668 - protein, 24 aa, Staphylococcus
AAAIACGFFLFMFGGVASDCWIAI

SEQ ID NO: 1869669 - protein, 24 aa, Staphylococcus
AAAIACGFFLFMFGGVINDFIFAI

SEQ ID NO: 1869670 - protein, 21 aa, Staphylococcus
AAAIACGFFLLMFGGVVSDCW

SEQ ID NO: 1869671 - protein, 17 aa, Staphylococcus
AAALAAFFIVKENKKLK

SEQ ID NO: 1869672 - protein, 21 aa, Staphylococcus
AAALFGWLPSYLVARFSIVTN

SEQ ID NO: 1869673 - protein, 18 aa, Staphylococcus
AAAMPFAGSAYSWINVLF

SEQ ID NO: 1869674 - protein, 17 aa, Staphylococcus
AAAVLFFFGESSVKGFA

SEQ ID NO: 1869675 - protein, 17 aa, Staphylococcus
AAAWVFRDRFLEILHIG

SEQ ID NO: 1869676 - protein, 17 aa, Staphylococcus
AACSNRIEKRLNKIDGV

SEQ ID NO: 1869677 - protein, 26 aa, Staphylococcus
AAEAARAGYPFPRPHHGLDINYKHDK

SEQ ID NO: 1869678 - protein, 22 aa, Staphylococcus
AAEGVNFVFGGFKFVDPKNPPF

SEQ ID NO: 1869679 - protein, 22 aa, Staphylococcus
AAEGVNFVFGGFKFVDPNNPPF

SEQ ID NO: 1869680 - protein, 22 aa, Staphylococcus
AAEGVNFVFGGFKFVNPKNPPF

SEQ ID NO: 1869681 - protein, 20 aa, Staphylococcus
AAELPYNMMTGMFKKLKEAA

SEQ ID NO: 1869682 - protein, 19 aa, Staphylococcus
AAENGILFKGGEFVERAHH

SEQ ID NO: 1869683 - protein, 19 aa, Staphylococcus
AAENGILFKGGEYVERTHQ

SEQ ID NO: 1869684 - protein, 18 aa, Staphylococcus
AAFAIVGWVGIKLVVIVL

SEQ ID NO: 1869685 - protein, 19 aa, Staphylococcus
AAFAIVGWVGIKLVVIVLA

SEQ ID NO: 1869686 - protein, 18 aa, Staphylococcus
AAFAIVGWVGIKLVVLVL

SEQ ID NO: 1869687 - protein, 20 aa, Staphylococcus
AAFGLFLVVFCWQPIHFYAL

SEQ ID NO: 1869688 - protein, 20 aa, Staphylococcus
AAFGPLVVMSLYWKGLSRTG

SEQ ID NO: 1869689 - protein, 21 aa, Staphylococcus
AAFIIGIPMFFEVGLIMLLPL

SEQ ID NO: 1869690 - protein, 18 aa, Staphylococcus
AAFTNVIVWLPLVIGILA

SEQ ID NO: 1869691 - protein, 22 aa, Staphylococcus
AAGASRWKAFNYGQASAIVEPI

SEQ ID NO: 1869692 - protein, 23 aa, Staphylococcus
AAGASRWKAFNYGQASAIVEPIF

SEQ ID NO: 1869693 - protein, 19 aa, Staphylococcus
AAGASSWKAFNYGQASAIV

SEQ ID NO: 1869694 - protein, 24 aa, Staphylococcus
AAGKAATLGAMFLLFGAFLYFIGT

SEQ ID NO: 1869695 - protein, 17 aa, Staphylococcus
AAGKSATLGAIFLLFGT

SEQ ID NO: 1869696 - protein, 24 aa, Staphylococcus
AAGRFGDGLVNVFTQLGPLFLWVA

SEQ ID NO: 1869697 - protein, 24 aa, Staphylococcus
AAGYFKPFWPLAIINVFEEFTSTL

SEQ ID NO: 1869698 - protein, 18 aa, Staphylococcus
AAHQFKFNGAGSCMVGIA

SEQ ID NO: 1869699 - protein, 17 aa, Staphylococcus
AAICCVIGSLIIQDYIL

SEQ ID NO: 1869700 - protein, 23 aa, Staphylococcus
AAIDKKFAGMIALRDEPKETAKN

SEQ ID NO: 1869701 - protein, 18 aa, Staphylococcus
AAIFISPIWFIFLFIFYR

SEQ ID NO: 1869702 - protein, 17 aa, Staphylococcus
AAIGISFTAFLATGVII

SEQ ID NO: 1869703 - protein, 27 aa, Staphylococcus
AAIGLLAPWVAGAAMALSSVSVVTNAL

SEQ ID NO: 1869704 - protein, 24 aa, Staphylococcus
AAIGMALGLVWYILFNRKTLGQVG

SEQ ID NO: 1869705 - protein, 24 aa, Staphylococcus
AAIGMALGLVWYLLFNRKNLGSVG

SEQ ID NO: 1869706 - protein, 24 aa, Staphylococcus
AAIGMALGLVWYMIFNKKNLGSVG

SEQ ID NO: 1869707 - protein, 24 aa, Staphylococcus
AAIGMALGLVWYVLFNRKNLGRVG

SEQ ID NO: 1869708 - protein, 24 aa, Staphylococcus
AAIGMALGLVWYVLFNRKNLGSVG

SEQ ID NO: 1869709 - protein, 18 aa, Staphylococcus
AAIICIPFAFLGANNLVK

SEQ ID NO: 1869710 - protein, 18 aa, Staphylococcus
AAIICIPFAFLGAQNLIK

SEQ ID NO: 1869711 - protein, 18 aa, Staphylococcus
AAIICIPLAFLGAQNMVK

SEQ ID NO: 1869712 - protein, 17 aa, Staphylococcus
AAIIVLWMNAHVKNPTY

SEQ ID NO: 1869713 - protein, 19 aa, Staphylococcus
AAIIVLWYYWRKRKSNIER

SEQ ID NO: 1869714 - protein, 18 aa, Staphylococcus
AAIIWNLLTWFYGIPSSS

SEQ ID NO: 1869715 - protein, 20 aa, Staphylococcus
AAILAIVFDLALRYIQKLSY

SEQ ID NO: 1869716 - protein, 18 aa, Staphylococcus
AAILSWIIGFIVIGTISY

SEQ ID NO: 1869717 - protein, 26 aa, Staphylococcus
AAIMTYILRYTWRVLIFGTSNKLGKI

SEQ ID NO: 1869718 - protein, 18 aa, Staphylococcus
AAIPAVFMTWNIFTYILS

SEQ ID NO: 1869719 - protein, 22 aa, Staphylococcus
AAIPGSLFFSWLSDKLGRRRPV

SEQ ID NO: 1869720 - protein, 23 aa, Staphylococcus
AAISMGMTRFQLMKDVELPLALP

SEQ ID NO: 1869721 - protein, 17 aa, Staphylococcus
AAKDVWINGFSPQYSMS

SEQ ID NO: 1869722 - protein, 19 aa, Staphylococcus
AAKGIGMKPGRRLSKVELP

SEQ ID NO: 1869723 - protein, 19 aa, Staphylococcus
AAKGIGMKPGRRLTKVELP

SEQ ID NO: 1869724 - protein, 19 aa, Staphylococcus
AALAEAMRSSFLHYGLHPW

SEQ ID NO: 1869725 - protein, 21 aa, Staphylococcus
AALAFSVVIVQSFKLAGISDS

SEQ ID NO: 1869726 - protein, 18 aa, Staphylococcus
AALFFLIGVMYKITKTHD

SEQ ID NO: 1869727 - protein, 17 aa, Staphylococcus
AALGKFIQIWPYVEGKI

SEQ ID NO: 1869728 - protein, 27 aa, Staphylococcus
AALGLLAPWIAGAAMALSSVSVVTNAL

SEQ ID NO: 1869729 - protein, 17 aa, Staphylococcus
AALIIGYLISLGFKNQK

SEQ ID NO: 1869730 - protein, 21 aa, Staphylococcus
AALLAIIFDLILRYMEKLSYK

SEQ ID NO: 1869731 - protein, 26 aa, Staphylococcus
AALLAILFDLVLRYMQNMSYKKLLIS

SEQ ID NO: 1869732 - protein, 20 aa, Staphylococcus
AALMPPTWSHWLGTDHLGRD

SEQ ID NO: 1869733 - protein, 21 aa, Staphylococcus
AALPLFIGISVLWIPVFSIGT

SEQ ID NO: 1869734 - protein, 18 aa, Staphylococcus
AALSWMFVGLGAIPATLI

SEQ ID NO: 1869735 - protein, 19 aa, Staphylococcus
AALTVFSFVTTNMIFGIVF

SEQ ID NO: 1869736 - protein, 19 aa, Staphylococcus
AALYAEHRHLLFGLFLAAN

SEQ ID NO: 1869737 - protein, 24 aa, Staphylococcus
AAMAQSFTSWGFTAWAVYGAVSGI

SEQ ID NO: 1869738 - protein, 23 aa, Staphylococcus
AAMFYWLLAMILEYIFNKMETSS

SEQ ID NO: 1869739 - protein, 22 aa, Staphylococcus
AAMIMPRIWPLNKIPDEFTKEV

SEQ ID NO: 1869740 - protein, 26 aa, Staphylococcus
AAPDNRLDYITGILKSRALMYRNRDI

SEQ ID NO: 1869741 - protein, 18 aa, Staphylococcus
AAPLLLTMLVHLFGIQIP

SEQ ID NO: 1869742 - protein, 17 aa, Staphylococcus
AAQFNPLIRETDYYVQV

SEQ ID NO: 1869743 - protein, 23 aa, Staphylococcus
AAQKEALKELGTLNSLNQPQRKK

SEQ ID NO: 1869744 - protein, 26 aa, Staphylococcus
AASAWKPDIRRAAKAIGVRVSNADVN

SEQ ID NO: 1869745 - protein, 17 aa, Staphylococcus
AASDFTFIMAVPIMLAA

SEQ ID NO: 1869746 - protein, 23 aa, Staphylococcus
AASESRSASLSDSMEVSTSESTS

SEQ ID NO: 1869747 - protein, 18 aa, Staphylococcus
AASGFLALIEAGPDKVNQ

SEQ ID NO: 1869748 - protein, 17 aa, Staphylococcus
AASHIIEGFSLGKAFQR

SEQ ID NO: 1869749 - protein, 20 aa, Staphylococcus
AATFYGGVLIIIGHIFLSLP

SEQ ID NO: 1869750 - protein, 17 aa, Staphylococcus
AATGISWVIESANAGTG

SEQ ID NO: 1869751 - protein, 17 aa, Staphylococcus
AATSVPLASSLDSDASA

SEQ ID NO: 1869752 - protein, 40 aa, Staphylococcus
AAVDSLPESERADAAKALLSDHPEYISATVYGETDSDGRY

SEQ ID NO: 1869753 - protein, 24 aa, Staphylococcus
AAVICIPFAFLGARNLVKVRPVTG

SEQ ID NO: 1869754 - protein, 17 aa, Staphylococcus
AAVLRISLGSATVAAIS

SEQ ID NO: 1869755 - protein, 18 aa, Staphylococcus
AAVMNFIGALTFTGVAGT

SEQ ID NO: 1869756 - protein, 27 aa, Staphylococcus
AAVSAFAGSFAYIYFMKDVLGFDFDHP

SEQ ID NO: 1869757 - protein, 19 aa, Staphylococcus
AAVWIIRPKLHYILYDSDR

SEQ ID NO: 1869758 - protein, 26 aa, Staphylococcus
AAWGILSGRMSFFFIVTIVVLGLLVF

SEQ ID NO: 1869759 - protein, 27 aa, Staphylococcus
AAYFYSIYEMIKWFSGATNMPHLYFET

SEQ ID NO: 1869760 - protein, 25 aa, Staphylococcus
AAYFYSIYEMSKWLLDSNAQPHLYF

SEQ ID NO: 1869761 - protein, 18 aa, Staphylococcus
AAYRTGAYMYRKDDAPSR

SEQ ID NO: 1869762 - protein, 18 aa, Staphylococcus
AAYRTGAYMYRKDDVPRQ

SEQ ID NO: 1869763 - protein, 18 aa, Staphylococcus
ACFLPMIFLLSPVTDNLK

SEQ ID NO: 1869764 - protein, 18 aa, Staphylococcus
ACGICILISLIALFILKL

SEQ ID NO: 1869765 - protein, 19 aa, Staphylococcus
ACKTLPVGTAYAIFVGIGT

SEQ ID NO: 1869766 - protein, 17 aa, Staphylococcus
ACLFAGVGYVHDHISQG

SEQ ID NO: 1869767 - protein, 24 aa, Staphylococcus
ACLVPASSYLIKWFSTKTLIVSGI

SEQ ID NO: 1869768 - protein, 18 aa, Staphylococcus
ACSVINVIILIASVIFAD

SEQ ID NO: 1869769 - protein, 19 aa, Staphylococcus
ACSVVNVIILIAAIIFSDK

SEQ ID NO: 1869770 - protein, 17 aa, Staphylococcus
ACVKSTIKFAYKVFEIY

SEQ ID NO: 1869771 - protein, 23 aa, Staphylococcus
ACVLIGPLLYYLSWWGVAITYVI

SEQ ID NO: 1869772 - protein, 17 aa, Staphylococcus
ACVSAIGSFAIKLMQGY

SEQ ID NO: 1869773 - protein, 24 aa, Staphylococcus
ADAEAWRWMIGLAVVPAIILLIGV

SEQ ID NO: 1869774 - protein, 23 aa, Staphylococcus
ADAPRAVLAVTLFVATWWITESI

SEQ ID NO: 1869775 - protein, 26 aa, Staphylococcus
ADEDLKLQFDNAINIANNVLNKKDGD

SEQ ID NO: 1869776 - protein, 25 aa, Staphylococcus
ADEKKSGVLGFIFTRPVSSIQYIIS

SEQ ID NO: 1869777 - protein, 26 aa, Staphylococcus
ADGNRTETKFIIKVVDTTAPTVKEIS

SEQ ID NO: 1869778 - protein, 25 aa, Staphylococcus
ADHEIKMGKYTAGIYIPKEFSHEIT

SEQ ID NO: 1869779 - protein, 26 aa, Staphylococcus
ADHEIKMGKYYAGIYIPKEFSHQITG

SEQ ID NO: 1869780 - protein, 26 aa, Staphylococcus
ADHEIKMGKYYAGIYIPSKFTHQITG

SEQ ID NO: 1869781 - protein, 26 aa, Staphylococcus
ADHEIKMGKYYAGIYIPSKFTHQVTG

SEQ ID NO: 1869782 - protein, 19 aa, Staphylococcus
ADIDLPFERGAAIDLAGRD

SEQ ID NO: 1869783 - protein, 20 aa, Staphylococcus
ADIDLPFERGAAIDLAGRDV

SEQ ID NO: 1869784 - protein, 21 aa, Staphylococcus
ADIFIVLSHLGVDPSTQTAWR

SEQ ID NO: 1869785 - protein, 17 aa, Staphylococcus
ADIFKPALIPVISILGM

SEQ ID NO: 1869786 - protein, 24 aa, Staphylococcus
ADIIPRFKSFMSLFIASVIGLGCS

SEQ ID NO: 1869787 - protein, 18 aa, Staphylococcus
ADIISGYFVPIVIAIALL

SEQ ID NO: 1869788 - protein, 17 aa, Staphylococcus
ADIISGYFVPIVVGIAI

SEQ ID NO: 1869789 - protein, 18 aa, Staphylococcus
ADIISGYFVPVVVGISLI

SEQ ID NO: 1869790 - protein, 17 aa, Staphylococcus
ADIPGIVQDAKAVNAQV

SEQ ID NO: 1869791 - protein, 22 aa, Staphylococcus
ADKFRGLGRYKGDIVSAQDKLN

SEQ ID NO: 1869792 - protein, 24 aa, Staphylococcus
ADKHREYEDNDGFQAHNGNKKRGL

SEQ ID NO: 1869793 - protein, 18 aa, Staphylococcus
ADKIFLLPFEKHMKDYMQ

SEQ ID NO: 1869794 - protein, 26 aa, Staphylococcus
ADKRGGWRAAIILSFISGIIQVTFGA

SEQ ID NO: 1869795 - protein, 25 aa, Staphylococcus
ADLEGARFGFAFGSGVAAISAVVML

SEQ ID NO: 1869796 - protein, 19 aa, Staphylococcus
ADLKKRYAQRLLQFPHAHN

SEQ ID NO: 1869797 - protein, 21 aa, Staphylococcus
ADLNMSFSILPIMMIVYGIVA

SEQ ID NO: 1869798 - protein, 17 aa, Staphylococcus
ADMAKAMNSVGYDAMAV

SEQ ID NO: 1869799 - protein, 25 aa, Staphylococcus
ADMGAWRWMLGLAVVPSLILLIGVA

SEQ ID NO: 1869800 - protein, 31 aa, Staphylococcus
ADMISGYFVPIVIGIAVLVFIIWIIFVHPGQ

SEQ ID NO: 1869801 - protein, 23 aa, Staphylococcus
ADMMKKYYDNFGIKKENIRKKYY

SEQ ID NO: 1869802 - protein, 20 aa, Staphylococcus
ADPNNLGWFFILPPLAGMIV

SEQ ID NO: 1869803 - protein, 20 aa, Staphylococcus
ADPSFFIIYFGMGFIFAALY

SEQ ID NO: 1869804 - protein, 17 aa, Staphylococcus
ADQFSEYIILTRGLFKY

SEQ ID NO: 1869805 - protein, 19 aa, Staphylococcus
ADRLFLLPFERHMSIYMRY

SEQ ID NO: 1869806 - protein, 20 aa, Staphylococcus
ADSLLSWTGTFIVIIISFFL

SEQ ID NO: 1869807 - protein, 18 aa, Staphylococcus
ADSNNLWDLFLLITGLFG

SEQ ID NO: 1869808 - protein, 26 aa, Staphylococcus
ADSVWYIVVLNLGMSVLFIIFTFFKE

SEQ ID NO: 1869809 - protein, 21 aa, Staphylococcus
ADTKKLTLAILKKAKDDKELQ

SEQ ID NO: 1869810 - protein, 25 aa, Staphylococcus
ADTLHIPNWILVILITLITLILVTK

SEQ ID NO: 1869811 - protein, 24 aa, Staphylococcus
ADTLMKLNPFWTILLSLIFLHEKV

SEQ ID NO: 1869812 - protein, 20 aa, Staphylococcus
ADTLSLIAFEIGMFGFMIIM

SEQ ID NO: 1869813 - protein, 18 aa, Staphylococcus
ADTSYIYLIVIYAIRMFA

SEQ ID NO: 1869814 - protein, 25 aa, Staphylococcus
ADTWKMTWIVLSLFSLIMGSFVLFG

SEQ ID NO: 1869815 - protein, 18 aa, Staphylococcus
ADVAWALGDLGVGLMAWL

SEQ ID NO: 1869816 - protein, 18 aa, Staphylococcus
ADVISGYFVPIVVGIAVL

SEQ ID NO: 1869817 - protein, 17 aa, Staphylococcus
ADVPGIIYSTIGFGALL

SEQ ID NO: 1869818 - protein, 25 aa, Staphylococcus
ADYFGRVRLTIIGLWLNIFGSLLII

SEQ ID NO: 1869819 - protein, 41 aa, Staphylococcus
AEDISRQGYHFTIYVPYGNDWFGYFMRRLAERPQNLALAYQ

SEQ ID NO: 1869820 - protein, 20 aa, Staphylococcus
AEDKGMLAMEFFNHNPKMHA

SEQ ID NO: 1869821 - protein, 21 aa, Staphylococcus
AEGFIKFNLGLGNKYQPIADT

SEQ ID NO: 1869822 - protein, 18 aa, Staphylococcus
AEGFIRKYAKTVNIDDNQ

SEQ ID NO: 1869823 - protein, 17 aa, Staphylococcus
AEGNTVIHFSDGTSATV

SEQ ID NO: 1869824 - protein, 20 aa, Staphylococcus
AEGVNFVFGGFKYVDPKNPP

SEQ ID NO: 1869825 - protein, 17 aa, Staphylococcus
AEIFKIGIPAFLMVVLM

SEQ ID NO: 1869826 - protein, 17 aa, Staphylococcus
AEIGKIVPETTVKQAAK

SEQ ID NO: 1869827 - protein, 17 aa, Staphylococcus
AEIILNLMRVSAVAITN

SEQ ID NO: 1869828 - protein, 25 aa, Staphylococcus
AEIITLKLLHEIIKSYFTYVDEIEE

SEQ ID NO: 1869829 - protein, 19 aa, Staphylococcus
AEIPKIWHGGIAIHGGLLG

SEQ ID NO: 1869830 - protein, 18 aa, Staphylococcus
AEISLIFIGFVFVAETLS

SEQ ID NO: 1869831 - protein, 21 aa, Staphylococcus
AEKEGTLALEFFDHDPKAHAK

SEQ ID NO: 1869832 - protein, 25 aa, Staphylococcus
AEKNFSHRPDFAVTNGGGIRASIQT

SEQ ID NO: 1869833 - protein, 21 aa, Staphylococcus
AELDFSFSILPIMMIVYGVLA

SEQ ID NO: 1869834 - protein, 21 aa, Staphylococcus
AELFFDLVFVYVLSTINQTVQ

SEQ ID NO: 1869835 - protein, 23 aa, Staphylococcus
AELIHWISILPVWLFVKAPRYIK

SEQ ID NO: 1869836 - protein, 29 aa, Staphylococcus
AELKEEYDWDFVICITDLPSISGNKVVIS

SEQ ID NO: 1869837 - protein, 20 aa, Staphylococcus
AELYHDFGYVGIIIGSMIIG

SEQ ID NO: 1869838 - protein, 17 aa, Staphylococcus
AELYIMILFAGLFHLMN

SEQ ID NO: 1869839 - protein, 18 aa, Staphylococcus
AEMVLGIMGSVFGIIAGI

SEQ ID NO: 1869840 - protein, 18 aa, Staphylococcus
AENGILFKGGEHIERTHQ

SEQ ID NO: 1869841 - protein, 19 aa, Staphylococcus
AENKGMLAMDFFDHNPKAH

SEQ ID NO: 1869842 - protein, 23 aa, Staphylococcus
AENRKNTVLYLMHYHNRISDKEY

SEQ ID NO: 1869843 - protein, 24 aa, Staphylococcus
AENRLKSSIQLYGRDDFIGNIALE

SEQ ID NO: 1869844 - protein, 26 aa, Staphylococcus
AENSGHAWSLVSFIALPMILINSIGT

SEQ ID NO: 1869845 - protein, 18 aa, Staphylococcus
AENWWVFIVLALLVGNVE

SEQ ID NO: 1869846 - protein, 20 aa, Staphylococcus
AEQVEGIGFAIPSNEVKVTI

SEQ ID NO: 1869847 - protein, 18 aa, Staphylococcus
AERLIQYGNRYRKDDNSL

SEQ ID NO: 1869848 - protein, 18 aa, Staphylococcus
AERLIQYGNRYRKDHHTV

SEQ ID NO: 1869849 - protein, 18 aa, Staphylococcus
AERLIQYGNRYRKDHNNV

SEQ ID NO: 1869850 - protein, 24 aa, Staphylococcus
AESKGFFKSAFVDPDREIKSIHTF

SEQ ID NO: 1869851 - protein, 17 aa, Staphylococcus
AESKINMSRKEVTPDSP

SEQ ID NO: 1869852 - protein, 22 aa, Staphylococcus
AESYRAAILFHQWYFIDHWKLA

SEQ ID NO: 1869853 - protein, 18 aa, Staphylococcus
AETIYVIFAVNDNKQLAG

SEQ ID NO: 1869854 - protein, 17 aa, Staphylococcus
AETLYALDIYHIEVDTS

SEQ ID NO: 1869855 - protein, 21 aa, Staphylococcus
AETPTRVVYKYTNAYVSVTPE

SEQ ID NO: 1869856 - protein, 19 aa, Staphylococcus
AETRPKVQELLTQANGLNT

SEQ ID NO: 1869857 - protein, 19 aa, Staphylococcus
AETVWGIRIGMIGIPIFFI

SEQ ID NO: 1869858 - protein, 22 aa, Staphylococcus
AEWMLSGILLWIGASLFLTFGL

SEQ ID NO: 1869859 - protein, 17 aa, Staphylococcus
AEYRRRSDEDGRYYNER

SEQ ID NO: 1869860 - protein, 30 aa, Staphylococcus
AFAIPFMLKKGFKSKYFITFVIAMIVTLGI

SEQ ID NO: 1869861 - protein, 23 aa, Staphylococcus
AFALFLVVFCWQPIHFYALAIKR

SEQ ID NO: 1869862 - protein, 17 aa, Staphylococcus
AFDKAERSMDQYKAKID

SEQ ID NO: 1869863 - protein, 18 aa, Staphylococcus
AFEIKGGFGTIIHDAIAN

SEQ ID NO: 1869864 - protein, 18 aa, Staphylococcus
AFEYSMQLPEGIEYVPNS

SEQ ID NO: 1869865 - protein, 17 aa, Staphylococcus
AFFFALKTYQGHKNIEM

SEQ ID NO: 1869866 - protein, 19 aa, Staphylococcus
AFFHESRLGKWIDNEVYEF

SEQ ID NO: 1869867 - protein, 17 aa, Staphylococcus
AFFQFRKKRNGLISTAM

SEQ ID NO: 1869868 - protein, 17 aa, Staphylococcus
AFFWPAVLNGVVFYTDR

SEQ ID NO: 1869869 - protein, 22 aa, Staphylococcus
AFGEGRFGRMMGLFVLIVVGAV

SEQ ID NO: 1869870 - protein, 18 aa, Staphylococcus
AFGKHKLWPVISPNKTIE

SEQ ID NO: 1869871 - protein, 17 aa, Staphylococcus
AFGLDYHWGLILISVIV

SEQ ID NO: 1869872 - protein, 27 aa, Staphylococcus
AFGLLAPWIAGTAMAFSSVSVVLNALR

SEQ ID NO: 1869873 - protein, 18 aa, Staphylococcus
AFGPLVLLSLYWKGLSRT

SEQ ID NO: 1869874 - protein, 19 aa, Staphylococcus
AFGSAFGSTALWIGAGLMS

SEQ ID NO: 1869875 - protein, 24 aa, Staphylococcus
AFGWRPVKKRFKNAIVAIINEVHH

SEQ ID NO: 1869876 - protein, 23 aa, Staphylococcus
AFGWRPVKNRFKHAIVTIINELH

SEQ ID NO: 1869877 - protein, 17 aa, Staphylococcus
AFHSSFWIIPIGVFCMA

SEQ ID NO: 1869878 - protein, 17 aa, Staphylococcus
AFICGIIALIINSSAYI

SEQ ID NO: 1869879 - protein, 17 aa, Staphylococcus
AFIIGLFRLIKGPTTAD

SEQ ID NO: 1869880 - protein, 18 aa, Staphylococcus
AFILAWSISVSWNQLVAL

SEQ ID NO: 1869881 - protein, 18 aa, Staphylococcus
AFILLVALLFTGMGLTYK

SEQ ID NO: 1869882 - protein, 18 aa, Staphylococcus
AFILMFLAFDVKEVLISL

SEQ ID NO: 1869883 - protein, 20 aa, Staphylococcus
AFILRPYLDVLLLGKDQSIN

SEQ ID NO: 1869884 - protein, 20 aa, Staphylococcus
AFIMLLKMAFMVDYFLFHII

SEQ ID NO: 1869885 - protein, 24 aa, Staphylococcus
AFINRFKRTLILSLILTVLSGATF

SEQ ID NO: 1869886 - protein, 25 aa, Staphylococcus
AFIPFVGMIIHWALFVLMIFFVFIV

SEQ ID NO: 1869887 - protein, 24 aa, Staphylococcus
AFIPIVGMFVHWVLFFLLVFFIFI

SEQ ID NO: 1869888 - protein, 20 aa, Staphylococcus
AFIRHFKRTLILTLVLTVLS

SEQ ID NO: 1869889 - protein, 23 aa, Staphylococcus
AFITVIVYNFFIKRDITIKMPKE

SEQ ID NO: 1869890 - protein, 24 aa, Staphylococcus
AFIVNCLLLILGAALFYGVNADKL

SEQ ID NO: 1869891 - protein, 20 aa, Staphylococcus
AFIVNCLLLVLGAALFFGVN

SEQ ID NO: 1869892 - protein, 23 aa, Staphylococcus
AFKEGKVGISHNILEFYTTDGDI

SEQ ID NO: 1869893 - protein, 21 aa, Staphylococcus
AFKISAIFLIIFFLLNYFSVK

SEQ ID NO: 1869894 - protein, 19 aa, Staphylococcus
AFKNLKIPATIAGQGQSSD

SEQ ID NO: 1869895 - protein, 26 aa, Staphylococcus
AFLFERYSYRRLYLFSLVIFTIGSLV

SEQ ID NO: 1869896 - protein, 17 aa, Staphylococcus
AFLGIILGLFEFIGGIL

SEQ ID NO: 1869897 - protein, 20 aa, Staphylococcus
AFLKSNRIGIVISVVCILLV

SEQ ID NO: 1869898 - protein, 24 aa, Staphylococcus
AFLLRPVGGIIFGIIGDKFGRKIV

SEQ ID NO: 1869899 - protein, 24 aa, Staphylococcus
AFLLRPVGGIIFGIIGDKYGRKVV

SEQ ID NO: 1869900 - protein, 18 aa, Staphylococcus
AFLPIIGMFTHWVLFFLM

SEQ ID NO: 1869901 - protein, 18 aa, Staphylococcus
AFLSYAIGGVFHIKFLQE

SEQ ID NO: 1869902 - protein, 23 aa, Staphylococcus
AFLTGVACILVFGIFSNLVPTFN

SEQ ID NO: 1869903 - protein, 21 aa, Staphylococcus
AFNAQMMSVWLLTNASAQAIN

SEQ ID NO: 1869904 - protein, 22 aa, Staphylococcus
AFNAQMMSVWLLTNASAQALNG

SEQ ID NO: 1869905 - protein, 17 aa, Staphylococcus
AFNKISPVFSIIFLIVI

SEQ ID NO: 1869906 - protein, 19 aa, Staphylococcus
AFNNMSFEIQEHVEALSTS

SEQ ID NO: 1869907 - protein, 18 aa, Staphylococcus
AFQHTRWNAYSFAAINTV

SEQ ID NO: 1869908 - protein, 18 aa, Staphylococcus
AFQHTSWNAYSFAAINTV

SEQ ID NO: 1869909 - protein, 19 aa, Staphylococcus
AFQNMSWHKSLFYALFQSA

SEQ ID NO: 1869910 - protein, 18 aa, Staphylococcus
AFSGFSWLIFLLIIQAST

SEQ ID NO: 1869911 - protein, 24 aa, Staphylococcus
AFSLSSFCLMQFPIDLINEKTTGW

SEQ ID NO: 1869912 - protein, 18 aa, Staphylococcus
AFSPLVIFSLYWKGLSRT

SEQ ID NO: 1869913 - protein, 20 aa, Staphylococcus
AFSPLVLFSLYWKDLTRAGA

SEQ ID NO: 1869914 - protein, 27 aa, Staphylococcus
AFSPLVLFSLYWKKLTREGAISGMIAG

SEQ ID NO: 1869915 - protein, 20 aa, Staphylococcus
AFSPLVLYSLYWKNLTRTGA

SEQ ID NO: 1869916 - protein, 18 aa, Staphylococcus
AFTGIIVYILLYVMYPGG

SEQ ID NO: 1869917 - protein, 18 aa, Staphylococcus
AFTGYAILELAKNGKLSL

SEQ ID NO: 1869918 - protein, 17 aa, Staphylococcus
AFTGYGILQLAEEGKLN

SEQ ID NO: 1869919 - protein, 19 aa, Staphylococcus
AFTLIEMLLVLLIISLLLI

SEQ ID NO: 1869920 - protein, 19 aa, Staphylococcus
AFTLLEMLLVLLVISVLLI

SEQ ID NO: 1869921 - protein, 20 aa, Staphylococcus
AFTQMLYRIGDSISNPITPM

SEQ ID NO: 1869922 - protein, 25 aa, Staphylococcus
AFVKSIWGGLVAWWQQNHVLIQAAA

SEQ ID NO: 1869923 - protein, 26 aa, Staphylococcus
AFVRHFKRTLILTAILTLLSGAAFFT

SEQ ID NO: 1869924 - protein, 19 aa, Staphylococcus
AFVTEFGFRSYLQSILESK

SEQ ID NO: 1869925 - protein, 19 aa, Staphylococcus
AFVTSAWNVIKSVSIRIWN

SEQ ID NO: 1869926 - protein, 20 aa, Staphylococcus
AFVTVIVYNFFIKRNITIKM

SEQ ID NO: 1869927 - protein, 24 aa, Staphylococcus
AFVVNCLLLTLGAALFFGTKTNDL

SEQ ID NO: 1869928 - protein, 24 aa, Staphylococcus
AFVVNCLLLTLGAALFFGTNTDEL

SEQ ID NO: 1869929 - protein, 17 aa, Staphylococcus
AFVVRMTLIPALTKLFG

SEQ ID NO: 1869930 - protein, 18 aa, Staphylococcus
AFVVRMTLIPALTKLFGK

SEQ ID NO: 1869931 - protein, 20 aa, Staphylococcus
AFVVVELFVTIVLPYASIFV

SEQ ID NO: 1869932 - protein, 27 aa, Staphylococcus
AFWLFMIGFNVCFLPQFILGLDGMPRR

SEQ ID NO: 1869933 - protein, 33 aa, Staphylococcus
AFWMFKEYFGLTIKETFLTWSLLETILSVSGII

SEQ ID NO: 1869934 - protein, 21 aa, Staphylococcus
AFWQVFVIFGVHWGITPMVLA

SEQ ID NO: 1869935 - protein, 18 aa, Staphylococcus
AFYFSISLFKNFYMMLLG

SEQ ID NO: 1869936 - protein, 25 aa, Staphylococcus
AFYLVNHLWLEWFAQETMKWILIIG

SEQ ID NO: 1869937 - protein, 20 aa, Staphylococcus
AGALGWSMIEYCMKKTTSLI

SEQ ID NO: 1869938 - protein, 19 aa, Staphylococcus
AGAYAAGKHKGKKDKNDNE

SEQ ID NO: 1869939 - protein, 18 aa, Staphylococcus
AGCFEILGVILLNELNRT

SEQ ID NO: 1869940 - protein, 17 aa, Staphylococcus
AGCFEILGVVLLNQLAR

SEQ ID NO: 1869941 - protein, 19 aa, Staphylococcus
AGDEPIVYVGGKDKKLVQT

SEQ ID NO: 1869942 - protein, 27 aa, Staphylococcus
AGDSIKITIPQALNLNGVTATAKAPNI

SEQ ID NO: 1869943 - protein, 23 aa, Staphylococcus
AGDSKWYFFKLLDYGVDGVISFN

SEQ ID NO: 1869944 - protein, 21 aa, Staphylococcus
AGFEVFKGNLLSSNDRIYSDL

SEQ ID NO: 1869945 - protein, 24 aa, Staphylococcus
AGFHELFFDLIFVYAIQKIAHVIL

SEQ ID NO: 1869946 - protein, 19 aa, Staphylococcus
AGFIAGYVAKWIKQIKVPK

SEQ ID NO: 1869947 - protein, 28 aa, Staphylococcus
AGFLSGLVCAIVLFTIIMILYRTPLLGL

SEQ ID NO: 1869948 - protein, 17 aa, Staphylococcus
AGFVEIIWVTGLDNAHS

SEQ ID NO: 1869949 - protein, 26 aa, Staphylococcus
AGFVVGWTYWLTWIISGMAEITAVAK

SEQ ID NO: 1869950 - protein, 19 aa, Staphylococcus
AGGELKHGTIALIEDDTPV

SEQ ID NO: 1869951 - protein, 19 aa, Staphylococcus
AGGELKHGTIALIEDGTPV

SEQ ID NO: 1869952 - protein, 19 aa, Staphylococcus
AGGELKHGTIALIEEGTPI

SEQ ID NO: 1869953 - protein, 24 aa, Staphylococcus
AGGGKLNFIIPLVFAVIFTIVVAI

SEQ ID NO: 1869954 - protein, 25 aa, Staphylococcus
AGGTRIRPILMTAIATIGALIPLLF

SEQ ID NO: 1869955 - protein, 25 aa, Staphylococcus
AGGTRIRPILMTAIATIGALLPLLF

SEQ ID NO: 1869956 - protein, 25 aa, Staphylococcus
AGGTRIRPILMTAIATIGALVPLLF

SEQ ID NO: 1869957 - protein, 26 aa, Staphylococcus
AGGTRIRPILMTALATIGALAPMLFG

SEQ ID NO: 1869958 - protein, 25 aa, Staphylococcus
AGGTRIRPILMTALATIGALIPLLF

SEQ ID NO: 1869959 - protein, 25 aa, Staphylococcus
AGIEGRWFDKSCMFLADLLLAIPSF

SEQ ID NO: 1869960 - protein, 22 aa, Staphylococcus
AGIERKWLDQIIMFIADMLLAI

SEQ ID NO: 1869961 - protein, 18 aa, Staphylococcus
AGIFGNFVSLSFNTTTIS

SEQ ID NO: 1869962 - protein, 27 aa, Staphylococcus
AGIFLLFRFTPLLGLSDIYVYIVTFVG

SEQ ID NO: 1869963 - protein, 18 aa, Staphylococcus
AGIFLNFLHPIWQVDTSN

SEQ ID NO: 1869964 - protein, 17 aa, Staphylococcus
AGIGFNILLGIFAFLVV

SEQ ID NO: 1869965 - protein, 24 aa, Staphylococcus
AGIKGALVGSIWLIVTIIPITIIL

SEQ ID NO: 1869966 - protein, 18 aa, Staphylococcus
AGIKGALVGTLWLMITII

SEQ ID NO: 1869967 - protein, 24 aa, Staphylococcus
AGIKGALVGTLWLMITIIPISIVL

SEQ ID NO: 1869968 - protein, 19 aa, Staphylococcus
AGILMPLMQTVLFLVYPAD

SEQ ID NO: 1869969 - protein, 22 aa, Staphylococcus
AGIMASIPFISRFIEQVFGPLF

SEQ ID NO: 1869970 - protein, 29 aa, Staphylococcus
AGIMLVSGITWRLLAPIFIAAIVIGSSII

SEQ ID NO: 1869971 - protein, 18 aa, Staphylococcus
AGISRGTFYLHYKDKFDL

SEQ ID NO: 1869972 - protein, 18 aa, Staphylococcus
AGIYFLNKWIKGDLNLGI

SEQ ID NO: 1869973 - protein, 19 aa, Staphylococcus
AGIYFRNVRRSMIEQLNED

SEQ ID NO: 1869974 - protein, 17 aa, Staphylococcus
AGKDHHILFGMGILAYT

SEQ ID NO: 1869975 - protein, 18 aa, Staphylococcus
AGKGGSNWGYAIVPVLGP

SEQ ID NO: 1869976 - protein, 19 aa, Staphylococcus
AGKGGSNWSYAIVPVLGPI

SEQ ID NO: 1869977 - protein, 20 aa, Staphylococcus
AGKGKSNWSYAIVPVLGPIA

SEQ ID NO: 1869978 - protein, 33 aa, Staphylococcus
AGKLLGVTVKELWVSVLTICFILAVSKITTYGG

SEQ ID NO: 1869979 - protein, 21 aa, Staphylococcus
AGKYKSRMASFGTEYDYEDGF

SEQ ID NO: 1869980 - protein, 26 aa, Staphylococcus
AGLAIGFFLARKYMMDFLKKNPPINE

SEQ ID NO: 1869981 - protein, 17 aa, Staphylococcus
AGLALIIGVDRILDMVR

SEQ ID NO: 1869982 - protein, 17 aa, Staphylococcus
AGLCCFIISCLCVGLFI

SEQ ID NO: 1869983 - protein, 22 aa, Staphylococcus
AGLCVFAGPGLVALFYDSIGVQ

SEQ ID NO: 1869984 - protein, 22 aa, Staphylococcus
AGLFLLFKFTPLLGLSDSYIYI

SEQ ID NO: 1869985 - protein, 24 aa, Staphylococcus
AGLGHIMITLAFILFFVLLNKRIN

SEQ ID NO: 1869986 - protein, 17 aa, Staphylococcus
AGLIAAVALIFIYISLG

SEQ ID NO: 1869987 - protein, 19 aa, Staphylococcus
AGLINIGYVIYHFKQQRIS

SEQ ID NO: 1869988 - protein, 18 aa, Staphylococcus
AGLKPVFKPENLEINLFG

SEQ ID NO: 1869989 - protein, 19 aa, Staphylococcus
AGLLEIVWVTSLNQAHSLT

SEQ ID NO: 1869990 - protein, 23 aa, Staphylococcus
AGLLSGIVKLGWEVMFPPRTPAR

SEQ ID NO: 1869991 - protein, 19 aa, Staphylococcus
AGLLTLWYYWRKRKPHIQK

SEQ ID NO: 1869992 - protein, 18 aa, Staphylococcus
AGLMIRYLPTPSELSFVS

SEQ ID NO: 1869993 - protein, 20 aa, Staphylococcus
AGLMTKVGIYALIRVMTLLF

SEQ ID NO: 1869994 - protein, 19 aa, Staphylococcus
AGLVEIIWVTGLNNADSIF

SEQ ID NO: 1869995 - protein, 26 aa, Staphylococcus
AGLVGKEYLEKWAGVPTEVHVASEFV

SEQ ID NO: 1869996 - protein, 21 aa, Staphylococcus
AGLYAGMIFFNIEALSWLDVL

SEQ ID NO: 1869997 - protein, 20 aa, Staphylococcus
AGNGADWIVIALGWGLAVSM

SEQ ID NO: 1869998 - protein, 18 aa, Staphylococcus
AGNNSWSSPIVVISLILG

SEQ ID NO: 1869999 - protein, 17 aa, Staphylococcus
AGNPELHHLGIAGGNME

SEQ ID NO: 1870000 - protein, 24 aa, Staphylococcus
AGPAGRDGVSITITNTETTPEGNT

SEQ ID NO: 1870001 - protein, 18 aa, Staphylococcus
AGPLFNFILAIVLFIGLA

SEQ ID NO: 1870002 - protein, 18 aa, Staphylococcus
AGPLFNFILALVLFIGLA

SEQ ID NO: 1870003 - protein, 19 aa, Staphylococcus
AGPLFNFILALVLFIGLAY

SEQ ID NO: 1870004 - protein, 18 aa, Staphylococcus
AGPLFNFILALVLFLGLA

SEQ ID NO: 1870005 - protein, 20 aa, Staphylococcus
AGPLFNFLLTLVLFIGLAYY

SEQ ID NO: 1870006 - protein, 20 aa, Staphylococcus
AGPLFPAIGIILISFTFLSP

SEQ ID NO: 1870007 - protein, 20 aa, Staphylococcus
AGPSAGFLFMYPVITYLIGL

SEQ ID NO: 1870008 - protein, 23 aa, Staphylococcus
AGQGGVIGVIFAVWILAMIEKRL

SEQ ID NO: 1870009 - protein, 23 aa, Staphylococcus
AGSGRAAELGVLFKSSESLEQTQ

SEQ ID NO: 1870010 - protein, 22 aa, Staphylococcus
AGSKYGIPFAMQLRQTYGDIGA

SEQ ID NO: 1870011 - protein, 17 aa, Staphylococcus
AGSLCWSINTIVTKKVV

SEQ ID NO: 1870012 - protein, 20 aa, Staphylococcus
AGSLEILGVVLLNELSRTQN

SEQ ID NO: 1870013 - protein, 20 aa, Staphylococcus
AGTFFFMKLIQIIRFKDVIF

SEQ ID NO: 1870014 - protein, 24 aa, Staphylococcus
AGTKESAGFGFIGMIGPISAFKFL

SEQ ID NO: 1870015 - protein, 23 aa, Staphylococcus
AGTKESAGFGFIGMVGPINAFKF

SEQ ID NO: 1870016 - protein, 21 aa, Staphylococcus
AGVGIFTWLIAEWRMLSYREL

SEQ ID NO: 1870017 - protein, 19 aa, Staphylococcus
AGVKGDKGDSITITSVTPQ

SEQ ID NO: 1870018 - protein, 17 aa, Staphylococcus
AGVMPLVPGILITNAIR

SEQ ID NO: 1870019 - protein, 19 aa, Staphylococcus
AGVPFFSISGSDFVEMFVG

SEQ ID NO: 1870020 - protein, 18 aa, Staphylococcus
AGVVLSFLSSIIVLLPVL

SEQ ID NO: 1870021 - protein, 20 aa, Staphylococcus
AGWFPLKLSAIILFVVIYTI

SEQ ID NO: 1870022 - protein, 25 aa, Staphylococcus
AHAGTGFAFASWVKPGAMDMAVSAL

SEQ ID NO: 1870023 - protein, 17 aa, Staphylococcus
AHAIKKDDEKALSKEVT

SEQ ID NO: 1870024 - protein, 18 aa, Staphylococcus
AHAPNALMMAVVIVGAGM

SEQ ID NO: 1870025 - protein, 19 aa, Staphylococcus
AHAYLRFLKNEGKLNELSQ

SEQ ID NO: 1870026 - protein, 19 aa, Staphylococcus
AHCATRLRLVLNDESKVDE

SEQ ID NO: 1870027 - protein, 19 aa, Staphylococcus
AHEELNTAIVLTGKDDVVV

SEQ ID NO: 1870028 - protein, 23 aa, Staphylococcus
AHEWLQVSFMSMFWSVIQVILIP

SEQ ID NO: 1870029 - protein, 29 aa, Staphylococcus
AHFHYTLVCGVVFACFAALIFWYPKMMGY

SEQ ID NO: 1870030 - protein, 30 aa, Staphylococcus
AHFPDIRLVILRSEYRSVIRPISRFIDKIN

SEQ ID NO: 1870031 - protein, 17 aa, Staphylococcus
AHGGPIVAVLGGIDHIV

SEQ ID NO: 1870032 - protein, 17 aa, Staphylococcus
AHGGPIVAVLGGIQHVL

SEQ ID NO: 1870033 - protein, 23 aa, Staphylococcus
AHHHPSMTPGWWFDGINYASLQI

SEQ ID NO: 1870034 - protein, 18 aa, Staphylococcus
AHIVEWTEKVDLLSLATP

SEQ ID NO: 1870035 - protein, 17 aa, Staphylococcus
AHKEGISGLLYSAVGLG

SEQ ID NO: 1870036 - protein, 25 aa, Staphylococcus
AHKFGRKRILSVSLLILVITSLGAA

SEQ ID NO: 1870037 - protein, 23 aa, Staphylococcus
AHKHIGPLAGFVVGWTYWLTWII

SEQ ID NO: 1870038 - protein, 19 aa, Staphylococcus
AHKYKADVITTDFNLNKIC

SEQ ID NO: 1870039 - protein, 19 aa, Staphylococcus
AHLNPAVSIALAMDGSFSW

SEQ ID NO: 1870040 - protein, 17 aa, Staphylococcus
AHLNPAVTMAIAMDGGI

SEQ ID NO: 1870041 - protein, 21 aa, Staphylococcus
AHLQLAIGFIAIFFIALGNAA

SEQ ID NO: 1870042 - protein, 22 aa, Staphylococcus
AHNIYIVYILRFIAGMGGGGEF

SEQ ID NO: 1870043 - protein, 22 aa, Staphylococcus
AHQPDIIGLFFSLLDQFMDTTT

SEQ ID NO: 1870044 - protein, 29 aa, Staphylococcus
AHRGMALITFCWIMITFIHAIKNYSENRT

SEQ ID NO: 1870045 - protein, 25 aa, Staphylococcus
AHRGMALVTFMWIMFTFIHAVKNYA

SEQ ID NO: 1870046 - protein, 20 aa, Staphylococcus
AHSLSEAGADVIIGHNSVVQ

SEQ ID NO: 1870047 - protein, 21 aa, Staphylococcus
AHSLTSWSFTLLMIALSFYLV

SEQ ID NO: 1870048 - protein, 21 aa, Staphylococcus
AHSQSDFSLVSSYLKKNTDNY

SEQ ID NO: 1870049 - protein, 18 aa, Staphylococcus
AHSSMLWMTQEGFEQLNK

SEQ ID NO: 1870050 - protein, 30 aa, Staphylococcus
AHVQIIKEIIKRTLGEFGVKTSDIQIEQLI

SEQ ID NO: 1870051 - protein, 31 aa, Staphylococcus
AHWFGIPRPMRFAGFGFDFGATLVFFIVAMV

SEQ ID NO: 1870052 - protein, 18 aa, Staphylococcus
AIAAFLYVSNWWYISQNV

SEQ ID NO: 1870053 - protein, 19 aa, Staphylococcus
AIAEAKKSLNSFARQKAKA

SEQ ID NO: 1870054 - protein, 22 aa, Staphylococcus
AIAIGLGFWLSAPEQGYRLVSG

SEQ ID NO: 1870055 - protein, 22 aa, Staphylococcus
AIAIIAVIIFFVGKTQMSVTKK

SEQ ID NO: 1870056 - protein, 23 aa, Staphylococcus
AIAKLRLTPEIEQDVLLFEFGYA

SEQ ID NO: 1870057 - protein, 18 aa, Staphylococcus
AIALFLVIFCWQPIHFYA

SEQ ID NO: 1870058 - protein, 23 aa, Staphylococcus
AIALFLVVFCWQPIHFYALAIKR

SEQ ID NO: 1870059 - protein, 19 aa, Staphylococcus
AIALFLVVFCWQPVHFYAL

SEQ ID NO: 1870060 - protein, 27 aa, Staphylococcus
AIALLFANICNFIILKKYAKFTFTETF

SEQ ID NO: 1870061 - protein, 24 aa, Staphylococcus
AIALLFAVLCNFYILKKYAKFNFS

SEQ ID NO: 1870062 - protein, 18 aa, Staphylococcus
AIAQRSLFKFSWNAYALW

SEQ ID NO: 1870063 - protein, 21 aa, Staphylococcus
AIARLFLKHAPIWILDEPTTA

SEQ ID NO: 1870064 - protein, 18 aa, Staphylococcus
AIAVLGIIIYHLNKQWLA

SEQ ID NO: 1870065 - protein, 18 aa, Staphylococcus
AICIILGIDLYRQNFKQL

SEQ ID NO: 1870066 - protein, 29 aa, Staphylococcus
AIDGFKIAVTVAIMLLAFISLMKGITIVF

SEQ ID NO: 1870067 - protein, 20 aa, Staphylococcus
AIDMGGPFNKAAYVFSTAAL

SEQ ID NO: 1870068 - protein, 21 aa, Staphylococcus
AIDMGGPFNKAAYVFSVAALT

SEQ ID NO: 1870069 - protein, 18 aa, Staphylococcus
AIEALRTAVNKVNAADEP

SEQ ID NO: 1870070 - protein, 18 aa, Staphylococcus
AIEQIEAILPETEQQSPQ

SEQ ID NO: 1870071 - protein, 21 aa, Staphylococcus
AIERLCKRDPLAGKTVTGGII

SEQ ID NO: 1870072 - protein, 25 aa, Staphylococcus
AIFANFFINIGIYVSIQFKEGLSKA

SEQ ID NO: 1870073 - protein, 34 aa, Staphylococcus
AIFAVLFRFIVHLIPIRYIFRVLSILIFVMAFKM

SEQ ID NO: 1870074 - protein, 22 aa, Staphylococcus
AIFCAVMYLGVFYNIHAANEAR

SEQ ID NO: 1870075 - protein, 27 aa, Staphylococcus
AIFDVVPRIALGSIVAYIIGQHVDVFI

SEQ ID NO: 1870076 - protein, 18 aa, Staphylococcus
AIFFIWAIVLFFTNIIRG

SEQ ID NO: 1870077 - protein, 18 aa, Staphylococcus
AIFHPVYIALAFSVASDS

SEQ ID NO: 1870078 - protein, 26 aa, Staphylococcus
AIFNILSIEGIIILVIYHGHDEGKLE

SEQ ID NO: 1870079 - protein, 17 aa, Staphylococcus
AIFRRPVNKKAETIIIA

SEQ ID NO: 1870080 - protein, 25 aa, Staphylococcus
AIFTLPFPIHFDFDSEVFMMAVIAP

SEQ ID NO: 1870081 - protein, 18 aa, Staphylococcus
AIFYILGVVFKRMKFLHR

SEQ ID NO: 1870082 - protein, 17 aa, Staphylococcus
AIGFLLGGLFIRLLDAI

SEQ ID NO: 1870083 - protein, 25 aa, Staphylococcus
AIGGAGCAFSMLFLSKIIDKNSKGF

SEQ ID NO: 1870084 - protein, 30 aa, Staphylococcus
AIGGIILSFAVWRMVFIILTVFGILMVIGS

SEQ ID NO: 1870085 - protein, 25 aa, Staphylococcus
AIGIFCIIMVFALLGFLPYNLNPAK

SEQ ID NO: 1870086 - protein, 23 aa, Staphylococcus
AIGIRTRHLLWSLVFQILLVTMI

SEQ ID NO: 1870087 - protein, 20 aa, Staphylococcus
AIGITSGFSLLGMGSLIGIS

SEQ ID NO: 1870088 - protein, 19 aa, Staphylococcus
AIGLLRLEDVYSRAHAAGK

SEQ ID NO: 1870089 - protein, 28 aa, Staphylococcus
AIGLMFYIIMFRFKIRKIPLIPFISISY

SEQ ID NO: 1870090 - protein, 18 aa, Staphylococcus
AIGPFFGLLLVKSFSIML

SEQ ID NO: 1870091 - protein, 25 aa, Staphylococcus
AIGTFCIIMIFALLGFLPYNLNPAK

SEQ ID NO: 1870092 - protein, 25 aa, Staphylococcus
AIGTFCVIMIFALLGFLPFNLNPAK

SEQ ID NO: 1870093 - protein, 25 aa, Staphylococcus
AIGTFCVIMVFALIGFLPYNLNPAK

SEQ ID NO: 1870094 - protein, 21 aa, Staphylococcus
AIIAAIAWNLITWLYGIPSSS

SEQ ID NO: 1870095 - protein, 21 aa, Staphylococcus
AIIAFLVKYCDFPVSVYIQPF

SEQ ID NO: 1870096 - protein, 18 aa, Staphylococcus
AIICFVMAPAVYNQSTVL

SEQ ID NO: 1870097 - protein, 17 aa, Staphylococcus
AIICILGLVPGVPLPFM

SEQ ID NO: 1870098 - protein, 25 aa, Staphylococcus
AIIFIAVSTVFAFFLSNRITKPLRQ

SEQ ID NO: 1870099 - protein, 27 aa, Staphylococcus
AIIFYPRFKISLLGGIVSILWIFHNDL

SEQ ID NO: 1870100 - protein, 19 aa, Staphylococcus
AIIGAALTVFSFVTTNMIF

SEQ ID NO: 1870101 - protein, 19 aa, Staphylococcus
AIIGEWAEASIVVILFAIS

SEQ ID NO: 1870102 - protein, 17 aa, Staphylococcus
AIIGGFFMALTYSLDDF

SEQ ID NO: 1870103 - protein, 19 aa, Staphylococcus
AIIICAAGLINIGYVIYHF

SEQ ID NO: 1870104 - protein, 24 aa, Staphylococcus
AIIICVSMIATLLVIPWLSAKKAR

SEQ ID NO: 1870105 - protein, 25 aa, Staphylococcus
AIIIILLFLRNIRTTAISVVSIPMS

SEQ ID NO: 1870106 - protein, 25 aa, Staphylococcus
AIIKKGASVGSVFLFIIIVIFLMYA

SEQ ID NO: 1870107 - protein, 24 aa, Staphylococcus
AIIKKKAKTTYVFRTDDKKRKVIA

SEQ ID NO: 1870108 - protein, 26 aa, Staphylococcus
AIILFIMCIYWWISYLGFQKEERLKE

SEQ ID NO: 1870109 - protein, 19 aa, Staphylococcus
AIIPITGMRLGIPDDSLKP

SEQ ID NO: 1870110 - protein, 26 aa, Staphylococcus
AIISRLVSCLLILFLGSAIFSLLGQH

SEQ ID NO: 1870111 - protein, 24 aa, Staphylococcus
AIITCVFVPIIFKKMFPIPDEANR

SEQ ID NO: 1870112 - protein, 25 aa, Staphylococcus
AIITCVFVPIVFKKLFPIPDEVNRK

SEQ ID NO: 1870113 - protein, 26 aa, Staphylococcus
AIIVILLFLRNIRTTAISIVSIPMSI

SEQ ID NO: 1870114 - protein, 25 aa, Staphylococcus
AIIVILLFLRNIRTTAISVVSIPLS

SEQ ID NO: 1870115 - protein, 18 aa, Staphylococcus
AIIWNLVTWFYGIPSSSS

SEQ ID NO: 1870116 - protein, 19 aa, Staphylococcus
AIIYHKFLAWFILVPIVSL

SEQ ID NO: 1870117 - protein, 17 aa, Staphylococcus
AIKEIIHLCLMKEETLN

SEQ ID NO: 1870118 - protein, 25 aa, Staphylococcus
AIKKGWPSMMYSIWKNPEKYNSYFI

SEQ ID NO: 1870119 - protein, 37 aa, Staphylococcus
AIKMLFHPFNPYYIFKIRVPFTPGLIPKRRDEIANKI

SEQ ID NO: 1870120 - protein, 38 aa, Staphylococcus
AIKMLFHPQRAYHIGKWRIPFTPGLVPKRREEIAYKIG

SEQ ID NO: 1870121 - protein, 18 aa, Staphylococcus
AIKRAWIPILAYLFVDGL

SEQ ID NO: 1870122 - protein, 23 aa, Staphylococcus
AIKSELYHSLTLNLVLSALLGIT

SEQ ID NO: 1870123 - protein, 22 aa, Staphylococcus
AIKSMNGNVRFYGGKTDPMEKR

SEQ ID NO: 1870124 - protein, 19 aa, Staphylococcus
AILAFCLTGIGLPLLGVVV

SEQ ID NO: 1870125 - protein, 17 aa, Staphylococcus
AILFTLVSFIVIFLIGR

SEQ ID NO: 1870126 - protein, 26 aa, Staphylococcus
AILFVFRCLVVVLVFIGAVAKTETVW

SEQ ID NO: 1870127 - protein, 17 aa, Staphylococcus
AILILRAVLNMSNQLLG

SEQ ID NO: 1870128 - protein, 25 aa, Staphylococcus
AILIPKLIILGLFGLGFLTIGLCLK

SEQ ID NO: 1870129 - protein, 18 aa, Staphylococcus
AILIPYMFSAFYQVKYTY

SEQ ID NO: 1870130 - protein, 18 aa, Staphylococcus
AILNVWFALYICVLITLI

SEQ ID NO: 1870131 - protein, 17 aa, Staphylococcus
AILPFIALYLITMINAV

SEQ ID NO: 1870132 - protein, 24 aa, Staphylococcus
AILSCVIGFLGIFIFFLYINKKVT

SEQ ID NO: 1870133 - protein, 27 aa, Staphylococcus
AILSFFISNVYYHFNLKPKNDQKIMTT

SEQ ID NO: 1870134 - protein, 25 aa, Staphylococcus
AILSFNFITFVSWIACGVLIIQRKK

SEQ ID NO: 1870135 - protein, 27 aa, Staphylococcus
AILTYVLRYVWRLSIFGTSQKLGKILR

SEQ ID NO: 1870136 - protein, 19 aa, Staphylococcus
AIMAMEACYIYPRLQRSSF

SEQ ID NO: 1870137 - protein, 18 aa, Staphylococcus
AIMMFARKDKVETVPAYY

SEQ ID NO: 1870138 - protein, 18 aa, Staphylococcus
AIMMFARKNKVEIVPAYG

SEQ ID NO: 1870139 - protein, 18 aa, Staphylococcus
AIMMFARKSKVETVPMYG

SEQ ID NO: 1870140 - protein, 20 aa, Staphylococcus
AIMMFARRSKIETVPAYGST

SEQ ID NO: 1870141 - protein, 18 aa, Staphylococcus
AIMMFVRKNKVETVPSYY

SEQ ID NO: 1870142 - protein, 27 aa, Staphylococcus
AIMPVETYSVFAMFGVGLILLVVTYLA

SEQ ID NO: 1870143 - protein, 27 aa, Staphylococcus
AIMSWKGWIALFAMILGVWFTSYFIFI

SEQ ID NO: 1870144 - protein, 23 aa, Staphylococcus
AIMSWKGWIALGSMILGVWFMSY

SEQ ID NO: 1870145 - protein, 20 aa, Staphylococcus
AINGVIWRILIFYIGAVFVI

SEQ ID NO: 1870146 - protein, 24 aa, Staphylococcus
AINIGALCYILWGIYLKDGLHKDS

SEQ ID NO: 1870147 - protein, 17 aa, Staphylococcus
AINQVLKGKAYHGIKNK

SEQ ID NO: 1870148 - protein, 24 aa, Staphylococcus
AINVLPIIIVPLVVERKKIKEHPD

SEQ ID NO: 1870149 - protein, 17 aa, Staphylococcus
AIPAEWIDGLGISESTY

SEQ ID NO: 1870150 - protein, 20 aa, Staphylococcus
AIPEDIRNARGITFGLFRLS

SEQ ID NO: 1870151 - protein, 17 aa, Staphylococcus
AIPHLFDRFYKLNASDN

SEQ ID NO: 1870152 - protein, 29 aa, Staphylococcus
AIQDLFKHRIGKLIIVWFTLIAVTIGCAA

SEQ ID NO: 1870153 - protein, 17 aa, Staphylococcus
AIQDMKAVQTEVVKKQN

SEQ ID NO: 1870154 - protein, 17 aa, Staphylococcus
AIQFAQQILEGIKHAHD

SEQ ID NO: 1870155 - protein, 23 aa, Staphylococcus
AIQPEVTKAVNLLHQKADNSELV

SEQ ID NO: 1870156 - protein, 24 aa, Staphylococcus
AIRHFPTTIVAKIFGFDKKEYFKA

SEQ ID NO: 1870157 - protein, 41 aa, Staphylococcus
AIRMLFHPFKPYYIFKMRIPFTPGLIPKRREEIATKIGQVI

SEQ ID NO: 1870158 - protein, 26 aa, Staphylococcus
AIRQVFWRILLFYVLSIAVISAIIPY

SEQ ID NO: 1870159 - protein, 29 aa, Staphylococcus
AIRSLLWEHIIKLKMPFFDKNESGQLMSR

SEQ ID NO: 1870160 - protein, 23 aa, Staphylococcus
AISIFIALMFDFEKAYWIPLSTH

SEQ ID NO: 1870161 - protein, 19 aa, Staphylococcus
AISLLWHLGSWSDPLNNSI

SEQ ID NO: 1870162 - protein, 18 aa, Staphylococcus
AISRYGRFKLGSDDEEPE

SEQ ID NO: 1870163 - protein, 23 aa, Staphylococcus
AISSHLALLCGIAGINVYIIRIL

SEQ ID NO: 1870164 - protein, 19 aa, Staphylococcus
AITAIIVWAIYYRDKKFWK

SEQ ID NO: 1870165 - protein, 25 aa, Staphylococcus
AITFVDMWHFFSLVTRYENEDKYDY

SEQ ID NO: 1870166 - protein, 26 aa, Staphylococcus
AITPQARKKRSAIDEIGAKVNAQNSE

SEQ ID NO: 1870167 - protein, 22 aa, Staphylococcus
AIVASALWLKVVFLPFQLLGIV

SEQ ID NO: 1870168 - protein, 24 aa, Staphylococcus
AIVFFIVSTIFAFFLSNRITKPLR

SEQ ID NO: 1870169 - protein, 19 aa, Staphylococcus
AIVGAGLAVFSFVTQALIF

SEQ ID NO: 1870170 - protein, 47 aa, Staphylococcus
AIVILIIFALLFRFIVKLIPIYYIFRVLSIFIFLMAFKMLGVSIQKL

SEQ ID NO: 1870171 - protein, 39 aa, Staphylococcus
AIVILIIFALLFRFIVKLIPIYYIFRVLSILIFIMAFKM

SEQ ID NO: 1870172 - protein, 21 aa, Staphylococcus
AIVPMFFGKPFLYQSEAHLHL

SEQ ID NO: 1870173 - protein, 19 aa, Staphylococcus
AIVSFLWFSVFGVLGIETG

SEQ ID NO: 1870174 - protein, 20 aa, Staphylococcus
AIVSYAKEKSLEFLEVDHFE

SEQ ID NO: 1870175 - protein, 26 aa, Staphylococcus
AIVVILLFLRNIRTTAISIVSIPMSI

SEQ ID NO: 1870176 - protein, 26 aa, Staphylococcus
AIWDREGWMIFIGWLSYFLLGFYIGT

SEQ ID NO: 1870177 - protein, 19 aa, Staphylococcus
AIWPQKGLIYFGMADIGGA

SEQ ID NO: 1870178 - protein, 18 aa, Staphylococcus
AIYAMAGVVWPNGGRQTF

SEQ ID NO: 1870179 - protein, 17 aa, Staphylococcus
AIYFYPRLKIRISGLLV

SEQ ID NO: 1870180 - protein, 24 aa, Staphylococcus
AIYSFLYSFAFSMIIGELIRATKG

SEQ ID NO: 1870181 - protein, 23 aa, Staphylococcus
AKAEKMGIWSLDSAFKEDNEDNK

SEQ ID NO: 1870182 - protein, 23 aa, Staphylococcus
AKANALADIISRVQSDKANALDL

SEQ ID NO: 1870183 - protein, 18 aa, Staphylococcus
AKAPNIMAGDQILATGTI

SEQ ID NO: 1870184 - protein, 24 aa, Staphylococcus
AKAQEKLKSLGLNHISIKKDYSRT

SEQ ID NO: 1870185 - protein, 17 aa, Staphylococcus
AKARITVRANISRLVGG

SEQ ID NO: 1870186 - protein, 18 aa, Staphylococcus
AKARITVRANISRLVGGA

SEQ ID NO: 1870187 - protein, 18 aa, Staphylococcus
AKARITVRANISRLVGGS

SEQ ID NO: 1870188 - protein, 18 aa, Staphylococcus
AKASLAYGGWPLPFHDII

SEQ ID NO: 1870189 - protein, 38 aa, Staphylococcus
AKDQWRVLMRLIRYTFSFKWLIALAFLMLAISTAASVA

SEQ ID NO: 1870190 - protein, 25 aa, Staphylococcus
AKEKELREKALNYKSQAEHHIETVK

SEQ ID NO: 1870191 - protein, 17 aa, Staphylococcus
AKEKLEKIYVAKRDSSL

SEQ ID NO: 1870192 - protein, 18 aa, Staphylococcus
AKELKALLEKEGATVSMT

SEQ ID NO: 1870193 - protein, 24 aa, Staphylococcus
AKELKKLLEKEGAKVKMTRTTDKY

SEQ ID NO: 1870194 - protein, 20 aa, Staphylococcus
AKELLLKGLEKLEYRGYDSA

SEQ ID NO: 1870195 - protein, 17 aa, Staphylococcus
AKELRRALEKAGATVKL

SEQ ID NO: 1870196 - protein, 21 aa, Staphylococcus
AKFLEALVIAFAIGSGISIAY

SEQ ID NO: 1870197 - protein, 18 aa, Staphylococcus
AKFLNFNLSIAMLIALAV

SEQ ID NO: 1870198 - protein, 21 aa, Staphylococcus
AKGDKKGWVAGWHTSLNIKAD

SEQ ID NO: 1870199 - protein, 22 aa, Staphylococcus
AKGELLPIIFFAVFFGLGIAAI

SEQ ID NO: 1870200 - protein, 17 aa, Staphylococcus
AKGIGMKPFRRLTKVEL

SEQ ID NO: 1870201 - protein, 17 aa, Staphylococcus
AKGIGMKPIRRLTKVEL

SEQ ID NO: 1870202 - protein, 18 aa, Staphylococcus
AKGIGMKPIRRLTKVELP

SEQ ID NO: 1870203 - protein, 17 aa, Staphylococcus
AKGIGMKPMRRLTKVEL

SEQ ID NO: 1870204 - protein, 26 aa, Staphylococcus
AKGLKLKVAFNFSIPLIIALLHSYFA

SEQ ID NO: 1870205 - protein, 17 aa, Staphylococcus
AKGLSLFYIFIGLLMFS

SEQ ID NO: 1870206 - protein, 29 aa, Staphylococcus
AKGNREVIGYWLGFAGIVLVPLISLVANI

SEQ ID NO: 1870207 - protein, 18 aa, Staphylococcus
AKGSREFKWRLPDKKTIR

SEQ ID NO: 1870208 - protein, 17 aa, Staphylococcus
AKHKAVIFIGAILILSI

SEQ ID NO: 1870209 - protein, 21 aa, Staphylococcus
AKHKPQFLIPYFFYILFIVFV

SEQ ID NO: 1870210 - protein, 24 aa, Staphylococcus
AKIFGELEFWFAIIKVTTIIVLIV

SEQ ID NO: 1870211 - protein, 18 aa, Staphylococcus
AKILKFMAPLSFVLASLA

SEQ ID NO: 1870212 - protein, 19 aa, Staphylococcus
AKIYGEKTFGKGIVQTTKE

SEQ ID NO: 1870213 - protein, 17 aa, Staphylococcus
AKKAAEIILNLMRVSAV

SEQ ID NO: 1870214 - protein, 26 aa, Staphylococcus
AKKDIKQLKHLSAVELKSYKEDIESA

SEQ ID NO: 1870215 - protein, 25 aa, Staphylococcus
AKKELNLIMSLGFLLGGIIGLLQGI

SEQ ID NO: 1870216 - protein, 20 aa, Staphylococcus
AKKFKSAIQAAKKVAQSFKK

SEQ ID NO: 1870217 - protein, 24 aa, Staphylococcus
AKKGIPIQRLIKLLGDIFIPILPA

SEQ ID NO: 1870218 - protein, 18 aa, Staphylococcus
AKKHGWDTPEKAIRGGAE

SEQ ID NO: 1870219 - protein, 18 aa, Staphylococcus
AKKHGWDTPQKAISGGAN

SEQ ID NO: 1870220 - protein, 21 aa, Staphylococcus
AKKLIPIITIGILFNIVTNLL

SEQ ID NO: 1870221 - protein, 23 aa, Staphylococcus
AKKSLNSFARQKAKATVEVNEGA

SEQ ID NO: 1870222 - protein, 24 aa, Staphylococcus
AKLEAKFSRKALYIGAFTFLIIGS

SEQ ID NO: 1870223 - protein, 29 aa, Staphylococcus
AKLFGELEFWFSIIKIITIIAMIIVGLVM

SEQ ID NO: 1870224 - protein, 26 aa, Staphylococcus
AKLFGELEFWLSIIKVITIVALIIVG

SEQ ID NO: 1870225 - protein, 26 aa, Staphylococcus
AKLFGELEFWLSLIKVITIIALIVVG

SEQ ID NO: 1870226 - protein, 22 aa, Staphylococcus
AKLLSFKLFTYIGKRSYSLYLW

SEQ ID NO: 1870227 - protein, 18 aa, Staphylococcus
AKLPIVVFLIYALGRGIM

SEQ ID NO: 1870228 - protein, 31 aa, Staphylococcus
AKLSKFKLLSWIASIYIEFLRGTPMLVQVFL

SEQ ID NO: 1870229 - protein, 24 aa, Staphylococcus
AKLSYKKLLITLGIILLIILLVIV

SEQ ID NO: 1870230 - protein, 24 aa, Staphylococcus
AKMTRKALYIFAFTCLMLCGILVF

SEQ ID NO: 1870231 - protein, 20 aa, Staphylococcus
AKMVLAQTFILSLIGTAIGL

SEQ ID NO: 1870232 - protein, 25 aa, Staphylococcus
AKNIYRLKRIAVFLNPFQYENNEGY

SEQ ID NO: 1870233 - protein, 23 aa, Staphylococcus
AKNKKEAIETILATRLNQDKAKI

SEQ ID NO: 1870234 - protein, 24 aa, Staphylococcus
AKNKLEYFNPAALYEEHKFTTMSK

SEQ ID NO: 1870235 - protein, 18 aa, Staphylococcus
AKNWSFMGIKYGLFVQSV

SEQ ID NO: 1870236 - protein, 20 aa, Staphylococcus
AKPDRVHNKMDFEVKYYATE

SEQ ID NO: 1870237 - protein, 17 aa, Staphylococcus
AKPFKMSRPMAFATSLT

SEQ ID NO: 1870238 - protein, 17 aa, Staphylococcus
AKPMLVVAFAIIMANTI

SEQ ID NO: 1870239 - protein, 22 aa, Staphylococcus
AKPQLLKALLFALISFAVCFIV

SEQ ID NO: 1870240 - protein, 17 aa, Staphylococcus
AKQAIDDAVTAKKAEID

SEQ ID NO: 1870241 - protein, 20 aa, Staphylococcus
AKQPEYALVLGIPTLQTGVF

SEQ ID NO: 1870242 - protein, 17 aa, Staphylococcus
AKREPFFGVAFIVMVFA

SEQ ID NO: 1870243 - protein, 23 aa, Staphylococcus
AKRKEYPNFITVDSGEGGTGATF

SEQ ID NO: 1870244 - protein, 23 aa, Staphylococcus
AKRNHLRIVTGIFNVKPYPDEQA

SEQ ID NO: 1870245 - protein, 21 aa, Staphylococcus
AKRNTIVLVMLISAFVAMLNQ

SEQ ID NO: 1870246 - protein, 24 aa, Staphylococcus
AKRPLLFGSAFTFIGLLLLSLTFL

SEQ ID NO: 1870247 - protein, 17 aa, Staphylococcus
AKRWIRYIHEVEEPDFL

SEQ ID NO: 1870248 - protein, 21 aa, Staphylococcus
AKSELEAKGFKVVVTQETEDK

SEQ ID NO: 1870249 - protein, 17 aa, Staphylococcus
AKSLGYSDSNSFVTNTV

SEQ ID NO: 1870250 - protein, 25 aa, Staphylococcus
AKTFRGWSGGFGNHVEITNGSLKSI

SEQ ID NO: 1870251 - protein, 17 aa, Staphylococcus
AKTLWRSTWEKAKGFVK

SEQ ID NO: 1870252 - protein, 18 aa, Staphylococcus
AKTPRHFNFNRLLIDQDH

SEQ ID NO: 1870253 - protein, 21 aa, Staphylococcus
AKVDFFKKNAVSLIAVDYKQP

SEQ ID NO: 1870254 - protein, 24 aa, Staphylococcus
AKVKETWKYDVILFLIQLIIISII

SEQ ID NO: 1870255 - protein, 17 aa, Staphylococcus
AKVLKRPFRLHQFVMSF

SEQ ID NO: 1870256 - protein, 21 aa, Staphylococcus
AKVTIIFGFAFIQAALQLLMF

SEQ ID NO: 1870257 - protein, 20 aa, Staphylococcus
AKWLAFPDIYLPFKDYVPSF

SEQ ID NO: 1870258 - protein, 21 aa, Staphylococcus
AKWLDFPHIYLPFKDYTPSFH

SEQ ID NO: 1870259 - protein, 21 aa, Staphylococcus
AKWVFFCSFIVLLFPIYFLGQ

SEQ ID NO: 1870260 - protein, 25 aa, Staphylococcus
AKWVRPVLIIGCLFAFFQQIIGINA

SEQ ID NO: 1870261 - protein, 25 aa, Staphylococcus
AKYKILPSLKRRGITTIDYLIITHP

SEQ ID NO: 1870262 - protein, 19 aa, Staphylococcus
AKYLFLFALVLEILSYFFI

SEQ ID NO: 1870263 - protein, 19 aa, Staphylococcus
AKYLIKWKPVPVIIGAVIF

SEQ ID NO: 1870264 - protein, 26 aa, Staphylococcus
ALAAFSFSFSMLLAMRILSALMHGVF

SEQ ID NO: 1870265 - protein, 17 aa, Staphylococcus
ALACITTACGLIVSVSQ

SEQ ID NO: 1870266 - protein, 25 aa, Staphylococcus
ALAEMSPKIRSMIAEITYEPQKNKQ

SEQ ID NO: 1870267 - protein, 21 aa, Staphylococcus
ALAFGVFFDAFIVRLLMIPAL

SEQ ID NO: 1870268 - protein, 23 aa, Staphylococcus
ALAGTIWLMISIIPISIVLGVGT

SEQ ID NO: 1870269 - protein, 17 aa, Staphylococcus
ALALAWINQILAMNRIS

SEQ ID NO: 1870270 - protein, 20 aa, Staphylococcus
ALAMKRYLIAKGVPEKRILM

SEQ ID NO: 1870271 - protein, 19 aa, Staphylococcus
ALAMKRYLIHHGVESNHIM

SEQ ID NO: 1870272 - protein, 23 aa, Staphylococcus
ALAMKRYLLSHGVPEQSIIMEAH

SEQ ID NO: 1870273 - protein, 25 aa, Staphylococcus
ALAPGMGLNAFFAFTVVLTMGIPWK

SEQ ID NO: 1870274 - protein, 26 aa, Staphylococcus
ALAWAYLRFIAFRHDLKYLPGGQTLI

SEQ ID NO: 1870275 - protein, 19 aa, Staphylococcus
ALCFTMISMVILRPMVEVI

SEQ ID NO: 1870276 - protein, 19 aa, Staphylococcus
ALCIALLSLLFPLKGLSVS

SEQ ID NO: 1870277 - protein, 18 aa, Staphylococcus
ALCTVLYFIVHGRKVKTQ

SEQ ID NO: 1870278 - protein, 24 aa, Staphylococcus
ALDNARSQLVLDRQPFITHINGEG

SEQ ID NO: 1870279 - protein, 25 aa, Staphylococcus
ALDYFEPVFNYGFLGLSIIFLIANY

SEQ ID NO: 1870280 - protein, 19 aa, Staphylococcus
ALEALLIDRVHRYLTSTRG

SEQ ID NO: 1870281 - protein, 19 aa, Staphylococcus
ALEEINFMLMRAMADHQRY

SEQ ID NO: 1870282 - protein, 19 aa, Staphylococcus
ALEEINFMLMRAMQDHQRQ

SEQ ID NO: 1870283 - protein, 17 aa, Staphylococcus
ALEEISFMLTRALSNEK

SEQ ID NO: 1870284 - protein, 21 aa, Staphylococcus
ALEHNHAFKGLSWHQELFYSF

SEQ ID NO: 1870285 - protein, 18 aa, Staphylococcus
ALELKRALEKAGAHVKLT

SEQ ID NO: 1870286 - protein, 17 aa, Staphylococcus
ALELKTLLEKEGAHVKM

SEQ ID NO: 1870287 - protein, 24 aa, Staphylococcus
ALEQARFPDRFTIQYHIDSSCKHV

SEQ ID NO: 1870288 - protein, 19 aa, Staphylococcus
ALETGLMFICFQKSPQQFI

SEQ ID NO: 1870289 - protein, 19 aa, Staphylococcus
ALETGLMFICFQKSTQQFI

SEQ ID NO: 1870290 - protein, 17 aa, Staphylococcus
ALFAAMVFMKLMGEYSP

SEQ ID NO: 1870291 - protein, 17 aa, Staphylococcus
ALFELLQQFPISDITSV

SEQ ID NO: 1870292 - protein, 18 aa, Staphylococcus
ALFGFVFLAVIERWNVSH

SEQ ID NO: 1870293 - protein, 18 aa, Staphylococcus
ALFIFLMIFYVMNSNQSE

SEQ ID NO: 1870294 - protein, 24 aa, Staphylococcus
ALFILNLFFSFTIVFLERRSPGSI

SEQ ID NO: 1870295 - protein, 19 aa, Staphylococcus
ALFIPMMIMLLIGAFTKSA

SEQ ID NO: 1870296 - protein, 19 aa, Staphylococcus
ALFLPIFIIYTIMKPADKN

SEQ ID NO: 1870297 - protein, 20 aa, Staphylococcus
ALFLPIFIVYTIMRPADKKN

SEQ ID NO: 1870298 - protein, 18 aa, Staphylococcus
ALFLPLFIAYTMINPIDR

SEQ ID NO: 1870299 - protein, 20 aa, Staphylococcus
ALFLPVFIIFTVKKPVQKNH

SEQ ID NO: 1870300 - protein, 20 aa, Staphylococcus
ALFRNLAPMIILFVIYIVHK

SEQ ID NO: 1870301 - protein, 17 aa, Staphylococcus
ALFSDSIATIIGAIFGT

SEQ ID NO: 1870302 - protein, 24 aa, Staphylococcus
ALFSFKLYQHYYYKLFAIATWLLL

SEQ ID NO: 1870303 - protein, 17 aa, Staphylococcus
ALFWGSLVLINVFVGGG

SEQ ID NO: 1870304 - protein, 19 aa, Staphylococcus
ALGALIRFGLSHFNQGNGF

SEQ ID NO: 1870305 - protein, 21 aa, Staphylococcus
ALGAYVLWGILPIYWELIHHI

SEQ ID NO: 1870306 - protein, 25 aa, Staphylococcus
ALGGFVAEFSFNFIFLANLVMYVLF

SEQ ID NO: 1870307 - protein, 21 aa, Staphylococcus
ALGGLILSFTGWRMVFIILTI

SEQ ID NO: 1870308 - protein, 21 aa, Staphylococcus
ALGLFPGWTSQALVAPAAQAI

SEQ ID NO: 1870309 - protein, 18 aa, Staphylococcus
ALGLFYKNKVYKKTDELR

SEQ ID NO: 1870310 - protein, 26 aa, Staphylococcus
ALGLLAPWIAGAAMALSSVSVVTNAL

SEQ ID NO: 1870311 - protein, 19 aa, Staphylococcus
ALGLYWSISAAFLIVQMHL

SEQ ID NO: 1870312 - protein, 18 aa, Staphylococcus
ALGLYWSVGAAFLIIQTF

SEQ ID NO: 1870313 - protein, 19 aa, Staphylococcus
ALGLYWSVSAAFLIVQTQV

SEQ ID NO: 1870314 - protein, 18 aa, Staphylococcus
ALGLYWSVSAAFLVVQTH

SEQ ID NO: 1870315 - protein, 18 aa, Staphylococcus
ALGLYWSVSAAFLVVQTY

SEQ ID NO: 1870316 - protein, 18 aa, Staphylococcus
ALGLYWSVSAIFMIVQTF

SEQ ID NO: 1870317 - protein, 18 aa, Staphylococcus
ALGMPIYALMILVVSVKL

SEQ ID NO: 1870318 - protein, 26 aa, Staphylococcus
ALGNGLFRWTEKYGNGVFITIFGISF

SEQ ID NO: 1870319 - protein, 37 aa, Staphylococcus
ALGPSMKTAWEVIKQAVIIVWEFIKTYVQVAIAVVSG

SEQ ID NO: 1870320 - protein, 18 aa, Staphylococcus
ALGPVVLGLGLVLRAVGS

SEQ ID NO: 1870321 - protein, 19 aa, Staphylococcus
ALGSAFGSTALWIGAGLMS

SEQ ID NO: 1870322 - protein, 17 aa, Staphylococcus
ALGSEFTAVGILMQRWF

SEQ ID NO: 1870323 - protein, 19 aa, Staphylococcus
ALGSWLLGDWGWHLGGIAV

SEQ ID NO: 1870324 - protein, 19 aa, Staphylococcus
ALGTCCLLLGIILMNYLPK

SEQ ID NO: 1870325 - protein, 26 aa, Staphylococcus
ALGTRIKRIKMILLILSVMLAGSSIS

SEQ ID NO: 1870326 - protein, 23 aa, Staphylococcus
ALGYLLKRINFIKSADSQVLSTL

SEQ ID NO: 1870327 - protein, 24 aa, Staphylococcus
ALHKFKVVLQMLILRIRAKKHADT

SEQ ID NO: 1870328 - protein, 21 aa, Staphylococcus
ALHSRCPEAMVIDINDTKMLT

SEQ ID NO: 1870329 - protein, 18 aa, Staphylococcus
ALIAGIVDCALVGTISHN

SEQ ID NO: 1870330 - protein, 18 aa, Staphylococcus
ALIEAGGTRIRPILMTAL

SEQ ID NO: 1870331 - protein, 17 aa, Staphylococcus
ALIGALIAMKFNLTPLA

SEQ ID NO: 1870332 - protein, 27 aa, Staphylococcus
ALIGFGASFFFNWLIQRDVIPQNLMPS

SEQ ID NO: 1870333 - protein, 23 aa, Staphylococcus
ALIGGILVWMGWYGFNTGSAFAF

SEQ ID NO: 1870334 - protein, 19 aa, Staphylococcus
ALIIGWLGRYLRYFRNLAR

SEQ ID NO: 1870335 - protein, 19 aa, Staphylococcus
ALILPFVIMTLTAIALVVV

SEQ ID NO: 1870336 - protein, 17 aa, Staphylococcus
ALILTAIVIGFAVTAFL

SEQ ID NO: 1870337 - protein, 24 aa, Staphylococcus
ALIMFSVFFAFVFQEDVMIKSMGM

SEQ ID NO: 1870338 - protein, 24 aa, Staphylococcus
ALIMFSVFIAFIFQDDTAIKSMGL

SEQ ID NO: 1870339 - protein, 25 aa, Staphylococcus
ALIMFSVFIAFVFQDDITVKAMGIS

SEQ ID NO: 1870340 - protein, 24 aa, Staphylococcus
ALIMFSVFIAFVFQDDMQIKSMGI

SEQ ID NO: 1870341 - protein, 25 aa, Staphylococcus
ALIMFSVFIAFVFQDDVMIKSMGIA

SEQ ID NO: 1870342 - protein, 25 aa, Staphylococcus
ALIMFSVFIAFVFQEDSAIKSMGIS

SEQ ID NO: 1870343 - protein, 20 aa, Staphylococcus
ALIMRLCDVMLAFPSYVVTL

SEQ ID NO: 1870344 - protein, 18 aa, Staphylococcus
ALISAFAAIGIIRLEDVY

SEQ ID NO: 1870345 - protein, 30 aa, Staphylococcus
ALITLPVAIAMRLTKGFKQLIILSIIIGEC

SEQ ID NO: 1870346 - protein, 27 aa, Staphylococcus
ALITLPVAIAMRWTKGFKQLIVLSIII

SEQ ID NO: 1870347 - protein, 18 aa, Staphylococcus
ALITVSIVLCIFHLFIEK

SEQ ID NO: 1870348 - protein, 18 aa, Staphylococcus
ALIVFGIALLIAMFRLIK

SEQ ID NO: 1870349 - protein, 17 aa, Staphylococcus
ALIYASIGIIIYVSLRF

SEQ ID NO: 1870350 - protein, 23 aa, Staphylococcus
ALIYCIVIYFFVRLMIEKGLKQR

SEQ ID NO: 1870351 - protein, 18 aa, Staphylococcus
ALKKEIPTYFSHVEAYLW

SEQ ID NO: 1870352 - protein, 20 aa, Staphylococcus
ALLAEYFIAVAFVASGFSAN

SEQ ID NO: 1870353 - protein, 28 aa, Staphylococcus
ALLAILFDFILRYMAKLSYKKLLITLGI

SEQ ID NO: 1870354 - protein, 17 aa, Staphylococcus
ALLAVIVVVVFGKNIVI

SEQ ID NO: 1870355 - protein, 23 aa, Staphylococcus
ALLDEANRLGVKLEEEIPTINKI

SEQ ID NO: 1870356 - protein, 18 aa, Staphylococcus
ALLEAGGTRIRPILMTAI

SEQ ID NO: 1870357 - protein, 17 aa, Staphylococcus
ALLEKEGATVSMTRESD

SEQ ID NO: 1870358 - protein, 20 aa, Staphylococcus
ALLEQFSWHSAFLINVPFVI

SEQ ID NO: 1870359 - protein, 20 aa, Staphylococcus
ALLFLLAHPMAWMMGDVHLE

SEQ ID NO: 1870360 - protein, 28 aa, Staphylococcus
ALLGITALICYRWILMLMQVSQDIFELT

SEQ ID NO: 1870361 - protein, 18 aa, Staphylococcus
ALLIPFIIMVLTAIALVI

SEQ ID NO: 1870362 - protein, 18 aa, Staphylococcus
ALLIPFILMVLTAIALVI

SEQ ID NO: 1870363 - protein, 18 aa, Staphylococcus
ALLIPFILMVLTSIALVV

SEQ ID NO: 1870364 - protein, 18 aa, Staphylococcus
ALLIPLFVQNGLGLSAFM

SEQ ID NO: 1870365 - protein, 18 aa, Staphylococcus
ALLLHLRPLGLKDKSLGE

SEQ ID NO: 1870366 - protein, 19 aa, Staphylococcus
ALLLHLRPLGLKDKSLGEG

SEQ ID NO: 1870367 - protein, 26 aa, Staphylococcus
ALLLLSLIGFIAWGMLSDKYTEMPDL

SEQ ID NO: 1870368 - protein, 18 aa, Staphylococcus
ALLLVSAVGIGFRLIQTG

SEQ ID NO: 1870369 - protein, 25 aa, Staphylococcus
ALLNVFLAWFFVYFQIGRSIVEGLA

SEQ ID NO: 1870370 - protein, 22 aa, Staphylococcus
ALLPLLKLVLLVVFAMVFFILV

SEQ ID NO: 1870371 - protein, 25 aa, Staphylococcus
ALLSFKLYKHYYFKLFAISTLILIC

SEQ ID NO: 1870372 - protein, 33 aa, Staphylococcus
ALLSFKLYKHYYYRLFAILTFVFIIFSFIPFID

SEQ ID NO: 1870373 - protein, 17 aa, Staphylococcus
ALLSIIGGYLFGAISFM

SEQ ID NO: 1870374 - protein, 19 aa, Staphylococcus
ALLSISVILNAIFKDATQV

SEQ ID NO: 1870375 - protein, 17 aa, Staphylococcus
ALLSITVLLNYLIPNAT

SEQ ID NO: 1870376 - protein, 26 aa, Staphylococcus
ALLTEPELKFVKVERVPNLVTKPSIN

SEQ ID NO: 1870377 - protein, 17 aa, Staphylococcus
ALLYEWSRINEMLDKQL

SEQ ID NO: 1870378 - protein, 24 aa, Staphylococcus
ALMIFFCVFLIFSPIGKLKLGKPN

SEQ ID NO: 1870379 - protein, 17 aa, Staphylococcus
ALMIPFLLMVLTAIAIV

SEQ ID NO: 1870380 - protein, 24 aa, Staphylococcus
ALMPYSVAFGIFWTLLLIVWYLLG

SEQ ID NO: 1870381 - protein, 17 aa, Staphylococcus
ALMTPLMLIVFRFPPHV

SEQ ID NO: 1870382 - protein, 18 aa, Staphylococcus
ALMTPLMLIVFRFPPHVA

SEQ ID NO: 1870383 - protein, 18 aa, Staphylococcus
ALMYCYKLLLTIYFGLLF

SEQ ID NO: 1870384 - protein, 24 aa, Staphylococcus
ALNALHIWAQVALFFTTVGSTILE

SEQ ID NO: 1870385 - protein, 18 aa, Staphylococcus
ALNDAMKALRDGINNKDE

SEQ ID NO: 1870386 - protein, 19 aa, Staphylococcus
ALNDMSFEIQENVQALSTS

SEQ ID NO: 1870387 - protein, 27 aa, Staphylococcus
ALNEGIARILSVEIVGWNSNNPTQSTH

SEQ ID NO: 1870388 - protein, 18 aa, Staphylococcus
ALNEKAKLIIALNNYMPD

SEQ ID NO: 1870389 - protein, 22 aa, Staphylococcus
ALNEKAKLILALNDYMPNIERL

SEQ ID NO: 1870390 - protein, 22 aa, Staphylococcus
ALNEKAKLILTLNEYMPNIRNA

SEQ ID NO: 1870391 - protein, 23 aa, Staphylococcus
ALNTGLLFLCFQKSPQQFIDIQN

SEQ ID NO: 1870392 - protein, 28 aa, Staphylococcus
ALPKTRRTVGAFVLQLALLLVTHIVFYF

SEQ ID NO: 1870393 - protein, 27 aa, Staphylococcus
ALQNIYLRVFYPPVVIGFTAIIAAVTL

SEQ ID NO: 1870394 - protein, 19 aa, Staphylococcus
ALQNIYLRVYYPPIVIGMT

SEQ ID NO: 1870395 - protein, 22 aa, Staphylococcus
ALQRFSGIVTFVFIFMHLWQTT

SEQ ID NO: 1870396 - protein, 20 aa, Staphylococcus
ALRGFSLLGIFIANLLIFQF

SEQ ID NO: 1870397 - protein, 23 aa, Staphylococcus
ALRLYDLKGILAYSTISQLGMIM

SEQ ID NO: 1870398 - protein, 26 aa, Staphylococcus
ALRQSFNIPALKAWQQTKEHAGNDAP

SEQ ID NO: 1870399 - protein, 26 aa, Staphylococcus
ALRQSFNIPALKAWQQVSSNAGKDAP

SEQ ID NO: 1870400 - protein, 25 aa, Staphylococcus
ALRQSFNIPALKTWQQVNSQAGDNA

SEQ ID NO: 1870401 - protein, 19 aa, Staphylococcus
ALSAHDSWTLAKHLKTLPV

SEQ ID NO: 1870402 - protein, 23 aa, Staphylococcus
ALSIGLGRAGTWMNTGEGGLSNH

SEQ ID NO: 1870403 - protein, 23 aa, Staphylococcus
ALSKGLGQAGTWMNTGEGGLSEH

SEQ ID NO: 1870404 - protein, 23 aa, Staphylococcus
ALSKGLSKAGTWMNTGEGGLSDY

SEQ ID NO: 1870405 - protein, 22 aa, Staphylococcus
ALSKGLSKAGTWMNTGEGGLSE

SEQ ID NO: 1870406 - protein, 18 aa, Staphylococcus
ALSLVVFNKINFITAAIA

SEQ ID NO: 1870407 - protein, 23 aa, Staphylococcus
ALSQGLARAGTWMNTGEGGLSDY

SEQ ID NO: 1870408 - protein, 23 aa, Staphylococcus
ALSQGLARAGTWMNTGEGGLSEY

SEQ ID NO: 1870409 - protein, 17 aa, Staphylococcus
ALSRIRIGAHFTSDVTM

SEQ ID NO: 1870410 - protein, 19 aa, Staphylococcus
ALSWIDVLKNIVWAFVGNY

SEQ ID NO: 1870411 - protein, 18 aa, Staphylococcus
ALSWLDVLKNIVFAFIGN

SEQ ID NO: 1870412 - protein, 17 aa, Staphylococcus
ALSWMFVGLGAMPATLI

SEQ ID NO: 1870413 - protein, 17 aa, Staphylococcus
ALTDAWNAIASSVGAAI

SEQ ID NO: 1870414 - protein, 19 aa, Staphylococcus
ALTDRKVFIDSHYDATQEE

SEQ ID NO: 1870415 - protein, 17 aa, Staphylococcus
ALTEIRILGAITPIGGV

SEQ ID NO: 1870416 - protein, 18 aa, Staphylococcus
ALTFKLNQTLTFWTAGGV

SEQ ID NO: 1870417 - protein, 23 aa, Staphylococcus
ALTGICYYSSIKLTNPSIASLGL

SEQ ID NO: 1870418 - protein, 24 aa, Staphylococcus
ALTGNELQPAYSYIHTKDAFKHTL

SEQ ID NO: 1870419 - protein, 17 aa, Staphylococcus
ALTSFGLILTLILLFLP

SEQ ID NO: 1870420 - protein, 25 aa, Staphylococcus
ALTYARPLYYFGNIMKPLIWLMNGS

SEQ ID NO: 1870421 - protein, 29 aa, Staphylococcus
ALTYARPLYYFGNVMKPLIWLMNGSARVI

SEQ ID NO: 1870422 - protein, 18 aa, Staphylococcus
ALVAGIIGALIVLGVGRL

SEQ ID NO: 1870423 - protein, 19 aa, Staphylococcus
ALVFIRQRLTMVILNGVIG

SEQ ID NO: 1870424 - protein, 19 aa, Staphylococcus
ALVFYRIGITSHFKSVYYK

SEQ ID NO: 1870425 - protein, 24 aa, Staphylococcus
ALVHAHLLPIVSIIVEPAKIVFLN

SEQ ID NO: 1870426 - protein, 24 aa, Staphylococcus
ALVHAHLLPLVSIIVEPAKIVFLN

SEQ ID NO: 1870427 - protein, 25 aa, Staphylococcus
ALVHAHLLPLVSILVEPAKIVFLNN

SEQ ID NO: 1870428 - protein, 18 aa, Staphylococcus
ALVIGAAPFYARLVEIAF

SEQ ID NO: 1870429 - protein, 19 aa, Staphylococcus
ALVIGAAPFYARLVEIAFK

SEQ ID NO: 1870430 - protein, 18 aa, Staphylococcus
ALVIQRFTTRQVFLTGIL

SEQ ID NO: 1870431 - protein, 21 aa, Staphylococcus
ALVSIGTAIGLVFTQIGFSIV

SEQ ID NO: 1870432 - protein, 19 aa, Staphylococcus
ALVSMPLLTLIGLDIHTSV

SEQ ID NO: 1870433 - protein, 23 aa, Staphylococcus
ALVSPDLAGIVERIGSGHTFTFI

SEQ ID NO: 1870434 - protein, 17 aa, Staphylococcus
ALVVISLWIFYEAIMRM

SEQ ID NO: 1870435 - protein, 18 aa, Staphylococcus
ALVVLSFLMVLPLENVLF

SEQ ID NO: 1870436 - protein, 29 aa, Staphylococcus
ALVYSRPLYYFGNVMKPLIWLMNGSARVI

SEQ ID NO: 1870437 - protein, 27 aa, Staphylococcus
ALWMGDSRLTPMLRMASFSFILIGILG

SEQ ID NO: 1870438 - protein, 18 aa, Staphylococcus
ALWVVIGGACIRFGTGTL

SEQ ID NO: 1870439 - protein, 19 aa, Staphylococcus
ALWYSNFYISLLIFVCLLY

SEQ ID NO: 1870440 - protein, 25 aa, Staphylococcus
AMEMRRYLMRFVHHIGGLADFSALK

SEQ ID NO: 1870441 - protein, 26 aa, Staphylococcus
AMGLLAPWIAGAAMALSSVSVVSNAL

SEQ ID NO: 1870442 - protein, 26 aa, Staphylococcus
AMGLLAPWIAGAAMALSSVSVVTNAL

SEQ ID NO: 1870443 - protein, 17 aa, Staphylococcus
AMGNHFALITAILSGPF

SEQ ID NO: 1870444 - protein, 22 aa, Staphylococcus
AMGSAFGSTALWIGAGLMSLAV

SEQ ID NO: 1870445 - protein, 25 aa, Staphylococcus
AMGTVLWLVLRKRIGLRERQLIMLD

SEQ ID NO: 1870446 - protein, 19 aa, Staphylococcus
AMHLKDRLIPISNQRIHAI

SEQ ID NO: 1870447 - protein, 18 aa, Staphylococcus
AMICLSRIYLGVHYPTDI

SEQ ID NO: 1870448 - protein, 26 aa, Staphylococcus
AMIFFKRKFTKEQRGSIVPNYVMGLS

SEQ ID NO: 1870449 - protein, 19 aa, Staphylococcus
AMILMVLIPIVFFIPNVFG

SEQ ID NO: 1870450 - protein, 23 aa, Staphylococcus
AMIPGIHDAYLFNFFSRLLTALI

SEQ ID NO: 1870451 - protein, 19 aa, Staphylococcus
AMIRLKRIPVLSQFIIIYN

SEQ ID NO: 1870452 - protein, 17 aa, Staphylococcus
AMLHRSIIGLSKHQEVT

SEQ ID NO: 1870453 - protein, 17 aa, Staphylococcus
AMLIPSMGYIVGLILGF

SEQ ID NO: 1870454 - protein, 17 aa, Staphylococcus
AMLIPSMGYIVGLILGL

SEQ ID NO: 1870455 - protein, 31 aa, Staphylococcus
AMLISKRLTRPLSFYIDWIGNLSLGKLHQPT

SEQ ID NO: 1870456 - protein, 24 aa, Staphylococcus
AMMSKLGIMGAIYYTIHDMLVKTA

SEQ ID NO: 1870457 - protein, 18 aa, Staphylococcus
AMMTEAFVGVNYTFAVIF

SEQ ID NO: 1870458 - protein, 25 aa, Staphylococcus
AMNDIKDQVDVFVILSHLGVDPNTK

SEQ ID NO: 1870459 - protein, 26 aa, Staphylococcus
AMNEIKNNVDVFVILSHLGVDKSTQK

SEQ ID NO: 1870460 - protein, 18 aa, Staphylococcus
AMNMILGMEKKHFRMIML

SEQ ID NO: 1870461 - protein, 20 aa, Staphylococcus
AMQIMVYWFVFGLGIRSNNP

SEQ ID NO: 1870462 - protein, 17 aa, Staphylococcus
AMSFLYILFNFIYTVSY

SEQ ID NO: 1870463 - protein, 19 aa, Staphylococcus
AMSISRFAYTPILPFMQQD

SEQ ID NO: 1870464 - protein, 20 aa, Staphylococcus
AMTCCAIGGIIATMILPNIL

SEQ ID NO: 1870465 - protein, 23 aa, Staphylococcus
AMTEAFVGANYAFAVIFITTQVI

SEQ ID NO: 1870466 - protein, 17 aa, Staphylococcus
AMTFALVFLFSEETGDL

SEQ ID NO: 1870467 - protein, 21 aa, Staphylococcus
AMYRLFGKQGLIAWIAIGTVL

SEQ ID NO: 1870468 - protein, 29 aa, Staphylococcus
ANADKKLILRLAVPGSMFAFIGAALVSHL

SEQ ID NO: 1870469 - protein, 26 aa, Staphylococcus
ANAFQVGPVWMILRVLAVVFVWMTYF

SEQ ID NO: 1870470 - protein, 29 aa, Staphylococcus
ANALLIIVGYKFLSKKSMLLTIVATVLIS

SEQ ID NO: 1870471 - protein, 24 aa, Staphylococcus
ANASIKITMLFSIAAGIGLINLLP

SEQ ID NO: 1870472 - protein, 18 aa, Staphylococcus
ANASLKITILISSAAAVG

SEQ ID NO: 1870473 - protein, 19 aa, Staphylococcus
ANASLKITILISSAAGIGL

SEQ ID NO: 1870474 - protein, 17 aa, Staphylococcus
ANDWFKKYGAWAVLLCR

SEQ ID NO: 1870475 - protein, 17 aa, Staphylococcus
ANDYKLPTFVMGIGLGG

SEQ ID NO: 1870476 - protein, 34 aa, Staphylococcus
ANEAVWKRTHRFVSRLFIATGFVLLVLALLQVIN

SEQ ID NO: 1870477 - protein, 17 aa, Staphylococcus
ANEGYHFTVYVPFGDDW

SEQ ID NO: 1870478 - protein, 17 aa, Staphylococcus
ANFSILMLAGFAGAVIG

SEQ ID NO: 1870479 - protein, 21 aa, Staphylococcus
ANGIWSFLVTWGILQSKKSQQ

SEQ ID NO: 1870480 - protein, 23 aa, Staphylococcus
ANGLWSFGVTWGFLQSPKSQRVF

SEQ ID NO: 1870481 - protein, 25 aa, Staphylococcus
ANHHTRFSSFYGVIIYIIVFFLFVT

SEQ ID NO: 1870482 - protein, 24 aa, Staphylococcus
ANHSLSISLIFAWVLMISAIQIVL

SEQ ID NO: 1870483 - protein, 23 aa, Staphylococcus
ANIFIIMICCVLIGSLLGFLFYN

SEQ ID NO: 1870484 - protein, 18 aa, Staphylococcus
ANIGRLLPLLGTAFSALT

SEQ ID NO: 1870485 - protein, 19 aa, Staphylococcus
ANINKSLLATMFASLGSVL

SEQ ID NO: 1870486 - protein, 25 aa, Staphylococcus
ANKELKLIMFLGFLLGGIIGLFQGV

SEQ ID NO: 1870487 - protein, 25 aa, Staphylococcus
ANKELKLIMLLGFLLGGIIGCLQGI

SEQ ID NO: 1870488 - protein, 26 aa, Staphylococcus
ANKELKLITLLGFILGGIIGLFQGLI

SEQ ID NO: 1870489 - protein, 30 aa, Staphylococcus
ANKIKRQQWLRFSFVLLAIVGIALAVFSFM

SEQ ID NO: 1870490 - protein, 21 aa, Staphylococcus
ANKSALFLIAFVIFVLVFVAL

SEQ ID NO: 1870491 - protein, 24 aa, Staphylococcus
ANKVINLLVCIALLAAVGLGLTSW

SEQ ID NO: 1870492 - protein, 26 aa, Staphylococcus
ANLLFLKRRGREFALLQTIGLSRFNI

SEQ ID NO: 1870493 - protein, 22 aa, Staphylococcus
ANLLKFMAPFSFVMASLAIYWA

SEQ ID NO: 1870494 - protein, 23 aa, Staphylococcus
ANLLKVMAPLSFVLASLAIYWAM

SEQ ID NO: 1870495 - protein, 26 aa, Staphylococcus
ANLTRANRNFRFFQMFTAALQSFSHG

SEQ ID NO: 1870496 - protein, 18 aa, Staphylococcus
ANLTRANRNFRFFQVFTA

SEQ ID NO: 1870497 - protein, 18 aa, Staphylococcus
ANLTRSNRNFRFFQIFTA

SEQ ID NO: 1870498 - protein, 25 aa, Staphylococcus
ANMGTYIKYAFFWIWGFAIVLLGIA

SEQ ID NO: 1870499 - protein, 25 aa, Staphylococcus
ANMGTYIKYAFFWIWGFAIVLLLIA

SEQ ID NO: 1870500 - protein, 28 aa, Staphylococcus
ANMILPRLLPLVIVFLIYWLLGRKKMNS

SEQ ID NO: 1870501 - protein, 19 aa, Staphylococcus
ANMPLSMILLGLMLNFRIE

SEQ ID NO: 1870502 - protein, 17 aa, Staphylococcus
ANNLSFLQVFFEVMSAF

SEQ ID NO: 1870503 - protein, 19 aa, Staphylococcus
ANPEQGWFISIITIVSIAP

SEQ ID NO: 1870504 - protein, 20 aa, Staphylococcus
ANPKSGWFTSIIMIVAVAPW

SEQ ID NO: 1870505 - protein, 18 aa, Staphylococcus
ANQPWKNIFNFKKIISVA

SEQ ID NO: 1870506 - protein, 17 aa, Staphylococcus
ANQRKRSIVIFKYGANS

SEQ ID NO: 1870507 - protein, 31 aa, Staphylococcus
ANQSGRNVNHLVFANTSYEILGGGKKYNQVF

SEQ ID NO: 1870508 - protein, 17 aa, Staphylococcus
ANQSISIGIVFAVVIWV

SEQ ID NO: 1870509 - protein, 24 aa, Staphylococcus
ANRKQALCIFGISGFLSFGNSLFI

SEQ ID NO: 1870510 - protein, 23 aa, Staphylococcus
ANRKSHYLWIIFSYGISYLITQI

SEQ ID NO: 1870511 - protein, 20 aa, Staphylococcus
ANRNFRFLQIFTAALQSFSH

SEQ ID NO: 1870512 - protein, 19 aa, Staphylococcus
ANRNIFWLLLIVFLILFIL

SEQ ID NO: 1870513 - protein, 24 aa, Staphylococcus
ANRSHEIMSIFGVQTKYSIQMNSR

SEQ ID NO: 1870514 - protein, 24 aa, Staphylococcus
ANSEFQMVQFIPLVVIPQVFFSGI

SEQ ID NO: 1870515 - protein, 20 aa, Staphylococcus
ANSLAMMPCFQKDLIKFIKQ

SEQ ID NO: 1870516 - protein, 30 aa, Staphylococcus
ANTFTYTISMNWSLEIARALTGGIGIVLTI

SEQ ID NO: 1870517 - protein, 25 aa, Staphylococcus
ANTFTYTISMNWSLEITRALTGGIG

SEQ ID NO: 1870518 - protein, 18 aa, Staphylococcus
ANTITYTISMNWSLEIAR

SEQ ID NO: 1870519 - protein, 25 aa, Staphylococcus
ANTKINLAFSDGHILTGTVDSNGNF

SEQ ID NO: 1870520 - protein, 17 aa, Staphylococcus
ANTRATNVVNYAANQSG

SEQ ID NO: 1870521 - protein, 17 aa, Staphylococcus
ANVAFPLLGHVHVTTVT

SEQ ID NO: 1870522 - protein, 18 aa, Staphylococcus
ANVAYEIGAKSILPFHNT

SEQ ID NO: 1870523 - protein, 17 aa, Staphylococcus
ANVGSVFLFIIIVIFLM

SEQ ID NO: 1870524 - protein, 17 aa, Staphylococcus
ANVISLIGFNIFVISEF

SEQ ID NO: 1870525 - protein, 18 aa, Staphylococcus
ANYKRHGMTPMILGNNEK

SEQ ID NO: 1870526 - protein, 20 aa, Staphylococcus
ANYLTCLLLTLFGALVIGLY

SEQ ID NO: 1870527 - protein, 21 aa, Staphylococcus
APAALCLNGYLLNETDYSYLY

SEQ ID NO: 1870528 - protein, 26 aa, Staphylococcus
APAVDKTKPGHVVFYGSNGDYINNVT

SEQ ID NO: 1870529 - protein, 22 aa, Staphylococcus
APDAETIYVIFAINTDGQLVGV

SEQ ID NO: 1870530 - protein, 21 aa, Staphylococcus
APDAETIYVIFATNVEGQLVG

SEQ ID NO: 1870531 - protein, 27 aa, Staphylococcus
APDEVKKPDARNTIDHAYEQKKQAIND

SEQ ID NO: 1870532 - protein, 21 aa, Staphylococcus
APEHIDLVFDRFYKVDASRKR

SEQ ID NO: 1870533 - protein, 18 aa, Staphylococcus
APEHPIKLILPIITLVGG

SEQ ID NO: 1870534 - protein, 22 aa, Staphylococcus
APFIAAIICIIAFKNKRTQLAG

SEQ ID NO: 1870535 - protein, 22 aa, Staphylococcus
APFIPVFYILFGLKTRDESKDQ

SEQ ID NO: 1870536 - protein, 26 aa, Staphylococcus
APFLLAYAAGVSWIYYENVSYVCPNC

SEQ ID NO: 1870537 - protein, 22 aa, Staphylococcus
APFLMFMPVWIGSLVISILLFF

SEQ ID NO: 1870538 - protein, 28 aa, Staphylococcus
APHLAILLICRFIMGFAIGMDSPVAFTF

SEQ ID NO: 1870539 - protein, 17 aa, Staphylococcus
APHNYFILIPLTFIVGA

SEQ ID NO: 1870540 - protein, 19 aa, Staphylococcus
APHPFVRMKSVEPNEDESE

SEQ ID NO: 1870541 - protein, 25 aa, Staphylococcus
APIAALTFLGAIKFVKNVGTNRKAP

SEQ ID NO: 1870542 - protein, 17 aa, Staphylococcus
APIAIALIIVHIALMYL

SEQ ID NO: 1870543 - protein, 19 aa, Staphylococcus
APIALILIKLKMILFGLMM

SEQ ID NO: 1870544 - protein, 20 aa, Staphylococcus
APIFKSMMHFSLPMMIGSLL

SEQ ID NO: 1870545 - protein, 23 aa, Staphylococcus
APIKDPKLAFSIVYTNQPVPPPW

SEQ ID NO: 1870546 - protein, 22 aa, Staphylococcus
APIPGRSAVGIEVPNDKISLVS

SEQ ID NO: 1870547 - protein, 28 aa, Staphylococcus
APKKPKEMMSYRMVFDTINVEVMNAILF

SEQ ID NO: 1870548 - protein, 25 aa, Staphylococcus
APKQLDFDVHFTKSLVGRPLNNEEF

SEQ ID NO: 1870549 - protein, 26 aa, Staphylococcus
APKQWQYKDISSFNFKQKDEIGTPGF

SEQ ID NO: 1870550 - protein, 17 aa, Staphylococcus
APLGVFAFICTTIITFG

SEQ ID NO: 1870551 - protein, 17 aa, Staphylococcus
APLLFLIITILIFLLFQ

SEQ ID NO: 1870552 - protein, 24 aa, Staphylococcus
APLLGRPALSWIVNAGGIGVVLGY

SEQ ID NO: 1870553 - protein, 17 aa, Staphylococcus
APMICQLIWLITNIIVS

SEQ ID NO: 1870554 - protein, 17 aa, Staphylococcus
APMYWLIKNEFMRMIPA

SEQ ID NO: 1870555 - protein, 17 aa, Staphylococcus
APPDWFYNLSLSISFVL

SEQ ID NO: 1870556 - protein, 17 aa, Staphylococcus
APPLFSALMLGFFGNLM

SEQ ID NO: 1870557 - protein, 26 aa, Staphylococcus
APPQRLASAMGWFWAMYSVGIGVLGS

SEQ ID NO: 1870558 - protein, 24 aa, Staphylococcus
APTEPKIHTTLIHKANTKTPVKVT

SEQ ID NO: 1870559 - protein, 17 aa, Staphylococcus
APTIDVFSNNFDQGYMK

SEQ ID NO: 1870560 - protein, 23 aa, Staphylococcus
APTLKLIFISAIILFPLGYIIGY

SEQ ID NO: 1870561 - protein, 17 aa, Staphylococcus
APTSRDAIEEIIFKQIA

SEQ ID NO: 1870562 - protein, 41 aa, Staphylococcus
APTVEVKPTTHWGMIFLYVCMAIAGLVLLGMLTIIGIKIYY

SEQ ID NO: 1870563 - protein, 18 aa, Staphylococcus
APVGAIISFIGVPYFLYL

SEQ ID NO: 1870564 - protein, 25 aa, Staphylococcus
APVNGKALRVYINFRNNNDDQVLMD

SEQ ID NO: 1870565 - protein, 19 aa, Staphylococcus
APWLAGILIGAFWQVFVIF

SEQ ID NO: 1870566 - protein, 18 aa, Staphylococcus
APWLGRNALNWIVNMSST

SEQ ID NO: 1870567 - protein, 17 aa, Staphylococcus
AQAASFVRNDLPQLEQE

SEQ ID NO: 1870568 - protein, 31 aa, Staphylococcus
AQAFKDMIPFAFSVSFFWIVDIVVRAFSKGN

SEQ ID NO: 1870569 - protein, 22 aa, Staphylococcus
AQAGSPIAYAYNLDDLYITANI

SEQ ID NO: 1870570 - protein, 19 aa, Staphylococcus
AQAGTPIAYAYNLDDSYIT

SEQ ID NO: 1870571 - protein, 25 aa, Staphylococcus
AQAHEKLIIHRDIKPQNILIDKNKT

SEQ ID NO: 1870572 - protein, 18 aa, Staphylococcus
AQAIYNFLTNSFGWLFLL

SEQ ID NO: 1870573 - protein, 17 aa, Staphylococcus
AQAPIAIALIIVHIALM

SEQ ID NO: 1870574 - protein, 20 aa, Staphylococcus
AQASARMRDWVKSSNNANNA

SEQ ID NO: 1870575 - protein, 18 aa, Staphylococcus
AQCLGLNYSKTMIHIILP

SEQ ID NO: 1870576 - protein, 18 aa, Staphylococcus
AQCLGLNYSKTMRYIILP

SEQ ID NO: 1870577 - protein, 22 aa, Staphylococcus
AQEVLPTPVFIFFMVGGAMFAL

SEQ ID NO: 1870578 - protein, 17 aa, Staphylococcus
AQEWKALEHELNIEPLD

SEQ ID NO: 1870579 - protein, 20 aa, Staphylococcus
AQFDLFRSAVGIGVGVVCLL

SEQ ID NO: 1870580 - protein, 19 aa, Staphylococcus
AQFKNGAWIIAGIGDLINT

SEQ ID NO: 1870581 - protein, 23 aa, Staphylococcus
AQFPFHVWLPKAMAAPTPVSAYL

SEQ ID NO: 1870582 - protein, 18 aa, Staphylococcus
AQFTFTNYLRLIWFVASL

SEQ ID NO: 1870583 - protein, 19 aa, Staphylococcus
AQGGLKFSAFQAGLLTLPY

SEQ ID NO: 1870584 - protein, 20 aa, Staphylococcus
AQGGTIVKFTDGHSITIPKG

SEQ ID NO: 1870585 - protein, 30 aa, Staphylococcus
AQIASLKLSLSFKVIERLLLALILPLIIFI

SEQ ID NO: 1870586 - protein, 20 aa, Staphylococcus
AQIGIAFGVVLRSRRNKDLR

SEQ ID NO: 1870587 - protein, 23 aa, Staphylococcus
AQINIWRVLVVTGKRGQEVANEI

SEQ ID NO: 1870588 - protein, 25 aa, Staphylococcus
AQINIWRVLVVTGLRGQEVSNKVMP

SEQ ID NO: 1870589 - protein, 19 aa, Staphylococcus
AQKGFNTIMVYAGLMLIFF

SEQ ID NO: 1870590 - protein, 25 aa, Staphylococcus
AQLSGLKFTISLTVINRLLLALILP

SEQ ID NO: 1870591 - protein, 29 aa, Staphylococcus
AQMEAWGWRIPFILGLFLGLFGLYLRRKL

SEQ ID NO: 1870592 - protein, 17 aa, Staphylococcus
AQPFSLQHSAFFNEKPY

SEQ ID NO: 1870593 - protein, 21 aa, Staphylococcus
AQPLIRPVIRLLKGNLKYQMF

SEQ ID NO: 1870594 - protein, 17 aa, Staphylococcus
AQPTLLFAVDLDETKQT

SEQ ID NO: 1870595 - protein, 19 aa, Staphylococcus
AQPTLLFAVDLDETKRTKV

SEQ ID NO: 1870596 - protein, 20 aa, Staphylococcus
AQPTLLFAVELDETGRTRPT

SEQ ID NO: 1870597 - protein, 20 aa, Staphylococcus
AQPTLLFAVNLDETGRTRAT

SEQ ID NO: 1870598 - protein, 20 aa, Staphylococcus
AQPTLLFAVNLDETGRTRPT

SEQ ID NO: 1870599 - protein, 24 aa, Staphylococcus
AQQCIPNKFLRRLFNKKDSKTTAY

SEQ ID NO: 1870600 - protein, 23 aa, Staphylococcus
AQQQRWLFKHIHSRLQHQRDTLI

SEQ ID NO: 1870601 - protein, 21 aa, Staphylococcus
AQREKLKELINHSDSRDDIKQ

SEQ ID NO: 1870602 - protein, 22 aa, Staphylococcus
AQRFSKGLFSWVGYPTETIEYK

SEQ ID NO: 1870603 - protein, 19 aa, Staphylococcus
AQRLLPVLMAIFIISNIIG

SEQ ID NO: 1870604 - protein, 22 aa, Staphylococcus
AQSDFSLVHSFLKKGSSSYDKV

SEQ ID NO: 1870605 - protein, 20 aa, Staphylococcus
AQSDGFKKFIAYVQENGPKL

SEQ ID NO: 1870606 - protein, 22 aa, Staphylococcus
AQSHLFIPIIILLLLGAFTKSA

SEQ ID NO: 1870607 - protein, 19 aa, Staphylococcus
AQSKFKNFFGVVGSYSTLA

SEQ ID NO: 1870608 - protein, 18 aa, Staphylococcus
AQSLIFYTIINWLPELLT

SEQ ID NO: 1870609 - protein, 17 aa, Staphylococcus
AQTRQANNEFLKETSTV

SEQ ID NO: 1870610 - protein, 18 aa, Staphylococcus
AQVESPTLFILVALCGAI

SEQ ID NO: 1870611 - protein, 19 aa, Staphylococcus
AQVRLRKAIKRQGQDINQL

SEQ ID NO: 1870612 - protein, 17 aa, Staphylococcus
AREEAKTLCVIGAGDQA

SEQ ID NO: 1870613 - protein, 25 aa, Staphylococcus
AREWRLIAISVLLLFFWSTEKILHP

SEQ ID NO: 1870614 - protein, 23 aa, Staphylococcus
AREWRLIVISILLLIFWSTEKVL

SEQ ID NO: 1870615 - protein, 22 aa, Staphylococcus
ARFTPIFALSEGWIWTVTAIGL

SEQ ID NO: 1870616 - protein, 18 aa, Staphylococcus
ARGAKPCIISMEGLEKEG

SEQ ID NO: 1870617 - protein, 26 aa, Staphylococcus
ARGLKLKVAFNFGLPLAIALLHAYFA

SEQ ID NO: 1870618 - protein, 18 aa, Staphylococcus
ARILKVLDDVGLKEKVLS

SEQ ID NO: 1870619 - protein, 37 aa, Staphylococcus
ARKDIQWKSIIILVVLNLFLAWFFIYFPWGKSGIKAA

SEQ ID NO: 1870620 - protein, 30 aa, Staphylococcus
ARKRGKQGTGLGLFICRMIIHEHGGTIDVK

SEQ ID NO: 1870621 - protein, 20 aa, Staphylococcus
ARLAMGYTFFHWGISQWSIF

SEQ ID NO: 1870622 - protein, 19 aa, Staphylococcus
ARLAREAKTSIKRRAYNYT

SEQ ID NO: 1870623 - protein, 21 aa, Staphylococcus
ARLMSMLIFLLGFFTSVIGPI

SEQ ID NO: 1870624 - protein, 18 aa, Staphylococcus
ARLTFNLNDGKATSYKQT

SEQ ID NO: 1870625 - protein, 26 aa, Staphylococcus
ARLVEARPKALAYINSLDKINDAQRT

SEQ ID NO: 1870626 - protein, 17 aa, Staphylococcus
ARMLYWFTDKEYPVIRK

SEQ ID NO: 1870627 - protein, 23 aa, Staphylococcus
ARMTPIFAVSQGWIWTVTAVGLI

SEQ ID NO: 1870628 - protein, 25 aa, Staphylococcus
ARMTPIFAVSQGWIWTVTLVGLITL

SEQ ID NO: 1870629 - protein, 20 aa, Staphylococcus
ARNALFNHIMSWVMVVLGLV

SEQ ID NO: 1870630 - protein, 30 aa, Staphylococcus
ARQNINLHFHSRFALNILLTISNHYNRNLR

SEQ ID NO: 1870631 - protein, 17 aa, Staphylococcus
ARQQYRGLMSIQPYHVV

SEQ ID NO: 1870632 - protein, 20 aa, Staphylococcus
ARRSKIETVPAYGSTYDYPP

SEQ ID NO: 1870633 - protein, 20 aa, Staphylococcus
ARRVCWSGSIIVAIVLAIPL

SEQ ID NO: 1870634 - protein, 22 aa, Staphylococcus
ARRVCWTGAILVALILAVPLYS

SEQ ID NO: 1870635 - protein, 17 aa, Staphylococcus
ARSFDFIIVTDVGLINV

SEQ ID NO: 1870636 - protein, 19 aa, Staphylococcus
ARSQKGLDFTVKEEEKQSV

SEQ ID NO: 1870637 - protein, 17 aa, Staphylococcus
ARTFFMQYFMQMQLAAQ

SEQ ID NO: 1870638 - protein, 29 aa, Staphylococcus
ARTGFASVVTGFCFLLAIFFSPLMEVVTS

SEQ ID NO: 1870639 - protein, 24 aa, Staphylococcus
ARTNICTVKFKWLDMVFFIVMLAL

SEQ ID NO: 1870640 - protein, 17 aa, Staphylococcus
ARTRKMGGTGLGLAISK

SEQ ID NO: 1870641 - protein, 22 aa, Staphylococcus
ARTWKGTQVSLFIGIVAAILDI

SEQ ID NO: 1870642 - protein, 20 aa, Staphylococcus
ARVAMGYTFFHWGISQWSIF

SEQ ID NO: 1870643 - protein, 17 aa, Staphylococcus
ARVIIRMLGVDPDAQTD

SEQ ID NO: 1870644 - protein, 17 aa, Staphylococcus
ASAGTLFLVQARRKENE

SEQ ID NO: 1870645 - protein, 23 aa, Staphylococcus
ASAIMLALGAWRVNKVGVPISVL

SEQ ID NO: 1870646 - protein, 25 aa, Staphylococcus
ASAIPETGGGFVFVKKAFSPGIAFI

SEQ ID NO: 1870647 - protein, 19 aa, Staphylococcus
ASAKTWILIAVFQIILPAV

SEQ ID NO: 1870648 - protein, 21 aa, Staphylococcus
ASAKVWENGTFEITPDNRAHS

SEQ ID NO: 1870649 - protein, 17 aa, Staphylococcus
ASALTLALYLFAGNGSA

SEQ ID NO: 1870650 - protein, 17 aa, Staphylococcus
ASAMANYQIFLSCAPAI

SEQ ID NO: 1870651 - protein, 18 aa, Staphylococcus
ASCLILLLNISWARKVLS

SEQ ID NO: 1870652 - protein, 22 aa, Staphylococcus
ASCLPFLLWGAMGWATQAPQQH

SEQ ID NO: 1870653 - protein, 19 aa, Staphylococcus
ASDILWADKIAKYMQAYYD

SEQ ID NO: 1870654 - protein, 21 aa, Staphylococcus
ASDILYWGIIEWAFYYQDPPH

SEQ ID NO: 1870655 - protein, 18 aa, Staphylococcus
ASEIKAAMDSSKFIDDDK

SEQ ID NO: 1870656 - protein, 24 aa, Staphylococcus
ASELPFKVLDAMGGKANIKHLDAC

SEQ ID NO: 1870657 - protein, 17 aa, Staphylococcus
ASFCTMIILPYAAVHSF

SEQ ID NO: 1870658 - protein, 19 aa, Staphylococcus
ASFKLFWSNYFNFKGRSRR

SEQ ID NO: 1870659 - protein, 20 aa, Staphylococcus
ASFLLCVVGILTFGIFPQLM

SEQ ID NO: 1870660 - protein, 19 aa, Staphylococcus
ASFLLDALTSFGLILTLIL

SEQ ID NO: 1870661 - protein, 20 aa, Staphylococcus
ASFLPLVMLGLHHIFTPIHI

SEQ ID NO: 1870662 - protein, 19 aa, Staphylococcus
ASFSPGLSSDLGYNQSYTT

SEQ ID NO: 1870663 - protein, 23 aa, Staphylococcus
ASFSPLVLFSLYWKKLTRAGAIS

SEQ ID NO: 1870664 - protein, 17 aa, Staphylococcus
ASGAIFGLIGAIFTFMY

SEQ ID NO: 1870665 - protein, 17 aa, Staphylococcus
ASGAIFGLIGSIFAMMF

SEQ ID NO: 1870666 - protein, 27 aa, Staphylococcus
ASGGRILRKEILKLFKLKEIKTPQPTM

SEQ ID NO: 1870667 - protein, 17 aa, Staphylococcus
ASGISSRTPYAFFDTAL

SEQ ID NO: 1870668 - protein, 21 aa, Staphylococcus
ASGKTPLGLFQFGKKEKSIVI

SEQ ID NO: 1870669 - protein, 24 aa, Staphylococcus
ASGLRMLVESNIDFASNRNLVIAS

SEQ ID NO: 1870670 - protein, 21 aa, Staphylococcus
ASGRKTLPILLGKKASITFMA

SEQ ID NO: 1870671 - protein, 22 aa, Staphylococcus
ASGRKTLPILLGKRASVIFMAI

SEQ ID NO: 1870672 - protein, 23 aa, Staphylococcus
ASGRLPSWAIGFSIYATTLSAIT

SEQ ID NO: 1870673 - protein, 27 aa, Staphylococcus
ASHSQHCKDVIKFPVQINPKDNFYNET

SEQ ID NO: 1870674 - protein, 21 aa, Staphylococcus
ASIAILCTFLIVTLGMTVTTY

SEQ ID NO: 1870675 - protein, 19 aa, Staphylococcus
ASIAISIKAPTKVTSKESY

SEQ ID NO: 1870676 - protein, 25 aa, Staphylococcus
ASIFSDLIPFLGMGAILQGILYIIF

SEQ ID NO: 1870677 - protein, 25 aa, Staphylococcus
ASIICIPFAFLGARNMVKLRPVTGI

SEQ ID NO: 1870678 - protein, 19 aa, Staphylococcus
ASIIGMIVWFFAGLHSKGH

SEQ ID NO: 1870679 - protein, 18 aa, Staphylococcus
ASILPSTFLGVLPMGMYL

SEQ ID NO: 1870680 - protein, 19 aa, Staphylococcus
ASILWIIREFVLKQWGPTS

SEQ ID NO: 1870681 - protein, 20 aa, Staphylococcus
ASINAIKNGETWTLDKQVSH

SEQ ID NO: 1870682 - protein, 21 aa, Staphylococcus
ASIRAVIQLVILGFILHFIFD

SEQ ID NO: 1870683 - protein, 19 aa, Staphylococcus
ASIRKPLYSKRIVQNLTLD

SEQ ID NO: 1870684 - protein, 31 aa, Staphylococcus
ASISFIIFLGWSQINWGLVIALSIGGLIAAP

SEQ ID NO: 1870685 - protein, 17 aa, Staphylococcus
ASIVNLIFLPPKFETKI

SEQ ID NO: 1870686 - protein, 17 aa, Staphylococcus
ASKEFNIEWLAPDDGLI

SEQ ID NO: 1870687 - protein, 22 aa, Staphylococcus
ASKELGWFNSIIMIVAIAPWAY

SEQ ID NO: 1870688 - protein, 20 aa, Staphylococcus
ASKGDGFRMFVYIMLLGAIV

SEQ ID NO: 1870689 - protein, 18 aa, Staphylococcus
ASKILPYIILVVLIIHII

SEQ ID NO: 1870690 - protein, 17 aa, Staphylococcus
ASKRLLTSIGIGIITSI

SEQ ID NO: 1870691 - protein, 18 aa, Staphylococcus
ASKVKGNVQTIEQSSANS

SEQ ID NO: 1870692 - protein, 24 aa, Staphylococcus
ASLAHDFSPLGLLVGIMDQLTGKS

SEQ ID NO: 1870693 - protein, 25 aa, Staphylococcus
ASLHSASALGLYWSVSAAFLIIQMH

SEQ ID NO: 1870694 - protein, 25 aa, Staphylococcus
ASLHSASALSLYWAISATFLIIQMH

SEQ ID NO: 1870695 - protein, 20 aa, Staphylococcus
ASLIALIVFFIWYPLTDKRH

SEQ ID NO: 1870696 - protein, 17 aa, Staphylococcus
ASLIFNWIFGVLMVASF

SEQ ID NO: 1870697 - protein, 19 aa, Staphylococcus
ASLIGMIVWFVLGLHNDGH

SEQ ID NO: 1870698 - protein, 17 aa, Staphylococcus
ASLIRRMIVAVRGMLLK

SEQ ID NO: 1870699 - protein, 23 aa, Staphylococcus
ASLISIIAMCFVRPGEKKMHMTK

SEQ ID NO: 1870700 - protein, 18 aa, Staphylococcus
ASLITFGVLGVAAYKHYE

SEQ ID NO: 1870701 - protein, 17 aa, Staphylococcus
ASLKITVTISVAAGVGL

SEQ ID NO: 1870702 - protein, 27 aa, Staphylococcus
ASLKLTISLKVIERAILALILPLIIFI

SEQ ID NO: 1870703 - protein, 17 aa, Staphylococcus
ASLLPVSLFALGIIDDV

SEQ ID NO: 1870704 - protein, 18 aa, Staphylococcus
ASLSFIVFLGMTHINWLA

SEQ ID NO: 1870705 - protein, 22 aa, Staphylococcus
ASLVGIVVWFFAGLKHKSGADK

SEQ ID NO: 1870706 - protein, 18 aa, Staphylococcus
ASLVLGMILIFFTKEQKF

SEQ ID NO: 1870707 - protein, 24 aa, Staphylococcus
ASNDKRLAYDDAVNSANEILTQTH

SEQ ID NO: 1870708 - protein, 22 aa, Staphylococcus
ASNKGAPYLLPSTPYNTLHASD

SEQ ID NO: 1870709 - protein, 17 aa, Staphylococcus
ASNKLEVGLGRDISGEP

SEQ ID NO: 1870710 - protein, 24 aa, Staphylococcus
ASNLILFLCIRFIQGFTAGGIIVI

SEQ ID NO: 1870711 - protein, 17 aa, Staphylococcus
ASNVFKYRQRIIDKANS

SEQ ID NO: 1870712 - protein, 20 aa, Staphylococcus
ASNVLYYWDTFKFFSPLTWS

SEQ ID NO: 1870713 - protein, 20 aa, Staphylococcus
ASNYKLSTKTVDANDSGSTD

SEQ ID NO: 1870714 - protein, 18 aa, Staphylococcus
ASPVMHHVFWISFVAIFI

SEQ ID NO: 1870715 - protein, 27 aa, Staphylococcus
ASQVLKAVTAFAGWVAKLFETHPAVAK

SEQ ID NO: 1870716 - protein, 24 aa, Staphylococcus
ASSLFNFSLALLIGLLSGVFSSIF

SEQ ID NO: 1870717 - protein, 21 aa, Staphylococcus
ASSLFNFSLALLIGLVSGVFS

SEQ ID NO: 1870718 - protein, 24 aa, Staphylococcus
ASSQKFLIIYSIVFMLVIVAVVLT

SEQ ID NO: 1870719 - protein, 21 aa, Staphylococcus
ASSRARSIIKPILEILSGIPT

SEQ ID NO: 1870720 - protein, 17 aa, Staphylococcus
ASTILGMAYKLMVFNGH

SEQ ID NO: 1870721 - protein, 24 aa, Staphylococcus
ASTVFPLLIAIAIYAPLERLLKRW

SEQ ID NO: 1870722 - protein, 24 aa, Staphylococcus
ASVESPILFVLIALFASLVFNTIV

SEQ ID NO: 1870723 - protein, 27 aa, Staphylococcus
ASVIGLGCSLPFFFPAIQSFFNNRRTP

SEQ ID NO: 1870724 - protein, 17 aa, Staphylococcus
ASVIGLVLLFIALCTGI

SEQ ID NO: 1870725 - protein, 27 aa, Staphylococcus
ASVIVAILVLRSGFYVTKSSLHVLMEG

SEQ ID NO: 1870726 - protein, 26 aa, Staphylococcus
ASVLIGSTILLGAVIDKEADAAEQQP

SEQ ID NO: 1870727 - protein, 18 aa, Staphylococcus
ASVMNFIGALTFTGVAGT

SEQ ID NO: 1870728 - protein, 17 aa, Staphylococcus
ASVSLFVGAVSFSAIYP

SEQ ID NO: 1870729 - protein, 21 aa, Staphylococcus
ASWSIWWSFFQIWLTSDSNGL

SEQ ID NO: 1870730 - protein, 17 aa, Staphylococcus
ASYIIGAIINFIKYFGY

SEQ ID NO: 1870731 - protein, 24 aa, Staphylococcus
ASYKLTRKRIFKMSPIHHHFELCG

SEQ ID NO: 1870732 - protein, 23 aa, Staphylococcus
ASYPGRFIYQGGITQVKHNEFTQ

SEQ ID NO: 1870733 - protein, 26 aa, Staphylococcus
ATAVKRSEIVFGYLAGYGMFAVLQTL

SEQ ID NO: 1870734 - protein, 18 aa, Staphylococcus
ATCTIFICAKLKLHDGIT

SEQ ID NO: 1870735 - protein, 27 aa, Staphylococcus
ATDFLRTTRNAFFIGRTGDYNVSLEGA

SEQ ID NO: 1870736 - protein, 28 aa, Staphylococcus
ATDNALHPNSSFSIPVQATTLIPVMKPV

SEQ ID NO: 1870737 - protein, 17 aa, Staphylococcus
ATDTTPPTKPRVTSPLG

SEQ ID NO: 1870738 - protein, 20 aa, Staphylococcus
ATEFPRIQLFMESYTGKRDW

SEQ ID NO: 1870739 - protein, 23 aa, Staphylococcus
ATEGKNVAGHTVVIAKKDDDSAV

SEQ ID NO: 1870740 - protein, 18 aa, Staphylococcus
ATFALRLLLGATLASIVS

SEQ ID NO: 1870741 - protein, 24 aa, Staphylococcus
ATFDHIKGGLYIDRGQEKPTSIWR

SEQ ID NO: 1870742 - protein, 19 aa, Staphylococcus
ATFKTKFNPILAVITGLLL

SEQ ID NO: 1870743 - protein, 17 aa, Staphylococcus
ATFKTVVNKGANMQAAT

SEQ ID NO: 1870744 - protein, 17 aa, Staphylococcus
ATFLPLVMFGLHQVLTP

SEQ ID NO: 1870745 - protein, 19 aa, Staphylococcus
ATFLPQAFLSYAIGGILHI

SEQ ID NO: 1870746 - protein, 21 aa, Staphylococcus
ATFLPQAFLSYAIGGVFHIEF

SEQ ID NO: 1870747 - protein, 23 aa, Staphylococcus
ATFLPQAFLSYAIGGVFHIEFLQ

SEQ ID NO: 1870748 - protein, 23 aa, Staphylococcus
ATFLPQAFLSYAIGGVFHIHFFQ

SEQ ID NO: 1870749 - protein, 20 aa, Staphylococcus
ATFLPQAFLSYAIGGVFHIK

SEQ ID NO: 1870750 - protein, 32 aa, Staphylococcus
ATGKFRQPLNVPLKQGDVVTATINKGGNTSLP

SEQ ID NO: 1870751 - protein, 23 aa, Staphylococcus
ATHCVTRLRLVLKDDDKVNKDKL

SEQ ID NO: 1870752 - protein, 26 aa, Staphylococcus
ATHDLRLLPHFDRIIVMQDGVILEDG

SEQ ID NO: 1870753 - protein, 23 aa, Staphylococcus
ATHGRTIYIATIFHAAMTFALVF

SEQ ID NO: 1870754 - protein, 33 aa, Staphylococcus
ATIEAADTIYPHKAEYVNLNYRFQAPDDVQAGD

SEQ ID NO: 1870755 - protein, 26 aa, Staphylococcus
ATIFMGICGEWFLDFARQAAEFNLHP

SEQ ID NO: 1870756 - protein, 23 aa, Staphylococcus
ATIGVGMPLMFVIAEFIGIKKNS

SEQ ID NO: 1870757 - protein, 19 aa, Staphylococcus
ATILMGWISLFIAQWIVEN

SEQ ID NO: 1870758 - protein, 25 aa, Staphylococcus
ATISVSWLWFIFLAIAGRTVGHFDK

SEQ ID NO: 1870759 - protein, 25 aa, Staphylococcus
ATITATKVGNGWTINKNISNIKLDE

SEQ ID NO: 1870760 - protein, 37 aa, Staphylococcus
ATITLSEIESAMTLADGLKVRIISLPNTDKVADNLTV

SEQ ID NO: 1870761 - protein, 24 aa, Staphylococcus
ATITRFSNKLGYANFQDMKFNLQH

SEQ ID NO: 1870762 - protein, 18 aa, Staphylococcus
ATITRFSNKLGYDNFQDM

SEQ ID NO: 1870763 - protein, 19 aa, Staphylococcus
ATIWMMIGFIIFGAISSLT

SEQ ID NO: 1870764 - protein, 22 aa, Staphylococcus
ATKIGEVWAMLSLSLMLIAYLM

SEQ ID NO: 1870765 - protein, 23 aa, Staphylococcus
ATKIGEVWAMVCLSLMLVAYLML

SEQ ID NO: 1870766 - protein, 19 aa, Staphylococcus
ATLAPLVSVQLQFLGVHII

SEQ ID NO: 1870767 - protein, 23 aa, Staphylococcus
ATLDELKAFLVEQFDKQQSDYRR

SEQ ID NO: 1870768 - protein, 26 aa, Staphylococcus
ATLDLPVDYYVRINMEAFVDAVDELG

SEQ ID NO: 1870769 - protein, 26 aa, Staphylococcus
ATLFFKEAFSKIAWIGSLIALSGVAL

SEQ ID NO: 1870770 - protein, 22 aa, Staphylococcus
ATLIPGWALLIRRFHDTGRTML

SEQ ID NO: 1870771 - protein, 18 aa, Staphylococcus
ATLITITFAFVFNTVQSN

SEQ ID NO: 1870772 - protein, 25 aa, Staphylococcus
ATLKNTKEYWVWKNKYYRYLFDFGK

SEQ ID NO: 1870773 - protein, 17 aa, Staphylococcus
ATLKWPTSGGILSYPTF

SEQ ID NO: 1870774 - protein, 19 aa, Staphylococcus
ATLNIPVDYYVRINMDAFV

SEQ ID NO: 1870775 - protein, 19 aa, Staphylococcus
ATLNVPVDYYVRVNMDAFV

SEQ ID NO: 1870776 - protein, 20 aa, Staphylococcus
ATLPLSIYFVVIFLMCVGNI

SEQ ID NO: 1870777 - protein, 28 aa, Staphylococcus
ATLSLVVFHHINFKIAVIAIILAPEFYN

SEQ ID NO: 1870778 - protein, 18 aa, Staphylococcus
ATLSWMFVGLGAIPSTLI

SEQ ID NO: 1870779 - protein, 22 aa, Staphylococcus
ATLVVPFMFMWVAKSKRNRAIG

SEQ ID NO: 1870780 - protein, 23 aa, Staphylococcus
ATMPGSLPTMFFTHIRYRTLAVT

SEQ ID NO: 1870781 - protein, 23 aa, Staphylococcus
ATMPGSLPTMFYTHIRYRTLAVT

SEQ ID NO: 1870782 - protein, 22 aa, Staphylococcus
ATMSWKGWIALASMILGAWTMS

SEQ ID NO: 1870783 - protein, 24 aa, Staphylococcus
ATNDFSLIMAITILFSSFFIVSIF

SEQ ID NO: 1870784 - protein, 24 aa, Staphylococcus
ATNGDWKALILVLINLLIAIVLYY

SEQ ID NO: 1870785 - protein, 24 aa, Staphylococcus
ATNNRSLVLLGLIGLISVMREGVE

SEQ ID NO: 1870786 - protein, 19 aa, Staphylococcus
ATNTFLVWMLIAAIIGFIF

SEQ ID NO: 1870787 - protein, 23 aa, Staphylococcus
ATNWISLILWLIAGIMLLVRKPK

SEQ ID NO: 1870788 - protein, 22 aa, Staphylococcus
ATPIAGFLVMFGFNNPMTVVIY

SEQ ID NO: 1870789 - protein, 23 aa, Staphylococcus
ATPIAGFLVMFGFNSPMKVIIYG

SEQ ID NO: 1870790 - protein, 27 aa, Staphylococcus
ATPIKRSEIVFGYLIGYGIFAIIQTLI

SEQ ID NO: 1870791 - protein, 23 aa, Staphylococcus
ATPLAGFLVMFGFNDPIKIFIYG

SEQ ID NO: 1870792 - protein, 19 aa, Staphylococcus
ATREVFKPILSSTIVTIIV

SEQ ID NO: 1870793 - protein, 21 aa, Staphylococcus
ATRRLFIKDGYLVEDDQTISV

SEQ ID NO: 1870794 - protein, 21 aa, Staphylococcus
ATRRLYIQDGYIIKDDQLISV

SEQ ID NO: 1870795 - protein, 21 aa, Staphylococcus
ATRYWRLIALLPITMSSITVG

SEQ ID NO: 1870796 - protein, 24 aa, Staphylococcus
ATSAGFKWFFAYPEQKIETVNHLT

SEQ ID NO: 1870797 - protein, 26 aa, Staphylococcus
ATSIKRSEIVFGYLVGYGIFAVLQTL

SEQ ID NO: 1870798 - protein, 18 aa, Staphylococcus
ATSLFFFFSSFILPYVLK

SEQ ID NO: 1870799 - protein, 25 aa, Staphylococcus
ATSRLFDLVIQWGVLALIVIFQPEI

SEQ ID NO: 1870800 - protein, 26 aa, Staphylococcus
ATSVKRSEIVFGYLAGYGLFAILQTL

SEQ ID NO: 1870801 - protein, 21 aa, Staphylococcus
ATSYGAGIIHFFGGIHEIYFP

SEQ ID NO: 1870802 - protein, 19 aa, Staphylococcus
ATSYGAGIIQFFGGIHEIY

SEQ ID NO: 1870803 - protein, 18 aa, Staphylococcus
ATTAIGMNVAIPHAKSAA

SEQ ID NO: 1870804 - protein, 29 aa, Staphylococcus
ATTLLNFFHGWPWYAVWLVMLGFGGGIII

SEQ ID NO: 1870805 - protein, 17 aa, Staphylococcus
ATTNLKKLISITKELDN

SEQ ID NO: 1870806 - protein, 28 aa, Staphylococcus
ATTSFVLAFPMAYVWPMIQSGLNAFSEG

SEQ ID NO: 1870807 - protein, 18 aa, Staphylococcus
ATTVSWKLTLIAMIPLPF

SEQ ID NO: 1870808 - protein, 18 aa, Staphylococcus
ATVEQILGSVFSKNEAQK

SEQ ID NO: 1870809 - protein, 33 aa, Staphylococcus
ATVGMPWRGFHRHFWKQALLLIMVAAVINYFWA

SEQ ID NO: 1870810 - protein, 21 aa, Staphylococcus
ATVIGIPKWIQFLFIIIVAMV

SEQ ID NO: 1870811 - protein, 24 aa, Staphylococcus
ATVIGVGFFIHWIWADLPMPAAFA

SEQ ID NO: 1870812 - protein, 21 aa, Staphylococcus
ATVIVSWLWFIFLAVVGKMIG

SEQ ID NO: 1870813 - protein, 26 aa, Staphylococcus
ATVKSKKKMTSLVVIVVVLGVLAFQY

SEQ ID NO: 1870814 - protein, 18 aa, Staphylococcus
ATVLSYPVYLFILGLIVM

SEQ ID NO: 1870815 - protein, 23 aa, Staphylococcus
ATVSVSWLWFIFLAIAGRLLGSV

SEQ ID NO: 1870816 - protein, 17 aa, Staphylococcus
ATVVFLGANQDAYASET

SEQ ID NO: 1870817 - protein, 23 aa, Staphylococcus
ATWLEPFGGIGGRKETNFPQQWT

SEQ ID NO: 1870818 - protein, 26 aa, Staphylococcus
ATYKRLRWQVFLGIFIGYAGYYLLRK

SEQ ID NO: 1870819 - protein, 24 aa, Staphylococcus
ATYLPQAFLSYAIGGVFHIKFFQE

SEQ ID NO: 1870820 - protein, 19 aa, Staphylococcus
ATYVKSYFVYYGILILIGL

SEQ ID NO: 1870821 - protein, 24 aa, Staphylococcus
AVAFICSFSTLKLAMNDIPMGTAY

SEQ ID NO: 1870822 - protein, 28 aa, Staphylococcus
AVAIYVFRYIWVYIWFKDFYAPKNVQSY

SEQ ID NO: 1870823 - protein, 17 aa, Staphylococcus
AVALFLVIFCWQPIHFY

SEQ ID NO: 1870824 - protein, 22 aa, Staphylococcus
AVALIIVGIVVKFIGVTYSVSG

SEQ ID NO: 1870825 - protein, 24 aa, Staphylococcus
AVALIIVGLVTKFLFTSYTVSGES

SEQ ID NO: 1870826 - protein, 17 aa, Staphylococcus
AVALSIPITAWVSARLI

SEQ ID NO: 1870827 - protein, 20 aa, Staphylococcus
AVAMWPGFSRSGSTISTGVL

SEQ ID NO: 1870828 - protein, 24 aa, Staphylococcus
AVAMWPGFSRSGSTISTGVLMKLN

SEQ ID NO: 1870829 - protein, 31 aa, Staphylococcus
AVASFLIIWLAQRYIRFMPAPLIAIIILTIC

SEQ ID NO: 1870830 - protein, 18 aa, Staphylococcus
AVCVPLLLVHLGTMMDLK

SEQ ID NO: 1870831 - protein, 33 aa, Staphylococcus
AVDSFFNYLFGWSRYMTYILISLISLYIAFAGK

SEQ ID NO: 1870832 - protein, 18 aa, Staphylococcus
AVEHGLASVDEFNTHNPQ

SEQ ID NO: 1870833 - protein, 18 aa, Staphylococcus
AVFEQTYHGLPIMNNEKA

SEQ ID NO: 1870834 - protein, 17 aa, Staphylococcus
AVFMRPDIGETFSEFRL

SEQ ID NO: 1870835 - protein, 45 aa, Staphylococcus
AVFMRPDIGETFSEFRTFLAVLLICLLGISITLVIASTYSIIKPI

SEQ ID NO: 1870836 - protein, 23 aa, Staphylococcus
AVFQVFFFDKFMKYMTELNFIAS

SEQ ID NO: 1870837 - protein, 25 aa, Staphylococcus
AVFTAEFYASFAFAILISIIIDIGA

SEQ ID NO: 1870838 - protein, 17 aa, Staphylococcus
AVFWFIFGLALRSNKMM

SEQ ID NO: 1870839 - protein, 28 aa, Staphylococcus
AVFYSLPILFLIAFNRFNFQWATVENIK

SEQ ID NO: 1870840 - protein, 20 aa, Staphylococcus
AVFYYNFRLAKRTNSRSLHS

SEQ ID NO: 1870841 - protein, 18 aa, Staphylococcus
AVGARTGFASVVTGFCFL

SEQ ID NO: 1870842 - protein, 28 aa, Staphylococcus
AVGASSYRKAFCQKFLSEVKVSVIKGNA

SEQ ID NO: 1870843 - protein, 28 aa, Staphylococcus
AVGIDYALFILFRYRQIVKTESNHIKAV

SEQ ID NO: 1870844 - protein, 25 aa, Staphylococcus
AVGLLGTLFIDWKYLRLGMLKTASI

SEQ ID NO: 1870845 - protein, 18 aa, Staphylococcus
AVGPFFGILLLNAFSITV

SEQ ID NO: 1870846 - protein, 25 aa, Staphylococcus
AVGTFCIIMVFALLGFLIYNVNPAK

SEQ ID NO: 1870847 - protein, 19 aa, Staphylococcus
AVGVDFSMLLIGRVLQAAG

SEQ ID NO: 1870848 - protein, 20 aa, Staphylococcus
AVGVFIPFTLAQYGMVLKWV

SEQ ID NO: 1870849 - protein, 18 aa, Staphylococcus
AVHFSWYYLLLVLLILIV

SEQ ID NO: 1870850 - protein, 23 aa, Staphylococcus
AVHIGWKGWVYVDQQIAKHMNDD

SEQ ID NO: 1870851 - protein, 18 aa, Staphylococcus
AVIAAFYAFTGFESVANA

SEQ ID NO: 1870852 - protein, 17 aa, Staphylococcus
AVIAGFFMALTYSLDDF

SEQ ID NO: 1870853 - protein, 25 aa, Staphylococcus
AVIAITLISVFIFLKHQLSPEQSVD

SEQ ID NO: 1870854 - protein, 18 aa, Staphylococcus
AVIAWFASIFALDIYFIL

SEQ ID NO: 1870855 - protein, 24 aa, Staphylococcus
AVILSTLIGIWGFYTGVTSFFNND

SEQ ID NO: 1870856 - protein, 18 aa, Staphylococcus
AVINYFWAAWAFLIAGVI

SEQ ID NO: 1870857 - protein, 23 aa, Staphylococcus
AVIPVIICLIIFKGNEEKIEQLL

SEQ ID NO: 1870858 - protein, 23 aa, Staphylococcus
AVIPVIICLIIFKGNSEKIEQLL

SEQ ID NO: 1870859 - protein, 17 aa, Staphylococcus
AVIPVIICLIIFNGNAA

SEQ ID NO: 1870860 - protein, 20 aa, Staphylococcus
AVIRLMIVESISFKKILSDY

SEQ ID NO: 1870861 - protein, 27 aa, Staphylococcus
AVISCIIGFLCVFIFFLYINKKVTLDI

SEQ ID NO: 1870862 - protein, 25 aa, Staphylococcus
AVITCVFVPIVFKKLFPIPNEVNRR

SEQ ID NO: 1870863 - protein, 24 aa, Staphylococcus
AVITCVFVPIVFKKMFPMPDEATR

SEQ ID NO: 1870864 - protein, 20 aa, Staphylococcus
AVITCVFVPMVFKKTFPMPE

SEQ ID NO: 1870865 - protein, 24 aa, Staphylococcus
AVITCVFVPVIFKKLFPVPNEMNR

SEQ ID NO: 1870866 - protein, 24 aa, Staphylococcus
AVITCVFVPVVFKKLFPIPDEVNR

SEQ ID NO: 1870867 - protein, 18 aa, Staphylococcus
AVIVALVEVFAFGNSLLY

SEQ ID NO: 1870868 - protein, 23 aa, Staphylococcus
AVKGVEFKDPLTSVKRAMNDIKD

SEQ ID NO: 1870869 - protein, 35 aa, Staphylococcus
AVKLIIEIVRAILLIELVGALLLAFYFYRDSSDIQ

SEQ ID NO: 1870870 - protein, 26 aa, Staphylococcus
AVKLKKKFIWGFSIAYFCEGAGYIIT

SEQ ID NO: 1870871 - protein, 18 aa, Staphylococcus
AVKMGWEALIPPRTPQRE

SEQ ID NO: 1870872 - protein, 23 aa, Staphylococcus
AVLAAFLGSFAYVYFMKGVLGFH

SEQ ID NO: 1870873 - protein, 19 aa, Staphylococcus
AVLDGLAFMMADIFNITVG

SEQ ID NO: 1870874 - protein, 20 aa, Staphylococcus
AVLFFFGESSVKGFATMLLL

SEQ ID NO: 1870875 - protein, 27 aa, Staphylococcus
AVLILIRILHAWVYFKCSGMAQNDSEI

SEQ ID NO: 1870876 - protein, 32 aa, Staphylococcus
AVLPGVALSFLFKIPMFVGALVTGMLASLFIG

SEQ ID NO: 1870877 - protein, 18 aa, Staphylococcus
AVLPGVALSFLFNIPMFI

SEQ ID NO: 1870878 - protein, 25 aa, Staphylococcus
AVLSCVIGFLGVFIFFLHINKKVTL

SEQ ID NO: 1870879 - protein, 31 aa, Staphylococcus
AVLSFLIIWLVPRWIKFIPAPLISIVILTII

SEQ ID NO: 1870880 - protein, 23 aa, Staphylococcus
AVLSLVINWIAALFWIIAGIMLL

SEQ ID NO: 1870881 - protein, 22 aa, Staphylococcus
AVLVVGCPCALVISTPISIVSA

SEQ ID NO: 1870882 - protein, 24 aa, Staphylococcus
AVMLNFVFVFSILKLFGYSKETIV

SEQ ID NO: 1870883 - protein, 25 aa, Staphylococcus
AVNAIIPWGVSGTFIMGALKVSTLA

SEQ ID NO: 1870884 - protein, 21 aa, Staphylococcus
AVNDIEFKDPLPSVTQAMNDI

SEQ ID NO: 1870885 - protein, 30 aa, Staphylococcus
AVPIILFLLCLTVFKMKGIYAAITTLVVTL

SEQ ID NO: 1870886 - protein, 18 aa, Staphylococcus
AVPVQFNIGTLIIFGIVL

SEQ ID NO: 1870887 - protein, 20 aa, Staphylococcus
AVQPKLDSAIHLLENKANNS

SEQ ID NO: 1870888 - protein, 27 aa, Staphylococcus
AVQYISSWPWDWAKFTSVLMEDGSIST

SEQ ID NO: 1870889 - protein, 24 aa, Staphylococcus
AVQYISSWPWDWAKPTQALMHNGS

SEQ ID NO: 1870890 - protein, 25 aa, Staphylococcus
AVQYISSWPWDWAKPTSALMHNGSI

SEQ ID NO: 1870891 - protein, 26 aa, Staphylococcus
AVQYMSSWPWEWAKFTSGLMDGSTIS

SEQ ID NO: 1870892 - protein, 20 aa, Staphylococcus
AVRFDWFRWLAYAVFSMLII

SEQ ID NO: 1870893 - protein, 21 aa, Staphylococcus
AVSFKGADLIQQWMPQHNVVL

SEQ ID NO: 1870894 - protein, 23 aa, Staphylococcus
AVSHYRFRRAFNVQHHRKSELKY

SEQ ID NO: 1870895 - protein, 20 aa, Staphylococcus
AVSHYRFRRAFQRQHHNKKE

SEQ ID NO: 1870896 - protein, 26 aa, Staphylococcus
AVSMISLFLCVWLGIIQVQNGNMDVI

SEQ ID NO: 1870897 - protein, 17 aa, Staphylococcus
AVSNKKGTYMVYFYPNQ

SEQ ID NO: 1870898 - protein, 24 aa, Staphylococcus
AVSSEYGNDIIFLFLGGFILAIAM

SEQ ID NO: 1870899 - protein, 19 aa, Staphylococcus
AVSSIYWGKFIVYILSFSV

SEQ ID NO: 1870900 - protein, 24 aa, Staphylococcus
AVTAWFKYWPLFAAIIILTLPELI

SEQ ID NO: 1870901 - protein, 24 aa, Staphylococcus
AVTFVDIWHFFSLVTRYENEDKYD

SEQ ID NO: 1870902 - protein, 25 aa, Staphylococcus
AVVIALICLILFFVALRNNKKIKRQ

SEQ ID NO: 1870903 - protein, 19 aa, Staphylococcus
AVVITVLFGLSADALYPFI

SEQ ID NO: 1870904 - protein, 23 aa, Staphylococcus
AVVKTKIKSGSDVKSIKMGDSST

SEQ ID NO: 1870905 - protein, 22 aa, Staphylococcus
AVVLMYIVGIWMHRRSSAKRWN

SEQ ID NO: 1870906 - protein, 24 aa, Staphylococcus
AVVLMYIVGIWMHRRSSAKRWNDM

SEQ ID NO: 1870907 - protein, 24 aa, Staphylococcus
AVVLTMFAIFIFKYSYNKNSETGK

SEQ ID NO: 1870908 - protein, 25 aa, Staphylococcus
AVVMGVSLYAFWRSRKIKTDSADGY

SEQ ID NO: 1870909 - protein, 17 aa, Staphylococcus
AVYKKIHSTVVDNGGKI

SEQ ID NO: 1870910 - protein, 24 aa, Staphylococcus
AVYVFRFVWVYVLYPYFYLPVSPF

SEQ ID NO: 1870911 - protein, 19 aa, Staphylococcus
AVYWVTMRFVIPRLGSYDD

SEQ ID NO: 1870912 - protein, 19 aa, Staphylococcus
AWAGFGAAFGPLVLLSLYW

SEQ ID NO: 1870913 - protein, 19 aa, Staphylococcus
AWALFPLLLFMLLFLGVGI

SEQ ID NO: 1870914 - protein, 18 aa, Staphylococcus
AWALIPLIIFVGMFLGVG

SEQ ID NO: 1870915 - protein, 19 aa, Staphylococcus
AWALLPLLLFIALFLGVGT

SEQ ID NO: 1870916 - protein, 18 aa, Staphylococcus
AWALLPLLLFVLLFLGVG

SEQ ID NO: 1870917 - protein, 19 aa, Staphylococcus
AWALLPLVLFIALFLGIGI

SEQ ID NO: 1870918 - protein, 18 aa, Staphylococcus
AWAQLKRNKLAVVGMIGL

SEQ ID NO: 1870919 - protein, 22 aa, Staphylococcus
AWAQSLNPIFIVVLAPIFATLW

SEQ ID NO: 1870920 - protein, 18 aa, Staphylococcus
AWAVYGIVALVFAYFSFH

SEQ ID NO: 1870921 - protein, 19 aa, Staphylococcus
AWGILSGKMGFFYIITIVI

SEQ ID NO: 1870922 - protein, 19 aa, Staphylococcus
AWGILSGKMGFFYIITLII

SEQ ID NO: 1870923 - protein, 25 aa, Staphylococcus
AWGILSGKMSFFFIITIIILVVLIV

SEQ ID NO: 1870924 - protein, 25 aa, Staphylococcus
AWIWPELPMPAAFAIAAILCPTDAV

SEQ ID NO: 1870925 - protein, 19 aa, Staphylococcus
AWRDLWLLPIALVGIFAFS

SEQ ID NO: 1870926 - protein, 20 aa, Staphylococcus
AWSQTFPIWSIVIRTIHISG

SEQ ID NO: 1870927 - protein, 29 aa, Staphylococcus
AYAAFIAYRVGLRWEDLEEGITKRLTTAM

SEQ ID NO: 1870928 - protein, 19 aa, Staphylococcus
AYADYAALSWMFVGLGAIP

SEQ ID NO: 1870929 - protein, 19 aa, Staphylococcus
AYADYAALSWMFVGLGAMP

SEQ ID NO: 1870930 - protein, 24 aa, Staphylococcus
AYAKNRLQESIAYEMSATERLTIG

SEQ ID NO: 1870931 - protein, 19 aa, Staphylococcus
AYAKVWLFFMYYWIIFGIG

SEQ ID NO: 1870932 - protein, 17 aa, Staphylococcus
AYALRGLGYPLFAYSFL

SEQ ID NO: 1870933 - protein, 25 aa, Staphylococcus
AYESFKQKRFNVYVDNGYALDHIKI

SEQ ID NO: 1870934 - protein, 26 aa, Staphylococcus
AYESFKQKRFTVSVDGGYMLNNVKIY

SEQ ID NO: 1870935 - protein, 21 aa, Staphylococcus
AYETPAFWFGVFRYIAEGATI

SEQ ID NO: 1870936 - protein, 25 aa, Staphylococcus
AYFIRNAKNPNFWLLILIIPTWINL

SEQ ID NO: 1870937 - protein, 26 aa, Staphylococcus
AYFIRSSKFQNIWLLILIIPTWINLL

SEQ ID NO: 1870938 - protein, 17 aa, Staphylococcus
AYFMLKRKINFNLLIGF

SEQ ID NO: 1870939 - protein, 18 aa, Staphylococcus
AYGHGVSGVNMGAKTGTG

SEQ ID NO: 1870940 - protein, 18 aa, Staphylococcus
AYGHGVSGVTMGAKTGTS

SEQ ID NO: 1870941 - protein, 20 aa, Staphylococcus
AYGKVWLFFMYYWIIFGIGC

SEQ ID NO: 1870942 - protein, 18 aa, Staphylococcus
AYGLPYIIAIGGFIYLYE

SEQ ID NO: 1870943 - protein, 21 aa, Staphylococcus
AYGSCIGWGAFILPGDWIGQS

SEQ ID NO: 1870944 - protein, 22 aa, Staphylococcus
AYGSCIGWGAFILPGDWIGQSG

SEQ ID NO: 1870945 - protein, 24 aa, Staphylococcus
AYGSCIGWGAFILPGDWIKQSGPI

SEQ ID NO: 1870946 - protein, 22 aa, Staphylococcus
AYGSCIGWGAFILPGDWIMQSG

SEQ ID NO: 1870947 - protein, 25 aa, Staphylococcus
AYGSCIGWGSFILPGDWIKQSGSIS

SEQ ID NO: 1870948 - protein, 17 aa, Staphylococcus
AYHFSAWLQTAYVEEGI

SEQ ID NO: 1870949 - protein, 17 aa, Staphylococcus
AYHKVRNEKGRYQLPNT

SEQ ID NO: 1870950 - protein, 20 aa, Staphylococcus
AYIFPEIFTMVISIILYVIA

SEQ ID NO: 1870951 - protein, 26 aa, Staphylococcus
AYIFPGIVTILFLFSFIAQVLKVYNT

SEQ ID NO: 1870952 - protein, 18 aa, Staphylococcus
AYIHFPLLGELHVTTITL

SEQ ID NO: 1870953 - protein, 24 aa, Staphylococcus
AYILTCIPVCIIMLVMNIIVTDQK

SEQ ID NO: 1870954 - protein, 24 aa, Staphylococcus
AYIPLELCFLLDLFKPRKKFEWPI

SEQ ID NO: 1870955 - protein, 18 aa, Staphylococcus
AYIPSVFVTAVLFVIGFW

SEQ ID NO: 1870956 - protein, 18 aa, Staphylococcus
AYKRRPTTMAGFLADYWW

SEQ ID NO: 1870957 - protein, 25 aa, Staphylococcus
AYLATRFSTKWLHVIAYAILLVGLI

SEQ ID NO: 1870958 - protein, 26 aa, Staphylococcus
AYLGELIRWLLVFGFLFQIPVLFLGL

SEQ ID NO: 1870959 - protein, 27 aa, Staphylococcus
AYLHELIRWLLIFGVLFQLPTLFMGLA

SEQ ID NO: 1870960 - protein, 18 aa, Staphylococcus
AYLLKISRSFEVILLEEK

SEQ ID NO: 1870961 - protein, 18 aa, Staphylococcus
AYLPIAIKYLCLHYGIGL

SEQ ID NO: 1870962 - protein, 19 aa, Staphylococcus
AYLSLIVYIILSIVKYFVG

SEQ ID NO: 1870963 - protein, 23 aa, Staphylococcus
AYLVVPIVGAFLIDLLGVPIVTI

SEQ ID NO: 1870964 - protein, 17 aa, Staphylococcus
AYNWAFFNPIRKIYYNI

SEQ ID NO: 1870965 - protein, 21 aa, Staphylococcus
AYPESYRYGFYVTPQYNRING

SEQ ID NO: 1870966 - protein, 18 aa, Staphylococcus
AYPLYKNRHKIIENLSII

SEQ ID NO: 1870967 - protein, 18 aa, Staphylococcus
AYQRYQQKLSRFNDLSTY

SEQ ID NO: 1870968 - protein, 30 aa, Staphylococcus
AYRLIKQLMTGIGIEGWDLFATSYVAVLVV

SEQ ID NO: 1870969 - protein, 24 aa, Staphylococcus
AYTEKEFYNTVSIINVINKTEEIS

SEQ ID NO: 1870970 - protein, 19 aa, Staphylococcus
AYTPNSFAPLKVAAVEGQS

SEQ ID NO: 1870971 - protein, 30 aa, Staphylococcus
AYTYRLTSEGKLYFMTKYDGKEYFISQTDV

SEQ ID NO: 1870972 - protein, 20 aa, Staphylococcus
CAGIYPAMLAIMVAPVADVK

SEQ ID NO: 1870973 - protein, 19 aa, Staphylococcus
CAGIYPAMLAIMVAPVAHV

SEQ ID NO: 1870974 - protein, 20 aa, Staphylococcus
CAGIYPAMLAIMVAPVAHVH

SEQ ID NO: 1870975 - protein, 18 aa, Staphylococcus
CALVLKKWFVSAVITFVA

SEQ ID NO: 1870976 - protein, 20 aa, Staphylococcus
CAMFAICWIAYIQWETTIAS

SEQ ID NO: 1870977 - protein, 19 aa, Staphylococcus
CATRLRFVLKDTDQADNSK

SEQ ID NO: 1870978 - protein, 18 aa, Staphylococcus
CAVVNMPGKEGSVIRKTL

SEQ ID NO: 1870979 - protein, 21 aa, Staphylococcus
CCVIGALLIRDYILFIVSIGV

SEQ ID NO: 1870980 - protein, 22 aa, Staphylococcus
CEIGGGYLIWLWLRASQSPLFG

SEQ ID NO: 1870981 - protein, 22 aa, Staphylococcus
CFFPYHFYLIFLLYTLLIAIIV

SEQ ID NO: 1870982 - protein, 18 aa, Staphylococcus
CFKLFKKKSTFIIPIIIM

SEQ ID NO: 1870983 - protein, 18 aa, Staphylococcus
CFKLSKKKSTWIWPIVII

SEQ ID NO: 1870984 - protein, 23 aa, Staphylococcus
CFLFICIYLNLAIGSSHIEFKDI

SEQ ID NO: 1870985 - protein, 19 aa, Staphylococcus
CFLTGNLLLLPRLGAALTV

SEQ ID NO: 1870986 - protein, 19 aa, Staphylococcus
CFNEISLGTVAIGASEEEV

SEQ ID NO: 1870987 - protein, 23 aa, Staphylococcus
CFSRSSKKFNRWLVNTKIHDEYV

SEQ ID NO: 1870988 - protein, 24 aa, Staphylococcus
CFVLKQRLFALVIFIVCLPDIIGW

SEQ ID NO: 1870989 - protein, 18 aa, Staphylococcus
CGECGTKLERQSKSVTAA

SEQ ID NO: 1870990 - protein, 26 aa, Staphylococcus
CGISTKKLICHVLRNALQVAVSIFCM

SEQ ID NO: 1870991 - protein, 18 aa, Staphylococcus
CGLLGGRVSEDINFGEVS

SEQ ID NO: 1870992 - protein, 19 aa, Staphylococcus
CGLSESFTIMMVGRVLQAI

SEQ ID NO: 1870993 - protein, 20 aa, Staphylococcus
CGNAFRLQFKLGGNKAYYFN

SEQ ID NO: 1870994 - protein, 18 aa, Staphylococcus
CGNCGTKLQSVTTETTGI

SEQ ID NO: 1870995 - protein, 24 aa, Staphylococcus
CGNYPKKKWSIFILRASQVVTSLP

SEQ ID NO: 1870996 - protein, 17 aa, Staphylococcus
CGPMPIVLTSLIKSLFN

SEQ ID NO: 1870997 - protein, 21 aa, Staphylococcus
CGSDWPLCHGAFLPQNLPIQT

SEQ ID NO: 1870998 - protein, 21 aa, Staphylococcus
CGSSWPLCHGALLPQNLPIDT

SEQ ID NO: 1870999 - protein, 18 aa, Staphylococcus
CGTVGSIIVLRGLSLMGD

SEQ ID NO: 1871000 - protein, 17 aa, Staphylococcus
CGVLFGFLCSSKLIQYL

SEQ ID NO: 1871001 - protein, 21 aa, Staphylococcus
CHIQNLILFVGLPWLIAYYHI

SEQ ID NO: 1871002 - protein, 19 aa, Staphylococcus
CICIAYWALNAIRLDQFFK

SEQ ID NO: 1871003 - protein, 20 aa, Staphylococcus
CIFLTLSFLGHSYIIYRFIH

SEQ ID NO: 1871004 - protein, 18 aa, Staphylococcus
CIIAPMIFYQLWAFIAPG

SEQ ID NO: 1871005 - protein, 20 aa, Staphylococcus
CILVVLFSVVTRSKWIGTLL

SEQ ID NO: 1871006 - protein, 25 aa, Staphylococcus
CITSRKGIPILIAILLGLMIYLLIQ

SEQ ID NO: 1871007 - protein, 21 aa, Staphylococcus
CIVSLTLIQHGPFIFLVIGFI

SEQ ID NO: 1871008 - protein, 21 aa, Staphylococcus
CIYLGQAFPEYGHYFMFLLAL

SEQ ID NO: 1871009 - protein, 20 aa, Staphylococcus
CKAFTLIEMLLVLLIISVLL

SEQ ID NO: 1871010 - protein, 18 aa, Staphylococcus
CKQILLDHEKELKLIAKT

SEQ ID NO: 1871011 - protein, 24 aa, Staphylococcus
CLAALLCLPLHFKVAAPDKEEEVK

SEQ ID NO: 1871012 - protein, 19 aa, Staphylococcus
CLALIFLSLFFRSKRQIKR

SEQ ID NO: 1871013 - protein, 17 aa, Staphylococcus
CLCRLNVVISLFISALI

SEQ ID NO: 1871014 - protein, 19 aa, Staphylococcus
CLCVGLFILKSCIYPKDIM

SEQ ID NO: 1871015 - protein, 20 aa, Staphylococcus
CLFATIPGIILWNKSIPSFG

SEQ ID NO: 1871016 - protein, 20 aa, Staphylococcus
CLFATIPGIVLWNRSVQSFG

SEQ ID NO: 1871017 - protein, 19 aa, Staphylococcus
CLFIVIATIITWLIRRYYI

SEQ ID NO: 1871018 - protein, 21 aa, Staphylococcus
CLFVLPIPMHFEFESEVFMMA

SEQ ID NO: 1871019 - protein, 19 aa, Staphylococcus
CLFVTLAVVGHSYIIYRFI

SEQ ID NO: 1871020 - protein, 20 aa, Staphylococcus
CLGGIGIATGMSWAAATDLG

SEQ ID NO: 1871021 - protein, 23 aa, Staphylococcus
CLGGVGISMGMSWAAATDLGRNF

SEQ ID NO: 1871022 - protein, 19 aa, Staphylococcus
CLIIFLKLNTFISLIITSI

SEQ ID NO: 1871023 - protein, 18 aa, Staphylococcus
CLIVPIIFYQLWSFIAPG

SEQ ID NO: 1871024 - protein, 19 aa, Staphylococcus
CLLLNLTPIFAILTAIVSI

SEQ ID NO: 1871025 - protein, 22 aa, Staphylococcus
CLLWFFFKDHINIIGVLIGLMI

SEQ ID NO: 1871026 - protein, 18 aa, Staphylococcus
CLRGDRIANIFAICVSIF

SEQ ID NO: 1871027 - protein, 19 aa, Staphylococcus
CLSGMGITTGMSWAAAADI

SEQ ID NO: 1871028 - protein, 19 aa, Staphylococcus
CLSLFIVFFGISWGPVLWV

SEQ ID NO: 1871029 - protein, 19 aa, Staphylococcus
CLTLLIRVNRFWKVPHEAA

SEQ ID NO: 1871030 - protein, 27 aa, Staphylococcus
CLVAAVIMPRIWPLRNIPDEYAVENSE

SEQ ID NO: 1871031 - protein, 18 aa, Staphylococcus
CLYYFTKDSLEEVAPDNY

SEQ ID NO: 1871032 - protein, 19 aa, Staphylococcus
CMINILFIYLRNRELKQFE

SEQ ID NO: 1871033 - protein, 18 aa, Staphylococcus
CMLLTCITYVILFFYSFI

SEQ ID NO: 1871034 - protein, 19 aa, Staphylococcus
CNFIALDLKSKDQTLIKDM

SEQ ID NO: 1871035 - protein, 20 aa, Staphylococcus
CPIVCGIPFILYVMKIEKFG

SEQ ID NO: 1871036 - protein, 25 aa, Staphylococcus
CQGSAAFGAWFIYKRRKMVKEEGLA

SEQ ID NO: 1871037 - protein, 23 aa, Staphylococcus
CQGSAAFGAWIVYKRKKMVKEEG

SEQ ID NO: 1871038 - protein, 18 aa, Staphylococcus
CQIILSCIKTLIDNHYSK

SEQ ID NO: 1871039 - protein, 25 aa, Staphylococcus
CQKSIQPSVSIPMIPLVPAQPSVPV

SEQ ID NO: 1871040 - protein, 20 aa, Staphylococcus
CQPHPFAQLLHDGIKAAYDY

SEQ ID NO: 1871041 - protein, 22 aa, Staphylococcus
CSDIFVWFKLVLNDTSEYHHIK

SEQ ID NO: 1871042 - protein, 17 aa, Staphylococcus
CSECPLKQQCMNFNLKT

SEQ ID NO: 1871043 - protein, 26 aa, Staphylococcus
CSFILAFPMAIIWPSIQGGLNAFSEG

SEQ ID NO: 1871044 - protein, 21 aa, Staphylococcus
CSISFEGKSIWIMLVAPINIK

SEQ ID NO: 1871045 - protein, 17 aa, Staphylococcus
CSIYGLIVAGPFLLIIA

SEQ ID NO: 1871046 - protein, 18 aa, Staphylococcus
CSLLLMSSTPVWLKGDKS

SEQ ID NO: 1871047 - protein, 19 aa, Staphylococcus
CSLSILFFANLCISMPSAI

SEQ ID NO: 1871048 - protein, 20 aa, Staphylococcus
CSLTSAIVIPLMINQEVAGT

SEQ ID NO: 1871049 - protein, 18 aa, Staphylococcus
CSNVEVFNAKGPVASSQK

SEQ ID NO: 1871050 - protein, 30 aa, Staphylococcus; identical to SEQ ID NO: 1738729

SEQ ID NO: 1871051 - protein, 17 aa, Staphylococcus
CSVGGTYFFVKLVQLIR

SEQ ID NO: 1871052 - protein, 21 aa, Staphylococcus
CSVLIGALLGFLFFNFHPAKI

SEQ ID NO: 1871053 - protein, 18 aa, Staphylococcus
CTFITYVIVFTFKKLANK

SEQ ID NO: 1871054 - protein, 22 aa, Staphylococcus
CTGASFVNYVMFSRLNIGGPSK

SEQ ID NO: 1871055 - protein, 22 aa, Staphylococcus
CTGSSFVNYVLFSRLNIGGSKS

SEQ ID NO: 1871056 - protein, 18 aa, Staphylococcus
CTIGCFSIMFISFLLSWL

SEQ ID NO: 1871057 - protein, 17 aa, Staphylococcus
CTKKMGVRREIASFVQP

SEQ ID NO: 1871058 - protein, 20 aa, Staphylococcus
CTPEGGLLYLDMIGILERIG

SEQ ID NO: 1871059 - protein, 19 aa, Staphylococcus
CTPMLSKLPLLRKGKIFNV

SEQ ID NO: 1871060 - protein, 23 aa, Staphylococcus
CVFIIIAAMGFRRGIWLSVLHFA

SEQ ID NO: 1871061 - protein, 19 aa, Staphylococcus
CVGTPIASWFMSKNFFTHV

SEQ ID NO: 1871062 - protein, 19 aa, Staphylococcus
CVIKGKVISVLNHTPYVSI

SEQ ID NO: 1871063 - protein, 20 aa, Staphylococcus
CVLIGSLLGFLFYNSHPAKI

SEQ ID NO: 1871064 - protein, 24 aa, Staphylococcus
CVLLIKELMNFFIAFIDKGNRIYI

SEQ ID NO: 1871065 - protein, 25 aa, Staphylococcus
CVLYHFCFISKILFTKDELKMYNII

SEQ ID NO: 1871066 - protein, 18 aa, Staphylococcus
CVRERIEAIREAFIDNIL

SEQ ID NO: 1871067 - protein, 22 aa, Staphylococcus
CVSTSLLILALMLYQWYVQQRS

SEQ ID NO: 1871068 - protein, 17 aa, Staphylococcus
CYFGQYLPMSWRQPLSF

SEQ ID NO: 1871069 - protein, 19 aa, Staphylococcus
CYLIYLGIQSIRSAHSTMN

SEQ ID NO: 1871070 - protein, 27 aa, Staphylococcus
DADGNRTDTKFSIKVVDTTAPTVKGIS

SEQ ID NO: 1871071 - protein, 19 aa, Staphylococcus
DADGNTVIHFSDGGTAVIS

SEQ ID NO: 1871072 - protein, 23 aa, Staphylococcus
DAEIRTGPNAGYPVIYKVEKGDS

SEQ ID NO: 1871073 - protein, 24 aa, Staphylococcus
DAEKGVYAHYMLKEINDQPAVMRR

SEQ ID NO: 1871074 - protein, 23 aa, Staphylococcus
DAELRTGPNAVYPEIFPADKGET

SEQ ID NO: 1871075 - protein, 24 aa, Staphylococcus
DAFGRKKIALTILVIYMLASLIAV

SEQ ID NO: 1871076 - protein, 17 aa, Staphylococcus
DAFGRKKVLLMILTIFL

SEQ ID NO: 1871077 - protein, 27 aa, Staphylococcus
DAFGRKRMGLIILCIFFLATLSGVFAS

SEQ ID NO: 1871078 - protein, 19 aa, Staphylococcus
DAFVVRMMIIPALTQLFGK

SEQ ID NO: 1871079 - protein, 24 aa, Staphylococcus
DAFVVRMTLIPALTKLFGKASWYL

SEQ ID NO: 1871080 - protein, 17 aa, Staphylococcus
DAGIRSGVFIALATFLR

SEQ ID NO: 1871081 - protein, 20 aa, Staphylococcus
DAHTCQNCGQSIKKETKNKS

SEQ ID NO: 1871082 - protein, 24 aa, Staphylococcus
DAINHVKNQLSAVLGAIDKDTRDV

SEQ ID NO: 1871083 - protein, 23 aa, Staphylococcus
DAIPVFASVIVILAFILLMIVFR

SEQ ID NO: 1871084 - protein, 26 aa, Staphylococcus
DAISRIVYPVIHLFVVILSPITKVLN

SEQ ID NO: 1871085 - protein, 17 aa, Staphylococcus
DAKALDAKQAPKKDPKN

SEQ ID NO: 1871086 - protein, 19 aa, Staphylococcus
DAKEKEFIEFTSTIYEKHH

SEQ ID NO: 1871087 - protein, 18 aa, Staphylococcus
DAKTALDQKAQQQDTIIN

SEQ ID NO: 1871088 - protein, 18 aa, Staphylococcus
DALAKLSGILMDDKVRES

SEQ ID NO: 1871089 - protein, 17 aa, Staphylococcus
DALAKLSGILMDDNVRE

SEQ ID NO: 1871090 - protein, 17 aa, Staphylococcus
DALAKLSGILMDDTVRE

SEQ ID NO: 1871091 - protein, 17 aa, Staphylococcus
DALAKLSGILMDENVRE

SEQ ID NO: 1871092 - protein, 18 aa, Staphylococcus
DALAKLSGILMDENVREK

SEQ ID NO: 1871093 - protein, 17 aa, Staphylococcus
DALAKLSGILMDEQVRA

SEQ ID NO: 1871094 - protein, 23 aa, Staphylococcus
DALKHSFDLLTLMVVFVYLIYKI

SEQ ID NO: 1871095 - protein, 17 aa, Staphylococcus
DALRGISLFGIILMNIL

SEQ ID NO: 1871096 - protein, 17 aa, Staphylococcus
DALSTEWVFLIFAVIGI

SEQ ID NO: 1871097 - protein, 19 aa, Staphylococcus
DAMKLLALAAHDIDKGKST

SEQ ID NO: 1871098 - protein, 24 aa, Staphylococcus
DAMLNILSTLGFIFLMFLSGLEID

SEQ ID NO: 1871099 - protein, 20 aa, Staphylococcus
DANGGEVLTLDFQNLTSNGS

SEQ ID NO: 1871100 - protein, 23 aa, Staphylococcus
DANGRTIAIGSYDSATNTAKYTF

SEQ ID NO: 1871101 - protein, 23 aa, Staphylococcus
DASHELRTPLQIIQGHLNLINRW

SEQ ID NO: 1871102 - protein, 24 aa, Staphylococcus
DASKELIESMGLPKSVIDATKITA

SEQ ID NO: 1871103 - protein, 18 aa, Staphylococcus
DATKSGYDSVEFTENALK

SEQ ID NO: 1871104 - protein, 26 aa, Staphylococcus
DAVSGAISSIVGWFAQLWASIQQTLQ

SEQ ID NO: 1871105 - protein, 23 aa, Staphylococcus
DAYKHYEYRKVISKGEHELDGKT

SEQ ID NO: 1871106 - protein, 21 aa, Staphylococcus
DCGGTLRCGIYPKKGIPTINI

SEQ ID NO: 1871107 - protein, 19 aa, Staphylococcus
DCSECPLKNQCMNFNSKTN

SEQ ID NO: 1871108 - protein, 20 aa, Staphylococcus
DDDVRFVVVVDFVALVVVVD

SEQ ID NO: 1871109 - protein, 17 aa, Staphylococcus
DDETYYLSGLIKATNDS

SEQ ID NO: 1871110 - protein, 21 aa, Staphylococcus
DDFEKNRQSIDPKEHQENTQD

SEQ ID NO: 1871111 - protein, 20 aa, Staphylococcus
DDFERNRQSIDPSHTNEDQK

SEQ ID NO: 1871112 - protein, 22 aa, Staphylococcus
DDFRYYPNFFHQTGQGKTSDSE

SEQ ID NO: 1871113 - protein, 31 aa, Staphylococcus
DDGISFLVIVQFFLKIVCVIIIGFGASFLFN

SEQ ID NO: 1871114 - protein, 24 aa, Staphylococcus
DDGPEKRKAVSFYSTIAGIGASGG

SEQ ID NO: 1871115 - protein, 25 aa, Staphylococcus
DDGWAKHGTYCIIRRIQIHIETWDR

SEQ ID NO: 1871116 - protein, 20 aa, Staphylococcus
DDICDLKPLLKLLGQVVAAS

SEQ ID NO: 1871117 - protein, 17 aa, Staphylococcus
DDIDTYINRSELIRTVK

SEQ ID NO: 1871118 - protein, 18 aa, Staphylococcus
DDILKSMLEQATNKEDLL

SEQ ID NO: 1871119 - protein, 19 aa, Staphylococcus
DDIQLDARYYQGYTQAELD

SEQ ID NO: 1871120 - protein, 23 aa, Staphylococcus
DDLPRFYFYLILFMFAMLGVVLA

SEQ ID NO: 1871121 - protein, 22 aa, Staphylococcus
DDLVSLKVNWFNGIMLALIVLV

SEQ ID NO: 1871122 - protein, 17 aa, Staphylococcus
DDLYIEGITSYDEERHH

SEQ ID NO: 1871123 - protein, 17 aa, Staphylococcus
DDLYIEGITSYDNERHH

SEQ ID NO: 1871124 - protein, 24 aa, Staphylococcus
DDNKAPSYATGWFVDDSEANTIVY

SEQ ID NO: 1871125 - protein, 45 aa, Staphylococcus
DDPLSYVKHISRSIFGFMRYNDAYDQVRIFGADELNPVEIESTFS

SEQ ID NO: 1871126 - protein, 22 aa, Staphylococcus
DDRFCGECGTDLTKSKPVAAAK

SEQ ID NO: 1871127 - protein, 17 aa, Staphylococcus
DDSDWIYNGGFYIISTM

SEQ ID NO: 1871128 - protein, 27 aa, Staphylococcus
DDSFWKSIEKIGALSFSFMVPILAGYI

SEQ ID NO: 1871129 - protein, 20 aa, Staphylococcus
DDVDHTPLLVAKKKKNNEEE

SEQ ID NO: 1871130 - protein, 17 aa, Staphylococcus
DEADKCFAEKWQRHYPD

SEQ ID NO: 1871131 - protein, 24 aa, Staphylococcus
DEALTKFIQIWPYVEGKIQTKNSS

SEQ ID NO: 1871132 - protein, 24 aa, Staphylococcus
DEAYARLQFTLARTSKSSIIVMNQ

SEQ ID NO: 1871133 - protein, 22 aa, Staphylococcus
DEESLDMFLNIILKESNRIESL

SEQ ID NO: 1871134 - protein, 22 aa, Staphylococcus
DEESLNMFLNIILKESNRIESL

SEQ ID NO: 1871135 - protein, 25 aa, Staphylococcus
DEFIIYKFGSDSIRVYNNEFEMQQD

SEQ ID NO: 1871136 - protein, 25 aa, Staphylococcus
DEFIIYKFGSDSIRVYNTEFEMQQD

SEQ ID NO: 1871137 - protein, 17 aa, Staphylococcus
DEFKFTTFFSGFLIGLI

SEQ ID NO: 1871138 - protein, 17 aa, Staphylococcus
DEFKFTTFFSGYLIGVI

SEQ ID NO: 1871139 - protein, 22 aa, Staphylococcus
DEFYYKKWQGLYHEIQNEPERD

SEQ ID NO: 1871140 - protein, 24 aa, Staphylococcus
DEIGILQYRFDTMRQSLKQVDAMR

SEQ ID NO: 1871141 - protein, 20 aa, Staphylococcus
DEIHESLAIVLDESKRLNRL

SEQ ID NO: 1871142 - protein, 20 aa, Staphylococcus
DEIKPGFTLEFNDRPDGFKA

SEQ ID NO: 1871143 - protein, 20 aa, Staphylococcus
DEILIHVYIQSVFVAVCTAL

SEQ ID NO: 1871144 - protein, 26 aa, Staphylococcus
DELIKSAEVKKVFPNKLSVKVTEKQI

SEQ ID NO: 1871145 - protein, 22 aa, Staphylococcus
DELIPYMKNVRVMITFGETQDK

SEQ ID NO: 1871146 - protein, 21 aa, Staphylococcus
DELKMYNIILFWISCFSGQLF

SEQ ID NO: 1871147 - protein, 19 aa, Staphylococcus
DELKQRYAKRLLQFKNVHN

SEQ ID NO: 1871148 - protein, 18 aa, Staphylococcus
DELLKMYPNMYINVDLKD

SEQ ID NO: 1871149 - protein, 23 aa, Staphylococcus
DELLNQRVIDYYGTLVPLTELDD

SEQ ID NO: 1871150 - protein, 21 aa, Staphylococcus
DENFLQTDYNWVLYVKEQIPK

SEQ ID NO: 1871151 - protein, 19 aa, Staphylococcus
DENGKSYGVVLTEMDGHGI

SEQ ID NO: 1871152 - protein, 21 aa, Staphylococcus
DENNPNLVDVTDWNNQDYNFN

SEQ ID NO: 1871153 - protein, 23 aa, Staphylococcus
DEQSLDMFLNIILKESNRIESLV

SEQ ID NO: 1871154 - protein, 19 aa, Staphylococcus
DESRYASSKPYFFKSNAVE

SEQ ID NO: 1871155 - protein, 25 aa, Staphylococcus
DEVIDARLGYYSVVRETNVQLLQPN

SEQ ID NO: 1871156 - protein, 31 aa, Staphylococcus
DEVIKSKHAFSFKLLLSLLIAGFLVVAILLA

SEQ ID NO: 1871157 - protein, 26 aa, Staphylococcus
DEVKNSVKVPGYPTSVGIPTITVDNP

SEQ ID NO: 1871158 - protein, 17 aa, Staphylococcus
DEVMACYDYVSTLDNHY

SEQ ID NO: 1871159 - protein, 23 aa, Staphylococcus
DEVQKAVTVPGFPSSKGTPVVTV

SEQ ID NO: 1871160 - protein, 20 aa, Staphylococcus
DEVQPHLSLDEAHRYVRELY

SEQ ID NO: 1871161 - protein, 22 aa, Staphylococcus
DEYFNKFVFHGRIQYNVEDLAR

SEQ ID NO: 1871162 - protein, 23 aa, Staphylococcus
DEYLKAIHFNGAVTVLENGKLKL

SEQ ID NO: 1871163 - protein, 24 aa, Staphylococcus
DFDWHEVKKAFSWNETGKINMAYE

SEQ ID NO: 1871164 - protein, 17 aa, Staphylococcus
DFGEAWFQSINPLFILL

SEQ ID NO: 1871165 - protein, 48 aa, Staphylococcus
DFGEPEKKKMSGISKLISTIIVLLLLSGLAFAIFAFVDHSNRSSERLN

SEQ ID NO: 1871166 - protein, 23 aa, Staphylococcus
DFGGWKAPFGIQFLGDSLSLLLV

SEQ ID NO: 1871167 - protein, 22 aa, Staphylococcus
DFGGWKAPFGIQFLGDTLSLLM

SEQ ID NO: 1871168 - protein, 18 aa, Staphylococcus
DFIFITVINFLMYIIHYA

SEQ ID NO: 1871169 - protein, 24 aa, Staphylococcus
DFIGFASAWGYWFSAFLGNVAYAT

SEQ ID NO: 1871170 - protein, 24 aa, Staphylococcus
DFIGFSSAWGYWFAAFLGNVAYAT

SEQ ID NO: 1871171 - protein, 27 aa, Staphylococcus
DFIKSYKWRIIGFFAFLIIAILFLTLG

SEQ ID NO: 1871172 - protein, 19 aa, Staphylococcus
DFILLRLLPTFILNLILLI

SEQ ID NO: 1871173 - protein, 22 aa, Staphylococcus
DFIQHFPQIILISFTICSLFLI

SEQ ID NO: 1871174 - protein, 19 aa, Staphylococcus
DFKKFMIMKEIQRPDENVT

SEQ ID NO: 1871175 - protein, 27 aa, Staphylococcus
DFKLVFKEPRSVIIGVILQFTIMPTLA

SEQ ID NO: 1871176 - protein, 25 aa, Staphylococcus
DFKQDEPLNRSRKSDDLQHDDRHDK

SEQ ID NO: 1871177 - protein, 22 aa, Staphylococcus
DFKQKLTRIDYWCDVGSSFDEQ

SEQ ID NO: 1871178 - protein, 19 aa, Staphylococcus
DFLTRLFVGSLITLGLTAF

SEQ ID NO: 1871179 - protein, 17 aa, Staphylococcus
DFMRYSLISGILIGFIA

SEQ ID NO: 1871180 - protein, 21 aa, Staphylococcus
DFMRYSLISGILIGFIAPFIG

SEQ ID NO: 1871181 - protein, 20 aa, Staphylococcus
DFMRYSLLSGILIGFIAPLI

SEQ ID NO: 1871182 - protein, 21 aa, Staphylococcus
DFMRYSLLSGILIGFIAPLIG

SEQ ID NO: 1871183 - protein, 24 aa, Staphylococcus
DFNEVPTLIHSWLNSDIHRSRMLN

SEQ ID NO: 1871184 - protein, 25 aa, Staphylococcus
DFQIFWKIVLPMSKPVVASITLFNA

SEQ ID NO: 1871185 - protein, 21 aa, Staphylococcus
DFQLVKVIPYLLVLILALVGV

SEQ ID NO: 1871186 - protein, 31 aa, Staphylococcus
DFTEIRHYIGPSIFLFIFILTFIHRFLEIKV

SEQ ID NO: 1871187 - protein, 18 aa, Staphylococcus
DFVAVRFGNVLGSRGSVI

SEQ ID NO: 1871188 - protein, 24 aa, Staphylococcus
DFVGFSSAWGYWFAAFLGNVAYAT

SEQ ID NO: 1871189 - protein, 22 aa, Staphylococcus
DFWYPDMPNWITAAATILVLVA

SEQ ID NO: 1871190 - protein, 18 aa, Staphylococcus
DFYMGIGTPGGNKIPTML

SEQ ID NO: 1871191 - protein, 19 aa, Staphylococcus
DGAREIMGLALNKLGYSLN

SEQ ID NO: 1871192 - protein, 24 aa, Staphylococcus
DGCGASWPLCHGALLPENLPIATI

SEQ ID NO: 1871193 - protein, 24 aa, Staphylococcus
DGCGASWPLCHGALLPQNLPIATI

SEQ ID NO: 1871194 - protein, 26 aa, Staphylococcus
DGDGNRTDTKFNIKVVDTTAPTVKGI

SEQ ID NO: 1871195 - protein, 18 aa, Staphylococcus
DGDGNTVIHFSDGQTATI

SEQ ID NO: 1871196 - protein, 19 aa, Staphylococcus
DGDGNTVIHFSDGQTATVS

SEQ ID NO: 1871197 - protein, 17 aa, Staphylococcus
DGEQVVANGVYDVDTKK

SEQ ID NO: 1871198 - protein, 17 aa, Staphylococcus
DGFIGGTLTDWVKSGMH

SEQ ID NO: 1871199 - protein, 23 aa, Staphylococcus
DGGYLTKIRTGAISGVATKYLSR

SEQ ID NO: 1871200 - protein, 17 aa, Staphylococcus
DGHSITINKGEKGDTGT

SEQ ID NO: 1871201 - protein, 26 aa, Staphylococcus
DGIIMKSAYNWAFFNPIRKIYYNITI

SEQ ID NO: 1871202 - protein, 22 aa, Staphylococcus
DGIKIMSFIGVVILSANGFAGV

SEQ ID NO: 1871203 - protein, 26 aa, Staphylococcus
DGILMKSAYNWAFLKPVRKIYYNITI

SEQ ID NO: 1871204 - protein, 26 aa, Staphylococcus
DGITHMFTQFGPLFTWTGKGIESLAN

SEQ ID NO: 1871205 - protein, 26 aa, Staphylococcus
DGIVMKSAYNWAFFNPIRKIYYNITI

SEQ ID NO: 1871206 - protein, 27 aa, Staphylococcus
DGKKALRPVPVLGMLQPDGITAYEYNG

SEQ ID NO: 1871207 - protein, 17 aa, Staphylococcus
DGLGLMFGLIISIIGVA

SEQ ID NO: 1871208 - protein, 25 aa, Staphylococcus
DGLINLLGAIAFSLALVLIVLTNSE

SEQ ID NO: 1871209 - protein, 17 aa, Staphylococcus
DGLTVAIVGVFIVTLLI

SEQ ID NO: 1871210 - protein, 17 aa, Staphylococcus
DGLVVAITGIFLLTVLI

SEQ ID NO: 1871211 - protein, 23 aa, Staphylococcus
DGNFFTKYGNFFLKGIQNTILIS

SEQ ID NO: 1871212 - protein, 26 aa, Staphylococcus
DGNFKPEMVEDVIVGTAFPEGLQGMN

SEQ ID NO: 1871213 - protein, 20 aa, Staphylococcus
DGQPAHLFFMIAAPEGGAQT

SEQ ID NO: 1871214 - protein, 25 aa, Staphylococcus
DGQTMWKYLLVIVIIFVLFLVMISK

SEQ ID NO: 1871215 - protein, 22 aa, Staphylococcus
DGRLEIMRALPIGRDTVLASAV

SEQ ID NO: 1871216 - protein, 17 aa, Staphylococcus
DGSEKSWIAGWHTSLNI

SEQ ID NO: 1871217 - protein, 24 aa, Staphylococcus
DGSGYPIGTFLHASNKGAPYLLPS

SEQ ID NO: 1871218 - protein, 20 aa, Staphylococcus
DGSLPQLVFLIAVPNDSNDT

SEQ ID NO: 1871219 - protein, 17 aa, Staphylococcus
DGSRMVMQILTPRRYER

SEQ ID NO: 1871220 - protein, 18 aa, Staphylococcus
DGSRMVMQILTPRRYERK

SEQ ID NO: 1871221 - protein, 23 aa, Staphylococcus
DGSWSVEVPGGTELNNGDKITAV

SEQ ID NO: 1871222 - protein, 25 aa, Staphylococcus
DGTGILTFNSLRVFGSIGNLLFGVI

SEQ ID NO: 1871223 - protein, 22 aa, Staphylococcus
DGTHLLFKFGFIQITTESLYRG

SEQ ID NO: 1871224 - protein, 25 aa, Staphylococcus
DGTLNDKYMYGYVVNPNGEVQNAYS

SEQ ID NO: 1871225 - protein, 21 aa, Staphylococcus
DGTSPKIVFLIVVPNNSNDTH

SEQ ID NO: 1871226 - protein, 18 aa, Staphylococcus
DGVEASYVIARREDNVVG

SEQ ID NO: 1871227 - protein, 19 aa, Staphylococcus
DGVSTMFASLIGGPPSTTY

SEQ ID NO: 1871228 - protein, 26 aa, Staphylococcus
DGYDLRFATTLAIPVALNEIFIRIFW

SEQ ID NO: 1871229 - protein, 20 aa, Staphylococcus
DGYFWFQGRVDDVIMTAGER

SEQ ID NO: 1871230 - protein, 20 aa, Staphylococcus
DGYYWFQGRVDDVIMTAGER

SEQ ID NO: 1871231 - protein, 19 aa, Staphylococcus
DHFEAIPGRGINATIDGKE

SEQ ID NO: 1871232 - protein, 18 aa, Staphylococcus
DHFRKIRQNPKWLVKLII

SEQ ID NO: 1871233 - protein, 18 aa, Staphylococcus
DHIALEITDYGRGISAKD

SEQ ID NO: 1871234 - protein, 19 aa, Staphylococcus
DHILFKFGIIQISTESIVR

SEQ ID NO: 1871235 - protein, 20 aa, Staphylococcus
DHIQFLKVRLGMQVVLTNIE

SEQ ID NO: 1871236 - protein, 20 aa, Staphylococcus
DHIQFLKVRLGMQVVVSNIA

SEQ ID NO: 1871237 - protein, 24 aa, Staphylococcus
DHLSEFYALVLFAGLFHLMNHAIF

SEQ ID NO: 1871238 - protein, 17 aa, Staphylococcus
DHPFVYWATLKNVASLL

SEQ ID NO: 1871239 - protein, 18 aa, Staphylococcus
DHPFVYWATLKNVASLLE

SEQ ID NO: 1871240 - protein, 24 aa, Staphylococcus
DHPVRIAVFVGLSILGFVGLILGV

SEQ ID NO: 1871241 - protein, 19 aa, Staphylococcus
DHREMKRDILANRHQYGEA

SEQ ID NO: 1871242 - protein, 22 aa, Staphylococcus
DHRSEYYSKVLLIIQSVGLGIC

SEQ ID NO: 1871243 - protein, 17 aa, Staphylococcus
DHTFWFKFWSVIESGGW

SEQ ID NO: 1871244 - protein, 23 aa, Staphylococcus
DIAHKPIMLSFNFIGQTGTAILI

SEQ ID NO: 1871245 - protein, 20 aa, Staphylococcus
DICRESGISRGTFYQHYTNK

SEQ ID NO: 1871246 - protein, 17 aa, Staphylococcus
DIDHASSNIGVYNAENE

SEQ ID NO: 1871247 - protein, 17 aa, Staphylococcus
DIDLAYRNLREILLKAN

SEQ ID NO: 1871248 - protein, 25 aa, Staphylococcus
DIDPRKSASILDIFGSCFQGLLPYS

SEQ ID NO: 1871249 - protein, 21 aa, Staphylococcus
DIESYFLTWVHQIKTPITASK

SEQ ID NO: 1871250 - protein, 19 aa, Staphylococcus
DIFGGCFQGLLPYSPQVIS

SEQ ID NO: 1871251 - protein, 19 aa, Staphylococcus
DIFGSCFQGLLPYSPQVIS

SEQ ID NO: 1871252 - protein, 21 aa, Staphylococcus
DIFMCGVATFLEANKITGTGL

SEQ ID NO: 1871253 - protein, 21 aa, Staphylococcus
DIFNSEFKTGVGNVEVNNSKL

SEQ ID NO: 1871254 - protein, 18 aa, Staphylococcus
DIFPSMAVPMIFGVIGII

SEQ ID NO: 1871255 - protein, 21 aa, Staphylococcus
DIHARFGVPRIAFLSFTITVI

SEQ ID NO: 1871256 - protein, 21 aa, Staphylococcus
DIHSKRLLTSIGIGIIASIIL

SEQ ID NO: 1871257 - protein, 20 aa, Staphylococcus
DIHSRFGLPRIAFLSFVSTI

SEQ ID NO: 1871258 - protein, 26 aa, Staphylococcus
DIIRFIVRVLIPFSFIISLFLISQGT

SEQ ID NO: 1871259 - protein, 19 aa, Staphylococcus
DIITGFFIIFENQFDVGDY

SEQ ID NO: 1871260 - protein, 17 aa, Staphylococcus
DIKTMRKIFPWDFKILI

SEQ ID NO: 1871261 - protein, 23 aa, Staphylococcus
DIKYGCRDLKVEGYDLDHVKIDS

SEQ ID NO: 1871262 - protein, 19 aa, Staphylococcus
DIKYTNAFSDTKAPAAEPA

SEQ ID NO: 1871263 - protein, 25 aa, Staphylococcus
DILGISAFYGGLVFLVAKIFDAFVD

SEQ ID NO: 1871264 - protein, 20 aa, Staphylococcus
DILHRVFKKQYSFVVYDIAP

SEQ ID NO: 1871265 - protein, 19 aa, Staphylococcus
DILLIPAYIFFQSIIPIIV

SEQ ID NO: 1871266 - protein, 24 aa, Staphylococcus
DILMGSAFLEFLPYALFGIAAYKM

SEQ ID NO: 1871267 - protein, 21 aa, Staphylococcus
DINARFGLPRIAFLSLVTTII

SEQ ID NO: 1871268 - protein, 17 aa, Staphylococcus
DINFTLLQIFKHIVFTV

SEQ ID NO: 1871269 - protein, 25 aa, Staphylococcus
DINYLTKDFAEFTTYINQNRAFNTG

SEQ ID NO: 1871270 - protein, 23 aa, Staphylococcus
DIPITNWRSKIGYVMQSNSMMTG

SEQ ID NO: 1871271 - protein, 23 aa, Staphylococcus
DIQKHLPNTLSVTIEENQVVGMI

SEQ ID NO: 1871272 - protein, 22 aa, Staphylococcus
DIQKVDIALDMSKKTLKNIKEN

SEQ ID NO: 1871273 - protein, 23 aa, Staphylococcus
DISKGIIYWSKFLLFLVYFVVLC

SEQ ID NO: 1871274 - protein, 25 aa, Staphylococcus
DISPLKGLVLISGLVLLGIATNRRK

SEQ ID NO: 1871275 - protein, 19 aa, Staphylococcus
DITSFVIPIGYTFNLDGSA

SEQ ID NO: 1871276 - protein, 19 aa, Staphylococcus
DIVIQWGVLALIVIFQPEI

SEQ ID NO: 1871277 - protein, 21 aa, Staphylococcus
DIVNRWQKFYILIIATLLSVL

SEQ ID NO: 1871278 - protein, 18 aa, Staphylococcus
DIYWCTADPGWVTGTSYG

SEQ ID NO: 1871279 - protein, 23 aa, Staphylococcus
DKAEFPSVKSVIWEDDNQILKRN

SEQ ID NO: 1871280 - protein, 18 aa, Staphylococcus
DKALAIAGGTPKYKTTGF

SEQ ID NO: 1871281 - protein, 25 aa, Staphylococcus
DKARARKMGGTGLGLAISKEIVEAH

SEQ ID NO: 1871282 - protein, 17 aa, Staphylococcus
DKDALSFVNYTTHLDEI

SEQ ID NO: 1871283 - protein, 18 aa, Staphylococcus
DKDGGFRGGPAYYITKGL

SEQ ID NO: 1871284 - protein, 23 aa, Staphylococcus
DKDGGFRGGPAYYITKGLNQKWL

SEQ ID NO: 1871285 - protein, 24 aa, Staphylococcus
DKDLEIFKSLGYGVKEKRNDPNFG

SEQ ID NO: 1871286 - protein, 18 aa, Staphylococcus
DKDNHVIGTGTTGANGHV

SEQ ID NO: 1871287 - protein, 25 aa, Staphylococcus
DKDNKLPVVFWMHGGGFIAGDKQYK

SEQ ID NO: 1871288 - protein, 22 aa, Staphylococcus
DKDSKEAKGKDSVVKDNSKSKT

SEQ ID NO: 1871289 - protein, 21 aa, Staphylococcus
DKEINGMLKFGGVLINTMPIL

SEQ ID NO: 1871290 - protein, 27 aa, Staphylococcus
DKEKFAYIKILCNYAFFDDDIIDSKEY

SEQ ID NO: 1871291 - protein, 23 aa, Staphylococcus
DKEVIKLSVSIGIGYLTADDYKS

SEQ ID NO: 1871292 - protein, 23 aa, Staphylococcus
DKEVIKLSVSIGVGYLTQDDRKS

SEQ ID NO: 1871293 - protein, 17 aa, Staphylococcus
DKFAKIGSYIFAFLIGT

SEQ ID NO: 1871294 - protein, 23 aa, Staphylococcus
DKFAKIGTFIFMFLIGTVAVAAI

SEQ ID NO: 1871295 - protein, 24 aa, Staphylococcus
DKFKCVWYGFWCFSVFAIGTFLKY

SEQ ID NO: 1871296 - protein, 21 aa, Staphylococcus
DKFLRKMIFLFMFKVLSYIVF

SEQ ID NO: 1871297 - protein, 27 aa, Staphylococcus
DKFRVNFKIVLPGAILTIIILFFLTNG

SEQ ID NO: 1871298 - protein, 23 aa, Staphylococcus
DKGEYRGGPAYYIEYGIGGKFGK

SEQ ID NO: 1871299 - protein, 26 aa, Staphylococcus
DKGIYDYKRALLRSSVPLEGKTKSLD

SEQ ID NO: 1871300 - protein, 22 aa, Staphylococcus
DKGIYDYQRALLRSSVPLEGKS

SEQ ID NO: 1871301 - protein, 24 aa, Staphylococcus
DKGKVICSGTLYFGDIKDKHLIQA

SEQ ID NO: 1871302 - protein, 18 aa, Staphylococcus
DKIGFWTSVRFYYKDIIV

SEQ ID NO: 1871303 - protein, 25 aa, Staphylococcus
DKIGRRRLVLFIAIIFALGAFILAI

SEQ ID NO: 1871304 - protein, 23 aa, Staphylococcus
DKIKRANGLSSNDIHNGQTLVIP

SEQ ID NO: 1871305 - protein, 21 aa, Staphylococcus
DKIVPMILAVISFISILVTIG

SEQ ID NO: 1871306 - protein, 18 aa, Staphylococcus
DKIYFKQSIDLGGPTLVL

SEQ ID NO: 1871307 - protein, 23 aa, Staphylococcus
DKKAYRIARFLAHPSEAMTALLI

SEQ ID NO: 1871308 - protein, 17 aa, Staphylococcus
DKKGNITKITWKATGKG

SEQ ID NO: 1871309 - protein, 21 aa, Staphylococcus
DKKGPKFVWILAGTAWSLVEI

SEQ ID NO: 1871310 - protein, 24 aa, Staphylococcus
DKKGPKFVWIVAGTAWSLVEIAMA

SEQ ID NO: 1871311 - protein, 23 aa, Staphylococcus
DKKGPKFVWLIAGTLWSLFEIGM

SEQ ID NO: 1871312 - protein, 25 aa, Staphylococcus
DKKIAFRLFPFVFIFAVGGASLATF

SEQ ID NO: 1871313 - protein, 23 aa, Staphylococcus
DKKLEITSSLFSAKSITVDLSDA

SEQ ID NO: 1871314 - protein, 17 aa, Staphylococcus
DKKSGKGKKAAAVGTGA

SEQ ID NO: 1871315 - protein, 22 aa, Staphylococcus
DKKTIFPFIIASGFIADTTSLP

SEQ ID NO: 1871316 - protein, 19 aa, Staphylococcus
DKKWYPASMTKLMTMYLTL

SEQ ID NO: 1871317 - protein, 17 aa, Staphylococcus
DKLAYGIALKGSSKLSG

SEQ ID NO: 1871318 - protein, 19 aa, Staphylococcus
DKLGGIYYDVPYDLDEPNT

SEQ ID NO: 1871319 - protein, 25 aa, Staphylococcus
DKLGRRRLVMLIAVVFIIGALTLAF

SEQ ID NO: 1871320 - protein, 25 aa, Staphylococcus
DKLGRRRVVFIIAIVYIIGALILAF

SEQ ID NO: 1871321 - protein, 19 aa, Staphylococcus
DKLILSMEVLPIIISVQYV

SEQ ID NO: 1871322 - protein, 19 aa, Staphylococcus
DKLKGEFKNVGTVVQAYLY

SEQ ID NO: 1871323 - protein, 17 aa, Staphylococcus
DKLKPGFTLEFNDRPDG

SEQ ID NO: 1871324 - protein, 20 aa, Staphylococcus
DKLMLPLSILIPVGAVALSL

SEQ ID NO: 1871325 - protein, 21 aa, Staphylococcus
DKLRVELLFRGKGEDEVNEID

SEQ ID NO: 1871326 - protein, 30 aa, Staphylococcus
DKNADKGIVLKAPFILYGVNADGSTTKLNE

SEQ ID NO: 1871327 - protein, 19 aa, Staphylococcus
DKNCPLGTHIKVAPYHTTF

SEQ ID NO: 1871328 - protein, 20 aa, Staphylococcus
DKNEILSFYMNNIYYGSDQY

SEQ ID NO: 1871329 - protein, 20 aa, Staphylococcus
DKNGKLIGIASLKIDMDHVE

SEQ ID NO: 1871330 - protein, 23 aa, Staphylococcus
DKNRINGGFFGQVFTSYFNDKYI

SEQ ID NO: 1871331 - protein, 17 aa, Staphylococcus
DKNVFKRDFKLYECDDC

SEQ ID NO: 1871332 - protein, 19 aa, Staphylococcus
DKNVYRVEGFSCANCAGKF

SEQ ID NO: 1871333 - protein, 23 aa, Staphylococcus
DKPKPAQWAFLSLQHLFAMFGST

SEQ ID NO: 1871334 - protein, 23 aa, Staphylococcus
DKPSEFITTILIIKNISNIILPV

SEQ ID NO: 1871335 - protein, 25 aa, Staphylococcus
DKQEFMAVSGLRRMGYNDDYIAGQR

SEQ ID NO: 1871336 - protein, 19 aa, Staphylococcus
DKQLATGLAEIFSSQLELG

SEQ ID NO: 1871337 - protein, 21 aa, Staphylococcus
DKQLYPWDRMIGVEHRHYTNY

SEQ ID NO: 1871338 - protein, 22 aa, Staphylococcus
DKRNISLYIWLLIGFIFGFAPP

SEQ ID NO: 1871339 - protein, 19 aa, Staphylococcus
DKRQMIGIWSGIILIVIAA

SEQ ID NO: 1871340 - protein, 19 aa, Staphylococcus
DKRQMVGIWAGIVLIIVAA

SEQ ID NO: 1871341 - protein, 20 aa, Staphylococcus
DKRTLALMFLAPLLVLTLMY

SEQ ID NO: 1871342 - protein, 18 aa, Staphylococcus
DKRVFSKKFVPVVMAASI

SEQ ID NO: 1871343 - protein, 21 aa, Staphylococcus
DKSHLIETILGMKLSPEEAKK

SEQ ID NO: 1871344 - protein, 18 aa, Staphylococcus
DKSRARSQGGNGLGLSIA

SEQ ID NO: 1871345 - protein, 19 aa, Staphylococcus
DKSRSRKLGGNGLGLSIAK

SEQ ID NO: 1871346 - protein, 25 aa, Staphylococcus
DKSTYKGIYSFDVLGLQNINRNMDE

SEQ ID NO: 1871347 - protein, 26 aa, Staphylococcus
DKTLADLRHRFHILKNKVNAEAKDWA

SEQ ID NO: 1871348 - protein, 17 aa, Staphylococcus
DKTLLILFLKFVAILLY

SEQ ID NO: 1871349 - protein, 19 aa, Staphylococcus
DKVAPGYTVVMSSLTSEGV

SEQ ID NO: 1871350 - protein, 21 aa, Staphylococcus
DKVFYGKSWINHVVDTIRTKD

SEQ ID NO: 1871351 - protein, 18 aa, Staphylococcus
DKVFYGRQWVNDVVATIR

SEQ ID NO: 1871352 - protein, 17 aa, Staphylococcus
DKVKIDINHIDWFVPHS

SEQ ID NO: 1871353 - protein, 32 aa, Staphylococcus
DKVKYFFKEHWAKVLIVLAVILLIVLINAIFN

SEQ ID NO: 1871354 - protein, 19 aa, Staphylococcus
DKVQWGREAVKLIIAFLMA

SEQ ID NO: 1871355 - protein, 19 aa, Staphylococcus
DKWSDIAVVKAKINDKNIK

SEQ ID NO: 1871356 - protein, 24 aa, Staphylococcus
DKWTSKRWLIISITIFIVMMLVLN

SEQ ID NO: 1871357 - protein, 25 aa, Staphylococcus
DKYGIKVLVIPGFTVLIIMTILHAF

SEQ ID NO: 1871358 - protein, 19 aa, Staphylococcus
DKYGLKILAVPGFIILIIM

SEQ ID NO: 1871359 - protein, 24 aa, Staphylococcus
DKYGPRPLIISGFTILTVCTFLLC

SEQ ID NO: 1871360 - protein, 19 aa, Staphylococcus
DKYMPRMFNVRGDRLGYSN

SEQ ID NO: 1871361 - protein, 20 aa, Staphylococcus
DKYMPRMFSVRGDRLGYSNS

SEQ ID NO: 1871362 - protein, 19 aa, Staphylococcus
DKYMPRMFTVRGDRLGYSN

SEQ ID NO: 1871363 - protein, 22 aa, Staphylococcus
DKYPELRLRLVKGAYKEDASIA

SEQ ID NO: 1871364 - protein, 23 aa, Staphylococcus
DKYSARFQKLLLLHTTAQGIYSE

SEQ ID NO: 1871365 - protein, 19 aa, Staphylococcus
DLAIAVVMGAAFNKIVTSL

SEQ ID NO: 1871366 - protein, 25 aa, Staphylococcus
DLAPFIAAIVCIIAFKDKRTQLAGL

SEQ ID NO: 1871367 - protein, 19 aa, Staphylococcus
DLAPFIASLVCILVFKYKK

SEQ ID NO: 1871368 - protein, 23 aa, Staphylococcus
DLDGKLFLSMLGQLTLNYMVSFN

SEQ ID NO: 1871369 - protein, 22 aa, Staphylococcus
DLDIPWVPFAYMFKYLGIAGYI

SEQ ID NO: 1871370 - protein, 25 aa, Staphylococcus
DLDIWEIIVSMGLSVIVIILLLWIA

SEQ ID NO: 1871371 - protein, 18 aa, Staphylococcus
DLDKILADLDVSSEKVDN

SEQ ID NO: 1871372 - protein, 25 aa, Staphylococcus
DLDVLPRFDKIIVMIDGEIKESGSY

SEQ ID NO: 1871373 - protein, 18 aa, Staphylococcus
DLDWKKSRTRMPEMTYNF

SEQ ID NO: 1871374 - protein, 20 aa, Staphylococcus
DLEKMGLKVIGGHHPLSLLD

SEQ ID NO: 1871375 - protein, 30 aa, Staphylococcus
DLEKVFGRDRLKLFVPWYYLVKYVLPVVIL

SEQ ID NO: 1871376 - protein, 19 aa, Staphylococcus
DLELFKNKPFIGAVIANFL

SEQ ID NO: 1871377 - protein, 24 aa, Staphylococcus
DLEMREVLDDLGLAHIDLDRMITL

SEQ ID NO: 1871378 - protein, 30 aa, Staphylococcus
DLFATPRFVLPMLIQGVSFVLLFTYISASP

SEQ ID NO: 1871379 - protein, 23 aa, Staphylococcus
DLFFKYIMMSLILWILWSHQTFF

SEQ ID NO: 1871380 - protein, 19 aa, Staphylococcus
DLFLNRVTIGLSIAFFVLM

SEQ ID NO: 1871381 - protein, 22 aa, Staphylococcus
DLFSRHMLIFTAKFLEALVIAF

SEQ ID NO: 1871382 - protein, 19 aa, Staphylococcus
DLGGFNFGSGYNVPERING

SEQ ID NO: 1871383 - protein, 21 aa, Staphylococcus
DLGPRIAHAILPIAGKGGSNW

SEQ ID NO: 1871384 - protein, 21 aa, Staphylococcus
DLGPRIAHAILPIAGKGKSNW

SEQ ID NO: 1871385 - protein, 21 aa, Staphylococcus
DLHVSEAWIGQLVTLYAVTFA

SEQ ID NO: 1871386 - protein, 23 aa, Staphylococcus
DLIEIAILIPVSFIITIASAITF

SEQ ID NO: 1871387 - protein, 18 aa, Staphylococcus
DLIKIKRVMFPMQEVVDT

SEQ ID NO: 1871388 - protein, 18 aa, Staphylococcus
DLIRWKPDCTLPLMDGLY

SEQ ID NO: 1871389 - protein, 21 aa, Staphylococcus
DLKIYRFLRRSIKNIIIVGAI

SEQ ID NO: 1871390 - protein, 21 aa, Staphylococcus
DLKLLDWGVFLVLGIFFGSYI

SEQ ID NO: 1871391 - protein, 19 aa, Staphylococcus
DLKLLPYFDKIVVLIDGQI

SEQ ID NO: 1871392 - protein, 26 aa, Staphylococcus
DLKQTKKSADFEVGSTNHAKDYTEKI

SEQ ID NO: 1871393 - protein, 20 aa, Staphylococcus
DLKSSGWAYFLYEWAGIPGT

SEQ ID NO: 1871394 - protein, 18 aa, Staphylococcus
DLKSYRLARDIKNQIEEE

SEQ ID NO: 1871395 - protein, 24 aa, Staphylococcus
DLKTPYERIDFMKLAKPLLGLSVL

SEQ ID NO: 1871396 - protein, 23 aa, Staphylococcus
DLKTSYEKWNFVKLAKPLIGFSI

SEQ ID NO: 1871397 - protein, 24 aa, Staphylococcus
DLKYGCRDLKVEGYDLDHVKIDST

SEQ ID NO: 1871398 - protein, 20 aa, Staphylococcus
DLLFGIPLIVGAIITVLDVF

SEQ ID NO: 1871399 - protein, 19 aa, Staphylococcus
DLLFGIPLLVGALITVFDV

SEQ ID NO: 1871400 - protein, 19 aa, Staphylococcus
DLLSEVLFFINIILTLYYI

SEQ ID NO: 1871401 - protein, 23 aa, Staphylococcus
DLLSNPLWLVFYIILTVAVIFHF

SEQ ID NO: 1871402 - protein, 22 aa, Staphylococcus
DLMAGELIAGMSRGVEAALTSF

SEQ ID NO: 1871403 - protein, 22 aa, Staphylococcus
DLMAGELLAGMSRGMEAALTAF

SEQ ID NO: 1871404 - protein, 19 aa, Staphylococcus
DLMVSMGIFCFIVSGIFIL

SEQ ID NO: 1871405 - protein, 20 aa, Staphylococcus
DLPDKSWFVSATVTTNNKTV

SEQ ID NO: 1871406 - protein, 20 aa, Staphylococcus
DLPPLIVHYFFDLMVSMGIF

SEQ ID NO: 1871407 - protein, 24 aa, Staphylococcus
DLQQRFDTIIAFLLIASLCKLILY

SEQ ID NO: 1871408 - protein, 17 aa, Staphylococcus
DLQVLAIYREMMAGSTL

SEQ ID NO: 1871409 - protein, 22 aa, Staphylococcus
DLSDYGISLIFVEDVIESLPEH

SEQ ID NO: 1871410 - protein, 25 aa, Staphylococcus
DLTEIAFLVPISFVLTIASAITFVD

SEQ ID NO: 1871411 - protein, 18 aa, Staphylococcus
DLTKVTAVKYVFDEPLVL

SEQ ID NO: 1871412 - protein, 23 aa, Staphylococcus
DLVGWRYTFLFIVFVSVLVGILM

SEQ ID NO: 1871413 - protein, 24 aa, Staphylococcus
DLVPRIALGSIVAYIIGQHVDVFI

SEQ ID NO: 1871414 - protein, 17 aa, Staphylococcus
DLYKPQATLPRKEDESP

SEQ ID NO: 1871415 - protein, 28 aa, Staphylococcus
DMAKGLKLKVIFNFGLPLIIALLHGYFA

SEQ ID NO: 1871416 - protein, 25 aa, Staphylococcus
DMEKLWYWLVSFAMILAIAMSGHAW

SEQ ID NO: 1871417 - protein, 23 aa, Staphylococcus
DMIAGSFGWLFLVIIFVLDVFLI

SEQ ID NO: 1871418 - protein, 21 aa, Staphylococcus
DMKLDGLSLMFGLIISLIGVG

SEQ ID NO: 1871419 - protein, 18 aa, Staphylococcus
DMLIKAALFFLIGVMYKI

SEQ ID NO: 1871420 - protein, 28 aa, Staphylococcus
DMLKGLGLKVIFNFGLPLIVSLLHAYFA

SEQ ID NO: 1871421 - protein, 25 aa, Staphylococcus
DMNIKRRRLILLYLITLLFIFPLYF

SEQ ID NO: 1871422 - protein, 20 aa, Staphylococcus
DMNRVRISFLPISNTGRISV

SEQ ID NO: 1871423 - protein, 19 aa, Staphylococcus
DMTHVISLNTGRSYPLELI

SEQ ID NO: 1871424 - protein, 25 aa, Staphylococcus
DMTPWKYRYVAGIFILALVVISYII

SEQ ID NO: 1871425 - protein, 22 aa, Staphylococcus
DMVARFGLKLLFGATLVSFISA

SEQ ID NO: 1871426 - protein, 38 aa, Staphylococcus
DMVILKAQVESVVWFIAISVFSSLVFISIVYTLVSLLG

SEQ ID NO: 1871427 - protein, 17 aa, Staphylococcus
DMVKAGFVLNIFAIIVI

SEQ ID NO: 1871428 - protein, 22 aa, Staphylococcus
DNAKELLLKGLEKLEYRGYDSA

SEQ ID NO: 1871429 - protein, 25 aa, Staphylococcus
DNAKELLLSGLEKLEYRGYDSAGIA

SEQ ID NO: 1871430 - protein, 23 aa, Staphylococcus
DNCKTDFVAVRFGNVLGSRGSVI

SEQ ID NO: 1871431 - protein, 34 aa, Staphylococcus
DNDQTEIPLVWGPKALPPYNPYVFDKTNNKIAAV

SEQ ID NO: 1871432 - protein, 23 aa, Staphylococcus
DNELKKKAIHFAGDEAIDHKNNN

SEQ ID NO: 1871433 - protein, 23 aa, Staphylococcus
DNESCPNCGQSLSRNKKRKNKTK

SEQ ID NO: 1871434 - protein, 41 aa, Staphylococcus
DNFEYIKNAIIAFFKEHWPKLLIIIGIILLLLILNAIFTTV

SEQ ID NO: 1871435 - protein, 24 aa, Staphylococcus
DNFSWRKKIILILFVIPFPLMVWG

SEQ ID NO: 1871436 - protein, 18 aa, Staphylococcus
DNFYIISIEIVFFHLSKN

SEQ ID NO: 1871437 - protein, 18 aa, Staphylococcus
DNFYIISIEIVFFSLIQE

SEQ ID NO: 1871438 - protein, 18 aa, Staphylococcus
DNGKFVGYLTFSFKGSNS

SEQ ID NO: 1871439 - protein, 45 aa, Staphylococcus
DNHDGKKKGGFMKIILPIIAAVLILGAIAIFAGMALNNHSNSGND

SEQ ID NO: 1871440 - protein, 18 aa, Staphylococcus
DNHIMIINTFFFKKEAVI

SEQ ID NO: 1871441 - protein, 20 aa, Staphylococcus
DNHQLVWVVLKYEFIDNRPT

SEQ ID NO: 1871442 - protein, 22 aa, Staphylococcus
DNHQLVWVVLKYQFNETRPVIS

SEQ ID NO: 1871443 - protein, 17 aa, Staphylococcus
DNIAWGSILGYFGYGYM

SEQ ID NO: 1871444 - protein, 18 aa, Staphylococcus
DNILLMLLNVVIASILAI

SEQ ID NO: 1871445 - protein, 22 aa, Staphylococcus
DNIPALFSRYDQLVGLLDKNQP

SEQ ID NO: 1871446 - protein, 30 aa, Staphylococcus
DNKQAGLFGGLFAALGSALLFGRRKKDKKE

SEQ ID NO: 1871447 - protein, 23 aa, Staphylococcus
DNLATQLKETFANTPGATVDELN

SEQ ID NO: 1871448 - protein, 17 aa, Staphylococcus
DNLDIKHSVNYSEASPD

SEQ ID NO: 1871449 - protein, 25 aa, Staphylococcus
DNLDVQVLGLITGDIGSMPDLKQTK

SEQ ID NO: 1871450 - protein, 22 aa, Staphylococcus
DNLEKLSALNLKGETRTKYDAL

SEQ ID NO: 1871451 - protein, 24 aa, Staphylococcus
DNLKEVPLILLITIIIDVFLALIT

SEQ ID NO: 1871452 - protein, 20 aa, Staphylococcus
DNLLSRGGIMSMLGSACLII

SEQ ID NO: 1871453 - protein, 17 aa, Staphylococcus
DNLPLLFAVGTALGLAG

SEQ ID NO: 1871454 - protein, 23 aa, Staphylococcus
DNLPRFYVYLLLFMFSMLGIVTA

SEQ ID NO: 1871455 - protein, 33 aa, Staphylococcus
DNMRSEVPFYSKSMLLNRLNSLATGSYKYNPYI

SEQ ID NO: 1871456 - protein, 45 aa, Staphylococcus
DNNKKKGGLLGKLLPIIAAILILAAIGIFGGMALTGNNDDKGSDD

SEQ ID NO: 1871457 - protein, 25 aa, Staphylococcus
DNNYLRYGGNNEFIIAESDQRQGTT

SEQ ID NO: 1871458 - protein, 21 aa, Staphylococcus
DNPDLKYAIMQGIFVSISATT

SEQ ID NO: 1871459 - protein, 26 aa, Staphylococcus
DNQLWLIPGLCICGVALFTSLIIAII

SEQ ID NO: 1871460 - protein, 20 aa, Staphylococcus
DNQVYCFIDEIFKGTNTTER

SEQ ID NO: 1871461 - protein, 32 aa, Staphylococcus
DNRFYDHGAIDYKRLFGAIGKNLTGGFGSQGA

SEQ ID NO: 1871462 - protein, 32 aa, Staphylococcus
DNRFYDHGALDYKRLFGAVGKNLTGGFGAQGA

SEQ ID NO: 1871463 - protein, 17 aa, Staphylococcus
DNRTMVIPKGDKGDKGD

SEQ ID NO: 1871464 - protein, 23 aa, Staphylococcus
DNSAKSKAIKHLQELVKQQMTKI

SEQ ID NO: 1871465 - protein, 23 aa, Staphylococcus
DNSGRFNFQLPNYTLQEGDHISA

SEQ ID NO: 1871466 - protein, 18 aa, Staphylococcus
DNSLTYTFTDYVDTHDNV

SEQ ID NO: 1871467 - protein, 18 aa, Staphylococcus
DNTFTYTISMNWSLEITR

SEQ ID NO: 1871468 - protein, 38 aa, Staphylococcus
DNTVAAKVSELFKEAPVKSSAFATVPVLVTVTKAVAES

SEQ ID NO: 1871469 - protein, 17 aa, Staphylococcus
DNVAIALGVAEAVGVDK

SEQ ID NO: 1871470 - protein, 18 aa, Staphylococcus
DNVEGMGFAIPINDAQKI

SEQ ID NO: 1871471 - protein, 24 aa, Staphylococcus
DNVLNILSTLGFIFLMFLSGLEID

SEQ ID NO: 1871472 - protein, 25 aa, Staphylococcus
DNVNRWIASIGYLFPLRYAGDALTK

SEQ ID NO: 1871473 - protein, 29 aa, Staphylococcus
DNVTGSFNLPLWADRNNAKDSGNYPVTTT

SEQ ID NO: 1871474 - protein, 34 aa, Staphylococcus
DNYNFCIYVPFGDDWFGYFMRRLAERPQNLNLAV

SEQ ID NO: 1871475 - protein, 20 aa, Staphylococcus
DNYTRLALSYLKLLNEASDM

SEQ ID NO: 1871476 - protein, 19 aa, Staphylococcus
DPAAIGIILGIDRLLDMTR

SEQ ID NO: 1871477 - protein, 21 aa, Staphylococcus
DPDKEHSVIALTPTVADNEIG

SEQ ID NO: 1871478 - protein, 19 aa, Staphylococcus
DPDKKIAYDNALSNAEHLL

SEQ ID NO: 1871479 - protein, 23 aa, Staphylococcus
DPFHRIDYMSAYALNSPFLYHYN

SEQ ID NO: 1871480 - protein, 18 aa, Staphylococcus
DPGHSFTGTVNFISKLPL

SEQ ID NO: 1871481 - protein, 17 aa, Staphylococcus
DPIPHALILTAIVIAFA

SEQ ID NO: 1871482 - protein, 19 aa, Staphylococcus
DPIRKDIYADTDVTDPKIA

SEQ ID NO: 1871483 - protein, 25 aa, Staphylococcus
DPKDHPWAKFIVGKPVIAVIVSLII

SEQ ID NO: 1871484 - protein, 20 aa, Staphylococcus
DPKLFKFSWIVLSILLIGYI

SEQ ID NO: 1871485 - protein, 23 aa, Staphylococcus
DPNFDFSGDIYINGKKYDIKDQN

SEQ ID NO: 1871486 - protein, 22 aa, Staphylococcus
DPRHMKKMMSFYALTKNLGSSI

SEQ ID NO: 1871487 - protein, 20 aa, Staphylococcus
DPTIMLVIGASYFLAMVCGS

SEQ ID NO: 1871488 - protein, 17 aa, Staphylococcus
DQFFIWAVPCYLCAILA

SEQ ID NO: 1871489 - protein, 17 aa, Staphylococcus
DQFFIWTVPCYLCAVLA

SEQ ID NO: 1871490 - protein, 29 aa, Staphylococcus
DQFFIWTVPCYLCIVFAIFYGFSGIGIKK

SEQ ID NO: 1871491 - protein, 20 aa, Staphylococcus
DQIEGISFLLACYNESETVR

SEQ ID NO: 1871492 - protein, 20 aa, Staphylococcus
DQITKFIIASSMKVGDSFEV

SEQ ID NO: 1871493 - protein, 25 aa, Staphylococcus
DQIWSNSKFKLALKVQDRQDSNEIL

SEQ ID NO: 1871494 - protein, 26 aa, Staphylococcus
DQLDEFFNKFVFHGRIQYNVDELQNV

SEQ ID NO: 1871495 - protein, 18 aa, Staphylococcus
DQLLKLKKQLNFPMITSN

SEQ ID NO: 1871496 - protein, 19 aa, Staphylococcus
DQLNFPILSTNTYKDNKLL

SEQ ID NO: 1871497 - protein, 30 aa, Staphylococcus
DQMQSWGWRIPFILGLFLGLFGLYLRRKLE

SEQ ID NO: 1871498 - protein, 25 aa, Staphylococcus
DQPAYHLMRQWHIFWGPPMIIISLF

SEQ ID NO: 1871499 - protein, 20 aa, Staphylococcus
DQQFPPRNAQRRQRRRNQAT

SEQ ID NO: 1871500 - protein, 19 aa, Staphylococcus
DQQFPPRNAQRRQRRRNQS

SEQ ID NO: 1871501 - protein, 18 aa, Staphylococcus
DQQPSILHRPDLSLQDAL

SEQ ID NO: 1871502 - protein, 22 aa, Staphylococcus
DQRADLKKIEYVYKTLNKDYYK

SEQ ID NO: 1871503 - protein, 17 aa, Staphylococcus
DQRLLQFSVINDGKQFT

SEQ ID NO: 1871504 - protein, 22 aa, Staphylococcus
DQSLEFAKIIGVVSGVIGSILT

SEQ ID NO: 1871505 - protein, 22 aa, Staphylococcus
DQYCGSCGNKLNGSLSQSTQST

SEQ ID NO: 1871506 - protein, 17 aa, Staphylococcus
DRAKFANTVLRSMFSLG

SEQ ID NO: 1871507 - protein, 18 aa, Staphylococcus
DRELKQKVLHFAGDDLIN

SEQ ID NO: 1871508 - protein, 19 aa, Staphylococcus
DRFLIIPILGAASMGIYFA

SEQ ID NO: 1871509 - protein, 23 aa, Staphylococcus
DRHRRNHEEGIDERQDNRNHKDQ

SEQ ID NO: 1871510 - protein, 23 aa, Staphylococcus
DRKRLLHAISIILVSMLTGLSFL

SEQ ID NO: 1871511 - protein, 23 aa, Staphylococcus
DRKSEGISLFSLSLVIGAAIGPF

SEQ ID NO: 1871512 - protein, 25 aa, Staphylococcus
DRLGRRRVVFVIAIVYIVGALILAL

SEQ ID NO: 1871513 - protein, 18 aa, Staphylococcus
DRLIVNKIKVTFNLLDTG

SEQ ID NO: 1871514 - protein, 19 aa, Staphylococcus
DRLKGEFKNVGTVIQAYLY

SEQ ID NO: 1871515 - protein, 18 aa, Staphylococcus
DRLKGEFRNVGTVIQGYL

SEQ ID NO: 1871516 - protein, 20 aa, Staphylococcus
DRPRFEKEWTGVNGGLIFVG

SEQ ID NO: 1871517 - protein, 20 aa, Staphylococcus
DRPSLKEGRYPNHSYEVAIN

SEQ ID NO: 1871518 - protein, 24 aa, Staphylococcus
DRQRALSFWSIGSWGGSGFASLFG

SEQ ID NO: 1871519 - protein, 23 aa, Staphylococcus
DRQRALSFWSIGSWGGSGLASIF

SEQ ID NO: 1871520 - protein, 22 aa, Staphylococcus
DRQRALSYWSIGSWGGSGICSY

SEQ ID NO: 1871521 - protein, 22 aa, Staphylococcus
DRRGRILSIVMMDRGMIPLGSV

SEQ ID NO: 1871522 - protein, 19 aa, Staphylococcus
DRRGRVRIINDMALKMLGM

SEQ ID NO: 1871523 - protein, 21 aa, Staphylococcus
DRRGRVRIVNDMAIKMLGMSK

SEQ ID NO: 1871524 - protein, 19 aa, Staphylococcus
DRRQMIGIWSGIVVIIIAS

SEQ ID NO: 1871525 - protein, 21 aa, Staphylococcus
DRSHIPTFYLHGYAGTGNSMK

SEQ ID NO: 1871526 - protein, 25 aa, Staphylococcus
DRTKLNTGASLAFYDVTSRYIDGSG

SEQ ID NO: 1871527 - protein, 17 aa, Staphylococcus
DRTSFITAMIKSRDLMY

SEQ ID NO: 1871528 - protein, 20 aa, Staphylococcus
DRTTLNYGRIFKDFGQLLKK

SEQ ID NO: 1871529 - protein, 23 aa, Staphylococcus
DRTYPFKYGYKNYIFKKDNEYYI

SEQ ID NO: 1871530 - protein, 24 aa, Staphylococcus
DRTYRFKLSYLYNISIILLSILVS

SEQ ID NO: 1871531 - protein, 24 aa, Staphylococcus
DRYKIIEFLGGGGMSNVYLAEDSI

SEQ ID NO: 1871532 - protein, 17 aa, Staphylococcus
DRYNWNYIISLTDLPLF

SEQ ID NO: 1871533 - protein, 17 aa, Staphylococcus
DRYSTRGLYIFSMAAFL

SEQ ID NO: 1871534 - protein, 32 aa, Staphylococcus
DSAFKVGPVWMTLRILAVVFVWMTYFKLGSKV

SEQ ID NO: 1871535 - protein, 17 aa, Staphylococcus
DSAHAGTGFAFASWVKP

SEQ ID NO: 1871536 - protein, 26 aa, Staphylococcus
DSDIVPWPTLFFGMFFNNLFFWCANQ

SEQ ID NO: 1871537 - protein, 31 aa, Staphylococcus
DSFFNYLFGMSRFLTYILVILGTVFITYSKK

SEQ ID NO: 1871538 - protein, 29 aa, Staphylococcus
DSFFNYLFGNSRFLTYILILIGTIFITYY

SEQ ID NO: 1871539 - protein, 20 aa, Staphylococcus
DSFFNYLFGYSRYLTYILVI

SEQ ID NO: 1871540 - protein, 19 aa, Staphylococcus
DSFTYNLINYFKMATQETV

SEQ ID NO: 1871541 - protein, 19 aa, Staphylococcus
DSGELRVGLSADYAPMEFE

SEQ ID NO: 1871542 - protein, 27 aa, Staphylococcus
DSGHFFWPAVIAFCLTGIGLPLLGVIV

SEQ ID NO: 1871543 - protein, 24 aa, Staphylococcus
DSGHFLWPAILAFALTGIGLPLLG

SEQ ID NO: 1871544 - protein, 21 aa, Staphylococcus
DSGIKGKEYLPFVNQSAISGI

SEQ ID NO: 1871545 - protein, 17 aa, Staphylococcus
DSGKYEPKVTPITKDFG

SEQ ID NO: 1871546 - protein, 22 aa, Staphylococcus
DSGMKGKEFLPFVNRSAIAGIL

SEQ ID NO: 1871547 - protein, 23 aa, Staphylococcus
DSGNYPVTTTVAGEAFNDNVQIN

SEQ ID NO: 1871548 - protein, 25 aa, Staphylococcus
DSIIANKNGGAWLLNKQVPHIVIDD

SEQ ID NO: 1871549 - protein, 23 aa, Staphylococcus
DSIICVGAIFLASSVGSTFSTVN

SEQ ID NO: 1871550 - protein, 23 aa, Staphylococcus
DSIICVGSIFLASSIGSTFSTVN

SEQ ID NO: 1871551 - protein, 18 aa, Staphylococcus
DSIVFRNTLIYAVIMAVA

SEQ ID NO: 1871552 - protein, 20 aa, Staphylococcus
DSKAFAVLYLWLVKLGEAKT

SEQ ID NO: 1871553 - protein, 20 aa, Staphylococcus
DSKLIDWGVLLVLGIFIGSY

SEQ ID NO: 1871554 - protein, 21 aa, Staphylococcus
DSKWQMSFTVNRQQQFKQQPK

SEQ ID NO: 1871555 - protein, 21 aa, Staphylococcus
DSKWQMSFTVNRQQQFKSQPE

SEQ ID NO: 1871556 - protein, 23 aa, Staphylococcus
DSLEWFKFFFEHVVAHTAGIFNI

SEQ ID NO: 1871557 - protein, 25 aa, Staphylococcus
DSLILIDFRLPRMLITILAGAALSM

SEQ ID NO: 1871558 - protein, 17 aa, Staphylococcus
DSLSLADSISESTSESV

SEQ ID NO: 1871559 - protein, 17 aa, Staphylococcus
DSLTAYHEQILKSLSKK

SEQ ID NO: 1871560 - protein, 24 aa, Staphylococcus
DSLTEFYVLVLFAGLFHLMNHAIF

SEQ ID NO: 1871561 - protein, 17 aa, Staphylococcus
DSLTVAIAGIFIMSLLL

SEQ ID NO: 1871562 - protein, 17 aa, Staphylococcus
DSLVFRNTLRYTVIIAV

SEQ ID NO: 1871563 - protein, 18 aa, Staphylococcus
DSLVVAISGVFILAVLIV

SEQ ID NO: 1871564 - protein, 17 aa, Staphylococcus
DSLVVAITGIFLLTVLL

SEQ ID NO: 1871565 - protein, 38 aa, Staphylococcus
DSNGNFSVSIPSGFNLTGKETISITAIDKGLNVSQPTT

SEQ ID NO: 1871566 - protein, 17 aa, Staphylococcus
DSNNLWDLFLLITGLFG

SEQ ID NO: 1871567 - protein, 25 aa, Staphylococcus
DSPEFIKQKWFGEQRSPVYVYKWED

SEQ ID NO: 1871568 - protein, 25 aa, Staphylococcus
DSPIASLLLCISICLIILNKQNSII

SEQ ID NO: 1871569 - protein, 24 aa, Staphylococcus
DSPNANGVTVYWLQDNQEALAQTL

SEQ ID NO: 1871570 - protein, 22 aa, Staphylococcus
DSPTTFIWVCIVTLIAQQLEGN

SEQ ID NO: 1871571 - protein, 18 aa, Staphylococcus
DSQIKWIFNILSYALPFV

SEQ ID NO: 1871572 - protein, 24 aa, Staphylococcus
DSQYFRFQYFNPLNAKEYYKNLDE

SEQ ID NO: 1871573 - protein, 20 aa, Staphylococcus
DSSGRVNITPTRPIPEGNVT

SEQ ID NO: 1871574 - protein, 17 aa, Staphylococcus
DSSLSFKGIAAAIIALS

SEQ ID NO: 1871575 - protein, 28 aa, Staphylococcus
DSSQTTIWASLLAFLGSTLLINRKNRKS

SEQ ID NO: 1871576 - protein, 19 aa, Staphylococcus
DSTAFAIVYLWLVKIGEAK

SEQ ID NO: 1871577 - protein, 27 aa, Staphylococcus
DSTGLFLLTRVGIFIGIYLVLFGVYYL

SEQ ID NO: 1871578 - protein, 25 aa, Staphylococcus
DSTKKMIFWIIIGIIGAALIIGIVY

SEQ ID NO: 1871579 - protein, 20 aa, Staphylococcus
DSTLKIPHYALVTITGENDN

SEQ ID NO: 1871580 - protein, 25 aa, Staphylococcus
DSVADWVSSIGYIFPLRYAGDALTN

SEQ ID NO: 1871581 - protein, 27 aa, Staphylococcus
DSVKEIPETATIVWFDFENATQAENDY

SEQ ID NO: 1871582 - protein, 21 aa, Staphylococcus
DSVLIQSGLNFGIRGDKKVVS

SEQ ID NO: 1871583 - protein, 24 aa, Staphylococcus
DSVLNILSTLGFIFLMFLSGLEID

SEQ ID NO: 1871584 - protein, 24 aa, Staphylococcus
DSVTKYLPWFKMKQPITLNQLMLH

SEQ ID NO: 1871585 - protein, 23 aa, Staphylococcus
DSYDVLMKAFQINAPVNPGNSGG

SEQ ID NO: 1871586 - protein, 20 aa, Staphylococcus
DSYEFYGHIQAGIITPTQKN

SEQ ID NO: 1871587 - protein, 18 aa, Staphylococcus
DSYLKSGQTMVVKKTNID

SEQ ID NO: 1871588 - protein, 18 aa, Staphylococcus
DTAKKLSSLITMKTDKIT

SEQ ID NO: 1871589 - protein, 18 aa, Staphylococcus
DTCIPNFLFYNIPLIIFG

SEQ ID NO: 1871590 - protein, 22 aa, Staphylococcus
DTDKLKGFVFPIVKKDELKKEF

SEQ ID NO: 1871591 - protein, 25 aa, Staphylococcus
DTDKSIVVDGQFTSVNAFKNLKIPA

SEQ ID NO: 1871592 - protein, 24 aa, Staphylococcus
DTEKSVVIDGQFTSVKALENLDIP

SEQ ID NO: 1871593 - protein, 17 aa, Staphylococcus
DTEVTFSDGTKVTIPKA

SEQ ID NO: 1871594 - protein, 17 aa, Staphylococcus
DTFTKRFVSILFIFTYV

SEQ ID NO: 1871595 - protein, 17 aa, Staphylococcus
DTFVIRGYEQFLYRLML

SEQ ID NO: 1871596 - protein, 19 aa, Staphylococcus
DTFVNTNFDVHIGDQIDAV

SEQ ID NO: 1871597 - protein, 17 aa, Staphylococcus
DTGEAIGLGASKLTLTF

SEQ ID NO: 1871598 - protein, 18 aa, Staphylococcus
DTGGLVFNDLLPTLVAVF

SEQ ID NO: 1871599 - protein, 18 aa, Staphylococcus
DTGGLVFYSLLPTLVAVF

SEQ ID NO: 1871600 - protein, 20 aa, Staphylococcus
DTHPAFYSSLVVLIVILILV

SEQ ID NO: 1871601 - protein, 20 aa, Staphylococcus
DTIGFFGIIRYYYKDILVCF

SEQ ID NO: 1871602 - protein, 25 aa, Staphylococcus
DTIIKKLFRLPAIKRFEDDEELLED

SEQ ID NO: 1871603 - protein, 24 aa, Staphylococcus
DTIIKKLFRLPAIKRFEEDEELLE

SEQ ID NO: 1871604 - protein, 18 aa, Staphylococcus
DTIIKRYTDIVFDHLKDD

SEQ ID NO: 1871605 - protein, 30 aa, Staphylococcus
DTIIYKVHLMKECLERGIDMISSMGAANKI

SEQ ID NO: 1871606 - protein, 30 aa, Staphylococcus
DTIIYKVHLMKECLERGIDMISSMGAANKT

SEQ ID NO: 1871607 - protein, 24 aa, Staphylococcus
DTINVEVMNAILFDDSVIVRSGRG

SEQ ID NO: 1871608 - protein, 19 aa, Staphylococcus
DTIPLLSFIFLKGRSRCCS

SEQ ID NO: 1871609 - protein, 39 aa, Staphylococcus
DTIQMKFERTLFALITAMLIIFVGVVIGYFVRRKNDKLK

SEQ ID NO: 1871610 - protein, 20 aa, Staphylococcus
DTKFSVFFKNMRHIFDNKGI

SEQ ID NO: 1871611 - protein, 23 aa, Staphylococcus
DTKLPWIVLYGFTGLLIPASLAT

SEQ ID NO: 1871612 - protein, 22 aa, Staphylococcus
DTKVTFSDGHIITIPKGKDGKS

SEQ ID NO: 1871613 - protein, 20 aa, Staphylococcus
DTLKNSLKYNAPSKPIIEIN

SEQ ID NO: 1871614 - protein, 18 aa, Staphylococcus
DTLMKLNPFWTILLSLLF

SEQ ID NO: 1871615 - protein, 18 aa, Staphylococcus
DTLMKLNPFWTILLSLVF

SEQ ID NO: 1871616 - protein, 31 aa, Staphylococcus
DTLPDGSRKVFFNDGHTAILPKGDKGDKGDT

SEQ ID NO: 1871617 - protein, 24 aa, Staphylococcus
DTMTRIAITLGHKESNSFVTNTVI

SEQ ID NO: 1871618 - protein, 22 aa, Staphylococcus
DTNHLLFGMGILAYTLGLRHAF

SEQ ID NO: 1871619 - protein, 23 aa, Staphylococcus
DTNSEYNTDCDYNTDSDYNSDCD

SEQ ID NO: 1871620 - protein, 26 aa, Staphylococcus
DTNYFKFQYFNPLKSRDYYKNLDKQV

SEQ ID NO: 1871621 - protein, 20 aa, Staphylococcus
DTPEAVILSGFDPIRREIAR

SEQ ID NO: 1871622 - protein, 25 aa, Staphylococcus
DTPEKAIRGGAEFIHKHFLSHDDQN

SEQ ID NO: 1871623 - protein, 20 aa, Staphylococcus
DTQLKHDFDEAITNAQQALD

SEQ ID NO: 1871624 - protein, 18 aa, Staphylococcus
DTSIEIFDAESSSNINPS

SEQ ID NO: 1871625 - protein, 24 aa, Staphylococcus
DTSILRYYFWFTILLVAVIVGLIV

SEQ ID NO: 1871626 - protein, 20 aa, Staphylococcus
DTSKYNVIIGDLDIPVRSGF

SEQ ID NO: 1871627 - protein, 23 aa, Staphylococcus
DTSLLKYYFWLTILVVVILVGIV

SEQ ID NO: 1871628 - protein, 24 aa, Staphylococcus
DTSLLKYYFWLTVVVVILLIVGIA

SEQ ID NO: 1871629 - protein, 23 aa, Staphylococcus
DTTPRINVVAFPKDISFDEAYDT

SEQ ID NO: 1871630 - protein, 18 aa, Staphylococcus
DTTRARAATSVPLASSLD

SEQ ID NO: 1871631 - protein, 24 aa, Staphylococcus
DTTVLRYYFWITIALITLIVASIA

SEQ ID NO: 1871632 - protein, 18 aa, Staphylococcus
DTVLYLMHKHHRITDKEY

SEQ ID NO: 1871633 - protein, 24 aa, Staphylococcus
DTVQPELNKAIHLLENKANNSELV

SEQ ID NO: 1871634 - protein, 19 aa, Staphylococcus
DVAAADRIYIIAAGTSYHA

SEQ ID NO: 1871635 - protein, 23 aa, Staphylococcus
DVAGKAFSSPVIDITSTPNTRVE

SEQ ID NO: 1871636 - protein, 22 aa, Staphylococcus
DVAHKPITLSFNFIGQTGTAIL

SEQ ID NO: 1871637 - protein, 30 aa, Staphylococcus
DVAIISSFHIFRIFFILFLIAPAIKYFLNY

SEQ ID NO: 1871638 - protein, 29 aa, Staphylococcus
DVAMISSFHIFRIFFILFIVAPIISYLLK

SEQ ID NO: 1871639 - protein, 29 aa, Staphylococcus
DVAMISSFHIFRIFFILFVVAPVIGFFLR

SEQ ID NO: 1871640 - protein, 26 aa, Staphylococcus
DVANKRKAYIKGLTNISEYNRNKAYK

SEQ ID NO: 1871641 - protein, 23 aa, Staphylococcus
DVATTLVLDFPVIVKPKADSNQT

SEQ ID NO: 1871642 - protein, 30 aa, Staphylococcus; identical to SEQ ID NO: 1736770

SEQ ID NO: 1871643 - protein, 26 aa, Staphylococcus
DVDPRKSASILDIFGSCFQGLLPYSP

SEQ ID NO: 1871644 - protein, 18 aa, Staphylococcus
DVDYGVAMNQEINDLESQ

SEQ ID NO: 1871645 - protein, 24 aa, Staphylococcus
DVEDARNPIVLKLLSILFTIVMAI

SEQ ID NO: 1871646 - protein, 24 aa, Staphylococcus
DVEDGRNPIVLKLLSVVFTVVMGL

SEQ ID NO: 1871647 - protein, 24 aa, Staphylococcus
DVEDSRNGFVLKILSVLYTLVLGI

SEQ ID NO: 1871648 - protein, 24 aa, Staphylococcus
DVEDSRNGILLKLLSVVFTVVMGV

SEQ ID NO: 1871649 - protein, 17 aa, Staphylococcus
DVFCGNCGTKLQSVTTE

SEQ ID NO: 1871650 - protein, 21 aa, Staphylococcus
DVILHRLGKLFAEIAKNVNSN

SEQ ID NO: 1871651 - protein, 21 aa, Staphylococcus
DVITVLPFGNLISQIEVKGSD

SEQ ID NO: 1871652 - protein, 18 aa, Staphylococcus
DVLEKFLKQSYFNQHQNI

SEQ ID NO: 1871653 - protein, 19 aa, Staphylococcus
DVLFREWIGRIISGVFANL

SEQ ID NO: 1871654 - protein, 20 aa, Staphylococcus
DVMFTSSIIYRIRKNAFSLT

SEQ ID NO: 1871655 - protein, 19 aa, Staphylococcus
DVNAIAFLKSNRIGIVISV

SEQ ID NO: 1871656 - protein, 20 aa, Staphylococcus
DVNIEFPLYMAIAVSLSGIV

SEQ ID NO: 1871657 - protein, 24 aa, Staphylococcus
DVPKHMKYAVLATEDNRFYHHGAL

SEQ ID NO: 1871658 - protein, 23 aa, Staphylococcus
DVPNDATIVWLDFEDATSEENDF

SEQ ID NO: 1871659 - protein, 22 aa, Staphylococcus
DVPSDATIIWYDFENASNKENE

SEQ ID NO: 1871660 - protein, 24 aa, Staphylococcus
DVQQRFDTIVAFLCIAFISKLLLY

SEQ ID NO: 1871661 - protein, 17 aa, Staphylococcus
DVRLVILHSEYRSIIRP

SEQ ID NO: 1871662 - protein, 17 aa, Staphylococcus
DVSDRYINIQAMMDDLS

SEQ ID NO: 1871663 - protein, 23 aa, Staphylococcus
DVSESVKSYVSRQISDKNEQTSY

SEQ ID NO: 1871664 - protein, 26 aa, Staphylococcus
DVSSDPNTRIELLDKDNHVIGSGTTD

SEQ ID NO: 1871665 - protein, 26 aa, Staphylococcus
DVSSDPNTRIELLDKDNHVIGTGTTG

SEQ ID NO: 1871666 - protein, 22 aa, Staphylococcus
DVSWGEWFMYAAPWSVLMSIAL

SEQ ID NO: 1871667 - protein, 25 aa, Staphylococcus
DVTPGSEVQLYFIGTSMGNTNGING

SEQ ID NO: 1871668 - protein, 22 aa, Staphylococcus
DVVARFGLKLLFGATLVSFISA

SEQ ID NO: 1871669 - protein, 18 aa, Staphylococcus
DVVFGRVVTDLVVVVLPV

SEQ ID NO: 1871670 - protein, 20 aa, Staphylococcus
DVVIGASFLIMFTAIGHLTG

SEQ ID NO: 1871671 - protein, 20 aa, Staphylococcus
DVVIGASFLIMFTALGHFTG

SEQ ID NO: 1871672 - protein, 23 aa, Staphylococcus
DVVIGASFLIMFTVLGHIFGLGL

SEQ ID NO: 1871673 - protein, 21 aa, Staphylococcus
DWDFVVCITDLPSISGNKVVI

SEQ ID NO: 1871674 - protein, 21 aa, Staphylococcus
DWINISLGWGLAVTLGVYAVG

SEQ ID NO: 1871675 - protein, 25 aa, Staphylococcus
DWIRIASKILPFIILLVIIFHIYAS

SEQ ID NO: 1871676 - protein, 35 aa, Staphylococcus
DWMSTWTLYYWGWWLSWSPFVGVFIARVSKGRSIR

SEQ ID NO: 1871677 - protein, 20 aa, Staphylococcus
DWTFVLAFIPWIMVIVPYLL

SEQ ID NO: 1871678 - protein, 19 aa, Staphylococcus
DYAAIALNVFLQGNTLVTY

SEQ ID NO: 1871679 - protein, 22 aa, Staphylococcus
DYAEGFIRRYASVVNIDSQQLI

SEQ ID NO: 1871680 - protein, 19 aa, Staphylococcus
DYAVPISIPLLLFSSNILK

SEQ ID NO: 1871681 - protein, 18 aa, Staphylococcus
DYDLGNFTGQFAVGSSVK

SEQ ID NO: 1871682 - protein, 19 aa, Staphylococcus
DYEGKIGPSEVLGGSSSEF

SEQ ID NO: 1871683 - protein, 20 aa, Staphylococcus
DYEIEVLNIFIINKILITYH

SEQ ID NO: 1871684 - protein, 21 aa, Staphylococcus
DYFLQFNWFQPLLIGLAAFLI

SEQ ID NO: 1871685 - protein, 29 aa, Staphylococcus
DYFVKSRFSKIFIPYIIWTVFYLLYRAFY

SEQ ID NO: 1871686 - protein, 26 aa, Staphylococcus
DYHWWVGGLLGVCFLTGNLLLLPRLG

SEQ ID NO: 1871687 - protein, 18 aa, Staphylococcus
DYIKRLIGKPGDTVKYKK

SEQ ID NO: 1871688 - protein, 19 aa, Staphylococcus
DYIVPLSIPLLLFSSNILK

SEQ ID NO: 1871689 - protein, 19 aa, Staphylococcus
DYKHPTWMLLFGIVAVIVT

SEQ ID NO: 1871690 - protein, 21 aa, Staphylococcus
DYKHPTWMLVFGIIAVIVTII

SEQ ID NO: 1871691 - protein, 24 aa, Staphylococcus
DYKHPTWMLVFGIIAVVVTIITGI

SEQ ID NO: 1871692 - protein, 21 aa, Staphylococcus
DYKHPTWMLVFGIVAVIVTII

SEQ ID NO: 1871693 - protein, 35 aa, Staphylococcus
DYLDIIKSFFKEHWPKIAIIIGVILLIIILNAIFT

SEQ ID NO: 1871694 - protein, 17 aa, Staphylococcus
DYLLIAGIIIPSSILYY

SEQ ID NO: 1871695 - protein, 20 aa, Staphylococcus
DYLLRVVEKWAVPKGLKISR

SEQ ID NO: 1871696 - protein, 20 aa, Staphylococcus
DYNLIKVIPYLLVLILALVG

SEQ ID NO: 1871697 - protein, 20 aa, Staphylococcus
DYNLIKVIPYVLVLVLALVG

SEQ ID NO: 1871698 - protein, 19 aa, Staphylococcus
DYPIFDWLVPLLIISLIYI

SEQ ID NO: 1871699 - protein, 18 aa, Staphylococcus
DYQNCIILTIQDNGIGMN

SEQ ID NO: 1871700 - protein, 17 aa, Staphylococcus
DYREMKRDVLANRHQFG

SEQ ID NO: 1871701 - protein, 19 aa, Staphylococcus
DYSLFILFRYKEIAKTEKD

SEQ ID NO: 1871702 - protein, 19 aa, Staphylococcus
DYSLFILFRYKEIKKSGTA

SEQ ID NO: 1871703 - protein, 20 aa, Staphylococcus
DYSLFILFRYKEIRKKGTPP

SEQ ID NO: 1871704 - protein, 24 aa, Staphylococcus
DYSQEAWSSMQNVLNASRQILNEN

SEQ ID NO: 1871705 - protein, 17 aa, Staphylococcus
DYSRLAGVSDTKSTDQS

SEQ ID NO: 1871706 - protein, 23 aa, Staphylococcus
DYSVEAWNNLQTALTNAKVVKNE

SEQ ID NO: 1871707 - protein, 17 aa, Staphylococcus
DYSYIGWVFSEEKLQKK

SEQ ID NO: 1871708 - protein, 21 aa, Staphylococcus
DYVKEGFVFSGSGDGFRQMMP

SEQ ID NO: 1871709 - protein, 17 aa, Staphylococcus
DYVKRVIGMPGDSIEYK

SEQ ID NO: 1871710 - protein, 18 aa, Staphylococcus
DYVKRVIGVPGDSVTYKK

SEQ ID NO: 1871711 - protein, 19 aa, Staphylococcus
DYYKGLRQGLLLIIPALIG

SEQ ID NO: 1871712 - protein, 24 aa, Staphylococcus
DYYLSNKGEVIFKLPSDKQSDKSK

SEQ ID NO: 1871713 - protein, 24 aa, Staphylococcus
DYYLSNKGEVIFRLPGDNKSSKSK

SEQ ID NO: 1871714 - protein, 22 aa, Staphylococcus
DYYLSNKGEVIFRLPNDNKSSK

SEQ ID NO: 1871715 - protein, 22 aa, Staphylococcus
DYYPRSFLEFNVMGDKKLSASQ

SEQ ID NO: 1871716 - protein, 21 aa, Staphylococcus
EAAAPLEKRIEAFEPELDQYD

SEQ ID NO: 1871717 - protein, 20 aa, Staphylococcus
EAAKQLRKLSSLTSPQSGDI

SEQ ID NO: 1871718 - protein, 25 aa, Staphylococcus
EADELFIRKPLRIYTWIMALIVYMT

SEQ ID NO: 1871719 - protein, 20 aa, Staphylococcus
EADIRKPLYSKRIYQNLTFD

SEQ ID NO: 1871720 - protein, 20 aa, Staphylococcus
EADQIFLLPFEKYMKRYMSL

SEQ ID NO: 1871721 - protein, 19 aa, Staphylococcus
EAEQILKDHHLTMGDISRK

SEQ ID NO: 1871722 - protein, 20 aa, Staphylococcus
EAFILFWKNYINFTGRARRA

SEQ ID NO: 1871723 - protein, 20 aa, Staphylococcus
EAFKLFWKNYFNFKGRSRRS

SEQ ID NO: 1871724 - protein, 19 aa, Staphylococcus
EAFVAANYAFAVIFITTQV

SEQ ID NO: 1871725 - protein, 28 aa, Staphylococcus
EAFVFYPRFKISISAFIIAMIWVFHNDI

SEQ ID NO: 1871726 - protein, 23 aa, Staphylococcus
EAGESKWSFAKLLNYGIDGLISF

SEQ ID NO: 1871727 - protein, 18 aa, Staphylococcus
EAGNKGWGSAEIVTMFII

SEQ ID NO: 1871728 - protein, 19 aa, Staphylococcus
EAGNKGWGSTEIIIMFIIG

SEQ ID NO: 1871729 - protein, 18 aa, Staphylococcus
EAGNKGWGSTEIIVMFIL

SEQ ID NO: 1871730 - protein, 18 aa, Staphylococcus
EAGNKGWGSTEIVSMFII

SEQ ID NO: 1871731 - protein, 18 aa, Staphylococcus
EAGNKGWGSTEIVTMFVI

SEQ ID NO: 1871732 - protein, 17 aa, Staphylococcus
EAGNLGWTNPLVYSMII

SEQ ID NO: 1871733 - protein, 22 aa, Staphylococcus
EAHKLEGLYMQRAFLDKLVQNN

SEQ ID NO: 1871734 - protein, 25 aa, Staphylococcus
EAIGLSNLWSHGGFMPNGWIGFFFA

SEQ ID NO: 1871735 - protein, 19 aa, Staphylococcus
EAIQMLCILIFSEDTTAAI

SEQ ID NO: 1871736 - protein, 22 aa, Staphylococcus
EAIVKPKYDATYKFKSDDKQKT

SEQ ID NO: 1871737 - protein, 22 aa, Staphylococcus
EAKDMKVSILVNEGSASASEVF

SEQ ID NO: 1871738 - protein, 25 aa, Staphylococcus
EAKEFYKVAGALLINIGTMTKANEQ

SEQ ID NO: 1871739 - protein, 20 aa, Staphylococcus
EAKISFSTIMDAIFHYNPKN

SEQ ID NO: 1871740 - protein, 18 aa, Staphylococcus
EAKTKLLVEDNMIVISCY

SEQ ID NO: 1871741 - protein, 24 aa, Staphylococcus
EALASFDLDWKKSRTRMPEMTYNF

SEQ ID NO: 1871742 - protein, 18 aa, Staphylococcus
EALERFSMDRARQSIRSL

SEQ ID NO: 1871743 - protein, 21 aa, Staphylococcus
EALKRIGLHKDTLVDVIFYCA

SEQ ID NO: 1871744 - protein, 24 aa, Staphylococcus
EALLSGYHAAFWFAVIISIISLIS

SEQ ID NO: 1871745 - protein, 17 aa, Staphylococcus
EALRMANKQSISGILYS

SEQ ID NO: 1871746 - protein, 19 aa, Staphylococcus
EALVRRNGQEIIIHVDDIA

SEQ ID NO: 1871747 - protein, 18 aa, Staphylococcus
EAMTALLIGRTISMTLLT

SEQ ID NO: 1871748 - protein, 20 aa, Staphylococcus
EANIRKPLYSKRIIQNLTLD

SEQ ID NO: 1871749 - protein, 24 aa, Staphylococcus
EAPIPGRSAVGIEVPNDKISLVAL

SEQ ID NO: 1871750 - protein, 24 aa, Staphylococcus
EAPIPGRSAVGIEVPNDKISLVSL

SEQ ID NO: 1871751 - protein, 19 aa, Staphylococcus
EAPYTIVFYFSFFSIVALI

SEQ ID NO: 1871752 - protein, 19 aa, Staphylococcus
EAPYTIVFYFSFFSIVVLI

SEQ ID NO: 1871753 - protein, 18 aa, Staphylococcus
EAQKMFIQEGIRMPQPLF

SEQ ID NO: 1871754 - protein, 28 aa, Staphylococcus
EAQVKPAAKAEIAQKVTDQEGVIQNTRG

SEQ ID NO: 1871755 - protein, 21 aa, Staphylococcus
EAQWYKFAVTLPVSRKQIVQS

SEQ ID NO: 1871756 - protein, 18 aa, Staphylococcus
EAQYLYTLVTNILSLTKL

SEQ ID NO: 1871757 - protein, 20 aa, Staphylococcus
EASLAYGQWPLPFNDLMPHN

SEQ ID NO: 1871758 - protein, 18 aa, Staphylococcus
EATFGRKRISGAPLTGKK

SEQ ID NO: 1871759 - protein, 31 aa, Staphylococcus
EATIRLKKIVPWAIGGFIIILLIIVFVLLKN

SEQ ID NO: 1871760 - protein, 19 aa, Staphylococcus
EAVKKLKNLGLKDIDVEQA

SEQ ID NO: 1871761 - protein, 17 aa, Staphylococcus
EAVNVLRSLPDLNKALG

SEQ ID NO: 1871762 - protein, 18 aa, Staphylococcus
EAVSAVQYMSSWPWDWAK

SEQ ID NO: 1871763 - protein, 32 aa, Staphylococcus
EAVSAVQYMSSWPWDWAKFMGKLMHNGTISTL

SEQ ID NO: 1871764 - protein, 20 aa, Staphylococcus
ECIHGIFFKIFSPRHKVHFG

SEQ ID NO: 1871765 - protein, 24 aa, Staphylococcus
EDAELRTGPSAAYPEIHSIDKGQN

SEQ ID NO: 1871766 - protein, 18 aa, Staphylococcus
EDAGDGQPVLQLISDNPQ

SEQ ID NO: 1871767 - protein, 18 aa, Staphylococcus
EDAHARLAREAKTSIKRR

SEQ ID NO: 1871768 - protein, 25 aa, Staphylococcus
EDDERFAIMLYDWRVIENELYLTNQ

SEQ ID NO: 1871769 - protein, 25 aa, Staphylococcus
EDEECFFLIMEYIDGPTLSEYIHSH

SEQ ID NO: 1871770 - protein, 22 aa, Staphylococcus
EDEGTFKWKAYQTYDNGDVVKW

SEQ ID NO: 1871771 - protein, 22 aa, Staphylococcus
EDEPERYYNGRDYRREQQLEEE

SEQ ID NO: 1871772 - protein, 27 aa, Staphylococcus
EDESIEAKKALLTEYVTSNSDVSEEEA

SEQ ID NO: 1871773 - protein, 21 aa, Staphylococcus
EDEVMACYDYVASIDNHYAVA

SEQ ID NO: 1871774 - protein, 18 aa, Staphylococcus
EDEVSVWIYALYSNINGD

SEQ ID NO: 1871775 - protein, 18 aa, Staphylococcus
EDFIPWDSLTHGILSWVN

SEQ ID NO: 1871776 - protein, 22 aa, Staphylococcus
EDFRYYPNFFHQTGQGKTSDAE

SEQ ID NO: 1871777 - protein, 29 aa, Staphylococcus
EDGKSELRRAPVLGLLQPDGIDTYDYNGE

SEQ ID NO: 1871778 - protein, 19 aa, Staphylococcus
EDGVGLPLLTALPIVSGML

SEQ ID NO: 1871779 - protein, 22 aa, Staphylococcus
EDGYYWFQGRVDDVIMTAGERV

SEQ ID NO: 1871780 - protein, 18 aa, Staphylococcus
EDHIKVPVTVGTDTVAPD

SEQ ID NO: 1871781 - protein, 24 aa, Staphylococcus
EDHKASEVARSFKIKDDKSTTISL

SEQ ID NO: 1871782 - protein, 23 aa, Staphylococcus
EDHVKRANAYFVNASLFNTPLQQ

SEQ ID NO: 1871783 - protein, 24 aa, Staphylococcus
EDINELKQRIALLEEINGGLKKYL

SEQ ID NO: 1871784 - protein, 30 aa, Staphylococcus
EDISKARWLYRIVAMITFATMFATIFKSFK

SEQ ID NO: 1871785 - protein, 25 aa, Staphylococcus
EDLILKRKVAIKAISIPPREKEETL

SEQ ID NO: 1871786 - protein, 23 aa, Staphylococcus
EDLKQRFAKRLLQFPHVHNKDYL

SEQ ID NO: 1871787 - protein, 24 aa, Staphylococcus
EDLPEGKSALGYGLEEATKVGLNA

SEQ ID NO: 1871788 - protein, 19 aa, Staphylococcus
EDLRNAKTYIHMEYYVLNL

SEQ ID NO: 1871789 - protein, 23 aa, Staphylococcus
EDMKTQMLIKYGDEYAQVYIDQQ

SEQ ID NO: 1871790 - protein, 33 aa, Staphylococcus
EDNRFYEHGALDYKRLFGAIGKNLTGGFGSQGA

SEQ ID NO: 1871791 - protein, 32 aa, Staphylococcus
EDNRFYEHGALDYKRLFGAVGKNLTGGFGSQG

SEQ ID NO: 1871792 - protein, 17 aa, Staphylococcus
EDQRVGSTILDSKTGGL

SEQ ID NO: 1871793 - protein, 22 aa, Staphylococcus
EDRRSGIQIYDLFNQANEGTTI

SEQ ID NO: 1871794 - protein, 24 aa, Staphylococcus
EDSFKLSTFFAGYLIGILVIYILH

SEQ ID NO: 1871795 - protein, 19 aa, Staphylococcus
EDSFLFSTFFSGYVIGIVV

SEQ ID NO: 1871796 - protein, 18 aa, Staphylococcus
EDSFSKFFDGSRETENFG

SEQ ID NO: 1871797 - protein, 19 aa, Staphylococcus
EDTGGLVFYDLLPTLVAVF

SEQ ID NO: 1871798 - protein, 25 aa, Staphylococcus
EDTMSRIAYSYGLDNTNSFVSNTAI

SEQ ID NO: 1871799 - protein, 24 aa, Staphylococcus
EDTMTRIAASYGLDDTYSFVTSTA

SEQ ID NO: 1871800 - protein, 22 aa, Staphylococcus
EDTRVALYFSPFWLLLLYVAYK

SEQ ID NO: 1871801 - protein, 24 aa, Staphylococcus
EDVFKRLFKLPPIKRFEEDEDLIE

SEQ ID NO: 1871802 - protein, 21 aa, Staphylococcus
EDVHFNDLFVAFKKGKYGKSL

SEQ ID NO: 1871803 - protein, 24 aa, Staphylococcus
EDVLKTRYTFILSPQELFFTKDGL

SEQ ID NO: 1871804 - protein, 23 aa, Staphylococcus
EDVPSKATIVWYDFEDATEKENE

SEQ ID NO: 1871805 - protein, 24 aa, Staphylococcus
EDYIKLGLRYSYFNRIILQIVLLI

SEQ ID NO: 1871806 - protein, 19 aa, Staphylococcus
EDYSRLAGVSDVDATNDSV

SEQ ID NO: 1871807 - protein, 20 aa, Staphylococcus
EEANLPSSVNNGVFVNDVKE

SEQ ID NO: 1871808 - protein, 24 aa, Staphylococcus
EEDDCFYLIMEYIDGPTLSEYIHT

SEQ ID NO: 1871809 - protein, 25 aa, Staphylococcus
EEDDCYFLVMEYIEGPTLSEYIQNH

SEQ ID NO: 1871810 - protein, 24 aa, Staphylococcus
EEDECFYLVMEYIEGPTLAEYIHS

SEQ ID NO: 1871811 - protein, 33 aa, Staphylococcus
EEDEKLATPRAISRIASPVMLAATDNVAAQESG

SEQ ID NO: 1871812 - protein, 17 aa, Staphylococcus
EEEEEKLNGKKNLHISD

SEQ ID NO: 1871813 - protein, 37 aa, Staphylococcus
EEEKKSKRKKGWFFGCGGCLVLLILIVIGISACTATF

SEQ ID NO: 1871814 - protein, 20 aa, Staphylococcus
EEFPHTVLWQSIFWAVLILL

SEQ ID NO: 1871815 - protein, 23 aa, Staphylococcus
EEFYKVAGALLINIGTLTKANEK

SEQ ID NO: 1871816 - protein, 28 aa, Staphylococcus
EEFYLKKIWVAIKFLAIYLYQLLTSSIS

SEQ ID NO: 1871817 - protein, 17 aa, Staphylococcus
EEGEAIDIILSKGPQKV

SEQ ID NO: 1871818 - protein, 20 aa, Staphylococcus
EEGLEVKLLYDAVGSKSVHK

SEQ ID NO: 1871819 - protein, 19 aa, Staphylococcus
EEIAIRRAFGAKARDIEIQ

SEQ ID NO: 1871820 - protein, 25 aa, Staphylococcus
EEIARQGYHFTVYVPYGNDWFAYFM

SEQ ID NO: 1871821 - protein, 20 aa, Staphylococcus
EEIGDLFSMKVIALATTAVG

SEQ ID NO: 1871822 - protein, 30 aa, Staphylococcus
EEIKDVRAITRFEIPDGYSIKDVTTEYARF

SEQ ID NO: 1871823 - protein, 17 aa, Staphylococcus
EEISLFYILAIINSKVF

SEQ ID NO: 1871824 - protein, 30 aa, Staphylococcus
EEKAKAKQMIKLLFEKAKIEIEKAKTSYEV

SEQ ID NO: 1871825 - protein, 22 aa, Staphylococcus
EEKARIKEMKKFKDHEAESVVT

SEQ ID NO: 1871826 - protein, 22 aa, Staphylococcus
EEKDAAKQLVARTQNNANQAIV

SEQ ID NO: 1871827 - protein, 25 aa, Staphylococcus
EEKFTRLGIALGIAVFIFVIVRPPI

SEQ ID NO: 1871828 - protein, 26 aa, Staphylococcus
EEKGEYRGGPAYYIQYGIKGRLGKIY

SEQ ID NO: 1871829 - protein, 26 aa, Staphylococcus
EEKILIALLLYRFAYYFVPVIIALIL

SEQ ID NO: 1871830 - protein, 20 aa, Staphylococcus
EEKLAYGIVLDDSITLNGDS

SEQ ID NO: 1871831 - protein, 22 aa, Staphylococcus
EEKQELIEIVDFLKDNKKFKDM

SEQ ID NO: 1871832 - protein, 22 aa, Staphylococcus
EEKQELIEIVDFLKDNKKFKKM

SEQ ID NO: 1871833 - protein, 22 aa, Staphylococcus
EEKQELIEIVDFLKDNKQFKQM

SEQ ID NO: 1871834 - protein, 26 aa, Staphylococcus
EELFKTRWIWPILFLDIVIVTPIVEE

SEQ ID NO: 1871835 - protein, 20 aa, Staphylococcus
EELGEVFAMKVIALSTAAVA

SEQ ID NO: 1871836 - protein, 17 aa, Staphylococcus
EELKLLIKESHEGGEIS

SEQ ID NO: 1871837 - protein, 18 aa, Staphylococcus
EELLEEFEEGLIRRHQAN

SEQ ID NO: 1871838 - protein, 23 aa, Staphylococcus
EELLEMYSNMYINVDLKDAPNTY

SEQ ID NO: 1871839 - protein, 21 aa, Staphylococcus
EENLFAITWLIGLLFIINGFI

SEQ ID NO: 1871840 - protein, 20 aa, Staphylococcus
EEPDFLIVIYHGGLNKISNK

SEQ ID NO: 1871841 - protein, 18 aa, Staphylococcus
EEQFRCIVPAYLPFRKAA

SEQ ID NO: 1871842 - protein, 20 aa, Staphylococcus
EERISELLGHIVWMNAIDYV

SEQ ID NO: 1871843 - protein, 30 aa, Staphylococcus
EERSRIAYSKLKFERRVGEFVENMRDFSIK

SEQ ID NO: 1871844 - protein, 21 aa, Staphylococcus
EESIYRFVDKHGKWFKLKGKD

SEQ ID NO: 1871845 - protein, 21 aa, Staphylococcus
EEVYRKLLASNLPSVPERFII

SEQ ID NO: 1871846 - protein, 25 aa, Staphylococcus
EEYSNVIGIPKWIQFLFIIIVAMVV

SEQ ID NO: 1871847 - protein, 25 aa, Staphylococcus
EEYSRVINIPKWIQFLFIVIVAMVI

SEQ ID NO: 1871848 - protein, 19 aa, Staphylococcus
EEYVFRKVFFGELYDRIKG

SEQ ID NO: 1871849 - protein, 19 aa, Staphylococcus
EFAFMIGVSIALIINYKSV

SEQ ID NO: 1871850 - protein, 19 aa, Staphylococcus
EFARGMYVLSYVNYLPTVT

SEQ ID NO: 1871851 - protein, 18 aa, Staphylococcus
EFDLRVLMDAMYELNDGK

SEQ ID NO: 1871852 - protein, 31 aa, Staphylococcus
EFFQIIHPFIPFSYAVDALREAVGGYVPEIL

SEQ ID NO: 1871853 - protein, 30 aa, Staphylococcus
EFFQVIHPYLPFSYSIDALREAVGGPVPEI

SEQ ID NO: 1871854 - protein, 19 aa, Staphylococcus
EFGHYFVFLIALNFGYSIT

SEQ ID NO: 1871855 - protein, 23 aa, Staphylococcus
EFHREQTKFFGMGPALTAMGQRW

SEQ ID NO: 1871856 - protein, 23 aa, Staphylococcus
EFHVKPNPLYNRMTIRIKDNGIG

SEQ ID NO: 1871857 - protein, 18 aa, Staphylococcus
EFIEFPIVAANPDKEGSF

SEQ ID NO: 1871858 - protein, 36 aa, Staphylococcus
EFIGNRVHPKFGFIFAVCIYLSIGALYGIPRAANVA

SEQ ID NO: 1871859 - protein, 32 aa, Staphylococcus
EFIIYKFGSDSIRVYRTEIEMEQDLNQLGEHI

SEQ ID NO: 1871860 - protein, 18 aa, Staphylococcus
EFINVAAPTNNEIESIFL

SEQ ID NO: 1871861 - protein, 19 aa, Staphylococcus
EFIPKKPWHNFLHNQTSLR

SEQ ID NO: 1871862 - protein, 25 aa, Staphylococcus
EFISKLKALVNRIHMQVNDSETNEE

SEQ ID NO: 1871863 - protein, 19 aa, Staphylococcus
EFKVPKGIEDHLFRITQEA

SEQ ID NO: 1871864 - protein, 20 aa, Staphylococcus
EFKVPKGLEDHLFRITQEAI

SEQ ID NO: 1871865 - protein, 19 aa, Staphylococcus
EFLSTPFVILFFVLEQFAR

SEQ ID NO: 1871866 - protein, 24 aa, Staphylococcus
EFLTRYKALIITAFNDKVTFDSLV

SEQ ID NO: 1871867 - protein, 22 aa, Staphylococcus
EFLVHLHLLPIVSIIVEPAKIL

SEQ ID NO: 1871868 - protein, 24 aa, Staphylococcus
EFMALVPLLACLTFFYHRNPHKRK

SEQ ID NO: 1871869 - protein, 20 aa, Staphylococcus
EFNDGSLLKYTEMKWLTPDG

SEQ ID NO: 1871870 - protein, 22 aa, Staphylococcus
EFNFIPHLILLYILLITIYRGF

SEQ ID NO: 1871871 - protein, 20 aa, Staphylococcus
EFNIPSGKDLEWAKVSNEKY

SEQ ID NO: 1871872 - protein, 24 aa, Staphylococcus
EFNIQLPLIKKFILKMTRHNHDST

SEQ ID NO: 1871873 - protein, 20 aa, Staphylococcus
EFPLYMSIIVMLFGVVIIFI

SEQ ID NO: 1871874 - protein, 19 aa, Staphylococcus
EFQDLKLLVQTMNKADADV

SEQ ID NO: 1871875 - protein, 19 aa, Staphylococcus
EFSNFSWASMLFCAGIGSD

SEQ ID NO: 1871876 - protein, 25 aa, Staphylococcus
EFTKEHKRLLLGSVFLMATSAIGPA

SEQ ID NO: 1871877 - protein, 20 aa, Staphylococcus
EFVIAIRFLLGIAGALIMPT

SEQ ID NO: 1871878 - protein, 34 aa, Staphylococcus
EFVSRKRADHDLKMGKYYAAMYIPEKFTHQITGT

SEQ ID NO: 1871879 - protein, 24 aa, Staphylococcus
EFVTAVEVPEAFVEQYKASSNHQQ

SEQ ID NO: 1871880 - protein, 17 aa, Staphylococcus
EFYICRFIIGKQPYKLD

SEQ ID NO: 1871881 - protein, 24 aa, Staphylococcus
EGAAVSKILALKAMLRSIPNRHRT

SEQ ID NO: 1871882 - protein, 33 aa, Staphylococcus
EGAETIDIILLLAFLILMIFSIYKLVKIKKMNE

SEQ ID NO: 1871883 - protein, 18 aa, Staphylococcus
EGAIPFAAADPIRVIPSM

SEQ ID NO: 1871884 - protein, 22 aa, Staphylococcus
EGFEVFKGNLLSSNDRIYSDLL

SEQ ID NO: 1871885 - protein, 24 aa, Staphylococcus
EGFQEVYHSLLLLIAVSSSILNFG

SEQ ID NO: 1871886 - protein, 17 aa, Staphylococcus
EGIIMKYAKAVNTDSSI

SEQ ID NO: 1871887 - protein, 18 aa, Staphylococcus
EGISTWERGLKYFPNSSV

SEQ ID NO: 1871888 - protein, 22 aa, Staphylococcus
EGKAIPHWNLFGLDINQVGYQG

SEQ ID NO: 1871889 - protein, 21 aa, Staphylococcus
EGKFVGMGNLVGQFREEMKGM

SEQ ID NO: 1871890 - protein, 24 aa, Staphylococcus
EGKRKKSLLYEWARINELLDKQLY

SEQ ID NO: 1871891 - protein, 19 aa, Staphylococcus
EGKYAFKAIQTYDNDDKVK

SEQ ID NO: 1871892 - protein, 19 aa, Staphylococcus
EGLHFILYAFLVVWLTDTG

SEQ ID NO: 1871893 - protein, 19 aa, Staphylococcus
EGLHYILFAFLIVWLTDTG

SEQ ID NO: 1871894 - protein, 19 aa, Staphylococcus
EGLHYILYAFLIVWLTDTG

SEQ ID NO: 1871895 - protein, 19 aa, Staphylococcus
EGLKRPYAIVYPTSADGSF

SEQ ID NO: 1871896 - protein, 26 aa, Staphylococcus
EGLKTTEIITVILILAILFLVFRSVV

SEQ ID NO: 1871897 - protein, 18 aa, Staphylococcus
EGLLKYSIPITIVTFILG

SEQ ID NO: 1871898 - protein, 17 aa, Staphylococcus
EGLSLKSHYLYGNADST

SEQ ID NO: 1871899 - protein, 17 aa, Staphylococcus
EGLYWRIAGCIIGALFV

SEQ ID NO: 1871900 - protein, 36 aa, Staphylococcus
EGMFPIELSAQFFRWIHPFSPMSYAIQGYREAIFTN

SEQ ID NO: 1871901 - protein, 20 aa, Staphylococcus
EGNLIYTFTDYVTNKNNITG

SEQ ID NO: 1871902 - protein, 18 aa, Staphylococcus
EGNLPILAGGLFILGVLL

SEQ ID NO: 1871903 - protein, 31 aa, Staphylococcus
EGNNKFAFTLTCIFVSWIWFIFLALVGKSVG

SEQ ID NO: 1871904 - protein, 24 aa, Staphylococcus
EGQGGIQDDGLWYFIPNDDSKQSA

SEQ ID NO: 1871905 - protein, 20 aa, Staphylococcus
EGQKLLNLVLVYAILMLMFF

SEQ ID NO: 1871906 - protein, 27 aa, Staphylococcus
EGRTRRKDFWWPVLFNMICLLMIAIIA

SEQ ID NO: 1871907 - protein, 19 aa, Staphylococcus
EGSNMSPILLAWIVAAVLR

SEQ ID NO: 1871908 - protein, 28 aa, Staphylococcus
EGSSVPWLPAAIGFLLGGLFIRGLDLVI

SEQ ID NO: 1871909 - protein, 20 aa, Staphylococcus
EGSTMSPILLAWIVAAVLRI

SEQ ID NO: 1871910 - protein, 20 aa, Staphylococcus
EGSTMSPILLAWIVAAVLRL

SEQ ID NO: 1871911 - protein, 19 aa, Staphylococcus
EGSTMSPILLAWIVTAVLR

SEQ ID NO: 1871912 - protein, 18 aa, Staphylococcus
EGTNWFKIWSVIESGGWT

SEQ ID NO: 1871913 - protein, 17 aa, Staphylococcus
EGTTVKLTIKRGSQEKE

SEQ ID NO: 1871914 - protein, 20 aa, Staphylococcus
EGTYRFKIKGIYGENYHTLK

SEQ ID NO: 1871915 - protein, 28 aa, Staphylococcus
EGVEKAFAIQAGREIRVIVSPEEIDDLK

SEQ ID NO: 1871916 - protein, 18 aa, Staphylococcus
EGVNFVFGGFKLDPKNPP

SEQ ID NO: 1871917 - protein, 19 aa, Staphylococcus
EGVQAYKAAVDSLPESERA

SEQ ID NO: 1871918 - protein, 29 aa, Staphylococcus
EGVRFILIIRRWDKGHWKMKLAQIGVHLH

SEQ ID NO: 1871919 - protein, 20 aa, Staphylococcus
EGYHFTVYVPFGDDWFAYFM

SEQ ID NO: 1871920 - protein, 21 aa, Staphylococcus
EHAGWLGGALYGFFYAPLVIT

SEQ ID NO: 1871921 - protein, 18 aa, Staphylococcus
EHAGWLGGFLYGLLYGPL

SEQ ID NO: 1871922 - protein, 18 aa, Staphylococcus
EHFIFKLGIIQISTESIV

SEQ ID NO: 1871923 - protein, 25 aa, Staphylococcus
EHKLIEFIGFLGISYVTFKSVQLIM

SEQ ID NO: 1871924 - protein, 30 aa, Staphylococcus
EHKYILPATICFSWICLFIAQWVVEHLFEA

SEQ ID NO: 1871925 - protein, 18 aa, Staphylococcus
EHLDRIRLSFFKYHNSDS

SEQ ID NO: 1871926 - protein, 20 aa, Staphylococcus
EHLDRLRISFFTYHRSDSDI

SEQ ID NO: 1871927 - protein, 25 aa, Staphylococcus
EHLTWRSVFYVVFPIAIIIIIASIF

SEQ ID NO: 1871928 - protein, 29 aa, Staphylococcus
EHPDLMLDSGDAFQGLPISNNTKGADMAK

SEQ ID NO: 1871929 - protein, 22 aa, Staphylococcus
EHPILTLLGTILIIVAIAIVIY

SEQ ID NO: 1871930 - protein, 20 aa, Staphylococcus
EHPLAEAIVSYAKEKSLEFL

SEQ ID NO: 1871931 - protein, 24 aa, Staphylococcus
EHTGRYAYVITMLRRNGYHVIMGD

SEQ ID NO: 1871932 - protein, 32 aa, Staphylococcus
EHTHFPNFGGGLIGFYLFKLLIPLISIAGVII

SEQ ID NO: 1871933 - protein, 22 aa, Staphylococcus
EHYETLPGHGIKAIINNKTLFI

SEQ ID NO: 1871934 - protein, 17 aa, Staphylococcus
EIAIRRAFGATGKNIEV

SEQ ID NO: 1871935 - protein, 25 aa, Staphylococcus
EIAKQARLNIERGVHNDDVKVAKDK

SEQ ID NO: 1871936 - protein, 21 aa, Staphylococcus
EIANFSGLLGRVLTEMRLVKI

SEQ ID NO: 1871937 - protein, 24 aa, Staphylococcus
EIDEVKQGFKMAFNEKDGTGYASF

SEQ ID NO: 1871938 - protein, 18 aa, Staphylococcus
EIEFNRVVTGTVDNPSNA

SEQ ID NO: 1871939 - protein, 19 aa, Staphylococcus
EIEGVLSIIGSLCSIIGFI

SEQ ID NO: 1871940 - protein, 17 aa, Staphylococcus
EIFQFFTSNGIYGIAGI

SEQ ID NO: 1871941 - protein, 19 aa, Staphylococcus
EIFSPRRVMTFAFIIWMIF

SEQ ID NO: 1871942 - protein, 19 aa, Staphylococcus
EIFTMVISIILYVIAVVSF

SEQ ID NO: 1871943 - protein, 30 aa, Staphylococcus
EIGGGYLIWLWLREGHTYWLGLMGGIILIL

SEQ ID NO: 1871944 - protein, 22 aa, Staphylococcus
EIGGGYLIWLWLREGQPSWLGV

SEQ ID NO: 1871945 - protein, 20 aa, Staphylococcus
EIGILKAIGIRTRHLLWSLV

SEQ ID NO: 1871946 - protein, 20 aa, Staphylococcus
EIGKGTTFILIFPKQNEIMK

SEQ ID NO: 1871947 - protein, 22 aa, Staphylococcus
EIGSVAELKRSIYIDPNKGLTV

SEQ ID NO: 1871948 - protein, 24 aa, Staphylococcus
EIHDLLLHFFLKFNNYKWFIPSLS

SEQ ID NO: 1871949 - protein, 24 aa, Staphylococcus
EIHEQPAVMRRIIQEYQDEEGNLK

SEQ ID NO: 1871950 - protein, 24 aa, Staphylococcus
EIHEQPAVMRRIIQEYQDNEGNLK

SEQ ID NO: 1871951 - protein, 25 aa, Staphylococcus
EIHHSASIWPIDFQHAALFSTLLLG

SEQ ID NO: 1871952 - protein, 17 aa, Staphylococcus
EIIKFIIVGGINTLDYY

SEQ ID NO: 1871953 - protein, 19 aa, Staphylococcus
EIIKFIIVGGVNTFNYYVV

SEQ ID NO: 1871954 - protein, 17 aa, Staphylococcus
EIIKFVIVGGINTLDYY

SEQ ID NO: 1871955 - protein, 17 aa, Staphylococcus
EIIKFVIVGGINTLNYY

SEQ ID NO: 1871956 - protein, 18 aa, Staphylococcus
EIILQIVLVVAISIIGSL

SEQ ID NO: 1871957 - protein, 22 aa, Staphylococcus
EIIPSYRAIMVTFDQHKIDIDE

SEQ ID NO: 1871958 - protein, 19 aa, Staphylococcus
EIIQMLCILLFSDNTEHAW

SEQ ID NO: 1871959 - protein, 20 aa, Staphylococcus
EIISHGGFKRHKKSASTLKT

SEQ ID NO: 1871960 - protein, 27 aa, Staphylococcus
EIISIGSFLTLLGIISFYSAAIYIITK

SEQ ID NO: 1871961 - protein, 23 aa, Staphylococcus
EIIYTYLNIVPFGRDYNGANISG

SEQ ID NO: 1871962 - protein, 19 aa, Staphylococcus
EIKKRGVLKVGLSADYAPL

SEQ ID NO: 1871963 - protein, 19 aa, Staphylococcus
EILAFRIIFSAIFMIFILI

SEQ ID NO: 1871964 - protein, 25 aa, Staphylococcus
EILDRLKGNIVMRFLIASVVSSLLF

SEQ ID NO: 1871965 - protein, 18 aa, Staphylococcus
EILISAIIFILASLSDFA

SEQ ID NO: 1871966 - protein, 25 aa, Staphylococcus
EILLLKITSFIPFLAPFELLVRAQS

SEQ ID NO: 1871967 - protein, 25 aa, Staphylococcus
EILNPALQIMVYWLVFGLGIRSNAP

SEQ ID NO: 1871968 - protein, 21 aa, Staphylococcus
EILRFIIVGGINTLNYYIVYL

SEQ ID NO: 1871969 - protein, 18 aa, Staphylococcus
EILSRYGKHANYYIETKS

SEQ ID NO: 1871970 - protein, 19 aa, Staphylococcus
EILVTVLIAVIFAIIYNLW

SEQ ID NO: 1871971 - protein, 19 aa, Staphylococcus
EILVTVLIAVVFAIIYNLW

SEQ ID NO: 1871972 - protein, 28 aa, Staphylococcus
EILYISLRLSLIKVLKPYYHLPIIVDDA

SEQ ID NO: 1871973 - protein, 19 aa, Staphylococcus
EILYSYVIGIVSLFTGLII

SEQ ID NO: 1871974 - protein, 18 aa, Staphylococcus
EIMIAAWAIALGAIAPML

SEQ ID NO: 1871975 - protein, 20 aa, Staphylococcus
EINARSAIVSAEYRTNARTI

SEQ ID NO: 1871976 - protein, 24 aa, Staphylococcus
EINEQPAVMRRIIQEYEDEKGDLK

SEQ ID NO: 1871977 - protein, 24 aa, Staphylococcus
EINEQPAVMRRIIQEYEDENGDLN

SEQ ID NO: 1871978 - protein, 19 aa, Staphylococcus
EINIAKALVEKLLNQALAQ

SEQ ID NO: 1871979 - protein, 20 aa, Staphylococcus
EINKQFPFSRIEKTEVHLKE

SEQ ID NO: 1871980 - protein, 20 aa, Staphylococcus
EIPEHKSAYDQALQQAQSII

SEQ ID NO: 1871981 - protein, 21 aa, Staphylococcus
EIPKEATLIWYDFNDPTEIEN

SEQ ID NO: 1871982 - protein, 24 aa, Staphylococcus
EIPNFRILRKIGYTHQDMLKGLGL

SEQ ID NO: 1871983 - protein, 18 aa, Staphylococcus
EIRIPRDIGAILVGVALG

SEQ ID NO: 1871984 - protein, 18 aa, Staphylococcus
EIRIPRDLGAILVGMALA

SEQ ID NO: 1871985 - protein, 18 aa, Staphylococcus
EIRIPRDLGAILVGMALS

SEQ ID NO: 1871986 - protein, 19 aa, Staphylococcus
EIRLPRLLTSLNQQSISPE

SEQ ID NO: 1871987 - protein, 18 aa, Staphylococcus
EISFDFKIKAGKADTRNA

SEQ ID NO: 1871988 - protein, 23 aa, Staphylococcus
EITEYRLPYLDVMDVSSRREHTY

SEQ ID NO: 1871989 - protein, 19 aa, Staphylococcus
EITMPLIFQKADEILNHNH

SEQ ID NO: 1871990 - protein, 21 aa, Staphylococcus
EIVEAHHGRIWANSVEGQGTS

SEQ ID NO: 1871991 - protein, 23 aa, Staphylococcus
EIVKIYVKYLLKHHWEYNQDNPK

SEQ ID NO: 1871992 - protein, 25 aa, Staphylococcus
EIVKYNPKNGYAYSVNGDKEALDII

SEQ ID NO: 1871993 - protein, 20 aa, Staphylococcus
EIVWGLAVVEIIFAVIVVAL

SEQ ID NO: 1871994 - protein, 24 aa, Staphylococcus
EKAIKAICTCLKHSTHYTSQQMRF

SEQ ID NO: 1871995 - protein, 17 aa, Staphylococcus
EKAKLIIALNNYMPDIE

SEQ ID NO: 1871996 - protein, 18 aa, Staphylococcus
EKAKLILALNEYMPNIEK

SEQ ID NO: 1871997 - protein, 25 aa, Staphylococcus
EKAKRSGAMSSRIAMLSIIDILYIC

SEQ ID NO: 1871998 - protein, 26 aa, Staphylococcus
EKAQWIYRMIAFYTFVTIAYIIYKSF

SEQ ID NO: 1871999 - protein, 22 aa, Staphylococcus
EKDAYEFYGKVQAGITTPTQKT

SEQ ID NO: 1872000 - protein, 22 aa, Staphylococcus
EKDAYEFYGKVQAGITTPTQRS

SEQ ID NO: 1872001 - protein, 19 aa, Staphylococcus
EKDIYGWEADITYAVDDQR

SEQ ID NO: 1872002 - protein, 19 aa, Staphylococcus
EKDTALTLLKATFDEKVRD

SEQ ID NO: 1872003 - protein, 23 aa, Staphylococcus
EKEATVIIKPRIEATKVEINFKN

SEQ ID NO: 1872004 - protein, 26 aa, Staphylococcus
EKEDRYGRTLAYVWLDDKTMYNEQLV

SEQ ID NO: 1872005 - protein, 20 aa, Staphylococcus
EKEGTLAMDFFNHDPKAHAK

SEQ ID NO: 1872006 - protein, 18 aa, Staphylococcus
EKELAHYTIKGMDGQIYT

SEQ ID NO: 1872007 - protein, 18 aa, Staphylococcus
EKELERQEREAAKAQQEE

SEQ ID NO: 1872008 - protein, 23 aa, Staphylococcus
EKEPRLEPRLGNQYGGKLTLILD

SEQ ID NO: 1872009 - protein, 24 aa, Staphylococcus
EKEPRLEPRLGNQYGGKLTLILDD

SEQ ID NO: 1872010 - protein, 23 aa, Staphylococcus
EKEPRLEPRMGNQYGGKLTLILD

SEQ ID NO: 1872011 - protein, 19 aa, Staphylococcus
EKFGRIRTILCGLVGLVII

SEQ ID NO: 1872012 - protein, 20 aa, Staphylococcus
EKFGRIRTILFGLIGLVIIC

SEQ ID NO: 1872013 - protein, 20 aa, Staphylococcus
EKFIQILWFYLIFFLFFGLL

SEQ ID NO: 1872014 - protein, 20 aa, Staphylococcus
EKFIRPNAKYDYQFQTYFDN

SEQ ID NO: 1872015 - protein, 30 aa, Staphylococcus
EKFQWLQNWTIFYWAWWVSWAPFVGIFIAR

SEQ ID NO: 1872016 - protein, 24 aa, Staphylococcus
EKFSHLAIAIGIALFIFVIVRPPI

SEQ ID NO: 1872017 - protein, 24 aa, Staphylococcus
EKFTRLFKMIYLRFKARKNRKKEE

SEQ ID NO: 1872018 - protein, 25 aa, Staphylococcus
EKGNRYYNDRDFRREQLLEEENEKN

SEQ ID NO: 1872019 - protein, 25 aa, Staphylococcus
EKGQYRGGPAFYIEYGIKGKLGKVY

SEQ ID NO: 1872020 - protein, 32 aa, Staphylococcus
EKGTNFRFTTLNGRWNAGRNVIVYQRNYASLP

SEQ ID NO: 1872021 - protein, 21 aa, Staphylococcus
EKGVKMWRFYAFSFIGILCFF

SEQ ID NO: 1872022 - protein, 18 aa, Staphylococcus
EKHHEILKRDITLTDKDN

SEQ ID NO: 1872023 - protein, 28 aa, Staphylococcus
EKHNLRNIPTLIVVVAFVLFVFMTIAFL

SEQ ID NO: 1872024 - protein, 24 aa, Staphylococcus
EKHWDFAICVTDLPSISGKKVVVS

SEQ ID NO: 1872025 - protein, 22 aa, Staphylococcus
EKIAHAYAYGGPNMAVNSLEKL

SEQ ID NO: 1872026 - protein, 17 aa, Staphylococcus
EKIKTNVAMNWYFIAAS

SEQ ID NO: 1872027 - protein, 18 aa, Staphylococcus
EKKEWKNIMLSTGEASIT

SEQ ID NO: 1872028 - protein, 19 aa, Staphylococcus
EKKFHPFVAAIAVGLIALL

SEQ ID NO: 1872029 - protein, 29 aa, Staphylococcus
EKKKHIFSFSETRFMRFLGGNDLIYGLVA

SEQ ID NO: 1872030 - protein, 22 aa, Staphylococcus
EKKQFLTLTFICKLIIVLLMLM

SEQ ID NO: 1872031 - protein, 25 aa, Staphylococcus
EKKRKEKQRQEEEWANQQAAEQERQ

SEQ ID NO: 1872032 - protein, 24 aa, Staphylococcus
EKKRLKWGSLLFHLGVIPVFFGHV

SEQ ID NO: 1872033 - protein, 20 aa, Staphylococcus
EKKTALDLEIERELLEMMEN

SEQ ID NO: 1872034 - protein, 26 aa, Staphylococcus
EKKTKKRTALTFIVSVCALFVIIYFN

SEQ ID NO: 1872035 - protein, 21 aa, Staphylococcus
EKKYKMTMLKPMKYNNTYALA

SEQ ID NO: 1872036 - protein, 17 aa, Staphylococcus
EKLAYGLALNGKIHLHG

SEQ ID NO: 1872037 - protein, 20 aa, Staphylococcus
EKLKEAKALDNAMKQLEDQV

SEQ ID NO: 1872038 - protein, 38 aa, Staphylococcus
EKLNEAIPVFAGVIVLLAFVLLVFVFRSILVPLKAVLG

SEQ ID NO: 1872039 - protein, 24 aa, Staphylococcus
EKLPEGKTALGYGFEEATIVGLKA

SEQ ID NO: 1872040 - protein, 23 aa, Staphylococcus
EKLPKKTKIILTIIILLVAILGS

SEQ ID NO: 1872041 - protein, 26 aa, Staphylococcus
EKLRAQIELTILFSLFAIISNFTGIE

SEQ ID NO: 1872042 - protein, 26 aa, Staphylococcus
EKLTLVRGFIAWFYTLLWSAIGFIWI

SEQ ID NO: 1872043 - protein, 18 aa, Staphylococcus
EKLYRFVDKYGKWIKLKG

SEQ ID NO: 1872044 - protein, 18 aa, Staphylococcus
EKMSELPNLTTFPLKEGT

SEQ ID NO: 1872045 - protein, 20 aa, Staphylococcus
EKMVFPFIIASGFIADTTSL

SEQ ID NO: 1872046 - protein, 29 aa, Staphylococcus
EKNDAMNVLDPRKNEAYNNIDQALTNDEV

SEQ ID NO: 1872047 - protein, 18 aa, Staphylococcus
EKNYKFIKHIMVGLLSII

SEQ ID NO: 1872048 - protein, 22 aa, Staphylococcus
EKPKPAQWAFLSLQHLFAMFGA

SEQ ID NO: 1872049 - protein, 17 aa, Staphylococcus
EKPKYFWIAIVGVIIAF

SEQ ID NO: 1872050 - protein, 20 aa, Staphylococcus
EKQDGFFFNTFVQPMKHLLQ

SEQ ID NO: 1872051 - protein, 18 aa, Staphylococcus
EKQELVEIVDFLKDNKKF

SEQ ID NO: 1872052 - protein, 25 aa, Staphylococcus
EKQRNMMGNAMMNRSFDQYSYKKVL

SEQ ID NO: 1872053 - protein, 27 aa, Staphylococcus
EKQTVKRKVVVQLTRFEKVLYITLITV

SEQ ID NO: 1872054 - protein, 48 aa, Staphylococcus
EKRQQLHSIRKFKVGTASILIGVTLIFGVPKVAYAEEMQAIQSNKQAN

SEQ ID NO: 1872055 - protein, 21 aa, Staphylococcus
EKRTGNLIAISSLVFSFLLVF

SEQ ID NO: 1872056 - protein, 18 aa, Staphylococcus
EKRYHPFVAGIAVGLIAL

SEQ ID NO: 1872057 - protein, 18 aa, Staphylococcus
EKRYHPFVAGIIVGLIAL

SEQ ID NO: 1872058 - protein, 18 aa, Staphylococcus
EKRYHPFVAGIVVGLIAL

SEQ ID NO: 1872059 - protein, 28 aa, Staphylococcus
EKSARPVAEIILRLMKVSAVAITNKTDI

SEQ ID NO: 1872060 - protein, 19 aa, Staphylococcus
EKSIKRFGAKRAMVVGPIF

SEQ ID NO: 1872061 - protein, 20 aa, Staphylococcus
EKSIRISIEVPDPIEKIEMP

SEQ ID NO: 1872062 - protein, 21 aa, Staphylococcus
EKSKLKIALKEAGSGLITGFV

SEQ ID NO: 1872063 - protein, 21 aa, Staphylococcus
EKSNVTLIDWCKRSEGHTEYF

SEQ ID NO: 1872064 - protein, 27 aa, Staphylococcus
EKTFFPFFLCIGILYLSISIQYSLHLN

SEQ ID NO: 1872065 - protein, 20 aa, Staphylococcus
EKTIFLALCLIFIGIIVRSM

SEQ ID NO: 1872066 - protein, 24 aa, Staphylococcus
EKTKGYKPIWIVISFIALIVILLL

SEQ ID NO: 1872067 - protein, 29 aa, Staphylococcus
EKTLQYKIFEFFGSPIIAMFVGVLYAIIV

SEQ ID NO: 1872068 - protein, 21 aa, Staphylococcus
EKVALLAAFIPIISGMSGNSG

SEQ ID NO: 1872069 - protein, 25 aa, Staphylococcus
EKVFKLSSYYLFNWFFIVYHLGVIV

SEQ ID NO: 1872070 - protein, 26 aa, Staphylococcus
EKVFKLSSYYLFNWFFIVYNIGVIIT

SEQ ID NO: 1872071 - protein, 26 aa, Staphylococcus
EKVFKLSSYYLFNWFFIVYNISVIAT

SEQ ID NO: 1872072 - protein, 25 aa, Staphylococcus
EKVFKLSSYYLFNWFFVIYHIGLLV

SEQ ID NO: 1872073 - protein, 26 aa, Staphylococcus
EKVLGWLNWIGLLLLTVATMFIALVS

SEQ ID NO: 1872074 - protein, 30 aa, Staphylococcus
EKVLLGLLMYRFAYYFIPLLISMILSIFEF

SEQ ID NO: 1872075 - protein, 24 aa, Staphylococcus
EKVWKYIVNNGFRVPLQMFILALL

SEQ ID NO: 1872076 - protein, 19 aa, Staphylococcus
EKYGDLAVLYSGDKVDRVG

SEQ ID NO: 1872077 - protein, 19 aa, Staphylococcus
EKYLVIMIMLALGSYVLFI

SEQ ID NO: 1872078 - protein, 30 aa, Staphylococcus
ELAGPMISYLIPLLIAYSGGRLIHEMRGGI

SEQ ID NO: 1872079 - protein, 19 aa, Staphylococcus
ELAILLLFDVERLLLEEVD

SEQ ID NO: 1872080 - protein, 20 aa, Staphylococcus
ELASKFLGKVMKHFVNIFSI

SEQ ID NO: 1872081 - protein, 25 aa, Staphylococcus
ELATLRVLGFYKRETVMYIYRETII

SEQ ID NO: 1872082 - protein, 18 aa, Staphylococcus
ELDPDAKGNRFWTQDESG

SEQ ID NO: 1872083 - protein, 23 aa, Staphylococcus
ELEAAKTEADRVIHDDNATPAQV

SEQ ID NO: 1872084 - protein, 26 aa, Staphylococcus
ELEEEIRDATTRPGVQSVAKLANQLN

SEQ ID NO: 1872085 - protein, 18 aa, Staphylococcus
ELEKALDKAVAFDDLDLN

SEQ ID NO: 1872086 - protein, 19 aa, Staphylococcus
ELFELPLVLIMTFSLLLSS

SEQ ID NO: 1872087 - protein, 24 aa, Staphylococcus
ELFELRMRQLLLGKFTKGAPYRQL

SEQ ID NO: 1872088 - protein, 17 aa, Staphylococcus
ELFHSGMRVGREILATS

SEQ ID NO: 1872089 - protein, 23 aa, Staphylococcus
ELGFEIFKGNLLSSSDRMYADLI

SEQ ID NO: 1872090 - protein, 19 aa, Staphylococcus
ELGGIKYDVPYNINEPNTN

SEQ ID NO: 1872091 - protein, 17 aa, Staphylococcus
ELGSLWLSIVFILVGGL

SEQ ID NO: 1872092 - protein, 24 aa, Staphylococcus
ELGSWKAPYSIVFVLDIFSALLII

SEQ ID NO: 1872093 - protein, 24 aa, Staphylococcus
ELGSWKAPYSIVFVLDLFSATLVI

SEQ ID NO: 1872094 - protein, 21 aa, Staphylococcus
ELGSWSAPYGIVFTLDLFSAM

SEQ ID NO: 1872095 - protein, 19 aa, Staphylococcus
ELGTFPIGNYNLKATKNID

SEQ ID NO: 1872096 - protein, 19 aa, Staphylococcus
ELIAALLIFLGSIIAVISA

SEQ ID NO: 1872097 - protein, 19 aa, Staphylococcus
ELIASILIFLGSIIAVISA

SEQ ID NO: 1872098 - protein, 25 aa, Staphylococcus
ELIERFPDLRLRLVKGAYKEDASIA

SEQ ID NO: 1872099 - protein, 20 aa, Staphylococcus
ELIESLGVRQVFVKDYEGKA

SEQ ID NO: 1872100 - protein, 28 aa, Staphylococcus
ELIGAFCLSLSFIPKFGIGQGLFISLFT

SEQ ID NO: 1872101 - protein, 19 aa, Staphylococcus
ELINPLWLVLSFLLITIGE

SEQ ID NO: 1872102 - protein, 19 aa, Staphylococcus
ELKELGVNAYQLFKDKYTR

SEQ ID NO: 1872103 - protein, 21 aa, Staphylococcus
ELKERYAKRLLHFKSASNKEF

SEQ ID NO: 1872104 - protein, 27 aa, Staphylococcus
ELKETWRNPSVYLMPLLVIGLTLLYHF

SEQ ID NO: 1872105 - protein, 17 aa, Staphylococcus
ELKRILKDFKAQRDHII

SEQ ID NO: 1872106 - protein, 29 aa, Staphylococcus
ELLAKFKTDGFIKVNLDWQTIGRLPNGQD

SEQ ID NO: 1872107 - protein, 19 aa, Staphylococcus
ELLFDRARVYLKSEKGGAD

SEQ ID NO: 1872108 - protein, 25 aa, Staphylococcus
ELLGPVFRPVMRPLFTLPGRSTVDN

SEQ ID NO: 1872109 - protein, 21 aa, Staphylococcus
ELLLSLLAGLFFQNGWGWIIS

SEQ ID NO: 1872110 - protein, 24 aa, Staphylococcus
ELLLSLLAGLVFQQPHWGWIISLP

SEQ ID NO: 1872111 - protein, 19 aa, Staphylococcus
ELLNKFVKGGREWEEKGDL

SEQ ID NO: 1872112 - protein, 19 aa, Staphylococcus
ELMLNRILKHLLKAENKGM

SEQ ID NO: 1872113 - protein, 24 aa, Staphylococcus
ELMNRLHISTAYSFLIVNFLSIPI

SEQ ID NO: 1872114 - protein, 21 aa, Staphylococcus
ELMRNQGWYWQTYQSQQLRDE

SEQ ID NO: 1872115 - protein, 19 aa, Staphylococcus
ELMSRFKIIYIAITGLVLF

SEQ ID NO: 1872116 - protein, 21 aa, Staphylococcus
ELMWFDMTQTLLLTLFSLISS

SEQ ID NO: 1872117 - protein, 19 aa, Staphylococcus
ELNDAMGKLRNSIQDQATV

SEQ ID NO: 1872118 - protein, 23 aa, Staphylococcus
ELNEAMKSLRAEVDKENQVKTES

SEQ ID NO: 1872119 - protein, 20 aa, Staphylococcus
ELNFRYFLYYFSLIYHYHFI

SEQ ID NO: 1872120 - protein, 20 aa, Staphylococcus
ELNNAMKLLRDAVNQQNQVH

SEQ ID NO: 1872121 - protein, 38 aa, Staphylococcus
ELNQGIDVLGSFFSFLTWGAVISLILAIIGGILISKKP

SEQ ID NO: 1872122 - protein, 18 aa, Staphylococcus
ELNVNFISTSPVFSDGAS

SEQ ID NO: 1872123 - protein, 19 aa, Staphylococcus
ELNVPIIIGLNMMDVAIQH

SEQ ID NO: 1872124 - protein, 24 aa, Staphylococcus
ELPLKGYVVRGGREMENHFECLWD

SEQ ID NO: 1872125 - protein, 24 aa, Staphylococcus
ELPMKGYVMRGGREMENHFECLWD

SEQ ID NO: 1872126 - protein, 21 aa, Staphylococcus
ELPMKGYVVRGGREMENHFEC

SEQ ID NO: 1872127 - protein, 19 aa, Staphylococcus
ELQLWEIIVSVLLSLIVMI

SEQ ID NO: 1872128 - protein, 23 aa, Staphylococcus
ELQVWEIIVSILISVVVMLILLW

SEQ ID NO: 1872129 - protein, 20 aa, Staphylococcus
ELRDRLAVRHGRYIEQDADD

SEQ ID NO: 1872130 - protein, 21 aa, Staphylococcus
ELRKQRPSAINQRRMNFEERR

SEQ ID NO: 1872131 - protein, 20 aa, Staphylococcus
ELRKRQRLFGEFDVNHINQY

SEQ ID NO: 1872132 - protein, 22 aa, Staphylococcus
ELSEIKAEISLFDGSLEAKTKL

SEQ ID NO: 1872133 - protein, 20 aa, Staphylococcus
ELSLKNYLIIAIPIFLYSCF

SEQ ID NO: 1872134 - protein, 19 aa, Staphylococcus
ELSNDFTVLDFTYDLPLTT

SEQ ID NO: 1872135 - protein, 24 aa, Staphylococcus
ELSYKYRRFVTPVTMRVKANEKLN

SEQ ID NO: 1872136 - protein, 23 aa, Staphylococcus
ELTNIFPNRLFKYIYSKNDDKTS

SEQ ID NO: 1872137 - protein, 22 aa, Staphylococcus
ELTRNSMNAFPVVAYSFSTKHD

SEQ ID NO: 1872138 - protein, 19 aa, Staphylococcus
ELVAIGVILLFLSICYALI

SEQ ID NO: 1872139 - protein, 28 aa, Staphylococcus
ELVRIRWYYRLASALYFIVFTYTTYKAF

SEQ ID NO: 1872140 - protein, 19 aa, Staphylococcus
EMGMNWRMPFYIMAVPILI

SEQ ID NO: 1872141 - protein, 21 aa, Staphylococcus
EMGRQPWIVRGYLRVSQAATQ

SEQ ID NO: 1872142 - protein, 20 aa, Staphylococcus
EMGRQPWIVRGYMRVSQAAT

SEQ ID NO: 1872143 - protein, 18 aa, Staphylococcus
EMGYFRWAAIVITSGLGA

SEQ ID NO: 1872144 - protein, 19 aa, Staphylococcus
EMIVLILSIVYHFILGVLF

SEQ ID NO: 1872145 - protein, 18 aa, Staphylococcus
EMKHFRRNIMISASLVGI

SEQ ID NO: 1872146 - protein, 18 aa, Staphylococcus
EMLIIFTALMIIANFYYI

SEQ ID NO: 1872147 - protein, 18 aa, Staphylococcus
EMLPKGYQGWIYNIDPFT

SEQ ID NO: 1872148 - protein, 23 aa, Staphylococcus
EMMKKKKIHIAAVYDDADFKGII

SEQ ID NO: 1872149 - protein, 25 aa, Staphylococcus
EMNKWTWCMLVTFVIAAVLIGPMIH

SEQ ID NO: 1872150 - protein, 18 aa, Staphylococcus
EMPGFGISFLTAVSPVIL

SEQ ID NO: 1872151 - protein, 30 aa, Staphylococcus
EMSNYRILRRIGFTHIDMMKGIGFKILFNF

SEQ ID NO: 1872152 - protein, 19 aa, Staphylococcus
EMTDFVIKRVYSLGKSTRQ

SEQ ID NO: 1872153 - protein, 17 aa, Staphylococcus
EMTKRKVDEAATKAKHN

SEQ ID NO: 1872154 - protein, 18 aa, Staphylococcus
EMTLYRKWVLIFLLICNV

SEQ ID NO: 1872155 - protein, 20 aa, Staphylococcus
EMWIMKRSAVEILFATLGLV

SEQ ID NO: 1872156 - protein, 25 aa, Staphylococcus
ENAELRTGPNAAYPVIYKIEKGDTF

SEQ ID NO: 1872157 - protein, 25 aa, Staphylococcus
ENAELRTGPNAAYPVIYQVEKGDTF

SEQ ID NO: 1872158 - protein, 22 aa, Staphylococcus
ENDSRIDSGFVIFYMAVNMGAL

SEQ ID NO: 1872159 - protein, 29 aa, Staphylococcus
ENEKNKKSKRWLIAIIAILLLIIGIFATK

SEQ ID NO: 1872160 - protein, 29 aa, Staphylococcus
ENEKSGRTKKWLIAIIVILLIIVAIFVTR

SEQ ID NO: 1872161 - protein, 24 aa, Staphylococcus
ENEPRLEPRLGNQYGGKLTLIQDD

SEQ ID NO: 1872162 - protein, 17 aa, Staphylococcus
ENFKILRKLGFTQEDMR

SEQ ID NO: 1872163 - protein, 18 aa, Staphylococcus
ENFSKLSMQLDKKKPANM

SEQ ID NO: 1872164 - protein, 21 aa, Staphylococcus
ENGDLIGIASLKINMDNVEGM

SEQ ID NO: 1872165 - protein, 17 aa, Staphylococcus
ENGILFKGGEHIEGTHA

SEQ ID NO: 1872166 - protein, 24 aa, Staphylococcus
ENGKDYKGQLQVFSSQHTKQANPN

SEQ ID NO: 1872167 - protein, 20 aa, Staphylococcus
ENGWALLFILLFSLVQFAVS

SEQ ID NO: 1872168 - protein, 19 aa, Staphylococcus
ENHQIIWVILKYEYLENRP

SEQ ID NO: 1872169 - protein, 24 aa, Staphylococcus
ENIADWVSVIGYLFPLRYAGDALT

SEQ ID NO: 1872170 - protein, 32 aa, Staphylococcus
ENIDLTFLFDYDELFYGNKLYFERTLINLIEN

SEQ ID NO: 1872171 - protein, 17 aa, Staphylococcus
ENIDVVDCCATRLRVTL

SEQ ID NO: 1872172 - protein, 17 aa, Staphylococcus
ENIEVVDCCATRLRVTL

SEQ ID NO: 1872173 - protein, 30 aa, Staphylococcus
ENIILAFILTRWAWFCRVIRTSVMQYTTAH

SEQ ID NO: 1872174 - protein, 17 aa, Staphylococcus
ENIKLGRPEASDQDVIA

SEQ ID NO: 1872175 - protein, 25 aa, Staphylococcus
ENKIFFRLILPLSKRSILSGIMMAF

SEQ ID NO: 1872176 - protein, 20 aa, Staphylococcus
ENLFIGSMLFGLFFGAGNLI

SEQ ID NO: 1872177 - protein, 24 aa, Staphylococcus
ENLNRRLDGLFGYEASLQIHSDHQ

SEQ ID NO: 1872178 - protein, 18 aa, Staphylococcus
ENNDYVVVNVDWGITDER

SEQ ID NO: 1872179 - protein, 18 aa, Staphylococcus
ENNIKFSLMSTDGNSNKT

SEQ ID NO: 1872180 - protein, 23 aa, Staphylococcus
ENPKADIPGIIFSTIGFGSLLYG

SEQ ID NO: 1872181 - protein, 29 aa, Staphylococcus
ENQKTRKSKKWLIAIIVILLIIVAIFVTR

SEQ ID NO: 1872182 - protein, 23 aa, Staphylococcus
ENRKRFTAMMLVCAMFAICWIAY

SEQ ID NO: 1872183 - protein, 29 aa, Staphylococcus
ENRKSNKGKKWLAAIVVILLIVVAIFIVR

SEQ ID NO: 1872184 - protein, 24 aa, Staphylococcus
ENRRVKLKKMINAMKKNEEFYPLY

SEQ ID NO: 1872185 - protein, 25 aa, Staphylococcus
ENSELRTGPNAAYPVIEKVDKGEGF

SEQ ID NO: 1872186 - protein, 29 aa, Staphylococcus
ENSLKNKLTEFFSGYSMAINSAFNMNNFD

SEQ ID NO: 1872187 - protein, 21 aa, Staphylococcus
ENSLYRFVDKYGKWVKLKSKD

SEQ ID NO: 1872188 - protein, 24 aa, Staphylococcus
ENTLLSTLVKNISNKKEEDEKLAT

SEQ ID NO: 1872189 - protein, 22 aa, Staphylococcus
ENTYKLSIKDRVKEFNDNRKRK

SEQ ID NO: 1872190 - protein, 17 aa, Staphylococcus
ENVKIVIVSGVIPFNII

SEQ ID NO: 1872191 - protein, 22 aa, Staphylococcus
ENVLFLKGLNLKSLNVINQVTD

SEQ ID NO: 1872192 - protein, 19 aa, Staphylococcus
ENVNFIWRLLACYVTSVTV

SEQ ID NO: 1872193 - protein, 23 aa, Staphylococcus
ENYKQMFSWKYFSMIWDSVIFAA

SEQ ID NO: 1872194 - protein, 24 aa, Staphylococcus
ENYPYKMGFTLKHIVALFKDEILI

SEQ ID NO: 1872195 - protein, 19 aa, Staphylococcus
EPATICFAIPLYKKRDVLK

SEQ ID NO: 1872196 - protein, 20 aa, Staphylococcus
EPATICFAIPLYKRRDVLKK

SEQ ID NO: 1872197 - protein, 17 aa, Staphylococcus
EPDEIHESLAIVLDESK

SEQ ID NO: 1872198 - protein, 21 aa, Staphylococcus
EPEAYRILDNFKWSVKDMESI

SEQ ID NO: 1872199 - protein, 25 aa, Staphylococcus
EPEITADGKWGFSFTDKDGDLAGSY

SEQ ID NO: 1872200 - protein, 25 aa, Staphylococcus
EPELIRNSIDAFPIVAYSFTNESND

SEQ ID NO: 1872201 - protein, 25 aa, Staphylococcus
EPENIKFLIMFTLLIALAIYVFRFI

SEQ ID NO: 1872202 - protein, 20 aa, Staphylococcus
EPEVFMMAVIAPLLFVEGTH

SEQ ID NO: 1872203 - protein, 19 aa, Staphylococcus
EPFFGVAFVVMIFAIGGVP

SEQ ID NO: 1872204 - protein, 25 aa, Staphylococcus
EPFTFLKLCGIILLFFGIFIMNYTK

SEQ ID NO: 1872205 - protein, 20 aa, Staphylococcus
EPHIPLMIGTAVAIGVTMLH

SEQ ID NO: 1872206 - protein, 21 aa, Staphylococcus
EPHKAPRSFISPSVVVGPNFY

SEQ ID NO: 1872207 - protein, 18 aa, Staphylococcus
EPHNLLFLVVITVLVALA

SEQ ID NO: 1872208 - protein, 24 aa, Staphylococcus
EPIKKDFDATLVYVTDGINMNRRN

SEQ ID NO: 1872209 - protein, 32 aa, Staphylococcus
EPILYGLILWYKRLIPIVLVSGAIGGAIIAIF

SEQ ID NO: 1872210 - protein, 18 aa, Staphylococcus
EPIVAILCGVIFLGDILN

SEQ ID NO: 1872211 - protein, 17 aa, Staphylococcus
EPIVMLIAICLWLLIGA

SEQ ID NO: 1872212 - protein, 19 aa, Staphylococcus
EPLQVAVVISIFVIITALL

SEQ ID NO: 1872213 - protein, 23 aa, Staphylococcus
EPLSITVKGNWIITVHKYPMEVL

SEQ ID NO: 1872214 - protein, 20 aa, Staphylococcus
EPLTAILLSVVWLGVSFGIW

SEQ ID NO: 1872215 - protein, 19 aa, Staphylococcus
EPLYGVAFVIMIFALGGVP

SEQ ID NO: 1872216 - protein, 20 aa, Staphylococcus
EPMIHKYAPFGIVGLTVCLF

SEQ ID NO: 1872217 - protein, 18 aa, Staphylococcus
EPMISRLELDNANDKLEQ

SEQ ID NO: 1872218 - protein, 18 aa, Staphylococcus
EPMISRLELDQANDKLES

SEQ ID NO: 1872219 - protein, 20 aa, Staphylococcus
EPMSKLQLLYLFGAGLSAAV

SEQ ID NO: 1872220 - protein, 18 aa, Staphylococcus
EPPQSIVNGVPYQVNIVM

SEQ ID NO: 1872221 - protein, 17 aa, Staphylococcus
EPQHFTGIQSPSQLTNI

SEQ ID NO: 1872222 - protein, 20 aa, Staphylococcus
EPQSGLVTINYQAVYPESLV

SEQ ID NO: 1872223 - protein, 20 aa, Staphylococcus
EPRVAVACIVRIINQLAQYA

SEQ ID NO: 1872224 - protein, 25 aa, Staphylococcus
EPSFKVPFFPVLPIITFILVLLVFW

SEQ ID NO: 1872225 - protein, 17 aa, Staphylococcus
EQESLQNTIGWNEPHHE

SEQ ID NO: 1872226 - protein, 25 aa, Staphylococcus
EQFLYRLMIGGGIIFTIVFVIKHPT

SEQ ID NO: 1872227 - protein, 25 aa, Staphylococcus
EQGIEGVTVTLTRPNGTTETTTTDS

SEQ ID NO: 1872228 - protein, 26 aa, Staphylococcus
EQHPERYYNGRDYRREQELQEENQKT

SEQ ID NO: 1872229 - protein, 20 aa, Staphylococcus
EQIAREGYHFTIYVPYGNDW

SEQ ID NO: 1872230 - protein, 25 aa, Staphylococcus
EQILLALLLYRFAYYFVPVVVALLL

SEQ ID NO: 1872231 - protein, 23 aa, Staphylococcus
EQIVRVGIILAMIVVFAVGHGTI

SEQ ID NO: 1872232 - protein, 26 aa, Staphylococcus
EQKKRKRTTLTYIVGVCFLFISIYLN

SEQ ID NO: 1872233 - protein, 26 aa, Staphylococcus
EQLDEFFNKFVFHGRIQYNVDDLQQI

SEQ ID NO: 1872234 - protein, 27 aa, Staphylococcus
EQLDEFFNKFVFHGRIQYNVDELQTIM

SEQ ID NO: 1872235 - protein, 18 aa, Staphylococcus
EQLELLKRIHAHLQNVEI

SEQ ID NO: 1872236 - protein, 20 aa, Staphylococcus
EQLIHVKINFKKRTNSFELE

SEQ ID NO: 1872237 - protein, 25 aa, Staphylococcus
EQLIKCAFSGVLFGGIMFIYYMIML

SEQ ID NO: 1872238 - protein, 23 aa, Staphylococcus
EQLKGAFETLGIQVGKDLTPAIQ

SEQ ID NO: 1872239 - protein, 19 aa, Staphylococcus
EQLKRYFDKNGHATADDIL

SEQ ID NO: 1872240 - protein, 17 aa, Staphylococcus
EQLKSHLIYEILLTYRI

SEQ ID NO: 1872241 - protein, 26 aa, Staphylococcus
EQLNEFFNKFVFHGRIQYNVDDLQEI

SEQ ID NO: 1872242 - protein, 27 aa, Staphylococcus
EQLQRELSDRLTFSSWLETDYLDSRDN

SEQ ID NO: 1872243 - protein, 23 aa, Staphylococcus
EQLWNIGKNSAFALIIPILAAFI

SEQ ID NO: 1872244 - protein, 24 aa, Staphylococcus
EQLWNIGKNSAFALIIPVLAGFIA

SEQ ID NO: 1872245 - protein, 24 aa, Staphylococcus
EQLWNIGKNSAFALIIPVLAGFIS

SEQ ID NO: 1872246 - protein, 24 aa, Staphylococcus
EQLWNIGNKSAFALIIPILAGFIS

SEQ ID NO: 1872247 - protein, 25 aa, Staphylococcus
EQLWNIGNKSAFALIIPILSGFIAR

SEQ ID NO: 1872248 - protein, 28 aa, Staphylococcus
EQLWNIGNKSAFMFIIPILAGYIARSIA

SEQ ID NO: 1872249 - protein, 30 aa, Staphylococcus
EQMASLKFTFSLKVIERLLLALIIPLFIFI

SEQ ID NO: 1872250 - protein, 19 aa, Staphylococcus
EQNAIELIKATPSDSEVKT

SEQ ID NO: 1872251 - protein, 23 aa, Staphylococcus
EQNRLKGVLDFENLKIKDVDTTP

SEQ ID NO: 1872252 - protein, 23 aa, Staphylococcus
EQRFCSKCGNDLRVFEDDSIESQ

SEQ ID NO: 1872253 - protein, 22 aa, Staphylococcus
EQRLKNPLIDFNLFKHKAYSGA

SEQ ID NO: 1872254 - protein, 23 aa, Staphylococcus
EQSHLKDWITWAIEPTMIRIGLN

SEQ ID NO: 1872255 - protein, 23 aa, Staphylococcus
EQSKFKIALREAGSGFLSGLVCS

SEQ ID NO: 1872256 - protein, 25 aa, Staphylococcus
EQSKFKVALREAGSGFLSGLVCALL

SEQ ID NO: 1872257 - protein, 23 aa, Staphylococcus
EQSKFKVALREAGSGLLSGLVCA

SEQ ID NO: 1872258 - protein, 18 aa, Staphylococcus
EQSLEVFLNIILKESNRI

SEQ ID NO: 1872259 - protein, 26 aa, Staphylococcus
EQSLKRLKLILLLKELELSLDDIKKL

SEQ ID NO: 1872260 - protein, 20 aa, Staphylococcus
EQSTGIGLFIVKHISNHIHH

SEQ ID NO: 1872261 - protein, 24 aa, Staphylococcus
EQTNHCPNCGATINDNGENSSNQA

SEQ ID NO: 1872262 - protein, 22 aa, Staphylococcus
EQVKSTMLITVWVFTGIEGAVV

SEQ ID NO: 1872263 - protein, 23 aa, Staphylococcus
EQVPGLIALIFKSAFGMQAAFGG

SEQ ID NO: 1872264 - protein, 20 aa, Staphylococcus
EQWIMKRSAVEILFATIGLI

SEQ ID NO: 1872265 - protein, 20 aa, Staphylococcus
EQYERCKQILLDHEKELKLI

SEQ ID NO: 1872266 - protein, 18 aa, Staphylococcus
EQYISIIVPGRMYAQAFK

SEQ ID NO: 1872267 - protein, 21 aa, Staphylococcus
EQYKVGITFSSKRLLKIAIVF

SEQ ID NO: 1872268 - protein, 24 aa, Staphylococcus
ERANGWYKRLMVTPMSISRYYGVK

SEQ ID NO: 1872269 - protein, 27 aa, Staphylococcus
EREIQSLKSNVGWKEMHDNVDVSESVK

SEQ ID NO: 1872270 - protein, 26 aa, Staphylococcus
EREKLRSQWQLTILFALFAITSNFTG

SEQ ID NO: 1872271 - protein, 22 aa, Staphylococcus
ERENVKVLYEVKPNKPVIDSNS

SEQ ID NO: 1872272 - protein, 20 aa, Staphylococcus
ERFFQRRKIGLFIFAVAITL

SEQ ID NO: 1872273 - protein, 23 aa, Staphylococcus
ERFGVKLLAFIGVIIVIVTTCYF

SEQ ID NO: 1872274 - protein, 26 aa, Staphylococcus
ERFNYKHILSIIMLWIGSFILIGANM

SEQ ID NO: 1872275 - protein, 24 aa, Staphylococcus
ERFTKRQALALGMIVLAIIFNVYG

SEQ ID NO: 1872276 - protein, 24 aa, Staphylococcus
ERGLRYFPNSGILNYEMAIANRSL

SEQ ID NO: 1872277 - protein, 18 aa, Staphylococcus
ERHFKERLLTLLLSTIQG

SEQ ID NO: 1872278 - protein, 20 aa, Staphylococcus
ERHHFDIAKKAYFVENGSLI

SEQ ID NO: 1872279 - protein, 21 aa, Staphylococcus
ERISFCILKARSTCDYCHQKL

SEQ ID NO: 1872280 - protein, 29 aa, Staphylococcus
ERISHLVLTRTGLYIIDSQLLKGHVYNGI

SEQ ID NO: 1872281 - protein, 20 aa, Staphylococcus
ERISRTSNYIAWISHGQLRM

SEQ ID NO: 1872282 - protein, 17 aa, Staphylococcus
ERKDFRKGYTAEGIAII

SEQ ID NO: 1872283 - protein, 17 aa, Staphylococcus
ERKDFRKGYTAEGLAIV

SEQ ID NO: 1872284 - protein, 21 aa, Staphylococcus
ERKGLKWAINGSFLFVVLVIV

SEQ ID NO: 1872285 - protein, 23 aa, Staphylococcus
ERKRIYSYIPLFITSVAFWMIQE

SEQ ID NO: 1872286 - protein, 20 aa, Staphylococcus
ERKTGPLLNRFGLCKNHIVT

SEQ ID NO: 1872287 - protein, 20 aa, Staphylococcus
ERKVGSFLIFTEFHGNLITA

SEQ ID NO: 1872288 - protein, 25 aa, Staphylococcus
ERKWKVDVPEGLILEHNDVTLIKAI

SEQ ID NO: 1872289 - protein, 17 aa, Staphylococcus
ERLFKNNRYKRAIEIAE

SEQ ID NO: 1872290 - protein, 29 aa, Staphylococcus
ERLMSMLIYLLGLFTSFIGPLVIWLVKRK

SEQ ID NO: 1872291 - protein, 20 aa, Staphylococcus
ERLNMAFSLINFVLILIGLI

SEQ ID NO: 1872292 - protein, 30 aa, Staphylococcus
ERLRRGKKIKAICLTLIFLLISLFLNEPYQ

SEQ ID NO: 1872293 - protein, 19 aa, Staphylococcus
ERLYRFVDKYGKWIKLKGK

SEQ ID NO: 1872294 - protein, 24 aa, Staphylococcus
ERNLYRFVNRYGKFLRVKTKDIDR

SEQ ID NO: 1872295 - protein, 24 aa, Staphylococcus
ERNTGWFKRLMVTPLSSKTYFTTK

SEQ ID NO: 1872296 - protein, 19 aa, Staphylococcus
ERPSIGIGLINLSEIPESY

SEQ ID NO: 1872297 - protein, 20 aa, Staphylococcus
ERPSIGIGLLNLSDIPDSYK

SEQ ID NO: 1872298 - protein, 24 aa, Staphylococcus
ERQRALSFWSIGSWGGSGICSLFG

SEQ ID NO: 1872299 - protein, 22 aa, Staphylococcus
ERQRALSYWSIGSWGGSGICSL

SEQ ID NO: 1872300 - protein, 22 aa, Staphylococcus
ERQRALSYWSIGSWGGSGLASL

SEQ ID NO: 1872301 - protein, 17 aa, Staphylococcus
ERQRISIARAFLKQAPI

SEQ ID NO: 1872302 - protein, 19 aa, Staphylococcus
ERSRIYSYIPLFITSVAFW

SEQ ID NO: 1872303 - protein, 24 aa, Staphylococcus
ERSRVISFIPLFIIGVIFWSIQEQ

SEQ ID NO: 1872304 - protein, 25 aa, Staphylococcus
ERSRVISFIPLFLLGVVFWSIQEQG

SEQ ID NO: 1872305 - protein, 26 aa, Staphylococcus
ERVKGRAQGDVKVFLENGTIKDEAWL

SEQ ID NO: 1872306 - protein, 17 aa, Staphylococcus
ERVQGMSVIKSFAIEDN

SEQ ID NO: 1872307 - protein, 25 aa, Staphylococcus
ERWGFPRWASILTIFIGLIAIIAIV

SEQ ID NO: 1872308 - protein, 32 aa, Staphylococcus
ERYNHAKPPVALVRFWTLFIVFLLGMVIMALL

SEQ ID NO: 1872309 - protein, 24 aa, Staphylococcus
ERYNISRLWGVIILFLVIIGVIAL

SEQ ID NO: 1872310 - protein, 24 aa, Staphylococcus
ERYPKKRTMLIYQIIECISLLAMA

SEQ ID NO: 1872311 - protein, 17 aa, Staphylococcus
ESAESKINMSRKEVTPD

SEQ ID NO: 1872312 - protein, 17 aa, Staphylococcus
ESAHKGTGFAFASFTTG

SEQ ID NO: 1872313 - protein, 29 aa, Staphylococcus
ESANGGRILKGKKNFGGSGLADVKVNSGA

SEQ ID NO: 1872314 - protein, 18 aa, Staphylococcus
ESDKEMFLNIALSLESYS

SEQ ID NO: 1872315 - protein, 23 aa, Staphylococcus
ESDRTGLDISYGRMYKEIIAYSI

SEQ ID NO: 1872316 - protein, 26 aa, Staphylococcus
ESDVSFTHWQWFISIASIVVLFIVNV

SEQ ID NO: 1872317 - protein, 23 aa, Staphylococcus
ESDYKIILEEGFRQMAVQLPSYI

SEQ ID NO: 1872318 - protein, 21 aa, Staphylococcus
ESDYRFKIQSIGVVYFSDGSV

SEQ ID NO: 1872319 - protein, 22 aa, Staphylococcus
ESEKADSAIPIYGHNDKEKQLK

SEQ ID NO: 1872320 - protein, 17 aa, Staphylococcus
ESEMPGFGLSLFTAILP

SEQ ID NO: 1872321 - protein, 24 aa, Staphylococcus
ESERLKGVMAFSNLKIKDVNTTPR

SEQ ID NO: 1872322 - protein, 27 aa, Staphylococcus
ESESIHFIIPKFKGTVYDLYNNKQEKL

SEQ ID NO: 1872323 - protein, 26 aa, Staphylococcus
ESEVIKWFYKEHDWFKAQLNNETNNV

SEQ ID NO: 1872324 - protein, 18 aa, Staphylococcus
ESEYWFALIKVITVIIFI

SEQ ID NO: 1872325 - protein, 18 aa, Staphylococcus
ESEYWFALIKVITVVIFI

SEQ ID NO: 1872326 - protein, 18 aa, Staphylococcus
ESEYWFALIKVVTVIVFI

SEQ ID NO: 1872327 - protein, 21 aa, Staphylococcus
ESFGIPTWLGALIMTIVIYLT

SEQ ID NO: 1872328 - protein, 21 aa, Staphylococcus
ESFGVPTWLGALIMVIVIYIT

SEQ ID NO: 1872329 - protein, 20 aa, Staphylococcus
ESFKLFWKNYVNFKGRATRP

SEQ ID NO: 1872330 - protein, 21 aa, Staphylococcus
ESFNYQPGYVFTSMANADDVL

SEQ ID NO: 1872331 - protein, 17 aa, Staphylococcus
ESFVYASDMRDYTKGAF

SEQ ID NO: 1872332 - protein, 25 aa, Staphylococcus
ESGAWKDGELAPQFLSVTREETERM

SEQ ID NO: 1872333 - protein, 19 aa, Staphylococcus
ESGELRVGLSADYAPFEFE

SEQ ID NO: 1872334 - protein, 24 aa, Staphylococcus
ESGKIKWFYFIGGILGVVFVTANI

SEQ ID NO: 1872335 - protein, 19 aa, Staphylococcus
ESGLAKWLGEQLVALNGVS

SEQ ID NO: 1872336 - protein, 21 aa, Staphylococcus
ESGLAKWLGLQLKSLDGVSPM

SEQ ID NO: 1872337 - protein, 19 aa, Staphylococcus
ESGLANWLGEQLKLIEGVS

SEQ ID NO: 1872338 - protein, 19 aa, Staphylococcus
ESGRKTLPILLGKNNSVRF

SEQ ID NO: 1872339 - protein, 23 aa, Staphylococcus
ESGRKTLPILLGKRASVIFMAAM

SEQ ID NO: 1872340 - protein, 24 aa, Staphylococcus
ESHIKLKLTHLFVLSIMILTVLVS

SEQ ID NO: 1872341 - protein, 19 aa, Staphylococcus
ESHSFKTLMPYIKTNYSTY

SEQ ID NO: 1872342 - protein, 27 aa, Staphylococcus
ESHSTKYSESVSMSESLSMSDSSSAST

SEQ ID NO: 1872343 - protein, 30 aa, Staphylococcus
ESIFSLITTQGWFKISFIDHLPLKQHSLEW

SEQ ID NO: 1872344 - protein, 24 aa, Staphylococcus
ESIKRKMNVWSLVMIIGFTLSSIL

SEQ ID NO: 1872345 - protein, 49 aa, Staphylococcus
ESISSKSQFSSSMVEPTSTSLPEFDLPSYLASESISASTSMSSSESLST

SEQ ID NO: 1872346 - protein, 33 aa, Staphylococcus
ESIYFYPRFKISILSLFISMIWIFNNDYVDYIL

SEQ ID NO: 1872347 - protein, 22 aa, Staphylococcus
ESIYRFVDKYGKWFKLKGNDVK

SEQ ID NO: 1872348 - protein, 27 aa, Staphylococcus
ESKENIKRVLLFLSRNTSSSGVERNNQ

SEQ ID NO: 1872349 - protein, 26 aa, Staphylococcus
ESKIFYRIVLPLSKRYILSGIVMSFA

SEQ ID NO: 1872350 - protein, 19 aa, Staphylococcus
ESKLLGIIGHVIIILIGIA

SEQ ID NO: 1872351 - protein, 19 aa, Staphylococcus
ESKNFWQDAWSQLRRNKLA

SEQ ID NO: 1872352 - protein, 17 aa, Staphylococcus
ESKRLLTSIGVGIATGI

SEQ ID NO: 1872353 - protein, 17 aa, Staphylococcus
ESKRLLTSLGVGIITGI

SEQ ID NO: 1872354 - protein, 23 aa, Staphylococcus
ESKSYIKTLNMILIPTLILISST

SEQ ID NO: 1872355 - protein, 20 aa, Staphylococcus
ESLIKDVVMLAARILLESGA

SEQ ID NO: 1872356 - protein, 19 aa, Staphylococcus
ESLSDSRSLSVVNSDSTST

SEQ ID NO: 1872357 - protein, 18 aa, Staphylococcus
ESLSGSLSTSTRKSTSDS

SEQ ID NO: 1872358 - protein, 20 aa, Staphylococcus
ESLYDYALTMGYEIIFYQAS

SEQ ID NO: 1872359 - protein, 20 aa, Staphylococcus
ESMAISTSNSIVVSESLSGS

SEQ ID NO: 1872360 - protein, 17 aa, Staphylococcus
ESMGGAVSASFKWYDFV

SEQ ID NO: 1872361 - protein, 20 aa, Staphylococcus
ESNKILAVRFLDSDTLAALQ

SEQ ID NO: 1872362 - protein, 19 aa, Staphylococcus
ESPDLYATLGYVIIISASY

SEQ ID NO: 1872363 - protein, 21 aa, Staphylococcus
ESPFVRLFALIGIPFAAGIIN

SEQ ID NO: 1872364 - protein, 24 aa, Staphylococcus
ESPHPCINHHKSIAPKHHSNDMAN

SEQ ID NO: 1872365 - protein, 31 aa, Staphylococcus
ESPIMLKLLFAVGCSLIGTALFVKLVSLIQV

SEQ ID NO: 1872366 - protein, 27 aa, Staphylococcus
ESPNGKPMLIASFELSGTTSAWELEDL

SEQ ID NO: 1872367 - protein, 18 aa, Staphylococcus
ESQPGTFIVTSAQPNNAI

SEQ ID NO: 1872368 - protein, 25 aa, Staphylococcus
ESRKFKIFSLISMIAIAGLAIFRFI

SEQ ID NO: 1872369 - protein, 24 aa, Staphylococcus
ESSSNINPSFYVNDSNYRNVTSNY

SEQ ID NO: 1872370 - protein, 22 aa, Staphylococcus
ESSVANGATVYWYKDSQSKLAE

SEQ ID NO: 1872371 - protein, 19 aa, Staphylococcus
ESSVKGFATMLLLGILIIF

SEQ ID NO: 1872372 - protein, 19 aa, Staphylococcus
ESSVKGFATMLLLGILMIF

SEQ ID NO: 1872373 - protein, 26 aa, Staphylococcus
ESTPIRKSTSYKIVKSQPKRIFETTI

SEQ ID NO: 1872374 - protein, 23 aa, Staphylococcus
ESVPRGRIVDRNGKVLVDNASKM

SEQ ID NO: 1872375 - protein, 24 aa, Staphylococcus
ESVSRLYVFSIFIILLLTLVFANF

SEQ ID NO: 1872376 - protein, 25 aa, Staphylococcus
ESYGIPTWLGSLIMVIAIYITLLMD

SEQ ID NO: 1872377 - protein, 18 aa, Staphylococcus
ESYLGFTVIFYIFGFALL

SEQ ID NO: 1872378 - protein, 29 aa, Staphylococcus
ESYPNCTALRQVHPGGVPQGHPAYQAKMD

SEQ ID NO: 1872379 - protein, 19 aa, Staphylococcus
ESYVLPVLVITIAYAGIYF

SEQ ID NO: 1872380 - protein, 18 aa, Staphylococcus
ETAKKLSSLINMDTDKIT

SEQ ID NO: 1872381 - protein, 25 aa, Staphylococcus
ETDSDGRYTLRFPDGTLNDKYMYGY

SEQ ID NO: 1872382 - protein, 19 aa, Staphylococcus
ETEFPRIQMFMHSYTGATK

SEQ ID NO: 1872383 - protein, 25 aa, Staphylococcus
ETEYPKERIRFIAIQYLLDNNQIYQ

SEQ ID NO: 1872384 - protein, 17 aa, Staphylococcus
ETFAIAVIGTFIASIIC

SEQ ID NO: 1872385 - protein, 19 aa, Staphylococcus
ETFGAKVLAIIGMSIVLIT

SEQ ID NO: 1872386 - protein, 18 aa, Staphylococcus
ETFGFPFYFKLIQFSISI

SEQ ID NO: 1872387 - protein, 17 aa, Staphylococcus
ETFKTRLLFLTTQSGGG

SEQ ID NO: 1872388 - protein, 23 aa, Staphylococcus
ETFSKLLQTIACRNIDILSASYK

SEQ ID NO: 1872389 - protein, 17 aa, Staphylococcus
ETFYYYFSIMFMLIGII

SEQ ID NO: 1872390 - protein, 25 aa, Staphylococcus
ETGRRPRHEPAYEKRDRELAEEEDD

SEQ ID NO: 1872391 - protein, 27 aa, Staphylococcus
ETHFPQDWTIFYWSWWLVYAPFIGLFI

SEQ ID NO: 1872392 - protein, 23 aa, Staphylococcus
ETHSYSITAVNAYNQNATTLTLR

SEQ ID NO: 1872393 - protein, 24 aa, Staphylococcus
ETIAKAKEINQFIDGLKEKADKTE

SEQ ID NO: 1872394 - protein, 27 aa, Staphylococcus
ETIEKLKAIQLPIAEPEVEVTLEKEIE

SEQ ID NO: 1872395 - protein, 20 aa, Staphylococcus
ETIELPLAHIIPEVIGNLLL

SEQ ID NO: 1872396 - protein, 17 aa, Staphylococcus
ETIFRLVTVIQSFMAFI

SEQ ID NO: 1872397 - protein, 29 aa, Staphylococcus
ETISVPSLIGMLMLIGIVVTNAIVLIDRV

SEQ ID NO: 1872398 - protein, 21 aa, Staphylococcus
ETISVPSLIGVLMLIGIVVTN

SEQ ID NO: 1872399 - protein, 17 aa, Staphylococcus
ETIYVIFAVNDDKQLVG

SEQ ID NO: 1872400 - protein, 17 aa, Staphylococcus
ETIYVIFAVNEAGQLVG

SEQ ID NO: 1872401 - protein, 24 aa, Staphylococcus
ETKEWPLFIVFALIFILLVPNTFY

SEQ ID NO: 1872402 - protein, 21 aa, Staphylococcus
ETKIFFKLILPLSKRSILAGI

SEQ ID NO: 1872403 - protein, 18 aa, Staphylococcus
ETKPEAPDIESNVEHVNV

SEQ ID NO: 1872404 - protein, 25 aa, Staphylococcus
ETKRFSKEEIRQMVTIAGSEGAFNE

SEQ ID NO: 1872405 - protein, 25 aa, Staphylococcus
ETLFMKCRFWLPLIFSSLIFSSQHL

SEQ ID NO: 1872406 - protein, 23 aa, Staphylococcus
ETLKAYPNLKGWEQINSSTGAMN

SEQ ID NO: 1872407 - protein, 17 aa, Staphylococcus
ETLKIVVSLIMAVSVVS

SEQ ID NO: 1872408 - protein, 32 aa, Staphylococcus
ETLNKWCFWLFMIGFNVCFIPQFILGLDGMPR

SEQ ID NO: 1872409 - protein, 19 aa, Staphylococcus
ETLPAILVVAITFTVLQAI

SEQ ID NO: 1872410 - protein, 27 aa, Staphylococcus
ETLSVPSMIGLLMLIGIVVTNAIVLVD

SEQ ID NO: 1872411 - protein, 25 aa, Staphylococcus
ETLTELRPAGIISLNDERIDAVSDG

SEQ ID NO: 1872412 - protein, 26 aa, Staphylococcus
ETLYTIRLLPVGGYVRMAGDGLEEPP

SEQ ID NO: 1872413 - protein, 24 aa, Staphylococcus
ETMLFTVIPFMGFVALLIGIIQGS

SEQ ID NO: 1872414 - protein, 29 aa, Staphylococcus
ETNGCLSCLGCFGIIFLILLLIGGCSAIF

SEQ ID NO: 1872415 - protein, 26 aa, Staphylococcus
ETPFRREGLSAFSFDRLRRPKFIRTI

SEQ ID NO: 1872416 - protein, 17 aa, Staphylococcus
ETPMLLGAMIMGPLVGW

SEQ ID NO: 1872417 - protein, 23 aa, Staphylococcus
ETPPKRGMYAFIMTLCGVHGTIS

SEQ ID NO: 1872418 - protein, 17 aa, Staphylococcus
ETPVALEVTRYVDSEGN

SEQ ID NO: 1872419 - protein, 25 aa, Staphylococcus
ETQHKRKAQALAHKRNKLIVSAILS

SEQ ID NO: 1872420 - protein, 24 aa, Staphylococcus
ETRPWRQILGKVFLYVIQGTFAAI

SEQ ID NO: 1872421 - protein, 22 aa, Staphylococcus
ETRRAIYFTPVWFIILGLMYYR

SEQ ID NO: 1872422 - protein, 27 aa, Staphylococcus
ETSIFSMLFKLIFMLDYHLFHLIQNSF

SEQ ID NO: 1872423 - protein, 36 aa, Staphylococcus
ETSLGFIGRKYKSVLNWSLNHKWIVIIVSTIILIAS

SEQ ID NO: 1872424 - protein, 23 aa, Staphylococcus
ETSLKRLVIDEVQLTRHISQAKG

SEQ ID NO: 1872425 - protein, 25 aa, Staphylococcus
ETSYPNERIRFIAIQYLLDNVKINE

SEQ ID NO: 1872426 - protein, 19 aa, Staphylococcus
ETTIAMVIWLLSFFTTFLG

SEQ ID NO: 1872427 - protein, 25 aa, Staphylococcus
ETTSWKWTLTALIYPIFTAYILTFA

SEQ ID NO: 1872428 - protein, 24 aa, Staphylococcus
ETTVPEPFSAPVGETTKSLEEQNP

SEQ ID NO: 1872429 - protein, 20 aa, Staphylococcus
ETTYYRVVTKNNPTYQADKT

SEQ ID NO: 1872430 - protein, 19 aa, Staphylococcus
ETVLPMFVQNIMKDTALQS

SEQ ID NO: 1872431 - protein, 19 aa, Staphylococcus
ETVLPMFVQNVLQRTPVDS

SEQ ID NO: 1872432 - protein, 22 aa, Staphylococcus
ETVSVIFIFYLKMDRVIIVEET

SEQ ID NO: 1872433 - protein, 19 aa, Staphylococcus
ETVSWKWTIIATLYPVVIA

SEQ ID NO: 1872434 - protein, 20 aa, Staphylococcus
ETWEQIKYGYLKMIASAKKS

SEQ ID NO: 1872435 - protein, 19 aa, Staphylococcus
ETYFKTGIIITIPVLFVTL

SEQ ID NO: 1872436 - protein, 19 aa, Staphylococcus
ETYLAKAIELSNDYVDNNL

SEQ ID NO: 1872437 - protein, 19 aa, Staphylococcus
ETYNIPPVNKIIKIGIGAV

SEQ ID NO: 1872438 - protein, 17 aa, Staphylococcus
ETYYYYFAVMFMETGII

SEQ ID NO: 1872439 - protein, 22 aa, Staphylococcus
EVAECFLKFNSMLGNTFTPQAD

SEQ ID NO: 1872440 - protein, 19 aa, Staphylococcus
EVAFAISTIFLFNLIAVFI

SEQ ID NO: 1872441 - protein, 19 aa, Staphylococcus
EVAGSIWWVLLINILIALA

SEQ ID NO: 1872442 - protein, 21 aa, Staphylococcus
EVAGWNLILFIVFRAISGIII

SEQ ID NO: 1872443 - protein, 20 aa, Staphylococcus
EVAGWNLLLFIIFRAISGIV

SEQ ID NO: 1872444 - protein, 21 aa, Staphylococcus
EVAGWNLLLFIVFRAISGIIL

SEQ ID NO: 1872445 - protein, 21 aa, Staphylococcus
EVAHARGAYVVAITNYEGSTL

SEQ ID NO: 1872446 - protein, 23 aa, Staphylococcus
EVAHKPIMLSFNFIGQTGTAILI

SEQ ID NO: 1872447 - protein, 18 aa, Staphylococcus
EVAIKVVLPAAASGILAS

SEQ ID NO: 1872448 - protein, 24 aa, Staphylococcus
EVAKELPWGLLILFGGGLALAKGI

SEQ ID NO: 1872449 - protein, 25 aa, Staphylococcus
EVAKELPWGVLILFGGGLALAKGIS

SEQ ID NO: 1872450 - protein, 23 aa, Staphylococcus
EVASSTLLFLLIGMVLIYAFLLG

SEQ ID NO: 1872451 - protein, 30 aa, Staphylococcus
EVDPRKSASLLDIFAGCFQGLLPYSPQLIA

SEQ ID NO: 1872452 - protein, 24 aa, Staphylococcus
EVDSELERSLKIYGSDIDRDSPFF

SEQ ID NO: 1872453 - protein, 24 aa, Staphylococcus
EVDSELERSLKIYGSDIDRNSPFF

SEQ ID NO: 1872454 - protein, 24 aa, Staphylococcus
EVDSELERSLKIYGSKIDRNSPFF

SEQ ID NO: 1872455 - protein, 25 aa, Staphylococcus
EVDSELERSLKIYGSKIDRNSPFFK

SEQ ID NO: 1872456 - protein, 19 aa, Staphylococcus
EVDVSPEFENLISHILKID

SEQ ID NO: 1872457 - protein, 25 aa, Staphylococcus
EVENIPFQIEYVVSKDLPVGQQEVQ

SEQ ID NO: 1872458 - protein, 18 aa, Staphylococcus
EVFLGLYIQIMINKRTND

SEQ ID NO: 1872459 - protein, 19 aa, Staphylococcus
EVFPINKRVTAISFISTSF

SEQ ID NO: 1872460 - protein, 18 aa, Staphylococcus
EVFRAGYVSVDYRQIEAG

SEQ ID NO: 1872461 - protein, 20 aa, Staphylococcus
EVFYKNVLLAIGAFIVFGIL

SEQ ID NO: 1872462 - protein, 20 aa, Staphylococcus
EVGMTKFIFDIRETVEKLNK

SEQ ID NO: 1872463 - protein, 19 aa, Staphylococcus
EVGNFQWAADKNFQYFTAP

SEQ ID NO: 1872464 - protein, 26 aa, Staphylococcus
EVGWLLCLFATIPGIILWNKSIPSFG

SEQ ID NO: 1872465 - protein, 19 aa, Staphylococcus
EVHVRRGIIFIKTNIIPYF

SEQ ID NO: 1872466 - protein, 18 aa, Staphylococcus
EVIDEVAHALKAFSEGKT

SEQ ID NO: 1872467 - protein, 19 aa, Staphylococcus
EVIKFIIVGGINTFNYYVV

SEQ ID NO: 1872468 - protein, 19 aa, Staphylococcus
EVITRLKAIGSKIYMTSLS

SEQ ID NO: 1872469 - protein, 20 aa, Staphylococcus
EVKFSFSIVADYFKTHVQGF

SEQ ID NO: 1872470 - protein, 20 aa, Staphylococcus
EVKKAVTVPDYPSSKGTPTV

SEQ ID NO: 1872471 - protein, 25 aa, Staphylococcus
EVKPLSCISVGFLLIQALVGAAAVM

SEQ ID NO: 1872472 - protein, 23 aa, Staphylococcus
EVLDRLKGEFKNVGTVIQAYLYD

SEQ ID NO: 1872473 - protein, 17 aa, Staphylococcus
EVLGRKPIMIFSVISVS

SEQ ID NO: 1872474 - protein, 19 aa, Staphylococcus
EVLQYFTSFGMMGTFGAMI

SEQ ID NO: 1872475 - protein, 22 aa, Staphylococcus
EVLSTKMIYTFLILHYIGITYL

SEQ ID NO: 1872476 - protein, 26 aa, Staphylococcus
EVMQRIGKCFALLQLTGEILNDIDGF

SEQ ID NO: 1872477 - protein, 19 aa, Staphylococcus
EVMRKIGLEQDLIKKIINK

SEQ ID NO: 1872478 - protein, 19 aa, Staphylococcus
EVNFARLVIVVAGLLSYGI

SEQ ID NO: 1872479 - protein, 23 aa, Staphylococcus
EVNIAESAYLIGLLQSPYYYTPY

SEQ ID NO: 1872480 - protein, 19 aa, Staphylococcus
EVNNRFYVVIMSYIEQFQP

SEQ ID NO: 1872481 - protein, 21 aa, Staphylococcus
EVNQYRTSYNVKHLDNPIKQE

SEQ ID NO: 1872482 - protein, 19 aa, Staphylococcus
EVNRRIEVALIGKNQLTIP

SEQ ID NO: 1872483 - protein, 20 aa, Staphylococcus
EVPQALSNVVLRATEKDKHN

SEQ ID NO: 1872484 - protein, 19 aa, Staphylococcus
EVQDGFKMAFNEKDGTGYA

SEQ ID NO: 1872485 - protein, 20 aa, Staphylococcus
EVQEGFKMAFNEKDGTGYQS

SEQ ID NO: 1872486 - protein, 25 aa, Staphylococcus
EVRTNARKALKAKADEQNALIDSNR

SEQ ID NO: 1872487 - protein, 26 aa, Staphylococcus
EVSAKDFILGIGIALVILAIFAVLFR

SEQ ID NO: 1872488 - protein, 30 aa, Staphylococcus
EVSDKSDEQFPPRNAQRRQRRRDTATNQRE

SEQ ID NO: 1872489 - protein, 21 aa, Staphylococcus
EVSKLSVLIASKILQKDISEK

SEQ ID NO: 1872490 - protein, 18 aa, Staphylococcus
EVSMSISKSMSASTSDSE

SEQ ID NO: 1872491 - protein, 18 aa, Staphylococcus
EVSRFKLMLKSIPNKIKT

SEQ ID NO: 1872492 - protein, 25 aa, Staphylococcus
EVTFARWMIILSGLFGFGMSIYLIA

SEQ ID NO: 1872493 - protein, 24 aa, Staphylococcus
EVTLFKSVGLAIVDIVVAHYFYKK

SEQ ID NO: 1872494 - protein, 26 aa, Staphylococcus
EVTLFKSVGLAIVDIVVANYFYKKTQ

SEQ ID NO: 1872495 - protein, 24 aa, Staphylococcus
EVTNARLGYYTVVKEPNVQVLEAN

SEQ ID NO: 1872496 - protein, 25 aa, Staphylococcus
EVTTDPFTRIELRDKYNKPLGASRT

SEQ ID NO: 1872497 - protein, 29 aa, Staphylococcus
EVVDFFKTFKWRIIGFLAFLIIAILFLTL

SEQ ID NO: 1872498 - protein, 18 aa, Staphylococcus
EVVGGIFLIFGILTPYVN

SEQ ID NO: 1872499 - protein, 22 aa, Staphylococcus
EVVTKPNAINSIDNLATQLKET

SEQ ID NO: 1872500 - protein, 27 aa, Staphylococcus
EWLQSWTIYYWGWWMSWSPFVGIFIAR

SEQ ID NO: 1872501 - protein, 26 aa, Staphylococcus
EWYRLITSIFLHYNFEHILMNMLSLF

SEQ ID NO: 1872502 - protein, 17 aa, Staphylococcus
EYAQLLLSIARSCQNKI

SEQ ID NO: 1872503 - protein, 19 aa, Staphylococcus
EYFDELFFLLQMSPEDNNA

SEQ ID NO: 1872504 - protein, 26 aa, Staphylococcus
EYFHTIMFSSYIWKNVGWDSIIYFAA

SEQ ID NO: 1872505 - protein, 19 aa, Staphylococcus
EYFYQAPLYIFDGIHIKVH

SEQ ID NO: 1872506 - protein, 27 aa, Staphylococcus
EYGHFTGQMKFDFRYAKGNTVEVNENF

SEQ ID NO: 1872507 - protein, 25 aa, Staphylococcus
EYHFEIHSLWYLGMIPWIGACFTAY

SEQ ID NO: 1872508 - protein, 25 aa, Staphylococcus
EYHFEIHSLWYLGMIPWIGAVFTAY

SEQ ID NO: 1872509 - protein, 19 aa, Staphylococcus
EYIGIIAIVAVFAGVFYKN

SEQ ID NO: 1872510 - protein, 23 aa, Staphylococcus
EYISLKATMPVKEALMHVKEQAP

SEQ ID NO: 1872511 - protein, 18 aa, Staphylococcus
EYIVWAIEPTMKKLGLHG

SEQ ID NO: 1872512 - protein, 29 aa, Staphylococcus
EYKKLNWSRWLPHTTLKALNIRGFVYNQR

SEQ ID NO: 1872513 - protein, 21 aa, Staphylococcus
EYKRKGVSYVGYLIFMLIVIP

SEQ ID NO: 1872514 - protein, 21 aa, Staphylococcus
EYLEMLFEIIVLGGICAPIAE

SEQ ID NO: 1872515 - protein, 19 aa, Staphylococcus
EYLLPRVGLTPEIDELPKE

SEQ ID NO: 1872516 - protein, 20 aa, Staphylococcus
EYLTIYILVAIMYWVVCFII

SEQ ID NO: 1872517 - protein, 20 aa, Staphylococcus
EYLTIYILVALLYWVVCFII

SEQ ID NO: 1872518 - protein, 26 aa, Staphylococcus
EYNRFSKGLFEWIGYNTKVFTYENVE

SEQ ID NO: 1872519 - protein, 24 aa, Staphylococcus
EYPSKRLRFIAIQYLLDNPEIERE

SEQ ID NO: 1872520 - protein, 19 aa, Staphylococcus
EYRIPRTLLGLIVGSSLAI

SEQ ID NO: 1872521 - protein, 18 aa, Staphylococcus
EYRIPRTLLGLLVGCSLA

SEQ ID NO: 1872522 - protein, 19 aa, Staphylococcus
EYRIPRTLLGLVVGSSLAI

SEQ ID NO: 1872523 - protein, 20 aa, Staphylococcus
EYSGVFIFKDLKSIEDTNNA

SEQ ID NO: 1872524 - protein, 19 aa, Staphylococcus
EYVLNFWLYEGELLLLLLK

SEQ ID NO: 1872525 - protein, 17 aa, Staphylococcus
EYVVWSIEPTMRKIGLD

SEQ ID NO: 1872526 - protein, 17 aa, Staphylococcus
EYYIQWTTIFFTLYQFL

SEQ ID NO: 1872527 - protein, 24 aa, Staphylococcus
EYYSLNAGYLWSLFFQHLLMSVYG

SEQ ID NO: 1872528 - protein, 19 aa, Staphylococcus
FAALMGFGNLFGVGGGTYI

SEQ ID NO: 1872529 - protein, 19 aa, Staphylococcus
FAASFAFAILLSIIIDIGA

SEQ ID NO: 1872530 - protein, 18 aa, Staphylococcus
FADLAILLNINWLAILLY

SEQ ID NO: 1872531 - protein, 18 aa, Staphylococcus
FADLKLLADTMHEAGADV

SEQ ID NO: 1872532 - protein, 17 aa, Staphylococcus
FADLKQYLWPGFLLILF

SEQ ID NO: 1872533 - protein, 20 aa, Staphylococcus
FAEHFVNWMLISLILIIILA

SEQ ID NO: 1872534 - protein, 17 aa, Staphylococcus
FAEINWKRFEVAVPAFI

SEQ ID NO: 1872535 - protein, 22 aa, Staphylococcus
FAEKGKIIGLLQMFMTKENIAE

SEQ ID NO: 1872536 - protein, 23 aa, Staphylococcus
FAEKGKIVGLLQMFMTKESIAER

SEQ ID NO: 1872537 - protein, 17 aa, Staphylococcus
FAFFIFKYSYNKNDESG

SEQ ID NO: 1872538 - protein, 24 aa, Staphylococcus
FAFFSPMMCCFMLMVMLLSPVSDN

SEQ ID NO: 1872539 - protein, 23 aa, Staphylococcus
FAFKKGRYATSLLLALISVVAIM

SEQ ID NO: 1872540 - protein, 25 aa, Staphylococcus
FAFMPLKHLWSLAIEEQFYIVFPIV

SEQ ID NO: 1872541 - protein, 21 aa, Staphylococcus
FAGPLFNFILALVIFIGLAYY

SEQ ID NO: 1872542 - protein, 56 aa, Staphylococcus
FAGSYVQPFNHSWAQGMNFEWGDNLGTPSSRTPGAFTRVATVIYPNGERENVKVLY

SEQ ID NO: 1872543 - protein, 31 aa, Staphylococcus
FAGTIATYVGWRWIFILSIIFAFIAIILLRG

SEQ ID NO: 1872544 - protein, 24 aa, Staphylococcus
FAGYHFLYTFAFSMIVGELIRATN

SEQ ID NO: 1872545 - protein, 24 aa, Staphylococcus
FAHRGMAFITFFWIMITFIHAVKN

SEQ ID NO: 1872546 - protein, 17 aa, Staphylococcus
FAIAILCAVLFGITQSA

SEQ ID NO: 1872547 - protein, 17 aa, Staphylococcus
FAIAVIGTFIASIICIP

SEQ ID NO: 1872548 - protein, 17 aa, Staphylococcus
FAIGVAIGMAKKNDGAV

SEQ ID NO: 1872549 - protein, 25 aa, Staphylococcus
FAILLALLKKFAWGPLKEVMDKRER

SEQ ID NO: 1872550 - protein, 18 aa, Staphylococcus
FAILTVIFIVGTFLVKTK

SEQ ID NO: 1872551 - protein, 17 aa, Staphylococcus
FAIPVNHALDLAKQLEK

SEQ ID NO: 1872552 - protein, 17 aa, Staphylococcus
FAIVLNATFSEKIKNPY

SEQ ID NO: 1872553 - protein, 25 aa, Staphylococcus
FAKVKRLPSGIGILLMVLGLLLTPV

SEQ ID NO: 1872554 - protein, 23 aa, Staphylococcus
FALEEISFMLSRALNDKNRTRID

SEQ ID NO: 1872555 - protein, 18 aa, Staphylococcus
FALEEISFMLSRAQHNPH

SEQ ID NO: 1872556 - protein, 17 aa, Staphylococcus
FALERLVTVLVIACPHA

SEQ ID NO: 1872557 - protein, 30 aa, Staphylococcus
FALFLTVFMLFRFDWKSEFSVKHHGDLVLN

SEQ ID NO: 1872558 - protein, 18 aa, Staphylococcus
FALIIPILYRFFKRIHIG

SEQ ID NO: 1872559 - protein, 17 aa, Staphylococcus
FALIIPILYRFVKRIHL

SEQ ID NO: 1872560 - protein, 31 aa, Staphylococcus
FALIIPILYRFVPRIHLGWFVLPVPIVLFIY

SEQ ID NO: 1872561 - protein, 25 aa, Staphylococcus
FALLFAAQLYLVFTKGAAGDREPVL

SEQ ID NO: 1872562 - protein, 17 aa, Staphylococcus
FALLFDWLVIFGSSYLS

SEQ ID NO: 1872563 - protein, 27 aa, Staphylococcus
FALLLAGLVGFIGMGVFGSKYEEMPDL

SEQ ID NO: 1872564 - protein, 17 aa, Staphylococcus
FALLRFLISATFIILGL

SEQ ID NO: 1872565 - protein, 19 aa, Staphylococcus
FALNMILGMEKKHIRVLLF

SEQ ID NO: 1872566 - protein, 25 aa, Staphylococcus
FALPIYLAYHFSDWLQSTYVTQWID

SEQ ID NO: 1872567 - protein, 18 aa, Staphylococcus
FAMMNNLDAYIVLNESDI

SEQ ID NO: 1872568 - protein, 25 aa, Staphylococcus
FANEPWSTIFDFKKIISVSFATGTY

SEQ ID NO: 1872569 - protein, 20 aa, Staphylococcus
FANFFINISLVIAMQIDDIL

SEQ ID NO: 1872570 - protein, 26 aa, Staphylococcus
FANIEGWRWMLGLAVVPSVILLIGIY

SEQ ID NO: 1872571 - protein, 18 aa, Staphylococcus
FANTPGATVDELNEANQQ

SEQ ID NO: 1872572 - protein, 26 aa, Staphylococcus
FANTVLRSMFSFGFLFGPLIGSLLNR

SEQ ID NO: 1872573 - protein, 27 aa, Staphylococcus
FANTVLRSMFSFGFLFGPLIGSRLIHF

SEQ ID NO: 1872574 - protein, 23 aa, Staphylococcus
FAPEHPVKLILPIITLVGGTVGG

SEQ ID NO: 1872575 - protein, 18 aa, Staphylococcus
FAPFAFLVGVPWNDAVQA

SEQ ID NO: 1872576 - protein, 23 aa, Staphylococcus
FAPIAFIMGVPWEEAIRAGSIMA

SEQ ID NO: 1872577 - protein, 25 aa, Staphylococcus
FAPIGLKVGRLLPNIVQKAIISILI

SEQ ID NO: 1872578 - protein, 17 aa, Staphylococcus
FAPKAYKSETFSHSTAQ

SEQ ID NO: 1872579 - protein, 34 aa, Staphylococcus
FAPNRPKDMRSYRMVYDTIPVETMNAILFDDSVI

SEQ ID NO: 1872580 - protein, 25 aa, Staphylococcus
FAPSALRAILCMTFVILLPKKFYTS

SEQ ID NO: 1872581 - protein, 20 aa, Staphylococcus
FAPVISMIWLKMGKKQPSLA

SEQ ID NO: 1872582 - protein, 20 aa, Staphylococcus
FAQDITREFNGIPLKNITVQ

SEQ ID NO: 1872583 - protein, 20 aa, Staphylococcus
FAQGAVIAFVMLIPALFGFV

SEQ ID NO: 1872584 - protein, 18 aa, Staphylococcus
FAQKLNIKVIGLGSSTPY

SEQ ID NO: 1872585 - protein, 19 aa, Staphylococcus
FAQLILSIARVCRKELIIL

SEQ ID NO: 1872586 - protein, 20 aa, Staphylococcus
FARTLIQQHVSDDSIVIDAT

SEQ ID NO: 1872587 - protein, 17 aa, Staphylococcus
FASDSVRNLSYAAYEKR

SEQ ID NO: 1872588 - protein, 17 aa, Staphylococcus
FASLGWLSNDLRLMTLC

SEQ ID NO: 1872589 - protein, 17 aa, Staphylococcus
FASMLFSILFNAPRRLL

SEQ ID NO: 1872590 - protein, 19 aa, Staphylococcus
FASSFAFAILLSILIDIGA

SEQ ID NO: 1872591 - protein, 24 aa, Staphylococcus
FASSWNPHHFGFFEGMGKSISITL

SEQ ID NO: 1872592 - protein, 21 aa, Staphylococcus
FATGGLIKSAGWYNIAEGGYP

SEQ ID NO: 1872593 - protein, 17 aa, Staphylococcus
FATGLMLKQLESENKIN

SEQ ID NO: 1872594 - protein, 24 aa, Staphylococcus
FATIGVGMPLMFAIAEFIGIRKND

SEQ ID NO: 1872595 - protein, 24 aa, Staphylococcus
FATIGVGMPLMFAIAEFLGIKKKD

SEQ ID NO: 1872596 - protein, 24 aa, Staphylococcus
FATIGVGMPLMFVIAELLGIRNND

SEQ ID NO: 1872597 - protein, 23 aa, Staphylococcus
FATIGVGMPVMFAVAEFIGIKKN

SEQ ID NO: 1872598 - protein, 19 aa, Staphylococcus
FATLWMKLGKHNPPTVYKF

SEQ ID NO: 1872599 - protein, 26 aa, Staphylococcus
FATSRFSKKSSIIWSIVYLVVVIGFS

SEQ ID NO: 1872600 - protein, 17 aa, Staphylococcus
FATTRIGAQEAIGKMEA

SEQ ID NO: 1872601 - protein, 20 aa, Staphylococcus
FAVEISRLVIKSGFTIKMPE

SEQ ID NO: 1872602 - protein, 17 aa, Staphylococcus
FAVFTMASILTFVSMII

SEQ ID NO: 1872603 - protein, 17 aa, Staphylococcus
FAVIVGLVLHDFKLLPA

SEQ ID NO: 1872604 - protein, 21 aa, Staphylococcus
FAVLCSLFGTFLFVKLIEMIR

SEQ ID NO: 1872605 - protein, 18 aa, Staphylococcus
FAVLITVTFAFVFNTVQS

SEQ ID NO: 1872606 - protein, 18 aa, Staphylococcus
FAVLMAFGNLFGVGGGTY

SEQ ID NO: 1872607 - protein, 23 aa, Staphylococcus
FAVLTLIFIVGIFLAKAKTVDYS

SEQ ID NO: 1872608 - protein, 25 aa, Staphylococcus
FAVPAVACTIAFIIFFIWYPLTDKR

SEQ ID NO: 1872609 - protein, 22 aa, Staphylococcus
FAVTAFFLVLTFRSYKELGTDN

SEQ ID NO: 1872610 - protein, 32 aa, Staphylococcus
FAVVLCVVFSFTADWLYPFFKQAAVTFYDPKA

SEQ ID NO: 1872611 - protein, 22 aa, Staphylococcus
FAWFEARFHLNFGIDLLLHNSY

SEQ ID NO: 1872612 - protein, 24 aa, Staphylococcus
FAWLLGLLVGWAFMNVLVKIHPTR

SEQ ID NO: 1872613 - protein, 24 aa, Staphylococcus
FAWLSGLLVGWAFMNVLVKLHPTR

SEQ ID NO: 1872614 - protein, 33 aa, Staphylococcus
FAYMPELNWHYGYFICLFVMLIISIILIIFFKR

SEQ ID NO: 1872615 - protein, 19 aa, Staphylococcus
FCAPVLAGLIGWQNTVRSY

SEQ ID NO: 1872616 - protein, 23 aa, Staphylococcus
FCMIVPWRLAMFYKYKKLKKSLV

SEQ ID NO: 1872617 - protein, 23 aa, Staphylococcus
FCMIVPWRLAMYYKYKKVKKSII

SEQ ID NO: 1872618 - protein, 20 aa, Staphylococcus
FCPRCGNKITKEQRFCSKCG

SEQ ID NO: 1872619 - protein, 17 aa, Staphylococcus
FCYLISIYLIVGLFYMM

SEQ ID NO: 1872620 - protein, 24 aa, Staphylococcus
FDAFVVRLLLIPALTQLFGKASWY

SEQ ID NO: 1872621 - protein, 28 aa, Staphylococcus
FDASNGILLFIMACVINIILSVSLKRTY

SEQ ID NO: 1872622 - protein, 18 aa, Staphylococcus
FDDVPTLIHSWMNSDIHR

SEQ ID NO: 1872623 - protein, 18 aa, Staphylococcus
FDDVPTLIHSWMNSDMHR

SEQ ID NO: 1872624 - protein, 17 aa, Staphylococcus
FDFDMKTLMTVAVIGAA

SEQ ID NO: 1872625 - protein, 17 aa, Staphylococcus
FDFEFPLYMSIAVMLLG

SEQ ID NO: 1872626 - protein, 18 aa, Staphylococcus
FDGKHYGIDYHLPEDTPI

SEQ ID NO: 1872627 - protein, 21 aa, Staphylococcus
FDGSFGWKGLLNAVSEGIIGM

SEQ ID NO: 1872628 - protein, 17 aa, Staphylococcus
FDGSLLDRAEQMRKLSG

SEQ ID NO: 1872629 - protein, 18 aa, Staphylococcus
FDGSRLLFYYAPVAILIS

SEQ ID NO: 1872630 - protein, 25 aa, Staphylococcus
FDHPNRVALFIALAIMGFVGLILGI

SEQ ID NO: 1872631 - protein, 17 aa, Staphylococcus
FDIIKNGIFAYLAIYVG

SEQ ID NO: 1872632 - protein, 17 aa, Staphylococcus
FDIPGICYFLVESIRSR

SEQ ID NO: 1872633 - protein, 24 aa, Staphylococcus
FDIVYEIIDIIIFIGTFTMTVRRL

SEQ ID NO: 1872634 - protein, 20 aa, Staphylococcus
FDKDNHLIGSGMTDHTGHIT

SEQ ID NO: 1872635 - protein, 24 aa, Staphylococcus
FDKFKFSAAQSELDDANTLMDRYE

SEQ ID NO: 1872636 - protein, 23 aa, Staphylococcus
FDKKRKRIMLNYLRDLAENHQVL

SEQ ID NO: 1872637 - protein, 24 aa, Staphylococcus
FDKMFPILMGFFVFLFVFLISGIA

SEQ ID NO: 1872638 - protein, 22 aa, Staphylococcus
FDKQRKAAMMDYLKEMAQTYQV

SEQ ID NO: 1872639 - protein, 25 aa, Staphylococcus
FDKQRKEIMMNYLRQMPNSYQILYF

SEQ ID NO: 1872640 - protein, 25 aa, Staphylococcus
FDKQRKSMMLNYLRELAKDYQVLYF

SEQ ID NO: 1872641 - protein, 23 aa, Staphylococcus
FDKQRKSMMLNYLRELSQEHQVL

SEQ ID NO: 1872642 - protein, 20 aa, Staphylococcus
FDKYGAFFIKGLKNTILISM

SEQ ID NO: 1872643 - protein, 19 aa, Staphylococcus
FDLALRYIQKLSYKKILIT

SEQ ID NO: 1872644 - protein, 19 aa, Staphylococcus
FDLDLAYENMREILLKADE

SEQ ID NO: 1872645 - protein, 27 aa, Staphylococcus
FDLDWKKSRSRLPEMSYNFKRVERYKH

SEQ ID NO: 1872646 - protein, 18 aa, Staphylococcus
FDLELAYQNLREILLKAN

SEQ ID NO: 1872647 - protein, 21 aa, Staphylococcus
FDLIIGLLLNFQIFLKNKKYD

SEQ ID NO: 1872648 - protein, 17 aa, Staphylococcus
FDLLNFILLRIIPTLIL

SEQ ID NO: 1872649 - protein, 21 aa, Staphylococcus
FDLLQGFGYLAGFIILFFRAI

SEQ ID NO: 1872650 - protein, 24 aa, Staphylococcus
FDLSSCKSISMGWMSLVDLHKQYI

SEQ ID NO: 1872651 - protein, 24 aa, Staphylococcus
FDLVPRIAVGSIIAYIIGQHVDVF

SEQ ID NO: 1872652 - protein, 26 aa, Staphylococcus
FDMAKVGGNIGVWLGVYIPVLVIFIM

SEQ ID NO: 1872653 - protein, 17 aa, Staphylococcus
FDMLVLYALSTFVCTVP

SEQ ID NO: 1872654 - protein, 26 aa, Staphylococcus
FDNAKELLLSGLEKLEYRGYDSAGIA

SEQ ID NO: 1872655 - protein, 22 aa, Staphylococcus
FDNEKYYGAVVFEKDFSKNAMS

SEQ ID NO: 1872656 - protein, 31 aa, Staphylococcus
FDNMPELRWHYSYYICLVVMLVIAIALIIFF

SEQ ID NO: 1872657 - protein, 20 aa, Staphylococcus
FDNPMAWPVLFIDIVILTPF

SEQ ID NO: 1872658 - protein, 24 aa, Staphylococcus
FDPKLGAMMGLWFNTMIAFTAYFI

SEQ ID NO: 1872659 - protein, 17 aa, Staphylococcus
FDPRTSTISGVATKVGT

SEQ ID NO: 1872660 - protein, 19 aa, Staphylococcus
FDQAMARAQAQINQAKNEA

SEQ ID NO: 1872661 - protein, 25 aa, Staphylococcus
FDQGNDWLGGLKFLGLNHVGFAISK

SEQ ID NO: 1872662 - protein, 24 aa, Staphylococcus
FDQISKWIIASSMKIGDSYEVIPH

SEQ ID NO: 1872663 - protein, 35 aa, Staphylococcus
FDQLPRHVAIMIGIVIAWTCYDRKTAFTKKVQIFT

SEQ ID NO: 1872664 - protein, 25 aa, Staphylococcus
FDQLTKWLIVKSMSIGDSYEVIPGF

SEQ ID NO: 1872665 - protein, 19 aa, Staphylococcus
FDTRTVIMIAHRQSTIRAA

SEQ ID NO: 1872666 - protein, 32 aa, Staphylococcus
FDVFLLLFIMKFGFRKIEAIVGTLIFTVLMIF

SEQ ID NO: 1872667 - protein, 32 aa, Staphylococcus; identical to SEQ ID NO: 1741034

SEQ ID NO: 1872668 - protein, 32 aa, Staphylococcus
FDVFLLLFIMRFGFRKIEAIVGTLIFTVLVIF

SEQ ID NO: 1872669 - protein, 34 aa, Staphylococcus
FDVHEVLESLPIDFKKLMIVGAIISALTAIVPVF

SEQ ID NO: 1872670 - protein, 25 aa, Staphylococcus
FDVPKRLYNTVGIVGACGWMVYTIF

SEQ ID NO: 1872671 - protein, 31 aa, Staphylococcus
FDYMPELKWHYAYFICLGVMLVITIVLVVFF

SEQ ID NO: 1872672 - protein, 18 aa, Staphylococcus
FDYVGMFIFGVFIAALMI

SEQ ID NO: 1872673 - protein, 20 aa, Staphylococcus
FEDMRYISLNSMIQRNTPKE

SEQ ID NO: 1872674 - protein, 19 aa, Staphylococcus
FEEHPKEALWWVQERKEKE

SEQ ID NO: 1872675 - protein, 18 aa, Staphylococcus
FEFFAQDITREFNGIPLK

SEQ ID NO: 1872676 - protein, 20 aa, Staphylococcus
FEFKSTKPFIDLRVLMHNTA

SEQ ID NO: 1872677 - protein, 25 aa, Staphylococcus
FEFLSFANPIGIMFYIVLQIVLSYL

SEQ ID NO: 1872678 - protein, 19 aa, Staphylococcus
FEGIFKLGHFSVYFILLVG

SEQ ID NO: 1872679 - protein, 24 aa, Staphylococcus
FEGTKLSFLQVFFEIMSAFGTCGL

SEQ ID NO: 1872680 - protein, 22 aa, Staphylococcus
FEIASRVSTSYAYIFTIGLYLV

SEQ ID NO: 1872681 - protein, 20 aa, Staphylococcus
FEIDATWLLLLAVFIIIINA

SEQ ID NO: 1872682 - protein, 22 aa, Staphylococcus
FEIIFGILLFWKRPCKWTKCVI

SEQ ID NO: 1872683 - protein, 17 aa, Staphylococcus
FEIPGLGAFLVDSIRSR

SEQ ID NO: 1872684 - protein, 24 aa, Staphylococcus
FEKGRPTPFIDFSIVKNRAFLGST

SEQ ID NO: 1872685 - protein, 18 aa, Staphylococcus
FEKKEKYGVVSYKTIALS

SEQ ID NO: 1872686 - protein, 20 aa, Staphylococcus
FEKYLYITLVTAIAVIAIYM

SEQ ID NO: 1872687 - protein, 17 aa, Staphylococcus
FELLVLFIVVSFIVSII

SEQ ID NO: 1872688 - protein, 20 aa, Staphylococcus
FELPQSVLIQKDCVLISKNN

SEQ ID NO: 1872689 - protein, 21 aa, Staphylococcus
FELSKSFLLPLIAVSLVLLSN

SEQ ID NO: 1872690 - protein, 17 aa, Staphylococcus
FENEIQNLIAVYDDILK

SEQ ID NO: 1872691 - protein, 17 aa, Staphylococcus
FENEIQNLIAVYDDILR

SEQ ID NO: 1872692 - protein, 18 aa, Staphylococcus
FENIVGRGIKGKIDHNNI

SEQ ID NO: 1872693 - protein, 17 aa, Staphylococcus
FENLLRNAIKYTNNEGA

SEQ ID NO: 1872694 - protein, 26 aa, Staphylococcus
FENMPELKWHYGYYATLVIMVLISLG

SEQ ID NO: 1872695 - protein, 26 aa, Staphylococcus
FEPDKIKAAIFFGGFYDMKTVKATEF

SEQ ID NO: 1872696 - protein, 23 aa, Staphylococcus
FEPLKHLWSLAIEEQFYLFFPVV

SEQ ID NO: 1872697 - protein, 19 aa, Staphylococcus
FEPMSAKKQIGFALSVSLL

SEQ ID NO: 1872698 - protein, 18 aa, Staphylococcus
FEPSEMGFNLFVNLLNII

SEQ ID NO: 1872699 - protein, 18 aa, Staphylococcus
FEQLLLIFIDNAMKYDKD

SEQ ID NO: 1872700 - protein, 20 aa, Staphylococcus
FEQLLLIFLDNAMKYDTDNK

SEQ ID NO: 1872701 - protein, 20 aa, Staphylococcus
FEQLLLIFLDNAMKYDTKRK

SEQ ID NO: 1872702 - protein, 30 aa, Staphylococcus
FEQRFTPSQIKGAIFFGGFYDMKTVRETEF

SEQ ID NO: 1872703 - protein, 19 aa, Staphylococcus
FESRIRKLVLILLVGGSIS

SEQ ID NO: 1872704 - protein, 17 aa, Staphylococcus
FETMSFLTLPPKEVFLA

SEQ ID NO: 1872705 - protein, 19 aa, Staphylococcus
FEYNHAFQNMSWHKSLFYA

SEQ ID NO: 1872706 - protein, 18 aa, Staphylococcus
FFAEQRHLLEASSYFFIC

SEQ ID NO: 1872707 - protein, 17 aa, Staphylococcus
FFAKTSFAQALISFAER

SEQ ID NO: 1872708 - protein, 23 aa, Staphylococcus
FFCTFIAVILLFVWPVVYNAIVT

SEQ ID NO: 1872709 - protein, 24 aa, Staphylococcus
FFDEKGKIVGLLQMFMTKESIADR

SEQ ID NO: 1872710 - protein, 19 aa, Staphylococcus
FFDKFMRYTTELTFITWAL

SEQ ID NO: 1872711 - protein, 19 aa, Staphylococcus
FFDVALVRDFLALMYQYKL

SEQ ID NO: 1872712 - protein, 18 aa, Staphylococcus
FFEGAIVVLLFTIGTLLQ

SEQ ID NO: 1872713 - protein, 17 aa, Staphylococcus
FFFAFGAYILWGILPIY

SEQ ID NO: 1872714 - protein, 27 aa, Staphylococcus
FFFGFILRLLGPFGLHHIFYLPFWQTA

SEQ ID NO: 1872715 - protein, 27 aa, Staphylococcus
FFFGFILRLLGPFGLHHIFYLPFWQTG

SEQ ID NO: 1872716 - protein, 18 aa, Staphylococcus
FFFIIAIMMFARKNKVEI

SEQ ID NO: 1872717 - protein, 26 aa, Staphylococcus
FFGFILRLLGPFGLHHIFYLPFWQTG

SEQ ID NO: 1872718 - protein, 41 aa, Staphylococcus; identical to SEQ ID NO: 1741045

SEQ ID NO: 1872719 - protein, 18 aa, Staphylococcus
FFGRGIRKKRERGFAHNQ

SEQ ID NO: 1872720 - protein, 18 aa, Staphylococcus
FFGSGKFVKQGFYMNNSL

SEQ ID NO: 1872721 - protein, 18 aa, Staphylococcus
FFHESRLGKWIDNEVYDF

SEQ ID NO: 1872722 - protein, 18 aa, Staphylococcus
FFHESRLGKWIDNEVYEF

SEQ ID NO: 1872723 - protein, 17 aa, Staphylococcus
FFIALKYAFTMSVISVI

SEQ ID NO: 1872724 - protein, 17 aa, Staphylococcus
FFIGMLFTFCIAMLSLA

SEQ ID NO: 1872725 - protein, 22 aa, Staphylococcus
FFIIFGVFIPRVIKSLRKLEYF

SEQ ID NO: 1872726 - protein, 19 aa, Staphylococcus
FFIIWVSHFLFHWQTSHIA

SEQ ID NO: 1872727 - protein, 17 aa, Staphylococcus
FFIKRNITIKMPKEVPP

SEQ ID NO: 1872728 - protein, 18 aa, Staphylococcus
FFILGILVKPVLDPIMRK

SEQ ID NO: 1872729 - protein, 20 aa, Staphylococcus
FFINIGIFVSMKFKEGLAKA

SEQ ID NO: 1872730 - protein, 21 aa, Staphylococcus
FFINIGIFVSMQFKEGLTKAF

SEQ ID NO: 1872731 - protein, 23 aa, Staphylococcus
FFIPFLLIFIIDGFKGIKETLPS

SEQ ID NO: 1872732 - protein, 26 aa, Staphylococcus
FFIQKRKVKNIGMILFGFGALFYGLE

SEQ ID NO: 1872733 - protein, 22 aa, Staphylococcus
FFISGTVTWFAFDKAKYEKQNY

SEQ ID NO: 1872734 - protein, 17 aa, Staphylococcus
FFISRVYKWYELDEQFV

SEQ ID NO: 1872735 - protein, 18 aa, Staphylococcus
FFKAFWKENGASIVNAFK

SEQ ID NO: 1872736 - protein, 26 aa, Staphylococcus
FFKASGRLPSWAIGFSIYATTLSAIT

SEQ ID NO: 1872737 - protein, 20 aa, Staphylococcus
FFLAATLVWFVHDKDIYKRL

SEQ ID NO: 1872738 - protein, 17 aa, Staphylococcus
FFLFPFIFYLNTITYIY

SEQ ID NO: 1872739 - protein, 17 aa, Staphylococcus
FFLIYGGTIKFLAKDSP

SEQ ID NO: 1872740 - protein, 18 aa, Staphylococcus
FFLLAFCMILPWRIAMLM

SEQ ID NO: 1872741 - protein, 26 aa, Staphylococcus
FFLLPRTLTLFFPKADWAQTISQTAN

SEQ ID NO: 1872742 - protein, 17 aa, Staphylococcus
FFLPLVMLGLHHIFTPI

SEQ ID NO: 1872743 - protein, 25 aa, Staphylococcus
FFLTCFPGILLIFIRKVAYFKYLTE

SEQ ID NO: 1872744 - protein, 19 aa, Staphylococcus
FFLVMEYIEGPTLSEYIKT

SEQ ID NO: 1872745 - protein, 24 aa, Staphylococcus
FFNEKGKIVGLLQMFMTRESIADR

SEQ ID NO: 1872746 - protein, 17 aa, Staphylococcus
FFNIEALSWLDVLKNIV

SEQ ID NO: 1872747 - protein, 18 aa, Staphylococcus
FFPCILIVLFSVVTKNKW

SEQ ID NO: 1872748 - protein, 22 aa, Staphylococcus
FFPCILVILFSVITRSKWVGVI

SEQ ID NO: 1872749 - protein, 18 aa, Staphylococcus
FFPCILVVLFSVVTRSKW

SEQ ID NO: 1872750 - protein, 22 aa, Staphylococcus
FFPCVLVVLFSVITRSKWVGVI

SEQ ID NO: 1872751 - protein, 17 aa, Staphylococcus
FFSCILLLAGCNYSKKQ

SEQ ID NO: 1872752 - protein, 18 aa, Staphylococcus
FFTACIGGGIGGAVIGGI

SEQ ID NO: 1872753 - protein, 17 aa, Staphylococcus
FFTACIGGGIGGAVVGG

SEQ ID NO: 1872754 - protein, 17 aa, Staphylococcus
FFTACLGGGIGGAVIGG

SEQ ID NO: 1872755 - protein, 17 aa, Staphylococcus
FFTILLALIQGYFILSE

SEQ ID NO: 1872756 - protein, 26 aa, Staphylococcus
FFTILTCTLIILLAITVFYFQSITKE

SEQ ID NO: 1872757 - protein, 20 aa, Staphylococcus
FFTKYGSFFVKGIVNTIILS

SEQ ID NO: 1872758 - protein, 25 aa, Staphylococcus
FFTNGGKILFHWGILTIESDGVLEG

SEQ ID NO: 1872759 - protein, 17 aa, Staphylococcus
FFVIYYVVFRLAIKVLK

SEQ ID NO: 1872760 - protein, 19 aa, Staphylococcus
FFVKTSFARFIISLGEKYL

SEQ ID NO: 1872761 - protein, 18 aa, Staphylococcus
FFVLFCMALAAALMMQYY

SEQ ID NO: 1872762 - protein, 17 aa, Staphylococcus
FFVNTSFAQWLIALGEH

SEQ ID NO: 1872763 - protein, 17 aa, Staphylococcus
FFVVIALIIAYLTQLLF

SEQ ID NO: 1872764 - protein, 24 aa, Staphylococcus
FFVVPFLIAWILDLVLRKVIHLYR

SEQ ID NO: 1872765 - protein, 17 aa, Staphylococcus
FFYEYKMNWRNTKKQIG

SEQ ID NO: 1872766 - protein, 19 aa, Staphylococcus
FFYGIPFLGGMIIFSYFWQ

SEQ ID NO: 1872767 - protein, 18 aa, Staphylococcus
FFYGIPFLGGSVIVSFGW

SEQ ID NO: 1872768 - protein, 24 aa, Staphylococcus
FFYYVVRFIFRSAIKKQVLRMVSS

SEQ ID NO: 1872769 - protein, 18 aa, Staphylococcus
FGAFDLVVLLGFKSLGIN

SEQ ID NO: 1872770 - protein, 17 aa, Staphylococcus
FGAGTIFDNMDFIVSNI

SEQ ID NO: 1872771 - protein, 17 aa, Staphylococcus
FGAIGFIIAILWMVIAK

SEQ ID NO: 1872772 - protein, 18 aa, Staphylococcus
FGAKRAMVVGPIFTATGI

SEQ ID NO: 1872773 - protein, 17 aa, Staphylococcus
FGALMRYLFSFFNHGHD

SEQ ID NO: 1872774 - protein, 20 aa, Staphylococcus
FGAMLGLWLNILMAIISFTV

SEQ ID NO: 1872775 - protein, 27 aa, Staphylococcus
FGASMIIMGGGIVWYVKHRKRKTKSQI

SEQ ID NO: 1872776 - protein, 23 aa, Staphylococcus
FGAVGIVMAVLWAIIAKDLPEQH

SEQ ID NO: 1872777 - protein, 17 aa, Staphylococcus
FGAYKIFSNTPKNTYLL

SEQ ID NO: 1872778 - protein, 23 aa, Staphylococcus
FGDINTHYIIKVVSKYQLDSEGN

SEQ ID NO: 1872779 - protein, 19 aa, Staphylococcus
FGDVPALLATFILGPVAGL

SEQ ID NO: 1872780 - protein, 18 aa, Staphylococcus
FGEAEFWLSAIKVATIII

SEQ ID NO: 1872781 - protein, 23 aa, Staphylococcus
FGFLRAMMRYVERLLSHRTTFTM

SEQ ID NO: 1872782 - protein, 18 aa, Staphylococcus
FGFLSIPITIIWIVAITN

SEQ ID NO: 1872783 - protein, 20 aa, Staphylococcus
FGFLSIPITVIWIVAITNAI

SEQ ID NO: 1872784 - protein, 17 aa, Staphylococcus
FGFMVPILAAYIAYSIA

SEQ ID NO: 1872785 - protein, 21 aa, Staphylococcus
FGFNMSSFWLVFSGAVTAIPL

SEQ ID NO: 1872786 - protein, 25 aa, Staphylococcus
FGGFIASTIGWQWIFIISIALSILS

SEQ ID NO: 1872787 - protein, 27 aa, Staphylococcus
FGGFIIGWTYWFCWIISSMSDLTAIGQ

SEQ ID NO: 1872788 - protein, 26 aa, Staphylococcus
FGGFMASTIGWQWIFIVSIALSILAF

SEQ ID NO: 1872789 - protein, 19 aa, Staphylococcus
FGGGLAYSGLVIEWNVPTT

SEQ ID NO: 1872790 - protein, 22 aa, Staphylococcus
FGGGLLDFFATNWIPLAQNHWL

SEQ ID NO: 1872791 - protein, 24 aa, Staphylococcus
FGGIGCAISMLFLSKIIDKHGTLF

SEQ ID NO: 1872792 - protein, 26 aa, Staphylococcus
FGGIHEIYFPYVLMRPLLFIAVILGG

SEQ ID NO: 1872793 - protein, 26 aa, Staphylococcus
FGGIHEIYFPYVLMRPLLFVSVILGG

SEQ ID NO: 1872794 - protein, 24 aa, Staphylococcus
FGGLIGGPVVKFLIKRYNLKPEHS

SEQ ID NO: 1872795 - protein, 23 aa, Staphylococcus
FGGLIGGPVVKYLIKRYNLTPEH

SEQ ID NO: 1872796 - protein, 25 aa, Staphylococcus
FGGLKTAYVVLAFFAFVFVLLFFSE

SEQ ID NO: 1872797 - protein, 31 aa, Staphylococcus
FGGLMSTFVGWRWIFIISIIVALLAMYLMRH

SEQ ID NO: 1872798 - protein, 31 aa, Staphylococcus
FGGMIDTAIGWRWIYIISIIVAILAILLIKG

SEQ ID NO: 1872799 - protein, 17 aa, Staphylococcus
FGGMYASSVNRSMDEIL

SEQ ID NO: 1872800 - protein, 23 aa, Staphylococcus
FGGSCVGLGIGIIVLAGGTTAGT

SEQ ID NO: 1872801 - protein, 23 aa, Staphylococcus
FGGSCVGLGIGVIVLAGGTTAGT

SEQ ID NO: 1872802 - protein, 23 aa, Staphylococcus
FGGTCVGLGIGIIVLAGGTTAGT

SEQ ID NO: 1872803 - protein, 23 aa, Staphylococcus
FGHALRNALIPVITIIVPMLAGI

SEQ ID NO: 1872804 - protein, 23 aa, Staphylococcus
FGHALRNALIPVITIIVPMLASI

SEQ ID NO: 1872805 - protein, 36 aa, Staphylococcus
FGHPRGLGVLFFVEFWERFSYYGMRALLIFYMFYAI

SEQ ID NO: 1872806 - protein, 40 aa, Staphylococcus
FGHPRGLGVLFFVEFWERFSYYGMRAMLIFYMYFAIHQNG

SEQ ID NO: 1872807 - protein, 37 aa, Staphylococcus
FGHPRGLGVLFFVEFWERFSYYGMRAMLLFYMYYAIA

SEQ ID NO: 1872808 - protein, 26 aa, Staphylococcus
FGIASPEWRGVMSMYIFGTIFGAIFF

SEQ ID NO: 1872809 - protein, 21 aa, Staphylococcus
FGICMKPVMDPIMRKIAKRAA

SEQ ID NO: 1872810 - protein, 19 aa, Staphylococcus
FGIDLSRGTDVNNYITFEG

SEQ ID NO: 1872811 - protein, 22 aa, Staphylococcus
FGIGFGEYMSRMIIPNLFSLIA

SEQ ID NO: 1872812 - protein, 20 aa, Staphylococcus
FGIGFLLIGVIFKPITDPLM

SEQ ID NO: 1872813 - protein, 21 aa, Staphylococcus
FGILCAEIIYYIYTRVKQHYG

SEQ ID NO: 1872814 - protein, 23 aa, Staphylococcus
FGILSIPITVIWIVAITNAINLI

SEQ ID NO: 1872815 - protein, 28 aa, Staphylococcus
FGIQIPSIFMNPWFQFILATPVQFIIGW

SEQ ID NO: 1872816 - protein, 18 aa, Staphylococcus
FGIRKFAIGIGSVALATV

SEQ ID NO: 1872817 - protein, 19 aa, Staphylococcus
FGISVSAILAGAGVVGVAV

SEQ ID NO: 1872818 - protein, 25 aa, Staphylococcus
FGITSVLAGISWNAESFIVFRIIQG

SEQ ID NO: 1872819 - protein, 17 aa, Staphylococcus
FGIVFYLIFLILFLFAA

SEQ ID NO: 1872820 - protein, 17 aa, Staphylococcus
FGKEAAMVAGYQHSEHC

SEQ ID NO: 1872821 - protein, 23 aa, Staphylococcus
FGKTSKTDVCFMMFNLFVLIFLS

SEQ ID NO: 1872822 - protein, 25 aa, Staphylococcus
FGLAMDYEVFLMSRIHEEYSKTRNN

SEQ ID NO: 1872823 - protein, 26 aa, Staphylococcus
FGLDIKWGAAITAIFSILIFVSKSGQ

SEQ ID NO: 1872824 - protein, 27 aa, Staphylococcus
FGLDIKWGAAITAVFSILIFVSRSGQK

SEQ ID NO: 1872825 - protein, 21 aa, Staphylococcus
FGLGFIIVGVILKPITDPLMR

SEQ ID NO: 1872826 - protein, 20 aa, Staphylococcus
FGLGILYTWVPLKANYLGGS

SEQ ID NO: 1872827 - protein, 18 aa, Staphylococcus
FGLIGSIFAMMFVSKTYS

SEQ ID NO: 1872828 - protein, 18 aa, Staphylococcus
FGLKGFAYSLVIANITKY

SEQ ID NO: 1872829 - protein, 17 aa, Staphylococcus
FGLKLLFGATLVSFISA

SEQ ID NO: 1872830 - protein, 25 aa, Staphylococcus
FGLKTKFFFEMLIELMKKSMTMKEL

SEQ ID NO: 1872831 - protein, 19 aa, Staphylococcus
FGLLGTRINKITTRKIIGI

SEQ ID NO: 1872832 - protein, 17 aa, Staphylococcus
FGLPVFTLPFIVATWIM

SEQ ID NO: 1872833 - protein, 17 aa, Staphylococcus
FGLSADLLFPIVKEGSE

SEQ ID NO: 1872834 - protein, 18 aa, Staphylococcus
FGLSADWLQPIIKDAAET

SEQ ID NO: 1872835 - protein, 25 aa, Staphylococcus
FGLTVKETFLTWSLLETVISVSGII

SEQ ID NO: 1872836 - protein, 25 aa, Staphylococcus
FGLTVKETFLTWSLLETVISVSGLV

SEQ ID NO: 1872837 - protein, 21 aa, Staphylococcus
FGLTVKETFLTWSMLETIISV

SEQ ID NO: 1872838 - protein, 18 aa, Staphylococcus
FGLVFGFVLMFVLKYTPL

SEQ ID NO: 1872839 - protein, 17 aa, Staphylococcus
FGLYPFKSPVSIMTYLF

SEQ ID NO: 1872840 - protein, 20 aa, Staphylococcus
FGMGFIFAALYVYTKRIWVP

SEQ ID NO: 1872841 - protein, 24 aa, Staphylococcus
FGMYEIIPGFIISVIVTYAVSKLT

SEQ ID NO: 1872842 - protein, 24 aa, Staphylococcus
FGMYEIIPGFIISVIVTYVVSLLT

SEQ ID NO: 1872843 - protein, 24 aa, Staphylococcus
FGMYEIIPGFIISVMVTYFVSKLT

SEQ ID NO: 1872844 - protein, 17 aa, Staphylococcus
FGNFSWASMLFCAGIGS

SEQ ID NO: 1872845 - protein, 21 aa, Staphylococcus
FGNTFKGIFNLMKAFAPNTHS

SEQ ID NO: 1872846 - protein, 17 aa, Staphylococcus
FGPIIASVICVRVFRLE

SEQ ID NO: 1872847 - protein, 32 aa, Staphylococcus
FGPLGLDSEVKWVFNLIRVVLPLIIILVLFIV

SEQ ID NO: 1872848 - protein, 18 aa, Staphylococcus
FGQGFYLIFLILFLFAAL

SEQ ID NO: 1872849 - protein, 23 aa, Staphylococcus
FGQLLRKPKFVIPMLLQGLTYVM

SEQ ID NO: 1872850 - protein, 17 aa, Staphylococcus
FGRGITLLGNKQVTIAF

SEQ ID NO: 1872851 - protein, 18 aa, Staphylococcus
FGSDWINISLGWGLAVTL

SEQ ID NO: 1872852 - protein, 31 aa, Staphylococcus
FGSGYNVPERINGRFNIYGGNTISNNLDMIK

SEQ ID NO: 1872853 - protein, 19 aa, Staphylococcus
FGSHMFQFINVERIIEAQP

SEQ ID NO: 1872854 - protein, 18 aa, Staphylococcus
FGSIILKAKENIYRVIFN

SEQ ID NO: 1872855 - protein, 25 aa, Staphylococcus
FGSKAALVIFMWLPKAYAVLNTELA

SEQ ID NO: 1872856 - protein, 18 aa, Staphylococcus
FGSKIEKNKIGWMIDVFC

SEQ ID NO: 1872857 - protein, 22 aa, Staphylococcus
FGSLNLIILPTFVAVFTGFVTL

SEQ ID NO: 1872858 - protein, 17 aa, Staphylococcus
FGSTALWIGAGLMSLAV

SEQ ID NO: 1872859 - protein, 18 aa, Staphylococcus
FGTFDLVVLLGLKHLNID

SEQ ID NO: 1872860 - protein, 18 aa, Staphylococcus
FGTFLFVKLIEMIRVKEV

SEQ ID NO: 1872861 - protein, 17 aa, Staphylococcus
FGTGSPFAFPGSMIGVL

SEQ ID NO: 1872862 - protein, 26 aa, Staphylococcus
FGTHYLRIVALCFPFLGLNFVLNGIV

SEQ ID NO: 1872863 - protein, 21 aa, Staphylococcus
FGVLVGTPIAIISCIVSIFVL

SEQ ID NO: 1872864 - protein, 26 aa, Staphylococcus
FGVNLKLRYPFIGAIVGSGIGAAYIS

SEQ ID NO: 1872865 - protein, 26 aa, Staphylococcus
FGVNLKLRYPFIGAIVGSGLGAAYIS

SEQ ID NO: 1872866 - protein, 25 aa, Staphylococcus
FGVPRDIASFVLPTGYSFNLDGAAM

SEQ ID NO: 1872867 - protein, 19 aa, Staphylococcus
FGVQIILIFILKMVITAVI

SEQ ID NO: 1872868 - protein, 25 aa, Staphylococcus
FGVSIAVGLIWSLTFVMPVTMPFYI

SEQ ID NO: 1872869 - protein, 22 aa, Staphylococcus
FGWRPVKKRFKNAIVTIINEVH

SEQ ID NO: 1872870 - protein, 22 aa, Staphylococcus
FGWRPVKNRFKQAILSIIQELH

SEQ ID NO: 1872871 - protein, 18 aa, Staphylococcus
FGYIPGFVLIYFRAIIPI

SEQ ID NO: 1872872 - protein, 17 aa, Staphylococcus
FGYSRYLTYILVILASG

SEQ ID NO: 1872873 - protein, 26 aa, Staphylococcus
FGYTKWRNNWLFILFIIHYAILIYFV

SEQ ID NO: 1872874 - protein, 18 aa, Staphylococcus
FGYVLGFLLPFIESFIPV

SEQ ID NO: 1872875 - protein, 19 aa, Staphylococcus
FHAAMTFAQVFLFSEETGD

SEQ ID NO: 1872876 - protein, 23 aa, Staphylococcus
FHAKTTIIFGFAFIQAAVQLLMF

SEQ ID NO: 1872877 - protein, 22 aa, Staphylococcus
FHELFFDLIFVYAMQKMAHVIL

SEQ ID NO: 1872878 - protein, 24 aa, Staphylococcus
FHELFYDLIFVYALQKIAHVLLHT

SEQ ID NO: 1872879 - protein, 19 aa, Staphylococcus
FHGLMTFIPVFLFSEETGD

SEQ ID NO: 1872880 - protein, 21 aa, Staphylococcus
FHIGYCVMDMYFLTGLLNKHV

SEQ ID NO: 1872881 - protein, 18 aa, Staphylococcus
FHIHFRSFMVGTLVYLLG

SEQ ID NO: 1872882 - protein, 17 aa, Staphylococcus
FHIWLPKAMAAPTPVSA

SEQ ID NO: 1872883 - protein, 17 aa, Staphylococcus
FHLKIFLNESLRFDLLI

SEQ ID NO: 1872884 - protein, 20 aa, Staphylococcus
FHMFSDALSLLVALIAFIYA

SEQ ID NO: 1872885 - protein, 17 aa, Staphylococcus
FHPLLALLLTAIFVGFT

SEQ ID NO: 1872886 - protein, 20 aa, Staphylococcus
FHRHSFRQSWKQGLQNIKQH

SEQ ID NO: 1872887 - protein, 21 aa, Staphylococcus
FHSYHDLEFLLVTREDEYKKL

SEQ ID NO: 1872888 - protein, 18 aa, Staphylococcus
FHTPTRVIIFKHLLPQVI

SEQ ID NO: 1872889 - protein, 17 aa, Staphylococcus
FHVPTHVIIFKHFMPQV

SEQ ID NO: 1872890 - protein, 22 aa, Staphylococcus
FIAAIFHWTAGFAFSAGLIDFV

SEQ ID NO: 1872891 - protein, 17 aa, Staphylococcus
FIAAIPIILFSSIFILI

SEQ ID NO: 1872892 - protein, 22 aa, Staphylococcus
FIAALFHWTAGFSFSAGLIDYV

SEQ ID NO: 1872893 - protein, 17 aa, Staphylococcus
FIAALYLPYFTEKLGNT

SEQ ID NO: 1872894 - protein, 23 aa, Staphylococcus
FIAAYIISFGIKFIEKKVPEGLD

SEQ ID NO: 1872895 - protein, 17 aa, Staphylococcus
FIACADLGISLGGVLMG

SEQ ID NO: 1872896 - protein, 25 aa, Staphylococcus
FIAEAYRAALLYHKWYFIEHWELAL

SEQ ID NO: 1872897 - protein, 29 aa, Staphylococcus
FIAGLCRYIIADNFVDWMVIALIIIVVLG

SEQ ID NO: 1872898 - protein, 27 aa, Staphylococcus
FIAGVCASSAMLLPGISGSFMLLVFGA

SEQ ID NO: 1872899 - protein, 24 aa, Staphylococcus
FIAGVLLVPALVSFVWFSVFGVLG

SEQ ID NO: 1872900 - protein, 26 aa, Staphylococcus
FIASMCASSAMLLPGISGSFMLLVFG

SEQ ID NO: 1872901 - protein, 18 aa, Staphylococcus
FIASYIVAFIIKLIQKKV

SEQ ID NO: 1872902 - protein, 19 aa, Staphylococcus
FIAVFLLRRREPELPRPYK

SEQ ID NO: 1872903 - protein, 19 aa, Staphylococcus
FIAVPLWGIMKKRQLKKSD

SEQ ID NO: 1872904 - protein, 19 aa, Staphylococcus
FIAVPLWGIMKKRQLKKST

SEQ ID NO: 1872905 - protein, 26 aa, Staphylococcus
FIDDGWAKNGTYCIIRRIQIHIETWD

SEQ ID NO: 1872906 - protein, 22 aa, Staphylococcus
FIDPSIGFTMGWLYYILWSLVS

SEQ ID NO: 1872907 - protein, 29 aa, Staphylococcus
FIDPSLGFTMGWLYYIMWALVSSVDVMVA

SEQ ID NO: 1872908 - protein, 17 aa, Staphylococcus
FIDSFTVVHMLKSNHLS

SEQ ID NO: 1872909 - protein, 23 aa, Staphylococcus
FIEHWKLLLYNVIVILIFFVLGS

SEQ ID NO: 1872910 - protein, 21 aa, Staphylococcus
FIELIIGIILIFAGVMMSQIN

SEQ ID NO: 1872911 - protein, 22 aa, Staphylococcus
FIETPFRKQGFKALSINKYKKS

SEQ ID NO: 1872912 - protein, 18 aa, Staphylococcus
FIFAPIVNVWIFKFFVDV

SEQ ID NO: 1872913 - protein, 30 aa, Staphylococcus
FIFAPIVNVWIFKFFVDVLKMNSFSIFLPW

SEQ ID NO: 1872914 - protein, 32 aa, Staphylococcus
FIFDWKLSLICLIPVILGFLLLKFMMGEDSKA

SEQ ID NO: 1872915 - protein, 25 aa, Staphylococcus
FIFFSGVFLSSWIQSYCKRSVIWKG

SEQ ID NO: 1872916 - protein, 18 aa, Staphylococcus
FIFIIAIFVIGTYLLSYF

SEQ ID NO: 1872917 - protein, 29 aa, Staphylococcus
FIFLFCFIGNIIGGFILFFLMKGTHIMTP

SEQ ID NO: 1872918 - protein, 26 aa, Staphylococcus
FIFLINCVLIVFSIIYPLLLGSFKNH

SEQ ID NO: 1872919 - protein, 27 aa, Staphylococcus
FIFLPALIGWSSMRVFGGNPVLGLVLG

SEQ ID NO: 1872920 - protein, 17 aa, Staphylococcus
FIFLRKRSILSMMNDSS

SEQ ID NO: 1872921 - protein, 20 aa, Staphylococcus
FIFLSFIGLFIYTYFQNTRV

SEQ ID NO: 1872922 - protein, 17 aa, Staphylococcus
FIFNVLNGVALAIVVGM

SEQ ID NO: 1872923 - protein, 18 aa, Staphylococcus
FIFPLLLLLIVLAICLMV

SEQ ID NO: 1872924 - protein, 23 aa, Staphylococcus
FIFRCLVVVLVFIGAVAKTETVW

SEQ ID NO: 1872925 - protein, 20 aa, Staphylococcus
FIFRFVIKIFNLNTIGRGDN

SEQ ID NO: 1872926 - protein, 25 aa, Staphylococcus
FIFSGDILFGYAFTGLFAVLFIKMK

SEQ ID NO: 1872927 - protein, 19 aa, Staphylococcus
FIGAFPIISAIIIILFGVL

SEQ ID NO: 1872928 - protein, 25 aa, Staphylococcus
FIGFLVTCLYFEFAGNPELHHLGIA

SEQ ID NO: 1872929 - protein, 23 aa, Staphylococcus
FIGFSSAWGYWFAAFLGNVAYAT

SEQ ID NO: 1872930 - protein, 18 aa, Staphylococcus
FIGGFLITLIGYYFHENR

SEQ ID NO: 1872931 - protein, 19 aa, Staphylococcus
FIGGFPIVSAIIIILFGIL

SEQ ID NO: 1872932 - protein, 25 aa, Staphylococcus
FIGGPGAVFWMWATAFLGASSAFIE

SEQ ID NO: 1872933 - protein, 21 aa, Staphylococcus
FIGIEGAVVFSSRAKRKKDVG

SEQ ID NO: 1872934 - protein, 17 aa, Staphylococcus
FIGLIGCLFLKRYIKEQ

SEQ ID NO: 1872935 - protein, 31 aa, Staphylococcus
FIGLILGVMVWLGMKAIPIFVILMFFSMQLV

SEQ ID NO: 1872936 - protein, 26 aa, Staphylococcus
FIGLVAIIVGMFWFKLYQRTTNPKAD

SEQ ID NO: 1872937 - protein, 17 aa, Staphylococcus
FIGPLVIWLVKRKDSKL

SEQ ID NO: 1872938 - protein, 18 aa, Staphylococcus
FIGSFPIISAVIIILFGI

SEQ ID NO: 1872939 - protein, 19 aa, Staphylococcus
FIGSLSLFISMISKNALIG

SEQ ID NO: 1872940 - protein, 27 aa, Staphylococcus
FIGTEGYANMQLIFGIIFILITGPLSS

SEQ ID NO: 1872941 - protein, 21 aa, Staphylococcus
FIGTSMGNISGFNSARLFVYD

SEQ ID NO: 1872942 - protein, 19 aa, Staphylococcus
FIGWLHLISGMTFANEPWS

SEQ ID NO: 1872943 - protein, 20 aa, Staphylococcus
FIGWYFWSTWSFVIAGLLII

SEQ ID NO: 1872944 - protein, 34 aa, Staphylococcus
FIHAISGLFSKRFWPSLKFLLPILTGMLLAIGLL

SEQ ID NO: 1872945 - protein, 22 aa, Staphylococcus
FIHNQWLLIISFIFIGINNLTM

SEQ ID NO: 1872946 - protein, 27 aa, Staphylococcus
FIHWIWPDLPMPAAFAIAAILCPTDAV

SEQ ID NO: 1872947 - protein, 25 aa, Staphylococcus
FIIACISGGIGALVASFFNPKYYAY

SEQ ID NO: 1872948 - protein, 17 aa, Staphylococcus
FIIASGFIADTTSLPFI

SEQ ID NO: 1872949 - protein, 18 aa, Staphylococcus
FIIASGFIADTTSLPLTV

SEQ ID NO: 1872950 - protein, 17 aa, Staphylococcus
FIIASGFIADTTSLPMI

SEQ ID NO: 1872951 - protein, 19 aa, Staphylococcus
FIIASGYIGVWLYHFLERV

SEQ ID NO: 1872952 - protein, 17 aa, Staphylococcus
FIIASGYVGVWLYHFLE

SEQ ID NO: 1872953 - protein, 27 aa, Staphylococcus
FIIATFLFKKTNGFFLFTPLFVSMVVG

SEQ ID NO: 1872954 - protein, 17 aa, Staphylococcus
FIIDALVGIGMFFVSYF

SEQ ID NO: 1872955 - protein, 24 aa, Staphylococcus
FIIFFISGTLSWFMHDKEKYKNLK

SEQ ID NO: 1872956 - protein, 22 aa, Staphylococcus
FIIFNFAGQVAMEIATEKTSRV

SEQ ID NO: 1872957 - protein, 18 aa, Staphylococcus
FIIGSGYVGVWLYHFLER

SEQ ID NO: 1872958 - protein, 27 aa, Staphylococcus
FIIHIVSWRWMFFINVLVVIIAILLQI

SEQ ID NO: 1872959 - protein, 17 aa, Staphylococcus
FIILFSFMPSSIDKSST

SEQ ID NO: 1872960 - protein, 18 aa, Staphylococcus
FIILFSLFVVWELKNSHP

SEQ ID NO: 1872961 - protein, 25 aa, Staphylococcus
FIILLALLKKFAWGPLKEVMDKRER

SEQ ID NO: 1872962 - protein, 17 aa, Staphylococcus
FIILPIVLPPTVLGFIL

SEQ ID NO: 1872963 - protein, 23 aa, Staphylococcus
FIILPVLLLIYFSFTDINGHFSF

SEQ ID NO: 1872964 - protein, 26 aa, Staphylococcus
FIINAILIVVGWKFLSRTTAIYTAIT

SEQ ID NO: 1872965 - protein, 23 aa, Staphylococcus
FIIPFLLIFIIDGFKGIKETLPQ

SEQ ID NO: 1872966 - protein, 18 aa, Staphylococcus
FIISPQWFSTHGVNDRDF

SEQ ID NO: 1872967 - protein, 18 aa, Staphylococcus
FIIVFFISFMMNIKVFKQ

SEQ ID NO: 1872968 - protein, 17 aa, Staphylococcus
FIIVFGVLVTVHEYGHM

SEQ ID NO: 1872969 - protein, 18 aa, Staphylococcus
FIIWIAFVQQGQFEPALV

SEQ ID NO: 1872970 - protein, 17 aa, Staphylococcus
FIIWIGSIALFFFFNMF

SEQ ID NO: 1872971 - protein, 19 aa, Staphylococcus
FIIYFGMGFIFAALYVYTK

SEQ ID NO: 1872972 - protein, 19 aa, Staphylococcus
FIIYFLRKSDIITMSLSYV

SEQ ID NO: 1872973 - protein, 26 aa, Staphylococcus
FIKDHLFGAIGLDKQVAWIFDLIRVI

SEQ ID NO: 1872974 - protein, 31 aa, Staphylococcus
FIKDHLFGPLGLDQQVAWIFDLVRILLPLIV

SEQ ID NO: 1872975 - protein, 23 aa, Staphylococcus
FIKKEFPKNTGLLIGIYSLSMGL

SEQ ID NO: 1872976 - protein, 17 aa, Staphylococcus
FIKKPLRNLTWIMTGVV

SEQ ID NO: 1872977 - protein, 22 aa, Staphylococcus
FIKNDLNNRLLVVSNQITQELS

SEQ ID NO: 1872978 - protein, 17 aa, Staphylococcus
FIKVCISNLAGVPSVVF

SEQ ID NO: 1872979 - protein, 20 aa, Staphylococcus
FIKVGWIPIKGFEITPFTWF

SEQ ID NO: 1872980 - protein, 32 aa, Staphylococcus
FILATPVQFIIGWQFYVGAYKNLRNGSANMDV

SEQ ID NO: 1872981 - protein, 28 aa, Staphylococcus
FILATPVQFILGWQFYKGAYSSLRNKSA

SEQ ID NO: 1872982 - protein, 17 aa, Staphylococcus
FILAYIFGLMFQYFHME

SEQ ID NO: 1872983 - protein, 18 aa, Staphylococcus
FILFFLMKGTHIMTPEMI

SEQ ID NO: 1872984 - protein, 17 aa, Staphylococcus
FILFFSMILLGTCCVAL

SEQ ID NO: 1872985 - protein, 17 aa, Staphylococcus
FILGAVIVVLSWVGIAR

SEQ ID NO: 1872986 - protein, 17 aa, Staphylococcus
FILGIGLAIIILIIFAF

SEQ ID NO: 1872987 - protein, 20 aa, Staphylococcus
FILICLYSPAITRKQPIPNH

SEQ ID NO: 1872988 - protein, 27 aa, Staphylococcus
FILIFKRSWLDKRVFSKKFVPVVMAAS

SEQ ID NO: 1872989 - protein, 30 aa, Staphylococcus
FILIIIGIVALTFGMNGGFKHHATGTKNYK

SEQ ID NO: 1872990 - protein, 24 aa, Staphylococcus
FILIVCVYLLFSRYSSITLGEEGE

SEQ ID NO: 1872991 - protein, 17 aa, Staphylococcus
FILKMVITAVIGFGASF

SEQ ID NO: 1872992 - protein, 22 aa, Staphylococcus
FILLCAGNLLGIVGVILGIPGY

SEQ ID NO: 1872993 - protein, 17 aa, Staphylococcus
FILLHQWIPYLAKIGAM

SEQ ID NO: 1872994 - protein, 17 aa, Staphylococcus
FILLLGFLGFTVYHTAL

SEQ ID NO: 1872995 - protein, 17 aa, Staphylococcus
FILLPIVLPPTVLGFIL

SEQ ID NO: 1872996 - protein, 18 aa, Staphylococcus
FILLSWLVVMLILLFIFY

SEQ ID NO: 1872997 - protein, 19 aa, Staphylococcus
FILLTLLTTFICYKNYRVF

SEQ ID NO: 1872998 - protein, 23 aa, Staphylococcus
FILNLIFAFTIIFMERRSAGSIW

SEQ ID NO: 1872999 - protein, 20 aa, Staphylococcus
FILNPLIISWIFLLLGMTRA

SEQ ID NO: 1873000 - protein, 22 aa, Staphylococcus
FILPIPLHFKFEPEVFMMAVIA

SEQ ID NO: 1873001 - protein, 17 aa, Staphylococcus
FILQFLLNFFIPSGSGQ

SEQ ID NO: 1873002 - protein, 22 aa, Staphylococcus
FILSIVYWFFFILMINYTVSFA

SEQ ID NO: 1873003 - protein, 18 aa, Staphylococcus
FILSLFVWFFAYIVIAYV

SEQ ID NO: 1873004 - protein, 23 aa, Staphylococcus
FILTLLFHRNLRLERYHETQGAL

SEQ ID NO: 1873005 - protein, 20 aa, Staphylococcus
FILTVFPALIIINPMWFGIL

SEQ ID NO: 1873006 - protein, 19 aa, Staphylococcus
FILVCEFFYGIPFLGGMII

SEQ ID NO: 1873007 - protein, 21 aa, Staphylococcus
FILVISTLFGIEFILLSLNMN

SEQ ID NO: 1873008 - protein, 19 aa, Staphylococcus
FILWSVLRLIAGITSGTVF

SEQ ID NO: 1873009 - protein, 18 aa, Staphylococcus
FIMANWLFLFAGLLFIIK

SEQ ID NO: 1873010 - protein, 18 aa, Staphylococcus
FIMLCFPFTPSALMNVVA

SEQ ID NO: 1873011 - protein, 17 aa, Staphylococcus
FIMYSIIKIFFKNANLT

SEQ ID NO: 1873012 - protein, 17 aa, Staphylococcus
FIMYSIVKVVFKNANLT

SEQ ID NO: 1873013 - protein, 17 aa, Staphylococcus
FINIEFKTTPIAITEGK

SEQ ID NO: 1873014 - protein, 25 aa, Staphylococcus
FINIGIYVSMLFKEGLARAFFIAAG

SEQ ID NO: 1873015 - protein, 25 aa, Staphylococcus
FINIGIYVSMLFKEGLARAFFIAVG

SEQ ID NO: 1873016 - protein, 17 aa, Staphylococcus
FINKIINRHEMAAKDTT

SEQ ID NO: 1873017 - protein, 24 aa, Staphylococcus
FINKRADISLPWLLIYCLSGLGIP

SEQ ID NO: 1873018 - protein, 23 aa, Staphylococcus
FINLKIPNWLNRLITRAIAVIPV

SEQ ID NO: 1873019 - protein, 29 aa, Staphylococcus
FINLKIPNWLRRLITRLIAILPIIICLIV

SEQ ID NO: 1873020 - protein, 28 aa, Staphylococcus
FINMPELKWHYGYYIVLGIMLAISAGCI

SEQ ID NO: 1873021 - protein, 20 aa, Staphylococcus
FINTYPELHHSLSHLTQQLL

SEQ ID NO: 1873022 - protein, 24 aa, Staphylococcus
FINYLKLLWFVSSLGLLAGAMGST

SEQ ID NO: 1873023 - protein, 22 aa, Staphylococcus
FIPFLLIFIIDGFKGIKETLPS

SEQ ID NO: 1873024 - protein, 18 aa, Staphylococcus
FIPFLLIFIIDGLKGVKE

SEQ ID NO: 1873025 - protein, 26 aa, Staphylococcus
FIPIPMPASVIGLVLLFIALCTGIVK

SEQ ID NO: 1873026 - protein, 26 aa, Staphylococcus
FIPIPMPASVIGLVLMFIALSTGIIK

SEQ ID NO: 1873027 - protein, 30 aa, Staphylococcus
FIPKFSVISDFSWFIGFIVAGGSYIILYLL

SEQ ID NO: 1873028 - protein, 24 aa, Staphylococcus
FIPLFIVGLSYLFSSAIIAFLVKY

SEQ ID NO: 1873029 - protein, 21 aa, Staphylococcus
FIPLLATWRGVFQGYESMGPT

SEQ ID NO: 1873030 - protein, 23 aa, Staphylococcus
FIPLLATWRGVFQGYKSMGPTAV

SEQ ID NO: 1873031 - protein, 21 aa, Staphylococcus
FIPLLATWRGVFQGYQSMGPT

SEQ ID NO: 1873032 - protein, 18 aa, Staphylococcus
FIPMMLMILLGAFTKSAQ

SEQ ID NO: 1873033 - protein, 17 aa, Staphylococcus
FIQALQFDYLGYILVAL

SEQ ID NO: 1873034 - protein, 24 aa, Staphylococcus
FIQDVPKWINTYWLADQGVNGTAY

SEQ ID NO: 1873035 - protein, 20 aa, Staphylococcus
FIQLLTPFAIYYIAETLHAS

SEQ ID NO: 1873036 - protein, 18 aa, Staphylococcus
FIQPRTPQGFEMLFNNFS

SEQ ID NO: 1873037 - protein, 19 aa, Staphylococcus
FIRHFKRTLILTLVLTILS

SEQ ID NO: 1873038 - protein, 26 aa, Staphylococcus
FIRRYSVFCAFFFFLGIAFAYFIGFP

SEQ ID NO: 1873039 - protein, 18 aa, Staphylococcus
FISAFIIHELCKKFIPSY

SEQ ID NO: 1873040 - protein, 17 aa, Staphylococcus
FISLFLISIIAHFWWIQ

SEQ ID NO: 1873041 - protein, 35 aa, Staphylococcus
FISPGSQQRLGMALLLPYKVMKLNSDGSFASDSVR

SEQ ID NO: 1873042 - protein, 24 aa, Staphylococcus
FISPKSAVEFSIFVLLIVLIYIFF

SEQ ID NO: 1873043 - protein, 22 aa, Staphylococcus
FISQLYYHFSKGVISEREPVLS

SEQ ID NO: 1873044 - protein, 28 aa, Staphylococcus
FISRNTWISIIMAFLFVMSPLYYRFTVY

SEQ ID NO: 1873045 - protein, 17 aa, Staphylococcus
FITACIGGGIGGAVIGG

SEQ ID NO: 1873046 - protein, 17 aa, Staphylococcus
FITAVFLSRGLLSLLVS

SEQ ID NO: 1873047 - protein, 17 aa, Staphylococcus
FITAVWNGIKYVSIAIW

SEQ ID NO: 1873048 - protein, 19 aa, Staphylococcus
FITFASIIFFLSWTILQYY

SEQ ID NO: 1873049 - protein, 30 aa, Staphylococcus
FITIIALFSFKLYRHYYFKLFAMITWILLI

SEQ ID NO: 1873050 - protein, 26 aa, Staphylococcus
FITIVLFCLVIIFFLKDALHDSELDE

SEQ ID NO: 1873051 - protein, 25 aa, Staphylococcus
FIVAKDGLFPKWFAKENENGAPVNA

SEQ ID NO: 1873052 - protein, 25 aa, Staphylococcus
FIVAKDGLFPKWFAKENKNKAPINA

SEQ ID NO: 1873053 - protein, 23 aa, Staphylococcus
FIVCLPDIIGWVVKMYSRSESQS

SEQ ID NO: 1873054 - protein, 22 aa, Staphylococcus
FIVCLPNIIGQIFKAHSHSNEQ

SEQ ID NO: 1873055 - protein, 23 aa, Staphylococcus
FIVFFCIFLIFSPIGKLKLGKPN

SEQ ID NO: 1873056 - protein, 24 aa, Staphylococcus
FIVFFIFLIRLIYLAIKGKPKKSA

SEQ ID NO: 1873057 - protein, 19 aa, Staphylococcus
FIVFIGFDLIRPAITNYFS

SEQ ID NO: 1873058 - protein, 18 aa, Staphylococcus
FIVFIGFDMIRPALTNYF

SEQ ID NO: 1873059 - protein, 18 aa, Staphylococcus
FIVFIGFDMIRPAVTNYF

SEQ ID NO: 1873060 - protein, 21 aa, Staphylococcus
FIVGAVIGFFGIVLISLSLIM

SEQ ID NO: 1873061 - protein, 18 aa, Staphylococcus
FIVGFLSLLGFKNITFVS

SEQ ID NO: 1873062 - protein, 25 aa, Staphylococcus
FIVGGRPFYHFAYVLFIIGMLAEVS

SEQ ID NO: 1873063 - protein, 17 aa, Staphylococcus
FIVGLFLIWLPTYVMEQ

SEQ ID NO: 1873064 - protein, 28 aa, Staphylococcus
FIVGVILFICGLVVFIVIFGFLSAIITG

SEQ ID NO: 1873065 - protein, 18 aa, Staphylococcus
FIVIIIIALIFYKIGTSS

SEQ ID NO: 1873066 - protein, 17 aa, Staphylococcus
FIVIMAVWLYKIATESG

SEQ ID NO: 1873067 - protein, 17 aa, Staphylococcus
FIVIMAVWLYKIATKSG

SEQ ID NO: 1873068 - protein, 17 aa, Staphylococcus
FIVKQKLFALVIFIVCL

SEQ ID NO: 1873069 - protein, 18 aa, Staphylococcus
FIVLCVFNVRPNVSTITF

SEQ ID NO: 1873070 - protein, 18 aa, Staphylococcus
FIVMSISGIIGFLILFFL

SEQ ID NO: 1873071 - protein, 17 aa, Staphylococcus
FIVMSISGIIGFLILFY

SEQ ID NO: 1873072 - protein, 17 aa, Staphylococcus
FIVMSITGVLGFLILYF

SEQ ID NO: 1873073 - protein, 19 aa, Staphylococcus
FIVNCLLLVLGAALFYGVN

SEQ ID NO: 1873074 - protein, 27 aa, Staphylococcus
FIVPNIYKFCIGRNITIKMPPQVPGNI

SEQ ID NO: 1873075 - protein, 22 aa, Staphylococcus
FIVSGCFLFIFAYFNLAIGSSE

SEQ ID NO: 1873076 - protein, 23 aa, Staphylococcus
FIVSLYWHFLDVVWIFIFTAVYM

SEQ ID NO: 1873077 - protein, 22 aa, Staphylococcus
FIVSLYWHFLDVVWVFIFTAVY

SEQ ID NO: 1873078 - protein, 18 aa, Staphylococcus
FIVVGGLLIAIALTLGGK

SEQ ID NO: 1873079 - protein, 26 aa, Staphylococcus
FIVVNPWLKYKNFRYSLEADVIYIRT

SEQ ID NO: 1873080 - protein, 22 aa, Staphylococcus
FIVYVFAFWFIFSSVLGIFVVT

SEQ ID NO: 1873081 - protein, 20 aa, Staphylococcus
FIYKRRKMVKEEGLALTSSV

SEQ ID NO: 1873082 - protein, 27 aa, Staphylococcus
FIYKYSIFCAVLFILGVIFAFFIGFPL

SEQ ID NO: 1873083 - protein, 18 aa, Staphylococcus
FIYLYRIMLFLSACIYIS

SEQ ID NO: 1873084 - protein, 19 aa, Staphylococcus
FIYNRRHTLSRSKHSTIHS

SEQ ID NO: 1873085 - protein, 18 aa, Staphylococcus
FIYSLPIKNWQAKLFYLL

SEQ ID NO: 1873086 - protein, 19 aa, Staphylococcus
FIYWLIVGISMWFFVNQGV

SEQ ID NO: 1873087 - protein, 22 aa, Staphylococcus
FIYYFVFRFLILKFKYKTPGRE

SEQ ID NO: 1873088 - protein, 17 aa, Staphylococcus
FKAGGKRRVIHAKANQA

SEQ ID NO: 1873089 - protein, 17 aa, Staphylococcus
FKAIFYMLMIILGSLAL

SEQ ID NO: 1873090 - protein, 19 aa, Staphylococcus
FKALKKHIILIIGSIVMIY

SEQ ID NO: 1873091 - protein, 20 aa, Staphylococcus
FKANEVIPIGGMLANNGLIA

SEQ ID NO: 1873092 - protein, 25 aa, Staphylococcus
FKAPLWSTWLLWGIVTIIIISILFF

SEQ ID NO: 1873093 - protein, 37 aa, Staphylococcus
FKDADGKYNALVSYGGRSFSILRASDLEMIYDSGSDI

SEQ ID NO: 1873094 - protein, 19 aa, Staphylococcus
FKDDLYIEGITAYDNERHH

SEQ ID NO: 1873095 - protein, 20 aa, Staphylococcus
FKDDMHGLFEPLKYTPSLSN

SEQ ID NO: 1873096 - protein, 19 aa, Staphylococcus
FKDGEFFVQMPLYIIENQS

SEQ ID NO: 1873097 - protein, 24 aa, Staphylococcus
FKDKGGHAEAFFPSKLPLINLRMN

SEQ ID NO: 1873098 - protein, 17 aa, Staphylococcus
FKDPLPSVTQAMNDIKD

SEQ ID NO: 1873099 - protein, 18 aa, Staphylococcus
FKEFWKSGLKTVIDMWFV

SEQ ID NO: 1873100 - protein, 27 aa, Staphylococcus
FKEKVIFPFIIACGFIADTTSLPFTVS

SEQ ID NO: 1873101 - protein, 17 aa, Staphylococcus
FKENIKLGRPEASDQDV

SEQ ID NO: 1873102 - protein, 22 aa, Staphylococcus
FKEPEKTGGGWGFSYTDKDGDL

SEQ ID NO: 1873103 - protein, 28 aa, Staphylococcus
FKETLFKRSSFWLPFILSSLIFASQHGI

SEQ ID NO: 1873104 - protein, 17 aa, Staphylococcus
FKFFFGLALIVSLVVGV

SEQ ID NO: 1873105 - protein, 17 aa, Staphylococcus
FKFIYLHQDYIIDKIQH

SEQ ID NO: 1873106 - protein, 17 aa, Staphylococcus
FKFLLSLVVITSVVVGV

SEQ ID NO: 1873107 - protein, 19 aa, Staphylococcus
FKFNKAITLDFIKLSFSNF

SEQ ID NO: 1873108 - protein, 21 aa, Staphylococcus
FKFTTFFSGFLIGLIVIYILH

SEQ ID NO: 1873109 - protein, 21 aa, Staphylococcus
FKFTTFFSGYLIGVIVIYILH

SEQ ID NO: 1873110 - protein, 17 aa, Staphylococcus
FKFVFGTILTVSLAAGI

SEQ ID NO: 1873111 - protein, 17 aa, Staphylococcus
FKFVFSLVAITTVIVSV

SEQ ID NO: 1873112 - protein, 22 aa, Staphylococcus
FKGAIALYCTFLYAQYISKNKI

SEQ ID NO: 1873113 - protein, 24 aa, Staphylococcus
FKGFITVFFPIWFPVHADGPLSTF

SEQ ID NO: 1873114 - protein, 24 aa, Staphylococcus
FKGFITVFFPLWFPVHADGIISTF

SEQ ID NO: 1873115 - protein, 19 aa, Staphylococcus
FKGFIVVFFPLWLPVQAEG

SEQ ID NO: 1873116 - protein, 23 aa, Staphylococcus
FKGHKEAYKVSGIIEDTMYSHSS

SEQ ID NO: 1873117 - protein, 26 aa, Staphylococcus
FKGIPLSSTHFIQWLNLLNIVPGYYG

SEQ ID NO: 1873118 - protein, 18 aa, Staphylococcus
FKGLSLYSSIFHHNILDY

SEQ ID NO: 1873119 - protein, 18 aa, Staphylococcus
FKGLSWHQSLFYSLFQSA

SEQ ID NO: 1873120 - protein, 20 aa, Staphylococcus
FKGNITILMTPARSIVKENF

SEQ ID NO: 1873121 - protein, 20 aa, Staphylococcus
FKGNVLDLAVAVVMGAAFNK

SEQ ID NO: 1873122 - protein, 25 aa, Staphylococcus
FKGQSLRKAYSFMMIATVGGIGFSS

SEQ ID NO: 1873123 - protein, 18 aa, Staphylococcus
FKGTTIVGIISFFAWGLG

SEQ ID NO: 1873124 - protein, 19 aa, Staphylococcus
FKGTTIVGIISFFAWGLGY

SEQ ID NO: 1873125 - protein, 25 aa, Staphylococcus
FKHKAYSGAVLSNFALNAVAGTLIV

SEQ ID NO: 1873126 - protein, 17 aa, Staphylococcus
FKHLYSMMDVKLNLSQT

SEQ ID NO: 1873127 - protein, 22 aa, Staphylococcus
FKIATPIFKPLYAWQMSRSLLW

SEQ ID NO: 1873128 - protein, 19 aa, Staphylococcus
FKIAVGVLVTGTFSLFDAV

SEQ ID NO: 1873129 - protein, 24 aa, Staphylococcus
FKIFSPRHKVHFGYSSGMIYCAIP

SEQ ID NO: 1873130 - protein, 26 aa, Staphylococcus
FKIISLPATIYIEFLRGTPMLVQVFI

SEQ ID NO: 1873131 - protein, 17 aa, Staphylococcus
FKILIGIGLLFCVGTPM

SEQ ID NO: 1873132 - protein, 20 aa, Staphylococcus
FKILSFLIRLLFGHRTFTHS

SEQ ID NO: 1873133 - protein, 19 aa, Staphylococcus
FKILYCKFTTLIIKYPKGV

SEQ ID NO: 1873134 - protein, 19 aa, Staphylococcus
FKINSPVFSLIIKEFKLYF

SEQ ID NO: 1873135 - protein, 19 aa, Staphylococcus
FKISNPIARGLALGTSGHT

SEQ ID NO: 1873136 - protein, 28 aa, Staphylococcus
FKKALKRLPWLIILTFLGMITATILGGF

SEQ ID NO: 1873137 - protein, 17 aa, Staphylococcus
FKKEGKEEVKVDGETEK

SEQ ID NO: 1873138 - protein, 17 aa, Staphylococcus
FKKEQRGSIVPNYVMGL

SEQ ID NO: 1873139 - protein, 22 aa, Staphylococcus
FKKGWPIIIVYILATIANIIWI

SEQ ID NO: 1873140 - protein, 19 aa, Staphylococcus
FKKKLGFNKSLLILLVLLG

SEQ ID NO: 1873141 - protein, 17 aa, Staphylococcus
FKKLKPYLLTLLYLAIF

SEQ ID NO: 1873142 - protein, 21 aa, Staphylococcus
FKKLSFWWPMLISSAIFSLNH

SEQ ID NO: 1873143 - protein, 17 aa, Staphylococcus
FKKYKDYTAKSVVKQNK

SEQ ID NO: 1873144 - protein, 18 aa, Staphylococcus
FKLFLGLILLNLIVIIFS

SEQ ID NO: 1873145 - protein, 18 aa, Staphylococcus
FKLFMKIILVSALPMVLI

SEQ ID NO: 1873146 - protein, 20 aa, Staphylococcus
FKLKAELLFRGKDEHEVNDI

SEQ ID NO: 1873147 - protein, 17 aa, Staphylococcus
FKLKTPHTYAILMFIIL

SEQ ID NO: 1873148 - protein, 18 aa, Staphylococcus
FKLLSIIVRILFGHRTFT

SEQ ID NO: 1873149 - protein, 19 aa, Staphylococcus
FKLPARIAGGATFEGFYQG

SEQ ID NO: 1873150 - protein, 20 aa, Staphylococcus
FKLPLNIAGGATFEGFYQGI

SEQ ID NO: 1873151 - protein, 22 aa, Staphylococcus
FKLPRVAGILRGYINTDMPDSA

SEQ ID NO: 1873152 - protein, 17 aa, Staphylococcus
FKLPTWLIILITALCSS

SEQ ID NO: 1873153 - protein, 22 aa, Staphylococcus
FKLQAMDTMTSFWIPQLGGQKY

SEQ ID NO: 1873154 - protein, 23 aa, Staphylococcus
FKLQSMDMMTSFWIPQLGGQKYA

SEQ ID NO: 1873155 - protein, 20 aa, Staphylococcus
FKLRRWTLIIYLVLIVINPI

SEQ ID NO: 1873156 - protein, 29 aa, Staphylococcus
FKLYKHYYFRLFAIMTWIFLIGSFTNGFD

SEQ ID NO: 1873157 - protein, 23 aa, Staphylococcus
FKLYKHYYYKLFAIITWFLLIGS

SEQ ID NO: 1873158 - protein, 28 aa, Staphylococcus
FKLYRHYYYRLFALMTVVLIIFTFIPLI

SEQ ID NO: 1873159 - protein, 25 aa, Staphylococcus
FKMGSDMNMPYGFKLQDKVKDGKDG

SEQ ID NO: 1873160 - protein, 17 aa, Staphylococcus
FKMLSYFIPLLIIVILI

SEQ ID NO: 1873161 - protein, 20 aa, Staphylococcus
FKMSPLHHHFELVGWNETKV

SEQ ID NO: 1873162 - protein, 32 aa, Staphylococcus
FKNAFFNHWILRWKVVLVISIAILPFYKFFIY

SEQ ID NO: 1873163 - protein, 27 aa, Staphylococcus
FKNEGWAKNATYCIARKIQIHIETWDR

SEQ ID NO: 1873164 - protein, 22 aa, Staphylococcus
FKNFYLIQRLAQFQVKITNTNN

SEQ ID NO: 1873165 - protein, 17 aa, Staphylococcus
FKNGAWVIAGIGDLINT

SEQ ID NO: 1873166 - protein, 18 aa, Staphylococcus
FKNKGYTGATVSNFLLNA

SEQ ID NO: 1873167 - protein, 27 aa, Staphylococcus
FKNKIRSSGYLLRFLFLSTSFSYWYYM

SEQ ID NO: 1873168 - protein, 29 aa, Staphylococcus
FKNKKWVNICAWGLIIILSFLNIYLIIET

SEQ ID NO: 1873169 - protein, 20 aa, Staphylococcus
FKNKPFIGAVIANFLLNTGV

SEQ ID NO: 1873170 - protein, 22 aa, Staphylococcus
FKNKVRTGAYVGRFIFMMAMLS

SEQ ID NO: 1873171 - protein, 19 aa, Staphylococcus
FKNKWTHFIISLPVIIGGS

SEQ ID NO: 1873172 - protein, 20 aa, Staphylococcus
FKNKWTHMIIGLPVVIGGML

SEQ ID NO: 1873173 - protein, 18 aa, Staphylococcus
FKNLFLPKGKLSSLVLNF

SEQ ID NO: 1873174 - protein, 18 aa, Staphylococcus
FKNMRHIFDNKGIVLCFF

SEQ ID NO: 1873175 - protein, 23 aa, Staphylococcus
FKNMVLVVFCYLISIYLIVGLFY

SEQ ID NO: 1873176 - protein, 20 aa, Staphylococcus
FKNTFIGIFNIFKAFAPNST

SEQ ID NO: 1873177 - protein, 27 aa, Staphylococcus
FKNVIFCLLGTLIIALGVNCFVIPGNL

SEQ ID NO: 1873178 - protein, 21 aa, Staphylococcus
FKPTYRKPGLYKDFDDGHVYI

SEQ ID NO: 1873179 - protein, 20 aa, Staphylococcus
FKPTYRKPGLYKDYNDGHIY

SEQ ID NO: 1873180 - protein, 28 aa, Staphylococcus
FKPVMKASWLDWPHIYLPFKDYTPSFHM

SEQ ID NO: 1873181 - protein, 17 aa, Staphylococcus
FKQFGIASIDVLKDYYE

SEQ ID NO: 1873182 - protein, 19 aa, Staphylococcus
FKQKRPGINNTIFNIYKFR

SEQ ID NO: 1873183 - protein, 18 aa, Staphylococcus
FKQLIVFSIILGEASVIG

SEQ ID NO: 1873184 - protein, 17 aa, Staphylococcus
FKQSRRAIIYSMISIIL

SEQ ID NO: 1873185 - protein, 20 aa, Staphylococcus
FKQYDYRKVISKGEHEIDGK

SEQ ID NO: 1873186 - protein, 17 aa, Staphylococcus
FKRKIPFLDKVVLKDST

SEQ ID NO: 1873187 - protein, 17 aa, Staphylococcus
FKRLKHLIIPLLSQNIR

SEQ ID NO: 1873188 - protein, 21 aa, Staphylococcus
FKRNHGLAFIMVILQMLFAFF

SEQ ID NO: 1873189 - protein, 20 aa, Staphylococcus
FKRSFLRGKDAFNIILRLVI

SEQ ID NO: 1873190 - protein, 30 aa, Staphylococcus
FKRSIIMPLYMMFSILITYYVSMGIANVLF

SEQ ID NO: 1873191 - protein, 19 aa, Staphylococcus
FKSGFKTVIDMWFVVLPVV

SEQ ID NO: 1873192 - protein, 29 aa, Staphylococcus
FKSITIPMAIIIAMFWIHLNTALIMLVTA

SEQ ID NO: 1873193 - protein, 27 aa, Staphylococcus
FKSKIVCGFLNWLGHLFSDVAGSSGTR

SEQ ID NO: 1873194 - protein, 21 aa, Staphylococcus
FKSKYDIYKDVAINPNDIKID

SEQ ID NO: 1873195 - protein, 17 aa, Staphylococcus
FKSLGFNVEEKRNDPNF

SEQ ID NO: 1873196 - protein, 23 aa, Staphylococcus
FKSSRRFSGLLAQLESNDVVGST

SEQ ID NO: 1873197 - protein, 17 aa, Staphylococcus
FKTGVGNVEVNNSKLKK

SEQ ID NO: 1873198 - protein, 23 aa, Staphylococcus
FKTPHTYALLLMVIIFAWIMTYV

SEQ ID NO: 1873199 - protein, 22 aa, Staphylococcus
FKVATPIFKPLFAWQLNRSLLW

SEQ ID NO: 1873200 - protein, 22 aa, Staphylococcus
FKVATPIFKPLFAWQMNRVLLW

SEQ ID NO: 1873201 - protein, 27 aa, Staphylococcus
FKVATPMFRPLFAWQMNRTLLWIYMIV

SEQ ID NO: 1873202 - protein, 19 aa, Staphylococcus
FKVICIQLAAAIATVVFSA

SEQ ID NO: 1873203 - protein, 20 aa, Staphylococcus
FKVIITILIILLVLIVAAAI

SEQ ID NO: 1873204 - protein, 20 aa, Staphylococcus
FKVIITILILLFVVLIGIVI

SEQ ID NO: 1873205 - protein, 21 aa, Staphylococcus
FKVLIACLLVLFILIMNLRGL

SEQ ID NO: 1873206 - protein, 19 aa, Staphylococcus
FKVLIGIGLLFCVGTPIAS

SEQ ID NO: 1873207 - protein, 34 aa, Staphylococcus
FKVLLRKRLYLIMSICLPLFFYLLFTSILDLPKS

SEQ ID NO: 1873208 - protein, 19 aa, Staphylococcus
FKVMDDFYQHIPILGVCLG

SEQ ID NO: 1873209 - protein, 18 aa, Staphylococcus
FKVNEFLQTISLPLFAVL

SEQ ID NO: 1873210 - protein, 25 aa, Staphylococcus
FKVNFKIVLPGALLTIVILFLLTHG

SEQ ID NO: 1873211 - protein, 24 aa, Staphylococcus
FKVNFRIVLPGAIISMIILGVLTH

SEQ ID NO: 1873212 - protein, 25 aa, Staphylococcus
FKVNFRIVLPGAILTIVVLFFLTNG

SEQ ID NO: 1873213 - protein, 17 aa, Staphylococcus
FKVPKGIEDHLFRITQE

SEQ ID NO: 1873214 - protein, 18 aa, Staphylococcus
FKVPKGIEDHLFRITQEA

SEQ ID NO: 1873215 - protein, 24 aa, Staphylococcus
FKVPLWSTWLVWGIVTIIIVGVLL

SEQ ID NO: 1873216 - protein, 20 aa, Staphylococcus
FKVTIWYTAPTALRMLMSAG

SEQ ID NO: 1873217 - protein, 20 aa, Staphylococcus
FKVTVWYTAPTALRMLMSAG

SEQ ID NO: 1873218 - protein, 19 aa, Staphylococcus
FKWAIAHNLTVYKGLIEYT

SEQ ID NO: 1873219 - protein, 19 aa, Staphylococcus
FKWHRRIGPVASIIWFFTG

SEQ ID NO: 1873220 - protein, 36 aa, Staphylococcus
FKYIWHHILFLLGIFCFFKGFIGFFIGEKPLYLYTF

SEQ ID NO: 1873221 - protein, 22 aa, Staphylococcus
FKYKIYPALMLIMSVFLSISVV

SEQ ID NO: 1873222 - protein, 20 aa, Staphylococcus
FKYKKGFLLVHISKKYFNKW

SEQ ID NO: 1873223 - protein, 23 aa, Staphylococcus
FKYKLFPIFMGMISVLLAICVVI

SEQ ID NO: 1873224 - protein, 22 aa, Staphylococcus
FKYKLRGAALIDSYILFSAVVA

SEQ ID NO: 1873225 - protein, 17 aa, Staphylococcus
FKYKVFPLSMGIVSMFL

SEQ ID NO: 1873226 - protein, 26 aa, Staphylococcus
FKYMPELNWHYSYFAFIGISLIVTIT

SEQ ID NO: 1873227 - protein, 25 aa, Staphylococcus
FKYNTEMGHGFALESTHLDIYEREH

SEQ ID NO: 1873228 - protein, 20 aa, Staphylococcus
FKYPMFVLGAAMVFITILCI

SEQ ID NO: 1873229 - protein, 18 aa, Staphylococcus
FLAASSFLLTAYFVTKYK

SEQ ID NO: 1873230 - protein, 19 aa, Staphylococcus
FLAEFSHRAPFYFAGTLGV

SEQ ID NO: 1873231 - protein, 19 aa, Staphylococcus
FLAEFSHRLPFYVAGFSGC

SEQ ID NO: 1873232 - protein, 19 aa, Staphylococcus
FLAEISHRLPFYFAGSLGA

SEQ ID NO: 1873233 - protein, 19 aa, Staphylococcus
FLAFISLFLVIWVPANPII

SEQ ID NO: 1873234 - protein, 18 aa, Staphylococcus
FLAGTSFLLSAYYVYKNK

SEQ ID NO: 1873235 - protein, 18 aa, Staphylococcus
FLAIMGYASAISVLVAVI

SEQ ID NO: 1873236 - protein, 18 aa, Staphylococcus
FLALFLISVIANFWFIQA

SEQ ID NO: 1873237 - protein, 24 aa, Staphylococcus
FLALMCVINYALVRYIAFDKYDSL

SEQ ID NO: 1873238 - protein, 18 aa, Staphylococcus
FLAMVCGSFMIFHNTISL

SEQ ID NO: 1873239 - protein, 20 aa, Staphylococcus
FLANCLKDLLGNIMPILIVL

SEQ ID NO: 1873240 - protein, 19 aa, Staphylococcus
FLAPLLVLTLMYFIFNSDE

SEQ ID NO: 1873241 - protein, 18 aa, Staphylococcus
FLAPPIAGAIGWQSTVRL

SEQ ID NO: 1873242 - protein, 18 aa, Staphylococcus
FLCIALILLLFGKNSSII

SEQ ID NO: 1873243 - protein, 24 aa, Staphylococcus
FLDQRVIKHYGTLIPLTPLDQSLL

SEQ ID NO: 1873244 - protein, 18 aa, Staphylococcus
FLEKIMLVLMVIMGIIFI

SEQ ID NO: 1873245 - protein, 17 aa, Staphylococcus
FLELRYDTFTKRFVSIL

SEQ ID NO: 1873246 - protein, 23 aa, Staphylococcus
FLEPSNLFNLLRQVSINGLIAFG

SEQ ID NO: 1873247 - protein, 24 aa, Staphylococcus
FLEQRYRWASTISGAIIALVGAML

SEQ ID NO: 1873248 - protein, 46 aa, Staphylococcus
FLERRSPGSIWAWLFVLAFLPILGFIIYLLFGRQIQREHIFKINEE

SEQ ID NO: 1873249 - protein, 20 aa, Staphylococcus
FLERSHLANLYFLIAKGSIF

SEQ ID NO: 1873250 - protein, 26 aa, Staphylococcus
FLETTRNAFFIGRAMDYNVSLEGALK

SEQ ID NO: 1873251 - protein, 25 aa, Staphylococcus
FLETTRNAFFIGRTIDYNVSQEGAL

SEQ ID NO: 1873252 - protein, 25 aa, Staphylococcus
FLETTRNAFFIGRTMDYNVSLEGSL

SEQ ID NO: 1873253 - protein, 20 aa, Staphylococcus
FLEWSNLGVIAAVKGAKLLQ

SEQ ID NO: 1873254 - protein, 19 aa, Staphylococcus
FLEWSNLGVIVAVKGAALL

SEQ ID NO: 1873255 - protein, 18 aa, Staphylococcus
FLFAELVLLPADFLGQQI

SEQ ID NO: 1873256 - protein, 18 aa, Staphylococcus
FLFAIGHHFPVLIASRIL

SEQ ID NO: 1873257 - protein, 19 aa, Staphylococcus
FLFCYIVIASIDFGAGVFL

SEQ ID NO: 1873258 - protein, 31 aa, Staphylococcus
FLFDASRLAPFISAVICILIFKNKRAQLSGL

SEQ ID NO: 1873259 - protein, 17 aa, Staphylococcus
FLFHWQTSHIAFWATNQ

SEQ ID NO: 1873260 - protein, 24 aa, Staphylococcus
FLFISGFLSILALEYNHAFKGYNW

SEQ ID NO: 1873261 - protein, 19 aa, Staphylococcus
FLFIYKFFKPFYKISYLLL

SEQ ID NO: 1873262 - protein, 26 aa, Staphylococcus
FLFKKLNWPVGLIIGAVIITSLGSIS

SEQ ID NO: 1873263 - protein, 26 aa, Staphylococcus
FLFKRLSWPYALIITAVIISSLGSLS

SEQ ID NO: 1873264 - protein, 26 aa, Staphylococcus
FLFKRLSWPYGLIIAAVIISSLGSIS

SEQ ID NO: 1873265 - protein, 26 aa, Staphylococcus
FLFKRLSWPYGLIIAAVIITSLGSLS

SEQ ID NO: 1873266 - protein, 24 aa, Staphylococcus
FLFLACTLIGLLFLAALLIDTLIK

SEQ ID NO: 1873267 - protein, 18 aa, Staphylococcus
FLFSDFLFSISYTGLGII

SEQ ID NO: 1873268 - protein, 19 aa, Staphylococcus
FLFSFSFMPGDIIKAIIAC

SEQ ID NO: 1873269 - protein, 21 aa, Staphylococcus
FLFYYRKIKLYSIMVVLISNL

SEQ ID NO: 1873270 - protein, 24 aa, Staphylococcus
FLGGFILAIAMERWNLHTRVALII

SEQ ID NO: 1873271 - protein, 23 aa, Staphylococcus
FLGGFILAIAMERWNLHTRVALR

SEQ ID NO: 1873272 - protein, 19 aa, Staphylococcus
FLGGLGGHRFYLGKTGSAV

SEQ ID NO: 1873273 - protein, 18 aa, Staphylococcus
FLGGMIIFSYFWQPLLFN

SEQ ID NO: 1873274 - protein, 25 aa, Staphylococcus
FLGGSFILGFGWQPLLINAFLYLIL

SEQ ID NO: 1873275 - protein, 20 aa, Staphylococcus
FLGGSIIVSFGWQPLLINAA

SEQ ID NO: 1873276 - protein, 18 aa, Staphylococcus
FLGGSIVLSFGWQPLLIN

SEQ ID NO: 1873277 - protein, 20 aa, Staphylococcus
FLGGSVIVSFGWQPLLFNAF

SEQ ID NO: 1873278 - protein, 25 aa, Staphylococcus
FLGNWIGQIGLNWFVLTTYHNAVYL

SEQ ID NO: 1873279 - protein, 24 aa, Staphylococcus
FLGPLFRPIMRPLFTLPGRSAVDN

SEQ ID NO: 1873280 - protein, 24 aa, Staphylococcus
FLGPLFRPIMRPLFTLPGRSTVDN

SEQ ID NO: 1873281 - protein, 24 aa, Staphylococcus
FLGPVFRPVMRPLFTLPGRSTVDN

SEQ ID NO: 1873282 - protein, 17 aa, Staphylococcus
FLGSFAYVYFMGGALGF

SEQ ID NO: 1873283 - protein, 21 aa, Staphylococcus
FLGVHIICYIIFMAYCINFNA

SEQ ID NO: 1873284 - protein, 17 aa, Staphylococcus
FLGVYLYQLITSSISII

SEQ ID NO: 1873285 - protein, 17 aa, Staphylococcus
FLHFIFLGIAYLDYDIS

SEQ ID NO: 1873286 - protein, 29 aa, Staphylococcus
FLHSNFWIYWKTMFAFEPWHSAMEMRRYL

SEQ ID NO: 1873287 - protein, 17 aa, Staphylococcus
FLHVDSAVMSIILIIIG

SEQ ID NO: 1873288 - protein, 20 aa, Staphylococcus
FLHVICICIAYWALHSLRLD

SEQ ID NO: 1873289 - protein, 22 aa, Staphylococcus
FLHVLGDLFGSIGAIVAAILIW

SEQ ID NO: 1873290 - protein, 22 aa, Staphylococcus
FLHVLGDLFGSIGAIVAALLIW

SEQ ID NO: 1873291 - protein, 17 aa, Staphylococcus
FLICAVFFAVLIYSTVI

SEQ ID NO: 1873292 - protein, 25 aa, Staphylococcus
FLIDAIVGAGGFLLSYFPTQRLTSR

SEQ ID NO: 1873293 - protein, 18 aa, Staphylococcus
FLIGIWISHPMEREIKPL

SEQ ID NO: 1873294 - protein, 18 aa, Staphylococcus
FLILCIGIVVVLISVKKN

SEQ ID NO: 1873295 - protein, 17 aa, Staphylococcus
FLILCIGVVVVLMSVKK

SEQ ID NO: 1873296 - protein, 26 aa, Staphylococcus
FLILLAGLITFLAFGMFGDKYTETPD

SEQ ID NO: 1873297 - protein, 20 aa, Staphylococcus
FLILSGRLGSLEMILLPVII

SEQ ID NO: 1873298 - protein, 18 aa, Staphylococcus
FLIMRPPIEYLRQYLAQW

SEQ ID NO: 1873299 - protein, 18 aa, Staphylococcus
FLINKGFKEKLSDYRINL

SEQ ID NO: 1873300 - protein, 28 aa, Staphylococcus
FLISAFILNLIFAFTIIFMERRSAGSIW

SEQ ID NO: 1873301 - protein, 25 aa, Staphylococcus
FLISFCSTLLFSILFNAPRKLLPAC

SEQ ID NO: 1873302 - protein, 26 aa, Staphylococcus
FLISKIIPVFAIRPWFDQKTTISSAF

SEQ ID NO: 1873303 - protein, 17 aa, Staphylococcus
FLITKFNQVWPILIFLP

SEQ ID NO: 1873304 - protein, 18 aa, Staphylococcus
FLIVRPPIEFIRQYLAQW

SEQ ID NO: 1873305 - protein, 18 aa, Staphylococcus
FLIWITLVHPGQFEDALV

SEQ ID NO: 1873306 - protein, 19 aa, Staphylococcus
FLIYIAVVLISCMVFLTFF

SEQ ID NO: 1873307 - protein, 17 aa, Staphylococcus
FLIYMLKDHEKFIPSIA

SEQ ID NO: 1873308 - protein, 17 aa, Staphylococcus
FLKERFNKLEWIAIGLA

SEQ ID NO: 1873309 - protein, 24 aa, Staphylococcus
FLKYMTIFVLLNFTITCTLIIILF

SEQ ID NO: 1873310 - protein, 18 aa, Staphylococcus
FLLCFLKADTSYMYLIII

SEQ ID NO: 1873311 - protein, 17 aa, Staphylococcus
FLLDALIGLSMFFVSYL

SEQ ID NO: 1873312 - protein, 26 aa, Staphylococcus
FLLEHNHAFKGMSWHQSLFYSLFQSA

SEQ ID NO: 1873313 - protein, 17 aa, Staphylococcus
FLLFKANVLNLLNTHQH

SEQ ID NO: 1873314 - protein, 18 aa, Staphylococcus
FLLFKRRYNKYYGDDSGE

SEQ ID NO: 1873315 - protein, 19 aa, Staphylococcus
FLLFKRRYNRYYGEDAGDY

SEQ ID NO: 1873316 - protein, 19 aa, Staphylococcus
FLLFKRRYNRYYGEDAGEY

SEQ ID NO: 1873317 - protein, 20 aa, Staphylococcus
FLLGGLFIRLLDAIIPHIHQ

SEQ ID NO: 1873318 - protein, 19 aa, Staphylococcus
FLLICEFFYGIPFLGGSFI

SEQ ID NO: 1873319 - protein, 19 aa, Staphylococcus
FLLITILAIGGMALWIMYA

SEQ ID NO: 1873320 - protein, 18 aa, Staphylococcus
FLLKRIEHELNHQNIQHV

SEQ ID NO: 1873321 - protein, 19 aa, Staphylococcus
FLLLAGRLGDLLGRKRIFL

SEQ ID NO: 1873322 - protein, 18 aa, Staphylococcus
FLLLRLLPTFIVNLLLLT

SEQ ID NO: 1873323 - protein, 17 aa, Staphylococcus
FLLNKLKQSYLSINKTY

SEQ ID NO: 1873324 - protein, 22 aa, Staphylococcus
FLLPRTLTLFFPDASWAQKVSD

SEQ ID NO: 1873325 - protein, 25 aa, Staphylococcus
FLLPRTLTLFFPKADWAQNIAEYAN

SEQ ID NO: 1873326 - protein, 25 aa, Staphylococcus
FLLPRTLTLFFPKADWAQTISEYAN

SEQ ID NO: 1873327 - protein, 25 aa, Staphylococcus
FLLPRTLTLFFPKAEWAQNIADTAN

SEQ ID NO: 1873328 - protein, 25 aa, Staphylococcus
FLLPRTLTLFFPKAEWAQQIADTAN

SEQ ID NO: 1873329 - protein, 26 aa, Staphylococcus
FLLPRTLTMFFPKADWAQQIANTANP

SEQ ID NO: 1873330 - protein, 21 aa, Staphylococcus
FLLQRVTGVITFIFVAIHLWQ

SEQ ID NO: 1873331 - protein, 17 aa, Staphylococcus
FLLRPIGGIVFGIIGDK

SEQ ID NO: 1873332 - protein, 17 aa, Staphylococcus
FLLRPIGGIVFGVIGDK

SEQ ID NO: 1873333 - protein, 17 aa, Staphylococcus
FLLTFLFLLSFSIYDIN

SEQ ID NO: 1873334 - protein, 25 aa, Staphylococcus
FLLWGISLIRFFYVPVVNYHFLYYR

SEQ ID NO: 1873335 - protein, 25 aa, Staphylococcus
FLLYANVVYFRFFSDFLTFSTLNQA

SEQ ID NO: 1873336 - protein, 18 aa, Staphylococcus
FLLYMAWSLWNEKPNNLE

SEQ ID NO: 1873337 - protein, 19 aa, Staphylococcus
FLLYMAWSLWNEKPNNLEN

SEQ ID NO: 1873338 - protein, 18 aa, Staphylococcus
FLMIKPFIGNADFKEQII

SEQ ID NO: 1873339 - protein, 23 aa, Staphylococcus
FLMLMCAGFLGAMLGGFIVLTIG

SEQ ID NO: 1873340 - protein, 19 aa, Staphylococcus
FLMSSYCLLVLGSTQVQLR

SEQ ID NO: 1873341 - protein, 19 aa, Staphylococcus
FLNAFFAEIIKVMSRFIGS

SEQ ID NO: 1873342 - protein, 24 aa, Staphylococcus
FLNISLPNWLRRLVTRAIAVIPVI

SEQ ID NO: 1873343 - protein, 19 aa, Staphylococcus
FLNPNYFLVSAFIICAVTS

SEQ ID NO: 1873344 - protein, 21 aa, Staphylococcus
FLNPTRFGYLIIIAISVIVGA

SEQ ID NO: 1873345 - protein, 22 aa, Staphylococcus
FLNSEHGIGWIIAILIAVIFFI

SEQ ID NO: 1873346 - protein, 20 aa, Staphylococcus
FLNYLDRFLIIPILGAASMG

SEQ ID NO: 1873347 - protein, 18 aa, Staphylococcus
FLPIIGFILYLLLGRQIQ

SEQ ID NO: 1873348 - protein, 18 aa, Staphylococcus
FLPIIILAVIYLLHKTIN

SEQ ID NO: 1873349 - protein, 18 aa, Staphylococcus
FLPKGKLSSLVLNFNLPG

SEQ ID NO: 1873350 - protein, 18 aa, Staphylococcus
FLPLIVIVFLRIKGHYKD

SEQ ID NO: 1873351 - protein, 28 aa, Staphylococcus
FLPLLGFILYLLFGRQIQRDHIFTLDKD

SEQ ID NO: 1873352 - protein, 23 aa, Staphylococcus
FLPLTLIAGIYGMNFENMPELKW

SEQ ID NO: 1873353 - protein, 23 aa, Staphylococcus
FLPSELLKPVVIVILTIVMIYTI

SEQ ID NO: 1873354 - protein, 22 aa, Staphylococcus
FLPSEVLKPLVIVILTLVLIYT

SEQ ID NO: 1873355 - protein, 18 aa, Staphylococcus
FLPTLKNKYDIFVSAPEL

SEQ ID NO: 1873356 - protein, 19 aa, Staphylococcus
FLPVERKLYALIILLVCVL

SEQ ID NO: 1873357 - protein, 28 aa, Staphylococcus
FLRKHLRIGETFFTYLIWYSIGRFFVEG

SEQ ID NO: 1873358 - protein, 20 aa, Staphylococcus
FLRLYLLTLLFFSANAILNV

SEQ ID NO: 1873359 - protein, 20 aa, Staphylococcus
FLRRSIKNIIIVGAIILLSA

SEQ ID NO: 1873360 - protein, 37 aa, Staphylococcus
FLSDDQMATWGWRIPFILGLFLGIFGFYLRRKLEESP

SEQ ID NO: 1873361 - protein, 19 aa, Staphylococcus
FLSGILWVHLKLFSILIFT

SEQ ID NO: 1873362 - protein, 17 aa, Staphylococcus
FLSIYFYTWNRFKNKWT

SEQ ID NO: 1873363 - protein, 17 aa, Staphylococcus
FLSKKSTILTIIATVLI

SEQ ID NO: 1873364 - protein, 17 aa, Staphylococcus
FLSLLGFKNITFVSLFF

SEQ ID NO: 1873365 - protein, 20 aa, Staphylococcus
FLSPFLFLVSIAIKLESKGP

SEQ ID NO: 1873366 - protein, 18 aa, Staphylococcus
FLSRFKLIYVTLTGLLLF

SEQ ID NO: 1873367 - protein, 20 aa, Staphylococcus
FLSYLIYRIGKDDASGLAAQ

SEQ ID NO: 1873368 - protein, 18 aa, Staphylococcus
FLTGFPIFGLMVLSTYLT

SEQ ID NO: 1873369 - protein, 17 aa, Staphylococcus
FLTGNLLLLPRLGAALT

SEQ ID NO: 1873370 - protein, 17 aa, Staphylococcus
FLTIGFMVFTIQRGRRV

SEQ ID NO: 1873371 - protein, 24 aa, Staphylococcus
FLTKGGTVLFHWKFITIETGGIIE

SEQ ID NO: 1873372 - protein, 21 aa, Staphylococcus
FLTLYLLHLHLGYTFSGGFID

SEQ ID NO: 1873373 - protein, 18 aa, Staphylococcus
FLVAFIFSYLIRIVIPDK

SEQ ID NO: 1873374 - protein, 22 aa, Staphylococcus
FLVGLNLTEWVYFTYLMLGVFL

SEQ ID NO: 1873375 - protein, 21 aa, Staphylococcus
FLVHLHLLPIVSIIVEPAKIL

SEQ ID NO: 1873376 - protein, 25 aa, Staphylococcus
FLVHLTFVPLLFLGRYTHMPYTLAA

SEQ ID NO: 1873377 - protein, 17 aa, Staphylococcus
FLVIMWLIFQTTFTWIG

SEQ ID NO: 1873378 - protein, 17 aa, Staphylococcus
FLVLSMMMTFLFITPKY

SEQ ID NO: 1873379 - protein, 18 aa, Staphylococcus
FLVNRFKKKLGFNKSLLI

SEQ ID NO: 1873380 - protein, 24 aa, Staphylococcus
FLVTFILMVIMFRCFGKQGLIAWV

SEQ ID NO: 1873381 - protein, 20 aa, Staphylococcus
FLVTFILMVLMFRAFGKQGL

SEQ ID NO: 1873382 - protein, 20 aa, Staphylococcus
FLVTFLLLVAMYRLFGKQGL

SEQ ID NO: 1873383 - protein, 19 aa, Staphylococcus
FLVVFCWQPVHFYALAIKR

SEQ ID NO: 1873384 - protein, 26 aa, Staphylococcus
FLWFNLAKPDIWITVIAGVLYFLQAY

SEQ ID NO: 1873385 - protein, 28 aa, Staphylococcus
FLWFNLTEPNLWISLIAAVVYFFQTLVN

SEQ ID NO: 1873386 - protein, 18 aa, Staphylococcus
FLWRLRTTLMERGKEDST

SEQ ID NO: 1873387 - protein, 17 aa, Staphylococcus
FLYPVVAFLIGWYRDRT

SEQ ID NO: 1873388 - protein, 24 aa, Staphylococcus
FLYQSEFILHLPIFNEMHITTVTI

SEQ ID NO: 1873389 - protein, 19 aa, Staphylococcus
FMAEFSHRLPFYFAGTLGI

SEQ ID NO: 1873390 - protein, 17 aa, Staphylococcus
FMAFFWFIGVHGPSVVG

SEQ ID NO: 1873391 - protein, 30 aa, Staphylococcus
FMDHLWLKDYSLEWFPIAVITTIIAYIIGI

SEQ ID NO: 1873392 - protein, 26 aa, Staphylococcus
FMDLNRTGLWMKIPGKPGGVDHTYGG

SEQ ID NO: 1873393 - protein, 18 aa, Staphylococcus
FMGNPVFVYLGKRSYSLY

SEQ ID NO: 1873394 - protein, 18 aa, Staphylococcus
FMHVDSVWLSLLLIIVAF

SEQ ID NO: 1873395 - protein, 19 aa, Staphylococcus
FMIFLIRTAITLPIIALMA

SEQ ID NO: 1873396 - protein, 18 aa, Staphylococcus
FMILIGLFLTYWAVTEFY

SEQ ID NO: 1873397 - protein, 20 aa, Staphylococcus
FMISILFFKLLTEFVNIMIH

SEQ ID NO: 1873398 - protein, 21 aa, Staphylococcus
FMISILFFKLLTEFVNIMIHG

SEQ ID NO: 1873399 - protein, 18 aa, Staphylococcus
FMIVEIIGGFLANSLALL

SEQ ID NO: 1873400 - protein, 18 aa, Staphylococcus
FMIVEILGGFIANSLALL

SEQ ID NO: 1873401 - protein, 31 aa, Staphylococcus
FMIYVPWSFKLHILLGFTIFACWPFTRLVHV

SEQ ID NO: 1873402 - protein, 18 aa, Staphylococcus
FMKMGGHVIALPLFMETF

SEQ ID NO: 1873403 - protein, 23 aa, Staphylococcus
FMKRRGRELSLLQIIGLTRSNIM

SEQ ID NO: 1873404 - protein, 18 aa, Staphylococcus
FMKYLRWNINVVKGSARS

SEQ ID NO: 1873405 - protein, 23 aa, Staphylococcus
FMLGGSLPFGKLVAMIYPFVGYV

SEQ ID NO: 1873406 - protein, 18 aa, Staphylococcus
FMLIKWPVTQTESIYKGK

SEQ ID NO: 1873407 - protein, 18 aa, Staphylococcus
FMLMRAMADHQRYTISDT

SEQ ID NO: 1873408 - protein, 29 aa, Staphylococcus
FMNSNFWIYWKTMFAFEPWHSAMEMRRYL

SEQ ID NO: 1873409 - protein, 25 aa, Staphylococcus
FMPVPMPASVIGLVLLFIALCTGIV

SEQ ID NO: 1873410 - protein, 17 aa, Staphylococcus
FMRMIPAKFGVIVTIVL

SEQ ID NO: 1873411 - protein, 18 aa, Staphylococcus
FMSYFLFVKPMKAMQKSS

SEQ ID NO: 1873412 - protein, 24 aa, Staphylococcus
FMTIPEAARLVLQAGAIAEGGEVF

SEQ ID NO: 1873413 - protein, 23 aa, Staphylococcus
FMTPPYIGAMGWMLTMQHNGLLE

SEQ ID NO: 1873414 - protein, 17 aa, Staphylococcus
FMTWLILAMGMQFSKMH

SEQ ID NO: 1873415 - protein, 24 aa, Staphylococcus
FMVGWTYWLTWIISGMAEVTAVAK

SEQ ID NO: 1873416 - protein, 17 aa, Staphylococcus
FMVPILAAYIAYSIADK

SEQ ID NO: 1873417 - protein, 24 aa, Staphylococcus
FMVPPYIGAMGWMLTMQRNGLLEQ

SEQ ID NO: 1873418 - protein, 17 aa, Staphylococcus
FMYITLLQMSQFYTQQA

SEQ ID NO: 1873419 - protein, 18 aa, Staphylococcus
FMYSGLFAVVIGILLLII

SEQ ID NO: 1873420 - protein, 17 aa, Staphylococcus
FMYWVIFGGFVLYTLMI

SEQ ID NO: 1873421 - protein, 25 aa, Staphylococcus
FNAGLYLGMVFYDFDAVAWLHVLKN

SEQ ID NO: 1873422 - protein, 17 aa, Staphylococcus
FNAPLVLYMGGGMLGGS

SEQ ID NO: 1873423 - protein, 19 aa, Staphylococcus
FNDLKLLVDTLREGGADVE

SEQ ID NO: 1873424 - protein, 18 aa, Staphylococcus
FNDLKLLVDTMREAGADV

SEQ ID NO: 1873425 - protein, 18 aa, Staphylococcus
FNDLSLLVDTMHNASADV

SEQ ID NO: 1873426 - protein, 19 aa, Staphylococcus
FNDRFKFIYLHQDYIIDKI

SEQ ID NO: 1873427 - protein, 18 aa, Staphylococcus
FNDVPTLIHSWMNSDIHR

SEQ ID NO: 1873428 - protein, 20 aa, Staphylococcus
FNDVPTLLHSWLNSDTHRSR

SEQ ID NO: 1873429 - protein, 22 aa, Staphylococcus
FNEFYVWCTFIFLFYLLISILT

SEQ ID NO: 1873430 - protein, 25 aa, Staphylococcus
FNEIERNRIQGVMDFEQLKITDIDT

SEQ ID NO: 1873431 - protein, 25 aa, Staphylococcus
FNEKMQVVLDGNVDFNITRMLDKTE

SEQ ID NO: 1873432 - protein, 17 aa, Staphylococcus
FNEVVWSKPLVYGLLIT

SEQ ID NO: 1873433 - protein, 17 aa, Staphylococcus
FNFISWAPFTFLPIFIA

SEQ ID NO: 1873434 - protein, 26 aa, Staphylococcus
FNFITLCSIAFFICWLGLQFYLNHQH

SEQ ID NO: 1873435 - protein, 23 aa, Staphylococcus
FNFSETWLHFGKIFMYGFIMMIG

SEQ ID NO: 1873436 - protein, 20 aa, Staphylococcus
FNFYQGLLITEWAYFAFLVA

SEQ ID NO: 1873437 - protein, 24 aa, Staphylococcus
FNGDGFARQTFKVHSVSQNDFDKW

SEQ ID NO: 1873438 - protein, 31 aa, Staphylococcus
FNGIKLTSPKFIQWLNERNIVPGYYGVNNLD

SEQ ID NO: 1873439 - protein, 20 aa, Staphylococcus
FNGKRLINENVREGIHHPKQ

SEQ ID NO: 1873440 - protein, 21 aa, Staphylococcus
FNGLQFKITLVFITFTILFSL

SEQ ID NO: 1873441 - protein, 17 aa, Staphylococcus
FNGLYRFQGLRKYKEKY

SEQ ID NO: 1873442 - protein, 20 aa, Staphylococcus
FNGPAPYIFAHRGGMSVRPE

SEQ ID NO: 1873443 - protein, 17 aa, Staphylococcus
FNHAHLWDDSAVNAIDT

SEQ ID NO: 1873444 - protein, 25 aa, Staphylococcus
FNHFKSSRYLSGILVKLDANDIGSS

SEQ ID NO: 1873445 - protein, 24 aa, Staphylococcus
FNHFKTARYLSGILAKVESVDFAS

SEQ ID NO: 1873446 - protein, 23 aa, Staphylococcus
FNHSRLKLYGTYIVTHTCLLLFV

SEQ ID NO: 1873447 - protein, 31 aa, Staphylococcus
FNHTIELPMLIMMAIFSFVIFDSVEHINNAA

SEQ ID NO: 1873448 - protein, 19 aa, Staphylococcus
FNIIKGIAVSAIFLLLYKR

SEQ ID NO: 1873449 - protein, 27 aa, Staphylococcus
FNIKGTPDSAGFGLIGLVGPIKSLNLL

SEQ ID NO: 1873450 - protein, 25 aa, Staphylococcus
FNILPKIIGGIGFVLAKITRQPKFE

SEQ ID NO: 1873451 - protein, 26 aa, Staphylococcus
FNILPKIIGGIGWLLAKITRQPKFES

SEQ ID NO: 1873452 - protein, 26 aa, Staphylococcus
FNILPKIIGGIGWVLAKITRQPKFES

SEQ ID NO: 1873453 - protein, 26 aa, Staphylococcus
FNILPKLIGAIGWVLAKITRQPKFES

SEQ ID NO: 1873454 - protein, 33 aa, Staphylococcus
FNINFIEYFLKMIIPNLFSLIASILILFLYFHK

SEQ ID NO: 1873455 - protein, 19 aa, Staphylococcus
FNIPLPLLHPVHMNTPMFF

SEQ ID NO: 1873456 - protein, 25 aa, Staphylococcus
FNIVPRIALGSIIAYIIGQHIDVFI

SEQ ID NO: 1873457 - protein, 17 aa, Staphylococcus
FNIYKFRSMKIDTPNVA

SEQ ID NO: 1873458 - protein, 19 aa, Staphylococcus
FNKEASFKNDVLEQLQSFD

SEQ ID NO: 1873459 - protein, 23 aa, Staphylococcus
FNKERKKLDISRIQSVDTSQSMI

SEQ ID NO: 1873460 - protein, 17 aa, Staphylococcus
FNKLEWIAIGLAVIGVL

SEQ ID NO: 1873461 - protein, 23 aa, Staphylococcus
FNKNEIYKLLSLLENDLDNMKLG

SEQ ID NO: 1873462 - protein, 17 aa, Staphylococcus
FNKSLLILLVLLGLFTL

SEQ ID NO: 1873463 - protein, 23 aa, Staphylococcus
FNKYSYRKLFIIALLLFTIGSLV

SEQ ID NO: 1873464 - protein, 23 aa, Staphylococcus
FNKYSYRKLFIIALTLFTLGSLV

SEQ ID NO: 1873465 - protein, 23 aa, Staphylococcus
FNKYSYRKLFIVGLALFTIGSLV

SEQ ID NO: 1873466 - protein, 24 aa, Staphylococcus
FNKYSYRKLFLIALLLFTIGSLVC

SEQ ID NO: 1873467 - protein, 25 aa, Staphylococcus
FNKYSYRKLFLVAMTLFTIGSLVCG

SEQ ID NO: 1873468 - protein, 26 aa, Staphylococcus
FNLIPRIALGSIIAYIIGQHVDVFIF

SEQ ID NO: 1873469 - protein, 24 aa, Staphylococcus
FNLTKPDIWITIIAGVLYFIQAYV

SEQ ID NO: 1873470 - protein, 20 aa, Staphylococcus
FNLVHPDIWITIIAGVLYFI

SEQ ID NO: 1873471 - protein, 20 aa, Staphylococcus
FNLVKPDIWITAIAGVLYFI

SEQ ID NO: 1873472 - protein, 25 aa, Staphylococcus
FNLVPRIALGSVVAYIIGQHLDVLL

SEQ ID NO: 1873473 - protein, 20 aa, Staphylococcus
FNMNNFDFISSYFKKNSSIY

SEQ ID NO: 1873474 - protein, 18 aa, Staphylococcus
FNNDASRRNNRHEASNRK

SEQ ID NO: 1873475 - protein, 22 aa, Staphylococcus
FNNFKISYKIYTQKYESPDFNK

SEQ ID NO: 1873476 - protein, 17 aa, Staphylococcus
FNNFSWAAMLFCAGIGS

SEQ ID NO: 1873477 - protein, 26 aa, Staphylococcus
FNNKPLRMMIYLGMFTFSISILYIVY

SEQ ID NO: 1873478 - protein, 27 aa, Staphylococcus
FNNKPLRMMIYLGMFTFSLSVLYLLYL

SEQ ID NO: 1873479 - protein, 34 aa, Staphylococcus
FNNKSKFGRICNFFSLFLMFIFKMPKMLKYNHIL

SEQ ID NO: 1873480 - protein, 22 aa, Staphylococcus
FNNLYRFRGLRQYKEKFKPHWE

SEQ ID NO: 1873481 - protein, 22 aa, Staphylococcus
FNNRNALFLSGEWELSQTQYVI

SEQ ID NO: 1873482 - protein, 23 aa, Staphylococcus
FNNRNALFLSGEWELSQTQYVVE

SEQ ID NO: 1873483 - protein, 29 aa, Staphylococcus
FNNSHWIWWFNYCIIALLVVALFYVFFIP

SEQ ID NO: 1873484 - protein, 25 aa, Staphylococcus
FNNSHWVWWLTYGVIALLLITLFYV

SEQ ID NO: 1873485 - protein, 23 aa, Staphylococcus
FNNSISPWIFVIFWVASIVILLG

SEQ ID NO: 1873486 - protein, 35 aa, Staphylococcus
FNNTDWRANLSYWKRRMASGLTGWGPTGRRKKYAT

SEQ ID NO: 1873487 - protein, 17 aa, Staphylococcus
FNPPAAWLNNLLLNGLN

SEQ ID NO: 1873488 - protein, 25 aa, Staphylococcus
FNQPIIWLCGGLDRGNGFDELIPYM

SEQ ID NO: 1873489 - protein, 19 aa, Staphylococcus
FNQVWPILIFLPIVVIGFL

SEQ ID NO: 1873490 - protein, 24 aa, Staphylococcus
FNRMKHGRFTSREMGFNLFLNLLN

SEQ ID NO: 1873491 - protein, 19 aa, Staphylococcus
FNRTILKVINFIIIAVALM

SEQ ID NO: 1873492 - protein, 17 aa, Staphylococcus
FNRTLKISITHDVLGRI

SEQ ID NO: 1873493 - protein, 21 aa, Staphylococcus
FNRTLLKILNFIVISILLIMS

SEQ ID NO: 1873494 - protein, 23 aa, Staphylococcus
FNRTRIGMFVWLILLLPLPFLLS

SEQ ID NO: 1873495 - protein, 22 aa, Staphylococcus
FNRTRVSMFFWLVVLLPLPFLL

SEQ ID NO: 1873496 - protein, 19 aa, Staphylococcus
FNSAILIGLFLKYFRTLKI

SEQ ID NO: 1873497 - protein, 30 aa, Staphylococcus
FNSLAEGSYKYNPFVINQIHQLDNSNGVIS

SEQ ID NO: 1873498 - protein, 18 aa, Staphylococcus
FNSPEAQAKIFVNAVKNN

SEQ ID NO: 1873499 - protein, 19 aa, Staphylococcus
FNSSFLVRAFHVVATAGMT

SEQ ID NO: 1873500 - protein, 18 aa, Staphylococcus
FNSYAIRGHKNIKNGYDQ

SEQ ID NO: 1873501 - protein, 21 aa, Staphylococcus
FNTFDRRTWMAIKKAPVQNTA

SEQ ID NO: 1873502 - protein, 26 aa, Staphylococcus
FNTGSHEYTQYIYVNPQSVNSYDTWL

SEQ ID NO: 1873503 - protein, 53 aa, Staphylococcus
FNTGSKVRLSGQGFKFTSPDEIEVYKVLNNSQFRDSFSPDYANLTQVRNPKII

SEQ ID NO: 1873504 - protein, 19 aa, Staphylococcus
FNTPIAITRKDEFGTLQYR

SEQ ID NO: 1873505 - protein, 22 aa, Staphylococcus
FNTSICLPQIVASVVSFALFPL

SEQ ID NO: 1873506 - protein, 25 aa, Staphylococcus
FNVKAMCITLIILAAVMLFLFLINN

SEQ ID NO: 1873507 - protein, 20 aa, Staphylococcus
FNVLSLPVSIILAISITINA

SEQ ID NO: 1873508 - protein, 18 aa, Staphylococcus
FNVMKIMLIVILLAGVIS

SEQ ID NO: 1873509 - protein, 18 aa, Staphylococcus
FNVNVSWIILRVLAVIFA

SEQ ID NO: 1873510 - protein, 26 aa, Staphylococcus
FNVSWVAGILWLIAAIMLLVRRPKNQ

SEQ ID NO: 1873511 - protein, 17 aa, Staphylococcus
FNWIFGVLMVASFISFI

SEQ ID NO: 1873512 - protein, 21 aa, Staphylococcus
FNYGQARAWGSFGYAVMALVA

SEQ ID NO: 1873513 - protein, 20 aa, Staphylococcus
FNYLCLIGGTGNGIFYFLMT

SEQ ID NO: 1873514 - protein, 21 aa, Staphylococcus
FNYLKRPKFIRTIVSIIAVIP

SEQ ID NO: 1873515 - protein, 22 aa, Staphylococcus
FNYWWMFVISFIFFLIAGVLTI

SEQ ID NO: 1873516 - protein, 17 aa, Staphylococcus
FPAFLGIILGLFEFIGG

SEQ ID NO: 1873517 - protein, 18 aa, Staphylococcus
FPALGLVLAVMIGVGAAE

SEQ ID NO: 1873518 - protein, 18 aa, Staphylococcus
FPALGLVLAVMLGVGVAE

SEQ ID NO: 1873519 - protein, 18 aa, Staphylococcus
FPALGLVLGVIIGIGAAE

SEQ ID NO: 1873520 - protein, 19 aa, Staphylococcus
FPALGLVLGVMIGIGAAEK

SEQ ID NO: 1873521 - protein, 17 aa, Staphylococcus
FPDNVAIALGVAEAVGV

SEQ ID NO: 1873522 - protein, 17 aa, Staphylococcus
FPEENLFAITWLIGLLF

SEQ ID NO: 1873523 - protein, 18 aa, Staphylococcus
FPEIEKAILQESQNALIF

SEQ ID NO: 1873524 - protein, 20 aa, Staphylococcus
FPFGGDIIFVRIIRNNESIV

SEQ ID NO: 1873525 - protein, 21 aa, Staphylococcus
FPFGGDIIFVRIIRNNESIVP

SEQ ID NO: 1873526 - protein, 21 aa, Staphylococcus
FPFGGDIIFVRILRNNESLVP

SEQ ID NO: 1873527 - protein, 20 aa, Staphylococcus
FPFGGDIIFVRIVRNNDSIV

SEQ ID NO: 1873528 - protein, 20 aa, Staphylococcus
FPFGGDVIFVRIIRNNESIV

SEQ ID NO: 1873529 - protein, 17 aa, Staphylococcus
FPFHIWLPDAMEAPTPV

SEQ ID NO: 1873530 - protein, 18 aa, Staphylococcus
FPFILIIIFGVMTTFGPL

SEQ ID NO: 1873531 - protein, 24 aa, Staphylococcus
FPFILRGVSIIGIDSVFTPIKLRR

SEQ ID NO: 1873532 - protein, 20 aa, Staphylococcus
FPFIPFAIVLNATFSEKIKN

SEQ ID NO: 1873533 - protein, 21 aa, Staphylococcus
FPFVGSNSWQYFVLPIVILVL

SEQ ID NO: 1873534 - protein, 26 aa, Staphylococcus
FPFYILTVYFFFGRLRKLTRKRSQAL

SEQ ID NO: 1873535 - protein, 28 aa, Staphylococcus
FPFYILTVYFFFGRLRKLTRVRSQALAE

SEQ ID NO: 1873536 - protein, 25 aa, Staphylococcus
FPFYILTVYFFFGRLRQLTRVRSQA

SEQ ID NO: 1873537 - protein, 23 aa, Staphylococcus
FPFYILTVYYFFGRLRGLTRERS

SEQ ID NO: 1873538 - protein, 21 aa, Staphylococcus
FPGAVPPLIGWTAIEGNISLV

SEQ ID NO: 1873539 - protein, 22 aa, Staphylococcus
FPGAVPPLIGWVAIDGNISLAA

SEQ ID NO: 1873540 - protein, 22 aa, Staphylococcus
FPGAVPPLIGWVAIDGNISLIA

SEQ ID NO: 1873541 - protein, 21 aa, Staphylococcus
FPGAVPPLIGWVAIDGSISVA

SEQ ID NO: 1873542 - protein, 20 aa, Staphylococcus
FPGYASTLFANAMVIGQLCG

SEQ ID NO: 1873543 - protein, 18 aa, Staphylococcus
FPHLPQWIPGVIAVVVLL

SEQ ID NO: 1873544 - protein, 18 aa, Staphylococcus
FPHSTLWQAIFWTVMILL

SEQ ID NO: 1873545 - protein, 18 aa, Staphylococcus
FPIFLLIRLVQGLTAGGI

SEQ ID NO: 1873546 - protein, 21 aa, Staphylococcus
FPILCKFKIATPVFRPLFVWQ

SEQ ID NO: 1873547 - protein, 19 aa, Staphylococcus
FPILMSFFVFLFVFLISGI

SEQ ID NO: 1873548 - protein, 20 aa, Staphylococcus
FPILRKFKVATPMFRPLFAW

SEQ ID NO: 1873549 - protein, 27 aa, Staphylococcus
FPINFFPRKIWYLFIIMTITILLTMKI

SEQ ID NO: 1873550 - protein, 17 aa, Staphylococcus
FPIQNIVAITWLIGIFF

SEQ ID NO: 1873551 - protein, 19 aa, Staphylococcus
FPISVAVVMGGLFLITGPT

SEQ ID NO: 1873552 - protein, 21 aa, Staphylococcus
FPISVAWLLINFNLHRIEANI

SEQ ID NO: 1873553 - protein, 19 aa, Staphylococcus
FPITLFIGLAIIFLFILVV

SEQ ID NO: 1873554 - protein, 20 aa, Staphylococcus
FPIVAILVIYYVIRFMMQSS

SEQ ID NO: 1873555 - protein, 18 aa, Staphylococcus
FPKSIIFIAPMIVFVFVF

SEQ ID NO: 1873556 - protein, 19 aa, Staphylococcus
FPKSIIFIAPMIVFVFVFG

SEQ ID NO: 1873557 - protein, 18 aa, Staphylococcus
FPKTIIFIAPMIVFLFVF

SEQ ID NO: 1873558 - protein, 18 aa, Staphylococcus
FPLGFVLSIVTLVIIMIF

SEQ ID NO: 1873559 - protein, 21 aa, Staphylococcus
FPLISKCLFFVIFALVNSIGS

SEQ ID NO: 1873560 - protein, 20 aa, Staphylococcus
FPLLQKFKKGWPIIIVYILA

SEQ ID NO: 1873561 - protein, 22 aa, Staphylococcus
FPLSIFLFFAYHFVSDMTLINL

SEQ ID NO: 1873562 - protein, 19 aa, Staphylococcus
FPLSVAWLALNFNLAKVES

SEQ ID NO: 1873563 - protein, 25 aa, Staphylococcus
FPLTLADILFFTGIFIIVYTIIWTV

SEQ ID NO: 1873564 - protein, 20 aa, Staphylococcus
FPLYMSIAVMLLGIFIIFVE

SEQ ID NO: 1873565 - protein, 18 aa, Staphylococcus
FPMGPTIHFGFLSIPITI

SEQ ID NO: 1873566 - protein, 20 aa, Staphylococcus
FPNENWWVFIVLLLLVGNVE

SEQ ID NO: 1873567 - protein, 24 aa, Staphylococcus
FPNFPHWITVLSIVFMLTLFNLLG

SEQ ID NO: 1873568 - protein, 24 aa, Staphylococcus
FPQQWTIFYWSWWIVYAPFIGLFI

SEQ ID NO: 1873569 - protein, 25 aa, Staphylococcus
FPQQWTIFYWSWWIVYAPFIGLFIA

SEQ ID NO: 1873570 - protein, 18 aa, Staphylococcus
FPSGHAMGATSYFGSIIY

SEQ ID NO: 1873571 - protein, 19 aa, Staphylococcus
FPSGHAMGSTAFFGGTIYI

SEQ ID NO: 1873572 - protein, 19 aa, Staphylococcus
FPSGHAMGSTAFFGSVMFI

SEQ ID NO: 1873573 - protein, 18 aa, Staphylococcus
FPSGHAMGSTSFFGSAMF

SEQ ID NO: 1873574 - protein, 18 aa, Staphylococcus
FPSGHAMGSTSFFGSAMY

SEQ ID NO: 1873575 - protein, 19 aa, Staphylococcus
FPSGHAMGSTSYFGSIIYI

SEQ ID NO: 1873576 - protein, 17 aa, Staphylococcus
FPSMHVLSVCILVSLIV

SEQ ID NO: 1873577 - protein, 21 aa, Staphylococcus
FPSQHKLEVGIGRDISGEPVS

SEQ ID NO: 1873578 - protein, 21 aa, Staphylococcus
FPTENWWVFIVLLLLVGNVEV

SEQ ID NO: 1873579 - protein, 24 aa, Staphylococcus
FPTLPEWIPGVIVIVLLAGANLVS

SEQ ID NO: 1873580 - protein, 21 aa, Staphylococcus
FPVHLLETIMNPWIQLILATP

SEQ ID NO: 1873581 - protein, 22 aa, Staphylococcus
FPVKDYGSGMTPFYTSLSIWVG

SEQ ID NO: 1873582 - protein, 22 aa, Staphylococcus
FPVKNYGSGMTPFYTALSIWVG

SEQ ID NO: 1873583 - protein, 20 aa, Staphylococcus
FPVMGIFGFILLFPILIKGI

SEQ ID NO: 1873584 - protein, 25 aa, Staphylococcus
FPVYILTVYFFFGRLRNLTRKRSQA

SEQ ID NO: 1873585 - protein, 27 aa, Staphylococcus
FQAEVPFKRFVFDMSTLAPFIAAIICI

SEQ ID NO: 1873586 - protein, 17 aa, Staphylococcus
FQASIGIKRFVFSINNL

SEQ ID NO: 1873587 - protein, 17 aa, Staphylococcus
FQASPSYETLDDAVHAI

SEQ ID NO: 1873588 - protein, 29 aa, Staphylococcus
FQASVGIKRFVFDITDLAPFIAAIVCIIA

SEQ ID NO: 1873589 - protein, 18 aa, Staphylococcus
FQDLKFNLQQEMTDKVIE

SEQ ID NO: 1873590 - protein, 22 aa, Staphylococcus
FQEKGKIVGLLQMFMTKESIAE

SEQ ID NO: 1873591 - protein, 25 aa, Staphylococcus
FQESFKVPIWLGALIMTVVIYGTLL

SEQ ID NO: 1873592 - protein, 18 aa, Staphylococcus
FQGLKLVSLASIAGLLIF

SEQ ID NO: 1873593 - protein, 23 aa, Staphylococcus
FQGSSLKGTFLIVILSIIVHYFT

SEQ ID NO: 1873594 - protein, 19 aa, Staphylococcus
FQHLSVAIGIALFIFLIVR

SEQ ID NO: 1873595 - protein, 17 aa, Staphylococcus
FQHTSWNAYSFAAINTV

SEQ ID NO: 1873596 - protein, 18 aa, Staphylococcus
FQIFFFDKFMRYTTELTF

SEQ ID NO: 1873597 - protein, 24 aa, Staphylococcus
FQILPSNIIKLNLKIGDKNDYYEK

SEQ ID NO: 1873598 - protein, 17 aa, Staphylococcus
FQITFTWIGTPLSDQLD

SEQ ID NO: 1873599 - protein, 17 aa, Staphylococcus
FQITFTWVGTPLSDKMD

SEQ ID NO: 1873600 - protein, 17 aa, Staphylococcus
FQKIEAIEVKQCDFKDD

SEQ ID NO: 1873601 - protein, 17 aa, Staphylococcus
FQKIYVPILIEQLFMML

SEQ ID NO: 1873602 - protein, 19 aa, Staphylococcus
FQLIIPILSGFIARSISDK

SEQ ID NO: 1873603 - protein, 27 aa, Staphylococcus
FQLMKDVELPLALPLILGGIRLSSVYV

SEQ ID NO: 1873604 - protein, 17 aa, Staphylococcus
FQLSITYFGAFWQVLLL

SEQ ID NO: 1873605 - protein, 17 aa, Staphylococcus
FQMLQFIPVIVVPQVLF

SEQ ID NO: 1873606 - protein, 19 aa, Staphylococcus
FQMMFCTIAVSILSGSIAE

SEQ ID NO: 1873607 - protein, 17 aa, Staphylococcus
FQMPVSFNGIKLTSPKF

SEQ ID NO: 1873608 - protein, 32 aa, Staphylococcus
FQMYLYEHFSQFKLFYDHSFGLGGDYVKDLSY

SEQ ID NO: 1873609 - protein, 24 aa, Staphylococcus
FQMYLYEHFTQFKGFYDESFGLGG

SEQ ID NO: 1873610 - protein, 17 aa, Staphylococcus
FQNRRTGDLMAHATNDI

SEQ ID NO: 1873611 - protein, 18 aa, Staphylococcus
FQPHFWKGQLSYPTIINR

SEQ ID NO: 1873612 - protein, 18 aa, Staphylococcus
FQPTRMILIGVAMYAMLT

SEQ ID NO: 1873613 - protein, 18 aa, Staphylococcus
FQQIEAIEVKKCDFKNEL

SEQ ID NO: 1873614 - protein, 17 aa, Staphylococcus
FQQIEAIEVKQCDFKDG

SEQ ID NO: 1873615 - protein, 17 aa, Staphylococcus
FQQRRTGDLMAHATNDI

SEQ ID NO: 1873616 - protein, 18 aa, Staphylococcus
FQSLWLAVSVVFTAIGAI

SEQ ID NO: 1873617 - protein, 18 aa, Staphylococcus
FQSPRSVIIGVILQYTIM

SEQ ID NO: 1873618 - protein, 22 aa, Staphylococcus
FQVFFFDKFMKFTTELNFIAWS

SEQ ID NO: 1873619 - protein, 20 aa, Staphylococcus
FQWALTIFVFFIVTMALTLI

SEQ ID NO: 1873620 - protein, 19 aa, Staphylococcus
FQWALTIFVFFVVTMALFI

SEQ ID NO: 1873621 - protein, 21 aa, Staphylococcus
FQWAMMIFIFFIVAYALPIIL

SEQ ID NO: 1873622 - protein, 17 aa, Staphylococcus
FQWAMMVFVFFVITMAL

SEQ ID NO: 1873623 - protein, 17 aa, Staphylococcus
FQWAMTIFVFFVLAFAF

SEQ ID NO: 1873624 - protein, 21 aa, Staphylococcus
FQYDNQPVWELIKPRLVPSLE

SEQ ID NO: 1873625 - protein, 21 aa, Staphylococcus
FQYFTAPLFKGDYKVKNSELV

SEQ ID NO: 1873626 - protein, 29 aa, Staphylococcus
FRAANGYLGFAIIFGFMAFFWFIGVHGPS

SEQ ID NO: 1873627 - protein, 21 aa, Staphylococcus
FRAFTYIEVLFALFITILIFS

SEQ ID NO: 1873628 - protein, 31 aa, Staphylococcus
FRCISGIVLAGLFPYYLVKALDKTGVTKLFR

SEQ ID NO: 1873629 - protein, 24 aa, Staphylococcus
FREKGGHAEAFFPSKLPLINLRMN

SEQ ID NO: 1873630 - protein, 17 aa, Staphylococcus
FRENGGQVEAFFQAKIP

SEQ ID NO: 1873631 - protein, 19 aa, Staphylococcus
FRFPPHVAVGTSMMMIFFS

SEQ ID NO: 1873632 - protein, 25 aa, Staphylococcus
FRGALLKRRVKTTINSASSLSVTDN

SEQ ID NO: 1873633 - protein, 18 aa, Staphylococcus
FRGDDKWAGAWMLFFFGW

SEQ ID NO: 1873634 - protein, 17 aa, Staphylococcus
FRGGPAYYITKGLNQKW

SEQ ID NO: 1873635 - protein, 18 aa, Staphylococcus
FRIERKYLPIAFKYLLIH

SEQ ID NO: 1873636 - protein, 25 aa, Staphylococcus
FRINRRLGGSQSYLFFGSLPVSRKD

SEQ ID NO: 1873637 - protein, 19 aa, Staphylococcus
FRISNPIARGLALGTSGHT

SEQ ID NO: 1873638 - protein, 20 aa, Staphylococcus
FRKKGGQVESFFPSKLPLIN

SEQ ID NO: 1873639 - protein, 17 aa, Staphylococcus
FRKSSIDLLSIIFIMMF

SEQ ID NO: 1873640 - protein, 21 aa, Staphylococcus
FRLDGLSLFFSLLISLIGLAV

SEQ ID NO: 1873641 - protein, 22 aa, Staphylococcus
FRLDGLSMIFALLITLIGTGVV

SEQ ID NO: 1873642 - protein, 19 aa, Staphylococcus
FRLEPWIIAIFLAVLLALI

SEQ ID NO: 1873643 - protein, 17 aa, Staphylococcus
FRLEVDVTFIAAVLTII

SEQ ID NO: 1873644 - protein, 19 aa, Staphylococcus
FRLFGKQGLIAWVAMGTII

SEQ ID NO: 1873645 - protein, 23 aa, Staphylococcus
FRLHRRLGGKSSYLFYESLPVSK

SEQ ID NO: 1873646 - protein, 19 aa, Staphylococcus
FRLKMHLIYQKNVILCTIP

SEQ ID NO: 1873647 - protein, 21 aa, Staphylococcus
FRLLSQRAVISLTQLDEYNRF

SEQ ID NO: 1873648 - protein, 20 aa, Staphylococcus
FRLLSQRAVKAMSSLKEYNR

SEQ ID NO: 1873649 - protein, 21 aa, Staphylococcus
FRLMLFIEGIYQYIIIGCLSI

SEQ ID NO: 1873650 - protein, 17 aa, Staphylococcus
FRNKFKIDEEVTLLTSN

SEQ ID NO: 1873651 - protein, 24 aa, Staphylococcus
FRNKGGHAESFFPSKLPLINLRMN

SEQ ID NO: 1873652 - protein, 24 aa, Staphylococcus
FRNKGGKAEAFFPSKLPLINLRMN

SEQ ID NO: 1873653 - protein, 25 aa, Staphylococcus
FRNTIRYTVIMAISIFIALMFDFEK

SEQ ID NO: 1873654 - protein, 24 aa, Staphylococcus
FRPILAALNYKFSIGAAVIDPYFG

SEQ ID NO: 1873655 - protein, 17 aa, Staphylococcus
FRQAGIKPILLGLVTWI

SEQ ID NO: 1873656 - protein, 23 aa, Staphylococcus
FRQKGGHVESFFPSKLPLINLRM

SEQ ID NO: 1873657 - protein, 18 aa, Staphylococcus
FRQTRLETPLLDFRVFKE

SEQ ID NO: 1873658 - protein, 18 aa, Staphylococcus
FRQTRLETPLLDFSVFKN

SEQ ID NO: 1873659 - protein, 29 aa, Staphylococcus
FRRLTKVELPIAMPVIMAGIRTAMVLIIG

SEQ ID NO: 1873660 - protein, 19 aa, Staphylococcus
FRTVFDYIVGVILIGLAVS

SEQ ID NO: 1873661 - protein, 21 aa, Staphylococcus
FRVHKRLGGQQAYIYFASLPV

SEQ ID NO: 1873662 - protein, 22 aa, Staphylococcus
FRVILIPVFILFALVDFGFGKV

SEQ ID NO: 1873663 - protein, 22 aa, Staphylococcus
FRVILIPVFILFALVDFGFGTV

SEQ ID NO: 1873664 - protein, 22 aa, Staphylococcus
FRVILIPVFILFALVNFGFGNM

SEQ ID NO: 1873665 - protein, 22 aa, Staphylococcus
FRVILIPVFILFALVNFGFGNV

SEQ ID NO: 1873666 - protein, 20 aa, Staphylococcus
FRVLGRPAGFVVTFLDIFKG

SEQ ID NO: 1873667 - protein, 22 aa, Staphylococcus
FRVLSFVIRLLFGHRTFTHSLA

SEQ ID NO: 1873668 - protein, 22 aa, Staphylococcus
FRVLSILIFIMAFKMLGVSIQK

SEQ ID NO: 1873669 - protein, 22 aa, Staphylococcus
FRVVLIPVFILFALVNFGFGKV

SEQ ID NO: 1873670 - protein, 19 aa, Staphylococcus
FRYKEIKKSGTATVEAIGK

SEQ ID NO: 1873671 - protein, 17 aa, Staphylococcus
FRYKEIRKKGTPPVESI

SEQ ID NO: 1873672 - protein, 20 aa, Staphylococcus
FRYLFLFTFIIGGVFALFHF

SEQ ID NO: 1873673 - protein, 20 aa, Staphylococcus
FRYWPFDKCESGFNPGTFPN

SEQ ID NO: 1873674 - protein, 20 aa, Staphylococcus
FRYWPLNKWKGGFNPGTFPN

SEQ ID NO: 1873675 - protein, 18 aa, Staphylococcus
FSAACIMPATLAIVNEYY

SEQ ID NO: 1873676 - protein, 19 aa, Staphylococcus
FSAAISVLFAVLASLTLLP

SEQ ID NO: 1873677 - protein, 24 aa, Staphylococcus
FSADTRAAIFISPIWFIFLFFYYK

SEQ ID NO: 1873678 - protein, 17 aa, Staphylococcus
FSAFFITSVNSFMNTPA

SEQ ID NO: 1873679 - protein, 18 aa, Staphylococcus
FSAGMGIGLVFYGSSEPI

SEQ ID NO: 1873680 - protein, 19 aa, Staphylococcus
FSALIPILGSLVPAVAAVG

SEQ ID NO: 1873681 - protein, 26 aa, Staphylococcus
FSAPQKRWHFIIAFNSAMLIGLYVKY

SEQ ID NO: 1873682 - protein, 26 aa, Staphylococcus
FSAPQKRWHFILAFNSTLLIGLFLKY

SEQ ID NO: 1873683 - protein, 19 aa, Staphylococcus
FSAVASFLCTNIIYHNYLK

SEQ ID NO: 1873684 - protein, 30 aa, Staphylococcus
FSDFGRLLKRPKFIIPMFLQGLTYVMLFSF

SEQ ID NO: 1873685 - protein, 19 aa, Staphylococcus
FSDGHEIVIPKGEKGDKGD

SEQ ID NO: 1873686 - protein, 21 aa, Staphylococcus
FSDGHEIVIPKGEKVDTGATG

SEQ ID NO: 1873687 - protein, 18 aa, Staphylococcus
FSDGKKVTIPKGAKGDKG

SEQ ID NO: 1873688 - protein, 18 aa, Staphylococcus
FSDGNSITIPRGQDGHSV

SEQ ID NO: 1873689 - protein, 23 aa, Staphylococcus
FSDGREINIPKGKDGKSVTITKA

SEQ ID NO: 1873690 - protein, 24 aa, Staphylococcus
FSDGREITIPKGKDGISVTVKNSH

SEQ ID NO: 1873691 - protein, 20 aa, Staphylococcus
FSDGRKVVIEASKQIQKQDV

SEQ ID NO: 1873692 - protein, 17 aa, Staphylococcus
FSDGSKVVIPKAKDGVD

SEQ ID NO: 1873693 - protein, 19 aa, Staphylococcus
FSDGTKVVIPKGEKGEKGE

SEQ ID NO: 1873694 - protein, 24 aa, Staphylococcus
FSDVELPTALSFFSGKRLVPIMTV

SEQ ID NO: 1873695 - protein, 19 aa, Staphylococcus
FSDVPALLATFLFGPVAGV

SEQ ID NO: 1873696 - protein, 19 aa, Staphylococcus
FSDVPTLLATFIFGPLSGL

SEQ ID NO: 1873697 - protein, 18 aa, Staphylococcus
FSDVPTLLATFLLGPIAG

SEQ ID NO: 1873698 - protein, 19 aa, Staphylococcus
FSEIIRVMSRFIGNFPVVS

SEQ ID NO: 1873699 - protein, 21 aa, Staphylococcus
FSETRFMKFLGGKDLLFALVS

SEQ ID NO: 1873700 - protein, 20 aa, Staphylococcus
FSFAHTLLLFLSMTISLGIL

SEQ ID NO: 1873701 - protein, 17 aa, Staphylococcus
FSFGLLVATGTLAHTYV

SEQ ID NO: 1873702 - protein, 19 aa, Staphylococcus
FSFMDAAFCLMSIAYVGIG

SEQ ID NO: 1873703 - protein, 21 aa, Staphylococcus
FSFMSVFFRLAGDLPVFQKSL

SEQ ID NO: 1873704 - protein, 23 aa, Staphylococcus
FSFSFGSGNSFFGDFTYIGLAHV

SEQ ID NO: 1873705 - protein, 22 aa, Staphylococcus
FSFTDINGHFSFTNYQQIFQYK

SEQ ID NO: 1873706 - protein, 22 aa, Staphylococcus
FSFTDVHGHFSFTNYEQIFSLR

SEQ ID NO: 1873707 - protein, 22 aa, Staphylococcus
FSFTETRFMKFLGGKDLLFALL

SEQ ID NO: 1873708 - protein, 24 aa, Staphylococcus
FSFVGCGLVCLMLSRNRKRSDLIY

SEQ ID NO: 1873709 - protein, 18 aa, Staphylococcus
FSGETFRNNMTVTDNYGV

SEQ ID NO: 1873710 - protein, 22 aa, Staphylococcus
FSGETLRKAYSYLMIATVGGIG

SEQ ID NO: 1873711 - protein, 18 aa, Staphylococcus
FSGIFLFILVLINFPISM

SEQ ID NO: 1873712 - protein, 17 aa, Staphylococcus
FSGKLNYANFQDMKFNL

SEQ ID NO: 1873713 - protein, 23 aa, Staphylococcus
FSGKRLVPIMTVFFSTILAVILL

SEQ ID NO: 1873714 - protein, 34 aa, Staphylococcus
FSGKRLVPIMTVFYCTFLIAILLFAWPFIYSAIV

SEQ ID NO: 1873715 - protein, 17 aa, Staphylococcus
FSGNPVLQHLGITGGNM

SEQ ID NO: 1873716 - protein, 22 aa, Staphylococcus
FSGQTFNYTWFVGGLLGVIFLT

SEQ ID NO: 1873717 - protein, 17 aa, Staphylococcus
FSGRSFSILKGSDLSMV

SEQ ID NO: 1873718 - protein, 24 aa, Staphylococcus
FSGTELPTALSFFSGKRLVPIMTA

SEQ ID NO: 1873719 - protein, 21 aa, Staphylococcus
FSIAHAFAYAILAERYSKVTV

SEQ ID NO: 1873720 - protein, 27 aa, Staphylococcus
FSIFIIMLCIIFRNYFRGYGFAIHLNS

SEQ ID NO: 1873721 - protein, 19 aa, Staphylococcus
FSIGTLLAGLSYILIGLVG

SEQ ID NO: 1873722 - protein, 20 aa, Staphylococcus
FSIIEWVILVKVFNRKIPFF

SEQ ID NO: 1873723 - protein, 17 aa, Staphylococcus
FSIRKFSIGTGSVLLGA

SEQ ID NO: 1873724 - protein, 32 aa, Staphylococcus
FSIRKFTVGTFSTVIATLSFITHTGHAAELDE

SEQ ID NO: 1873725 - protein, 28 aa, Staphylococcus
FSIRKHKFGVSSILVGSIIGLTMLMTKE

SEQ ID NO: 1873726 - protein, 20 aa, Staphylococcus
FSISLFKNFYMMLLGQLFLA

SEQ ID NO: 1873727 - protein, 18 aa, Staphylococcus
FSIVRMLISFAILVLIIY

SEQ ID NO: 1873728 - protein, 20 aa, Staphylococcus
FSIVSFIVVFAVFAVARTFF

SEQ ID NO: 1873729 - protein, 22 aa, Staphylococcus
FSKEILFVLFLYAGFYKSVVPF

SEQ ID NO: 1873730 - protein, 23 aa, Staphylococcus
FSKGLYEWIGYNTKVFTYENVER

SEQ ID NO: 1873731 - protein, 20 aa, Staphylococcus
FSKHHGFDIKGTTRALFSTI

SEQ ID NO: 1873732 - protein, 18 aa, Staphylococcus
FSKINRWFLIGLFICGGA

SEQ ID NO: 1873733 - protein, 39 aa, Staphylococcus
FSKLWEIIKRNLKWLIILPIVCLLLSVLVTAVAVHPKYQ

SEQ ID NO: 1873734 - protein, 18 aa, Staphylococcus
FSKMFGQIGIGMGIGTGF

SEQ ID NO: 1873735 - protein, 23 aa, Staphylococcus
FSKPKFKVVFDYVVGIVLIGLSI

SEQ ID NO: 1873736 - protein, 24 aa, Staphylococcus
FSKTELPIALSFFSGKRLVPILTA

SEQ ID NO: 1873737 - protein, 19 aa, Staphylococcus
FSKTLLRFQMIGLIIFSVI

SEQ ID NO: 1873738 - protein, 17 aa, Staphylococcus
FSKYMTLFMLANIILGV

SEQ ID NO: 1873739 - protein, 18 aa, Staphylococcus
FSLALLIGLISGVFSSIF

SEQ ID NO: 1873740 - protein, 17 aa, Staphylococcus
FSLALLIGLVSGVFSSV

SEQ ID NO: 1873741 - protein, 25 aa, Staphylococcus
FSLFRLEVDLTFIAAVLTIVGYSIN

SEQ ID NO: 1873742 - protein, 28 aa, Staphylococcus
FSLIASILVLWLYFRKSIPGKFDAVNIR

SEQ ID NO: 1873743 - protein, 27 aa, Staphylococcus
FSLIASILVLWLYFRKSIPRKFDAVNI

SEQ ID NO: 1873744 - protein, 20 aa, Staphylococcus
FSLLASIIVLWIYFRTSIPK

SEQ ID NO: 1873745 - protein, 29 aa, Staphylococcus
FSLLLFEGMFKLGHFSVYFILLVGVILGT

SEQ ID NO: 1873746 - protein, 21 aa, Staphylococcus
FSLLLSIILYFSFTTLQFTHS

SEQ ID NO: 1873747 - protein, 21 aa, Staphylococcus
FSLPAAWEHTYIRSILLIVIG

SEQ ID NO: 1873748 - protein, 24 aa, Staphylococcus
FSLPQRRWVYFLALSSGALIALFI

SEQ ID NO: 1873749 - protein, 24 aa, Staphylococcus
FSLPQRRWVYFLSISTSILIALYI

SEQ ID NO: 1873750 - protein, 20 aa, Staphylococcus
FSLRVMFVALSFVLSIFFSL

SEQ ID NO: 1873751 - protein, 17 aa, Staphylococcus
FSLSVLYLLYLLINIMI

SEQ ID NO: 1873752 - protein, 18 aa, Staphylococcus
FSLYWKDLTRAGAVSGMI

SEQ ID NO: 1873753 - protein, 18 aa, Staphylococcus
FSLYWKKLTRAGAISGMV

SEQ ID NO: 1873754 - protein, 24 aa, Staphylococcus
FSMLFFIVAWFFARKPSKILDYIG

SEQ ID NO: 1873755 - protein, 26 aa, Staphylococcus
FSMMPYCIYSILLGICGILAIVFRFP

SEQ ID NO: 1873756 - protein, 27 aa, Staphylococcus
FSMPWELSVIYSPFRLILLMIIAILGM

SEQ ID NO: 1873757 - protein, 20 aa, Staphylococcus
FSNAGSLGFTSWMFYVPLIL

SEQ ID NO: 1873758 - protein, 18 aa, Staphylococcus
FSNKLGYDNFQDMKFSVQ

SEQ ID NO: 1873759 - protein, 17 aa, Staphylococcus
FSNVFLKQRVFSDKTHG

SEQ ID NO: 1873760 - protein, 23 aa, Staphylococcus
FSPEKRQIRLLSIPRDTISYIPK

SEQ ID NO: 1873761 - protein, 20 aa, Staphylococcus
FSPNFTTLLFARIVQALGSG

SEQ ID NO: 1873762 - protein, 20 aa, Staphylococcus
FSPTQLASAFASIANGGTYN

SEQ ID NO: 1873763 - protein, 18 aa, Staphylococcus
FSPVFDHPIALTILLIIS

SEQ ID NO: 1873764 - protein, 27 aa, Staphylococcus
FSQPFTKRYFSLIIMMAIITFICTFIG

SEQ ID NO: 1873765 - protein, 29 aa, Staphylococcus
FSQSKFFSQIESISFDGTNMITDNNGQNW

SEQ ID NO: 1873766 - protein, 19 aa, Staphylococcus
FSQVWPILIFLPIVVYIFT

SEQ ID NO: 1873767 - protein, 24 aa, Staphylococcus
FSQYPEIFFIIAAILLMAFNYFTT

SEQ ID NO: 1873768 - protein, 18 aa, Staphylococcus
FSRNDYKHIVLAGKYNSR

SEQ ID NO: 1873769 - protein, 17 aa, Staphylococcus
FSSAAPFITQKIYDMTP

SEQ ID NO: 1873770 - protein, 17 aa, Staphylococcus
FSSASPFITQKIYHMTP

SEQ ID NO: 1873771 - protein, 17 aa, Staphylococcus
FSSASPFITQKIYNMTP

SEQ ID NO: 1873772 - protein, 20 aa, Staphylococcus
FSSATGHTMDFFWELATLIL

SEQ ID NO: 1873773 - protein, 23 aa, Staphylococcus
FSSDRKHIRWKYVALLLVIQFIF

SEQ ID NO: 1873774 - protein, 25 aa, Staphylococcus
FSSKAALVIFMWLPKAYAVLNTELA

SEQ ID NO: 1873775 - protein, 18 aa, Staphylococcus
FSSLLLAIVINTTINMFI

SEQ ID NO: 1873776 - protein, 17 aa, Staphylococcus
FSSNIIQLITFRGLQGI

SEQ ID NO: 1873777 - protein, 26 aa, Staphylococcus
FSSNLKSGKDTPGLDFKINDASPTMI

SEQ ID NO: 1873778 - protein, 18 aa, Staphylococcus
FSSSKSVKQIDDKIDTPR

SEQ ID NO: 1873779 - protein, 17 aa, Staphylococcus
FSSSLLIGLYVKYFRTV

SEQ ID NO: 1873780 - protein, 18 aa, Staphylococcus
FSSVFAYFTYISSILVDV

SEQ ID NO: 1873781 - protein, 17 aa, Staphylococcus
FSSVSALGLYWSVSAAF

SEQ ID NO: 1873782 - protein, 17 aa, Staphylococcus
FSSWLETDYLDSRDNGS

SEQ ID NO: 1873783 - protein, 21 aa, Staphylococcus
FSTILGIFGALTIKGRKNLAG

SEQ ID NO: 1873784 - protein, 24 aa, Staphylococcus
FSTPERRWVYIFAIMSAGLIALFI

SEQ ID NO: 1873785 - protein, 17 aa, Staphylococcus
FSTRQVFLTAIFIFFIG

SEQ ID NO: 1873786 - protein, 19 aa, Staphylococcus
FSTTIWMLIGFMIFGAISS

SEQ ID NO: 1873787 - protein, 20 aa, Staphylococcus
FSVGILVFICIWTFILSLIF

SEQ ID NO: 1873788 - protein, 29 aa, Staphylococcus
FSVIKSPWLRPTLIIGCIFAIFQQFIGIN

SEQ ID NO: 1873789 - protein, 26 aa, Staphylococcus
FSVMPYCIYSFLLGICGIIAIILRYP

SEQ ID NO: 1873790 - protein, 26 aa, Staphylococcus
FSVQLRWFPVAGWEGLPTIVLPSLSL

SEQ ID NO: 1873791 - protein, 25 aa, Staphylococcus
FSVRLRWFPVAGWEGISTAILPSLA

SEQ ID NO: 1873792 - protein, 20 aa, Staphylococcus
FSVVTRSKWIGTLLTLILIG

SEQ ID NO: 1873793 - protein, 19 aa, Staphylococcus
FSWFMPTYVAILLSAIIAS

SEQ ID NO: 1873794 - protein, 27 aa, Staphylococcus
FSYMPELDWHYSYFVFIAISLVVVVSL

SEQ ID NO: 1873795 - protein, 25 aa, Staphylococcus
FSYYEAIVLLAYVAYRFIFPHPTDL

SEQ ID NO: 1873796 - protein, 22 aa, Staphylococcus
FTAIGIVFALLITRETISVPSL

SEQ ID NO: 1873797 - protein, 17 aa, Staphylococcus
FTANGLLSLGASPTMSE

SEQ ID NO: 1873798 - protein, 25 aa, Staphylococcus
FTAREFPTGMNLFFAILSGAGWSFG

SEQ ID NO: 1873799 - protein, 20 aa, Staphylococcus
FTATIPYKGTLVVMKDDYTK

SEQ ID NO: 1873800 - protein, 18 aa, Staphylococcus
FTAVGILMQRWFPEIPEY

SEQ ID NO: 1873801 - protein, 18 aa, Staphylococcus
FTDGHSITIPKGDKGDRG

SEQ ID NO: 1873802 - protein, 21 aa, Staphylococcus
FTDGNVITVLKGRDGKDGVDG

SEQ ID NO: 1873803 - protein, 21 aa, Staphylococcus
FTDMFWYLPGFFVMLLSVVSS

SEQ ID NO: 1873804 - protein, 20 aa, Staphylococcus
FTEGLYWRIAGCIIGTIFVV

SEQ ID NO: 1873805 - protein, 19 aa, Staphylococcus
FTEVLSILGKAFVDNRLVT

SEQ ID NO: 1873806 - protein, 27 aa, Staphylococcus
FTFGSLICAISMNFPIMMTGRVLQAIG

SEQ ID NO: 1873807 - protein, 17 aa, Staphylococcus
FTFKVVIQLGSVFAAAW

SEQ ID NO: 1873808 - protein, 19 aa, Staphylococcus
FTFLKAVGIIILFFGILLM

SEQ ID NO: 1873809 - protein, 20 aa, Staphylococcus
FTFVSGLFLILRSMRRRASK

SEQ ID NO: 1873810 - protein, 17 aa, Staphylococcus
FTGNVFIVGTVGFLWGM

SEQ ID NO: 1873811 - protein, 31 aa, Staphylococcus
FTGRARRAEYWWCVLWAAFLFLPLLGLGFIT

SEQ ID NO: 1873812 - protein, 23 aa, Staphylococcus
FTGWEIIDPIISIIISLIIFNGG

SEQ ID NO: 1873813 - protein, 25 aa, Staphylococcus
FTHFDLPLSFAYVIFIIFWQVGFSN

SEQ ID NO: 1873814 - protein, 17 aa, Staphylococcus
FTHIRYRTLAITFNVSV

SEQ ID NO: 1873815 - protein, 18 aa, Staphylococcus
FTHNRNLFWIFLIILLVL

SEQ ID NO: 1873816 - protein, 21 aa, Staphylococcus
FTHSLLFIGIIVFLLNLIQTP

SEQ ID NO: 1873817 - protein, 22 aa, Staphylococcus
FTHSLLFLGMIGFLLILIQTPT

SEQ ID NO: 1873818 - protein, 17 aa, Staphylococcus
FTIADPIASILVSIIIL

SEQ ID NO: 1873819 - protein, 22 aa, Staphylococcus
FTIFACWPFTRLVHVWSVPISY

SEQ ID NO: 1873820 - protein, 21 aa, Staphylococcus
FTIFACWPFTRLVHVWSVPLS

SEQ ID NO: 1873821 - protein, 27 aa, Staphylococcus
FTIGVVSIVAGITFFISEHDVQAAEQQ

SEQ ID NO: 1873822 - protein, 19 aa, Staphylococcus
FTIIGVLLILVGVFFVFKP

SEQ ID NO: 1873823 - protein, 21 aa, Staphylococcus
FTILACTKLNLQVGTTVAVLT

SEQ ID NO: 1873824 - protein, 25 aa, Staphylococcus
FTILACWPFTRLVHVWSIPLAYTNR

SEQ ID NO: 1873825 - protein, 21 aa, Staphylococcus
FTILACWPFTRLVHVWSVPLS

SEQ ID NO: 1873826 - protein, 22 aa, Staphylococcus
FTILACWPFTRLVHVWSVPLSY

SEQ ID NO: 1873827 - protein, 23 aa, Staphylococcus
FTILTCTLLLIWAAYSSLNQSFK

SEQ ID NO: 1873828 - protein, 21 aa, Staphylococcus
FTILVCTKLNLQVGTTVAVLT

SEQ ID NO: 1873829 - protein, 17 aa, Staphylococcus
FTIRKAKSIAFRDVKNH

SEQ ID NO: 1873830 - protein, 24 aa, Staphylococcus
FTISSRFVQFTSFREMLRALVEKP

SEQ ID NO: 1873831 - protein, 31 aa, Staphylococcus
FTITCTLIIILFFKVLPNIYWDINEIEPTYL

SEQ ID NO: 1873832 - protein, 18 aa, Staphylococcus
FTKISYPIIIYIPLILAF

SEQ ID NO: 1873833 - protein, 24 aa, Staphylococcus
FTKKDIHEPWLFSMPSLVLMILIP

SEQ ID NO: 1873834 - protein, 23 aa, Staphylococcus
FTKKSIHEPWLFSLPAMILMVLI

SEQ ID NO: 1873835 - protein, 22 aa, Staphylococcus
FTKPRLLIREITSPTIYCAYTE

SEQ ID NO: 1873836 - protein, 21 aa, Staphylococcus
FTKRFVSILFIFTYVVSFLPV

SEQ ID NO: 1873837 - protein, 26 aa, Staphylococcus
FTKVILMLLMFIGRVGLISFIIMIGG

SEQ ID NO: 1873838 - protein, 28 aa, Staphylococcus
FTLATPVQFIIGWQFYKGAYKNLKNGSA

SEQ ID NO: 1873839 - protein, 17 aa, Staphylococcus
FTLDKAKEANKAEVNKL

SEQ ID NO: 1873840 - protein, 24 aa, Staphylococcus
FTLFTYKAPNGMRAMGALANAAIA

SEQ ID NO: 1873841 - protein, 24 aa, Staphylococcus
FTLLESFEFINLYFKYRDKELKNK

SEQ ID NO: 1873842 - protein, 23 aa, Staphylococcus
FTLLESFKFLNFYYLSKNVQLAS

SEQ ID NO: 1873843 - protein, 18 aa, Staphylococcus
FTLLIIMTILHTFLSTDT

SEQ ID NO: 1873844 - protein, 26 aa, Staphylococcus
FTLYESFKFLNLHFKYKGTKTQMELM

SEQ ID NO: 1873845 - protein, 17 aa, Staphylococcus
FTMKNADGEVIATGTNN

SEQ ID NO: 1873846 - protein, 18 aa, Staphylococcus
FTNFYFSYYEAVVLGFYF

SEQ ID NO: 1873847 - protein, 25 aa, Staphylococcus
FTNIREYIVPAVLFIFFLISFIGQI

SEQ ID NO: 1873848 - protein, 20 aa, Staphylococcus
FTNIRHYIGPGIFLLIILFS

SEQ ID NO: 1873849 - protein, 28 aa, Staphylococcus
FTNLKVIILSGIIPFNIIKGCVISIIFI

SEQ ID NO: 1873850 - protein, 17 aa, Staphylococcus
FTNLLVVVSFVIGLTIV

SEQ ID NO: 1873851 - protein, 18 aa, Staphylococcus
FTNQILKGVAQAHEKLII

SEQ ID NO: 1873852 - protein, 18 aa, Staphylococcus
FTNTLTLGLRLYGNIYAG

SEQ ID NO: 1873853 - protein, 20 aa, Staphylococcus
FTPASAYAFMLFILLYIPCL

SEQ ID NO: 1873854 - protein, 17 aa, Staphylococcus
FTPDLTHLDSTDSKKVS

SEQ ID NO: 1873855 - protein, 26 aa, Staphylococcus
FTPIEGWRWMLGLAVVPSLILLIGVA

SEQ ID NO: 1873856 - protein, 26 aa, Staphylococcus
FTPYPWIKWLMYVVALFLPVFVIFTI

SEQ ID NO: 1873857 - protein, 18 aa, Staphylococcus
FTQCIFVIGLGRIIDSLA

SEQ ID NO: 1873858 - protein, 19 aa, Staphylococcus
FTQINWWFVIALSIGGMIA

SEQ ID NO: 1873859 - protein, 24 aa, Staphylococcus
FTQVWPILFFLPFVVSVFMRINTH

SEQ ID NO: 1873860 - protein, 26 aa, Staphylococcus
FTRKVKEIMVASRMEHEYSKNEILSF

SEQ ID NO: 1873861 - protein, 25 aa, Staphylococcus
FTSEYLRIMFLSAPFVILFFILEQF

SEQ ID NO: 1873862 - protein, 23 aa, Staphylococcus
FTSKLWLNRCLLIALMFLNGLGI

SEQ ID NO: 1873863 - protein, 26 aa, Staphylococcus
FTSLSVSLPAFFIGILLLYIFDLKLN

SEQ ID NO: 1873864 - protein, 26 aa, Staphylococcus
FTSLSVSLPSFFIGLILLFIFNQKLN

SEQ ID NO: 1873865 - protein, 24 aa, Staphylococcus
FTSVDAFKNLQIPLSMAGQSQNSN

SEQ ID NO: 1873866 - protein, 17 aa, Staphylococcus
FTSVIWLLGSFAFGFYI

SEQ ID NO: 1873867 - protein, 20 aa, Staphylococcus
FTSVNAFKNLKIPATIAGQG

SEQ ID NO: 1873868 - protein, 28 aa, Staphylococcus
FTTAKKRLPWLIILTFLGMITATILGSF

SEQ ID NO: 1873869 - protein, 25 aa, Staphylococcus
FTTARRFSGLLGRVNTNDETSIFSM

SEQ ID NO: 1873870 - protein, 40 aa, Staphylococcus
FTTMNLAEERFGHLIQGSFKYNPFVVNQISRMSEDGNTSE

SEQ ID NO: 1873871 - protein, 25 aa, Staphylococcus
FTTSEWLRVWGLMYFITIFTNLFWG

SEQ ID NO: 1873872 - protein, 24 aa, Staphylococcus
FTTSEWLRVWGLMYIITIFTNLFW

SEQ ID NO: 1873873 - protein, 26 aa, Staphylococcus
FTVGTASILLGSLLFLGQNDAQAAEE

SEQ ID NO: 1873874 - protein, 25 aa, Staphylococcus
FTVIFYFLGGVFKKAQFLQKLNDGT

SEQ ID NO: 1873875 - protein, 28 aa, Staphylococcus
FTVIGLLAIFFADWFIDFFGNITPEQFL

SEQ ID NO: 1873876 - protein, 19 aa, Staphylococcus
FTVLLFKKNTPVAVLEGEG

SEQ ID NO: 1873877 - protein, 17 aa, Staphylococcus
FTVRAFGEAEFWLSAIK

SEQ ID NO: 1873878 - protein, 23 aa, Staphylococcus
FTVSIPSFFLGTILIYVFAQKWN

SEQ ID NO: 1873879 - protein, 19 aa, Staphylococcus
FTVSYALSMKKAMSGYIVC

SEQ ID NO: 1873880 - protein, 23 aa, Staphylococcus
FTVTLKTYFSYYVDFSLGVKGLV

SEQ ID NO: 1873881 - protein, 21 aa, Staphylococcus
FTVYFNQHYVIVLASNIGDNS

SEQ ID NO: 1873882 - protein, 21 aa, Staphylococcus
FTWSFYGDVLIYFPITLLGVE

SEQ ID NO: 1873883 - protein, 21 aa, Staphylococcus
FTYKAPSGMRAMGALANAAIA

SEQ ID NO: 1873884 - protein, 17 aa, Staphylococcus
FTYKNVEREAGESKWTF

SEQ ID NO: 1873885 - protein, 23 aa, Staphylococcus
FTYTISMNWSLEITRAISGGIGI

SEQ ID NO: 1873886 - protein, 18 aa, Staphylococcus
FVAAFFVHELCKKFIGNY

SEQ ID NO: 1873887 - protein, 25 aa, Staphylococcus
FVADHIIKVLLLFHVPKYILGTVSA

SEQ ID NO: 1873888 - protein, 49 aa, Staphylococcus
FVAELIPVIIFETLIRCYWFYKQKFYYGKSFKESLSIANSRELSRLLLV

SEQ ID NO: 1873889 - protein, 24 aa, Staphylococcus
FVALCLIVPFVFYQLWAFIAPGLH

SEQ ID NO: 1873890 - protein, 19 aa, Staphylococcus
FVAMFIPLFFIFKYKQPMF

SEQ ID NO: 1873891 - protein, 19 aa, Staphylococcus
FVAMFIPLFFIYKYKQPMF

SEQ ID NO: 1873892 - protein, 18 aa, Staphylococcus
FVAPTIKFMEWRVAVQTA

SEQ ID NO: 1873893 - protein, 25 aa, Staphylococcus
FVAPTIRFMQWRVAVQTEMHDYVGR

SEQ ID NO: 1873894 - protein, 20 aa, Staphylococcus
FVARGVIAILGFVVFSISIF

SEQ ID NO: 1873895 - protein, 21 aa, Staphylococcus
FVCSATALIILLSGTYNVTDG

SEQ ID NO: 1873896 - protein, 17 aa, Staphylococcus
FVDAFFIAASAFTVTGL

SEQ ID NO: 1873897 - protein, 17 aa, Staphylococcus
FVDDNGFIDSSKINEIS

SEQ ID NO: 1873898 - protein, 26 aa, Staphylococcus
FVDKSLGFTMGWLYWAIWLLVTSVDI

SEQ ID NO: 1873899 - protein, 17 aa, Staphylococcus
FVDKYGKWIKLKGKDVA

SEQ ID NO: 1873900 - protein, 17 aa, Staphylococcus
FVDKYGKWVKLKSKDLK

SEQ ID NO: 1873901 - protein, 18 aa, Staphylococcus
FVDPSLGFALGWNYWFNW

SEQ ID NO: 1873902 - protein, 26 aa, Staphylococcus
FVDPSLGFTMGWLYWGMWSLVTSVDI

SEQ ID NO: 1873903 - protein, 26 aa, Staphylococcus
FVDPSLGFTMGWLYWGMWTLVTSVDV

SEQ ID NO: 1873904 - protein, 25 aa, Staphylococcus
FVEANRRLDIQLSDITVNNPTSGGA

SEQ ID NO: 1873905 - protein, 24 aa, Staphylococcus
FVEEDRRVIGMAKVKGLKDQIQPD

SEQ ID NO: 1873906 - protein, 22 aa, Staphylococcus
FVEELIFRHLIIHELGKKLTYG

SEQ ID NO: 1873907 - protein, 23 aa, Staphylococcus
FVEGIKIMSFIGVVILSANGFAG

SEQ ID NO: 1873908 - protein, 17 aa, Staphylococcus
FVEIIWVTGLDNAHSLL

SEQ ID NO: 1873909 - protein, 21 aa, Staphylococcus
FVEPMISRLELEAANEKLDAI

SEQ ID NO: 1873910 - protein, 18 aa, Staphylococcus
FVFAAALFIFVVFTLYRE

SEQ ID NO: 1873911 - protein, 19 aa, Staphylococcus
FVFDIKDLAPFIASLVCIL

SEQ ID NO: 1873912 - protein, 20 aa, Staphylococcus
FVFIVCLFISLLLLILKKRY

SEQ ID NO: 1873913 - protein, 22 aa, Staphylococcus
FVGESLALLPVFFVLQYNTLLN

SEQ ID NO: 1873914 - protein, 20 aa, Staphylococcus
FVGLEIFEFAHYVSEGVTPQ

SEQ ID NO: 1873915 - protein, 23 aa, Staphylococcus
FVGLILGIMVWLGMKSLPIFILL

SEQ ID NO: 1873916 - protein, 23 aa, Staphylococcus
FVGLILGVMVWLGMKSIPLFFIL

SEQ ID NO: 1873917 - protein, 23 aa, Staphylococcus
FVGLIVPHIVRFIIGTDYSKVLP

SEQ ID NO: 1873918 - protein, 24 aa, Staphylococcus
FVGLMVPHIVRFIIGTDYSKVLPL

SEQ ID NO: 1873919 - protein, 23 aa, Staphylococcus
FVGLMVPHIVRFLVGTDYAKVLP

SEQ ID NO: 1873920 - protein, 23 aa, Staphylococcus
FVGLMVPHIVRFLVGTDYSKILP

SEQ ID NO: 1873921 - protein, 17 aa, Staphylococcus
FVGMCLVLLLFYLMHQK

SEQ ID NO: 1873922 - protein, 19 aa, Staphylococcus
FVGMSRYLTYILILLATGF

SEQ ID NO: 1873923 - protein, 23 aa, Staphylococcus
FVGSFMPIFAMLFGFSMDKLYQS

SEQ ID NO: 1873924 - protein, 19 aa, Staphylococcus
FVGSSTWLHFVLPVTVLVI

SEQ ID NO: 1873925 - protein, 18 aa, Staphylococcus
FVGVVFGAILGAFIALMK

SEQ ID NO: 1873926 - protein, 24 aa, Staphylococcus
FVHFICSYFPFTILAILAGWFPLK

SEQ ID NO: 1873927 - protein, 27 aa, Staphylococcus
FVHWIWPELPIGAAFAIAAILCPTDAV

SEQ ID NO: 1873928 - protein, 23 aa, Staphylococcus
FVIARTFFIQNFMQMQLAAQFQQ

SEQ ID NO: 1873929 - protein, 24 aa, Staphylococcus
FVIELVGALLLAFYFYRDNPDLKH

SEQ ID NO: 1873930 - protein, 24 aa, Staphylococcus
FVIFGENFIVIWAGQDFRPAYIMT

SEQ ID NO: 1873931 - protein, 23 aa, Staphylococcus
FVIGGPISSIFSVLTTWLKGMQG

SEQ ID NO: 1873932 - protein, 25 aa, Staphylococcus
FVILLALLKKFAWGPLKEVMDKRER

SEQ ID NO: 1873933 - protein, 17 aa, Staphylococcus
FVIPMLLQGLTYVMLFS

SEQ ID NO: 1873934 - protein, 26 aa, Staphylococcus
FVIPTLKFFEWRVAIQTETHDYVGRA

SEQ ID NO: 1873935 - protein, 18 aa, Staphylococcus
FVIRELRMKAPMLNLEVL

SEQ ID NO: 1873936 - protein, 22 aa, Staphylococcus
FVISSRFVCKWTNPVINLRKPA

SEQ ID NO: 1873937 - protein, 17 aa, Staphylococcus
FVITLIMAYGFGRGEQR

SEQ ID NO: 1873938 - protein, 19 aa, Staphylococcus
FVKAPRYIKMINIAYVLFS

SEQ ID NO: 1873939 - protein, 18 aa, Staphylococcus
FVKLAKPLIALSILIVIV

SEQ ID NO: 1873940 - protein, 24 aa, Staphylococcus
FVKLAKPLIGFSILILIVGIVILS

SEQ ID NO: 1873941 - protein, 18 aa, Staphylococcus
FVKLAKPLIGLSILILIV

SEQ ID NO: 1873942 - protein, 25 aa, Staphylococcus
FVKRIRLSILSMIFILIAIVSALLF

SEQ ID NO: 1873943 - protein, 17 aa, Staphylococcus
FVKVCISNLAGVPSVVF

SEQ ID NO: 1873944 - protein, 24 aa, Staphylococcus
FVKVLPLLVIYGIGIVYFYRHYIY

SEQ ID NO: 1873945 - protein, 18 aa, Staphylococcus
FVKVQGLPYKDHSLPENA

SEQ ID NO: 1873946 - protein, 18 aa, Staphylococcus
FVLANWLFLFAGLLFIIK

SEQ ID NO: 1873947 - protein, 22 aa, Staphylococcus
FVLASLAIYWAMWPTTAEVILI

SEQ ID NO: 1873948 - protein, 31 aa, Staphylococcus; identical to SEQ ID NO: 1739670

SEQ ID NO: 1873949 - protein, 17 aa, Staphylococcus
FVLAVLLQYVFAVRLRW

SEQ ID NO: 1873950 - protein, 24 aa, Staphylococcus
FVLCTCILSIFLVMIVVPFTENYP

SEQ ID NO: 1873951 - protein, 19 aa, Staphylococcus
FVLDVKLALIALIFLPIIM

SEQ ID NO: 1873952 - protein, 17 aa, Staphylococcus
FVLFFFLKDGHHFKETA

SEQ ID NO: 1873953 - protein, 18 aa, Staphylococcus
FVLGQLVGLIPMVVLASV

SEQ ID NO: 1873954 - protein, 17 aa, Staphylococcus
FVLIYFRAIIPILPLTL

SEQ ID NO: 1873955 - protein, 23 aa, Staphylococcus
FVLLCAGNLLGIVGVILAIPGYA

SEQ ID NO: 1873956 - protein, 22 aa, Staphylococcus
FVLLPSSWFTGLVNKKTLAENR

SEQ ID NO: 1873957 - protein, 25 aa, Staphylococcus
FVLLTSILFWLFGIWNILSGFDNVI

SEQ ID NO: 1873958 - protein, 17 aa, Staphylococcus
FVLSALFILINVLVHKD

SEQ ID NO: 1873959 - protein, 24 aa, Staphylococcus
FVLTNIYYHFNLKASNDAKIMKTL

SEQ ID NO: 1873960 - protein, 28 aa, Staphylococcus
FVLTPIVNVWIFKFFVDVLGMNSFSVNL

SEQ ID NO: 1873961 - protein, 17 aa, Staphylococcus
FVMNGLFGLTGIVWSLL

SEQ ID NO: 1873962 - protein, 22 aa, Staphylococcus
FVMPIFRYKNFRYAIEEDEVHV

SEQ ID NO: 1873963 - protein, 20 aa, Staphylococcus
FVNIFHKLLSLFGVQTKYSL

SEQ ID NO: 1873964 - protein, 25 aa, Staphylococcus
FVNKSWVNYCSWILIIVLSVLNVYL

SEQ ID NO: 1873965 - protein, 37 aa, Staphylococcus
FVPFLLIFMIDGFRGIKEILPSILVVSVTYTFLQVII

SEQ ID NO: 1873966 - protein, 18 aa, Staphylococcus
FVPIGLWISAIAAGVHVG

SEQ ID NO: 1873967 - protein, 18 aa, Staphylococcus
FVPIGLWISAIAAGVKVN

SEQ ID NO: 1873968 - protein, 25 aa, Staphylococcus
FVPVVMAASVALFFLNLAFAETDRP

SEQ ID NO: 1873969 - protein, 19 aa, Staphylococcus
FVQEGIKLPQPMYVRNTDK

SEQ ID NO: 1873970 - protein, 17 aa, Staphylococcus
FVQPRTPQGFEMLFNNF

SEQ ID NO: 1873971 - protein, 21 aa, Staphylococcus
FVRSRVKSRRGAEIGIASLVS

SEQ ID NO: 1873972 - protein, 25 aa, Staphylococcus
FVSDGLVHVVNWVIDVGGIFSGFII

SEQ ID NO: 1873973 - protein, 17 aa, Staphylococcus
FVSFRMYEAGFKTMIEG

SEQ ID NO: 1873974 - protein, 23 aa, Staphylococcus
FVSIPSFFLGIILIYLFSQKMQL

SEQ ID NO: 1873975 - protein, 17 aa, Staphylococcus
FVSLAIILFVIGYYLQA

SEQ ID NO: 1873976 - protein, 22 aa, Staphylococcus
FVSLCIGVLLFIGYSIIGLDYS

SEQ ID NO: 1873977 - protein, 20 aa, Staphylococcus
FVSRAYKWTELDKQFVDGIK

SEQ ID NO: 1873978 - protein, 18 aa, Staphylococcus
FVTKRVTKPMSYYIHWIN

SEQ ID NO: 1873979 - protein, 17 aa, Staphylococcus
FVVAFIFGYLVSLVVPS

SEQ ID NO: 1873980 - protein, 25 aa, Staphylococcus
FVVAKDSLFPKWFAKENKNKAPVNS

SEQ ID NO: 1873981 - protein, 17 aa, Staphylococcus
FVVALILLVFAMTSQKI

SEQ ID NO: 1873982 - protein, 23 aa, Staphylococcus
FVVCYLYWYCKKIKQEPKASYAY

SEQ ID NO: 1873983 - protein, 17 aa, Staphylococcus
FVVGICMVPVFFIYVVN

SEQ ID NO: 1873984 - protein, 18 aa, Staphylococcus
FVVLVLLKIRSHYRDIAE

SEQ ID NO: 1873985 - protein, 23 aa, Staphylococcus
FVVNLFRAIPFIILILLLIPFTS

SEQ ID NO: 1873986 - protein, 25 aa, Staphylococcus
FVVPFLLMYIMDGFKGVKETFPATL

SEQ ID NO: 1873987 - protein, 17 aa, Staphylococcus
FVVRIINQLSLFGLVVI

SEQ ID NO: 1873988 - protein, 22 aa, Staphylococcus
FVVVGAISIYLSDLRDIVKKFN

SEQ ID NO: 1873989 - protein, 18 aa, Staphylococcus
FVVWKKQWLYQPYILIAI

SEQ ID NO: 1873990 - protein, 19 aa, Staphylococcus
FVWAIAYGSCIGWGSFILP

SEQ ID NO: 1873991 - protein, 20 aa, Staphylococcus
FVYDAIVAFGKWIINFGPFG

SEQ ID NO: 1873992 - protein, 18 aa, Staphylococcus
FVYLCMYLLIVVIAGYSK

SEQ ID NO: 1873993 - protein, 19 aa, Staphylococcus
FVYLCMYLLIVVIAGYSKS

SEQ ID NO: 1873994 - protein, 19 aa, Staphylococcus
FVYLCMYLLIVVIAGYSKT

SEQ ID NO: 1873995 - protein, 19 aa, Staphylococcus
FVYLCMYLLLVIIADYSKS

SEQ ID NO: 1873996 - protein, 19 aa, Staphylococcus
FVYLCMYLLLVIIADYSKT

SEQ ID NO: 1873997 - protein, 35 aa, Staphylococcus
FVYSGWRMLLIMLVAILGMMLWVIVAHGLWESTSE

SEQ ID NO: 1873998 - protein, 24 aa, Staphylococcus
FWDAFNFFSPLAWSLIFITLLLLL

SEQ ID NO: 1873999 - protein, 27 aa, Staphylococcus
FWDFLSQKWWFVLAIVVIVCGTLSQIF

SEQ ID NO: 1874000 - protein, 26 aa, Staphylococcus
FWDFLSQKWWFVLILVVIVCGTITQI

SEQ ID NO: 1874001 - protein, 24 aa, Staphylococcus
FWEREGWMLFLGWISYFLLGFYTG

SEQ ID NO: 1874002 - protein, 25 aa, Staphylococcus
FWERGLRYFPNSGILNYQLAIANRS

SEQ ID NO: 1874003 - protein, 21 aa, Staphylococcus
FWFPQIPNWVSALFCVLILMT

SEQ ID NO: 1874004 - protein, 17 aa, Staphylococcus
FWINIMITLLFLGFNII

SEQ ID NO: 1874005 - protein, 18 aa, Staphylococcus
FWLLILIIPTWINLLLKT

SEQ ID NO: 1874006 - protein, 18 aa, Staphylococcus
FWLLPIGLVCMAVGYLYT

SEQ ID NO: 1874007 - protein, 26 aa, Staphylococcus
FWQISVVQFFNWFALMYLWTYSTGAI

SEQ ID NO: 1874008 - protein, 21 aa, Staphylococcus
FWQVFVIFGVHWVSFSNQKMQ

SEQ ID NO: 1874009 - protein, 17 aa, Staphylococcus
FWVWGHPEVYIVILPAF

SEQ ID NO: 1874010 - protein, 20 aa, Staphylococcus
FWWPQIPNWVSALFCVLLLM

SEQ ID NO: 1874011 - protein, 20 aa, Staphylococcus
FWYFITFGAFVAFGLFLPNY

SEQ ID NO: 1874012 - protein, 20 aa, Staphylococcus
FWYFITFGSFVAFGIFLPKY

SEQ ID NO: 1874013 - protein, 17 aa, Staphylococcus
FYAAIVFFIVGWLTIRN

SEQ ID NO: 1874014 - protein, 38 aa, Staphylococcus
FYAGHSIDYHWWVGGLLGVCFLTGNLLLLPRLGAALTV

SEQ ID NO: 1874015 - protein, 25 aa, Staphylococcus
FYAGIWVKQLLKYGIGIFILGAVVF

SEQ ID NO: 1874016 - protein, 20 aa, Staphylococcus
FYCAIFGFIVARIYFVIFQW

SEQ ID NO: 1874017 - protein, 20 aa, Staphylococcus
FYCAIFGFLVARIYFVIFQW

SEQ ID NO: 1874018 - protein, 19 aa, Staphylococcus
FYCMAFIAVFLLRRREPEL

SEQ ID NO: 1874019 - protein, 19 aa, Staphylococcus
FYCYLLLFMGAMLGLVLSD

SEQ ID NO: 1874020 - protein, 17 aa, Staphylococcus
FYDFFKKNHKIRMLGFY

SEQ ID NO: 1874021 - protein, 19 aa, Staphylococcus
FYDHGAFDVKGIFRALFST

SEQ ID NO: 1874022 - protein, 18 aa, Staphylococcus
FYDIVWSKPLVYGLLITG

SEQ ID NO: 1874023 - protein, 20 aa, Staphylococcus
FYDYKEGYVELVRFDRTTYY

SEQ ID NO: 1874024 - protein, 18 aa, Staphylococcus
FYETRIHNPLIDFRIFKN

SEQ ID NO: 1874025 - protein, 21 aa, Staphylococcus
FYFRFLHVRSFRENKKSGQPA

SEQ ID NO: 1874026 - protein, 17 aa, Staphylococcus
FYGGFLIMIGHILLSLP

SEQ ID NO: 1874027 - protein, 18 aa, Staphylococcus
FYGHIGLLLIIIGICIVN

SEQ ID NO: 1874028 - protein, 18 aa, Staphylococcus
FYGHLALLVVVIFICMLA

SEQ ID NO: 1874029 - protein, 18 aa, Staphylococcus
FYGHLGLLAIIIIACMFK

SEQ ID NO: 1874030 - protein, 20 aa, Staphylococcus
FYGIGISQLLATKISKFSNR

SEQ ID NO: 1874031 - protein, 17 aa, Staphylococcus
FYGIPFLGGSVILSFGW

SEQ ID NO: 1874032 - protein, 29 aa, Staphylococcus
FYGLLGAFIFRFIALFLISIIANFWFIQA

SEQ ID NO: 1874033 - protein, 29 aa, Staphylococcus
FYGLLGAFIFRFLALFLISIIANFWFIQA

SEQ ID NO: 1874034 - protein, 25 aa, Staphylococcus
FYHNFKFHWPQFFSLCNALWCNVRM

SEQ ID NO: 1874035 - protein, 20 aa, Staphylococcus
FYHRTLRMGVKGMVSTDAHQ

SEQ ID NO: 1874036 - protein, 26 aa, Staphylococcus
FYILCIDFYLGPSWHKTAIQIYTGCF

SEQ ID NO: 1874037 - protein, 18 aa, Staphylococcus
FYILIGLQLLYTAFRILK

SEQ ID NO: 1874038 - protein, 18 aa, Staphylococcus
FYITCLMLALLLIFNGLQ

SEQ ID NO: 1874039 - protein, 17 aa, Staphylococcus
FYKNPDFKKINPSKYEY

SEQ ID NO: 1874040 - protein, 21 aa, Staphylococcus
FYLAYCFTIVYSTLQTDTIGP

SEQ ID NO: 1874041 - protein, 19 aa, Staphylococcus
FYLFFPFILVILLLTIKKY

SEQ ID NO: 1874042 - protein, 18 aa, Staphylococcus
FYLFFPFVLITLLLTIKK

SEQ ID NO: 1874043 - protein, 18 aa, Staphylococcus
FYLFFPFVLVILLLTIKK

SEQ ID NO: 1874044 - protein, 18 aa, Staphylococcus
FYLFFPVVLILLLNKVKK

SEQ ID NO: 1874045 - protein, 17 aa, Staphylococcus
FYLIFLILFLFAALTSS

SEQ ID NO: 1874046 - protein, 20 aa, Staphylococcus
FYLIMEYIDGPTLSEYIHSH

SEQ ID NO: 1874047 - protein, 17 aa, Staphylococcus
FYLISLVTLFVIASVVH

SEQ ID NO: 1874048 - protein, 24 aa, Staphylococcus
FYLLGSVFKRLNFMQRLMGGTTQI

SEQ ID NO: 1874049 - protein, 26 aa, Staphylococcus
FYLNVKLTLAALVIFPVYILTVYFFF

SEQ ID NO: 1874050 - protein, 17 aa, Staphylococcus
FYLSWYSTIYWLLNALV

SEQ ID NO: 1874051 - protein, 17 aa, Staphylococcus
FYLTMKIKRGLPDSNYT

SEQ ID NO: 1874052 - protein, 20 aa, Staphylococcus
FYLTMYIKRGQPDSNYSVAI

SEQ ID NO: 1874053 - protein, 19 aa, Staphylococcus
FYLVMEYIEGPTLSEYIQK

SEQ ID NO: 1874054 - protein, 17 aa, Staphylococcus
FYLWKVQKDALKFKNQS

SEQ ID NO: 1874055 - protein, 28 aa, Staphylococcus
FYNKNWINFCSWSLIIILSLLNVYLIIE

SEQ ID NO: 1874056 - protein, 30 aa, Staphylococcus
FYNTPTVHINSFWDFARGSNEYDRNSYFNR

SEQ ID NO: 1874057 - protein, 26 aa, Staphylococcus
FYQHIPILGVCLGFQMIYQYFGGTII

SEQ ID NO: 1874058 - protein, 23 aa, Staphylococcus
FYQKHRIAGYLLIPYICWSAFAS

SEQ ID NO: 1874059 - protein, 21 aa, Staphylococcus
FYQWGWNYERMQGSGYLFTIL

SEQ ID NO: 1874060 - protein, 23 aa, Staphylococcus
FYRMLKSKIKKMFGLEDTNTLSY

SEQ ID NO: 1874061 - protein, 17 aa, Staphylococcus
FYSIVSFIVNLFRAIPF

SEQ ID NO: 1874062 - protein, 24 aa, Staphylococcus
FYSMSFLAVMILRKREPDMERPYK

SEQ ID NO: 1874063 - protein, 19 aa, Staphylococcus
FYSQPKVGVATSFSFSQLL

SEQ ID NO: 1874064 - protein, 18 aa, Staphylococcus
FYSSMAIQIFGHIFTLWT

SEQ ID NO: 1874065 - protein, 18 aa, Staphylococcus
FYSVIPWFVITLPLVLCL

SEQ ID NO: 1874066 - protein, 25 aa, Staphylococcus
FYTALACWVGALLMVSLLTTDNKHK

SEQ ID NO: 1874067 - protein, 21 aa, Staphylococcus
FYTEDIFNALALYTPLALISI

SEQ ID NO: 1874068 - protein, 17 aa, Staphylococcus
FYTIVSFIVNLFRAIPF

SEQ ID NO: 1874069 - protein, 19 aa, Staphylococcus
FYTWNRFKNKWTHMIIGLP

SEQ ID NO: 1874070 - protein, 18 aa, Staphylococcus
FYTYEFMLHLILLTCAIG

SEQ ID NO: 1874071 - protein, 21 aa, Staphylococcus
FYVAAFFRFALVMIGVLSSSI

SEQ ID NO: 1874072 - protein, 25 aa, Staphylococcus
FYVSAFYRFALVMIGVISSSIVNLV

SEQ ID NO: 1874073 - protein, 19 aa, Staphylococcus
FYWQYELGTQMVLNLIVGS

SEQ ID NO: 1874074 - protein, 31 aa, Staphylococcus
GAACGGLDLLPGFFAGYIVGYLMKYTEKYVP

SEQ ID NO: 1874075 - protein, 21 aa, Staphylococcus
GAAFLTFSFVQRFIQIKFFSE

SEQ ID NO: 1874076 - protein, 22 aa, Staphylococcus
GAAGGGVEWGTVIVTVITFAIL

SEQ ID NO: 1874077 - protein, 18 aa, Staphylococcus
GAAGRDGQSITIASIEPQ

SEQ ID NO: 1874078 - protein, 25 aa, Staphylococcus
GAAIREILKPYGLPMLTFPFVFMTW

SEQ ID NO: 1874079 - protein, 20 aa, Staphylococcus
GAAISYFLLIMLKKRGLLDR

SEQ ID NO: 1874080 - protein, 17 aa, Staphylococcus
GAALSMPIKAAGASSWK

SEQ ID NO: 1874081 - protein, 23 aa, Staphylococcus
GAAQFKDGVWLLVGVGDLINTML

SEQ ID NO: 1874082 - protein, 22 aa, Staphylococcus
GAAQFKNGVWIIAGIGDLINTM

SEQ ID NO: 1874083 - protein, 22 aa, Staphylococcus
GACIYRAAYKGAFDTMSVVAII

SEQ ID NO: 1874084 - protein, 32 aa, Staphylococcus
GAEIWKAIVEMAKNIWSILGDYLKQSWQNIVD

SEQ ID NO: 1874085 - protein, 19 aa, Staphylococcus
GAFEIKGGFGTIVHDAIAN

SEQ ID NO: 1874086 - protein, 17 aa, Staphylococcus
GAFILNLIFAFTIIFME

SEQ ID NO: 1874087 - protein, 25 aa, Staphylococcus
GAFILNLIFAFTIIFMERRTANSIW

SEQ ID NO: 1874088 - protein, 17 aa, Staphylococcus
GAFLTNYTYGLSLVIAN

SEQ ID NO: 1874089 - protein, 25 aa, Staphylococcus
GAFWQEMVMVFDIIKNGIFAYLAIY

SEQ ID NO: 1874090 - protein, 18 aa, Staphylococcus
GAGFGYSLLWAVVFSIVA

SEQ ID NO: 1874091 - protein, 26 aa, Staphylococcus
GAGITRGKILAAMLFGMFIAILNQTL

SEQ ID NO: 1874092 - protein, 23 aa, Staphylococcus
GAGLCVFAGPGLVALFYDSVGVK

SEQ ID NO: 1874093 - protein, 20 aa, Staphylococcus
GAHLHFQRMEGGVGNDYAID

SEQ ID NO: 1874094 - protein, 27 aa, Staphylococcus
GAIAAIVISCYFIRKVTAFFTKKLLEY

SEQ ID NO: 1874095 - protein, 18 aa, Staphylococcus
GAIEFLGGVLAALSGPVG

SEQ ID NO: 1874096 - protein, 24 aa, Staphylococcus
GAIEIPGLLSFLADDSFKTKVKGL

SEQ ID NO: 1874097 - protein, 25 aa, Staphylococcus
GAIFDEMIPFLGIGIIISALIYCIV

SEQ ID NO: 1874098 - protein, 19 aa, Staphylococcus
GAIFLMFLGFGLFGLSRIL

SEQ ID NO: 1874099 - protein, 17 aa, Staphylococcus
GAIFWAAAEPMYYFIDV

SEQ ID NO: 1874100 - protein, 20 aa, Staphylococcus
GAIGTFFFGFILRLLGPFGL

SEQ ID NO: 1874101 - protein, 17 aa, Staphylococcus
GAIKIPGLLSFLADNNI

SEQ ID NO: 1874102 - protein, 19 aa, Staphylococcus
GAILTCLFIVIATIITWLI

SEQ ID NO: 1874103 - protein, 17 aa, Staphylococcus
GAIQWPGVVLMITAFMI

SEQ ID NO: 1874104 - protein, 22 aa, Staphylococcus
GAKKPYLIFGMCDETFVINNMA

SEQ ID NO: 1874105 - protein, 27 aa, Staphylococcus
GAKLFGEIEFWFAIIKIITIVAIILIG

SEQ ID NO: 1874106 - protein, 27 aa, Staphylococcus
GAKLFGELEFWFALIKIITILALIVVG

SEQ ID NO: 1874107 - protein, 23 aa, Staphylococcus
GALAAILPMWGVYKTVVGGASLV

SEQ ID NO: 1874108 - protein, 19 aa, Staphylococcus
GALAAWCYNKFYNISLPSY

SEQ ID NO: 1874109 - protein, 20 aa, Staphylococcus
GALAAWCYNKFYNITLPAFL

SEQ ID NO: 1874110 - protein, 18 aa, Staphylococcus
GALAVFGSSFMNFVLFKR

SEQ ID NO: 1874111 - protein, 24 aa, Staphylococcus
GALGASFKWYDFVYFIDTIIYLFI

SEQ ID NO: 1874112 - protein, 17 aa, Staphylococcus
GALKDYHKAKVYGSKSF

SEQ ID NO: 1874113 - protein, 19 aa, Staphylococcus
GALKVLLQYVNKLASVEGV

SEQ ID NO: 1874114 - protein, 19 aa, Staphylococcus
GALMMAVGFLFLVVSIIYS

SEQ ID NO: 1874115 - protein, 20 aa, Staphylococcus
GALTSFAINGLRLFTSFRKV

SEQ ID NO: 1874116 - protein, 18 aa, Staphylococcus
GALVSFAINGARLFTSFR

SEQ ID NO: 1874117 - protein, 17 aa, Staphylococcus
GALYGFFYAPLVITGLH

SEQ ID NO: 1874118 - protein, 23 aa, Staphylococcus
GAMIKGPILKAVFYSLPILFLIA

SEQ ID NO: 1874119 - protein, 17 aa, Staphylococcus
GAMIMGPLVGWLMKKTD

SEQ ID NO: 1874120 - protein, 17 aa, Staphylococcus
GAMKDYGKAKIYGEKTF

SEQ ID NO: 1874121 - protein, 19 aa, Staphylococcus
GAMKDYHKAKVYGSKTFGK

SEQ ID NO: 1874122 - protein, 17 aa, Staphylococcus
GAMKDYNKAKVYGSKTF

SEQ ID NO: 1874123 - protein, 20 aa, Staphylococcus
GANMPLSMILLGLMLNFSID

SEQ ID NO: 1874124 - protein, 19 aa, Staphylococcus
GAPVFPLLFFTITCGALSG

SEQ ID NO: 1874125 - protein, 22 aa, Staphylococcus
GAQPLVVFSCIIVGSLGYDKFG

SEQ ID NO: 1874126 - protein, 30 aa, Staphylococcus
GARILRKEIQKLFVQEGIKLPQPVFSQYES

SEQ ID NO: 1874127 - protein, 24 aa, Staphylococcus
GARVQRLKMILLILSVMLAGASIS

SEQ ID NO: 1874128 - protein, 24 aa, Staphylococcus
GASAEVIGIIVAFVILLITFGSLI

SEQ ID NO: 1874129 - protein, 18 aa, Staphylococcus
GASFGLAITYAFYPEAPF

SEQ ID NO: 1874130 - protein, 18 aa, Staphylococcus
GASFMLAVTYAFYPSANF

SEQ ID NO: 1874131 - protein, 28 aa, Staphylococcus
GASKYRKDFCKYFLKKIKPTVIKGNASE

SEQ ID NO: 1874132 - protein, 21 aa, Staphylococcus
GASPLQIIRYFLIPEALGSLV

SEQ ID NO: 1874133 - protein, 22 aa, Staphylococcus
GASPLQIIRYFLLPEALGSLIL

SEQ ID NO: 1874134 - protein, 28 aa, Staphylococcus
GASSTARYYGDENFAFLNGEKPEQGQGL

SEQ ID NO: 1874135 - protein, 18 aa, Staphylococcus
GATFGLAMTYAFYPEAPF

SEQ ID NO: 1874136 - protein, 25 aa, Staphylococcus
GATIVLCAFAIYIGTFIYSKISQQI

SEQ ID NO: 1874137 - protein, 25 aa, Staphylococcus
GATKIGEVWAMLCLSLTLVAYLMLK

SEQ ID NO: 1874138 - protein, 25 aa, Staphylococcus
GATKLGEVWAMVCLSLMLIAYLMLK

SEQ ID NO: 1874139 - protein, 17 aa, Staphylococcus
GATLVFFIVALVSLIES

SEQ ID NO: 1874140 - protein, 21 aa, Staphylococcus
GATMYGAVLIIVGHVVLSLPL

SEQ ID NO: 1874141 - protein, 31 aa, Staphylococcus
GAVGRGYKKVLKWSLNHKWIVLILTTLILIG

SEQ ID NO: 1874142 - protein, 24 aa, Staphylococcus
GAVIYRLFYKGAFDTMSVVAIVLL

SEQ ID NO: 1874143 - protein, 18 aa, Staphylococcus
GAVLALVIILGYVLLGVL

SEQ ID NO: 1874144 - protein, 19 aa, Staphylococcus
GAVPPLIGWTAIDGQISLV

SEQ ID NO: 1874145 - protein, 25 aa, Staphylococcus
GAVSASFKWYDFVYFIDTIVYLFIL

SEQ ID NO: 1874146 - protein, 25 aa, Staphylococcus
GAVSASFKWYDFVYFLDTIVYLFIL

SEQ ID NO: 1874147 - protein, 17 aa, Staphylococcus
GAVSFSAIYPLRKMLTK

SEQ ID NO: 1874148 - protein, 25 aa, Staphylococcus
GAVSWDFQTLIGFVFAPLAFLSGVP

SEQ ID NO: 1874149 - protein, 24 aa, Staphylococcus
GAVTASFKWYDFVYFIDTIIYLFV

SEQ ID NO: 1874150 - protein, 24 aa, Staphylococcus
GAVVDRDGKLIGIVSLKIDMDNVE

SEQ ID NO: 1874151 - protein, 24 aa, Staphylococcus
GAWNDMKAVIVAAVNYIKNRVQAQ

SEQ ID NO: 1874152 - protein, 25 aa, Staphylococcus
GAYFFFRSTVSLIFKAIKKVRQDTV

SEQ ID NO: 1874153 - protein, 20 aa, Staphylococcus
GAYFWPAILAFCLTGIGLPL

SEQ ID NO: 1874154 - protein, 17 aa, Staphylococcus
GAYILWGILPIYWELIS

SEQ ID NO: 1874155 - protein, 22 aa, Staphylococcus
GAYLFFRSSVSIIFKSLKKLKH

SEQ ID NO: 1874156 - protein, 21 aa, Staphylococcus
GAYLFFRSSVSLIFKTIKRSK

SEQ ID NO: 1874157 - protein, 20 aa, Staphylococcus
GAYLFFRSSVSVIFKTIKNA

SEQ ID NO: 1874158 - protein, 25 aa, Staphylococcus
GAYLFFRSTVSLIFKSIKHFKHGHV

SEQ ID NO: 1874159 - protein, 17 aa, Staphylococcus
GAYLTFDYVQRFIQIKF

SEQ ID NO: 1874160 - protein, 25 aa, Staphylococcus
GAYVGRFIFMMAMLSYWFILPQMMQ

SEQ ID NO: 1874161 - protein, 21 aa, Staphylococcus
GCAGIYPAMLAIMVAPVAHVD

SEQ ID NO: 1874162 - protein, 21 aa, Staphylococcus
GCAGIYPAMLAIMVAPVANVD

SEQ ID NO: 1874163 - protein, 20 aa, Staphylococcus
GCAIFLYSKVQFYSILTVLS

SEQ ID NO: 1874164 - protein, 28 aa, Staphylococcus
GCGKSTLSKLACRFWDLKTGDITIDGHN

SEQ ID NO: 1874165 - protein, 26 aa, Staphylococcus
GCHKLIWRKKMRRFSIIFKQFIQYYI

SEQ ID NO: 1874166 - protein, 20 aa, Staphylococcus
GCILAFVWNPFGLKKTKYKM

SEQ ID NO: 1874167 - protein, 22 aa, Staphylococcus
GCLPMLIQIPILFGLYATLKWP

SEQ ID NO: 1874168 - protein, 25 aa, Staphylococcus
GCNHPGCPLEAAIVVPLRVKNDVVG

SEQ ID NO: 1874169 - protein, 20 aa, Staphylococcus
GCSNLEVFNAKGPVASSQKF

SEQ ID NO: 1874170 - protein, 29 aa, Staphylococcus
GCYFGQYLPMEWRRPLSIALLVLILATLF

SEQ ID NO: 1874171 - protein, 26 aa, Staphylococcus
GCYFGQYLPMSWRKPLSIALFVILLA

SEQ ID NO: 1874172 - protein, 19 aa, Staphylococcus
GDADPFYSQNIDFYKKLKE

SEQ ID NO: 1874173 - protein, 20 aa, Staphylococcus
GDADPFYSQNIEFYKKLKSK

SEQ ID NO: 1874174 - protein, 22 aa, Staphylococcus
GDADPFYSQNIEFYRKLKEEGI

SEQ ID NO: 1874175 - protein, 23 aa, Staphylococcus
GDDDGFLSGLFDDEGNLSLPNTG

SEQ ID NO: 1874176 - protein, 25 aa, Staphylococcus
GDDLPTNGFLFYWNPKTTGSNTSQW

SEQ ID NO: 1874177 - protein, 26 aa, Staphylococcus
GDEVLDARLGYYSVVRETNVQLLQAN

SEQ ID NO: 1874178 - protein, 26 aa, Staphylococcus
GDEVMDARLGYYSVVRETNVQLLQAN

SEQ ID NO: 1874179 - protein, 19 aa, Staphylococcus
GDFGEGFKIGIDDKKKSVA

SEQ ID NO: 1874180 - protein, 17 aa, Staphylococcus
GDFGYVLGFLLPFIESF

SEQ ID NO: 1874181 - protein, 19 aa, Staphylococcus
GDFWGFLSGWAQAFIYFPA

SEQ ID NO: 1874182 - protein, 18 aa, Staphylococcus
GDGQPVLQLISDNPQIKS

SEQ ID NO: 1874183 - protein, 22 aa, Staphylococcus
GDGTHMLFEWGIIHISTESIVR

SEQ ID NO: 1874184 - protein, 22 aa, Staphylococcus
GDGTHMLFKWGIIQISTESIVR

SEQ ID NO: 1874185 - protein, 17 aa, Staphylococcus
GDHVLVNIIGYKVGTVK

SEQ ID NO: 1874186 - protein, 26 aa, Staphylococcus
GDIFLKNIWFYVIFLLFYGLVLFLLT

SEQ ID NO: 1874187 - protein, 17 aa, Staphylococcus
GDIPGASILIIKDNKVF

SEQ ID NO: 1874188 - protein, 25 aa, Staphylococcus
GDIVGWRYTFLFIIVVSVLAGILML

SEQ ID NO: 1874189 - protein, 18 aa, Staphylococcus
GDKGENGASITIDRTEET

SEQ ID NO: 1874190 - protein, 19 aa, Staphylococcus
GDKIKFYAIDQHTYQQIQD

SEQ ID NO: 1874191 - protein, 17 aa, Staphylococcus
GDKLKKGDTVAEVTAQG

SEQ ID NO: 1874192 - protein, 25 aa, Staphylococcus
GDLDIPVRSGFSMDAKIPLKSLKLP

SEQ ID NO: 1874193 - protein, 21 aa, Staphylococcus
GDLKFIDWGVFLVLGIFIGSY

SEQ ID NO: 1874194 - protein, 18 aa, Staphylococcus
GDLLPIIFFAVFFGLGLA

SEQ ID NO: 1874195 - protein, 19 aa, Staphylococcus
GDLSFNFINILPYIFVLIA

SEQ ID NO: 1874196 - protein, 18 aa, Staphylococcus
GDMRVQVIIVAFLFGSLI

SEQ ID NO: 1874197 - protein, 19 aa, Staphylococcus
GDMSPEHWLGTDAGGRDIL

SEQ ID NO: 1874198 - protein, 22 aa, Staphylococcus
GDMSVVGPRPALYNQYELIEKR

SEQ ID NO: 1874199 - protein, 30 aa, Staphylococcus
GDNAPALYPNYWGGTKFPVKKRLEKLGYDV

SEQ ID NO: 1874200 - protein, 20 aa, Staphylococcus
GDNKLILGIVLGVVTFWLFA

SEQ ID NO: 1874201 - protein, 17 aa, Staphylococcus
GDNKLLIGIIIGVLTFW

SEQ ID NO: 1874202 - protein, 20 aa, Staphylococcus
GDNKLLLGIILGVITFWLFA

SEQ ID NO: 1874203 - protein, 17 aa, Staphylococcus
GDNRLLLGIILGVITFW

SEQ ID NO: 1874204 - protein, 20 aa, Staphylococcus
GDNRLLLGIILGVITFWLFA

SEQ ID NO: 1874205 - protein, 17 aa, Staphylococcus
GDNRLLVGIIISVLTFW

SEQ ID NO: 1874206 - protein, 18 aa, Staphylococcus
GDNTEFWMITLGLLLLMA

SEQ ID NO: 1874207 - protein, 20 aa, Staphylococcus
GDQGISFLIPCFNEEETIED

SEQ ID NO: 1874208 - protein, 17 aa, Staphylococcus
GDQIGTPGFVRGMHDMH

SEQ ID NO: 1874209 - protein, 28 aa, Staphylococcus
GDQRLAKAKFKAETFINQLKDLNNAQRV

SEQ ID NO: 1874210 - protein, 35 aa, Staphylococcus
GDQVKWLFDTIRFVLPVIVVLIAFMVLYTLAPNVK

SEQ ID NO: 1874211 - protein, 19 aa, Staphylococcus
GDRGESGTSIAIDKIETLP

SEQ ID NO: 1874212 - protein, 18 aa, Staphylococcus
GDRKLVFSDNTTVIIPKG

SEQ ID NO: 1874213 - protein, 23 aa, Staphylococcus
GDSFKKLKTTGKWIEVQNAKGDK

SEQ ID NO: 1874214 - protein, 24 aa, Staphylococcus
GDSNLKIIFPKGINVDWEDYLYLF

SEQ ID NO: 1874215 - protein, 17 aa, Staphylococcus
GDSRASAMANYQIFLSC

SEQ ID NO: 1874216 - protein, 23 aa, Staphylococcus
GDSSNLILGQSILVVGNPLGVDF

SEQ ID NO: 1874217 - protein, 21 aa, Staphylococcus
GDSSTLVLGEPIIVVGNPLGV

SEQ ID NO: 1874218 - protein, 17 aa, Staphylococcus
GDSTFNIILLALGYFIV

SEQ ID NO: 1874219 - protein, 18 aa, Staphylococcus
GDTMKLTIIRDGKEKEVT

SEQ ID NO: 1874220 - protein, 21 aa, Staphylococcus
GDVFPLLSPILGWIGVFMTGS

SEQ ID NO: 1874221 - protein, 18 aa, Staphylococcus
GDVLSIFGGAVITETIFS

SEQ ID NO: 1874222 - protein, 24 aa, Staphylococcus
GDVLVAGGIEFMGAVPMGGNEPTN

SEQ ID NO: 1874223 - protein, 22 aa, Staphylococcus
GDVVARFGIKLLFGATLVSFIS

SEQ ID NO: 1874224 - protein, 25 aa, Staphylococcus
GDYKHPTWMLWFGIVAVVVTIVIGI

SEQ ID NO: 1874225 - protein, 20 aa, Staphylococcus
GEALKYAGTPAKALGVSIED

SEQ ID NO: 1874226 - protein, 20 aa, Staphylococcus
GEASKIEMIYINPEGEPASI

SEQ ID NO: 1874227 - protein, 34 aa, Staphylococcus
GEDYTQNVIFNYGNRTVPVISDINYLTKDFAEFT

SEQ ID NO: 1874228 - protein, 18 aa, Staphylococcus
GEFFGWVAGWALLAEYFI

SEQ ID NO: 1874229 - protein, 17 aa, Staphylococcus
GEFIYSLVSAKRIKDIF

SEQ ID NO: 1874230 - protein, 21 aa, Staphylococcus
GEFLKLKGQEFVLASRTLGAS

SEQ ID NO: 1874231 - protein, 17 aa, Staphylococcus
GEFPIVSLMLAFSFGIY

SEQ ID NO: 1874232 - protein, 27 aa, Staphylococcus
GEFSGQLKFDFRYGKSNTVEVNENFNE

SEQ ID NO: 1874233 - protein, 21 aa, Staphylococcus
GEFSVIMGLVLAFYMNISPGG

SEQ ID NO: 1874234 - protein, 18 aa, Staphylococcus
GEGFSRQTFDVHSVSQSD

SEQ ID NO: 1874235 - protein, 20 aa, Staphylococcus
GEGFSRQTFKVHSVSEKDFD

SEQ ID NO: 1874236 - protein, 21 aa, Staphylococcus
GEGGGSIWLSAILIVFTAIFY

SEQ ID NO: 1874237 - protein, 26 aa, Staphylococcus
GEGITRNKILAAMLFGMFIAILNQTL

SEQ ID NO: 1874238 - protein, 19 aa, Staphylococcus
GEHIFHWQPQNIRFWPTNQ

SEQ ID NO: 1874239 - protein, 21 aa, Staphylococcus
GEIILGILGIVFILAGYYLST

SEQ ID NO: 1874240 - protein, 20 aa, Staphylococcus
GEILRGVTILRNPQVAIACV

SEQ ID NO: 1874241 - protein, 31 aa, Staphylococcus
GEKFKWLQQWTIFYWAWWISWAPFVGIFIAR

SEQ ID NO: 1874242 - protein, 31 aa, Staphylococcus
GEKFQWLQQWTIFYWAWWISWAPFVGIFIAR

SEQ ID NO: 1874243 - protein, 27 aa, Staphylococcus
GEKGIYDYKRALLRSSVPLEGATTSLD

SEQ ID NO: 1874244 - protein, 22 aa, Staphylococcus
GEKGVLLVAPFFSLVILFSLGI

SEQ ID NO: 1874245 - protein, 20 aa, Staphylococcus
GEKIGETFIPDGQKGDKGDK

SEQ ID NO: 1874246 - protein, 23 aa, Staphylococcus
GEKNPRFAIMVGIDAILLILVIV

SEQ ID NO: 1874247 - protein, 17 aa, Staphylococcus
GEKYTQWAIIIASFIVG

SEQ ID NO: 1874248 - protein, 17 aa, Staphylococcus
GELLAGMSRGVEAALTS

SEQ ID NO: 1874249 - protein, 20 aa, Staphylococcus
GELLPVIFFSVFFGLALAAI

SEQ ID NO: 1874250 - protein, 20 aa, Staphylococcus
GELPFKPNLFASGSGHRKVI

SEQ ID NO: 1874251 - protein, 25 aa, Staphylococcus
GELQRLCLARLFLKEAPIWLLDEPT

SEQ ID NO: 1874252 - protein, 18 aa, Staphylococcus
GELSRALNDMSFEIQENV

SEQ ID NO: 1874253 - protein, 20 aa, Staphylococcus
GELSVVLGLVLAFYMNISPG

SEQ ID NO: 1874254 - protein, 19 aa, Staphylococcus
GELSYTFNNMSYKIQEHIE

SEQ ID NO: 1874255 - protein, 19 aa, Staphylococcus
GELVAWLPVILLYNHLLGM

SEQ ID NO: 1874256 - protein, 22 aa, Staphylococcus
GEMRLYATLRRMFKVNNKILLN

SEQ ID NO: 1874257 - protein, 19 aa, Staphylococcus
GEMSKEFHVSKALIGQLVT

SEQ ID NO: 1874258 - protein, 20 aa, Staphylococcus
GEQYLSIILPGKTFKDSFDS

SEQ ID NO: 1874259 - protein, 20 aa, Staphylococcus
GESEYWFALIKVVTVIIFIV

SEQ ID NO: 1874260 - protein, 21 aa, Staphylococcus
GESFISNPLLIYMEPYASSTA

SEQ ID NO: 1874261 - protein, 20 aa, Staphylococcus
GESFLHQIINQFTQNIGDFL

SEQ ID NO: 1874262 - protein, 20 aa, Staphylococcus
GESHIPLYFETSAVLITLIL

SEQ ID NO: 1874263 - protein, 21 aa, Staphylococcus
GESKWTFSSLLNYGIDGLISF

SEQ ID NO: 1874264 - protein, 23 aa, Staphylococcus
GESPDFYAILGYVIIIASSYYMF

SEQ ID NO: 1874265 - protein, 20 aa, Staphylococcus
GESSVKGFATMLLLGILMIF

SEQ ID NO: 1874266 - protein, 20 aa, Staphylococcus
GETAVSIAIKHIQDAIPNVT

SEQ ID NO: 1874267 - protein, 19 aa, Staphylococcus
GETAVSIAIKHIQDPMPNA

SEQ ID NO: 1874268 - protein, 20 aa, Staphylococcus
GETAVSIAIKHIQDSIPNIT

SEQ ID NO: 1874269 - protein, 19 aa, Staphylococcus
GETCYEVLNLIGYPNSITT

SEQ ID NO: 1874270 - protein, 25 aa, Staphylococcus
GETETPLRYSIPFNEDNRYLVMPAL

SEQ ID NO: 1874271 - protein, 21 aa, Staphylococcus
GETFNILGLPLFIIGIVLFTI

SEQ ID NO: 1874272 - protein, 30 aa, Staphylococcus
GETISVPSMIGMLMLIGIVVTNAIVLIDRV

SEQ ID NO: 1874273 - protein, 18 aa, Staphylococcus
GETITLTVIRDGKTKDIE

SEQ ID NO: 1874274 - protein, 18 aa, Staphylococcus
GETLELIEAAKIARNQGA

SEQ ID NO: 1874275 - protein, 23 aa, Staphylococcus
GETPDFYAFIGYIIIIGASYFMF

SEQ ID NO: 1874276 - protein, 23 aa, Staphylococcus
GETPDFYALIGYVIIIGASYYMF

SEQ ID NO: 1874277 - protein, 17 aa, Staphylococcus
GETVKLTVIRDGKTKDV

SEQ ID NO: 1874278 - protein, 19 aa, Staphylococcus
GEVKSVIYITLFLAIVLLF

SEQ ID NO: 1874279 - protein, 31 aa, Staphylococcus
GEVTENDIITVLPFGNLISQIQVKGSDVEKA

SEQ ID NO: 1874280 - protein, 21 aa, Staphylococcus
GEVTFKYQHMRMGILSQNPYI

SEQ ID NO: 1874281 - protein, 17 aa, Staphylococcus
GEVWAMVCLSLLLVAYL

SEQ ID NO: 1874282 - protein, 28 aa, Staphylococcus
GEWYRLISSMFLHFNFEHILMNMLSLFI

SEQ ID NO: 1874283 - protein, 18 aa, Staphylococcus
GEYKIPMDRFFKTLFGFG

SEQ ID NO: 1874284 - protein, 22 aa, Staphylococcus
GEYKIPVDHFFKTLIGQGEYYD

SEQ ID NO: 1874285 - protein, 21 aa, Staphylococcus
GEYNIPVSRFFQILTGQGDYT

SEQ ID NO: 1874286 - protein, 20 aa, Staphylococcus
GFAACAALIAGIVDCALVGT

SEQ ID NO: 1874287 - protein, 27 aa, Staphylococcus
GFADMGAWRWMLGLAVVPSIILLIGIA

SEQ ID NO: 1874288 - protein, 20 aa, Staphylococcus
GFCIFVLFSPIGKLKLGKPK

SEQ ID NO: 1874289 - protein, 33 aa, Staphylococcus
GFEIQIILSFALRFVIAIVIGFGASYLFMMLIK

SEQ ID NO: 1874290 - protein, 21 aa, Staphylococcus
GFFKNKLIYLGIPYIIINIGI

SEQ ID NO: 1874291 - protein, 18 aa, Staphylococcus
GFFPNGIQGFLMAFQMAI

SEQ ID NO: 1874292 - protein, 22 aa, Staphylococcus
GFFSVRLLLSLIFINLTSPVGM

SEQ ID NO: 1874293 - protein, 26 aa, Staphylococcus
GFFTGWTYWFCWVATGIADITAVTKY

SEQ ID NO: 1874294 - protein, 19 aa, Staphylococcus
GFFTNVFGVWGFDPIMADD

SEQ ID NO: 1874295 - protein, 17 aa, Staphylococcus
GFGFDLSSTLVFFIVAI

SEQ ID NO: 1874296 - protein, 20 aa, Staphylococcus
GFGFQLLFIFIFKMLIVALI

SEQ ID NO: 1874297 - protein, 20 aa, Staphylococcus
GFGLHVILIFGCQIIGTIAI

SEQ ID NO: 1874298 - protein, 23 aa, Staphylococcus
GFGTLMFERGFFWTREPNTIIHD

SEQ ID NO: 1874299 - protein, 18 aa, Staphylococcus
GFIAAIPIILFSSIFILI

SEQ ID NO: 1874300 - protein, 18 aa, Staphylococcus
GFIAAIPIILFSSIFILV

SEQ ID NO: 1874301 - protein, 20 aa, Staphylococcus
GFIAGYVAKWIKQVKVPKAM

SEQ ID NO: 1874302 - protein, 19 aa, Staphylococcus
GFIFSKHLLLLIGTPTTLL

SEQ ID NO: 1874303 - protein, 19 aa, Staphylococcus
GFIGGLLITLIGYYFNVNR

SEQ ID NO: 1874304 - protein, 21 aa, Staphylococcus
GFIGGLLITLMGYYFKTNKTR

SEQ ID NO: 1874305 - protein, 18 aa, Staphylococcus
GFIIFGICMKPVMDPIMR

SEQ ID NO: 1874306 - protein, 24 aa, Staphylococcus
GFIIFPLSVAWIILNFNLAKIENL

SEQ ID NO: 1874307 - protein, 18 aa, Staphylococcus
GFIISFLGYMFIGTPNGN

SEQ ID NO: 1874308 - protein, 17 aa, Staphylococcus
GFILKFDTIAIILIAAV

SEQ ID NO: 1874309 - protein, 17 aa, Staphylococcus
GFIPLLVVGRAIQGLSA

SEQ ID NO: 1874310 - protein, 25 aa, Staphylococcus
GFITGWTYWLCWIITGMAEVTAVAK

SEQ ID NO: 1874311 - protein, 17 aa, Staphylococcus
GFITVFFPIWLPVYADG

SEQ ID NO: 1874312 - protein, 18 aa, Staphylococcus
GFLADKWSSKTWLLTATI

SEQ ID NO: 1874313 - protein, 20 aa, Staphylococcus
GFLAEFSHRLPFYFAGSLGI

SEQ ID NO: 1874314 - protein, 23 aa, Staphylococcus
GFLCFNFHPAKIFLGDSGALLIG

SEQ ID NO: 1874315 - protein, 25 aa, Staphylococcus
GFLLKRFGAKPVLTLGFLMAFGSLF

SEQ ID NO: 1874316 - protein, 25 aa, Staphylococcus
GFLLKRLGTKLVLTLGFLLAFASLF

SEQ ID NO: 1874317 - protein, 24 aa, Staphylococcus
GFLMKMVLAQTFILALIGTLIGLI

SEQ ID NO: 1874318 - protein, 19 aa, Staphylococcus
GFLSLMFALFFAMSVSGLS

SEQ ID NO: 1874319 - protein, 28 aa, Staphylococcus
GFLTIASWRLLFVILGILGLVWVIIWAK

SEQ ID NO: 1874320 - protein, 20 aa, Staphylococcus
GFLYICKEIFYPDSTNLNNK

SEQ ID NO: 1874321 - protein, 24 aa, Staphylococcus
GFMPHGIVGFFFALSIVIGSYQGV

SEQ ID NO: 1874322 - protein, 24 aa, Staphylococcus
GFMPNGIVGFFFALSIVIGSYQGV

SEQ ID NO: 1874323 - protein, 21 aa, Staphylococcus
GFNPKKAVTVISEYNRQISSD

SEQ ID NO: 1874324 - protein, 24 aa, Staphylococcus
GFNRTRISMFIWLVLLLPIPFMLS

SEQ ID NO: 1874325 - protein, 30 aa, Staphylococcus
GFPAFISIQHQFWWPVYLPITIAALVIPAI

SEQ ID NO: 1874326 - protein, 18 aa, Staphylococcus
GFPGKVFIFKGAIENGNY

SEQ ID NO: 1874327 - protein, 18 aa, Staphylococcus
GFQFGLRKRDEMLLFLPE

SEQ ID NO: 1874328 - protein, 23 aa, Staphylococcus
GFREFLRGFFWFKEQDDVLDDSS

SEQ ID NO: 1874329 - protein, 21 aa, Staphylococcus
GFRLSLVFWVILGLAAITLWL

SEQ ID NO: 1874330 - protein, 18 aa, Staphylococcus
GFSILRFLISAALVVLCL

SEQ ID NO: 1874331 - protein, 18 aa, Staphylococcus
GFSRSGSTISTGVLMKMN

SEQ ID NO: 1874332 - protein, 18 aa, Staphylococcus
GFTHKWLYMYAYSFYLFF

SEQ ID NO: 1874333 - protein, 18 aa, Staphylococcus
GFTHMWLYMYAYSFYLFF

SEQ ID NO: 1874334 - protein, 19 aa, Staphylococcus
GFTKDGFAQSNDRIDNVSS

SEQ ID NO: 1874335 - protein, 21 aa, Staphylococcus
GFTLIECFTFLNMHIQYKQKD

SEQ ID NO: 1874336 - protein, 24 aa, Staphylococcus
GFTLLECFNFINLYFNYKNKNIAN

SEQ ID NO: 1874337 - protein, 18 aa, Staphylococcus
GFVAANYAFAVIFITTQV

SEQ ID NO: 1874338 - protein, 25 aa, Staphylococcus
GFVAAYIASFGMKWMEEKLPDGLDL

SEQ ID NO: 1874339 - protein, 24 aa, Staphylococcus
GFVGESYLYLGVFGIILASVIFGV

SEQ ID NO: 1874340 - protein, 19 aa, Staphylococcus
GFVIFPISFAWLVLNFNLD

SEQ ID NO: 1874341 - protein, 24 aa, Staphylococcus
GFVIFPLSVAWIILNFNLAKLEAK

SEQ ID NO: 1874342 - protein, 25 aa, Staphylococcus
GFVIGWTYWICWIVSSMSDLTAMGQ

SEQ ID NO: 1874343 - protein, 25 aa, Staphylococcus
GFVIGWTYWICWVVSSMSDLTAMGQ

SEQ ID NO: 1874344 - protein, 24 aa, Staphylococcus
GFVIGWTYWISWIISSMSDLTAMG

SEQ ID NO: 1874345 - protein, 23 aa, Staphylococcus
GFVIGWTYWLAWIASSMSDLTAM

SEQ ID NO: 1874346 - protein, 25 aa, Staphylococcus
GFVIGWTYWLSWIVSSMSDLTAMGQ

SEQ ID NO: 1874347 - protein, 20 aa, Staphylococcus
GFVKQKLLTLGIPYILINFG

SEQ ID NO: 1874348 - protein, 26 aa, Staphylococcus
GFVSLNLIAIFAWTFCGVLLLKNKEA

SEQ ID NO: 1874349 - protein, 19 aa, Staphylococcus
GFVVFCISLFMSIQTDNLV

SEQ ID NO: 1874350 - protein, 18 aa, Staphylococcus
GFWMCIFMTIGGFFLIFE

SEQ ID NO: 1874351 - protein, 23 aa, Staphylococcus
GFWMFKEYFGLTVKETFLTWSML

SEQ ID NO: 1874352 - protein, 33 aa, Staphylococcus; identical to SEQ ID NO: 1741465

SEQ ID NO: 1874353 - protein, 20 aa, Staphylococcus
GFYILYQFLFKRTHEHHTHV

SEQ ID NO: 1874354 - protein, 17 aa, Staphylococcus
GGAFIMLLKMAFMVDYF

SEQ ID NO: 1874355 - protein, 18 aa, Staphylococcus
GGAFKQILIDGGVGDTIK

SEQ ID NO: 1874356 - protein, 19 aa, Staphylococcus
GGAFSWLVVEYCITKKLSL

SEQ ID NO: 1874357 - protein, 25 aa, Staphylococcus
GGAFYFSIGVFKNFYMMLAGQVFLA

SEQ ID NO: 1874358 - protein, 26 aa, Staphylococcus
GGAIKWDFQTLIGFVFAPLAFLAGVP

SEQ ID NO: 1874359 - protein, 25 aa, Staphylococcus
GGALEAVFWMIGKVLLLAPIAVFAF

SEQ ID NO: 1874360 - protein, 19 aa, Staphylococcus
GGALKRFSIFAMGIMPYIT

SEQ ID NO: 1874361 - protein, 20 aa, Staphylococcus
GGAMPFIIVTIITLSAILTL

SEQ ID NO: 1874362 - protein, 20 aa, Staphylococcus
GGAMPLIIVIIITLSGILSV

SEQ ID NO: 1874363 - protein, 27 aa, Staphylococcus
GGAVTASFKWYDFVYFIDTFIYLFILI

SEQ ID NO: 1874364 - protein, 18 aa, Staphylococcus
GGELKHGTIALIEDRTPV

SEQ ID NO: 1874365 - protein, 18 aa, Staphylococcus
GGELKHGTIALIEEGTPV

SEQ ID NO: 1874366 - protein, 21 aa, Staphylococcus
GGFEGVVWSDFIQGIILLGGA

SEQ ID NO: 1874367 - protein, 25 aa, Staphylococcus
GGFMPNGFVGFFFALSIVIGSYQGV

SEQ ID NO: 1874368 - protein, 25 aa, Staphylococcus
GGFMPNGLVGFFFALSIVIGSYQGV

SEQ ID NO: 1874369 - protein, 24 aa, Staphylococcus
GGFMPNGWIGFFFALSIVIGSYQG

SEQ ID NO: 1874370 - protein, 24 aa, Staphylococcus
GGFMPNGWVGFFFALSIVVGSYQG

SEQ ID NO: 1874371 - protein, 22 aa, Staphylococcus
GGFSPHFSVLLIARIIQALGSG

SEQ ID NO: 1874372 - protein, 17 aa, Staphylococcus
GGFSWAQVPGYIVCQML

SEQ ID NO: 1874373 - protein, 23 aa, Staphylococcus
GGFVAEFSFNFIFLANLIMYVLF

SEQ ID NO: 1874374 - protein, 19 aa, Staphylococcus
GGFWDFIQALQFDYLGYIL

SEQ ID NO: 1874375 - protein, 17 aa, Staphylococcus
GGGEFGIGMALVAEVFA

SEQ ID NO: 1874376 - protein, 25 aa, Staphylococcus
GGGILEFATWHWLFFINIPIAIIAI

SEQ ID NO: 1874377 - protein, 25 aa, Staphylococcus
GGGILEFATWHWLFFVNIPISIIAI

SEQ ID NO: 1874378 - protein, 17 aa, Staphylococcus
GGGIRASIEKGKDVTLG

SEQ ID NO: 1874379 - protein, 37 aa, Staphylococcus
GGGQNLVVMFSRMNIVGWARFGLAAFKETLNVYQYHS

SEQ ID NO: 1874380 - protein, 18 aa, Staphylococcus
GGGSKEPNHSGGSGGGSG

SEQ ID NO: 1874381 - protein, 25 aa, Staphylococcus
GGGTFPIEVTPEFFQIIHPFIPFSY

SEQ ID NO: 1874382 - protein, 25 aa, Staphylococcus
GGGTFPIQVTPEFFQVIHPYLPFSY

SEQ ID NO: 1874383 - protein, 25 aa, Staphylococcus
GGGTFPVVTAPGFFQTISPYLPFTY

SEQ ID NO: 1874384 - protein, 19 aa, Staphylococcus
GGGTLNFITPVIIAVIFTL

SEQ ID NO: 1874385 - protein, 26 aa, Staphylococcus
GGHIKWDFQTLIGFVFAPFAFLTGVP

SEQ ID NO: 1874386 - protein, 20 aa, Staphylococcus
GGHPQFVRPLINPMVQGALR

SEQ ID NO: 1874387 - protein, 18 aa, Staphylococcus
GGHSDLLAGAVITNREDV

SEQ ID NO: 1874388 - protein, 21 aa, Staphylococcus
GGIDEIVWFFIAVIIGSIITM

SEQ ID NO: 1874389 - protein, 18 aa, Staphylococcus
GGIDWLLNVVRGRVKSKR

SEQ ID NO: 1874390 - protein, 25 aa, Staphylococcus
GGIDWLLQFVRARVKSKRGAELGIA

SEQ ID NO: 1874391 - protein, 17 aa, Staphylococcus
GGIGCAVFTLGLYFVPE

SEQ ID NO: 1874392 - protein, 26 aa, Staphylococcus
GGIGDLALVYGYQRFDTMVIIITVIV

SEQ ID NO: 1874393 - protein, 22 aa, Staphylococcus
GGIIEHVPWLVIILVSLVTIIV

SEQ ID NO: 1874394 - protein, 19 aa, Staphylococcus
GGIIGVIFAVWILSIIEKK

SEQ ID NO: 1874395 - protein, 19 aa, Staphylococcus
GGIRIALVVAIGIVAIGSF

SEQ ID NO: 1874396 - protein, 19 aa, Staphylococcus
GGIRIALVVAVGIVAIGSF

SEQ ID NO: 1874397 - protein, 24 aa, Staphylococcus
GGIRIRPILMTAIATIGALLPLLF

SEQ ID NO: 1874398 - protein, 18 aa, Staphylococcus
GGITWLLNFVRNRVKSKR

SEQ ID NO: 1874399 - protein, 26 aa, Staphylococcus
GGKAALVMFMWLPKAYAALNTELAAL

SEQ ID NO: 1874400 - protein, 24 aa, Staphylococcus
GGKVMLLYFMFCGIMAFCQNVIGI

SEQ ID NO: 1874401 - protein, 19 aa, Staphylococcus
GGKYAFAYASGIAAITAVL

SEQ ID NO: 1874402 - protein, 23 aa, Staphylococcus
GGLAGWIGSLVFKKYPIVTKQDM

SEQ ID NO: 1874403 - protein, 18 aa, Staphylococcus
GGLCVVVALIAINYSPHH

SEQ ID NO: 1874404 - protein, 20 aa, Staphylococcus
GGLDLIPGFVAGYVIGYLMK

SEQ ID NO: 1874405 - protein, 25 aa, Staphylococcus
GGLHRELINPIWLVLSFLLITIGEL

SEQ ID NO: 1874406 - protein, 22 aa, Staphylococcus
GGLIGGPVVKFLINKYNLKPEQ

SEQ ID NO: 1874407 - protein, 17 aa, Staphylococcus
GGLIGWIAGGIVGKDIP

SEQ ID NO: 1874408 - protein, 19 aa, Staphylococcus
GGLIGWVAGMIMGKDIPGG

SEQ ID NO: 1874409 - protein, 19 aa, Staphylococcus
GGLIKSYPVLGWTFFIAAL

SEQ ID NO: 1874410 - protein, 17 aa, Staphylococcus
GGLIKYSIPITLVTFVL

SEQ ID NO: 1874411 - protein, 25 aa, Staphylococcus
GGLLGVCFLTGNLLLLPRLGAALTV

SEQ ID NO: 1874412 - protein, 20 aa, Staphylococcus
GGLLSAIGIAGMDRVTQFNI

SEQ ID NO: 1874413 - protein, 20 aa, Staphylococcus
GGLLSIVFILFIFVFATKAG

SEQ ID NO: 1874414 - protein, 26 aa, Staphylococcus
GGLNKLIKGVNWVAGKLSMDKLPYIK

SEQ ID NO: 1874415 - protein, 17 aa, Staphylococcus
GGLTLLSIVAYSLLSTK

SEQ ID NO: 1874416 - protein, 25 aa, Staphylococcus
GGLVFSSAFLLMFLAFDVKQVLVAL

SEQ ID NO: 1874417 - protein, 17 aa, Staphylococcus
GGMIGVILMRFAATWFV

SEQ ID NO: 1874418 - protein, 23 aa, Staphylococcus
GGMIGVILMRFAATWFVDLLNKY

SEQ ID NO: 1874419 - protein, 23 aa, Staphylococcus
GGMIGVILMRFAATWFVELLNKY

SEQ ID NO: 1874420 - protein, 17 aa, Staphylococcus
GGNARFEFRRILDTNEG

SEQ ID NO: 1874421 - protein, 19 aa, Staphylococcus
GGPDWLKGPYTFFLVFHII

SEQ ID NO: 1874422 - protein, 18 aa, Staphylococcus
GGPMARVATVLKAKSVNE

SEQ ID NO: 1874423 - protein, 20 aa, Staphylococcus
GGPMPISWTPFGELFSGLFM

SEQ ID NO: 1874424 - protein, 20 aa, Staphylococcus
GGPMPISWTPFGELFSGVFM

SEQ ID NO: 1874425 - protein, 20 aa, Staphylococcus
GGQFTDWVKMMMQYLHLLPF

SEQ ID NO: 1874426 - protein, 22 aa, Staphylococcus
GGQLKGGDYTFILTDLNTPDHP

SEQ ID NO: 1874427 - protein, 21 aa, Staphylococcus
GGQSLIFYSLINWMPAYLSQS

SEQ ID NO: 1874428 - protein, 24 aa, Staphylococcus
GGRFGDGLVSIFTQLMPLFKWSSQ

SEQ ID NO: 1874429 - protein, 20 aa, Staphylococcus
GGSFMYRFRRVILPMFVSGY

SEQ ID NO: 1874430 - protein, 25 aa, Staphylococcus
GGSIFGQAIGVIFVCIVTIVISCII

SEQ ID NO: 1874431 - protein, 17 aa, Staphylococcus
GGSKEPNYSGGSGGGSG

SEQ ID NO: 1874432 - protein, 17 aa, Staphylococcus
GGSSLWSLMTGIGVILS

SEQ ID NO: 1874433 - protein, 18 aa, Staphylococcus
GGTASDFWIACLAGGAAF

SEQ ID NO: 1874434 - protein, 19 aa, Staphylococcus
GGTCVGVGIGVIVLAGGTT

SEQ ID NO: 1874435 - protein, 17 aa, Staphylococcus
GGTFPVVTLPKFFQNIS

SEQ ID NO: 1874436 - protein, 23 aa, Staphylococcus
GGTITFIVFMIFLITKFSQVWPI

SEQ ID NO: 1874437 - protein, 23 aa, Staphylococcus
GGTKESAGFGFIGMVGPINAFKF

SEQ ID NO: 1874438 - protein, 23 aa, Staphylococcus
GGTKESAGFGIIGLVGPINAFRF

SEQ ID NO: 1874439 - protein, 26 aa, Staphylococcus
GGTLDWNFQTLIGFVFAPFAFLTGVP

SEQ ID NO: 1874440 - protein, 23 aa, Staphylococcus
GGTRIRPILMTAVATIGALLPLL

SEQ ID NO: 1874441 - protein, 21 aa, Staphylococcus
GGTYFFVKLVQLIRVKDVIFI

SEQ ID NO: 1874442 - protein, 20 aa, Staphylococcus
GGVVSDCWIAILAGGAAFLT

SEQ ID NO: 1874443 - protein, 20 aa, Staphylococcus
GGWIHVKGSFGLNQILGVFM

SEQ ID NO: 1874444 - protein, 30 aa, Staphylococcus
GGWVASTIGWHWIFIISIALSFVAFFLIKH

SEQ ID NO: 1874445 - protein, 17 aa, Staphylococcus
GHALRNALIPIITIIVP

SEQ ID NO: 1874446 - protein, 25 aa, Staphylococcus
GHDVSWGEWFLYAAPWSILMSIALF

SEQ ID NO: 1874447 - protein, 25 aa, Staphylococcus
GHDVSWGEWFLYAAPWSILMSVALY

SEQ ID NO: 1874448 - protein, 27 aa, Staphylococcus
GHEICQEWLYHMGLPIDQIECLATQHC

SEQ ID NO: 1874449 - protein, 23 aa, Staphylococcus
GHGGFFNDDFRLFNTDNSSGELT

SEQ ID NO: 1874450 - protein, 25 aa, Staphylococcus
GHIFQGHVAWHYAIVLVISSYFGAK

SEQ ID NO: 1874451 - protein, 19 aa, Staphylococcus
GHILIKLIFAVICSVGGTY

SEQ ID NO: 1874452 - protein, 19 aa, Staphylococcus
GHIPGLSVLIMKDNKVYLN

SEQ ID NO: 1874453 - protein, 22 aa, Staphylococcus
GHKHVQWAMLVAAFIVGIALFF

SEQ ID NO: 1874454 - protein, 21 aa, Staphylococcus
GHKLLSIIIMYVIGLIVTLGI

SEQ ID NO: 1874455 - protein, 20 aa, Staphylococcus
GHLFLLIIVMIICFIGGYHP

SEQ ID NO: 1874456 - protein, 27 aa, Staphylococcus
GHLPAWLPAAIGFILGGVFIRGLDAVI

SEQ ID NO: 1874457 - protein, 23 aa, Staphylococcus
GHLTKAPVLLAIFGIIITVILYA

SEQ ID NO: 1874458 - protein, 23 aa, Staphylococcus
GHLTKAPVLLAIFGIVITVVLYA

SEQ ID NO: 1874459 - protein, 39 aa, Staphylococcus
GHPKGLGVLFFVEFWERFSYYGMRAMLIFYMYYAINQGG

SEQ ID NO: 1874460 - protein, 29 aa, Staphylococcus
GHQYSAKKKRSWVSLIIHIIVLILLTISM

SEQ ID NO: 1874461 - protein, 17 aa, Staphylococcus
GHSEAFSTEISQLEKQN

SEQ ID NO: 1874462 - protein, 26 aa, Staphylococcus
GHSKHLKLGESILVVGNPLGNDFKNT

SEQ ID NO: 1874463 - protein, 24 aa, Staphylococcus
GHTQSVWIGLILFIRGCAVGGVML

SEQ ID NO: 1874464 - protein, 28 aa, Staphylococcus
GHTSIWWLYLMLFIRGCSVGGIMLGFTS

SEQ ID NO: 1874465 - protein, 19 aa, Staphylococcus
GHVDLNWADLFFSPFAWSV

SEQ ID NO: 1874466 - protein, 19 aa, Staphylococcus
GHVYFAWLFGLLLGMIGMN

SEQ ID NO: 1874467 - protein, 17 aa, Staphylococcus
GHVYNGISNKQFAELPT

SEQ ID NO: 1874468 - protein, 19 aa, Staphylococcus
GHYSWFRNWMFLLQRITGV

SEQ ID NO: 1874469 - protein, 25 aa, Staphylococcus
GIAKAGSIFPLLSPVLGWIGVFMTG

SEQ ID NO: 1874470 - protein, 18 aa, Staphylococcus
GIAKTGAIFPLLSPVLGW

SEQ ID NO: 1874471 - protein, 23 aa, Staphylococcus
GIALGFGVLFDAFVVRMTLIPAL

SEQ ID NO: 1874472 - protein, 20 aa, Staphylococcus
GIALLIAMFRLIKGPTTADR

SEQ ID NO: 1874473 - protein, 21 aa, Staphylococcus
GIALLVCLLRLIKGPTTADRV

SEQ ID NO: 1874474 - protein, 20 aa, Staphylococcus
GIAMILPVTMPFHLNTINYI

SEQ ID NO: 1874475 - protein, 20 aa, Staphylococcus
GIAMTCCAIGGIIATVILPK

SEQ ID NO: 1874476 - protein, 18 aa, Staphylococcus
GIARGIMNMAGYVMSRAR

SEQ ID NO: 1874477 - protein, 17 aa, Staphylococcus
GIATKVGTYPIVVTSKD

SEQ ID NO: 1874478 - protein, 18 aa, Staphylococcus
GIATYRFNTIWASITLHF

SEQ ID NO: 1874479 - protein, 19 aa, Staphylococcus
GIDKVLWFFIAVIIGSLVT

SEQ ID NO: 1874480 - protein, 24 aa, Staphylococcus
GIDPEYYAILDFTGFEKMIDELEP

SEQ ID NO: 1874481 - protein, 55 aa, Staphylococcus
GIDTPVEVPVKVWVYKFDFANSVYKIQIGQTFPGGTWVKKYVHLENGDDLPTNGF

SEQ ID NO: 1874482 - protein, 20 aa, Staphylococcus
GIELFKMPSIEQVLVGELEV

SEQ ID NO: 1874483 - protein, 17 aa, Staphylococcus
GIFCFPLAIEIKILLNL

SEQ ID NO: 1874484 - protein, 17 aa, Staphylococcus
GIFGIPITVIWIVAITN

SEQ ID NO: 1874485 - protein, 21 aa, Staphylococcus
GIFLLFKFTPILGLSDSYIYI

SEQ ID NO: 1874486 - protein, 25 aa, Staphylococcus
GIFLLFRFTPVLGLSDAYIYIVTFV

SEQ ID NO: 1874487 - protein, 25 aa, Staphylococcus
GIFLLFRFTPVLGLSNSYIYIVTFV

SEQ ID NO: 1874488 - protein, 25 aa, Staphylococcus
GIFLLFRFTSVLGLSDFYIYSVTFV

SEQ ID NO: 1874489 - protein, 17 aa, Staphylococcus
GIFRYEWTFNQMSANFV

SEQ ID NO: 1874490 - protein, 18 aa, Staphylococcus
GIFSQWLANRIKWPSIVV

SEQ ID NO: 1874491 - protein, 18 aa, Staphylococcus
GIFSQWLATQIKWPSIVV

SEQ ID NO: 1874492 - protein, 28 aa, Staphylococcus
GIFYALVMLAIFLPGYKAMPGNVDKLPI

SEQ ID NO: 1874493 - protein, 22 aa, Staphylococcus
GIGCAVSMLFLSKIIDKNSKGF

SEQ ID NO: 1874494 - protein, 19 aa, Staphylococcus
GIGDAYFFNFFSRLLTAVI

SEQ ID NO: 1874495 - protein, 23 aa, Staphylococcus
GIGDLALAYGYQRFDTIVIVITV

SEQ ID NO: 1874496 - protein, 18 aa, Staphylococcus
GIGDLFAKIMSPLAGNIW

SEQ ID NO: 1874497 - protein, 19 aa, Staphylococcus
GIGHVLDALSILPQVAMFF

SEQ ID NO: 1874498 - protein, 25 aa, Staphylococcus
GIGIPGLIAFLAFWAINFAIGIGGG

SEQ ID NO: 1874499 - protein, 19 aa, Staphylococcus
GIGLILFCITFFIFSITNS

SEQ ID NO: 1874500 - protein, 24 aa, Staphylococcus
GIGPNEFIEFPLLVESPKEEGTYS

SEQ ID NO: 1874501 - protein, 24 aa, Staphylococcus
GIGTLPAIIALVVYALLPILRNTY

SEQ ID NO: 1874502 - protein, 18 aa, Staphylococcus
GIHEAYFFNFFSRLLTAI

SEQ ID NO: 1874503 - protein, 20 aa, Staphylococcus
GIIAAIAFLILCIGIVVVLI

SEQ ID NO: 1874504 - protein, 20 aa, Staphylococcus
GIIAAIAFLILCIGVVVVLM

SEQ ID NO: 1874505 - protein, 26 aa, Staphylococcus
GIIAAIAFLVLCIGIVVVLISVKKNL

SEQ ID NO: 1874506 - protein, 19 aa, Staphylococcus
GIIAAVAFLILVIGIVVVL

SEQ ID NO: 1874507 - protein, 18 aa, Staphylococcus
GIIALVFLLLAKKSKAVN

SEQ ID NO: 1874508 - protein, 26 aa, Staphylococcus
GIIDGPSTFIWVCVITLIAQQLEGNV

SEQ ID NO: 1874509 - protein, 25 aa, Staphylococcus
GIIDGPSTFIWVCVVTLIAQQLEGN

SEQ ID NO: 1874510 - protein, 30 aa, Staphylococcus
GIIGLYYWSAWALFIVCIMILALIIEALLY

SEQ ID NO: 1874511 - protein, 18 aa, Staphylococcus
GIIGVIFAVWLLSIIEKR

SEQ ID NO: 1874512 - protein, 18 aa, Staphylococcus
GIIGVIFAVWLLSLIEKR

SEQ ID NO: 1874513 - protein, 18 aa, Staphylococcus
GIIHFFGGIHEIYFPYVL

SEQ ID NO: 1874514 - protein, 18 aa, Staphylococcus
GIIIAFGILLGYFVAQKS

SEQ ID NO: 1874515 - protein, 20 aa, Staphylococcus
GIIICKLRNLHPFQIGDIVA

SEQ ID NO: 1874516 - protein, 24 aa, Staphylococcus
GIIIPSSILYYFFDSFALIILLVG

SEQ ID NO: 1874517 - protein, 24 aa, Staphylococcus
GIILGVVVGYFLARNILHQKQIQA

SEQ ID NO: 1874518 - protein, 19 aa, Staphylococcus
GIILTRFSPVFDHPIALTI

SEQ ID NO: 1874519 - protein, 18 aa, Staphylococcus
GIIQFFGGIHEIYFPYVL

SEQ ID NO: 1874520 - protein, 25 aa, Staphylococcus
GIIQSPTAFIWVCVVTLVAQQLEGN

SEQ ID NO: 1874521 - protein, 17 aa, Staphylococcus
GIISFKIAVAALITGGF

SEQ ID NO: 1874522 - protein, 24 aa, Staphylococcus
GIISFKIAVGILVTGAFSLFEAIQ

SEQ ID NO: 1874523 - protein, 24 aa, Staphylococcus
GIISFKIAVGVLITGSFSLFEAVQ

SEQ ID NO: 1874524 - protein, 25 aa, Staphylococcus
GIISFKIAVGVLITGVFSIFEAIEQ

SEQ ID NO: 1874525 - protein, 17 aa, Staphylococcus
GIISFKIAVGVLVTGTF

SEQ ID NO: 1874526 - protein, 26 aa, Staphylococcus
GIISLKQFWIRRVKRLLPAVVALLIV

SEQ ID NO: 1874527 - protein, 21 aa, Staphylococcus
GIIVIPFVLLGILVFSFHQMW

SEQ ID NO: 1874528 - protein, 21 aa, Staphylococcus
GIIWLIFQITFTWVGTPLSDK

SEQ ID NO: 1874529 - protein, 30 aa, Staphylococcus
GIIYLFIVGFYRLPGIIAVITLTTYIYITL

SEQ ID NO: 1874530 - protein, 21 aa, Staphylococcus
GIKADSFLMPKIVKGKKFAKD

SEQ ID NO: 1874531 - protein, 27 aa, Staphylococcus
GIKAPGFRLFFKSGFKTVIDMWFVILP

SEQ ID NO: 1874532 - protein, 23 aa, Staphylococcus
GIKGTPLSAGFGYTGLVGPINAF

SEQ ID NO: 1874533 - protein, 21 aa, Staphylococcus
GIKIAGLLSALVIAILAIVRF

SEQ ID NO: 1874534 - protein, 20 aa, Staphylococcus
GIKKWKADAIVLNKDANQTV

SEQ ID NO: 1874535 - protein, 22 aa, Staphylococcus
GIKKWKADAIVLNKDANQTVQQ

SEQ ID NO: 1874536 - protein, 24 aa, Staphylococcus
GIKTRHLLTSLLLQILIVTLLSVV

SEQ ID NO: 1874537 - protein, 18 aa, Staphylococcus
GIKYETMSFLTLPPKDVF

SEQ ID NO: 1874538 - protein, 18 aa, Staphylococcus
GIKYETMSFLTLPPKEVF

SEQ ID NO: 1874539 - protein, 27 aa, Staphylococcus
GILATDRRGRVRIANDMALKMLGLAKE

SEQ ID NO: 1874540 - protein, 29 aa, Staphylococcus
GILATDRRGRVRIANDMALKMLGMAKEDL

SEQ ID NO: 1874541 - protein, 20 aa, Staphylococcus
GILCILSILTILALNFYENF

SEQ ID NO: 1874542 - protein, 18 aa, Staphylococcus
GILGLLSVHGYLIGFGAL

SEQ ID NO: 1874543 - protein, 17 aa, Staphylococcus
GILHIKFLQDIGDLAGS

SEQ ID NO: 1874544 - protein, 32 aa, Staphylococcus
GILLVMIIASGFLLRQAFMKMDSYVDGLSGHI

SEQ ID NO: 1874545 - protein, 33 aa, Staphylococcus
GILLVRFRLTLTRRGIENINMFVFLQLLTPFVT

SEQ ID NO: 1874546 - protein, 27 aa, Staphylococcus
GILPIYWRFIHGISAFEILAYRIILAM

SEQ ID NO: 1874547 - protein, 27 aa, Staphylococcus
GILPSRSKRLTVVTNVDNWHSYSTDPN

SEQ ID NO: 1874548 - protein, 19 aa, Staphylococcus
GILSLISVYGFILCVGSFG

SEQ ID NO: 1874549 - protein, 17 aa, Staphylococcus
GILSVPFTVFWIIAITN

SEQ ID NO: 1874550 - protein, 28 aa, Staphylococcus
GILTCLKLNISPVFAVIVGLVLHDYKLL

SEQ ID NO: 1874551 - protein, 17 aa, Staphylococcus
GILTGFILSLSRALGET

SEQ ID NO: 1874552 - protein, 37 aa, Staphylococcus
GILTSLVSWRLCFLINIPMCIIFILLAIKLLPQTTTS

SEQ ID NO: 1874553 - protein, 27 aa, Staphylococcus
GILVALNLFLAWFFVYFEQGRKVVRGL

SEQ ID NO: 1874554 - protein, 20 aa, Staphylococcus
GILVKPVLDPIMRKISKRVA

SEQ ID NO: 1874555 - protein, 27 aa, Staphylococcus
GILYIPHFLSWVVVIGIFKKLLAPDDG

SEQ ID NO: 1874556 - protein, 20 aa, Staphylococcus
GIMEIFFRRLTKAFVGISGG

SEQ ID NO: 1874557 - protein, 19 aa, Staphylococcus
GIMGPMVIIPLYFQTFKHY

SEQ ID NO: 1874558 - protein, 17 aa, Staphylococcus
GIMGSVFGIIAGIFGLL

SEQ ID NO: 1874559 - protein, 24 aa, Staphylococcus
GIMIRGVETPGYFSTIAAILLLGG

SEQ ID NO: 1874560 - protein, 19 aa, Staphylococcus
GIMLFIMIIYWLVQLSGFK

SEQ ID NO: 1874561 - protein, 25 aa, Staphylococcus
GIMLSFRIEKQFLPIAVKYLIVHYG

SEQ ID NO: 1874562 - protein, 18 aa, Staphylococcus
GIMLTRFSPLFNGDIATM

SEQ ID NO: 1874563 - protein, 18 aa, Staphylococcus
GIMSMLGSACLIILALAL

SEQ ID NO: 1874564 - protein, 17 aa, Staphylococcus
GIMTGFILSLSRALGET

SEQ ID NO: 1874565 - protein, 19 aa, Staphylococcus
GINIPGYFTTIAAILLLGG

SEQ ID NO: 1874566 - protein, 18 aa, Staphylococcus
GINLPLIFTIVIIAVGLL

SEQ ID NO: 1874567 - protein, 20 aa, Staphylococcus
GINMASFWLLFSGAVTAVPL

SEQ ID NO: 1874568 - protein, 19 aa, Staphylococcus
GINNTIFNIYKFRSMKIDT

SEQ ID NO: 1874569 - protein, 24 aa, Staphylococcus
GINPEYYAVIDFTGFEKMIDELAP

SEQ ID NO: 1874570 - protein, 20 aa, Staphylococcus
GINVIFLWISAISFSALFTF

SEQ ID NO: 1874571 - protein, 18 aa, Staphylococcus
GIPAFLMSILMGFTGLVL

SEQ ID NO: 1874572 - protein, 31 aa, Staphylococcus
GIPIAACGLLAPWVAGAAMALSSVSVVTNAL

SEQ ID NO: 1874573 - protein, 27 aa, Staphylococcus
GIPIGIFIARFKKLAWPVITIANVIQT

SEQ ID NO: 1874574 - protein, 21 aa, Staphylococcus
GIPLSFAYVIFIIFWQVGFSN

SEQ ID NO: 1874575 - protein, 25 aa, Staphylococcus
GIPLTSKRFIQWLNLLNIVPGFYGI

SEQ ID NO: 1874576 - protein, 22 aa, Staphylococcus
GIPTTLGTYPIEVMSKDNENNV

SEQ ID NO: 1874577 - protein, 21 aa, Staphylococcus
GIPYLKPSFFTNFSSSMPQMA

SEQ ID NO: 1874578 - protein, 20 aa, Staphylococcus
GIQHVLWFFVAVIIGSLITM

SEQ ID NO: 1874579 - protein, 25 aa, Staphylococcus
GIQNLTALIHYPGIDTPVEVPVKVW

SEQ ID NO: 1874580 - protein, 19 aa, Staphylococcus
GIRMFKRYATITTSARILE

SEQ ID NO: 1874581 - protein, 24 aa, Staphylococcus
GIRYLDKELLAFIKPYQLTDEEDI

SEQ ID NO: 1874582 - protein, 18 aa, Staphylococcus
GISGFLGVLLVAGFSVGG

SEQ ID NO: 1874583 - protein, 17 aa, Staphylococcus
GISIMKAQHQHYDSNNT

SEQ ID NO: 1874584 - protein, 25 aa, Staphylococcus
GISKAGSVFPILSPILGWIGVFMTG

SEQ ID NO: 1874585 - protein, 21 aa, Staphylococcus
GISKIEWLVIILLIALVLSFE

SEQ ID NO: 1874586 - protein, 17 aa, Staphylococcus
GISKWVILYGRRKFAAM

SEQ ID NO: 1874587 - protein, 25 aa, Staphylococcus
GISLLITVILGFFIARTITKPITDM

SEQ ID NO: 1874588 - protein, 42 aa, Staphylococcus
GISPNEFKFGLSFFSRAVSLSRFPWLSANIEYKKTREPYFST

SEQ ID NO: 1874589 - protein, 26 aa, Staphylococcus
GISPNEFKFGLSFLTRSVALARFPWL

SEQ ID NO: 1874590 - protein, 17 aa, Staphylococcus
GISQAVAMWPGFSRSGS

SEQ ID NO: 1874591 - protein, 20 aa, Staphylococcus
GISVAYIYSLYAFYMNNFSS

SEQ ID NO: 1874592 - protein, 21 aa, Staphylococcus
GISVAYIYSLYAFYMNNFSSA

SEQ ID NO: 1874593 - protein, 26 aa, Staphylococcus
GITALITVVALWEFSFAHTLLLFLSM

SEQ ID NO: 1874594 - protein, 29 aa, Staphylococcus
GITLFLIACIVIIFGIIAIFKNKNYLKML

SEQ ID NO: 1874595 - protein, 18 aa, Staphylococcus
GITTFLSMAYILAVNPQV

SEQ ID NO: 1874596 - protein, 26 aa, Staphylococcus
GITTNFSEIFLVTSIGGSVLILIGIF

SEQ ID NO: 1874597 - protein, 17 aa, Staphylococcus
GITVITCQFFVYVFSKR

SEQ ID NO: 1874598 - protein, 26 aa, Staphylococcus
GITVNLLDPTGIRLATTTTDITGHYN

SEQ ID NO: 1874599 - protein, 18 aa, Staphylococcus
GIVAIIFLLLARQSDVVS

SEQ ID NO: 1874600 - protein, 25 aa, Staphylococcus
GIVARMCGISIFSIMKILKSEILLA

SEQ ID NO: 1874601 - protein, 25 aa, Staphylococcus
GIVASCITFLWGSLRVNKLGVNLIL

SEQ ID NO: 1874602 - protein, 20 aa, Staphylococcus
GIVFACLTISGWREVIINAI

SEQ ID NO: 1874603 - protein, 24 aa, Staphylococcus
GIVFTLDLFSAMLIITSIVITMLI

SEQ ID NO: 1874604 - protein, 21 aa, Staphylococcus
GIVGACGWMVYTIFFDGLNTH

SEQ ID NO: 1874605 - protein, 24 aa, Staphylococcus
GIVIARYKKLAWPIITIANIIQTV

SEQ ID NO: 1874606 - protein, 19 aa, Staphylococcus
GIVIARYKKLSWTIITIAN

SEQ ID NO: 1874607 - protein, 24 aa, Staphylococcus
GIVIFSLIALFLIKTIKKSNHIYN

SEQ ID NO: 1874608 - protein, 19 aa, Staphylococcus
GIVIMSLIWLFKDKGQDQH

SEQ ID NO: 1874609 - protein, 19 aa, Staphylococcus
GIVISTIVLFKSRRLASQK

SEQ ID NO: 1874610 - protein, 18 aa, Staphylococcus
GIVLCLFTLFTSKAPNGS

SEQ ID NO: 1874611 - protein, 25 aa, Staphylococcus
GIVMGTGFAFWSFVLAIVLIVVDVM

SEQ ID NO: 1874612 - protein, 17 aa, Staphylococcus
GIVSRVCGVRITQVIKL

SEQ ID NO: 1874613 - protein, 17 aa, Staphylococcus
GIWQIHHMSAFAVIMVM

SEQ ID NO: 1874614 - protein, 37 aa, Staphylococcus
GIYFILRIIFKYRYDIVSRWEKFYLLVIGAILALLSS

SEQ ID NO: 1874615 - protein, 23 aa, Staphylococcus
GIYFILRVVFQYRHDIVSRWQKC

SEQ ID NO: 1874616 - protein, 35 aa, Staphylococcus
GIYFLLRIIFEYRYDIVTRWQKFYLLMFGTILALF

SEQ ID NO: 1874617 - protein, 25 aa, Staphylococcus
GIYILYQFAFKGKRSYTDGPPPSNK

SEQ ID NO: 1874618 - protein, 18 aa, Staphylococcus
GIYKYIFYFISFMIIMVV

SEQ ID NO: 1874619 - protein, 20 aa, Staphylococcus
GKAKVLADVINRIQSDKESA

SEQ ID NO: 1874620 - protein, 20 aa, Staphylococcus
GKALMLPVAILPAAGILLTF

SEQ ID NO: 1874621 - protein, 20 aa, Staphylococcus
GKALMLPVAILPAAGLLLAL

SEQ ID NO: 1874622 - protein, 19 aa, Staphylococcus
GKASFTMGLFGITEGAIPF

SEQ ID NO: 1874623 - protein, 27 aa, Staphylococcus
GKAVLYLLFCWTGIPGVIGIYEGIIAF

SEQ ID NO: 1874624 - protein, 26 aa, Staphylococcus
GKDNLPRFFIYLLLFMFAMLGIVVSN

SEQ ID NO: 1874625 - protein, 22 aa, Staphylococcus
GKDVKKYYVEWNEKKWISYGEW

SEQ ID NO: 1874626 - protein, 21 aa, Staphylococcus
GKEILYAWSPFIILTVIVMIW

SEQ ID NO: 1874627 - protein, 20 aa, Staphylococcus
GKELLGYARFRHDAEGDFGR

SEQ ID NO: 1874628 - protein, 18 aa, Staphylococcus
GKENELGSGVVYKKVGDS

SEQ ID NO: 1874629 - protein, 27 aa, Staphylococcus
GKFIAEHKWVSIIAWLLILGVIVTPLL

SEQ ID NO: 1874630 - protein, 27 aa, Staphylococcus
GKFIAKNKWLSVIGWLVILGVIITPLM

SEQ ID NO: 1874631 - protein, 17 aa, Staphylococcus
GKFIAKNKWVSILAWLI

SEQ ID NO: 1874632 - protein, 25 aa, Staphylococcus
GKFTNKRSFLALVIVLVVMVPIIVF

SEQ ID NO: 1874633 - protein, 26 aa, Staphylococcus
GKFVKRLTGFSALCIISVYNLTFTVY

SEQ ID NO: 1874634 - protein, 19 aa, Staphylococcus
GKGGWTVPEITWIIRIISI

SEQ ID NO: 1874635 - protein, 26 aa, Staphylococcus
GKGISRGKILAAMLFGMFIAILNQTL

SEQ ID NO: 1874636 - protein, 19 aa, Staphylococcus
GKGKSNWSYAIVPVLGPIA

SEQ ID NO: 1874637 - protein, 19 aa, Staphylococcus
GKGKSNWSYAIVPVLGPIT

SEQ ID NO: 1874638 - protein, 28 aa, Staphylococcus
GKGSWYIPKWLGGILPKIDIEGKALEEG

SEQ ID NO: 1874639 - protein, 31 aa, Staphylococcus
GKHDPRNGQAIPGYGTSSFRDGGNTVSIDGG

SEQ ID NO: 1874640 - protein, 23 aa, Staphylococcus
GKHEPPGIIGDRWQYTGQTTTAD

SEQ ID NO: 1874641 - protein, 26 aa, Staphylococcus
GKHKEPRSFTAPSIVVGPDYYMGIGT

SEQ ID NO: 1874642 - protein, 23 aa, Staphylococcus
GKHQPPGIIGDRWQYTGKVTEKD

SEQ ID NO: 1874643 - protein, 21 aa, Staphylococcus
GKHQPPSIIGDRWQYTGKVTE

SEQ ID NO: 1874644 - protein, 19 aa, Staphylococcus
GKIDAAIFNLGYLPKGDKS

SEQ ID NO: 1874645 - protein, 17 aa, Staphylococcus
GKIKEKQHEITLIVSDN

SEQ ID NO: 1874646 - protein, 17 aa, Staphylococcus
GKIKPIHFIGGVLGVVF

SEQ ID NO: 1874647 - protein, 24 aa, Staphylococcus
GKIMSICIIAFFVFIFGVLFVNPE

SEQ ID NO: 1874648 - protein, 20 aa, Staphylococcus
GKINLSFSQSKFFSQIESIS

SEQ ID NO: 1874649 - protein, 19 aa, Staphylococcus
GKINRFGSIILKAKENIYR

SEQ ID NO: 1874650 - protein, 20 aa, Staphylococcus
GKINRLWLVLLFAGGGASLI

SEQ ID NO: 1874651 - protein, 21 aa, Staphylococcus
GKINRLWLVLLFAGGGASLLI

SEQ ID NO: 1874652 - protein, 18 aa, Staphylococcus
GKINYRMHKRIDVTYSLR

SEQ ID NO: 1874653 - protein, 29 aa, Staphylococcus
GKIPKSRRTSGIFLLQFVLLLIAQLNFHF

SEQ ID NO: 1874654 - protein, 19 aa, Staphylococcus
GKISFLQGFFEVMSAFGTC

SEQ ID NO: 1874655 - protein, 17 aa, Staphylococcus
GKIVLSVLLSILSVFSG

SEQ ID NO: 1874656 - protein, 26 aa, Staphylococcus
GKKEANLEHGIAILLVTTGAGLIYLR

SEQ ID NO: 1874657 - protein, 22 aa, Staphylococcus
GKKLIICIGLGLFAISEFLFAA

SEQ ID NO: 1874658 - protein, 22 aa, Staphylococcus
GKKLIICIGLILFAVSEFLFAV

SEQ ID NO: 1874659 - protein, 20 aa, Staphylococcus
GKKLSPVFIYSAIIVAIVVI

SEQ ID NO: 1874660 - protein, 20 aa, Staphylococcus
GKKLTFIISPQWFTNHGLTN

SEQ ID NO: 1874661 - protein, 23 aa, Staphylococcus
GKKLTFIISPQWFTNHGLTNQNF

SEQ ID NO: 1874662 - protein, 21 aa, Staphylococcus
GKKLTFRLLLIDTPETKDPRK

SEQ ID NO: 1874663 - protein, 18 aa, Staphylococcus
GKKMTFIISPQWFSTHGV

SEQ ID NO: 1874664 - protein, 25 aa, Staphylococcus
GKKNYKSGTIFSIVCWLVISIAIFV

SEQ ID NO: 1874665 - protein, 23 aa, Staphylococcus
GKKTWLKFFIGILLLNLVVLITG

SEQ ID NO: 1874666 - protein, 17 aa, Staphylococcus
GKLALIFDDGTEAEVER

SEQ ID NO: 1874667 - protein, 19 aa, Staphylococcus
GKLDFDFKATNSETVNVTE

SEQ ID NO: 1874668 - protein, 17 aa, Staphylococcus
GKLFMIFLIRTAITLPI

SEQ ID NO: 1874669 - protein, 17 aa, Staphylococcus
GKLFPFVFIASGAGAIL

SEQ ID NO: 1874670 - protein, 23 aa, Staphylococcus
GKLLKIMAPLSFVLASLAIYWAM

SEQ ID NO: 1874671 - protein, 17 aa, Staphylococcus
GKLLNKVLEAFGVNMDA

SEQ ID NO: 1874672 - protein, 21 aa, Staphylococcus
GKLLNKVLQGFGISKDSFGIS

SEQ ID NO: 1874673 - protein, 30 aa, Staphylococcus
GKLPKTRRLTGSIVLQFALLFAAQLYLVFT

SEQ ID NO: 1874674 - protein, 17 aa, Staphylococcus
GKLRSWLTKTWKNIKNS

SEQ ID NO: 1874675 - protein, 17 aa, Staphylococcus
GKLSFGFMVPILAAYIA

SEQ ID NO: 1874676 - protein, 17 aa, Staphylococcus
GKLSWIFYISMIVLTLL

SEQ ID NO: 1874677 - protein, 19 aa, Staphylococcus
GKLTIYLGYSPGVGKTYEM

SEQ ID NO: 1874678 - protein, 19 aa, Staphylococcus
GKNYFNFLLSYVIWSIIGT

SEQ ID NO: 1874679 - protein, 18 aa, Staphylococcus
GKNYLNFVISYTIWTIII

SEQ ID NO: 1874680 - protein, 26 aa, Staphylococcus
GKQIYIPGYNIPFLIQPASAGEGAVG

SEQ ID NO: 1874681 - protein, 22 aa, Staphylococcus
GKRPFIKRFVALGGSLVALALA

SEQ ID NO: 1874682 - protein, 21 aa, Staphylococcus
GKSATLGAIFLLFGTFLYFIA

SEQ ID NO: 1874683 - protein, 22 aa, Staphylococcus
GKSGASMLPGAFEYSMQLPEGI

SEQ ID NO: 1874684 - protein, 22 aa, Staphylococcus
GKSGIKAAATGISWVIESANAG

SEQ ID NO: 1874685 - protein, 21 aa, Staphylococcus
GKSMFGKLLGWVIDLVIIFTL

SEQ ID NO: 1874686 - protein, 18 aa, Staphylococcus
GKSYLEYQYEDILRGKKK

SEQ ID NO: 1874687 - protein, 18 aa, Staphylococcus
GKSYLEYQYEDVLKGTKK

SEQ ID NO: 1874688 - protein, 17 aa, Staphylococcus
GKSYLEYQYEDVLRGKK

SEQ ID NO: 1874689 - protein, 18 aa, Staphylococcus
GKSYLEYQYEDVLRGKKK

SEQ ID NO: 1874690 - protein, 19 aa, Staphylococcus
GKTAMLIAINQEYRGMVAV

SEQ ID NO: 1874691 - protein, 17 aa, Staphylococcus
GKTESIVAGSVCAHKRW

SEQ ID NO: 1874692 - protein, 24 aa, Staphylococcus
GKTETPLRYVLPFNNENKYLVMPA

SEQ ID NO: 1874693 - protein, 25 aa, Staphylococcus
GKTYIKHFLLFNGLMGGLSFVLLLI

SEQ ID NO: 1874694 - protein, 23 aa, Staphylococcus
GKTYLNYYISYFIYSVVAVILVY

SEQ ID NO: 1874695 - protein, 18 aa, Staphylococcus
GKVERPSIGLGLINLSDI

SEQ ID NO: 1874696 - protein, 25 aa, Staphylococcus
GKVFGCVGIALAMYFTTPKKNRKKV

SEQ ID NO: 1874697 - protein, 18 aa, Staphylococcus
GKVFLKKDIREFGSGNTG

SEQ ID NO: 1874698 - protein, 20 aa, Staphylococcus
GKVIGMPKVKGLKDKENPDL

SEQ ID NO: 1874699 - protein, 17 aa, Staphylococcus
GKVKLDKGYGFKNFENG

SEQ ID NO: 1874700 - protein, 22 aa, Staphylococcus
GKVMLLYFMFCGIMAICQNIIG

SEQ ID NO: 1874701 - protein, 26 aa, Staphylococcus
GKVNFLPIKFNKVGTYIYQITEQVGT

SEQ ID NO: 1874702 - protein, 24 aa, Staphylococcus
GKVNLKNGDPFTIALFGVDSDAER

SEQ ID NO: 1874703 - protein, 17 aa, Staphylococcus
GKVPAIIALVVYALLPI

SEQ ID NO: 1874704 - protein, 21 aa, Staphylococcus
GKYMAYAILVFFAFIFIVLLI

SEQ ID NO: 1874705 - protein, 24 aa, Staphylococcus
GKYQRRIYIVIAFILILMMPRIIY

SEQ ID NO: 1874706 - protein, 21 aa, Staphylococcus
GKYYDIEWTFLLLVSTIVMLS

SEQ ID NO: 1874707 - protein, 20 aa, Staphylococcus
GLACEIIFAIFRYKSRSAMV

SEQ ID NO: 1874708 - protein, 25 aa, Staphylococcus
GLADVKVNSGAYLKATTTQTKYTVT

SEQ ID NO: 1874709 - protein, 21 aa, Staphylococcus
GLAGACLVGLTGIAFVPEYHI

SEQ ID NO: 1874710 - protein, 28 aa, Staphylococcus
GLAGAFGIAGAGAFAFGGMAISALKMLK

SEQ ID NO: 1874711 - protein, 17 aa, Staphylococcus
GLAIVIIVCLVRLILMP

SEQ ID NO: 1874712 - protein, 17 aa, Staphylococcus
GLALLAGFIMIYIVTGT

SEQ ID NO: 1874713 - protein, 22 aa, Staphylococcus
GLAMDYEVFLMSRIHEEYSKTR

SEQ ID NO: 1874714 - protein, 22 aa, Staphylococcus
GLAMDYEVFLMSRIHEEYSRTH

SEQ ID NO: 1874715 - protein, 19 aa, Staphylococcus
GLAVFLFGFIKRLLIPFGL

SEQ ID NO: 1874716 - protein, 18 aa, Staphylococcus
GLAVFSFVTQALIFAIIF

SEQ ID NO: 1874717 - protein, 18 aa, Staphylococcus
GLCVVVALMLIHRQPRKN

SEQ ID NO: 1874718 - protein, 19 aa, Staphylococcus
GLDGLRAIAVIGIIIYHLN

SEQ ID NO: 1874719 - protein, 24 aa, Staphylococcus
GLDGLRAIAVIGIIIYHLNKKWLT

SEQ ID NO: 1874720 - protein, 24 aa, Staphylococcus
GLDGLRAIAVIGIIIYHLNKQWLS

SEQ ID NO: 1874721 - protein, 24 aa, Staphylococcus
GLDGLRAIAVLGIIIYHLNPQWLS

SEQ ID NO: 1874722 - protein, 23 aa, Staphylococcus
GLDLNLSYIIAFVLTILWVAYFS

SEQ ID NO: 1874723 - protein, 20 aa, Staphylococcus
GLDNTWLSGNKVELETEDNR

SEQ ID NO: 1874724 - protein, 25 aa, Staphylococcus
GLDVKWGAAITAIFAILIFVSKSGQ

SEQ ID NO: 1874725 - protein, 25 aa, Staphylococcus
GLDVKWGAAITAIFSILIFVSKSGQ

SEQ ID NO: 1874726 - protein, 18 aa, Staphylococcus
GLEGAAFAIVGWVGIKLV

SEQ ID NO: 1874727 - protein, 23 aa, Staphylococcus
GLEGAAFAIVGWVGIKLVVIVLA

SEQ ID NO: 1874728 - protein, 23 aa, Staphylococcus
GLEGAAFAIVGWVGIKLVVLVLA

SEQ ID NO: 1874729 - protein, 23 aa, Staphylococcus
GLEGAAFAIVGWVGIKLVVMVLA

SEQ ID NO: 1874730 - protein, 18 aa, Staphylococcus
GLEIKMLYDDMGSRGLRK

SEQ ID NO: 1874731 - protein, 18 aa, Staphylococcus
GLELKKLLEQEGAKVKMT

SEQ ID NO: 1874732 - protein, 18 aa, Staphylococcus
GLEVKLLYDDVGSKKVGL

SEQ ID NO: 1874733 - protein, 19 aa, Staphylococcus
GLEVPFMVILGMLATKLQT

SEQ ID NO: 1874734 - protein, 19 aa, Staphylococcus
GLEVPFMVILGMLSAKLAT

SEQ ID NO: 1874735 - protein, 18 aa, Staphylococcus
GLFARPALSTAVSTTPAE

SEQ ID NO: 1874736 - protein, 19 aa, Staphylococcus
GLFEPLKYTPSLSNKFDGS

SEQ ID NO: 1874737 - protein, 19 aa, Staphylococcus
GLFGTHLHNVLGLIAVISI

SEQ ID NO: 1874738 - protein, 24 aa, Staphylococcus
GLFINIIVAWIMLRGSDVEENLNM

SEQ ID NO: 1874739 - protein, 20 aa, Staphylococcus
GLFSGMLFFNIDGMSGLGVL

SEQ ID NO: 1874740 - protein, 30 aa, Staphylococcus
GLFSKRFWESLKFLLPIGIGMVVAIGLLSK

SEQ ID NO: 1874741 - protein, 19 aa, Staphylococcus
GLGAFMFLLLSLIRLNHLK

SEQ ID NO: 1874742 - protein, 24 aa, Staphylococcus
GLGAKPLVIFSCVIVGTLGYTTFG

SEQ ID NO: 1874743 - protein, 28 aa, Staphylococcus
GLGAMWKFPYMAGIYGGGAFLFLFLIFT

SEQ ID NO: 1874744 - protein, 26 aa, Staphylococcus
GLGAMWKFPYMAGIYGGGAFLLMFLV

SEQ ID NO: 1874745 - protein, 26 aa, Staphylococcus
GLGAMWKFPYMAGIYGGGAFLSLFLL

SEQ ID NO: 1874746 - protein, 21 aa, Staphylococcus
GLGEHSIGFVLIQQFVISFGF

SEQ ID NO: 1874747 - protein, 25 aa, Staphylococcus
GLGIPEFVLMIAFASFFKPSIWNLV

SEQ ID NO: 1874748 - protein, 18 aa, Staphylococcus
GLGIPKQDLEFIFDRFYR

SEQ ID NO: 1874749 - protein, 30 aa, Staphylococcus
GLGMLEVYVVISIIYWLLALIIQGTFTIIS

SEQ ID NO: 1874750 - protein, 23 aa, Staphylococcus
GLGYFLKRIHFVKAADSQVLATL

SEQ ID NO: 1874751 - protein, 29 aa, Staphylococcus
GLHHIFHAPFWFEFGAWKNAAGEMIHGDQ

SEQ ID NO: 1874752 - protein, 30 aa, Staphylococcus
GLHHIFHAPFWFEFGSWKNAAGHIVRGDQL

SEQ ID NO: 1874753 - protein, 25 aa, Staphylococcus
GLHHIFHAPFWFEFGSYKNAAGQII

SEQ ID NO: 1874754 - protein, 18 aa, Staphylococcus
GLHYILFAFLVVWLTDTG

SEQ ID NO: 1874755 - protein, 20 aa, Staphylococcus
GLIAALAFLVLVIGIVLVLV

SEQ ID NO: 1874756 - protein, 24 aa, Staphylococcus
GLIDGSFNWKGLLTAISKGIIGME

SEQ ID NO: 1874757 - protein, 20 aa, Staphylococcus
GLIGCLFLKRYIKEQKSMSI

SEQ ID NO: 1874758 - protein, 22 aa, Staphylococcus
GLIGGFFLARKYMMDYLKKNPP

SEQ ID NO: 1874759 - protein, 18 aa, Staphylococcus
GLIGSWLALISYAIFSAI

SEQ ID NO: 1874760 - protein, 17 aa, Staphylococcus
GLIGSWMALIAYAFTSA

SEQ ID NO: 1874761 - protein, 18 aa, Staphylococcus
GLIGSWVALILYALTSAI

SEQ ID NO: 1874762 - protein, 19 aa, Staphylococcus
GLIHLSIGIVIYIVFLIIY

SEQ ID NO: 1874763 - protein, 17 aa, Staphylococcus
GLIILISAIFYKAPSWI

SEQ ID NO: 1874764 - protein, 18 aa, Staphylococcus
GLIIWLSIPIVITIGLIN

SEQ ID NO: 1874765 - protein, 25 aa, Staphylococcus
GLINFFRLVPILLISVWAGSLADKY

SEQ ID NO: 1874766 - protein, 18 aa, Staphylococcus
GLISAVWNSITSVISSAV

SEQ ID NO: 1874767 - protein, 24 aa, Staphylococcus
GLISFFVPFLLMFIIDGLKGVKET

SEQ ID NO: 1874768 - protein, 27 aa, Staphylococcus
GLITGFVCAVILFLIIVIIYRQPFLAL

SEQ ID NO: 1874769 - protein, 18 aa, Staphylococcus
GLITMMFGSLTALRQYDL

SEQ ID NO: 1874770 - protein, 23 aa, Staphylococcus
GLIVGYVCSVLFKNYPIVSKEDI

SEQ ID NO: 1874771 - protein, 22 aa, Staphylococcus
GLIVIVCGFIFHITKVEWLFIL

SEQ ID NO: 1874772 - protein, 18 aa, Staphylococcus
GLIYLRYTRKARKLEVNN

SEQ ID NO: 1874773 - protein, 23 aa, Staphylococcus
GLKDEKYYGVAIFNKDFSKNAMS

SEQ ID NO: 1874774 - protein, 20 aa, Staphylococcus
GLKDKEFFKESAGYQKKMKK

SEQ ID NO: 1874775 - protein, 22 aa, Staphylococcus
GLKFSIIFGVLFFILNYFSGTR

SEQ ID NO: 1874776 - protein, 18 aa, Staphylococcus
GLKGDKGDSISITSITPQ

SEQ ID NO: 1874777 - protein, 20 aa, Staphylococcus
GLLAEIVILVSFYAMHLKDR

SEQ ID NO: 1874778 - protein, 18 aa, Staphylococcus
GLLFCLATPMASWFYNKN

SEQ ID NO: 1874779 - protein, 21 aa, Staphylococcus
GLLFKVLPLVFSKMHFGIAFY

SEQ ID NO: 1874780 - protein, 26 aa, Staphylococcus
GLLGAFIFRFIALFLISIIANFWWIQ

SEQ ID NO: 1874781 - protein, 18 aa, Staphylococcus
GLLGIAVILNAIFKDATK

SEQ ID NO: 1874782 - protein, 19 aa, Staphylococcus
GLLILYYICRLISEEKLYH

SEQ ID NO: 1874783 - protein, 19 aa, Staphylococcus
GLLILYYICRLISEEKLYR

SEQ ID NO: 1874784 - protein, 21 aa, Staphylococcus
GLLILYYLCRLIKEESIYRFV

SEQ ID NO: 1874785 - protein, 23 aa, Staphylococcus
GLLIPLFTGRLVDKFSTSTINWN

SEQ ID NO: 1874786 - protein, 17 aa, Staphylococcus
GLLKMFFYSAVGAGFLG

SEQ ID NO: 1874787 - protein, 25 aa, Staphylococcus
GLLLIIPALIGYFFGFFNFGLLIST

SEQ ID NO: 1874788 - protein, 19 aa, Staphylococcus
GLLLLFPIIVSYKEKLHII

SEQ ID NO: 1874789 - protein, 27 aa, Staphylococcus
GLLSGLVCATVLFIIIVVIYRQPFLAL

SEQ ID NO: 1874790 - protein, 18 aa, Staphylococcus
GLLSIAIILNAVFKDATK

SEQ ID NO: 1874791 - protein, 17 aa, Staphylococcus
GLLSIGLILAIWSASNG

SEQ ID NO: 1874792 - protein, 21 aa, Staphylococcus
GLLSIRLFLNLINRIKLIPFA

SEQ ID NO: 1874793 - protein, 18 aa, Staphylococcus
GLLSISVILNYIYKDATK

SEQ ID NO: 1874794 - protein, 19 aa, Staphylococcus
GLLSYCIAIYLIAADSNNL

SEQ ID NO: 1874795 - protein, 18 aa, Staphylococcus
GLLSYIIFVLLLSLIVGQ

SEQ ID NO: 1874796 - protein, 17 aa, Staphylococcus
GLLTIFIIMPIAGFVSD

SEQ ID NO: 1874797 - protein, 19 aa, Staphylococcus
GLLTVNLAHEFMKTFQHKY

SEQ ID NO: 1874798 - protein, 19 aa, Staphylococcus
GLLTVNLAHEFMKTYEHKY

SEQ ID NO: 1874799 - protein, 17 aa, Staphylococcus
GLLYLVRFLFGIGEAPM

SEQ ID NO: 1874800 - protein, 18 aa, Staphylococcus
GLMAWLITWYYRKRGYER

SEQ ID NO: 1874801 - protein, 18 aa, Staphylococcus
GLMFICFQKSPQQFIDIQ

SEQ ID NO: 1874802 - protein, 19 aa, Staphylococcus
GLMKPNISNIVGRLYPEND

SEQ ID NO: 1874803 - protein, 23 aa, Staphylococcus
GLMSCGLMMLFISFLGERISMVS

SEQ ID NO: 1874804 - protein, 29 aa, Staphylococcus
GLMYSAFNVKWGWLILRVLAVCFVWMTYF

SEQ ID NO: 1874805 - protein, 26 aa, Staphylococcus
GLNGRDGRDAQPYTPVIIVNNYIDAY

SEQ ID NO: 1874806 - protein, 19 aa, Staphylococcus
GLNQTMLWIGLVPLIGLVI

SEQ ID NO: 1874807 - protein, 22 aa, Staphylococcus
GLPAEGLALIIGVDRILDMVRT

SEQ ID NO: 1874808 - protein, 21 aa, Staphylococcus
GLPALIAAVALIYFSIAHAIL

SEQ ID NO: 1874809 - protein, 22 aa, Staphylococcus
GLPWNEAWEVAQQMAKKIVTNE

SEQ ID NO: 1874810 - protein, 17 aa, Staphylococcus
GLSAMWITIGLSLGAYV

SEQ ID NO: 1874811 - protein, 19 aa, Staphylococcus
GLSASKLTLTFGISKSFMK

SEQ ID NO: 1874812 - protein, 19 aa, Staphylococcus
GLSFPLSQVGGFRFSLVFW

SEQ ID NO: 1874813 - protein, 21 aa, Staphylococcus
GLSILNFFVVFGVLTTLIGLL

SEQ ID NO: 1874814 - protein, 24 aa, Staphylococcus
GLSIPEFVIMIALASFFHPSIWNL

SEQ ID NO: 1874815 - protein, 25 aa, Staphylococcus
GLSIPEFVIMIALASFFRPSIWNLV

SEQ ID NO: 1874816 - protein, 25 aa, Staphylococcus
GLSIPEFVLMIALASFFKPSIWNLV

SEQ ID NO: 1874817 - protein, 25 aa, Staphylococcus
GLSKWNVYRRIVFPQAFGYALPNIE

SEQ ID NO: 1874818 - protein, 25 aa, Staphylococcus
GLSLFIAATFHWTAGFSFSAGLIDY

SEQ ID NO: 1874819 - protein, 17 aa, Staphylococcus
GLSNREFAFVDYDPDKK

SEQ ID NO: 1874820 - protein, 54 aa, Staphylococcus
GLSSRPTITRYFVQRGGRVEYHFSVPVRDWNGDLSFNGKVLMFDNNVTLVGQGV

SEQ ID NO: 1874821 - protein, 22 aa, Staphylococcus
GLTAMFLIFTFLKEVKLYQHLY

SEQ ID NO: 1874822 - protein, 22 aa, Staphylococcus
GLTFPIVWSGLYVAMGIAYTVA

SEQ ID NO: 1874823 - protein, 20 aa, Staphylococcus
GLTQINWFAVIALSVGGMLA

SEQ ID NO: 1874824 - protein, 17 aa, Staphylococcus
GLTTYYYKNISYLCPNC

SEQ ID NO: 1874825 - protein, 17 aa, Staphylococcus
GLVCMAVGYLYTGGPLP

SEQ ID NO: 1874826 - protein, 19 aa, Staphylococcus
GLVDKTGVIGTFFFGFILR

SEQ ID NO: 1874827 - protein, 20 aa, Staphylococcus
GLVFFFSLGLFKYADAHVTI

SEQ ID NO: 1874828 - protein, 24 aa, Staphylococcus
GLVFSSAFILMFLAFDVQKVVKSL

SEQ ID NO: 1874829 - protein, 25 aa, Staphylococcus
GLVGFLWGMCLAGFVPISALVPSLV

SEQ ID NO: 1874830 - protein, 22 aa, Staphylococcus
GLVGGFFLARKYMMDYLKKNPP

SEQ ID NO: 1874831 - protein, 19 aa, Staphylococcus
GLVGKEYLEKWAGTPTEVH

SEQ ID NO: 1874832 - protein, 26 aa, Staphylococcus
GLVLHDFKLLPAFIAAYIISFGIKFI

SEQ ID NO: 1874833 - protein, 21 aa, Staphylococcus
GLVNFCRLVPILLLSVWAGSI

SEQ ID NO: 1874834 - protein, 25 aa, Staphylococcus
GLVNGIKSGLSWVVDAARNVAQSAV

SEQ ID NO: 1874835 - protein, 19 aa, Staphylococcus
GLVPIFILMCFPFTPNTVV

SEQ ID NO: 1874836 - protein, 18 aa, Staphylococcus
GLVTLIVRVVPFLMISRI

SEQ ID NO: 1874837 - protein, 24 aa, Staphylococcus
GLVYFLLCLGFKNMSFMYLFSETF

SEQ ID NO: 1874838 - protein, 18 aa, Staphylococcus
GLWFPVQTFPIWLQKISK

SEQ ID NO: 1874839 - protein, 17 aa, Staphylococcus
GLWSFLVTWGVLQSKKS

SEQ ID NO: 1874840 - protein, 27 aa, Staphylococcus
GLYFVLRYRIGGGITEHPHFLWFNLVH

SEQ ID NO: 1874841 - protein, 18 aa, Staphylococcus
GLYKYVMYFIVFLLAIFM

SEQ ID NO: 1874842 - protein, 26 aa, Staphylococcus
GLYLLFRFTPILSYASWVGYIVITVG

SEQ ID NO: 1874843 - protein, 30 aa, Staphylococcus
GLYPLDSPGGWQIIGRTPIRVFNKDDQPMT

SEQ ID NO: 1874844 - protein, 17 aa, Staphylococcus
GLYRFQGLRKYKEKYSP

SEQ ID NO: 1874845 - protein, 25 aa, Staphylococcus
GMASLPRILKFPALQQQIKEFDKYV

SEQ ID NO: 1874846 - protein, 20 aa, Staphylococcus
GMDLLPGFFAGYLIGYVMKY

SEQ ID NO: 1874847 - protein, 18 aa, Staphylococcus
GMESRFLLFYSSVILSCL

SEQ ID NO: 1874848 - protein, 23 aa, Staphylococcus
GMFLKRYEFTGIGLLFAQKTIDA

SEQ ID NO: 1874849 - protein, 18 aa, Staphylococcus
GMFPHGPFGFLMSFQIAV

SEQ ID NO: 1874850 - protein, 21 aa, Staphylococcus
GMGGLLLVVPFFSFVVLMALG

SEQ ID NO: 1874851 - protein, 19 aa, Staphylococcus
GMGKTSFLFNALKSDDIDG

SEQ ID NO: 1874852 - protein, 26 aa, Staphylococcus
GMGWIIPALIGFIIGLIVFKVRGSKQ

SEQ ID NO: 1874853 - protein, 22 aa, Staphylococcus
GMGWPPSGRVLVHWYSVSERGS

SEQ ID NO: 1874854 - protein, 23 aa, Staphylococcus
GMICAATCFLIIPFTHSIVAVMI

SEQ ID NO: 1874855 - protein, 24 aa, Staphylococcus
GMIFKFNRYKIWSVVALISGIIST

SEQ ID NO: 1874856 - protein, 22 aa, Staphylococcus
GMIVLLCFGLIFLSIFDRGLPK

SEQ ID NO: 1874857 - protein, 33 aa, Staphylococcus
GMKPGRRLSKVELPIAMPVIMAGIRTAMVLIIG

SEQ ID NO: 1874858 - protein, 19 aa, Staphylococcus
GMLIIKGRPILAGCLLIVA

SEQ ID NO: 1874859 - protein, 21 aa, Staphylococcus
GMLITRPYIGTSIDRIGSKKV

SEQ ID NO: 1874860 - protein, 19 aa, Staphylococcus
GMLLFNMHDGFWLKQLSSL

SEQ ID NO: 1874861 - protein, 17 aa, Staphylococcus
GMLPHARIAQSLRYISQ

SEQ ID NO: 1874862 - protein, 25 aa, Staphylococcus
GMLSKHGWSGIQFNSPFADMAILLN

SEQ ID NO: 1874863 - protein, 20 aa, Staphylococcus
GMLYAVRFLFGIGEAPMYPS

SEQ ID NO: 1874864 - protein, 20 aa, Staphylococcus
GMMAWLNIIAIWILHKPAIQ

SEQ ID NO: 1874865 - protein, 17 aa, Staphylococcus
GMMSGLIISGVDPLQAI

SEQ ID NO: 1874866 - protein, 18 aa, Staphylococcus
GMMTGLIIGGVLPLQAIK

SEQ ID NO: 1874867 - protein, 17 aa, Staphylococcus
GMRVGREILATSANTIY

SEQ ID NO: 1874868 - protein, 21 aa, Staphylococcus
GMSGLIGGPFVAIIVGIVSGL

SEQ ID NO: 1874869 - protein, 24 aa, Staphylococcus
GMSLALKYAFGWSPALSSLIINTL

SEQ ID NO: 1874870 - protein, 20 aa, Staphylococcus
GMSMGETFKTITIVQSIVGI

SEQ ID NO: 1874871 - protein, 18 aa, Staphylococcus
GMSMKEALLEAGGTRIRP

SEQ ID NO: 1874872 - protein, 18 aa, Staphylococcus
GMSYQSAKIFMVQQVLDA

SEQ ID NO: 1874873 - protein, 24 aa, Staphylococcus
GMTHINWLAVIALSVGGLIAAPIS

SEQ ID NO: 1874874 - protein, 17 aa, Staphylococcus
GMTPFYTALSIWVGALL

SEQ ID NO: 1874875 - protein, 17 aa, Staphylococcus
GMTPFYTALSIWVGGLL

SEQ ID NO: 1874876 - protein, 18 aa, Staphylococcus
GMTPFYTSLSIWVGALLL

SEQ ID NO: 1874877 - protein, 24 aa, Staphylococcus
GMVGESTFEFLLHPLFSSIGLSET

SEQ ID NO: 1874878 - protein, 19 aa, Staphylococcus
GMVRFIRQLVIYSFTSELI

SEQ ID NO: 1874879 - protein, 21 aa, Staphylococcus
GNACIFLPNAVNWSVIIDTAP

SEQ ID NO: 1874880 - protein, 20 aa, Staphylococcus
GNALTTIWVYAIIYFIGFVL

SEQ ID NO: 1874881 - protein, 20 aa, Staphylococcus
GNASFLMFMPVWISSIVASI

SEQ ID NO: 1874882 - protein, 24 aa, Staphylococcus
GNDEFRYYPNFFHQTGQGKTSDAE

SEQ ID NO: 1874883 - protein, 26 aa, Staphylococcus
GNEICQEWLYHMGVPINQIEDLAKTQ

SEQ ID NO: 1874884 - protein, 26 aa, Staphylococcus
GNEICQEWLYHMGVPTNQIKDLAQNQ

SEQ ID NO: 1874885 - protein, 20 aa, Staphylococcus
GNELAKFLASLMVVNGIISI

SEQ ID NO: 1874886 - protein, 17 aa, Staphylococcus
GNFSVNHYESFKNDLSN

SEQ ID NO: 1874887 - protein, 17 aa, Staphylococcus
GNGEVKEAFISQMMQED

SEQ ID NO: 1874888 - protein, 18 aa, Staphylococcus
GNHEFDFGLDQAVKYKDQ

SEQ ID NO: 1874889 - protein, 24 aa, Staphylococcus
GNILARLGLIIGAFILPWMMSVYV

SEQ ID NO: 1874890 - protein, 17 aa, Staphylococcus
GNILNKVNNSQDEIDEV

SEQ ID NO: 1874891 - protein, 18 aa, Staphylococcus
GNKKRSKTLISLVQNVVK

SEQ ID NO: 1874892 - protein, 18 aa, Staphylococcus
GNKKRSKTLVSLVQNVVK

SEQ ID NO: 1874893 - protein, 22 aa, Staphylococcus
GNKKRSRTLISLVQNVVSYIVW

SEQ ID NO: 1874894 - protein, 24 aa, Staphylococcus
GNKKTRIIQALSEMSPEVRSLIAE

SEQ ID NO: 1874895 - protein, 17 aa, Staphylococcus
GNLAVFILFGFYSVIGG

SEQ ID NO: 1874896 - protein, 17 aa, Staphylococcus
GNLAVLILFGFYSVIGG

SEQ ID NO: 1874897 - protein, 17 aa, Staphylococcus
GNLILGPIFNKRVPFHV

SEQ ID NO: 1874898 - protein, 23 aa, Staphylococcus
GNLKMQMLVGIFVFILSFFITSF

SEQ ID NO: 1874899 - protein, 21 aa, Staphylococcus
GNLKYQMLVGIVIFILSFFVT

SEQ ID NO: 1874900 - protein, 23 aa, Staphylococcus
GNMGGGVLDFLATNWIPLGKDHW

SEQ ID NO: 1874901 - protein, 24 aa, Staphylococcus
GNMGGGVLDFLATNWIPLGKEHWM

SEQ ID NO: 1874902 - protein, 38 aa, Staphylococcus
GNNENNRRGLIPAIAAMLAGLGFLKRKKKDNKENKDEE

SEQ ID NO: 1874903 - protein, 25 aa, Staphylococcus
GNNHWFILGCILIIYWIITFLNLKF

SEQ ID NO: 1874904 - protein, 25 aa, Staphylococcus
GNNLHYRSQLALNILVTVSNHYNRN

SEQ ID NO: 1874905 - protein, 20 aa, Staphylococcus
GNPAMAFFKQLHKGLEDYSN

SEQ ID NO: 1874906 - protein, 20 aa, Staphylococcus
GNPGKALAIILLVLQIAGGG

SEQ ID NO: 1874907 - protein, 19 aa, Staphylococcus
GNPLGLEFANSVTSGIISA

SEQ ID NO: 1874908 - protein, 23 aa, Staphylococcus
GNQAGGLAIIIGWIITAIGMISL

SEQ ID NO: 1874909 - protein, 21 aa, Staphylococcus
GNRFLNVLIFIGWMLLAQIPI

SEQ ID NO: 1874910 - protein, 27 aa, Staphylococcus
GNSHPYILVGYPMKAEPGSHTEYSGVF

SEQ ID NO: 1874911 - protein, 20 aa, Staphylococcus
GNSSLLFLVAVVFLFYYRKI

SEQ ID NO: 1874912 - protein, 23 aa, Staphylococcus
GNSVETKFIIKVVDTTAPTVKEI

SEQ ID NO: 1874913 - protein, 23 aa, Staphylococcus
GNSVETKFIIKVVDTTAPTVKGI

SEQ ID NO: 1874914 - protein, 30 aa, Staphylococcus
GNTMVYTDVKWCRMMIRQILSNSLKYSKNS

SEQ ID NO: 1874915 - protein, 26 aa, Staphylococcus
GNTQEIRIYWILGTVIAIICFSAHIL

SEQ ID NO: 1874916 - protein, 29 aa, Staphylococcus
GNTVTMLRQAGGFFPGSYVNSVTSNNIGQ

SEQ ID NO: 1874917 - protein, 19 aa, Staphylococcus
GNVCLRYYPFRSFNYEFNK

SEQ ID NO: 1874918 - protein, 17 aa, Staphylococcus
GNVDIIFQIGPGLFGVR

SEQ ID NO: 1874919 - protein, 24 aa, Staphylococcus
GNVISGAIPIMFVASAMNLLVNSR

SEQ ID NO: 1874920 - protein, 20 aa, Staphylococcus
GNYFWNVWSLVIALLLIVLV

SEQ ID NO: 1874921 - protein, 23 aa, Staphylococcus
GNYLTKIRTGAISGVATKYLARE

SEQ ID NO: 1874922 - protein, 29 aa, Staphylococcus
GNYLVEFVMPEGYIPTQANSTVDDKDSDV

SEQ ID NO: 1874923 - protein, 21 aa, Staphylococcus
GPAAMLAIEFGWFLTEVGRQP

SEQ ID NO: 1874924 - protein, 24 aa, Staphylococcus
GPAGPDLYLSIPWFAASVSTVAGA

SEQ ID NO: 1874925 - protein, 24 aa, Staphylococcus
GPASLLAIEFGWFLTEMGRQPWII

SEQ ID NO: 1874926 - protein, 21 aa, Staphylococcus
GPDLYLSIPWFAASISTVAGA

SEQ ID NO: 1874927 - protein, 24 aa, Staphylococcus
GPEKINMPNVIGIKKEEAIKKLKD

SEQ ID NO: 1874928 - protein, 18 aa, Staphylococcus
GPFGFLMAFQIAVYSFIG

SEQ ID NO: 1874929 - protein, 19 aa, Staphylococcus
GPFGFLMSFQIAVYSFIGI

SEQ ID NO: 1874930 - protein, 23 aa, Staphylococcus
GPFLRLYFITWMMHILLIGGSRL

SEQ ID NO: 1874931 - protein, 17 aa, Staphylococcus
GPGSFLPELLDQMYQID

SEQ ID NO: 1874932 - protein, 23 aa, Staphylococcus
GPILEEFVFRKVIFGEIYNLINA

SEQ ID NO: 1874933 - protein, 23 aa, Staphylococcus
GPILEEFVFRKVLFGELYNAIKG

SEQ ID NO: 1874934 - protein, 17 aa, Staphylococcus
GPILVKLTNRFAVRPVL

SEQ ID NO: 1874935 - protein, 18 aa, Staphylococcus
GPIPISWTPLGELFSGIF

SEQ ID NO: 1874936 - protein, 20 aa, Staphylococcus
GPKDFIFRVLSGVAIGIVAG

SEQ ID NO: 1874937 - protein, 17 aa, Staphylococcus
GPLGLDKQVEWVFDLVR

SEQ ID NO: 1874938 - protein, 25 aa, Staphylococcus
GPLGLDSQVKWIFSLIRVVLPLIII

SEQ ID NO: 1874939 - protein, 23 aa, Staphylococcus
GPLKRKIKGNVLNKVNNSENEIK

SEQ ID NO: 1874940 - protein, 18 aa, Staphylococcus
GPLPISWTPFGELFSGVF

SEQ ID NO: 1874941 - protein, 19 aa, Staphylococcus
GPLQIRWYGIIIACGILLG

SEQ ID NO: 1874942 - protein, 17 aa, Staphylococcus
GPLSGIVNIHLNRNVTV

SEQ ID NO: 1874943 - protein, 26 aa, Staphylococcus
GPMIILPLFFQRFQHFNAIETAIMLM

SEQ ID NO: 1874944 - protein, 17 aa, Staphylococcus
GPMPIVLMSLIKSLFHQ

SEQ ID NO: 1874945 - protein, 18 aa, Staphylococcus
GPMPIVLMSLVKSIFNSH

SEQ ID NO: 1874946 - protein, 18 aa, Staphylococcus
GPSSTFFIVTFALPINMP

SEQ ID NO: 1874947 - protein, 23 aa, Staphylococcus
GPVANFAAAVSFLLTAFYVSKLI

SEQ ID NO: 1874948 - protein, 18 aa, Staphylococcus
GPVLFGFFGHSSIAIDED

SEQ ID NO: 1874949 - protein, 18 aa, Staphylococcus
GPYTFFLVFHIILSTVGG

SEQ ID NO: 1874950 - protein, 21 aa, Staphylococcus
GQAGGLAIIIGWVITAIGMIS

SEQ ID NO: 1874951 - protein, 22 aa, Staphylococcus
GQAGGLAIMIGWIITAIGMISL

SEQ ID NO: 1874952 - protein, 18 aa, Staphylococcus
GQDGHSIGIQEITKNAQG

SEQ ID NO: 1874953 - protein, 17 aa, Staphylococcus
GQDGTSIGIRTITPQTN

SEQ ID NO: 1874954 - protein, 27 aa, Staphylococcus
GQEFYLRKIWVAVKFLVVYLYQLITSS

SEQ ID NO: 1874955 - protein, 19 aa, Staphylococcus
GQEHLHSFMYPSLKEVMTI

SEQ ID NO: 1874956 - protein, 19 aa, Staphylococcus
GQEPARYVITAKPDRVHNK

SEQ ID NO: 1874957 - protein, 21 aa, Staphylococcus
GQEVMQFFTPFGLWSYIGVLI

SEQ ID NO: 1874958 - protein, 21 aa, Staphylococcus
GQEVMQFFTPYGLWSYIGVLI

SEQ ID NO: 1874959 - protein, 21 aa, Staphylococcus
GQEVMQFFTPYGLWSYIGVLL

SEQ ID NO: 1874960 - protein, 21 aa, Staphylococcus
GQEVMQFFTPYGLWSYIGVVL

SEQ ID NO: 1874961 - protein, 20 aa, Staphylococcus
GQFGRIRMVLQGAIAGFLDA

SEQ ID NO: 1874962 - protein, 22 aa, Staphylococcus
GQHFLLRYIDWVGHALTGNLGY

SEQ ID NO: 1874963 - protein, 19 aa, Staphylococcus
GQIGIGMGIGTGFIISSLF

SEQ ID NO: 1874964 - protein, 21 aa, Staphylococcus
GQILTFKAFEYIGSSRAMPVT

SEQ ID NO: 1874965 - protein, 20 aa, Staphylococcus
GQIPFIRLNNVSFKYNTEMG

SEQ ID NO: 1874966 - protein, 18 aa, Staphylococcus
GQIPGVLALFILTICIIG

SEQ ID NO: 1874967 - protein, 17 aa, Staphylococcus
GQIPGVLALFILTICVI

SEQ ID NO: 1874968 - protein, 18 aa, Staphylococcus
GQIPGVLALFILTICVIA

SEQ ID NO: 1874969 - protein, 19 aa, Staphylococcus
GQIPGVLALFILTICVIAK

SEQ ID NO: 1874970 - protein, 24 aa, Staphylococcus
GQITADTGIKTDLQNQANDKKQQI

SEQ ID NO: 1874971 - protein, 24 aa, Staphylococcus
GQKSTRFTIMVGIDLILIVLLVVT

SEQ ID NO: 1874972 - protein, 23 aa, Staphylococcus
GQKTTRFAIMVGIDAILIVLILV

SEQ ID NO: 1874973 - protein, 22 aa, Staphylococcus
GQKVCTQCGTPVDQHQHPSRAS

SEQ ID NO: 1874974 - protein, 21 aa, Staphylococcus
GQKVRQGERLISYDTNTSKRQ

SEQ ID NO: 1874975 - protein, 19 aa, Staphylococcus
GQLILALQHYKIFDADVTD

SEQ ID NO: 1874976 - protein, 21 aa, Staphylococcus
GQLKPGFTMEFKDRDDGYKAV

SEQ ID NO: 1874977 - protein, 17 aa, Staphylococcus
GQLLGLILGPLCFALIL

SEQ ID NO: 1874978 - protein, 20 aa, Staphylococcus
GQLLIALVILIGFSLLLSNV

SEQ ID NO: 1874979 - protein, 28 aa, Staphylococcus
GQLLYQYNINKTWYPASMTKLMTMYLTL

SEQ ID NO: 1874980 - protein, 17 aa, Staphylococcus
GQLPIYVYFVDIILTVL

SEQ ID NO: 1874981 - protein, 21 aa, Staphylococcus
GQLPPEQFIGQDWQYTGHKIE

SEQ ID NO: 1874982 - protein, 25 aa, Staphylococcus
GQLTDRGPIIEGFKGDKKQEIVHAL

SEQ ID NO: 1874983 - protein, 28 aa, Staphylococcus
GQLTLFFWFFKLHYSFGHIINSKIFAQE

SEQ ID NO: 1874984 - protein, 28 aa, Staphylococcus
GQLTLFFWFFKLNYSFGHIINSKIFAQE

SEQ ID NO: 1874985 - protein, 25 aa, Staphylococcus
GQLTLNYMVSFNFTAIVVFLIGEAG

SEQ ID NO: 1874986 - protein, 19 aa, Staphylococcus
GQMPKIFTRVMKNGVPFYP

SEQ ID NO: 1874987 - protein, 22 aa, Staphylococcus
GQMRRIELCRLLVMNPDLVIFD

SEQ ID NO: 1874988 - protein, 26 aa, Staphylococcus
GQMRRIELCRVLLLRPSILIFDEPTT

SEQ ID NO: 1874989 - protein, 18 aa, Staphylococcus
GQMSIWNFLFLRRSLPLT

SEQ ID NO: 1874990 - protein, 19 aa, Staphylococcus
GQMSIWNFLFLRRSLPLTK

SEQ ID NO: 1874991 - protein, 23 aa, Staphylococcus
GQNGRDGASITITRTETDAAGNT

SEQ ID NO: 1874992 - protein, 18 aa, Staphylococcus
GQNGTSIGIRTITPQANG

SEQ ID NO: 1874993 - protein, 23 aa, Staphylococcus
GQNLDFEAVDALKDAISETKDAL

SEQ ID NO: 1874994 - protein, 24 aa, Staphylococcus
GQNYSVLIPLTFIIGADLLLLSDV

SEQ ID NO: 1874995 - protein, 21 aa, Staphylococcus
GQSFSINWSGFVSLLLLLIFY

SEQ ID NO: 1874996 - protein, 20 aa, Staphylococcus
GQSPFAFSLIFASIGVTLII

SEQ ID NO: 1874997 - protein, 23 aa, Staphylococcus
GQVGAALALWVRCKNNTTLRTAI

SEQ ID NO: 1874998 - protein, 22 aa, Staphylococcus
GQVSRRSFLKMLGIGGAGVVIG

SEQ ID NO: 1874999 - protein, 19 aa, Staphylococcus
GQYFWPSILAFALTGIGLP

SEQ ID NO: 1875000 - protein, 26 aa, Staphylococcus
GQYLPVEWRRPLSITLFVIVLATLFI

SEQ ID NO: 1875001 - protein, 22 aa, Staphylococcus
GRAAEKGILFKGGQYVEQAQHI

SEQ ID NO: 1875002 - protein, 20 aa, Staphylococcus
GRAGLDGRDGRDGKNGSDGK

SEQ ID NO: 1875003 - protein, 17 aa, Staphylococcus
GRALFSDSLATIVGAIF

SEQ ID NO: 1875004 - protein, 21 aa, Staphylococcus
GRALKHGWVIWANVLLTIIVL

SEQ ID NO: 1875005 - protein, 24 aa, Staphylococcus
GRAQEILAPLAPMFQQVWSQIVAI

SEQ ID NO: 1875006 - protein, 19 aa, Staphylococcus
GRDDFIGNIALEIVSRSLY

SEQ ID NO: 1875007 - protein, 18 aa, Staphylococcus
GRGVKWLSNLNIILGALL

SEQ ID NO: 1875008 - protein, 26 aa, Staphylococcus
GRIDRFKIAFDMFKDSPIYGKGIDSF

SEQ ID NO: 1875009 - protein, 18 aa, Staphylococcus
GRIHPGRIEEMVDKARKE

SEQ ID NO: 1875010 - protein, 25 aa, Staphylococcus
GRISFESPMLFSLAFIPTFTIGGVT

SEQ ID NO: 1875011 - protein, 26 aa, Staphylococcus
GRITFESPMLFSLAFIPNFLLGGVTG

SEQ ID NO: 1875012 - protein, 30 aa, Staphylococcus
GRKAQEAYLSYRLEQEYSKDDIFQMYLNKI

SEQ ID NO: 1875013 - protein, 20 aa, Staphylococcus
GRKKPLLIAMVIFTLASLGI

SEQ ID NO: 1875014 - protein, 17 aa, Staphylococcus
GRKTLPILLGKNNSIRF

SEQ ID NO: 1875015 - protein, 20 aa, Staphylococcus
GRLGSLEMILLPVIIPVVSG

SEQ ID NO: 1875016 - protein, 18 aa, Staphylococcus
GRLGTKRVLTLALLTCVV

SEQ ID NO: 1875017 - protein, 23 aa, Staphylococcus
GRLIEYFTLLFLFCIVVIMISGT

SEQ ID NO: 1875018 - protein, 21 aa, Staphylococcus
GRLKVTTSHKFRDKNGKYNAL

SEQ ID NO: 1875019 - protein, 24 aa, Staphylococcus
GRLNPSGFVKIVWGVMLSAIAYVL

SEQ ID NO: 1875020 - protein, 21 aa, Staphylococcus
GRLSDKFSRINIYSIGLIVFL

SEQ ID NO: 1875021 - protein, 27 aa, Staphylococcus
GRLTMLSLFAIIGMIAWIILAHNLWES

SEQ ID NO: 1875022 - protein, 20 aa, Staphylococcus
GRNGTSVGIRTITPQANGDT

SEQ ID NO: 1875023 - protein, 26 aa, Staphylococcus
GRPDVKGREAILYVHARNKPLDETVD

SEQ ID NO: 1875024 - protein, 20 aa, Staphylococcus
GRPILAGCLLIVAALVGIFN

SEQ ID NO: 1875025 - protein, 21 aa, Staphylococcus
GRQGTELISGITPPTDSDGLN

SEQ ID NO: 1875026 - protein, 18 aa, Staphylococcus
GRSGIVAIIRDMTNEHNL

SEQ ID NO: 1875027 - protein, 19 aa, Staphylococcus
GRSIREFISGVLLVPAIVS

SEQ ID NO: 1875028 - protein, 29 aa, Staphylococcus
GRSIREFISGVLLVPAIVSFIWFSVFGVL

SEQ ID NO: 1875029 - protein, 29 aa, Staphylococcus
GRSIREFISGVLLVPAIVSFLWFSVFGVL

SEQ ID NO: 1875030 - protein, 19 aa, Staphylococcus
GRSIREFISGVLLVPALIS

SEQ ID NO: 1875031 - protein, 29 aa, Staphylococcus
GRSIREFMSGVLLVPAIVSFIWFSVFGVL

SEQ ID NO: 1875032 - protein, 25 aa, Staphylococcus
GRSRSDGFNPMRIILAGAAVSALLT

SEQ ID NO: 1875033 - protein, 34 aa, Staphylococcus
GRTIKEFILGVLFVPALVCFFFFAVFGASAIYLQ

SEQ ID NO: 1875034 - protein, 31 aa, Staphylococcus
GRTIKEFILGVLFVPALVCFFFFAVFGASAV

SEQ ID NO: 1875035 - protein, 31 aa, Staphylococcus
GRTIKEFILGVLFVPALVCFIFFAVFGASAM

SEQ ID NO: 1875036 - protein, 31 aa, Staphylococcus
GRTIKEFILGVLFVPALVCFLFFAVFGASAI

SEQ ID NO: 1875037 - protein, 24 aa, Staphylococcus
GRTIKEFILGVLFVPAVVCFLFFA

SEQ ID NO: 1875038 - protein, 20 aa, Staphylococcus
GRTIREIFLLVSIVAAVVSH

SEQ ID NO: 1875039 - protein, 19 aa, Staphylococcus
GRTPGTYTVPATVTYPDGT

SEQ ID NO: 1875040 - protein, 24 aa, Staphylococcus
GRTRPTSFIIPGFFAIGVSVIVGF

SEQ ID NO: 1875041 - protein, 23 aa, Staphylococcus
GRTRPTSFIIPGFFVIIVSVVIG

SEQ ID NO: 1875042 - protein, 20 aa, Staphylococcus
GRVALGIIIFAIFVYYILFT

SEQ ID NO: 1875043 - protein, 22 aa, Staphylococcus
GRVPAIIALVVYALLPILRNTY

SEQ ID NO: 1875044 - protein, 17 aa, Staphylococcus
GSAGGIFLTIAITLFAF

SEQ ID NO: 1875045 - protein, 18 aa, Staphylococcus
GSAGGIFLTIAITLFAFS

SEQ ID NO: 1875046 - protein, 24 aa, Staphylococcus
GSAIREFLKPYGVSMLTSPFVIMT

SEQ ID NO: 1875047 - protein, 21 aa, Staphylococcus
GSALAGFGMLRVMFGVAEGPI

SEQ ID NO: 1875048 - protein, 22 aa, Staphylococcus
GSALGGIILLKFINTNMLIYSA

SEQ ID NO: 1875049 - protein, 19 aa, Staphylococcus
GSARVIVRMFGFDPDAQSD

SEQ ID NO: 1875050 - protein, 24 aa, Staphylococcus
GSASAKWAILAPILVPMLMLLGYH

SEQ ID NO: 1875051 - protein, 25 aa, Staphylococcus
GSASAKWGILAPIFVPMMILLGYHP

SEQ ID NO: 1875052 - protein, 25 aa, Staphylococcus
GSASAKWGILAPIFVPMMLLIGFHP

SEQ ID NO: 1875053 - protein, 25 aa, Staphylococcus
GSASAKWGILASIFIPMLMLVGFHP

SEQ ID NO: 1875054 - protein, 22 aa, Staphylococcus
GSDPKYGIWALVIGTLKITVIA

SEQ ID NO: 1875055 - protein, 19 aa, Staphylococcus
GSDQIKVYRTEIEMEQDLN

SEQ ID NO: 1875056 - protein, 18 aa, Staphylococcus
GSDVKQAFEHSLSSTTDI

SEQ ID NO: 1875057 - protein, 21 aa, Staphylococcus
GSEAMKSHVSNQIKDKQEQMA

SEQ ID NO: 1875058 - protein, 18 aa, Staphylococcus
GSFANRLATAAKEKQAKL

SEQ ID NO: 1875059 - protein, 18 aa, Staphylococcus
GSFGVLHYQGFTKIIIVL

SEQ ID NO: 1875060 - protein, 28 aa, Staphylococcus
GSFIAKHKWWAIVAWVVLIAAVLTPIAI

SEQ ID NO: 1875061 - protein, 24 aa, Staphylococcus
GSFLKRYTNTYSRDEEKLIQSVSK

SEQ ID NO: 1875062 - protein, 23 aa, Staphylococcus
GSFMCIPLAWVIGLHHVAIKPLM

SEQ ID NO: 1875063 - protein, 22 aa, Staphylococcus
GSFQSVIPWERIFNQFQHIAQA

SEQ ID NO: 1875064 - protein, 28 aa, Staphylococcus
GSFVAKHKWWSVVAWVIILAAIIIPLTV

SEQ ID NO: 1875065 - protein, 20 aa, Staphylococcus
GSGAFPIGVLQIMTRMYERL

SEQ ID NO: 1875066 - protein, 27 aa, Staphylococcus
GSGFLSGLVCALLLFIIIMVLYGQAIL

SEQ ID NO: 1875067 - protein, 29 aa, Staphylococcus
GSGFLSGLVCSVVLFLIIVVIYRQPLLAL

SEQ ID NO: 1875068 - protein, 21 aa, Staphylococcus
GSGIMLFIMVIYWFIALSEFK

SEQ ID NO: 1875069 - protein, 24 aa, Staphylococcus
GSGKSVCINGIIASILLNAKPHEV

SEQ ID NO: 1875070 - protein, 23 aa, Staphylococcus
GSGKSVCINGIITSILLNAKPHE

SEQ ID NO: 1875071 - protein, 20 aa, Staphylococcus
GSGLAIFLGLSFIWVPIFSI

SEQ ID NO: 1875072 - protein, 22 aa, Staphylococcus
GSGLALFLGLSFLWIPFFSIGF

SEQ ID NO: 1875073 - protein, 21 aa, Staphylococcus
GSGLALFLGLSFLWVPFFSIA

SEQ ID NO: 1875074 - protein, 22 aa, Staphylococcus
GSGLAVVIGVSFIWLPIFSVLF

SEQ ID NO: 1875075 - protein, 18 aa, Staphylococcus
GSGLFLILPGVKKGGYLG

SEQ ID NO: 1875076 - protein, 20 aa, Staphylococcus
GSGLMKPSISNIVGRLYPEN

SEQ ID NO: 1875077 - protein, 26 aa, Staphylococcus
GSGVVYKKVDGAIYIMTNAHVVGNEK

SEQ ID NO: 1875078 - protein, 20 aa, Staphylococcus
GSHFLAKITGAGCLLGAVVG

SEQ ID NO: 1875079 - protein, 19 aa, Staphylococcus
GSIALWIISLVAIILSLVA

SEQ ID NO: 1875080 - protein, 19 aa, Staphylococcus
GSIALWIVSIIAIILSLVA

SEQ ID NO: 1875081 - protein, 18 aa, Staphylococcus
GSIFEFMELKFIKEDTSQ

SEQ ID NO: 1875082 - protein, 19 aa, Staphylococcus
GSIFPLLSPILGWIGVFLT

SEQ ID NO: 1875083 - protein, 23 aa, Staphylococcus
GSIGCAISMLFLSKIIDKNSTGF

SEQ ID NO: 1875084 - protein, 17 aa, Staphylococcus
GSIIMLFIMDWQMTLLT

SEQ ID NO: 1875085 - protein, 19 aa, Staphylococcus
GSIIPNYVMGLSFITEGAI

SEQ ID NO: 1875086 - protein, 23 aa, Staphylococcus
GSILGAYLLRLGRFRSSIAKGMT

SEQ ID NO: 1875087 - protein, 24 aa, Staphylococcus
GSILGSMLLKFGGFQTSIAKGLTY

SEQ ID NO: 1875088 - protein, 23 aa, Staphylococcus
GSIMCIPLAWVLGFSNLAIKPLM

SEQ ID NO: 1875089 - protein, 25 aa, Staphylococcus
GSIPTRSRYAFIMTMCGIHGTISLS

SEQ ID NO: 1875090 - protein, 19 aa, Staphylococcus
GSIVPNFVMGASFITEGAI

SEQ ID NO: 1875091 - protein, 18 aa, Staphylococcus
GSIVPNYVMGASFITEGA

SEQ ID NO: 1875092 - protein, 23 aa, Staphylococcus
GSKAALVLFMWLPKAYAVLNTEL

SEQ ID NO: 1875093 - protein, 17 aa, Staphylococcus
GSKEFKGINLIHYPYDF

SEQ ID NO: 1875094 - protein, 17 aa, Staphylococcus
GSKILGSIMPIVLVVGV

SEQ ID NO: 1875095 - protein, 18 aa, Staphylococcus
GSKLLPILIFIVIIIHIL

SEQ ID NO: 1875096 - protein, 38 aa, Staphylococcus
GSKMGWLSIFIICLICFCIMMAIVFYYFERKYTHPLID

SEQ ID NO: 1875097 - protein, 19 aa, Staphylococcus
GSKSTRFTVMVGIDAILIV

SEQ ID NO: 1875098 - protein, 19 aa, Staphylococcus
GSLDVIKPIIIAIIITIAI

SEQ ID NO: 1875099 - protein, 24 aa, Staphylococcus
GSLFKRYTNTYSRDEEKLIEAVSK

SEQ ID NO: 1875100 - protein, 17 aa, Staphylococcus
GSLIMLFIMDWQMTLLT

SEQ ID NO: 1875101 - protein, 21 aa, Staphylococcus
GSLITMFTVLLFKKNTPVAVL

SEQ ID NO: 1875102 - protein, 24 aa, Staphylococcus
GSLLCIPMAWVLGMQDFFVKPLMI

SEQ ID NO: 1875103 - protein, 17 aa, Staphylococcus
GSLLDRAEQMRKLSGNS

SEQ ID NO: 1875104 - protein, 21 aa, Staphylococcus
GSLLKKPAFIIPMLLQGLTYV

SEQ ID NO: 1875105 - protein, 20 aa, Staphylococcus
GSLLSRYLTLDSFNLYFGIF

SEQ ID NO: 1875106 - protein, 20 aa, Staphylococcus
GSLQTWLLIIIFHIILPAVI

SEQ ID NO: 1875107 - protein, 18 aa, Staphylococcus
GSLVAIFVYLWKTNDGFR

SEQ ID NO: 1875108 - protein, 32 aa, Staphylococcus
GSLVASVLLFFAFRTSNNFKIQHRIIASFGQM

SEQ ID NO: 1875109 - protein, 18 aa, Staphylococcus
GSMFPFAFLAQLISAGTL

SEQ ID NO: 1875110 - protein, 32 aa, Staphylococcus
GSMITSVLLFYAFRTSKNFAIQHRIIASVGQM

SEQ ID NO: 1875111 - protein, 23 aa, Staphylococcus
GSNYFRFQYFNPLNASKYYENLD

SEQ ID NO: 1875112 - protein, 19 aa, Staphylococcus
GSPFVKVFALVGIPFAAGM

SEQ ID NO: 1875113 - protein, 29 aa, Staphylococcus
GSQVGPGAYAFDLRQAYTDANGKEHKYSA

SEQ ID NO: 1875114 - protein, 25 aa, Staphylococcus
GSRFVSCLLMLFFGSFIFNLLGQNA

SEQ ID NO: 1875115 - protein, 19 aa, Staphylococcus
GSRILRKEIANFLNKEGIK

SEQ ID NO: 1875116 - protein, 19 aa, Staphylococcus
GSRILRKEIQRVFVQEGIK

SEQ ID NO: 1875117 - protein, 22 aa, Staphylococcus
GSRIPKGVLLVGPPGTGKTLLA

SEQ ID NO: 1875118 - protein, 33 aa, Staphylococcus
GSRKRLEFYRLYLFMVHLLKFGGMYASSVNRSM

SEQ ID NO: 1875119 - protein, 31 aa, Staphylococcus
GSRSDFMLDVLILFIYFCYRNQIAERTHTKK

SEQ ID NO: 1875120 - protein, 20 aa, Staphylococcus
GSSILINRPAIATGDTLQAL

SEQ ID NO: 1875121 - protein, 17 aa, Staphylococcus
GSSKLDYIHLDYKDEPK

SEQ ID NO: 1875122 - protein, 25 aa, Staphylococcus
GSSLWSLMCGIGVLLSIYYHQPKQY

SEQ ID NO: 1875123 - protein, 19 aa, Staphylococcus
GSSLYLLATRSFRLQLNQH

SEQ ID NO: 1875124 - protein, 18 aa, Staphylococcus
GSSMPAMLLFAGIMMLLG

SEQ ID NO: 1875125 - protein, 23 aa, Staphylococcus
GSSPFEFIPYLYAGFFIVFVYFK

SEQ ID NO: 1875126 - protein, 18 aa, Staphylococcus
GSSQKFATGLMLKQLESE

SEQ ID NO: 1875127 - protein, 17 aa, Staphylococcus
GSSQKFTTGLILKQLEV

SEQ ID NO: 1875128 - protein, 20 aa, Staphylococcus
GSSRIVFIILTFISLFVLLG

SEQ ID NO: 1875129 - protein, 23 aa, Staphylococcus
GSSVKGATLLTGYQNHTIKVGEE

SEQ ID NO: 1875130 - protein, 23 aa, Staphylococcus
GSSVKGGTLLAGYQNGAIHVGEE

SEQ ID NO: 1875131 - protein, 24 aa, Staphylococcus
GSSVKGGTLLAGYQNHAIKVGETM

SEQ ID NO: 1875132 - protein, 24 aa, Staphylococcus
GSSVKGGTLLAGYQNNAIKVGEQM

SEQ ID NO: 1875133 - protein, 20 aa, Staphylococcus
GSTDGEWLINDITIINSETH

SEQ ID NO: 1875134 - protein, 24 aa, Staphylococcus
GSTIALCLILFMALVLIITNTKST

SEQ ID NO: 1875135 - protein, 49 aa, Staphylococcus
GSVFLPFLLSGFLFYICLPFQTLLEKWGFPRWASILTIFIVLIAIIAIV

SEQ ID NO: 1875136 - protein, 26 aa, Staphylococcus
GSVNFAEDWAFWGIKYGLFIQSIIDF

SEQ ID NO: 1875137 - protein, 18 aa, Staphylococcus
GSVSDVRINSGSYITSNV

SEQ ID NO: 1875138 - protein, 24 aa, Staphylococcus
GSVSEGIVSGLNRHVPVDIDKDNQ

SEQ ID NO: 1875139 - protein, 18 aa, Staphylococcus
GSVSKGIISGLDRHVPVD

SEQ ID NO: 1875140 - protein, 19 aa, Staphylococcus
GSVVIKLALNYALIMLLHT

SEQ ID NO: 1875141 - protein, 30 aa, Staphylococcus
GSVYLFLGLAIFCFVLYIAFGKYGNVTLGR

SEQ ID NO: 1875142 - protein, 19 aa, Staphylococcus
GSVYSTGLSAIWITIGLTL

SEQ ID NO: 1875143 - protein, 18 aa, Staphylococcus
GSVYSTGLSAMWITIGLS

SEQ ID NO: 1875144 - protein, 19 aa, Staphylococcus
GSVYSTGLSTIWITIGLTI

SEQ ID NO: 1875145 - protein, 20 aa, Staphylococcus
GSWAGIKGSFGLDQILGAFM

SEQ ID NO: 1875146 - protein, 17 aa, Staphylococcus
GSWRMLVIYFVSGLFGN

SEQ ID NO: 1875147 - protein, 17 aa, Staphylococcus
GSYFIIAVALVYVYFKS

SEQ ID NO: 1875148 - protein, 24 aa, Staphylococcus
GSYKQFEHYSGYGIRSLMNNRLNH

SEQ ID NO: 1875149 - protein, 19 aa, Staphylococcus
GSYLIIGAGLAFVYVKSGM

SEQ ID NO: 1875150 - protein, 17 aa, Staphylococcus
GTAILCLGILFIGVNKI

SEQ ID NO: 1875151 - protein, 27 aa, Staphylococcus
GTAISLFITVILGFFIARTITKPITDM

SEQ ID NO: 1875152 - protein, 24 aa, Staphylococcus
GTALENIGKITFDYTNGKVENVHD

SEQ ID NO: 1875153 - protein, 17 aa, Staphylococcus
GTAMPWTIPPIISGFLA

SEQ ID NO: 1875154 - protein, 19 aa, Staphylococcus
GTCYEVLKMIGYPEIILTQ

SEQ ID NO: 1875155 - protein, 23 aa, Staphylococcus
GTFAAILMSLWVIFGLGLDIENM

SEQ ID NO: 1875156 - protein, 27 aa, Staphylococcus
GTFIAKHKWLSIIIWLVVLGVVIAPLL

SEQ ID NO: 1875157 - protein, 27 aa, Staphylococcus
GTFIAKNKWLSVIAWIILLLMIVVPLM

SEQ ID NO: 1875158 - protein, 28 aa, Staphylococcus
GTFRLTEDILKRFNIEFTTVDATQAENI

SEQ ID NO: 1875159 - protein, 18 aa, Staphylococcus
GTFSAYGSAYGHGVSGVN

SEQ ID NO: 1875160 - protein, 18 aa, Staphylococcus
GTGLPIVLGCTFTAVAPM

SEQ ID NO: 1875161 - protein, 24 aa, Staphylococcus
GTGRAAEEGILFKGGEYVERTHQI

SEQ ID NO: 1875162 - protein, 27 aa, Staphylococcus
GTHQPRYIIGDKWRYSGVTVTENGITK

SEQ ID NO: 1875163 - protein, 18 aa, Staphylococcus
GTIFLMFLGFGLYGLSRI

SEQ ID NO: 1875164 - protein, 24 aa, Staphylococcus
GTIFPDNWTIIAGLIFALLFFYLI

SEQ ID NO: 1875165 - protein, 25 aa, Staphylococcus
GTILNIILVLGFLVNLVLAFILIFL

SEQ ID NO: 1875166 - protein, 24 aa, Staphylococcus
GTINLLGAIAFSLALVLIVLTHSE

SEQ ID NO: 1875167 - protein, 23 aa, Staphylococcus
GTITVPIPLLFGLLLLIVTVIAY

SEQ ID NO: 1875168 - protein, 27 aa, Staphylococcus
GTLAHRFGRKRILSISLLILMITSLGA

SEQ ID NO: 1875169 - protein, 17 aa, Staphylococcus
GTLENYSSYIILNPKKD

SEQ ID NO: 1875170 - protein, 19 aa, Staphylococcus
GTLENYSSYIILNPKKDYG

SEQ ID NO: 1875171 - protein, 20 aa, Staphylococcus
GTLFGSLFAALGGLFLVGRR

SEQ ID NO: 1875172 - protein, 18 aa, Staphylococcus
GTLGHIALIFGLGAILGK

SEQ ID NO: 1875173 - protein, 23 aa, Staphylococcus
GTLKFNYFFSRSVCDHCNQNVKP

SEQ ID NO: 1875174 - protein, 24 aa, Staphylococcus
GTLKIRVSRLVKDTTLSKIIHMVE

SEQ ID NO: 1875175 - protein, 17 aa, Staphylococcus
GTLKITFIGTLVAVPIG

SEQ ID NO: 1875176 - protein, 19 aa, Staphylococcus
GTLKVTFIATIFAVPVGLG

SEQ ID NO: 1875177 - protein, 18 aa, Staphylococcus
GTLLWVVLGKHIGIRERQ

SEQ ID NO: 1875178 - protein, 19 aa, Staphylococcus
GTLPTIFFTHIRYRTLAIT

SEQ ID NO: 1875179 - protein, 18 aa, Staphylococcus
GTLQYRFEAMRQSLKQVD

SEQ ID NO: 1875180 - protein, 18 aa, Staphylococcus
GTLYEINGGLIFIGTVVS

SEQ ID NO: 1875181 - protein, 23 aa, Staphylococcus
GTMPGTLPTLFFSNVRYRTLSWT

SEQ ID NO: 1875182 - protein, 25 aa, Staphylococcus
GTMVRPYQVGLRYVDAETNNGGVKR

SEQ ID NO: 1875183 - protein, 18 aa, Staphylococcus
GTPFFSISGSDFVEMFVG

SEQ ID NO: 1875184 - protein, 18 aa, Staphylococcus
GTPGRNGTSVGIRTITPQ

SEQ ID NO: 1875185 - protein, 17 aa, Staphylococcus
GTPMASWFMSNNFFTHV

SEQ ID NO: 1875186 - protein, 18 aa, Staphylococcus
GTPMLVQVFIVFFGTTAL

SEQ ID NO: 1875187 - protein, 26 aa, Staphylococcus
GTQLSPLPTHIEWRDKNGNVVSKTDD

SEQ ID NO: 1875188 - protein, 18 aa, Staphylococcus
GTRDIRRLGGMRHHFPKM

SEQ ID NO: 1875189 - protein, 22 aa, Staphylococcus
GTRDIRRLSGMRKFFPKMNLVM

SEQ ID NO: 1875190 - protein, 30 aa, Staphylococcus
GTSYHAGLVGKEFIEKWAGVPTEVHVSSEF

SEQ ID NO: 1875191 - protein, 31 aa, Staphylococcus
GTSYHAGLVGKEFLEKWSGVPTEVHVASEFV

SEQ ID NO: 1875192 - protein, 17 aa, Staphylococcus
GTTELSRLVARKNHYNF

SEQ ID NO: 1875193 - protein, 19 aa, Staphylococcus
GTTVLGIISLFAWGLGYFG

SEQ ID NO: 1875194 - protein, 18 aa, Staphylococcus
GTTVLGIISLFSWGLGYF

SEQ ID NO: 1875195 - protein, 26 aa, Staphylococcus
GTTWIQLKWSAPIIIVTVILIILLSK

SEQ ID NO: 1875196 - protein, 19 aa, Staphylococcus
GTVGRGYQKVLSWSLNHKW

SEQ ID NO: 1875197 - protein, 20 aa, Staphylococcus
GTVILFSFLIGMWLGHPIER

SEQ ID NO: 1875198 - protein, 19 aa, Staphylococcus
GTVILLSFLIGIWLGHPIE

SEQ ID NO: 1875199 - protein, 20 aa, Staphylococcus
GTVILLSFLVGIWLGHPIET

SEQ ID NO: 1875200 - protein, 19 aa, Staphylococcus
GTVKLILDIVKTIFVIELV

SEQ ID NO: 1875201 - protein, 22 aa, Staphylococcus
GTVKLILDIVRTILIIEVVGAA

SEQ ID NO: 1875202 - protein, 25 aa, Staphylococcus
GTVLGELILLFIFYLMHRKYLIPLA

SEQ ID NO: 1875203 - protein, 60 aa, Staphylococcus
GTVLLIIAIILILFAIVAVFKNKNYFKYFAMAITIILLSILALGIHKMIESNNPSKNQAT

SEQ ID NO: 1875204 - protein, 23 aa, Staphylococcus
GTVNLGGAIMLAARACVFSGSGL

SEQ ID NO: 1875205 - protein, 17 aa, Staphylococcus
GTYSFKAVQTYDNKDKV

SEQ ID NO: 1875206 - protein, 23 aa, Staphylococcus
GVAFALIVAFIFSFNRKAIDYKK

SEQ ID NO: 1875207 - protein, 22 aa, Staphylococcus
GVALVRFRVTLSRRGIENINMF

SEQ ID NO: 1875208 - protein, 17 aa, Staphylococcus
GVANRLLIPTGLHHALN

SEQ ID NO: 1875209 - protein, 18 aa, Staphylococcus
GVASDCWIAILAGGSAFL

SEQ ID NO: 1875210 - protein, 17 aa, Staphylococcus
GVASIRIGGHPQFVRPL

SEQ ID NO: 1875211 - protein, 19 aa, Staphylococcus
GVATKVGTYPIVVISTDAD

SEQ ID NO: 1875212 - protein, 19 aa, Staphylococcus
GVATKVGTYPIVVISTDTE

SEQ ID NO: 1875213 - protein, 19 aa, Staphylococcus
GVAYLAFWLSIIPLILYLN

SEQ ID NO: 1875214 - protein, 18 aa, Staphylococcus
GVDEGHGFTKDDNDTQEK

SEQ ID NO: 1875215 - protein, 19 aa, Staphylococcus
GVEIKVETQGGVGTENALT

SEQ ID NO: 1875216 - protein, 20 aa, Staphylococcus
GVENKIPWGTIIVFGVGISL

SEQ ID NO: 1875217 - protein, 24 aa, Staphylococcus
GVFFVFKPQIDHFITGKQNDEKIE

SEQ ID NO: 1875218 - protein, 19 aa, Staphylococcus
GVFHIHFFQVIGDLAGSLA

SEQ ID NO: 1875219 - protein, 18 aa, Staphylococcus
GVFHIKFFQEIGDLAGSL

SEQ ID NO: 1875220 - protein, 18 aa, Staphylococcus
GVFHIKFLQEIGDLAGSL

SEQ ID NO: 1875221 - protein, 17 aa, Staphylococcus
GVFIPFTLAQYGMVVKW

SEQ ID NO: 1875222 - protein, 19 aa, Staphylococcus
GVFLFIGSFFLNIVLSLNL

SEQ ID NO: 1875223 - protein, 18 aa, Staphylococcus
GVGDFRLLSQRAVKSIVS

SEQ ID NO: 1875224 - protein, 17 aa, Staphylococcus
GVGFIPEKGEIVAPFDG

SEQ ID NO: 1875225 - protein, 18 aa, Staphylococcus
GVGFIPEKGEIVAPFDGT

SEQ ID NO: 1875226 - protein, 18 aa, Staphylococcus
GVGIAAGVAVTFLNRDNQ

SEQ ID NO: 1875227 - protein, 33 aa, Staphylococcus
GVGIIYLFMLGFYRLPGLVAIIALTTYIYLTLV

SEQ ID NO: 1875228 - protein, 19 aa, Staphylococcus
GVGIPKEDIEFIFDRFYRV

SEQ ID NO: 1875229 - protein, 22 aa, Staphylococcus
GVGKLPAIVALFIYVLLPILNN

SEQ ID NO: 1875230 - protein, 20 aa, Staphylococcus
GVGLGYCVGMLPHARIAQSL

SEQ ID NO: 1875231 - protein, 18 aa, Staphylococcus
GVGLVIRAGGTMDGTEIM

SEQ ID NO: 1875232 - protein, 20 aa, Staphylococcus
GVGMSMGMSWAAATDLGRNF

SEQ ID NO: 1875233 - protein, 17 aa, Staphylococcus
GVHPYLAFFPIIGVLVI

SEQ ID NO: 1875234 - protein, 18 aa, Staphylococcus
GVIALRLSIRKKLNHPAF

SEQ ID NO: 1875235 - protein, 17 aa, Staphylococcus
GVICAIPTIIIAGPLYG

SEQ ID NO: 1875236 - protein, 19 aa, Staphylococcus
GVIIFGVFSYINGNGNTPK

SEQ ID NO: 1875237 - protein, 17 aa, Staphylococcus
GVILKPITDPLMRKVSS

SEQ ID NO: 1875238 - protein, 28 aa, Staphylococcus
GVIPFNIIKGIIISIIFVLLYKRLKNIL

SEQ ID NO: 1875239 - protein, 24 aa, Staphylococcus
GVIPFNIIKGIVISIIFILLYNRL

SEQ ID NO: 1875240 - protein, 17 aa, Staphylococcus
GVISFIVWMLIQNDVDF

SEQ ID NO: 1875241 - protein, 18 aa, Staphylococcus
GVISSSIVNLVFLPPKFE

SEQ ID NO: 1875242 - protein, 22 aa, Staphylococcus
GVITKVIIVWFFIKYDNQIRGA

SEQ ID NO: 1875243 - protein, 23 aa, Staphylococcus
GVKECIPTLFGYAGVGLSFGIVA

SEQ ID NO: 1875244 - protein, 19 aa, Staphylococcus
GVKECIPTLLGYAGVGISF

SEQ ID NO: 1875245 - protein, 26 aa, Staphylococcus
GVKESKRYIISWALLGFCIVMVYQVV

SEQ ID NO: 1875246 - protein, 27 aa, Staphylococcus
GVKWNTAQRMIITWVITLPISALVAAI

SEQ ID NO: 1875247 - protein, 23 aa, Staphylococcus
GVLAKFTVLWLFNKHNNHIKGTV

SEQ ID NO: 1875248 - protein, 25 aa, Staphylococcus
GVLAKIIVIWCFRKYNNQMRGSVGM

SEQ ID NO: 1875249 - protein, 18 aa, Staphylococcus
GVLCSGIFFAILTMTGLR

SEQ ID NO: 1875250 - protein, 20 aa, Staphylococcus
GVLCSILATWAMLYSTHEWL

SEQ ID NO: 1875251 - protein, 27 aa, Staphylococcus
GVLFNVKWLLNLRMFITTIILCMLITI

SEQ ID NO: 1875252 - protein, 20 aa, Staphylococcus
GVLIIPPLISFTWIAGFGGT

SEQ ID NO: 1875253 - protein, 18 aa, Staphylococcus
GVLKFFTGLGNTFQPRAN

SEQ ID NO: 1875254 - protein, 21 aa, Staphylococcus
GVLLAFMWPPFKLKTQPPKAL

SEQ ID NO: 1875255 - protein, 18 aa, Staphylococcus
GVLLWVLGIHPYFAFFPI

SEQ ID NO: 1875256 - protein, 20 aa, Staphylococcus
GVLMKDMFEDMNLDRSNLSR

SEQ ID NO: 1875257 - protein, 21 aa, Staphylococcus
GVLMKEMFEKMNLSRSVLSRT

SEQ ID NO: 1875258 - protein, 22 aa, Staphylococcus
GVLSASLVNLVFLPPKFETKIY

SEQ ID NO: 1875259 - protein, 20 aa, Staphylococcus
GVLTLPGLAALVLGVGMAVD

SEQ ID NO: 1875260 - protein, 22 aa, Staphylococcus
GVLYCIQFLSSVIFGFVIAKSK

SEQ ID NO: 1875261 - protein, 25 aa, Staphylococcus
GVMYQYRLLLTIYFALTFWISIIIL

SEQ ID NO: 1875262 - protein, 18 aa, Staphylococcus
GVNFVFGGFEFVDPKNPP

SEQ ID NO: 1875263 - protein, 20 aa, Staphylococcus
GVNIPGYFTTIAAITLLGGI

SEQ ID NO: 1875264 - protein, 24 aa, Staphylococcus
GVNLKLRYPFIGAIIGSAIGSAYI

SEQ ID NO: 1875265 - protein, 25 aa, Staphylococcus
GVNLKLRYPFIGAIVGSAFGAAYIS

SEQ ID NO: 1875266 - protein, 22 aa, Staphylococcus
GVNLKLRYPFIGAVVGSGLGSA

SEQ ID NO: 1875267 - protein, 22 aa, Staphylococcus
GVNLPLKYPFIAAILTSSVLGA

SEQ ID NO: 1875268 - protein, 21 aa, Staphylococcus
GVNLPLKYPFIAAISTSCILG

SEQ ID NO: 1875269 - protein, 24 aa, Staphylococcus
GVNLPLKYPFVAAISTSAILGAFV

SEQ ID NO: 1875270 - protein, 24 aa, Staphylococcus
GVNRLGVPLTIFLGGVKMMLPNMV

SEQ ID NO: 1875271 - protein, 22 aa, Staphylococcus
GVNTTMDWDRKYLYGDTLRGIF

SEQ ID NO: 1875272 - protein, 33 aa, Staphylococcus
GVPIGTMIGDWVGWRFTFLFIMAVSVLVGILMI

SEQ ID NO: 1875273 - protein, 19 aa, Staphylococcus
GVPLLVGALVAHRFNFSPL

SEQ ID NO: 1875274 - protein, 26 aa, Staphylococcus
GVPQYKIIFVHALRNALIPVITVIVP

SEQ ID NO: 1875275 - protein, 33 aa, Staphylococcus
GVQAFCYLVSLILCLPLNFSEHIIAKENTDVSI

SEQ ID NO: 1875276 - protein, 26 aa, Staphylococcus
GVQEGMKGLKRQLGVVNSEMKANLSA

SEQ ID NO: 1875277 - protein, 30 aa, Staphylococcus
GVSKEEKDRIKVIIEQIVKKSFKDIDLASR

SEQ ID NO: 1875278 - protein, 23 aa, Staphylococcus
GVSTLIGIVFGWIPARAASKKEL

SEQ ID NO: 1875279 - protein, 17 aa, Staphylococcus
GVSTMFASIIGGPPSTT

SEQ ID NO: 1875280 - protein, 20 aa, Staphylococcus
GVTYPAYMYNALVDEYNSLT

SEQ ID NO: 1875281 - protein, 19 aa, Staphylococcus
GVVIIPVLFIMNGLFGLTG

SEQ ID NO: 1875282 - protein, 20 aa, Staphylococcus
GVVIIPVLFVMNGLFGLTGI

SEQ ID NO: 1875283 - protein, 17 aa, Staphylococcus
GVVLWNKSIQSFGISAL

SEQ ID NO: 1875284 - protein, 25 aa, Staphylococcus
GVVMKSAYNWAFFNPIRKIYYNITI

SEQ ID NO: 1875285 - protein, 26 aa, Staphylococcus
GVVNWVIGVGGIFSGFIIGAFFLPLV

SEQ ID NO: 1875286 - protein, 21 aa, Staphylococcus
GVVSPIYRAHTNNSLSTSGGS

SEQ ID NO: 1875287 - protein, 19 aa, Staphylococcus
GWFKAFISVGNDLIWSQYL

SEQ ID NO: 1875288 - protein, 26 aa, Staphylococcus
GWFQGMGWPPSGRVLVHWYSVSERGS

SEQ ID NO: 1875289 - protein, 19 aa, Staphylococcus
GWGSTEIIIMFIIGVVFII

SEQ ID NO: 1875290 - protein, 24 aa, Staphylococcus
GWGSTEIIVMFILGAVFITLFVIR

SEQ ID NO: 1875291 - protein, 19 aa, Staphylococcus
GWHMRTWITTVGTLLGTFL

SEQ ID NO: 1875292 - protein, 25 aa, Staphylococcus
GWIISLPGLIIWQGFSIFVGTIQAY

SEQ ID NO: 1875293 - protein, 19 aa, Staphylococcus
GWKGWAHMNQHIVQHMKDD

SEQ ID NO: 1875294 - protein, 25 aa, Staphylococcus
GWLHYGIGMLIAFIVAFGLTYGLSY

SEQ ID NO: 1875295 - protein, 17 aa, Staphylococcus
GWLHYLIGMMIAFIVSI

SEQ ID NO: 1875296 - protein, 18 aa, Staphylococcus
GWSGINFNSPFADMAILL

SEQ ID NO: 1875297 - protein, 19 aa, Staphylococcus
GWSVLFGYVSVITFEAVAL

SEQ ID NO: 1875298 - protein, 23 aa, Staphylococcus
GWTSRFTLTVAIVGLIALVVFYI

SEQ ID NO: 1875299 - protein, 21 aa, Staphylococcus
GWVGIIYIPIIWKEASWQFMM

SEQ ID NO: 1875300 - protein, 27 aa, Staphylococcus
GWVKQIRWFGCIGMALSTLAFYYIPEW

SEQ ID NO: 1875301 - protein, 27 aa, Staphylococcus
GWVRQVRWFGCIGMALSTLAFYYLPSW

SEQ ID NO: 1875302 - protein, 26 aa, Staphylococcus
GWVRQVRWFGCIGMAVSTLAFYYFPA

SEQ ID NO: 1875303 - protein, 19 aa, Staphylococcus
GWWFPTMASAFLIFTIIIM

SEQ ID NO: 1875304 - protein, 24 aa, Staphylococcus
GWYGFNTGSAFAFNSVALTSFINT

SEQ ID NO: 1875305 - protein, 19 aa, Staphylococcus
GWYGFNVGSALSFNKIAMI

SEQ ID NO: 1875306 - protein, 18 aa, Staphylococcus
GYDSVEFTENALKQQLDE

SEQ ID NO: 1875307 - protein, 24 aa, Staphylococcus
GYFIIPFISAFVVHELCKKFIHSY

SEQ ID NO: 1875308 - protein, 24 aa, Staphylococcus
GYFIIPFVLGFLVHQLCKKVIPGY

SEQ ID NO: 1875309 - protein, 39 aa, Staphylococcus
GYGDVKFSVPVKNWNSDLSVNGFVMMYPNGNGYSNNLDP

SEQ ID NO: 1875310 - protein, 18 aa, Staphylococcus
GYHAAFWFTVIIAIIAFF

SEQ ID NO: 1875311 - protein, 21 aa, Staphylococcus
GYHFTIYVPYGNDWFSYFMRR

SEQ ID NO: 1875312 - protein, 21 aa, Staphylococcus
GYHSGFLFAVIITFISLLLTF

SEQ ID NO: 1875313 - protein, 22 aa, Staphylococcus
GYIDLSVGASFIPYKNQEAQQS

SEQ ID NO: 1875314 - protein, 19 aa, Staphylococcus
GYIEKKANITFAIIVTSVL

SEQ ID NO: 1875315 - protein, 27 aa, Staphylococcus
GYIGVWLYHFLERVLIPTGLHHFIYAP

SEQ ID NO: 1875316 - protein, 27 aa, Staphylococcus
GYIGVWLYHFLERVLIPTGLHHFVYAP

SEQ ID NO: 1875317 - protein, 18 aa, Staphylococcus
GYIKEIKPLSIISVAFLL

SEQ ID NO: 1875318 - protein, 18 aa, Staphylococcus
GYIKEVKPLAIISVAFLL

SEQ ID NO: 1875319 - protein, 24 aa, Staphylococcus
GYIMPPLMLLLGFLALENQYPSLF

SEQ ID NO: 1875320 - protein, 22 aa, Staphylococcus
GYKDLYMLKGGYKKWTGKIKTK

SEQ ID NO: 1875321 - protein, 25 aa, Staphylococcus
GYLKGFEGAFIFPALLAIIVAIIAF

SEQ ID NO: 1875322 - protein, 32 aa, Staphylococcus
GYLKISCTALLVSGTIIGYGFTHNTHADSTET

SEQ ID NO: 1875323 - protein, 21 aa, Staphylococcus
GYLLRIFQLLLLYATPMFVFI

SEQ ID NO: 1875324 - protein, 26 aa, Staphylococcus
GYLQTRLGFHFGFAVAAIGMFIGLVT

SEQ ID NO: 1875325 - protein, 25 aa, Staphylococcus
GYLQTRLGFHVGFAAAAVGMFLGLV

SEQ ID NO: 1875326 - protein, 23 aa, Staphylococcus
GYLVEYFDWRSLFHVVAPIAALT

SEQ ID NO: 1875327 - protein, 23 aa, Staphylococcus
GYLVEYFNWRSLFHVVAPIAAIT

SEQ ID NO: 1875328 - protein, 17 aa, Staphylococcus
GYPSAMYLISYEGKRTG

SEQ ID NO: 1875329 - protein, 17 aa, Staphylococcus
GYQGWIYNIDPFTHYTN

SEQ ID NO: 1875330 - protein, 27 aa, Staphylococcus
GYQKVLSWSLNHKWLVIIITTIILIAS

SEQ ID NO: 1875331 - protein, 23 aa, Staphylococcus
GYREYKYLCGLAKKEPFFGVAFV

SEQ ID NO: 1875332 - protein, 18 aa, Staphylococcus
GYSFPSMHVLSVCILVSL

SEQ ID NO: 1875333 - protein, 24 aa, Staphylococcus
GYSGDNPTSIWGIVIGSIIAIVLP

SEQ ID NO: 1875334 - protein, 20 aa, Staphylococcus
GYSLSISCSSVYVFGATTNG

SEQ ID NO: 1875335 - protein, 19 aa, Staphylococcus
GYTLKRINYFKANDSQVLS

SEQ ID NO: 1875336 - protein, 24 aa, Staphylococcus
GYVFPIVWPTLYLSMGIAHDIISQ

SEQ ID NO: 1875337 - protein, 26 aa, Staphylococcus
GYVGVWLYHFLERVLIPTGLHHFIYA

SEQ ID NO: 1875338 - protein, 23 aa, Staphylococcus
GYVKGSIFALVCWFIISVAIFLV

SEQ ID NO: 1875339 - protein, 19 aa, Staphylococcus
GYVNMQLIVGILFILITGP

SEQ ID NO: 1875340 - protein, 19 aa, Staphylococcus
GYVYFSWLLGLLVGMVGMN

SEQ ID NO: 1875341 - protein, 19 aa, Staphylococcus
GYVYFSWLLGLLVGMVVMN

SEQ ID NO: 1875342 - protein, 25 aa, Staphylococcus
GYYMATEMFGVFKSLTKTSATPFII

SEQ ID NO: 1875343 - protein, 25 aa, Staphylococcus
HAAGKAATLGAMFLLFGTFLYFYAT

SEQ ID NO: 1875344 - protein, 19 aa, Staphylococcus
HAAMSFGLVFLFSEEIGDL

SEQ ID NO: 1875345 - protein, 23 aa, Staphylococcus
HAAPFSLYIFIAWFTASISTIAG

SEQ ID NO: 1875346 - protein, 17 aa, Staphylococcus
HADRTTLNYGRIFKDFG

SEQ ID NO: 1875347 - protein, 22 aa, Staphylococcus
HAFKNAKFELQKILDRFKNNGR

SEQ ID NO: 1875348 - protein, 24 aa, Staphylococcus
HAFQGASWHKALFYAMFQSTTTRS

SEQ ID NO: 1875349 - protein, 26 aa, Staphylococcus
HAGCCAGDFYWVWKMIKAPKNATIET

SEQ ID NO: 1875350 - protein, 18 aa, Staphylococcus
HAGWLGGAIYGFFYAPLV

SEQ ID NO: 1875351 - protein, 17 aa, Staphylococcus
HAGWLGGALYGLLYAPL

SEQ ID NO: 1875352 - protein, 20 aa, Staphylococcus
HAHILIKLLFAMLLSIAGTF

SEQ ID NO: 1875353 - protein, 22 aa, Staphylococcus
HAIFKCVLFMGVGIIDHEAGTR

SEQ ID NO: 1875354 - protein, 21 aa, Staphylococcus
HAIGISNLWSHGGFMPHGIVG

SEQ ID NO: 1875355 - protein, 21 aa, Staphylococcus
HAIGISNLWSHGGFMPNGFVG

SEQ ID NO: 1875356 - protein, 25 aa, Staphylococcus
HAIGLSNLWSHGGFMPNGWVGFFFA

SEQ ID NO: 1875357 - protein, 30 aa, Staphylococcus
HAKNGGIKFVKGSNFNFNNFNNFISNAPSG

SEQ ID NO: 1875358 - protein, 37 aa, Staphylococcus
HAKPPVFLVRILTLFASFLIGLTLMGILLFNDLGRVH

SEQ ID NO: 1875359 - protein, 22 aa, Staphylococcus
HAKTTIIFGFAFIQAALQLLMF

SEQ ID NO: 1875360 - protein, 19 aa, Staphylococcus
HAKVPDFVVRFWTILIASL

SEQ ID NO: 1875361 - protein, 21 aa, Staphylococcus
HALDLLKLAGLSTLDTITLPN

SEQ ID NO: 1875362 - protein, 18 aa, Staphylococcus
HALFYGGILIMFGHIMLT

SEQ ID NO: 1875363 - protein, 23 aa, Staphylococcus
HAMLPDGFTGFFTAVGLVSFATG

SEQ ID NO: 1875364 - protein, 23 aa, Staphylococcus
HAMLSNGMTPMFNTGTIPRFASG

SEQ ID NO: 1875365 - protein, 25 aa, Staphylococcus
HAQFIPEFIGSVVIAIIAVAGHTLI

SEQ ID NO: 1875366 - protein, 26 aa, Staphylococcus
HAQFIPEFLGSLVIGIIAVIGHSLVP

SEQ ID NO: 1875367 - protein, 26 aa, Staphylococcus
HAQFIPEFLGSLVIGIISVLGHYLLP

SEQ ID NO: 1875368 - protein, 26 aa, Staphylococcus
HAQFIPEFMGALVIGLVTIIGHNLIP

SEQ ID NO: 1875369 - protein, 26 aa, Staphylococcus
HAQFIPEFVGSLVIGIIAVFGHWLAP

SEQ ID NO: 1875370 - protein, 26 aa, Staphylococcus
HAQFIPEFVGSLVIGMIAVTGHHFIP

SEQ ID NO: 1875371 - protein, 42 aa, Staphylococcus
HASDVKGIAYITAKRVKDGYEWDILFNKGHSNHENMIYWFGI

SEQ ID NO: 1875372 - protein, 18 aa, Staphylococcus
HASMSFAQVFLFSEETGD

SEQ ID NO: 1875373 - protein, 24 aa, Staphylococcus
HATIKGVIKTGGHGVDIGTFVMTV

SEQ ID NO: 1875374 - protein, 26 aa, Staphylococcus
HAVLPGVALSFLFNIPMFIGALVTGM

SEQ ID NO: 1875375 - protein, 26 aa, Staphylococcus
HAVLPGVALSFLFNIPMFVGALVTGM

SEQ ID NO: 1875376 - protein, 19 aa, Staphylococcus
HAVSIILFLYGASNILGNV

SEQ ID NO: 1875377 - protein, 20 aa, Staphylococcus
HAWALLPLLLFVLLFLGVGI

SEQ ID NO: 1875378 - protein, 19 aa, Staphylococcus
HAWAVYGIVGLVFAYFNFH

SEQ ID NO: 1875379 - protein, 17 aa, Staphylococcus
HAYAYGGPDMAVKSLEK

SEQ ID NO: 1875380 - protein, 17 aa, Staphylococcus
HAYAYGGPTMAVKSLEK

SEQ ID NO: 1875381 - protein, 24 aa, Staphylococcus
HCATRLRIVLKRSIPDAKKKVASM

SEQ ID NO: 1875382 - protein, 18 aa, Staphylococcus
HCATRLRLILNDESKVDE

SEQ ID NO: 1875383 - protein, 18 aa, Staphylococcus
HCVTRLRIVLKDDNKVNK

SEQ ID NO: 1875384 - protein, 18 aa, Staphylococcus
HDAFMIVAVFSLFRIEID

SEQ ID NO: 1875385 - protein, 18 aa, Staphylococcus
HDAFMIVAVFSLFRIEVD

SEQ ID NO: 1875386 - protein, 18 aa, Staphylococcus
HDAFMIVAVFSLFRLEVD

SEQ ID NO: 1875387 - protein, 18 aa, Staphylococcus
HDDWDWYSQYGIQMLQEH

SEQ ID NO: 1875388 - protein, 20 aa, Staphylococcus
HDEREWDYVLAITDLPIFHH

SEQ ID NO: 1875389 - protein, 17 aa, Staphylococcus
HDGILPKALIRAMIQDV

SEQ ID NO: 1875390 - protein, 19 aa, Staphylococcus
HDIKNDWLIIVVITLLLLV

SEQ ID NO: 1875391 - protein, 24 aa, Staphylococcus
HDILKLRLMRSVVVALIPIIALLV

SEQ ID NO: 1875392 - protein, 25 aa, Staphylococcus
HDKIIRLAISIGIALFIFAVVRPPI

SEQ ID NO: 1875393 - protein, 26 aa, Staphylococcus
HDKLMRRLRVPVLPVIARNGKGTAHM

SEQ ID NO: 1875394 - protein, 19 aa, Staphylococcus
HDTKAVSILNILSVILFII

SEQ ID NO: 1875395 - protein, 23 aa, Staphylococcus
HDTRISSFYGVVIFIIITFIIVS

SEQ ID NO: 1875396 - protein, 20 aa, Staphylococcus
HDVKRVICRLENSNEDEEMK

SEQ ID NO: 1875397 - protein, 17 aa, Staphylococcus
HEFALNMILGMEKKHIR

SEQ ID NO: 1875398 - protein, 17 aa, Staphylococcus
HEFDFGYDQLLKLQKQL

SEQ ID NO: 1875399 - protein, 25 aa, Staphylococcus
HEFRENYGTLGIEFFKQYQSKKDKY

SEQ ID NO: 1875400 - protein, 25 aa, Staphylococcus
HEGDTFKIGIKELGEDTRLPKELKA

SEQ ID NO: 1875401 - protein, 22 aa, Staphylococcus
HEHLRPILTARQIYMGKAGFFF

SEQ ID NO: 1875402 - protein, 21 aa, Staphylococcus
HEKTRKGSIFMDYRNSVKTPN

SEQ ID NO: 1875403 - protein, 24 aa, Staphylococcus
HELKEKFYLPGLCLVLIGILILIG

SEQ ID NO: 1875404 - protein, 29 aa, Staphylococcus
HELKYKAKWFPFGPIFAGVLCVIVIIGQD

SEQ ID NO: 1875405 - protein, 17 aa, Staphylococcus
HENEIQNLIAVYDEILQ

SEQ ID NO: 1875406 - protein, 17 aa, Staphylococcus
HENEIQNLVAVYDEILK

SEQ ID NO: 1875407 - protein, 22 aa, Staphylococcus
HETNAKVLLVVGGQNGSTDPFS

SEQ ID NO: 1875408 - protein, 18 aa, Staphylococcus
HFGIPAIVGLLGMGIITM

SEQ ID NO: 1875409 - protein, 28 aa, Staphylococcus
HFGKDKFKLFMPWYYLVKFILPVIIVLI

SEQ ID NO: 1875410 - protein, 19 aa, Staphylococcus
HFIIASGYIGVWLYHFLER

SEQ ID NO: 1875411 - protein, 18 aa, Staphylococcus
HFLIPSLILIIASFIGWY

SEQ ID NO: 1875412 - protein, 19 aa, Staphylococcus
HFLWFNLVHPDIWITIIAG

SEQ ID NO: 1875413 - protein, 18 aa, Staphylococcus
HFMGDLLNSLGVIVAVVL

SEQ ID NO: 1875414 - protein, 18 aa, Staphylococcus
HFMVQPWFQFILATPVQF

SEQ ID NO: 1875415 - protein, 22 aa, Staphylococcus
HFPGQRLLRKEVIQYFSEEGIH

SEQ ID NO: 1875416 - protein, 25 aa, Staphylococcus
HFSSLREKPTWGLKLIIAIVIVALS

SEQ ID NO: 1875417 - protein, 18 aa, Staphylococcus
HFTPRQVISLALMLGAII

SEQ ID NO: 1875418 - protein, 23 aa, Staphylococcus
HFTSKLWINRTLIVVLMFLNGLG

SEQ ID NO: 1875419 - protein, 18 aa, Staphylococcus
HFTSSFLKVMFLSSPAVI

SEQ ID NO: 1875420 - protein, 19 aa, Staphylococcus
HFYMICTYIPIVGLLLSFI

SEQ ID NO: 1875421 - protein, 23 aa, Staphylococcus
HGGFFNDDFRLFDTDNMSGELTY

SEQ ID NO: 1875422 - protein, 26 aa, Staphylococcus
HGGFLPHGWMGFFFALSIVIGSYQGV

SEQ ID NO: 1875423 - protein, 21 aa, Staphylococcus
HGINLPLIFSIIVIILGIILA

SEQ ID NO: 1875424 - protein, 23 aa, Staphylococcus
HGISRIVILYGRRKFAAMILTGM

SEQ ID NO: 1875425 - protein, 23 aa, Staphylococcus
HGKIERPSIGIGLINLSDIPDSY

SEQ ID NO: 1875426 - protein, 19 aa, Staphylococcus
HGKIERPSIGIGLINLSEI

SEQ ID NO: 1875427 - protein, 24 aa, Staphylococcus
HGKSYSKFMVMFVILLATFAGALM

SEQ ID NO: 1875428 - protein, 19 aa, Staphylococcus
HGKVERPSIGIGLLNLSDI

SEQ ID NO: 1875429 - protein, 19 aa, Staphylococcus
HGLFSSIMGMGFIAAFLSS

SEQ ID NO: 1875430 - protein, 19 aa, Staphylococcus
HGLLYLVRFLFGIGEAPMY

SEQ ID NO: 1875431 - protein, 31 aa, Staphylococcus
HGLMNRLTLIVVICFVLFLILLFMFLNYNDE

SEQ ID NO: 1875432 - protein, 18 aa, Staphylococcus
HGMNFLFIMVVGMLLSNA

SEQ ID NO: 1875433 - protein, 22 aa, Staphylococcus
HGNFKVKFFVSLIFAIPIILLS

SEQ ID NO: 1875434 - protein, 17 aa, Staphylococcus
HGRKRSVTLTALVKNVV

SEQ ID NO: 1875435 - protein, 21 aa, Staphylococcus
HGVNLPLIFSVIVIIVGLILA

SEQ ID NO: 1875436 - protein, 21 aa, Staphylococcus
HGYHAGFLFAVIITVISFLCT

SEQ ID NO: 1875437 - protein, 20 aa, Staphylococcus
HGYHAGFLFAVIITVVSFLC

SEQ ID NO: 1875438 - protein, 28 aa, Staphylococcus
HHFELCGWNEWKVVTVFWSVGLITGLIG

SEQ ID NO: 1875439 - protein, 28 aa, Staphylococcus
HHFELCGWNEWKVVTVFWTVGLVTGLIG

SEQ ID NO: 1875440 - protein, 20 aa, Staphylococcus
HHGLLYLVRFLFGIGEAPMY

SEQ ID NO: 1875441 - protein, 25 aa, Staphylococcus
HHGNFKVKFFVSLIFAIPIILLSPM

SEQ ID NO: 1875442 - protein, 17 aa, Staphylococcus
HHILFGMGILAYTLGLR

SEQ ID NO: 1875443 - protein, 17 aa, Staphylococcus
HHKRIVHRDIKPQNILI

SEQ ID NO: 1875444 - protein, 23 aa, Staphylococcus
HHKYFDLSCVPILSKSKKKLQGM

SEQ ID NO: 1875445 - protein, 24 aa, Staphylococcus
HHLDPRAKVLFVFMFIILIFFAHS

SEQ ID NO: 1875446 - protein, 17 aa, Staphylococcus
HHLSGNVDIIFQIGPGL

SEQ ID NO: 1875447 - protein, 23 aa, Staphylococcus
HHMILRYLDWVVHAFTGDLGYSF

SEQ ID NO: 1875448 - protein, 20 aa, Staphylococcus
HHPIKTMLSLENKLTQESQY

SEQ ID NO: 1875449 - protein, 19 aa, Staphylococcus
HHSWFKLFLGLILLNLIVI

SEQ ID NO: 1875450 - protein, 18 aa, Staphylococcus
HHWFSLFVVTGFLGGLTT

SEQ ID NO: 1875451 - protein, 17 aa, Staphylococcus
HIAFCIPIVVIIVLPQL

SEQ ID NO: 1875452 - protein, 18 aa, Staphylococcus
HIAVRPIFHFSWSEYSLW

SEQ ID NO: 1875453 - protein, 17 aa, Staphylococcus
HICVGIFVVFSIIGIAL

SEQ ID NO: 1875454 - protein, 21 aa, Staphylococcus
HIDSKLILQVLFNLVDNALKH

SEQ ID NO: 1875455 - protein, 19 aa, Staphylococcus
HIDSLDALLNWVHELQQTG

SEQ ID NO: 1875456 - protein, 17 aa, Staphylococcus
HIEGVAYLAFWLSIIPL

SEQ ID NO: 1875457 - protein, 24 aa, Staphylococcus
HIFQGHVAWGYSIILIISSYIGAQ

SEQ ID NO: 1875458 - protein, 17 aa, Staphylococcus
HIGYIPKEDAAIFNNYI

SEQ ID NO: 1875459 - protein, 20 aa, Staphylococcus
HIHLNMYIILVISIIYIIVH

SEQ ID NO: 1875460 - protein, 18 aa, Staphylococcus
HIIAHLQLAIGFIAIFFI

SEQ ID NO: 1875461 - protein, 24 aa, Staphylococcus
HIIVPFIIAVSIMFGIEYILISIT

SEQ ID NO: 1875462 - protein, 17 aa, Staphylococcus
HIKKASFDLGNEHIQFF

SEQ ID NO: 1875463 - protein, 23 aa, Staphylococcus
HIKSILSHDGFAYIMNNAIKNFS

SEQ ID NO: 1875464 - protein, 23 aa, Staphylococcus
HILAKIAAVIAVAFTQVIMIILT

SEQ ID NO: 1875465 - protein, 26 aa, Staphylococcus
HILKIKRIKLLSLRPHYKVYLDKTNI

SEQ ID NO: 1875466 - protein, 18 aa, Staphylococcus
HILLPFMFGPIIASVICV

SEQ ID NO: 1875467 - protein, 25 aa, Staphylococcus
HILRALRFAQKFGLPVQGIGSSTPC

SEQ ID NO: 1875468 - protein, 22 aa, Staphylococcus
HILRALRFAQKLNIKVIGLGSS

SEQ ID NO: 1875469 - protein, 23 aa, Staphylococcus
HILVARSFFYLGLLNSSIKEDEL

SEQ ID NO: 1875470 - protein, 19 aa, Staphylococcus
HIMNVMWTAIPGFIISFLG

SEQ ID NO: 1875471 - protein, 20 aa, Staphylococcus
HIMRALRFGQKFNLKLTGVG

SEQ ID NO: 1875472 - protein, 22 aa, Staphylococcus
HIMSIYVIRSLGMAFVMMPLMT

SEQ ID NO: 1875473 - protein, 24 aa, Staphylococcus
HIMSRILKSPVVIFMIPGIIPLVP

SEQ ID NO: 1875474 - protein, 17 aa, Staphylococcus
HINFLLLIGIMLVAANL

SEQ ID NO: 1875475 - protein, 17 aa, Staphylococcus
HINIIGVLIGLMISYIV

SEQ ID NO: 1875476 - protein, 23 aa, Staphylococcus
HINKAQLTHGLKDVASTDSLTKL

SEQ ID NO: 1875477 - protein, 25 aa, Staphylococcus
HINPAELFIFLGIAHGIEKLGLPTA

SEQ ID NO: 1875478 - protein, 23 aa, Staphylococcus
HINPDIFSPLIIAFIVFSLHAVA

SEQ ID NO: 1875479 - protein, 20 aa, Staphylococcus
HIPLALFMLFQLMFCTIAVS

SEQ ID NO: 1875480 - protein, 24 aa, Staphylococcus
HIPQEMFELSAFFIALKYAFTMSV

SEQ ID NO: 1875481 - protein, 23 aa, Staphylococcus
HIQFLKIRLGIQVALGNFFKTIV

SEQ ID NO: 1875482 - protein, 19 aa, Staphylococcus
HIQFLKVRLGLQVVVSNLA

SEQ ID NO: 1875483 - protein, 19 aa, Staphylococcus
HIRAMMWTTIPASLIGMIV

SEQ ID NO: 1875484 - protein, 18 aa, Staphylococcus
HIREIKGLLTTKILQAQE

SEQ ID NO: 1875485 - protein, 26 aa, Staphylococcus
HISFPKRVFTALAIGIILGIAMHLIY

SEQ ID NO: 1875486 - protein, 18 aa, Staphylococcus
HISWLSGITTNFSEIFLV

SEQ ID NO: 1875487 - protein, 17 aa, Staphylococcus
HIVICYIGFLPLAILAG

SEQ ID NO: 1875488 - protein, 18 aa, Staphylococcus
HIVLFPGILLQGAAISAL

SEQ ID NO: 1875489 - protein, 24 aa, Staphylococcus
HIVQGHVAWGYAIILIIASYFGAK

SEQ ID NO: 1875490 - protein, 21 aa, Staphylococcus
HKAERRLNNVVNNRTQQIIND

SEQ ID NO: 1875491 - protein, 23 aa, Staphylococcus
HKAMKDSTAYMLAEMLKGTFKAY

SEQ ID NO: 1875492 - protein, 24 aa, Staphylococcus
HKAMKDYTAYMLAEILKGTFKAYG

SEQ ID NO: 1875493 - protein, 24 aa, Staphylococcus
HKAMKDYTAYMLAEMLKGTFSAYG

SEQ ID NO: 1875494 - protein, 24 aa, Staphylococcus
HKAMKDYTSYMLAEMLTGTFKAYG

SEQ ID NO: 1875495 - protein, 31 aa, Staphylococcus
HKAPRSYTSPSIIVGPDFYMGIGTPGGNKIP

SEQ ID NO: 1875496 - protein, 31 aa, Staphylococcus
HKAPRSYTSPSIVVGPDFYMGIGTPGGNKIP

SEQ ID NO: 1875497 - protein, 18 aa, Staphylococcus
HKAPRSYTSPTIIVGPDF

SEQ ID NO: 1875498 - protein, 18 aa, Staphylococcus
HKDGIRKIVLDLRNNPGG

SEQ ID NO: 1875499 - protein, 22 aa, Staphylococcus
HKDILRNDRRYSFQEAFQKQTQ

SEQ ID NO: 1875500 - protein, 17 aa, Staphylococcus
HKDWRIVTKERKHHDIL

SEQ ID NO: 1875501 - protein, 27 aa, Staphylococcus
HKESKRYIIPWAILGFFIVMLYQVIVG

SEQ ID NO: 1875502 - protein, 25 aa, Staphylococcus
HKFGFKRNYLFFVFLFLIGSIIGLF

SEQ ID NO: 1875503 - protein, 18 aa, Staphylococcus
HKGIIGVFLRIGSRENYY

SEQ ID NO: 1875504 - protein, 19 aa, Staphylococcus
HKGNHRFTYKYIDNDHHII

SEQ ID NO: 1875505 - protein, 18 aa, Staphylococcus
HKHEEDWVLLKALTNRAH

SEQ ID NO: 1875506 - protein, 17 aa, Staphylococcus
HKHSVNLINEINDVLNA

SEQ ID NO: 1875507 - protein, 19 aa, Staphylococcus
HKILLSIPIISKFFKYYKT

SEQ ID NO: 1875508 - protein, 30 aa, Staphylococcus
HKIMHLVFFLPFYKSFRVHKLVKKKWLPYF

SEQ ID NO: 1875509 - protein, 17 aa, Staphylococcus
HKIMPGIVANALNTRPS

SEQ ID NO: 1875510 - protein, 19 aa, Staphylococcus
HKISLPAYLGFFGGSRFVP

SEQ ID NO: 1875511 - protein, 23 aa, Staphylococcus
HKIYFCINLILPFILITIFLIFL

SEQ ID NO: 1875512 - protein, 21 aa, Staphylococcus
HKKALKMTMILGFIQTLLSML

SEQ ID NO: 1875513 - protein, 19 aa, Staphylococcus
HKKALKMTMIVGFLSTILS

SEQ ID NO: 1875514 - protein, 17 aa, Staphylococcus
HKKEDKLRDEAEKARKK

SEQ ID NO: 1875515 - protein, 19 aa, Staphylococcus
HKKIYVFIDEIFKGTNTTE

SEQ ID NO: 1875516 - protein, 21 aa, Staphylococcus
HKKLDICGILLLGITSATLIY

SEQ ID NO: 1875517 - protein, 20 aa, Staphylococcus
HKKMKMMSVMRDIYADIPGY

SEQ ID NO: 1875518 - protein, 19 aa, Staphylococcus
HKLDEGLEIKMLYDDMGSR

SEQ ID NO: 1875519 - protein, 19 aa, Staphylococcus
HKLHYRGLLSVAIFAVVLC

SEQ ID NO: 1875520 - protein, 20 aa, Staphylococcus
HKLLSLFGVQTKYSLYMTSS

SEQ ID NO: 1875521 - protein, 20 aa, Staphylococcus
HKLSLIVYLVMGWVGVIFAP

SEQ ID NO: 1875522 - protein, 25 aa, Staphylococcus
HKLSLIVYLVMGWVGVIFIPVIIMR

SEQ ID NO: 1875523 - protein, 21 aa, Staphylococcus
HKNEVFRVQKYIYDRDQSNKY

SEQ ID NO: 1875524 - protein, 17 aa, Staphylococcus
HKNIKPIILDNINYANA

SEQ ID NO: 1875525 - protein, 20 aa, Staphylococcus
HKNNAISSIHQVAHQKSRSI

SEQ ID NO: 1875526 - protein, 18 aa, Staphylococcus
HKNSNGFVDLLKNTLGFV

SEQ ID NO: 1875527 - protein, 24 aa, Staphylococcus
HKQTSIICLAAFILMVTMPNEIYK

SEQ ID NO: 1875528 - protein, 17 aa, Staphylococcus
HKSQLLLIAESLLTEET

SEQ ID NO: 1875529 - protein, 29 aa, Staphylococcus
HKTIHLFFFLPYIHAFRWHKLNKKKWLPY

SEQ ID NO: 1875530 - protein, 19 aa, Staphylococcus
HKTTFTMLRDVRVQFLEKL

SEQ ID NO: 1875531 - protein, 18 aa, Staphylococcus
HKVKYPIIELSLFKNKIR

SEQ ID NO: 1875532 - protein, 23 aa, Staphylococcus
HKVYFCINLILPFILISSLFIFL

SEQ ID NO: 1875533 - protein, 19 aa, Staphylococcus
HKVYFCINLILPILLLTGI

SEQ ID NO: 1875534 - protein, 20 aa, Staphylococcus
HKYILPATILISWISLFIAQ

SEQ ID NO: 1875535 - protein, 25 aa, Staphylococcus
HKYILPATILISWISLFMAQWVVEN

SEQ ID NO: 1875536 - protein, 21 aa, Staphylococcus
HKYYNFFGIGAFDQDAIATGH

SEQ ID NO: 1875537 - protein, 17 aa, Staphylococcus
HLAHIPFYLLGFLAAFI

SEQ ID NO: 1875538 - protein, 18 aa, Staphylococcus
HLAHIPFYLLGFLAAFIV

SEQ ID NO: 1875539 - protein, 25 aa, Staphylococcus
HLANFKFIIAKGFENKKIGLKYTDA

SEQ ID NO: 1875540 - protein, 18 aa, Staphylococcus
HLANLYFLIAKGSIFEFM

SEQ ID NO: 1875541 - protein, 25 aa, Staphylococcus
HLDDVFFKRAIELSDDYIKNNSTLV

SEQ ID NO: 1875542 - protein, 17 aa, Staphylococcus
HLDRLRISFFSYHNNDN

SEQ ID NO: 1875543 - protein, 21 aa, Staphylococcus
HLEALGTLSALAFDKTGTLTE

SEQ ID NO: 1875544 - protein, 22 aa, Staphylococcus
HLFMAFFVEFGFRSYLQNIVET

SEQ ID NO: 1875545 - protein, 24 aa, Staphylococcus
HLFSRAVILEVIFSMSGLGKLLIT

SEQ ID NO: 1875546 - protein, 18 aa, Staphylococcus
HLFSRVIILEVIFSISGL

SEQ ID NO: 1875547 - protein, 18 aa, Staphylococcus
HLGFKEKVIFPFIIACGF

SEQ ID NO: 1875548 - protein, 24 aa, Staphylococcus
HLGRIKPLYFIGGILGVVFVTSNI

SEQ ID NO: 1875549 - protein, 25 aa, Staphylococcus
HLGVDPSTQTAWRGDTLANTLAQDP

SEQ ID NO: 1875550 - protein, 21 aa, Staphylococcus
HLHFQRMKGGIGNDYAEDPQP

SEQ ID NO: 1875551 - protein, 18 aa, Staphylococcus
HLHYEMQRNGVAFDPTSW

SEQ ID NO: 1875552 - protein, 23 aa, Staphylococcus
HLIVCMICILISTLIKNLNVISK

SEQ ID NO: 1875553 - protein, 18 aa, Staphylococcus
HLKLLQRLSRALMDDATR

SEQ ID NO: 1875554 - protein, 19 aa, Staphylococcus
HLKLLQRLSRALMDDETRE

SEQ ID NO: 1875555 - protein, 19 aa, Staphylococcus
HLKTLPVRFKQSVENAERL

SEQ ID NO: 1875556 - protein, 25 aa, Staphylococcus
HLLGDLKGRIAIAIMYQNISLILGS

SEQ ID NO: 1875557 - protein, 17 aa, Staphylococcus
HLLQWLGNDVLHNDYGL

SEQ ID NO: 1875558 - protein, 26 aa, Staphylococcus
HLLYKLPKYIYIFLLFWLIINVISYV

SEQ ID NO: 1875559 - protein, 19 aa, Staphylococcus
HLMGLKGSFGLDQILGVFM

SEQ ID NO: 1875560 - protein, 26 aa, Staphylococcus
HLMIPCKPDHPFVYWATFSNAAALLD

SEQ ID NO: 1875561 - protein, 26 aa, Staphylococcus
HLMQNRMSALFLKRLYYVAFKLVVFT

SEQ ID NO: 1875562 - protein, 26 aa, Staphylococcus
HLNSARGSLDHNVFYGTLGQSRNYTI

SEQ ID NO: 1875563 - protein, 22 aa, Staphylococcus
HLPAELAIGVILVGCCPGGTSS

SEQ ID NO: 1875564 - protein, 20 aa, Staphylococcus
HLPLFLILRFVQGLTGGGAI

SEQ ID NO: 1875565 - protein, 18 aa, Staphylococcus
HLPNRALLILTIIGVLIG

SEQ ID NO: 1875566 - protein, 18 aa, Staphylococcus
HLPNRALLILTIIGVVIG

SEQ ID NO: 1875567 - protein, 20 aa, Staphylococcus
HLPNRALVILTIIGVLIGSM

SEQ ID NO: 1875568 - protein, 21 aa, Staphylococcus
HLTERLSLFMIILFGEGIVQI

SEQ ID NO: 1875569 - protein, 25 aa, Staphylococcus
HLTIPKDRPVVFKLQSMDMMTSFWI

SEQ ID NO: 1875570 - protein, 17 aa, Staphylococcus
HLTKGPVLLAIFGIAIT

SEQ ID NO: 1875571 - protein, 22 aa, Staphylococcus
HLTKPSVLLAIFGIAITIILYA

SEQ ID NO: 1875572 - protein, 19 aa, Staphylococcus
HLVVFTAGIGMFLSTLDSG

SEQ ID NO: 1875573 - protein, 19 aa, Staphylococcus
HLYMLCFIAIISIINFALS

SEQ ID NO: 1875574 - protein, 19 aa, Staphylococcus
HLYNIFMFIVWIGIIAAFF

SEQ ID NO: 1875575 - protein, 18 aa, Staphylococcus
HLYQGESLAIIGEPGSSK

SEQ ID NO: 1875576 - protein, 35 aa, Staphylococcus
HMFFAKRAGIMCPEFAIGMGPKIFSFRKDETLYTI

SEQ ID NO: 1875577 - protein, 35 aa, Staphylococcus
HMFFAKRVGIMCPEFAIGMGPKIFSFRKDETLYTI

SEQ ID NO: 1875578 - protein, 19 aa, Staphylococcus
HMILFPGILLQGASISALL

SEQ ID NO: 1875579 - protein, 19 aa, Staphylococcus
HMILFPGILLQGASITALV

SEQ ID NO: 1875580 - protein, 24 aa, Staphylococcus
HMKLGETFFLYLIWYSIGRFFVEG

SEQ ID NO: 1875581 - protein, 18 aa, Staphylococcus
HMLKVLKLEEDFSLDEIQ

SEQ ID NO: 1875582 - protein, 18 aa, Staphylococcus
HMLLPFMFGPIIASIIVV

SEQ ID NO: 1875583 - protein, 17 aa, Staphylococcus
HMPHLYFETSAVLITLI

SEQ ID NO: 1875584 - protein, 25 aa, Staphylococcus
HMSELLPSILKVGLIYGLVILVIAL

SEQ ID NO: 1875585 - protein, 18 aa, Staphylococcus
HMSVKLSLLGSEFDLELA

SEQ ID NO: 1875586 - protein, 18 aa, Staphylococcus
HMSVKLSSLGGEFDTELA

SEQ ID NO: 1875587 - protein, 21 aa, Staphylococcus
HNAFKVPSWIIATILAVILGL

SEQ ID NO: 1875588 - protein, 20 aa, Staphylococcus
HNANGATVYWYQNSQETLAE

SEQ ID NO: 1875589 - protein, 26 aa, Staphylococcus
HNASYKKLPWMMALAAFIIGIPMFFE

SEQ ID NO: 1875590 - protein, 25 aa, Staphylococcus
HNDHSRSYILLGYPMKAQKGSHSHY

SEQ ID NO: 1875591 - protein, 44 aa, Staphylococcus
HNGKKKRGLAGILLPLIALLLILAALAIFIGMYLNNDKKDSNQA

SEQ ID NO: 1875592 - protein, 44 aa, Staphylococcus
HNGNKKRGLMGILLPLIALLLILAALAIFIGMYLNNDHKEKNNN

SEQ ID NO: 1875593 - protein, 23 aa, Staphylococcus
HNHKETRVPYSITNQPKDLEGED

SEQ ID NO: 1875594 - protein, 19 aa, Staphylococcus
HNHWWNKGIGAGIVTVAGL

SEQ ID NO: 1875595 - protein, 23 aa, Staphylococcus
HNISNFLSVLPWFIITIPIILML

SEQ ID NO: 1875596 - protein, 23 aa, Staphylococcus
HNISNFYSVLPWFIITVPVVLLL

SEQ ID NO: 1875597 - protein, 20 aa, Staphylococcus
HNKYSLPYFFGTVGILYNKD

SEQ ID NO: 1875598 - protein, 20 aa, Staphylococcus
HNKYSLPYFFGTVGILYNKK

SEQ ID NO: 1875599 - protein, 34 aa, Staphylococcus
HNPETLVPVNLYVKPALKQKISYWHNNEGQSIES

SEQ ID NO: 1875600 - protein, 24 aa, Staphylococcus
HNQPVWDLIGPRLIPSMEMGITAM

SEQ ID NO: 1875601 - protein, 18 aa, Staphylococcus
HNQPVWDLISPRLIPSLE

SEQ ID NO: 1875602 - protein, 30 aa, Staphylococcus
HNQSIPPFFSRTAPYIFAHRGGMAVRPEQT

SEQ ID NO: 1875603 - protein, 22 aa, Staphylococcus
HNRMAPTTVFLLQFTIVAICMA

SEQ ID NO: 1875604 - protein, 25 aa, Staphylococcus
HNSRMPRMLAGLLIGGALALAGLLM

SEQ ID NO: 1875605 - protein, 19 aa, Staphylococcus
HNTFTWLITLLFIALSFYL

SEQ ID NO: 1875606 - protein, 25 aa, Staphylococcus
HNVRMPRMLAALFIGAALGVAGLLM

SEQ ID NO: 1875607 - protein, 26 aa, Staphylococcus
HNVRMPRMLAGLVIGGALGIAGLLMQ

SEQ ID NO: 1875608 - protein, 21 aa, Staphylococcus
HNYQFKKGRKYHMNGDQALTY

SEQ ID NO: 1875609 - protein, 18 aa, Staphylococcus
HNYYNFYGIGAFDENAVH

SEQ ID NO: 1875610 - protein, 28 aa, Staphylococcus
HPDLVKILGRLNYRTSYGQNVLKHSMEV

SEQ ID NO: 1875611 - protein, 30 aa, Staphylococcus
HPFKIKRLVGQSGMSYGALGSRAITALSKG

SEQ ID NO: 1875612 - protein, 19 aa, Staphylococcus
HPFLLGLIIGTCGSLINTY

SEQ ID NO: 1875613 - protein, 24 aa, Staphylococcus
HPGKDGAINLVKRIYLQDNGIEAG

SEQ ID NO: 1875614 - protein, 23 aa, Staphylococcus
HPGTLPNYSSFVLLNSKEKNAVV

SEQ ID NO: 1875615 - protein, 26 aa, Staphylococcus
HPHFTFINYVKLVWFVSSLGLLAGAM

SEQ ID NO: 1875616 - protein, 20 aa, Staphylococcus
HPHIRLLSFFTNFKAFKTNK

SEQ ID NO: 1875617 - protein, 22 aa, Staphylococcus
HPIIDLRLFKNVSFSSPIFAIF

SEQ ID NO: 1875618 - protein, 18 aa, Staphylococcus
HPIKLILPIITLVGGTVG

SEQ ID NO: 1875619 - protein, 20 aa, Staphylococcus
HPIMIGHTIIIISIILLTLL

SEQ ID NO: 1875620 - protein, 19 aa, Staphylococcus
HPIRMKFNVIRNMKELTNI

SEQ ID NO: 1875621 - protein, 34 aa, Staphylococcus
HPKGLGVLFFVEFWERFSYYGMRALLIFYMYFAI

SEQ ID NO: 1875622 - protein, 18 aa, Staphylococcus
HPLAEAIVNYAKDQNLTL

SEQ ID NO: 1875623 - protein, 19 aa, Staphylococcus
HPLATAIVKYAKTKQLTLT

SEQ ID NO: 1875624 - protein, 20 aa, Staphylococcus
HPLFSSIGIPEAWIHPFTIG

SEQ ID NO: 1875625 - protein, 19 aa, Staphylococcus
HPLFSSIGIPEAWIQPFTI

SEQ ID NO: 1875626 - protein, 17 aa, Staphylococcus
HPLKLILPIITLVGGTV

SEQ ID NO: 1875627 - protein, 19 aa, Staphylococcus
HPLLERKHLANFKFIIAKG

SEQ ID NO: 1875628 - protein, 17 aa, Staphylococcus
HPLMLLVQGIVFFILYY

SEQ ID NO: 1875629 - protein, 22 aa, Staphylococcus
HPNDLNMPYGFKKKDLIKDGKD

SEQ ID NO: 1875630 - protein, 17 aa, Staphylococcus
HPNDLNMPYGFKKVDTI

SEQ ID NO: 1875631 - protein, 17 aa, Staphylococcus
HPNHLWSKVTTRIAQII

SEQ ID NO: 1875632 - protein, 17 aa, Staphylococcus
HPNVYKMNSSDRMIDIL

SEQ ID NO: 1875633 - protein, 17 aa, Staphylococcus
HPSEAMTALLIGRTISM

SEQ ID NO: 1875634 - protein, 39 aa, Staphylococcus
HPSGLGVLFFVEFWERFSYYGMRAMLIFYMYDQIKNGGL

SEQ ID NO: 1875635 - protein, 35 aa, Staphylococcus
HPVELPFKGVYVLGITVWIAIWWITEAIPIAATSF

SEQ ID NO: 1875636 - protein, 18 aa, Staphylococcus
HQEQLRLIAKTLLTEETL

SEQ ID NO: 1875637 - protein, 19 aa, Staphylococcus
HQFKQLKFSSVLIAITINA

SEQ ID NO: 1875638 - protein, 17 aa, Staphylococcus
HQFWQNVVLGYWYGYFI

SEQ ID NO: 1875639 - protein, 19 aa, Staphylococcus
HQLDNWLGHSFKGAGIFAL

SEQ ID NO: 1875640 - protein, 18 aa, Staphylococcus
HQLFLPIAILVGAFLLVF

SEQ ID NO: 1875641 - protein, 18 aa, Staphylococcus
HQLFLPISILIGAFLLVL

SEQ ID NO: 1875642 - protein, 24 aa, Staphylococcus
HQLKIRYGLFNVKSLTVPTIRIQA

SEQ ID NO: 1875643 - protein, 17 aa, Staphylococcus
HQLWWSGPIIIVAIIVM

SEQ ID NO: 1875644 - protein, 24 aa, Staphylococcus
HQNKSIPLVRLLKKHQLQQLTDKD

SEQ ID NO: 1875645 - protein, 18 aa, Staphylococcus
HQPKEIIYAWSPFVILTV

SEQ ID NO: 1875646 - protein, 17 aa, Staphylococcus
HQPPSIIGDKWQYTGQT

SEQ ID NO: 1875647 - protein, 20 aa, Staphylococcus
HRAEGVSLYSLFSMIPNLIG

SEQ ID NO: 1875648 - protein, 18 aa, Staphylococcus
HRATFTMLRNVRVQFFKK

SEQ ID NO: 1875649 - protein, 20 aa, Staphylococcus
HRGKILSIVMMDRGMIPLGS

SEQ ID NO: 1875650 - protein, 19 aa, Staphylococcus
HRGKILSVVMMDRGMIPLG

SEQ ID NO: 1875651 - protein, 26 aa, Staphylococcus
HRGMAFITFMWIMFTFIHAIKNYSDN

SEQ ID NO: 1875652 - protein, 18 aa, Staphylococcus
HRKNTKPIFLIGTGGNTD

SEQ ID NO: 1875653 - protein, 17 aa, Staphylococcus
HRMWLNRLIIVAMMFLN

SEQ ID NO: 1875654 - protein, 23 aa, Staphylococcus
HRSDEDFNRRNDVDWSSDDRKDN

SEQ ID NO: 1875655 - protein, 27 aa, Staphylococcus
HRSIFEWKSARMFLLRLLCISAAVFIL

SEQ ID NO: 1875656 - protein, 19 aa, Staphylococcus
HRTTFTMLRDIRVQFFSGL

SEQ ID NO: 1875657 - protein, 20 aa, Staphylococcus
HRTTFTMLRDVRVQFLKKLI

SEQ ID NO: 1875658 - protein, 29 aa, Staphylococcus
HRVMPGKFYLIRIYRMIKLVFIFLLELIK

SEQ ID NO: 1875659 - protein, 17 aa, Staphylococcus
HRWFILSWIQLILGLTR

SEQ ID NO: 1875660 - protein, 18 aa, Staphylococcus
HRYNIAKKSYFVENGSLI

SEQ ID NO: 1875661 - protein, 19 aa, Staphylococcus
HRYSVLKKTVLRSIWFNVI

SEQ ID NO: 1875662 - protein, 20 aa, Staphylococcus
HSAFTFKIVIQLGSVFAAAW

SEQ ID NO: 1875663 - protein, 27 aa, Staphylococcus
HSAYELISALILAWSLMVSWNQLVAFS

SEQ ID NO: 1875664 - protein, 22 aa, Staphylococcus
HSEHPIIFLICYIAIFIYFLIL

SEQ ID NO: 1875665 - protein, 19 aa, Staphylococcus
HSFTHMWLYMYAYSLYLFF

SEQ ID NO: 1875666 - protein, 22 aa, Staphylococcus
HSGTKYPYRIIALITGDTSQLN

SEQ ID NO: 1875667 - protein, 30 aa, Staphylococcus
HSHFPNFGGGLIGFYLLKIFIPLISIAGVI

SEQ ID NO: 1875668 - protein, 40 aa, Staphylococcus
HSHFPNFGGGLIGYYLLELFIPLISIIGVFIITVLLVASS

SEQ ID NO: 1875669 - protein, 23 aa, Staphylococcus
HSIEGLPTISVIGFYPSFETIGA

SEQ ID NO: 1875670 - protein, 25 aa, Staphylococcus
HSKIVYRFTTFFTMIAAFIDGVKAS

SEQ ID NO: 1875671 - protein, 25 aa, Staphylococcus
HSKLKRIVYLILWIVYLVLIANIVT

SEQ ID NO: 1875672 - protein, 20 aa, Staphylococcus
HSKLNSVIMPRKENAPEPPI

SEQ ID NO: 1875673 - protein, 18 aa, Staphylococcus
HSLAFIIIIGFLLYLIQT

SEQ ID NO: 1875674 - protein, 26 aa, Staphylococcus
HSLHGLSWPIVIVLLILFFFYSHYLF

SEQ ID NO: 1875675 - protein, 23 aa, Staphylococcus
HSNAPFGLAFSHMFNPTVGSIVI

SEQ ID NO: 1875676 - protein, 24 aa, Staphylococcus
HSNDEIYIRRGIIFINTKIIPFYR

SEQ ID NO: 1875677 - protein, 22 aa, Staphylococcus
HSNKIKGIVLINHSNITTNFGV

SEQ ID NO: 1875678 - protein, 19 aa, Staphylococcus
HSPIGLFIFTVIYFAVVLY

SEQ ID NO: 1875679 - protein, 24 aa, Staphylococcus
HSQQTLKDDIGWNEVYHEADTSET

SEQ ID NO: 1875680 - protein, 22 aa, Staphylococcus
HSRKKWSVVITRIAQVVTSLPE

SEQ ID NO: 1875681 - protein, 23 aa, Staphylococcus
HSRSKWNILCYVFIICEIIVTIV

SEQ ID NO: 1875682 - protein, 23 aa, Staphylococcus
HSSLKYPERVLALITGDTGAIDT

SEQ ID NO: 1875683 - protein, 21 aa, Staphylococcus
HSYASWIIVIVVSLILVTIVG

SEQ ID NO: 1875684 - protein, 27 aa, Staphylococcus
HSYLAWKLNPAGSMSIMISLSLFLLLN

SEQ ID NO: 1875685 - protein, 21 aa, Staphylococcus
HSYVSWVIVVGISLILVAIVS

SEQ ID NO: 1875686 - protein, 22 aa, Staphylococcus
HTCACLLLLLNVVGVYRLSKRA

SEQ ID NO: 1875687 - protein, 19 aa, Staphylococcus
HTDFIFAIICEELGLVGGL

SEQ ID NO: 1875688 - protein, 34 aa, Staphylococcus
HTEKMALLYARPLYYFGNVMKPLIWLMNGSARVI

SEQ ID NO: 1875689 - protein, 31 aa, Staphylococcus
HTGKSYAKEASWTSPRKAILGGAKFIRTNYF

SEQ ID NO: 1875690 - protein, 18 aa, Staphylococcus
HTHAIAIDKHKNYTGTHA

SEQ ID NO: 1875691 - protein, 30 aa, Staphylococcus
HTHFPNFGGGIIGFYLLKLFVPLISIAGII

SEQ ID NO: 1875692 - protein, 23 aa, Staphylococcus
HTHIVWLSLILFIRGCSVGGINL

SEQ ID NO: 1875693 - protein, 18 aa, Staphylococcus
HTIMKRSAVEILFATIGL

SEQ ID NO: 1875694 - protein, 23 aa, Staphylococcus
HTKEPWERIDWRVNEQDNTPMYQ

SEQ ID NO: 1875695 - protein, 17 aa, Staphylococcus
HTKHFAMTYINDDKDYT

SEQ ID NO: 1875696 - protein, 19 aa, Staphylococcus
HTKMHSVQAIISRLVSCLL

SEQ ID NO: 1875697 - protein, 18 aa, Staphylococcus
HTLMLGSIFVLFSDIIGR

SEQ ID NO: 1875698 - protein, 26 aa, Staphylococcus
HTLQFLDLIPIISFIFLKGKCRYCNE

SEQ ID NO: 1875699 - protein, 32 aa, Staphylococcus; identical to SEQ ID NO: 1741866

SEQ ID NO: 1875700 - protein, 17 aa, Staphylococcus
HTMMLGSIFVLISDIVG

SEQ ID NO: 1875701 - protein, 23 aa, Staphylococcus
HTNKFSGVFIYQDLKTIEDTNNV

SEQ ID NO: 1875702 - protein, 36 aa, Staphylococcus
HTSKQYLIYMLGFMPGFPYLGGLDSRIHMPRRSEPR

SEQ ID NO: 1875703 - protein, 19 aa, Staphylococcus
HTTLFKTLVRKVADGEVTL

SEQ ID NO: 1875704 - protein, 30 aa, Staphylococcus
HTVYGKENLYRIAIRYYGEGTQANVDKIKR

SEQ ID NO: 1875705 - protein, 21 aa, Staphylococcus
HTYILYRFIHDGILFTGPNDG

SEQ ID NO: 1875706 - protein, 18 aa, Staphylococcus
HVHLWIRQLLGPAMPYVA

SEQ ID NO: 1875707 - protein, 20 aa, Staphylococcus
HVIGFWPFNQLIVALGRSLL

SEQ ID NO: 1875708 - protein, 19 aa, Staphylococcus
HVLLPFMFGPIIAAIIVVK

SEQ ID NO: 1875709 - protein, 19 aa, Staphylococcus
HVLPILGLILCLFATIPGI

SEQ ID NO: 1875710 - protein, 23 aa, Staphylococcus
HVLPILGLILCLFATIPGVVLWN

SEQ ID NO: 1875711 - protein, 22 aa, Staphylococcus
HVPESFSGFAGMGHTGMLAGLL

SEQ ID NO: 1875712 - protein, 22 aa, Staphylococcus
HVPHFKLNYGTEVEKAIKAICT

SEQ ID NO: 1875713 - protein, 28 aa, Staphylococcus
HVPLSFKCHILLGFTILACWPFTRLVHV

SEQ ID NO: 1875714 - protein, 19 aa, Staphylococcus
HVPSIAFSLIWISINGYSL

SEQ ID NO: 1875715 - protein, 18 aa, Staphylococcus
HVQWAMLVAAFIVGIALF

SEQ ID NO: 1875716 - protein, 24 aa, Staphylococcus
HVSDKEIAMAQSAIKEESSLSDPS

SEQ ID NO: 1875717 - protein, 18 aa, Staphylococcus
HVSFLQRICIPPPVIGGL

SEQ ID NO: 1875718 - protein, 26 aa, Staphylococcus
HVSFPKRVFTALGIGIVLGIALHLIF

SEQ ID NO: 1875719 - protein, 26 aa, Staphylococcus
HVSFPKRVFTALGIGIVYGIVLHLSY

SEQ ID NO: 1875720 - protein, 26 aa, Staphylococcus
HVSFPKRVFTALGLGIVFGIALHLIY

SEQ ID NO: 1875721 - protein, 26 aa, Staphylococcus
HVSFPKRVFTALGLGIVYGIILHLIY

SEQ ID NO: 1875722 - protein, 21 aa, Staphylococcus
HVSYRTNATFRGRDTQRTGDN

SEQ ID NO: 1875723 - protein, 22 aa, Staphylococcus
HVVDIQRSFAVFTMASILTFVS

SEQ ID NO: 1875724 - protein, 33 aa, Staphylococcus
HVVSGNENLYRIAIQYYGEGTVENVNKLKQANG

SEQ ID NO: 1875725 - protein, 26 aa, Staphylococcus
HVYRQFELYSGYSIRMLMKNKLNHYI

SEQ ID NO: 1875726 - protein, 22 aa, Staphylococcus
HWDYVICLTDLPSISDNKVVIS

SEQ ID NO: 1875727 - protein, 26 aa, Staphylococcus
HWFELPRPFRFAGFGFDLDATLVFFI

SEQ ID NO: 1875728 - protein, 24 aa, Staphylococcus
HWFVGGLLGVCFLTGNLLLLPRLG

SEQ ID NO: 1875729 - protein, 18 aa, Staphylococcus
HWGLHAWAVYGIVALVFA

SEQ ID NO: 1875730 - protein, 19 aa, Staphylococcus
HWGVHAWAVYGIVALVFAY

SEQ ID NO: 1875731 - protein, 19 aa, Staphylococcus
HWGVHAWAVYGIVGLVFAY

SEQ ID NO: 1875732 - protein, 30 aa, Staphylococcus
HWLGIPRPFRFSGFGFDFGATLVFTIVAIV

SEQ ID NO: 1875733 - protein, 18 aa, Staphylococcus
HWLNSGILFLIELIIIVA

SEQ ID NO: 1875734 - protein, 24 aa, Staphylococcus
HWVGIPVPFRFSGFGFDVGATLVF

SEQ ID NO: 1875735 - protein, 19 aa, Staphylococcus
HYGCGCPFGCFSSIFISIV

SEQ ID NO: 1875736 - protein, 28 aa, Staphylococcus
HYGETVLPYMASVGLFVGAVSFAAIYPL

SEQ ID NO: 1875737 - protein, 23 aa, Staphylococcus
HYLNRPLAIIFWIIAELAIIATD

SEQ ID NO: 1875738 - protein, 34 aa, Staphylococcus
HYLPLFDIGMGWMLPALIGFIIGLIVYKIRLPRQ

SEQ ID NO: 1875739 - protein, 17 aa, Staphylococcus
HYNLRQQMLLNIVIGGT

SEQ ID NO: 1875740 - protein, 23 aa, Staphylococcus
HYPWDFLVIIIVALIFYQLGAIS

SEQ ID NO: 1875741 - protein, 23 aa, Staphylococcus
HYPYDFIAIIVLSLIFYKIGSSS

SEQ ID NO: 1875742 - protein, 24 aa, Staphylococcus
HYQFRNMKKYVAKLIFTMLILSVT

SEQ ID NO: 1875743 - protein, 24 aa, Staphylococcus
HYSIDILFGLCLVFGVVSLILSFF

SEQ ID NO: 1875744 - protein, 17 aa, Staphylococcus
HYSKFKGAYDQSFGLGG

SEQ ID NO: 1875745 - protein, 19 aa, Staphylococcus
HYTDFYLTMYIKRGQPDSN

SEQ ID NO: 1875746 - protein, 18 aa, Staphylococcus
HYVPEKWMLGLLGLIPIY

SEQ ID NO: 1875747 - protein, 19 aa, Staphylococcus
IAAACSKLGLATNQNIITI

SEQ ID NO: 1875748 - protein, 26 aa, Staphylococcus
IAAALCLLNASWVAFVLWLIASIMLF

SEQ ID NO: 1875749 - protein, 24 aa, Staphylococcus
IAAAVLFFFGQSSVKGFATMLLLG

SEQ ID NO: 1875750 - protein, 18 aa, Staphylococcus
IAAELGIIGILIFSIILI

SEQ ID NO: 1875751 - protein, 19 aa, Staphylococcus
IAAGGLLAFFLVKDKEGEK

SEQ ID NO: 1875752 - protein, 24 aa, Staphylococcus
IAAHMSWRIVYFILTVVYILLAFW

SEQ ID NO: 1875753 - protein, 22 aa, Staphylococcus
IAAIIPISGMRLGMPDDSLKPN

SEQ ID NO: 1875754 - protein, 18 aa, Staphylococcus
IAAIMYFILTFTLSRGMS

SEQ ID NO: 1875755 - protein, 24 aa, Staphylococcus
IAAKDAHILLGMGLLAYTLGLRHA

SEQ ID NO: 1875756 - protein, 20 aa, Staphylococcus
IAALFIPLGEQLGMSTMALI

SEQ ID NO: 1875757 - protein, 20 aa, Staphylococcus
IAALILLPPGFLGRQLELKH

SEQ ID NO: 1875758 - protein, 27 aa, Staphylococcus
IAALLIIFFRWGWADPLASVIVAILVL

SEQ ID NO: 1875759 - protein, 23 aa, Staphylococcus
IAAPFAACLVKILPMNILAVCVG

SEQ ID NO: 1875760 - protein, 22 aa, Staphylococcus
IAASVLCGVLFFSLNDQQMAAW

SEQ ID NO: 1875761 - protein, 27 aa, Staphylococcus
IADEALRFIIMYFRWRNDKWRARMKQI

SEQ ID NO: 1875762 - protein, 23 aa, Staphylococcus
IADEIMKGILPKNGYIENYLTRN

SEQ ID NO: 1875763 - protein, 18 aa, Staphylococcus
IADIFIPLIPAFVGAGLV

SEQ ID NO: 1875764 - protein, 21 aa, Staphylococcus
IAELFSAAGIFHFLKPEGFTR

SEQ ID NO: 1875765 - protein, 18 aa, Staphylococcus
IAESAYLIGLLQSPYTYT

SEQ ID NO: 1875766 - protein, 20 aa, Staphylococcus
IAESLDFLFLKSGYYYLLSL

SEQ ID NO: 1875767 - protein, 23 aa, Staphylococcus
IAESYRAAILFHQWYFIDHWKLM

SEQ ID NO: 1875768 - protein, 25 aa, Staphylococcus
IAETICAIASMLIVYALRDRLTVDT

SEQ ID NO: 1875769 - protein, 24 aa, Staphylococcus
IAETLCALAAMLIVYLLRNKLTVD

SEQ ID NO: 1875770 - protein, 21 aa, Staphylococcus
IAETLRAYLYFDGYKQILDKY

SEQ ID NO: 1875771 - protein, 25 aa, Staphylococcus
IAETVCAFLAMFIVYSLRNRLTVDK

SEQ ID NO: 1875772 - protein, 18 aa, Staphylococcus
IAFANIFVYFVRYGVLDW

SEQ ID NO: 1875773 - protein, 17 aa, Staphylococcus
IAFCVGFIMYSIIKIFF

SEQ ID NO: 1875774 - protein, 17 aa, Staphylococcus
IAFGLLSLTSYAAEVPD

SEQ ID NO: 1875775 - protein, 19 aa, Staphylococcus
IAFICSFSTLKLSMIDIPM

SEQ ID NO: 1875776 - protein, 17 aa, Staphylococcus
IAFILVLIVLILLIILF

SEQ ID NO: 1875777 - protein, 19 aa, Staphylococcus
IAFISGWSVLFGYVSVITF

SEQ ID NO: 1875778 - protein, 32 aa, Staphylococcus
IAFLIAFAIYIFRFIWVYVLFKDFYYPKNVEA

SEQ ID NO: 1875779 - protein, 27 aa, Staphylococcus
IAFLVCIGCTGLYSALFPFTFKFGPEN

SEQ ID NO: 1875780 - protein, 21 aa, Staphylococcus
IAFRTRIQRPISIVLGILLTV

SEQ ID NO: 1875781 - protein, 25 aa, Staphylococcus
IAGACASSAMLLPGISGSFMLLVFG

SEQ ID NO: 1875782 - protein, 18 aa, Staphylococcus
IAGAIGWQSTVRLYLIVM

SEQ ID NO: 1875783 - protein, 18 aa, Staphylococcus
IAGILTLWYYWRKRKKNI

SEQ ID NO: 1875784 - protein, 26 aa, Staphylococcus
IAGILTLWYYWRKRKPFIDEMTASDH

SEQ ID NO: 1875785 - protein, 18 aa, Staphylococcus
IAGILTLWYYWRKRKPHI

SEQ ID NO: 1875786 - protein, 20 aa, Staphylococcus
IAGKGASNWAYAIVPVLGPI

SEQ ID NO: 1875787 - protein, 19 aa, Staphylococcus
IAGKLLGLTVKELWISVLT

SEQ ID NO: 1875788 - protein, 18 aa, Staphylococcus
IAGLAIVVMTSFAFTQID

SEQ ID NO: 1875789 - protein, 18 aa, Staphylococcus
IAGLFPKAFGSRAQAIYN

SEQ ID NO: 1875790 - protein, 23 aa, Staphylococcus
IAGTFLFVKLVQYIRFTDVIFIP

SEQ ID NO: 1875791 - protein, 20 aa, Staphylococcus
IAGVASIRIGGHPQFVRPLI

SEQ ID NO: 1875792 - protein, 25 aa, Staphylococcus
IAHGFGWKGSFGLNQILGVFMYPFA

SEQ ID NO: 1875793 - protein, 20 aa, Staphylococcus
IAIAAFFTKIGWAHNQDIIT

SEQ ID NO: 1875794 - protein, 21 aa, Staphylococcus
IAIAEVVRYEASFFYYLFSKN

SEQ ID NO: 1875795 - protein, 20 aa, Staphylococcus
IAICAVLLMQLGFKALPAAM

SEQ ID NO: 1875796 - protein, 26 aa, Staphylococcus
IAIEIARLRTWLSIIVEEQNSDTIHT

SEQ ID NO: 1875797 - protein, 23 aa, Staphylococcus
IAIERELKGIIAVADTVKDTAKQ

SEQ ID NO: 1875798 - protein, 27 aa, Staphylococcus
IAIGFGASFLFNWLIKLDFISQGLMPS

SEQ ID NO: 1875799 - protein, 21 aa, Staphylococcus
IAIGVIRGFDLYPFKDPISIF

SEQ ID NO: 1875800 - protein, 25 aa, Staphylococcus
IAIIALLILFSFVPIGLWISAIAAG

SEQ ID NO: 1875801 - protein, 18 aa, Staphylococcus
IAIILGFGAIRIATGAIT

SEQ ID NO: 1875802 - protein, 17 aa, Staphylococcus
IAIILVVITFHFENEST

SEQ ID NO: 1875803 - protein, 19 aa, Staphylococcus
IAIISCIVSIFVLDISFLL

SEQ ID NO: 1875804 - protein, 17 aa, Staphylococcus
IAILALEHNHAFKGLSW

SEQ ID NO: 1875805 - protein, 23 aa, Staphylococcus
IAILNIMVSFVFIKNQIYFEDHK

SEQ ID NO: 1875806 - protein, 26 aa, Staphylococcus
IAILTFSIWLLWIHPGSFEDALVAAI

SEQ ID NO: 1875807 - protein, 28 aa, Staphylococcus
IAILVLINLFLAWFLMYFPWGKTAVQSL

SEQ ID NO: 1875808 - protein, 21 aa, Staphylococcus
IAISCKLILYLIIVTFDNIVA

SEQ ID NO: 1875809 - protein, 24 aa, Staphylococcus
IAISHYRFRRAFKVQNYNKHELKY

SEQ ID NO: 1875810 - protein, 24 aa, Staphylococcus
IAITVCITLAISHKVSGLTKDERQ

SEQ ID NO: 1875811 - protein, 20 aa, Staphylococcus
IAIVFKLIYLAGAIQASQSL

SEQ ID NO: 1875812 - protein, 20 aa, Staphylococcus
IAIVIGSLFNAFPYTAYSQN

SEQ ID NO: 1875813 - protein, 20 aa, Staphylococcus
IAIYTVVIMLFSAVASFILS

SEQ ID NO: 1875814 - protein, 26 aa, Staphylococcus
IAKALTDWCNLAFVTKLVLGQSEQPR

SEQ ID NO: 1875815 - protein, 32 aa, Staphylococcus
IAKANFGSWFKFMIPLFIVWLVVGSIVLFIFT

SEQ ID NO: 1875816 - protein, 24 aa, Staphylococcus
IAKDDTWILWAIIIVWATVSIFLE

SEQ ID NO: 1875817 - protein, 22 aa, Staphylococcus
IAKDKYLGFSYSQLINEIEGEL

SEQ ID NO: 1875818 - protein, 17 aa, Staphylococcus
IAKKISPVVGMILIPSI

SEQ ID NO: 1875819 - protein, 21 aa, Staphylococcus
IAKKLANGHLSQSQIVEQLKR

SEQ ID NO: 1875820 - protein, 24 aa, Staphylococcus
IAKNKWVSILAWLIVLGVIITPLM

SEQ ID NO: 1875821 - protein, 37 aa, Staphylococcus
IAKTPAVLVILGGLALLPSFYAWFNLEATWDPYGNTK

SEQ ID NO: 1875822 - protein, 18 aa, Staphylococcus
IAKTWPIYTLFTLSSVSS

SEQ ID NO: 1875823 - protein, 26 aa, Staphylococcus
IALAIYLFRFLWVFVLYPYFYLPVSP

SEQ ID NO: 1875824 - protein, 26 aa, Staphylococcus
IALAPGMGLNAFFAFTVVLNLGIPWQ

SEQ ID NO: 1875825 - protein, 26 aa, Staphylococcus
IALAPGMGLNAFFAFTVVLTMGIPWQ

SEQ ID NO: 1875826 - protein, 19 aa, Staphylococcus
IALEHFKSEIVPLESHFFW

SEQ ID NO: 1875827 - protein, 19 aa, Staphylococcus
IALFASWLLIPQKLSRYII

SEQ ID NO: 1875828 - protein, 17 aa, Staphylococcus
IALFLIYSKSDEETNDT

SEQ ID NO: 1875829 - protein, 20 aa, Staphylococcus
IALGALYLPILFKVVKLQLN

SEQ ID NO: 1875830 - protein, 20 aa, Staphylococcus
IALGALYLPVLFKVIQLQLN

SEQ ID NO: 1875831 - protein, 25 aa, Staphylococcus
IALGRLFIKGSSIWLLDEPTTALDE

SEQ ID NO: 1875832 - protein, 17 aa, Staphylococcus
IALGVWLVLGLVFFAIR

SEQ ID NO: 1875833 - protein, 18 aa, Staphylococcus
IALICIIIRGCSYIFINK

SEQ ID NO: 1875834 - protein, 19 aa, Staphylococcus
IALIICILVGALFFTPQIG

SEQ ID NO: 1875835 - protein, 18 aa, Staphylococcus
IALLAYVLQVIFFGCSTM

SEQ ID NO: 1875836 - protein, 41 aa, Staphylococcus
IALLKLSKIKLLSWLASAYIEFLRGTPLLVQVFLVYFGTTA

SEQ ID NO: 1875837 - protein, 19 aa, Staphylococcus
IALMVPLMLVVSFLTFLLT

SEQ ID NO: 1875838 - protein, 19 aa, Staphylococcus
IALSILAFFLIKHTPETKV

SEQ ID NO: 1875839 - protein, 17 aa, Staphylococcus
IALSLIIAYFFKKIARV

SEQ ID NO: 1875840 - protein, 21 aa, Staphylococcus
IALTFIRQRLTMVVLNGIIGY

SEQ ID NO: 1875841 - protein, 25 aa, Staphylococcus
IALTLLCVMFSICWIAYIQWESTIA

SEQ ID NO: 1875842 - protein, 25 aa, Staphylococcus
IALVFRLNQSLTFWSAGGVSGTTWH

SEQ ID NO: 1875843 - protein, 17 aa, Staphylococcus
IALVVAIGIVAIGSFIG

SEQ ID NO: 1875844 - protein, 17 aa, Staphylococcus
IALVVAVGIVAIGSFIG

SEQ ID NO: 1875845 - protein, 17 aa, Staphylococcus
IALVVAVGVVAVGSFIG

SEQ ID NO: 1875846 - protein, 36 aa, Staphylococcus
IALWLCLIGFTTLFAFLCYLIWSSVFGSRHFNQSVD

SEQ ID NO: 1875847 - protein, 21 aa, Staphylococcus
IALYMLIQFFINRRAVTELNQ

SEQ ID NO: 1875848 - protein, 18 aa, Staphylococcus
IAMHLWQTRLQKAFFGKA

SEQ ID NO: 1875849 - protein, 19 aa, Staphylococcus
IAMHLWQTRLQKAFFGKAV

SEQ ID NO: 1875850 - protein, 17 aa, Staphylococcus
IAMISIFLSLVIGAQQV

SEQ ID NO: 1875851 - protein, 33 aa, Staphylococcus
IAMNQYEVMAGYRAKFVGLIILTMIVFVLLNTY

SEQ ID NO: 1875852 - protein, 17 aa, Staphylococcus
IAMRFKLSPLATAVVAS

SEQ ID NO: 1875853 - protein, 27 aa, Staphylococcus
IANALKPTWILMSWATVLMLPLGVGLG

SEQ ID NO: 1875854 - protein, 18 aa, Staphylococcus
IANATSLITNADIFNTGS

SEQ ID NO: 1875855 - protein, 26 aa, Staphylococcus
IANDGYRIQPHIGLAIHDATNSDDIG

SEQ ID NO: 1875856 - protein, 22 aa, Staphylococcus
IANDVFKWIKLVLNDTTEYHHV

SEQ ID NO: 1875857 - protein, 25 aa, Staphylococcus
IANEGYRFITVYTVAAMFYWLLAMI

SEQ ID NO: 1875858 - protein, 29 aa, Staphylococcus
IANKELKLIMSLGFILGGIIGIFQGIVAI

SEQ ID NO: 1875859 - protein, 30 aa, Staphylococcus
IANKELKLIMSLGFLLGGIIGFFQGVIAIF

SEQ ID NO: 1875860 - protein, 25 aa, Staphylococcus
IANNGYRIQPHIGLAIHDSTNTDEL

SEQ ID NO: 1875861 - protein, 26 aa, Staphylococcus
IANNGYRIQPHIGLAIHESTNKDDLG

SEQ ID NO: 1875862 - protein, 25 aa, Staphylococcus
IANNGYRIQPHIGLSIHDATNKDEL

SEQ ID NO: 1875863 - protein, 23 aa, Staphylococcus
IANNGYRIQPHVGLEIRKATNKD

SEQ ID NO: 1875864 - protein, 26 aa, Staphylococcus
IANNGYRVQPHIGLAIHDATNSDQVG

SEQ ID NO: 1875865 - protein, 17 aa, Staphylococcus
IAPSFGVLMFARVIQAI

SEQ ID NO: 1875866 - protein, 20 aa, Staphylococcus
IAPWLGRTALTWIVNMSSTG

SEQ ID NO: 1875867 - protein, 17 aa, Staphylococcus
IAQFFSLAIWILLVVLI

SEQ ID NO: 1875868 - protein, 28 aa, Staphylococcus
IAQGFNWLVAVAPWLAGLLIGAFWQVFV

SEQ ID NO: 1875869 - protein, 25 aa, Staphylococcus
IAQIKANAMNDLNAVVVNVEQKAIA

SEQ ID NO: 1875870 - protein, 25 aa, Staphylococcus
IAQILCFICLVFSYNSGLLLLAGIL

SEQ ID NO: 1875871 - protein, 18 aa, Staphylococcus
IAQQIPIVVVSIVSVLSV

SEQ ID NO: 1875872 - protein, 24 aa, Staphylococcus
IAQRLELFIPFPKTRAFDLNYAIQ

SEQ ID NO: 1875873 - protein, 25 aa, Staphylococcus
IAQSRFQNILLMVMIIPTWINLLLK

SEQ ID NO: 1875874 - protein, 25 aa, Staphylococcus
IAQSYRAAILFHEWYFIQHWRLLVY

SEQ ID NO: 1875875 - protein, 27 aa, Staphylococcus
IARRIANIGKYDFYSFQGLLPADNQRL

SEQ ID NO: 1875876 - protein, 20 aa, Staphylococcus
IASFFGAFVMLNYILSDMIF

SEQ ID NO: 1875877 - protein, 17 aa, Staphylococcus
IASILVSVIILKSAYGI

SEQ ID NO: 1875878 - protein, 23 aa, Staphylococcus
IASKRLLPSIGIGLITAVVLIIV

SEQ ID NO: 1875879 - protein, 19 aa, Staphylococcus
IASLFSVRYMMLKNYQNNL

SEQ ID NO: 1875880 - protein, 19 aa, Staphylococcus
IASMLVSVLLLRSSYGLIK

SEQ ID NO: 1875881 - protein, 18 aa, Staphylococcus
IASPISGKLDSFDAKEDK

SEQ ID NO: 1875882 - protein, 20 aa, Staphylococcus
IASYAALIVMYIIHLIIVSG

SEQ ID NO: 1875883 - protein, 24 aa, Staphylococcus
IATALSALAFILSLFLKGKDHYMS

SEQ ID NO: 1875884 - protein, 22 aa, Staphylococcus
IATAMLIFRKKFTKEQRGSIVP

SEQ ID NO: 1875885 - protein, 23 aa, Staphylococcus
IATGGLFPIAMVLPINMTSTPSD

SEQ ID NO: 1875886 - protein, 23 aa, Staphylococcus
IATICMAAFYLLVGLDFEIFQYQ

SEQ ID NO: 1875887 - protein, 26 aa, Staphylococcus
IATLIIYFPFIKDWISKGYVFSGVGD

SEQ ID NO: 1875888 - protein, 25 aa, Staphylococcus
IATMVLCAIFILSAYNNANSEQTYE

SEQ ID NO: 1875889 - protein, 26 aa, Staphylococcus
IATPVFRPLFVWQFNRVLAYIYFVVL

SEQ ID NO: 1875890 - protein, 17 aa, Staphylococcus
IATYLYKKTNGFFLLAP

SEQ ID NO: 1875891 - protein, 38 aa, Staphylococcus
IAVCGLSLVGIDFLAIMGFASAISVLFAVLAALTLLPA

SEQ ID NO: 1875892 - protein, 38 aa, Staphylococcus
IAVCGLSLVGIDFLAVMGFASAISVLFAVFAALTLLPA

SEQ ID NO: 1875893 - protein, 25 aa, Staphylococcus
IAVCGLSLVGIDFLSVMGFASAISV

SEQ ID NO: 1875894 - protein, 20 aa, Staphylococcus
IAVEGFNWYAYQSRNKKLIY

SEQ ID NO: 1875895 - protein, 18 aa, Staphylococcus
IAVILGFGAIRIATGAIT

SEQ ID NO: 1875896 - protein, 24 aa, Staphylococcus
IAVIPVIVCLIIFHGNEAMMEQLL

SEQ ID NO: 1875897 - protein, 32 aa, Staphylococcus
IAVIYLFMLGFYRLPGLVAVIALTTYIYLTLV

SEQ ID NO: 1875898 - protein, 32 aa, Staphylococcus
IAVIYLFMVGFYRLPGFVAIIALTTYIYLTLV

SEQ ID NO: 1875899 - protein, 25 aa, Staphylococcus
IAVLLIALIVAFSVLKNQFSPEKQA

SEQ ID NO: 1875900 - protein, 18 aa, Staphylococcus
IAVMAVICIVLIIMMMSS

SEQ ID NO: 1875901 - protein, 24 aa, Staphylococcus
IAVPLAAGVLAFAGLILSPAVGAI

SEQ ID NO: 1875902 - protein, 18 aa, Staphylococcus
IAVPLWGIMKKRQLKKSD

SEQ ID NO: 1875903 - protein, 18 aa, Staphylococcus
IAVPLWGIMKKRQLKKSP

SEQ ID NO: 1875904 - protein, 17 aa, Staphylococcus
IAVSAIFLLLYKRLKKA

SEQ ID NO: 1875905 - protein, 17 aa, Staphylococcus
IAVSIMIHMMQNGFVVI

SEQ ID NO: 1875906 - protein, 19 aa, Staphylococcus
IAVSQYWWLFLISIICLIA

SEQ ID NO: 1875907 - protein, 32 aa, Staphylococcus
IAVVIGVLLICGIGGAAAYYFTKNTPKNTYLL

SEQ ID NO: 1875908 - protein, 25 aa, Staphylococcus
IAVVLAMLIAIFAILKHQFSPESQA

SEQ ID NO: 1875909 - protein, 25 aa, Staphylococcus
IAVVLMYIVGIWMHRRSSAKRWNDM

SEQ ID NO: 1875910 - protein, 26 aa, Staphylococcus
IAWSPFIGGFVARVSRGRTIREFVIG

SEQ ID NO: 1875911 - protein, 21 aa, Staphylococcus
IAYACSRNRKHIQWKSIGILV

SEQ ID NO: 1875912 - protein, 23 aa, Staphylococcus
IAYWNRHPYLWWFMFAVYISNAF

SEQ ID NO: 1875913 - protein, 21 aa, Staphylococcus
ICDSVRWKMSVIDTLLTPINK

SEQ ID NO: 1875914 - protein, 17 aa, Staphylococcus
ICGLLLAPLFYEYVQIN

SEQ ID NO: 1875915 - protein, 35 aa, Staphylococcus
ICGPILVKLTHRFSARSVLLWTLLIFIIGNAMIAL

SEQ ID NO: 1875916 - protein, 17 aa, Staphylococcus
ICGTILVLSSYKFWSKN

SEQ ID NO: 1875917 - protein, 19 aa, Staphylococcus
ICHPQSKIGRRFKLISFFI

SEQ ID NO: 1875918 - protein, 17 aa, Staphylococcus
ICHTGSKIGRKLKLLSL

SEQ ID NO: 1875919 - protein, 25 aa, Staphylococcus
ICILIGAGVSYCYTIYLFDYYPFIN

SEQ ID NO: 1875920 - protein, 20 aa, Staphylococcus
ICILPIYKIFIYEPFNLKQL

SEQ ID NO: 1875921 - protein, 20 aa, Staphylococcus
ICIPLAFLGAKNIVKLRPVT

SEQ ID NO: 1875922 - protein, 21 aa, Staphylococcus
ICIPLAFLGAQNMVKLRPVSG

SEQ ID NO: 1875923 - protein, 26 aa, Staphylococcus
ICIRVFKMDIQWPFWISQLGLILLGV

SEQ ID NO: 1875924 - protein, 21 aa, Staphylococcus
ICLIGVFGCMIYRSFQEDHGY

SEQ ID NO: 1875925 - protein, 19 aa, Staphylococcus
ICLITISLMLFLFKKKVAI

SEQ ID NO: 1875926 - protein, 20 aa, Staphylococcus
ICLLLKKKYFAGLILILSLP

SEQ ID NO: 1875927 - protein, 19 aa, Staphylococcus
ICLSLFILFFGATWGPIMW

SEQ ID NO: 1875928 - protein, 20 aa, Staphylococcus
ICMGIVLGFFAQIFVQGGTI

SEQ ID NO: 1875929 - protein, 24 aa, Staphylococcus
ICQGSAAFGAWLIYKRRKMAKEEG

SEQ ID NO: 1875930 - protein, 18 aa, Staphylococcus
ICSFIRFILQPINRYSYR

SEQ ID NO: 1875931 - protein, 34 aa, Staphylococcus
ICTLFGGLMSTHFGWRTIFIVSIVLTLLSMYLIK

SEQ ID NO: 1875932 - protein, 22 aa, Staphylococcus
ICTYIPIVGLLLSFISPSVGIP

SEQ ID NO: 1875933 - protein, 17 aa, Staphylococcus
ICVAYWALNALRLEQLF

SEQ ID NO: 1875934 - protein, 19 aa, Staphylococcus
ICVIGELCLSPTGNSAAVK

SEQ ID NO: 1875935 - protein, 29 aa, Staphylococcus
ICVKAFKLEIKWPFWLSQIGLIFLGVQIG

SEQ ID NO: 1875936 - protein, 24 aa, Staphylococcus
IDAFNKLGKLGMRYFDKVPGGSIV

SEQ ID NO: 1875937 - protein, 23 aa, Staphylococcus
IDAFSWRMPFYVVATIAIIAFVI

SEQ ID NO: 1875938 - protein, 17 aa, Staphylococcus
IDALLIFVLVIALIAIL

SEQ ID NO: 1875939 - protein, 21 aa, Staphylococcus
IDALLIKLAHKYKADVITTDF

SEQ ID NO: 1875940 - protein, 20 aa, Staphylococcus
IDALVGIGMFFVSYFPTQRL

SEQ ID NO: 1875941 - protein, 19 aa, Staphylococcus
IDASDLKKGDIVRVETGEQ

SEQ ID NO: 1875942 - protein, 18 aa, Staphylococcus
IDAVPIRILIFYVGALAV

SEQ ID NO: 1875943 - protein, 25 aa, Staphylococcus
IDDGWAKNGTYCIIRRIQIHIETWD

SEQ ID NO: 1875944 - protein, 27 aa, Staphylococcus
IDFGDLRYSTAIAFIFVNFLSIPIAFS

SEQ ID NO: 1875945 - protein, 25 aa, Staphylococcus
IDFILFRLIPTFIINFILLLILYPI

SEQ ID NO: 1875946 - protein, 28 aa, Staphylococcus
IDFLKSYKWRIIGFFAFLIIAILFLTLG

SEQ ID NO: 1875947 - protein, 23 aa, Staphylococcus
IDFLSVMGFASAISVAFAVFSAL

SEQ ID NO: 1875948 - protein, 25 aa, Staphylococcus
IDFLVFRLLLAGIFLLLYLSFSKKQ

SEQ ID NO: 1875949 - protein, 17 aa, Staphylococcus
IDFPHIYLPFKDYVPSI

SEQ ID NO: 1875950 - protein, 20 aa, Staphylococcus
IDGFSSIILYDVFMAGLMFG

SEQ ID NO: 1875951 - protein, 23 aa, Staphylococcus
IDGHIGIGHTRWATHGVPSTVNS

SEQ ID NO: 1875952 - protein, 17 aa, Staphylococcus
IDGLSPFFKNYLPQVFK

SEQ ID NO: 1875953 - protein, 21 aa, Staphylococcus
IDGSIGIGHTRWATHGVPNYQ

SEQ ID NO: 1875954 - protein, 19 aa, Staphylococcus
IDHFRILNRMGFTHHDMLK

SEQ ID NO: 1875955 - protein, 19 aa, Staphylococcus
IDHVSWRVPFIIIVGIALI

SEQ ID NO: 1875956 - protein, 18 aa, Staphylococcus
IDIFPVKNYGSGMTPFYT

SEQ ID NO: 1875957 - protein, 17 aa, Staphylococcus
IDIKADFFLPDDTHAKT

SEQ ID NO: 1875958 - protein, 24 aa, Staphylococcus
IDIKFWVIMVIIGFLYICKEIFYP

SEQ ID NO: 1875959 - protein, 25 aa, Staphylococcus
IDIRVPIYGHRMLKNLTLDSFIFRN

SEQ ID NO: 1875960 - protein, 18 aa, Staphylococcus
IDISGFSFPSGHAMGATS

SEQ ID NO: 1875961 - protein, 18 aa, Staphylococcus
IDISGFSFPSGHAMGSTA

SEQ ID NO: 1875962 - protein, 18 aa, Staphylococcus
IDKDLILSILIGVVGSLV

SEQ ID NO: 1875963 - protein, 24 aa, Staphylococcus
IDKKEFMAVSGLGRMGYNENYIAG

SEQ ID NO: 1875964 - protein, 23 aa, Staphylococcus
IDKKEFMEVSGIVRMGYNENYIV

SEQ ID NO: 1875965 - protein, 24 aa, Staphylococcus
IDKKEFMSVSGIGRMGYNNKYLAG

SEQ ID NO: 1875966 - protein, 18 aa, Staphylococcus
IDKLKALIDAKTLAKQEI

SEQ ID NO: 1875967 - protein, 23 aa, Staphylococcus
IDKRFLPIAIKYLVAHYGLGIIA

SEQ ID NO: 1875968 - protein, 23 aa, Staphylococcus
IDKYPELRLRLVKGAYKENDTIA

SEQ ID NO: 1875969 - protein, 24 aa, Staphylococcus
IDLFLHRLTIILAIIFFIILIGIS

SEQ ID NO: 1875970 - protein, 19 aa, Staphylococcus
IDLFLHRLTIVLSVIFFLL

SEQ ID NO: 1875971 - protein, 31 aa, Staphylococcus
IDLKKFWTRRIKRLIPAMVFVVSIVTIVTLL

SEQ ID NO: 1875972 - protein, 18 aa, Staphylococcus
IDLLSIIFIMMFISNPGY

SEQ ID NO: 1875973 - protein, 17 aa, Staphylococcus
IDLPKLIIPILLIIGLL

SEQ ID NO: 1875974 - protein, 19 aa, Staphylococcus
IDLPSELTKTVNINNPGNY

SEQ ID NO: 1875975 - protein, 20 aa, Staphylococcus
IDLRLPRIIIALCVGAMLSV

SEQ ID NO: 1875976 - protein, 21 aa, Staphylococcus
IDLSVGASFIPYSDGGSTKST

SEQ ID NO: 1875977 - protein, 20 aa, Staphylococcus
IDLYLSIPWFAASISTVAGA

SEQ ID NO: 1875978 - protein, 22 aa, Staphylococcus
IDMDHVEGIAFAIPVNDAESIA

SEQ ID NO: 1875979 - protein, 29 aa, Staphylococcus
IDMMKGIGFKILFNFGLPLLIALLHALFA

SEQ ID NO: 1875980 - protein, 17 aa, Staphylococcus
IDMSELERLFKVSMISF

SEQ ID NO: 1875981 - protein, 18 aa, Staphylococcus
IDNASWRVPFIIIVGIAL

SEQ ID NO: 1875982 - protein, 17 aa, Staphylococcus
IDNSHKNGIAIHGKTNS

SEQ ID NO: 1875983 - protein, 24 aa, Staphylococcus
IDNTSWRVPFIIVVAISAVIFIFG

SEQ ID NO: 1875984 - protein, 25 aa, Staphylococcus
IDNTSWRVPFIIVVGIALVGYIFGA

SEQ ID NO: 1875985 - protein, 31 aa, Staphylococcus
IDPNNPSIVWPRYTDLASLTKSVTRTIKYVD

SEQ ID NO: 1875986 - protein, 24 aa, Staphylococcus
IDQVTKWIIASSMKIGDSYEVIPN

SEQ ID NO: 1875987 - protein, 24 aa, Staphylococcus
IDRERYYFHFSIVFMLVGIIGAFT

SEQ ID NO: 1875988 - protein, 25 aa, Staphylococcus
IDRERYYYHFSITFMLVGIIGAFTT

SEQ ID NO: 1875989 - protein, 25 aa, Staphylococcus
IDRFSEIYTPIVFILALLVMVIPPI

SEQ ID NO: 1875990 - protein, 19 aa, Staphylococcus
IDRGGAEKLLGKGDMLYFG

SEQ ID NO: 1875991 - protein, 20 aa, Staphylococcus
IDRKRLLVIGNIGMVASLLI

SEQ ID NO: 1875992 - protein, 26 aa, Staphylococcus
IDRLLGIIIGCLWIVFFMMILFQQNY

SEQ ID NO: 1875993 - protein, 26 aa, Staphylococcus
IDSAAFLRIPVGLNHNPIVEYYVEDD

SEQ ID NO: 1875994 - protein, 17 aa, Staphylococcus
IDSDWQTAVSICEKALD

SEQ ID NO: 1875995 - protein, 19 aa, Staphylococcus
IDSFFNYFVGMSRYLTYIL

SEQ ID NO: 1875996 - protein, 21 aa, Staphylococcus
IDSFFNYLFGASRYLTYILVS

SEQ ID NO: 1875997 - protein, 20 aa, Staphylococcus
IDSFFNYLFGMSRYLTYILL

SEQ ID NO: 1875998 - protein, 18 aa, Staphylococcus
IDSPEFQDLQLLVQTLHE

SEQ ID NO: 1875999 - protein, 26 aa, Staphylococcus
IDSQLLKGHVYNGISGAQFKELPTMS

SEQ ID NO: 1876000 - protein, 26 aa, Staphylococcus
IDSQLLKGHVYNGISGAQFQELPMLK

SEQ ID NO: 1876001 - protein, 26 aa, Staphylococcus
IDSQLLKGHVYNGISGAQFSELPTME

SEQ ID NO: 1876002 - protein, 22 aa, Staphylococcus
IDSQLLKGHVYNGISNKQFAEL

SEQ ID NO: 1876003 - protein, 26 aa, Staphylococcus
IDSQLLKGHVYNGVSAAQFKEQPMME

SEQ ID NO: 1876004 - protein, 25 aa, Staphylococcus
IDSQLLKGHVYQGISGKQFNELPMM

SEQ ID NO: 1876005 - protein, 21 aa, Staphylococcus
IDTKYEFKAGGKRRVIHAKAN

SEQ ID NO: 1876006 - protein, 27 aa, Staphylococcus
IDTPGGIICLILQFVLYSLVTKLVGAL

SEQ ID NO: 1876007 - protein, 24 aa, Staphylococcus
IDVKWGAAITAIFSILIFVSKSGQ

SEQ ID NO: 1876008 - protein, 17 aa, Staphylococcus
IDVMVIFLREGLEVLLI

SEQ ID NO: 1876009 - protein, 26 aa, Staphylococcus
IDVTPGSELQFHFIGTSMGNISGFNS

SEQ ID NO: 1876010 - protein, 17 aa, Staphylococcus
IDVVSLLAGYLIIDQLE

SEQ ID NO: 1876011 - protein, 17 aa, Staphylococcus
IDWEVAKDLPWGVLILF

SEQ ID NO: 1876012 - protein, 18 aa, Staphylococcus
IDYISSILKSRDLMYRNR

SEQ ID NO: 1876013 - protein, 24 aa, Staphylococcus
IDYKGGGMANLFKNLKHLVGTITN

SEQ ID NO: 1876014 - protein, 20 aa, Staphylococcus
IDYMPGFSRILTGVIIASFW

SEQ ID NO: 1876015 - protein, 25 aa, Staphylococcus
IEALTPLLCDRARIYLSSAKGEQDI

SEQ ID NO: 1876016 - protein, 18 aa, Staphylococcus
IEANITRKTLYIGAFTSL

SEQ ID NO: 1876017 - protein, 25 aa, Staphylococcus
IEAPIPGRSAVGIEVPNDKISLVSL

SEQ ID NO: 1876018 - protein, 17 aa, Staphylococcus
IEDEGFKIVGIANDAME

SEQ ID NO: 1876019 - protein, 23 aa, Staphylococcus
IEDNLRYRQIIFSHREDLKTITA

SEQ ID NO: 1876020 - protein, 22 aa, Staphylococcus
IEDSLRYRQIIFEHKDDKKSLS

SEQ ID NO: 1876021 - protein, 17 aa, Staphylococcus
IEELVRIRWYYRLASAL

SEQ ID NO: 1876022 - protein, 27 aa, Staphylococcus
IEFGFCISGFTYLISMIFLLFTLAFNR

SEQ ID NO: 1876023 - protein, 28 aa, Staphylococcus
IEFIIKWKIYLIIGLVVLAMVVLSLFNH

SEQ ID NO: 1876024 - protein, 18 aa, Staphylococcus
IEGEIKSPVIGKVSMIAP

SEQ ID NO: 1876025 - protein, 21 aa, Staphylococcus
IEGFEAVVLLDVFVTGTMFGL

SEQ ID NO: 1876026 - protein, 18 aa, Staphylococcus
IEGFIMRKYKLAHLHLST

SEQ ID NO: 1876027 - protein, 17 aa, Staphylococcus
IEGFSLGKAFQRCQLPV

SEQ ID NO: 1876028 - protein, 21 aa, Staphylococcus
IEGLPTLSWIGFYPSFETIIA

SEQ ID NO: 1876029 - protein, 21 aa, Staphylococcus
IEGMDCGSCAKSIEKHLNNLP

SEQ ID NO: 1876030 - protein, 17 aa, Staphylococcus
IEGMKIIQAFNQERRLN

SEQ ID NO: 1876031 - protein, 22 aa, Staphylococcus
IEGPTTFIWVCVVTLIAQQLEG

SEQ ID NO: 1876032 - protein, 23 aa, Staphylococcus
IEIIATKADDQWNLNHKISGIQI

SEQ ID NO: 1876033 - protein, 18 aa, Staphylococcus
IEKHPLYIPMMLMLLLGA

SEQ ID NO: 1876034 - protein, 25 aa, Staphylococcus
IEKKRLKWGSLLFHLGIIPVAAGHF

SEQ ID NO: 1876035 - protein, 26 aa, Staphylococcus
IEKNGKRFGVFDHYTFNIPKYSIAMY

SEQ ID NO: 1876036 - protein, 25 aa, Staphylococcus
IELDTSLLRYYLWMTAIVIFIIVAF

SEQ ID NO: 1876037 - protein, 24 aa, Staphylococcus
IELTKRIIQTIAHIDEKKINELIY

SEQ ID NO: 1876038 - protein, 18 aa, Staphylococcus
IENKSNFVSADNMPNYVK

SEQ ID NO: 1876039 - protein, 17 aa, Staphylococcus
IENNHFILTTGIFNKER

SEQ ID NO: 1876040 - protein, 26 aa, Staphylococcus
IENYKQYRYLIIILVLLVIILLIFIK

SEQ ID NO: 1876041 - protein, 21 aa, Staphylococcus
IEPLVAIIISITWLNESFGYY

SEQ ID NO: 1876042 - protein, 17 aa, Staphylococcus
IEPYPSLNNEVFAEIYS

SEQ ID NO: 1876043 - protein, 23 aa, Staphylococcus
IEQLRAAIVYVVLNIIGSWLFLL

SEQ ID NO: 1876044 - protein, 23 aa, Staphylococcus
IERERYYYYFSIMFMLIGIIGAF

SEQ ID NO: 1876045 - protein, 29 aa, Staphylococcus
IERLKAAKLKADKFIEGLNHINKAQLTHG

SEQ ID NO: 1876046 - protein, 23 aa, Staphylococcus
IERLPAMILPNWAHNMIAPVSID

SEQ ID NO: 1876047 - protein, 20 aa, Staphylococcus
IERYLTCKKIGLFVVTTSLI

SEQ ID NO: 1876048 - protein, 19 aa, Staphylococcus
IESDKKPSAEEIAIAQTAI

SEQ ID NO: 1876049 - protein, 20 aa, Staphylococcus
IESICKRDPLAGKTVTGGII

SEQ ID NO: 1876050 - protein, 25 aa, Staphylococcus
IESNEIFLVLGVMIVLVLARFITAY

SEQ ID NO: 1876051 - protein, 20 aa, Staphylococcus
IETKFSIKVVDTTAPTVKGI

SEQ ID NO: 1876052 - protein, 23 aa, Staphylococcus
IEVKPSAKDDINLVANEVKDKIN

SEQ ID NO: 1876053 - protein, 20 aa, Staphylococcus
IEVMIALRFIQGVTGGAASV

SEQ ID NO: 1876054 - protein, 23 aa, Staphylococcus
IEYASLIGCIKRSQSLAGAINTI

SEQ ID NO: 1876055 - protein, 25 aa, Staphylococcus
IEYYSVNFGYLWDLFIKHLLMSVYG

SEQ ID NO: 1876056 - protein, 20 aa, Staphylococcus
IFAAIFWNLLTWYFGIPSSS

SEQ ID NO: 1876057 - protein, 17 aa, Staphylococcus
IFAIILIILFKGKTENL

SEQ ID NO: 1876058 - protein, 18 aa, Staphylococcus
IFAIPIILLSPMMGVNLP

SEQ ID NO: 1876059 - protein, 20 aa, Staphylococcus
IFALICMLILTLALLVLSII

SEQ ID NO: 1876060 - protein, 18 aa, Staphylococcus
IFALIIPIVYRFIKRIHI

SEQ ID NO: 1876061 - protein, 17 aa, Staphylococcus
IFALWPFTRLVHVWSVP

SEQ ID NO: 1876062 - protein, 17 aa, Staphylococcus
IFAPIVNVWIFKFFVDV

SEQ ID NO: 1876063 - protein, 17 aa, Staphylococcus
IFATISIMLNQEFSLLF

SEQ ID NO: 1876064 - protein, 26 aa, Staphylococcus
IFCISMRELVGSLMLRPPNTDTSATY

SEQ ID NO: 1876065 - protein, 17 aa, Staphylococcus
IFCNFFINIGIFVSMQF

SEQ ID NO: 1876066 - protein, 17 aa, Staphylococcus
IFCNFFINIGIYVSMLF

SEQ ID NO: 1876067 - protein, 22 aa, Staphylococcus
IFDLILRYMEKLSYKKIIITLG

SEQ ID NO: 1876068 - protein, 27 aa, Staphylococcus
IFDLVPRIALGSIIAYIIGQHVDVFIF

SEQ ID NO: 1876069 - protein, 19 aa, Staphylococcus
IFDLVRILLPLIVIIILFL

SEQ ID NO: 1876070 - protein, 24 aa, Staphylococcus
IFDNLPLLFAMGTALGLAGGDGVA

SEQ ID NO: 1876071 - protein, 24 aa, Staphylococcus
IFDNLPMIFALGVAIGLAGGDGVA

SEQ ID NO: 1876072 - protein, 24 aa, Staphylococcus
IFDNLPMIFAMGVAIGLASGDGVA

SEQ ID NO: 1876073 - protein, 18 aa, Staphylococcus
IFDRFYRVDKSRARSQGG

SEQ ID NO: 1876074 - protein, 18 aa, Staphylococcus
IFDRFYRVDKSRSRKQGG

SEQ ID NO: 1876075 - protein, 25 aa, Staphylococcus
IFDVILRLMAKLSYKKLMLATGAIL

SEQ ID NO: 1876076 - protein, 19 aa, Staphylococcus
IFEDSRYISLNSVVQREVP

SEQ ID NO: 1876077 - protein, 24 aa, Staphylococcus
IFEVIKGVILGIILGFMGYFVAKY

SEQ ID NO: 1876078 - protein, 25 aa, Staphylococcus
IFFAHSFATFAWVILLILCFMKMAK

SEQ ID NO: 1876079 - protein, 24 aa, Staphylococcus
IFFAHSFATFGWIILLILMFMFLA

SEQ ID NO: 1876080 - protein, 19 aa, Staphylococcus
IFFAHSFTTFAWLLLIILA

SEQ ID NO: 1876081 - protein, 21 aa, Staphylococcus
IFFFFKGFIGFFIPDNHNEVY

SEQ ID NO: 1876082 - protein, 20 aa, Staphylococcus
IFFFIIAIMMFARKSKVETV

SEQ ID NO: 1876083 - protein, 19 aa, Staphylococcus
IFFFITAIMMFARRSKIET

SEQ ID NO: 1876084 - protein, 20 aa, Staphylococcus
IFFGFTWGPVLWVMLPELFP

SEQ ID NO: 1876085 - protein, 19 aa, Staphylococcus
IFFICSLFMFGVGNLTHDR

SEQ ID NO: 1876086 - protein, 17 aa, Staphylococcus
IFFIFFGILSWLSTVIL

SEQ ID NO: 1876087 - protein, 20 aa, Staphylococcus
IFFIIARLALLFATFYGSIK

SEQ ID NO: 1876088 - protein, 28 aa, Staphylococcus
IFFLIRHIKRWVKSYLIFTFALASITLM

SEQ ID NO: 1876089 - protein, 19 aa, Staphylococcus
IFFMEPHASISYLLIIGFI

SEQ ID NO: 1876090 - protein, 22 aa, Staphylococcus
IFFVCVYLLFSRYASITLGEEG

SEQ ID NO: 1876091 - protein, 19 aa, Staphylococcus
IFGALAGVMVFFISRAYKW

SEQ ID NO: 1876092 - protein, 17 aa, Staphylococcus
IFGGIKWIANAATAIVP

SEQ ID NO: 1876093 - protein, 21 aa, Staphylococcus
IFGGMKFKVTALFVVYTVIFS

SEQ ID NO: 1876094 - protein, 17 aa, Staphylococcus
IFGSCFQGLLPYSPQVI

SEQ ID NO: 1876095 - protein, 20 aa, Staphylococcus
IFHLIRLAIRVEAPFSKIFI

SEQ ID NO: 1876096 - protein, 18 aa, Staphylococcus
IFHSKGLYIYLIVCNVLM

SEQ ID NO: 1876097 - protein, 17 aa, Staphylococcus
IFIAIIMPLGRIMQHIS

SEQ ID NO: 1876098 - protein, 17 aa, Staphylococcus
IFICSIGLLVQLANILI

SEQ ID NO: 1876099 - protein, 24 aa, Staphylococcus
IFIFAIICSAVFIITIGVTVFKVP

SEQ ID NO: 1876100 - protein, 17 aa, Staphylococcus
IFIFCFIGNIVGGFILF

SEQ ID NO: 1876101 - protein, 18 aa, Staphylococcus
IFIFCFIGNVLGGIILFF

SEQ ID NO: 1876102 - protein, 18 aa, Staphylococcus
IFIGLINFFVVKSRKKNK

SEQ ID NO: 1876103 - protein, 26 aa, Staphylococcus
IFIILCIGVALWAFGVHPYLAFFPII

SEQ ID NO: 1876104 - protein, 19 aa, Staphylococcus
IFIILFFYYVVRFIFRSAI

SEQ ID NO: 1876105 - protein, 26 aa, Staphylococcus
IFIKKLKLPIILLIVVCPFFSNYITQ

SEQ ID NO: 1876106 - protein, 26 aa, Staphylococcus
IFILIICLFSGLTLEHFHNEYNLNKD

SEQ ID NO: 1876107 - protein, 29 aa, Staphylococcus
IFILLIISVVIFKYILRDHKQQHSGYDTY

SEQ ID NO: 1876108 - protein, 22 aa, Staphylococcus
IFIPFEMKYAFILPTLMTLFIS

SEQ ID NO: 1876109 - protein, 17 aa, Staphylococcus
IFIPIVLIILASMLHIL

SEQ ID NO: 1876110 - protein, 24 aa, Staphylococcus
IFIPLLATWRGVFQGYKSMGPTAV

SEQ ID NO: 1876111 - protein, 26 aa, Staphylococcus
IFIRVEMKMHYPLIDFKLFNNKAYTS

SEQ ID NO: 1876112 - protein, 17 aa, Staphylococcus
IFISLRLILIVMIATIM

SEQ ID NO: 1876113 - protein, 17 aa, Staphylococcus
IFISLRLITIVMVATIM

SEQ ID NO: 1876114 - protein, 26 aa, Staphylococcus
IFISLYLKWWIVFGVAIVLLIVVALA

SEQ ID NO: 1876115 - protein, 19 aa, Staphylococcus
IFITICFIVSIISLTPVLS

SEQ ID NO: 1876116 - protein, 18 aa, Staphylococcus
IFIVPLVTERKHIKNHSE

SEQ ID NO: 1876117 - protein, 24 aa, Staphylococcus
IFIVSFCLFIIWELKTNHPIIDLR

SEQ ID NO: 1876118 - protein, 17 aa, Staphylococcus
IFIVYTVVKPVTEHNKL

SEQ ID NO: 1876119 - protein, 30 aa, Staphylococcus
IFKEILFKRTRFWLPFILSSLIFASQHGIS

SEQ ID NO: 1876120 - protein, 21 aa, Staphylococcus
IFKIGFDLLSAISIILILIII

SEQ ID NO: 1876121 - protein, 21 aa, Staphylococcus
IFKLKAELMFRGKDEDEVHAI

SEQ ID NO: 1876122 - protein, 18 aa, Staphylococcus
IFKMSFKQLLFMAMTSGA

SEQ ID NO: 1876123 - protein, 23 aa, Staphylococcus
IFKMSFKTLLLMALTSGAVGVTF

SEQ ID NO: 1876124 - protein, 17 aa, Staphylococcus
IFLAANVFNRMLTHQDI

SEQ ID NO: 1876125 - protein, 20 aa, Staphylococcus
IFLACTLIGLIVLAALLVDT

SEQ ID NO: 1876126 - protein, 18 aa, Staphylococcus
IFLACVYVAKKLNRIDKV

SEQ ID NO: 1876127 - protein, 22 aa, Staphylococcus
IFLAITTIFAFFLSSRITKPLR

SEQ ID NO: 1876128 - protein, 23 aa, Staphylococcus
IFLEPFGDLGVIWILGILYFIST

SEQ ID NO: 1876129 - protein, 23 aa, Staphylococcus
IFLFLVFHLIRLASKINSQYNKV

SEQ ID NO: 1876130 - protein, 18 aa, Staphylococcus
IFLGDSGALLIGFIIGFL

SEQ ID NO: 1876131 - protein, 17 aa, Staphylococcus
IFLGEWSTMVQVVFGLL

SEQ ID NO: 1876132 - protein, 25 aa, Staphylococcus
IFLILCIGITLWLLGVHPYLVFFPI

SEQ ID NO: 1876133 - protein, 19 aa, Staphylococcus
IFLLISLIITFLFMTPKYE

SEQ ID NO: 1876134 - protein, 31 aa, Staphylococcus
IFLNESLRFDLLIYSCLSFLLVIYGAKFISR

SEQ ID NO: 1876135 - protein, 36 aa, Staphylococcus
IFLNKRIPVAYVRIHICIVALPPLLAFIGLLFTSNQ

SEQ ID NO: 1876136 - protein, 24 aa, Staphylococcus
IFLPAEVLKPLIIIILTLVMVYTL

SEQ ID NO: 1876137 - protein, 19 aa, Staphylococcus
IFLREGLEVLLVIMTLTTM

SEQ ID NO: 1876138 - protein, 24 aa, Staphylococcus
IFLRSRIYWILWLLFLHFIFLGIA

SEQ ID NO: 1876139 - protein, 17 aa, Staphylococcus
IFLSLAVFYGYYFISSR

SEQ ID NO: 1876140 - protein, 19 aa, Staphylococcus
IFLSLPLDIVGLFISMFFI

SEQ ID NO: 1876141 - protein, 19 aa, Staphylococcus
IFLSRCGWFEKDAKHFWTS

SEQ ID NO: 1876142 - protein, 18 aa, Staphylococcus
IFLVNWGPNVSYAAEGKS

SEQ ID NO: 1876143 - protein, 21 aa, Staphylococcus
IFLWMFGILVLLAIIAVIYVA

SEQ ID NO: 1876144 - protein, 19 aa, Staphylococcus
IFLYIELKHSVDLKNKIAE

SEQ ID NO: 1876145 - protein, 23 aa, Staphylococcus
IFMAFFAEFGFRSYLQNIVESKV

SEQ ID NO: 1876146 - protein, 19 aa, Staphylococcus
IFNELPFGFILSIVALALI

SEQ ID NO: 1876147 - protein, 19 aa, Staphylococcus
IFNGGFKIIKNAWKVLMER

SEQ ID NO: 1876148 - protein, 24 aa, Staphylococcus
IFPFYILTVYFFFGKLRSLTRVRS

SEQ ID NO: 1876149 - protein, 20 aa, Staphylococcus
IFPIDFKILIGIGLLFCVGT

SEQ ID NO: 1876150 - protein, 17 aa, Staphylococcus
IFPKISYKVYVIGFTII

SEQ ID NO: 1876151 - protein, 23 aa, Staphylococcus
IFPPERRGAAMGTLGIAMILAPA

SEQ ID NO: 1876152 - protein, 18 aa, Staphylococcus
IFQGLKLVSLSIIASLLI

SEQ ID NO: 1876153 - protein, 26 aa, Staphylococcus
IFRMTKGRWRLISIRPLVMSIWLFIF

SEQ ID NO: 1876154 - protein, 18 aa, Staphylococcus
IFRSIPFIILLIAIVPFT

SEQ ID NO: 1876155 - protein, 17 aa, Staphylococcus
IFSKIAVVVQGIQYTIP

SEQ ID NO: 1876156 - protein, 29 aa, Staphylococcus
IFSSFSILFGVFFRFLLNKLKQSYLSINK

SEQ ID NO: 1876157 - protein, 18 aa, Staphylococcus
IFSSVLMAVMLNFVFVFS

SEQ ID NO: 1876158 - protein, 18 aa, Staphylococcus
IFTFLNFSSIYRWQTTPL

SEQ ID NO: 1876159 - protein, 24 aa, Staphylococcus
IFTFYLFMYLKFKPAPMFIATILY

SEQ ID NO: 1876160 - protein, 18 aa, Staphylococcus
IFTRVMKNGVPFYPVLTI

SEQ ID NO: 1876161 - protein, 20 aa, Staphylococcus
IFVAPTMKFMEWRVAIQTEE

SEQ ID NO: 1876162 - protein, 25 aa, Staphylococcus
IFVDNIWLMIALRFVQGFCGGAGAV

SEQ ID NO: 1876163 - protein, 24 aa, Staphylococcus
IFVHSFLPIFAILFGFSMDKLYQS

SEQ ID NO: 1876164 - protein, 25 aa, Staphylococcus
IFVIELVGALLLAFYFYRDNPDLKN

SEQ ID NO: 1876165 - protein, 24 aa, Staphylococcus
IFVLWCIGILLWIVGVHPYLAFFP

SEQ ID NO: 1876166 - protein, 23 aa, Staphylococcus
IFVMFIQIFLLRSAIVHTNEMAP

SEQ ID NO: 1876167 - protein, 20 aa, Staphylococcus
IFVMLPASWFTGLINSKTLA

SEQ ID NO: 1876168 - protein, 23 aa, Staphylococcus
IFVSTFFLNFAIYIWVGKYYDIE

SEQ ID NO: 1876169 - protein, 17 aa, Staphylococcus
IFWSAIFGFITARIYFV

SEQ ID NO: 1876170 - protein, 17 aa, Staphylococcus
IFYRPLMISTFDPTFSR

SEQ ID NO: 1876171 - protein, 22 aa, Staphylococcus
IFYTCLGILAGLLSNTIGKSQF

SEQ ID NO: 1876172 - protein, 26 aa, Staphylococcus
IGAASILVGSLLFLGGGQASAAESNE

SEQ ID NO: 1876173 - protein, 20 aa, Staphylococcus
IGAFEIKGGFGTIVSDAIAN

SEQ ID NO: 1876174 - protein, 17 aa, Staphylococcus
IGAFLIFFIQKRKVKNI

SEQ ID NO: 1876175 - protein, 28 aa, Staphylococcus
IGAFNKLSPRFSVVFLIIIYLTIGPLFA

SEQ ID NO: 1876176 - protein, 17 aa, Staphylococcus
IGAGLAFVYVKSGMNLA

SEQ ID NO: 1876177 - protein, 21 aa, Staphylococcus
IGAIIPMWLVIVNKVTDLKIY

SEQ ID NO: 1876178 - protein, 18 aa, Staphylococcus
IGAILSFIKLFKVDPIEA

SEQ ID NO: 1876179 - protein, 21 aa, Staphylococcus
IGAKLRLKYMYLLTFFEYIAL

SEQ ID NO: 1876180 - protein, 24 aa, Staphylococcus
IGAKWVFFCSFIILLFPIFFLGQA

SEQ ID NO: 1876181 - protein, 24 aa, Staphylococcus
IGAKWVFFCSFVILLFPIFFLGQA

SEQ ID NO: 1876182 - protein, 21 aa, Staphylococcus
IGALAAWCYNKFYNIQLPQFL

SEQ ID NO: 1876183 - protein, 23 aa, Staphylococcus
IGALFAVIFTFIFGDQSPFAYAL

SEQ ID NO: 1876184 - protein, 19 aa, Staphylococcus
IGALFAVIFTYIFGDQSPF

SEQ ID NO: 1876185 - protein, 21 aa, Staphylococcus
IGALFAVLFTFIFGDPSALTY

SEQ ID NO: 1876186 - protein, 23 aa, Staphylococcus
IGALFAVVFTFIFGDQSPFAYAL

SEQ ID NO: 1876187 - protein, 23 aa, Staphylococcus
IGALFAVVFTYIFGDQSPLSYAL

SEQ ID NO: 1876188 - protein, 19 aa, Staphylococcus
IGAPISSIFAALTTWLKGM

SEQ ID NO: 1876189 - protein, 24 aa, Staphylococcus
IGCGCLPILIILSFLITWLLNLMN

SEQ ID NO: 1876190 - protein, 26 aa, Staphylococcus
IGCNNPNCPLREAIVVPLMTHGNVAG

SEQ ID NO: 1876191 - protein, 31 aa, Staphylococcus
IGCYFGQFLPMEWRRPLSLALMVLVLITLVF

SEQ ID NO: 1876192 - protein, 18 aa, Staphylococcus
IGDFRLLSQRAVISLTQL

SEQ ID NO: 1876193 - protein, 21 aa, Staphylococcus
IGDLREGYEYSRSGNPTRTAL

SEQ ID NO: 1876194 - protein, 31 aa, Staphylococcus
IGEELAHPFKVKRLVGQSGMSYGSLGGRAIT

SEQ ID NO: 1876195 - protein, 17 aa, Staphylococcus
IGEKPNRFAVFIEPLTQ

SEQ ID NO: 1876196 - protein, 19 aa, Staphylococcus
IGELSRAFNNMSFEIQEHV

SEQ ID NO: 1876197 - protein, 18 aa, Staphylococcus
IGFILYLLLGRQIQREQI

SEQ ID NO: 1876198 - protein, 18 aa, Staphylococcus
IGFILYLLLGRQIQRNRI

SEQ ID NO: 1876199 - protein, 24 aa, Staphylococcus
IGFNDGRLSWIFYVAMILFTLFIL

SEQ ID NO: 1876200 - protein, 18 aa, Staphylococcus
IGFRTIKTAVGMALGIII

SEQ ID NO: 1876201 - protein, 18 aa, Staphylococcus
IGFSFLWFAGKDHHILFG

SEQ ID NO: 1876202 - protein, 17 aa, Staphylococcus
IGFSFLWIAGREHHILF

SEQ ID NO: 1876203 - protein, 25 aa, Staphylococcus
IGGALLIVGIVLKFIGTSYTVSGSS

SEQ ID NO: 1876204 - protein, 17 aa, Staphylococcus
IGGDFGEGFKIGIDDKK

SEQ ID NO: 1876205 - protein, 17 aa, Staphylococcus
IGGFIIHIVSWRWMFFI

SEQ ID NO: 1876206 - protein, 24 aa, Staphylococcus
IGGIGCAFSMLFLSKIIDNNSRGF

SEQ ID NO: 1876207 - protein, 24 aa, Staphylococcus
IGGIGCAISMLFLSKIIDNHGKSF

SEQ ID NO: 1876208 - protein, 30 aa, Staphylococcus
IGGIILVVLFIWRQSRLDTPLLNFGVFKNK

SEQ ID NO: 1876209 - protein, 21 aa, Staphylococcus
IGGLAAWCYNKFYNISLPSYL

SEQ ID NO: 1876210 - protein, 26 aa, Staphylococcus
IGGLFTLAGTFIALIFQFRKDERDKR

SEQ ID NO: 1876211 - protein, 22 aa, Staphylococcus
IGGLKAFLPQAIGMVIVAVIYA

SEQ ID NO: 1876212 - protein, 33 aa, Staphylococcus
IGGLLISVGNWRWIFWINIPFIFIGLIGCLFLK

SEQ ID NO: 1876213 - protein, 20 aa, Staphylococcus
IGGLRIALVVAVGVVAVGSF

SEQ ID NO: 1876214 - protein, 24 aa, Staphylococcus
IGGLSDVIPWDWITDEFSQISQAI

SEQ ID NO: 1876215 - protein, 18 aa, Staphylococcus
IGGMIGGLVVSQWEVSFL

SEQ ID NO: 1876216 - protein, 23 aa, Staphylococcus
IGGPGAVFWMWISAFLGASSAFI

SEQ ID NO: 1876217 - protein, 22 aa, Staphylococcus
IGGPGAVFWMWITAFLGASSAF

SEQ ID NO: 1876218 - protein, 26 aa, Staphylococcus
IGGSRISWRVTRKFVVGKHQKKKPTL

SEQ ID NO: 1876219 - protein, 18 aa, Staphylococcus
IGGVCCYFVINYIKGKLH

SEQ ID NO: 1876220 - protein, 25 aa, Staphylococcus
IGGWSLKLGSWHVIFIVLTIVTFIL

SEQ ID NO: 1876221 - protein, 24 aa, Staphylococcus
IGHICLSLPFALFGLFSSMFFIII

SEQ ID NO: 1876222 - protein, 25 aa, Staphylococcus
IGHICLSLPFAMFGLFASMFFIIVG

SEQ ID NO: 1876223 - protein, 18 aa, Staphylococcus
IGHTRWATHGVPNYQNSH

SEQ ID NO: 1876224 - protein, 25 aa, Staphylococcus
IGHVCLSLPFAMFGLFASMFFIIIG

SEQ ID NO: 1876225 - protein, 21 aa, Staphylococcus
IGIAGALAWSLLGQVMNTLYH

SEQ ID NO: 1876226 - protein, 34 aa, Staphylococcus
IGIALVRFRLTLTRRGIENINMFTFLQLLTPFVT

SEQ ID NO: 1876227 - protein, 25 aa, Staphylococcus
IGIFSGLIFQWFINRNIRIKMPDQV

SEQ ID NO: 1876228 - protein, 18 aa, Staphylococcus
IGIGCIMLVYLLINAAFL

SEQ ID NO: 1876229 - protein, 19 aa, Staphylococcus
IGIGIILREFYICRFIIGK

SEQ ID NO: 1876230 - protein, 26 aa, Staphylococcus
IGIGMACTYALMFPLTFKFGPENSNV

SEQ ID NO: 1876231 - protein, 18 aa, Staphylococcus
IGIIAVFGHWLAPSGDLA

SEQ ID NO: 1876232 - protein, 33 aa, Staphylococcus
IGIIIYITFRFEWRMGLSSVLALLHDAFMIVAV

SEQ ID NO: 1876233 - protein, 33 aa, Staphylococcus
IGIIIYVSLRFEWRMGLSAVLALLHDVFIIVAL

SEQ ID NO: 1876234 - protein, 33 aa, Staphylococcus
IGIIIYVSLRFEWRMGLSSVLALLHDVFMIVAL

SEQ ID NO: 1876235 - protein, 29 aa, Staphylococcus
IGIIKFGIPMLIPLLIKYAIDGVINNGTL

SEQ ID NO: 1876236 - protein, 29 aa, Staphylococcus
IGIIKFGIPMLIPLLIKYAIDGVINNSAL

SEQ ID NO: 1876237 - protein, 30 aa, Staphylococcus
IGIIKFGIPMLIPLLIKYVIDGVINNHDIT

SEQ ID NO: 1876238 - protein, 24 aa, Staphylococcus
IGIKGTPLSAGFGYTGLVGPINAF

SEQ ID NO: 1876239 - protein, 24 aa, Staphylococcus
IGIKTKHLLTALLLQIILTTMVGV

SEQ ID NO: 1876240 - protein, 18 aa, Staphylococcus
IGILCFFVPVTIGGTNTI

SEQ ID NO: 1876241 - protein, 30 aa, Staphylococcus
IGILLLWRSRWMKVYNRIPSILSINSLYNA

SEQ ID NO: 1876242 - protein, 24 aa, Staphylococcus
IGILLRSIIGLSWLYIGTTLIGIG

SEQ ID NO: 1876243 - protein, 23 aa, Staphylococcus
IGIPIGIFISRFGRMSKLVITIA

SEQ ID NO: 1876244 - protein, 17 aa, Staphylococcus
IGISNLWSHGGFLPHGW

SEQ ID NO: 1876245 - protein, 17 aa, Staphylococcus
IGIYLAIILIVTTLYLS

SEQ ID NO: 1876246 - protein, 23 aa, Staphylococcus
IGKGESFHFLGLPLSETSYVSSV

SEQ ID NO: 1876247 - protein, 22 aa, Staphylococcus
IGKIFFKKDIRQFGSGNTGATN

SEQ ID NO: 1876248 - protein, 22 aa, Staphylococcus
IGKRPKIKRYVALAGTALTLIF

SEQ ID NO: 1876249 - protein, 19 aa, Staphylococcus
IGKWHWWMSTVLIFILMIA

SEQ ID NO: 1876250 - protein, 23 aa, Staphylococcus
IGLAFLLYMAWSLWNEKPSHLEH

SEQ ID NO: 1876251 - protein, 32 aa, Staphylococcus
IGLDMYKFWLEMGKIWLPMIIITAAYYFVYQW

SEQ ID NO: 1876252 - protein, 17 aa, Staphylococcus
IGLGIIFANIFKPGAGL

SEQ ID NO: 1876253 - protein, 18 aa, Staphylococcus
IGLIAVVIINRFADKKLD

SEQ ID NO: 1876254 - protein, 17 aa, Staphylococcus
IGLIFFFIRYPKLKKMD

SEQ ID NO: 1876255 - protein, 19 aa, Staphylococcus
IGLILCLFATIPGIIMWHK

SEQ ID NO: 1876256 - protein, 22 aa, Staphylococcus
IGLILGIMVWLGMKAIPIFVIL

SEQ ID NO: 1876257 - protein, 19 aa, Staphylococcus
IGLIVAVVIAIIFFVLFLI

SEQ ID NO: 1876258 - protein, 22 aa, Staphylococcus
IGLLILFYLCRLISENSLYRFV

SEQ ID NO: 1876259 - protein, 24 aa, Staphylococcus
IGLLISVMISFIFQIIGNNIINHF

SEQ ID NO: 1876260 - protein, 17 aa, Staphylococcus
IGLLLIYGLFFSSAPKQ

SEQ ID NO: 1876261 - protein, 19 aa, Staphylococcus
IGLLLYRKSLLKRKWIAIG

SEQ ID NO: 1876262 - protein, 19 aa, Staphylococcus
IGLLVLYYICRLVNEEKLY

SEQ ID NO: 1876263 - protein, 18 aa, Staphylococcus
IGLPSLTMPFILATWIML

SEQ ID NO: 1876264 - protein, 18 aa, Staphylococcus
IGLQVVIMIVLFPLFYVI

SEQ ID NO: 1876265 - protein, 28 aa, Staphylococcus
IGLSAWYYDDVVAWVWFAPIVSLIGFLI

SEQ ID NO: 1876266 - protein, 22 aa, Staphylococcus
IGLTCIFLVFTFLREVKLYQHF

SEQ ID NO: 1876267 - protein, 25 aa, Staphylococcus
IGLTVFSFVSANIIFGIIFAILSVV

SEQ ID NO: 1876268 - protein, 26 aa, Staphylococcus
IGLVAIAVGFFWFRLYQRTTNPKADV

SEQ ID NO: 1876269 - protein, 23 aa, Staphylococcus
IGLVAVLVGYIWFRLYQHTENPK

SEQ ID NO: 1876270 - protein, 20 aa, Staphylococcus
IGLVIALLISGIGYAAYNAY

SEQ ID NO: 1876271 - protein, 17 aa, Staphylococcus
IGMGWIVPAIIGFVVGL

SEQ ID NO: 1876272 - protein, 33 aa, Staphylococcus
IGMIIYISLRFEWRMGLSSILALLHDAFMIVAV

SEQ ID NO: 1876273 - protein, 24 aa, Staphylococcus
IGMKTKHLLSALIIQILITTMIGV

SEQ ID NO: 1876274 - protein, 24 aa, Staphylococcus
IGMLIVRLRIYLSMNKGLKDGNTM

SEQ ID NO: 1876275 - protein, 17 aa, Staphylococcus
IGMTFSGGFIDYILYGL

SEQ ID NO: 1876276 - protein, 31 aa, Staphylococcus
IGNDLAHPFIVKRLVGQSGMSYGALGQRAIT

SEQ ID NO: 1876277 - protein, 26 aa, Staphylococcus
IGNFFMCLFGLLFILYANRFIMRRRQ

SEQ ID NO: 1876278 - protein, 28 aa, Staphylococcus
IGNGDIQAGDMLRLFKVPDNVSNIKIQL

SEQ ID NO: 1876279 - protein, 28 aa, Staphylococcus
IGNIDLPIRAGFSLEAKIPLKTLKLPKN

SEQ ID NO: 1876280 - protein, 27 aa, Staphylococcus
IGNIIGGIFLFFLMKFAHIMTPEMIQS

SEQ ID NO: 1876281 - protein, 19 aa, Staphylococcus
IGNKSAFQLIIPILSGFIA

SEQ ID NO: 1876282 - protein, 23 aa, Staphylococcus
IGNNGYRVQPHVGLEIRKATNKE

SEQ ID NO: 1876283 - protein, 26 aa, Staphylococcus
IGNSDKLVLGESILIVGNPLGEEFRN

SEQ ID NO: 1876284 - protein, 27 aa, Staphylococcus
IGNVRVWTNNELIRTSTVWNPSLYETT

SEQ ID NO: 1876285 - protein, 21 aa, Staphylococcus
IGNYFKPFWPLAIINVFEEFS

SEQ ID NO: 1876286 - protein, 18 aa, Staphylococcus
IGPALLFNQDYGPFLFDK

SEQ ID NO: 1876287 - protein, 21 aa, Staphylococcus
IGPELRQYLFLADTKGKPFSR

SEQ ID NO: 1876288 - protein, 20 aa, Staphylococcus
IGPKGKFRPFILYGTVPLAI

SEQ ID NO: 1876289 - protein, 23 aa, Staphylococcus
IGPKRMIILAGISVVIGLITIGV

SEQ ID NO: 1876290 - protein, 18 aa, Staphylococcus
IGPTKAKAIIEYRQQHGP

SEQ ID NO: 1876291 - protein, 20 aa, Staphylococcus
IGQIPGILALFILTICIIGK

SEQ ID NO: 1876292 - protein, 19 aa, Staphylococcus
IGRINSWLDPYSYSSGDGY

SEQ ID NO: 1876293 - protein, 31 aa, Staphylococcus
IGRKAQEAYLSYRLEQEYSKDDIFQMYLNKI

SEQ ID NO: 1876294 - protein, 32 aa, Staphylococcus
IGRKAQEAYLSYRLEQEYSKDEIFQMYLNKIY

SEQ ID NO: 1876295 - protein, 25 aa, Staphylococcus
IGRSRRDGFNPMRIILAGAAVSALL

SEQ ID NO: 1876296 - protein, 19 aa, Staphylococcus
IGRYLRYFRNLTRDIQKRP

SEQ ID NO: 1876297 - protein, 26 aa, Staphylococcus
IGSAFREFFKPFGVPMLTMPYVFVSW

SEQ ID NO: 1876298 - protein, 25 aa, Staphylococcus
IGSAQKFTTGLILKHLELSNKININ

SEQ ID NO: 1876299 - protein, 21 aa, Staphylococcus
IGSAQKFTTGLILKKLENENK

SEQ ID NO: 1876300 - protein, 20 aa, Staphylococcus
IGSAQKFTTGLMLKQLELEH

SEQ ID NO: 1876301 - protein, 25 aa, Staphylococcus
IGSDILYWGVIEWAYYYQVPPHGAK

SEQ ID NO: 1876302 - protein, 25 aa, Staphylococcus
IGSDILYWGVIEWAYYYQVPPNGAK

SEQ ID NO: 1876303 - protein, 27 aa, Staphylococcus
IGSEICQQVCRFAPARIILLGHGENSI

SEQ ID NO: 1876304 - protein, 18 aa, Staphylococcus
IGSFAIKLMQGYVPLGNA

SEQ ID NO: 1876305 - protein, 25 aa, Staphylococcus
IGSILGALLLKIGRFESSIAKGMAY

SEQ ID NO: 1876306 - protein, 19 aa, Staphylococcus
IGSKEFKGINLIHYPYDFI

SEQ ID NO: 1876307 - protein, 18 aa, Staphylococcus
IGSKEFKGLNWIHYPWDF

SEQ ID NO: 1876308 - protein, 19 aa, Staphylococcus
IGSLCLIIAPVAWLLLVGR

SEQ ID NO: 1876309 - protein, 24 aa, Staphylococcus
IGSLICIPLAWILNLQNFFVKPLM

SEQ ID NO: 1876310 - protein, 26 aa, Staphylococcus
IGSLIMLFIMDWKLTLLTFITIPIFV

SEQ ID NO: 1876311 - protein, 25 aa, Staphylococcus
IGSLMCIPLSWILGLQHFFIKPLML

SEQ ID NO: 1876312 - protein, 25 aa, Staphylococcus
IGSLMCIPMAWILGFHNFVVKPLML

SEQ ID NO: 1876313 - protein, 20 aa, Staphylococcus
IGSLVCGLSESFTIMMVGRV

SEQ ID NO: 1876314 - protein, 20 aa, Staphylococcus
IGSMFPFNFLAQLISAGTLV

SEQ ID NO: 1876315 - protein, 20 aa, Staphylococcus
IGSMIMLFVMDWQMTLLTFI

SEQ ID NO: 1876316 - protein, 25 aa, Staphylococcus
IGSMPELKKPSDREKKEDADIQSHD

SEQ ID NO: 1876317 - protein, 25 aa, Staphylococcus
IGSSICCILSIITLLFKPVNFDASF

SEQ ID NO: 1876318 - protein, 19 aa, Staphylococcus
IGSTALWIGIFLMAFAVLF

SEQ ID NO: 1876319 - protein, 20 aa, Staphylococcus
IGSYGWKAILYFEIITTIAI

SEQ ID NO: 1876320 - protein, 27 aa, Staphylococcus
IGTAISLFITVILGFFIARTITRPITD

SEQ ID NO: 1876321 - protein, 18 aa, Staphylococcus
IGTFIFDWHTVVAAVPSL

SEQ ID NO: 1876322 - protein, 22 aa, Staphylococcus
IGTGEWRIYPNISKETTMNGAL

SEQ ID NO: 1876323 - protein, 20 aa, Staphylococcus
IGTICGLYWAVSSNLTVEPT

SEQ ID NO: 1876324 - protein, 20 aa, Staphylococcus
IGTLKITFIATIVSVPIGLG

SEQ ID NO: 1876325 - protein, 18 aa, Staphylococcus
IGTLKITIIAALFAVPIG

SEQ ID NO: 1876326 - protein, 23 aa, Staphylococcus
IGTLKITLIAAIFAVPIGLGAAI

SEQ ID NO: 1876327 - protein, 20 aa, Staphylococcus
IGTLLWVVLGKRIGIRERQL

SEQ ID NO: 1876328 - protein, 22 aa, Staphylococcus
IGTLQSRFDTMRKRLGQVDEMR

SEQ ID NO: 1876329 - protein, 17 aa, Staphylococcus
IGTMALTLGILFIGVNK

SEQ ID NO: 1876330 - protein, 30 aa, Staphylococcus
IGTMIGDAIGWRFTFLFIIIVSVIAGVLMM

SEQ ID NO: 1876331 - protein, 27 aa, Staphylococcus
IGTNMQRTGIYMGVKPTSDYMTTSKDQ

SEQ ID NO: 1876332 - protein, 17 aa, Staphylococcus
IGTPGFVRGLHDMHEKE

SEQ ID NO: 1876333 - protein, 19 aa, Staphylococcus
IGTPGFVRGMHDMHEREGK

SEQ ID NO: 1876334 - protein, 23 aa, Staphylococcus
IGTSMLGHESIVKAAESNQQATN

SEQ ID NO: 1876335 - protein, 24 aa, Staphylococcus
IGTVSTLVATFVFLGVNHDAQASE

SEQ ID NO: 1876336 - protein, 18 aa, Staphylococcus
IGTYFWSVWSFGIAAVLI

SEQ ID NO: 1876337 - protein, 17 aa, Staphylococcus
IGVAFAFFIGFPLIINF

SEQ ID NO: 1876338 - protein, 34 aa, Staphylococcus
IGVALVRFRLTLTRRGIENINMFTFIQLLTPFVT

SEQ ID NO: 1876339 - protein, 18 aa, Staphylococcus
IGVGDGFNVIASDALAML

SEQ ID NO: 1876340 - protein, 28 aa, Staphylococcus
IGVGLFIHWIWPTLPIGAAFAVAAILCP

SEQ ID NO: 1876341 - protein, 21 aa, Staphylococcus
IGVICIIVYIIYNRMKQYNTV

SEQ ID NO: 1876342 - protein, 20 aa, Staphylococcus
IGVIIFGVFSYINGNGNTPK

SEQ ID NO: 1876343 - protein, 20 aa, Staphylococcus
IGVIIMRFAATWFVNLLNKY

SEQ ID NO: 1876344 - protein, 20 aa, Staphylococcus
IGVILMRFAANWFVELLNKY

SEQ ID NO: 1876345 - protein, 20 aa, Staphylococcus
IGVIPPIMVRTILDQYVNYF

SEQ ID NO: 1876346 - protein, 23 aa, Staphylococcus
IGVIPVILAFYIRRNLDETDAWK

SEQ ID NO: 1876347 - protein, 23 aa, Staphylococcus
IGVLLLICFLIYLFYSPRLKFDV

SEQ ID NO: 1876348 - protein, 17 aa, Staphylococcus
IGVLLLITFLIYLFYSP

SEQ ID NO: 1876349 - protein, 20 aa, Staphylococcus
IGVMALLSIALIVLFKKKRW

SEQ ID NO: 1876350 - protein, 18 aa, Staphylococcus
IGVSFIWLPIFSVLFSIM

SEQ ID NO: 1876351 - protein, 18 aa, Staphylococcus
IGVSRFALMNNLEAFVVL

SEQ ID NO: 1876352 - protein, 18 aa, Staphylococcus
IGVSRFAMMNNLDAYIVL

SEQ ID NO: 1876353 - protein, 19 aa, Staphylococcus
IGVSRFAMMNNLDAYIVLN

SEQ ID NO: 1876354 - protein, 24 aa, Staphylococcus
IGVVIVMCLLRWLFNMFGIGPTQY

SEQ ID NO: 1876355 - protein, 20 aa, Staphylococcus
IGYIKEIKPLSIISVGFLLL

SEQ ID NO: 1876356 - protein, 19 aa, Staphylococcus
IGYIKEVKPLSCISVGFLL

SEQ ID NO: 1876357 - protein, 17 aa, Staphylococcus
IGYLYWYAKRIKKNPKR

SEQ ID NO: 1876358 - protein, 18 aa, Staphylococcus
IHAESGIAKAAKTTSSNH

SEQ ID NO: 1876359 - protein, 20 aa, Staphylococcus
IHALLEMTELFGVSLNHLVK

SEQ ID NO: 1876360 - protein, 19 aa, Staphylococcus
IHAQYRKKILFKEVVRTTR

SEQ ID NO: 1876361 - protein, 20 aa, Staphylococcus
IHARFGVPRIAFLSIVTTII

SEQ ID NO: 1876362 - protein, 17 aa, Staphylococcus
IHCMTRVRLKINNETQV

SEQ ID NO: 1876363 - protein, 18 aa, Staphylococcus
IHDLRGGIIAATATMGVI

SEQ ID NO: 1876364 - protein, 17 aa, Staphylococcus
IHEICKKLIPSYHDGIY

SEQ ID NO: 1876365 - protein, 17 aa, Staphylococcus
IHELCKKIIPGYTNDIY

SEQ ID NO: 1876366 - protein, 26 aa, Staphylococcus
IHELDPRAKLIFVFLFIITIFFAHSF

SEQ ID NO: 1876367 - protein, 24 aa, Staphylococcus
IHESFKLPYWISSLLLVLLILATL

SEQ ID NO: 1876368 - protein, 29 aa, Staphylococcus
IHGRFVEDDGRVIGMAKVKGLKDKYNPDL

SEQ ID NO: 1876369 - protein, 22 aa, Staphylococcus
IHHANFPLMLLILVAGTMLLVW

SEQ ID NO: 1876370 - protein, 27 aa, Staphylococcus
IHHLDPRAKLIFVFLFIVLIFFAHSFG

SEQ ID NO: 1876371 - protein, 32 aa, Staphylococcus
IHHSASIWPIDFQRAALLSSLLLAVSMTVWAF

SEQ ID NO: 1876372 - protein, 28 aa, Staphylococcus
IHHSASIWPIDFQRAALLSTLLLAVSMT

SEQ ID NO: 1876373 - protein, 24 aa, Staphylococcus
IHIGYCLIDLYLVGITFTNKFEYV

SEQ ID NO: 1876374 - protein, 19 aa, Staphylococcus
IHIGYCVLDILLVSLALAS

SEQ ID NO: 1876375 - protein, 25 aa, Staphylococcus
IHIWAMFLFNCLFAVLYEAFPEEVL

SEQ ID NO: 1876376 - protein, 24 aa, Staphylococcus
IHKARRISWIGAFIVTIIIGIPLY

SEQ ID NO: 1876377 - protein, 20 aa, Staphylococcus
IHKASSWNILCYAFVVVELF

SEQ ID NO: 1876378 - protein, 24 aa, Staphylococcus
IHKNTKLGLKYTFKSQIDDKTVYI

SEQ ID NO: 1876379 - protein, 18 aa, Staphylococcus
IHKRTKRSTDNNVDNNQD

SEQ ID NO: 1876380 - protein, 27 aa, Staphylococcus
IHLEITRLSNLIKELLLLSELDNANHL

SEQ ID NO: 1876381 - protein, 24 aa, Staphylococcus
IHLFSRIIILEVIFSISGLGKLLI

SEQ ID NO: 1876382 - protein, 25 aa, Staphylococcus
IHLRRASLQYSFFMNFLAAFIACGF

SEQ ID NO: 1876383 - protein, 25 aa, Staphylococcus
IHLRRASLQYSFLLNFFAAAIACGF

SEQ ID NO: 1876384 - protein, 26 aa, Staphylococcus
IHLVWPDLPIGAAFAIAAILCPTDAP

SEQ ID NO: 1876385 - protein, 23 aa, Staphylococcus
IHMSYCMIDVFLVALAFTSKFKY

SEQ ID NO: 1876386 - protein, 25 aa, Staphylococcus
IHNIKQNLFWAFGYNIAGIPIAACG

SEQ ID NO: 1876387 - protein, 26 aa, Staphylococcus
IHNIRMPRMIGGLLIGAALAVAGLFM

SEQ ID NO: 1876388 - protein, 17 aa, Staphylococcus
IHNLLVMCELFDISLDD

SEQ ID NO: 1876389 - protein, 23 aa, Staphylococcus
IHNRFPKIPAAFIQIALGVAIFT

SEQ ID NO: 1876390 - protein, 27 aa, Staphylococcus
IHNVRMPRMIGGLIIGGALALAGLLMQ

SEQ ID NO: 1876391 - protein, 26 aa, Staphylococcus
IHNVRMPRMIGGLLIGGALALAGLLM

SEQ ID NO: 1876392 - protein, 25 aa, Staphylococcus
IHPGTSRKPYRVNNIHDANGRTIAI

SEQ ID NO: 1876393 - protein, 17 aa, Staphylococcus
IHPHELFIPALVLSLLI

SEQ ID NO: 1876394 - protein, 22 aa, Staphylococcus
IHPHELFIPATILSLLILFFYL

SEQ ID NO: 1876395 - protein, 17 aa, Staphylococcus
IHPHELFIPATVLSLLI

SEQ ID NO: 1876396 - protein, 19 aa, Staphylococcus
IHPHLKYVHDLADIHVVIP

SEQ ID NO: 1876397 - protein, 23 aa, Staphylococcus
IHQRFDHIIAFLIIAILTKIICY

SEQ ID NO: 1876398 - protein, 26 aa, Staphylococcus
IHRLDPRAKLIFVFVFIIFIFFAHSF

SEQ ID NO: 1876399 - protein, 19 aa, Staphylococcus
IHSILFGFPTKRENEPRFE

SEQ ID NO: 1876400 - protein, 18 aa, Staphylococcus
IIAACMYFVLTFLLSRLM

SEQ ID NO: 1876401 - protein, 18 aa, Staphylococcus
IIAAFVLAFIGLIKPIIP

SEQ ID NO: 1876402 - protein, 19 aa, Staphylococcus
IIAAVALMFIYISLGYIGN

SEQ ID NO: 1876403 - protein, 25 aa, Staphylococcus
IIAFIFLALFAWKIYAERNYNNTNI

SEQ ID NO: 1876404 - protein, 19 aa, Staphylococcus
IIAHFWWIQALGAIYLLYM

SEQ ID NO: 1876405 - protein, 18 aa, Staphylococcus
IIAHSYWSIMLISFIVFI

SEQ ID NO: 1876406 - protein, 18 aa, Staphylococcus
IIAIAIALVLVLVITNFI

SEQ ID NO: 1876407 - protein, 43 aa, Staphylococcus
IIAIFKNKNYLKMLAMAIIIILLSMLALGIHKVIESNNPSKSD

SEQ ID NO: 1876408 - protein, 18 aa, Staphylococcus
IIAIIWARWLKRKSFKNK

SEQ ID NO: 1876409 - protein, 17 aa, Staphylococcus
IIAIMIALCMPRRKYEL

SEQ ID NO: 1876410 - protein, 18 aa, Staphylococcus
IIAIVCIIISLLLKLFKH

SEQ ID NO: 1876411 - protein, 24 aa, Staphylococcus
IIAKKPKFASAILFFTTLLALFNM

SEQ ID NO: 1876412 - protein, 22 aa, Staphylococcus
IIAKTAMKAGIQPRRPLIASVL

SEQ ID NO: 1876413 - protein, 21 aa, Staphylococcus
IIALIWGMIFIIDFQYSEYVI

SEQ ID NO: 1876414 - protein, 22 aa, Staphylococcus
IIALVIGSTLIWVSRRKKHHAS

SEQ ID NO: 1876415 - protein, 23 aa, Staphylococcus
IIAMVIAIFGMLFVVKPEFSSSM

SEQ ID NO: 1876416 - protein, 18 aa, Staphylococcus
IIAPFPWLLITGRALQGL

SEQ ID NO: 1876417 - protein, 17 aa, Staphylococcus
IIAPVAWLLLVGRALQG

SEQ ID NO: 1876418 - protein, 18 aa, Staphylococcus
IIASLIIIGLTFYLWKVQ

SEQ ID NO: 1876419 - protein, 17 aa, Staphylococcus
IIASRYVYKIVNRLRLL

SEQ ID NO: 1876420 - protein, 32 aa, Staphylococcus
IIASVICVRVFRLEIEWPFWLSQIGLVLLGVQ

SEQ ID NO: 1876421 - protein, 19 aa, Staphylococcus
IIASVYALIRIMFRHPDDD

SEQ ID NO: 1876422 - protein, 24 aa, Staphylococcus
IIATICFITLFLLLIIQEGIFDAT

SEQ ID NO: 1876423 - protein, 19 aa, Staphylococcus
IIATIITAGISYIFSSQIT

SEQ ID NO: 1876424 - protein, 25 aa, Staphylococcus
IIAVCGLGLIGIKFLGVMGYMSAIS

SEQ ID NO: 1876425 - protein, 26 aa, Staphylococcus
IIAVCGLSLVGIDFLAIMGYASAISV

SEQ ID NO: 1876426 - protein, 17 aa, Staphylococcus
IIAVLAIIAIIYIALKY

SEQ ID NO: 1876427 - protein, 17 aa, Staphylococcus
IICGIFMLKYLKNAYNY

SEQ ID NO: 1876428 - protein, 19 aa, Staphylococcus
IIDEVPMNEVEYSDDASSK

SEQ ID NO: 1876429 - protein, 17 aa, Staphylococcus
IIDGFKEGKKEKMIQAL

SEQ ID NO: 1876430 - protein, 24 aa, Staphylococcus
IIDIQRSFAVFIMATVLTFVSIII

SEQ ID NO: 1876431 - protein, 17 aa, Staphylococcus
IIDISSWRVPFIAVAVI

SEQ ID NO: 1876432 - protein, 31 aa, Staphylococcus
IIDLQREMWKYLSIIGVIVLFTVYLASRSIN

SEQ ID NO: 1876433 - protein, 23 aa, Staphylococcus
IIDRFKFTNLIVLSIMILLLFSF

SEQ ID NO: 1876434 - protein, 20 aa, Staphylococcus
IIEAIRRFFNPIKVQSTEMF

SEQ ID NO: 1876435 - protein, 23 aa, Staphylococcus
IIEEIIFRGLLIKGIFRGAPIVG

SEQ ID NO: 1876436 - protein, 21 aa, Staphylococcus
IIEELLFRHLIIHELGKKITY

SEQ ID NO: 1876437 - protein, 19 aa, Staphylococcus
IIELLKDKRTLALMFLAPL

SEQ ID NO: 1876438 - protein, 22 aa, Staphylococcus
IIFALLFRFIVKLIPVHYIFRV

SEQ ID NO: 1876439 - protein, 24 aa, Staphylococcus
IIFEKPKVKMCFDYIVSTTLIALS

SEQ ID NO: 1876440 - protein, 22 aa, Staphylococcus
IIFGAFAFFWFVGIHGPSIVEP

SEQ ID NO: 1876441 - protein, 22 aa, Staphylococcus
IIFGAFALFWFVGIHGPSIVEP

SEQ ID NO: 1876442 - protein, 24 aa, Staphylococcus
IIFGIAAIGFIIGAIMVKSTKVGH

SEQ ID NO: 1876443 - protein, 24 aa, Staphylococcus
IIFGVALLVCLFRLIKGPTTADRV

SEQ ID NO: 1876444 - protein, 21 aa, Staphylococcus
IIFHISYRKMPIIKQIHLMSN

SEQ ID NO: 1876445 - protein, 18 aa, Staphylococcus
IIFILLSLVIRFILYKTT

SEQ ID NO: 1876446 - protein, 18 aa, Staphylococcus
IIFKRKFTKEQRGSIIPN

SEQ ID NO: 1876447 - protein, 24 aa, Staphylococcus
IIFLAVSTIFAFFLSSRITKPLRE

SEQ ID NO: 1876448 - protein, 24 aa, Staphylococcus
IIFLGISTVFAFFLSNRITKPLRK

SEQ ID NO: 1876449 - protein, 23 aa, Staphylococcus
IIFLREGIEVLLIIMTLTTMTRK

SEQ ID NO: 1876450 - protein, 24 aa, Staphylococcus
IIFLREGLEVLLIILTLTTMTRNV

SEQ ID NO: 1876451 - protein, 23 aa, Staphylococcus
IIFLREGLEVLLIIMTLTTMTRN

SEQ ID NO: 1876452 - protein, 18 aa, Staphylococcus
IIFMIGMFCFNTFADSFI

SEQ ID NO: 1876453 - protein, 34 aa, Staphylococcus
IIFNPDYLYDIGFQFSFIISFFIILSFPLIKKLT

SEQ ID NO: 1876454 - protein, 19 aa, Staphylococcus
IIFNSEVTDIGMLNQRPYI

SEQ ID NO: 1876455 - protein, 34 aa, Staphylococcus
IIFRSNKGFYWKENKVKLVFFLAIAQRDIELTKR

SEQ ID NO: 1876456 - protein, 17 aa, Staphylococcus
IIFSIMFIILGFYDGFL

SEQ ID NO: 1876457 - protein, 17 aa, Staphylococcus
IIFSYIIGFVSLFTGLI

SEQ ID NO: 1876458 - protein, 26 aa, Staphylococcus
IIFVAAGLICFFVFDISDMLKGFKIE

SEQ ID NO: 1876459 - protein, 17 aa, Staphylococcus
IIFVVALILLVFAMTSQ

SEQ ID NO: 1876460 - protein, 27 aa, Staphylococcus
IIFVVLFIWRQERLETPLLSFKVFKNN

SEQ ID NO: 1876461 - protein, 24 aa, Staphylococcus
IIFYCALLGFLAARIYFVIFQWPY

SEQ ID NO: 1876462 - protein, 22 aa, Staphylococcus
IIFYRPLKISTFDPTFSKMSGL

SEQ ID NO: 1876463 - protein, 20 aa, Staphylococcus
IIGAACWGIIGLFIQPLYNR

SEQ ID NO: 1876464 - protein, 24 aa, Staphylococcus
IIGAKWVFFSSFIVLLFPIFFLGQ

SEQ ID NO: 1876465 - protein, 20 aa, Staphylococcus
IIGALFVIGYLYWYSKKIKK

SEQ ID NO: 1876466 - protein, 17 aa, Staphylococcus
IIGALLVLGAFKIGSII

SEQ ID NO: 1876467 - protein, 25 aa, Staphylococcus
IIGALRSWIIAAWNYIKNKVVALAK

SEQ ID NO: 1876468 - protein, 22 aa, Staphylococcus
IIGCALLILSYIASLQIFKRQE

SEQ ID NO: 1876469 - protein, 17 aa, Staphylococcus
IIGEFSVIMGLVLAFYM

SEQ ID NO: 1876470 - protein, 22 aa, Staphylococcus
IIGFLFICKEIFYPESENLNNK

SEQ ID NO: 1876471 - protein, 18 aa, Staphylococcus
IIGGDWKGLHYFQRFFTD

SEQ ID NO: 1876472 - protein, 26 aa, Staphylococcus
IIGHICLSLPFAMVGLFASMFFIIIG

SEQ ID NO: 1876473 - protein, 25 aa, Staphylococcus
IIGICIGVGMMLREFYIFRFVIGKQ

SEQ ID NO: 1876474 - protein, 20 aa, Staphylococcus
IIGILCLVMSHWFKSKENTH

SEQ ID NO: 1876475 - protein, 30 aa, Staphylococcus
IIGIPIGILIARYSKIAWPVITIANIIQTV

SEQ ID NO: 1876476 - protein, 30 aa, Staphylococcus
IIGIPIGILISRYTKLSWPIITIANIIQTV

SEQ ID NO: 1876477 - protein, 19 aa, Staphylococcus
IIGIPIGIVIARYKKLAWP

SEQ ID NO: 1876478 - protein, 18 aa, Staphylococcus
IIGKLLYESLETIDPGPM

SEQ ID NO: 1876479 - protein, 18 aa, Staphylococcus
IIGKLLYESLETIEPGPM

SEQ ID NO: 1876480 - protein, 17 aa, Staphylococcus
IIGLFLGYVFIISGAIS

SEQ ID NO: 1876481 - protein, 18 aa, Staphylococcus
IIGLKLNTFIALIITSVI

SEQ ID NO: 1876482 - protein, 18 aa, Staphylococcus
IIGLKYSLILACIAAVTS

SEQ ID NO: 1876483 - protein, 26 aa, Staphylococcus
IIGLLVILAAAGWIFFSMISDQILFK

SEQ ID NO: 1876484 - protein, 20 aa, Staphylococcus
IIGRIKGHITGMVNAVKSGL

SEQ ID NO: 1876485 - protein, 24 aa, Staphylococcus
IIGSFMLIEIIGGYLANSLALLSD

SEQ ID NO: 1876486 - protein, 17 aa, Staphylococcus
IIGSGYVGVWLYHFLER

SEQ ID NO: 1876487 - protein, 18 aa, Staphylococcus
IIGSLVYMTGYREYKYLN

SEQ ID NO: 1876488 - protein, 17 aa, Staphylococcus
IIGSVFLPFLISGFLFY

SEQ ID NO: 1876489 - protein, 21 aa, Staphylococcus
IIGSWLFLLGIGMLYKTVGTL

SEQ ID NO: 1876490 - protein, 25 aa, Staphylococcus
IIGTLTMIICYGFQLMQQFTLLREP

SEQ ID NO: 1876491 - protein, 20 aa, Staphylococcus
IIGVAIILLLVIAAFIVKQT

SEQ ID NO: 1876492 - protein, 19 aa, Staphylococcus
IIHCMTRVRIKIHDYDKVN

SEQ ID NO: 1876493 - protein, 19 aa, Staphylococcus
IIHFATWQWIFFINIFVTI

SEQ ID NO: 1876494 - protein, 22 aa, Staphylococcus
IIIACALYLLLQGKFGSLEMII

SEQ ID NO: 1876495 - protein, 17 aa, Staphylococcus
IIIACGILLGYFVAQEA

SEQ ID NO: 1876496 - protein, 18 aa, Staphylococcus
IIIAFLWDLLSTIRNGDS

SEQ ID NO: 1876497 - protein, 24 aa, Staphylococcus
IIIAIICFILFLVALKSKNNMKHK

SEQ ID NO: 1876498 - protein, 18 aa, Staphylococcus
IIIALCVGAMLSVSEALL

SEQ ID NO: 1876499 - protein, 18 aa, Staphylococcus
IIIARLLYRGTGHFTKLL

SEQ ID NO: 1876500 - protein, 20 aa, Staphylococcus
IIIEAIKRFFAPPEVQSTEM

SEQ ID NO: 1876501 - protein, 21 aa, Staphylococcus
IIIEAIRRFFAPPEVQSQEMF

SEQ ID NO: 1876502 - protein, 19 aa, Staphylococcus
IIIFGDWVVQIPMPILAAI

SEQ ID NO: 1876503 - protein, 26 aa, Staphylococcus
IIIFGIKLPLLIAFSVILAGLSFGFV

SEQ ID NO: 1876504 - protein, 19 aa, Staphylococcus
IIIFGRLSDKFSRINIYSI

SEQ ID NO: 1876505 - protein, 19 aa, Staphylococcus
IIIFYRPLMVSTFDPVFSR

SEQ ID NO: 1876506 - protein, 23 aa, Staphylococcus
IIIGELSVILGLVVAFYINISPG

SEQ ID NO: 1876507 - protein, 27 aa, Staphylococcus
IIIGFGASFLFNWLIKHDLIPQSLMPP

SEQ ID NO: 1876508 - protein, 18 aa, Staphylococcus
IIIGHIFLSLPLDIVGLF

SEQ ID NO: 1876509 - protein, 25 aa, Staphylococcus
IIIGHSMGSIVGRIFAQRYPDVAQG

SEQ ID NO: 1876510 - protein, 24 aa, Staphylococcus
IIIGYKFLSKRSMYLTVVATILMS

SEQ ID NO: 1876511 - protein, 18 aa, Staphylococcus
IIIICLSLFILFFGATWG

SEQ ID NO: 1876512 - protein, 17 aa, Staphylococcus
IIIIFFLSNSLRHNEVD

SEQ ID NO: 1876513 - protein, 25 aa, Staphylococcus
IIIIPFVAVFAVELMQDFDVNKAFK

SEQ ID NO: 1876514 - protein, 20 aa, Staphylococcus
IIIKIDILSTILIVVILINF

SEQ ID NO: 1876515 - protein, 25 aa, Staphylococcus
IIILCGIVTWLTRIIPFVMISKVHL

SEQ ID NO: 1876516 - protein, 24 aa, Staphylococcus
IIILIAVGIMFYLRSNKRKIVEQA

SEQ ID NO: 1876517 - protein, 21 aa, Staphylococcus
IIILVMICGKIGVATVLALFI

SEQ ID NO: 1876518 - protein, 25 aa, Staphylococcus
IIILYAGIMLMFFIILNYANQVAME

SEQ ID NO: 1876519 - protein, 18 aa, Staphylococcus
IIIMRTSWLFILFIVLGG

SEQ ID NO: 1876520 - protein, 17 aa, Staphylococcus
IIIPENFSKLSMQLDKK

SEQ ID NO: 1876521 - protein, 23 aa, Staphylococcus
IIIPEVVNDLGFNQFPILTNHYI

SEQ ID NO: 1876522 - protein, 18 aa, Staphylococcus
IIIPEVVSDLGINTYPII

SEQ ID NO: 1876523 - protein, 22 aa, Staphylococcus
IIIPSTILFFIFSSASVIFLFF

SEQ ID NO: 1876524 - protein, 17 aa, Staphylococcus
IIIPVILLVYFSFTDVH

SEQ ID NO: 1876525 - protein, 17 aa, Staphylococcus
IIISGILFLAFVLMPAS

SEQ ID NO: 1876526 - protein, 20 aa, Staphylococcus
IIISIYRQPLLAVIVGGSLT

SEQ ID NO: 1876527 - protein, 19 aa, Staphylococcus
IIITFPILRKFKVATPMFR

SEQ ID NO: 1876528 - protein, 26 aa, Staphylococcus
IIIVITCILLFLLIFFLFNLPLSAFL

SEQ ID NO: 1876529 - protein, 21 aa, Staphylococcus
IIIVVIYRQPFLALIVGGSLT

SEQ ID NO: 1876530 - protein, 17 aa, Staphylococcus
IIKEPYSQLILFGIIVE

SEQ ID NO: 1876531 - protein, 23 aa, Staphylococcus
IIKGRLKFIIMSLIGILLFLIPI

SEQ ID NO: 1876532 - protein, 25 aa, Staphylococcus
IIKKNWGIWLFIPIIFLLISLIITF

SEQ ID NO: 1876533 - protein, 21 aa, Staphylococcus
IIKNAWKVLMERIPDGYDSDE

SEQ ID NO: 1876534 - protein, 20 aa, Staphylococcus
IIKNAWKVLMERVPDGFNTD

SEQ ID NO: 1876535 - protein, 22 aa, Staphylococcus
IIKNAWKVLMERVPEGYSSDEI

SEQ ID NO: 1876536 - protein, 21 aa, Staphylococcus
IIKRAVKIFVVATICLVITTI

SEQ ID NO: 1876537 - protein, 25 aa, Staphylococcus
IIKSLEVWNDCALITVSIVLCIFHL

SEQ ID NO: 1876538 - protein, 36 aa, Staphylococcus
IILADGREVCVPCIQGTRATIKYYYIDQAGNVHIDF

SEQ ID NO: 1876539 - protein, 17 aa, Staphylococcus
IILAFVISTLIKKFNLM

SEQ ID NO: 1876540 - protein, 19 aa, Staphylococcus
IILALFGLGFIIVGVILKP

SEQ ID NO: 1876541 - protein, 26 aa, Staphylococcus
IILASYRKYSAFLFSKSRQRLSDLNS

SEQ ID NO: 1876542 - protein, 23 aa, Staphylococcus
IILATLYFLYVWKNDQPQNQDHY

SEQ ID NO: 1876543 - protein, 27 aa, Staphylococcus
IILAVAGIFSLLSIHGFIITIGAFGIL

SEQ ID NO: 1876544 - protein, 17 aa, Staphylococcus
IILCGIVTILVRVIPFM

SEQ ID NO: 1876545 - protein, 23 aa, Staphylococcus
IILCGIVTLLIRIIPFMMISRVH

SEQ ID NO: 1876546 - protein, 26 aa, Staphylococcus
IILFGMKVPLLIAFSVIFAGLSFGYV

SEQ ID NO: 1876547 - protein, 27 aa, Staphylococcus
IILFLLCLTVFKMKGIYAAITTLVVTL

SEQ ID NO: 1876548 - protein, 25 aa, Staphylococcus
IILFLLCLTVFKMKGIYAAVTTLVV

SEQ ID NO: 1876549 - protein, 25 aa, Staphylococcus
IILFLLCLTVFKMKGVYAALTTLII

SEQ ID NO: 1876550 - protein, 25 aa, Staphylococcus
IILFLMEFARGMYTLSYINYLPTVT

SEQ ID NO: 1876551 - protein, 18 aa, Staphylococcus
IILFSLVVRIDFFKSPKV

SEQ ID NO: 1876552 - protein, 17 aa, Staphylococcus
IILGCFIITIYLVIMLP

SEQ ID NO: 1876553 - protein, 18 aa, Staphylococcus
IILGELSVVLGLVLAFYM

SEQ ID NO: 1876554 - protein, 23 aa, Staphylococcus
IILIAIGVMFYMRSNKRNSIEKA

SEQ ID NO: 1876555 - protein, 29 aa, Staphylococcus
IILIGAFILNLAFAFTIIFMERRSANSIW

SEQ ID NO: 1876556 - protein, 26 aa, Staphylococcus
IILILQRFTKGFLKSIAILIGLVAGT

SEQ ID NO: 1876557 - protein, 21 aa, Staphylococcus
IILIWKYVPKNGIAADENHDA

SEQ ID NO: 1876558 - protein, 23 aa, Staphylococcus
IILKQWKQLVIFFTILTCTLLLI

SEQ ID NO: 1876559 - protein, 23 aa, Staphylococcus
IILLCIIVGSILAFKINQQNDWI

SEQ ID NO: 1876560 - protein, 23 aa, Staphylococcus
IILLCIIVGSILAYKINQQNQWI

SEQ ID NO: 1876561 - protein, 19 aa, Staphylococcus
IILLFKIIFMLDYVIFHII

SEQ ID NO: 1876562 - protein, 17 aa, Staphylococcus
IILLIAIGIMFFLRSNK

SEQ ID NO: 1876563 - protein, 18 aa, Staphylococcus
IILLLLILNAIFTTVNKN

SEQ ID NO: 1876564 - protein, 21 aa, Staphylococcus
IILLLVIAAFIVKQTTGSGNK

SEQ ID NO: 1876565 - protein, 23 aa, Staphylococcus
IILLSILVSIVFIKNQIYYKDHT

SEQ ID NO: 1876566 - protein, 25 aa, Staphylococcus
IILMCCIAIIYSLMAKINFPTKQLL

SEQ ID NO: 1876567 - protein, 23 aa, Staphylococcus
IILMCLPLGIGLFYLQLFYYERR

SEQ ID NO: 1876568 - protein, 18 aa, Staphylococcus
IILMRTSLWFILFIFLGG

SEQ ID NO: 1876569 - protein, 17 aa, Staphylococcus
IILPFSVSMAIVGLVES

SEQ ID NO: 1876570 - protein, 17 aa, Staphylococcus
IILPPLAAMLFIKIGYH

SEQ ID NO: 1876571 - protein, 22 aa, Staphylococcus
IILPPLAAMLFIKIGYHPIAGL

SEQ ID NO: 1876572 - protein, 19 aa, Staphylococcus
IILPVGFYLLFTSLLDLPE

SEQ ID NO: 1876573 - protein, 26 aa, Staphylococcus
IILRDFQAALVVKRFVFDITDLSPFI

SEQ ID NO: 1876574 - protein, 19 aa, Staphylococcus
IILSMIFMVVLIYAMGKYT

SEQ ID NO: 1876575 - protein, 24 aa, Staphylococcus
IILSSLVGIVFFLAILVGATYLIT

SEQ ID NO: 1876576 - protein, 24 aa, Staphylococcus
IILTICAWWLKPDIVYVHHLASLH

SEQ ID NO: 1876577 - protein, 17 aa, Staphylococcus
IILTILAMFLMKHTPET

SEQ ID NO: 1876578 - protein, 30 aa, Staphylococcus
IILVAILILFSFVPVGLWISAIAAGVKVGI

SEQ ID NO: 1876579 - protein, 27 aa, Staphylococcus
IILVVYEFGMALLLFKVNVLSHRLFMA

SEQ ID NO: 1876580 - protein, 17 aa, Staphylococcus
IIMAGIRTAMVLIIGTA

SEQ ID NO: 1876581 - protein, 18 aa, Staphylococcus
IIMALNYLFNLALTPLFT

SEQ ID NO: 1876582 - protein, 20 aa, Staphylococcus
IIMILYRTPLLGLIVAGSLT

SEQ ID NO: 1876583 - protein, 18 aa, Staphylococcus
IIMSGLIGAILLTLGDGL

SEQ ID NO: 1876584 - protein, 17 aa, Staphylococcus
IIMVVSIMMSIVISIVS

SEQ ID NO: 1876585 - protein, 18 aa, Staphylococcus
IINICRSIGPAIAGVILA

SEQ ID NO: 1876586 - protein, 22 aa, Staphylococcus
IINIIVAWLMMRGGDTHHNINM

SEQ ID NO: 1876587 - protein, 20 aa, Staphylococcus
IINKQIIWIFSIPVIVAIIH

SEQ ID NO: 1876588 - protein, 27 aa, Staphylococcus
IINLKQFWIRRIKRLLPAVIALLITVG

SEQ ID NO: 1876589 - protein, 27 aa, Staphylococcus
IINLKQFWLRRIKRLIPAVLVLVVTVT

SEQ ID NO: 1876590 - protein, 18 aa, Staphylococcus
IINPALQIAVYWFVFGLG

SEQ ID NO: 1876591 - protein, 23 aa, Staphylococcus
IINVFFLYFWIFKVTKTQTRKSA

SEQ ID NO: 1876592 - protein, 21 aa, Staphylococcus
IIPAMIAGIVFAFGVAYILGK

SEQ ID NO: 1876593 - protein, 25 aa, Staphylococcus
IIPDLTDEFLILDFSYDMPLATYLG

SEQ ID NO: 1876594 - protein, 18 aa, Staphylococcus
IIPGIVWGIGNLFMFYSQ

SEQ ID NO: 1876595 - protein, 17 aa, Staphylococcus
IIPGVVWAIGNLFLFFS

SEQ ID NO: 1876596 - protein, 20 aa, Staphylococcus
IIPMGLEFDEVQPIGFDLQK

SEQ ID NO: 1876597 - protein, 20 aa, Staphylococcus
IIPSIMLGFFNRRFDSRYPK

SEQ ID NO: 1876598 - protein, 24 aa, Staphylococcus
IIPTFARKRLFGHQSMVWATAGIA

SEQ ID NO: 1876599 - protein, 23 aa, Staphylococcus
IIQGHVAWDYSIVLIISSYIGAK

SEQ ID NO: 1876600 - protein, 23 aa, Staphylococcus
IIQGHVAWSYSIILIISSYIGAQ

SEQ ID NO: 1876601 - protein, 19 aa, Staphylococcus
IIQNLTLDSFVFKNTCIYA

SEQ ID NO: 1876602 - protein, 19 aa, Staphylococcus
IIQRYCIRYLAGDRSYRKY

SEQ ID NO: 1876603 - protein, 17 aa, Staphylococcus
IIREIAGVASIRIGGHP

SEQ ID NO: 1876604 - protein, 17 aa, Staphylococcus
IIRFLDVYLNYIPVLTH

SEQ ID NO: 1876605 - protein, 24 aa, Staphylococcus
IIRGRAKFIVMSIIGIILFLIPVP

SEQ ID NO: 1876606 - protein, 19 aa, Staphylococcus
IIRGTPLLVQVFIVFFGTT

SEQ ID NO: 1876607 - protein, 19 aa, Staphylococcus
IIRILKLPFTISLHFYLFF

SEQ ID NO: 1876608 - protein, 26 aa, Staphylococcus
IIRKISRFFKLIGLRFKARKESRKET

SEQ ID NO: 1876609 - protein, 17 aa, Staphylococcus
IIRRIQIHIETWDRTSL

SEQ ID NO: 1876610 - protein, 19 aa, Staphylococcus
IISCISLIGGYLFGSLFFM

SEQ ID NO: 1876611 - protein, 25 aa, Staphylococcus
IISEKEFFLYSGLFTLLIGVILVAI

SEQ ID NO: 1876612 - protein, 20 aa, Staphylococcus
IISFMIAFIFGYLISLVVPA

SEQ ID NO: 1876613 - protein, 23 aa, Staphylococcus
IISGIRLSSVYVISWATLASYVG

SEQ ID NO: 1876614 - protein, 18 aa, Staphylococcus
IISGLFLLVMFKIMNSRQ

SEQ ID NO: 1876615 - protein, 20 aa, Staphylococcus
IISMIFAVEISRLVIKSGFT

SEQ ID NO: 1876616 - protein, 17 aa, Staphylococcus
IISMLWFTAFGITGIEI

SEQ ID NO: 1876617 - protein, 21 aa, Staphylococcus
IISNFKEFINVAAPTNNEIES

SEQ ID NO: 1876618 - protein, 19 aa, Staphylococcus
IISPFLKNKSDAYIDIKNH

SEQ ID NO: 1876619 - protein, 17 aa, Staphylococcus
IISWLKRKQFVFITIKP

SEQ ID NO: 1876620 - protein, 18 aa, Staphylococcus
IITAIVMFGLRKGKDMDT

SEQ ID NO: 1876621 - protein, 18 aa, Staphylococcus
IITGFFIIFENQFDVGDY

SEQ ID NO: 1876622 - protein, 18 aa, Staphylococcus
IITIIAMIIVGLVMIFFS

SEQ ID NO: 1876623 - protein, 21 aa, Staphylococcus
IITIILCYLGFQFGLKKRDEM

SEQ ID NO: 1876624 - protein, 17 aa, Staphylococcus
IITIPLVLLVVTLIIPI

SEQ ID NO: 1876625 - protein, 29 aa, Staphylococcus
IITIVALVIIGVVGFYFYHNATSYVTTDN

SEQ ID NO: 1876626 - protein, 31 aa, Staphylococcus
IITKYSSFHAIRIPVFFGILLYIALQLIVLM

SEQ ID NO: 1876627 - protein, 18 aa, Staphylococcus
IITLVLSCIINKKRVLIG

SEQ ID NO: 1876628 - protein, 20 aa, Staphylococcus
IITPDRVIPEGNVTAKATDN

SEQ ID NO: 1876629 - protein, 22 aa, Staphylococcus
IITPILNSWVLKFFVDNLGMNG

SEQ ID NO: 1876630 - protein, 17 aa, Staphylococcus
IITVIVFIVVALVTALL

SEQ ID NO: 1876631 - protein, 23 aa, Staphylococcus
IIVAIAFILSFFFMKDVIPNRKI

SEQ ID NO: 1876632 - protein, 17 aa, Staphylococcus
IIVAIIMFKSGDTSHNL

SEQ ID NO: 1876633 - protein, 26 aa, Staphylococcus
IIVALFSMWRYFNWYHLIVYILIFLV

SEQ ID NO: 1876634 - protein, 17 aa, Staphylococcus
IIVALLAMYLMRHTPET

SEQ ID NO: 1876635 - protein, 29 aa, Staphylococcus
IIVALLILFSFVPVGLWISALAAGVHVGI

SEQ ID NO: 1876636 - protein, 19 aa, Staphylococcus
IIVAMAFFKLPGSIAGGAT

SEQ ID NO: 1876637 - protein, 21 aa, Staphylococcus
IIVCGLPLFFIIPNILGKYLI

SEQ ID NO: 1876638 - protein, 21 aa, Staphylococcus
IIVEAIKRFFAPPEVQSTEMF

SEQ ID NO: 1876639 - protein, 23 aa, Staphylococcus
IIVFFCIFLIFSPIGKLKLGKPN

SEQ ID NO: 1876640 - protein, 26 aa, Staphylococcus
IIVFIFAIIVLRLGYLQIAQGSHYKQ

SEQ ID NO: 1876641 - protein, 19 aa, Staphylococcus
IIVFLPLVFVAGSVGEMFR

SEQ ID NO: 1876642 - protein, 24 aa, Staphylococcus
IIVGARYTLAIAIMTLLMIVIIGV

SEQ ID NO: 1876643 - protein, 18 aa, Staphylococcus
IIVGFSNWHMVYFTLTVL

SEQ ID NO: 1876644 - protein, 20 aa, Staphylococcus
IIVGIFVMRQIRIDNPLLNM

SEQ ID NO: 1876645 - protein, 22 aa, Staphylococcus
IIVIGGLFGLNAYSNQHPNNHS

SEQ ID NO: 1876646 - protein, 18 aa, Staphylococcus
IIVIIGLFIIFLFIWMIF

SEQ ID NO: 1876647 - protein, 19 aa, Staphylococcus
IIVIIYRQPFLALIVGASL

SEQ ID NO: 1876648 - protein, 20 aa, Staphylococcus
IIVLCIYLGYQGILWIMDHF

SEQ ID NO: 1876649 - protein, 26 aa, Staphylococcus
IIVLIVIGVVGFYFWNNATSYVSTDN

SEQ ID NO: 1876650 - protein, 22 aa, Staphylococcus
IIVLRTSWIFILFIVLGGLSYT

SEQ ID NO: 1876651 - protein, 28 aa, Staphylococcus
IIVLVVIGVLAFWFWNNATSYVTTDNAK

SEQ ID NO: 1876652 - protein, 25 aa, Staphylococcus
IIVPLISALFFHYLFVKVLKIYNPN

SEQ ID NO: 1876653 - protein, 17 aa, Staphylococcus
IIVPQFISGYSMAALLV

SEQ ID NO: 1876654 - protein, 19 aa, Staphylococcus
IIVQIKEIFAPLMTISINS

SEQ ID NO: 1876655 - protein, 24 aa, Staphylococcus
IIVSFCIGVLLFIGYSIIGLKYSL

SEQ ID NO: 1876656 - protein, 23 aa, Staphylococcus
IIVSFCIGVLLLIGYSIIGLKYP

SEQ ID NO: 1876657 - protein, 18 aa, Staphylococcus
IIVSFGWQPLLINAAIYF

SEQ ID NO: 1876658 - protein, 18 aa, Staphylococcus
IIVSIVWALLLSACYYVY

SEQ ID NO: 1876659 - protein, 19 aa, Staphylococcus
IIVSLVLFGIFVMLPASWF

SEQ ID NO: 1876660 - protein, 25 aa, Staphylococcus
IIVVACLKTAIGLITAFSETFTELF

SEQ ID NO: 1876661 - protein, 25 aa, Staphylococcus
IIVVALLILFSFVPIGLWISAIAAG

SEQ ID NO: 1876662 - protein, 27 aa, Staphylococcus
IIVVFYYLKWLKLKTAPLLIATILYGA

SEQ ID NO: 1876663 - protein, 20 aa, Staphylococcus
IIVVIYRQPLLALIVGGSLT

SEQ ID NO: 1876664 - protein, 24 aa, Staphylococcus
IIVVLRLILYFVLMMGAVQYFLKR

SEQ ID NO: 1876665 - protein, 26 aa, Staphylococcus
IIVVVFKQPFLALIVAASLTIAMTVG

SEQ ID NO: 1876666 - protein, 17 aa, Staphylococcus
IIVVVLIFYNTRKSASK

SEQ ID NO: 1876667 - protein, 43 aa, Staphylococcus
IIVYFIICLLISFLALISMNIRILSGFLFLLAAIVTIPLVLLV

SEQ ID NO: 1876668 - protein, 41 aa, Staphylococcus
IIVYFIICLLISFLALISMNIRILSGILFLIASIITLPLVL

SEQ ID NO: 1876669 - protein, 43 aa, Staphylococcus
IIVYFIVCLLISFLALISMNIRILSGFLFLLSAIITIPLVLLV

SEQ ID NO: 1876670 - protein, 42 aa, Staphylococcus
IIVYFIVCLLISFLALISMNMRILSGFLFLIASIITLPLVLL

SEQ ID NO: 1876671 - protein, 17 aa, Staphylococcus
IIWIIEFLKSRKYVSEI

SEQ ID NO: 1876672 - protein, 22 aa, Staphylococcus
IIWLLGSFAFGWYISNFGNYSK

SEQ ID NO: 1876673 - protein, 18 aa, Staphylococcus
IIWLLGSFGFGWYLSNFG

SEQ ID NO: 1876674 - protein, 17 aa, Staphylococcus
IIYAWSPFVILTVVVMI

SEQ ID NO: 1876675 - protein, 24 aa, Staphylococcus
IIYKFGSDTIKVFSTEIEMEQELN

SEQ ID NO: 1876676 - protein, 17 aa, Staphylococcus
IIYKIEKGDSFKKVDKQ

SEQ ID NO: 1876677 - protein, 23 aa, Staphylococcus
IIYKKLKHIFIGFFTILTCTLII

SEQ ID NO: 1876678 - protein, 30 aa, Staphylococcus
IIYLFMVGFYRLPGIVAVIALTVYVYLTLV

SEQ ID NO: 1876679 - protein, 30 aa, Staphylococcus
IIYLFMVGFYRLPGLVAIIALTVYIYLTLV

SEQ ID NO: 1876680 - protein, 21 aa, Staphylococcus
IIYLPKHIHLVFTPEEKIAII

SEQ ID NO: 1876681 - protein, 21 aa, Staphylococcus
IIYNRFPKIPAAFIQIALGVC

SEQ ID NO: 1876682 - protein, 39 aa, Staphylococcus
IIYRLIFKFKSIYFKTMSGGLLIKISMMMLTFTLILAIL

SEQ ID NO: 1876683 - protein, 17 aa, Staphylococcus
IIYRRIKYQPAIYKNAG

SEQ ID NO: 1876684 - protein, 17 aa, Staphylococcus
IIYTYLNIVPFGRDYEG

SEQ ID NO: 1876685 - protein, 17 aa, Staphylococcus
IIYTYLNIVPFGRDYNG

SEQ ID NO: 1876686 - protein, 22 aa, Staphylococcus
IIYTYLNIVPFGRDYNGANITG

SEQ ID NO: 1876687 - protein, 26 aa, Staphylococcus
IKAAYDYKISCVHLPINGEEGLGGVI

SEQ ID NO: 1876688 - protein, 19 aa, Staphylococcus
IKAFIPLLIPLFISAFQRA

SEQ ID NO: 1876689 - protein, 20 aa, Staphylococcus
IKAFLNFSSIYRWDAKQLSD

SEQ ID NO: 1876690 - protein, 17 aa, Staphylococcus
IKAPLNRLAGKISDEEM

SEQ ID NO: 1876691 - protein, 19 aa, Staphylococcus
IKAPTKVTSKESYKIKSSK

SEQ ID NO: 1876692 - protein, 22 aa, Staphylococcus
IKAWCEKFDVIINMKQRKGLEV

SEQ ID NO: 1876693 - protein, 17 aa, Staphylococcus
IKAYTMVLIATMVLCAI

SEQ ID NO: 1876694 - protein, 20 aa, Staphylococcus
IKDAETFEAISLDYLRGADY

SEQ ID NO: 1876695 - protein, 17 aa, Staphylococcus
IKDELKIGRTLKQAYKK

SEQ ID NO: 1876696 - protein, 23 aa, Staphylococcus
IKDELRIGRTLKQAFNKANKSSF

SEQ ID NO: 1876697 - protein, 23 aa, Staphylococcus
IKDELRIGRTLKQAYTKANRSSF

SEQ ID NO: 1876698 - protein, 23 aa, Staphylococcus
IKDELRVGRTLKQAYSKANKSSF

SEQ ID NO: 1876699 - protein, 37 aa, Staphylococcus
IKDFWNRWHMTLSFWFRDCIYMRSLFFMSKKKLMKSQ

SEQ ID NO: 1876700 - protein, 17 aa, Staphylococcus
IKDGYLPLEKVSVIDIN

SEQ ID NO: 1876701 - protein, 19 aa, Staphylococcus
IKDHDDFTIDNGYFESTSD

SEQ ID NO: 1876702 - protein, 25 aa, Staphylococcus
IKDKFELGEAFPVTIAIKDNDKLTT

SEQ ID NO: 1876703 - protein, 20 aa, Staphylococcus
IKDKHLIQATVFNYVNTIVK

SEQ ID NO: 1876704 - protein, 17 aa, Staphylococcus
IKDVVMLAARILLESGA

SEQ ID NO: 1876705 - protein, 18 aa, Staphylococcus
IKEEFKGRILSLNQSIVQ

SEQ ID NO: 1876706 - protein, 21 aa, Staphylococcus
IKEGLSVFVPLVIVAITLNFL

SEQ ID NO: 1876707 - protein, 21 aa, Staphylococcus
IKEKFTPLILSYADISARVNQ

SEQ ID NO: 1876708 - protein, 26 aa, Staphylococcus
IKELKYARWDTVISISIGGIISAAIL

SEQ ID NO: 1876709 - protein, 26 aa, Staphylococcus
IKELSRTGVYFKWQMLITILFVIPCH

SEQ ID NO: 1876710 - protein, 26 aa, Staphylococcus
IKELSRTGVYFKWQMLITLIFVIPCH

SEQ ID NO: 1876711 - protein, 26 aa, Staphylococcus
IKELSRTGVYFKWQMLVTLIFVIPCH

SEQ ID NO: 1876712 - protein, 31 aa, Staphylococcus
IKELTRTGVYYKWQMLVTLVFVIPCHELYMR

SEQ ID NO: 1876713 - protein, 17 aa, Staphylococcus
IKEPSLLIIIPILILSF

SEQ ID NO: 1876714 - protein, 22 aa, Staphylococcus
IKERFKLFIHPHIIRIMTVTVC

SEQ ID NO: 1876715 - protein, 21 aa, Staphylococcus
IKESGELKVGLSADYAPMEFE

SEQ ID NO: 1876716 - protein, 21 aa, Staphylococcus
IKFEMIDCGKGIPEEERQLIF

SEQ ID NO: 1876717 - protein, 19 aa, Staphylococcus
IKFFKGFIPAITIGFGGSS

SEQ ID NO: 1876718 - protein, 17 aa, Staphylococcus
IKFFSEFVASAVVITIA

SEQ ID NO: 1876719 - protein, 17 aa, Staphylococcus
IKFGAGTIFDNMDFIVS

SEQ ID NO: 1876720 - protein, 19 aa, Staphylococcus
IKFLGALYIAYLGLKTILN

SEQ ID NO: 1876721 - protein, 17 aa, Staphylococcus
IKFLINKGFKEKLSDYR

SEQ ID NO: 1876722 - protein, 19 aa, Staphylococcus
IKFMEWRVAVQTATHDYVG

SEQ ID NO: 1876723 - protein, 25 aa, Staphylococcus
IKFQMRDYFAIFGIIIPSTILFGVI

SEQ ID NO: 1876724 - protein, 21 aa, Staphylococcus
IKFSDLFFAFKKGRYATSLLL

SEQ ID NO: 1876725 - protein, 17 aa, Staphylococcus
IKFTEQILSGIKHAHDM

SEQ ID NO: 1876726 - protein, 17 aa, Staphylococcus
IKFVMHIFFGKHRPDRL

SEQ ID NO: 1876727 - protein, 19 aa, Staphylococcus
IKGAVKHPNVYKMNSSDRM

SEQ ID NO: 1876728 - protein, 17 aa, Staphylococcus
IKGDAFISIHNDSLDSP

SEQ ID NO: 1876729 - protein, 20 aa, Staphylococcus
IKGDIWYYNANYYNGFTIKV

SEQ ID NO: 1876730 - protein, 20 aa, Staphylococcus
IKGHIGGMVSGVKGGLNKLI

SEQ ID NO: 1876731 - protein, 21 aa, Staphylococcus
IKGIFCNFFINIGIYVSMLFK

SEQ ID NO: 1876732 - protein, 20 aa, Staphylococcus
IKGMAPVGAVMLRITTALTG

SEQ ID NO: 1876733 - protein, 17 aa, Staphylococcus
IKGNILNKVNNSQDEID

SEQ ID NO: 1876734 - protein, 18 aa, Staphylococcus
IKGSFGLDQILGAFMYPF

SEQ ID NO: 1876735 - protein, 19 aa, Staphylococcus
IKHIFGISIPTYLFVISTL

SEQ ID NO: 1876736 - protein, 39 aa, Staphylococcus
IKHTMNKRISFVFGAIVVIFGIIVLRLGYLQIAQGSQYS

SEQ ID NO: 1876737 - protein, 17 aa, Staphylococcus
IKHYAIYMFSLVISTVL

SEQ ID NO: 1876738 - protein, 17 aa, Staphylococcus
IKHYGMFLFSLLLSIVL

SEQ ID NO: 1876739 - protein, 18 aa, Staphylococcus
IKIALIIIYIIVALIVIA

SEQ ID NO: 1876740 - protein, 26 aa, Staphylococcus
IKIDKGMPLRSFHRHFFIFSVIILIL

SEQ ID NO: 1876741 - protein, 24 aa, Staphylococcus
IKIDRYQFEQMLIIFIDNAMKYDQ

SEQ ID NO: 1876742 - protein, 24 aa, Staphylococcus
IKIKDLPMVMVMLYASLGSVLLYE

SEQ ID NO: 1876743 - protein, 17 aa, Staphylococcus
IKIKRVMFPMQELVETI

SEQ ID NO: 1876744 - protein, 25 aa, Staphylococcus
IKILKSELLLAFSTSSSEAVLPSMM

SEQ ID NO: 1876745 - protein, 20 aa, Staphylococcus
IKIPGLLSFLADNNINTKVK

SEQ ID NO: 1876746 - protein, 23 aa, Staphylococcus
IKIPSIHYDHTYTTYIVMKHSEK

SEQ ID NO: 1876747 - protein, 19 aa, Staphylococcus
IKISIIFAIVFFLLNFFSE

SEQ ID NO: 1876748 - protein, 20 aa, Staphylococcus
IKKAKSLAFRDVKNHFVRNE

SEQ ID NO: 1876749 - protein, 25 aa, Staphylococcus
IKKFEWPLFVVFGMIFLLLVPNTFY

SEQ ID NO: 1876750 - protein, 24 aa, Staphylococcus
IKKGWPSMMHAIWKNPEKYDSYFI

SEQ ID NO: 1876751 - protein, 24 aa, Staphylococcus
IKKGWPSMMHSIWKNPEKFNSYFI

SEQ ID NO: 1876752 - protein, 23 aa, Staphylococcus
IKKLKRQSVVGGFFFGALTTLFD

SEQ ID NO: 1876753 - protein, 17 aa, Staphylococcus
IKKNSSYERIYEKAQKQ

SEQ ID NO: 1876754 - protein, 18 aa, Staphylococcus
IKKQLPNTLKVQITENQV

SEQ ID NO: 1876755 - protein, 20 aa, Staphylococcus
IKKQWLAYLILILTIVLTLT

SEQ ID NO: 1876756 - protein, 17 aa, Staphylococcus
IKKVEFFYFLETSMNID

SEQ ID NO: 1876757 - protein, 22 aa, Staphylococcus
IKLEDPETLFIVMSQILFHPLV

SEQ ID NO: 1876758 - protein, 22 aa, Staphylococcus
IKLEDPETLFIVMSQVLFHPLV

SEQ ID NO: 1876759 - protein, 17 aa, Staphylococcus
IKLKLTPILKEDLAGGL

SEQ ID NO: 1876760 - protein, 21 aa, Staphylococcus
IKLTLAAIIIFPFYVFTVYFF

SEQ ID NO: 1876761 - protein, 18 aa, Staphylococcus
IKLVFIFLLELIKANLDV

SEQ ID NO: 1876762 - protein, 20 aa, Staphylococcus
IKLWLTIIFIVTTVLILLSA

SEQ ID NO: 1876763 - protein, 19 aa, Staphylococcus
IKLWLTIILIVETVLILLS

SEQ ID NO: 1876764 - protein, 24 aa, Staphylococcus
IKMFEINWLWPVLFLDIVIITPVV

SEQ ID NO: 1876765 - protein, 27 aa, Staphylococcus
IKMFKYFEQLRWFIGELNHVYVTYMVI

SEQ ID NO: 1876766 - protein, 18 aa, Staphylococcus
IKNAPKTDAFVMILTVII

SEQ ID NO: 1876767 - protein, 17 aa, Staphylococcus
IKNEFMRMIPAKFGVIV

SEQ ID NO: 1876768 - protein, 23 aa, Staphylococcus
IKNFKELVMWLANQFKFLILFSL

SEQ ID NO: 1876769 - protein, 24 aa, Staphylococcus
IKNFSVKVWNYIKNKVISFAKSLY

SEQ ID NO: 1876770 - protein, 19 aa, Staphylococcus
IKNGETWTLDKQVSHINID

SEQ ID NO: 1876771 - protein, 24 aa, Staphylococcus
IKNIEPQKKWIVIISNFKEFINVA

SEQ ID NO: 1876772 - protein, 18 aa, Staphylococcus
IKNIRLVSLIVFAIAIVF

SEQ ID NO: 1876773 - protein, 23 aa, Staphylococcus
IKNPIMFVVEVGMLLALGLTIYP

SEQ ID NO: 1876774 - protein, 24 aa, Staphylococcus
IKNREAVEIAQPLNYVMMDKTGTL

SEQ ID NO: 1876775 - protein, 17 aa, Staphylococcus
IKNRPSLLDRLHADAQR

SEQ ID NO: 1876776 - protein, 24 aa, Staphylococcus
IKPFARFSGWIALIAPILSALYFV

SEQ ID NO: 1876777 - protein, 19 aa, Staphylococcus
IKPGEKIPVDGVIIKGMTS

SEQ ID NO: 1876778 - protein, 20 aa, Staphylococcus
IKPIHFIGGVLGVVFVTSNI

SEQ ID NO: 1876779 - protein, 21 aa, Staphylococcus
IKPKIAYAFMAAIRMVPLIIS

SEQ ID NO: 1876780 - protein, 17 aa, Staphylococcus
IKPKISLILSGKGNKYK

SEQ ID NO: 1876781 - protein, 17 aa, Staphylococcus
IKPLIMKYRIHFIEQHT

SEQ ID NO: 1876782 - protein, 17 aa, Staphylococcus
IKPLSIISVAFLLVQAL

SEQ ID NO: 1876783 - protein, 18 aa, Staphylococcus
IKPTFGAAFEAFKDPGQL

SEQ ID NO: 1876784 - protein, 18 aa, Staphylococcus
IKPTFGAAFEAFKDPSQL

SEQ ID NO: 1876785 - protein, 33 aa, Staphylococcus
IKQEGRKWLFFKDYKFDIPRYNIYVDSMSDIDE

SEQ ID NO: 1876786 - protein, 17 aa, Staphylococcus
IKQKWFGNQKTPVYVYK

SEQ ID NO: 1876787 - protein, 25 aa, Staphylococcus
IKQVFWRILIFYILAIFVIGMLIPY

SEQ ID NO: 1876788 - protein, 25 aa, Staphylococcus
IKQVFWRILLFYVLSIAVIAAIIPY

SEQ ID NO: 1876789 - protein, 20 aa, Staphylococcus
IKREREALKQQVAKEKQQSK

SEQ ID NO: 1876790 - protein, 21 aa, Staphylococcus
IKRFEREVHNLTQLSHKNIVN

SEQ ID NO: 1876791 - protein, 17 aa, Staphylococcus
IKRMLFDRPTLLKHTDA

SEQ ID NO: 1876792 - protein, 23 aa, Staphylococcus
IKRPASWLKKGINLFLLAVLPAN

SEQ ID NO: 1876793 - protein, 28 aa, Staphylococcus
IKRPFRYLKLCLSFIMGALVLYINHIVI

SEQ ID NO: 1876794 - protein, 24 aa, Staphylococcus
IKRTGEHVLTWIGVAIQALVAIMF

SEQ ID NO: 1876795 - protein, 17 aa, Staphylococcus
IKRVIGTPGDKVEYEGD

SEQ ID NO: 1876796 - protein, 23 aa, Staphylococcus
IKSAVNDVIWRILIFYIGAIFVI

SEQ ID NO: 1876797 - protein, 21 aa, Staphylococcus
IKSIHTFSFKLLGSLLAIGLI

SEQ ID NO: 1876798 - protein, 24 aa, Staphylococcus
IKSKEFITFIIAMLLCLTITSFYQ

SEQ ID NO: 1876799 - protein, 17 aa, Staphylococcus
IKSMMWTTIPASIIGMI

SEQ ID NO: 1876800 - protein, 18 aa, Staphylococcus
IKSPVIGKVSMIAPSKHA

SEQ ID NO: 1876801 - protein, 19 aa, Staphylococcus
IKSRIHIKIPSIHYDHTYT

SEQ ID NO: 1876802 - protein, 20 aa, Staphylococcus
IKSTIVLKNKLPSFTFIEMI

SEQ ID NO: 1876803 - protein, 18 aa, Staphylococcus
IKTAHLIAYSSVIIAILY

SEQ ID NO: 1876804 - protein, 17 aa, Staphylococcus
IKTGLIIGGGMQLTVLG

SEQ ID NO: 1876805 - protein, 18 aa, Staphylococcus
IKTISVAVGAFFKAFWKE

SEQ ID NO: 1876806 - protein, 17 aa, Staphylococcus
IKTNVAMNWYFIAASVV

SEQ ID NO: 1876807 - protein, 20 aa, Staphylococcus
IKTPLTHIHRLLSTLQSNVN

SEQ ID NO: 1876808 - protein, 32 aa, Staphylococcus
IKTQAEASINQAINVARLTAAKEHAIENVNQF

SEQ ID NO: 1876809 - protein, 17 aa, Staphylococcus
IKTRHLLSSLIIEIILT

SEQ ID NO: 1876810 - protein, 24 aa, Staphylococcus
IKTSEGFMTLVWYIAYGLPYIIAI

SEQ ID NO: 1876811 - protein, 21 aa, Staphylococcus
IKVATRLGHVKDYFIYPYKDE

SEQ ID NO: 1876812 - protein, 19 aa, Staphylococcus
IKVGKLFQFISFFPTVSSG

SEQ ID NO: 1876813 - protein, 21 aa, Staphylococcus
IKVIFEVVSAFGTVGLSMDFT

SEQ ID NO: 1876814 - protein, 24 aa, Staphylococcus
IKVLKSEILLAFSTSSSEAVLPVM

SEQ ID NO: 1876815 - protein, 17 aa, Staphylococcus
IKVPVTVGTDTVAPDAP

SEQ ID NO: 1876816 - protein, 19 aa, Staphylococcus
IKVSIKFDLVDRPNFRKVH

SEQ ID NO: 1876817 - protein, 18 aa, Staphylococcus
IKVSMALFGLFFAYNLGL

SEQ ID NO: 1876818 - protein, 21 aa, Staphylococcus
IKVYRTEIEMEQDLNALGQYI

SEQ ID NO: 1876819 - protein, 22 aa, Staphylococcus
IKWAESNAQIIADFYKEMKTEG

SEQ ID NO: 1876820 - protein, 22 aa, Staphylococcus
IKWAESNASLMAHFYEDMKTEG

SEQ ID NO: 1876821 - protein, 17 aa, Staphylococcus
IKYDVPYNINEPNTNDT

SEQ ID NO: 1876822 - protein, 17 aa, Staphylococcus
IKYETMSFLTLPPKDIF

SEQ ID NO: 1876823 - protein, 17 aa, Staphylococcus
IKYETMTFLTLPPKDVF

SEQ ID NO: 1876824 - protein, 19 aa, Staphylococcus
IKYFIAKVISIVFISFLMT

SEQ ID NO: 1876825 - protein, 20 aa, Staphylococcus
IKYKDRLTVRILNGKFEGKS

SEQ ID NO: 1876826 - protein, 24 aa, Staphylococcus
IKYLPPHWIVMLLLSSISILCSIM

SEQ ID NO: 1876827 - protein, 20 aa, Staphylococcus
IKYSDINGIIDITLNQENNH

SEQ ID NO: 1876828 - protein, 27 aa, Staphylococcus
IKYSLWCALLFIIGVAFAFFIGFPLII

SEQ ID NO: 1876829 - protein, 25 aa, Staphylococcus
IKYYKFRYILIMLIILLLGIMVLFI

SEQ ID NO: 1876830 - protein, 25 aa, Staphylococcus
ILAAIKWVLDIGGPFSGFVLGATFL

SEQ ID NO: 1876831 - protein, 19 aa, Staphylococcus
ILAAVGLNQTMLWIGLVPL

SEQ ID NO: 1876832 - protein, 21 aa, Staphylococcus
ILAESAHQFGISKAMMARASI

SEQ ID NO: 1876833 - protein, 25 aa, Staphylococcus
ILAFHPSMLVSIFILSFSAMFTEAL

SEQ ID NO: 1876834 - protein, 17 aa, Staphylococcus
ILAFIWPPFKLKQNPNP

SEQ ID NO: 1876835 - protein, 18 aa, Staphylococcus
ILAFRIIFSMIFMILLLV

SEQ ID NO: 1876836 - protein, 24 aa, Staphylococcus
ILAFRIVLSMVFMLFILIITKNMA

SEQ ID NO: 1876837 - protein, 19 aa, Staphylococcus
ILAFVWPPFKLKANPPKVL

SEQ ID NO: 1876838 - protein, 18 aa, Staphylococcus
ILAFVWPPFKLKVNPPQR

SEQ ID NO: 1876839 - protein, 19 aa, Staphylococcus
ILAGIPTIVFGFFALTFIT

SEQ ID NO: 1876840 - protein, 18 aa, Staphylococcus
ILAGIPTIVFGFFALTFV

SEQ ID NO: 1876841 - protein, 18 aa, Staphylococcus
ILAGVSWNIIVFNIFRIL

SEQ ID NO: 1876842 - protein, 18 aa, Staphylococcus
ILALCIYLSILNLNFVWL

SEQ ID NO: 1876843 - protein, 19 aa, Staphylococcus
ILAPIMKFIMHILSVAVEA

SEQ ID NO: 1876844 - protein, 19 aa, Staphylococcus
ILAPIMKFIMHILSVAVEF

SEQ ID NO: 1876845 - protein, 22 aa, Staphylococcus
ILAQGIGRWGNFMNHEAHGGPV

SEQ ID NO: 1876846 - protein, 25 aa, Staphylococcus
ILATLFLKFERLITVLGMVTPFLII

SEQ ID NO: 1876847 - protein, 22 aa, Staphylococcus
ILATLPLCFLQYDSSYMFLVII

SEQ ID NO: 1876848 - protein, 21 aa, Staphylococcus
ILAVILICILELIRNSKKNKA

SEQ ID NO: 1876849 - protein, 18 aa, Staphylococcus
ILAYRIILAMVFMILMIF

SEQ ID NO: 1876850 - protein, 18 aa, Staphylococcus
ILAYRIILSMIFMIIMIY

SEQ ID NO: 1876851 - protein, 18 aa, Staphylococcus
ILAYRIILSMIFMVVLIY

SEQ ID NO: 1876852 - protein, 21 aa, Staphylococcus
ILCLCRLNVVLSLFVSGLVGG

SEQ ID NO: 1876853 - protein, 28 aa, Staphylococcus
ILDGLSFLILYLLNVHLGYTFSGGFIDY

SEQ ID NO: 1876854 - protein, 29 aa, Staphylococcus
ILDLQKEMWKYLSIVGVIVLITVYLASRS

SEQ ID NO: 1876855 - protein, 20 aa, Staphylococcus
ILDNFKWSVKDMESIMLEIE

SEQ ID NO: 1876856 - protein, 23 aa, Staphylococcus
ILDTHPAFYISFIAVALALCVVA

SEQ ID NO: 1876857 - protein, 21 aa, Staphylococcus
ILDVIKCGFLDGEILIPQGVI

SEQ ID NO: 1876858 - protein, 19 aa, Staphylococcus
ILEEKIIPMGLEFDEVQPI

SEQ ID NO: 1876859 - protein, 22 aa, Staphylococcus
ILEEYIFRKVIFGEIYNKIKGN

SEQ ID NO: 1876860 - protein, 25 aa, Staphylococcus
ILEFFYILIGLQFLYTAYRALRATD

SEQ ID NO: 1876861 - protein, 25 aa, Staphylococcus
ILEIFYILIGLQFLYTAYRALRSQD

SEQ ID NO: 1876862 - protein, 28 aa, Staphylococcus
ILELQIQMWKYIALIGLFVIIIIFLVVR

SEQ ID NO: 1876863 - protein, 19 aa, Staphylococcus
ILEPFFKGYANKILILTSI

SEQ ID NO: 1876864 - protein, 17 aa, Staphylococcus
ILEPQLSGTNIVSGETS

SEQ ID NO: 1876865 - protein, 18 aa, Staphylococcus
ILERLGLFDRDIVVCATN

SEQ ID NO: 1876866 - protein, 26 aa, Staphylococcus
ILEYIFKIDQVWILLIAVLVIIINAS

SEQ ID NO: 1876867 - protein, 17 aa, Staphylococcus
ILEYYSLNWAFLLELSF

SEQ ID NO: 1876868 - protein, 17 aa, Staphylococcus
ILFAIGVALGMAKKNDG

SEQ ID NO: 1876869 - protein, 17 aa, Staphylococcus
ILFCLCMFNLFFTTHFS

SEQ ID NO: 1876870 - protein, 22 aa, Staphylococcus
ILFCLNMINLLFTSHVSDFHQW

SEQ ID NO: 1876871 - protein, 20 aa, Staphylococcus
ILFFIIAIMMFVRKNKVETV

SEQ ID NO: 1876872 - protein, 20 aa, Staphylococcus
ILFFLIAWFFSRKPSKILDY

SEQ ID NO: 1876873 - protein, 19 aa, Staphylococcus
ILFFLMKYAHVMTPEMTDA

SEQ ID NO: 1876874 - protein, 24 aa, Staphylococcus
ILFGEFFGWIVGWALIAEYLIAVS

SEQ ID NO: 1876875 - protein, 18 aa, Staphylococcus
ILFGLAEQGLGPKVFGKV

SEQ ID NO: 1876876 - protein, 17 aa, Staphylococcus
ILFIFKLNLGIDFTSGT

SEQ ID NO: 1876877 - protein, 23 aa, Staphylococcus
ILFIFRLNLGIDFTSGTRVDFES

SEQ ID NO: 1876878 - protein, 20 aa, Staphylococcus
ILFIKRRSYELGLLQIMGLN

SEQ ID NO: 1876879 - protein, 22 aa, Staphylococcus
ILFIYYRANVVDNFFLKHYPPL

SEQ ID NO: 1876880 - protein, 17 aa, Staphylococcus
ILFKEVVRSTRHAYDVL

SEQ ID NO: 1876881 - protein, 26 aa, Staphylococcus
ILFKNKELLAIIGVILAFNLCGQMIN

SEQ ID NO: 1876882 - protein, 18 aa, Staphylococcus
ILFLLIGYYMIRFKMQSI

SEQ ID NO: 1876883 - protein, 23 aa, Staphylococcus
ILFPAVMIFFAIVSLILFTISML

SEQ ID NO: 1876884 - protein, 17 aa, Staphylococcus
ILFSLPYTIIGVVVALV

SEQ ID NO: 1876885 - protein, 17 aa, Staphylococcus
ILFSRMYFHAHFLTDVV

SEQ ID NO: 1876886 - protein, 25 aa, Staphylococcus
ILFSSRIPRTISILLSGSSLALAGL

SEQ ID NO: 1876887 - protein, 22 aa, Staphylococcus
ILFVHKHYFLFLLILISIFFIL

SEQ ID NO: 1876888 - protein, 18 aa, Staphylococcus
ILGAASMGIYFAASAISK

SEQ ID NO: 1876889 - protein, 17 aa, Staphylococcus
ILGACYLIYLGIQSIRS

SEQ ID NO: 1876890 - protein, 24 aa, Staphylococcus
ILGACYLIYLGVQSIRSARQSMNF

SEQ ID NO: 1876891 - protein, 22 aa, Staphylococcus
ILGFLLHFIFGVNQTWLLIVFV

SEQ ID NO: 1876892 - protein, 18 aa, Staphylococcus
ILGGASFVRKEYFDKEQL

SEQ ID NO: 1876893 - protein, 25 aa, Staphylococcus
ILGGGKKYNQVFMTMDGKLKIKIDY

SEQ ID NO: 1876894 - protein, 19 aa, Staphylococcus
ILGILGTFIIKGNRVLAAC

SEQ ID NO: 1876895 - protein, 23 aa, Staphylococcus
ILGISAFYGGLVFLVAKIFDAFV

SEQ ID NO: 1876896 - protein, 19 aa, Staphylococcus
ILGLIVIAIFTFRQLKIDH

SEQ ID NO: 1876897 - protein, 25 aa, Staphylococcus
ILGLLAFLFGLAWFKIYQKTINPKA

SEQ ID NO: 1876898 - protein, 20 aa, Staphylococcus
ILGMAYKLMVFNGHTTALLT

SEQ ID NO: 1876899 - protein, 17 aa, Staphylococcus
ILGQLGLIFAIGVAIGM

SEQ ID NO: 1876900 - protein, 18 aa, Staphylococcus
ILGSFIFSAGVNAFVISG

SEQ ID NO: 1876901 - protein, 17 aa, Staphylococcus
ILGSFQSVIPWERIFNQ

SEQ ID NO: 1876902 - protein, 21 aa, Staphylococcus
ILGSMLLRMGGFKSSIARGLT

SEQ ID NO: 1876903 - protein, 22 aa, Staphylococcus
ILGYCIKMPFAIDYDNGSFAVI

SEQ ID NO: 1876904 - protein, 35 aa, Staphylococcus
ILHAQVEHVGWFIGLTVLISIVFVTIVYTLVSLLG

SEQ ID NO: 1876905 - protein, 21 aa, Staphylococcus
ILHEMIHRVLFILFSKGEKPK

SEQ ID NO: 1876906 - protein, 24 aa, Staphylococcus
ILHFIFDLNSPWILILFVLVIIVN

SEQ ID NO: 1876907 - protein, 23 aa, Staphylococcus
ILHVVCICIAYWALNAVRLEQFF

SEQ ID NO: 1876908 - protein, 24 aa, Staphylococcus
ILIAELLGLLSIMYQKLVMKIYWI

SEQ ID NO: 1876909 - protein, 18 aa, Staphylococcus
ILIAFYVPFFKKLHVTSA

SEQ ID NO: 1876910 - protein, 18 aa, Staphylococcus
ILIAFYVPFFKKLKVTSA

SEQ ID NO: 1876911 - protein, 18 aa, Staphylococcus
ILIAFYVPFFKKLRVTSA

SEQ ID NO: 1876912 - protein, 17 aa, Staphylococcus
ILICVTFSLLMVTPISL

SEQ ID NO: 1876913 - protein, 20 aa, Staphylococcus
ILIFKRNWLDTRAFSKKFVP

SEQ ID NO: 1876914 - protein, 18 aa, Staphylococcus
ILIFRACTPMLSKLPLLR

SEQ ID NO: 1876915 - protein, 18 aa, Staphylococcus
ILIGIIIWLLTPIRPEGL

SEQ ID NO: 1876916 - protein, 19 aa, Staphylococcus
ILIICALFMGALSFSIYFY

SEQ ID NO: 1876917 - protein, 18 aa, Staphylococcus
ILIIIIGFILKFDTIAII

SEQ ID NO: 1876918 - protein, 30 aa, Staphylococcus
ILIIILSVFLVWYLNIFVLKTFSITGKNND

SEQ ID NO: 1876919 - protein, 25 aa, Staphylococcus
ILIIIRRKVHILLTIFILCQLIISN

SEQ ID NO: 1876920 - protein, 18 aa, Staphylococcus
ILIIIYIALKYAPFLRDQ

SEQ ID NO: 1876921 - protein, 17 aa, Staphylococcus
ILIILCLGLVLLQGDIG

SEQ ID NO: 1876922 - protein, 18 aa, Staphylococcus
ILIIPAFIGIWFMPEPVK

SEQ ID NO: 1876923 - protein, 17 aa, Staphylococcus
ILIIVIVLVAIFMGAMY

SEQ ID NO: 1876924 - protein, 17 aa, Staphylococcus
ILIIYILSIVFYFIDFI

SEQ ID NO: 1876925 - protein, 19 aa, Staphylococcus
ILILFLFTICMAAFYLLVG

SEQ ID NO: 1876926 - protein, 25 aa, Staphylococcus
ILILQRFTRGFLKSIAILIGLIAGT

SEQ ID NO: 1876927 - protein, 25 aa, Staphylococcus
ILIMKLRHRDVLKSLFTKIKDFSQA

SEQ ID NO: 1876928 - protein, 22 aa, Staphylococcus
ILIMLICLGFINHPIQAAENQS

SEQ ID NO: 1876929 - protein, 25 aa, Staphylococcus
ILIPVTICLSWIGLFVAEWIVENLF

SEQ ID NO: 1876930 - protein, 19 aa, Staphylococcus
ILIPYAFSAFYQFKYTIQE

SEQ ID NO: 1876931 - protein, 17 aa, Staphylococcus
ILIPYMFSAFYQLKYTI

SEQ ID NO: 1876932 - protein, 26 aa, Staphylococcus
ILISGFYRWTAILGLAFTMLFIGVIV

SEQ ID NO: 1876933 - protein, 19 aa, Staphylococcus
ILISGVIFIIFVLLPAQLF

SEQ ID NO: 1876934 - protein, 17 aa, Staphylococcus
ILISGVIFIIFVLMPSS

SEQ ID NO: 1876935 - protein, 21 aa, Staphylococcus
ILISKWLYRRRGIIARILESI

SEQ ID NO: 1876936 - protein, 17 aa, Staphylococcus
ILITIIAGVLYFLQSLV

SEQ ID NO: 1876937 - protein, 18 aa, Staphylococcus
ILITYAIALTAIYLKKVL

SEQ ID NO: 1876938 - protein, 29 aa, Staphylococcus
ILIVAIAIIGFFVFVHFKYGDQSGQSHKS

SEQ ID NO: 1876939 - protein, 17 aa, Staphylococcus
ILIVALIFYNTRKNMNQ

SEQ ID NO: 1876940 - protein, 22 aa, Staphylococcus
ILIVCVYLLFSRYASITLGKEG

SEQ ID NO: 1876941 - protein, 23 aa, Staphylococcus
ILIVCVYLLFSRYSSITLGEEGE

SEQ ID NO: 1876942 - protein, 18 aa, Staphylococcus
ILIVLFSVVTKNKWIGTS

SEQ ID NO: 1876943 - protein, 26 aa, Staphylococcus
ILIVQRFTAGFLKSIAILIGLIVGTV

SEQ ID NO: 1876944 - protein, 18 aa, Staphylococcus
ILIYSMLTAFLFIDKVFV

SEQ ID NO: 1876945 - protein, 24 aa, Staphylococcus
ILKEKQLWLTLAITLFGFSSVFAY

SEQ ID NO: 1876946 - protein, 18 aa, Staphylococcus
ILKGITIMKDEPKVLLGG

SEQ ID NO: 1876947 - protein, 25 aa, Staphylococcus
ILKICVGCLLFVFIAIFTIVHFKYE

SEQ ID NO: 1876948 - protein, 18 aa, Staphylococcus
ILKIFDFGIAKALSETSM

SEQ ID NO: 1876949 - protein, 27 aa, Staphylococcus
ILKNDLLRLFIMFTLASLAFVIGNYTH

SEQ ID NO: 1876950 - protein, 20 aa, Staphylococcus
ILKYGKTYAKIKVFDNKDRV

SEQ ID NO: 1876951 - protein, 20 aa, Staphylococcus
ILLAILAYLYFSVMKNNAQI

SEQ ID NO: 1876952 - protein, 17 aa, Staphylococcus
ILLARFIPTKPIAQQIP

SEQ ID NO: 1876953 - protein, 18 aa, Staphylococcus
ILLAWIVAAVLRISLGSA

SEQ ID NO: 1876954 - protein, 19 aa, Staphylococcus
ILLAWIVAAVLRLALGSAT

SEQ ID NO: 1876955 - protein, 18 aa, Staphylococcus
ILLCIGFYDGFLGGGTGS

SEQ ID NO: 1876956 - protein, 22 aa, Staphylococcus
ILLEIIFYFKILKNYQYDQTNV

SEQ ID NO: 1876957 - protein, 25 aa, Staphylococcus
ILLFIFYRRARVIKRPFRYLKLCLS

SEQ ID NO: 1876958 - protein, 17 aa, Staphylococcus
ILLFKLVLMLLFGLTFG

SEQ ID NO: 1876959 - protein, 20 aa, Staphylococcus
ILLIEWVCFTLTYELILGLH

SEQ ID NO: 1876960 - protein, 24 aa, Staphylococcus
ILLIIVAIFVTRAIMNHNDDKVNN

SEQ ID NO: 1876961 - protein, 18 aa, Staphylococcus
ILLILCFMKMAKIQFWFL

SEQ ID NO: 1876962 - protein, 24 aa, Staphylococcus
ILLIMSLYFGYAIQVIGQRIADKL

SEQ ID NO: 1876963 - protein, 27 aa, Staphylococcus
ILLIVGIAWLFGRRFERPHQFQEFSQC

SEQ ID NO: 1876964 - protein, 18 aa, Staphylococcus
ILLKGGLVLMLFAYLLAL

SEQ ID NO: 1876965 - protein, 23 aa, Staphylococcus
ILLKGGTVLMLFAYLLALIALKE

SEQ ID NO: 1876966 - protein, 20 aa, Staphylococcus
ILLLIIGLGIAFLMNLIMPS

SEQ ID NO: 1876967 - protein, 27 aa, Staphylococcus
ILLLLVASLFGFIAMGMFGSKYAEVPD

SEQ ID NO: 1876968 - protein, 19 aa, Staphylococcus
ILLMGGTTLMLFAYLLALI

SEQ ID NO: 1876969 - protein, 19 aa, Staphylococcus
ILLNLNWLAILLYIEAVVS

SEQ ID NO: 1876970 - protein, 24 aa, Staphylococcus
ILLRYLDWLGHALIGDLGYSFSTQ

SEQ ID NO: 1876971 - protein, 19 aa, Staphylococcus
ILLSPMMGVNLPFQFTFPG

SEQ ID NO: 1876972 - protein, 19 aa, Staphylococcus
ILLSVCIGLVFGLIAGIER

SEQ ID NO: 1876973 - protein, 18 aa, Staphylococcus
ILLTCGLLSIAIILNAVF

SEQ ID NO: 1876974 - protein, 17 aa, Staphylococcus
ILLTLYLFKVHKDALNL

SEQ ID NO: 1876975 - protein, 18 aa, Staphylococcus
ILLTYKWAFTFTQVIEQS

SEQ ID NO: 1876976 - protein, 19 aa, Staphylococcus
ILLVCTISSKNLLTISKSN

SEQ ID NO: 1876977 - protein, 19 aa, Staphylococcus
ILLVLAFVVQQTFLYYFNH

SEQ ID NO: 1876978 - protein, 17 aa, Staphylococcus
ILLYIALLFIIIYIAQV

SEQ ID NO: 1876979 - protein, 23 aa, Staphylococcus
ILMAFFAEFGFRSYLQNIVENKV

SEQ ID NO: 1876980 - protein, 17 aa, Staphylococcus
ILMAIVFLFGANSFDPK

SEQ ID NO: 1876981 - protein, 17 aa, Staphylococcus
ILMAIVFLFGANSFKPD

SEQ ID NO: 1876982 - protein, 17 aa, Staphylococcus
ILMCFPFTPNTVVNFVA

SEQ ID NO: 1876983 - protein, 22 aa, Staphylococcus
ILMEGRTTIVIAHRLSTIKKAG

SEQ ID NO: 1876984 - protein, 25 aa, Staphylococcus
ILMGDSRLAPMIRMASLSYLFIGIL

SEQ ID NO: 1876985 - protein, 27 aa, Staphylococcus
ILMGFSEHFLIWSVLRIIAGITSGTIF

SEQ ID NO: 1876986 - protein, 20 aa, Staphylococcus
ILMIVCIDAIFYYVSKIKHA

SEQ ID NO: 1876987 - protein, 17 aa, Staphylococcus
ILMKNMLVYGLGGMIVP

SEQ ID NO: 1876988 - protein, 25 aa, Staphylococcus
ILMLIAILGMTGWLLYAHQLIERKT

SEQ ID NO: 1876989 - protein, 17 aa, Staphylococcus
ILMLWLYITGFIIIIGA

SEQ ID NO: 1876990 - protein, 20 aa, Staphylococcus
ILMMPRIIYRDTYGNFAGFF

SEQ ID NO: 1876991 - protein, 29 aa, Staphylococcus
ILMMVSLYLKWWVAFGIAIAMLFVVAVAL

SEQ ID NO: 1876992 - protein, 39 aa, Staphylococcus
ILMNPWFQFILATPIQFIIGWQFYVGAYKNLRNGGFNMD

SEQ ID NO: 1876993 - protein, 18 aa, Staphylococcus
ILMSIALFFIMMKVMPPE

SEQ ID NO: 1876994 - protein, 26 aa, Staphylococcus
ILNAFMPVTMPFYLSYSQVLLMIVVF

SEQ ID NO: 1876995 - protein, 17 aa, Staphylococcus
ILNDLGMTPPPIYTNHY

SEQ ID NO: 1876996 - protein, 19 aa, Staphylococcus
ILNLRVFKNKTFTLTTICS

SEQ ID NO: 1876997 - protein, 20 aa, Staphylococcus
ILNLRVFKSRVFTFSTITSM

SEQ ID NO: 1876998 - protein, 21 aa, Staphylococcus
ILNMMNIHFPDPVIDFFSVLS

SEQ ID NO: 1876999 - protein, 25 aa, Staphylococcus
ILNNSRPKIEAITPQARKKRSAIDE

SEQ ID NO: 1877000 - protein, 18 aa, Staphylococcus
ILNTFKLIKPLNHLYQAL

SEQ ID NO: 1877001 - protein, 31 aa, Staphylococcus
ILPAVVSYLLYRVCKNAGWIKDGDQKINIGT

SEQ ID NO: 1877002 - protein, 18 aa, Staphylococcus
ILPGMIPWFMILFSHIRF

SEQ ID NO: 1877003 - protein, 17 aa, Staphylococcus
ILPILVAILAIRKGVNI

SEQ ID NO: 1877004 - protein, 18 aa, Staphylococcus
ILPLCLILFKGFVSGEDG

SEQ ID NO: 1877005 - protein, 19 aa, Staphylococcus
ILPQAFKNILPALGNEFVT

SEQ ID NO: 1877006 - protein, 17 aa, Staphylococcus
ILPQAIRVSVPALGNTF

SEQ ID NO: 1877007 - protein, 24 aa, Staphylococcus
ILPSFLSLVLYRFELNLRSASILG

SEQ ID NO: 1877008 - protein, 21 aa, Staphylococcus
ILPVPVEFNFDSELFMLATIA

SEQ ID NO: 1877009 - protein, 23 aa, Staphylococcus
ILQGHVAWSYSIILIISSYIGAQ

SEQ ID NO: 1877010 - protein, 21 aa, Staphylococcus
ILQIFFFKDVKVEHPIEEGPH

SEQ ID NO: 1877011 - protein, 26 aa, Staphylococcus
ILQIIFKLPIIVSIVVAILLGVFVGF

SEQ ID NO: 1877012 - protein, 17 aa, Staphylococcus
ILQQLWLAWDYNNNILF

SEQ ID NO: 1877013 - protein, 17 aa, Staphylococcus
ILRALKLAQNLDIPTYG

SEQ ID NO: 1877014 - protein, 20 aa, Staphylococcus
ILRILAVVFVWITYLKVGTE

SEQ ID NO: 1877015 - protein, 33 aa, Staphylococcus
ILRILKLPFSISLRFYSCFFIGVIITGLLKMFF

SEQ ID NO: 1877016 - protein, 21 aa, Staphylococcus
ILRMLSIEQFAIFVITGILGV

SEQ ID NO: 1877017 - protein, 19 aa, Staphylococcus
ILRSIPFIILLIAIVPFTK

SEQ ID NO: 1877018 - protein, 25 aa, Staphylococcus
ILRSLRLANKVGLEFYGLGSHTPYH

SEQ ID NO: 1877019 - protein, 22 aa, Staphylococcus
ILRVLAVCFVWMTYFKFGSHVI

SEQ ID NO: 1877020 - protein, 21 aa, Staphylococcus
ILSAISALVFLFATNVGLLLA

SEQ ID NO: 1877021 - protein, 19 aa, Staphylococcus
ILSCCILFVFTDYVGNPIL

SEQ ID NO: 1877022 - protein, 28 aa, Staphylococcus
ILSCLIAAVIMPRIWPLNTIPDEYAKDT

SEQ ID NO: 1877023 - protein, 19 aa, Staphylococcus
ILSGIPTIVFGFFALTFVT

SEQ ID NO: 1877024 - protein, 29 aa, Staphylococcus
ILSGSICYYFFNRFALFIVILAAIFYFYK

SEQ ID NO: 1877025 - protein, 25 aa, Staphylococcus
ILSIARVCRKELIILNHIIEHLDED

SEQ ID NO: 1877026 - protein, 18 aa, Staphylococcus
ILSIFKLNLGIDFSSGTR

SEQ ID NO: 1877027 - protein, 25 aa, Staphylococcus
ILSLIIIAWFGFRQFKLDDPFLDLR

SEQ ID NO: 1877028 - protein, 29 aa, Staphylococcus
ILSLIMPVTMPFYLGYGTILLMIVIFLIV

SEQ ID NO: 1877029 - protein, 19 aa, Staphylococcus
ILSTILIVVILINFIFNEF

SEQ ID NO: 1877030 - protein, 28 aa, Staphylococcus
ILTALICIFAFDLKKLFKNFDIQMNHLA

SEQ ID NO: 1877031 - protein, 18 aa, Staphylococcus
ILTCIIFLGFLYQLYSNK

SEQ ID NO: 1877032 - protein, 25 aa, Staphylococcus
ILTCLNLGVSPVFAVIVGLVLHDFK

SEQ ID NO: 1877033 - protein, 29 aa, Staphylococcus
ILTCLNLGVSPVFAVIVGLVLHDSKLLPA

SEQ ID NO: 1877034 - protein, 24 aa, Staphylococcus
ILTCLNMGVSPVFAVIVGLVLHDS

SEQ ID NO: 1877035 - protein, 25 aa, Staphylococcus
ILTKFKFEYQCLAFNMNISTAEQLQ

SEQ ID NO: 1877036 - protein, 19 aa, Staphylococcus
ILTLGALTIAISRVIDDSI

SEQ ID NO: 1877037 - protein, 24 aa, Staphylococcus
ILTLTMHWPIWMLIIAFFLNISPV

SEQ ID NO: 1877038 - protein, 18 aa, Staphylococcus
ILTPFWYVFVIIYFLFIA

SEQ ID NO: 1877039 - protein, 22 aa, Staphylococcus
ILTTILCILTFQHAKLPIVVFL

SEQ ID NO: 1877040 - protein, 21 aa, Staphylococcus
ILTVCTFLLCFLKADTSYMYL

SEQ ID NO: 1877041 - protein, 25 aa, Staphylococcus
ILTVLSCAIIMFFSNFVTVITFVLF

SEQ ID NO: 1877042 - protein, 19 aa, Staphylococcus
ILVAIEFLLIMVLQTLLTT

SEQ ID NO: 1877043 - protein, 17 aa, Staphylococcus
ILVAIGWWQIAHRHVNT

SEQ ID NO: 1877044 - protein, 24 aa, Staphylococcus
ILVAQPLIRPAIILLKGNLKYQML

SEQ ID NO: 1877045 - protein, 17 aa, Staphylococcus
ILVASCVALVFLQKDVG

SEQ ID NO: 1877046 - protein, 18 aa, Staphylococcus
ILVFFAFIFVILLINSST

SEQ ID NO: 1877047 - protein, 18 aa, Staphylococcus
ILVILSFIIFIHKKYIQS

SEQ ID NO: 1877048 - protein, 27 aa, Staphylococcus
ILVISLVVAIAFFFGMKMYQSHKNIQL

SEQ ID NO: 1877049 - protein, 22 aa, Staphylococcus
ILVLDFSIWFPFVKAYDKLKLD

SEQ ID NO: 1877050 - protein, 26 aa, Staphylococcus
ILVLQRFTKGFLKSIAILIGLVLGTA

SEQ ID NO: 1877051 - protein, 17 aa, Staphylococcus
ILVTAFVTFSFVGPITR

SEQ ID NO: 1877052 - protein, 18 aa, Staphylococcus
ILVTCVLLSISVILNAVF

SEQ ID NO: 1877053 - protein, 27 aa, Staphylococcus
ILVTLFLKFDRLIAVLGIVTPFLVIVV

SEQ ID NO: 1877054 - protein, 19 aa, Staphylococcus
ILVTYAVGLTTYYYKNISY

SEQ ID NO: 1877055 - protein, 19 aa, Staphylococcus
ILVTYKWAINYVDIIEQRF

SEQ ID NO: 1877056 - protein, 25 aa, Staphylococcus
ILVVCSCYLAFILIGSLQGKDMSNS

SEQ ID NO: 1877057 - protein, 32 aa, Staphylococcus
ILVVGNPLGVDFKGSVSKGIISGMNRFVPADL

SEQ ID NO: 1877058 - protein, 20 aa, Staphylococcus
ILVVLFIFRQTRLETPLLDF

SEQ ID NO: 1877059 - protein, 22 aa, Staphylococcus
ILWHKSRMSFGIGALITVVLVV

SEQ ID NO: 1877060 - protein, 17 aa, Staphylococcus
ILYFAHVLLPFMFGPII

SEQ ID NO: 1877061 - protein, 25 aa, Staphylococcus
ILYFEIITTIAIGLGIIFANIFKPG

SEQ ID NO: 1877062 - protein, 20 aa, Staphylococcus
ILYMLYNWILNKRSVTELDQ

SEQ ID NO: 1877063 - protein, 19 aa, Staphylococcus
ILYQFLFKRHKDFHTHVGT

SEQ ID NO: 1877064 - protein, 19 aa, Staphylococcus
ILYQFLYKRHQTVVKDPST

SEQ ID NO: 1877065 - protein, 19 aa, Staphylococcus
IMALQAFYFYPRFNITTIG

SEQ ID NO: 1877066 - protein, 21 aa, Staphylococcus
IMANIFLPRNEFGDVQRISHL

SEQ ID NO: 1877067 - protein, 34 aa, Staphylococcus
IMAVCGLSLVGIDFLTVMGFSAAISVLFAVLASL

SEQ ID NO: 1877068 - protein, 25 aa, Staphylococcus
IMDIQRSFAVFIMASILTFVSMIVI

SEQ ID NO: 1877069 - protein, 21 aa, Staphylococcus
IMDIQRSFAVFTMASILTFVS

SEQ ID NO: 1877070 - protein, 24 aa, Staphylococcus
IMEDVFKIRGDIIKLKRIIYPMNE

SEQ ID NO: 1877071 - protein, 19 aa, Staphylococcus
IMFFLDIKLTLAAIIIFPF

SEQ ID NO: 1877072 - protein, 19 aa, Staphylococcus
IMFSICWIAYIQWESTIAS

SEQ ID NO: 1877073 - protein, 17 aa, Staphylococcus
IMGFSIFMIIGGIITIS

SEQ ID NO: 1877074 - protein, 17 aa, Staphylococcus
IMGGAAFIRHQYFENEQ

SEQ ID NO: 1877075 - protein, 17 aa, Staphylococcus
IMGGKFIGFETFNSGEG

SEQ ID NO: 1877076 - protein, 18 aa, Staphylococcus
IMGIEGIIAQTLFIASAM

SEQ ID NO: 1877077 - protein, 27 aa, Staphylococcus
IMGIRFLDKEALAFLKPYPLANESDDN

SEQ ID NO: 1877078 - protein, 17 aa, Staphylococcus
IMGPMLIIPLFFQNFKH

SEQ ID NO: 1877079 - protein, 27 aa, Staphylococcus
IMHLLDVKIGMTFSGGFIDYVLFGLLN

SEQ ID NO: 1877080 - protein, 24 aa, Staphylococcus
IMICAKIKLWFLLKGLTPIFIFLI

SEQ ID NO: 1877081 - protein, 24 aa, Staphylococcus
IMIGFLYKYIIAYFIQVYAINPLQ

SEQ ID NO: 1877082 - protein, 26 aa, Staphylococcus
IMIISIVLAYAFKWLGLVDDVLLMII

SEQ ID NO: 1877083 - protein, 26 aa, Staphylococcus
IMIISVILAYAFKWLGLVDDVLLMII

SEQ ID NO: 1877084 - protein, 32 aa, Staphylococcus
IMIIVYVVAAWIILRFVNKAIAQFFKIQNKGK

SEQ ID NO: 1877085 - protein, 17 aa, Staphylococcus
IMIKVTWGIAQSLIAFV

SEQ ID NO: 1877086 - protein, 26 aa, Staphylococcus
IMILLIFRFLMGIAIGMDSPVAFTFI

SEQ ID NO: 1877087 - protein, 25 aa, Staphylococcus
IMIPCKPDHPFVYWSTFSNVAELLE

SEQ ID NO: 1877088 - protein, 26 aa, Staphylococcus
IMIVSIILAFAFKWFGLIDDVLLMVI

SEQ ID NO: 1877089 - protein, 19 aa, Staphylococcus
IMIWTCIMIAYLGFVKRNP

SEQ ID NO: 1877090 - protein, 19 aa, Staphylococcus
IMLAGRILLESGAEGTRVE

SEQ ID NO: 1877091 - protein, 17 aa, Staphylococcus
IMLAVGSWRVNKPGVPI

SEQ ID NO: 1877092 - protein, 20 aa, Staphylococcus
IMLFLNGWFQGMGWPPSGRV

SEQ ID NO: 1877093 - protein, 24 aa, Staphylococcus
IMLFPAISAIIVWIYFYKHQKFTE

SEQ ID NO: 1877094 - protein, 17 aa, Staphylococcus
IMLFVWPFIFSAIVIFG

SEQ ID NO: 1877095 - protein, 25 aa, Staphylococcus
IMLGFLYKYIIAYLINVYAILPLLM

SEQ ID NO: 1877096 - protein, 19 aa, Staphylococcus
IMLGVCGLIAILIGYPKLK

SEQ ID NO: 1877097 - protein, 17 aa, Staphylococcus
IMLHYSYYNDKKPEYYK

SEQ ID NO: 1877098 - protein, 26 aa, Staphylococcus
IMLISIILAYAFKWLGLVDDVLLMVI

SEQ ID NO: 1877099 - protein, 18 aa, Staphylococcus
IMLISMLLRGLIVLLETI

SEQ ID NO: 1877100 - protein, 17 aa, Staphylococcus
IMLKLMLAIAFFAVSLA

SEQ ID NO: 1877101 - protein, 19 aa, Staphylococcus
IMLNQEFSLLFIGLVFVIE

SEQ ID NO: 1877102 - protein, 22 aa, Staphylococcus
IMLPILMSIGIPPTFFLAMVQT

SEQ ID NO: 1877103 - protein, 17 aa, Staphylococcus
IMLPRIVGTMTVLFQFV

SEQ ID NO: 1877104 - protein, 22 aa, Staphylococcus
IMLVSGITWRILAPLFIVAFVF

SEQ ID NO: 1877105 - protein, 26 aa, Staphylococcus
IMMGFLYKYIIAHLINVYAIMPLLMH

SEQ ID NO: 1877106 - protein, 21 aa, Staphylococcus
IMMMFACFLTYIIPAGAFDTN

SEQ ID NO: 1877107 - protein, 17 aa, Staphylococcus
IMMPLLFIFLIIVVVKS

SEQ ID NO: 1877108 - protein, 18 aa, Staphylococcus
IMMSHDLWESVKSSKNKR

SEQ ID NO: 1877109 - protein, 18 aa, Staphylococcus
IMNMAGYVMSRARALASR

SEQ ID NO: 1877110 - protein, 19 aa, Staphylococcus
IMNMVPWGGPMARVASVLK

SEQ ID NO: 1877111 - protein, 20 aa, Staphylococcus
IMNMVPWGGPMARVATVLKV

SEQ ID NO: 1877112 - protein, 30 aa, Staphylococcus
IMPNIGAFIAWGFIAAIFIDNGWFPNKDLA

SEQ ID NO: 1877113 - protein, 31 aa, Staphylococcus
IMPNIGAFIAWGFIAAIFIDNGWLPNKDLAQ

SEQ ID NO: 1877114 - protein, 24 aa, Staphylococcus
IMSAICFFIVPILFIPKTHLSIVD

SEQ ID NO: 1877115 - protein, 25 aa, Staphylococcus
IMSLYNKWLLLLAIILSVLLLKRGI

SEQ ID NO: 1877116 - protein, 22 aa, Staphylococcus
IMTELDEVYFLGNERLIHQALS

SEQ ID NO: 1877117 - protein, 25 aa, Staphylococcus
IMTIEIVGALLLAFYFYRDNPDLKN

SEQ ID NO: 1877118 - protein, 25 aa, Staphylococcus
IMTLTAIALVVVWFVFNQLVAGIAT

SEQ ID NO: 1877119 - protein, 18 aa, Staphylococcus
IMVFNVFFILCLVSMFIT

SEQ ID NO: 1877120 - protein, 24 aa, Staphylococcus
IMVLTAIALVIVWFIFNQIVAGIA

SEQ ID NO: 1877121 - protein, 17 aa, Staphylococcus
IMVPFFLIYMLKDHEKF

SEQ ID NO: 1877122 - protein, 18 aa, Staphylococcus
IMVRTILDQYVNYFMLFN

SEQ ID NO: 1877123 - protein, 19 aa, Staphylococcus
IMWLIFQTTFTWIGTPLSD

SEQ ID NO: 1877124 - protein, 18 aa, Staphylococcus
IMYIWRKKIFKIPLVPYI

SEQ ID NO: 1877125 - protein, 19 aa, Staphylococcus
IMYVFKIGPALLFNQDYGP

SEQ ID NO: 1877126 - protein, 18 aa, Staphylococcus
INAIKYTPQYGLIQIHLS

SEQ ID NO: 1877127 - protein, 19 aa, Staphylococcus
INAKLFGIIGMLLSLIAGR

SEQ ID NO: 1877128 - protein, 17 aa, Staphylococcus
INAKLFGIIGMLLSLLA

SEQ ID NO: 1877129 - protein, 20 aa, Staphylococcus
INAWSKFGINILIILAVMVP

SEQ ID NO: 1877130 - protein, 17 aa, Staphylococcus
INCMTRVRIKVLDEDKI

SEQ ID NO: 1877131 - protein, 40 aa, Staphylococcus
INDADNWTLDSGFYKTPVKYSLGDYVWYDSNQDGIQDYEE

SEQ ID NO: 1877132 - protein, 20 aa, Staphylococcus
INDHEYYGAAIFNKNFSKNA

SEQ ID NO: 1877133 - protein, 18 aa, Staphylococcus
INDQPAVMRRIIQEYQDG

SEQ ID NO: 1877134 - protein, 21 aa, Staphylococcus
INEAKSLLQNRADNSQLVRAK

SEQ ID NO: 1877135 - protein, 24 aa, Staphylococcus
INFEIPLSIAYVIFIVFWQVGFSN

SEQ ID NO: 1877136 - protein, 21 aa, Staphylococcus
INFKCLDQRLLQFSVINDGKQ

SEQ ID NO: 1877137 - protein, 17 aa, Staphylococcus
INFMLMRAMADHQRYTI

SEQ ID NO: 1877138 - protein, 25 aa, Staphylococcus
INFQTPEGYTPTKSYQGMNTEVDSN

SEQ ID NO: 1877139 - protein, 26 aa, Staphylococcus
INFTSAFILSCLLLFVMLLISILYGD

SEQ ID NO: 1877140 - protein, 18 aa, Staphylococcus
INGGLIFIGTVVSIILFI

SEQ ID NO: 1877141 - protein, 17 aa, Staphylococcus
INGIFSMILTLIIYYYS

SEQ ID NO: 1877142 - protein, 17 aa, Staphylococcus
INGLRIMIIIAPLLFVC

SEQ ID NO: 1877143 - protein, 18 aa, Staphylococcus
INGQFPYRGHQKAKILTF

SEQ ID NO: 1877144 - protein, 19 aa, Staphylococcus
INGSKSWIDLGFMNLQASE

SEQ ID NO: 1877145 - protein, 27 aa, Staphylococcus
INHAPHYFKLEIVPIYYINSNKQERTQ

SEQ ID NO: 1877146 - protein, 17 aa, Staphylococcus
INHLIARYLNPVWEVTN

SEQ ID NO: 1877147 - protein, 27 aa, Staphylococcus
INIALITSIIMIFVGVTGRFIYRKIKN

SEQ ID NO: 1877148 - protein, 19 aa, Staphylococcus
INICCVFCYVGMIALFPSA

SEQ ID NO: 1877149 - protein, 17 aa, Staphylococcus
INICPVSSIGPLGFSMA

SEQ ID NO: 1877150 - protein, 28 aa, Staphylococcus
INIFKAFKWRIIGFLAFLLIAILFLTLG

SEQ ID NO: 1877151 - protein, 17 aa, Staphylococcus
INIGLTIGVFGTIIFLI

SEQ ID NO: 1877152 - protein, 17 aa, Staphylococcus
INIGLTIGVFGTVIFII

SEQ ID NO: 1877153 - protein, 17 aa, Staphylococcus
INIGLTIGVFGTVIFLI

SEQ ID NO: 1877154 - protein, 21 aa, Staphylococcus
INILRSIPFIILLIAIVPFTK

SEQ ID NO: 1877155 - protein, 24 aa, Staphylococcus
INISQVIGGMIWTGPGEGDVVTST

SEQ ID NO: 1877156 - protein, 25 aa, Staphylococcus
INKKPKLAGILLIIAGILAIATNWI

SEQ ID NO: 1877157 - protein, 20 aa, Staphylococcus
INKLNKWAFFACTMIGLLVL

SEQ ID NO: 1877158 - protein, 17 aa, Staphylococcus
INKNGHKLTTFIKNNEG

SEQ ID NO: 1877159 - protein, 23 aa, Staphylococcus
INKRFKPQFIRTIITIVLALPLI

SEQ ID NO: 1877160 - protein, 29 aa, Staphylococcus
INLIKMLVVPIVFCSLALSISNVGDTKTI

SEQ ID NO: 1877161 - protein, 24 aa, Staphylococcus
INLILFCIFTFLANNRNYFMVNYR

SEQ ID NO: 1877162 - protein, 17 aa, Staphylococcus
INLILPILLLTGIFVLL

SEQ ID NO: 1877163 - protein, 27 aa, Staphylococcus
INLKFHSRFALEILLTIANHYNRNLRL

SEQ ID NO: 1877164 - protein, 24 aa, Staphylococcus
INLKFHSRFALEILTTIANHYNRN

SEQ ID NO: 1877165 - protein, 26 aa, Staphylococcus
INLKFHSRFALNILLTIANHYNRNLR

SEQ ID NO: 1877166 - protein, 25 aa, Staphylococcus
INLKNFWIRRIKRLLPAVLALLIVV

SEQ ID NO: 1877167 - protein, 24 aa, Staphylococcus
INLKNFWLRRLKRLVPAVLALLLV

SEQ ID NO: 1877168 - protein, 23 aa, Staphylococcus
INLRDYPLILGILMMMITIIMIL

SEQ ID NO: 1877169 - protein, 23 aa, Staphylococcus
INLRDYPVILGILMMIITFIMVL

SEQ ID NO: 1877170 - protein, 19 aa, Staphylococcus
INMILAFIVLIGLFLVGPT

SEQ ID NO: 1877171 - protein, 18 aa, Staphylococcus
INMILAFIVLLVLFCVGP

SEQ ID NO: 1877172 - protein, 20 aa, Staphylococcus
INMILAFVVLIVLFAVGPTL

SEQ ID NO: 1877173 - protein, 18 aa, Staphylococcus
INMPYGFEKEKLIKNKDD

SEQ ID NO: 1877174 - protein, 25 aa, Staphylococcus
INNGWAKNGTYCIIRRIQIHIETWD

SEQ ID NO: 1877175 - protein, 18 aa, Staphylococcus
INNPKLSFSIVYTNQPVP

SEQ ID NO: 1877176 - protein, 27 aa, Staphylococcus
INNRLNKKFVIFFSIAYFFEGAGYIIT

SEQ ID NO: 1877177 - protein, 24 aa, Staphylococcus
INNYRILRRIGFTHTDMTKGLALK

SEQ ID NO: 1877178 - protein, 24 aa, Staphylococcus
INNYRILRRIGFTNTDMIKGLALK

SEQ ID NO: 1877179 - protein, 22 aa, Staphylococcus
INPEVQVKPFALDEIQQQANNQ

SEQ ID NO: 1877180 - protein, 23 aa, Staphylococcus
INPEYYAVVDFTGFEKMVDELEP

SEQ ID NO: 1877181 - protein, 18 aa, Staphylococcus
INPLELLSIVFILMFFIN

SEQ ID NO: 1877182 - protein, 23 aa, Staphylococcus
INQARESLGLIVPQNKKLYIRQA

SEQ ID NO: 1877183 - protein, 17 aa, Staphylococcus
INQLETFMGTNGNATDS

SEQ ID NO: 1877184 - protein, 17 aa, Staphylococcus
INQLITFIFIWAGIIVY

SEQ ID NO: 1877185 - protein, 30 aa, Staphylococcus
INQSIRKMVPWGIGTFIIILLIILFFLLKN

SEQ ID NO: 1877186 - protein, 18 aa, Staphylococcus
INRIKAFIPLLIPLFISA

SEQ ID NO: 1877187 - protein, 26 aa, Staphylococcus
INRISYCFIAILLLLISVWLFDLKRK

SEQ ID NO: 1877188 - protein, 19 aa, Staphylococcus
INRSREIDRLLLVGHGSLC

SEQ ID NO: 1877189 - protein, 18 aa, Staphylococcus
INSFKANLAIVIIIISIF

SEQ ID NO: 1877190 - protein, 30 aa, Staphylococcus
INSMVTRVISRWATEHNIYFKRYSSDQFVA

SEQ ID NO: 1877191 - protein, 19 aa, Staphylococcus
INSPYVVVINGHVDPNSNG

SEQ ID NO: 1877192 - protein, 21 aa, Staphylococcus
INSVPLRILVFYVGALAVIMS

SEQ ID NO: 1877193 - protein, 18 aa, Staphylococcus
INSVPMRILLFYVGSLAV

SEQ ID NO: 1877194 - protein, 30 aa, Staphylococcus
INTETIQLFSFFIGYHFDKFDLGVQQLFIE

SEQ ID NO: 1877195 - protein, 27 aa, Staphylococcus
INTQIATFFLMDIVSYLLLNDPHMNQL

SEQ ID NO: 1877196 - protein, 17 aa, Staphylococcus
INTRYFVIITSYIEQIQ

SEQ ID NO: 1877197 - protein, 17 aa, Staphylococcus
INVARVVLIGATVYGSI

SEQ ID NO: 1877198 - protein, 20 aa, Staphylococcus
INVLCAVFVGPWFGLAQAFI

SEQ ID NO: 1877199 - protein, 24 aa, Staphylococcus
INVLPIVIVPLVVERKRIKEHPDV

SEQ ID NO: 1877200 - protein, 33 aa, Staphylococcus
INVLTILSSIFFPLTLLTGWFGMNFTNMPELHW

SEQ ID NO: 1877201 - protein, 24 aa, Staphylococcus
INVLYKFMGVVGMFIVVAVLIKYF

SEQ ID NO: 1877202 - protein, 18 aa, Staphylococcus
INVSISFEPMALIQTMIM

SEQ ID NO: 1877203 - protein, 18 aa, Staphylococcus
INVTRVVLIAATVYGAVK

SEQ ID NO: 1877204 - protein, 26 aa, Staphylococcus
INYLVELTACWTVFMILSGTYMLIKK

SEQ ID NO: 1877205 - protein, 18 aa, Staphylococcus
INYLYTFSVLFFVDLIIV

SEQ ID NO: 1877206 - protein, 26 aa, Staphylococcus
IPAFFSGQAPFLFAHRGGMAVRPEQT

SEQ ID NO: 1877207 - protein, 20 aa, Staphylococcus
IPAFIGIWFMPEPVKNKQKF

SEQ ID NO: 1877208 - protein, 20 aa, Staphylococcus
IPAGILGLMFDDLIEKYLFS

SEQ ID NO: 1877209 - protein, 19 aa, Staphylococcus
IPALICLVGVFGTMIYQSF

SEQ ID NO: 1877210 - protein, 35 aa, Staphylococcus
IPALTKLFGKASWYLPKWLGAVLPNIDVEGKALEE

SEQ ID NO: 1877211 - protein, 32 aa, Staphylococcus
IPALVIIACLLFRFSTVPAMLVSSVAAILVGS

SEQ ID NO: 1877212 - protein, 19 aa, Staphylococcus
IPANGKWYDHIGIPHERRQ

SEQ ID NO: 1877213 - protein, 17 aa, Staphylococcus
IPAQPTLLFAVELDETG

SEQ ID NO: 1877214 - protein, 19 aa, Staphylococcus
IPASFVIIAMFILQFLLNF

SEQ ID NO: 1877215 - protein, 22 aa, Staphylococcus
IPASIIGLIVWFFAGLNSQGNV

SEQ ID NO: 1877216 - protein, 24 aa, Staphylococcus
IPAYGWRPLTKRLEKTIVTVIHEI

SEQ ID NO: 1877217 - protein, 17 aa, Staphylococcus
IPEGLSIGVAFGGIASS

SEQ ID NO: 1877218 - protein, 18 aa, Staphylococcus
IPEGLSIGVAFGGIATGN

SEQ ID NO: 1877219 - protein, 19 aa, Staphylococcus
IPEGLSIGVAFGGIATGNG

SEQ ID NO: 1877220 - protein, 21 aa, Staphylococcus
IPEGLSIGVAFGGIVSGNGQA

SEQ ID NO: 1877221 - protein, 18 aa, Staphylococcus
IPEGLSIGVAFGGVVSGN

SEQ ID NO: 1877222 - protein, 21 aa, Staphylococcus
IPEGLSIGVAFGGVVSGNGQA

SEQ ID NO: 1877223 - protein, 17 aa, Staphylococcus
IPFANTFLSYYSDIFSP

SEQ ID NO: 1877224 - protein, 17 aa, Staphylococcus
IPFIISILVRNILIFIK

SEQ ID NO: 1877225 - protein, 19 aa, Staphylococcus
IPFTPGLIPKRRDEIATKI

SEQ ID NO: 1877226 - protein, 18 aa, Staphylococcus
IPGEGASGARIIRKEAQK

SEQ ID NO: 1877227 - protein, 18 aa, Staphylococcus
IPGEGASGGRILRKEILK

SEQ ID NO: 1877228 - protein, 17 aa, Staphylococcus
IPGFLASVITTYFVSKY

SEQ ID NO: 1877229 - protein, 20 aa, Staphylococcus
IPGGSIFFLLALLSFPMPIK

SEQ ID NO: 1877230 - protein, 17 aa, Staphylococcus
IPGICYFLVESIRSRDY

SEQ ID NO: 1877231 - protein, 18 aa, Staphylococcus
IPGKSGGVNKEYAGQMDV

SEQ ID NO: 1877232 - protein, 18 aa, Staphylococcus
IPGLGAFLVDSIRSRDYP

SEQ ID NO: 1877233 - protein, 17 aa, Staphylococcus
IPGMMTGLIIGGVPPLQ

SEQ ID NO: 1877234 - protein, 21 aa, Staphylococcus
IPGSLVFLFGRMLKTKQQIHP

SEQ ID NO: 1877235 - protein, 18 aa, Staphylococcus
IPHAEFHLFHGFTPAFFA

SEQ ID NO: 1877236 - protein, 20 aa, Staphylococcus
IPHALILTAIVIAFATTAFF

SEQ ID NO: 1877237 - protein, 30 aa, Staphylococcus
IPIAALGLLAPWIAGAAMALSSVSVVTNAL

SEQ ID NO: 1877238 - protein, 21 aa, Staphylococcus
IPIFAALVWWFLLQRNSTQNE

SEQ ID NO: 1877239 - protein, 20 aa, Staphylococcus
IPIFMAIMIPLGRKMQKISM

SEQ ID NO: 1877240 - protein, 20 aa, Staphylococcus
IPIFMGIMIPLGRRMQKISK

SEQ ID NO: 1877241 - protein, 24 aa, Staphylococcus
IPIGEIAIGLGLLFGVLSYTASFF

SEQ ID NO: 1877242 - protein, 17 aa, Staphylococcus
IPIGNAFVLSFILSFTD

SEQ ID NO: 1877243 - protein, 17 aa, Staphylococcus
IPIIFLMVYSFNSAGNM

SEQ ID NO: 1877244 - protein, 27 aa, Staphylococcus
IPIIITMILCYFGFQFGLKKRDEMLMF

SEQ ID NO: 1877245 - protein, 22 aa, Staphylococcus
IPIILCVIGFKGDKLIATMVII

SEQ ID NO: 1877246 - protein, 17 aa, Staphylococcus
IPILFGLYATLKWPTSG

SEQ ID NO: 1877247 - protein, 18 aa, Staphylococcus
IPILFLISTIASFIGLLI

SEQ ID NO: 1877248 - protein, 21 aa, Staphylococcus
IPILIGFILQKVFKNFAAKSA

SEQ ID NO: 1877249 - protein, 27 aa, Staphylococcus
IPILYRFFKKIHLGWFVLPIPVVLFIY

SEQ ID NO: 1877250 - protein, 27 aa, Staphylococcus
IPILYRFFKKIHLGWFVLPVPVVLFIY

SEQ ID NO: 1877251 - protein, 27 aa, Staphylococcus
IPILYRFFKRIHIGWFVLPVPVVLFIY

SEQ ID NO: 1877252 - protein, 27 aa, Staphylococcus
IPILYRFVKRIHLGWFVLPVPILLFIY

SEQ ID NO: 1877253 - protein, 17 aa, Staphylococcus
IPISNMRLGMPGDSMKP

SEQ ID NO: 1877254 - protein, 17 aa, Staphylococcus
IPITIIWIVAITNAINL

SEQ ID NO: 1877255 - protein, 18 aa, Staphylococcus
IPITVIWIVAITNAINLI

SEQ ID NO: 1877256 - protein, 26 aa, Staphylococcus
IPIVYRFIKRIHIGWFVLPVPVVLFI

SEQ ID NO: 1877257 - protein, 22 aa, Staphylococcus
IPKELMPYIDRGSINIYVSDIF

SEQ ID NO: 1877258 - protein, 25 aa, Staphylococcus
IPKEPGRYDIIVTVIDSNSNQADVH

SEQ ID NO: 1877259 - protein, 25 aa, Staphylococcus
IPKIDLPRVEQFGVNPTNLSYKNID

SEQ ID NO: 1877260 - protein, 25 aa, Staphylococcus
IPKRHYKRKRRAFFHNKEREERVQR

SEQ ID NO: 1877261 - protein, 21 aa, Staphylococcus
IPKSQIKNVFKIIDKQEFMAV

SEQ ID NO: 1877262 - protein, 26 aa, Staphylococcus
IPKTELKEKIGLVLQDAFMFYGTIAS

SEQ ID NO: 1877263 - protein, 17 aa, Staphylococcus
IPLFKKQIEAGGPITVT

SEQ ID NO: 1877264 - protein, 17 aa, Staphylococcus
IPLFTGKMVDKFSMSSV

SEQ ID NO: 1877265 - protein, 17 aa, Staphylococcus
IPLFVAIMIPLGRVMQR

SEQ ID NO: 1877266 - protein, 17 aa, Staphylococcus
IPLGIILYYTYLKTKSV

SEQ ID NO: 1877267 - protein, 17 aa, Staphylococcus
IPLGIVIGNGIVMTICD

SEQ ID NO: 1877268 - protein, 17 aa, Staphylococcus
IPLHEGHLFSIANKIIN

SEQ ID NO: 1877269 - protein, 19 aa, Staphylococcus
IPLHMLFIFTFCICVIVPI

SEQ ID NO: 1877270 - protein, 18 aa, Staphylococcus
IPLIPAFVGAGLVGGIAA

SEQ ID NO: 1877271 - protein, 26 aa, Staphylococcus
IPLIVIIICLLMKMSTVPAMLISALS

SEQ ID NO: 1877272 - protein, 25 aa, Staphylococcus
IPLIVIIICLMFKVSTVPSMLASSI

SEQ ID NO: 1877273 - protein, 33 aa, Staphylococcus
IPLLLFSSNILKIWKESRRLLVIFFVASIGTMI

SEQ ID NO: 1877274 - protein, 23 aa, Staphylococcus
IPLSIKFPFTFKTGGFLDASLST

SEQ ID NO: 1877275 - protein, 21 aa, Staphylococcus
IPLSILIAIVALKLSNVSLNI

SEQ ID NO: 1877276 - protein, 20 aa, Staphylococcus
IPLSILIALIALKLSDVSLN

SEQ ID NO: 1877277 - protein, 20 aa, Staphylococcus
IPLSILIALIALKLSNVSLN

SEQ ID NO: 1877278 - protein, 20 aa, Staphylococcus
IPLSILIALVALKLTDVSLN

SEQ ID NO: 1877279 - protein, 20 aa, Staphylococcus
IPLSKWRNKIGYVMQSNSMM

SEQ ID NO: 1877280 - protein, 25 aa, Staphylococcus
IPLSKWRTKIGYVMQSNSMMSGTIR

SEQ ID NO: 1877281 - protein, 23 aa, Staphylococcus
IPLTIKFPFTFKTGGLVDVSLAT

SEQ ID NO: 1877282 - protein, 20 aa, Staphylococcus
IPLVSIVGVVVFTIILFISS

SEQ ID NO: 1877283 - protein, 19 aa, Staphylococcus
IPMFIIILILVVFAILFIV

SEQ ID NO: 1877284 - protein, 18 aa, Staphylococcus
IPMGTAYAIWTGIGTGGG

SEQ ID NO: 1877285 - protein, 18 aa, Staphylococcus
IPMHFEFESEVFMMAVIA

SEQ ID NO: 1877286 - protein, 23 aa, Staphylococcus
IPMIMGGLVVIEYIFAWPGLGQL

SEQ ID NO: 1877287 - protein, 17 aa, Staphylococcus
IPMSAPVYDTVWDYIVP

SEQ ID NO: 1877288 - protein, 19 aa, Staphylococcus
IPMSILIALVALKLSNVSL

SEQ ID NO: 1877289 - protein, 17 aa, Staphylococcus
IPNAIFWLKTYPERLKN

SEQ ID NO: 1877290 - protein, 18 aa, Staphylococcus
IPNLMPAIIGGFFMALTY

SEQ ID NO: 1877291 - protein, 19 aa, Staphylococcus
IPNLMPSIIGGFFMALTYS

SEQ ID NO: 1877292 - protein, 19 aa, Staphylococcus
IPPFFTRKKQYIFAHRGGM

SEQ ID NO: 1877293 - protein, 17 aa, Staphylococcus
IPPFSGFYGKYFIVKAA

SEQ ID NO: 1877294 - protein, 26 aa, Staphylococcus
IPPSLLIPGIFIMSGFAALTLGTSTG

SEQ ID NO: 1877295 - protein, 21 aa, Staphylococcus
IPQFYSYFLNYGFVLLSIIVL

SEQ ID NO: 1877296 - protein, 18 aa, Staphylococcus
IPQMIKKYLEDGTDQVIA

SEQ ID NO: 1877297 - protein, 17 aa, Staphylococcus
IPREKYGRKRREYFHNE

SEQ ID NO: 1877298 - protein, 22 aa, Staphylococcus
IPRSKYGRKRHEYFHNEEREER

SEQ ID NO: 1877299 - protein, 20 aa, Staphylococcus
IPSGVLGLIGIVGYVSYYSI

SEQ ID NO: 1877300 - protein, 25 aa, Staphylococcus
IPSIGALLLGYGIKDLVKFFNSGLE

SEQ ID NO: 1877301 - protein, 21 aa, Staphylococcus
IPSMLSEYFDGFGPKLASFAE

SEQ ID NO: 1877302 - protein, 20 aa, Staphylococcus
IPSNGKWYDHIGIDSDRRQA

SEQ ID NO: 1877303 - protein, 23 aa, Staphylococcus
IPSNIYFLMFVRLINGIATAIAT

SEQ ID NO: 1877304 - protein, 22 aa, Staphylococcus
IPTHLKIAYILPTISTLIISVL

SEQ ID NO: 1877305 - protein, 29 aa, Staphylococcus
IPTIIWLIIDACLIPGMIEENKEKVRRHA

SEQ ID NO: 1877306 - protein, 18 aa, Staphylococcus
IPTKRIAQQIPIVVVSIV

SEQ ID NO: 1877307 - protein, 17 aa, Staphylococcus
IPTLLGYAGVGISFGIV

SEQ ID NO: 1877308 - protein, 19 aa, Staphylococcus
IPTMLSDYFDGFGSKLATF

SEQ ID NO: 1877309 - protein, 20 aa, Staphylococcus
IPTWDILGLEIKQLNYQGQV

SEQ ID NO: 1877310 - protein, 19 aa, Staphylococcus
IPTWHLFGLEIKQLNYQGQ

SEQ ID NO: 1877311 - protein, 26 aa, Staphylococcus
IPTYFSHVEAYLWFDGDDVIGFSGTN

SEQ ID NO: 1877312 - protein, 22 aa, Staphylococcus
IPVDYYVRINMDAFVQAVDKLG

SEQ ID NO: 1877313 - protein, 17 aa, Staphylococcus
IPVEFNFDSELFMVTLI

SEQ ID NO: 1877314 - protein, 21 aa, Staphylococcus
IPVHYIFRVLSILIFIMTFKM

SEQ ID NO: 1877315 - protein, 21 aa, Staphylococcus
IPVIIMRTSWLFILFIFLGGL

SEQ ID NO: 1877316 - protein, 17 aa, Staphylococcus
IPVILLVYFSFTDVHGH

SEQ ID NO: 1877317 - protein, 20 aa, Staphylococcus
IPVLIIALLFIFFLSQAQGG

SEQ ID NO: 1877318 - protein, 17 aa, Staphylococcus
IPVLLLVYFSFIDINGH

SEQ ID NO: 1877319 - protein, 22 aa, Staphylococcus
IPVLRCLISLPAGMTHMPFWTF

SEQ ID NO: 1877320 - protein, 18 aa, Staphylococcus
IPVNGKWYDNIGIDKDKR

SEQ ID NO: 1877321 - protein, 19 aa, Staphylococcus
IPVNHALDLAKQLEKHGHI

SEQ ID NO: 1877322 - protein, 25 aa, Staphylococcus
IPVQATTLIPVMKPVINTDVAGKAF

SEQ ID NO: 1877323 - protein, 25 aa, Staphylococcus
IPVSTLRAGLIIGSKGSSYPILKRM

SEQ ID NO: 1877324 - protein, 20 aa, Staphylococcus
IPVYFKHLIIAIPLILNGLI

SEQ ID NO: 1877325 - protein, 26 aa, Staphylococcus
IPYKGKRYYNFFGIGAFDEDAMKHGH

SEQ ID NO: 1877326 - protein, 17 aa, Staphylococcus
IPYMFSAFYQLKYTIEH

SEQ ID NO: 1877327 - protein, 17 aa, Staphylococcus
IQAFIHSILFGFPTKKS

SEQ ID NO: 1877328 - protein, 41 aa, Staphylococcus
IQAILSFKLYRHFYYRVFAILTIIFICFNFIPFIDQLFNGF

SEQ ID NO: 1877329 - protein, 18 aa, Staphylococcus
IQAPIMIGTIIIALSFVV

SEQ ID NO: 1877330 - protein, 17 aa, Staphylococcus
IQEALEILMEGRTTIVI

SEQ ID NO: 1877331 - protein, 23 aa, Staphylococcus
IQEDGRSGIVVIIRDMTNEHNLD

SEQ ID NO: 1877332 - protein, 29 aa, Staphylococcus
IQFLVESVVLCLIGGIIGLIIGIAIASLV

SEQ ID NO: 1877333 - protein, 29 aa, Staphylococcus
IQFLVESVVLCLLGGIIGLILGIIIATLV

SEQ ID NO: 1877334 - protein, 19 aa, Staphylococcus
IQFYFLFPLLQKFKKGWPI

SEQ ID NO: 1877335 - protein, 25 aa, Staphylococcus
IQGLPRAAELKAITYFNENVQSNFS

SEQ ID NO: 1877336 - protein, 18 aa, Staphylococcus
IQGMSVIHFFGKAKRLPN

SEQ ID NO: 1877337 - protein, 18 aa, Staphylococcus
IQHRMIASFGQMLLAMIT

SEQ ID NO: 1877338 - protein, 20 aa, Staphylococcus
IQKAKSFAFRDVKNHYVRNE

SEQ ID NO: 1877339 - protein, 22 aa, Staphylococcus
IQKEYWMVYAICTIIAVIVPAV

SEQ ID NO: 1877340 - protein, 23 aa, Staphylococcus
IQKPTARKAINTKADEIKLSINN

SEQ ID NO: 1877341 - protein, 21 aa, Staphylococcus
IQKSLARQAIDDEATIKKAEI

SEQ ID NO: 1877342 - protein, 24 aa, Staphylococcus
IQLFMKSYTGMNNWETNFKNLSQM

SEQ ID NO: 1877343 - protein, 17 aa, Staphylococcus
IQLIVFRGLQGIGAAML

SEQ ID NO: 1877344 - protein, 24 aa, Staphylococcus
IQLLKGIVVIVIFQQISKVLNLTA

SEQ ID NO: 1877345 - protein, 28 aa, Staphylococcus
IQLLTKWKTHIIILIAVVLLFIVILMLM

SEQ ID NO: 1877346 - protein, 18 aa, Staphylococcus
IQLSIAFIVNCLLLILGA

SEQ ID NO: 1877347 - protein, 29 aa, Staphylococcus
IQLSIAFVINCLLLVLGAALFFGGNSESL

SEQ ID NO: 1877348 - protein, 18 aa, Staphylococcus
IQLSVAFVVNCLLLTLGA

SEQ ID NO: 1877349 - protein, 18 aa, Staphylococcus
IQLTISFAMIGLALGQFF

SEQ ID NO: 1877350 - protein, 18 aa, Staphylococcus
IQLTLSFAMIGLALGQFL

SEQ ID NO: 1877351 - protein, 21 aa, Staphylococcus
IQMTARPVISFVHDMKLSKYY

SEQ ID NO: 1877352 - protein, 22 aa, Staphylococcus
IQMTIRPVISFVHDLKLANFYH

SEQ ID NO: 1877353 - protein, 20 aa, Staphylococcus
IQNIEVIEGFIMRKYKLAHL

SEQ ID NO: 1877354 - protein, 21 aa, Staphylococcus
IQNIVAITWLIGIFFIANGIM

SEQ ID NO: 1877355 - protein, 17 aa, Staphylococcus
IQNLVAVYDEILKEMAK

SEQ ID NO: 1877356 - protein, 27 aa, Staphylococcus
IQPDIVKKAAARKAIDDAATAKKQEID

SEQ ID NO: 1877357 - protein, 26 aa, Staphylococcus
IQPHSGSSFKGRIIKIDTFPTTSTFN

SEQ ID NO: 1877358 - protein, 21 aa, Staphylococcus
IQPRTPKGFEMLFNNFSAGIL

SEQ ID NO: 1877359 - protein, 24 aa, Staphylococcus
IQPSEFMKIILILALAKIVSNHNR

SEQ ID NO: 1877360 - protein, 25 aa, Staphylococcus
IQPSEFMKIILILALAKIVSRHNKY

SEQ ID NO: 1877361 - protein, 24 aa, Staphylococcus
IQPSEFMKIILILALAKTVSRHNQ

SEQ ID NO: 1877362 - protein, 24 aa, Staphylococcus
IQPSEFMKIILILALSKVVARHNQ

SEQ ID NO: 1877363 - protein, 23 aa, Staphylococcus
IQPSEFMKIVLILALAKIVERHN

SEQ ID NO: 1877364 - protein, 23 aa, Staphylococcus
IQPSEFMKVILILALAKSVSNHN

SEQ ID NO: 1877365 - protein, 24 aa, Staphylococcus
IQQDGRSGIVIIIRDMTNEHNLDQ

SEQ ID NO: 1877366 - protein, 18 aa, Staphylococcus
IQQKRAGLKPVFKPENLE

SEQ ID NO: 1877367 - protein, 18 aa, Staphylococcus
IQQLKTILQNALNALQSD

SEQ ID NO: 1877368 - protein, 24 aa, Staphylococcus
IQRFTTGFFKSIAILIGLIVGTVL

SEQ ID NO: 1877369 - protein, 23 aa, Staphylococcus
IQRPASWLKKGINLFLLAVFPAN

SEQ ID NO: 1877370 - protein, 17 aa, Staphylococcus
IQRRGELLTTIFEHIQI

SEQ ID NO: 1877371 - protein, 24 aa, Staphylococcus
IQSEIKKSSSYQRIYDKAKAQGMS

SEQ ID NO: 1877372 - protein, 20 aa, Staphylococcus
IQTIDFVIGIALAIVILIIF

SEQ ID NO: 1877373 - protein, 22 aa, Staphylococcus
IQTRPINNISILDLSASLENYE

SEQ ID NO: 1877374 - protein, 18 aa, Staphylococcus
IQTTPKFFQAISPYLPFT

SEQ ID NO: 1877375 - protein, 18 aa, Staphylococcus
IQVVNIFSLLFIFFSYIQ

SEQ ID NO: 1877376 - protein, 17 aa, Staphylococcus
IQYIIVTTLILLIILFL

SEQ ID NO: 1877377 - protein, 17 aa, Staphylococcus
IQYKEPQHFTGIQSPSQ

SEQ ID NO: 1877378 - protein, 19 aa, Staphylococcus
IQYTVITVLVLLIVIFLLY

SEQ ID NO: 1877379 - protein, 23 aa, Staphylococcus
IRADYRLMVPLTMVIGADLLLLS

SEQ ID NO: 1877380 - protein, 24 aa, Staphylococcus
IRDFDFTNIYAYIFPGIVTILFLF

SEQ ID NO: 1877381 - protein, 18 aa, Staphylococcus
IREADGIIIAADRQVDLA

SEQ ID NO: 1877382 - protein, 26 aa, Staphylococcus
IREFIMCVLIVPPLISFVWIAGFGGM

SEQ ID NO: 1877383 - protein, 26 aa, Staphylococcus
IREFIMCVLIVPPLISFVWICGFGGM

SEQ ID NO: 1877384 - protein, 18 aa, Staphylococcus
IRFDKSRILEHQDEINNY

SEQ ID NO: 1877385 - protein, 17 aa, Staphylococcus
IRFWPTNQLIVAYVRTI

SEQ ID NO: 1877386 - protein, 20 aa, Staphylococcus
IRGNSLLFLSIFCLLISLTS

SEQ ID NO: 1877387 - protein, 17 aa, Staphylococcus
IRHKIKPFKIFDKEKYR

SEQ ID NO: 1877388 - protein, 19 aa, Staphylococcus
IRHQIMIVALFLLLFLMIF

SEQ ID NO: 1877389 - protein, 17 aa, Staphylococcus
IRIDGVRIFTLIMIVNT

SEQ ID NO: 1877390 - protein, 17 aa, Staphylococcus
IRIGGHPQFVRPLINPM

SEQ ID NO: 1877391 - protein, 26 aa, Staphylococcus
IRIGIFLSRFAWRFFSLMPSHRINTT

SEQ ID NO: 1877392 - protein, 18 aa, Staphylococcus
IRIIIGLLVIIFAGTSVS

SEQ ID NO: 1877393 - protein, 21 aa, Staphylococcus
IRIITVGAVIAWILGAIALHT

SEQ ID NO: 1877394 - protein, 20 aa, Staphylococcus
IRIITVGAVIAWILGSMALH

SEQ ID NO: 1877395 - protein, 19 aa, Staphylococcus
IRIKNLYLYIKSYSIEQIK

SEQ ID NO: 1877396 - protein, 20 aa, Staphylococcus
IRKAKSIAFRDVKNHFIRNE

SEQ ID NO: 1877397 - protein, 17 aa, Staphylococcus
IRKAKSIAFRDVKNHFV

SEQ ID NO: 1877398 - protein, 26 aa, Staphylococcus
IRKHLRVGETFTLYLIWYSIGRFFVE

SEQ ID NO: 1877399 - protein, 17 aa, Staphylococcus
IRLIGSLLFIIFHLGRI

SEQ ID NO: 1877400 - protein, 20 aa, Staphylococcus
IRLLLQPIINYKYRFYRVND

SEQ ID NO: 1877401 - protein, 25 aa, Staphylococcus
IRLTKGHYRLSIKGIYGEDYHTLKQ

SEQ ID NO: 1877402 - protein, 17 aa, Staphylococcus
IRMFKRYATITTSARIL

SEQ ID NO: 1877403 - protein, 37 aa, Staphylococcus
IRMLFHPFKPYYIFKMRIPFTPGLIPKRRGEIAEKIG

SEQ ID NO: 1877404 - protein, 23 aa, Staphylococcus
IRNARGITFGLFRLSVGLENPDE

SEQ ID NO: 1877405 - protein, 25 aa, Staphylococcus
IRNIKQNLFWAFGYNAAGIPIAAMG

SEQ ID NO: 1877406 - protein, 25 aa, Staphylococcus
IRNIKQNLFWAFGYNIAGIPIAAMG

SEQ ID NO: 1877407 - protein, 17 aa, Staphylococcus
IRPLRHYAGYISLFAPV

SEQ ID NO: 1877408 - protein, 19 aa, Staphylococcus
IRPMEIVKYLIITFLVLVA

SEQ ID NO: 1877409 - protein, 18 aa, Staphylococcus
IRPQEVVKFITITFLILV

SEQ ID NO: 1877410 - protein, 25 aa, Staphylococcus
IRQSFNIPALKTWQATRSQAGNNAP

SEQ ID NO: 1877411 - protein, 26 aa, Staphylococcus
IRRKFDYDISCVHLPTSGETGLSGQI

SEQ ID NO: 1877412 - protein, 20 aa, Staphylococcus
IRSGSHLYISGRNKENNVKN

SEQ ID NO: 1877413 - protein, 17 aa, Staphylococcus
IRSGVFIALATFLRPIG

SEQ ID NO: 1877414 - protein, 17 aa, Staphylococcus
IRSGVFIALATFLRPVG

SEQ ID NO: 1877415 - protein, 27 aa, Staphylococcus
IRSILWEHIIQLKMPFFDKNESGQLMS

SEQ ID NO: 1877416 - protein, 27 aa, Staphylococcus
IRSLLWEHIIQLKMPFFDKNESGQLMS

SEQ ID NO: 1877417 - protein, 19 aa, Staphylococcus
IRTELRKAGFTIKSSPKGI

SEQ ID NO: 1877418 - protein, 22 aa, Staphylococcus
IRVGEMLLRKVGPRQPMLLGTF

SEQ ID NO: 1877419 - protein, 20 aa, Staphylococcus
IRVLSGILFLIASIITLPLV

SEQ ID NO: 1877420 - protein, 19 aa, Staphylococcus
IRVMSRFIGAFPIISAIII

SEQ ID NO: 1877421 - protein, 17 aa, Staphylococcus
IRVMSRFIGNFPVVSAV

SEQ ID NO: 1877422 - protein, 19 aa, Staphylococcus
IRVNRSWKIPYEAAKVSGK

SEQ ID NO: 1877423 - protein, 17 aa, Staphylococcus
IRYIITIIIVIISILGI

SEQ ID NO: 1877424 - protein, 20 aa, Staphylococcus
IRYSIAIVVVIFWIGVLSCR

SEQ ID NO: 1877425 - protein, 25 aa, Staphylococcus
IRYYFKDILVCFVAVVFFNVTNYTV

SEQ ID NO: 1877426 - protein, 25 aa, Staphylococcus
IRYYYKDILVCFVAVVFFNVTNYMV

SEQ ID NO: 1877427 - protein, 25 aa, Staphylococcus
IRYYYKDILVCFVAVVFFNVTNYSV

SEQ ID NO: 1877428 - protein, 25 aa, Staphylococcus
IRYYYKDILVCFVAVVFFNVTNYTV

SEQ ID NO: 1877429 - protein, 20 aa, Staphylococcus
ISAFIGAGVLTFIHGNYIKP

SEQ ID NO: 1877430 - protein, 17 aa, Staphylococcus
ISAFKFLHVDSAVMSII

SEQ ID NO: 1877431 - protein, 21 aa, Staphylococcus
ISAIFYKAPSWIIQSINWEIA

SEQ ID NO: 1877432 - protein, 17 aa, Staphylococcus
ISAIITWIHNRYYSKRL

SEQ ID NO: 1877433 - protein, 25 aa, Staphylococcus
ISALGGKIVKMFKISNPIARGLALG

SEQ ID NO: 1877434 - protein, 22 aa, Staphylococcus
ISALPWFIMFILILSAGAISDK

SEQ ID NO: 1877435 - protein, 24 aa, Staphylococcus
ISAMICGMIAMVINCAAYIAEIIR

SEQ ID NO: 1877436 - protein, 25 aa, Staphylococcus
ISAMMAAMCGFLFLAADPAKDGGFL

SEQ ID NO: 1877437 - protein, 19 aa, Staphylococcus
ISASLSGSSSVIASESLST

SEQ ID NO: 1877438 - protein, 19 aa, Staphylococcus
ISASSWHYIFWISAVLYLV

SEQ ID NO: 1877439 - protein, 17 aa, Staphylococcus
ISASTSMSSSESLSTST

SEQ ID NO: 1877440 - protein, 24 aa, Staphylococcus
ISAVLCLIIGYFLLTKEEHHQTSD

SEQ ID NO: 1877441 - protein, 29 aa, Staphylococcus
ISAVVILLIVAGIGFGAYKIFSNTPKNTY

SEQ ID NO: 1877442 - protein, 25 aa, Staphylococcus
ISAYCYHKFLPWLILVPVVSIIGLL

SEQ ID NO: 1877443 - protein, 19 aa, Staphylococcus
ISCVVFIVFFMNLYHNAQM

SEQ ID NO: 1877444 - protein, 43 aa, Staphylococcus
ISDDLEARVEITLANGSKVIVHVPVKVIEQALIVAKNQAIKDI

SEQ ID NO: 1877445 - protein, 17 aa, Staphylococcus
ISDFVFKSSAKMIGAGL

SEQ ID NO: 1877446 - protein, 21 aa, Staphylococcus
ISDITSALAITLIFIFIVTSA

SEQ ID NO: 1877447 - protein, 20 aa, Staphylococcus
ISDKHLLMLSFGMMLVGEAC

SEQ ID NO: 1877448 - protein, 27 aa, Staphylococcus
ISDWLGFKFMYLLCASFVVIAMVSSVS

SEQ ID NO: 1877449 - protein, 18 aa, Staphylococcus
ISEFNRSVSLVFVTDLLI

SEQ ID NO: 1877450 - protein, 22 aa, Staphylococcus
ISEGISGILFLPITVSVILGSM

SEQ ID NO: 1877451 - protein, 17 aa, Staphylococcus
ISEIKYAPKQNSPNRIL

SEQ ID NO: 1877452 - protein, 18 aa, Staphylococcus
ISEKLYKSSFIVMTITGF

SEQ ID NO: 1877453 - protein, 18 aa, Staphylococcus
ISELFGHVVWMMVIEMVR

SEQ ID NO: 1877454 - protein, 23 aa, Staphylococcus
ISERKKQAIVDISPIDVIPAIKQ

SEQ ID NO: 1877455 - protein, 28 aa, Staphylococcus
ISFAVCFIVYRFASAFIAQFSTQMQMLQ

SEQ ID NO: 1877456 - protein, 18 aa, Staphylococcus
ISFIAGTIALVFLALALQ

SEQ ID NO: 1877457 - protein, 25 aa, Staphylococcus
ISFLAPEPFKQLILLGITLESITLL

SEQ ID NO: 1877458 - protein, 24 aa, Staphylococcus
ISFLDMRYNDMTIYVPRDLENLKV

SEQ ID NO: 1877459 - protein, 23 aa, Staphylococcus
ISFLGCLWGLFAGVSFATNMFTL

SEQ ID NO: 1877460 - protein, 17 aa, Staphylococcus
ISFLGIRIDGVRIFTLI

SEQ ID NO: 1877461 - protein, 19 aa, Staphylococcus
ISFWRTRQASIYGAQKSLI

SEQ ID NO: 1877462 - protein, 17 aa, Staphylococcus
ISFWRTRQASLYGAQKS

SEQ ID NO: 1877463 - protein, 20 aa, Staphylococcus
ISGAFILTLMIKKLRKYVTH

SEQ ID NO: 1877464 - protein, 17 aa, Staphylococcus
ISGCIVTLFAHWLRHRN

SEQ ID NO: 1877465 - protein, 30 aa, Staphylococcus
ISGFIVYWLLIRLLGDRSSIFVLGIIIILF

SEQ ID NO: 1877466 - protein, 42 aa, Staphylococcus
ISGFLFYICLPFQTLLEKWGFPRWASILTIFVVLIAIIAIVV

SEQ ID NO: 1877467 - protein, 17 aa, Staphylococcus
ISGFLSVLLVAGFSVGG

SEQ ID NO: 1877468 - protein, 19 aa, Staphylococcus
ISGIIGFLILFFLAPDIAA

SEQ ID NO: 1877469 - protein, 19 aa, Staphylococcus
ISGIIGFLILFYLAPDIAV

SEQ ID NO: 1877470 - protein, 30 aa, Staphylococcus
ISGILPDTVKKAAARKAIDDAATAKKEAIN

SEQ ID NO: 1877471 - protein, 22 aa, Staphylococcus
ISGIRLSSVYVISWATLASYIG

SEQ ID NO: 1877472 - protein, 23 aa, Staphylococcus
ISGIRLSSVYVISWATLASYVGA

SEQ ID NO: 1877473 - protein, 19 aa, Staphylococcus
ISGIYKWNELDSQFVEGIK

SEQ ID NO: 1877474 - protein, 21 aa, Staphylococcus
ISGLLLIYIGYYYKANRNIFW

SEQ ID NO: 1877475 - protein, 17 aa, Staphylococcus
ISGLPYFILFLSCFILV

SEQ ID NO: 1877476 - protein, 25 aa, Staphylococcus
ISGMTCAACSARIERVLNRTEGVDS

SEQ ID NO: 1877477 - protein, 22 aa, Staphylococcus
ISGMTCAACSNRIEKVLNKMDG

SEQ ID NO: 1877478 - protein, 27 aa, Staphylococcus
ISGMTLWIGALVYLVWYAMIKKSLDQV

SEQ ID NO: 1877479 - protein, 25 aa, Staphylococcus
ISGNAFGGAFGRIFTGFISSIYGYQ

SEQ ID NO: 1877480 - protein, 19 aa, Staphylococcus
ISGVLLRQAFLKMDNYVDD

SEQ ID NO: 1877481 - protein, 17 aa, Staphylococcus
ISGWREVIINAIPYQMK

SEQ ID NO: 1877482 - protein, 31 aa, Staphylococcus
ISGYFVPIVVGIAVLTFIIWIAFVQQGQFEP

SEQ ID NO: 1877483 - protein, 22 aa, Staphylococcus
ISHLVLTRTGLYIIDSKLLKGH

SEQ ID NO: 1877484 - protein, 27 aa, Staphylococcus
ISHLVLTRTGLYIIDSQLLKGHVYNGI

SEQ ID NO: 1877485 - protein, 27 aa, Staphylococcus
ISHLVLTRTGLYIIDSQLLKGHVYQGI

SEQ ID NO: 1877486 - protein, 24 aa, Staphylococcus
ISHNRLNEGNGMYKVHKNGEVEYK

SEQ ID NO: 1877487 - protein, 17 aa, Staphylococcus
ISHPEMLGLDFAITAMF

SEQ ID NO: 1877488 - protein, 17 aa, Staphylococcus
ISIALFLIYSKSDEETN

SEQ ID NO: 1877489 - protein, 19 aa, Staphylococcus
ISIALSFVAFFLIKHTPET

SEQ ID NO: 1877490 - protein, 21 aa, Staphylococcus
ISICLSMMWILFYKSNKTSNF

SEQ ID NO: 1877491 - protein, 17 aa, Staphylococcus
ISIDRQHYVLKRMLVEG

SEQ ID NO: 1877492 - protein, 26 aa, Staphylococcus
ISIFCLIVLIRFCFDTTFRHWFIEND

SEQ ID NO: 1877493 - protein, 20 aa, Staphylococcus
ISIFIYLRIDWKNYLYSNKF

SEQ ID NO: 1877494 - protein, 24 aa, Staphylococcus
ISIFKSPLTYIAFILVIGLTVFQA

SEQ ID NO: 1877495 - protein, 24 aa, Staphylococcus
ISIFLEFTESWKIETGNILVNAVF

SEQ ID NO: 1877496 - protein, 17 aa, Staphylococcus
ISIGKIFRISYIINALN

SEQ ID NO: 1877497 - protein, 17 aa, Staphylococcus
ISIGLAIFFSVYIVIFI

SEQ ID NO: 1877498 - protein, 20 aa, Staphylococcus
ISIIAAILVLFIIALIVKNA

SEQ ID NO: 1877499 - protein, 24 aa, Staphylococcus
ISIICLIAAWVLTILKKSPGTAFM

SEQ ID NO: 1877500 - protein, 17 aa, Staphylococcus
ISIIIAIIIVLLIQAFV

SEQ ID NO: 1877501 - protein, 23 aa, Staphylococcus
ISIIIISIFVRRQLTISNPLLNL

SEQ ID NO: 1877502 - protein, 17 aa, Staphylococcus
ISIILIIFFKRKNGFKP

SEQ ID NO: 1877503 - protein, 20 aa, Staphylococcus
ISIIVNFWFIQAIGAAYLIF

SEQ ID NO: 1877504 - protein, 17 aa, Staphylococcus
ISILIIYYIIRFKMQSI

SEQ ID NO: 1877505 - protein, 26 aa, Staphylococcus
ISIVGMACWLLYAHKLIERKTAKSQR

SEQ ID NO: 1877506 - protein, 19 aa, Staphylococcus
ISIVLGVGTAIYLEEYAKD

SEQ ID NO: 1877507 - protein, 21 aa, Staphylococcus
ISKDILDKDVKGIKMQMITAS

SEQ ID NO: 1877508 - protein, 23 aa, Staphylococcus
ISKDYFLMVPLTFLIGADLLLLS

SEQ ID NO: 1877509 - protein, 19 aa, Staphylococcus
ISKKLTFISYIPIVRFYYS

SEQ ID NO: 1877510 - protein, 23 aa, Staphylococcus
ISKKTYQGIFSFDVLGLQDIHRN

SEQ ID NO: 1877511 - protein, 22 aa, Staphylococcus
ISKKVFKFYVIAIMMLFFLVPI

SEQ ID NO: 1877512 - protein, 24 aa, Staphylococcus
ISKLIPLFYIRKWFDMKTTISSAF

SEQ ID NO: 1877513 - protein, 25 aa, Staphylococcus
ISKNGTRFLIFNNMSYRPPTKTVIV

SEQ ID NO: 1877514 - protein, 23 aa, Staphylococcus
ISKRTYQGIFSFDVLGLQDIHKN

SEQ ID NO: 1877515 - protein, 35 aa, Staphylococcus
ISKVHIVIPALKYDHEYTTHIELESVIPTIEDPEP

SEQ ID NO: 1877516 - protein, 21 aa, Staphylococcus
ISKYIPGFYMKYDDKKQDITI

SEQ ID NO: 1877517 - protein, 18 aa, Staphylococcus
ISLFRFIVGFVLAILIGV

SEQ ID NO: 1877518 - protein, 21 aa, Staphylococcus
ISLFYCIVIFPITIILYTRIA

SEQ ID NO: 1877519 - protein, 17 aa, Staphylococcus
ISLFYILAIINSKVFNF

SEQ ID NO: 1877520 - protein, 23 aa, Staphylococcus
ISLGFGVLFDAFIVRMTLIPALT

SEQ ID NO: 1877521 - protein, 18 aa, Staphylococcus
ISLICGKFIYNRRHTLSR

SEQ ID NO: 1877522 - protein, 24 aa, Staphylococcus
ISLIIAIVFFFGMRTYQGHKNLDL

SEQ ID NO: 1877523 - protein, 18 aa, Staphylococcus
ISLIIPIITAIVMFGLRK

SEQ ID NO: 1877524 - protein, 20 aa, Staphylococcus
ISLIITFLFMTPKYEATTQI

SEQ ID NO: 1877525 - protein, 25 aa, Staphylococcus
ISLILAIVFFFGLKSYQGHKNIELM

SEQ ID NO: 1877526 - protein, 25 aa, Staphylococcus
ISLISIIISVVFVRFVNTKKRKMRK

SEQ ID NO: 1877527 - protein, 18 aa, Staphylococcus
ISLISLYIAFAGKIPKSR

SEQ ID NO: 1877528 - protein, 31 aa, Staphylococcus
ISLPAAGKVLKLSVLPFAIIALVIGSTLIWV

SEQ ID NO: 1877529 - protein, 21 aa, Staphylococcus
ISLSILVSAVFIKNQIYFKDH

SEQ ID NO: 1877530 - protein, 24 aa, Staphylococcus
ISLSVLILDWLKKIPNFYYKTNNF

SEQ ID NO: 1877531 - protein, 21 aa, Staphylococcus
ISLVLAIAFFFGTKAYQGHKN

SEQ ID NO: 1877532 - protein, 19 aa, Staphylococcus
ISLWLIKKITAYATKKLLE

SEQ ID NO: 1877533 - protein, 24 aa, Staphylococcus
ISMFGINIATSFSIPRMLESVAEK

SEQ ID NO: 1877534 - protein, 32 aa, Staphylococcus
ISMIGVVISLYFILRRLFAIKHGKYKVQRSKA

SEQ ID NO: 1877535 - protein, 17 aa, Staphylococcus
ISNFKALAILSSDALSS

SEQ ID NO: 1877536 - protein, 21 aa, Staphylococcus
ISNLTSWRVTLLFIVLISTLT

SEQ ID NO: 1877537 - protein, 26 aa, Staphylococcus
ISPIYFRFTVYWPFFSDVFIWLPLLL

SEQ ID NO: 1877538 - protein, 26 aa, Staphylococcus
ISPLYFRFTVYWPFFSDVFIFMPLLL

SEQ ID NO: 1877539 - protein, 17 aa, Staphylococcus
ISPMIGLFMSIVMILVI

SEQ ID NO: 1877540 - protein, 17 aa, Staphylococcus
ISPRKAVEALYFNRYLK

SEQ ID NO: 1877541 - protein, 17 aa, Staphylococcus
ISPVFSIIFLIVIYLTI

SEQ ID NO: 1877542 - protein, 23 aa, Staphylococcus
ISPYLPFTYAIDALRETVGGIVP

SEQ ID NO: 1877543 - protein, 21 aa, Staphylococcus
ISPYLPFTYVIDSLRETVGGI

SEQ ID NO: 1877544 - protein, 19 aa, Staphylococcus
ISQHIKLKVDGKVRTYVLL

SEQ ID NO: 1877545 - protein, 17 aa, Staphylococcus
ISQLGAEFDLDLAEKNL

SEQ ID NO: 1877546 - protein, 25 aa, Staphylococcus
ISQRLKFILKVPMINTYFKLFKTYQ

SEQ ID NO: 1877547 - protein, 26 aa, Staphylococcus
ISQYQDYFLQFNWFQPLLIGLAGLLI

SEQ ID NO: 1877548 - protein, 23 aa, Staphylococcus
ISRFFRMFYLRFKARKNLRKQEY

SEQ ID NO: 1877549 - protein, 20 aa, Staphylococcus
ISRVYKWTELDSQFVEGIKI

SEQ ID NO: 1877550 - protein, 18 aa, Staphylococcus
ISRVYKWYELDEQFVDGI

SEQ ID NO: 1877551 - protein, 18 aa, Staphylococcus
ISSFKLILTRVLALIILS

SEQ ID NO: 1877552 - protein, 21 aa, Staphylococcus
ISSFLSWQFIFVISIALSIIA

SEQ ID NO: 1877553 - protein, 18 aa, Staphylococcus
ISSLIIRAIFYKKTNQSL

SEQ ID NO: 1877554 - protein, 17 aa, Staphylococcus
ISSLLGWQGGMQSKKYK

SEQ ID NO: 1877555 - protein, 22 aa, Staphylococcus
ISSLPWFIMFILILSAGAISDK

SEQ ID NO: 1877556 - protein, 18 aa, Staphylococcus
ISSQLIVFIPFPKTIAYD

SEQ ID NO: 1877557 - protein, 21 aa, Staphylococcus
ISSRIPRTVSILISGSSIALA

SEQ ID NO: 1877558 - protein, 24 aa, Staphylococcus
ISTALFLLCFYFLPNLNRYNETRS

SEQ ID NO: 1877559 - protein, 17 aa, Staphylococcus
ISTEMFGKFEVLTMVLV

SEQ ID NO: 1877560 - protein, 18 aa, Staphylococcus
ISTFLGFEPNNYELFIFT

SEQ ID NO: 1877561 - protein, 21 aa, Staphylococcus
ISTIIISWIWFILLAILGKIL

SEQ ID NO: 1877562 - protein, 20 aa, Staphylococcus
ISTIMVSWIWFISLAILGKT

SEQ ID NO: 1877563 - protein, 18 aa, Staphylococcus
ISTLFLILAILLLIGLSF

SEQ ID NO: 1877564 - protein, 18 aa, Staphylococcus
ISTLLVSFIIMFVGIQVV

SEQ ID NO: 1877565 - protein, 22 aa, Staphylococcus
ISTLLVSFIIMFVGIQVVIENA

SEQ ID NO: 1877566 - protein, 21 aa, Staphylococcus
ISTLLVSFIIMFVGIQVVTEN

SEQ ID NO: 1877567 - protein, 21 aa, Staphylococcus
ISTLYTGVGVLRTDEGTVISL

SEQ ID NO: 1877568 - protein, 25 aa, Staphylococcus
ISTMLASICGFLFLAADPAKEGGFL

SEQ ID NO: 1877569 - protein, 26 aa, Staphylococcus
ISTMMAAMCGFLFLAADPVKDGGFLS

SEQ ID NO: 1877570 - protein, 18 aa, Staphylococcus
ISTPYALLFFDLLVVLIS

SEQ ID NO: 1877571 - protein, 19 aa, Staphylococcus
ISTSVSLTFQFPAVTQTVL

SEQ ID NO: 1877572 - protein, 25 aa, Staphylococcus
ISTSYSIYESSVFSEINSLSHSAST

SEQ ID NO: 1877573 - protein, 32 aa, Staphylococcus
ISTTLLNIFHGWPWYAVWLVLLGFGGGMIIPA

SEQ ID NO: 1877574 - protein, 20 aa, Staphylococcus
ISTWRSIFVILTIITIIVII

SEQ ID NO: 1877575 - protein, 17 aa, Staphylococcus
ISTYKGILVQGFDSETN

SEQ ID NO: 1877576 - protein, 22 aa, Staphylococcus
ISVAVGAFFKAFWKENGASIVN

SEQ ID NO: 1877577 - protein, 25 aa, Staphylococcus
ISVDLIRWLPDLDLPLMDGLYLHML

SEQ ID NO: 1877578 - protein, 27 aa, Staphylococcus
ISVDLIRWLPELDLPLMDGLYLHMLLW

SEQ ID NO: 1877579 - protein, 17 aa, Staphylococcus
ISVDTMNSILFNDSVVV

SEQ ID NO: 1877580 - protein, 20 aa, Staphylococcus
ISVLCCILITGILIYSLNDI

SEQ ID NO: 1877581 - protein, 19 aa, Staphylococcus
ISWGQWFLYAAPWSVLMSI

SEQ ID NO: 1877582 - protein, 19 aa, Staphylococcus
ISWIVLVVLMIGYFVSEWL

SEQ ID NO: 1877583 - protein, 21 aa, Staphylococcus
ISYGGSSLWSLMAGIGVILSI

SEQ ID NO: 1877584 - protein, 17 aa, Staphylococcus
ISYISGLIEAFKQNIIV

SEQ ID NO: 1877585 - protein, 25 aa, Staphylococcus
ISYNIIRMGLGIMVLVGTVLLVNQQ

SEQ ID NO: 1877586 - protein, 22 aa, Staphylococcus
ITAFAGSFAYVYFMHGVLGFDF

SEQ ID NO: 1877587 - protein, 17 aa, Staphylococcus
ITAKIYRDGELKEVKIK

SEQ ID NO: 1877588 - protein, 28 aa, Staphylococcus
ITALKKNWKLFILIPVVFVVISLLITIF

SEQ ID NO: 1877589 - protein, 20 aa, Staphylococcus
ITALVSIIFYTLTKVRCPLF

SEQ ID NO: 1877590 - protein, 27 aa, Staphylococcus
ITALWLSVLCAFLGLANALFMFYYSAQ

SEQ ID NO: 1877591 - protein, 19 aa, Staphylococcus
ITAWITALLIKHPKFNQKH

SEQ ID NO: 1877592 - protein, 18 aa, Staphylococcus
ITAWITAWLIHRHPDKTA

SEQ ID NO: 1877593 - protein, 49 aa, Staphylococcus
ITDLKRVAKTPAVWVILTGLAILPSFYAWFNLWAMWDPYSHTGHIKVAV

SEQ ID NO: 1877594 - protein, 49 aa, Staphylococcus
ITDLKRVAKTPGVWVILAGLAILPSFYAWFNLWAMWDPYGNTGHIKVAV

SEQ ID NO: 1877595 - protein, 17 aa, Staphylococcus
ITDMRLIGIRERLVKEK

SEQ ID NO: 1877596 - protein, 18 aa, Staphylococcus
ITEIFGIDISHQLEQVSG

SEQ ID NO: 1877597 - protein, 21 aa, Staphylococcus
ITESIFTLFAFIAPLIYFIFN

SEQ ID NO: 1877598 - protein, 24 aa, Staphylococcus
ITEVKRPWLPPLPENVYQDELMTT

SEQ ID NO: 1877599 - protein, 24 aa, Staphylococcus
ITFATALFCIVVFTLYRELSHIDF

SEQ ID NO: 1877600 - protein, 27 aa, Staphylococcus
ITFEGNNRYGATTSWKDNRQPDKNVAG

SEQ ID NO: 1877601 - protein, 19 aa, Staphylococcus
ITFFTRVSFADFFLTMDWN

SEQ ID NO: 1877602 - protein, 19 aa, Staphylococcus
ITFFTRVSIVEFLFTKDWN

SEQ ID NO: 1877603 - protein, 17 aa, Staphylococcus
ITFIVFMIFLITKFSHV

SEQ ID NO: 1877604 - protein, 18 aa, Staphylococcus
ITFIVFMIFLITKFSHVW

SEQ ID NO: 1877605 - protein, 18 aa, Staphylococcus
ITFSHTLLLFSFITKTVS

SEQ ID NO: 1877606 - protein, 18 aa, Staphylococcus
ITFSIIFAILTVIFLVGL

SEQ ID NO: 1877607 - protein, 26 aa, Staphylococcus
ITFSSKRLLKIAIVFYGLKLNIDEIL

SEQ ID NO: 1877608 - protein, 22 aa, Staphylococcus
ITFSTLFLFVLNELMWFDMTQT

SEQ ID NO: 1877609 - protein, 23 aa, Staphylococcus
ITFVDIWHFFSLVNRYENEDKVD

SEQ ID NO: 1877610 - protein, 20 aa, Staphylococcus
ITFYKFRYILITLIIILLAS

SEQ ID NO: 1877611 - protein, 25 aa, Staphylococcus
ITGAGCLLGAVVGAFLFRNTHPSIE

SEQ ID NO: 1877612 - protein, 20 aa, Staphylococcus
ITGAGCLLGGIVASFLFREE

SEQ ID NO: 1877613 - protein, 19 aa, Staphylococcus
ITGAGCLLGGVVASFLFRN

SEQ ID NO: 1877614 - protein, 28 aa, Staphylococcus
ITGAGCLLGSLVAGFLFRNTHPSLQVLE

SEQ ID NO: 1877615 - protein, 20 aa, Staphylococcus
ITGFCFLLALFFSPLIEVVT

SEQ ID NO: 1877616 - protein, 19 aa, Staphylococcus
ITGFIGFLVLYLLAPSIAG

SEQ ID NO: 1877617 - protein, 23 aa, Staphylococcus
ITGMTCAACANRIEKNLNKLDDV

SEQ ID NO: 1877618 - protein, 21 aa, Staphylococcus
ITGMTCAACSNKVEKNLNKLD

SEQ ID NO: 1877619 - protein, 22 aa, Staphylococcus
ITGMTCAACSNRIEKKLNKLDN

SEQ ID NO: 1877620 - protein, 23 aa, Staphylococcus
ITGMTCAACSNRIEKKLNRLDDV

SEQ ID NO: 1877621 - protein, 23 aa, Staphylococcus
ITGMTCAACSNRIEKRLNKMDNV

SEQ ID NO: 1877622 - protein, 22 aa, Staphylococcus
ITGMTCAACSNRIEKVLNKMDG

SEQ ID NO: 1877623 - protein, 24 aa, Staphylococcus
ITGMTCAACSNRIEKVLSKQPGVN

SEQ ID NO: 1877624 - protein, 18 aa, Staphylococcus
ITGSLGIKAKNPADGKIV

SEQ ID NO: 1877625 - protein, 25 aa, Staphylococcus
ITGTRLSIKLKLYIGTFGALVTMIG

SEQ ID NO: 1877626 - protein, 19 aa, Staphylococcus
ITGVLGFIILYALSPMIAT

SEQ ID NO: 1877627 - protein, 22 aa, Staphylococcus
ITGWTYWLTWIISGMAEVTAVA

SEQ ID NO: 1877628 - protein, 20 aa, Staphylococcus
ITHAHAYGGPIAAMDTVEAT

SEQ ID NO: 1877629 - protein, 19 aa, Staphylococcus
ITHKGRYTSGADFGNGGTE

SEQ ID NO: 1877630 - protein, 22 aa, Staphylococcus
ITHRASATFIVLPGVKKGGYLG

SEQ ID NO: 1877631 - protein, 21 aa, Staphylococcus
ITHRGSATFLVLPGVKKGGYL

SEQ ID NO: 1877632 - protein, 30 aa, Staphylococcus
ITHSIPFTILWPILITFIIFVIFKQTNPLH

SEQ ID NO: 1877633 - protein, 30 aa, Staphylococcus
ITHSIPFTILWPILITFIIYVLFPGVDTTH

SEQ ID NO: 1877634 - protein, 30 aa, Staphylococcus
ITHSIPFTILWPILITFLIFVIFNHTNPLH

SEQ ID NO: 1877635 - protein, 30 aa, Staphylococcus
ITHSIPFTILWPILITFLIFVIFNNTNPLH

SEQ ID NO: 1877636 - protein, 30 aa, Staphylococcus
ITHSIPFTILWPILLAFIIYVIFPHVDVTH

SEQ ID NO: 1877637 - protein, 24 aa, Staphylococcus
ITHSIPFTILWPLFITLLIFTFFK

SEQ ID NO: 1877638 - protein, 18 aa, Staphylococcus
ITHTAYWSTIIISIIVLL

SEQ ID NO: 1877639 - protein, 19 aa, Staphylococcus
ITIARAMLKDAPIVLLDEA

SEQ ID NO: 1877640 - protein, 21 aa, Staphylococcus
ITIFILLWIAVRSYKNTILSF

SEQ ID NO: 1877641 - protein, 18 aa, Staphylococcus
ITIGIFFYFVMSFVAALL

SEQ ID NO: 1877642 - protein, 18 aa, Staphylococcus
ITIGLLFGLAMDYEVFLM

SEQ ID NO: 1877643 - protein, 17 aa, Staphylococcus
ITIIALIFIGKRPKIKR

SEQ ID NO: 1877644 - protein, 24 aa, Staphylococcus
ITIIPALMIGFFIRKFDPRYPKLG

SEQ ID NO: 1877645 - protein, 18 aa, Staphylococcus
ITIISFIGLGVIIHHTIY

SEQ ID NO: 1877646 - protein, 19 aa, Staphylococcus
ITILAPWTLPGPIGALFAT

SEQ ID NO: 1877647 - protein, 26 aa, Staphylococcus
ITIYAVSAGYKWFFAYPDQKVETVNT

SEQ ID NO: 1877648 - protein, 20 aa, Staphylococcus
ITKPKFSVIYVVLGIGLPVA

SEQ ID NO: 1877649 - protein, 19 aa, Staphylococcus
ITKQERRAMLFANIGLLVV

SEQ ID NO: 1877650 - protein, 17 aa, Staphylococcus
ITKVTWKATGKGIGPNE

SEQ ID NO: 1877651 - protein, 26 aa, Staphylococcus
ITKVVLMLLMFIGRVGLISFIIMISG

SEQ ID NO: 1877652 - protein, 19 aa, Staphylococcus
ITKYPRFLWFNLTEPNIMM

SEQ ID NO: 1877653 - protein, 24 aa, Staphylococcus
ITLAKRWAKGYAITVAVGVVTGTI

SEQ ID NO: 1877654 - protein, 17 aa, Staphylococcus
ITLCSLSLLLSIYKYLA

SEQ ID NO: 1877655 - protein, 18 aa, Staphylococcus
ITLFGNAHAAQAAEQTDN

SEQ ID NO: 1877656 - protein, 19 aa, Staphylococcus
ITLFYSRFVNEVDGVSIML

SEQ ID NO: 1877657 - protein, 24 aa, Staphylococcus
ITLIGGILVWIGWYGFNTGSAYTL

SEQ ID NO: 1877658 - protein, 35 aa, Staphylococcus
ITLIGGILVWLGWYGFNVGSAFTFDQIAMISFVNT

SEQ ID NO: 1877659 - protein, 19 aa, Staphylococcus
ITLILCYLGFQFGLKKRDE

SEQ ID NO: 1877660 - protein, 19 aa, Staphylococcus
ITLLIIWGIRSYYLYRTYE

SEQ ID NO: 1877661 - protein, 26 aa, Staphylococcus
ITLLIVYIVPRFFKAIPAPLIAIILL

SEQ ID NO: 1877662 - protein, 28 aa, Staphylococcus
ITLLPLVFLFLFAWKKVPAIPTLLVGST

SEQ ID NO: 1877663 - protein, 20 aa, Staphylococcus
ITLPAFLGFFAGKRFVPIVT

SEQ ID NO: 1877664 - protein, 18 aa, Staphylococcus
ITLSCLVVGFLPMSIPNL

SEQ ID NO: 1877665 - protein, 23 aa, Staphylococcus
ITLSLKTYFAYYVDFSLGVKGLV

SEQ ID NO: 1877666 - protein, 19 aa, Staphylococcus
ITLVLGKHRRLDWLNKIMY

SEQ ID NO: 1877667 - protein, 21 aa, Staphylococcus
ITLVTAIAVIAIYMLSLKMDA

SEQ ID NO: 1877668 - protein, 24 aa, Staphylococcus
ITLVTAIAVLAIYMLSLKMDAYDT

SEQ ID NO: 1877669 - protein, 27 aa, Staphylococcus
ITMFALLCLILLILFIASMFYFHRITS

SEQ ID NO: 1877670 - protein, 17 aa, Staphylococcus
ITMFFVLNIITPFANAE

SEQ ID NO: 1877671 - protein, 18 aa, Staphylococcus
ITMPNVQWPEVWQAIYET

SEQ ID NO: 1877672 - protein, 18 aa, Staphylococcus
ITMSGLIGAILIIVSDTL

SEQ ID NO: 1877673 - protein, 21 aa, Staphylococcus
ITMTDYCYRNYKDYLKDAIVH

SEQ ID NO: 1877674 - protein, 24 aa, Staphylococcus
ITNFSEIFLVTSIIGSLLIIIGIF

SEQ ID NO: 1877675 - protein, 27 aa, Staphylococcus
ITNRFSPRPVLLYALLVFIVGNMIIAF

SEQ ID NO: 1877676 - protein, 18 aa, Staphylococcus
ITPHIAVAVSGSIYNERV

SEQ ID NO: 1877677 - protein, 24 aa, Staphylococcus
ITPIIIKVSFKFNLVDRPNYRKVH

SEQ ID NO: 1877678 - protein, 24 aa, Staphylococcus
ITPRKAIESLYFNRYLKAGDEVLD

SEQ ID NO: 1877679 - protein, 23 aa, Staphylococcus
ITPTRPIPEGDVYAKAIDNAEHP

SEQ ID NO: 1877680 - protein, 17 aa, Staphylococcus
ITPTRPIPEGNVTAKAI

SEQ ID NO: 1877681 - protein, 19 aa, Staphylococcus
ITPTRPIPVGNVSAKAYDN

SEQ ID NO: 1877682 - protein, 19 aa, Staphylococcus
ITQINWWFVIALSVGGMIA

SEQ ID NO: 1877683 - protein, 20 aa, Staphylococcus
ITQINWWLVVALSIGGMAAA

SEQ ID NO: 1877684 - protein, 25 aa, Staphylococcus
ITQNLYRLVLKYLTWYIQTVKGRIK

SEQ ID NO: 1877685 - protein, 17 aa, Staphylococcus
ITSFIAVNFSWYYLLLV

SEQ ID NO: 1877686 - protein, 18 aa, Staphylococcus
ITSFPAFLIFFITILILI

SEQ ID NO: 1877687 - protein, 21 aa, Staphylococcus
ITSIFYWFFFVLIINYTAAYA

SEQ ID NO: 1877688 - protein, 21 aa, Staphylococcus
ITSIVYWFFLIFMINYTVAFA

SEQ ID NO: 1877689 - protein, 21 aa, Staphylococcus
ITSKLKFHPLLALLLTAIFVG

SEQ ID NO: 1877690 - protein, 26 aa, Staphylococcus
ITSLPEYWLAIIFIYYFGVKWHLFPF

SEQ ID NO: 1877691 - protein, 27 aa, Staphylococcus
ITSPWMLLKLVIVWTLVQFFEGHFISP

SEQ ID NO: 1877692 - protein, 17 aa, Staphylococcus
ITSYIFGILLCYLGGKI

SEQ ID NO: 1877693 - protein, 18 aa, Staphylococcus
ITTFLSMAYILAVNPQVL

SEQ ID NO: 1877694 - protein, 19 aa, Staphylococcus
ITTIFCYFVHPSFNELKNM

SEQ ID NO: 1877695 - protein, 24 aa, Staphylococcus
ITTPECIAGILGLIMMMLGYYMST

SEQ ID NO: 1877696 - protein, 31 aa, Staphylococcus
ITTSKAFELLWFFLMFHLFFGLLLYLFSLIV

SEQ ID NO: 1877697 - protein, 24 aa, Staphylococcus
ITVAPVFLVPLIVERKRIKDHPDV

SEQ ID NO: 1877698 - protein, 19 aa, Staphylococcus
ITVGYVFNLFKFGKYIVGG

SEQ ID NO: 1877699 - protein, 23 aa, Staphylococcus
ITVICCLMLVFAAGVASIVIIMV

SEQ ID NO: 1877700 - protein, 34 aa, Staphylococcus
ITVILFSALVSFLFANVYYHFNLKAHNDAKIMRT

SEQ ID NO: 1877701 - protein, 17 aa, Staphylococcus
ITVISFVILVFLEGVFP

SEQ ID NO: 1877702 - protein, 17 aa, Staphylococcus
ITVLLGAVKLMMPTLIR

SEQ ID NO: 1877703 - protein, 25 aa, Staphylococcus
ITVLPVILVPLIVERKRIKDHPDVQ

SEQ ID NO: 1877704 - protein, 18 aa, Staphylococcus
ITVPEIIGGILGILMIAL

SEQ ID NO: 1877705 - protein, 20 aa, Staphylococcus
ITVPELIAGILGIIMIIFGY

SEQ ID NO: 1877706 - protein, 18 aa, Staphylococcus
ITVPKGQDGHSIGIQEIT

SEQ ID NO: 1877707 - protein, 19 aa, Staphylococcus
ITVVVAWLGLLLYTLNKAG

SEQ ID NO: 1877708 - protein, 18 aa, Staphylococcus
ITWKGVEKTIPWGTIIVF

SEQ ID NO: 1877709 - protein, 18 aa, Staphylococcus
ITYIGLWLSIIGSLLIII

SEQ ID NO: 1877710 - protein, 27 aa, Staphylococcus
ITYTISMNWSLEVARALIGGIGIVLTI

SEQ ID NO: 1877711 - protein, 28 aa, Staphylococcus
ITYTISMNWSLEVARAMTGGIGIVLTIP

SEQ ID NO: 1877712 - protein, 20 aa, Staphylococcus
IVAACVTFIFGSIRVNSMGV

SEQ ID NO: 1877713 - protein, 20 aa, Staphylococcus
IVAACVTFIFGSLRVNSAGV

SEQ ID NO: 1877714 - protein, 22 aa, Staphylococcus
IVAACVTFLFGSIRVNGAGVNL

SEQ ID NO: 1877715 - protein, 20 aa, Staphylococcus
IVAACVTFLFGSLRVNSIGV

SEQ ID NO: 1877716 - protein, 22 aa, Staphylococcus
IVAACVTFLFGSLRVNSIGVNL

SEQ ID NO: 1877717 - protein, 20 aa, Staphylococcus
IVAAILYFILTFTLSRVMYY

SEQ ID NO: 1877718 - protein, 20 aa, Staphylococcus
IVAAVLRLALGSATVAAIST

SEQ ID NO: 1877719 - protein, 17 aa, Staphylococcus
IVAFGEWLVGFGSFGAF

SEQ ID NO: 1877720 - protein, 17 aa, Staphylococcus
IVAFGKWIINFGPFGAF

SEQ ID NO: 1877721 - protein, 24 aa, Staphylococcus
IVAGGIELMSAVPMGGNEPTNNPI

SEQ ID NO: 1877722 - protein, 26 aa, Staphylococcus
IVAGGIPGLLGLLLLPYTKLITVGIG

SEQ ID NO: 1877723 - protein, 17 aa, Staphylococcus
IVAGILFIIYLGAFIGF

SEQ ID NO: 1877724 - protein, 26 aa, Staphylococcus
IVAIAVGLLLVWLVVTFVAKSYTIKG

SEQ ID NO: 1877725 - protein, 28 aa, Staphylococcus
IVAIAVGLLLVWVMVNFVAKSYTIKGDS

SEQ ID NO: 1877726 - protein, 19 aa, Staphylococcus
IVAIIAIVIIVFFALKYAP

SEQ ID NO: 1877727 - protein, 17 aa, Staphylococcus
IVAILGGIDEIVWFFIA

SEQ ID NO: 1877728 - protein, 22 aa, Staphylococcus
IVAKIIVIWFFRKYSNQMRGSV

SEQ ID NO: 1877729 - protein, 20 aa, Staphylococcus
IVALFPLFSISVRRFHDCGR

SEQ ID NO: 1877730 - protein, 18 aa, Staphylococcus
IVALLVERIHRFKILIYL

SEQ ID NO: 1877731 - protein, 24 aa, Staphylococcus
IVALSMMVSFVFIKNQIYFQDHQD

SEQ ID NO: 1877732 - protein, 23 aa, Staphylococcus
IVAWFYWLTWTVALGSEFTAVGI

SEQ ID NO: 1877733 - protein, 18 aa, Staphylococcus
IVCVGAIFLASSMGSTFS

SEQ ID NO: 1877734 - protein, 23 aa, Staphylococcus
IVDETLCTFWQGVDYTIDMNALP

SEQ ID NO: 1877735 - protein, 19 aa, Staphylococcus
IVDFNMFINKIINRHEMSA

SEQ ID NO: 1877736 - protein, 20 aa, Staphylococcus
IVDFNMFINKIINRHEMSAK

SEQ ID NO: 1877737 - protein, 20 aa, Staphylococcus
IVDFNMYINKIINRHEMAAK

SEQ ID NO: 1877738 - protein, 18 aa, Staphylococcus
IVDIVVAHYFYKKALKNS

SEQ ID NO: 1877739 - protein, 25 aa, Staphylococcus
IVDRLKQAFNQHGLVSSDDILNDIL

SEQ ID NO: 1877740 - protein, 17 aa, Staphylococcus
IVEELLFRHLLIHELGK

SEQ ID NO: 1877741 - protein, 19 aa, Staphylococcus
IVEEMVCRGLLMGYIEKKT

SEQ ID NO: 1877742 - protein, 17 aa, Staphylococcus
IVEIPVSISEDIDHVEE

SEQ ID NO: 1877743 - protein, 17 aa, Staphylococcus
IVEKAGCLDVMLNTVSK

SEQ ID NO: 1877744 - protein, 17 aa, Staphylococcus
IVEPLALSDEEFLTRYK

SEQ ID NO: 1877745 - protein, 18 aa, Staphylococcus
IVERDKDNDIYVLPDTGN

SEQ ID NO: 1877746 - protein, 19 aa, Staphylococcus
IVFFALKYAPFLKDQEWNP

SEQ ID NO: 1877747 - protein, 18 aa, Staphylococcus
IVFFCIFLILSPIGKLKL

SEQ ID NO: 1877748 - protein, 29 aa, Staphylococcus
IVFFILYYVIFRFVIQFFNLNTIGRGDNE

SEQ ID NO: 1877749 - protein, 17 aa, Staphylococcus
IVFFPIFYIGHLVTKEQ

SEQ ID NO: 1877750 - protein, 25 aa, Staphylococcus
IVFIFVIIVLRLGYLQIAQGSHYKQ

SEQ ID NO: 1877751 - protein, 17 aa, Staphylococcus
IVFIGIFSIYTGLNQTP

SEQ ID NO: 1877752 - protein, 19 aa, Staphylococcus
IVFILLCVGLVFLQKDVGQ

SEQ ID NO: 1877753 - protein, 17 aa, Staphylococcus
IVFIVLCVFNVRPNVST

SEQ ID NO: 1877754 - protein, 17 aa, Staphylococcus
IVFLFVFGVGTANIALS

SEQ ID NO: 1877755 - protein, 19 aa, Staphylococcus
IVFNFWLYLIIFWFVPLLT

SEQ ID NO: 1877756 - protein, 19 aa, Staphylococcus
IVGASLSFIKLVKVNPIQA

SEQ ID NO: 1877757 - protein, 19 aa, Staphylococcus
IVGFILFMFMRAMGELLLS

SEQ ID NO: 1877758 - protein, 23 aa, Staphylococcus
IVGGFILFFLLKFSHVMTPEMTN

SEQ ID NO: 1877759 - protein, 19 aa, Staphylococcus
IVGGLIGWIAGAILGKDIP

SEQ ID NO: 1877760 - protein, 19 aa, Staphylococcus
IVGHWKMLGIYLISGIFGN

SEQ ID NO: 1877761 - protein, 17 aa, Staphylococcus
IVGIPIFLVIMWLIFQA

SEQ ID NO: 1877762 - protein, 19 aa, Staphylococcus
IVGISMWFFINEGVLEGSK

SEQ ID NO: 1877763 - protein, 17 aa, Staphylococcus
IVGIVRLFNGIDIVSIF

SEQ ID NO: 1877764 - protein, 20 aa, Staphylococcus
IVGLIVWWFEYRYRISNTRE

SEQ ID NO: 1877765 - protein, 18 aa, Staphylococcus
IVGLLGVIDLCINLKQLM

SEQ ID NO: 1877766 - protein, 18 aa, Staphylococcus
IVGLTTFLGPLITKIVGL

SEQ ID NO: 1877767 - protein, 20 aa, Staphylococcus
IVGPLRMLGIYVISGLLGNF

SEQ ID NO: 1877768 - protein, 18 aa, Staphylococcus
IVGPRHQLFLPIAVLVGA

SEQ ID NO: 1877769 - protein, 18 aa, Staphylococcus
IVGPRPALYNQYELIEKR

SEQ ID NO: 1877770 - protein, 18 aa, Staphylococcus
IVGTMTVLFQFVLVYLLI

SEQ ID NO: 1877771 - protein, 17 aa, Staphylococcus
IVGVVFSALFFATKISN

SEQ ID NO: 1877772 - protein, 17 aa, Staphylococcus
IVHRDIKPQNILIDKNK

SEQ ID NO: 1877773 - protein, 19 aa, Staphylococcus
IVHYFFDLMVSMGIFCFIV

SEQ ID NO: 1877774 - protein, 19 aa, Staphylococcus
IVHYYFDLMVSMGVFCLVV

SEQ ID NO: 1877775 - protein, 17 aa, Staphylococcus
IVIAAGWGLAVSMGAYA

SEQ ID NO: 1877776 - protein, 22 aa, Staphylococcus
IVIAISIFGLFQLGIIGRAVDS

SEQ ID NO: 1877777 - protein, 17 aa, Staphylococcus
IVIALGWGLAVSMGAYA

SEQ ID NO: 1877778 - protein, 31 aa, Staphylococcus
IVIDWRMACAMLITIPISFFAFKKLMSGFND

SEQ ID NO: 1877779 - protein, 17 aa, Staphylococcus
IVIGIAGALAWSLLGQV

SEQ ID NO: 1877780 - protein, 23 aa, Staphylococcus
IVIGISACTATFVNDTGGDSDNN

SEQ ID NO: 1877781 - protein, 17 aa, Staphylococcus
IVIGMSFLMMAITGQAQ

SEQ ID NO: 1877782 - protein, 24 aa, Staphylococcus
IVIIICLILKISTVPSMLVSALSA

SEQ ID NO: 1877783 - protein, 19 aa, Staphylococcus
IVIIIKFILAWILQPIFWI

SEQ ID NO: 1877784 - protein, 25 aa, Staphylococcus
IVIIMMIVYIALRYAPFLRDQEWNP

SEQ ID NO: 1877785 - protein, 18 aa, Staphylococcus
IVIIVFFALKYAPFLKDQ

SEQ ID NO: 1877786 - protein, 26 aa, Staphylococcus
IVIKEMLTEPVTIYFSEIEEVIIENR

SEQ ID NO: 1877787 - protein, 17 aa, Staphylococcus
IVIKPGEKIPVDGVIIK

SEQ ID NO: 1877788 - protein, 27 aa, Staphylococcus
IVIKVFKLEVKWPFWLSQIGLILLGVQ

SEQ ID NO: 1877789 - protein, 19 aa, Staphylococcus
IVILLCLIIFLKLNTFISL

SEQ ID NO: 1877790 - protein, 17 aa, Staphylococcus
IVIPLMINQEVAGTLKF

SEQ ID NO: 1877791 - protein, 28 aa, Staphylococcus
IVISAILVAIGWRLIWKKQIDKHKKVML

SEQ ID NO: 1877792 - protein, 29 aa, Staphylococcus
IVISAILVAIGWRLIWKRQIDKHKKVMLW

SEQ ID NO: 1877793 - protein, 19 aa, Staphylococcus
IVISAILVAIGWWQIAHRH

SEQ ID NO: 1877794 - protein, 19 aa, Staphylococcus
IVISAVLARQAMIKMDNYV

SEQ ID NO: 1877795 - protein, 17 aa, Staphylococcus
IVISMVFILLGNINKTF

SEQ ID NO: 1877796 - protein, 25 aa, Staphylococcus
IVIVACLKTAIGLITAFSETFTELF

SEQ ID NO: 1877797 - protein, 20 aa, Staphylococcus
IVIVSGVIPFNIIKGIVISI

SEQ ID NO: 1877798 - protein, 19 aa, Staphylococcus
IVKENFKEKRFMIKPNHTY

SEQ ID NO: 1877799 - protein, 18 aa, Staphylococcus
IVKPEFSSSVIPSIAGLF

SEQ ID NO: 1877800 - protein, 17 aa, Staphylococcus
IVKPKIDTKYEFKAGGK

SEQ ID NO: 1877801 - protein, 23 aa, Staphylococcus
IVKRDFWLIPGYLIINIVLPLIL

SEQ ID NO: 1877802 - protein, 18 aa, Staphylococcus
IVKRDFWLIVAYLIVGQF

SEQ ID NO: 1877803 - protein, 20 aa, Staphylococcus
IVKSQPKRIFETTINGQFVF

SEQ ID NO: 1877804 - protein, 27 aa, Staphylococcus
IVKSVLLPFILSGFLFYVFLPLQKLLE

SEQ ID NO: 1877805 - protein, 21 aa, Staphylococcus
IVKSYPMVPGIDLAGTIEETN

SEQ ID NO: 1877806 - protein, 24 aa, Staphylococcus
IVLGGPGAVFWMWIIASIGAASAF

SEQ ID NO: 1877807 - protein, 25 aa, Staphylococcus
IVLGGPGAVFWMWVIAFIGAASAFI

SEQ ID NO: 1877808 - protein, 25 aa, Staphylococcus
IVLGGPGAVFWMWVIAFIGAASAFM

SEQ ID NO: 1877809 - protein, 17 aa, Staphylococcus
IVLGTAIYTHVANLVIL

SEQ ID NO: 1877810 - protein, 26 aa, Staphylococcus
IVLIFVLIVLRLGYLQIAQGAHYSQL

SEQ ID NO: 1877811 - protein, 17 aa, Staphylococcus
IVLIILCCVVFIVITPF

SEQ ID NO: 1877812 - protein, 18 aa, Staphylococcus
IVLIKRRFLLAIWLPTTV

SEQ ID NO: 1877813 - protein, 17 aa, Staphylococcus
IVLKLPIPIVAILFCIT

SEQ ID NO: 1877814 - protein, 18 aa, Staphylococcus
IVLLCINHKDILRNDRRY

SEQ ID NO: 1877815 - protein, 17 aa, Staphylococcus
IVLLFAGIFIANALLSG

SEQ ID NO: 1877816 - protein, 17 aa, Staphylococcus
IVLLFLVWIYIRYIAFK

SEQ ID NO: 1877817 - protein, 24 aa, Staphylococcus
IVLLIIFIHWWVKYLGFKRNEDLK

SEQ ID NO: 1877818 - protein, 27 aa, Staphylococcus
IVLLLFGLFGFMAMGMFGNKYLETPDL

SEQ ID NO: 1877819 - protein, 26 aa, Staphylococcus
IVLLTIPVLFLFPFVQKHFVKGINIG

SEQ ID NO: 1877820 - protein, 17 aa, Staphylococcus
IVLMLRATLNFINQLLG

SEQ ID NO: 1877821 - protein, 23 aa, Staphylococcus
IVLPICIFVYMLSSNKTHKEERS

SEQ ID NO: 1877822 - protein, 17 aa, Staphylococcus
IVLPIILIQIFGYGEDT

SEQ ID NO: 1877823 - protein, 18 aa, Staphylococcus
IVLPLAGGMVIGRLTAKA

SEQ ID NO: 1877824 - protein, 22 aa, Staphylococcus
IVLPPLTAMVFIKLGYHPIAGL

SEQ ID NO: 1877825 - protein, 17 aa, Staphylococcus
IVLSFVWPPVQDGLNNL

SEQ ID NO: 1877826 - protein, 18 aa, Staphylococcus
IVLTSILSRFGISVSAIL

SEQ ID NO: 1877827 - protein, 17 aa, Staphylococcus
IVLVFSFIILYLYSKVQ

SEQ ID NO: 1877828 - protein, 20 aa, Staphylococcus
IVLVLARFITAYAKNRLQES

SEQ ID NO: 1877829 - protein, 17 aa, Staphylococcus
IVLYEMLVGEPPFSGET

SEQ ID NO: 1877830 - protein, 31 aa, Staphylococcus
IVMEGFLRLSIPNWLRRLITRGLAVIPVIIC

SEQ ID NO: 1877831 - protein, 31 aa, Staphylococcus
IVMEGFLRLSIPNWLRRLITRSLAVIPVIIC

SEQ ID NO: 1877832 - protein, 17 aa, Staphylococcus
IVMGLYFVLRYQIGGGI

SEQ ID NO: 1877833 - protein, 27 aa, Staphylococcus
IVMLIAICLWLLIGALFYLANFFFSHT

SEQ ID NO: 1877834 - protein, 19 aa, Staphylococcus
IVMYLAIAVGIVYVYMKSQ

SEQ ID NO: 1877835 - protein, 19 aa, Staphylococcus
IVNDKSVVINFKIFEKGIY

SEQ ID NO: 1877836 - protein, 22 aa, Staphylococcus
IVNEIKPDIVIDANKDKVSQVA

SEQ ID NO: 1877837 - protein, 23 aa, Staphylococcus
IVNIIVALLMFRGGDTSHNINMR

SEQ ID NO: 1877838 - protein, 21 aa, Staphylococcus
IVNRLFGGLILEIKVPSDSIK

SEQ ID NO: 1877839 - protein, 25 aa, Staphylococcus
IVNRWQKCYLLIIGVLLSVMSSILG

SEQ ID NO: 1877840 - protein, 23 aa, Staphylococcus
IVNVWIFKFFVDVIGMNSFSIFL

SEQ ID NO: 1877841 - protein, 25 aa, Staphylococcus
IVNVWIFKFFVDVLKMNSFSIFLPW

SEQ ID NO: 1877842 - protein, 22 aa, Staphylococcus
IVPALSSTFFKNGINEKRKRSL

SEQ ID NO: 1877843 - protein, 22 aa, Staphylococcus
IVPEPYKQLILLGMILESTTLL

SEQ ID NO: 1877844 - protein, 30 aa, Staphylococcus
IVPETIVKINARQLLLNAINNKKQEALENK

SEQ ID NO: 1877845 - protein, 24 aa, Staphylococcus
IVPKLAFEIPFRYKIMGIVGSVWG

SEQ ID NO: 1877846 - protein, 17 aa, Staphylococcus
IVPNYVMGLSFITEGAI

SEQ ID NO: 1877847 - protein, 23 aa, Staphylococcus
IVPTRPIPEGNVTAVATDDSGNS

SEQ ID NO: 1877848 - protein, 23 aa, Staphylococcus
IVQKGAMIGAIFLFIIIIIFLMY

SEQ ID NO: 1877849 - protein, 19 aa, Staphylococcus
IVQNGEPNVRGVLASDNGS

SEQ ID NO: 1877850 - protein, 19 aa, Staphylococcus
IVQYFLRRGENVKRPVNEK

SEQ ID NO: 1877851 - protein, 20 aa, Staphylococcus
IVRNVFKYRQSIMMKAQSDV

SEQ ID NO: 1877852 - protein, 25 aa, Staphylococcus
IVRPVEIIKFLAITLLILIANSVTF

SEQ ID NO: 1877853 - protein, 25 aa, Staphylococcus
IVSFCFIFLLLLFFRYILKRYFNYM

SEQ ID NO: 1877854 - protein, 23 aa, Staphylococcus
IVSFCIGILLFIGYSIIGLDYSL

SEQ ID NO: 1877855 - protein, 23 aa, Staphylococcus
IVSFCIGILLFIGYTIIGLDYSL

SEQ ID NO: 1877856 - protein, 21 aa, Staphylococcus
IVSGGRAPLLFLIITILIFLL

SEQ ID NO: 1877857 - protein, 23 aa, Staphylococcus
IVSGIILALAINWKSLTHRMIKQ

SEQ ID NO: 1877858 - protein, 17 aa, Staphylococcus
IVSIAVALIIVGIVVKF

SEQ ID NO: 1877859 - protein, 18 aa, Staphylococcus
IVSLAVIIGLKISIKPAD

SEQ ID NO: 1877860 - protein, 17 aa, Staphylococcus
IVSLFAWGLGYFGQPHI

SEQ ID NO: 1877861 - protein, 25 aa, Staphylococcus
IVSLFLIKKVTAFFTKKLLEYKFNK

SEQ ID NO: 1877862 - protein, 18 aa, Staphylococcus
IVSLYLIRLVTGYFTKKL

SEQ ID NO: 1877863 - protein, 27 aa, Staphylococcus
IVSRWQKCYLLIIGAMFALLSSILGFY

SEQ ID NO: 1877864 - protein, 21 aa, Staphylococcus
IVSVLACIFANVGLTKIIMYS

SEQ ID NO: 1877865 - protein, 22 aa, Staphylococcus
IVTFCLPMNLPIAPDQALVRGL

SEQ ID NO: 1877866 - protein, 17 aa, Staphylococcus
IVTFILMVLMYRFFGKH

SEQ ID NO: 1877867 - protein, 25 aa, Staphylococcus
IVTFVLRLTPYGILAIMTSTIATSD

SEQ ID NO: 1877868 - protein, 22 aa, Staphylococcus
IVTGFCFLLALFFSPLIAVVTS

SEQ ID NO: 1877869 - protein, 18 aa, Staphylococcus
IVTIPLVLLVVTLIIPIL

SEQ ID NO: 1877870 - protein, 18 aa, Staphylococcus
IVTKERKHHDILVTAIHG

SEQ ID NO: 1877871 - protein, 19 aa, Staphylococcus
IVTKMYYKLINAFVEDVQF

SEQ ID NO: 1877872 - protein, 20 aa, Staphylococcus
IVTLCISLVLVTVVFILLWR

SEQ ID NO: 1877873 - protein, 20 aa, Staphylococcus
IVTLCRLVMYEEFVGTPMIY

SEQ ID NO: 1877874 - protein, 24 aa, Staphylococcus
IVTLKIRWLDWLFIVGTLLLCITY

SEQ ID NO: 1877875 - protein, 18 aa, Staphylococcus
IVTMFVIGIIFIVLFVIR

SEQ ID NO: 1877876 - protein, 28 aa, Staphylococcus
IVVAEILMGIVIGHSFLNLVERDAMLNI

SEQ ID NO: 1877877 - protein, 20 aa, Staphylococcus
IVVAIFIVRNMMQPKNDDQT

SEQ ID NO: 1877878 - protein, 23 aa, Staphylococcus
IVVAVICLILFIVALKSKKKAQE

SEQ ID NO: 1877879 - protein, 17 aa, Staphylococcus
IVVGISLILVAIVSVYL

SEQ ID NO: 1877880 - protein, 29 aa, Staphylococcus
IVVGLILQYVFKLPLLVTAVIGVLMGMLI

SEQ ID NO: 1877881 - protein, 24 aa, Staphylococcus
IVVIIALIALFLILKSQFSPEKQA

SEQ ID NO: 1877882 - protein, 26 aa, Staphylococcus
IVVLAVIGIIGFHFYNNATSYVTTDN

SEQ ID NO: 1877883 - protein, 27 aa, Staphylococcus
IVVLVIIGVVGFHFYNQATGFVSTDNA

SEQ ID NO: 1877884 - protein, 19 aa, Staphylococcus
IVVMLINFILIYVADPLSL

SEQ ID NO: 1877885 - protein, 17 aa, Staphylococcus
IVVSILSLTPILTIISG

SEQ ID NO: 1877886 - protein, 22 aa, Staphylococcus
IVVSIWLHLIIQRFLKTYASDL

SEQ ID NO: 1877887 - protein, 24 aa, Staphylococcus
IVVSYLNWHWVYFILTILYLTLTF

SEQ ID NO: 1877888 - protein, 28 aa, Staphylococcus
IVVVAIICIFAFDLKRMLKGFDVSMSHI

SEQ ID NO: 1877889 - protein, 19 aa, Staphylococcus
IVYACALFGVQGLYSAGVY

SEQ ID NO: 1877890 - protein, 39 aa, Staphylococcus
IVYFIICLLISFLALISMNIRILSGILFLVASVVTLPLV

SEQ ID NO: 1877891 - protein, 20 aa, Staphylococcus
IVYIMWCVILITLVTELHTL

SEQ ID NO: 1877892 - protein, 18 aa, Staphylococcus
IVYLFILIFKRSWLDKRV

SEQ ID NO: 1877893 - protein, 30 aa, Staphylococcus
IVYLIVCLLISFLALISMNIRVLSGILFLI

SEQ ID NO: 1877894 - protein, 17 aa, Staphylococcus
IVYMHITGILGLKLIGT

SEQ ID NO: 1877895 - protein, 25 aa, Staphylococcus
IVYNVDVLHFWPAVINIIAAFIGNY

SEQ ID NO: 1877896 - protein, 21 aa, Staphylococcus
IVYPFEINIGLTIGVFGTVIF

SEQ ID NO: 1877897 - protein, 25 aa, Staphylococcus
IWAAAVCSLIRLRRGIKAQGLDANK

SEQ ID NO: 1877898 - protein, 25 aa, Staphylococcus
IWAVPCYLCAILAIIYGFTGIGIRK

SEQ ID NO: 1877899 - protein, 18 aa, Staphylococcus
IWAWLLVLVFLPIVGFIL

SEQ ID NO: 1877900 - protein, 25 aa, Staphylococcus
IWAYIICFSMYIATFILGLFFRKTL

SEQ ID NO: 1877901 - protein, 22 aa, Staphylococcus
IWDCLLRPWLMNRQHGYLLKTH

SEQ ID NO: 1877902 - protein, 19 aa, Staphylococcus
IWFVVPIIIVIALAIPTVK

SEQ ID NO: 1877903 - protein, 18 aa, Staphylococcus
IWFVVPIIIVIALSIPTV

SEQ ID NO: 1877904 - protein, 19 aa, Staphylococcus
IWFVVPILIVIALAIPTVK

SEQ ID NO: 1877905 - protein, 23 aa, Staphylococcus
IWFYLKSIIILVVYEFGMALLLF

SEQ ID NO: 1877906 - protein, 23 aa, Staphylococcus
IWGDEWAFVIAFLPWIIVLIPFL

SEQ ID NO: 1877907 - protein, 24 aa, Staphylococcus
IWGDEWAFVLAFLPWIVIILPYLL

SEQ ID NO: 1877908 - protein, 20 aa, Staphylococcus
IWITNLMYIIAIVVSGIKPL

SEQ ID NO: 1877909 - protein, 17 aa, Staphylococcus
IWIVLLIFNLINTFLVL

SEQ ID NO: 1877910 - protein, 17 aa, Staphylococcus
IWIVLLVFNLINTFLVL

SEQ ID NO: 1877911 - protein, 26 aa, Staphylococcus
IWKEASWQFMMFILLGGIAYTIGAWF

SEQ ID NO: 1877912 - protein, 24 aa, Staphylococcus
IWKRPFRFQWQWRENDIESQVWKR

SEQ ID NO: 1877913 - protein, 25 aa, Staphylococcus
IWLDCITIVIALSIMFFLDVKLTFA

SEQ ID NO: 1877914 - protein, 25 aa, Staphylococcus
IWLDCITIVIALTIMFYLNVKLTLA

SEQ ID NO: 1877915 - protein, 19 aa, Staphylococcus
IWLLGSFAFGFYISNFGNY

SEQ ID NO: 1877916 - protein, 20 aa, Staphylococcus
IWMMVGFILFGAISSLVSAI

SEQ ID NO: 1877917 - protein, 22 aa, Staphylococcus
IWRGTIYGGLAFAVGFSTIVAI

SEQ ID NO: 1877918 - protein, 25 aa, Staphylococcus
IWTIPCYICAIIAVIYGFTGIGIKK

SEQ ID NO: 1877919 - protein, 25 aa, Staphylococcus
IWTVPCYLCALIAITYGFTGIGIKK

SEQ ID NO: 1877920 - protein, 17 aa, Staphylococcus
IWVGILFMIAVHILVAR

SEQ ID NO: 1877921 - protein, 18 aa, Staphylococcus
IWYFYKDEINIIGVVIGL

SEQ ID NO: 1877922 - protein, 17 aa, Staphylococcus
IWYIISSVVGYLLFGTG

SEQ ID NO: 1877923 - protein, 17 aa, Staphylococcus
IYAICLILGVIGMAVFI

SEQ ID NO: 1877924 - protein, 23 aa, Staphylococcus
IYAIRPSLLYVFVALICSVVIGA

SEQ ID NO: 1877925 - protein, 30 aa, Staphylococcus
IYAIRSVLWRHIIHLKMPFFDQNESGQLMS

SEQ ID NO: 1877926 - protein, 17 aa, Staphylococcus
IYALRLVAISLLMMPIN

SEQ ID NO: 1877927 - protein, 17 aa, Staphylococcus
IYAMAGAVWPNGGRQTF

SEQ ID NO: 1877928 - protein, 24 aa, Staphylococcus
IYDFGIGIAAFFALYVPTQLLTSK

SEQ ID NO: 1877929 - protein, 24 aa, Staphylococcus
IYDLIEILVLIPISLIITIASAIT

SEQ ID NO: 1877930 - protein, 18 aa, Staphylococcus
IYESAAIDGANRFKQIIH

SEQ ID NO: 1877931 - protein, 17 aa, Staphylococcus
IYFFVFRYLILKFDIPL

SEQ ID NO: 1877932 - protein, 19 aa, Staphylococcus
IYFGTGCFAFYMHMSGEEK

SEQ ID NO: 1877933 - protein, 22 aa, Staphylococcus
IYFHKVRGLLAFWIGALLIAFT

SEQ ID NO: 1877934 - protein, 20 aa, Staphylococcus
IYFHKVRGLLSFWIGTLLIA

SEQ ID NO: 1877935 - protein, 18 aa, Staphylococcus
IYFSIQLIVFVYIGINIA

SEQ ID NO: 1877936 - protein, 17 aa, Staphylococcus
IYFSIQLIVLIYIGISI

SEQ ID NO: 1877937 - protein, 19 aa, Staphylococcus
IYGGGAFLFLFLIFTIFVG

SEQ ID NO: 1877938 - protein, 24 aa, Staphylococcus
IYGGSFMYRFRKIIVPQFISGYSM

SEQ ID NO: 1877939 - protein, 18 aa, Staphylococcus
IYHGTFVIHVQWKLLGYF

SEQ ID NO: 1877940 - protein, 17 aa, Staphylococcus
IYHKLRYKTKIIPLDKV

SEQ ID NO: 1877941 - protein, 29 aa, Staphylococcus
IYHSFLLKKWHLFFYLILMMCAFLTALLV

SEQ ID NO: 1877942 - protein, 25 aa, Staphylococcus
IYHSFLLKKWYLFLYLFLMIIALIT

SEQ ID NO: 1877943 - protein, 23 aa, Staphylococcus
IYHSFLLKKWYLFVYLILIVLSL

SEQ ID NO: 1877944 - protein, 18 aa, Staphylococcus
IYHSINWLTTAHMGLMSA

SEQ ID NO: 1877945 - protein, 17 aa, Staphylococcus
IYIATLFHAAMSFGLVF

SEQ ID NO: 1877946 - protein, 23 aa, Staphylococcus
IYIFGCVYFYFIMNFVANTPITV

SEQ ID NO: 1877947 - protein, 17 aa, Staphylococcus
IYIFPALLGSIILIFVV

SEQ ID NO: 1877948 - protein, 22 aa, Staphylococcus
IYIIDLLCVMFATQPSTFQSIV

SEQ ID NO: 1877949 - protein, 18 aa, Staphylococcus
IYIIKWIYIMIVKYLKWN

SEQ ID NO: 1877950 - protein, 21 aa, Staphylococcus
IYILYQFLFKRNREIHTHVGK

SEQ ID NO: 1877951 - protein, 30 aa, Staphylococcus
IYINVYKNGSEWSVDQVIEGIILNAHTGEI

SEQ ID NO: 1877952 - protein, 19 aa, Staphylococcus
IYIPKEFSHQITGTLRKKP

SEQ ID NO: 1877953 - protein, 17 aa, Staphylococcus
IYISLRLIFIVMIATIM

SEQ ID NO: 1877954 - protein, 18 aa, Staphylococcus
IYITCFIIIIGAEINAII

SEQ ID NO: 1877955 - protein, 17 aa, Staphylococcus
IYIVFIVFFILKNRQNK

SEQ ID NO: 1877956 - protein, 21 aa, Staphylococcus
IYIVHGYRSGVNYAEKHAKDI

SEQ ID NO: 1877957 - protein, 18 aa, Staphylococcus
IYIVYSVFNFKNEAFVTD

SEQ ID NO: 1877958 - protein, 17 aa, Staphylococcus
IYKFGSDQIKVYRTEIE

SEQ ID NO: 1877959 - protein, 27 aa, Staphylococcus
IYKGKTETYRFLLIDTPETKHPRVGKQ

SEQ ID NO: 1877960 - protein, 26 aa, Staphylococcus
IYKKDYKSGTVFAILCWLVISVAIFV

SEQ ID NO: 1877961 - protein, 19 aa, Staphylococcus
IYKKIKHICVGIFVVFSII

SEQ ID NO: 1877962 - protein, 23 aa, Staphylococcus
IYKNFSFSLLFLIIIFVFQKEFS

SEQ ID NO: 1877963 - protein, 18 aa, Staphylococcus
IYKRRKMAKEEGLALTSG

SEQ ID NO: 1877964 - protein, 27 aa, Staphylococcus
IYLAVVVIICCSYLIMILVGSFQGNDM

SEQ ID NO: 1877965 - protein, 22 aa, Staphylococcus
IYLFYSPRLKFDVLENPNKDST

SEQ ID NO: 1877966 - protein, 23 aa, Staphylococcus
IYLFYSPRLKFDVLENPNKKAPT

SEQ ID NO: 1877967 - protein, 23 aa, Staphylococcus
IYLFYSPRLKFDVLENPNKNHKT

SEQ ID NO: 1877968 - protein, 23 aa, Staphylococcus
IYLFYSPRLKFDVLENPNKSNKS

SEQ ID NO: 1877969 - protein, 23 aa, Staphylococcus
IYLFYSPRLKFDVLENPNKTVST

SEQ ID NO: 1877970 - protein, 23 aa, Staphylococcus
IYLFYSPRLKFDVLENPNNNNKI

SEQ ID NO: 1877971 - protein, 17 aa, Staphylococcus
IYLGIKVAIFDDCEGEK

SEQ ID NO: 1877972 - protein, 23 aa, Staphylococcus
IYLGKLIARRKFNVLHRSVYKGL

SEQ ID NO: 1877973 - protein, 18 aa, Staphylococcus
IYLGLKVAIFDDCEGEKR

SEQ ID NO: 1877974 - protein, 18 aa, Staphylococcus
IYLIIAIGIIYIFIHQNR

SEQ ID NO: 1877975 - protein, 17 aa, Staphylococcus
IYLNFALTLVGMVLFAL

SEQ ID NO: 1877976 - protein, 19 aa, Staphylococcus
IYLPKNVNICFTTEEKMAI

SEQ ID NO: 1877977 - protein, 20 aa, Staphylococcus
IYLQNLRGFSALDSGLLLLP

SEQ ID NO: 1877978 - protein, 20 aa, Staphylococcus
IYLQNLRGFTAIDSGLLMLP

SEQ ID NO: 1877979 - protein, 17 aa, Staphylococcus
IYLTLMAIDLITVLIII

SEQ ID NO: 1877980 - protein, 17 aa, Staphylococcus
IYLTPIWFIILGLMYLR

SEQ ID NO: 1877981 - protein, 25 aa, Staphylococcus
IYLVLKRPFKLTAFKAQNIERNKVV

SEQ ID NO: 1877982 - protein, 18 aa, Staphylococcus
IYLVWVIGLFIGLMYGIL

SEQ ID NO: 1877983 - protein, 18 aa, Staphylococcus
IYMFSMFNLIFISHFPNF

SEQ ID NO: 1877984 - protein, 18 aa, Staphylococcus
IYNGGFYLISLVTLFVIA

SEQ ID NO: 1877985 - protein, 20 aa, Staphylococcus
IYNMILSGFLKRTFEQDLNS

SEQ ID NO: 1877986 - protein, 32 aa, Staphylococcus
IYNNVRGSFSLLSWPFKELVTTDKQSVPVGIT

SEQ ID NO: 1877987 - protein, 19 aa, Staphylococcus
IYNRFPKIPTAFIQIALGV

SEQ ID NO: 1877988 - protein, 26 aa, Staphylococcus
IYPIITFRFEHIPNLIEIVIGIYSHI

SEQ ID NO: 1877989 - protein, 17 aa, Staphylococcus
IYPVFGALLLVSAVGIG

SEQ ID NO: 1877990 - protein, 20 aa, Staphylococcus
IYPYLCLSIFVIGHIARYKY

SEQ ID NO: 1877991 - protein, 17 aa, Staphylococcus
IYQGEALAIIGEPGASK

SEQ ID NO: 1877992 - protein, 18 aa, Staphylococcus
IYQGEALGIIGEGDSSKS

SEQ ID NO: 1877993 - protein, 19 aa, Staphylococcus
IYRTYRVTKEYEISALRGE

SEQ ID NO: 1877994 - protein, 19 aa, Staphylococcus
IYSDLLRYNKCILMTQSFI

SEQ ID NO: 1877995 - protein, 29 aa, Staphylococcus
IYSQRKIDVEPVFGFMKAILGFTRMSVRG

SEQ ID NO: 1877996 - protein, 33 aa, Staphylococcus
IYSQRKIDVEPVFGFMKAILVFTRMSVRGLNKV

SEQ ID NO: 1877997 - protein, 24 aa, Staphylococcus
IYTFPLMLIVGFIIIFLFIWVIFK

SEQ ID NO: 1877998 - protein, 19 aa, Staphylococcus
IYTGVIVLIGFVLMYLVLF

SEQ ID NO: 1877999 - protein, 18 aa, Staphylococcus
IYTVVLVTGGKDVGADSF

SEQ ID NO: 1878000 - protein, 25 aa, Staphylococcus
IYTYASALLLSWLIVMFAILVAAYR

SEQ ID NO: 1878001 - protein, 24 aa, Staphylococcus
IYTYASLILLSWILLIFILLILAY

SEQ ID NO: 1878002 - protein, 17 aa, Staphylococcus
IYWRLIGNISAFEILAY

SEQ ID NO: 1878003 - protein, 17 aa, Staphylococcus
KAAEIILNLMRVSAVAI

SEQ ID NO: 1878004 - protein, 17 aa, Staphylococcus
KAARQLLPKEVRDDHRF

SEQ ID NO: 1878005 - protein, 27 aa, Staphylococcus
KADALEALKKLGFEKISMNQEYSKMKL

SEQ ID NO: 1878006 - protein, 27 aa, Staphylococcus
KADASLSQFVKIWPYVEGKIQTKNSSL

SEQ ID NO: 1878007 - protein, 20 aa, Staphylococcus
KADDLLQLKHRLDQAQHQAD

SEQ ID NO: 1878008 - protein, 17 aa, Staphylococcus
KADEVIRDGSAQLTNIV

SEQ ID NO: 1878009 - protein, 26 aa, Staphylococcus
KADHEIRMGKYYAGIYIPKKFTHQIT

SEQ ID NO: 1878010 - protein, 22 aa, Staphylococcus
KAFGETEFWLSLVKVVTIIIFI

SEQ ID NO: 1878011 - protein, 20 aa, Staphylococcus
KAFGSRAQAIYNFLTNSFGW

SEQ ID NO: 1878012 - protein, 18 aa, Staphylococcus
KAFIPLFILGMLFWSIQE

SEQ ID NO: 1878013 - protein, 18 aa, Staphylococcus
KAFIPLLIPLFISAFQRG

SEQ ID NO: 1878014 - protein, 17 aa, Staphylococcus
KAFPVILISLLVIRTII

SEQ ID NO: 1878015 - protein, 19 aa, Staphylococcus
KAFTGYAMMQLVEAHKINL

SEQ ID NO: 1878016 - protein, 20 aa, Staphylococcus
KAFTLIEMLLVLLIISVLLI

SEQ ID NO: 1878017 - protein, 17 aa, Staphylococcus
KAFWKTTFKVLIPSITG

SEQ ID NO: 1878018 - protein, 23 aa, Staphylococcus
KAGELTALIGVIAGCFIFPPFGI

SEQ ID NO: 1878019 - protein, 19 aa, Staphylococcus
KAGFLGTVGLVGSLIFINK

SEQ ID NO: 1878020 - protein, 18 aa, Staphylococcus
KAGIGTWINNDISMLTKK

SEQ ID NO: 1878021 - protein, 18 aa, Staphylococcus
KAGLLKPVMEKLNSKTNV

SEQ ID NO: 1878022 - protein, 30 aa, Staphylococcus
KAHHPIEFDMIWKALLIPSIGYIVGLALGL

SEQ ID NO: 1878023 - protein, 32 aa, Staphylococcus
KAHHPIEFNMIWKAMLIPSLGYIVGLILGMFY

SEQ ID NO: 1878024 - protein, 32 aa, Staphylococcus
KAHHPIEFNMIWKAMLIPSLGYIVGLVIGLFV

SEQ ID NO: 1878025 - protein, 26 aa, Staphylococcus
KAHHPIEFNMIWKAMLIPSMGYIAGL

SEQ ID NO: 1878026 - protein, 26 aa, Staphylococcus
KAHHPIEFNMIWKAMLIPSMGYIVGL

SEQ ID NO: 1878027 - protein, 28 aa, Staphylococcus
KAHHPIEFSMIWKAMLIPSMGYIVGLIL

SEQ ID NO: 1878028 - protein, 31 aa, Staphylococcus
KAHHPIEMGMIWKAMIIPSLGYIVGLILGIY

SEQ ID NO: 1878029 - protein, 19 aa, Staphylococcus
KAHILKYQFINQQNNPPFI

SEQ ID NO: 1878030 - protein, 18 aa, Staphylococcus
KAHSEGVKKIVLDLRNNP

SEQ ID NO: 1878031 - protein, 19 aa, Staphylococcus
KAIAANALKEQADKVQDMI

SEQ ID NO: 1878032 - protein, 18 aa, Staphylococcus
KAIACVYSLIIVIGFSLI

SEQ ID NO: 1878033 - protein, 18 aa, Staphylococcus
KAIDYKKPLIMLVIQVLL

SEQ ID NO: 1878034 - protein, 24 aa, Staphylococcus
KAIEALYYNRYLKRNDAVTSVRLG

SEQ ID NO: 1878035 - protein, 17 aa, Staphylococcus
KAIFCNFFINIGIYVSM

SEQ ID NO: 1878036 - protein, 25 aa, Staphylococcus
KAIGRASVVPTFFGVNEPILFGAPL

SEQ ID NO: 1878037 - protein, 22 aa, Staphylococcus
KAIHLIFFIPYYKSFKKYKLLR

SEQ ID NO: 1878038 - protein, 18 aa, Staphylococcus
KAIIMFIMIVWFFIDVFV

SEQ ID NO: 1878039 - protein, 17 aa, Staphylococcus
KAIKISWGIYFKTGIVI

SEQ ID NO: 1878040 - protein, 25 aa, Staphylococcus
KAIKLPDKVKNGVVIKQIDTDSLGE

SEQ ID NO: 1878041 - protein, 23 aa, Staphylococcus
KAIKRMPIGLVVIDADDHIEWIN

SEQ ID NO: 1878042 - protein, 26 aa, Staphylococcus
KAILYFEIITTIAIGLGLIIGNLFKP

SEQ ID NO: 1878043 - protein, 20 aa, Staphylococcus
KAILYFEIITTVAIGLGIII

SEQ ID NO: 1878044 - protein, 18 aa, Staphylococcus
KAIRRFKKNDIPASMMPA

SEQ ID NO: 1878045 - protein, 19 aa, Staphylococcus
KAISIRTWNAIKNGVINAI

SEQ ID NO: 1878046 - protein, 18 aa, Staphylococcus
KAKAKFDVDKAAKARENV

SEQ ID NO: 1878047 - protein, 23 aa, Staphylococcus
KAKELLLSGLEKLEYRGYDSAGI

SEQ ID NO: 1878048 - protein, 24 aa, Staphylococcus
KAKIDRLKYLQATDIKSYKEDIED

SEQ ID NO: 1878049 - protein, 31 aa, Staphylococcus
KAKKNTKKQCKIMKTNWLKKNMNNNKQNKLK

SEQ ID NO: 1878050 - protein, 21 aa, Staphylococcus
KAKLAEMLKGFTIVVEEPKVL

SEQ ID NO: 1878051 - protein, 20 aa, Staphylococcus
KAKPYLLTLLYLAIFIALYL

SEQ ID NO: 1878052 - protein, 22 aa, Staphylococcus
KAKRLPNVVTIILMVIGTLLTP

SEQ ID NO: 1878053 - protein, 18 aa, Staphylococcus
KAKSIAFRDVKNHFVRNE

SEQ ID NO: 1878054 - protein, 20 aa, Staphylococcus
KAKTINNAMHTLRQNITDNA

SEQ ID NO: 1878055 - protein, 18 aa, Staphylococcus
KAKVYRDGKVINIDIKLK

SEQ ID NO: 1878056 - protein, 17 aa, Staphylococcus
KALKMTMIVGFISTLLS

SEQ ID NO: 1878057 - protein, 17 aa, Staphylococcus
KALLEFAKKRATAKLEV

SEQ ID NO: 1878058 - protein, 23 aa, Staphylococcus
KALLEILKSLNWINDKGATFAIL

SEQ ID NO: 1878059 - protein, 24 aa, Staphylococcus
KALLKEANRLGVKLENEIPTINKI

SEQ ID NO: 1878060 - protein, 18 aa, Staphylococcus
KALMLPVAILPAAGLLLA

SEQ ID NO: 1878061 - protein, 17 aa, Staphylococcus
KAMKIGLTALGYKVDNE

SEQ ID NO: 1878062 - protein, 27 aa, Staphylococcus
KAMSGYIVCVYGIFSFLIPATIIFFNH

SEQ ID NO: 1878063 - protein, 22 aa, Staphylococcus
KANEIILAQRLERILSKEEIIY

SEQ ID NO: 1878064 - protein, 19 aa, Staphylococcus
KANELVLSMRAENLLTKDE

SEQ ID NO: 1878065 - protein, 21 aa, Staphylococcus
KANILKFMAPLSFVLASLAIY

SEQ ID NO: 1878066 - protein, 26 aa, Staphylococcus
KAPIFKAMMHFSLPMMIGTLLSVIYG

SEQ ID NO: 1878067 - protein, 21 aa, Staphylococcus
KAQHGIGLSIIKDAVNYHHGS

SEQ ID NO: 1878068 - protein, 17 aa, Staphylococcus
KARELVEQAKTEAKNNI

SEQ ID NO: 1878069 - protein, 23 aa, Staphylococcus
KARKEERAQLKAERSEEKKRKKE

SEQ ID NO: 1878070 - protein, 18 aa, Staphylococcus
KARLRFNINDGKATSYEQ

SEQ ID NO: 1878071 - protein, 20 aa, Staphylococcus
KARMLCDFLLTLSSSAILPF

SEQ ID NO: 1878072 - protein, 19 aa, Staphylococcus
KARRIKQDGSYEMIDASDL

SEQ ID NO: 1878073 - protein, 18 aa, Staphylococcus
KASEMPSFGLSILTAVLP

SEQ ID NO: 1878074 - protein, 25 aa, Staphylococcus
KASGQRINAIKVLNKENGEYEDLDP

SEQ ID NO: 1878075 - protein, 22 aa, Staphylococcus
KASIALYCTYLFAKHLTKHHLI

SEQ ID NO: 1878076 - protein, 24 aa, Staphylococcus
KASKTRLFIYVQFTALLIAISSSL

SEQ ID NO: 1878077 - protein, 24 aa, Staphylococcus
KASNGSGIGLYFANEVIKQYNSEI

SEQ ID NO: 1878078 - protein, 18 aa, Staphylococcus
KASPEFFVNTSFAQWLIA

SEQ ID NO: 1878079 - protein, 21 aa, Staphylococcus
KATEFPRIQLFMKSYTGMNNW

SEQ ID NO: 1878080 - protein, 25 aa, Staphylococcus
KATQYEMYHSLGLIGIGILSGTTKM

SEQ ID NO: 1878081 - protein, 18 aa, Staphylococcus
KATVYAILGNVLGFVIVA

SEQ ID NO: 1878082 - protein, 17 aa, Staphylococcus
KAVAKEQVNGLVQNTTT

SEQ ID NO: 1878083 - protein, 27 aa, Staphylococcus
KAVEAGKAIPHWDLFGLHINQVGYQGQ

SEQ ID NO: 1878084 - protein, 27 aa, Staphylococcus
KAVEAGKAIPHWDVFGLHINQVGYQGQ

SEQ ID NO: 1878085 - protein, 20 aa, Staphylococcus
KAVLNIPLIVAFHTAGAILS

SEQ ID NO: 1878086 - protein, 21 aa, Staphylococcus
KAYETYQYLVFHSMDTPFNRD

SEQ ID NO: 1878087 - protein, 24 aa, Staphylococcus
KAYGEDRFENEFEFQDKMKDESYL

SEQ ID NO: 1878088 - protein, 19 aa, Staphylococcus
KAYIKNRITNFRFSLFTKI

SEQ ID NO: 1878089 - protein, 23 aa, Staphylococcus
KAYKEYQTAIILTGETDVIVQDN

SEQ ID NO: 1878090 - protein, 25 aa, Staphylococcus
KAYRDYRFQNVFNYSLLMIGVLCVG

SEQ ID NO: 1878091 - protein, 19 aa, Staphylococcus
KCDHCGRKLGWFELVPIFS

SEQ ID NO: 1878092 - protein, 18 aa, Staphylococcus
KCNHTLQFLDLIPIISFI

SEQ ID NO: 1878093 - protein, 22 aa, Staphylococcus
KDALVDIIFWSAIFGFITARIY

SEQ ID NO: 1878094 - protein, 19 aa, Staphylococcus
KDDFSPISLNVFLSEKVLV

SEQ ID NO: 1878095 - protein, 26 aa, Staphylococcus
KDDSLNHIAKIVIWDTDQQPSILHRP

SEQ ID NO: 1878096 - protein, 22 aa, Staphylococcus
KDDTWLLWAIIIVWATVSLFLE

SEQ ID NO: 1878097 - protein, 23 aa, Staphylococcus
KDEKGRASSMLLAGSYFGPVLAP

SEQ ID NO: 1878098 - protein, 17 aa, Staphylococcus
KDELEQAKHDLILDYDA

SEQ ID NO: 1878099 - protein, 25 aa, Staphylococcus
KDEMLNILSTLGFIFLMFLSGLEID

SEQ ID NO: 1878100 - protein, 20 aa, Staphylococcus
KDFHSSLNIIQWAITGYMLA

SEQ ID NO: 1878101 - protein, 17 aa, Staphylococcus
KDFILGIGLAIIILIIF

SEQ ID NO: 1878102 - protein, 17 aa, Staphylococcus
KDFLKSGIPLTIIGYIL

SEQ ID NO: 1878103 - protein, 19 aa, Staphylococcus
KDFNIEYSQVQWLTTAFLL

SEQ ID NO: 1878104 - protein, 36 aa, Staphylococcus
KDFWNRWHMSLSFWFRDCIYMRALFYMSKKKLLKSQ

SEQ ID NO: 1878105 - protein, 36 aa, Staphylococcus
KDFWNRWHMSLSFWFRDCIYMRSLFFMSKKRLLKSQ

SEQ ID NO: 1878106 - protein, 37 aa, Staphylococcus
KDFWNRWHMSLSFWFRDCIYMRTLFYMSRKKTFKSQF

SEQ ID NO: 1878107 - protein, 36 aa, Staphylococcus
KDFWNRWHMSLSFWFRDCVYMRTLFYMSRKKIMKNQ

SEQ ID NO: 1878108 - protein, 37 aa, Staphylococcus; identical to SEQ ID NO: 1573116

SEQ ID NO: 1878109 - protein, 37 aa, Staphylococcus
KDFWNRWHMTLSFWFRDCIYMRSLFYMSRKKMFKSQL

SEQ ID NO: 1878110 - protein, 24 aa, Staphylococcus
KDGFFKQKLLTLGIPYIIINLGLA

SEQ ID NO: 1878111 - protein, 21 aa, Staphylococcus
KDGKKFLFFDNYSFNVPQKSV

SEQ ID NO: 1878112 - protein, 19 aa, Staphylococcus
KDGKLMLDKGYGYQNISSK

SEQ ID NO: 1878113 - protein, 20 aa, Staphylococcus
KDGKQVIPKRHYKRKRRAFF

SEQ ID NO: 1878114 - protein, 30 aa, Staphylococcus
KDGSLPAWLPAAIGFLFGGIFIRVLDSVIP

SEQ ID NO: 1878115 - protein, 20 aa, Staphylococcus
KDIAMSIGIIALVGTVFALI

SEQ ID NO: 1878116 - protein, 19 aa, Staphylococcus
KDIAWRDLFLIPIIFVTLL

SEQ ID NO: 1878117 - protein, 27 aa, Staphylococcus
KDIDGKKFKGALMINMSDDATAYESFK

SEQ ID NO: 1878118 - protein, 25 aa, Staphylococcus
KDIEEILSHGIDVWTTLNIQHIESL

SEQ ID NO: 1878119 - protein, 17 aa, Staphylococcus
KDIIPLSFGEEIGNAAS

SEQ ID NO: 1878120 - protein, 17 aa, Staphylococcus
KDIIPLSFGEEIGNSVS

SEQ ID NO: 1878121 - protein, 26 aa, Staphylococcus
KDIIPRGKALLLFAISAILGLGNSLF

SEQ ID NO: 1878122 - protein, 20 aa, Staphylococcus
KDIITGFFIIFENQFDVGDY

SEQ ID NO: 1878123 - protein, 29 aa, Staphylococcus
KDILQSFYFKRYLLRAIMAGFILGVITVF

SEQ ID NO: 1878124 - protein, 23 aa, Staphylococcus
KDIPRYLFFNNIIILSLIVIILM

SEQ ID NO: 1878125 - protein, 21 aa, Staphylococcus
KDIRTFLNFSSIYRWQTRKLD

SEQ ID NO: 1878126 - protein, 18 aa, Staphylococcus
KDISLEVFEELLAEHWFD

SEQ ID NO: 1878127 - protein, 20 aa, Staphylococcus
KDITSFVVPIGYTFNLDGSA

SEQ ID NO: 1878128 - protein, 21 aa, Staphylococcus
KDIVSFVIPIGYTFNLDGSAL

SEQ ID NO: 1878129 - protein, 21 aa, Staphylococcus
KDIYKRLKYNETFHQSSISKL

SEQ ID NO: 1878130 - protein, 17 aa, Staphylococcus
KDKDLLLAILVGVVGGL

SEQ ID NO: 1878131 - protein, 19 aa, Staphylococcus
KDKGFKVGDTLSLSQSDEK

SEQ ID NO: 1878132 - protein, 26 aa, Staphylococcus
KDKKMVKRIIKYREKSGMVIISEGLL

SEQ ID NO: 1878133 - protein, 24 aa, Staphylococcus
KDKPEFKTVSWLAMLFSAGMGIGL

SEQ ID NO: 1878134 - protein, 24 aa, Staphylococcus
KDKPKPAQWAFLSLQHLFAMFGST

SEQ ID NO: 1878135 - protein, 17 aa, Staphylococcus
KDKRFDHHKGIVSNDNA

SEQ ID NO: 1878136 - protein, 26 aa, Staphylococcus
KDKVAYKFMRQWFMFWGPPMIIISLF

SEQ ID NO: 1878137 - protein, 20 aa, Staphylococcus
KDKVHICIDPGHSFTGTVNF

SEQ ID NO: 1878138 - protein, 19 aa, Staphylococcus
KDKVWYPASMTKLMTMYLT

SEQ ID NO: 1878139 - protein, 22 aa, Staphylococcus
KDKYMPRMFIVRGDRLGYSNSI

SEQ ID NO: 1878140 - protein, 18 aa, Staphylococcus
KDLFLAILVSITGSLIAL

SEQ ID NO: 1878141 - protein, 21 aa, Staphylococcus
KDLHSYRMVYDTISVETMNSI

SEQ ID NO: 1878142 - protein, 17 aa, Staphylococcus
KDLKYIRKYATGISPEY

SEQ ID NO: 1878143 - protein, 20 aa, Staphylococcus
KDLMLHRSGLYKFSANPNTK

SEQ ID NO: 1878144 - protein, 18 aa, Staphylococcus
KDLMLYESGLHKYEASTN

SEQ ID NO: 1878145 - protein, 31 aa, Staphylococcus
KDLSRSGVYFKWQILVTLLFVIPCHELYMRT

SEQ ID NO: 1878146 - protein, 22 aa, Staphylococcus
KDMFDIYGGLIFVGTIVSLVLM

SEQ ID NO: 1878147 - protein, 18 aa, Staphylococcus
KDMFKQWTKMAANMTDGD

SEQ ID NO: 1878148 - protein, 18 aa, Staphylococcus
KDMFKQWTKMAAQMTDGD

SEQ ID NO: 1878149 - protein, 23 aa, Staphylococcus
KDMLSSKDGFKFTEEEAQYAVDH

SEQ ID NO: 1878150 - protein, 17 aa, Staphylococcus
KDMPFILLLGFLGFTVY

SEQ ID NO: 1878151 - protein, 17 aa, Staphylococcus
KDMQVSILVNEGSASAS

SEQ ID NO: 1878152 - protein, 19 aa, Staphylococcus
KDMSNRAYIDRLLATHLSN

SEQ ID NO: 1878153 - protein, 20 aa, Staphylococcus
KDNFTPIALNVFLDGKTLIT

SEQ ID NO: 1878154 - protein, 21 aa, Staphylococcus
KDNFYIISIEIVFFHLSKNFM

SEQ ID NO: 1878155 - protein, 26 aa, Staphylococcus
KDNSYDVLMKAFQVDAPVNPGNSGGA

SEQ ID NO: 1878156 - protein, 23 aa, Staphylococcus
KDNYKVTFDNGYRKSDATLTNTE

SEQ ID NO: 1878157 - protein, 17 aa, Staphylococcus
KDPELASYVNFVKSELM

SEQ ID NO: 1878158 - protein, 26 aa, Staphylococcus
KDPKNHPWAKFVVGKPVLAIIISLII

SEQ ID NO: 1878159 - protein, 24 aa, Staphylococcus
KDQARLKFISDIAVEQNHLVTRLT

SEQ ID NO: 1878160 - protein, 24 aa, Staphylococcus
KDQMEFQMLYGFRSDLAQSIANEG

SEQ ID NO: 1878161 - protein, 24 aa, Staphylococcus
KDQMEFQMLYGFRSELAQSIANEG

SEQ ID NO: 1878162 - protein, 20 aa, Staphylococcus
KDRESHGFGLSIINDAVNYH

SEQ ID NO: 1878163 - protein, 25 aa, Staphylococcus
KDRGLDAILDISPIPVVKQAAREAI

SEQ ID NO: 1878164 - protein, 24 aa, Staphylococcus
KDRYEFQMLYGFRSDLAEQIAGEG

SEQ ID NO: 1878165 - protein, 30 aa, Staphylococcus
KDSAMPWLPAAIGFLFGGLFIRGLDFVIPH

SEQ ID NO: 1878166 - protein, 30 aa, Staphylococcus
KDSDVVFENGRYIAHVTIKDADNMTIDAGL

SEQ ID NO: 1878167 - protein, 25 aa, Staphylococcus
KDSMLNILSTLGFIFLMFLSGLEID

SEQ ID NO: 1878168 - protein, 18 aa, Staphylococcus
KDSNFIWYDCIKPTKEER

SEQ ID NO: 1878169 - protein, 17 aa, Staphylococcus
KDSRISKYQDFFLQFNW

SEQ ID NO: 1878170 - protein, 21 aa, Staphylococcus
KDSRLAALLIITSVQAVSIWN

SEQ ID NO: 1878171 - protein, 24 aa, Staphylococcus
KDTKLPVIFWMHGGGYVAGDKQYK

SEQ ID NO: 1878172 - protein, 22 aa, Staphylococcus
KDVESYFLTWVHQIKTPITASQ

SEQ ID NO: 1878173 - protein, 17 aa, Staphylococcus
KDVIKSIKSRGYHLDTD

SEQ ID NO: 1878174 - protein, 18 aa, Staphylococcus
KDVIPFRNGDFITQNYKY

SEQ ID NO: 1878175 - protein, 23 aa, Staphylococcus
KDVKDMKVSILVNEGSASASEVF

SEQ ID NO: 1878176 - protein, 18 aa, Staphylococcus
KDVSAIRPFELIIVVLII

SEQ ID NO: 1878177 - protein, 25 aa, Staphylococcus
KDVTLGDIITVLPFGNTISQIQVKG

SEQ ID NO: 1878178 - protein, 21 aa, Staphylococcus
KDVTSFVIPIGYSFNLDGSAL

SEQ ID NO: 1878179 - protein, 31 aa, Staphylococcus
KDWIPNRLVLLTIHFSFFVVIALIIAYLTQL

SEQ ID NO: 1878180 - protein, 18 aa, Staphylococcus
KDWRLHSIVLVIVIISEV

SEQ ID NO: 1878181 - protein, 49 aa, Staphylococcus
KDYEAHEKKKMSGISKIISTLIVLLLLGGLVFAVFAFVDNSNRVNERLN

SEQ ID NO: 1878182 - protein, 22 aa, Staphylococcus
KDYGSGKERIWIYNLPVKNGNE

SEQ ID NO: 1878183 - protein, 23 aa, Staphylococcus
KDYGSGKERVWVYNIPVKVDKQT

SEQ ID NO: 1878184 - protein, 20 aa, Staphylococcus
KDYHDRIAFLKVLDDDDEDS

SEQ ID NO: 1878185 - protein, 21 aa, Staphylococcus
KDYIKAIGMAVGTAGSAVIFA

SEQ ID NO: 1878186 - protein, 25 aa, Staphylococcus
KDYRLFRWSWLVLSVLFIGYILSEF

SEQ ID NO: 1878187 - protein, 26 aa, Staphylococcus
KEAEKILRQSHLEIGNISRDYSDDYP

SEQ ID NO: 1878188 - protein, 27 aa, Staphylococcus
KEAEKVLKASHLEIGHISREYNDDYPE

SEQ ID NO: 1878189 - protein, 22 aa, Staphylococcus
KEAKDMKFSILVNEGSASASEV

SEQ ID NO: 1878190 - protein, 20 aa, Staphylococcus
KEAKLGLVVPKYMDVNSIED

SEQ ID NO: 1878191 - protein, 20 aa, Staphylococcus
KEALIEAGGTRIRPILMTAV

SEQ ID NO: 1878192 - protein, 19 aa, Staphylococcus
KEALIKTLLSTRLGNNEAS

SEQ ID NO: 1878193 - protein, 21 aa, Staphylococcus
KEAREPADIMSILKQFKSLLQ

SEQ ID NO: 1878194 - protein, 21 aa, Staphylococcus
KEARFLTLYDYMLNIIAMIAI

SEQ ID NO: 1878195 - protein, 19 aa, Staphylococcus
KEATPEAPGIEASEEHVTV

SEQ ID NO: 1878196 - protein, 23 aa, Staphylococcus
KEAVSWKQIISGFFFAFAALTYL

SEQ ID NO: 1878197 - protein, 21 aa, Staphylococcus
KEAYNTKVNLYNYWPNQNTPG

SEQ ID NO: 1878198 - protein, 22 aa, Staphylococcus
KECIPTLLGYIGIGLSFGIVAA

SEQ ID NO: 1878199 - protein, 22 aa, Staphylococcus
KEDGHKLIGIRGMPRVGKTESI

SEQ ID NO: 1878200 - protein, 26 aa, Staphylococcus
KEDILLRFVLSLAIILAIHIGITYAV

SEQ ID NO: 1878201 - protein, 28 aa, Staphylococcus
KEDPSRIAKVRVESVQPNKLVFKLVSGQ

SEQ ID NO: 1878202 - protein, 17 aa, Staphylococcus
KEDRPSLKEGRYPNHSY

SEQ ID NO: 1878203 - protein, 20 aa, Staphylococcus
KEEIRTMLIVAGREGAFNET

SEQ ID NO: 1878204 - protein, 21 aa, Staphylococcus
KEERISELLGHIVWMNTIDLI

SEQ ID NO: 1878205 - protein, 17 aa, Staphylococcus
KEFGGIFATFPAVFLVS

SEQ ID NO: 1878206 - protein, 17 aa, Staphylococcus
KEFGGIFATLPAVFLVS

SEQ ID NO: 1878207 - protein, 22 aa, Staphylococcus
KEFKDGSLLKYTQMKWLTPKDH

SEQ ID NO: 1878208 - protein, 17 aa, Staphylococcus
KEFNIEWLAPDDGLILH

SEQ ID NO: 1878209 - protein, 21 aa, Staphylococcus
KEFSLKIVMNYFKRNLEGSKI

SEQ ID NO: 1878210 - protein, 25 aa, Staphylococcus
KEFTEGIKIMAYIGVVILTANGFAG

SEQ ID NO: 1878211 - protein, 17 aa, Staphylococcus
KEGFLMRKYELASLHLS

SEQ ID NO: 1878212 - protein, 20 aa, Staphylococcus
KEGKGGWTIDDITWIIRVIS

SEQ ID NO: 1878213 - protein, 21 aa, Staphylococcus
KEGKTAMLISVDNELRGVVAV

SEQ ID NO: 1878214 - protein, 19 aa, Staphylococcus
KEGSNLWFDNMVIPKTAQN

SEQ ID NO: 1878215 - protein, 20 aa, Staphylococcus
KEGSNLWFDNMVIPKTAQNK

SEQ ID NO: 1878216 - protein, 19 aa, Staphylococcus
KEGSNVWFDNMVIPKTAQN

SEQ ID NO: 1878217 - protein, 20 aa, Staphylococcus
KEGSVIRKTLGPALLYCLLV

SEQ ID NO: 1878218 - protein, 20 aa, Staphylococcus
KEHGVNRVICRFEAGGERES

SEQ ID NO: 1878219 - protein, 20 aa, Staphylococcus
KEHQSLVVLSLYVLGIVIAL

SEQ ID NO: 1878220 - protein, 21 aa, Staphylococcus
KEHYMISSWVFPNLLIHFVLV

SEQ ID NO: 1878221 - protein, 22 aa, Staphylococcus
KEIHWKSVVILVVVNLFLAWFF

SEQ ID NO: 1878222 - protein, 20 aa, Staphylococcus
KEIIHLCLMKEETLNDVKIT

SEQ ID NO: 1878223 - protein, 22 aa, Staphylococcus
KEIKEADGIIIAADRQVDLSRF

SEQ ID NO: 1878224 - protein, 21 aa, Staphylococcus
KEIKVGKLIQFISFFPTISSG

SEQ ID NO: 1878225 - protein, 21 aa, Staphylococcus
KEIKVGKLIQFISFFPTVSSG

SEQ ID NO: 1878226 - protein, 24 aa, Staphylococcus
KEIKVWKLIQFISFFPTISSGPID

SEQ ID NO: 1878227 - protein, 21 aa, Staphylococcus
KEILEYCYAHIEFSGGSLSLT

SEQ ID NO: 1878228 - protein, 43 aa, Staphylococcus
KEILYIALRLSLIKTLKPYYPFPIIIDDAFVHFDKQRKEIMMN

SEQ ID NO: 1878229 - protein, 18 aa, Staphylococcus
KEIPNFKKIISLSFATAT

SEQ ID NO: 1878230 - protein, 20 aa, Staphylococcus
KEIPPHRKGILGILVAVVLA

SEQ ID NO: 1878231 - protein, 17 aa, Staphylococcus
KEIQRVFVQEGIKLPQP

SEQ ID NO: 1878232 - protein, 17 aa, Staphylococcus
KEITLKDLMLYESGLHK

SEQ ID NO: 1878233 - protein, 21 aa, Staphylococcus
KEITSFVIPIGYTFNLDGSAL

SEQ ID NO: 1878234 - protein, 23 aa, Staphylococcus
KEKDAFEFYGKVQAGITTPTQKT

SEQ ID NO: 1878235 - protein, 18 aa, Staphylococcus
KEKGAYLFDEELVYNYRS

SEQ ID NO: 1878236 - protein, 19 aa, Staphylococcus
KEKGFKLGDTLSLSQSDEK

SEQ ID NO: 1878237 - protein, 22 aa, Staphylococcus
KEKGHKLIGIRGMPRVGKTESI

SEQ ID NO: 1878238 - protein, 21 aa, Staphylococcus
KEKHLKLGNISRSYSDKYAEN

SEQ ID NO: 1878239 - protein, 20 aa, Staphylococcus
KEKIEESSPVTKEEKTNELK

SEQ ID NO: 1878240 - protein, 25 aa, Staphylococcus
KEKKGYKLLWIIISFIVLIAILLLP

SEQ ID NO: 1878241 - protein, 36 aa, Staphylococcus
KEKLRLSFPETRFMKFMGGKDLLFALIMLILIGIAI

SEQ ID NO: 1878242 - protein, 19 aa, Staphylococcus
KEKNAVVILANLNTDATPN

SEQ ID NO: 1878243 - protein, 21 aa, Staphylococcus
KEKRFMIKPNHTYKVNDIKLF

SEQ ID NO: 1878244 - protein, 20 aa, Staphylococcus
KEKYFLIIFMSNAIFGVLQD

SEQ ID NO: 1878245 - protein, 19 aa, Staphylococcus
KEKYGVVSYKTIALSVTYV

SEQ ID NO: 1878246 - protein, 19 aa, Staphylococcus
KELEGKLNIEPLTFPEQGI

SEQ ID NO: 1878247 - protein, 20 aa, Staphylococcus
KELELRSKLVKLIISAVLAA

SEQ ID NO: 1878248 - protein, 18 aa, Staphylococcus
KELESMGLNVQVKTTNRD

SEQ ID NO: 1878249 - protein, 21 aa, Staphylococcus
KELIILIPVSFVLTIASAVTF

SEQ ID NO: 1878250 - protein, 19 aa, Staphylococcus
KELIKDVKITKVIPNTLNV

SEQ ID NO: 1878251 - protein, 20 aa, Staphylococcus
KELKKVIAYKNNNFKAFTLI

SEQ ID NO: 1878252 - protein, 17 aa, Staphylococcus
KELKNKIIASIKSGETC

SEQ ID NO: 1878253 - protein, 31 aa, Staphylococcus
KELKYKAKWFPFGPIFAGILCVIVIIGQDVD

SEQ ID NO: 1878254 - protein, 22 aa, Staphylococcus
KELNNAMKAMRVSIKDQDQVRQ

SEQ ID NO: 1878255 - protein, 17 aa, Staphylococcus
KELNSNIEFTNWQWFIS

SEQ ID NO: 1878256 - protein, 21 aa, Staphylococcus
KELRATAAVERAKSNSSISNI

SEQ ID NO: 1878257 - protein, 19 aa, Staphylococcus
KEMIRLMFHGEKSPTGISS

SEQ ID NO: 1878258 - protein, 19 aa, Staphylococcus
KEMLREFGRGITILKNKNV

SEQ ID NO: 1878259 - protein, 21 aa, Staphylococcus
KEMMKIVVAFIFAGAVVTLVF

SEQ ID NO: 1878260 - protein, 17 aa, Staphylococcus
KEMPIAIVNHDEGINIQ

SEQ ID NO: 1878261 - protein, 19 aa, Staphylococcus
KEMSIKVVMDYFKRNLEGS

SEQ ID NO: 1878262 - protein, 17 aa, Staphylococcus
KENAPEPPIVTVNEKEA

SEQ ID NO: 1878263 - protein, 21 aa, Staphylococcus
KENIYRVIFNIDKGRIRFVKL

SEQ ID NO: 1878264 - protein, 24 aa, Staphylococcus
KENKKRFIALLLLCVMFAICWIAY

SEQ ID NO: 1878265 - protein, 19 aa, Staphylococcus
KENLPVILIIEQSWSKICI

SEQ ID NO: 1878266 - protein, 20 aa, Staphylococcus
KENQALVVLSLYVIGIVVAL

SEQ ID NO: 1878267 - protein, 18 aa, Staphylococcus
KEPDFNAPLVLYMGGGML

SEQ ID NO: 1878268 - protein, 24 aa, Staphylococcus
KEPKRYLVQYALLGFIVVMIYQMF

SEQ ID NO: 1878269 - protein, 20 aa, Staphylococcus
KEPYSQLILFGIIVESITLL

SEQ ID NO: 1878270 - protein, 19 aa, Staphylococcus
KEQGYELITPVIITNSDEF

SEQ ID NO: 1878271 - protein, 17 aa, Staphylococcus
KEQIRMLSIPRDTISYI

SEQ ID NO: 1878272 - protein, 17 aa, Staphylococcus
KEQRGSIVPNYVMGLSF

SEQ ID NO: 1878273 - protein, 17 aa, Staphylococcus
KERFNTFETLAIVSAAI

SEQ ID NO: 1878274 - protein, 29 aa, Staphylococcus
KERKQKRNWWLRLSFIVLSIVGLGLTLFS

SEQ ID NO: 1878275 - protein, 24 aa, Staphylococcus
KERQRAVSYWSIGSWGGSGICSLF

SEQ ID NO: 1878276 - protein, 28 aa, Staphylococcus
KESFGKDKFKLFVPWYILIKYIMPVIII

SEQ ID NO: 1878277 - protein, 25 aa, Staphylococcus
KESFKGGFSSFSWVVFLMIIQASTI

SEQ ID NO: 1878278 - protein, 22 aa, Staphylococcus
KESFKQKRFTVTTEGGSMLDDI

SEQ ID NO: 1878279 - protein, 22 aa, Staphylococcus
KESGRKTLPILLGKKASITLMA

SEQ ID NO: 1878280 - protein, 17 aa, Staphylococcus
KESGWAYFLYEWAGIPG

SEQ ID NO: 1878281 - protein, 45 aa, Staphylococcus
KESNKRGIKGLLLPLLALLLVLAALAIFLGMYLNKDHGDNQADDN

SEQ ID NO: 1878282 - protein, 19 aa, Staphylococcus
KESRDKLKEQYNKYKEDPE

SEQ ID NO: 1878283 - protein, 23 aa, Staphylococcus
KESRIEASAPFFKHLGEMNYQVM

SEQ ID NO: 1878284 - protein, 22 aa, Staphylococcus
KESRSSKRGYSFNLNPFKRSKF

SEQ ID NO: 1878285 - protein, 18 aa, Staphylococcus
KESTYRNAYQIESRFSEN

SEQ ID NO: 1878286 - protein, 20 aa, Staphylococcus
KESYLGFTIVFFIFGLAMLI

SEQ ID NO: 1878287 - protein, 19 aa, Staphylococcus
KESYLGFTVIFLIFGFAML

SEQ ID NO: 1878288 - protein, 29 aa, Staphylococcus
KESYLSLNKRYLFIITIVLLVSFILLYMV

SEQ ID NO: 1878289 - protein, 17 aa, Staphylococcus
KETFKSGFISIVGMGVI

SEQ ID NO: 1878290 - protein, 19 aa, Staphylococcus
KETFKSGTISIVLMGIIYS

SEQ ID NO: 1878291 - protein, 18 aa, Staphylococcus
KETIKIIVSFIMAGAVVT

SEQ ID NO: 1878292 - protein, 26 aa, Staphylococcus
KETLFSRAAFWLPLILSSLIFALQHS

SEQ ID NO: 1878293 - protein, 20 aa, Staphylococcus
KETLNTVLLSIVGITTFSFI

SEQ ID NO: 1878294 - protein, 19 aa, Staphylococcus
KETMVWLIVIFISIQLIGA

SEQ ID NO: 1878295 - protein, 17 aa, Staphylococcus
KETPKILHFTKQLAPTQ

SEQ ID NO: 1878296 - protein, 22 aa, Staphylococcus
KEVHPIMYVLMVLFILYFIFVH

SEQ ID NO: 1878297 - protein, 21 aa, Staphylococcus
KEVKPLCIISVAFLLIQALVG

SEQ ID NO: 1878298 - protein, 21 aa, Staphylococcus
KEVKPLCIISVAFLLVQALVG

SEQ ID NO: 1878299 - protein, 17 aa, Staphylococcus
KEVKVKIVKKPKAQETI

SEQ ID NO: 1878300 - protein, 21 aa, Staphylococcus
KEVQDGFKMAFNEKDGTGYAS

SEQ ID NO: 1878301 - protein, 26 aa, Staphylococcus
KEYHDIFPFSNLRKIRTYADETHTMH

SEQ ID NO: 1878302 - protein, 19 aa, Staphylococcus
KEYLEKWAGTPTEVHVASE

SEQ ID NO: 1878303 - protein, 21 aa, Staphylococcus
KEYMYSMIVFSCMNFCLISFP

SEQ ID NO: 1878304 - protein, 19 aa, Staphylococcus
KFAKIGSYIFMFLIGTVAI

SEQ ID NO: 1878305 - protein, 20 aa, Staphylococcus
KFAKIGSYIFMFLIGTVAIA

SEQ ID NO: 1878306 - protein, 20 aa, Staphylococcus
KFDTLCFILLLVALQIIIYA

SEQ ID NO: 1878307 - protein, 18 aa, Staphylococcus
KFEFRRNFLFFVTLFLIG

SEQ ID NO: 1878308 - protein, 18 aa, Staphylococcus
KFEHYLKYIIFNVPKDVF

SEQ ID NO: 1878309 - protein, 18 aa, Staphylococcus
KFFSEFISAIVVIGVAAV

SEQ ID NO: 1878310 - protein, 17 aa, Staphylococcus
KFFSEFVAAAVVITIAA

SEQ ID NO: 1878311 - protein, 17 aa, Staphylococcus
KFFSEFVASAVVISIAA

SEQ ID NO: 1878312 - protein, 24 aa, Staphylococcus
KFGFPRWASITTIFIALIAIVAVV

SEQ ID NO: 1878313 - protein, 24 aa, Staphylococcus
KFGGKWLARIGLLILVLSTLPFTV

SEQ ID NO: 1878314 - protein, 25 aa, Staphylococcus
KFGPRKMISIALLWWSAFTILTGMI

SEQ ID NO: 1878315 - protein, 25 aa, Staphylococcus
KFGPRKMITIALLWWSAFTIFTGMI

SEQ ID NO: 1878316 - protein, 26 aa, Staphylococcus
KFGPRKMITIALVWWSAFTIFTGMIK

SEQ ID NO: 1878317 - protein, 20 aa, Staphylococcus
KFHHLAIAIGITLFIFLIVR

SEQ ID NO: 1878318 - protein, 26 aa, Staphylococcus
KFIAVSIACGFFLFMFGGVAQDFIYA

SEQ ID NO: 1878319 - protein, 20 aa, Staphylococcus
KFIFPILIGIIIWLLTPIRP

SEQ ID NO: 1878320 - protein, 24 aa, Staphylococcus
KFIKKLKFPITIGYMLIIISIVLL

SEQ ID NO: 1878321 - protein, 18 aa, Staphylococcus
KFILEPRLEDISMEGVLF

SEQ ID NO: 1878322 - protein, 19 aa, Staphylococcus
KFILPIVVGLIIWALTPFK

SEQ ID NO: 1878323 - protein, 24 aa, Staphylococcus
KFILPIVVGLLIWALTPFKPDALD

SEQ ID NO: 1878324 - protein, 18 aa, Staphylococcus
KFIQPFIFIILGCFIITI

SEQ ID NO: 1878325 - protein, 17 aa, Staphylococcus
KFIRRTSIDELPQLFNI

SEQ ID NO: 1878326 - protein, 21 aa, Staphylococcus
KFIRSGHVDLNIVLKLFPFVF

SEQ ID NO: 1878327 - protein, 21 aa, Staphylococcus
KFKEMVRMLLFNNAAFLTTDN

SEQ ID NO: 1878328 - protein, 18 aa, Staphylococcus
KFKGEFKNVGTVIQAYLY

SEQ ID NO: 1878329 - protein, 23 aa, Staphylococcus
KFLPMYFGMGMLFSLAYTYTNRI

SEQ ID NO: 1878330 - protein, 20 aa, Staphylococcus
KFLTLFAGPLFNFILAIVLF

SEQ ID NO: 1878331 - protein, 20 aa, Staphylococcus
KFLTLFAGPLFNFILALVLF

SEQ ID NO: 1878332 - protein, 18 aa, Staphylococcus
KFMATGILIFFAFIFIVL

SEQ ID NO: 1878333 - protein, 30 aa, Staphylococcus
KFNKVENIMPWNGFHRHFFIPSIIVLILAS

SEQ ID NO: 1878334 - protein, 19 aa, Staphylococcus
KFNSSDLIARMIGRVEALQ

SEQ ID NO: 1878335 - protein, 37 aa, Staphylococcus
KFNSYLKVSCSVLLMSGTLVGYGFTKDGFAQSNDRID

SEQ ID NO: 1878336 - protein, 29 aa, Staphylococcus
KFNTIWASITLHFCWNLSQLLLITEKESQ

SEQ ID NO: 1878337 - protein, 19 aa, Staphylococcus
KFQKIEAIEVKRCDFKDDL

SEQ ID NO: 1878338 - protein, 18 aa, Staphylococcus
KFQLPYKLLSIFLTLSTI

SEQ ID NO: 1878339 - protein, 17 aa, Staphylococcus
KFRKLGALVSFAINGAR

SEQ ID NO: 1878340 - protein, 18 aa, Staphylococcus
KFRKLPLSYLSSRDLSDF

SEQ ID NO: 1878341 - protein, 35 aa, Staphylococcus
KFSIRKYAIGTFSTVIATLVFIGFNTGQAQANESD

SEQ ID NO: 1878342 - protein, 17 aa, Staphylococcus
KFSIRKYAIGTVSTLVA

SEQ ID NO: 1878343 - protein, 33 aa, Staphylococcus
KFSIRKYAVGTFSTLIATLVFLGTHTDQAHASE

SEQ ID NO: 1878344 - protein, 18 aa, Staphylococcus
KFSNEAIYISGIDDEMVN

SEQ ID NO: 1878345 - protein, 21 aa, Staphylococcus
KFSNRIEVIDTLKLEEIEQYD

SEQ ID NO: 1878346 - protein, 21 aa, Staphylococcus
KFTGNELIPIAGMLANNGLIA

SEQ ID NO: 1878347 - protein, 30 aa, Staphylococcus
KFTKQRIIDTWKRFAILFIAELVLVLIALI

SEQ ID NO: 1878348 - protein, 19 aa, Staphylococcus
KFTTGLMLKQLELEHKINI

SEQ ID NO: 1878349 - protein, 26 aa, Staphylococcus
KFVEFKIPWMPAIDVNLDFRLDGLGL

SEQ ID NO: 1878350 - protein, 18 aa, Staphylococcus
KFVKERLSGHAAPREIEF

SEQ ID NO: 1878351 - protein, 25 aa, Staphylococcus
KFVQLRWIPEMFRAIGEKPETLDNG

SEQ ID NO: 1878352 - protein, 18 aa, Staphylococcus
KFYGHLFLLIIVMIICFI

SEQ ID NO: 1878353 - protein, 24 aa, Staphylococcus
KFYKFRFILIMLIVFLMSTMVLFI

SEQ ID NO: 1878354 - protein, 25 aa, Staphylococcus
KFYKFRYILIMLIIFLLGSMVLFIN

SEQ ID NO: 1878355 - protein, 24 aa, Staphylococcus
KFYKFRYVLIMLIIVLLSLMVLFI

SEQ ID NO: 1878356 - protein, 26 aa, Staphylococcus
KFYRFRYTLIMLIIFLLGSMVLFISG

SEQ ID NO: 1878357 - protein, 21 aa, Staphylococcus
KGALVGTLWLMITIIPISIIL

SEQ ID NO: 1878358 - protein, 21 aa, Staphylococcus
KGALVGTLWLMLTIIPFSIIL

SEQ ID NO: 1878359 - protein, 17 aa, Staphylococcus
KGANPKDFFKQKNGSPI

SEQ ID NO: 1878360 - protein, 19 aa, Staphylococcus
KGAPVKRGLVMGLTMILIL

SEQ ID NO: 1878361 - protein, 20 aa, Staphylococcus
KGDDSHVAPLIAKKKRESKE

SEQ ID NO: 1878362 - protein, 24 aa, Staphylococcus
KGDNGRDGTSIGITNIQTDAAGNN

SEQ ID NO: 1878363 - protein, 18 aa, Staphylococcus
KGDSISISKIDTLPDGSR

SEQ ID NO: 1878364 - protein, 17 aa, Staphylococcus
KGDSISITSITPQPNGD

SEQ ID NO: 1878365 - protein, 20 aa, Staphylococcus
KGDSITIKRVEPQTNGDIKV

SEQ ID NO: 1878366 - protein, 31 aa, Staphylococcus
KGENFARKSMSRFYYKMINTFVEDIQFEDGV

SEQ ID NO: 1878367 - protein, 27 aa, Staphylococcus
KGETFPLENLWIFIVLWIILFFVIIAF

SEQ ID NO: 1878368 - protein, 17 aa, Staphylococcus
KGETKTKYDAMKKDNLE

SEQ ID NO: 1878369 - protein, 17 aa, Staphylococcus
KGETKTKYDAMKKDNTE

SEQ ID NO: 1878370 - protein, 25 aa, Staphylococcus
KGETRKKYDAFKRDTLDYTNNYLAP

SEQ ID NO: 1878371 - protein, 22 aa, Staphylococcus
KGEVPMTVKIAYYIAAAVLLIA

SEQ ID NO: 1878372 - protein, 19 aa, Staphylococcus
KGFINKMPFINNNSDHNTE

SEQ ID NO: 1878373 - protein, 21 aa, Staphylococcus
KGFITVFFPIWLPVHADGPLS

SEQ ID NO: 1878374 - protein, 22 aa, Staphylococcus
KGFITVFFPLWLPVHAHGPIST

SEQ ID NO: 1878375 - protein, 21 aa, Staphylococcus
KGFLRALPFNLGVLLGILLTL

SEQ ID NO: 1878376 - protein, 20 aa, Staphylococcus
KGGATLWLIGVLVIFTVIFY

SEQ ID NO: 1878377 - protein, 18 aa, Staphylococcus
KGGMLVYNLLLIPLIILI

SEQ ID NO: 1878378 - protein, 18 aa, Staphylococcus
KGHITGMVNAVKSGLNKL

SEQ ID NO: 1878379 - protein, 29 aa, Staphylococcus
KGHSNHENMIYWFGIPRDQTPVGQVTFSI

SEQ ID NO: 1878380 - protein, 28 aa, Staphylococcus
KGIESIKDIQPIIVKKPAARVELDKALK

SEQ ID NO: 1878381 - protein, 19 aa, Staphylococcus
KGIFCNFFINIGIFISLQF

SEQ ID NO: 1878382 - protein, 21 aa, Staphylococcus
KGIGIPGGMALIFSIISGAGW

SEQ ID NO: 1878383 - protein, 20 aa, Staphylococcus
KGIIILALISSIFGLKEYFN

SEQ ID NO: 1878384 - protein, 17 aa, Staphylococcus
KGILFALGAHLLWGILP

SEQ ID NO: 1878385 - protein, 19 aa, Staphylococcus
KGILYALGAYVVWGILPIY

SEQ ID NO: 1878386 - protein, 25 aa, Staphylococcus
KGIPLTSRRFIQWLNTLNIVPGYYG

SEQ ID NO: 1878387 - protein, 26 aa, Staphylococcus
KGIQRLSDVNVWLSFLLLGFVFVVGP

SEQ ID NO: 1878388 - protein, 25 aa, Staphylococcus
KGIRQCILMLIPLLVGYLTGHFSTG

SEQ ID NO: 1878389 - protein, 25 aa, Staphylococcus
KGITRGKILAAMLFGMFIAILNQTL

SEQ ID NO: 1878390 - protein, 24 aa, Staphylococcus
KGIVLCFFVSLTILTSFVSMYTIL

SEQ ID NO: 1878391 - protein, 20 aa, Staphylococcus
KGIYPKILVRDIKNLPLKRE

SEQ ID NO: 1878392 - protein, 18 aa, Staphylococcus
KGKRVLVIGAIIRTVIIA

SEQ ID NO: 1878393 - protein, 18 aa, Staphylococcus
KGKYRLSVKGIYGENYQT

SEQ ID NO: 1878394 - protein, 31 aa, Staphylococcus
KGLESYKGILNWKGNEYKFLYKVKDINKPMS

SEQ ID NO: 1878395 - protein, 24 aa, Staphylococcus
KGLFTGDFSLMWQGIKQVFSGALL

SEQ ID NO: 1878396 - protein, 26 aa, Staphylococcus
KGLKLDIPLIRVFKISYIINALNAIV

SEQ ID NO: 1878397 - protein, 32 aa, Staphylococcus
KGLLSGLLSLIFGLAIFRKSRKDKKDRKEDNN

SEQ ID NO: 1878398 - protein, 23 aa, Staphylococcus
KGLPKYLTYFVLFMFAIFTIPDF

SEQ ID NO: 1878399 - protein, 25 aa, Staphylococcus
KGLQYLKRRWFIIIIAFLLAYGLSS

SEQ ID NO: 1878400 - protein, 20 aa, Staphylococcus
KGLSRTGAISGMISGSVVVI

SEQ ID NO: 1878401 - protein, 20 aa, Staphylococcus
KGLSRTGAISGMLSGAVVVI

SEQ ID NO: 1878402 - protein, 20 aa, Staphylococcus
KGLSRTGALAGMITGALVVI

SEQ ID NO: 1878403 - protein, 20 aa, Staphylococcus
KGLSRTGAVSGMLSGAIVVI

SEQ ID NO: 1878404 - protein, 32 aa, Staphylococcus
KGLSTLFFTEFWERFSYYGMKAILAYYLYYAV

SEQ ID NO: 1878405 - protein, 33 aa, Staphylococcus
KGLSTLFFTEFWERFSYYGMKAILAYYLYYSVS

SEQ ID NO: 1878406 - protein, 31 aa, Staphylococcus
KGLSTLFFTEFWERFSYYGMKAILIYYLYYS

SEQ ID NO: 1878407 - protein, 31 aa, Staphylococcus
KGLSTLFFTEFWERFSYYGMKAILVYYLYYS

SEQ ID NO: 1878408 - protein, 24 aa, Staphylococcus
KGLTRAGAISGMIAGAATVIVWIV

SEQ ID NO: 1878409 - protein, 24 aa, Staphylococcus
KGLTRAGAISGMISGALVVIIWIA

SEQ ID NO: 1878410 - protein, 24 aa, Staphylococcus
KGMEELAALGFNANQVMSAMPGVI

SEQ ID NO: 1878411 - protein, 24 aa, Staphylococcus
KGMYVDVICGWPYEYSNEKQVEKN

SEQ ID NO: 1878412 - protein, 22 aa, Staphylococcus
KGNGLIRFFFAKSVLFRRDFGT

SEQ ID NO: 1878413 - protein, 18 aa, Staphylococcus
KGNKDIFTFLNFSSIYRW

SEQ ID NO: 1878414 - protein, 19 aa, Staphylococcus
KGNKKRSKTLISLVQNVVK

SEQ ID NO: 1878415 - protein, 21 aa, Staphylococcus
KGNLKYQMFVGILIFMLSFFV

SEQ ID NO: 1878416 - protein, 18 aa, Staphylococcus
KGNLKYQMLVGILIFMLS

SEQ ID NO: 1878417 - protein, 25 aa, Staphylococcus
KGNPEIRTFLNFSSIYRWQIRRLDD

SEQ ID NO: 1878418 - protein, 26 aa, Staphylococcus
KGPELTEMPNLFGMTKSEALDKLKDL

SEQ ID NO: 1878419 - protein, 24 aa, Staphylococcus
KGQFDLICAVGILLVIATLVLGLV

SEQ ID NO: 1878420 - protein, 18 aa, Staphylococcus
KGQFRYKHNLYHFTFKSP

SEQ ID NO: 1878421 - protein, 32 aa, Staphylococcus
KGQNLKSRILKNLRYAHAVSNKKGTYMVYFYP

SEQ ID NO: 1878422 - protein, 27 aa, Staphylococcus
KGRGQGLPAPFWSYLQKLNFGKVKLSN

SEQ ID NO: 1878423 - protein, 27 aa, Staphylococcus
KGRKKRFSLKMPGAFTILFILTVIAVM

SEQ ID NO: 1878424 - protein, 21 aa, Staphylococcus
KGRREMLGMTLAELEERTQIK

SEQ ID NO: 1878425 - protein, 18 aa, Staphylococcus
KGRRERLGMTLNELEQRT

SEQ ID NO: 1878426 - protein, 18 aa, Staphylococcus
KGRRERLGMTLNELETRT

SEQ ID NO: 1878427 - protein, 18 aa, Staphylococcus
KGRRERLGMTLTELEQRT

SEQ ID NO: 1878428 - protein, 20 aa, Staphylococcus
KGRSIREFIAGVLLVPALVS

SEQ ID NO: 1878429 - protein, 31 aa, Staphylococcus
KGRSIREFISGVLLVPALVSFVWFSVFGVLG

SEQ ID NO: 1878430 - protein, 26 aa, Staphylococcus
KGRSRRSEFWYAMLWNLIFMIPGIIG

SEQ ID NO: 1878431 - protein, 17 aa, Staphylococcus
KGSDLSMVYDNGSDIEQ

SEQ ID NO: 1878432 - protein, 24 aa, Staphylococcus
KGSNEADLRVDLMTDDSKQIKNAT

SEQ ID NO: 1878433 - protein, 28 aa, Staphylococcus
KGSSVPWLPAAIGFILGGFFIRALDYVI

SEQ ID NO: 1878434 - protein, 19 aa, Staphylococcus
KGTFWNMIQSIQFDYLGYI

SEQ ID NO: 1878435 - protein, 17 aa, Staphylococcus
KGTGFAFASFTTGKQMD

SEQ ID NO: 1878436 - protein, 17 aa, Staphylococcus
KGTKVTLTIKRGSQEKD

SEQ ID NO: 1878437 - protein, 17 aa, Staphylococcus
KGTQISLVIGIVAALLD

SEQ ID NO: 1878438 - protein, 20 aa, Staphylococcus
KGTSHSYILLGYPMQSQDRK

SEQ ID NO: 1878439 - protein, 20 aa, Staphylococcus
KGTTVIGIISFFAWGLGYFG

SEQ ID NO: 1878440 - protein, 19 aa, Staphylococcus
KGVDVMRRLFGIFLAFTIN

SEQ ID NO: 1878441 - protein, 21 aa, Staphylococcus
KGVEKTIPWGTIIVFGVGISL

SEQ ID NO: 1878442 - protein, 18 aa, Staphylococcus
KGVFDYRRSLLRTDVILN

SEQ ID NO: 1878443 - protein, 23 aa, Staphylococcus
KGVKDMKGRAAINDDNFTQFQIA

SEQ ID NO: 1878444 - protein, 19 aa, Staphylococcus
KGVLFAIIGATLWGLGGTA

SEQ ID NO: 1878445 - protein, 19 aa, Staphylococcus
KGVNILNIISIILIVIYVI

SEQ ID NO: 1878446 - protein, 25 aa, Staphylococcus
KGVPLTSKRFIDWLNLNNIVPGFYG

SEQ ID NO: 1878447 - protein, 19 aa, Staphylococcus
KGYIQPFWPLAIINVFEEF

SEQ ID NO: 1878448 - protein, 24 aa, Staphylococcus
KGYPNMQLLLGIIFVFITGPLSSH

SEQ ID NO: 1878449 - protein, 24 aa, Staphylococcus
KHALPHTVLLGAIFVLFSDILGRL

SEQ ID NO: 1878450 - protein, 37 aa, Staphylococcus
KHAQAPVYIVKFWTILISLVLGMVVMFALIFTNTGNI

SEQ ID NO: 1878451 - protein, 18 aa, Staphylococcus
KHDLKNMLTLVVVLLFIL

SEQ ID NO: 1878452 - protein, 27 aa, Staphylococcus
KHEGNSKYLVYDVFFNNDGVNFISPGS

SEQ ID NO: 1878453 - protein, 18 aa, Staphylococcus
KHFSSLMKVAKWNAYHHD

SEQ ID NO: 1878454 - protein, 21 aa, Staphylococcus
KHGYLSHIILFKMPFLSSYIL

SEQ ID NO: 1878455 - protein, 18 aa, Staphylococcus
KHHGFDVKGTTRALFSTI

SEQ ID NO: 1878456 - protein, 23 aa, Staphylococcus
KHHKIKGIILVKDTFVNTNFDVH

SEQ ID NO: 1878457 - protein, 25 aa, Staphylococcus
KHHLISLLMAFLFVISPLYFRFTVY

SEQ ID NO: 1878458 - protein, 25 aa, Staphylococcus
KHHNAKEIIYAWSPFVILTVVVMIW

SEQ ID NO: 1878459 - protein, 23 aa, Staphylococcus
KHHPWAKFVVGKPVLATIISLVI

SEQ ID NO: 1878460 - protein, 24 aa, Staphylococcus
KHIWLNRILVIILMFLNGLGIYMG

SEQ ID NO: 1878461 - protein, 31 aa, Staphylococcus
KHKAPRSFISPSIIVGTDFYMGIGTPGGNKI

SEQ ID NO: 1878462 - protein, 17 aa, Staphylococcus
KHLRIGDTFCLYLIWYS

SEQ ID NO: 1878463 - protein, 19 aa, Staphylococcus
KHLSRNIDYLNHIIKSLKS

SEQ ID NO: 1878464 - protein, 21 aa, Staphylococcus
KHPTISAILLIIAVVLSVFNV

SEQ ID NO: 1878465 - protein, 23 aa, Staphylococcus
KHQFKYDVSLFTHWAQKGNSISY

SEQ ID NO: 1878466 - protein, 17 aa, Staphylococcus
KHQLDEINHANATDESK

SEQ ID NO: 1878467 - protein, 31 aa, Staphylococcus
KHRHLFNFKRGRLFLKHMFIYLYRIMLFLSA

SEQ ID NO: 1878468 - protein, 20 aa, Staphylococcus
KHRRERLGMTLAELESRTQI

SEQ ID NO: 1878469 - protein, 26 aa, Staphylococcus
KHSKMKITVLSLIFALLLAGLVGFIG

SEQ ID NO: 1878470 - protein, 26 aa, Staphylococcus
KHTMNKRIRFIFGAIVLIFVLIVLRL

SEQ ID NO: 1878471 - protein, 26 aa, Staphylococcus
KHVFLCGLCLFLLFSITTGLATNTMM

SEQ ID NO: 1878472 - protein, 18 aa, Staphylococcus
KHVLGQNVAYYFVQATTV

SEQ ID NO: 1878473 - protein, 18 aa, Staphylococcus
KHVLIPPFVIQILVENAI

SEQ ID NO: 1878474 - protein, 17 aa, Staphylococcus
KHWLLKVDWILVAIITL

SEQ ID NO: 1878475 - protein, 21 aa, Staphylococcus
KHYKLSIWMVLTITSGTLLNY

SEQ ID NO: 1878476 - protein, 20 aa, Staphylococcus
KIAETKKALLEFAKKRATAK

SEQ ID NO: 1878477 - protein, 17 aa, Staphylococcus
KIAFLIPKIDLPRVEQF

SEQ ID NO: 1878478 - protein, 27 aa, Staphylococcus
KIAHRDTDGGLSWSPDHKSIIYRYDAT

SEQ ID NO: 1878479 - protein, 17 aa, Staphylococcus
KIAYHIINRFNPKRNSN

SEQ ID NO: 1878480 - protein, 24 aa, Staphylococcus
KIDGKGWQKDKSWGGYNVTRYEVV

SEQ ID NO: 1878481 - protein, 21 aa, Staphylococcus
KIDINHIDWFVPHSANQRMLE

SEQ ID NO: 1878482 - protein, 35 aa, Staphylococcus
KIDYLKGLRQGLLMIIPAFIGYFMGYFSLGILVAT

SEQ ID NO: 1878483 - protein, 25 aa, Staphylococcus
KIEAKANRYTFVWKKSIQNHESKMN

SEQ ID NO: 1878484 - protein, 25 aa, Staphylococcus
KIENGAHCYEIFQYLDYANDIITQI

SEQ ID NO: 1878485 - protein, 22 aa, Staphylococcus
KIERPSIGIGLLNVSEIPEQYK

SEQ ID NO: 1878486 - protein, 18 aa, Staphylococcus
KIFFKLILPLSKRAILAG

SEQ ID NO: 1878487 - protein, 24 aa, Staphylococcus
KIFIACLLVLFILIMNLRGLTESA

SEQ ID NO: 1878488 - protein, 28 aa, Staphylococcus
KIFMLCFIGNALGGLVFFLILKGSDVMT

SEQ ID NO: 1878489 - protein, 27 aa, Staphylococcus
KIFMLCFLGNILGALAFFLILRMSDSM

SEQ ID NO: 1878490 - protein, 19 aa, Staphylococcus
KIFTRVMKNGVPFYPVLAI

SEQ ID NO: 1878491 - protein, 18 aa, Staphylococcus
KIGIACIVLTVAAWYGEA

SEQ ID NO: 1878492 - protein, 18 aa, Staphylococcus
KIGIPMMAALSVTHGFLP

SEQ ID NO: 1878493 - protein, 23 aa, Staphylococcus
KIGITILMVCIFLGSALTGLNRG

SEQ ID NO: 1878494 - protein, 17 aa, Staphylococcus
KIGLFIFAIALTLFSNF

SEQ ID NO: 1878495 - protein, 20 aa, Staphylococcus
KIGLSSKIPFDFRDIPHFPN

SEQ ID NO: 1878496 - protein, 19 aa, Staphylococcus
KIGPEMRQYLYANDTEGKP

SEQ ID NO: 1878497 - protein, 20 aa, Staphylococcus
KIGQKLYKSSFVVMFITGII

SEQ ID NO: 1878498 - protein, 21 aa, Staphylococcus
KIGSYGWKSILYFEIITTIAI

SEQ ID NO: 1878499 - protein, 24 aa, Staphylococcus
KIHLESFQTFLINKKVNGEEVTPF

SEQ ID NO: 1878500 - protein, 21 aa, Staphylococcus
KIHPLHFVFMMSLVVLIAWIL

SEQ ID NO: 1878501 - protein, 25 aa, Staphylococcus
KIHPTRFAFTMSLVVIIAWILYYFV

SEQ ID NO: 1878502 - protein, 26 aa, Staphylococcus
KIHYLQEFNKIVLIDKVKLKAKSQIF

SEQ ID NO: 1878503 - protein, 20 aa, Staphylococcus
KIIDADALANGYIKSQTDAT

SEQ ID NO: 1878504 - protein, 19 aa, Staphylococcus
KIIERFPKTIIFIAPMIVF

SEQ ID NO: 1878505 - protein, 17 aa, Staphylococcus
KIIESFIPFPMPASVIG

SEQ ID NO: 1878506 - protein, 30 aa, Staphylococcus
KIIESFIPFPMPASVIGLVLLFIALCTGIV

SEQ ID NO: 1878507 - protein, 17 aa, Staphylococcus
KIIESFIPIPMPASVIG

SEQ ID NO: 1878508 - protein, 25 aa, Staphylococcus
KIIFRKKLTTFLSIILPVGFYLLFT

SEQ ID NO: 1878509 - protein, 19 aa, Staphylococcus
KIIMSHPYTRYPVYDEDID

SEQ ID NO: 1878510 - protein, 20 aa, Staphylococcus
KIISVISFMIGVMFVSLIHA

SEQ ID NO: 1878511 - protein, 17 aa, Staphylococcus
KIIYGMVVLLLICGCIP

SEQ ID NO: 1878512 - protein, 24 aa, Staphylococcus
KIKDRGELRVGLSADYAPLEFEKT

SEQ ID NO: 1878513 - protein, 19 aa, Staphylococcus
KIKEIKARKDLTDEQKAKL

SEQ ID NO: 1878514 - protein, 19 aa, Staphylococcus
KIKFFKWVTIIGFILLSLL

SEQ ID NO: 1878515 - protein, 27 aa, Staphylococcus
KIKMKSVIPGALFASVVWILGTAAFGL

SEQ ID NO: 1878516 - protein, 18 aa, Staphylococcus
KIKNSDIFNSEFKTGVGN

SEQ ID NO: 1878517 - protein, 18 aa, Staphylococcus
KIKQEPKASYAYEDKAEF

SEQ ID NO: 1878518 - protein, 27 aa, Staphylococcus
KIKQRGELRVGLSADYAPLEFEKIKNG

SEQ ID NO: 1878519 - protein, 39 aa, Staphylococcus
KIKRTVEHILTWLGVVLQALAAIMFLVLKPLMGNSNFKD

SEQ ID NO: 1878520 - protein, 22 aa, Staphylococcus
KIKSRAFIIMTVIISLLIIGGA

SEQ ID NO: 1878521 - protein, 20 aa, Staphylococcus
KIKWPSIVVMAIVGLLVGPI

SEQ ID NO: 1878522 - protein, 19 aa, Staphylococcus
KILAVPGFIILIIMTILHC

SEQ ID NO: 1878523 - protein, 17 aa, Staphylococcus
KILDFPISVAVVMGGLF

SEQ ID NO: 1878524 - protein, 26 aa, Staphylococcus
KILDVCIKLVFVFSVVQIFTGFFTNV

SEQ ID NO: 1878525 - protein, 21 aa, Staphylococcus
KILGFPISIAIVMGGLLLITG

SEQ ID NO: 1878526 - protein, 22 aa, Staphylococcus
KILKDELLLAFSTSSSEAVLPV

SEQ ID NO: 1878527 - protein, 23 aa, Staphylococcus
KILKDELLLAFSTSSSEAVLPVM

SEQ ID NO: 1878528 - protein, 23 aa, Staphylococcus
KILKLNILIILGYFLGLLLYMHT

SEQ ID NO: 1878529 - protein, 22 aa, Staphylococcus
KILNPRQSIFIVFRNVTNTIQL

SEQ ID NO: 1878530 - protein, 17 aa, Staphylococcus
KILNYISTICMLLALII

SEQ ID NO: 1878531 - protein, 23 aa, Staphylococcus
KILRPAEVVKYLAITFLILVANS

SEQ ID NO: 1878532 - protein, 24 aa, Staphylococcus
KILRPGEVAKFLAITFLLLVANSV

SEQ ID NO: 1878533 - protein, 17 aa, Staphylococcus
KILSIFTAFLFVISPLY

SEQ ID NO: 1878534 - protein, 18 aa, Staphylococcus
KILYIAVAGVSLFAIGSL

SEQ ID NO: 1878535 - protein, 24 aa, Staphylococcus
KILYKRILFTLMIIFIYILGSNIK

SEQ ID NO: 1878536 - protein, 18 aa, Staphylococcus
KIMEVGLEGSFDSISNQQ

SEQ ID NO: 1878537 - protein, 19 aa, Staphylococcus
KIMKNYNWEYFKSQINKKL

SEQ ID NO: 1878538 - protein, 26 aa, Staphylococcus
KINEEKARLLADVISRVSKDKKDVLQ

SEQ ID NO: 1878539 - protein, 22 aa, Staphylococcus
KINHAYAYGGPKMAVNSLEELM

SEQ ID NO: 1878540 - protein, 21 aa, Staphylococcus
KINHAYAYGGPKMAVNSLEKL

SEQ ID NO: 1878541 - protein, 30 aa, Staphylococcus
KINKFKPLSWLASIYIEFLRGTPMLVQVFI

SEQ ID NO: 1878542 - protein, 17 aa, Staphylococcus
KIPAAFIQIALGVCLFI

SEQ ID NO: 1878543 - protein, 17 aa, Staphylococcus
KIPTAFIQIGLGVVIFT

SEQ ID NO: 1878544 - protein, 25 aa, Staphylococcus
KIPVWKLVFIWFIRVALTLLIAIPF

SEQ ID NO: 1878545 - protein, 17 aa, Staphylococcus
KIQEALEVLMKGRTTIV

SEQ ID NO: 1878546 - protein, 18 aa, Staphylococcus
KIQEALEVLMKGRTTIVI

SEQ ID NO: 1878547 - protein, 26 aa, Staphylococcus
KIQLGEKFAKIGFFIFVFLIGTVAVA

SEQ ID NO: 1878548 - protein, 18 aa, Staphylococcus
KIQPKRPLIASVLTANLA

SEQ ID NO: 1878549 - protein, 22 aa, Staphylococcus
KIQVVRMLLGLLVIILAGLSVS

SEQ ID NO: 1878550 - protein, 22 aa, Staphylococcus
KIRKLAALFLFIINVTRLATSY

SEQ ID NO: 1878551 - protein, 26 aa, Staphylococcus
KIRQNPKWLVKLIIFIVLTFVSMALA

SEQ ID NO: 1878552 - protein, 21 aa, Staphylococcus
KISEFKGMSYQSAKIFMVQQV

SEQ ID NO: 1878553 - protein, 18 aa, Staphylococcus
KISKFKALAILSSDALSS

SEQ ID NO: 1878554 - protein, 19 aa, Staphylococcus
KISNFKALAILSSDALSSV

SEQ ID NO: 1878555 - protein, 19 aa, Staphylococcus
KITHAHAYGGPTASMDSVE

SEQ ID NO: 1878556 - protein, 20 aa, Staphylococcus
KITHAHAYGGPVAAMDSVEA

SEQ ID NO: 1878557 - protein, 19 aa, Staphylococcus
KITKFKGLAILSSDALSSV

SEQ ID NO: 1878558 - protein, 17 aa, Staphylococcus
KITSRYEKMSELPNLTT

SEQ ID NO: 1878559 - protein, 23 aa, Staphylococcus
KITTCTYLFLFVFGVLAILALEH

SEQ ID NO: 1878560 - protein, 17 aa, Staphylococcus
KIVDILFIFGLLGGAAT

SEQ ID NO: 1878561 - protein, 18 aa, Staphylococcus
KIVKKPKAQETILNVARK

SEQ ID NO: 1878562 - protein, 20 aa, Staphylococcus
KIVKMFRISNPIARGLALGT

SEQ ID NO: 1878563 - protein, 24 aa, Staphylococcus
KIVNLIYVEVFEGSVIADYKTTDG

SEQ ID NO: 1878564 - protein, 23 aa, Staphylococcus
KIVWLFTVCFIGNIVGGFVLFGL

SEQ ID NO: 1878565 - protein, 22 aa, Staphylococcus
KIYHNKFIWLLGITNTIGILLQ

SEQ ID NO: 1878566 - protein, 19 aa, Staphylococcus
KIYPTIKDGEQVVANGVYD

SEQ ID NO: 1878567 - protein, 21 aa, Staphylococcus
KKADALSKLEVELQKLKDKVS

SEQ ID NO: 1878568 - protein, 23 aa, Staphylococcus
KKAEAKQAIDVAVSAKKQEIDNN

SEQ ID NO: 1878569 - protein, 21 aa, Staphylococcus
KKAEAKRAIDEVAKAKKQEID

SEQ ID NO: 1878570 - protein, 19 aa, Staphylococcus
KKAGHPVYEVMAGNMHNNS

SEQ ID NO: 1878571 - protein, 25 aa, Staphylococcus
KKAIFVIGIFCYTFGYIIITSANVL

SEQ ID NO: 1878572 - protein, 23 aa, Staphylococcus
KKAKLAGVLLIIAAVLSLVINWI

SEQ ID NO: 1878573 - protein, 22 aa, Staphylococcus
KKAKYDLDGKYQVELAKQKALE

SEQ ID NO: 1878574 - protein, 23 aa, Staphylococcus
KKALFWANMSFLLLIVALIICCI

SEQ ID NO: 1878575 - protein, 23 aa, Staphylococcus
KKALKLTMILGVVFTLGSMLAGD

SEQ ID NO: 1878576 - protein, 19 aa, Staphylococcus
KKANGIMSVIPVKSGQTHI

SEQ ID NO: 1878577 - protein, 19 aa, Staphylococcus
KKANITFAIIVTSVLFALV

SEQ ID NO: 1878578 - protein, 20 aa, Staphylococcus
KKAPRTDAFVMILTVAIVLI

SEQ ID NO: 1878579 - protein, 25 aa, Staphylococcus
KKARRICWFGSITVTLILAVPLYCS

SEQ ID NO: 1878580 - protein, 21 aa, Staphylococcus
KKATAMIGVAGFIVFESINFL

SEQ ID NO: 1878581 - protein, 20 aa, Staphylococcus
KKAVEGFILFQLTIVMISIL

SEQ ID NO: 1878582 - protein, 25 aa, Staphylococcus
KKAYKPLHMTLRLFLVLILFSGVWQ

SEQ ID NO: 1878583 - protein, 22 aa, Staphylococcus
KKAYPKFVVGWFISALGTIIMF

SEQ ID NO: 1878584 - protein, 24 aa, Staphylococcus
KKCDFKDKMYVEGITSYDDERHRY

SEQ ID NO: 1878585 - protein, 17 aa, Staphylococcus
KKDELKKEFNISKDIWI

SEQ ID NO: 1878586 - protein, 19 aa, Staphylococcus
KKDFIANVSHELRTPIALL

SEQ ID NO: 1878587 - protein, 20 aa, Staphylococcus
KKDFIANVSHELRTPIALLQ

SEQ ID NO: 1878588 - protein, 18 aa, Staphylococcus
KKDMDFWTWMMLIWILLA

SEQ ID NO: 1878589 - protein, 22 aa, Staphylococcus
KKDNHFDWEFVSRKRADHDLKM

SEQ ID NO: 1878590 - protein, 18 aa, Staphylococcus
KKDNIGVFTINKFQDNTA

SEQ ID NO: 1878591 - protein, 18 aa, Staphylococcus
KKDYKFIVKDGSIHLDYN

SEQ ID NO: 1878592 - protein, 18 aa, Staphylococcus
KKDYKFVVEDGKVHIDYP

SEQ ID NO: 1878593 - protein, 24 aa, Staphylococcus
KKEEIKRLSLMVGSAIIMFAIILI

SEQ ID NO: 1878594 - protein, 17 aa, Staphylococcus
KKEFGLNGKANADDILQ

SEQ ID NO: 1878595 - protein, 24 aa, Staphylococcus
KKEKSIVIDGEFTSVDALKNFEIP

SEQ ID NO: 1878596 - protein, 20 aa, Staphylococcus
KKERLETAFSNFFSYENLTR

SEQ ID NO: 1878597 - protein, 22 aa, Staphylococcus
KKETFKLFDVIAILLTLTGTFL

SEQ ID NO: 1878598 - protein, 21 aa, Staphylococcus
KKFFYTLIIVLLLFGLFGFMA

SEQ ID NO: 1878599 - protein, 19 aa, Staphylococcus
KKFIRIFCIALILISVIAL

SEQ ID NO: 1878600 - protein, 22 aa, Staphylococcus
KKFIYILICFTFLIMIPSGVYS

SEQ ID NO: 1878601 - protein, 27 aa, Staphylococcus
KKFLYSNRFEMILGYIVAIIALILIIM

SEQ ID NO: 1878602 - protein, 26 aa, Staphylococcus
KKFPKTRRTFGLISLQFVLLITTQII

SEQ ID NO: 1878603 - protein, 22 aa, Staphylococcus
KKFSFKTSLTLFLVIALVVWSF

SEQ ID NO: 1878604 - protein, 17 aa, Staphylococcus
KKFSLKTSFTIFLVLAL

SEQ ID NO: 1878605 - protein, 19 aa, Staphylococcus
KKFSPVFIYSAIIVAIIVL

SEQ ID NO: 1878606 - protein, 17 aa, Staphylococcus
KKFVVSFIIAILVVAIA

SEQ ID NO: 1878607 - protein, 25 aa, Staphylococcus
KKGAYLKVSLFLGEAKSYNEISKDK

SEQ ID NO: 1878608 - protein, 19 aa, Staphylococcus
KKGDKIGTPGFVRGLHDMH

SEQ ID NO: 1878609 - protein, 20 aa, Staphylococcus
KKGFIPVYFIGALLLFLLFH

SEQ ID NO: 1878610 - protein, 22 aa, Staphylococcus
KKGHYGKSVLLALITVVLFIIM

SEQ ID NO: 1878611 - protein, 24 aa, Staphylococcus
KKGNITKIIWTARGKGIGPDEFMD

SEQ ID NO: 1878612 - protein, 18 aa, Staphylococcus
KKGQIGVITINRFQENTS

SEQ ID NO: 1878613 - protein, 18 aa, Staphylococcus
KKGSFIFVDIKGAVQHPD

SEQ ID NO: 1878614 - protein, 18 aa, Staphylococcus
KKGTCFLNKMFRRLINGV

SEQ ID NO: 1878615 - protein, 24 aa, Staphylococcus
KKHAGDVLSVISLVFASGIFTGVM

SEQ ID NO: 1878616 - protein, 19 aa, Staphylococcus
KKHAPSHGLFWATIILIII

SEQ ID NO: 1878617 - protein, 18 aa, Staphylococcus
KKHIQWKSIAILVLINLF

SEQ ID NO: 1878618 - protein, 18 aa, Staphylococcus
KKHLQGMVVVLHDITNLK

SEQ ID NO: 1878619 - protein, 17 aa, Staphylococcus
KKIAFIISPQWFTNHGL

SEQ ID NO: 1878620 - protein, 17 aa, Staphylococcus
KKIAILISITGQNPTII

SEQ ID NO: 1878621 - protein, 25 aa, Staphylococcus
KKIAVLAAFIFVISPIYFRFTVYWP

SEQ ID NO: 1878622 - protein, 18 aa, Staphylococcus
KKIEAIKSIYPLRTSPLS

SEQ ID NO: 1878623 - protein, 24 aa, Staphylococcus
KKIHLKLWHLIILIIGIILITVAI

SEQ ID NO: 1878624 - protein, 20 aa, Staphylococcus
KKILFKEVVRTTRLAYEVLN

SEQ ID NO: 1878625 - protein, 19 aa, Staphylococcus
KKISPVFIYSAIIAAIVVL

SEQ ID NO: 1878626 - protein, 20 aa, Staphylococcus
KKISPVVGMILIPSIGALLL

SEQ ID NO: 1878627 - protein, 24 aa, Staphylococcus
KKKFELPHVLLIMLIMMMFACFLT

SEQ ID NO: 1878628 - protein, 33 aa, Staphylococcus
KKKGKGIILKLLIPILIIIGIIIGVMYALSLRA

SEQ ID NO: 1878629 - protein, 25 aa, Staphylococcus
KKKKFEMPGAFAILFIITVVAVIAT

SEQ ID NO: 1878630 - protein, 27 aa, Staphylococcus
KKKKFKFRMPGAFAILFILTVVAVIAT

SEQ ID NO: 1878631 - protein, 26 aa, Staphylococcus
KKKKLRKLPFVILIIVVLLIVMITYV

SEQ ID NO: 1878632 - protein, 34 aa, Staphylococcus
KKKKRKKGWLWGCGGCLVLLILLIIGLTSCTGAF

SEQ ID NO: 1878633 - protein, 30 aa, Staphylococcus
KKKKSKRLFLRMLIIFIIIFALFTGLMYFL

SEQ ID NO: 1878634 - protein, 18 aa, Staphylococcus
KKKLEIFEHDLKTPLTVM

SEQ ID NO: 1878635 - protein, 24 aa, Staphylococcus
KKKLRKLPFIILIILILLIAAIIY

SEQ ID NO: 1878636 - protein, 19 aa, Staphylococcus
KKKMKMMSIMRDIYAEIPG

SEQ ID NO: 1878637 - protein, 29 aa, Staphylococcus
KKKNKRIFLRLFIIFVFIYALFIGLMYYL

SEQ ID NO: 1878638 - protein, 26 aa, Staphylococcus
KKKRFKLRMPGAFMILFLLTVVAVIA

SEQ ID NO: 1878639 - protein, 32 aa, Staphylococcus
KKKRKKSWLFGCGGCLVLLILIIIGVTACTGS

SEQ ID NO: 1878640 - protein, 21 aa, Staphylococcus
KKKRNAILISICFLVLSLLVS

SEQ ID NO: 1878641 - protein, 23 aa, Staphylococcus
KKKRSWVSIIIHLIILILTAITG

SEQ ID NO: 1878642 - protein, 23 aa, Staphylococcus
KKKRSWVSMIIQFIVLVLTAITG

SEQ ID NO: 1878643 - protein, 29 aa, Staphylococcus
KKKSKRLFLRLFIFLIIIIILFLGLMFFL

SEQ ID NO: 1878644 - protein, 20 aa, Staphylococcus
KKKYFAGLILILSLPNIISR

SEQ ID NO: 1878645 - protein, 17 aa, Staphylococcus
KKLHTMMIISSIISTIS

SEQ ID NO: 1878646 - protein, 20 aa, Staphylococcus
KKLIAPYAIFYAFFSIYYFV

SEQ ID NO: 1878647 - protein, 20 aa, Staphylococcus
KKLIICIGLVLFAISEFLFA

SEQ ID NO: 1878648 - protein, 20 aa, Staphylococcus
KKLIICIGLVLFSVSEFIFA

SEQ ID NO: 1878649 - protein, 19 aa, Staphylococcus
KKLIVPYALFFAFFSIYYY

SEQ ID NO: 1878650 - protein, 23 aa, Staphylococcus
KKLKAFTLIEMLLVLLIISVLLI

SEQ ID NO: 1878651 - protein, 20 aa, Staphylococcus
KKLLIPYVIFFGFFSFYYYL

SEQ ID NO: 1878652 - protein, 18 aa, Staphylococcus
KKLLSIIITMVLLIISFL

SEQ ID NO: 1878653 - protein, 20 aa, Staphylococcus
KKLPEMLGVFQGLTFVVTIS

SEQ ID NO: 1878654 - protein, 21 aa, Staphylococcus
KKLPENLYFQGLTFQLITFSV

SEQ ID NO: 1878655 - protein, 22 aa, Staphylococcus
KKLRLISIIVLIIFFIVYYIHP

SEQ ID NO: 1878656 - protein, 19 aa, Staphylococcus
KKLSPVFIYGSILVLIVVL

SEQ ID NO: 1878657 - protein, 17 aa, Staphylococcus
KKLSSLITMKTDKITER

SEQ ID NO: 1878658 - protein, 23 aa, Staphylococcus
KKLTIKIKQLWTNKERLEEFIRP

SEQ ID NO: 1878659 - protein, 22 aa, Staphylococcus
KKMLSIALIWWSAFTILTGVVK

SEQ ID NO: 1878660 - protein, 27 aa, Staphylococcus
KKMRVVRRRVTVFGGILLAIIIILSIM

SEQ ID NO: 1878661 - protein, 40 aa, Staphylococcus
KKMSGFAKIVSGLIVLLLVGGLIFAIFAFVDHSNKANERL

SEQ ID NO: 1878662 - protein, 23 aa, Staphylococcus
KKNEGINSIGQITADTGIKTDLQ

SEQ ID NO: 1878663 - protein, 18 aa, Staphylococcus
KKNGYKNLYMLKGGYKKW

SEQ ID NO: 1878664 - protein, 23 aa, Staphylococcus
KKNHKIRMLGFYTLGIVWLFQTI

SEQ ID NO: 1878665 - protein, 19 aa, Staphylococcus
KKNVKWKYVGILLVIQFIF

SEQ ID NO: 1878666 - protein, 19 aa, Staphylococcus
KKNVRWHYVGLLLIIQLIL

SEQ ID NO: 1878667 - protein, 27 aa, Staphylococcus
KKPAARVELDKALKRKQNEVNQLPNAT

SEQ ID NO: 1878668 - protein, 28 aa, Staphylococcus
KKPFIIACISGGIGALVASFFNPKYYAY

SEQ ID NO: 1878669 - protein, 19 aa, Staphylococcus
KKPKRSLYALIMTLCGVHG

SEQ ID NO: 1878670 - protein, 31 aa, Staphylococcus
KKPKVAGVLLIIAGVISFLGNWINAVLWLVA

SEQ ID NO: 1878671 - protein, 30 aa, Staphylococcus
KKPLPKFLTLFAGPLFNFILALILFIALAY

SEQ ID NO: 1878672 - protein, 25 aa, Staphylococcus
KKPLPKFLTLFAGPLFNFILALVLF

SEQ ID NO: 1878673 - protein, 26 aa, Staphylococcus
KKPYLKRLTLATAISTLQGMQYYAVG

SEQ ID NO: 1878674 - protein, 21 aa, Staphylococcus
KKQAYDLAVQHAKDIINGTNQ

SEQ ID NO: 1878675 - protein, 22 aa, Staphylococcus
KKQFYKLIFSIVLSVPLLMTML

SEQ ID NO: 1878676 - protein, 21 aa, Staphylococcus
KKQGVKHIVFMSGIIPNDTQL

SEQ ID NO: 1878677 - protein, 21 aa, Staphylococcus
KKQGVKHIVFMSGLIPDDNHL

SEQ ID NO: 1878678 - protein, 30 aa, Staphylococcus
KKQIFEIWKYPGHRFQLILFGAIGMLGAQY

SEQ ID NO: 1878679 - protein, 21 aa, Staphylococcus
KKQLFPWERMIAIEQQKHTNY

SEQ ID NO: 1878680 - protein, 26 aa, Staphylococcus
KKQLNFPMITSNVYKNGKSDFEPSTI

SEQ ID NO: 1878681 - protein, 30 aa, Staphylococcus; identical to SEQ ID NO: 1580252

SEQ ID NO: 1878682 - protein, 26 aa, Staphylococcus
KKRFRKLPFIILIGIIILAIIIGYSV

SEQ ID NO: 1878683 - protein, 25 aa, Staphylococcus
KKRFRLKMPGAFTILFILTIIAVLA

SEQ ID NO: 1878684 - protein, 24 aa, Staphylococcus
KKRKLKSIPIFIALIALIVLIFII

SEQ ID NO: 1878685 - protein, 18 aa, Staphylococcus
KKRTRIPEMTYNFRRIER

SEQ ID NO: 1878686 - protein, 22 aa, Staphylococcus
KKRVAGLMLAGSISAFFVGVTE

SEQ ID NO: 1878687 - protein, 24 aa, Staphylococcus
KKRVRKLPFIILFILIILIVIIAY

SEQ ID NO: 1878688 - protein, 18 aa, Staphylococcus
KKSGDRVTDIQIINHDTG

SEQ ID NO: 1878689 - protein, 19 aa, Staphylococcus
KKSGLKIGDVIVKLEGKTL

SEQ ID NO: 1878690 - protein, 24 aa, Staphylococcus
KKSHKIKGIMLIKDSKIKTNKNFT

SEQ ID NO: 1878691 - protein, 20 aa, Staphylococcus
KKSLFVSELGYLNFTNMNSE

SEQ ID NO: 1878692 - protein, 27 aa, Staphylococcus
KKSLLYLLFCWTGIPGVIGMVEGVLTL

SEQ ID NO: 1878693 - protein, 17 aa, Staphylococcus
KKSPKFKRVFNNGEFET

SEQ ID NO: 1878694 - protein, 26 aa, Staphylococcus
KKSSKKKKFLFAFIFALLLIGLIAFI

SEQ ID NO: 1878695 - protein, 32 aa, Staphylococcus
KKSTIPLGILLFIIGGGLIWFIKRNKSKNCKY

SEQ ID NO: 1878696 - protein, 18 aa, Staphylococcus
KKTALDLEIERELLEMME

SEQ ID NO: 1878697 - protein, 17 aa, Staphylococcus
KKTFEVLAFAFTSRSSA

SEQ ID NO: 1878698 - protein, 19 aa, Staphylococcus
KKTGIAYAKAYFVSWLRHV

SEQ ID NO: 1878699 - protein, 22 aa, Staphylococcus
KKTGNLRIARSYFAIAGMICAA

SEQ ID NO: 1878700 - protein, 24 aa, Staphylococcus
KKTKGREFLLIFFVSILMVLGGTL

SEQ ID NO: 1878701 - protein, 19 aa, Staphylococcus
KKTNGFFLLAPLFVSMVVG

SEQ ID NO: 1878702 - protein, 20 aa, Staphylococcus
KKTYQGIFSFNVLGLQDIHR

SEQ ID NO: 1878703 - protein, 18 aa, Staphylococcus
KKVFKIIMVVSIMMSIVI

SEQ ID NO: 1878704 - protein, 20 aa, Staphylococcus
KKVKEPYLEYNMKRKQGEYI

SEQ ID NO: 1878705 - protein, 23 aa, Staphylococcus
KKVPEGLDLIAVILIAPALVFGL

SEQ ID NO: 1878706 - protein, 19 aa, Staphylococcus
KKVPEGLDLIVVILVAPAL

SEQ ID NO: 1878707 - protein, 22 aa, Staphylococcus
KKVPMKVIHDIQDFKVPKGIED

SEQ ID NO: 1878708 - protein, 26 aa, Staphylococcus
KKVPMKVVHDIEEFKVPKGLEDHLFR

SEQ ID NO: 1878709 - protein, 25 aa, Staphylococcus
KKYAKFKFSYSWIQFAKIFLYSFIM

SEQ ID NO: 1878710 - protein, 19 aa, Staphylococcus
KKYDAGIKFSSKKILHYSI

SEQ ID NO: 1878711 - protein, 23 aa, Staphylococcus
KKYGAWAVLLCRFIPVLRVLITI

SEQ ID NO: 1878712 - protein, 20 aa, Staphylococcus
KKYKDMYLEMDVEMLTPDKE

SEQ ID NO: 1878713 - protein, 17 aa, Staphylococcus
KKYKEAHHCTGFFKTTL

SEQ ID NO: 1878714 - protein, 17 aa, Staphylococcus
KKYWKQILGGITLGTTA

SEQ ID NO: 1878715 - protein, 18 aa, Staphylococcus
KKYWLQIFGGIAIGTLIA

SEQ ID NO: 1878716 - protein, 19 aa, Staphylococcus
KLADWNLNKALKIIFIVFI

SEQ ID NO: 1878717 - protein, 19 aa, Staphylococcus
KLADWNLNKALKIIFTTFI

SEQ ID NO: 1878718 - protein, 17 aa, Staphylococcus
KLAESIEGIRMIQVFNQ

SEQ ID NO: 1878719 - protein, 19 aa, Staphylococcus
KLAESIEGMKIIQAFNQER

SEQ ID NO: 1878720 - protein, 18 aa, Staphylococcus
KLAIPGAITSFIGAAFLS

SEQ ID NO: 1878721 - protein, 20 aa, Staphylococcus
KLAISSAFSGFSWLIFLLII

SEQ ID NO: 1878722 - protein, 31 aa, Staphylococcus
KLALLYSRPLYYFGVVMKPLIWLMNGSARMI

SEQ ID NO: 1878723 - protein, 17 aa, Staphylococcus
KLANALTEHAFKQYDYR

SEQ ID NO: 1878724 - protein, 20 aa, Staphylococcus
KLASILVICLFIFKNKHQAI

SEQ ID NO: 1878725 - protein, 22 aa, Staphylococcus
KLAVELVAWVLLLNKRLFRLYD

SEQ ID NO: 1878726 - protein, 21 aa, Staphylococcus
KLDHINHVYLSLSAPDDTAIG

SEQ ID NO: 1878727 - protein, 20 aa, Staphylococcus
KLDKDLIFAIIVGVIGALVA

SEQ ID NO: 1878728 - protein, 19 aa, Staphylococcus
KLDNAISLLHDKENNSRLV

SEQ ID NO: 1878729 - protein, 18 aa, Staphylococcus
KLDTKYEFKDGGKKKTVI

SEQ ID NO: 1878730 - protein, 19 aa, Staphylococcus
KLEIVPIHYIHSDKPTNTP

SEQ ID NO: 1878731 - protein, 17 aa, Staphylococcus
KLERERIVLFFVAVILS

SEQ ID NO: 1878732 - protein, 17 aa, Staphylococcus
KLFAILKKNMKYLIILP

SEQ ID NO: 1878733 - protein, 19 aa, Staphylococcus
KLFESDKYYPIYGSSELGK

SEQ ID NO: 1878734 - protein, 18 aa, Staphylococcus
KLFGFIRAIARYGERLLS

SEQ ID NO: 1878735 - protein, 30 aa, Staphylococcus
KLFGKGSWYLPKWLGSILPELDIEGKALEQ

SEQ ID NO: 1878736 - protein, 18 aa, Staphylococcus
KLFGNWIISMICILIGAG

SEQ ID NO: 1878737 - protein, 20 aa, Staphylococcus
KLFLNFPRQYRNVFLLMVIV

SEQ ID NO: 1878738 - protein, 23 aa, Staphylococcus
KLFMKDNIQVLGNISMISDKLKY

SEQ ID NO: 1878739 - protein, 18 aa, Staphylococcus
KLFNYGIDGLISFNSKPL

SEQ ID NO: 1878740 - protein, 24 aa, Staphylococcus
KLFQLSKYYLFNWFYYVYNIGVVV

SEQ ID NO: 1878741 - protein, 25 aa, Staphylococcus
KLGAKRPMMFGALLNAVGMLLIALT

SEQ ID NO: 1878742 - protein, 18 aa, Staphylococcus
KLGFKIKKVEFFYFLETS

SEQ ID NO: 1878743 - protein, 18 aa, Staphylococcus
KLGLYLLLLIILQPIIFH

SEQ ID NO: 1878744 - protein, 35 aa, Staphylococcus
KLGRISKEYKRVLGWSLNHKWLVLIISIVILIASI

SEQ ID NO: 1878745 - protein, 24 aa, Staphylococcus
KLGSFEMIILPVLIPVVSGTIGLM

SEQ ID NO: 1878746 - protein, 25 aa, Staphylococcus
KLGWFELVPIFSFFILKGKSHCCNQ

SEQ ID NO: 1878747 - protein, 17 aa, Staphylococcus
KLHIAPNIAEKVLGNAE

SEQ ID NO: 1878748 - protein, 24 aa, Staphylococcus
KLHLLCLTLPIVVAIIGLVTTQQR

SEQ ID NO: 1878749 - protein, 25 aa, Staphylococcus
KLHPTRFAFMMSLVVIVAWVMYYFV

SEQ ID NO: 1878750 - protein, 17 aa, Staphylococcus
KLIANAIGGTITFIVFM

SEQ ID NO: 1878751 - protein, 18 aa, Staphylococcus
KLIEGPVGLIIMNDKHID

SEQ ID NO: 1878752 - protein, 20 aa, Staphylococcus
KLIFYWVKYLNYQIVYRAKE

SEQ ID NO: 1878753 - protein, 24 aa, Staphylococcus
KLIGWKYSKALPVALTALYGFPGD

SEQ ID NO: 1878754 - protein, 18 aa, Staphylococcus
KLIKELLSTRLGNNEASQ

SEQ ID NO: 1878755 - protein, 41 aa, Staphylococcus
KLIKILKKNLKWLIILPLVFLVVGMILTFFVIKPEYEASTQ

SEQ ID NO: 1878756 - protein, 24 aa, Staphylococcus
KLIPIAVIVVFGWFNSSNVDFSLF

SEQ ID NO: 1878757 - protein, 25 aa, Staphylococcus
KLIPISIIILCLFFVGYVLHPINAD

SEQ ID NO: 1878758 - protein, 21 aa, Staphylococcus
KLISFFIRMIFGHRTFTHSLL

SEQ ID NO: 1878759 - protein, 35 aa, Staphylococcus
KLKDNNLKAALPLYGRDDFIGSIAIEIISRSLYEQ

SEQ ID NO: 1878760 - protein, 19 aa, Staphylococcus
KLKEILKGITIMKDEPKVL

SEQ ID NO: 1878761 - protein, 23 aa, Staphylococcus
KLKEPMLEFRVFSYNIYTLGTAL

SEQ ID NO: 1878762 - protein, 21 aa, Staphylococcus
KLKGRKAINLIAMLTNTVPGM

SEQ ID NO: 1878763 - protein, 19 aa, Staphylococcus
KLKHSAFFDEKVYQKYMAR

SEQ ID NO: 1878764 - protein, 26 aa, Staphylococcus
KLKISKSKLAWAIAFMMGFQSMIFYT

SEQ ID NO: 1878765 - protein, 24 aa, Staphylococcus
KLKKEDRKGLAMIVDEQIEALESD

SEQ ID NO: 1878766 - protein, 23 aa, Staphylococcus
KLKKEDRKGLAMIVDEQLNALEK

SEQ ID NO: 1878767 - protein, 24 aa, Staphylococcus
KLKKNGKFDWQFVSRAKADHEIKM

SEQ ID NO: 1878768 - protein, 21 aa, Staphylococcus
KLKLSFYIFFFAGALSIILTI

SEQ ID NO: 1878769 - protein, 23 aa, Staphylococcus
KLKVREIKGLITTKILQAQEKEI

SEQ ID NO: 1878770 - protein, 28 aa, Staphylococcus
KLKYKAKLFPFGPIFAGILCIIVIIGQD

SEQ ID NO: 1878771 - protein, 30 aa, Staphylococcus
KLKYKAKLFPFGPIFAGILCVLVIIGQDVD

SEQ ID NO: 1878772 - protein, 25 aa, Staphylococcus
KLKYYDFIPIFSFLILKGKSRCCKQ

SEQ ID NO: 1878773 - protein, 17 aa, Staphylococcus
KLLESFILLPIVLPPTV

SEQ ID NO: 1878774 - protein, 27 aa, Staphylococcus
KLLEYRKPVVLMAMGLVFTTVIGVGFF

SEQ ID NO: 1878775 - protein, 20 aa, Staphylococcus
KLLLPYFIFFAFYSVYYFLT

SEQ ID NO: 1878776 - protein, 19 aa, Staphylococcus
KLLMILTVIVGFLSIKGFP

SEQ ID NO: 1878777 - protein, 24 aa, Staphylococcus
KLLPKARRIGIAWMVIGLAGACLV

SEQ ID NO: 1878778 - protein, 24 aa, Staphylococcus
KLLPKARRLGISWMAIGLLGAVGV

SEQ ID NO: 1878779 - protein, 24 aa, Staphylococcus
KLLPKARRLGISWMTIGLLGAVCV

SEQ ID NO: 1878780 - protein, 23 aa, Staphylococcus
KLLPKARRLGISWMTVGLLGAVG

SEQ ID NO: 1878781 - protein, 18 aa, Staphylococcus
KLLRAKWVRPVLIIGCLF

SEQ ID NO: 1878782 - protein, 18 aa, Staphylococcus
KLLSDFVFVNTFSFILFI

SEQ ID NO: 1878783 - protein, 17 aa, Staphylococcus
KLLTSFTSLISFFKLGV

SEQ ID NO: 1878784 - protein, 26 aa, Staphylococcus
KLMEYKKPIVLMAMALVFATVIGVGY

SEQ ID NO: 1878785 - protein, 17 aa, Staphylococcus
KLMKLKVHLSIGFEPQA

SEQ ID NO: 1878786 - protein, 21 aa, Staphylococcus
KLMTKIKMLWSAQRPLESFIR

SEQ ID NO: 1878787 - protein, 38 aa, Staphylococcus
KLNDAIPVFAGVIVALAFVLLMFVFRSIIIPLKAVLGF

SEQ ID NO: 1878788 - protein, 19 aa, Staphylococcus
KLNPFWTILLSLIFLNEKV

SEQ ID NO: 1878789 - protein, 25 aa, Staphylococcus
KLNRAELTGVFALGGASILLLSFYD

SEQ ID NO: 1878790 - protein, 22 aa, Staphylococcus
KLNRFSKLIILRFKARKDSHHS

SEQ ID NO: 1878791 - protein, 18 aa, Staphylococcus
KLNSETTYILGFQPEKEH

SEQ ID NO: 1878792 - protein, 20 aa, Staphylococcus
KLPGGKYMGYAILVFFILVF

SEQ ID NO: 1878793 - protein, 17 aa, Staphylococcus
KLPGINTTMDWDRKYPY

SEQ ID NO: 1878794 - protein, 24 aa, Staphylococcus
KLPGVNTSMDWDRKYPYGDSLRGI

SEQ ID NO: 1878795 - protein, 23 aa, Staphylococcus
KLPGVNTSMDWDRKYPYKDTLRG

SEQ ID NO: 1878796 - protein, 19 aa, Staphylococcus
KLPKISYKMFVLIFSLLGF

SEQ ID NO: 1878797 - protein, 24 aa, Staphylococcus
KLPLKNINAWLLVIFFMLQSGLFY

SEQ ID NO: 1878798 - protein, 19 aa, Staphylococcus
KLPLYPVLPAITFVLVLLV

SEQ ID NO: 1878799 - protein, 19 aa, Staphylococcus
KLPTFVMGIGLGGLIILNL

SEQ ID NO: 1878800 - protein, 20 aa, Staphylococcus
KLRYMPGLDGLRAIAVLGII

SEQ ID NO: 1878801 - protein, 18 aa, Staphylococcus
KLRYTAVEKGDINLIDAY

SEQ ID NO: 1878802 - protein, 23 aa, Staphylococcus
KLSDINVWLSFLLLAFVFIVGPT

SEQ ID NO: 1878803 - protein, 18 aa, Staphylococcus
KLSEEVDNILSLHKDSDR

SEQ ID NO: 1878804 - protein, 32 aa, Staphylococcus
KLSKIKIISWIAAAYIEIIRGTPLLVQVFIVF

SEQ ID NO: 1878805 - protein, 22 aa, Staphylococcus
KLSKIPFGFLMKGLTPIFFFLI

SEQ ID NO: 1878806 - protein, 18 aa, Staphylococcus
KLSLYILMFEQIVSIIWV

SEQ ID NO: 1878807 - protein, 18 aa, Staphylococcus
KLSPIIIIIAMTMLLYFL

SEQ ID NO: 1878808 - protein, 19 aa, Staphylococcus
KLSPIIVLILFIALLYFLV

SEQ ID NO: 1878809 - protein, 26 aa, Staphylococcus
KLSRQFKISSAILVITSSLIGSNIVL

SEQ ID NO: 1878810 - protein, 27 aa, Staphylococcus
KLSRYIIGSIVTFLFVVQIIGIVANMT

SEQ ID NO: 1878811 - protein, 22 aa, Staphylococcus
KLSSRFQKLILLHTAAQGIYSE

SEQ ID NO: 1878812 - protein, 25 aa, Staphylococcus
KLSTGFDILSVIVLLMFMVIAPMIH

SEQ ID NO: 1878813 - protein, 20 aa, Staphylococcus
KLSTRFQKLLLLHTSAQGIY

SEQ ID NO: 1878814 - protein, 28 aa, Staphylococcus
KLSVGIASVSLGTLVFLGGAQAANAEDA

SEQ ID NO: 1878815 - protein, 19 aa, Staphylococcus
KLSYAHLIINIALGGVNAA

SEQ ID NO: 1878816 - protein, 23 aa, Staphylococcus
KLTEASPIIGMIVGIVATLAGIL

SEQ ID NO: 1878817 - protein, 33 aa, Staphylococcus
KLTFVRGAIAWFYSMIWAILGFLWINHTLDGSF

SEQ ID NO: 1878818 - protein, 19 aa, Staphylococcus
KLTIGKAVIFVSLMLIIGF

SEQ ID NO: 1878819 - protein, 25 aa, Staphylococcus
KLTKKRWLNVIGWNGNLAVFILFGF

SEQ ID NO: 1878820 - protein, 18 aa, Staphylococcus
KLTLAAMFIFPFYILTVY

SEQ ID NO: 1878821 - protein, 20 aa, Staphylococcus
KLTLIAMIPLPFMVLLTSIY

SEQ ID NO: 1878822 - protein, 20 aa, Staphylococcus
KLTLTYGISKSFLKKIGMSS

SEQ ID NO: 1878823 - protein, 18 aa, Staphylococcus
KLTRAGAISGMVAGALVV

SEQ ID NO: 1878824 - protein, 18 aa, Staphylococcus
KLTREGAISGMIAGALVV

SEQ ID NO: 1878825 - protein, 18 aa, Staphylococcus
KLTVFVILGSVILKLLLN

SEQ ID NO: 1878826 - protein, 19 aa, Staphylococcus
KLTVIRDGKTLTVNVNLKS

SEQ ID NO: 1878827 - protein, 20 aa, Staphylococcus
KLVALFSMYIIYYVILFVSS

SEQ ID NO: 1878828 - protein, 17 aa, Staphylococcus
KLVCVGVASYIGSQTFV

SEQ ID NO: 1878829 - protein, 19 aa, Staphylococcus
KLVEASSEYAAKIDDAKTN

SEQ ID NO: 1878830 - protein, 19 aa, Staphylococcus
KLVGFSAILLIILIGITIV

SEQ ID NO: 1878831 - protein, 19 aa, Staphylococcus
KLVPISIIILIVFYVTYTY

SEQ ID NO: 1878832 - protein, 27 aa, Staphylococcus
KLVPWAHVFILKLLYYIKCRETKEELH

SEQ ID NO: 1878833 - protein, 26 aa, Staphylococcus
KLVVLTIKNDSYWKEFKVEGQRVTTI

SEQ ID NO: 1878834 - protein, 25 aa, Staphylococcus
KLVYTYRINTPIKFIYKTDSDNNYI

SEQ ID NO: 1878835 - protein, 20 aa, Staphylococcus
KLWTALKIGVLAIIRTLIST

SEQ ID NO: 1878836 - protein, 21 aa, Staphylococcus
KLYECDDCSECPLKNQCMNFN

SEQ ID NO: 1878837 - protein, 19 aa, Staphylococcus
KLYFERTLINLIENSIEHN

SEQ ID NO: 1878838 - protein, 24 aa, Staphylococcus
KLYKHFYYRLFAILTLAFILLSFV

SEQ ID NO: 1878839 - protein, 20 aa, Staphylococcus
KLYLGCVIFFICSLFMFGVG

SEQ ID NO: 1878840 - protein, 17 aa, Staphylococcus
KLYRFVDRHGKWMKLKS

SEQ ID NO: 1878841 - protein, 20 aa, Staphylococcus
KMAKIQFWFLIKGLTPIFFF

SEQ ID NO: 1878842 - protein, 19 aa, Staphylococcus
KMAVLHPIQSLKLVITAVW

SEQ ID NO: 1878843 - protein, 25 aa, Staphylococcus
KMDSAKKDLDYIVSPIKNRPSIFDR

SEQ ID NO: 1878844 - protein, 25 aa, Staphylococcus
KMELKKCVLLILFVFYILTMGIFNS

SEQ ID NO: 1878845 - protein, 19 aa, Staphylococcus
KMFADSILFAVIITLVTLL

SEQ ID NO: 1878846 - protein, 17 aa, Staphylococcus
KMFYNFNGGLIFVGSLV

SEQ ID NO: 1878847 - protein, 24 aa, Staphylococcus
KMGLPTKVFLWFIGILVLLALIAV

SEQ ID NO: 1878848 - protein, 18 aa, Staphylococcus
KMHKFNHIEDATLSFKEK

SEQ ID NO: 1878849 - protein, 17 aa, Staphylococcus
KMIGVIILTFVLTVIAQ

SEQ ID NO: 1878850 - protein, 26 aa, Staphylococcus
KMIVIPVVFCSLALSISNVGESKTVG

SEQ ID NO: 1878851 - protein, 18 aa, Staphylococcus
KMKMMSVMRDIYADIPGN

SEQ ID NO: 1878852 - protein, 18 aa, Staphylococcus
KMKMMSVMRDIYADIPGY

SEQ ID NO: 1878853 - protein, 18 aa, Staphylococcus
KMKMMSVMRDIYAEIPGY

SEQ ID NO: 1878854 - protein, 28 aa, Staphylococcus
KMKMRIVRRRITVFGGILLAIILMLIIV

SEQ ID NO: 1878855 - protein, 27 aa, Staphylococcus
KMKMRVVRRRITVFGGILLAIILILLV

SEQ ID NO: 1878856 - protein, 28 aa, Staphylococcus
KMMHLKVGVSIGFEFPALIQTIVMLVLA

SEQ ID NO: 1878857 - protein, 17 aa, Staphylococcus
KMMLKVILYAYTQSVFS

SEQ ID NO: 1878858 - protein, 28 aa, Staphylococcus
KMMRVVRRRIALFGGIMLAIIILLCIML

SEQ ID NO: 1878859 - protein, 20 aa, Staphylococcus
KMNSPEFNDLSLLVDTMHNA

SEQ ID NO: 1878860 - protein, 22 aa, Staphylococcus
KMSESLATVGTRVTDLEYETKS

SEQ ID NO: 1878861 - protein, 19 aa, Staphylococcus
KMSNKLLIFMALTSGVIGV

SEQ ID NO: 1878862 - protein, 17 aa, Staphylococcus
KMSPLHHHFELSGWNEW

SEQ ID NO: 1878863 - protein, 24 aa, Staphylococcus
KMTMKDVLKNIAFFILAIICSITS

SEQ ID NO: 1878864 - protein, 24 aa, Staphylococcus
KMVQNLWWGAGYNIVAVPLAAGAL

SEQ ID NO: 1878865 - protein, 17 aa, Staphylococcus
KMYHFSRKSVSEINQPI

SEQ ID NO: 1878866 - protein, 26 aa, Staphylococcus
KMYKEIISYSVPFVIVSLNFPLFNLV

SEQ ID NO: 1878867 - protein, 24 aa, Staphylococcus
KMYLGHVKVLLGMFLSLKTLYRKR

SEQ ID NO: 1878868 - protein, 23 aa, Staphylococcus
KNADSVLSWSITLLIIALSFALV

SEQ ID NO: 1878869 - protein, 22 aa, Staphylococcus
KNAECHIIEGFALAQAFSKYNL

SEQ ID NO: 1878870 - protein, 28 aa, Staphylococcus
KNAFKELWLPIITICFILVISKLMTYAG

SEQ ID NO: 1878871 - protein, 17 aa, Staphylococcus
KNAIKKAHKQGVRNIVL

SEQ ID NO: 1878872 - protein, 19 aa, Staphylococcus
KNAKFANTVLRSMFSFGFL

SEQ ID NO: 1878873 - protein, 19 aa, Staphylococcus
KNAKFANTVLRSMFSLGFL

SEQ ID NO: 1878874 - protein, 30 aa, Staphylococcus
KNAKHNLSYDEIKVLATSYLKDDIKIKSSQ

SEQ ID NO: 1878875 - protein, 17 aa, Staphylococcus
KNDELMQTFQIDASVNP

SEQ ID NO: 1878876 - protein, 25 aa, Staphylococcus
KNDLPPMIVHYFFDLMVSMGVFCFI

SEQ ID NO: 1878877 - protein, 18 aa, Staphylococcus
KNDRKVSGTYSIFDIHVK

SEQ ID NO: 1878878 - protein, 25 aa, Staphylococcus
KNDRYGRTLAYVWLDKDHMYNKELI

SEQ ID NO: 1878879 - protein, 25 aa, Staphylococcus
KNDRYGRTLAYVWLSKNRMFNRELV

SEQ ID NO: 1878880 - protein, 17 aa, Staphylococcus
KNDWAITFLTILIIITP

SEQ ID NO: 1878881 - protein, 21 aa, Staphylococcus
KNEEKHGSKKKGAAVAGGAAA

SEQ ID NO: 1878882 - protein, 18 aa, Staphylococcus
KNEILSFYLNNIYYGSDQ

SEQ ID NO: 1878883 - protein, 25 aa, Staphylococcus
KNEKSLVVDGQFKSVKALKDLEIPL

SEQ ID NO: 1878884 - protein, 18 aa, Staphylococcus
KNELFIEGITAYDEQRHH

SEQ ID NO: 1878885 - protein, 26 aa, Staphylococcus
KNELPPLIVHYFFDLMVSMGVFCFVI

SEQ ID NO: 1878886 - protein, 22 aa, Staphylococcus
KNELPPLIVHYFFDLMVTMGVL

SEQ ID NO: 1878887 - protein, 32 aa, Staphylococcus
KNEVKDVRAITRFKIPESYSMRDVTREYAEFI

SEQ ID NO: 1878888 - protein, 22 aa, Staphylococcus
KNFFTHRVFEIPLPLLKPMQVH

SEQ ID NO: 1878889 - protein, 18 aa, Staphylococcus
KNFKDLFATPRFVLPMLI

SEQ ID NO: 1878890 - protein, 28 aa, Staphylococcus
KNFMSRTLCYYFWLPFGPVLYSYLDGSI

SEQ ID NO: 1878891 - protein, 24 aa, Staphylococcus
KNFSEFPALGLVLAVMIGIGAAEK

SEQ ID NO: 1878892 - protein, 20 aa, Staphylococcus
KNFSEFPALGLVLAVMIGVG

SEQ ID NO: 1878893 - protein, 20 aa, Staphylococcus
KNFSEFPALGLVLAVMLGVG

SEQ ID NO: 1878894 - protein, 19 aa, Staphylococcus
KNFSEFPALGLVLGVIIGI

SEQ ID NO: 1878895 - protein, 20 aa, Staphylococcus
KNFSEFPALGLVLGVMIGIG

SEQ ID NO: 1878896 - protein, 21 aa, Staphylococcus
KNGELTYQMFLNGRPTFNDEY

SEQ ID NO: 1878897 - protein, 20 aa, Staphylococcus
KNGRFIFYGMMIAEGIIAMI

SEQ ID NO: 1878898 - protein, 19 aa, Staphylococcus
KNGVFSGKLDFDFKATNSE

SEQ ID NO: 1878899 - protein, 17 aa, Staphylococcus
KNGVPFYPVLAIALGIL

SEQ ID NO: 1878900 - protein, 17 aa, Staphylococcus
KNGYKDLYMLKGGYKKW

SEQ ID NO: 1878901 - protein, 20 aa, Staphylococcus
KNHKRLLLGSVFLMATSAIG

SEQ ID NO: 1878902 - protein, 25 aa, Staphylococcus
KNIDGKKFKGAITIDMSDNTSTAYE

SEQ ID NO: 1878903 - protein, 24 aa, Staphylococcus
KNIEYRLLAALLIGSFLGVPLGIW

SEQ ID NO: 1878904 - protein, 19 aa, Staphylococcus
KNIIAIVIIMMIVYIALRY

SEQ ID NO: 1878905 - protein, 21 aa, Staphylococcus
KNIIAVIAILIIIYIALKYAP

SEQ ID NO: 1878906 - protein, 21 aa, Staphylococcus
KNIIFCLIGTFINAIGVNCFL

SEQ ID NO: 1878907 - protein, 17 aa, Staphylococcus
KNIKIIIVSGIIPFNII

SEQ ID NO: 1878908 - protein, 25 aa, Staphylococcus
KNIKRPKLKLFRRSLGLLTLGFLHA

SEQ ID NO: 1878909 - protein, 18 aa, Staphylococcus
KNILFPGAFKHIMGGIHM

SEQ ID NO: 1878910 - protein, 21 aa, Staphylococcus
KNIVAVIAILSIVYFALKYAP

SEQ ID NO: 1878911 - protein, 31 aa, Staphylococcus
KNKAKFANAVLRSMFSFGFLFGPLIGALLLS

SEQ ID NO: 1878912 - protein, 24 aa, Staphylococcus
KNKAKMILKSKAWAGLTGIISGVL

SEQ ID NO: 1878913 - protein, 21 aa, Staphylococcus
KNKEALKGIVIEKNNIGNAWW

SEQ ID NO: 1878914 - protein, 32 aa, Staphylococcus
KNKKALLYLLFCWTEIPGVIGMIEGVLTLVRP

SEQ ID NO: 1878915 - protein, 22 aa, Staphylococcus
KNKLWINIVSWTLIVILSALNI

SEQ ID NO: 1878916 - protein, 30 aa, Staphylococcus; identical to SEQ ID NO: 1583500

SEQ ID NO: 1878917 - protein, 19 aa, Staphylococcus
KNKNLKAFTLLEMLLVLLV

SEQ ID NO: 1878918 - protein, 18 aa, Staphylococcus
KNKQGLAVQQTWNGKQSK

SEQ ID NO: 1878919 - protein, 18 aa, Staphylococcus
KNKVVALAKALGAGVKRA

SEQ ID NO: 1878920 - protein, 21 aa, Staphylococcus
KNLKDGDPMTVVLYGIDDDAQ

SEQ ID NO: 1878921 - protein, 21 aa, Staphylococcus
KNLKDIKDFIADSIYNGKQYQ

SEQ ID NO: 1878922 - protein, 25 aa, Staphylococcus
KNLLKRYVLSVLIFFILSMVISNTS

SEQ ID NO: 1878923 - protein, 34 aa, Staphylococcus
KNLPHLITYCVRRLKKIWKWFAMSLVIGIILVLG

SEQ ID NO: 1878924 - protein, 17 aa, Staphylococcus
KNLPKAIPLAILIIGTA

SEQ ID NO: 1878925 - protein, 22 aa, Staphylococcus
KNLPNRALIVLSIVAVVIGAVF

SEQ ID NO: 1878926 - protein, 19 aa, Staphylococcus
KNLSEKFVWAIAYGSCIGW

SEQ ID NO: 1878927 - protein, 25 aa, Staphylococcus
KNLYQFRAALRFTYKNEDKYFKHKY

SEQ ID NO: 1878928 - protein, 31 aa, Staphylococcus
KNMIGCLPILIQLPILYGLIITLKFPSDGGI

SEQ ID NO: 1878929 - protein, 18 aa, Staphylococcus
KNMKRMMSLYTLTKSLGN

SEQ ID NO: 1878930 - protein, 21 aa, Staphylococcus
KNNEGRWIVQNGEPNVRGVLA

SEQ ID NO: 1878931 - protein, 19 aa, Staphylococcus
KNNGIAAIDAINVQARTRD

SEQ ID NO: 1878932 - protein, 24 aa, Staphylococcus
KNNITGQISIPGYIDPKNVTHTGK

SEQ ID NO: 1878933 - protein, 22 aa, Staphylococcus
KNPDIIKVFVVRIINQLSLFGL

SEQ ID NO: 1878934 - protein, 23 aa, Staphylococcus
KNPEKYNSYFIGDWYVSGDSAYQ

SEQ ID NO: 1878935 - protein, 19 aa, Staphylococcus
KNPFTNFVKVCISNLAGVP

SEQ ID NO: 1878936 - protein, 19 aa, Staphylococcus
KNQLEYFNPAGLYEKHSFK

SEQ ID NO: 1878937 - protein, 26 aa, Staphylococcus
KNQSIKDIESILSLISKKPQAKLEVQ

SEQ ID NO: 1878938 - protein, 17 aa, Staphylococcus
KNRAFKPLIAVIVISLC

SEQ ID NO: 1878939 - protein, 24 aa, Staphylococcus
KNRIPNFRFSLFAKITTITYFALF

SEQ ID NO: 1878940 - protein, 17 aa, Staphylococcus
KNRLNDIAKDWASLSYL

SEQ ID NO: 1878941 - protein, 33 aa, Staphylococcus
KNRMSLPAKILVWCVGILFILALLAMIYVIAKI

SEQ ID NO: 1878942 - protein, 19 aa, Staphylococcus
KNSHPIIDLRMFKNISFSS

SEQ ID NO: 1878943 - protein, 17 aa, Staphylococcus
KNSQFAVGIVIMAFTMI

SEQ ID NO: 1878944 - protein, 23 aa, Staphylococcus
KNSTYRFLGNRANLTALWNVQDR

SEQ ID NO: 1878945 - protein, 24 aa, Staphylococcus
KNTFEFQMLYGFRNELAEEIARQG

SEQ ID NO: 1878946 - protein, 26 aa, Staphylococcus
KNTIFCLLGTLLIALGVNCFVIPGNL

SEQ ID NO: 1878947 - protein, 23 aa, Staphylococcus
KNTKSHWLLTFVFAMINVLILFV

SEQ ID NO: 1878948 - protein, 20 aa, Staphylococcus
KNTNLLKHWVILDDKKQNHK

SEQ ID NO: 1878949 - protein, 20 aa, Staphylococcus
KNTVSTIRARFEIDDNGSLE

SEQ ID NO: 1878950 - protein, 19 aa, Staphylococcus
KNVIKSGLISAILLLIIYF

SEQ ID NO: 1878951 - protein, 26 aa, Staphylococcus
KNVKPRGNIILNILIFIGWMLLSQMV

SEQ ID NO: 1878952 - protein, 25 aa, Staphylococcus
KNVNYAEGFIRKYAKAVNIDSVQLI

SEQ ID NO: 1878953 - protein, 19 aa, Staphylococcus
KNVQWAMVIAAFVIGIALF

SEQ ID NO: 1878954 - protein, 25 aa, Staphylococcus
KNVTRAQIIAAMLFGMFIAILNQTL

SEQ ID NO: 1878955 - protein, 25 aa, Staphylococcus
KNYDYHLVKVIPYVLVLVLALIGVN

SEQ ID NO: 1878956 - protein, 19 aa, Staphylococcus
KNYDYRKVLSKGQHRIQGK

SEQ ID NO: 1878957 - protein, 19 aa, Staphylococcus
KPALIPVISILGMSVGGLI

SEQ ID NO: 1878958 - protein, 25 aa, Staphylococcus
KPAYHLTRQWHIFWGPPMIVISLFV

SEQ ID NO: 1878959 - protein, 23 aa, Staphylococcus
KPAYNLLRYWFLIWGPPMIAISL

SEQ ID NO: 1878960 - protein, 17 aa, Staphylococcus
KPDCTLPLMDGLYLNML

SEQ ID NO: 1878961 - protein, 20 aa, Staphylococcus
KPDHPFVYWATYNNVASLLD

SEQ ID NO: 1878962 - protein, 23 aa, Staphylococcus
KPENRTGFFYNTFVKNMDNIIHW

SEQ ID NO: 1878963 - protein, 26 aa, Staphylococcus
KPERNLPRAIPLAILVIGIVYIGIII

SEQ ID NO: 1878964 - protein, 24 aa, Staphylococcus
KPFILKMFTALVIMTIIIQIIMQI

SEQ ID NO: 1878965 - protein, 25 aa, Staphylococcus
KPFKRKDIMINIGWALLLRVIVIGM

SEQ ID NO: 1878966 - protein, 26 aa, Staphylococcus
KPGIVELICGIILFLFTLLELNNRNA

SEQ ID NO: 1878967 - protein, 25 aa, Staphylococcus
KPGQSIAFKGGKLIRDDRQVDEPFT

SEQ ID NO: 1878968 - protein, 22 aa, Staphylococcus
KPHVTNVMYTRHGMKEMILPNN

SEQ ID NO: 1878969 - protein, 17 aa, Staphylococcus
KPIIEINYLIPNLTITP

SEQ ID NO: 1878970 - protein, 26 aa, Staphylococcus
KPIIFFYKLMYPFIWLLNGAARLILK

SEQ ID NO: 1878971 - protein, 30 aa, Staphylococcus
KPIRRLTKVELPIAMPVIMAGIRTAMVLII

SEQ ID NO: 1878972 - protein, 31 aa, Staphylococcus
KPIRRLTKVELPIAMPVIMAGIRTAMVLIIG

SEQ ID NO: 1878973 - protein, 18 aa, Staphylococcus
KPKAIVISPGPGRPSDYP

SEQ ID NO: 1878974 - protein, 20 aa, Staphylococcus
KPKAQETILNVARKQKAKID

SEQ ID NO: 1878975 - protein, 20 aa, Staphylococcus
KPKIAYAFMAAIRMVPLIIS

SEQ ID NO: 1878976 - protein, 24 aa, Staphylococcus
KPKINLWKGIRQGLLMIIPTLIGY

SEQ ID NO: 1878977 - protein, 20 aa, Staphylococcus
KPKNATGYVILPTVYAKGMH

SEQ ID NO: 1878978 - protein, 18 aa, Staphylococcus
KPLDEVVKMVRGKKGTKV

SEQ ID NO: 1878979 - protein, 19 aa, Staphylococcus
KPLFAWQMNRVLLWIYLIV

SEQ ID NO: 1878980 - protein, 18 aa, Staphylococcus
KPLIPIVVSFAISFAHAI

SEQ ID NO: 1878981 - protein, 17 aa, Staphylococcus
KPLKDQFHYGFMLQGNG

SEQ ID NO: 1878982 - protein, 23 aa, Staphylococcus
KPLKEQFPYGFMLQGNGKVFGCL

SEQ ID NO: 1878983 - protein, 30 aa, Staphylococcus
KPLRDGVKVCTNCGTPVYQQGSNQSHHQYQ

SEQ ID NO: 1878984 - protein, 20 aa, Staphylococcus
KPLYSKRIYQNLTFDSIVFR

SEQ ID NO: 1878985 - protein, 19 aa, Staphylococcus
KPNEVIPIAGMLGSNGLIA

SEQ ID NO: 1878986 - protein, 18 aa, Staphylococcus
KPNEVIPISGMLANNGLI

SEQ ID NO: 1878987 - protein, 21 aa, Staphylococcus
KPNKPLIIISILVAVIAITLI

SEQ ID NO: 1878988 - protein, 17 aa, Staphylococcus
KPNMLKDIPYFFNGPAP

SEQ ID NO: 1878989 - protein, 21 aa, Staphylococcus
KPPKRSLYALIMTICGVHGTI

SEQ ID NO: 1878990 - protein, 20 aa, Staphylococcus
KPPKRSLYALIMTLCGVHGT

SEQ ID NO: 1878991 - protein, 22 aa, Staphylococcus
KPSKWRKVLRTIANIFVPLIPA

SEQ ID NO: 1878992 - protein, 21 aa, Staphylococcus
KPSLLPIIPLLGLSVGSLIGG

SEQ ID NO: 1878993 - protein, 25 aa, Staphylococcus
KPSQRKFWYSFGLIFGGLGLISMFF

SEQ ID NO: 1878994 - protein, 18 aa, Staphylococcus
KPTGLTQTVVDSGNDDAK

SEQ ID NO: 1878995 - protein, 19 aa, Staphylococcus
KPTYRKPGLYKDFEDGHIY

SEQ ID NO: 1878996 - protein, 19 aa, Staphylococcus
KPTYRKPGLYKDYDDGHIY

SEQ ID NO: 1878997 - protein, 19 aa, Staphylococcus
KPTYRKPGLYKEFDDGHVY

SEQ ID NO: 1878998 - protein, 19 aa, Staphylococcus
KPTYRKPGLYKTFDDGHIY

SEQ ID NO: 1878999 - protein, 21 aa, Staphylococcus
KPVFHPIYLILGIALPCVVYA

SEQ ID NO: 1879000 - protein, 25 aa, Staphylococcus
KPVFVEIFCGIIIFLFTFIEFNNRN

SEQ ID NO: 1879001 - protein, 17 aa, Staphylococcus
KPVGFKIVVSKVAEIEE

SEQ ID NO: 1879002 - protein, 18 aa, Staphylococcus
KPVGFKIVVSRVDEVEAL

SEQ ID NO: 1879003 - protein, 18 aa, Staphylococcus
KPVGFKIVVSRVEDIETL

SEQ ID NO: 1879004 - protein, 18 aa, Staphylococcus
KPVGISIDTANGALTVGY

SEQ ID NO: 1879005 - protein, 26 aa, Staphylococcus
KPVMNGWDHLDFVGLDATDYKRIGEE

SEQ ID NO: 1879006 - protein, 20 aa, Staphylococcus
KPYRFVCLQLVVIMFMILLT

SEQ ID NO: 1879007 - protein, 26 aa, Staphylococcus
KPYYHLPIIVDDAFVHFDKKRKRIML

SEQ ID NO: 1879008 - protein, 24 aa, Staphylococcus
KQAEKILKNHQLKLGDISRDYSNK

SEQ ID NO: 1879009 - protein, 23 aa, Staphylococcus
KQAMARSGGNPDLQNFNTVIDKG

SEQ ID NO: 1879010 - protein, 18 aa, Staphylococcus
KQAPLMIATILYGASTVG

SEQ ID NO: 1879011 - protein, 22 aa, Staphylococcus
KQDGLKFKVKEEEKQSVFVSIL

SEQ ID NO: 1879012 - protein, 19 aa, Staphylococcus
KQDGLKFTVKEEEKQSVFV

SEQ ID NO: 1879013 - protein, 18 aa, Staphylococcus
KQDISHLVDMGKLNEESK

SEQ ID NO: 1879014 - protein, 19 aa, Staphylococcus
KQEAVGRVNQLLNRAINDI

SEQ ID NO: 1879015 - protein, 22 aa, Staphylococcus
KQELIKTILLTKFDHIDTSKIV

SEQ ID NO: 1879016 - protein, 30 aa, Staphylococcus
KQEYKIAYFRKKIWISAGILGIIHYSGLLL

SEQ ID NO: 1879017 - protein, 20 aa, Staphylococcus
KQFGIALMLMMSYVMALLLY

SEQ ID NO: 1879018 - protein, 23 aa, Staphylococcus
KQFKQSVLYRIIPIGIFQYTALI

SEQ ID NO: 1879019 - protein, 30 aa, Staphylococcus
KQFSIRLLGRLLFIWFLRKMNAINENYGYF

SEQ ID NO: 1879020 - protein, 22 aa, Staphylococcus
KQFSQYMILLFIGFGIIFWIIE

SEQ ID NO: 1879021 - protein, 24 aa, Staphylococcus
KQGDKIGTPGFVRGMHDMHEKEGK

SEQ ID NO: 1879022 - protein, 17 aa, Staphylococcus
KQGRVSITDVVFTSSIM

SEQ ID NO: 1879023 - protein, 18 aa, Staphylococcus
KQHEAYRILADLVPEMDF

SEQ ID NO: 1879024 - protein, 17 aa, Staphylococcus
KQIEAGGPITVTHPDIT

SEQ ID NO: 1879025 - protein, 25 aa, Staphylococcus
KQIIPEIFAEPRYTVQGQNFPEGKG

SEQ ID NO: 1879026 - protein, 25 aa, Staphylococcus
KQIKDKRLPQVIKEATNIFNKLTNA

SEQ ID NO: 1879027 - protein, 27 aa, Staphylococcus
KQIKDKRLPQVINEAILIFTNLTNGAY

SEQ ID NO: 1879028 - protein, 25 aa, Staphylococcus
KQIKDKRLPQVINEATDIFAHLTNG

SEQ ID NO: 1879029 - protein, 26 aa, Staphylococcus
KQIKDKRLPQVINEAVNIFTALTQGN

SEQ ID NO: 1879030 - protein, 32 aa, Staphylococcus
KQIKDKRLPQVIQEAVSIFKYLTNGAYTMINY

SEQ ID NO: 1879031 - protein, 17 aa, Staphylococcus
KQINFTSAFILSCLLLF

SEQ ID NO: 1879032 - protein, 20 aa, Staphylococcus
KQIRFEFKWITIPYLIFAII

SEQ ID NO: 1879033 - protein, 24 aa, Staphylococcus
KQKAWDYAICITDLPNLSNNKTVV

SEQ ID NO: 1879034 - protein, 22 aa, Staphylococcus
KQKFYIVLMAITFIFSFSFLKL

SEQ ID NO: 1879035 - protein, 30 aa, Staphylococcus
KQKGKGLFFKIVIGLIIIVAIFFGVMYAMS

SEQ ID NO: 1879036 - protein, 31 aa, Staphylococcus
KQKKNFFPYILLSIGAFLTIGFMVFTIQRGR

SEQ ID NO: 1879037 - protein, 25 aa, Staphylococcus
KQKMLRITFVLLAIVGAGLAVFSFV

SEQ ID NO: 1879038 - protein, 26 aa, Staphylococcus
KQKNGSPIEARVTWVNNRGPNINSNQ

SEQ ID NO: 1879039 - protein, 20 aa, Staphylococcus
KQKVEEAVMRAKKLLEGANT

SEQ ID NO: 1879040 - protein, 18 aa, Staphylococcus
KQKVGLVLQDPFIFYGTI

SEQ ID NO: 1879041 - protein, 18 aa, Staphylococcus
KQKVKFSSSKSVKQIDDK

SEQ ID NO: 1879042 - protein, 17 aa, Staphylococcus
KQKVLHLPGDELINHSN

SEQ ID NO: 1879043 - protein, 19 aa, Staphylococcus
KQLDLKGILAFSTVSQLGM

SEQ ID NO: 1879044 - protein, 19 aa, Staphylococcus
KQLEHALNVEPLHFPEKGI

SEQ ID NO: 1879045 - protein, 21 aa, Staphylococcus
KQLELEHKININAPVSKYLPW

SEQ ID NO: 1879046 - protein, 19 aa, Staphylococcus
KQLKFSSLLLAIVINTTIN

SEQ ID NO: 1879047 - protein, 23 aa, Staphylococcus
KQLKWGSLMFHLGVIPVFFGHVV

SEQ ID NO: 1879048 - protein, 19 aa, Staphylococcus
KQLLAPIIVLISWNLITGV

SEQ ID NO: 1879049 - protein, 19 aa, Staphylococcus
KQLLAPIMVLISWNLITHI

SEQ ID NO: 1879050 - protein, 19 aa, Staphylococcus
KQLLAPIVVLIAWNMITNA

SEQ ID NO: 1879051 - protein, 27 aa, Staphylococcus
KQLLITPRFVLPMLIQGVTFIMLFSYI

SEQ ID NO: 1879052 - protein, 20 aa, Staphylococcus
KQLQSLILLMSHHSDNSNKV

SEQ ID NO: 1879053 - protein, 19 aa, Staphylococcus
KQLSSLQLLLLVFFSSTFT

SEQ ID NO: 1879054 - protein, 25 aa, Staphylococcus
KQMFPPEWSYLKAIWQPMLDTIRMA

SEQ ID NO: 1879055 - protein, 23 aa, Staphylococcus
KQMLPEGYQKWAYGWNPFTHYTT

SEQ ID NO: 1879056 - protein, 18 aa, Staphylococcus
KQNALWIKNVLNALQQKY

SEQ ID NO: 1879057 - protein, 27 aa, Staphylococcus
KQNESPLRYIIAIVIIILVVLGAFQLG

SEQ ID NO: 1879058 - protein, 21 aa, Staphylococcus
KQNFIEWVFDFVRGIIESNLA

SEQ ID NO: 1879059 - protein, 20 aa, Staphylococcus
KQNFIEWVFDFVRGIIESNM

SEQ ID NO: 1879060 - protein, 21 aa, Staphylococcus
KQNFWIKILLVSLFILQQLWL

SEQ ID NO: 1879061 - protein, 27 aa, Staphylococcus
KQNSDQLIALLLIELANQMDKDKVQAN

SEQ ID NO: 1879062 - protein, 18 aa, Staphylococcus
KQPLKYSYLIGELLAILP

SEQ ID NO: 1879063 - protein, 19 aa, Staphylococcus
KQQDLKGILAFSTVSQLGM

SEQ ID NO: 1879064 - protein, 22 aa, Staphylococcus
KQQDLKGILAFSTVSQLGMIMS

SEQ ID NO: 1879065 - protein, 23 aa, Staphylococcus
KQQKAEPRSSQQTQEAQTDEKTT

SEQ ID NO: 1879066 - protein, 21 aa, Staphylococcus
KQRVKELGLYQLIGLTRTNII

SEQ ID NO: 1879067 - protein, 25 aa, Staphylococcus
KQSKEYYKNCTLMRKKYPNGVKKGH

SEQ ID NO: 1879068 - protein, 24 aa, Staphylococcus
KQTESPLRYIIAIIVVILVILGAF

SEQ ID NO: 1879069 - protein, 20 aa, Staphylococcus
KQTSVAYILWFFLGGLGGHR

SEQ ID NO: 1879070 - protein, 24 aa, Staphylococcus
KQVFWRILLFYILAIFVIGMIIPY

SEQ ID NO: 1879071 - protein, 24 aa, Staphylococcus
KQVFWRILLFYILAIFVIGMLIPY

SEQ ID NO: 1879072 - protein, 17 aa, Staphylococcus
KQVKAKLIGKDTVSDIA

SEQ ID NO: 1879073 - protein, 19 aa, Staphylococcus
KQVKARLIGKDALTDIAVL

SEQ ID NO: 1879074 - protein, 17 aa, Staphylococcus
KQYPDIRLVTLHSEYRS

SEQ ID NO: 1879075 - protein, 21 aa, Staphylococcus
KQYSLEWFPIAVVATIIGYVV

SEQ ID NO: 1879076 - protein, 20 aa, Staphylococcus
KQYSLEWLPIAIISIIIGYI

SEQ ID NO: 1879077 - protein, 19 aa, Staphylococcus
KRAILAGIMMSFARAIGEF

SEQ ID NO: 1879078 - protein, 19 aa, Staphylococcus
KRAKIIQALSEMKPDIRSS

SEQ ID NO: 1879079 - protein, 29 aa, Staphylococcus
KRANDWFKRYGAWAVLLCRFIPVLRVLIT

SEQ ID NO: 1879080 - protein, 30 aa, Staphylococcus
KRANDWFKRYGAWAVLLCRFIPVLRVLITI

SEQ ID NO: 1879081 - protein, 23 aa, Staphylococcus
KRDLKQRNDIVFNRLESTADKKQ

SEQ ID NO: 1879082 - protein, 21 aa, Staphylococcus
KRDMSFGWLLIVIMFALPVWG

SEQ ID NO: 1879083 - protein, 18 aa, Staphylococcus
KRDTSSFRSAPENNVSND

SEQ ID NO: 1879084 - protein, 25 aa, Staphylococcus
KRDYKKGTAFAFICWLVISIAIFAV

SEQ ID NO: 1879085 - protein, 18 aa, Staphylococcus
KREANKIRREERLREKEE

SEQ ID NO: 1879086 - protein, 24 aa, Staphylococcus
KREIIGGITTFLSMAYILAVNPQV

SEQ ID NO: 1879087 - protein, 19 aa, Staphylococcus
KRFDHHKGIVSNDNANDTH

SEQ ID NO: 1879088 - protein, 19 aa, Staphylococcus
KRFEREVHNSSQLSHENIV

SEQ ID NO: 1879089 - protein, 21 aa, Staphylococcus
KRFEREVNNATQLSHENIVEV

SEQ ID NO: 1879090 - protein, 21 aa, Staphylococcus
KRFGTPHWLLLLFYIIGALPI

SEQ ID NO: 1879091 - protein, 24 aa, Staphylococcus
KRFNKDYWKFVLIMFPTIPISAIL

SEQ ID NO: 1879092 - protein, 21 aa, Staphylococcus
KRFTQKYFRISSVATLEKVVF

SEQ ID NO: 1879093 - protein, 24 aa, Staphylococcus
KRGLRILTEVELSYLISEAPIIAV

SEQ ID NO: 1879094 - protein, 25 aa, Staphylococcus
KRGRLFAEKIIKLFEVEDNIEESDK

SEQ ID NO: 1879095 - protein, 20 aa, Staphylococcus
KRGTAMGLFGLVIAFAPAIG

SEQ ID NO: 1879096 - protein, 20 aa, Staphylococcus
KRHKFKRFESLGGEVEAFFA

SEQ ID NO: 1879097 - protein, 17 aa, Staphylococcus
KRIALYGSVATGLASTL

SEQ ID NO: 1879098 - protein, 19 aa, Staphylococcus
KRIATLFDIILTLFLLALA

SEQ ID NO: 1879099 - protein, 24 aa, Staphylococcus
KRIEDNLRYRQIIFNHREDKSTLK

SEQ ID NO: 1879100 - protein, 21 aa, Staphylococcus
KRIEGVIDVHEFHLWSITTNQ

SEQ ID NO: 1879101 - protein, 23 aa, Staphylococcus
KRIGKNRYKVIGGKGGTIKLHLP

SEQ ID NO: 1879102 - protein, 21 aa, Staphylococcus
KRIGTALFWTILAILFIAGPY

SEQ ID NO: 1879103 - protein, 24 aa, Staphylococcus
KRIKKLPIAILIVLILLVSLIVYI

SEQ ID NO: 1879104 - protein, 18 aa, Staphylococcus
KRINYFKANDSQVLSTLV

SEQ ID NO: 1879105 - protein, 22 aa, Staphylococcus
KRIYQNLTFDSIVFRNALQYTV

SEQ ID NO: 1879106 - protein, 25 aa, Staphylococcus
KRKFEWPLFIVFAVIFILILPNTFY

SEQ ID NO: 1879107 - protein, 20 aa, Staphylococcus
KRKFTKEQRGSIIPNYVMGL

SEQ ID NO: 1879108 - protein, 18 aa, Staphylococcus
KRKINFNLLIGFLLSLCG

SEQ ID NO: 1879109 - protein, 21 aa, Staphylococcus
KRKKRRFGLNSEDIDKENSSN

SEQ ID NO: 1879110 - protein, 20 aa, Staphylococcus
KRKLDISIEDFIAHIKNFAS

SEQ ID NO: 1879111 - protein, 20 aa, Staphylococcus
KRKMSLKTSFTFVLLIVLIV

SEQ ID NO: 1879112 - protein, 19 aa, Staphylococcus
KRKRSLGAVGRGYKKVLKW

SEQ ID NO: 1879113 - protein, 20 aa, Staphylococcus
KRLAQKLMRLPLGVVEAKKI

SEQ ID NO: 1879114 - protein, 20 aa, Staphylococcus
KRLFDIQSHKKIYVFIDEIF

SEQ ID NO: 1879115 - protein, 21 aa, Staphylococcus
KRLFWVIPVYVFLKVLMPIII

SEQ ID NO: 1879116 - protein, 21 aa, Staphylococcus
KRLKNISNRSYIDRLLATHLS

SEQ ID NO: 1879117 - protein, 24 aa, Staphylococcus
KRLLESWKGFALLLLTGIIMILAS

SEQ ID NO: 1879118 - protein, 29 aa, Staphylococcus
KRLLKRKKILSIVLYCFILVVSFVTFEPV

SEQ ID NO: 1879119 - protein, 27 aa, Staphylococcus
KRLLVACGFVGAVAWTIYQYTVDLDLG

SEQ ID NO: 1879120 - protein, 20 aa, Staphylococcus
KRLPATVIGALFAVVFTYIF

SEQ ID NO: 1879121 - protein, 20 aa, Staphylococcus
KRLPDAVSILLMVVGTVISP

SEQ ID NO: 1879122 - protein, 32 aa, Staphylococcus
KRLPMLNLPIIPIWLSRFWVRLISQVPKEMVY

SEQ ID NO: 1879123 - protein, 26 aa, Staphylococcus
KRLPRPRLKLLRRAIFLLILGFIHAS

SEQ ID NO: 1879124 - protein, 19 aa, Staphylococcus
KRLVGQSGMSYGALGENAI

SEQ ID NO: 1879125 - protein, 32 aa, Staphylococcus
KRLVPIMTAFFCTFLAIVLLFVWPPVFNAIVT

SEQ ID NO: 1879126 - protein, 26 aa, Staphylococcus
KRMASLLDIFACCALMVLPHDSGMLM

SEQ ID NO: 1879127 - protein, 23 aa, Staphylococcus
KRNGFRINQVILGAGDYKHIGGE

SEQ ID NO: 1879128 - protein, 19 aa, Staphylococcus
KRNHYAFIMTMCGIHGTIS

SEQ ID NO: 1879129 - protein, 21 aa, Staphylococcus
KRNKLAIVGMIGLILIVILAF

SEQ ID NO: 1879130 - protein, 21 aa, Staphylococcus
KRNKLAVIGMIGLILIIILAL

SEQ ID NO: 1879131 - protein, 20 aa, Staphylococcus
KRNKLIISAILAFPLLLTML

SEQ ID NO: 1879132 - protein, 25 aa, Staphylococcus
KRNKLKFGLIIGILVLISYLLFLLL

SEQ ID NO: 1879133 - protein, 25 aa, Staphylococcus
KRNKLKFGLIIGILVLISYLLFLLS

SEQ ID NO: 1879134 - protein, 25 aa, Staphylococcus
KRNKLKFSLIIGILVLISYLLFLLS

SEQ ID NO: 1879135 - protein, 25 aa, Staphylococcus
KRNKLKFSLIIGVLIMISYLLFLLS

SEQ ID NO: 1879136 - protein, 24 aa, Staphylococcus
KRNKWKMFFWLAGLIILTLIIPPA

SEQ ID NO: 1879137 - protein, 19 aa, Staphylococcus
KRNLIVAVMLVSAFVAILN

SEQ ID NO: 1879138 - protein, 28 aa, Staphylococcus
KRNNLFMICPFIPFIGLIICFISPSTGV

SEQ ID NO: 1879139 - protein, 21 aa, Staphylococcus
KRNSIYTGIIFVVALILLVFA

SEQ ID NO: 1879140 - protein, 19 aa, Staphylococcus
KRNYLPLIISVSLSALLLY

SEQ ID NO: 1879141 - protein, 19 aa, Staphylococcus
KRPEVASQLSKAKELNKVM

SEQ ID NO: 1879142 - protein, 20 aa, Staphylococcus
KRPFRLHQFVMSFIMSVVVL

SEQ ID NO: 1879143 - protein, 23 aa, Staphylococcus
KRPHIKRYVALVGTIITLIIAIL

SEQ ID NO: 1879144 - protein, 21 aa, Staphylococcus
KRPIFVGQLLIILSFTIMTLL

SEQ ID NO: 1879145 - protein, 20 aa, Staphylococcus
KRPLIKRYVALAGSILTLIV

SEQ ID NO: 1879146 - protein, 20 aa, Staphylococcus
KRPVHNFVISILLFVLCTCI

SEQ ID NO: 1879147 - protein, 26 aa, Staphylococcus
KRPVIKRYVALIGCVLTLVAAIVNFN

SEQ ID NO: 1879148 - protein, 26 aa, Staphylococcus
KRQKMLRMVFILLAIVGAALTVFAFL

SEQ ID NO: 1879149 - protein, 27 aa, Staphylococcus
KRQKRIQYVIITFLVLLIILFLLYMFT

SEQ ID NO: 1879150 - protein, 20 aa, Staphylococcus
KRQQFKINYGHDIEDAIEKI

SEQ ID NO: 1879151 - protein, 25 aa, Staphylococcus
KRRHSETILPLSLFKYKSFSLSGRG

SEQ ID NO: 1879152 - protein, 26 aa, Staphylococcus
KRRKRRERQRRIQLSVFGVLIALIAL

SEQ ID NO: 1879153 - protein, 20 aa, Staphylococcus
KRRNFLYTLIVLVITLVLLV

SEQ ID NO: 1879154 - protein, 26 aa, Staphylococcus
KRRQREFAVYMILGMEKKHIKVSLVI

SEQ ID NO: 1879155 - protein, 17 aa, Staphylococcus
KRRRKARRKDWKERDRQ

SEQ ID NO: 1879156 - protein, 17 aa, Staphylococcus
KRSAVEILFATIGLIIG

SEQ ID NO: 1879157 - protein, 24 aa, Staphylococcus
KRSEIPQALSNVILKATEKNRSDR

SEQ ID NO: 1879158 - protein, 17 aa, Staphylococcus
KRSFSAGTIAAFMTMFA

SEQ ID NO: 1879159 - protein, 19 aa, Staphylococcus
KRSGRLIAMSSLLFCILLI

SEQ ID NO: 1879160 - protein, 19 aa, Staphylococcus
KRSIHELAHDFTKKEVNDT

SEQ ID NO: 1879161 - protein, 25 aa, Staphylococcus
KRSKKKKFAIIFILALLLLSLIGFI

SEQ ID NO: 1879162 - protein, 25 aa, Staphylococcus
KRSKKKKFFFALIFLILLAGLITFL

SEQ ID NO: 1879163 - protein, 21 aa, Staphylococcus
KRSYSLYLWHFAVISFIHSHY

SEQ ID NO: 1879164 - protein, 21 aa, Staphylococcus
KRSYSLYLWHFAVISFLHIHF

SEQ ID NO: 1879165 - protein, 21 aa, Staphylococcus
KRTFFSFLIVIIIKFILAWIL

SEQ ID NO: 1879166 - protein, 18 aa, Staphylococcus
KRTLGHKSDWIVISFGWG

SEQ ID NO: 1879167 - protein, 19 aa, Staphylococcus
KRTLWASLIITLIFTIVEF

SEQ ID NO: 1879168 - protein, 22 aa, Staphylococcus
KRTRVSMFFWLVCLLPLPFFFT

SEQ ID NO: 1879169 - protein, 24 aa, Staphylococcus
KRTTLLFIGSVCFLFIVMYFNLTV

SEQ ID NO: 1879170 - protein, 17 aa, Staphylococcus
KRVFSKKFVPVVMAASV

SEQ ID NO: 1879171 - protein, 18 aa, Staphylococcus
KRVIGVPGDNVIYKNDKL

SEQ ID NO: 1879172 - protein, 26 aa, Staphylococcus
KRVKLWSLRPHYRVCIDGSEVGILQM

SEQ ID NO: 1879173 - protein, 26 aa, Staphylococcus
KRVLAFSFAIITAFMIVELIGGYFAN

SEQ ID NO: 1879174 - protein, 19 aa, Staphylococcus
KRVNEVYLISHALLETGSV

SEQ ID NO: 1879175 - protein, 19 aa, Staphylococcus
KRYGIIFGAIAALIAIVLV

SEQ ID NO: 1879176 - protein, 30 aa, Staphylococcus
KRYHYRFLLLLRLFLTIVFTILLILIGLVT

SEQ ID NO: 1879177 - protein, 25 aa, Staphylococcus
KRYQDYFLQFNWFQPLLIGLSALLV

SEQ ID NO: 1879178 - protein, 20 aa, Staphylococcus
KRYTDFYLTMKIKRGLPDSN

SEQ ID NO: 1879179 - protein, 19 aa, Staphylococcus
KRYTNAYTKDEEKLIQSVS

SEQ ID NO: 1879180 - protein, 19 aa, Staphylococcus
KRYYLKYDKIIGMEIKTHP

SEQ ID NO: 1879181 - protein, 25 aa, Staphylococcus
KSADMKRLNRYGVDGVFTNYADKYK

SEQ ID NO: 1879182 - protein, 24 aa, Staphylococcus
KSAEIPYNLMKAMFGKLKEAAKNL

SEQ ID NO: 1879183 - protein, 20 aa, Staphylococcus
KSALILGVAIILFIMCIYWW

SEQ ID NO: 1879184 - protein, 31 aa, Staphylococcus
KSANIKARKIIPWGIAFFIIILLIIIFFLLK

SEQ ID NO: 1879185 - protein, 19 aa, Staphylococcus
KSATLGAIFLLFGTFLYFI

SEQ ID NO: 1879186 - protein, 22 aa, Staphylococcus
KSAVNGVIWRILIFYIGAIFVI

SEQ ID NO: 1879187 - protein, 20 aa, Staphylococcus
KSDAKSYLHQQLSAKIHAVE

SEQ ID NO: 1879188 - protein, 28 aa, Staphylococcus
KSDDIIPNILPYIVVKENARSMINQTAD

SEQ ID NO: 1879189 - protein, 17 aa, Staphylococcus
KSDDLQHDDRHDKKDGH

SEQ ID NO: 1879190 - protein, 18 aa, Staphylococcus
KSDIITMSLSYVRPTKEI

SEQ ID NO: 1879191 - protein, 17 aa, Staphylococcus
KSDVKNEEKHGSKKKGA

SEQ ID NO: 1879192 - protein, 22 aa, Staphylococcus
KSEAKRAIDDEVIAKKAEIDQN

SEQ ID NO: 1879193 - protein, 20 aa, Staphylococcus
KSEALDKLKDLGIKDSKVKQ

SEQ ID NO: 1879194 - protein, 20 aa, Staphylococcus
KSEANEIPWAMKKKQAPESS

SEQ ID NO: 1879195 - protein, 22 aa, Staphylococcus
KSEIIQSYILSLAVNFHPHEVA

SEQ ID NO: 1879196 - protein, 22 aa, Staphylococcus
KSEIVPLESHFFWFSDKLTKEK

SEQ ID NO: 1879197 - protein, 31 aa, Staphylococcus
KSELKYKAKWFPFGPIFAGILCVIVIVGQDV

SEQ ID NO: 1879198 - protein, 22 aa, Staphylococcus
KSEPHNLLFLIGITLLVALAVY

SEQ ID NO: 1879199 - protein, 18 aa, Staphylococcus
KSERRIRRKPSSDYNERE

SEQ ID NO: 1879200 - protein, 25 aa, Staphylococcus
KSFSINLLFLICLILGIASLIVSLF

SEQ ID NO: 1879201 - protein, 26 aa, Staphylococcus
KSGGNCYEVLKLLTFSPGILSQIYFA

SEQ ID NO: 1879202 - protein, 23 aa, Staphylococcus
KSGGSGLGLYIAQMLAHQIDGHI

SEQ ID NO: 1879203 - protein, 18 aa, Staphylococcus
KSGIPLTIVGYILVIIFS

SEQ ID NO: 1879204 - protein, 19 aa, Staphylococcus
KSGLYKFQASPSYETLDDA

SEQ ID NO: 1879205 - protein, 17 aa, Staphylococcus
KSGRLLILLNKISSIII

SEQ ID NO: 1879206 - protein, 17 aa, Staphylococcus
KSGYDSVEFTENALKQQ

SEQ ID NO: 1879207 - protein, 18 aa, Staphylococcus
KSGYIDLSVGASFIPYSD

SEQ ID NO: 1879208 - protein, 17 aa, Staphylococcus
KSHYMWIIVSYGISYLI

SEQ ID NO: 1879209 - protein, 17 aa, Staphylococcus
KSIASIYLSDNIDFKKS

SEQ ID NO: 1879210 - protein, 17 aa, Staphylococcus
KSIENIGKLSFGFMVPI

SEQ ID NO: 1879211 - protein, 17 aa, Staphylococcus
KSIKRLFDIQSHKKIYV

SEQ ID NO: 1879212 - protein, 17 aa, Staphylococcus
KSILRKIINLFRKEKKQ

SEQ ID NO: 1879213 - protein, 26 aa, Staphylococcus
KSILYFEIITTIAIGLGLIIGNIFKP

SEQ ID NO: 1879214 - protein, 25 aa, Staphylococcus
KSIPELADYAALSWMFVGLGAIPST

SEQ ID NO: 1879215 - protein, 17 aa, Staphylococcus
KSIPGVGPSKAREIINY

SEQ ID NO: 1879216 - protein, 26 aa, Staphylococcus
KSIPLYHYLLILSFFFLALFQVHHTL

SEQ ID NO: 1879217 - protein, 31 aa, Staphylococcus
KSIRRLFNISSKRQIYCFIDEIFKGTNTTER

SEQ ID NO: 1879218 - protein, 20 aa, Staphylococcus
KSIYYFIKYHNYHIVNIDKN

SEQ ID NO: 1879219 - protein, 20 aa, Staphylococcus
KSIYYWIKYFNYKLEHTDKN

SEQ ID NO: 1879220 - protein, 18 aa, Staphylococcus
KSKAFIIFMAIVVVLMVG

SEQ ID NO: 1879221 - protein, 22 aa, Staphylococcus
KSKAFTLIEMLLVLLIISLLLI

SEQ ID NO: 1879222 - protein, 19 aa, Staphylococcus
KSKAITAISAINAQPHKRQ

SEQ ID NO: 1879223 - protein, 18 aa, Staphylococcus
KSKEFLKNGNYFEGIYPG

SEQ ID NO: 1879224 - protein, 19 aa, Staphylococcus
KSKFKKFRENGGQVEAFFQ

SEQ ID NO: 1879225 - protein, 25 aa, Staphylococcus
KSKLRIVWWCAVGFTLCIILGTITV

SEQ ID NO: 1879226 - protein, 21 aa, Staphylococcus
KSKPRLSTFVLFIGFIIVIIN

SEQ ID NO: 1879227 - protein, 19 aa, Staphylococcus
KSKSIDILGMILLGLISIS

SEQ ID NO: 1879228 - protein, 26 aa, Staphylococcus
KSLLQRPKFVLPMLLQGMTFVILFSY

SEQ ID NO: 1879229 - protein, 23 aa, Staphylococcus
KSLLYIRIVISFVVGAIISALLQ

SEQ ID NO: 1879230 - protein, 17 aa, Staphylococcus
KSLPIFILLMFFSMQMV

SEQ ID NO: 1879231 - protein, 19 aa, Staphylococcus
KSMLSRLIDFTSLLPNTVP

SEQ ID NO: 1879232 - protein, 20 aa, Staphylococcus
KSNFKNYALYLFSLIFSIIL

SEQ ID NO: 1879233 - protein, 19 aa, Staphylococcus
KSNIIRWILILLILIPFVL

SEQ ID NO: 1879234 - protein, 25 aa, Staphylococcus
KSNLFSEKILDEFISSNSFPEDEVR

SEQ ID NO: 1879235 - protein, 24 aa, Staphylococcus
KSNPEIRTFLKFSSIYRWQIRKLD

SEQ ID NO: 1879236 - protein, 17 aa, Staphylococcus
KSPHEPFLFTLPSAIMM

SEQ ID NO: 1879237 - protein, 23 aa, Staphylococcus
KSPIFKAMMHFSLTMMIGTLLSV

SEQ ID NO: 1879238 - protein, 23 aa, Staphylococcus
KSPKSAFLYHWLVSGVTLLIELI

SEQ ID NO: 1879239 - protein, 18 aa, Staphylococcus
KSPLEIVMYLAIAVGIVY

SEQ ID NO: 1879240 - protein, 20 aa, Staphylococcus
KSPLLIGVGDDFNVIASDAI

SEQ ID NO: 1879241 - protein, 20 aa, Staphylococcus
KSPLLIGVGDGFNVIASDAL

SEQ ID NO: 1879242 - protein, 24 aa, Staphylococcus
KSPLLVGVGEGFNVIASDALAMIK

SEQ ID NO: 1879243 - protein, 20 aa, Staphylococcus
KSQALFPWEQLISVEERHHT

SEQ ID NO: 1879244 - protein, 17 aa, Staphylococcus
KSQGLKKVWGFIQNNGF

SEQ ID NO: 1879245 - protein, 24 aa, Staphylococcus
KSRFRIYIILIICVITMMLLLSLV

SEQ ID NO: 1879246 - protein, 24 aa, Staphylococcus
KSRKTADTRWSRFVVGSPLAAVLI

SEQ ID NO: 1879247 - protein, 18 aa, Staphylococcus
KSRRERLGMTLNELEQRT

SEQ ID NO: 1879248 - protein, 18 aa, Staphylococcus
KSRTRIPELTYNFKRIER

SEQ ID NO: 1879249 - protein, 18 aa, Staphylococcus
KSRTRMPEMTYNFKRIER

SEQ ID NO: 1879250 - protein, 19 aa, Staphylococcus
KSRTRMPEMTYNFKRIERY

SEQ ID NO: 1879251 - protein, 18 aa, Staphylococcus
KSRVFTFSTITSMILMMT

SEQ ID NO: 1879252 - protein, 20 aa, Staphylococcus
KSSGANGVTVYWYKKQQEGL

SEQ ID NO: 1879253 - protein, 25 aa, Staphylococcus
KSSKANGSTVYWFKDNQKALAETLS

SEQ ID NO: 1879254 - protein, 24 aa, Staphylococcus
KSSKGKKFLIALIIILLIASLAGF

SEQ ID NO: 1879255 - protein, 25 aa, Staphylococcus
KSSTLWGGLCGGLIVTFLILMINLG

SEQ ID NO: 1879256 - protein, 21 aa, Staphylococcus
KSSVFKGMMHFSVPMMIGSLL

SEQ ID NO: 1879257 - protein, 20 aa, Staphylococcus
KSSYYWIRYLNYDYIYQNSE

SEQ ID NO: 1879258 - protein, 25 aa, Staphylococcus
KSTEFPRIQLFMRSYTGTTNWESNF

SEQ ID NO: 1879259 - protein, 24 aa, Staphylococcus
KSTFMKAIAINLILAQTIETAVAA

SEQ ID NO: 1879260 - protein, 24 aa, Staphylococcus
KSTFMKALAINLILAQTIETATAD

SEQ ID NO: 1879261 - protein, 24 aa, Staphylococcus
KSTFMKAVALNIVLSQTIHTATAH

SEQ ID NO: 1879262 - protein, 24 aa, Staphylococcus
KSTFMKAVALNVIMAQSLNIATAE

SEQ ID NO: 1879263 - protein, 21 aa, Staphylococcus
KSTLCHLLLRFYDVDEGSIRI

SEQ ID NO: 1879264 - protein, 18 aa, Staphylococcus
KSTLLRLLVREFDTKRPE

SEQ ID NO: 1879265 - protein, 23 aa, Staphylococcus
KSTYLRSATSYSQSNLDIVTSNT

SEQ ID NO: 1879266 - protein, 24 aa, Staphylococcus
KSVAPWGQFFRRFSFYAIAGQYFV

SEQ ID NO: 1879267 - protein, 24 aa, Staphylococcus
KSVAPWNQFFKRMSFYAIAGQYFV

SEQ ID NO: 1879268 - protein, 21 aa, Staphylococcus
KSVCINGIITSLLLNAKPHEV

SEQ ID NO: 1879269 - protein, 19 aa, Staphylococcus
KSVEYKKKGNIGVFTITKF

SEQ ID NO: 1879270 - protein, 20 aa, Staphylococcus
KSWYKLGPISVQPSEFMKIV

SEQ ID NO: 1879271 - protein, 22 aa, Staphylococcus
KSYESYQYLVFHSMYKDDFSPI

SEQ ID NO: 1879272 - protein, 19 aa, Staphylococcus
KSYFAFYGILIFIGLIIGL

SEQ ID NO: 1879273 - protein, 19 aa, Staphylococcus
KSYSLEWFPIAIVTTIIGY

SEQ ID NO: 1879274 - protein, 19 aa, Staphylococcus
KTAAIAIILAPEFYNSIKD

SEQ ID NO: 1879275 - protein, 21 aa, Staphylococcus
KTAIYKKQFVFLQRNKKFIKR

SEQ ID NO: 1879276 - protein, 18 aa, Staphylococcus
KTALKLAKDPYHYNMALP

SEQ ID NO: 1879277 - protein, 18 aa, Staphylococcus
KTAQGIFVLDGLVVLSFL

SEQ ID NO: 1879278 - protein, 27 aa, Staphylococcus
KTASKRLPWLLILTFLGMITATILGSF

SEQ ID NO: 1879279 - protein, 18 aa, Staphylococcus
KTCIYGIGASALIAQDFK

SEQ ID NO: 1879280 - protein, 22 aa, Staphylococcus
KTDGYIDLSVGASFIPYKNSTG

SEQ ID NO: 1879281 - protein, 24 aa, Staphylococcus
KTDKSLVVDGQFKSVNALKNLKIP

SEQ ID NO: 1879282 - protein, 49 aa, Staphylococcus
KTDLKKIAKTPAVWIILAGLAILPSFYAWFNLWAMWDPYGNTGHIKVAI

SEQ ID NO: 1879283 - protein, 20 aa, Staphylococcus
KTELSFVEPMISRLELEAAN

SEQ ID NO: 1879284 - protein, 21 aa, Staphylococcus
KTEPHNLLFLIVITVLVALAV

SEQ ID NO: 1879285 - protein, 20 aa, Staphylococcus
KTEPHNLLFLVVITALVALA

SEQ ID NO: 1879286 - protein, 17 aa, Staphylococcus
KTESSWSVLKSKWLRPT

SEQ ID NO: 1879287 - protein, 24 aa, Staphylococcus
KTFFPFFLCVTIMYMSIGLQYLVQ

SEQ ID NO: 1879288 - protein, 26 aa, Staphylococcus
KTFGYKRFEILAALFNGVTLFVIGII

SEQ ID NO: 1879289 - protein, 24 aa, Staphylococcus
KTFGYKRFEILAAVLNGITLMLIA

SEQ ID NO: 1879290 - protein, 25 aa, Staphylococcus
KTFGYKRFEVLAALFNGVTLFIISA

SEQ ID NO: 1879291 - protein, 18 aa, Staphylococcus
KTFKDSFDSIGLSKKYLT

SEQ ID NO: 1879292 - protein, 18 aa, Staphylococcus
KTFLNFSSIYRWQSRKLN

SEQ ID NO: 1879293 - protein, 20 aa, Staphylococcus
KTGGLVAISGGRNFKDVVDN

SEQ ID NO: 1879294 - protein, 17 aa, Staphylococcus
KTGIAIILAMSIASLLP

SEQ ID NO: 1879295 - protein, 18 aa, Staphylococcus
KTGIKKAHSEGVKKIVLD

SEQ ID NO: 1879296 - protein, 24 aa, Staphylococcus
KTGTTRPGSLIDRLMKYINKHVYS

SEQ ID NO: 1879297 - protein, 25 aa, Staphylococcus
KTGTYEVFNFISWAPFTFLPIFIAI

SEQ ID NO: 1879298 - protein, 23 aa, Staphylococcus
KTHFPNFGGGVIGYYLVHLSIPL

SEQ ID NO: 1879299 - protein, 25 aa, Staphylococcus
KTILICGSTIFVSFLVILFAQFDLF

SEQ ID NO: 1879300 - protein, 26 aa, Staphylococcus
KTILYFEIITTIAIALGIILANLFKP

SEQ ID NO: 1879301 - protein, 26 aa, Staphylococcus
KTILYFEIITTIAIGLGIIFGNLFKP

SEQ ID NO: 1879302 - protein, 27 aa, Staphylococcus
KTIPKLSYKFVWLIMMLIFLFSILRVV

SEQ ID NO: 1879303 - protein, 20 aa, Staphylococcus
KTIQYPALLLIVFLIMLIIL

SEQ ID NO: 1879304 - protein, 21 aa, Staphylococcus
KTIYYWIRYLNYDVISREKDD

SEQ ID NO: 1879305 - protein, 23 aa, Staphylococcus
KTKAFTLIEMLLVLLIISLLLIL

SEQ ID NO: 1879306 - protein, 19 aa, Staphylococcus
KTKEVVSLVAVFDSPVIYN

SEQ ID NO: 1879307 - protein, 19 aa, Staphylococcus
KTKGINVINTIQLEIIKKV

SEQ ID NO: 1879308 - protein, 25 aa, Staphylococcus
KTKIKSVFPGALFTSIIWLLGSFGF

SEQ ID NO: 1879309 - protein, 25 aa, Staphylococcus
KTKLKSVLPGAIFTSVIWLLGSFAF

SEQ ID NO: 1879310 - protein, 21 aa, Staphylococcus
KTKRQREGLGVISKEYRRILK

SEQ ID NO: 1879311 - protein, 17 aa, Staphylococcus
KTLAKQEIIDFANKKHQ

SEQ ID NO: 1879312 - protein, 26 aa, Staphylococcus
KTLFIPEFLGSAVIGAIAIFGHSMVP

SEQ ID NO: 1879313 - protein, 22 aa, Staphylococcus
KTLGAAVGWFWFVFTGGLNVLG

SEQ ID NO: 1879314 - protein, 19 aa, Staphylococcus
KTLGAFPVGDYNLKASKKM

SEQ ID NO: 1879315 - protein, 21 aa, Staphylococcus
KTLKDNLQYRHILFNHRQDLK

SEQ ID NO: 1879316 - protein, 28 aa, Staphylococcus
KTLKNIKENLFFAFCYNAIGIPVAAFGL

SEQ ID NO: 1879317 - protein, 22 aa, Staphylococcus
KTLNTAMHGLRESIKDKAEIKN

SEQ ID NO: 1879318 - protein, 27 aa, Staphylococcus
KTLPFRRIISFFLVFTMLFSAGVVPLY

SEQ ID NO: 1879319 - protein, 28 aa, Staphylococcus
KTLYRKRTVIWPFYFYTIIRTLSIKVLN

SEQ ID NO: 1879320 - protein, 20 aa, Staphylococcus
KTLYYWIRYLNYDLLSSEKD

SEQ ID NO: 1879321 - protein, 22 aa, Staphylococcus
KTMKIGLTALGFKVDNETKSFD

SEQ ID NO: 1879322 - protein, 22 aa, Staphylococcus
KTMKVGLNVLGYHINNHSTEFD

SEQ ID NO: 1879323 - protein, 18 aa, Staphylococcus
KTMLWAAVFALTFFIIYA

SEQ ID NO: 1879324 - protein, 28 aa, Staphylococcus
KTMRKIFPWDFKILIGIGLLFCVSTPIA

SEQ ID NO: 1879325 - protein, 27 aa, Staphylococcus
KTMRKIFPWDFKKLIAIGLSFCALTPC

SEQ ID NO: 1879326 - protein, 20 aa, Staphylococcus
KTNIRIAIIVTSLFFGVIHL

SEQ ID NO: 1879327 - protein, 26 aa, Staphylococcus
KTNKPSQYLVPFTTMNLAEERFGHLI

SEQ ID NO: 1879328 - protein, 23 aa, Staphylococcus
KTNSNFILWLAIGLVFGSAPPIQ

SEQ ID NO: 1879329 - protein, 19 aa, Staphylococcus
KTPFMKLAITMVVATTLSH

SEQ ID NO: 1879330 - protein, 22 aa, Staphylococcus
KTPHTYALLMFVIFLAWLLTYI

SEQ ID NO: 1879331 - protein, 20 aa, Staphylococcus
KTPSRYALKSMMAGFLLSIV

SEQ ID NO: 1879332 - protein, 17 aa, Staphylococcus
KTQQVIIDKASPNYTES

SEQ ID NO: 1879333 - protein, 25 aa, Staphylococcus
KTQTLIKFKNIYAQIYIDQQSNEIV

SEQ ID NO: 1879334 - protein, 26 aa, Staphylococcus
KTQYKVVLPEGATFVTAENATGSFNE

SEQ ID NO: 1879335 - protein, 26 aa, Staphylococcus
KTQYKVVLPEGVQFISAQNARANYNS

SEQ ID NO: 1879336 - protein, 25 aa, Staphylococcus
KTRGKRLRYMPGLDGLRAIAVIGII

SEQ ID NO: 1879337 - protein, 23 aa, Staphylococcus
KTRRTFGLILLQFVLLIVSQLIY

SEQ ID NO: 1879338 - protein, 27 aa, Staphylococcus
KTSHRLNPTFMRWFSIAYFCEGAGYII

SEQ ID NO: 1879339 - protein, 26 aa, Staphylococcus
KTSKPGKIIIPRDGRTPNLTTSVQRG

SEQ ID NO: 1879340 - protein, 17 aa, Staphylococcus
KTSNGSKDKSELPETGL

SEQ ID NO: 1879341 - protein, 23 aa, Staphylococcus
KTSRLSWALATLMYIYINYVLSL

SEQ ID NO: 1879342 - protein, 19 aa, Staphylococcus
KTSTGFILASAGSAIGLGA

SEQ ID NO: 1879343 - protein, 19 aa, Staphylococcus
KTSTRYGAINIYDRINSLI

SEQ ID NO: 1879344 - protein, 25 aa, Staphylococcus
KTSYEVTKIDAEYSKLITKTLPENK

SEQ ID NO: 1879345 - protein, 18 aa, Staphylococcus
KTTAIGKFIPGDYLLETK

SEQ ID NO: 1879346 - protein, 25 aa, Staphylococcus
KTTDLRLFGGLIKQYPVLGWTFFIA

SEQ ID NO: 1879347 - protein, 20 aa, Staphylococcus
KTTLLIAWLLPVGVAIIPYS

SEQ ID NO: 1879348 - protein, 18 aa, Staphylococcus
KTTTPVKEGLLLVKEQAP

SEQ ID NO: 1879349 - protein, 23 aa, Staphylococcus
KTVGRYGWKTILYFEIITTIAIG

SEQ ID NO: 1879350 - protein, 17 aa, Staphylococcus
KTVNSPNRFDFIDSPED

SEQ ID NO: 1879351 - protein, 18 aa, Staphylococcus
KTWIIASIIIVVIIALIA

SEQ ID NO: 1879352 - protein, 20 aa, Staphylococcus
KTYFNFYGIGAFDENAVHTG

SEQ ID NO: 1879353 - protein, 25 aa, Staphylococcus
KTYGYKRFEVLAALFNGVTLFIISL

SEQ ID NO: 1879354 - protein, 25 aa, Staphylococcus
KTYGYKRFEVLAALFNGVTLFVISI

SEQ ID NO: 1879355 - protein, 20 aa, Staphylococcus
KTYQGIFSFDVLGLQDIHRN

SEQ ID NO: 1879356 - protein, 17 aa, Staphylococcus
KTYQIANEFSLFFQNGI

SEQ ID NO: 1879357 - protein, 33 aa, Staphylococcus
KTYTSRYWFIVCGLTLLPIYYFFIFKQFELQHF

SEQ ID NO: 1879358 - protein, 27 aa, Staphylococcus
KVAELPLFSGWGLRTIIYVFILTAAIT

SEQ ID NO: 1879359 - protein, 20 aa, Staphylococcus
KVAGYLFYFAVSVGVISFIV

SEQ ID NO: 1879360 - protein, 20 aa, Staphylococcus
KVAIALLMMFLFLFVPSMTK

SEQ ID NO: 1879361 - protein, 19 aa, Staphylococcus
KVAIVYFIVLAIFSIFTGL

SEQ ID NO: 1879362 - protein, 20 aa, Staphylococcus
KVAQEIPLFIILISIVGPIL

SEQ ID NO: 1879363 - protein, 24 aa, Staphylococcus
KVDIIKNRVLAAENNLLGAEKLAY

SEQ ID NO: 1879364 - protein, 25 aa, Staphylococcus
KVDRLPIEGMILFSPLLELQKNKTT

SEQ ID NO: 1879365 - protein, 20 aa, Staphylococcus
KVDWILVAIITLLAILSVTL

SEQ ID NO: 1879366 - protein, 25 aa, Staphylococcus
KVDYLYCLGLALALVIFTEIGNPKN

SEQ ID NO: 1879367 - protein, 19 aa, Staphylococcus
KVFFGELYDRIKGNRIIAF

SEQ ID NO: 1879368 - protein, 17 aa, Staphylococcus
KVFKGIIILALISSIFG

SEQ ID NO: 1879369 - protein, 17 aa, Staphylococcus
KVFKMMFQFILAILLIF

SEQ ID NO: 1879370 - protein, 26 aa, Staphylococcus
KVFKNKEFAVGLAIMAATMISMIGSE

SEQ ID NO: 1879371 - protein, 24 aa, Staphylococcus
KVFPIMGLFGFILLIPIIFKGFKR

SEQ ID NO: 1879372 - protein, 22 aa, Staphylococcus
KVFPIMGLFGFILLIPILYQGF

SEQ ID NO: 1879373 - protein, 23 aa, Staphylococcus
KVFPIMGLFGFILLIPVIYKGFL

SEQ ID NO: 1879374 - protein, 24 aa, Staphylococcus
KVFPWDFKILIGIGLLFCVATPLA

SEQ ID NO: 1879375 - protein, 27 aa, Staphylococcus
KVFVAPTMKFHVWRVAIQTDKHDYVGT

SEQ ID NO: 1879376 - protein, 17 aa, Staphylococcus
KVGEEMIDEPLHFRGGL

SEQ ID NO: 1879377 - protein, 19 aa, Staphylococcus
KVGLTGVLFSGIFFAILTV

SEQ ID NO: 1879378 - protein, 19 aa, Staphylococcus
KVGLTGVLFSGVFFAILTA

SEQ ID NO: 1879379 - protein, 27 aa, Staphylococcus
KVHKELEIAKILVMKALTNEEVAQIKL

SEQ ID NO: 1879380 - protein, 40 aa, Staphylococcus
KVIFEKNKLVIIVGCALVLLLAICCYKFLNVSNTDDNSNA

SEQ ID NO: 1879381 - protein, 17 aa, Staphylococcus
KVIKGYEQFLYRLMFMI

SEQ ID NO: 1879382 - protein, 27 aa, Staphylococcus
KVIRNRLKRQGIRKGVKVVFSDESPIV

SEQ ID NO: 1879383 - protein, 27 aa, Staphylococcus
KVIRNRLKRVGIRKGVKVVFSDESPIV

SEQ ID NO: 1879384 - protein, 24 aa, Staphylococcus
KVISFKLAWMPAIDLNLDLRLDGL

SEQ ID NO: 1879385 - protein, 18 aa, Staphylococcus
KVKAIGIYHLLAVSGSHV

SEQ ID NO: 1879386 - protein, 24 aa, Staphylococcus
KVKEKAHLTDSYYVDPSNYEDVTS

SEQ ID NO: 1879387 - protein, 31 aa, Staphylococcus
KVKELGVEPIARFVGFKAVGVDPKLMGIGPA

SEQ ID NO: 1879388 - protein, 26 aa, Staphylococcus
KVKELGVTPIARFVGYKAVGVDPKVM

SEQ ID NO: 1879389 - protein, 18 aa, Staphylococcus
KVKGLKMTLLILSVVLAG

SEQ ID NO: 1879390 - protein, 18 aa, Staphylococcus
KVKMKSIAFLIFIVVMLI

SEQ ID NO: 1879391 - protein, 17 aa, Staphylococcus
KVKNIITQLEYIKSKAI

SEQ ID NO: 1879392 - protein, 17 aa, Staphylococcus
KVLGYPIGLNFKSSGLT

SEQ ID NO: 1879393 - protein, 19 aa, Staphylococcus
KVLHAPVIQTVKFTRTPIV

SEQ ID NO: 1879394 - protein, 18 aa, Staphylococcus
KVLLISFLIIGSFMLIEI

SEQ ID NO: 1879395 - protein, 20 aa, Staphylococcus
KVLSFITIPLGIIIGNKKII

SEQ ID NO: 1879396 - protein, 20 aa, Staphylococcus
KVLVSHVFLLFKRRYNRYYG

SEQ ID NO: 1879397 - protein, 24 aa, Staphylococcus
KVLYRLTFVGSIFLAVIAILPIIA

SEQ ID NO: 1879398 - protein, 24 aa, Staphylococcus
KVLYRLTFVGSIFLAVIAILPIVA

SEQ ID NO: 1879399 - protein, 22 aa, Staphylococcus
KVMKRDFGLIPLYFLLLNVGQI

SEQ ID NO: 1879400 - protein, 18 aa, Staphylococcus
KVNIKIVLPGAIFTVIVL

SEQ ID NO: 1879401 - protein, 27 aa, Staphylococcus
KVNSAGVIPVIFAMAFFLLPRTLTMFF

SEQ ID NO: 1879402 - protein, 22 aa, Staphylococcus
KVPAIPAICMGIVLGFFAQIFV

SEQ ID NO: 1879403 - protein, 22 aa, Staphylococcus
KVPEGLDLITVILIAPAVAFGL

SEQ ID NO: 1879404 - protein, 18 aa, Staphylococcus
KVPEGLDLIVVILLAPAI

SEQ ID NO: 1879405 - protein, 21 aa, Staphylococcus
KVPFFPVLPVITFLLVLLVFW

SEQ ID NO: 1879406 - protein, 22 aa, Staphylococcus
KVPGHLNLAMLVFGLIMIVSII

SEQ ID NO: 1879407 - protein, 24 aa, Staphylococcus
KVPKKHIHEPWLFSLPAIILMVMI

SEQ ID NO: 1879408 - protein, 23 aa, Staphylococcus
KVPNEMTDDLLIDSFKTMNQLKS

SEQ ID NO: 1879409 - protein, 20 aa, Staphylococcus
KVPVNIAVAIILGLLVAILI

SEQ ID NO: 1879410 - protein, 18 aa, Staphylococcus
KVRAIKGLVTTKILQAQE

SEQ ID NO: 1879411 - protein, 28 aa, Staphylococcus
KVRFYPMIYRRLSFLLVIGVIHGMFIFS

SEQ ID NO: 1879412 - protein, 24 aa, Staphylococcus
KVRIENRWIVFLIFLISSIIVLIS

SEQ ID NO: 1879413 - protein, 18 aa, Staphylococcus
KVRKSVDSILRWESIILD

SEQ ID NO: 1879414 - protein, 25 aa, Staphylococcus
KVRKSVDSILRWESIILDPIGPILA

SEQ ID NO: 1879415 - protein, 17 aa, Staphylococcus
KVRNSVDTVLRWESIIL

SEQ ID NO: 1879416 - protein, 22 aa, Staphylococcus
KVSGMKRPIVISLCISGGLIIA

SEQ ID NO: 1879417 - protein, 17 aa, Staphylococcus
KVSKFLCIGTMLVTTVI

SEQ ID NO: 1879418 - protein, 19 aa, Staphylococcus
KVSKWKRLIPEGAQINKDI

SEQ ID NO: 1879419 - protein, 17 aa, Staphylococcus
KVSPLKLGLPMVTALSV

SEQ ID NO: 1879420 - protein, 24 aa, Staphylococcus
KVSRLFCIIAMGILVALLTFTPYI

SEQ ID NO: 1879421 - protein, 20 aa, Staphylococcus
KVTAVKYVFDEPLVLTNGQS

SEQ ID NO: 1879422 - protein, 25 aa, Staphylococcus
KVTEAKANAAQHLDQLTALNQAQHQ

SEQ ID NO: 1879423 - protein, 25 aa, Staphylococcus
KVTKTFKAIEHWIMQRSAVEILFAT

SEQ ID NO: 1879424 - protein, 17 aa, Staphylococcus
KVTMPRKETTPDSPTIE

SEQ ID NO: 1879425 - protein, 18 aa, Staphylococcus
KVTTLRGTFFGILIHIAF

SEQ ID NO: 1879426 - protein, 19 aa, Staphylococcus
KVVFYNSLVGFLFIILSII

SEQ ID NO: 1879427 - protein, 18 aa, Staphylococcus
KVVLKKFLFYGVPLTVSF

SEQ ID NO: 1879428 - protein, 21 aa, Staphylococcus
KVVYPVLIAFILGLVLLGVAH

SEQ ID NO: 1879429 - protein, 26 aa, Staphylococcus
KVYTDLKWCRMMIRQILSNSLKYSED

SEQ ID NO: 1879430 - protein, 20 aa, Staphylococcus
KWAESNASLIADFYKKINTE

SEQ ID NO: 1879431 - protein, 23 aa, Staphylococcus
KWAGAWMLFFFGWFIGYGPLMGM

SEQ ID NO: 1879432 - protein, 18 aa, Staphylococcus
KWFGEQRTPVYVYKWEDV

SEQ ID NO: 1879433 - protein, 26 aa, Staphylococcus
KWFTWGIPLHEGHLFGIANKVINLLV

SEQ ID NO: 1879434 - protein, 19 aa, Staphylococcus
KWGSLLFHLGIIPVFLGHV

SEQ ID NO: 1879435 - protein, 23 aa, Staphylococcus
KWIAIPARFILNIVRTIPDLLLA

SEQ ID NO: 1879436 - protein, 24 aa, Staphylococcus
KWINIPARFILNIVRTIPDLLLAA

SEQ ID NO: 1879437 - protein, 23 aa, Staphylococcus
KWITIPARFILNIVRTIPDLLLA

SEQ ID NO: 1879438 - protein, 20 aa, Staphylococcus
KWKRHFPDVRLVILHSEYRS

SEQ ID NO: 1879439 - protein, 18 aa, Staphylococcus
KWLDGRTEMHFSVGQFTE

SEQ ID NO: 1879440 - protein, 21 aa, Staphylococcus
KWLFFTCIVIALLVLAALLIQ

SEQ ID NO: 1879441 - protein, 22 aa, Staphylococcus
KWLHIPLAGSIIGMILFYILLH

SEQ ID NO: 1879442 - protein, 20 aa, Staphylococcus
KWLSVFDIFPVYGVKLTSVD

SEQ ID NO: 1879443 - protein, 21 aa, Staphylococcus
KWLTWGIPLHEGHLFSIANKI

SEQ ID NO: 1879444 - protein, 17 aa, Staphylococcus
KWMLITTTITFLTIFLF

SEQ ID NO: 1879445 - protein, 18 aa, Staphylococcus
KWNFRKLFNYGIDGLISF

SEQ ID NO: 1879446 - protein, 18 aa, Staphylococcus
KWPSIVVMAIVGLLVGPV

SEQ ID NO: 1879447 - protein, 19 aa, Staphylococcus
KWQFCAVMLAPLVIITIGL

SEQ ID NO: 1879448 - protein, 25 aa, Staphylococcus
KWRSQWQLLIIFGLFAITSNFTGIE

SEQ ID NO: 1879449 - protein, 22 aa, Staphylococcus
KWTSKRWLTISIAVFVVMMVLL

SEQ ID NO: 1879450 - protein, 20 aa, Staphylococcus
KWVILYGRRKFAAMILTGMV

SEQ ID NO: 1879451 - protein, 19 aa, Staphylococcus
KWVPLSIIILIGFFIGYVL

SEQ ID NO: 1879452 - protein, 36 aa, Staphylococcus
KYAKPKSKKPWIWVGVGCLVFFILIIIGIVALTFGM

SEQ ID NO: 1879453 - protein, 19 aa, Staphylococcus
KYAPPYHKTLIILTVIGII

SEQ ID NO: 1879454 - protein, 19 aa, Staphylococcus
KYDIKTILSNVSFLIPQGE

SEQ ID NO: 1879455 - protein, 20 aa, Staphylococcus
KYDKRIVIIILKAIASLIYI

SEQ ID NO: 1879456 - protein, 24 aa, Staphylococcus
KYDVKDILKDVSFRIPQGQVSAFV

SEQ ID NO: 1879457 - protein, 20 aa, Staphylococcus
KYFDTSCVPILSKTKKNLYG

SEQ ID NO: 1879458 - protein, 19 aa, Staphylococcus
KYFDVSCVPILSKSKKHLQ

SEQ ID NO: 1879459 - protein, 24 aa, Staphylococcus
KYFKHKYFDCMNIIIIKYCENLIS

SEQ ID NO: 1879460 - protein, 17 aa, Staphylococcus
KYFLLLILFIILMYPIH

SEQ ID NO: 1879461 - protein, 18 aa, Staphylococcus
KYGAIAVFICRFIPVLRV

SEQ ID NO: 1879462 - protein, 18 aa, Staphylococcus
KYGAKILAFIGMLIVVVT

SEQ ID NO: 1879463 - protein, 18 aa, Staphylococcus
KYGAWAVFLCRFVPVLRV

SEQ ID NO: 1879464 - protein, 20 aa, Staphylococcus
KYGCRDLKVNGYDLDHVKID

SEQ ID NO: 1879465 - protein, 21 aa, Staphylococcus
KYGHINFTFLNTLDSFKNTVS

SEQ ID NO: 1879466 - protein, 18 aa, Staphylococcus
KYGRIRTILFGICGLVMI

SEQ ID NO: 1879467 - protein, 17 aa, Staphylococcus
KYHHKVILDTTMLNMNQ

SEQ ID NO: 1879468 - protein, 19 aa, Staphylococcus
KYHIMPTLKKRGISNLDYI

SEQ ID NO: 1879469 - protein, 36 aa, Staphylococcus
KYIFQHILLFIGIFCFLKGFIGFFIGAKRLYIYTFP

SEQ ID NO: 1879470 - protein, 30 aa, Staphylococcus
KYIGMPIFLWIMWLIFQITFTWIGTPLSDQ

SEQ ID NO: 1879471 - protein, 19 aa, Staphylococcus
KYILRTALGYGIFASGLRY

SEQ ID NO: 1879472 - protein, 20 aa, Staphylococcus
KYIRFHLALLLLPVIVGIVG

SEQ ID NO: 1879473 - protein, 20 aa, Staphylococcus
KYIRKYATGISPEYTDLNES

SEQ ID NO: 1879474 - protein, 18 aa, Staphylococcus
KYITRVLYRLTFVGSIFL

SEQ ID NO: 1879475 - protein, 17 aa, Staphylococcus
KYKDYTAKSVVKQNKEA

SEQ ID NO: 1879476 - protein, 19 aa, Staphylococcus
KYKLGLFGTKIISVAKVHT

SEQ ID NO: 1879477 - protein, 21 aa, Staphylococcus
KYKLIKHILITMFALLCLILL

SEQ ID NO: 1879478 - protein, 19 aa, Staphylococcus
KYKSAMFVVLLIIVLLYLF

SEQ ID NO: 1879479 - protein, 19 aa, Staphylococcus
KYLLAWSKKKYESITNFSS

SEQ ID NO: 1879480 - protein, 20 aa, Staphylococcus
KYLLRLALGYGYFALGLKIL

SEQ ID NO: 1879481 - protein, 18 aa, Staphylococcus
KYLMEHIYNGKLYQLGGV

SEQ ID NO: 1879482 - protein, 34 aa, Staphylococcus
KYLPFFDIGMGWILPALIGFIIGLIVYKIRSNKS

SEQ ID NO: 1879483 - protein, 23 aa, Staphylococcus
KYLTEFYKYILVLIVVLLIDTCL

SEQ ID NO: 1879484 - protein, 17 aa, Staphylococcus
KYMIPRVAIIFNAIISM

SEQ ID NO: 1879485 - protein, 21 aa, Staphylococcus
KYNRKLAYIYVDGEMLNNILV

SEQ ID NO: 1879486 - protein, 18 aa, Staphylococcus
KYPFMMFGLPAAAFAIYR

SEQ ID NO: 1879487 - protein, 18 aa, Staphylococcus
KYPYGDSLRGIFGDVSTS

SEQ ID NO: 1879488 - protein, 18 aa, Staphylococcus
KYPYGDSLRGIFGNVSTP

SEQ ID NO: 1879489 - protein, 18 aa, Staphylococcus
KYPYGETLRSIFGSVSTP

SEQ ID NO: 1879490 - protein, 23 aa, Staphylococcus
KYQFSDLQNGSYVINFQTPEGYT

SEQ ID NO: 1879491 - protein, 24 aa, Staphylococcus
KYRKRFIALLLLCVMFAICWIAYI

SEQ ID NO: 1879492 - protein, 18 aa, Staphylococcus
KYRNVTLIFWIVSLASLL

SEQ ID NO: 1879493 - protein, 29 aa, Staphylococcus
KYSATSGQYYKLWIEDYQTKNGNTVTMLR

SEQ ID NO: 1879494 - protein, 19 aa, Staphylococcus
KYSFSIFFLSSFTMTFINI

SEQ ID NO: 1879495 - protein, 21 aa, Staphylococcus
KYSIGLLIFVCIWTFILSLIF

SEQ ID NO: 1879496 - protein, 33 aa, Staphylococcus
KYSIRKFKLGAASVTVASLLIFGTAGVAKAAEV

SEQ ID NO: 1879497 - protein, 28 aa, Staphylococcus
KYTAKLFPFGPIFAGFLCIIVILGQDVD

SEQ ID NO: 1879498 - protein, 21 aa, Staphylococcus
KYTLKNIIPGVVWAIGNLFLF

SEQ ID NO: 1879499 - protein, 19 aa, Staphylococcus
KYTQMKWLTPDDHYIHGKG

SEQ ID NO: 1879500 - protein, 18 aa, Staphylococcus
KYTTRKLYIFSMAAFLIG

SEQ ID NO: 1879501 - protein, 19 aa, Staphylococcus
KYVLPMLIQGVTFIMLFSY

SEQ ID NO: 1879502 - protein, 23 aa, Staphylococcus
KYVLRTALGYGIFATGLRYLSRL

SEQ ID NO: 1879503 - protein, 17 aa, Staphylococcus
KYVNRFGPKKILIVGLI

SEQ ID NO: 1879504 - protein, 19 aa, Staphylococcus
KYVQWAMLIAAFIVGIALF

SEQ ID NO: 1879505 - protein, 24 aa, Staphylococcus
KYVVNRLGLEFLKKNPPVKKEEIN

SEQ ID NO: 1879506 - protein, 18 aa, Staphylococcus
KYWYIGFITLLVCTTMHI

SEQ ID NO: 1879507 - protein, 19 aa, Staphylococcus
KYYFCFDLITPVIIITVIC

SEQ ID NO: 1879508 - protein, 20 aa, Staphylococcus
KYYFCLCLITPLVVITAACI

SEQ ID NO: 1879509 - protein, 20 aa, Staphylococcus
KYYFCLNLLLPFIIITGIFI

SEQ ID NO: 1879510 - protein, 36 aa, Staphylococcus
KYYFQITLDNASWWKSFRFFDENETELPTTVVDNNT

SEQ ID NO: 1879511 - protein, 18 aa, Staphylococcus
KYYGAAIFEKDFSKHAMS

SEQ ID NO: 1879512 - protein, 19 aa, Staphylococcus
KYYHTWLDSLIRSVTSFTV

SEQ ID NO: 1879513 - protein, 24 aa, Staphylococcus
KYYKNLDDQVLALITGDIGSMPDL

SEQ ID NO: 1879514 - protein, 20 aa, Staphylococcus
KYYLPKRIATLFDIILTLFL

SEQ ID NO: 1879515 - protein, 18 aa, Staphylococcus
KYYNFFGVGALDEDPIKT

SEQ ID NO: 1879516 - protein, 19 aa, Staphylococcus
KYYNFYGVGALDSDPVKTG

SEQ ID NO: 1879517 - protein, 27 aa, Staphylococcus
LAAFIACGFFLFMFGGTASDFWIACLA

SEQ ID NO: 1879518 - protein, 19 aa, Staphylococcus
LAAGILAFIGLILSPAIGA

SEQ ID NO: 1879519 - protein, 19 aa, Staphylococcus
LAAGVLAFIGLVLSPAIGA

SEQ ID NO: 1879520 - protein, 19 aa, Staphylococcus
LAAIMNFIGALTFTGVAGT

SEQ ID NO: 1879521 - protein, 22 aa, Staphylococcus
LAAKAIDSVVQFVARNRSKFAE

SEQ ID NO: 1879522 - protein, 24 aa, Staphylococcus
LAAKRVAAVHVMFNVIGASIFLII

SEQ ID NO: 1879523 - protein, 20 aa, Staphylococcus
LAALFAGLMTKVGIYALIRV

SEQ ID NO: 1879524 - protein, 21 aa, Staphylococcus
LAAQMTYHFVLAMFPMLIFLL

SEQ ID NO: 1879525 - protein, 20 aa, Staphylococcus
LAAVMNFIGALAFTGVAGTI

SEQ ID NO: 1879526 - protein, 19 aa, Staphylococcus
LAAVQRSEVGNGFVYGIGI

SEQ ID NO: 1879527 - protein, 18 aa, Staphylococcus
LACEIIFAIFKYKSRSLM

SEQ ID NO: 1879528 - protein, 19 aa, Staphylococcus
LACEIIFAIFRYKSRTIMV

SEQ ID NO: 1879529 - protein, 18 aa, Staphylococcus
LACEVVFAIFKYKSRSLM

SEQ ID NO: 1879530 - protein, 23 aa, Staphylococcus
LADLEGFKQLMLDMSSNPIYGLI

SEQ ID NO: 1879531 - protein, 20 aa, Staphylococcus
LADLLKWVFGGGDTFFNIVY

SEQ ID NO: 1879532 - protein, 23 aa, Staphylococcus
LADRIKWPSIVVMAIVGLLVGPI

SEQ ID NO: 1879533 - protein, 24 aa, Staphylococcus
LAEGYRAAILHHEWYFITHWHLTI

SEQ ID NO: 1879534 - protein, 22 aa, Staphylococcus
LAELRKLDAGYYFTDINRQYPY

SEQ ID NO: 1879535 - protein, 24 aa, Staphylococcus
LAESYRAAILFHEWYFIEHWKLLL

SEQ ID NO: 1879536 - protein, 23 aa, Staphylococcus
LAESYRAAILFHQWYFIEHWRLL

SEQ ID NO: 1879537 - protein, 23 aa, Staphylococcus
LAFAGLILSPAVGAILMSLSTII

SEQ ID NO: 1879538 - protein, 19 aa, Staphylococcus
LAFASLFLVIWFPTSPFVL

SEQ ID NO: 1879539 - protein, 19 aa, Staphylococcus
LAFDHAVSFDVDGFETDVR

SEQ ID NO: 1879540 - protein, 31 aa, Staphylococcus
LAFFVFKRKIGFPIFILIGLLFIYNQNMWDD

SEQ ID NO: 1879541 - protein, 21 aa, Staphylococcus
LAFGVLFDAFIVRMTLIPALT

SEQ ID NO: 1879542 - protein, 24 aa, Staphylococcus
LAFIFARAGLYSSKGGGMGGYAEY

SEQ ID NO: 1879543 - protein, 20 aa, Staphylococcus
LAFITDLFIAMSLIGYNLYI

SEQ ID NO: 1879544 - protein, 24 aa, Staphylococcus
LAFIVIGPVALWLGTGITNGVTFV

SEQ ID NO: 1879545 - protein, 20 aa, Staphylococcus
LAFLIAKGFYLPPEIAIGVI

SEQ ID NO: 1879546 - protein, 25 aa, Staphylococcus
LAGACASSAMLLPGISGSFMLLVFG

SEQ ID NO: 1879547 - protein, 17 aa, Staphylococcus
LAGIFAVGIFTKRANTF

SEQ ID NO: 1879548 - protein, 20 aa, Staphylococcus
LAGIGIMSGLLFYKRQQSQQ

SEQ ID NO: 1879549 - protein, 25 aa, Staphylococcus
LAGITFAAGAALVSRRMVQKKDKLK

SEQ ID NO: 1879550 - protein, 19 aa, Staphylococcus
LAGKFLGQVMKHFVNIFSI

SEQ ID NO: 1879551 - protein, 18 aa, Staphylococcus
LAGLFFQNGWGWIISIPG

SEQ ID NO: 1879552 - protein, 19 aa, Staphylococcus
LAGMTLWLGALVYLICYAK

SEQ ID NO: 1879553 - protein, 30 aa, Staphylococcus
LAGPMITYLIPLLIAFSGGRLIHDLRGGII

SEQ ID NO: 1879554 - protein, 31 aa, Staphylococcus
LAGPMITYLIPLLIAFSGGRLIHGLRGGIIA

SEQ ID NO: 1879555 - protein, 17 aa, Staphylococcus
LAGSIVGLLMFYLLLQF

SEQ ID NO: 1879556 - protein, 30 aa, Staphylococcus
LAGSRLLYSFGRDGILPSWLGKLNNKNLPN

SEQ ID NO: 1879557 - protein, 31 aa, Staphylococcus
LAGSRLLYSFGRDGLLPPWLSKLNHKHLPNR

SEQ ID NO: 1879558 - protein, 31 aa, Staphylococcus
LAGSRLLYSFGRDGLLPSWLAKLNHKHLPNR

SEQ ID NO: 1879559 - protein, 30 aa, Staphylococcus
LAGSRLLYSFGRDGLLPSWLGKLNNKHLPN

SEQ ID NO: 1879560 - protein, 30 aa, Staphylococcus; identical to SEQ ID NO: 1737218

SEQ ID NO: 1879561 - protein, 18 aa, Staphylococcus
LAGTLWLMITIIPISIIL

SEQ ID NO: 1879562 - protein, 20 aa, Staphylococcus
LAGTYLFVKLINLIRVKEVI

SEQ ID NO: 1879563 - protein, 17 aa, Staphylococcus
LAGVFAVGIFTKRTNTL

SEQ ID NO: 1879564 - protein, 20 aa, Staphylococcus
LAGVIEFIASGLFATSVLHK

SEQ ID NO: 1879565 - protein, 30 aa, Staphylococcus
LAHIIPEVIGNLLLSLAIFVCMIVIDWRMA

SEQ ID NO: 1879566 - protein, 25 aa, Staphylococcus
LAHLEKGKYGFAFASGIAAISAVLL

SEQ ID NO: 1879567 - protein, 17 aa, Staphylococcus
LAHSFNIMSSDIQRHID

SEQ ID NO: 1879568 - protein, 19 aa, Staphylococcus
LAIAHYFLNVFISKKLDEK

SEQ ID NO: 1879569 - protein, 25 aa, Staphylococcus
LAIATAMLIFRKKFTKEQKGSIVPN

SEQ ID NO: 1879570 - protein, 26 aa, Staphylococcus
LAIATTMLVFRKKFKKEQRGSIVPNY

SEQ ID NO: 1879571 - protein, 19 aa, Staphylococcus
LAIAYIWFRVYQVTTNPKA

SEQ ID NO: 1879572 - protein, 21 aa, Staphylococcus
LAIGAMLGWGWVVLSGEWVSA

SEQ ID NO: 1879573 - protein, 25 aa, Staphylococcus
LAIGGMALWIMYAHGLWEASTSLTT

SEQ ID NO: 1879574 - protein, 40 aa, Staphylococcus
LAIIILIIFAFAFRFIVKLIPVRFIFRVLSILIFVMTFKM

SEQ ID NO: 1879575 - protein, 20 aa, Staphylococcus
LAIIILLCIMLVFQKHSNEK

SEQ ID NO: 1879576 - protein, 17 aa, Staphylococcus
LAIILVVCSCYLAFILI

SEQ ID NO: 1879577 - protein, 24 aa, Staphylococcus
LAIKAESKGPIIFKQKRPGINNTI

SEQ ID NO: 1879578 - protein, 17 aa, Staphylococcus
LAILAFAVIMWVTEAVI

SEQ ID NO: 1879579 - protein, 17 aa, Staphylococcus
LAILAFAVIMWVTEAVT

SEQ ID NO: 1879580 - protein, 18 aa, Staphylococcus
LAILALEHHHAFKGLSWH

SEQ ID NO: 1879581 - protein, 20 aa, Staphylococcus
LAILLNINWLAILLYIEAVV

SEQ ID NO: 1879582 - protein, 18 aa, Staphylococcus
LAIPGSISAFIGAGVLTF

SEQ ID NO: 1879583 - protein, 17 aa, Staphylococcus
LAIPGSISGFIGAALLT

SEQ ID NO: 1879584 - protein, 20 aa, Staphylococcus
LAISRYGRFKLGADNEEPEF

SEQ ID NO: 1879585 - protein, 18 aa, Staphylococcus
LAITMIVIFVKRNLSSSD

SEQ ID NO: 1879586 - protein, 20 aa, Staphylococcus
LAIVCVIIYALYRSIAHKKY

SEQ ID NO: 1879587 - protein, 24 aa, Staphylococcus
LAIYREMMSGSALDPQTIKNEDVS

SEQ ID NO: 1879588 - protein, 27 aa, Staphylococcus
LAIYVFRFIWVFILFKQFYYPNNIQSY

SEQ ID NO: 1879589 - protein, 26 aa, Staphylococcus
LAIYVFRFIWVFVWYKDFYFPKNIQY

SEQ ID NO: 1879590 - protein, 27 aa, Staphylococcus
LAIYVFRFVWVYLLFKDFYYPNNVQSY

SEQ ID NO: 1879591 - protein, 24 aa, Staphylococcus
LAIYVVRFIWVFLLYKDFYYPNHL

SEQ ID NO: 1879592 - protein, 24 aa, Staphylococcus
LAKAHPIIYYYTAIDPVEVTLKAN

SEQ ID NO: 1879593 - protein, 23 aa, Staphylococcus
LAKCIPMVVAMIFSIIADVVAHS

SEQ ID NO: 1879594 - protein, 24 aa, Staphylococcus
LAKEAKTSILRRAYNYMDGTNEDT

SEQ ID NO: 1879595 - protein, 17 aa, Staphylococcus
LAKKDKQAIDNDIETVR

SEQ ID NO: 1879596 - protein, 20 aa, Staphylococcus
LAKREPFFGIAFVIMIFAIG

SEQ ID NO: 1879597 - protein, 24 aa, Staphylococcus
LALGALYLPLLFKIVQLQLNLSKG

SEQ ID NO: 1879598 - protein, 24 aa, Staphylococcus
LALGALYLPVLFKIVQLQLNLSNG

SEQ ID NO: 1879599 - protein, 17 aa, Staphylococcus
LALGRGGDQVAIKHING

SEQ ID NO: 1879600 - protein, 24 aa, Staphylococcus
LALHHIMPIWGWGIVVMFAGLIVM

SEQ ID NO: 1879601 - protein, 27 aa, Staphylococcus
LALIIGWLGRYLRYFRNLARDTMTQPF

SEQ ID NO: 1879602 - protein, 18 aa, Staphylococcus
LALLFATFYGSIKTADVA

SEQ ID NO: 1879603 - protein, 25 aa, Staphylococcus
LALLYSRPLYYFGNIMKPLIWLMNG

SEQ ID NO: 1879604 - protein, 25 aa, Staphylococcus
LALNLRKAKSLAFRDVKNHFVRNEN

SEQ ID NO: 1879605 - protein, 20 aa, Staphylococcus
LALPIYKIFIFEPFNFNQTT

SEQ ID NO: 1879606 - protein, 20 aa, Staphylococcus
LALTIGWIGRYLRYFRNLTR

SEQ ID NO: 1879607 - protein, 22 aa, Staphylococcus
LALYPNEWVQMSLAHSWLSKAI

SEQ ID NO: 1879608 - protein, 18 aa, Staphylococcus
LAMFCAQIGYPAQSKAIP

SEQ ID NO: 1879609 - protein, 29 aa, Staphylococcus
LAMIFLKERFTKMEWLAIIFAVIGVLYMT

SEQ ID NO: 1879610 - protein, 22 aa, Staphylococcus
LANEINSWLGLILTIIMLAVMY

SEQ ID NO: 1879611 - protein, 19 aa, Staphylococcus
LANELALFYKNGISLQKIV

SEQ ID NO: 1879612 - protein, 24 aa, Staphylococcus
LANLKAFITRTWTAIKNTTVKLAK

SEQ ID NO: 1879613 - protein, 25 aa, Staphylococcus
LANQFKFLILFSLLFVRSSIGYLLN

SEQ ID NO: 1879614 - protein, 24 aa, Staphylococcus
LAPGDYFITVRLGDREEQFEVRAK

SEQ ID NO: 1879615 - protein, 24 aa, Staphylococcus
LAPGMGLNAFFAFTVVLTMGIPWK

SEQ ID NO: 1879616 - protein, 24 aa, Staphylococcus
LAPGMGLNAFFAFTVVLTMGIPWQ

SEQ ID NO: 1879617 - protein, 18 aa, Staphylococcus
LAPIMKFIMHILSVGVEA

SEQ ID NO: 1879618 - protein, 24 aa, Staphylococcus
LAPLAEWVSAGFKKMGAAFNQWAQ

SEQ ID NO: 1879619 - protein, 19 aa, Staphylococcus
LAPLGVFAFICTTIITFGA

SEQ ID NO: 1879620 - protein, 19 aa, Staphylococcus
LAPLGVFAFICVTIMTFGA

SEQ ID NO: 1879621 - protein, 18 aa, Staphylococcus
LAQASIWNFLFLRRALPL

SEQ ID NO: 1879622 - protein, 18 aa, Staphylococcus
LAQEEHLNIWSGEVPADT

SEQ ID NO: 1879623 - protein, 20 aa, Staphylococcus
LAQGIGRWGNFMNHEAHGGM

SEQ ID NO: 1879624 - protein, 20 aa, Staphylococcus
LAQGIGRWGNFMNHEAHGGP

SEQ ID NO: 1879625 - protein, 19 aa, Staphylococcus
LAQMSEKFASWSATVAQSD

SEQ ID NO: 1879626 - protein, 21 aa, Staphylococcus
LARKWELVTNMGKFLDPLADK

SEQ ID NO: 1879627 - protein, 22 aa, Staphylococcus
LARKWELVTNMGKFLDPLADKL

SEQ ID NO: 1879628 - protein, 20 aa, Staphylococcus
LARLEGGKYAFAYASGIAAI

SEQ ID NO: 1879629 - protein, 22 aa, Staphylococcus
LASRLDRALTLYVQQPNAKFIV

SEQ ID NO: 1879630 - protein, 18 aa, Staphylococcus
LASVPLLFIFTFMMISFI

SEQ ID NO: 1879631 - protein, 19 aa, Staphylococcus
LATDYPLTPLSAGNRILVV

SEQ ID NO: 1879632 - protein, 25 aa, Staphylococcus
LATFLERFSYFLIIPFLSIYLAQNY

SEQ ID NO: 1879633 - protein, 17 aa, Staphylococcus
LATGLGQNVTWIRTISL

SEQ ID NO: 1879634 - protein, 24 aa, Staphylococcus
LATGVAILACIFANVGLTKIIMYS

SEQ ID NO: 1879635 - protein, 22 aa, Staphylococcus
LATIEKWLRKVVPTVLDNLLTP

SEQ ID NO: 1879636 - protein, 24 aa, Staphylococcus
LATIFAGSLGYLVVESLYRANLKT

SEQ ID NO: 1879637 - protein, 20 aa, Staphylococcus
LATLPTVFKADGTVTAGTSA

SEQ ID NO: 1879638 - protein, 17 aa, Staphylococcus
LATMFASLGSVLLFGRR

SEQ ID NO: 1879639 - protein, 17 aa, Staphylococcus
LATPKFVLPMLIQGFSF

SEQ ID NO: 1879640 - protein, 23 aa, Staphylococcus
LATQIKWPSIVVMSIVGLLIGPI

SEQ ID NO: 1879641 - protein, 21 aa, Staphylococcus
LATRYWRLVSLIPITLSCLVV

SEQ ID NO: 1879642 - protein, 24 aa, Staphylococcus
LATTRNAFFIGRTMDYNVSLEGAL

SEQ ID NO: 1879643 - protein, 18 aa, Staphylococcus
LATTTTDITGHYNFDNLT

SEQ ID NO: 1879644 - protein, 21 aa, Staphylococcus
LAVAIWGDFFDKLAGSSEIGT

SEQ ID NO: 1879645 - protein, 21 aa, Staphylococcus
LAVGSWRVNKPGVPITVLLGA

SEQ ID NO: 1879646 - protein, 24 aa, Staphylococcus
LAVIPVIICLIVFKGNENKMEQLL

SEQ ID NO: 1879647 - protein, 24 aa, Staphylococcus
LAVIPVLLCLVIFRGNESKMEQLL

SEQ ID NO: 1879648 - protein, 22 aa, Staphylococcus
LAVLFIPVWVLVLFLMYQKYKK

SEQ ID NO: 1879649 - protein, 20 aa, Staphylococcus
LAVNDFKWAIAHNLTVYKGL

SEQ ID NO: 1879650 - protein, 22 aa, Staphylococcus
LAVSITDFFQGVIMLIAMVMVP

SEQ ID NO: 1879651 - protein, 21 aa, Staphylococcus
LAVSLTDFFQGVIMLIAMVMV

SEQ ID NO: 1879652 - protein, 22 aa, Staphylococcus
LAVSLTDFFQGVVMLIAMVMVP

SEQ ID NO: 1879653 - protein, 24 aa, Staphylococcus
LAVSLTDFFQGVVMLIAMVMVPIV

SEQ ID NO: 1879654 - protein, 19 aa, Staphylococcus
LAVSRYGRFKLGDNDEAPE

SEQ ID NO: 1879655 - protein, 17 aa, Staphylococcus
LAVSVVFTAIGAIISSV

SEQ ID NO: 1879656 - protein, 25 aa, Staphylococcus
LAVYLFRFIWVYVLYPLFYLSVSPF

SEQ ID NO: 1879657 - protein, 25 aa, Staphylococcus
LAVYLFRFLWVYVLYPYFYLAVSPF

SEQ ID NO: 1879658 - protein, 25 aa, Staphylococcus
LAVYVFRFIWVYVLYPLFYLSVSPF

SEQ ID NO: 1879659 - protein, 25 aa, Staphylococcus
LAVYVFRFIWVYVLYPYFYLSVSPF

SEQ ID NO: 1879660 - protein, 23 aa, Staphylococcus
LAWLGIITQLFILLGLGIGTMFG

SEQ ID NO: 1879661 - protein, 18 aa, Staphylococcus
LAYDKAKAQYDIDDMKNL

SEQ ID NO: 1879662 - protein, 26 aa, Staphylococcus
LAYIPFELVLLLPLFVPKRKFEWPLF

SEQ ID NO: 1879663 - protein, 24 aa, Staphylococcus
LAYKDIKKIAAYQVILSIGFVILG

SEQ ID NO: 1879664 - protein, 17 aa, Staphylococcus
LAYRIVLSMIFMILMIV

SEQ ID NO: 1879665 - protein, 19 aa, Staphylococcus
LCGIVALAIGSSWSTMATV

SEQ ID NO: 1879666 - protein, 24 aa, Staphylococcus
LCGLVGLVIICCLIGFVRSFILLI

SEQ ID NO: 1879667 - protein, 22 aa, Staphylococcus
LCLACLLFLLGEFVVKHVSFLQ

SEQ ID NO: 1879668 - protein, 19 aa, Staphylococcus
LCLCRLNVVISLFISALVG

SEQ ID NO: 1879669 - protein, 18 aa, Staphylococcus
LCLCRLNVVISLFVSALV

SEQ ID NO: 1879670 - protein, 19 aa, Staphylococcus
LCMFVADLLLAIPSFIIAL

SEQ ID NO: 1879671 - protein, 25 aa, Staphylococcus
LCNMLSYGIGENVNFIWRLLACYVT

SEQ ID NO: 1879672 - protein, 26 aa, Staphylococcus
LCPNCHTRFKPGMWSFIKARHTMHTR

SEQ ID NO: 1879673 - protein, 17 aa, Staphylococcus
LCQFLPKLYLSKVSNDM

SEQ ID NO: 1879674 - protein, 18 aa, Staphylococcus
LCSLLVPLIMQFFVDFDI

SEQ ID NO: 1879675 - protein, 17 aa, Staphylococcus
LCSSSLFIYLDKWWIVI

SEQ ID NO: 1879676 - protein, 25 aa, Staphylococcus
LCSTAEMWFNHSIILPIILYSISGI

SEQ ID NO: 1879677 - protein, 17 aa, Staphylococcus
LCYFVSLTLLTMFISMY

SEQ ID NO: 1879678 - protein, 25 aa, Staphylococcus
LCYVSIVGFRRGLWLSSIHVICTLA

SEQ ID NO: 1879679 - protein, 17 aa, Staphylococcus
LDACITRLRVEVADKSK

SEQ ID NO: 1879680 - protein, 19 aa, Staphylococcus
LDALAKLSGILMDENVRAS

SEQ ID NO: 1879681 - protein, 18 aa, Staphylococcus
LDALSILPQVAMFFTSVG

SEQ ID NO: 1879682 - protein, 18 aa, Staphylococcus
LDASKLTLTYGVSKSFLK

SEQ ID NO: 1879683 - protein, 18 aa, Staphylococcus
LDDWKKRDTPYGYVDGDK

SEQ ID NO: 1879684 - protein, 21 aa, Staphylococcus
LDEIQRLDAGYHFKDINNDTP

SEQ ID NO: 1879685 - protein, 22 aa, Staphylococcus
LDEVKRTLVADLRRINDEDYSQ

SEQ ID NO: 1879686 - protein, 17 aa, Staphylococcus
LDFKVLIGIGLLFCVGT

SEQ ID NO: 1879687 - protein, 27 aa, Staphylococcus
LDFLPNIYNKYSIRKFTVGTASILLGS

SEQ ID NO: 1879688 - protein, 44 aa, Staphylococcus
LDFLPNKLNKYSIRRFTVGTASILVGATLIFGVANDQAEAAENN

SEQ ID NO: 1879689 - protein, 18 aa, Staphylococcus
LDGLSFLTLYLLHLHLGY

SEQ ID NO: 1879690 - protein, 18 aa, Staphylococcus
LDGYFVFDKGMTHAFYHQ

SEQ ID NO: 1879691 - protein, 23 aa, Staphylococcus
LDILIVWYVLYLLITVFKGTKAI

SEQ ID NO: 1879692 - protein, 18 aa, Staphylococcus
LDINRQITVLAFQYGDAI

SEQ ID NO: 1879693 - protein, 17 aa, Staphylococcus
LDIPNWLTALACVLLLM

SEQ ID NO: 1879694 - protein, 18 aa, Staphylococcus
LDIPVTWEAVSKGEVDAM

SEQ ID NO: 1879695 - protein, 17 aa, Staphylococcus
LDIRKAKSIAFRDVKNH

SEQ ID NO: 1879696 - protein, 24 aa, Staphylococcus
LDITGMTCAACSNRIEKVLNKAPG

SEQ ID NO: 1879697 - protein, 17 aa, Staphylococcus
LDKAVAFDDLDLNDPED

SEQ ID NO: 1879698 - protein, 17 aa, Staphylococcus
LDKDLFLAILVSITGSL

SEQ ID NO: 1879699 - protein, 19 aa, Staphylococcus
LDKDNHVIGSGTTDSNGRV

SEQ ID NO: 1879700 - protein, 30 aa, Staphylococcus
LDKQVAWIFDLIRVILPFIIILLLFITLYS

SEQ ID NO: 1879701 - protein, 20 aa, Staphylococcus
LDKQVEWVFDLVRIVLPLII

SEQ ID NO: 1879702 - protein, 19 aa, Staphylococcus
LDKRSVIYSTLGFGLILYA

SEQ ID NO: 1879703 - protein, 21 aa, Staphylococcus
LDLAVAVVMGAAFNKIITSLV

SEQ ID NO: 1879704 - protein, 21 aa, Staphylococcus
LDLFLTFKYYQIFISPKSAVE

SEQ ID NO: 1879705 - protein, 21 aa, Staphylococcus
LDLIIVWYVLYLLITVFKGTK

SEQ ID NO: 1879706 - protein, 22 aa, Staphylococcus
LDLLIVWYVLYLLITVFKGTKA

SEQ ID NO: 1879707 - protein, 20 aa, Staphylococcus
LDLLVILLMFFARAKTRKEY

SEQ ID NO: 1879708 - protein, 17 aa, Staphylococcus
LDLPSKRHRFIAVQYLL

SEQ ID NO: 1879709 - protein, 34 aa, Staphylococcus
LDLQKNMWKYLSLIGIIVLIAIYLAVRSINRTYI

SEQ ID NO: 1879710 - protein, 23 aa, Staphylococcus
LDLRGNILLFLSIFCLLISLTAW

SEQ ID NO: 1879711 - protein, 19 aa, Staphylococcus
LDLSFSILPIMMLIYGILA

SEQ ID NO: 1879712 - protein, 23 aa, Staphylococcus
LDLVIVWYVIYLLITVFKGTKAI

SEQ ID NO: 1879713 - protein, 23 aa, Staphylococcus
LDNFKEIFKQGTLLNALFISVAK

SEQ ID NO: 1879714 - protein, 22 aa, Staphylococcus
LDNLKLPKFLSIFHDTVVASAT

SEQ ID NO: 1879715 - protein, 20 aa, Staphylococcus
LDPILIFGFHLDVVGAALGT

SEQ ID NO: 1879716 - protein, 26 aa, Staphylococcus
LDQASFFLCLVLSLGVVAPIKNFTNY

SEQ ID NO: 1879717 - protein, 25 aa, Staphylococcus
LDQMKGRIAVAIAFQNVLLILLAFI

SEQ ID NO: 1879718 - protein, 23 aa, Staphylococcus
LDRISWVRWILYIVALFLPIFII

SEQ ID NO: 1879719 - protein, 17 aa, Staphylococcus
LDRVLITLGSTIVAIFA

SEQ ID NO: 1879720 - protein, 17 aa, Staphylococcus
LDRYRFYTHKKYKNLIV

SEQ ID NO: 1879721 - protein, 24 aa, Staphylococcus
LDSGHFFWPAILAFALTGIGLPLL

SEQ ID NO: 1879722 - protein, 25 aa, Staphylococcus
LDSGHYFWPAILAFVITGIGLPLLG

SEQ ID NO: 1879723 - protein, 24 aa, Staphylococcus
LDSGIKGKEFLPFVNHSAIAGILT

SEQ ID NO: 1879724 - protein, 25 aa, Staphylococcus
LDSIIFRNALTYAVIMGAAIFVSLF

SEQ ID NO: 1879725 - protein, 24 aa, Staphylococcus
LDTAKRLSKLIKMDTDHITTRDKQ

SEQ ID NO: 1879726 - protein, 18 aa, Staphylococcus
LDTAMKKLRDSIADANDI

SEQ ID NO: 1879727 - protein, 17 aa, Staphylococcus
LDTFFAEKGKIVGLLQM

SEQ ID NO: 1879728 - protein, 17 aa, Staphylococcus
LDTFVIRTGIEQGDFSY

SEQ ID NO: 1879729 - protein, 18 aa, Staphylococcus
LDTPLLNFGVFKNKQFAI

SEQ ID NO: 1879730 - protein, 17 aa, Staphylococcus
LDVDGNPAMAFFKQLHK

SEQ ID NO: 1879731 - protein, 32 aa, Staphylococcus
LDVFILLFIMKFGFRKIEAIVGALIFTVLAIF

SEQ ID NO: 1879732 - protein, 17 aa, Staphylococcus
LDVKWGAAITAVLAIGV

SEQ ID NO: 1879733 - protein, 25 aa, Staphylococcus
LDWKESRSRLPEMSYNFKRVERYRH

SEQ ID NO: 1879734 - protein, 21 aa, Staphylococcus
LDWWSSKLWIWIIPLALIGKS

SEQ ID NO: 1879735 - protein, 19 aa, Staphylococcus
LEADILFDGESTPIRKSTS

SEQ ID NO: 1879736 - protein, 21 aa, Staphylococcus
LEAKIPLKTLKLPKNVLTKDN

SEQ ID NO: 1879737 - protein, 26 aa, Staphylococcus
LEAMAHCATRLRLVLKDESIVDEAKL

SEQ ID NO: 1879738 - protein, 17 aa, Staphylococcus
LEDFKGDNLNSITKALS

SEQ ID NO: 1879739 - protein, 21 aa, Staphylococcus
LEDGGTLSSVFVPWNTCGVFI

SEQ ID NO: 1879740 - protein, 20 aa, Staphylococcus
LEDGGTLTSVFVPWNTCGVF

SEQ ID NO: 1879741 - protein, 17 aa, Staphylococcus
LEDHLFRITQEAISNTL

SEQ ID NO: 1879742 - protein, 18 aa, Staphylococcus
LEEISFMLMRAMQDKQRQ

SEQ ID NO: 1879743 - protein, 18 aa, Staphylococcus
LEEKPSRVEEGNFNTDQE

SEQ ID NO: 1879744 - protein, 22 aa, Staphylococcus
LEELEKMMLQLATFHSYHDLEF

SEQ ID NO: 1879745 - protein, 19 aa, Staphylococcus
LEFTGLGLLVCQKTIDAMV

SEQ ID NO: 1879746 - protein, 17 aa, Staphylococcus
LEGAAFAIVGWVGIKLV

SEQ ID NO: 1879747 - protein, 18 aa, Staphylococcus
LEGILQPLVEKYYVIEPI

SEQ ID NO: 1879748 - protein, 19 aa, Staphylococcus
LEGLFNHPIAIVFTFITVV

SEQ ID NO: 1879749 - protein, 22 aa, Staphylococcus
LEGLKPTLIYPLISVTITGLLM

SEQ ID NO: 1879750 - protein, 17 aa, Staphylococcus
LEGLKPTLIYPVLSVTI

SEQ ID NO: 1879751 - protein, 21 aa, Staphylococcus
LEHHHAFKGLSWHQSLFYSLF

SEQ ID NO: 1879752 - protein, 21 aa, Staphylococcus
LEHLDRLRLSFFTYHRNDTDI

SEQ ID NO: 1879753 - protein, 24 aa, Staphylococcus
LEHLDRLRLSYFTYHRTDADIDIV

SEQ ID NO: 1879754 - protein, 25 aa, Staphylococcus
LEHNHAFKGLSWHQALFDSLFQSAT

SEQ ID NO: 1879755 - protein, 20 aa, Staphylococcus
LEIATWHWLFFINIPIALIA

SEQ ID NO: 1879756 - protein, 19 aa, Staphylococcus
LEIDTLIAYHEQIFISLSK

SEQ ID NO: 1879757 - protein, 18 aa, Staphylococcus
LEIFSKTFVGLVYTFFIG

SEQ ID NO: 1879758 - protein, 17 aa, Staphylococcus
LEIGMICDGYLMRIDNL

SEQ ID NO: 1879759 - protein, 22 aa, Staphylococcus
LEILIIPSLVLQLLIRSLKPYP

SEQ ID NO: 1879760 - protein, 24 aa, Staphylococcus
LEIMTNIFLLMAMVALGLNVSFKD

SEQ ID NO: 1879761 - protein, 24 aa, Staphylococcus
LEKMTQKFAEWSVGISKSDGFKKF

SEQ ID NO: 1879762 - protein, 23 aa, Staphylococcus
LEKSHLAHLHFIIAKGAVNEDIK

SEQ ID NO: 1879763 - protein, 27 aa, Staphylococcus
LEKYRVPRWGSITIIFVILIGIITAAV

SEQ ID NO: 1879764 - protein, 17 aa, Staphylococcus
LELDRWHWIFIINIISA

SEQ ID NO: 1879765 - protein, 21 aa, Staphylococcus
LELIGNSVLNHFIPIIITMIL

SEQ ID NO: 1879766 - protein, 26 aa, Staphylococcus
LELLGPLFRPVMRPLFTLPGRSTVDN

SEQ ID NO: 1879767 - protein, 19 aa, Staphylococcus
LELLPKFDRIAVMIEGELV

SEQ ID NO: 1879768 - protein, 23 aa, Staphylococcus
LELLVIACPCALVISTPVAIVTG

SEQ ID NO: 1879769 - protein, 20 aa, Staphylococcus
LELTISFIALFIIVLGNGNS

SEQ ID NO: 1879770 - protein, 23 aa, Staphylococcus
LEMKEALIEAGGTRIRPILMTAI

SEQ ID NO: 1879771 - protein, 26 aa, Staphylococcus
LEMMKKRKVHIAAVYNDADFKGIITL

SEQ ID NO: 1879772 - protein, 20 aa, Staphylococcus
LENFKEGFTYLLNDKVLLKF

SEQ ID NO: 1879773 - protein, 25 aa, Staphylococcus
LENMPQWLSSLGYLFPLRYAGNALT

SEQ ID NO: 1879774 - protein, 17 aa, Staphylococcus
LENYSSYIILNPKKDYG

SEQ ID NO: 1879775 - protein, 24 aa, Staphylococcus
LEPEVFTKINWKVFITPIILTLVL

SEQ ID NO: 1879776 - protein, 19 aa, Staphylococcus
LERKDFRKGYTAEGLAIIL

SEQ ID NO: 1879777 - protein, 17 aa, Staphylococcus
LERLGLFERNIVVCSTN

SEQ ID NO: 1879778 - protein, 24 aa, Staphylococcus
LERLLKRWVPKVLQLFLVPMLSLI

SEQ ID NO: 1879779 - protein, 22 aa, Staphylococcus
LESEGKTVMFIAVKNQLTGMIA

SEQ ID NO: 1879780 - protein, 19 aa, Staphylococcus
LESELRWLPRKEQDRIMFK

SEQ ID NO: 1879781 - protein, 19 aa, Staphylococcus
LESFIRPNHNYSYQFDTYK

SEQ ID NO: 1879782 - protein, 18 aa, Staphylococcus
LESGAWKDGALAPQFLSV

SEQ ID NO: 1879783 - protein, 31 aa, Staphylococcus
LESITKFFKKHWVKVVIVVALIILILLLSAI

SEQ ID NO: 1879784 - protein, 18 aa, Staphylococcus
LESTIMYAGIIVDTRNFT

SEQ ID NO: 1879785 - protein, 18 aa, Staphylococcus
LESTVMYAGIIVDTRNFT

SEQ ID NO: 1879786 - protein, 23 aa, Staphylococcus
LETDFKLLLKIVGISIVPMGLIL

SEQ ID NO: 1879787 - protein, 20 aa, Staphylococcus
LETLLTLLILIIIIMISPSI

SEQ ID NO: 1879788 - protein, 20 aa, Staphylococcus
LEVATWHWLFYINIPIALIA

SEQ ID NO: 1879789 - protein, 17 aa, Staphylococcus
LEVKILYDDVGSKKVRM

SEQ ID NO: 1879790 - protein, 17 aa, Staphylococcus
LEVKLLYDDVGSKKLKR

SEQ ID NO: 1879791 - protein, 24 aa, Staphylococcus
LEVLKYSFYPVIFVICTIITIQFG

SEQ ID NO: 1879792 - protein, 18 aa, Staphylococcus
LEVLSSWGVIGLLIVIIL

SEQ ID NO: 1879793 - protein, 17 aa, Staphylococcus
LEVPFMIILGVLSSKLE

SEQ ID NO: 1879794 - protein, 19 aa, Staphylococcus
LEVPFMVILGILSRKLPTR

SEQ ID NO: 1879795 - protein, 17 aa, Staphylococcus
LEVPFMVLLGILSAKLT

SEQ ID NO: 1879796 - protein, 18 aa, Staphylococcus
LEVPILIHICINVEATIV

SEQ ID NO: 1879797 - protein, 27 aa, Staphylococcus
LEVSKYTNWRFSILIIVLIGLIGLMSI

SEQ ID NO: 1879798 - protein, 18 aa, Staphylococcus
LEVTRYVDITGNEVQETE

SEQ ID NO: 1879799 - protein, 21 aa, Staphylococcus
LEVVRGIQVIKAFSKEDTSLN

SEQ ID NO: 1879800 - protein, 22 aa, Staphylococcus
LEWFPMAIAALIIGYLISLGFK

SEQ ID NO: 1879801 - protein, 18 aa, Staphylococcus
LEYATMYGMFHWGPIAWA

SEQ ID NO: 1879802 - protein, 20 aa, Staphylococcus
LEYLDEAFLNKAKQLSKDYV

SEQ ID NO: 1879803 - protein, 24 aa, Staphylococcus
LEYNHAFKGYNWHQSLFYALFQSA

SEQ ID NO: 1879804 - protein, 17 aa, Staphylococcus
LFAARTSNQFGLEKTIF

SEQ ID NO: 1879805 - protein, 17 aa, Staphylococcus
LFAFAFSGLGIVLFVII

SEQ ID NO: 1879806 - protein, 24 aa, Staphylococcus
LFAKSFLLSIAMVISGFVSLIISG

SEQ ID NO: 1879807 - protein, 18 aa, Staphylococcus
LFAMERFFREKKIGLFIF

SEQ ID NO: 1879808 - protein, 18 aa, Staphylococcus
LFASEFIMTILMIIDYRR

SEQ ID NO: 1879809 - protein, 18 aa, Staphylococcus
LFATIPGIIMWHKSIATF

SEQ ID NO: 1879810 - protein, 18 aa, Staphylococcus
LFATIPGVVLWNKSIQSF

SEQ ID NO: 1879811 - protein, 19 aa, Staphylococcus
LFAVGHTFVTLIISRILGG

SEQ ID NO: 1879812 - protein, 20 aa, Staphylococcus
LFCIICCIIKPASANVLPDM

SEQ ID NO: 1879813 - protein, 17 aa, Staphylococcus
LFCITFIVAGVFSLFIM

SEQ ID NO: 1879814 - protein, 22 aa, Staphylococcus
LFCLALNLNPIFAILTAIVTIE

SEQ ID NO: 1879815 - protein, 24 aa, Staphylococcus
LFCLMLDLTPIFAILTAIVTIEPT

SEQ ID NO: 1879816 - protein, 24 aa, Staphylococcus
LFCMLLHLTPIFAILTAIVTIEPT

SEQ ID NO: 1879817 - protein, 19 aa, Staphylococcus
LFCSLLVPLVMQFFVDFNL

SEQ ID NO: 1879818 - protein, 24 aa, Staphylococcus
LFDDLFNRNSILDGIKDISNPSPG

SEQ ID NO: 1879819 - protein, 27 aa, Staphylococcus
LFDIILRFMEKLSYKKLLIVLGTMIVV

SEQ ID NO: 1879820 - protein, 19 aa, Staphylococcus
LFELPLVLIMTFALLISSY

SEQ ID NO: 1879821 - protein, 19 aa, Staphylococcus
LFELPLVLIMTFALLLSSY

SEQ ID NO: 1879822 - protein, 22 aa, Staphylococcus
LFELPLVLLMTFALLISSYTCG

SEQ ID NO: 1879823 - protein, 20 aa, Staphylococcus
LFEMAGNIGLFIGLVYTITF

SEQ ID NO: 1879824 - protein, 17 aa, Staphylococcus
LFFFGESSVKGFATMLL

SEQ ID NO: 1879825 - protein, 18 aa, Staphylococcus
LFFFGESSVKGFATMLLL

SEQ ID NO: 1879826 - protein, 18 aa, Staphylococcus
LFFIFKYKQPMFGKLSSQ

SEQ ID NO: 1879827 - protein, 21 aa, Staphylococcus
LFFKKLRKFKVNKAMLYAILL

SEQ ID NO: 1879828 - protein, 18 aa, Staphylococcus
LFFLCTVIGLVVLVALLA

SEQ ID NO: 1879829 - protein, 27 aa, Staphylococcus
LFFVLAFFVLFHVSAFAAEIPAKTANQ

SEQ ID NO: 1879830 - protein, 18 aa, Staphylococcus
LFGAIGLVMIGTYCLYLS

SEQ ID NO: 1879831 - protein, 19 aa, Staphylococcus
LFGALLFMFIRKVTTGREG

SEQ ID NO: 1879832 - protein, 19 aa, Staphylococcus
LFGDILTGIFILFTILNLI

SEQ ID NO: 1879833 - protein, 26 aa, Staphylococcus
LFGFIKRLLIPFGLHHIFHAPFWFEF

SEQ ID NO: 1879834 - protein, 31 aa, Staphylococcus
LFGGMIATFLSWRWIFVFSIIVSLIAVLLIK

SEQ ID NO: 1879835 - protein, 32 aa, Staphylococcus
LFGGMVATFVGWRWIYILSIIIALLAMYLIKG

SEQ ID NO: 1879836 - protein, 20 aa, Staphylococcus
LFGHVVWMMVIEMVRRYFFK

SEQ ID NO: 1879837 - protein, 18 aa, Staphylococcus
LFGIESWGINATNKANKN

SEQ ID NO: 1879838 - protein, 26 aa, Staphylococcus
LFGIGRLPAIIALVVYALLPILRNTY

SEQ ID NO: 1879839 - protein, 19 aa, Staphylococcus
LFGIIFLLIGIIFKPITDP

SEQ ID NO: 1879840 - protein, 20 aa, Staphylococcus
LFGIIGMLLSLIAGRISDLI

SEQ ID NO: 1879841 - protein, 19 aa, Staphylococcus
LFGIIGMLLSLLAGRISDR

SEQ ID NO: 1879842 - protein, 19 aa, Staphylococcus
LFGLIGMLLALAAGRVSDF

SEQ ID NO: 1879843 - protein, 30 aa, Staphylococcus
LFGNASWYLPKWLGVILPKIDVEGKALEER

SEQ ID NO: 1879844 - protein, 18 aa, Staphylococcus
LFGWKTDFGPALFQSINP

SEQ ID NO: 1879845 - protein, 20 aa, Staphylococcus
LFHLKAGWIVPIAILTALSI

SEQ ID NO: 1879846 - protein, 22 aa, Staphylococcus
LFHLKPSILRTLAFSTSTRNAL

SEQ ID NO: 1879847 - protein, 23 aa, Staphylococcus
LFIAAIFHWTAGFSFSAGLIDFV

SEQ ID NO: 1879848 - protein, 18 aa, Staphylococcus
LFIAMSLIGYNLYIPVYL

SEQ ID NO: 1879849 - protein, 27 aa, Staphylococcus
LFIASLFQWTAGFSFSAGLIDYVLSLI

SEQ ID NO: 1879850 - protein, 24 aa, Staphylococcus
LFIFCITTILPFFLIRKGLVKYGE

SEQ ID NO: 1879851 - protein, 20 aa, Staphylococcus
LFIFCIVMIVLVRPISVLFS

SEQ ID NO: 1879852 - protein, 20 aa, Staphylococcus
LFIFQYSKLILFTTYILIHT

SEQ ID NO: 1879853 - protein, 24 aa, Staphylococcus
LFIFRCLVVILVFVGAVVKTETVW

SEQ ID NO: 1879854 - protein, 24 aa, Staphylococcus
LFIFRCLVVVLVFFGAVIKTETVW

SEQ ID NO: 1879855 - protein, 24 aa, Staphylococcus
LFIFRCLVVVLVFTGAVVKTETVW

SEQ ID NO: 1879856 - protein, 24 aa, Staphylococcus
LFIFRCLVVVLVFVGAVIKTETVW

SEQ ID NO: 1879857 - protein, 17 aa, Staphylococcus
LFIFVFILVNIFLVVIY

SEQ ID NO: 1879858 - protein, 17 aa, Staphylococcus
LFIFVFILVNILLVLIY

SEQ ID NO: 1879859 - protein, 17 aa, Staphylococcus
LFIFVFILVNILLVMIY

SEQ ID NO: 1879860 - protein, 19 aa, Staphylococcus
LFIIFLFVWWAFKTVQIQA

SEQ ID NO: 1879861 - protein, 17 aa, Staphylococcus
LFIKFLINKGFKEKLSD

SEQ ID NO: 1879862 - protein, 19 aa, Staphylococcus
LFIKKPLRTLTWLMAIIVY

SEQ ID NO: 1879863 - protein, 22 aa, Staphylococcus
LFIKQVTELFGLDLTSQLEQAS

SEQ ID NO: 1879864 - protein, 17 aa, Staphylococcus
LFIKRARKYGLIISHIY

SEQ ID NO: 1879865 - protein, 25 aa, Staphylococcus
LFIKTRKNWVLWFLFLNLMMLGISY

SEQ ID NO: 1879866 - protein, 26 aa, Staphylococcus
LFIKYFSTIRLKTYIWTNIVAQSAVF

SEQ ID NO: 1879867 - protein, 26 aa, Staphylococcus
LFILIFKRQWLSTKAFSKKFVPVVMA

SEQ ID NO: 1879868 - protein, 19 aa, Staphylococcus
LFILLGLGIGTMFGGTSEV

SEQ ID NO: 1879869 - protein, 17 aa, Staphylococcus
LFILMSVAIIFSTIVTL

SEQ ID NO: 1879870 - protein, 23 aa, Staphylococcus
LFIQSFIYWFLAIIAINYTLAFV

SEQ ID NO: 1879871 - protein, 18 aa, Staphylococcus
LFISLLLLILKKRYKYLT

SEQ ID NO: 1879872 - protein, 29 aa, Staphylococcus
LFITIAIAFYMLRRIINIYHGTFVIHVQW

SEQ ID NO: 1879873 - protein, 17 aa, Staphylococcus
LFITLFYSRFVNEVDGV

SEQ ID NO: 1879874 - protein, 17 aa, Staphylococcus
LFIVFLLGMVIMALLMF

SEQ ID NO: 1879875 - protein, 18 aa, Staphylococcus
LFKDEILIHVYIQSVFVA

SEQ ID NO: 1879876 - protein, 23 aa, Staphylococcus
LFKELLSPMLIGGFTTVTVASVV

SEQ ID NO: 1879877 - protein, 25 aa, Staphylococcus
LFKGRRGPAGFFFMLGVTIFVLIYW

SEQ ID NO: 1879878 - protein, 18 aa, Staphylococcus
LFKKQIEAGGPITVTHPD

SEQ ID NO: 1879879 - protein, 24 aa, Staphylococcus
LFKKTSFWLPFIISSIVFGSQHGI

SEQ ID NO: 1879880 - protein, 18 aa, Staphylococcus
LFKLSLLENIRFYKPDAT

SEQ ID NO: 1879881 - protein, 24 aa, Staphylococcus
LFKNKELLAIMGVLLTFNLCLQTL

SEQ ID NO: 1879882 - protein, 24 aa, Staphylococcus
LFKNRRLAYITSIWATSTLLLGIG

SEQ ID NO: 1879883 - protein, 20 aa, Staphylococcus
LFKPLALGVQQFFDKSVLIF

SEQ ID NO: 1879884 - protein, 17 aa, Staphylococcus
LFLAIGAMLGWGWVVLS

SEQ ID NO: 1879885 - protein, 26 aa, Staphylococcus
LFLAYIPFELCLLLRLFKPRKKYEWP

SEQ ID NO: 1879886 - protein, 18 aa, Staphylococcus
LFLFFTFIILFSFMPSSI

SEQ ID NO: 1879887 - protein, 19 aa, Staphylococcus
LFLGIMVFLAGCDYSKPEK

SEQ ID NO: 1879888 - protein, 19 aa, Staphylococcus
LFLGIMVFLAGCDYSKQGN

SEQ ID NO: 1879889 - protein, 18 aa, Staphylococcus
LFLGLMVFLAGCDYSKPG

SEQ ID NO: 1879890 - protein, 17 aa, Staphylococcus
LFLIIAMYLLLEVLTII

SEQ ID NO: 1879891 - protein, 31 aa, Staphylococcus
LFLKTRSNWIFWIIFLQFVFLGMAYIDYDMA

SEQ ID NO: 1879892 - protein, 25 aa, Staphylococcus
LFLLCIIVIISFLALGAIITHAIYN

SEQ ID NO: 1879893 - protein, 20 aa, Staphylococcus
LFLLFFIFLSFIGLFIYTYF

SEQ ID NO: 1879894 - protein, 27 aa, Staphylococcus
LFLLKKLKWPIGLIIVAVSISSLGSIS

SEQ ID NO: 1879895 - protein, 26 aa, Staphylococcus
LFLLMLVRLLHGIAFGLASTATGTIS

SEQ ID NO: 1879896 - protein, 18 aa, Staphylococcus
LFLNGWFQGMGWPPSGRV

SEQ ID NO: 1879897 - protein, 19 aa, Staphylococcus
LFLPFLMDYGLLEFLGPVF

SEQ ID NO: 1879898 - protein, 19 aa, Staphylococcus
LFLPFLMEYGLLEFLGPLF

SEQ ID NO: 1879899 - protein, 17 aa, Staphylococcus
LFLPIFIVYTVVKPVTE

SEQ ID NO: 1879900 - protein, 19 aa, Staphylococcus
LFLPLLMEYGLLEFLGPLF

SEQ ID NO: 1879901 - protein, 17 aa, Staphylococcus
LFLPNGKLSSLVLNFNL

SEQ ID NO: 1879902 - protein, 19 aa, Staphylococcus
LFLQFDRLIAVLGGVTPFL

SEQ ID NO: 1879903 - protein, 19 aa, Staphylococcus
LFLRGCSIGGINLGLTTDT

SEQ ID NO: 1879904 - protein, 24 aa, Staphylococcus
LFLTACLFGQLFIENITIYNSLII

SEQ ID NO: 1879905 - protein, 20 aa, Staphylococcus
LFLVVFCWQPIHFYALAIKR

SEQ ID NO: 1879906 - protein, 22 aa, Staphylococcus
LFMEVHEVFTPIATIIGSVFLP

SEQ ID NO: 1879907 - protein, 20 aa, Staphylococcus
LFMIFLIRTAITLPIIALMA

SEQ ID NO: 1879908 - protein, 19 aa, Staphylococcus
LFMLGFAVALIINYPHLNI

SEQ ID NO: 1879909 - protein, 18 aa, Staphylococcus
LFMNFYFSYYQAIVLGFY

SEQ ID NO: 1879910 - protein, 17 aa, Staphylococcus
LFMSMFWIVGTVIYMLF

SEQ ID NO: 1879911 - protein, 17 aa, Staphylococcus
LFNDMKNWISKYESNKE

SEQ ID NO: 1879912 - protein, 27 aa, Staphylococcus
LFNGIDIVSIFAIALGIMEIFLSLGQR

SEQ ID NO: 1879913 - protein, 28 aa, Staphylococcus
LFNHSKIVYRFTIFFTMIASFIDGVKAS

SEQ ID NO: 1879914 - protein, 18 aa, Staphylococcus
LFNSMIEGVVGLNDKSEI

SEQ ID NO: 1879915 - protein, 17 aa, Staphylococcus
LFPCLLVVLFSVVTRNK

SEQ ID NO: 1879916 - protein, 17 aa, Staphylococcus
LFPFTFKFGPENSNTII

SEQ ID NO: 1879917 - protein, 22 aa, Staphylococcus
LFPPTIVLIISMIIFNYYVFKT

SEQ ID NO: 1879918 - protein, 20 aa, Staphylococcus
LFQLIGVLLILTFVSLFITN

SEQ ID NO: 1879919 - protein, 18 aa, Staphylococcus
LFRERKAGTLIFGLSLTL

SEQ ID NO: 1879920 - protein, 17 aa, Staphylococcus
LFRINARDTNLIKISQA

SEQ ID NO: 1879921 - protein, 18 aa, Staphylococcus
LFSAEWIVEHLFEATTEV

SEQ ID NO: 1879922 - protein, 21 aa, Staphylococcus
LFSFWYWPGAIILFITLALTI

SEQ ID NO: 1879923 - protein, 25 aa, Staphylococcus
LFSLLRLEVDITFIAAILTIVGYSI

SEQ ID NO: 1879924 - protein, 25 aa, Staphylococcus
LFSLLRLEVDITFIAAVLTIVGYSI

SEQ ID NO: 1879925 - protein, 25 aa, Staphylococcus
LFSMGRSGIMPSVFSKLHKKYKTPY

SEQ ID NO: 1879926 - protein, 25 aa, Staphylococcus
LFSMGRSGIMPSVFSRIHSKYKTPY

SEQ ID NO: 1879927 - protein, 25 aa, Staphylococcus
LFSMGRSGIMPTAFSKLHSKYKTPY

SEQ ID NO: 1879928 - protein, 25 aa, Staphylococcus
LFSMGRSGIMPTMFSKLHSKYKTPY

SEQ ID NO: 1879929 - protein, 25 aa, Staphylococcus
LFSMGRSGIMPTVFSKLHSKYKTPY

SEQ ID NO: 1879930 - protein, 24 aa, Staphylococcus
LFSSDRKNIRWKYVGLLLVIQLIF

SEQ ID NO: 1879931 - protein, 25 aa, Staphylococcus
LFSSDRKNIRWQYIGLLLVIQLVFA

SEQ ID NO: 1879932 - protein, 24 aa, Staphylococcus
LFSSDRKNIRWQYVGILLVIQLVF

SEQ ID NO: 1879933 - protein, 24 aa, Staphylococcus
LFSSDRKNIRWQYVGLLLVIQLIF

SEQ ID NO: 1879934 - protein, 22 aa, Staphylococcus
LFSSRIPRTVSIIISGSSLALA

SEQ ID NO: 1879935 - protein, 23 aa, Staphylococcus
LFSSRIPRTVSILLSGSSLALAG

SEQ ID NO: 1879936 - protein, 18 aa, Staphylococcus
LFTDMFPPDLSYLSQILN

SEQ ID NO: 1879937 - protein, 22 aa, Staphylococcus
LFTICMAAFYLLVGLDFEIFQY

SEQ ID NO: 1879938 - protein, 20 aa, Staphylococcus
LFVGLPWLIAYYHINTGIMY

SEQ ID NO: 1879939 - protein, 29 aa, Staphylococcus
LFVTIAVFCSLVFNSIIYTCVSLLGNPGK

SEQ ID NO: 1879940 - protein, 21 aa, Staphylococcus
LFVVCIISLLLYFQLFNISAF

SEQ ID NO: 1879941 - protein, 18 aa, Staphylococcus
LFVVWELKNSHPIIDLRM

SEQ ID NO: 1879942 - protein, 24 aa, Staphylococcus
LFWELTSFSSFLLISFWRDKQASI

SEQ ID NO: 1879943 - protein, 24 aa, Staphylococcus
LFWELTSFSSFLLISFWREKQASI

SEQ ID NO: 1879944 - protein, 25 aa, Staphylococcus
LFWKRPCKWTKCVINAFLLAVFPAN

SEQ ID NO: 1879945 - protein, 27 aa, Staphylococcus
LFYGLIGAFVFRFISLFLISIIAHFWW

SEQ ID NO: 1879946 - protein, 32 aa, Staphylococcus
LFYGLLGAFVFRFASLFLISYLVNFWFIQAAG

SEQ ID NO: 1879947 - protein, 27 aa, Staphylococcus
LFYGLLGAFVFRFLALFLISVIANFWF

SEQ ID NO: 1879948 - protein, 22 aa, Staphylococcus
LFYGTFDWIGLLSSISKGIIGM

SEQ ID NO: 1879949 - protein, 20 aa, Staphylococcus
LFYNRCQELLLGKFSSEKSN

SEQ ID NO: 1879950 - protein, 18 aa, Staphylococcus
LGAALTVVITVAGQIIMG

SEQ ID NO: 1879951 - protein, 25 aa, Staphylococcus
LGAAVKISADFEAQMSRVGAIAQAS

SEQ ID NO: 1879952 - protein, 19 aa, Staphylococcus
LGADFKGSVSSGIISGLNR

SEQ ID NO: 1879953 - protein, 17 aa, Staphylococcus
LGAIIISGIITWIHNRY

SEQ ID NO: 1879954 - protein, 18 aa, Staphylococcus
LGAISFSLALVLIVLTNS

SEQ ID NO: 1879955 - protein, 22 aa, Staphylococcus
LGAKAIDSVVQFVARNRSKFAE

SEQ ID NO: 1879956 - protein, 19 aa, Staphylococcus
LGAMWKFPYMAGVYGGGAF

SEQ ID NO: 1879957 - protein, 35 aa, Staphylococcus
LGARLFGELEFWFSIIKIVTIIAMIIVGLVMIFFS

SEQ ID NO: 1879958 - protein, 26 aa, Staphylococcus
LGARVKRLKMVLLILSVMLAGASISV

SEQ ID NO: 1879959 - protein, 20 aa, Staphylococcus
LGASKIMGLVGIDNGGAQVQ

SEQ ID NO: 1879960 - protein, 17 aa, Staphylococcus
LGASKLTLTFGVSKSFM

SEQ ID NO: 1879961 - protein, 17 aa, Staphylococcus
LGASKLTLTYGISKSFL

SEQ ID NO: 1879962 - protein, 26 aa, Staphylococcus
LGAVVLKLALNIPLIMTFHTAGAILS

SEQ ID NO: 1879963 - protein, 19 aa, Staphylococcus
LGAYVLWGILPIYWELIDH

SEQ ID NO: 1879964 - protein, 20 aa, Staphylococcus
LGAYVVWGILPIYWKLIGGV

SEQ ID NO: 1879965 - protein, 24 aa, Staphylococcus
LGCDFKGNNAITFLLQNIQPHQTL

SEQ ID NO: 1879966 - protein, 21 aa, Staphylococcus
LGCLPMLIQMPIIMGLFFVLK

SEQ ID NO: 1879967 - protein, 26 aa, Staphylococcus
LGDLLGVQHFYDWINHVLKTGHSAWR

SEQ ID NO: 1879968 - protein, 19 aa, Staphylococcus
LGDWLGVHHFYEWLNHVLK

SEQ ID NO: 1879969 - protein, 30 aa, Staphylococcus; identical to SEQ ID NO: 1737247

SEQ ID NO: 1879970 - protein, 24 aa, Staphylococcus
LGEDGRVIGMSKLKTIKEQEHPDL

SEQ ID NO: 1879971 - protein, 19 aa, Staphylococcus
LGEDTRLPKELKADDGTTF

SEQ ID NO: 1879972 - protein, 25 aa, Staphylococcus
LGFDKKAIFPFIIASGFIADTTSLP

SEQ ID NO: 1879973 - protein, 22 aa, Staphylococcus
LGFEVFKGNLLSSSDRIYADLI

SEQ ID NO: 1879974 - protein, 20 aa, Staphylococcus
LGFFFVFNFISLIIGGSIYE

SEQ ID NO: 1879975 - protein, 17 aa, Staphylococcus
LGFGGGMIIPAIYAMAG

SEQ ID NO: 1879976 - protein, 17 aa, Staphylococcus
LGFISFFVPFLLIFMID

SEQ ID NO: 1879977 - protein, 23 aa, Staphylococcus
LGFLAASLFLIWKRPFRFQWQWR

SEQ ID NO: 1879978 - protein, 17 aa, Staphylococcus
LGFPAFFGVILGLFEFI

SEQ ID NO: 1879979 - protein, 24 aa, Staphylococcus
LGFVLSLLATLGFTTLVMQDGFLG

SEQ ID NO: 1879980 - protein, 20 aa, Staphylococcus
LGFYFIYRLIAVHPQDIVNR

SEQ ID NO: 1879981 - protein, 26 aa, Staphylococcus
LGGAILEFATWHWLFFINIPIAIIAI

SEQ ID NO: 1879982 - protein, 31 aa, Staphylococcus
LGGFLTQFLSWRWIFFINIFVVIIAVPLMNK

SEQ ID NO: 1879983 - protein, 17 aa, Staphylococcus
LGGFYDLYHALKTQPLL

SEQ ID NO: 1879984 - protein, 25 aa, Staphylococcus
LGGGILEFATWHWLFFINIPIAIVA

SEQ ID NO: 1879985 - protein, 26 aa, Staphylococcus
LGGIHEIYFPYVLMRPLLFIAVILGG

SEQ ID NO: 1879986 - protein, 27 aa, Staphylococcus
LGGIHEIYFPYVLMRPLLFIAVILGGM

SEQ ID NO: 1879987 - protein, 28 aa, Staphylococcus
LGGIHEIYFPYVLMRPMLFISVILGGMT

SEQ ID NO: 1879988 - protein, 20 aa, Staphylococcus
LGGIILSVAVWRVVFVILTI

SEQ ID NO: 1879989 - protein, 25 aa, Staphylococcus
LGGIILSVSIWRTVFIVLTVFGILM

SEQ ID NO: 1879990 - protein, 26 aa, Staphylococcus
LGGLANWRVVFGIMIILAVITMLGMM

SEQ ID NO: 1879991 - protein, 18 aa, Staphylococcus
LGGLIIHFATWQWIFFIN

SEQ ID NO: 1879992 - protein, 23 aa, Staphylococcus
LGGLRIALVVAIGVVAVGSFIGA

SEQ ID NO: 1879993 - protein, 25 aa, Staphylococcus
LGGLSWPIVLVLLILFYFYSHYLFA

SEQ ID NO: 1879994 - protein, 24 aa, Staphylococcus
LGGMGVSMGMSWAAANDIGRNFAG

SEQ ID NO: 1879995 - protein, 27 aa, Staphylococcus
LGHDVSWGEWFLFAAPWSILMSIALFF

SEQ ID NO: 1879996 - protein, 18 aa, Staphylococcus
LGHFSVYFILLVGFVLGT

SEQ ID NO: 1879997 - protein, 18 aa, Staphylococcus
LGHFSVYFILLVGVVLGT

SEQ ID NO: 1879998 - protein, 23 aa, Staphylococcus
LGHIKSIYFVGGILGMAFVTSNV

SEQ ID NO: 1879999 - protein, 25 aa, Staphylococcus
LGHKSDWIVISFGWGLAVTMGVYAV

SEQ ID NO: 1880000 - protein, 18 aa, Staphylococcus
LGHVKDYFIYPYKDEMEH

SEQ ID NO: 1880001 - protein, 25 aa, Staphylococcus
LGIAAMIFGYFWFRLYQRTTNPRAD

SEQ ID NO: 1880002 - protein, 17 aa, Staphylococcus
LGICIGIGIILREFYIC

SEQ ID NO: 1880003 - protein, 17 aa, Staphylococcus
LGIEHAGAIDLNAACAG

SEQ ID NO: 1880004 - protein, 18 aa, Staphylococcus
LGIEQYRPHIAIITNIYS

SEQ ID NO: 1880005 - protein, 19 aa, Staphylococcus
LGIFSQWLADRIKWPSIVV

SEQ ID NO: 1880006 - protein, 19 aa, Staphylococcus
LGIFSQWLANRIKWPSIVV

SEQ ID NO: 1880007 - protein, 22 aa, Staphylococcus
LGIIAGLLVHFFLPVNDEMIKT

SEQ ID NO: 1880008 - protein, 24 aa, Staphylococcus
LGIIFTFLLIIGFILNLILAFIII

SEQ ID NO: 1880009 - protein, 17 aa, Staphylococcus
LGIIFVVLFIWRQERLE

SEQ ID NO: 1880010 - protein, 22 aa, Staphylococcus
LGIIIFFLIFGWFIKKATLALK

SEQ ID NO: 1880011 - protein, 21 aa, Staphylococcus
LGILFAIGVAIGMAKKNDGAV

SEQ ID NO: 1880012 - protein, 19 aa, Staphylococcus
LGILFAIGVALGMAKKNDG

SEQ ID NO: 1880013 - protein, 17 aa, Staphylococcus
LGILFLFGYNFVNTVSR

SEQ ID NO: 1880014 - protein, 18 aa, Staphylococcus
LGILPKFFFFILATLHAG

SEQ ID NO: 1880015 - protein, 18 aa, Staphylococcus
LGIMEIFLSLGQRKQIKR

SEQ ID NO: 1880016 - protein, 23 aa, Staphylococcus
LGINISVSIIFNFHAVLETLLLI

SEQ ID NO: 1880017 - protein, 24 aa, Staphylococcus
LGINVRRERMIILFAAVALSSAAV

SEQ ID NO: 1880018 - protein, 22 aa, Staphylococcus
LGIPQPFRFSGFGFDLGAILVF

SEQ ID NO: 1880019 - protein, 19 aa, Staphylococcus
LGIVFLITFLIYLFYSPRL

SEQ ID NO: 1880020 - protein, 22 aa, Staphylococcus
LGKGAFFIMMGIIQALIVTIGD

SEQ ID NO: 1880021 - protein, 30 aa, Staphylococcus
LGKGFENSGKFYLTVLMIYVLLSIVLIVIA

SEQ ID NO: 1880022 - protein, 18 aa, Staphylococcus
LGKGWKLLLIDIGVILFV

SEQ ID NO: 1880023 - protein, 21 aa, Staphylococcus
LGKHRRLDWLNKIMYKSFNKN

SEQ ID NO: 1880024 - protein, 23 aa, Staphylococcus
LGKKLIICLGLVFFTISEFLFAM

SEQ ID NO: 1880025 - protein, 21 aa, Staphylococcus
LGKKSGLKIGDVVVELDSKSI

SEQ ID NO: 1880026 - protein, 23 aa, Staphylococcus
LGKKYTALIGIGGFVIFEVLNFL

SEQ ID NO: 1880027 - protein, 17 aa, Staphylococcus
LGKLFQFISFFPTISSG

SEQ ID NO: 1880028 - protein, 24 aa, Staphylococcus
LGKVMKHFVNIFSILLLLLTGTVF

SEQ ID NO: 1880029 - protein, 21 aa, Staphylococcus
LGLALFIVWAIRSYYLFRTYE

SEQ ID NO: 1880030 - protein, 17 aa, Staphylococcus
LGLDKQVEWVFDLVRIV

SEQ ID NO: 1880031 - protein, 19 aa, Staphylococcus
LGLESMPLIATIALITLFN

SEQ ID NO: 1880032 - protein, 27 aa, Staphylococcus
LGLFGEVSRGIFIISFLSVVVIVSVLY

SEQ ID NO: 1880033 - protein, 17 aa, Staphylococcus
LGLFQFPWILFLLGVIF

SEQ ID NO: 1880034 - protein, 19 aa, Staphylococcus
LGLFSPIILSLIVVFIVSL

SEQ ID NO: 1880035 - protein, 18 aa, Staphylococcus
LGLGIHFFVVYGAAVKFM

SEQ ID NO: 1880036 - protein, 17 aa, Staphylococcus
LGLGWLGEPVFEKLLHP

SEQ ID NO: 1880037 - protein, 25 aa, Staphylococcus
LGLIAIIIGFIWFRLYQRTTNPKAD

SEQ ID NO: 1880038 - protein, 21 aa, Staphylococcus
LGLIAKITILAPWTLPGPIGA

SEQ ID NO: 1880039 - protein, 19 aa, Staphylococcus
LGLILCLFATIPGIILWNK

SEQ ID NO: 1880040 - protein, 18 aa, Staphylococcus
LGLILCLFATIPGIVLWN

SEQ ID NO: 1880041 - protein, 17 aa, Staphylococcus
LGLIPEWGDNIQKSLKY

SEQ ID NO: 1880042 - protein, 17 aa, Staphylococcus
LGLISILLMGLFAFMNV

SEQ ID NO: 1880043 - protein, 21 aa, Staphylococcus
LGLLAGLLVHFFLPVSDNMIK

SEQ ID NO: 1880044 - protein, 17 aa, Staphylococcus
LGLLFALTIGWLGRYLR

SEQ ID NO: 1880045 - protein, 24 aa, Staphylococcus
LGLLHLLPSLLLNGSDWQFIMTWL

SEQ ID NO: 1880046 - protein, 17 aa, Staphylococcus
LGLLVKWQWLKLNLSSW

SEQ ID NO: 1880047 - protein, 17 aa, Staphylococcus
LGLMLFTIGSLFSGLSD

SEQ ID NO: 1880048 - protein, 18 aa, Staphylococcus
LGLMLSIIGCICLISTHL

SEQ ID NO: 1880049 - protein, 26 aa, Staphylococcus
LGLNQPVLIQWWEWFTRILHLDFGTS

SEQ ID NO: 1880050 - protein, 17 aa, Staphylococcus
LGLRTAGALGCGIFAIV

SEQ ID NO: 1880051 - protein, 20 aa, Staphylococcus
LGLTEMQTGLVIVPYTIMAV

SEQ ID NO: 1880052 - protein, 17 aa, Staphylococcus
LGLVWIIIWYKVFTDYP

SEQ ID NO: 1880053 - protein, 19 aa, Staphylococcus
LGMLARVIIGPSLADRVVA

SEQ ID NO: 1880054 - protein, 31 aa, Staphylococcus
LGMLEVYIVISVVYWLIALIIQGVFTIIDKR

SEQ ID NO: 1880055 - protein, 19 aa, Staphylococcus
LGMSVLFIIFTFFKESRLS

SEQ ID NO: 1880056 - protein, 20 aa, Staphylococcus
LGMVCLFIVMAIGRFAYTPI

SEQ ID NO: 1880057 - protein, 29 aa, Staphylococcus
LGNHIMTWISFCVGRGIFIFSKGVFDKPF

SEQ ID NO: 1880058 - protein, 23 aa, Staphylococcus
LGNTDFVKGVFNRIGRLSGNKYS

SEQ ID NO: 1880059 - protein, 26 aa, Staphylococcus
LGNTKYVYDPSIGKNTDRAILDSDGD

SEQ ID NO: 1880060 - protein, 24 aa, Staphylococcus
LGNVFDVLFALAWLIISISIVISV

SEQ ID NO: 1880061 - protein, 34 aa, Staphylococcus
LGNVSWTFVLSWLPAHAKWLLTSVYLFLLMMMIW

SEQ ID NO: 1880062 - protein, 24 aa, Staphylococcus
LGNWIGQIALNWYVYELYHNAFYL

SEQ ID NO: 1880063 - protein, 24 aa, Staphylococcus
LGNWIGQIGLNWFVLTTYHNAVYL

SEQ ID NO: 1880064 - protein, 24 aa, Staphylococcus
LGNWIGQIGLNWYVLTSYHNAVYL

SEQ ID NO: 1880065 - protein, 18 aa, Staphylococcus
LGNWIGQITLNWYVFTLY

SEQ ID NO: 1880066 - protein, 21 aa, Staphylococcus
LGPISVRWYGIIIAMGILLGY

SEQ ID NO: 1880067 - protein, 29 aa, Staphylococcus
LGPLAGFMVGWTYWFTWIISGMAEVTAVA

SEQ ID NO: 1880068 - protein, 17 aa, Staphylococcus
LGPLLGWGLFPTIASKF

SEQ ID NO: 1880069 - protein, 19 aa, Staphylococcus
LGPRIAHAILPIAGKGGSN

SEQ ID NO: 1880070 - protein, 20 aa, Staphylococcus
LGPRIAHALLPIAGKGASNW

SEQ ID NO: 1880071 - protein, 22 aa, Staphylococcus
LGPSEILGGGASEFSPTQLASA

SEQ ID NO: 1880072 - protein, 23 aa, Staphylococcus
LGPVFRPIMRPLFTLPGRSTVDN

SEQ ID NO: 1880073 - protein, 35 aa, Staphylococcus
LGQAKNRLNYILDPIVNRPSLLDRITGNTSGSNLG

SEQ ID NO: 1880074 - protein, 17 aa, Staphylococcus
LGQCIAALVVVYYGVTI

SEQ ID NO: 1880075 - protein, 21 aa, Staphylococcus
LGQGIGRWGNFMNHEAHGGTV

SEQ ID NO: 1880076 - protein, 17 aa, Staphylococcus
LGQLLFKSKSDYHILML

SEQ ID NO: 1880077 - protein, 23 aa, Staphylococcus
LGQVKSTMLVTVWVFTGIEGAVV

SEQ ID NO: 1880078 - protein, 24 aa, Staphylococcus
LGQVMKHFVNIFSILLLLLTGTVF

SEQ ID NO: 1880079 - protein, 18 aa, Staphylococcus
LGQWREKIGYVMQSNSMM

SEQ ID NO: 1880080 - protein, 23 aa, Staphylococcus
LGRIKPLYFIGGMLGMAFVTANI

SEQ ID NO: 1880081 - protein, 22 aa, Staphylococcus
LGRKRIALIILSVFVLASCSAI

SEQ ID NO: 1880082 - protein, 19 aa, Staphylococcus
LGRYLRYFRNLTRDIQKEP

SEQ ID NO: 1880083 - protein, 17 aa, Staphylococcus
LGSACLIILALALGGLL

SEQ ID NO: 1880084 - protein, 18 aa, Staphylococcus
LGSAFGSTALWIGAGLMS

SEQ ID NO: 1880085 - protein, 18 aa, Staphylococcus
LGSFEMIILPVLVPVVSG

SEQ ID NO: 1880086 - protein, 24 aa, Staphylococcus
LGSLFDVFFSLTWIIISLSLILNV

SEQ ID NO: 1880087 - protein, 26 aa, Staphylococcus
LGSLLMIRIGERFMQKKGPQIPLMAG

SEQ ID NO: 1880088 - protein, 20 aa, Staphylococcus
LGSMALHFVLGFSVTISLVL

SEQ ID NO: 1880089 - protein, 19 aa, Staphylococcus
LGSMLLRMGGFQSSIARGL

SEQ ID NO: 1880090 - protein, 19 aa, Staphylococcus
LGSVFDVFYFLNWLILSIS

SEQ ID NO: 1880091 - protein, 20 aa, Staphylococcus
LGTAAFWTILAILFIGGPYI

SEQ ID NO: 1880092 - protein, 24 aa, Staphylococcus
LGTAIGGWKIIKTVGGNIMKIRPA

SEQ ID NO: 1880093 - protein, 18 aa, Staphylococcus
LGTAILILFGGGVCANVN

SEQ ID NO: 1880094 - protein, 17 aa, Staphylococcus
LGTAILILFGGGVVANL

SEQ ID NO: 1880095 - protein, 17 aa, Staphylococcus
LGTAILVLFGGGVCANV

SEQ ID NO: 1880096 - protein, 17 aa, Staphylococcus
LGTFIIKGNRVLAACVF

SEQ ID NO: 1880097 - protein, 18 aa, Staphylococcus
LGTIAAVYYHTWLDRLIR

SEQ ID NO: 1880098 - protein, 24 aa, Staphylococcus
LGTMLTRFLPFLIFSKDKETPKYI

SEQ ID NO: 1880099 - protein, 17 aa, Staphylococcus
LGTRHRAAIGISEVSDS

SEQ ID NO: 1880100 - protein, 24 aa, Staphylococcus
LGTVFTILLALGFVINLVLAFIII

SEQ ID NO: 1880101 - protein, 34 aa, Staphylococcus
LGVAVIYLFMLGFYRLPGLVAIIALTTYIYLTLV

SEQ ID NO: 1880102 - protein, 20 aa, Staphylococcus
LGVGLFVHWIWPELPIGAAF

SEQ ID NO: 1880103 - protein, 26 aa, Staphylococcus
LGVGVLTAFIGGFGYVYFMSAVQGFD

SEQ ID NO: 1880104 - protein, 22 aa, Staphylococcus
LGVHHFYEWLNHVLKTGHTAWR

SEQ ID NO: 1880105 - protein, 18 aa, Staphylococcus
LGVIFLVLFLIYLFYSPR

SEQ ID NO: 1880106 - protein, 23 aa, Staphylococcus
LGVLCIHLAHLISFVDFICSFIG

SEQ ID NO: 1880107 - protein, 25 aa, Staphylococcus
LGVLIVLGLYGWVVVKSLIYAGRTI

SEQ ID NO: 1880108 - protein, 21 aa, Staphylococcus
LGVLVGIPIAIISWVTSVFGF

SEQ ID NO: 1880109 - protein, 17 aa, Staphylococcus
LGVSSFYQQVVKGVVII

SEQ ID NO: 1880110 - protein, 23 aa, Staphylococcus
LGVVFLVSFLIYLFYSPRLKFDV

SEQ ID NO: 1880111 - protein, 20 aa, Staphylococcus
LGWRAFMYPKLTNIGVTKGL

SEQ ID NO: 1880112 - protein, 20 aa, Staphylococcus
LGYLLKRINFLKAADSQVLS

SEQ ID NO: 1880113 - protein, 17 aa, Staphylococcus
LGYMFLSLFIIITITFF

SEQ ID NO: 1880114 - protein, 18 aa, Staphylococcus
LGYMFLSLFIIITITFFL

SEQ ID NO: 1880115 - protein, 26 aa, Staphylococcus
LGYNVSWGEWFLYAAPWSILMSIALY

SEQ ID NO: 1880116 - protein, 18 aa, Staphylococcus
LGYSNSIIVLGVLAIILI

SEQ ID NO: 1880117 - protein, 19 aa, Staphylococcus
LGYSNSILVLGIFAIILII

SEQ ID NO: 1880118 - protein, 17 aa, Staphylococcus
LGYWLSDGLTWLYEFGG

SEQ ID NO: 1880119 - protein, 22 aa, Staphylococcus
LHAYFAALVFMKFIGFTNQMSI

SEQ ID NO: 1880120 - protein, 19 aa, Staphylococcus
LHCMTRIRLKLNNKQHVNY

SEQ ID NO: 1880121 - protein, 19 aa, Staphylococcus
LHDLLKPALLPTIPLIGLS

SEQ ID NO: 1880122 - protein, 23 aa, Staphylococcus
LHDRIMQPFILFRNYQINIADQS

SEQ ID NO: 1880123 - protein, 19 aa, Staphylococcus
LHDVFMIVALFSLLRLEVD

SEQ ID NO: 1880124 - protein, 17 aa, Staphylococcus
LHEGHLFSIANKIINLL

SEQ ID NO: 1880125 - protein, 22 aa, Staphylococcus
LHELIHRISFFIFSRGEQPHFK

SEQ ID NO: 1880126 - protein, 17 aa, Staphylococcus
LHELKFLKPDKRQQFKI

SEQ ID NO: 1880127 - protein, 22 aa, Staphylococcus
LHEYEPTLPWGVYKFTQANAHK

SEQ ID NO: 1880128 - protein, 22 aa, Staphylococcus
LHFKEAIMQKGIYDRGASFIQM

SEQ ID NO: 1880129 - protein, 24 aa, Staphylococcus
LHFLFKVPSNFGVQVVIVIISTVL

SEQ ID NO: 1880130 - protein, 25 aa, Staphylococcus
LHFSLTSGWAFIGSFLIIKSNNSFN

SEQ ID NO: 1880131 - protein, 21 aa, Staphylococcus
LHGYHAGFLFAVIITVISLLL

SEQ ID NO: 1880132 - protein, 23 aa, Staphylococcus
LHHIFYAPFWFEFGHYTNHAGDL

SEQ ID NO: 1880133 - protein, 23 aa, Staphylococcus
LHHIFYAPFWFEFGHYTNHAGEL

SEQ ID NO: 1880134 - protein, 24 aa, Staphylococcus
LHHIFYAPFWFEFGHYVNESGNLV

SEQ ID NO: 1880135 - protein, 32 aa, Staphylococcus
LHIGKLKALLGYFKMPVLYALLLAIILNYNHI

SEQ ID NO: 1880136 - protein, 19 aa, Staphylococcus
LHILPTVAMFFSIVGTAIL

SEQ ID NO: 1880137 - protein, 19 aa, Staphylococcus
LHIMLPFMFGPIIASIICI

SEQ ID NO: 1880138 - protein, 18 aa, Staphylococcus
LHINRQITVLAFQYGDAI

SEQ ID NO: 1880139 - protein, 23 aa, Staphylococcus
LHINRQLTVLAFQYGDAISNILF

SEQ ID NO: 1880140 - protein, 23 aa, Staphylococcus
LHINRQLTVLAFQYGDAISNVLF

SEQ ID NO: 1880141 - protein, 23 aa, Staphylococcus
LHINRQLTVLAFQYGDSISNILF

SEQ ID NO: 1880142 - protein, 23 aa, Staphylococcus
LHINRQLTVLAFQYGDSISNVLF

SEQ ID NO: 1880143 - protein, 17 aa, Staphylococcus
LHIPEFIIRNMYIEGVY

SEQ ID NO: 1880144 - protein, 34 aa, Staphylococcus
LHISKSIRVYYDMNKAPGSRVLKIEVLNKQTNQF

SEQ ID NO: 1880145 - protein, 18 aa, Staphylococcus
LHKDRLVDVIFYSAIFGF

SEQ ID NO: 1880146 - protein, 19 aa, Staphylococcus
LHKGVHLLFFLPFYKSFRI

SEQ ID NO: 1880147 - protein, 28 aa, Staphylococcus
LHLAGISLWLGALIYLFSSVFTKKRDAV

SEQ ID NO: 1880148 - protein, 19 aa, Staphylococcus
LHLLFCWTGIPHIIAIISA

SEQ ID NO: 1880149 - protein, 21 aa, Staphylococcus
LHLLFFLPYVNSFRIHKLNKK

SEQ ID NO: 1880150 - protein, 17 aa, Staphylococcus
LHLPDFIIRNMYIEGQY

SEQ ID NO: 1880151 - protein, 17 aa, Staphylococcus
LHLSPKISDSLIVESIG

SEQ ID NO: 1880152 - protein, 26 aa, Staphylococcus
LHMILHFPIAVAIVVAGLFLITGPTV

SEQ ID NO: 1880153 - protein, 21 aa, Staphylococcus
LHMVLGFTIFACWPFTRLVHV

SEQ ID NO: 1880154 - protein, 26 aa, Staphylococcus
LHMVLRVVILLTLISGFWIIIKEFAS

SEQ ID NO: 1880155 - protein, 31 aa, Staphylococcus
LHNSPKIFKIKRWKFIILLIAIILITVILTV

SEQ ID NO: 1880156 - protein, 17 aa, Staphylococcus
LHPLFELIHLPDALTTT

SEQ ID NO: 1880157 - protein, 19 aa, Staphylococcus
LHPLFELMHLPSALTTTVS

SEQ ID NO: 1880158 - protein, 24 aa, Staphylococcus
LHPTRFAFMMSLVVVIAWVLYYFV

SEQ ID NO: 1880159 - protein, 24 aa, Staphylococcus
LHQFKQLRFSSILIAISLNAIIDL

SEQ ID NO: 1880160 - protein, 18 aa, Staphylococcus
LHRWFIAAVISFVVLGVL

SEQ ID NO: 1880161 - protein, 29 aa, Staphylococcus
LHSYLGLYIRWQWYLGQKSSWTINTLLVI

SEQ ID NO: 1880162 - protein, 20 aa, Staphylococcus
LHTFRQLRLSTLLIALTINS

SEQ ID NO: 1880163 - protein, 19 aa, Staphylococcus
LHTIYSSFFGSLALGIISH

SEQ ID NO: 1880164 - protein, 17 aa, Staphylococcus
LHTMMIISSIISTISAI

SEQ ID NO: 1880165 - protein, 17 aa, Staphylococcus
LHTNDMHGRILGEDGRV

SEQ ID NO: 1880166 - protein, 21 aa, Staphylococcus
LHTRVALTIIKYIGASTAKIL

SEQ ID NO: 1880167 - protein, 17 aa, Staphylococcus
LHVDSAWISLGLIVLAF

SEQ ID NO: 1880168 - protein, 22 aa, Staphylococcus
LHVVGGWIGWAVFTLLWGTTIW

SEQ ID NO: 1880169 - protein, 19 aa, Staphylococcus
LHWQSIFVLSIILSVVALW

SEQ ID NO: 1880170 - protein, 20 aa, Staphylococcus
LHYGLHPWAVYGIVALALAY

SEQ ID NO: 1880171 - protein, 18 aa, Staphylococcus
LIAAIPIILFLLCLTVFK

SEQ ID NO: 1880172 - protein, 24 aa, Staphylococcus
LIAAMIMPRIWPLKNIPDEYAKDV

SEQ ID NO: 1880173 - protein, 17 aa, Staphylococcus
LIAATALIFIYISLGFI

SEQ ID NO: 1880174 - protein, 17 aa, Staphylococcus
LIAAVALIFIYISLGFI

SEQ ID NO: 1880175 - protein, 17 aa, Staphylococcus
LIACLLVLFILLLNLRG

SEQ ID NO: 1880176 - protein, 25 aa, Staphylococcus
LIAETICALAAMLIVYLLRDRLTVD

SEQ ID NO: 1880177 - protein, 17 aa, Staphylococcus
LIAEYLIAVSFVASGFS

SEQ ID NO: 1880178 - protein, 17 aa, Staphylococcus
LIAFGVVSFFASKIGNT

SEQ ID NO: 1880179 - protein, 17 aa, Staphylococcus
LIAFLWVLFQDEDSFLF

SEQ ID NO: 1880180 - protein, 17 aa, Staphylococcus
LIAFLWVLFQDEDSFQF

SEQ ID NO: 1880181 - protein, 22 aa, Staphylococcus
LIAGIFPKLFGKYAQSTYDMIA

SEQ ID NO: 1880182 - protein, 18 aa, Staphylococcus
LIAIAVGIILVILIINFV

SEQ ID NO: 1880183 - protein, 17 aa, Staphylococcus
LIAIIILTICAWWLKPD

SEQ ID NO: 1880184 - protein, 21 aa, Staphylococcus
LIAILFKFNLAHVATLASVTA

SEQ ID NO: 1880185 - protein, 19 aa, Staphylococcus
LIAKKKRESKETSTNTKGK

SEQ ID NO: 1880186 - protein, 17 aa, Staphylococcus
LIALAIYVFRFVWVYLL

SEQ ID NO: 1880187 - protein, 19 aa, Staphylococcus
LIALIALIILYMFTPISRI

SEQ ID NO: 1880188 - protein, 17 aa, Staphylococcus
LIALLPITMSSITVGFI

SEQ ID NO: 1880189 - protein, 43 aa, Staphylococcus
LIALVLSVFLFFKGKKAFWFIFVGGFLLTFLLYANVVYFRFFS

SEQ ID NO: 1880190 - protein, 43 aa, Staphylococcus
LIALVLSVFLFFKGKKAFWFMFVGGFLLTFLLYANVVYFRFFS

SEQ ID NO: 1880191 - protein, 18 aa, Staphylococcus
LIAPKPALIYALGIFLIL

SEQ ID NO: 1880192 - protein, 19 aa, Staphylococcus
LIARYPIALAPGMGLNAFF

SEQ ID NO: 1880193 - protein, 35 aa, Staphylococcus
LIASELFYGIPFLGGTVILSFGWQPLLLNALLYLI

SEQ ID NO: 1880194 - protein, 20 aa, Staphylococcus
LIASILVLWLYFRKSIPIRF

SEQ ID NO: 1880195 - protein, 23 aa, Staphylococcus
LIASLCKLILYLIIITFDNIVTY

SEQ ID NO: 1880196 - protein, 25 aa, Staphylococcus
LIAVGYKFLSKRSMYLTIVATVLIS

SEQ ID NO: 1880197 - protein, 26 aa, Staphylococcus
LIAYIIGVIIEFTRYYGYTLKEENHQ

SEQ ID NO: 1880198 - protein, 17 aa, Staphylococcus
LIAYMCGLIAIWNQHTY

SEQ ID NO: 1880199 - protein, 24 aa, Staphylococcus
LIDGSFGWKGLLKAISEGIIGMED

SEQ ID NO: 1880200 - protein, 20 aa, Staphylococcus
LIDRLRYRELEIIENKKQEQ

SEQ ID NO: 1880201 - protein, 23 aa, Staphylococcus
LIDTFSWRAPFIVVAAIAIIAFI

SEQ ID NO: 1880202 - protein, 18 aa, Staphylococcus
LIEAAKIARNQGAYVVVI

SEQ ID NO: 1880203 - protein, 19 aa, Staphylococcus
LIEAFKQNIIVIIVFLVFN

SEQ ID NO: 1880204 - protein, 20 aa, Staphylococcus
LIEASSYFFICYAIASLITR

SEQ ID NO: 1880205 - protein, 18 aa, Staphylococcus
LIEVIWVIGLNNAHNFVT

SEQ ID NO: 1880206 - protein, 29 aa, Staphylococcus
LIFADDVSNAWSLVKFIALPMILINSIGT

SEQ ID NO: 1880207 - protein, 24 aa, Staphylococcus
LIFAILVLRLGYLQIAQGSHYKQL

SEQ ID NO: 1880208 - protein, 34 aa, Staphylococcus
LIFALIIPFVYRFYKRIHLGWFVLPIPVVLFIYF

SEQ ID NO: 1880209 - protein, 25 aa, Staphylococcus
LIFIACLNLRMSIQSIPPVINLIQD

SEQ ID NO: 1880210 - protein, 34 aa, Staphylococcus
LIFIFPLGLFVMWRYSKWPSIAKTIVTVAIVVIA

SEQ ID NO: 1880211 - protein, 28 aa, Staphylococcus
LIFIGFIAAMLYGAYYAYEHYVKDDDKT

SEQ ID NO: 1880212 - protein, 18 aa, Staphylococcus
LIFLDNAIKYDIRDKKID

SEQ ID NO: 1880213 - protein, 26 aa, Staphylococcus
LIFLKERFNKFEWLAIIFALIGVLYM

SEQ ID NO: 1880214 - protein, 27 aa, Staphylococcus
LIFLKERFNKFEWLAILFAFIGVLYMT

SEQ ID NO: 1880215 - protein, 19 aa, Staphylococcus
LIFLWSHFNWWHFLIYIFI

SEQ ID NO: 1880216 - protein, 19 aa, Staphylococcus
LIFMIIEFQLKLTSNRQLF

SEQ ID NO: 1880217 - protein, 17 aa, Staphylococcus
LIFRHLFIHELAKCIPM

SEQ ID NO: 1880218 - protein, 18 aa, Staphylococcus
LIFSAVVGMIASIFTGGF

SEQ ID NO: 1880219 - protein, 22 aa, Staphylococcus
LIFSIILYFSFVTLQYTHSINN

SEQ ID NO: 1880220 - protein, 24 aa, Staphylococcus
LIGAIIPMFFIFKSKVVDVKIYLI

SEQ ID NO: 1880221 - protein, 20 aa, Staphylococcus
LIGFILYLFFGRTVSKRKME

SEQ ID NO: 1880222 - protein, 17 aa, Staphylococcus
LIGFVGVIALRLSIRKK

SEQ ID NO: 1880223 - protein, 20 aa, Staphylococcus
LIGFVLYLFFGRTVSKRKME

SEQ ID NO: 1880224 - protein, 18 aa, Staphylococcus
LIGGIAMLVGIFYIPLAI

SEQ ID NO: 1880225 - protein, 31 aa, Staphylococcus
LIGHSMGGQTIRLLEHFLRHGNQEEIDYQKA

SEQ ID NO: 1880226 - protein, 26 aa, Staphylococcus
LIGIFFKRLEFSGIGLLFCQKTIDAM

SEQ ID NO: 1880227 - protein, 25 aa, Staphylococcus
LIGLFICGGASMLLLSLYDVILVKT

SEQ ID NO: 1880228 - protein, 23 aa, Staphylococcus
LIGLFLKYFRTLKIKSYLISNII

SEQ ID NO: 1880229 - protein, 17 aa, Staphylococcus
LIGLISLLISAIVGVSV

SEQ ID NO: 1880230 - protein, 25 aa, Staphylococcus
LIGLVIGFGLCWPYVLLPYGFGQIF

SEQ ID NO: 1880231 - protein, 18 aa, Staphylococcus
LIGLVITFVLKWEPVGKN

SEQ ID NO: 1880232 - protein, 17 aa, Staphylococcus
LIGLYVKYFRTISIPNY

SEQ ID NO: 1880233 - protein, 27 aa, Staphylococcus
LIGNSMLNHFIPIIITIILCYLGFQFG

SEQ ID NO: 1880234 - protein, 27 aa, Staphylococcus
LIGPMIHYFSWLGLFIILILYMIGLFA

SEQ ID NO: 1880235 - protein, 17 aa, Staphylococcus
LIGSFGYIYFMKDVLGF

SEQ ID NO: 1880236 - protein, 19 aa, Staphylococcus
LIGSLLFIIFHLGRIAIVI

SEQ ID NO: 1880237 - protein, 26 aa, Staphylococcus
LIGVGDWKAIFIVNFPLSILAFVFGY

SEQ ID NO: 1880238 - protein, 17 aa, Staphylococcus
LIHFIMVFFIGILAFST

SEQ ID NO: 1880239 - protein, 24 aa, Staphylococcus
LIHHYRYHPVLAYLDILLNYIPVL

SEQ ID NO: 1880240 - protein, 19 aa, Staphylococcus
LIHLIIKFIQPIVFSLIAI

SEQ ID NO: 1880241 - protein, 17 aa, Staphylococcus
LIHLIILAPYYKHIKKK

SEQ ID NO: 1880242 - protein, 24 aa, Staphylococcus
LIHPHELFIPAIILSLLILFFYLF

SEQ ID NO: 1880243 - protein, 25 aa, Staphylococcus
LIHPHELFIPALILSLLILFFYLFS

SEQ ID NO: 1880244 - protein, 23 aa, Staphylococcus
LIHPHELFIPATILSLLILFFYL

SEQ ID NO: 1880245 - protein, 35 aa, Staphylococcus
LIHPILGLRLKWQWYRARLSQWILNVLIFLINFIT

SEQ ID NO: 1880246 - protein, 19 aa, Staphylococcus
LIHRFFFKRVFYLKKVWVI

SEQ ID NO: 1880247 - protein, 18 aa, Staphylococcus
LIHYLSWSSTYSMIEFTK

SEQ ID NO: 1880248 - protein, 20 aa, Staphylococcus
LIIAGYKFLSKRSTYLTILA

SEQ ID NO: 1880249 - protein, 27 aa, Staphylococcus
LIICCIPEGSWLRNAKTGSLIDDSPLI

SEQ ID NO: 1880250 - protein, 18 aa, Staphylococcus
LIIFGVIFLLLAFFAIFI

SEQ ID NO: 1880251 - protein, 18 aa, Staphylococcus
LIIFIICMFIFNNYADSF

SEQ ID NO: 1880252 - protein, 29 aa, Staphylococcus
LIIGCLIFFYLKIGLYSVLAIFGSALIMY

SEQ ID NO: 1880253 - protein, 22 aa, Staphylococcus
LIIGGAVAKFIGPFLNDFMVSL

SEQ ID NO: 1880254 - protein, 18 aa, Staphylococcus
LIIGGPILMYFSYILALI

SEQ ID NO: 1880255 - protein, 17 aa, Staphylococcus
LIIGLAVGGSMSTVPVY

SEQ ID NO: 1880256 - protein, 18 aa, Staphylococcus
LIIICGFLMLTIKKWSGR

SEQ ID NO: 1880257 - protein, 24 aa, Staphylococcus
LIIICIALILWLGIKEKNRHTNRL

SEQ ID NO: 1880258 - protein, 35 aa, Staphylococcus
LIIILALLVWRKKWLYHPLVLLGIVVIFFVQQVVM

SEQ ID NO: 1880259 - protein, 20 aa, Staphylococcus
LIIIPGFIPLLVVGRAIQGL

SEQ ID NO: 1880260 - protein, 18 aa, Staphylococcus
LIIKEFKLYFSSLTYVSN

SEQ ID NO: 1880261 - protein, 31 aa, Staphylococcus
LIILGFILHYIFKIDQAWILMLAVLIIIINA

SEQ ID NO: 1880262 - protein, 31 aa, Staphylococcus
LIILGGGLYCWKAFHWPHFIFYILLVLTICS

SEQ ID NO: 1880263 - protein, 17 aa, Staphylococcus
LIIMGLCEGVVPLIAYN

SEQ ID NO: 1880264 - protein, 23 aa, Staphylococcus
LIIMPLCLILFKGFVPSEENTFV

SEQ ID NO: 1880265 - protein, 24 aa, Staphylococcus
LIIMVCVLVGFVAVGRWLTHDVQT

SEQ ID NO: 1880266 - protein, 31 aa, Staphylococcus
LIINTLVIIVGWKFLSTRTAIYTVVANTSIS

SEQ ID NO: 1880267 - protein, 17 aa, Staphylococcus
LIIPIFFFIIAIMMFAR

SEQ ID NO: 1880268 - protein, 18 aa, Staphylococcus
LIIPTWINLLLKTYAFIG

SEQ ID NO: 1880269 - protein, 20 aa, Staphylococcus
LIIPTWINLLLKTYAFIGLL

SEQ ID NO: 1880270 - protein, 20 aa, Staphylococcus
LIIRAILYVRYSGYYLENEE

SEQ ID NO: 1880271 - protein, 17 aa, Staphylococcus
LIISALIIFGVALLVCL

SEQ ID NO: 1880272 - protein, 18 aa, Staphylococcus
LIITCLQTLISLMTISPS

SEQ ID NO: 1880273 - protein, 17 aa, Staphylococcus
LIITFPILRKFKIATPI

SEQ ID NO: 1880274 - protein, 18 aa, Staphylococcus
LIITFPILRKFKVATPIF

SEQ ID NO: 1880275 - protein, 19 aa, Staphylococcus
LIITFPILRKFKVATPIFK

SEQ ID NO: 1880276 - protein, 18 aa, Staphylococcus
LIITIPITFVLSKYILRD

SEQ ID NO: 1880277 - protein, 17 aa, Staphylococcus
LIITIPVTFILSKWILK

SEQ ID NO: 1880278 - protein, 17 aa, Staphylococcus
LIITTALRWEVVGKNVE

SEQ ID NO: 1880279 - protein, 24 aa, Staphylococcus
LIIVGLFVICMFVSISMGTSVGTV

SEQ ID NO: 1880280 - protein, 19 aa, Staphylococcus
LIIVGSFFTLFALPPIPYF

SEQ ID NO: 1880281 - protein, 18 aa, Staphylococcus
LIIVRIINGFSFGLCTTS

SEQ ID NO: 1880282 - protein, 17 aa, Staphylococcus
LIKARIVATVTVLIQCV

SEQ ID NO: 1880283 - protein, 20 aa, Staphylococcus
LIKELAKTGVHWKWQMLVTL

SEQ ID NO: 1880284 - protein, 19 aa, Staphylococcus
LIKEPALLLIIPFLILAFL

SEQ ID NO: 1880285 - protein, 19 aa, Staphylococcus
LIKEPSILIIIPILIVAFL

SEQ ID NO: 1880286 - protein, 25 aa, Staphylococcus
LIKIEAIKSLFSFKKPPLAHVKPAT

SEQ ID NO: 1880287 - protein, 24 aa, Staphylococcus
LIKIEAIKSLFSFTKPPLSHVDPA

SEQ ID NO: 1880288 - protein, 22 aa, Staphylococcus
LIKLKMILFGLMMHISITIDKV

SEQ ID NO: 1880289 - protein, 22 aa, Staphylococcus
LIKNVVRYIVWFIVLTTVLSKF

SEQ ID NO: 1880290 - protein, 25 aa, Staphylococcus
LILAFKDFRFDTGIIGGDWKGLHYF

SEQ ID NO: 1880291 - protein, 18 aa, Staphylococcus
LILAIIGGILINKKPKLA

SEQ ID NO: 1880292 - protein, 23 aa, Staphylococcus
LILALPFPIILAIMFNEIKDSKL

SEQ ID NO: 1880293 - protein, 31 aa, Staphylococcus
LILATPVQFIIGWQFYVGAYKNLRNGSANMD

SEQ ID NO: 1880294 - protein, 23 aa, Staphylococcus
LILEAFLSFLFLLFFVGSVSGIS

SEQ ID NO: 1880295 - protein, 17 aa, Staphylococcus
LILFFKKLRKFKVNKAM

SEQ ID NO: 1880296 - protein, 17 aa, Staphylococcus
LILFQWGLDSIFRAILI

SEQ ID NO: 1880297 - protein, 18 aa, Staphylococcus
LILFVLCQFLPKLYLSKV

SEQ ID NO: 1880298 - protein, 17 aa, Staphylococcus
LILGFIFSVISYRFNAY

SEQ ID NO: 1880299 - protein, 18 aa, Staphylococcus
LILGIALFFFIIFIHNFD

SEQ ID NO: 1880300 - protein, 18 aa, Staphylococcus
LILGSAMILFPLGYIIGY

SEQ ID NO: 1880301 - protein, 24 aa, Staphylococcus
LILHLPIWILFISFLALVGPVTGI

SEQ ID NO: 1880302 - protein, 24 aa, Staphylococcus
LILHVVCICVAFWALNALRLEQFF

SEQ ID NO: 1880303 - protein, 18 aa, Staphylococcus
LILIANSVTFVFINPLIL

SEQ ID NO: 1880304 - protein, 20 aa, Staphylococcus
LILIVVLFFLLKNFNSPDAQ

SEQ ID NO: 1880305 - protein, 25 aa, Staphylococcus
LILIVVVVGFGIYFYASKDKEINNT

SEQ ID NO: 1880306 - protein, 17 aa, Staphylococcus
LILKDFQAEVPFKRFVF

SEQ ID NO: 1880307 - protein, 27 aa, Staphylococcus
LILKDRRYRINLSYIFGISIILLNLMV

SEQ ID NO: 1880308 - protein, 18 aa, Staphylococcus
LILLARFVPTKPIAQQIP

SEQ ID NO: 1880309 - protein, 23 aa, Staphylococcus
LILLLIGGCSAIFSDDNNNDNTD

SEQ ID NO: 1880310 - protein, 27 aa, Staphylococcus
LILLMIIAILGMAGWLLYAHQLLERKT

SEQ ID NO: 1880311 - protein, 26 aa, Staphylococcus
LILLSGCSNLEVFNAKGPVASSQKFL

SEQ ID NO: 1880312 - protein, 17 aa, Staphylococcus
LILLYILLITIYRGFGI

SEQ ID NO: 1880313 - protein, 25 aa, Staphylococcus
LILMFANSFSFGGALFMLSILLIVV

SEQ ID NO: 1880314 - protein, 17 aa, Staphylococcus
LILMLFSYLLAFIALKE

SEQ ID NO: 1880315 - protein, 18 aa, Staphylococcus
LILPYLVLCLRWIGYQLD

SEQ ID NO: 1880316 - protein, 25 aa, Staphylococcus
LILQRFTTGFLKSIAILIGLIIGTV

SEQ ID NO: 1880317 - protein, 20 aa, Staphylococcus
LILRDFQASIGIKRFVFSIN

SEQ ID NO: 1880318 - protein, 23 aa, Staphylococcus
LILSCIGFGLFLWGFSNVSTEGW

SEQ ID NO: 1880319 - protein, 18 aa, Staphylococcus
LILSCWLLAIFYSTLNSN

SEQ ID NO: 1880320 - protein, 39 aa, Staphylococcus
LILSIFLFFKGKKAYWFIFIGGFLLTFLLYANVVYFRFF

SEQ ID NO: 1880321 - protein, 17 aa, Staphylococcus
LILSIVLYYSFVTLQYT

SEQ ID NO: 1880322 - protein, 24 aa, Staphylococcus
LILSLPLIYTMVGHFSFLSFLPLP

SEQ ID NO: 1880323 - protein, 51 aa, Staphylococcus
LILSVFLFFKGKKAYWFIFIAGFLLTFLLYANVVYFRFFTDFLTFSTLNQA

SEQ ID NO: 1880324 - protein, 23 aa, Staphylococcus
LILTEMPPFIAGLLIATIFAAAQ

SEQ ID NO: 1880325 - protein, 17 aa, Staphylococcus
LILTRVLALIILSFLPI

SEQ ID NO: 1880326 - protein, 17 aa, Staphylococcus
LILVCMLVSISTALVGP

SEQ ID NO: 1880327 - protein, 22 aa, Staphylococcus
LILVFHLIRLASRINDQYNKVF

SEQ ID NO: 1880328 - protein, 22 aa, Staphylococcus
LILVMACVLTLTPIILMLVSLW

SEQ ID NO: 1880329 - protein, 17 aa, Staphylococcus
LILVSLFGIYWLVTENY

SEQ ID NO: 1880330 - protein, 24 aa, Staphylococcus
LILVYSLMIAFLFIDKVFVNIIYF

SEQ ID NO: 1880331 - protein, 21 aa, Staphylococcus
LIMAFVVEFGFRSYLQHIVET

SEQ ID NO: 1880332 - protein, 27 aa, Staphylococcus
LIMLPMSIWAMERFFRERKLGWFIFAI

SEQ ID NO: 1880333 - protein, 17 aa, Staphylococcus
LIMMISFTIAITIKDLL

SEQ ID NO: 1880334 - protein, 18 aa, Staphylococcus
LIMMKLMLAIAMFAVSLA

SEQ ID NO: 1880335 - protein, 17 aa, Staphylococcus
LIMNKFKIDPAVASGPF

SEQ ID NO: 1880336 - protein, 25 aa, Staphylococcus
LIMPFVGLLLKWQWYTYKLESWSLH

SEQ ID NO: 1880337 - protein, 27 aa, Staphylococcus
LIMVLSIILAFAFKWLGFVDDVLLMVI

SEQ ID NO: 1880338 - protein, 20 aa, Staphylococcus
LINFRLNYRNHRKIVVIDGV

SEQ ID NO: 1880339 - protein, 18 aa, Staphylococcus
LINKSMNLDDAMKALKDS

SEQ ID NO: 1880340 - protein, 42 aa, Staphylococcus
LINSFPIKLLFTICLLCGIISFIISFFIKLQFEVESNTESKK

SEQ ID NO: 1880341 - protein, 17 aa, Staphylococcus
LINYAFTPIEGWRWMLG

SEQ ID NO: 1880342 - protein, 21 aa, Staphylococcus
LINYFLLHWLTLMQISIGLAI

SEQ ID NO: 1880343 - protein, 21 aa, Staphylococcus
LIPCIGALILGYSVADLVKFF

SEQ ID NO: 1880344 - protein, 33 aa, Staphylococcus
LIPEMEFKPAHIGMPWRGFHRHFLIPSLVLILI

SEQ ID NO: 1880345 - protein, 17 aa, Staphylococcus
LIPFIPIKFSFIKFNNV

SEQ ID NO: 1880346 - protein, 25 aa, Staphylococcus
LIPKDYNVWWGFEDDKLYKFAKDEI

SEQ ID NO: 1880347 - protein, 20 aa, Staphylococcus
LIPKRRGEIATKIGQVIEEH

SEQ ID NO: 1880348 - protein, 18 aa, Staphylococcus
LIPLYAVGVFIPFTLAQY

SEQ ID NO: 1880349 - protein, 19 aa, Staphylococcus
LIPLYAVGVFIPFTLAQYG

SEQ ID NO: 1880350 - protein, 23 aa, Staphylococcus
LIPMMMISVLWGILAGISANITQ

SEQ ID NO: 1880351 - protein, 19 aa, Staphylococcus
LIPVLIIALLFIFFLSQAQ

SEQ ID NO: 1880352 - protein, 17 aa, Staphylococcus
LIPVLVIALLFIFFLSQ

SEQ ID NO: 1880353 - protein, 17 aa, Staphylococcus
LIQELYVPDSLLCIQLI

SEQ ID NO: 1880354 - protein, 26 aa, Staphylococcus
LIQIAGVILICFTLIFHLPLWVLVIA

SEQ ID NO: 1880355 - protein, 23 aa, Staphylococcus
LIQLPFIFVLAWVVTKIVPGEDL

SEQ ID NO: 1880356 - protein, 27 aa, Staphylococcus
LIQTVLYRFPSFITFIVPFISLSIVYS

SEQ ID NO: 1880357 - protein, 23 aa, Staphylococcus
LIRFPLEANLALVWLTGSLFGRN

SEQ ID NO: 1880358 - protein, 23 aa, Staphylococcus
LIRLTFVPLLFLGRYTNVGYTFI

SEQ ID NO: 1880359 - protein, 25 aa, Staphylococcus
LIRPFRDVVKMKWSQNGFVSGKLEE

SEQ ID NO: 1880360 - protein, 18 aa, Staphylococcus
LIRPLIMKYRIQFIEQHT

SEQ ID NO: 1880361 - protein, 21 aa, Staphylococcus
LIRRYSILSVVFMVYFGVCMT

SEQ ID NO: 1880362 - protein, 23 aa, Staphylococcus
LIRYNKCLLMTKSFIFNSLAFNE

SEQ ID NO: 1880363 - protein, 17 aa, Staphylococcus
LISAALVVLCLYLAYQG

SEQ ID NO: 1880364 - protein, 22 aa, Staphylococcus
LISCAMKSPGVSIAVGIVLYFA

SEQ ID NO: 1880365 - protein, 18 aa, Staphylococcus
LISCMVFLTFFLSVNQSA

SEQ ID NO: 1880366 - protein, 23 aa, Staphylococcus
LISDLKIGYIIGTLIYILLSAII

SEQ ID NO: 1880367 - protein, 18 aa, Staphylococcus
LISFAERYLPFFTIGMGW

SEQ ID NO: 1880368 - protein, 26 aa, Staphylococcus
LISFVWICGFGGMAVKFAMGGDKIAS

SEQ ID NO: 1880369 - protein, 23 aa, Staphylococcus
LISGSLVGIMFGLATYKFNTIWA

SEQ ID NO: 1880370 - protein, 26 aa, Staphylococcus
LISGVFLFFIGREGYVNMQLIVGILF

SEQ ID NO: 1880371 - protein, 23 aa, Staphylococcus
LISHLPQIFLFVFSTLLTLSIII

SEQ ID NO: 1880372 - protein, 26 aa, Staphylococcus
LISIVCIMLGIPIYVVLVIFCIVVAS

SEQ ID NO: 1880373 - protein, 47 aa, Staphylococcus
LISKKPKIAGILLIIAGLIALMSNWISVILWIVAGIMLLVRKGKKKD

SEQ ID NO: 1880374 - protein, 24 aa, Staphylococcus
LISKKSKIAGIILLIVGVIALLTS

SEQ ID NO: 1880375 - protein, 17 aa, Staphylococcus
LISKRAVQALTSMDEYN

SEQ ID NO: 1880376 - protein, 18 aa, Staphylococcus
LISLAVSRYGRFKLGDND

SEQ ID NO: 1880377 - protein, 18 aa, Staphylococcus
LISLHIIMFALTFFNQKL

SEQ ID NO: 1880378 - protein, 34 aa, Staphylococcus
LISLPALGWIGLRKKLKQCLLYFSESIYRSQHQD

SEQ ID NO: 1880379 - protein, 33 aa, Staphylococcus
LISSAYAALIAWRVGLKWKDLEEGITRRLTTAM

SEQ ID NO: 1880380 - protein, 25 aa, Staphylococcus
LISSIILMFGLKVPLLIAATVILAG

SEQ ID NO: 1880381 - protein, 25 aa, Staphylococcus
LISSNFFKKSNWLFGVSKKNIHNAN

SEQ ID NO: 1880382 - protein, 26 aa, Staphylococcus
LISSYHIFRIFFILFLIAPLLGHLLK

SEQ ID NO: 1880383 - protein, 18 aa, Staphylococcus
LISVGLTIFAFITTSITF

SEQ ID NO: 1880384 - protein, 17 aa, Staphylococcus
LITCGLLSISVILNYIY

SEQ ID NO: 1880385 - protein, 19 aa, Staphylococcus
LITDAMEAYASKNFSHQPD

SEQ ID NO: 1880386 - protein, 18 aa, Staphylococcus
LITFPFESPVGIVTSFVG

SEQ ID NO: 1880387 - protein, 23 aa, Staphylococcus
LITGIGCLIVLYSISYLSRQEQL

SEQ ID NO: 1880388 - protein, 24 aa, Staphylococcus
LITLCLTLAFPAYLLKISRSFEVI

SEQ ID NO: 1880389 - protein, 27 aa, Staphylococcus
LITLFLKFERLIAILGMVTPFLVIIVT

SEQ ID NO: 1880390 - protein, 25 aa, Staphylococcus
LITVICCLMMVFAAGVASIVIIMVG

SEQ ID NO: 1880391 - protein, 20 aa, Staphylococcus
LITWLISTLIWKFGKVEQCW

SEQ ID NO: 1880392 - protein, 26 aa, Staphylococcus
LIVAFSVFICYNILEPFFKGYANKIL

SEQ ID NO: 1880393 - protein, 20 aa, Staphylococcus
LIVFGCAGIISRLMGDGHLA

SEQ ID NO: 1880394 - protein, 19 aa, Staphylococcus
LIVFIVWFSLITPLDFQSS

SEQ ID NO: 1880395 - protein, 24 aa, Staphylococcus
LIVFPYEINIGLTIGVFGTIIFLI

SEQ ID NO: 1880396 - protein, 17 aa, Staphylococcus
LIVGIFSYVLLAAILGS

SEQ ID NO: 1880397 - protein, 20 aa, Staphylococcus
LIVIFICMMVSFIITLSKDR

SEQ ID NO: 1880398 - protein, 19 aa, Staphylococcus
LIVIFPILITYAIALTAIY

SEQ ID NO: 1880399 - protein, 25 aa, Staphylococcus
LIVIIVCLLLKISTVPAMLISSLSA

SEQ ID NO: 1880400 - protein, 27 aa, Staphylococcus
LIVILLLTIIISFIFFMITKKDNYDKD

SEQ ID NO: 1880401 - protein, 23 aa, Staphylococcus
LIVIPLCLILWKGFAPTTDSGVL

SEQ ID NO: 1880402 - protein, 17 aa, Staphylococcus
LIVISILLLLFWSTEKV

SEQ ID NO: 1880403 - protein, 33 aa, Staphylococcus
LIVISMLFYLWIIPWLSAKRVRILKQQVTTHEQ

SEQ ID NO: 1880404 - protein, 19 aa, Staphylococcus
LIVIVFLRIKGHYKDIAKQ

SEQ ID NO: 1880405 - protein, 24 aa, Staphylococcus
LIVKPEFSSAMLPSLAGLFSGIFA

SEQ ID NO: 1880406 - protein, 24 aa, Staphylococcus
LIVLCGLVTLIIRVVPFLMISRIQ

SEQ ID NO: 1880407 - protein, 19 aa, Staphylococcus
LIVLCGLVTLIVRVVPFLM

SEQ ID NO: 1880408 - protein, 36 aa, Staphylococcus
LIVLIYIFFCYKKLKILFLFVIVFIVLCVFNVRPNV

SEQ ID NO: 1880409 - protein, 18 aa, Staphylococcus
LIVMAFLPFIALYLTDMV

SEQ ID NO: 1880410 - protein, 29 aa, Staphylococcus
LIVQPDFLYDIGFQFSFLISLFLILAQPS

SEQ ID NO: 1880411 - protein, 17 aa, Staphylococcus
LIVSRYLYSVALNVPSK

SEQ ID NO: 1880412 - protein, 30 aa, Staphylococcus
LIVVGLGILCGFLFSSRIIKYFLTHHFIGT

SEQ ID NO: 1880413 - protein, 22 aa, Staphylococcus
LIWFVVGIIIYLSYGVRHSKKN

SEQ ID NO: 1880414 - protein, 17 aa, Staphylococcus
LIYACGRGILNAVETPI

SEQ ID NO: 1880415 - protein, 18 aa, Staphylococcus
LIYGIPFLGGSIIVSFGW

SEQ ID NO: 1880416 - protein, 20 aa, Staphylococcus
LIYTCFDASNGILLFIMACV

SEQ ID NO: 1880417 - protein, 19 aa, Staphylococcus
LIYTPISFFVFIFKPITKI

SEQ ID NO: 1880418 - protein, 17 aa, Staphylococcus
LIYVCAGVEALINKDTL

SEQ ID NO: 1880419 - protein, 22 aa, Staphylococcus
LIYVIMSFIIVFFISFMMNIKV

SEQ ID NO: 1880420 - protein, 25 aa, Staphylococcus
LKAAGWMMFGGIVIFSGSLYVLSLT

SEQ ID NO: 1880421 - protein, 17 aa, Staphylococcus
LKAAVAKAPNIRQTSDY

SEQ ID NO: 1880422 - protein, 17 aa, Staphylococcus
LKAGHYPTKDNEVAINN

SEQ ID NO: 1880423 - protein, 21 aa, Staphylococcus
LKAHAPNALMMAAVIIAAGMF

SEQ ID NO: 1880424 - protein, 22 aa, Staphylococcus
LKAHAPNALMMAAVIIAAGMFL

SEQ ID NO: 1880425 - protein, 18 aa, Staphylococcus
LKAIIKMGLVQGNLIPAF

SEQ ID NO: 1880426 - protein, 20 aa, Staphylococcus
LKAQGFTNGFLMKMVLAQTF

SEQ ID NO: 1880427 - protein, 17 aa, Staphylococcus
LKAVLGFVLSLLATLGF

SEQ ID NO: 1880428 - protein, 18 aa, Staphylococcus
LKAVLGFVLSLVATLGFT

SEQ ID NO: 1880429 - protein, 18 aa, Staphylococcus
LKAYIKNRVTNFRFSLFT

SEQ ID NO: 1880430 - protein, 23 aa, Staphylococcus
LKAYLFVCLPLVILAAFTETYVA

SEQ ID NO: 1880431 - protein, 18 aa, Staphylococcus
LKDGKYQVMIIIPENFSK

SEQ ID NO: 1880432 - protein, 20 aa, Staphylococcus
LKDGSLLKYTQMKWLTPDDH

SEQ ID NO: 1880433 - protein, 20 aa, Staphylococcus
LKDKGFKVGDTITLSQSDEK

SEQ ID NO: 1880434 - protein, 18 aa, Staphylococcus
LKDLELHKSGLYKFQASP

SEQ ID NO: 1880435 - protein, 25 aa, Staphylococcus
LKDYKGDISHDVPIIDGFKEGKKEK

SEQ ID NO: 1880436 - protein, 24 aa, Staphylococcus
LKEAKDMKVSILINEGSASASEVF

SEQ ID NO: 1880437 - protein, 28 aa, Staphylococcus
LKEAKFLNNEMEELKAAVAKAPNIRQTS

SEQ ID NO: 1880438 - protein, 21 aa, Staphylococcus
LKEGKDNIAKIVAKEITNALI

SEQ ID NO: 1880439 - protein, 29 aa, Staphylococcus
LKEGQSFCNQCGAHIRQSYQNHPPHYNQN

SEQ ID NO: 1880440 - protein, 25 aa, Staphylococcus
LKEIYRLGLKQAKISAVVQPISGVV

SEQ ID NO: 1880441 - protein, 21 aa, Staphylococcus
LKEIYSNSVGAEFGQDALDKT

SEQ ID NO: 1880442 - protein, 24 aa, Staphylococcus
LKELKKLDAGFHFTDINGRHIYRG

SEQ ID NO: 1880443 - protein, 18 aa, Staphylococcus
LKEMTPFGHVPRLPVADM

SEQ ID NO: 1880444 - protein, 17 aa, Staphylococcus
LKFETMSFLTLPPKEVF

SEQ ID NO: 1880445 - protein, 22 aa, Staphylococcus
LKFKVYPIWMFIISTLLAITVV

SEQ ID NO: 1880446 - protein, 18 aa, Staphylococcus
LKFMSIALILNFLVNSII

SEQ ID NO: 1880447 - protein, 17 aa, Staphylococcus
LKFSSVLIAITINALIN

SEQ ID NO: 1880448 - protein, 18 aa, Staphylococcus
LKGILAFSTVSQLGMIMA

SEQ ID NO: 1880449 - protein, 18 aa, Staphylococcus
LKGILAFSTVSQLGMVMA

SEQ ID NO: 1880450 - protein, 18 aa, Staphylococcus
LKGILAYSTISQLGMIMS

SEQ ID NO: 1880451 - protein, 19 aa, Staphylococcus
LKGILFAIIGASLWGLGGT

SEQ ID NO: 1880452 - protein, 20 aa, Staphylococcus
LKGKDVRRANDWFKRYGAWA

SEQ ID NO: 1880453 - protein, 21 aa, Staphylococcus
LKGKRERLGMTLNELEKQTNV

SEQ ID NO: 1880454 - protein, 22 aa, Staphylococcus
LKGTFKAYGSAYGHGVSGVNMG

SEQ ID NO: 1880455 - protein, 21 aa, Staphylococcus
LKHALPHTMMLGSIFVLISDI

SEQ ID NO: 1880456 - protein, 18 aa, Staphylococcus
LKHFKNFRKKGGHVEAFF

SEQ ID NO: 1880457 - protein, 20 aa, Staphylococcus
LKHLWSLAIEEQFYVFYPIV

SEQ ID NO: 1880458 - protein, 26 aa, Staphylococcus
LKHYHFRRMSLFIIKLIGGLVVMSIS

SEQ ID NO: 1880459 - protein, 19 aa, Staphylococcus
LKIDPEIVKDVAAADRIYI

SEQ ID NO: 1880460 - protein, 21 aa, Staphylococcus
LKIDSQKGIKAMKFANSSKVQ

SEQ ID NO: 1880461 - protein, 22 aa, Staphylococcus
LKIEVAGSIWWVLLVNILIALS

SEQ ID NO: 1880462 - protein, 19 aa, Staphylococcus
LKIFAIIFVGILFFLAIFI

SEQ ID NO: 1880463 - protein, 18 aa, Staphylococcus
LKIFDFGIAKALSETSMT

SEQ ID NO: 1880464 - protein, 20 aa, Staphylococcus
LKIFSGLIIVIFFTLYTHSG

SEQ ID NO: 1880465 - protein, 18 aa, Staphylococcus
LKIIVTLLIMSFVGLGIS

SEQ ID NO: 1880466 - protein, 17 aa, Staphylococcus
LKINGIFSMILTLIIYY

SEQ ID NO: 1880467 - protein, 33 aa, Staphylococcus
LKINMPNIEGMGFAIPIDAAREIAEELEKKGEI

SEQ ID NO: 1880468 - protein, 25 aa, Staphylococcus
LKINMPSIEGMGFAIPINEGKSIAK

SEQ ID NO: 1880469 - protein, 26 aa, Staphylococcus
LKINRAGVPLTIFLGGVKMMIPNMVR

SEQ ID NO: 1880470 - protein, 17 aa, Staphylococcus
LKISIGKIFRISYIINA

SEQ ID NO: 1880471 - protein, 20 aa, Staphylococcus
LKITIIAALFAVPIGLGAAI

SEQ ID NO: 1880472 - protein, 25 aa, Staphylococcus
LKKGFFKNKLIYLGIPYIIINLSIS

SEQ ID NO: 1880473 - protein, 19 aa, Staphylococcus
LKKHIPLIIIVMVALYVLQ

SEQ ID NO: 1880474 - protein, 17 aa, Staphylococcus
LKKKGVDTVEAIATAVG

SEQ ID NO: 1880475 - protein, 20 aa, Staphylococcus
LKKKIKGNVLNRVNNTQDQL

SEQ ID NO: 1880476 - protein, 26 aa, Staphylococcus
LKKLTSFQSILAITCIAQYSSIIIST

SEQ ID NO: 1880477 - protein, 19 aa, Staphylococcus
LKKNDIIALIILNAISIVI

SEQ ID NO: 1880478 - protein, 19 aa, Staphylococcus
LKKNGYKDIYMLKGGYKKW

SEQ ID NO: 1880479 - protein, 25 aa, Staphylococcus
LKKNMKYLIILPIVFLVLSMMMTFL

SEQ ID NO: 1880480 - protein, 19 aa, Staphylococcus
LKKQWKAVIISLFGILGST

SEQ ID NO: 1880481 - protein, 20 aa, Staphylococcus
LKKRDEMLLFLPENMARSMS

SEQ ID NO: 1880482 - protein, 18 aa, Staphylococcus
LKKVFPITHIVMLLSALS

SEQ ID NO: 1880483 - protein, 18 aa, Staphylococcus
LKKVWGFIQNNGFHVPIQ

SEQ ID NO: 1880484 - protein, 20 aa, Staphylococcus
LKKYAKFTFTETFIQFAKIF

SEQ ID NO: 1880485 - protein, 18 aa, Staphylococcus
LKKYWLQIFGGIALGTVV

SEQ ID NO: 1880486 - protein, 17 aa, Staphylococcus
LKKYWLQIFGGITLGTL

SEQ ID NO: 1880487 - protein, 19 aa, Staphylococcus
LKLAIVWTLVQFFEGHFIS

SEQ ID NO: 1880488 - protein, 25 aa, Staphylococcus
LKLANEIHPWLGLVLTVIMLAVMYN

SEQ ID NO: 1880489 - protein, 19 aa, Staphylococcus
LKLAVVFFVELLKANIDVL

SEQ ID NO: 1880490 - protein, 19 aa, Staphylococcus
LKLDMSLTKVFRVSYIINA

SEQ ID NO: 1880491 - protein, 17 aa, Staphylococcus
LKLEVPVLYLGDTISPW

SEQ ID NO: 1880492 - protein, 24 aa, Staphylococcus
LKLFKDDYQFLGMIFQLVTVIQSF

SEQ ID NO: 1880493 - protein, 25 aa, Staphylococcus
LKLGDRKSRIAVCIEPLSQADVVSA

SEQ ID NO: 1880494 - protein, 18 aa, Staphylococcus
LKLGLPMVTALSVTHGFL

SEQ ID NO: 1880495 - protein, 19 aa, Staphylococcus
LKLGLPMVTALSVTHGFLP

SEQ ID NO: 1880496 - protein, 17 aa, Staphylococcus
LKLILYFIIISFILFVL

SEQ ID NO: 1880497 - protein, 17 aa, Staphylococcus
LKLKISIGKIFRISYII

SEQ ID NO: 1880498 - protein, 17 aa, Staphylococcus
LKLKSQEFVMASRTLGA

SEQ ID NO: 1880499 - protein, 19 aa, Staphylococcus
LKLMFRRLLFLFVVGIFGM

SEQ ID NO: 1880500 - protein, 17 aa, Staphylococcus
LKLNKGYGYQNFQHKTK

SEQ ID NO: 1880501 - protein, 17 aa, Staphylococcus
LKLNTFIALIITSVITA

SEQ ID NO: 1880502 - protein, 18 aa, Staphylococcus
LKLPIPIVAILFCITVAS

SEQ ID NO: 1880503 - protein, 32 aa, Staphylococcus
LKLQTHKKANAKRIIQNKADEIIRNIEDNDKV

SEQ ID NO: 1880504 - protein, 18 aa, Staphylococcus
LKLRRWTLLIYGLLLIFF

SEQ ID NO: 1880505 - protein, 17 aa, Staphylococcus
LKLSAIILFVVIYTIVY

SEQ ID NO: 1880506 - protein, 19 aa, Staphylococcus
LKLYPNMRINVDLKDHPGS

SEQ ID NO: 1880507 - protein, 21 aa, Staphylococcus
LKMGISPVFAVIIGLVLHDFK

SEQ ID NO: 1880508 - protein, 20 aa, Staphylococcus
LKMLCGLGVLALMEVSIAKR

SEQ ID NO: 1880509 - protein, 17 aa, Staphylococcus
LKMMVMSLFVITAIVLS

SEQ ID NO: 1880510 - protein, 18 aa, Staphylococcus
LKMTKLGLMLSIIGCICL

SEQ ID NO: 1880511 - protein, 34 aa, Staphylococcus
LKMVITAVIGFGASFIFNWLIQRDFIPQNLMPSI

SEQ ID NO: 1880512 - protein, 17 aa, Staphylococcus
LKNELILAFSTSSSESV

SEQ ID NO: 1880513 - protein, 18 aa, Staphylococcus
LKNEPGFFVYHTDLKTDW

SEQ ID NO: 1880514 - protein, 21 aa, Staphylococcus
LKNFITRLWQSIKAISIRTWN

SEQ ID NO: 1880515 - protein, 17 aa, Staphylococcus
LKNGTTLTAIIGALLLF

SEQ ID NO: 1880516 - protein, 18 aa, Staphylococcus
LKNGVPFYTVLAVSIGIL

SEQ ID NO: 1880517 - protein, 19 aa, Staphylococcus
LKNIKGFGSKTFEKLKEYF

SEQ ID NO: 1880518 - protein, 21 aa, Staphylococcus
LKNIRLLKPFMIGFLLLGCNI

SEQ ID NO: 1880519 - protein, 17 aa, Staphylococcus
LKNKIIASIKSGETCYE

SEQ ID NO: 1880520 - protein, 25 aa, Staphylococcus
LKNKLPSFTFIEMIFSLMITTILLT

SEQ ID NO: 1880521 - protein, 23 aa, Staphylococcus
LKNKTMKLQLLFGQADNDKDEPK

SEQ ID NO: 1880522 - protein, 20 aa, Staphylococcus
LKNLFINLVVTFVVAFVFDY

SEQ ID NO: 1880523 - protein, 29 aa, Staphylococcus
LKNLTTLIVVGAFILFLILLFMLMNHSDQ

SEQ ID NO: 1880524 - protein, 21 aa, Staphylococcus
LKNMLTLVVVLLFILFIILLF

SEQ ID NO: 1880525 - protein, 22 aa, Staphylococcus
LKNRPVLNPIKVIKNYKNSGRT

SEQ ID NO: 1880526 - protein, 24 aa, Staphylococcus
LKNSKRIIILLPFLVVVLSAFFGQ

SEQ ID NO: 1880527 - protein, 17 aa, Staphylococcus
LKNTLDAAIAVKNDPNA

SEQ ID NO: 1880528 - protein, 17 aa, Staphylococcus
LKNVRLGYFERNHSNEL

SEQ ID NO: 1880529 - protein, 20 aa, Staphylococcus
LKPALLPTIPLIGLSVGSLI

SEQ ID NO: 1880530 - protein, 22 aa, Staphylococcus
LKPEIPTCHVIFTPHQKEWERL

SEQ ID NO: 1880531 - protein, 18 aa, Staphylococcus
LKPGFTLEFNDRPDGFKA

SEQ ID NO: 1880532 - protein, 19 aa, Staphylococcus
LKPGFTLEFNDRPDGFKAV

SEQ ID NO: 1880533 - protein, 19 aa, Staphylococcus
LKPIAGIMLIIAGGGAFGQ

SEQ ID NO: 1880534 - protein, 20 aa, Staphylococcus
LKPLALFGIAVMTYGTYELT

SEQ ID NO: 1880535 - protein, 17 aa, Staphylococcus
LKPYIIGIWNGIKTASM

SEQ ID NO: 1880536 - protein, 17 aa, Staphylococcus
LKPYVLIVTIIAILATF

SEQ ID NO: 1880537 - protein, 21 aa, Staphylococcus
LKQEIFGIIWLFTLFLSLAIA

SEQ ID NO: 1880538 - protein, 25 aa, Staphylococcus
LKQFPSLPSKKNFSYGTASALTLAL

SEQ ID NO: 1880539 - protein, 23 aa, Staphylococcus
LKQKLRNFISFVIQYMHSNGSDN

SEQ ID NO: 1880540 - protein, 19 aa, Staphylococcus
LKQKVLHFAGDDLINHENS

SEQ ID NO: 1880541 - protein, 20 aa, Staphylococcus
LKQLDAGYRFTDINGTKVYR

SEQ ID NO: 1880542 - protein, 26 aa, Staphylococcus
LKQYLWPGFLLILFIASFIINAAKVF

SEQ ID NO: 1880543 - protein, 19 aa, Staphylococcus
LKRLDYFSFYALNSPFIYH

SEQ ID NO: 1880544 - protein, 22 aa, Staphylococcus
LKRVSLSAGITGIFGITEPSMY

SEQ ID NO: 1880545 - protein, 27 aa, Staphylococcus
LKRVYKVIKLIVVFFIELMKANIDVSK

SEQ ID NO: 1880546 - protein, 21 aa, Staphylococcus
LKSGIPLTIIGYILVILFSLT

SEQ ID NO: 1880547 - protein, 17 aa, Staphylococcus
LKSLVAMSFIVLSYTVL

SEQ ID NO: 1880548 - protein, 18 aa, Staphylococcus
LKSMSISMILVFIFYYAK

SEQ ID NO: 1880549 - protein, 24 aa, Staphylococcus
LKSQKFTYCTKIIYQAYKYGVDKN

SEQ ID NO: 1880550 - protein, 27 aa, Staphylococcus
LKSQQAFSFKLLFSLIIVGLLVVALLL

SEQ ID NO: 1880551 - protein, 19 aa, Staphylococcus
LKSSVKILEEFDKNQIKSH

SEQ ID NO: 1880552 - protein, 19 aa, Staphylococcus
LKSSVKLLEEFDVNQIKSH

SEQ ID NO: 1880553 - protein, 18 aa, Staphylococcus
LKSYGVPMLTFPFVLMTW

SEQ ID NO: 1880554 - protein, 17 aa, Staphylococcus
LKTAPLLIATILYGAST

SEQ ID NO: 1880555 - protein, 27 aa, Staphylococcus
LKTDGYIDLSVGASFIPYNGATGAESE

SEQ ID NO: 1880556 - protein, 22 aa, Staphylococcus
LKTELSFVEPMISRLELDQAND

SEQ ID NO: 1880557 - protein, 21 aa, Staphylococcus
LKTELSFVEPMISRLELNEAN

SEQ ID NO: 1880558 - protein, 18 aa, Staphylococcus
LKTFPIRFKQSVANAEKL

SEQ ID NO: 1880559 - protein, 27 aa, Staphylococcus
LKTGHTAWRYLIVVLYLVPYAFFGLFI

SEQ ID NO: 1880560 - protein, 27 aa, Staphylococcus
LKTIRLDGLLLRPAIGMLSIFATVMIL

SEQ ID NO: 1880561 - protein, 21 aa, Staphylococcus
LKTLTAKIYRNGTEKTIQIKL

SEQ ID NO: 1880562 - protein, 20 aa, Staphylococcus
LKTPLSCIISYSEGLKEGII

SEQ ID NO: 1880563 - protein, 33 aa, Staphylococcus
LKTPYDHWNFMKLAKPLFWFSGIIILAGVVILF

SEQ ID NO: 1880564 - protein, 23 aa, Staphylococcus
LKTSFERWNFVKLAKPLIGLSIL

SEQ ID NO: 1880565 - protein, 19 aa, Staphylococcus
LKTSFTFVLLIVLIVWSFI

SEQ ID NO: 1880566 - protein, 17 aa, Staphylococcus
LKTSFTIFLVLALIIWS

SEQ ID NO: 1880567 - protein, 18 aa, Staphylococcus
LKVDFLFMIIGAIILGIA

SEQ ID NO: 1880568 - protein, 19 aa, Staphylococcus
LKVDGKVRTYVLLGYPTKI

SEQ ID NO: 1880569 - protein, 18 aa, Staphylococcus
LKVGDIITKVDSKKVDDD

SEQ ID NO: 1880570 - protein, 19 aa, Staphylococcus
LKVGDTVTFKGHHHNYKIS

SEQ ID NO: 1880571 - protein, 24 aa, Staphylococcus
LKVHGHRLLPILVAIFIVSNLVGM

SEQ ID NO: 1880572 - protein, 23 aa, Staphylococcus
LKVKDLWIIIIFITFSWSFYTIF

SEQ ID NO: 1880573 - protein, 21 aa, Staphylococcus
LKVLFRKKVYLIFSILLPLFF

SEQ ID NO: 1880574 - protein, 24 aa, Staphylococcus
LKVLMPIIIVFGVYGIWAVLTQDK

SEQ ID NO: 1880575 - protein, 20 aa, Staphylococcus
LKVLTPILVAIFVYKYTTDN

SEQ ID NO: 1880576 - protein, 25 aa, Staphylococcus
LKVLYCLFISLTLLIMFISMYSILN

SEQ ID NO: 1880577 - protein, 19 aa, Staphylococcus
LKVPVFPIVARKAKGTNEL

SEQ ID NO: 1880578 - protein, 22 aa, Staphylococcus
LKVREIKGLITTKILQAQEKAI

SEQ ID NO: 1880579 - protein, 18 aa, Staphylococcus
LKVSYGLLNVKNITVPTD

SEQ ID NO: 1880580 - protein, 26 aa, Staphylococcus
LKWFTPELSSFFIAIAVFLIIVALIL

SEQ ID NO: 1880581 - protein, 21 aa, Staphylococcus
LKWGSLLFHLGIIPVFFGHVV

SEQ ID NO: 1880582 - protein, 29 aa, Staphylococcus
LKWTAPFKARMILGFVMSFLNAIFIAMPI

SEQ ID NO: 1880583 - protein, 25 aa, Staphylococcus
LKWVKERPKGWGIKLSFNLVGGTIT

SEQ ID NO: 1880584 - protein, 23 aa, Staphylococcus
LKYGCRDLKVDGFDLDHVKIDGT

SEQ ID NO: 1880585 - protein, 21 aa, Staphylococcus
LKYIFLTGHHTFYMAAFLAIL

SEQ ID NO: 1880586 - protein, 21 aa, Staphylococcus
LKYKPTSILYFNPKHDKDVTI

SEQ ID NO: 1880587 - protein, 19 aa, Staphylococcus
LKYQMLVGILIFMLSFFVT

SEQ ID NO: 1880588 - protein, 26 aa, Staphylococcus
LKYTEMKWLTPDGHYIHGKGIKPDIE

SEQ ID NO: 1880589 - protein, 26 aa, Staphylococcus
LKYTEMKWLTPDGHYIHGKGIQPDTK

SEQ ID NO: 1880590 - protein, 26 aa, Staphylococcus
LKYTEMKWLTPKGHYIHGKGIQPDVK

SEQ ID NO: 1880591 - protein, 25 aa, Staphylococcus
LKYTQMKWLTPDGHNIHGKGIQPDT

SEQ ID NO: 1880592 - protein, 26 aa, Staphylococcus
LKYTQMKWLTPKDHYIHGKGIQPDIK

SEQ ID NO: 1880593 - protein, 30 aa, Staphylococcus
LLAAAILPLWGWRALFLIGVIPVILAFYIR

SEQ ID NO: 1880594 - protein, 24 aa, Staphylococcus
LLACGFVGAMGWIIYKLSFDADLG

SEQ ID NO: 1880595 - protein, 20 aa, Staphylococcus
LLAFIFLKERFNTFETLAIV

SEQ ID NO: 1880596 - protein, 18 aa, Staphylococcus
LLAILFDIILRFMEKLSY

SEQ ID NO: 1880597 - protein, 17 aa, Staphylococcus
LLAIPSFIIALVILGLV

SEQ ID NO: 1880598 - protein, 19 aa, Staphylococcus
LLAIPSFIIALVILSLVSN

SEQ ID NO: 1880599 - protein, 17 aa, Staphylococcus
LLAIPSFIIALVVLSLV

SEQ ID NO: 1880600 - protein, 21 aa, Staphylococcus
LLAITRQTFWTTIIIGVIVIL

SEQ ID NO: 1880601 - protein, 21 aa, Staphylococcus
LLAITRQTFWTTIIIGVIVML

SEQ ID NO: 1880602 - protein, 19 aa, Staphylococcus
LLALIIFGGIKWIANAATA

SEQ ID NO: 1880603 - protein, 17 aa, Staphylococcus
LLAPLFISVIVFGSSII

SEQ ID NO: 1880604 - protein, 22 aa, Staphylococcus
LLASLLYRYRKHLFMAAFGEVI

SEQ ID NO: 1880605 - protein, 18 aa, Staphylococcus
LLASRLNRALSIYNQQSH

SEQ ID NO: 1880606 - protein, 19 aa, Staphylococcus
LLATIVVLITICLTKEKPE

SEQ ID NO: 1880607 - protein, 19 aa, Staphylococcus
LLATMFAYDGWIHVGNIAG

SEQ ID NO: 1880608 - protein, 20 aa, Staphylococcus
LLATMFAYDGWMHVGTIAGE

SEQ ID NO: 1880609 - protein, 26 aa, Staphylococcus
LLAYSLAMLCVIPFISLSTKAFKWFN

SEQ ID NO: 1880610 - protein, 18 aa, Staphylococcus
LLCAILMFVRGGIDALLM

SEQ ID NO: 1880611 - protein, 18 aa, Staphylococcus
LLCATPCFIMLSETLLGL

SEQ ID NO: 1880612 - protein, 29 aa, Staphylococcus
LLCHVKRWLSAKHLIYFNIILFCLCMINL

SEQ ID NO: 1880613 - protein, 24 aa, Staphylococcus
LLDCTPLMMYMFMQFYGTLYGMGV

SEQ ID NO: 1880614 - protein, 29 aa, Staphylococcus
LLDGLSFLILYLLHLHLGYTFSGGFIDYV

SEQ ID NO: 1880615 - protein, 21 aa, Staphylococcus
LLDGSFNWIKFLKAASEGMIG

SEQ ID NO: 1880616 - protein, 18 aa, Staphylococcus
LLDNLLLNNDIDKFREEF

SEQ ID NO: 1880617 - protein, 19 aa, Staphylococcus
LLDPVSVGLLGRFYIIFAL

SEQ ID NO: 1880618 - protein, 18 aa, Staphylococcus
LLDTSAIIDGRILDIIKC

SEQ ID NO: 1880619 - protein, 18 aa, Staphylococcus
LLDTSAIIDGRILDVIRC

SEQ ID NO: 1880620 - protein, 18 aa, Staphylococcus
LLDTSAIIDGRILEVIRC

SEQ ID NO: 1880621 - protein, 25 aa, Staphylococcus
LLEASSYFFICYAIASLVTRPIAGR

SEQ ID NO: 1880622 - protein, 17 aa, Staphylococcus
LLEKEGAHVKMTRSDDE

SEQ ID NO: 1880623 - protein, 19 aa, Staphylococcus
LLELIAMKMSVLRYLIYAG

SEQ ID NO: 1880624 - protein, 26 aa, Staphylococcus
LLEMRYGTFTKRFVSILFIFTYVVSF

SEQ ID NO: 1880625 - protein, 17 aa, Staphylococcus
LLETIWFIIPVIIVIAL

SEQ ID NO: 1880626 - protein, 23 aa, Staphylococcus
LLETIWFIVPFIILFALAIPTVK

SEQ ID NO: 1880627 - protein, 17 aa, Staphylococcus
LLFALAHNDIKFLPMYF

SEQ ID NO: 1880628 - protein, 29 aa, Staphylococcus
LLFALTIGWLGRYLRYFRNLTRDIQKQPF

SEQ ID NO: 1880629 - protein, 23 aa, Staphylococcus
LLFCVATPLASWFYGENFFTHTE

SEQ ID NO: 1880630 - protein, 19 aa, Staphylococcus
LLFCVGTPMASWFMSNNFF

SEQ ID NO: 1880631 - protein, 25 aa, Staphylococcus
LLFIIRLSLSLLWKDTKSKKQILNK

SEQ ID NO: 1880632 - protein, 18 aa, Staphylococcus
LLFKVLPLVFSQMGFGVM

SEQ ID NO: 1880633 - protein, 24 aa, Staphylococcus
LLFKYPRLAIWFICTILSGTLINI

SEQ ID NO: 1880634 - protein, 18 aa, Staphylococcus
LLFLLNIFSVKAFGETEF

SEQ ID NO: 1880635 - protein, 24 aa, Staphylococcus
LLFLRNIKTTAISIVSIPLSILIA

SEQ ID NO: 1880636 - protein, 20 aa, Staphylococcus
LLFLSICYALIYSLATLIPG

SEQ ID NO: 1880637 - protein, 26 aa, Staphylococcus
LLFLTFVPLLFLGRYTNVFFTMVSAA

SEQ ID NO: 1880638 - protein, 17 aa, Staphylococcus
LLFNRTVLKVVNMFVIA

SEQ ID NO: 1880639 - protein, 19 aa, Staphylococcus
LLFPSEIILISILLLLFSL

SEQ ID NO: 1880640 - protein, 25 aa, Staphylococcus
LLFRRKLSSFMAFIFPLAFYLLFTS

SEQ ID NO: 1880641 - protein, 17 aa, Staphylococcus
LLFRVGLSILRFLISVG

SEQ ID NO: 1880642 - protein, 29 aa, Staphylococcus
LLFSKIFIFYCILVIFFVFVNCNQVIDKN

SEQ ID NO: 1880643 - protein, 26 aa, Staphylococcus
LLFSMGRAGVMPKAFSKLHPKYKTPY

SEQ ID NO: 1880644 - protein, 27 aa, Staphylococcus
LLFSMGRSGIMPRVFSKLHPVYKTPYV

SEQ ID NO: 1880645 - protein, 19 aa, Staphylococcus
LLFVVLLGLWLLFKDKHQK

SEQ ID NO: 1880646 - protein, 25 aa, Staphylococcus
LLFYEGLKYISFREANIIRTLNPIF

SEQ ID NO: 1880647 - protein, 19 aa, Staphylococcus
LLGALIPVFFIVLLWAAGI

SEQ ID NO: 1880648 - protein, 18 aa, Staphylococcus
LLGAMIMGPLVGWLMKKV

SEQ ID NO: 1880649 - protein, 22 aa, Staphylococcus
LLGDISSLLGMLGISIVTINGV

SEQ ID NO: 1880650 - protein, 23 aa, Staphylococcus
LLGDISSLLGMLGISIVTINGVD

SEQ ID NO: 1880651 - protein, 25 aa, Staphylococcus
LLGDLKGRIAIAIIYQNVLLIISAF

SEQ ID NO: 1880652 - protein, 22 aa, Staphylococcus
LLGEAMPLIILFIVTLSGILSI

SEQ ID NO: 1880653 - protein, 18 aa, Staphylococcus
LLGEFLKLFMDAHPMLET

SEQ ID NO: 1880654 - protein, 23 aa, Staphylococcus
LLGEPLAMWIGFPLGQVLLYIGV

SEQ ID NO: 1880655 - protein, 26 aa, Staphylococcus
LLGGAILEFATWHWLFFINIPIAVIA

SEQ ID NO: 1880656 - protein, 19 aa, Staphylococcus
LLGGIVASFLFREENPTLQ

SEQ ID NO: 1880657 - protein, 18 aa, Staphylococcus
LLGGMLFDKLGGYRTIII

SEQ ID NO: 1880658 - protein, 27 aa, Staphylococcus
LLGGRLSGRIGIKRVISLALLTSTLSL

SEQ ID NO: 1880659 - protein, 17 aa, Staphylococcus
LLGGVVASFLFRNTRPE

SEQ ID NO: 1880660 - protein, 18 aa, Staphylococcus
LLGGWRFTIAGFIILLVL

SEQ ID NO: 1880661 - protein, 19 aa, Staphylococcus
LLGGWRFVIAGCMMLILTF

SEQ ID NO: 1880662 - protein, 25 aa, Staphylococcus
LLGILLFAYYAWKAPAFNESKLQDP

SEQ ID NO: 1880663 - protein, 19 aa, Staphylococcus
LLGLIPIYLGIKVAIFDDC

SEQ ID NO: 1880664 - protein, 19 aa, Staphylococcus
LLGLIPIYLGIKVAIYDDC

SEQ ID NO: 1880665 - protein, 19 aa, Staphylococcus
LLGLIPIYLGIKVAIYGDS

SEQ ID NO: 1880666 - protein, 19 aa, Staphylococcus
LLGLIPIYLGLKVAIFDDC

SEQ ID NO: 1880667 - protein, 21 aa, Staphylococcus
LLGLLPLYLGVKMWIKGEEDE

SEQ ID NO: 1880668 - protein, 25 aa, Staphylococcus
LLGNETFKAVPGLGIEATINGHRIL

SEQ ID NO: 1880669 - protein, 18 aa, Staphylococcus
LLGSLFSVLSIRKIDPLK

SEQ ID NO: 1880670 - protein, 22 aa, Staphylococcus
LLGSRFLLLILVKLMNIKESIH

SEQ ID NO: 1880671 - protein, 30 aa, Staphylococcus
LLGTPRFVLPMLIQGVSFILLFSYISASPF

SEQ ID NO: 1880672 - protein, 19 aa, Staphylococcus
LLGVCGLASIIFLYPKLKA

SEQ ID NO: 1880673 - protein, 17 aa, Staphylococcus
LLGVMVFLAGCDYSKPE

SEQ ID NO: 1880674 - protein, 18 aa, Staphylococcus
LLGVSSFYQQVVKGVVIL

SEQ ID NO: 1880675 - protein, 24 aa, Staphylococcus
LLHALCITILFGLIAYFILLMLRS

SEQ ID NO: 1880676 - protein, 23 aa, Staphylococcus
LLHAYFASWAFLKLMGSNDHSPV

SEQ ID NO: 1880677 - protein, 18 aa, Staphylococcus
LLHLPKMDLLFTVPAFIL

SEQ ID NO: 1880678 - protein, 18 aa, Staphylococcus
LLHPEFKTTVNGEVKIYS

SEQ ID NO: 1880679 - protein, 17 aa, Staphylococcus
LLHPLFVLLPLPDALNA

SEQ ID NO: 1880680 - protein, 20 aa, Staphylococcus
LLHYIFEIDATWLLLLAVFI

SEQ ID NO: 1880681 - protein, 18 aa, Staphylococcus
LLIAFYVPFFKKLKVTSA

SEQ ID NO: 1880682 - protein, 22 aa, Staphylococcus
LLIAGLCLGAGYGNISSCMQAI

SEQ ID NO: 1880683 - protein, 22 aa, Staphylococcus
LLIAIGIMFFLRSNKRTLISNA

SEQ ID NO: 1880684 - protein, 18 aa, Staphylococcus
LLIALAIYVFRFIWVFIL

SEQ ID NO: 1880685 - protein, 26 aa, Staphylococcus
LLIASLAGFIAWGVFGDKYEETPDLS

SEQ ID NO: 1880686 - protein, 17 aa, Staphylococcus
LLICSKIGVNILNTHYI

SEQ ID NO: 1880687 - protein, 17 aa, Staphylococcus
LLICVYRSFGVAMILAA

SEQ ID NO: 1880688 - protein, 19 aa, Staphylococcus
LLIFCLNHQVGITMFILPL

SEQ ID NO: 1880689 - protein, 17 aa, Staphylococcus
LLIFERSIIMPLYMIAS

SEQ ID NO: 1880690 - protein, 18 aa, Staphylococcus
LLIFFIAFGLLSLTSYAA

SEQ ID NO: 1880691 - protein, 28 aa, Staphylococcus
LLIICGCIPKLGALANMIPLPVLGGAMI

SEQ ID NO: 1880692 - protein, 17 aa, Staphylococcus
LLIIIPILILAFIVSKL

SEQ ID NO: 1880693 - protein, 19 aa, Staphylococcus
LLIIMGGIGPLVFLDLVTT

SEQ ID NO: 1880694 - protein, 17 aa, Staphylococcus
LLILATLPLCFLQYDSS

SEQ ID NO: 1880695 - protein, 34 aa, Staphylococcus
LLILGFLLHYIFKINDKWLLILCVLVIIINASWN

SEQ ID NO: 1880696 - protein, 35 aa, Staphylococcus
LLILGFLLHYIFKINEKWLLMLCVLVIIINASWNT

SEQ ID NO: 1880697 - protein, 19 aa, Staphylococcus
LLILGLILEYIFKIDQVWI

SEQ ID NO: 1880698 - protein, 18 aa, Staphylococcus
LLIPLSYLTAFVLGWGYI

SEQ ID NO: 1880699 - protein, 17 aa, Staphylococcus
LLIRRFHDTGRTMLMPL

SEQ ID NO: 1880700 - protein, 30 aa, Staphylococcus
LLIRSYLFVYYRLDFRFKSLLYISIAVSFV

SEQ ID NO: 1880701 - protein, 30 aa, Staphylococcus
LLISCIMKSPGVSIAVGIVFYFAASIISGL

SEQ ID NO: 1880702 - protein, 17 aa, Staphylococcus
LLISGIGYAAYNAYNNK

SEQ ID NO: 1880703 - protein, 17 aa, Staphylococcus
LLISLGVIVIILLLVII

SEQ ID NO: 1880704 - protein, 18 aa, Staphylococcus
LLISSFILLLKLHHRDVA

SEQ ID NO: 1880705 - protein, 25 aa, Staphylococcus
LLISYPAAYSIRSSKNQNMWLLILI

SEQ ID NO: 1880706 - protein, 18 aa, Staphylococcus
LLITLIGYYFNVNRNIFW

SEQ ID NO: 1880707 - protein, 24 aa, Staphylococcus
LLITLSLLIAYFFKKIARVNTETA

SEQ ID NO: 1880708 - protein, 25 aa, Staphylococcus
LLITYVVLCLFGLIMVYSASMVAAT

SEQ ID NO: 1880709 - protein, 17 aa, Staphylococcus
LLIVFTALMIIANFYYI

SEQ ID NO: 1880710 - protein, 19 aa, Staphylococcus
LLIYCLSGLGIPAALASVL

SEQ ID NO: 1880711 - protein, 17 aa, Staphylococcus
LLIYFYVPFFKKLKVTS

SEQ ID NO: 1880712 - protein, 19 aa, Staphylococcus
LLKEAEMWIMKRSAVEILF

SEQ ID NO: 1880713 - protein, 25 aa, Staphylococcus
LLKFILKRFDTIYFIMSAICFFIVP

SEQ ID NO: 1880714 - protein, 24 aa, Staphylococcus
LLKGIIVIVIGRWVSAALDLTTTA

SEQ ID NO: 1880715 - protein, 18 aa, Staphylococcus
LLKIPGVGPAKVREIIDY

SEQ ID NO: 1880716 - protein, 28 aa, Staphylococcus
LLKIYRPKLHYFKINFKILYQVSTLGIP

SEQ ID NO: 1880717 - protein, 20 aa, Staphylococcus
LLKKPSFVIPMLLQGLTYVM

SEQ ID NO: 1880718 - protein, 18 aa, Staphylococcus
LLKRGIDAIYALVMSIVT

SEQ ID NO: 1880719 - protein, 19 aa, Staphylococcus
LLKTNRFSLILSLISLVLV

SEQ ID NO: 1880720 - protein, 19 aa, Staphylococcus
LLLACGFVGALAWTIYQYT

SEQ ID NO: 1880721 - protein, 22 aa, Staphylococcus
LLLDSGDAFQGLPVSNNSKGEE

SEQ ID NO: 1880722 - protein, 17 aa, Staphylococcus
LLLFVMMMIQWLMHQPL

SEQ ID NO: 1880723 - protein, 18 aa, Staphylococcus
LLLGIMVFLAGCDYSKPE

SEQ ID NO: 1880724 - protein, 19 aa, Staphylococcus
LLLGITLFFFVIFIHNFDY

SEQ ID NO: 1880725 - protein, 24 aa, Staphylococcus
LLLGLPWDTAWIVAQQMAKKIVTN

SEQ ID NO: 1880726 - protein, 17 aa, Staphylococcus
LLLHLRPLGLKDKSLGE

SEQ ID NO: 1880727 - protein, 25 aa, Staphylococcus
LLLIAQLNFHFTKGVLAEREPVLSY

SEQ ID NO: 1880728 - protein, 28 aa, Staphylococcus
LLLICGCIPKLGALANIIPLPVLGGAMI

SEQ ID NO: 1880729 - protein, 24 aa, Staphylococcus
LLLICGCIPKLGALANVIPLPVLG

SEQ ID NO: 1880730 - protein, 27 aa, Staphylococcus
LLLICGCLPKLGALANIIPLPVLGGAM

SEQ ID NO: 1880731 - protein, 24 aa, Staphylococcus
LLLIFPALLGYFLGNFALGLFVST

SEQ ID NO: 1880732 - protein, 23 aa, Staphylococcus
LLLIGLIAFISMAVFGSKYEEMP

SEQ ID NO: 1880733 - protein, 18 aa, Staphylococcus
LLLIVGLGIAFLMNMIMP

SEQ ID NO: 1880734 - protein, 25 aa, Staphylococcus
LLLLCTITIISFIGLGAILHHTIYQ

SEQ ID NO: 1880735 - protein, 17 aa, Staphylococcus
LLLLFAALLNYIFPNAV

SEQ ID NO: 1880736 - protein, 25 aa, Staphylococcus
LLLLICVGFVSQLFVTKTLFPSKEQ

SEQ ID NO: 1880737 - protein, 18 aa, Staphylococcus
LLLLISISLVIASTYAIV

SEQ ID NO: 1880738 - protein, 18 aa, Staphylococcus
LLLLIVIVCKLTIHSETV

SEQ ID NO: 1880739 - protein, 19 aa, Staphylococcus
LLLLPRLGAALTVVITVAG

SEQ ID NO: 1880740 - protein, 22 aa, Staphylococcus
LLLLVCVGFASQFLVTKSLFPT

SEQ ID NO: 1880741 - protein, 19 aa, Staphylococcus
LLLMIPLLFLISIVIFGIS

SEQ ID NO: 1880742 - protein, 18 aa, Staphylococcus
LLLNIPLIMAFHTVGAVL

SEQ ID NO: 1880743 - protein, 18 aa, Staphylococcus
LLLPVIFYTRLYKLKKEA

SEQ ID NO: 1880744 - protein, 25 aa, Staphylococcus
LLLQRFTTGFLKSIAILIGLVIGTI

SEQ ID NO: 1880745 - protein, 17 aa, Staphylococcus
LLLQVFFFKDIKTEHTV

SEQ ID NO: 1880746 - protein, 17 aa, Staphylococcus
LLLRVIVIGMSFLMMAI

SEQ ID NO: 1880747 - protein, 18 aa, Staphylococcus
LLLSILIKLMHLHIHASI

SEQ ID NO: 1880748 - protein, 23 aa, Staphylococcus
LLLSLCIHYKYFMFGVINLINSF

SEQ ID NO: 1880749 - protein, 22 aa, Staphylococcus
LLLSLFIKIDFETVKPSHNDSG

SEQ ID NO: 1880750 - protein, 25 aa, Staphylococcus
LLLSLSFIPRYGFGKGVYISLFTSV

SEQ ID NO: 1880751 - protein, 24 aa, Staphylococcus
LLLTGHASFEPKVIIVGLISGAFW

SEQ ID NO: 1880752 - protein, 27 aa, Staphylococcus
LLLTILLLVMFDWKGQFSIKTDHGTML

SEQ ID NO: 1880753 - protein, 20 aa, Staphylococcus
LLLVTGWRMRTLITIVSTLV

SEQ ID NO: 1880754 - protein, 17 aa, Staphylococcus
LLLVVGLGIAFLMNSIM

SEQ ID NO: 1880755 - protein, 24 aa, Staphylococcus
LLLWTQMKYIFGISIATYVVSALT

SEQ ID NO: 1880756 - protein, 21 aa, Staphylococcus
LLLYFFIRFVFPYNHPTPIQS

SEQ ID NO: 1880757 - protein, 19 aa, Staphylococcus
LLLYMSWSSALGRISTHKQ

SEQ ID NO: 1880758 - protein, 17 aa, Staphylococcus
LLLYVIILTTMLSFLIL

SEQ ID NO: 1880759 - protein, 24 aa, Staphylococcus
LLMSSQLPSIFGISTATYIFAVLS

SEQ ID NO: 1880760 - protein, 32 aa, Staphylococcus
LLMTLGTSIIAIFIGVIIAYLLKRRKQDEGAQ

SEQ ID NO: 1880761 - protein, 19 aa, Staphylococcus
LLMTYKLANELALFYKNGI

SEQ ID NO: 1880762 - protein, 27 aa, Staphylococcus
LLMVLTAIAIVVVWFVFNQLIAGIASA

SEQ ID NO: 1880763 - protein, 23 aa, Staphylococcus
LLMVRHKIKPFKIFDKPQYERTY

SEQ ID NO: 1880764 - protein, 18 aa, Staphylococcus
LLNFCMLSFPLDMIEERN

SEQ ID NO: 1880765 - protein, 24 aa, Staphylococcus
LLNFSSDVSWIFDVAQILTHPLMT

SEQ ID NO: 1880766 - protein, 25 aa, Staphylococcus
LLNKSRLRIERDLKKSVTNKQLYNL

SEQ ID NO: 1880767 - protein, 21 aa, Staphylococcus
LLNKTRLRIERDLKNNVTNKQ

SEQ ID NO: 1880768 - protein, 18 aa, Staphylococcus
LLNLRVFRSKTFTLSAVA

SEQ ID NO: 1880769 - protein, 17 aa, Staphylococcus
LLNPNYFLVSAFIISAI

SEQ ID NO: 1880770 - protein, 19 aa, Staphylococcus
LLNRTMGYAGLFGGTVAVI

SEQ ID NO: 1880771 - protein, 20 aa, Staphylococcus
LLNYWSVKILTSFTSLISVF

SEQ ID NO: 1880772 - protein, 25 aa, Staphylococcus
LLPACGFVGAMGWIIYVIAMDMNTG

SEQ ID NO: 1880773 - protein, 24 aa, Staphylococcus
LLPAVCALGLVFIRTHSRLSRIFS

SEQ ID NO: 1880774 - protein, 17 aa, Staphylococcus
LLPFIFALIIPIVYRFI

SEQ ID NO: 1880775 - protein, 20 aa, Staphylococcus
LLPFLCALILVFIKDKSKVS

SEQ ID NO: 1880776 - protein, 22 aa, Staphylococcus
LLPFLCALVLVFTKNKNNTSKI

SEQ ID NO: 1880777 - protein, 20 aa, Staphylococcus
LLPGSLLGSFLSRYLTLESF

SEQ ID NO: 1880778 - protein, 17 aa, Staphylococcus
LLPIMSYILLKGRARCC

SEQ ID NO: 1880779 - protein, 24 aa, Staphylococcus
LLPKARRLGISWMVIGLLGAVAVG

SEQ ID NO: 1880780 - protein, 17 aa, Staphylococcus
LLPKLFINFPRRYRNVF

SEQ ID NO: 1880781 - protein, 18 aa, Staphylococcus
LLPLIFALIIPFVYRFYK

SEQ ID NO: 1880782 - protein, 17 aa, Staphylococcus
LLPLIFALIIPILYRFV

SEQ ID NO: 1880783 - protein, 18 aa, Staphylococcus
LLPLLKLVLVVVFAMVFF

SEQ ID NO: 1880784 - protein, 20 aa, Staphylococcus
LLPLYLKGALLFSSVIAGLT

SEQ ID NO: 1880785 - protein, 17 aa, Staphylococcus
LLPNSAIKVMDNGQREE

SEQ ID NO: 1880786 - protein, 21 aa, Staphylococcus
LLPQARYNLWISILTLLSIII

SEQ ID NO: 1880787 - protein, 18 aa, Staphylococcus
LLPSNPFLDFTGERTTST

SEQ ID NO: 1880788 - protein, 17 aa, Staphylococcus
LLPSSLLGNERLLHQAF

SEQ ID NO: 1880789 - protein, 18 aa, Staphylococcus
LLPTLVAVFFFAALFLPF

SEQ ID NO: 1880790 - protein, 18 aa, Staphylococcus
LLQDLRLASVDSSNYKNF

SEQ ID NO: 1880791 - protein, 18 aa, Staphylococcus
LLQGMTFVILFSYISASP

SEQ ID NO: 1880792 - protein, 20 aa, Staphylococcus
LLQIKLEIDTLIAYHEQIFI

SEQ ID NO: 1880793 - protein, 17 aa, Staphylococcus
LLQKGKINYRMHKRIDV

SEQ ID NO: 1880794 - protein, 26 aa, Staphylococcus
LLQNHWFKVSIIVLFVIQQAFILSND

SEQ ID NO: 1880795 - protein, 21 aa, Staphylococcus
LLRNAIKYTNNEGAINIKLQH

SEQ ID NO: 1880796 - protein, 19 aa, Staphylococcus
LLRPKLTIINAVLTIALLV

SEQ ID NO: 1880797 - protein, 20 aa, Staphylococcus
LLRSNFRFISLLFLAVFSIS

SEQ ID NO: 1880798 - protein, 25 aa, Staphylococcus
LLSDLKGRIAVAIIYQNVFLIIGSF

SEQ ID NO: 1880799 - protein, 17 aa, Staphylococcus
LLSEIIFFINIVLALYY

SEQ ID NO: 1880800 - protein, 19 aa, Staphylococcus
LLSIKGFPIAFGALYLPIL

SEQ ID NO: 1880801 - protein, 18 aa, Staphylococcus
LLSILGVFLVAGFSFQGT

SEQ ID NO: 1880802 - protein, 25 aa, Staphylococcus
LLSILKFIFATALFIFVIFTLYREL

SEQ ID NO: 1880803 - protein, 18 aa, Staphylococcus
LLSILKFVFAAALFIFVV

SEQ ID NO: 1880804 - protein, 18 aa, Staphylococcus
LLSILKFVFAAVLFIAVV

SEQ ID NO: 1880805 - protein, 27 aa, Staphylococcus
LLSKFPLSDITSGLAILLIFLFIVTSA

SEQ ID NO: 1880806 - protein, 19 aa, Staphylococcus
LLSLIVMILLLWIAVRSYR

SEQ ID NO: 1880807 - protein, 20 aa, Staphylococcus
LLSLVIRFILYKTTNQSLDE

SEQ ID NO: 1880808 - protein, 24 aa, Staphylococcus
LLSNAKFVVPMLMQGLTYVMLFSY

SEQ ID NO: 1880809 - protein, 32 aa, Staphylococcus
LLSNQQMADWGWRIPFILAAPLGIIGIILRSS

SEQ ID NO: 1880810 - protein, 19 aa, Staphylococcus
LLSPACASWDQYNTFEERG

SEQ ID NO: 1880811 - protein, 19 aa, Staphylococcus
LLSRFKILYIAVAGVSLFA

SEQ ID NO: 1880812 - protein, 23 aa, Staphylococcus
LLSTICSIIGMFFSYLYNLPSGA

SEQ ID NO: 1880813 - protein, 20 aa, Staphylococcus
LLSVFCTLAGRKKEQAQRFE

SEQ ID NO: 1880814 - protein, 20 aa, Staphylococcus
LLSVKFKFQPTRMILIGVAM

SEQ ID NO: 1880815 - protein, 17 aa, Staphylococcus
LLTIAKVVFATVLFIIV

SEQ ID NO: 1880816 - protein, 18 aa, Staphylococcus
LLTIFFAEISYRFIETPF

SEQ ID NO: 1880817 - protein, 24 aa, Staphylococcus
LLTIKKYRNVAVIFWIISLVSLLL

SEQ ID NO: 1880818 - protein, 26 aa, Staphylococcus
LLTIMSMFLIQSCQLYYFKYVLDKSN

SEQ ID NO: 1880819 - protein, 23 aa, Staphylococcus
LLTKITSFIPFLAPFELLVRSQS

SEQ ID NO: 1880820 - protein, 18 aa, Staphylococcus
LLTLDFYKPIFGKNKSDK

SEQ ID NO: 1880821 - protein, 18 aa, Staphylococcus
LLTMARAFIPPRSPRKYH

SEQ ID NO: 1880822 - protein, 17 aa, Staphylococcus
LLTPFAVYFVAEMLHAS

SEQ ID NO: 1880823 - protein, 17 aa, Staphylococcus
LLTRFKILYIAMIGVFL

SEQ ID NO: 1880824 - protein, 19 aa, Staphylococcus
LLTRFKILYITVVGILLFG

SEQ ID NO: 1880825 - protein, 17 aa, Staphylococcus
LLTSIGIGIIASIILII

SEQ ID NO: 1880826 - protein, 17 aa, Staphylococcus
LLTSIGIGIITSIVLII

SEQ ID NO: 1880827 - protein, 30 aa, Staphylococcus
LLTSSFLAGILWIIAGIMLLARKPKNDSNH

SEQ ID NO: 1880828 - protein, 17 aa, Staphylococcus
LLTTIFEHIQISFIALL

SEQ ID NO: 1880829 - protein, 25 aa, Staphylococcus
LLTTPRFVLPMLIQGVTFIMLFSYI

SEQ ID NO: 1880830 - protein, 25 aa, Staphylococcus
LLVACGFVGAVAWTIYQFTVGMDLG

SEQ ID NO: 1880831 - protein, 19 aa, Staphylococcus
LLVAYAGGFIFTYFFGTTK

SEQ ID NO: 1880832 - protein, 17 aa, Staphylococcus
LLVCLTIVSLFVGVSQL

SEQ ID NO: 1880833 - protein, 18 aa, Staphylococcus
LLVFFPIYIIITVNTDFG

SEQ ID NO: 1880834 - protein, 24 aa, Staphylococcus
LLVGEKFGSLTLIILPTIVGVIAS

SEQ ID NO: 1880835 - protein, 19 aa, Staphylococcus
LLVGLFIWNIVQWSTNPAI

SEQ ID NO: 1880836 - protein, 20 aa, Staphylococcus
LLVGLFIWRQERLDTPLLSF

SEQ ID NO: 1880837 - protein, 17 aa, Staphylococcus
LLVGWVVMNFLIKIHPL

SEQ ID NO: 1880838 - protein, 18 aa, Staphylococcus
LLVIISWLFVLREYQHGH

SEQ ID NO: 1880839 - protein, 17 aa, Staphylococcus
LLVILFFLLRNFNSPNA

SEQ ID NO: 1880840 - protein, 20 aa, Staphylococcus
LLVILWQFIDSFTIVHTLQS

SEQ ID NO: 1880841 - protein, 20 aa, Staphylococcus
LLVILWQFIDSFTVVHMLKS

SEQ ID NO: 1880842 - protein, 20 aa, Staphylococcus
LLVILWQFIDSFTVVHMLQT

SEQ ID NO: 1880843 - protein, 18 aa, Staphylococcus
LLVLVFLPLIGFILYLLL

SEQ ID NO: 1880844 - protein, 26 aa, Staphylococcus
LLVMIFISAFALRNGFLRLDNYVDDL

SEQ ID NO: 1880845 - protein, 22 aa, Staphylococcus
LLVPLFTGRIVDKFSVSSINWG

SEQ ID NO: 1880846 - protein, 26 aa, Staphylococcus
LLVPYICFFCFFSVYYYLTGKSSNLQ

SEQ ID NO: 1880847 - protein, 25 aa, Staphylococcus
LLVQGVCFFVLYYVIFRVVIQVFNL

SEQ ID NO: 1880848 - protein, 17 aa, Staphylococcus
LLVSFIIMFVGIQVVIE

SEQ ID NO: 1880849 - protein, 18 aa, Staphylococcus
LLVSFIIMFVGIQVVIEN

SEQ ID NO: 1880850 - protein, 26 aa, Staphylococcus
LLVTGLKLRSWITIASTLLGTLLSIG

SEQ ID NO: 1880851 - protein, 22 aa, Staphylococcus
LLVTGWHWRTAITIASTLVGTF

SEQ ID NO: 1880852 - protein, 18 aa, Staphylococcus
LLVTYVILCLIGLVMVYS

SEQ ID NO: 1880853 - protein, 18 aa, Staphylococcus
LLVVLFSVVTRNKWIGTL

SEQ ID NO: 1880854 - protein, 17 aa, Staphylococcus
LLWFNKRQRLPFSIEFK

SEQ ID NO: 1880855 - protein, 17 aa, Staphylococcus
LLWMFIAAIIGFIFPTQ

SEQ ID NO: 1880856 - protein, 19 aa, Staphylococcus
LLWVHCVVILLIIDIINAN

SEQ ID NO: 1880857 - protein, 22 aa, Staphylococcus
LLYFILCIGLFILIIIPETPIT

SEQ ID NO: 1880858 - protein, 18 aa, Staphylococcus
LLYFVTMIILCLIIIDLL

SEQ ID NO: 1880859 - protein, 24 aa, Staphylococcus
LLYIPGLFVYRFVQRNNHKPLTKG

SEQ ID NO: 1880860 - protein, 20 aa, Staphylococcus
LLYIPGLFVYYTVQKNKGQK

SEQ ID NO: 1880861 - protein, 18 aa, Staphylococcus
LLYLFRISSIVSQPLFGI

SEQ ID NO: 1880862 - protein, 40 aa, Staphylococcus; identical to SEQ ID NO: 1743297

SEQ ID NO: 1880863 - protein, 40 aa, Staphylococcus
LLYVALRLSLIKVLKPYYPFPIIVDDAFVHFDKDRKERML

SEQ ID NO: 1880864 - protein, 18 aa, Staphylococcus
LLYWKILLIFIYTLLNAN

SEQ ID NO: 1880865 - protein, 18 aa, Staphylococcus
LMAGELLAGMSRGVEAAL

SEQ ID NO: 1880866 - protein, 21 aa, Staphylococcus
LMAGELLAGMSRGVEAALTAF

SEQ ID NO: 1880867 - protein, 21 aa, Staphylococcus
LMAGELLAGMSRGVEAALTSF

SEQ ID NO: 1880868 - protein, 20 aa, Staphylococcus
LMAGVQYFFSLTIESTPIYL

SEQ ID NO: 1880869 - protein, 26 aa, Staphylococcus
LMALFTFKLYRHYYYKIFAIITWFLL

SEQ ID NO: 1880870 - protein, 17 aa, Staphylococcus
LMALWGVEDRLRHPNDI

SEQ ID NO: 1880871 - protein, 18 aa, Staphylococcus
LMAMLIYLLSLFSGFIGP

SEQ ID NO: 1880872 - protein, 19 aa, Staphylococcus
LMCLIGFYDGFLGGGTGSF

SEQ ID NO: 1880873 - protein, 18 aa, Staphylococcus
LMDGRVALGIIIFAIFVY

SEQ ID NO: 1880874 - protein, 17 aa, Staphylococcus
LMDYFFKVYYRDHTMVF

SEQ ID NO: 1880875 - protein, 21 aa, Staphylococcus
LMEGRTTIVIAHRLSTIKKAG

SEQ ID NO: 1880876 - protein, 23 aa, Staphylococcus
LMENRTTVVIAHRLSTIKKAEQI

SEQ ID NO: 1880877 - protein, 27 aa, Staphylococcus
LMERYRIPRLLGITIIYVAVVGIITLI

SEQ ID NO: 1880878 - protein, 27 aa, Staphylococcus
LMERYRIPRLVGIMIIYIAIVGIIALI

SEQ ID NO: 1880879 - protein, 17 aa, Staphylococcus
LMFGTLILLSGCSNLEV

SEQ ID NO: 1880880 - protein, 17 aa, Staphylococcus
LMFGTLILLSGCSNVEV

SEQ ID NO: 1880881 - protein, 22 aa, Staphylococcus
LMFIKFPIPFLPPYLTLDFGDV

SEQ ID NO: 1880882 - protein, 21 aa, Staphylococcus
LMFMFKEWTIYQAGALAILAS

SEQ ID NO: 1880883 - protein, 18 aa, Staphylococcus
LMFMPVWMGSLITSVILF

SEQ ID NO: 1880884 - protein, 17 aa, Staphylococcus
LMFYGMFFIGLVAIAVG

SEQ ID NO: 1880885 - protein, 26 aa, Staphylococcus
LMGAVLSLLAGLGLMKRSRKNKEDKK

SEQ ID NO: 1880886 - protein, 25 aa, Staphylococcus
LMGFTEQYLIWSIFRLISGITSGTV

SEQ ID NO: 1880887 - protein, 17 aa, Staphylococcus
LMGNAFAAFTVITASIG

SEQ ID NO: 1880888 - protein, 25 aa, Staphylococcus
LMGSSLKGTYLWPIVAISNICQGSA

SEQ ID NO: 1880889 - protein, 28 aa, Staphylococcus
LMGTGEHLWRFAVGFGALIALVLYILRI

SEQ ID NO: 1880890 - protein, 17 aa, Staphylococcus
LMGVIIGNSFLNLVEKD

SEQ ID NO: 1880891 - protein, 18 aa, Staphylococcus
LMHLHIHASIGFEVAALI

SEQ ID NO: 1880892 - protein, 17 aa, Staphylococcus
LMHMHKRISDKEYEKAK

SEQ ID NO: 1880893 - protein, 18 aa, Staphylococcus
LMIFAFIFTIGYILSNID

SEQ ID NO: 1880894 - protein, 25 aa, Staphylococcus
LMIFMLWILLGWKVAVVYFVVLAIF

SEQ ID NO: 1880895 - protein, 28 aa, Staphylococcus
LMIILCLLRLNVIISLFISSLVGGLISG

SEQ ID NO: 1880896 - protein, 18 aa, Staphylococcus
LMIISWIQLICGLTRANK

SEQ ID NO: 1880897 - protein, 17 aa, Staphylococcus
LMILPLWAQHKVKSTYE

SEQ ID NO: 1880898 - protein, 18 aa, Staphylococcus
LMIVRLIHGLAFGMSSTT

SEQ ID NO: 1880899 - protein, 17 aa, Staphylococcus
LMKVAKWNAYHHDGELD

SEQ ID NO: 1880900 - protein, 19 aa, Staphylococcus
LMLALLLIFNGLQFKITLV

SEQ ID NO: 1880901 - protein, 18 aa, Staphylococcus
LMLFLKIIGVSIFPMLLI

SEQ ID NO: 1880902 - protein, 20 aa, Staphylococcus
LMLFMLWALLGWKVAVVYFV

SEQ ID NO: 1880903 - protein, 23 aa, Staphylococcus
LMLHKSGLFKYKASPNYKNLNEA

SEQ ID NO: 1880904 - protein, 17 aa, Staphylococcus
LMLHRSGLYKFEASPKT

SEQ ID NO: 1880905 - protein, 18 aa, Staphylococcus
LMLLIGLSAAYYGHPSLF

SEQ ID NO: 1880906 - protein, 19 aa, Staphylococcus
LMLNRILKQLLKAEDNGTL

SEQ ID NO: 1880907 - protein, 25 aa, Staphylococcus
LMMAFFAEFGFRSYLQTVVESKVNT

SEQ ID NO: 1880908 - protein, 17 aa, Staphylococcus
LMNPLMIFMLWILLGWK

SEQ ID NO: 1880909 - protein, 17 aa, Staphylococcus
LMNPLMLFMLWALLGWK

SEQ ID NO: 1880910 - protein, 18 aa, Staphylococcus
LMNRRLFKMYDRIEISGH

SEQ ID NO: 1880911 - protein, 19 aa, Staphylococcus
LMNYICTYFYLLFGEILTS

SEQ ID NO: 1880912 - protein, 26 aa, Staphylococcus
LMQRWFPEIPEYIFAASAIILVLIFN

SEQ ID NO: 1880913 - protein, 18 aa, Staphylococcus
LMQTFQIDASVNPGNSGG

SEQ ID NO: 1880914 - protein, 24 aa, Staphylococcus
LMRITEFVMLFPFIPFAIVLNATF

SEQ ID NO: 1880915 - protein, 23 aa, Staphylococcus
LMRKLKVPVFPIVARKGKGTEEL

SEQ ID NO: 1880916 - protein, 19 aa, Staphylococcus
LMRSLKLSLLTAIITSILA

SEQ ID NO: 1880917 - protein, 24 aa, Staphylococcus
LMSCGLMMCLISLFGKRLAMVSGP

SEQ ID NO: 1880918 - protein, 17 aa, Staphylococcus
LMSGLSPTFAFLITSRA

SEQ ID NO: 1880919 - protein, 31 aa, Staphylococcus
LMSTTLLNFFHGWPWYAVWLVALGFGGGMIV

SEQ ID NO: 1880920 - protein, 17 aa, Staphylococcus
LMTHASIPKDVREKEGI

SEQ ID NO: 1880921 - protein, 23 aa, Staphylococcus
LMTKCYYKLVNRFVDVPIEDGVG

SEQ ID NO: 1880922 - protein, 25 aa, Staphylococcus
LMTLPVAIAMRITKGFKQLIVFSII

SEQ ID NO: 1880923 - protein, 20 aa, Staphylococcus
LMTLVGSILLLSAFRRKNVK

SEQ ID NO: 1880924 - protein, 21 aa, Staphylococcus
LMVDSGDAFQGLPVSNNSKGE

SEQ ID NO: 1880925 - protein, 29 aa, Staphylococcus
LMVFCGGMLTVLLVWLMVKFQKKSGEVSA

SEQ ID NO: 1880926 - protein, 19 aa, Staphylococcus
LMVIFKIRKEMAIHREELI

SEQ ID NO: 1880927 - protein, 23 aa, Staphylococcus
LMVLIAWILYYFVKIRLTNYNTR

SEQ ID NO: 1880928 - protein, 18 aa, Staphylococcus
LMVLMFRAFGKQGLIVWI

SEQ ID NO: 1880929 - protein, 18 aa, Staphylococcus
LMVLPLWAQHKVKSNYEK

SEQ ID NO: 1880930 - protein, 24 aa, Staphylococcus
LMVLTAIALVIVWFIFNQIVAGIA

SEQ ID NO: 1880931 - protein, 27 aa, Staphylococcus
LMVLTSIALVVVWFIFKPLVATIAAAI

SEQ ID NO: 1880932 - protein, 22 aa, Staphylococcus
LMVRHKIKPFKIFNKPQYEKTY

SEQ ID NO: 1880933 - protein, 18 aa, Staphylococcus
LMVSMGVFCFIISGLYML

SEQ ID NO: 1880934 - protein, 17 aa, Staphylococcus
LMVTRRIAITMLMITTA

SEQ ID NO: 1880935 - protein, 27 aa, Staphylococcus
LMYLVSLMTAYLFYSYERHKGQVNFVK

SEQ ID NO: 1880936 - protein, 22 aa, Staphylococcus
LMYVIIGFLIRFSGTGWLMHLL

SEQ ID NO: 1880937 - protein, 18 aa, Staphylococcus
LNAAYTLGGPELLRQTLN

SEQ ID NO: 1880938 - protein, 18 aa, Staphylococcus
LNAFFAEIIKVMSRFIGG

SEQ ID NO: 1880939 - protein, 18 aa, Staphylococcus
LNAFFSEIIRVMSRFIGN

SEQ ID NO: 1880940 - protein, 26 aa, Staphylococcus
LNAHGGFLGEDYRLFSTDNMSGELTY

SEQ ID NO: 1880941 - protein, 24 aa, Staphylococcus
LNAKITIIFGFAFIQAAVQLLMFM

SEQ ID NO: 1880942 - protein, 26 aa, Staphylococcus
LNAPKGEFLHMVLGVFLAALVSFVVA

SEQ ID NO: 1880943 - protein, 35 aa, Staphylococcus
LNDAIPVFAGIIVTLAFLLLMLVFRSIIIPLKAVG

SEQ ID NO: 1880944 - protein, 18 aa, Staphylococcus
LNDGKGLVELVEQKKLKQ

SEQ ID NO: 1880945 - protein, 26 aa, Staphylococcus
LNDLKGRIAVAIAFQNIMLIISAFIM

SEQ ID NO: 1880946 - protein, 21 aa, Staphylococcus
LNEAIQMACILIFANDTASAW

SEQ ID NO: 1880947 - protein, 17 aa, Staphylococcus
LNEDLFKAFPLLKFEHY

SEQ ID NO: 1880948 - protein, 17 aa, Staphylococcus
LNEFKVEVGDDVKAGDT

SEQ ID NO: 1880949 - protein, 24 aa, Staphylococcus
LNEIYKLGLRQAKIVAIIQPISSV

SEQ ID NO: 1880950 - protein, 18 aa, Staphylococcus
LNELILLIYLFSIACYFF

SEQ ID NO: 1880951 - protein, 22 aa, Staphylococcus
LNELKEFFINAFKRPDQVIKDN

SEQ ID NO: 1880952 - protein, 17 aa, Staphylococcus
LNEQFGIEFEDSEDIDT

SEQ ID NO: 1880953 - protein, 35 aa, Staphylococcus; identical to SEQ ID NO: 1573151

SEQ ID NO: 1880954 - protein, 21 aa, Staphylococcus
LNFDLDQQFQLRERWSNASNN

SEQ ID NO: 1880955 - protein, 25 aa, Staphylococcus
LNFHSRFALDILLTISNHYNRNLRL

SEQ ID NO: 1880956 - protein, 24 aa, Staphylococcus
LNFMICGWFYIALFIATYVIFKTQ

SEQ ID NO: 1880957 - protein, 29 aa, Staphylococcus
LNFNKRYIFPFIIACGFIADTTSLPLIVS

SEQ ID NO: 1880958 - protein, 22 aa, Staphylococcus
LNFNLSIAMLIALAVCLIPTTI

SEQ ID NO: 1880959 - protein, 32 aa, Staphylococcus
LNFPMLSSNIYKDGHLIFKPSTIITKNNIRYG

SEQ ID NO: 1880960 - protein, 21 aa, Staphylococcus
LNFVWLPSFILLIVLLFLLKI

SEQ ID NO: 1880961 - protein, 23 aa, Staphylococcus
LNGIICGIVAYLLNIKGTPLSAG

SEQ ID NO: 1880962 - protein, 17 aa, Staphylococcus
LNGKELLGYARFRHDAE

SEQ ID NO: 1880963 - protein, 22 aa, Staphylococcus
LNGKELLGYARFRHDAEGDFGR

SEQ ID NO: 1880964 - protein, 19 aa, Staphylococcus
LNGKELLGYARFRHDEEGD

SEQ ID NO: 1880965 - protein, 23 aa, Staphylococcus
LNGKRKYILGKLVFSCLVSIPFI

SEQ ID NO: 1880966 - protein, 17 aa, Staphylococcus
LNGLAIAIVVGMLPNAI

SEQ ID NO: 1880967 - protein, 21 aa, Staphylococcus
LNGLGIFMGRFLRFHTVHLIT

SEQ ID NO: 1880968 - protein, 20 aa, Staphylococcus
LNGLGIYIGRFLRLHTVYLI

SEQ ID NO: 1880969 - protein, 20 aa, Staphylococcus
LNGLGIYMGRFLRFHTVHLI

SEQ ID NO: 1880970 - protein, 19 aa, Staphylococcus
LNGLGIYMGRFLRFHTVYL

SEQ ID NO: 1880971 - protein, 20 aa, Staphylococcus
LNGLMGALKESIKDNATIIS

SEQ ID NO: 1880972 - protein, 17 aa, Staphylococcus
LNIIAIWILHKPAIQAL

SEQ ID NO: 1880973 - protein, 19 aa, Staphylococcus
LNIIGSLVIIVWAASSWAQ

SEQ ID NO: 1880974 - protein, 19 aa, Staphylococcus
LNIIGSLVIIVWAISAWAQ

SEQ ID NO: 1880975 - protein, 27 aa, Staphylococcus
LNIKGTPDSAGFGLIGLVGPIKSLNLL

SEQ ID NO: 1880976 - protein, 24 aa, Staphylococcus
LNIKGTPLSAGFGYTGLVGPINAL

SEQ ID NO: 1880977 - protein, 18 aa, Staphylococcus
LNIKKGSRIYTFSKSKAI

SEQ ID NO: 1880978 - protein, 17 aa, Staphylococcus
LNILAFVFLLLLIVQPD

SEQ ID NO: 1880979 - protein, 23 aa, Staphylococcus
LNINLAGSLAYVILINILLAIAA

SEQ ID NO: 1880980 - protein, 23 aa, Staphylococcus
LNIVLKLFPFVFIFAAGGASLAI

SEQ ID NO: 1880981 - protein, 24 aa, Staphylococcus
LNIVLKLFPFVFIFAAGGASLATM

SEQ ID NO: 1880982 - protein, 17 aa, Staphylococcus
LNKGYGLQNIQENKQNQ

SEQ ID NO: 1880983 - protein, 17 aa, Staphylococcus
LNKGYGYQNFQHKTKNS

SEQ ID NO: 1880984 - protein, 18 aa, Staphylococcus
LNKIPIRININGIRGKST

SEQ ID NO: 1880985 - protein, 24 aa, Staphylococcus
LNKISPKFSIIFLIIIYLTIGPLF

SEQ ID NO: 1880986 - protein, 18 aa, Staphylococcus
LNKKRKELNLSRIQSLDT

SEQ ID NO: 1880987 - protein, 33 aa, Staphylococcus
LNKPFFWLFVIGFNVCFMPQFILGLDGMPRRLY

SEQ ID NO: 1880988 - protein, 21 aa, Staphylococcus
LNKRLFRLYDRVEIDGHIGDV

SEQ ID NO: 1880989 - protein, 24 aa, Staphylococcus
LNKSETRVAAYLQTRAGENVLRVS

SEQ ID NO: 1880990 - protein, 25 aa, Staphylococcus
LNKSIAKAESINFFDPGDKEDAAVL

SEQ ID NO: 1880991 - protein, 23 aa, Staphylococcus
LNKSRIRIERDLKNSITNKQLYR

SEQ ID NO: 1880992 - protein, 19 aa, Staphylococcus
LNKSRIRIERELKNNITNK

SEQ ID NO: 1880993 - protein, 20 aa, Staphylococcus
LNKSRIRIERELKNNITNKQ

SEQ ID NO: 1880994 - protein, 19 aa, Staphylococcus
LNKSRIRIERELKNNITNR

SEQ ID NO: 1880995 - protein, 18 aa, Staphylococcus
LNKVCHLQGIMALNVNDL

SEQ ID NO: 1880996 - protein, 18 aa, Staphylococcus
LNKVCHVQGIKALNVNDL

SEQ ID NO: 1880997 - protein, 18 aa, Staphylococcus
LNKVCHVQGITALNVNDL

SEQ ID NO: 1880998 - protein, 17 aa, Staphylococcus
LNLHLGYTFSGGFIDFV

SEQ ID NO: 1880999 - protein, 21 aa, Staphylococcus
LNLIFAFVIIFMERRSAGSIW

SEQ ID NO: 1881000 - protein, 17 aa, Staphylococcus
LNLIGWNGNLAVFVLFG

SEQ ID NO: 1881001 - protein, 30 aa, Staphylococcus
LNLIKMIIIPIVFCALALSISNLGDSKKIG

SEQ ID NO: 1881002 - protein, 30 aa, Staphylococcus; identical to SEQ ID NO: 1743342

SEQ ID NO: 1881003 - protein, 29 aa, Staphylococcus
LNLIKMIIIPIVFCSLALSISNLGDSKKI

SEQ ID NO: 1881004 - protein, 18 aa, Staphylococcus
LNLILSVRLNNMTQMYNA

SEQ ID NO: 1881005 - protein, 20 aa, Staphylococcus
LNLKFTPTTILYFNPKNDGD

SEQ ID NO: 1881006 - protein, 23 aa, Staphylococcus
LNLKISLLKTIRVGYIVNALNAV

SEQ ID NO: 1881007 - protein, 23 aa, Staphylococcus
LNLKPEMVIAFAHGTFNVTNTLI

SEQ ID NO: 1881008 - protein, 17 aa, Staphylococcus
LNLKSLNVINQVTDNIT

SEQ ID NO: 1881009 - protein, 17 aa, Staphylococcus
LNLLLKVGLSIIIIGFS

SEQ ID NO: 1881010 - protein, 20 aa, Staphylococcus
LNLPEEVNKGVVIGDVKDNS

SEQ ID NO: 1881011 - protein, 17 aa, Staphylococcus
LNLRFYISTIIIGFIIT

SEQ ID NO: 1881012 - protein, 17 aa, Staphylococcus
LNLVFGWSILHLFFNIF

SEQ ID NO: 1881013 - protein, 24 aa, Staphylococcus
LNMIKSKIAWMVALTMGFQSMIFY

SEQ ID NO: 1881014 - protein, 21 aa, Staphylococcus
LNMILIPTLILISSTVMIIYV

SEQ ID NO: 1881015 - protein, 18 aa, Staphylococcus
LNMSRYLLILLLALSAAV

SEQ ID NO: 1881016 - protein, 18 aa, Staphylococcus
LNNAHNFVTWLFTLVFIA

SEQ ID NO: 1881017 - protein, 17 aa, Staphylococcus
LNNAMKSLRESVNNVNH

SEQ ID NO: 1881018 - protein, 22 aa, Staphylococcus
LNNARKALAKSTGKDLDENQVD

SEQ ID NO: 1881019 - protein, 17 aa, Staphylococcus
LNNFKFLAGTIFDNMDF

SEQ ID NO: 1881020 - protein, 27 aa, Staphylococcus
LNNKDFKAGEFFVQMPLYIIENQNNVI

SEQ ID NO: 1881021 - protein, 20 aa, Staphylococcus
LNNKGGYLFDNELVYNYRSF

SEQ ID NO: 1881022 - protein, 20 aa, Staphylococcus
LNNYFRMIIQPKKVLMGNII

SEQ ID NO: 1881023 - protein, 17 aa, Staphylococcus
LNPAGSITIMMSLSIFI

SEQ ID NO: 1881024 - protein, 25 aa, Staphylococcus
LNPFKRSKFNIHITIPPDKLKQLNI

SEQ ID NO: 1881025 - protein, 19 aa, Staphylococcus
LNPFWTILLSLIFLKENIK

SEQ ID NO: 1881026 - protein, 18 aa, Staphylococcus
LNPFWTILLSLIFLNEKV

SEQ ID NO: 1881027 - protein, 17 aa, Staphylococcus
LNPFWTILLSLLFLHEK

SEQ ID NO: 1881028 - protein, 22 aa, Staphylococcus
LNPKKSYGIVVLANMNSNKVTQ

SEQ ID NO: 1881029 - protein, 19 aa, Staphylococcus
LNPNYRKIFFEGSDYQQVS

SEQ ID NO: 1881030 - protein, 21 aa, Staphylococcus
LNPTKSYGIVVLGNMNSSQVA

SEQ ID NO: 1881031 - protein, 24 aa, Staphylococcus
LNPWRYLRKTAEVLIFAFTSRSSA

SEQ ID NO: 1881032 - protein, 24 aa, Staphylococcus
LNQDKAKILASVITRIQNDKTDAL

SEQ ID NO: 1881033 - protein, 22 aa, Staphylococcus
LNQRFGFESIFIVSLVIIIIAF

SEQ ID NO: 1881034 - protein, 17 aa, Staphylococcus
LNQRIGDHMATKVKYDL

SEQ ID NO: 1881035 - protein, 29 aa, Staphylococcus
LNQVRVEGLPSGWTQTFVKNSNNETGTLT

SEQ ID NO: 1881036 - protein, 17 aa, Staphylococcus
LNRLIIVAMMFLNGLGI

SEQ ID NO: 1881037 - protein, 21 aa, Staphylococcus
LNRPIAFSNQFLKEYVFKEKV

SEQ ID NO: 1881038 - protein, 17 aa, Staphylococcus
LNRSLLWVYMVVLLCVM

SEQ ID NO: 1881039 - protein, 21 aa, Staphylococcus
LNSDGSFASDSVRNLSYAAYE

SEQ ID NO: 1881040 - protein, 20 aa, Staphylococcus
LNSFRFDGVMYLLAYLSGVI

SEQ ID NO: 1881041 - protein, 18 aa, Staphylococcus
LNSGRLYTIAGWDVYITE

SEQ ID NO: 1881042 - protein, 19 aa, Staphylococcus
LNSHISKPLIHESKTSKYP

SEQ ID NO: 1881043 - protein, 20 aa, Staphylococcus
LNSIFDVFFTLTWIIISLSL

SEQ ID NO: 1881044 - protein, 18 aa, Staphylococcus
LNSLKINGIFSMILTLII

SEQ ID NO: 1881045 - protein, 26 aa, Staphylococcus
LNSLQRGSNYFRFEYFNPTNSSKYYK

SEQ ID NO: 1881046 - protein, 21 aa, Staphylococcus
LNSRHLFYGISMLDKFKGTGA

SEQ ID NO: 1881047 - protein, 23 aa, Staphylococcus
LNSTVWMLIGFMIFGIISSLIAA

SEQ ID NO: 1881048 - protein, 30 aa, Staphylococcus
LNTLDNLRFYTKDGQVIQVLDLVQASTGIE

SEQ ID NO: 1881049 - protein, 20 aa, Staphylococcus
LNTTMLHYFVMLLLALVTVA

SEQ ID NO: 1881050 - protein, 36 aa, Staphylococcus
LNTYLLRQLKSIGMFIIIVILALYFIDMNRNNAILA

SEQ ID NO: 1881051 - protein, 20 aa, Staphylococcus
LNVFIFNYFFTVPRFTLEMY

SEQ ID NO: 1881052 - protein, 26 aa, Staphylococcus
LNVFVFNYFFTVPRFTLEMYRFEYPI

SEQ ID NO: 1881053 - protein, 17 aa, Staphylococcus
LNVKNFHGGFLIAAIGM

SEQ ID NO: 1881054 - protein, 31 aa, Staphylococcus
LNVLESIISWKLFIFCAVMIILVRPISILLS

SEQ ID NO: 1881055 - protein, 20 aa, Staphylococcus
LNVLFRKYIDVFNVQVQESV

SEQ ID NO: 1881056 - protein, 17 aa, Staphylococcus
LNVPMMIGLNMIDVSAK

SEQ ID NO: 1881057 - protein, 21 aa, Staphylococcus
LNYLYTFSFMFFIDLAIILVF

SEQ ID NO: 1881058 - protein, 24 aa, Staphylococcus
LNYVPEKWILGLLGLIPIYLGIKV

SEQ ID NO: 1881059 - protein, 24 aa, Staphylococcus
LNYVPEKWILGLLGLIPIYLGLKV

SEQ ID NO: 1881060 - protein, 17 aa, Staphylococcus
LNYWSVKLLTSFTSLIS

SEQ ID NO: 1881061 - protein, 18 aa, Staphylococcus
LPAFLGFFAGKRFVPIAT

SEQ ID NO: 1881062 - protein, 18 aa, Staphylococcus
LPAFPGYASTLFANAMVI

SEQ ID NO: 1881063 - protein, 18 aa, Staphylococcus
LPAIEQAYINAMQTAQAY

SEQ ID NO: 1881064 - protein, 19 aa, Staphylococcus
LPALIGWSSMKVFGGSPIL

SEQ ID NO: 1881065 - protein, 20 aa, Staphylococcus
LPALIGWSSMKVFGGSPILG

SEQ ID NO: 1881066 - protein, 23 aa, Staphylococcus
LPALIGWSSMRVFGGSQILGLVL

SEQ ID NO: 1881067 - protein, 17 aa, Staphylococcus
LPAQGLALIIGVDRLLD

SEQ ID NO: 1881068 - protein, 20 aa, Staphylococcus
LPAVISFALYKYFFKKQWIM

SEQ ID NO: 1881069 - protein, 17 aa, Staphylococcus
LPAYLGFFSGSRFVPII

SEQ ID NO: 1881070 - protein, 17 aa, Staphylococcus
LPCGLKYRKSRLKRAIA

SEQ ID NO: 1881071 - protein, 17 aa, Staphylococcus
LPDAILSLKSHKVDAVV

SEQ ID NO: 1881072 - protein, 22 aa, Staphylococcus
LPDLLPSILTLVGSLIMLFIMD

SEQ ID NO: 1881073 - protein, 21 aa, Staphylococcus
LPEDKAKHVAHFQDKDENVAM

SEQ ID NO: 1881074 - protein, 22 aa, Staphylococcus
LPEEFPHGALWQSIFWAVLILL

SEQ ID NO: 1881075 - protein, 17 aa, Staphylococcus
LPEGVTFDPRTNTISGV

SEQ ID NO: 1881076 - protein, 17 aa, Staphylococcus
LPEGVTFDPRTSTISGV

SEQ ID NO: 1881077 - protein, 17 aa, Staphylococcus
LPEGVTFDSRTNTISGV

SEQ ID NO: 1881078 - protein, 17 aa, Staphylococcus
LPEGVTFNPTTNTISGI

SEQ ID NO: 1881079 - protein, 23 aa, Staphylococcus
LPEHFPHSILWQSIFWTVMILLV

SEQ ID NO: 1881080 - protein, 18 aa, Staphylococcus
LPFGIGVFLMQLCYFERR

SEQ ID NO: 1881081 - protein, 19 aa, Staphylococcus
LPFILLLIIIIVFIVLLII

SEQ ID NO: 1881082 - protein, 20 aa, Staphylococcus
LPFISYGGSSLWSLMTGIGV

SEQ ID NO: 1881083 - protein, 20 aa, Staphylococcus
LPFMLKVGIKSKFFVLFCMA

SEQ ID NO: 1881084 - protein, 19 aa, Staphylococcus
LPFNVLKAMGGEENIKHLD

SEQ ID NO: 1881085 - protein, 24 aa, Staphylococcus
LPFSLKLNDWYTIALSMLILGLAL

SEQ ID NO: 1881086 - protein, 19 aa, Staphylococcus
LPFTISLHFYLFFFIGVIV

SEQ ID NO: 1881087 - protein, 17 aa, Staphylococcus
LPGGKYMGYAILVFFFL

SEQ ID NO: 1881088 - protein, 22 aa, Staphylococcus
LPGGLYMGYAILVFFIFVFGLL

SEQ ID NO: 1881089 - protein, 27 aa, Staphylococcus
LPGKTIVPRDGKTPNLEFTNTRTNRKG

SEQ ID NO: 1881090 - protein, 18 aa, Staphylococcus
LPGSFYLKRVYKVIKLIV

SEQ ID NO: 1881091 - protein, 19 aa, Staphylococcus
LPGSLIGSFLSRYLTLNSF

SEQ ID NO: 1881092 - protein, 19 aa, Staphylococcus
LPGSLIGSIISRYLTLESF

SEQ ID NO: 1881093 - protein, 20 aa, Staphylococcus
LPHTMLLGACFVLISDIIGR

SEQ ID NO: 1881094 - protein, 23 aa, Staphylococcus
LPHVPGHEPIGMYIAPVIIVCGL

SEQ ID NO: 1881095 - protein, 21 aa, Staphylococcus
LPIAIAMRITKGFKQLIILSV

SEQ ID NO: 1881096 - protein, 26 aa, Staphylococcus
LPIAISMRITKGFKQLIALSVALGEL

SEQ ID NO: 1881097 - protein, 25 aa, Staphylococcus
LPIAISMRITNGFKQLIISSIILGE

SEQ ID NO: 1881098 - protein, 24 aa, Staphylococcus
LPIDFKQLMIIGSLISLATAIVPT

SEQ ID NO: 1881099 - protein, 20 aa, Staphylococcus
LPIDQAWHVAQDMAKKIVTN

SEQ ID NO: 1881100 - protein, 25 aa, Staphylococcus
LPIFIGICVIVSLLALTPILTFISQ

SEQ ID NO: 1881101 - protein, 17 aa, Staphylococcus
LPIFILLMFFSMQMVTL

SEQ ID NO: 1881102 - protein, 21 aa, Staphylococcus
LPIFISGAIFIIFVLLPSSWF

SEQ ID NO: 1881103 - protein, 17 aa, Staphylococcus
LPIFIVYTVVKPVTEHN

SEQ ID NO: 1881104 - protein, 17 aa, Staphylococcus
LPIGAAFAVAAILCPTD

SEQ ID NO: 1881105 - protein, 23 aa, Staphylococcus
LPIGVAYHFSDWLQSHYVEHWIS

SEQ ID NO: 1881106 - protein, 20 aa, Staphylococcus
LPIIITVFLSYLGFQFGLKK

SEQ ID NO: 1881107 - protein, 17 aa, Staphylococcus
LPIIKRWFKTDYQTEST

SEQ ID NO: 1881108 - protein, 22 aa, Staphylococcus
LPIIPIIVSRYWVQLISSVPKE

SEQ ID NO: 1881109 - protein, 19 aa, Staphylococcus
LPIMIIIMLGIMTTFGPLT

SEQ ID NO: 1881110 - protein, 21 aa, Staphylococcus
LPIPVVLFIYFLSLISTTQSG

SEQ ID NO: 1881111 - protein, 22 aa, Staphylococcus
LPIPVVLFIYFLSYISTTMSGN

SEQ ID NO: 1881112 - protein, 19 aa, Staphylococcus
LPISKSVMLSFVFMPGDLL

SEQ ID NO: 1881113 - protein, 18 aa, Staphylococcus
LPISVLMISFFINICPVS

SEQ ID NO: 1881114 - protein, 19 aa, Staphylococcus
LPKAIPLAILIIGTAFIGL

SEQ ID NO: 1881115 - protein, 27 aa, Staphylococcus
LPKELKADDGTTFAIRDSYKSLYNNPN

SEQ ID NO: 1881116 - protein, 17 aa, Staphylococcus
LPKGVTFDPRTSTISGV

SEQ ID NO: 1881117 - protein, 20 aa, Staphylococcus
LPKIPYKMYVVFFTFVSFLL

SEQ ID NO: 1881118 - protein, 21 aa, Staphylococcus
LPKNRGKMIGVVYSGFSAANV

SEQ ID NO: 1881119 - protein, 18 aa, Staphylococcus
LPLFKRIQAPIMIGTIII

SEQ ID NO: 1881120 - protein, 17 aa, Staphylococcus
LPLGTALVIVLLLLTLI

SEQ ID NO: 1881121 - protein, 23 aa, Staphylococcus
LPLIIGAFCYPLGNRKMMILVDN

SEQ ID NO: 1881122 - protein, 17 aa, Staphylococcus
LPLIISLIIPLLIFIFV

SEQ ID NO: 1881123 - protein, 19 aa, Staphylococcus
LPLIMIIVLGAMTAFGPML

SEQ ID NO: 1881124 - protein, 18 aa, Staphylococcus
LPLIPDILHRVFKKQYSF

SEQ ID NO: 1881125 - protein, 21 aa, Staphylococcus
LPLLCALVLVFTKEKNRLSKI

SEQ ID NO: 1881126 - protein, 19 aa, Staphylococcus
LPLLFAVGTALGLAGGDGV

SEQ ID NO: 1881127 - protein, 20 aa, Staphylococcus
LPLLKPGMISGWILIFCISM

SEQ ID NO: 1881128 - protein, 17 aa, Staphylococcus
LPLLLIVGRVIQGLSAA

SEQ ID NO: 1881129 - protein, 19 aa, Staphylococcus
LPLLMTMLVHLFNMHLPDI

SEQ ID NO: 1881130 - protein, 20 aa, Staphylococcus
LPLLTARTSIPSLRNDISGD

SEQ ID NO: 1881131 - protein, 20 aa, Staphylococcus
LPLNHFYNFMALNLFLAYIP

SEQ ID NO: 1881132 - protein, 27 aa, Staphylococcus
LPLPSMLMNPWFQFTLATPVQFIIGWQ

SEQ ID NO: 1881133 - protein, 27 aa, Staphylococcus
LPLSDIQLSWLLPFIILLFIGLIIDYF

SEQ ID NO: 1881134 - protein, 25 aa, Staphylococcus
LPLSDWRNKIGYVMQSNAMMSGTIR

SEQ ID NO: 1881135 - protein, 24 aa, Staphylococcus
LPLSLRLNDWYTIAMSMFILGITL

SEQ ID NO: 1881136 - protein, 27 aa, Staphylococcus
LPLVFSKMHFGIAFYFIFLILFLFAAL

SEQ ID NO: 1881137 - protein, 32 aa, Staphylococcus
LPLVFVAGSVGEMFRPFALAITFSLLASLLVS

SEQ ID NO: 1881138 - protein, 18 aa, Staphylococcus
LPLYPVLPAITFILVLLV

SEQ ID NO: 1881139 - protein, 18 aa, Staphylococcus
LPLYTVFYSYNIDGSHLL

SEQ ID NO: 1881140 - protein, 19 aa, Staphylococcus
LPMLLLIVLGTMTAFGPMI

SEQ ID NO: 1881141 - protein, 24 aa, Staphylococcus
LPMSWRQPLSFVLLGLVLITLIFN

SEQ ID NO: 1881142 - protein, 20 aa, Staphylococcus
LPNDINDGILVKKLKDDGLG

SEQ ID NO: 1881143 - protein, 25 aa, Staphylococcus
LPNIVVEPFFQWFVWIGGAGATLSL

SEQ ID NO: 1881144 - protein, 25 aa, Staphylococcus
LPNKTAWWLVIPVGLVYAVIYYVIF

SEQ ID NO: 1881145 - protein, 19 aa, Staphylococcus
LPNLMPAVIAGFFMALTYS

SEQ ID NO: 1881146 - protein, 18 aa, Staphylococcus
LPNRALVILTVIGVLIGS

SEQ ID NO: 1881147 - protein, 38 aa, Staphylococcus
LPNTGEVVKKSWLPVTVLLVIAGGTLIGLGRRKQQKTK

SEQ ID NO: 1881148 - protein, 23 aa, Staphylococcus
LPNYDMIGLWAPALLLLARILQG

SEQ ID NO: 1881149 - protein, 17 aa, Staphylococcus
LPPEIAIGVILVGCCPG

SEQ ID NO: 1881150 - protein, 18 aa, Staphylococcus
LPPKDIFLASVLIGSLGA

SEQ ID NO: 1881151 - protein, 19 aa, Staphylococcus
LPPKDVFLASVLIGTLGAI

SEQ ID NO: 1881152 - protein, 22 aa, Staphylococcus
LPPKEVFLASVMIGSLGAVMDV

SEQ ID NO: 1881153 - protein, 25 aa, Staphylococcus
LPPWKRFLSHFSFYAIALQYFVVQF

SEQ ID NO: 1881154 - protein, 25 aa, Staphylococcus
LPPWKRFLTHFSFYAIAIQYFVVQF

SEQ ID NO: 1881155 - protein, 20 aa, Staphylococcus
LPQHFTFRGLEHIGKMSLTF

SEQ ID NO: 1881156 - protein, 19 aa, Staphylococcus
LPQRRWVYFLVLSTSALMA

SEQ ID NO: 1881157 - protein, 17 aa, Staphylococcus
LPRIMKDFHIEYSQVQW

SEQ ID NO: 1881158 - protein, 22 aa, Staphylococcus
LPSHLNLALTVFGFIMLISIIL

SEQ ID NO: 1881159 - protein, 17 aa, Staphylococcus
LPSHLQLALTVFSLIMV

SEQ ID NO: 1881160 - protein, 19 aa, Staphylococcus
LPSLEAGYIEATQTAKNYF

SEQ ID NO: 1881161 - protein, 21 aa, Staphylococcus
LPSSGRLIGLISLLISAIVGV

SEQ ID NO: 1881162 - protein, 21 aa, Staphylococcus
LPTFMSLILYRFELNLRSASI

SEQ ID NO: 1881163 - protein, 26 aa, Staphylococcus
LPTIKRIILQTGICILPIYKIFIYEP

SEQ ID NO: 1881164 - protein, 22 aa, Staphylococcus
LPTLLLVLGNKVFWPSKKSAEH

SEQ ID NO: 1881165 - protein, 17 aa, Staphylococcus
LPTMGSVIAHFLFGPLG

SEQ ID NO: 1881166 - protein, 20 aa, Staphylococcus
LPVDPASFWVRGLAMLVGGL

SEQ ID NO: 1881167 - protein, 17 aa, Staphylococcus
LPVFVIFTILRPVQENQ

SEQ ID NO: 1881168 - protein, 17 aa, Staphylococcus
LPVGFLGIGEPLIYGVT

SEQ ID NO: 1881169 - protein, 22 aa, Staphylococcus
LPVIIIRTSWLFILFIVLGGLS

SEQ ID NO: 1881170 - protein, 22 aa, Staphylococcus
LPVIVIGILFGLAMDYEVFLMS

SEQ ID NO: 1881171 - protein, 18 aa, Staphylococcus
LPVKRADYVKSYYLLFGA

SEQ ID NO: 1881172 - protein, 23 aa, Staphylococcus
LPVLGGAMIAMFGMVMAYGVSIL

SEQ ID NO: 1881173 - protein, 20 aa, Staphylococcus
LPVLVIIFILSFIFLGKPVF

SEQ ID NO: 1881174 - protein, 19 aa, Staphylococcus
LPVWLFVKAPRYIKMINIA

SEQ ID NO: 1881175 - protein, 19 aa, Staphylococcus
LPWDEAWLVAQQMAKKIVT

SEQ ID NO: 1881176 - protein, 24 aa, Staphylococcus
LPYLKKAVIFSITFGFFGVNMAFA

SEQ ID NO: 1881177 - protein, 19 aa, Staphylococcus
LPYNRLLVFMSLVSIPISV

SEQ ID NO: 1881178 - protein, 26 aa, Staphylococcus
LQAIISRFVSCILILILGSIIFSLLG

SEQ ID NO: 1881179 - protein, 31 aa, Staphylococcus
LQANIFIIMICCVLLGSLIGFLFYNFHPAKI

SEQ ID NO: 1881180 - protein, 25 aa, Staphylococcus
LQAQYNWGVVPSDYTYASYQEYNRL

SEQ ID NO: 1881181 - protein, 17 aa, Staphylococcus
LQEALSIAGNYSNYNKP

SEQ ID NO: 1881182 - protein, 26 aa, Staphylococcus
LQEKRKRTTLAYIVSVCFLFICIYLN

SEQ ID NO: 1881183 - protein, 17 aa, Staphylococcus
LQFKLHMVLGFTIFACW

SEQ ID NO: 1881184 - protein, 18 aa, Staphylococcus
LQFLLNFFIPSGSGQALT

SEQ ID NO: 1881185 - protein, 23 aa, Staphylococcus
LQFPKENWWVFIVLLLLVGNIEV

SEQ ID NO: 1881186 - protein, 35 aa, Staphylococcus
LQGKAYRSAKQFFSAVVIPLSYSMKTLSDMTEEAC

SEQ ID NO: 1881187 - protein, 20 aa, Staphylococcus
LQGRWFIKRGLNRKFYENKL

SEQ ID NO: 1881188 - protein, 18 aa, Staphylococcus
LQGTKFVNGAIKAELEGI

SEQ ID NO: 1881189 - protein, 26 aa, Staphylococcus
LQIDYPRQFLKGSHAPSVKVEHVAHW

SEQ ID NO: 1881190 - protein, 25 aa, Staphylococcus
LQIKLELDSLIAFHEQILKSLSKKA

SEQ ID NO: 1881191 - protein, 24 aa, Staphylococcus
LQIKLELDSLVAVHEQIYKSLSKK

SEQ ID NO: 1881192 - protein, 20 aa, Staphylococcus
LQILISLLFLFTLVIGNVSD

SEQ ID NO: 1881193 - protein, 26 aa, Staphylococcus
LQILKEKRLWLTLAVTLFGFSSVFAY

SEQ ID NO: 1881194 - protein, 23 aa, Staphylococcus
LQIVYKLPIIVSVVIAVLLGILV

SEQ ID NO: 1881195 - protein, 23 aa, Staphylococcus
LQIVYKLPIIVSVVVAVLLGVLV

SEQ ID NO: 1881196 - protein, 28 aa, Staphylococcus
LQKGSNYFRFEYFNPLNSKKYYKNLDEQ

SEQ ID NO: 1881197 - protein, 24 aa, Staphylococcus
LQKKVPMKVIYDIQDFKVPKGIED

SEQ ID NO: 1881198 - protein, 24 aa, Staphylococcus
LQKRLKLLHIFILIICLFSGLTLE

SEQ ID NO: 1881199 - protein, 24 aa, Staphylococcus
LQLIDPRYFLVVVVILCGIVALAI

SEQ ID NO: 1881200 - protein, 28 aa, Staphylococcus
LQLMKDVQLPLALPMIISGIRLSSVYVI

SEQ ID NO: 1881201 - protein, 19 aa, Staphylococcus
LQLSIAFVVNCLLLTLGAA

SEQ ID NO: 1881202 - protein, 21 aa, Staphylococcus
LQMIVMPLIFVSIVAAFSKIQ

SEQ ID NO: 1881203 - protein, 25 aa, Staphylococcus
LQMLLRLFMVLALISGFWELIKEFA

SEQ ID NO: 1881204 - protein, 33 aa, Staphylococcus
LQMLNMKYSHWLRFVWPVVVFVMVFGGAMLVAQ

SEQ ID NO: 1881205 - protein, 33 aa, Staphylococcus
LQMLNMRYSHWLKFVWPVVAFVLVFGGGLLIAQ

SEQ ID NO: 1881206 - protein, 17 aa, Staphylococcus
LQMSFSQIWNTLSYALN

SEQ ID NO: 1881207 - protein, 17 aa, Staphylococcus
LQMSYNHTWNILGYALN

SEQ ID NO: 1881208 - protein, 19 aa, Staphylococcus
LQMSYNHTWNILGYALNGF

SEQ ID NO: 1881209 - protein, 25 aa, Staphylococcus
LQMSYNHTWNILGYVLNGFVFSILG

SEQ ID NO: 1881210 - protein, 18 aa, Staphylococcus
LQNIYLRVYYPPIVIGLT

SEQ ID NO: 1881211 - protein, 19 aa, Staphylococcus
LQNIYLRVYYPPVVIGITA

SEQ ID NO: 1881212 - protein, 18 aa, Staphylococcus
LQNTIGWNEPHHEVDSSE

SEQ ID NO: 1881213 - protein, 24 aa, Staphylococcus
LQPEVFTKIDWKVFLTPILLTLIL

SEQ ID NO: 1881214 - protein, 19 aa, Staphylococcus
LQPPMIVHYYFDLMVSMGV

SEQ ID NO: 1881215 - protein, 20 aa, Staphylococcus
LQRFIAREAIPVAIIMLLVG

SEQ ID NO: 1881216 - protein, 19 aa, Staphylococcus
LQRFNKKKIAVIVYIIGVV

SEQ ID NO: 1881217 - protein, 22 aa, Staphylococcus
LQSIEYLPLFKQFGIASIDVLK

SEQ ID NO: 1881218 - protein, 20 aa, Staphylococcus
LQSMTVRLGIASGYDLAQVT

SEQ ID NO: 1881219 - protein, 26 aa, Staphylococcus
LQSSEFLKLASIFYFSYIIDRKLSKQ

SEQ ID NO: 1881220 - protein, 22 aa, Staphylococcus
LQTFKVLFAIIITLITVIGTYW

SEQ ID NO: 1881221 - protein, 17 aa, Staphylococcus
LQTRVGFHAGFATAAIG

SEQ ID NO: 1881222 - protein, 18 aa, Staphylococcus
LQVALLFISQLYYHFSKG

SEQ ID NO: 1881223 - protein, 17 aa, Staphylococcus
LQVFFFKDIKTEHTVSD

SEQ ID NO: 1881224 - protein, 24 aa, Staphylococcus
LQVLNCIRPILIGVTIGLVVKAIL

SEQ ID NO: 1881225 - protein, 27 aa, Staphylococcus
LQVSKSIRIGFDMDKKSGDRVTDIQII

SEQ ID NO: 1881226 - protein, 25 aa, Staphylococcus
LQYTRILPLIINWLGWLISKINGMG

SEQ ID NO: 1881227 - protein, 21 aa, Staphylococcus
LQYYFCVAMVITILLLFFGSF

SEQ ID NO: 1881228 - protein, 17 aa, Staphylococcus
LQYYFCVAMVIVVLLMF

SEQ ID NO: 1881229 - protein, 18 aa, Staphylococcus
LRAKKSGRFIAYASVILA

SEQ ID NO: 1881230 - protein, 18 aa, Staphylococcus
LRAQFGYVPQEHFLFSTT

SEQ ID NO: 1881231 - protein, 21 aa, Staphylococcus
LRAVGSAAKGYGFIKQTNGNQ

SEQ ID NO: 1881232 - protein, 23 aa, Staphylococcus
LRDKRTLALMLFAPILVLTLLYF

SEQ ID NO: 1881233 - protein, 20 aa, Staphylococcus
LREFYIFRFVIGKQPYKLQF

SEQ ID NO: 1881234 - protein, 29 aa, Staphylococcus
LRFIVLMIISILGMAGWLLYAHQLFEEKT

SEQ ID NO: 1881235 - protein, 22 aa, Staphylococcus
LRFPLTGLFSKMFGQIGIGMGI

SEQ ID NO: 1881236 - protein, 18 aa, Staphylococcus
LRFVQGFCGGAGAVISRA

SEQ ID NO: 1881237 - protein, 19 aa, Staphylococcus
LRFYISTIIIGFIITIYHL

SEQ ID NO: 1881238 - protein, 17 aa, Staphylococcus
LRGGIIAATATMGVIVA

SEQ ID NO: 1881239 - protein, 21 aa, Staphylococcus
LRGHLDMLGLNHKFEISLLKD

SEQ ID NO: 1881240 - protein, 20 aa, Staphylococcus
LRGTFFGILIHIAFHEYILP

SEQ ID NO: 1881241 - protein, 20 aa, Staphylococcus
LRHEWVKSNGDIYEKINEND

SEQ ID NO: 1881242 - protein, 17 aa, Staphylococcus
LRHYAMYIFSLIVSIVL

SEQ ID NO: 1881243 - protein, 18 aa, Staphylococcus
LRIARSGLAIFGMTLAAI

SEQ ID NO: 1881244 - protein, 17 aa, Staphylococcus
LRIARSGLSIAGMICAA

SEQ ID NO: 1881245 - protein, 18 aa, Staphylococcus
LRIETLFFIIVMSLSSIL

SEQ ID NO: 1881246 - protein, 25 aa, Staphylococcus
LRIGDTFCLYLIWYSIGRFFVEGMR

SEQ ID NO: 1881247 - protein, 17 aa, Staphylococcus
LRIIFKHILPNTLGAVI

SEQ ID NO: 1881248 - protein, 21 aa, Staphylococcus
LRIISTSTFIGWLHLISGMTF

SEQ ID NO: 1881249 - protein, 24 aa, Staphylococcus
LRIITVGAAIAWVLGAIALHMILH

SEQ ID NO: 1881250 - protein, 18 aa, Staphylococcus
LRKAGFTIKSSPKGIEAM

SEQ ID NO: 1881251 - protein, 18 aa, Staphylococcus
LRKAIKRQGQDINQLLPY

SEQ ID NO: 1881252 - protein, 22 aa, Staphylococcus
LRKAKLYIRIVLSFIIGAIISA

SEQ ID NO: 1881253 - protein, 27 aa, Staphylococcus
LRKHLKIGETFFIYLIWYSIGRFFVEG

SEQ ID NO: 1881254 - protein, 17 aa, Staphylococcus
LRKHLRIGDTFCLYLIW

SEQ ID NO: 1881255 - protein, 19 aa, Staphylococcus
LRKKIILILFILPFPIMVW

SEQ ID NO: 1881256 - protein, 20 aa, Staphylococcus
LRKKTGSLRIARSGLSIAGM

SEQ ID NO: 1881257 - protein, 18 aa, Staphylococcus
LRKLFGYTSIHFVITSDM

SEQ ID NO: 1881258 - protein, 20 aa, Staphylococcus
LRKRDEMLLFLPENMARSMS

SEQ ID NO: 1881259 - protein, 17 aa, Staphylococcus
LRKSFFVNDNFNHIAKD

SEQ ID NO: 1881260 - protein, 24 aa, Staphylococcus
LRKTRTDLLLSIGLFVVALIHVSV

SEQ ID NO: 1881261 - protein, 20 aa, Staphylococcus
LRLDGLGLMFALIISIIGIA

SEQ ID NO: 1881262 - protein, 20 aa, Staphylococcus
LRLDGLGLMFGLIISIIGVA

SEQ ID NO: 1881263 - protein, 17 aa, Staphylococcus
LRLFKPRKKYEWPLFII

SEQ ID NO: 1881264 - protein, 19 aa, Staphylococcus
LRLFRISWIVLVVLMIGYF

SEQ ID NO: 1881265 - protein, 20 aa, Staphylococcus
LRLLPTFILNLILLIIMFPI

SEQ ID NO: 1881266 - protein, 17 aa, Staphylococcus
LRLLPTFIVNLLLLTIL

SEQ ID NO: 1881267 - protein, 21 aa, Staphylococcus
LRLSIILFMFILIILIVLLCI

SEQ ID NO: 1881268 - protein, 21 aa, Staphylococcus
LRLYFISVILAFSFVLINLWQ

SEQ ID NO: 1881269 - protein, 18 aa, Staphylococcus
LRMFTYWQLRVGKKKHAR

SEQ ID NO: 1881270 - protein, 34 aa, Staphylococcus
LRMIIPNLFSFLASIFVLWLYFKKSLPKSTNIED

SEQ ID NO: 1881271 - protein, 17 aa, Staphylococcus
LRMLAIEQITLFISTGI

SEQ ID NO: 1881272 - protein, 25 aa, Staphylococcus
LRMLSIEQFTFFALTGIIGIFIGTF

SEQ ID NO: 1881273 - protein, 18 aa, Staphylococcus
LRNLHPFQIGDIVAPSII

SEQ ID NO: 1881274 - protein, 27 aa, Staphylococcus
LRPDVKICTNCGAPVNGSSNATQSTQS

SEQ ID NO: 1881275 - protein, 19 aa, Staphylococcus
LRPFYKGFLFFHINLATLG

SEQ ID NO: 1881276 - protein, 17 aa, Staphylococcus
LRPGERNKNDLGKQIYI

SEQ ID NO: 1881277 - protein, 20 aa, Staphylococcus
LRPIGGIVFGIIGDKYGRKV

SEQ ID NO: 1881278 - protein, 20 aa, Staphylococcus
LRPILIQSYPFIKYILWLIP

SEQ ID NO: 1881279 - protein, 20 aa, Staphylococcus
LRPMVEVIIYKHIIIHELSK

SEQ ID NO: 1881280 - protein, 21 aa, Staphylococcus
LRQISINGLIAFGMTFIILTG

SEQ ID NO: 1881281 - protein, 24 aa, Staphylococcus
LRQSFNIPALKTWQQVKKQAGNDA

SEQ ID NO: 1881282 - protein, 21 aa, Staphylococcus
LRQVSINGLIAFGMTFVILTG

SEQ ID NO: 1881283 - protein, 17 aa, Staphylococcus
LRRMFKVNNKILLNRFK

SEQ ID NO: 1881284 - protein, 17 aa, Staphylococcus
LRSEMGFEQRFTPSQIK

SEQ ID NO: 1881285 - protein, 18 aa, Staphylococcus
LRSLPALNSGLGSYRDYI

SEQ ID NO: 1881286 - protein, 23 aa, Staphylococcus
LRSLPDLNKALGNYRDFIKNDLN

SEQ ID NO: 1881287 - protein, 19 aa, Staphylococcus
LRSSFFHWGFHAWAVYGVV

SEQ ID NO: 1881288 - protein, 17 aa, Staphylococcus
LRSWLTKTWKNIKNSVV

SEQ ID NO: 1881289 - protein, 19 aa, Staphylococcus
LRTDLSFIELNKFRSDYNK

SEQ ID NO: 1881290 - protein, 17 aa, Staphylococcus
LRTERLAHLKAENEKIT

SEQ ID NO: 1881291 - protein, 19 aa, Staphylococcus
LRTLSLFFHNTMSFSHYTI

SEQ ID NO: 1881292 - protein, 20 aa, Staphylococcus
LRTLSLFFHNTMSFSHYTIL

SEQ ID NO: 1881293 - protein, 21 aa, Staphylococcus
LRVFMLLTLFSGFWLLIQEFM

SEQ ID NO: 1881294 - protein, 22 aa, Staphylococcus
LRVLVIPDFTLLIIMTILHTFL

SEQ ID NO: 1881295 - protein, 26 aa, Staphylococcus
LRVSKNGRRYLIFDNMSFTAPTKEAI

SEQ ID NO: 1881296 - protein, 25 aa, Staphylococcus
LRVSKNGTRLLIFDNMSYTAPTKKA

SEQ ID NO: 1881297 - protein, 24 aa, Staphylococcus
LRVVTAFAGFIAKLFETHPAVAKM

SEQ ID NO: 1881298 - protein, 17 aa, Staphylococcus
LRYKIMGIVGSVWGISS

SEQ ID NO: 1881299 - protein, 21 aa, Staphylococcus
LRYNKCILMTQSFIFNSLAFN

SEQ ID NO: 1881300 - protein, 21 aa, Staphylococcus
LRYQIGGGITHHPHFLWFNLV

SEQ ID NO: 1881301 - protein, 31 aa, Staphylococcus
LSAAYASVIAWRVGLRWKDLEEGITARLGTA

SEQ ID NO: 1881302 - protein, 28 aa, Staphylococcus
LSAKLFGELEFWFSIIKIVTIIALIVVG

SEQ ID NO: 1881303 - protein, 18 aa, Staphylococcus
LSAKSVIGDVHLRNFNAS

SEQ ID NO: 1881304 - protein, 23 aa, Staphylococcus
LSALCSGVIGLLLFYEGLKYISF

SEQ ID NO: 1881305 - protein, 30 aa, Staphylococcus
LSALIPLFKLCLTVVIAMLFFIFIVLGIVS

SEQ ID NO: 1881306 - protein, 20 aa, Staphylococcus
LSALPGAIAYSFIVGMNPSI

SEQ ID NO: 1881307 - protein, 25 aa, Staphylococcus
LSAMLLQSMTIRLGISTGMDLAQAT

SEQ ID NO: 1881308 - protein, 26 aa, Staphylococcus
LSAMLLQSMTLRLGIATSHDLAQMTK

SEQ ID NO: 1881309 - protein, 20 aa, Staphylococcus
LSAQLSYYFMLSLFPMLLFL

SEQ ID NO: 1881310 - protein, 19 aa, Staphylococcus
LSAQMMALWMLSNATAQSI

SEQ ID NO: 1881311 - protein, 17 aa, Staphylococcus
LSASKLTLTFGVSKSFL

SEQ ID NO: 1881312 - protein, 17 aa, Staphylococcus
LSCLMIYFCSMIVNVNK

SEQ ID NO: 1881313 - protein, 25 aa, Staphylococcus
LSDAKPSTLPNWFVAGVNYASFNTA

SEQ ID NO: 1881314 - protein, 21 aa, Staphylococcus
LSDALKIVGLKTVTFAPKNPE

SEQ ID NO: 1881315 - protein, 18 aa, Staphylococcus
LSDIKFGAGTIFDNMDFI

SEQ ID NO: 1881316 - protein, 17 aa, Staphylococcus
LSDKYSRLNIYSLGLTI

SEQ ID NO: 1881317 - protein, 26 aa, Staphylococcus
LSDLKGRIAVAIAFQNIMLILSAFVM

SEQ ID NO: 1881318 - protein, 26 aa, Staphylococcus
LSDLKGRVAVAIAFQNIMLILCAFVM

SEQ ID NO: 1881319 - protein, 21 aa, Staphylococcus
LSDLTRELLILSELDNASHIQ

SEQ ID NO: 1881320 - protein, 21 aa, Staphylococcus
LSEEEARAYLNYIKAEDDLTN

SEQ ID NO: 1881321 - protein, 17 aa, Staphylococcus
LSEKFVWAIAYGSCIGW

SEQ ID NO: 1881322 - protein, 23 aa, Staphylococcus
LSELKLMLIFIIINIMISFYPGI

SEQ ID NO: 1881323 - protein, 18 aa, Staphylococcus
LSESADCENGIQAGSNNY

SEQ ID NO: 1881324 - protein, 23 aa, Staphylococcus
LSETVIKWLSFIPITLFTALILD

SEQ ID NO: 1881325 - protein, 22 aa, Staphylococcus
LSETVIKWLSFIPVSLFTALVI

SEQ ID NO: 1881326 - protein, 24 aa, Staphylococcus
LSEYHLKGGCDIIYQIGPGLFGVR

SEQ ID NO: 1881327 - protein, 19 aa, Staphylococcus
LSEYHLKGGGDIIFQIGPG

SEQ ID NO: 1881328 - protein, 25 aa, Staphylococcus
LSFATWRMVFVILTLFGVSMVIGSL

SEQ ID NO: 1881329 - protein, 24 aa, Staphylococcus
LSFGMNMSSFWLLFSGAITAIPLI

SEQ ID NO: 1881330 - protein, 24 aa, Staphylococcus
LSFIIDGFIGLGGFVVSYFPTQRL

SEQ ID NO: 1881331 - protein, 24 aa, Staphylococcus
LSFISYPCYIIWINPTSHKRSKYY

SEQ ID NO: 1881332 - protein, 17 aa, Staphylococcus
LSFKEAIFGILGLLMIA

SEQ ID NO: 1881333 - protein, 17 aa, Staphylococcus
LSFKEKLSYGFGDLGNG

SEQ ID NO: 1881334 - protein, 29 aa, Staphylococcus
LSFKLYKHYYYRLFAIATWIMLIGSLTPH

SEQ ID NO: 1881335 - protein, 18 aa, Staphylococcus
LSFKRMALSYSLYTLQFI

SEQ ID NO: 1881336 - protein, 23 aa, Staphylococcus
LSFSETRFMRFFGGKDLIFALSA

SEQ ID NO: 1881337 - protein, 25 aa, Staphylococcus
LSFTGWRMVFIILTIFGLLMFIGTL

SEQ ID NO: 1881338 - protein, 19 aa, Staphylococcus
LSGAFPMVYLIRKYFSNAL

SEQ ID NO: 1881339 - protein, 17 aa, Staphylococcus
LSGFLKRTFEQDLNSMF

SEQ ID NO: 1881340 - protein, 19 aa, Staphylococcus
LSGFSEIFLLKSVLAGTLI

SEQ ID NO: 1881341 - protein, 19 aa, Staphylococcus
LSGIIAFILLVSFFFIISD

SEQ ID NO: 1881342 - protein, 17 aa, Staphylococcus
LSGIKFGAGTIFDNMDF

SEQ ID NO: 1881343 - protein, 23 aa, Staphylococcus
LSGILCGLIDVFIIGEPLKAKKR

SEQ ID NO: 1881344 - protein, 23 aa, Staphylococcus
LSGILWIHIKWVAFLINLLLIII

SEQ ID NO: 1881345 - protein, 26 aa, Staphylococcus
LSGIPAWSWSCLFLIIIFGLNALSVR

SEQ ID NO: 1881346 - protein, 20 aa, Staphylococcus
LSGLGIYIGRFLRFHSVFLI

SEQ ID NO: 1881347 - protein, 20 aa, Staphylococcus
LSGRLSINKLNKWAFFACTM

SEQ ID NO: 1881348 - protein, 20 aa, Staphylococcus
LSGVSLWLGASMFLTLGLII

SEQ ID NO: 1881349 - protein, 27 aa, Staphylococcus
LSGYLVEFFDWRSLFHVVAPIAAITFL

SEQ ID NO: 1881350 - protein, 18 aa, Staphylococcus
LSHILEYLDEAFLNKAKQ

SEQ ID NO: 1881351 - protein, 23 aa, Staphylococcus
LSHNALTMSAGWVTSTIISGTII

SEQ ID NO: 1881352 - protein, 18 aa, Staphylococcus
LSIFCTFVGRKEKVHDSS

SEQ ID NO: 1881353 - protein, 37 aa, Staphylococcus
LSIFLFFKGKKAFWFIFIGGFILTFLLYANVVYFRFF

SEQ ID NO: 1881354 - protein, 22 aa, Staphylococcus
LSIFTAFLFVISPLYFRFTAYW

SEQ ID NO: 1881355 - protein, 19 aa, Staphylococcus
LSIGLSFLISFIILIVIAF

SEQ ID NO: 1881356 - protein, 20 aa, Staphylococcus
LSIIEWVILVKIFNKKIPFL

SEQ ID NO: 1881357 - protein, 21 aa, Staphylococcus
LSIIEWVILVKLFKRKIPFLD

SEQ ID NO: 1881358 - protein, 21 aa, Staphylococcus
LSIIIKIFFNHNIKYVPLIPF

SEQ ID NO: 1881359 - protein, 31 aa, Staphylococcus
LSIIYCLLVLPATVMIYFRIVKKNYLYSNRI

SEQ ID NO: 1881360 - protein, 23 aa, Staphylococcus
LSIKEMAKVGVWVNLISAVIIIV

SEQ ID NO: 1881361 - protein, 17 aa, Staphylococcus
LSILGFVGLILGVMVWL

SEQ ID NO: 1881362 - protein, 22 aa, Staphylococcus
LSIMGIYVLRSFGMAFIMMPIM

SEQ ID NO: 1881363 - protein, 17 aa, Staphylococcus
LSIPNWMRRLVTRSLAV

SEQ ID NO: 1881364 - protein, 17 aa, Staphylococcus
LSIVEWVILVKLLNRKI

SEQ ID NO: 1881365 - protein, 17 aa, Staphylococcus
LSIVKYFVGYVYDSAAV

SEQ ID NO: 1881366 - protein, 21 aa, Staphylococcus
LSIVLFFSFITIKYVHHLNVH

SEQ ID NO: 1881367 - protein, 19 aa, Staphylococcus
LSIVLYFSFSTLKYSHSIN

SEQ ID NO: 1881368 - protein, 24 aa, Staphylococcus
LSKAKKKLQGMVVVLHDITNLKKL

SEQ ID NO: 1881369 - protein, 19 aa, Staphylococcus
LSKEIYFSIQLIVLIYIGI

SEQ ID NO: 1881370 - protein, 20 aa, Staphylococcus
LSKHELDGYFVFDKGMTHAF

SEQ ID NO: 1881371 - protein, 19 aa, Staphylococcus
LSKHQWLDLVIMIPFMTPP

SEQ ID NO: 1881372 - protein, 22 aa, Staphylococcus
LSKKDLRVLAIYREMSAGSTMN

SEQ ID NO: 1881373 - protein, 17 aa, Staphylococcus
LSKMSPEIRDMISEIKY

SEQ ID NO: 1881374 - protein, 25 aa, Staphylococcus
LSKNHKGMIVQQDWTGKASRFHLTP

SEQ ID NO: 1881375 - protein, 17 aa, Staphylococcus
LSKNRFSFMDAAFCLMS

SEQ ID NO: 1881376 - protein, 24 aa, Staphylococcus
LSKQEARAYLNYIKTEDDLNNVGS

SEQ ID NO: 1881377 - protein, 18 aa, Staphylococcus
LSKSGKWIEVESRDGSEK

SEQ ID NO: 1881378 - protein, 25 aa, Staphylococcus
LSKSIAKAESINFFDPGDKEDAAVL

SEQ ID NO: 1881379 - protein, 23 aa, Staphylococcus
LSKSKKKLQGMVVVMHDITNLKK

SEQ ID NO: 1881380 - protein, 18 aa, Staphylococcus
LSKWRNKIGYVMQSNSMM

SEQ ID NO: 1881381 - protein, 22 aa, Staphylococcus
LSKYKFYIAMVALIILFTATKI

SEQ ID NO: 1881382 - protein, 24 aa, Staphylococcus
LSLAEFTLLSGLLLLLKRRKKEDK

SEQ ID NO: 1881383 - protein, 19 aa, Staphylococcus
LSLAITVGYVFNLFKFGKY

SEQ ID NO: 1881384 - protein, 17 aa, Staphylococcus
LSLCGTLIMLINQTYIN

SEQ ID NO: 1881385 - protein, 24 aa, Staphylococcus
LSLCVVSYLLLRKMKIDALFFAIV

SEQ ID NO: 1881386 - protein, 18 aa, Staphylococcus
LSLEFPNKQIIVINDGSS

SEQ ID NO: 1881387 - protein, 19 aa, Staphylococcus
LSLFCKGNYTASFIGLFLS

SEQ ID NO: 1881388 - protein, 25 aa, Staphylococcus
LSLFIAALFHWTAGFAFSAGLIDYS

SEQ ID NO: 1881389 - protein, 25 aa, Staphylococcus
LSLFIAALFHWTAGFSFSAGLIDYA

SEQ ID NO: 1881390 - protein, 17 aa, Staphylococcus
LSLFIASLFQWTAGFSF

SEQ ID NO: 1881391 - protein, 20 aa, Staphylococcus
LSLFIKIDFKTVASKNDTSN

SEQ ID NO: 1881392 - protein, 18 aa, Staphylococcus
LSLFIVFFGISWGPVLWV

SEQ ID NO: 1881393 - protein, 19 aa, Staphylococcus
LSLFLPLTFLIYLCMFTFI

SEQ ID NO: 1881394 - protein, 17 aa, Staphylococcus
LSLFMYLIMGWVGIIYI

SEQ ID NO: 1881395 - protein, 17 aa, Staphylococcus
LSLFPMLLFLLSIVPVV

SEQ ID NO: 1881396 - protein, 18 aa, Staphylococcus
LSLFPMLLFLMSLLPLFK

SEQ ID NO: 1881397 - protein, 19 aa, Staphylococcus
LSLHIKWMNPFFITGILGG

SEQ ID NO: 1881398 - protein, 17 aa, Staphylococcus
LSLIIAYFFKKIARVNT

SEQ ID NO: 1881399 - protein, 25 aa, Staphylococcus
LSLIISIVLYFSFVTIRYVRHININ

SEQ ID NO: 1881400 - protein, 26 aa, Staphylococcus
LSLIPFVIATYFYKKTNGFFLLAPLF

SEQ ID NO: 1881401 - protein, 24 aa, Staphylococcus
LSLITNIYIVWGIALFIGLMYGIL

SEQ ID NO: 1881402 - protein, 19 aa, Staphylococcus
LSLIWPTFMKMGGHVIALP

SEQ ID NO: 1881403 - protein, 17 aa, Staphylococcus
LSLKEAHDICDRVESHL

SEQ ID NO: 1881404 - protein, 21 aa, Staphylococcus
LSLKTSFSILIVAVLVIWSFV

SEQ ID NO: 1881405 - protein, 18 aa, Staphylococcus
LSLLENIRFYKPDATKAE

SEQ ID NO: 1881406 - protein, 20 aa, Staphylococcus
LSLLGSEFDLELAYQNLREI

SEQ ID NO: 1881407 - protein, 20 aa, Staphylococcus
LSLLIAFFFKKIARVNTETA

SEQ ID NO: 1881408 - protein, 26 aa, Staphylococcus
LSLLLDRIGLFISMVLLILQLSASEG

SEQ ID NO: 1881409 - protein, 17 aa, Staphylococcus
LSLLTAIITSILAFFAA

SEQ ID NO: 1881410 - protein, 18 aa, Staphylococcus
LSLLWPTFMQMGGHVIAL

SEQ ID NO: 1881411 - protein, 20 aa, Staphylococcus
LSLMTLIGFMLLQVFDKIPR

SEQ ID NO: 1881412 - protein, 24 aa, Staphylococcus
LSLMYAFGLSPAWTSFIINTVVVF

SEQ ID NO: 1881413 - protein, 17 aa, Staphylococcus
LSLVEKWVVPKGLKVSR

SEQ ID NO: 1881414 - protein, 25 aa, Staphylococcus
LSLVLGSAIGPFFGILLLKSFSINL

SEQ ID NO: 1881415 - protein, 31 aa, Staphylococcus
LSLWGMERFFQKRRIGLFIFSVALTLFSNFY

SEQ ID NO: 1881416 - protein, 17 aa, Staphylococcus
LSLYWKGLSRTGAVSGM

SEQ ID NO: 1881417 - protein, 23 aa, Staphylococcus
LSMFRRSNDFRTRKRKKFKDKVD

SEQ ID NO: 1881418 - protein, 17 aa, Staphylococcus
LSMMLIPGSLVFLFGRM

SEQ ID NO: 1881419 - protein, 19 aa, Staphylococcus
LSNAIPLGWIPHTEVYSNN

SEQ ID NO: 1881420 - protein, 26 aa, Staphylococcus
LSNSDWRFMMSWLPLQVKITLFSFVL

SEQ ID NO: 1881421 - protein, 24 aa, Staphylococcus
LSNTKLYPGQKWTISDLLQITVSN

SEQ ID NO: 1881422 - protein, 26 aa, Staphylococcus
LSNTPFKITCIIVAGLILLQIIWDCL

SEQ ID NO: 1881423 - protein, 18 aa, Staphylococcus
LSPFRKIIPPIGMIDISS

SEQ ID NO: 1881424 - protein, 37 aa, Staphylococcus
LSPHVPILFVFMILLFYGRIRGFSWDEIQSGIISGIS

SEQ ID NO: 1881425 - protein, 17 aa, Staphylococcus
LSPILGWIGVFLTGSVT

SEQ ID NO: 1881426 - protein, 22 aa, Staphylococcus
LSPIMWINFFIIWVSHFLFHWQ

SEQ ID NO: 1881427 - protein, 29 aa, Staphylococcus
LSPIMWVNFIIVWIGEHIFHWQPQNIRFW

SEQ ID NO: 1881428 - protein, 29 aa, Staphylococcus
LSQGVALIFRLNQSLTFWSAGGISGTTWG

SEQ ID NO: 1881429 - protein, 29 aa, Staphylococcus
LSQGVALLFRLNQSLTFWSAGGVSGTTWN

SEQ ID NO: 1881430 - protein, 18 aa, Staphylococcus
LSQKAIKISWGIYFKTGI

SEQ ID NO: 1881431 - protein, 22 aa, Staphylococcus
LSQKGMKISWGVYFKTGVIITI

SEQ ID NO: 1881432 - protein, 32 aa, Staphylococcus
LSQLAGPMITYLIPLLIAFSGGRLIHDLRGGI

SEQ ID NO: 1881433 - protein, 18 aa, Staphylococcus
LSQTLNFQVQKDKTNDVS

SEQ ID NO: 1881434 - protein, 20 aa, Staphylococcus
LSQYNEIFSKIAVVVQGIQY

SEQ ID NO: 1881435 - protein, 18 aa, Staphylococcus
LSRIDYMSFYGLNSPFIY

SEQ ID NO: 1881436 - protein, 21 aa, Staphylococcus
LSRIKVKIIIIIALLAMSIMS

SEQ ID NO: 1881437 - protein, 24 aa, Staphylococcus
LSRMMIPNLFALVASIVVLWIYFR

SEQ ID NO: 1881438 - protein, 24 aa, Staphylococcus
LSRNKKRLQGMVVVLHDITSLKKL

SEQ ID NO: 1881439 - protein, 17 aa, Staphylococcus
LSRRIHHRYSLYIQMIL

SEQ ID NO: 1881440 - protein, 17 aa, Staphylococcus
LSSAYAALIARRVGLKW

SEQ ID NO: 1881441 - protein, 20 aa, Staphylococcus
LSSEKDFNNDASRRNNRHEA

SEQ ID NO: 1881442 - protein, 18 aa, Staphylococcus
LSSFQLLGIEQYRPHIAI

SEQ ID NO: 1881443 - protein, 18 aa, Staphylococcus
LSSGECTPEGGLLYLDMI

SEQ ID NO: 1881444 - protein, 19 aa, Staphylococcus
LSSKHAFVVILVILAVFLP

SEQ ID NO: 1881445 - protein, 18 aa, Staphylococcus
LSSKRARRLKQLVKVQQS

SEQ ID NO: 1881446 - protein, 19 aa, Staphylococcus
LSSLGGEFDTELAYNNLRE

SEQ ID NO: 1881447 - protein, 17 aa, Staphylococcus
LSSLITMKTDKITERDK

SEQ ID NO: 1881448 - protein, 25 aa, Staphylococcus
LSSLMPYTFALGVVWTLFVIAWYLL

SEQ ID NO: 1881449 - protein, 17 aa, Staphylococcus
LSSLYLLFVIIGYFAMK

SEQ ID NO: 1881450 - protein, 19 aa, Staphylococcus
LSSMLYRVFLDISSFSSKG

SEQ ID NO: 1881451 - protein, 17 aa, Staphylococcus
LSSRFEKLLLLHTSAQG

SEQ ID NO: 1881452 - protein, 21 aa, Staphylococcus
LSSRIPRTVSILISGSTLAIA

SEQ ID NO: 1881453 - protein, 21 aa, Staphylococcus
LSSRIPRTVSILISGSTLALA

SEQ ID NO: 1881454 - protein, 22 aa, Staphylococcus
LSTEIYFSMQLIILVYISINIG

SEQ ID NO: 1881455 - protein, 23 aa, Staphylococcus
LSTFMPVTMPFHITITNMLLVIS

SEQ ID NO: 1881456 - protein, 18 aa, Staphylococcus
LSTIIIILLLIIFGILYI

SEQ ID NO: 1881457 - protein, 25 aa, Staphylococcus
LSTSTSMRESLSASGSGSADTDVSV

SEQ ID NO: 1881458 - protein, 23 aa, Staphylococcus
LSTSYSGSMSDSLSISTSLSNSY

SEQ ID NO: 1881459 - protein, 26 aa, Staphylococcus
LSTTFLMKCDFCFKSFAFEREGDFWN

SEQ ID NO: 1881460 - protein, 31 aa, Staphylococcus
LSTTLLNFFHGWPWYAVWLVLLGFGGGMIVP

SEQ ID NO: 1881461 - protein, 22 aa, Staphylococcus
LSTTQFVIWLQNGVWAIIVYFI

SEQ ID NO: 1881462 - protein, 25 aa, Staphylococcus
LSVAVWRVVFVILTIFGILMIMGSL

SEQ ID NO: 1881463 - protein, 17 aa, Staphylococcus
LSVAWIILNFNLAKIEA

SEQ ID NO: 1881464 - protein, 20 aa, Staphylococcus
LSVFALFLVLTATSVCVTQA

SEQ ID NO: 1881465 - protein, 17 aa, Staphylococcus
LSVFCTFVGKNDSISSQ

SEQ ID NO: 1881466 - protein, 37 aa, Staphylococcus
LSVFLFFKGKKAFWFMFIGGFLLTFLLYANVVYFRFF

SEQ ID NO: 1881467 - protein, 28 aa, Staphylococcus
LSVILVITIVISFLFYFLTTEKKVDKDT

SEQ ID NO: 1881468 - protein, 19 aa, Staphylococcus
LSVIMGLVLAFYMNISPGG

SEQ ID NO: 1881469 - protein, 18 aa, Staphylococcus
LSVKEVLYAWSPFYILTI

SEQ ID NO: 1881470 - protein, 20 aa, Staphylococcus
LSVPFTVFWIIAITNAINLI

SEQ ID NO: 1881471 - protein, 26 aa, Staphylococcus
LSWCICLIGAIGLYLLWDLGSLTDSF

SEQ ID NO: 1881472 - protein, 20 aa, Staphylococcus
LSWFMPSYVAILIASMLAAT

SEQ ID NO: 1881473 - protein, 17 aa, Staphylococcus
LSWLPYISIVILLHIIG

SEQ ID NO: 1881474 - protein, 18 aa, Staphylococcus
LSWLPYIVIVILLHIIGF

SEQ ID NO: 1881475 - protein, 24 aa, Staphylococcus
LSYAAYEKRSGRNSLLSESPSDFI

SEQ ID NO: 1881476 - protein, 20 aa, Staphylococcus
LSYIFYPFIYIFPIGDKALL

SEQ ID NO: 1881477 - protein, 22 aa, Staphylococcus
LSYKYRRLVTPVTMRVKASDKL

SEQ ID NO: 1881478 - protein, 19 aa, Staphylococcus
LSYLIYRIGKDDASGLAAQ

SEQ ID NO: 1881479 - protein, 32 aa, Staphylococcus
LTAEQMQSWGWRIPFILGLFLGLFGLYLRRRL

SEQ ID NO: 1881480 - protein, 18 aa, Staphylococcus
LTAFLIAKLFHLPPEVAI

SEQ ID NO: 1881481 - protein, 25 aa, Staphylococcus
LTAGTAFLIWLGEQITQFGVGNGIS

SEQ ID NO: 1881482 - protein, 33 aa, Staphylococcus
LTAILCFLSFKMGELPIYIILIYACGRGILNAV

SEQ ID NO: 1881483 - protein, 18 aa, Staphylococcus
LTAITWVVFIPFLPWTIP

SEQ ID NO: 1881484 - protein, 28 aa, Staphylococcus
LTAIVSRLVSCLLILFLGSAIFSILGQH

SEQ ID NO: 1881485 - protein, 18 aa, Staphylococcus
LTALSQGVALIFRLNQSL

SEQ ID NO: 1881486 - protein, 17 aa, Staphylococcus
LTAMIFMTLFYYRDSDR

SEQ ID NO: 1881487 - protein, 17 aa, Staphylococcus
LTAMIIIMLFNYRNVDN

SEQ ID NO: 1881488 - protein, 22 aa, Staphylococcus
LTAMVIVTFTWVLLGFSLSFGK

SEQ ID NO: 1881489 - protein, 19 aa, Staphylococcus
LTAPEHRGKMIGIVYSGFS

SEQ ID NO: 1881490 - protein, 26 aa, Staphylococcus
LTARLTIKDSISFVKLLSDFVFVNTF

SEQ ID NO: 1881491 - protein, 19 aa, Staphylococcus
LTCDFHFEDGSTFYGNKLY

SEQ ID NO: 1881492 - protein, 23 aa, Staphylococcus
LTCGLVGACGWMVYVIFFNGLRL

SEQ ID NO: 1881493 - protein, 19 aa, Staphylococcus
LTEIIRLIIRHEQYTIDAK

SEQ ID NO: 1881494 - protein, 35 aa, Staphylococcus
LTEMDGHGIITPREPLPLGKIYARATDGAETPNSI

SEQ ID NO: 1881495 - protein, 22 aa, Staphylococcus
LTFLIECYRMEKYGANLVRIIV

SEQ ID NO: 1881496 - protein, 17 aa, Staphylococcus
LTFNPSVLIQFPYILSA

SEQ ID NO: 1881497 - protein, 21 aa, Staphylococcus
LTFPFVFMTWLILAMGMQFSK

SEQ ID NO: 1881498 - protein, 23 aa, Staphylococcus
LTFSDGHEVIIPKGAKGDKGDTG

SEQ ID NO: 1881499 - protein, 17 aa, Staphylococcus
LTGAEMLESLVLGVLFS

SEQ ID NO: 1881500 - protein, 18 aa, Staphylococcus
LTGDWRGAWQTMSKAGAE

SEQ ID NO: 1881501 - protein, 23 aa, Staphylococcus
LTGGLYLFLGIDWDILEYQLQSR

SEQ ID NO: 1881502 - protein, 18 aa, Staphylococcus
LTGLKLIVAVTFIAQLGA

SEQ ID NO: 1881503 - protein, 18 aa, Staphylococcus
LTGLKMGISPVFAVIIGL

SEQ ID NO: 1881504 - protein, 23 aa, Staphylococcus
LTGRGKEGIYFSGEKIVIKEMLT

SEQ ID NO: 1881505 - protein, 18 aa, Staphylococcus
LTGSMAIGFYLAAALLVV

SEQ ID NO: 1881506 - protein, 25 aa, Staphylococcus
LTGSSLKPFLAYGPAIENMQWATNR

SEQ ID NO: 1881507 - protein, 25 aa, Staphylococcus
LTGSSLKPFLSYGPAIENMQWATNH

SEQ ID NO: 1881508 - protein, 21 aa, Staphylococcus
LTHALDFWQIIIIFLAVAIVY

SEQ ID NO: 1881509 - protein, 18 aa, Staphylococcus
LTHKEKYFLIIFMSNAIF

SEQ ID NO: 1881510 - protein, 20 aa, Staphylococcus
LTHLPTALFSLIWIAINLFT

SEQ ID NO: 1881511 - protein, 23 aa, Staphylococcus
LTHRGMALIAFIWILITFIHAVN

SEQ ID NO: 1881512 - protein, 17 aa, Staphylococcus
LTHSYLYESYNSYQTEY

SEQ ID NO: 1881513 - protein, 24 aa, Staphylococcus
LTIANWKAIFLILTIISFAILLFA

SEQ ID NO: 1881514 - protein, 17 aa, Staphylococcus
LTICVIAKLFYESLETI

SEQ ID NO: 1881515 - protein, 17 aa, Staphylococcus
LTIFAFITTSITFSIIF

SEQ ID NO: 1881516 - protein, 28 aa, Staphylococcus
LTIIDLICFRWFNIVLKIMLALMVILFS

SEQ ID NO: 1881517 - protein, 25 aa, Staphylococcus
LTIKGRKNLAGALLIAAAVTGLITM

SEQ ID NO: 1881518 - protein, 23 aa, Staphylococcus
LTIPKDRPVVFKLQSMDTMTSFW

SEQ ID NO: 1881519 - protein, 25 aa, Staphylococcus
LTISNWRLLFILLGILGLIWVVIWS

SEQ ID NO: 1881520 - protein, 17 aa, Staphylococcus
LTISTWRSIFVILTIIT

SEQ ID NO: 1881521 - protein, 18 aa, Staphylococcus
LTITYGVSKSFLKKVGLS

SEQ ID NO: 1881522 - protein, 17 aa, Staphylococcus
LTIVGLIAIVFNITSKT

SEQ ID NO: 1881523 - protein, 24 aa, Staphylococcus
LTIVIGGAIAKLFGPALNEFMTGL

SEQ ID NO: 1881524 - protein, 19 aa, Staphylococcus
LTKDFLPIIILAVIYLLHK

SEQ ID NO: 1881525 - protein, 29 aa, Staphylococcus
LTKEIKTLYPFVFNVLYEIVQRMSDDSGV

SEQ ID NO: 1881526 - protein, 23 aa, Staphylococcus
LTKGELLPIIFFAVFFGLALAAI

SEQ ID NO: 1881527 - protein, 19 aa, Staphylococcus
LTKIFVVIAILSFLVSVYF

SEQ ID NO: 1881528 - protein, 19 aa, Staphylococcus
LTKKRIFKMSPIHHHFELC

SEQ ID NO: 1881529 - protein, 19 aa, Staphylococcus
LTKKRIFKMSPIHHHFELS

SEQ ID NO: 1881530 - protein, 20 aa, Staphylococcus
LTKKRIFKMSPIHHHFELSG

SEQ ID NO: 1881531 - protein, 19 aa, Staphylococcus
LTKKRIFKMTPIHHHFELS

SEQ ID NO: 1881532 - protein, 31 aa, Staphylococcus; identical to SEQ ID NO: 1739406

SEQ ID NO: 1881533 - protein, 22 aa, Staphylococcus
LTKLRVELLFRGKSEEQIDEID

SEQ ID NO: 1881534 - protein, 20 aa, Staphylococcus
LTKSVTRTIKYVDAENTSKV

SEQ ID NO: 1881535 - protein, 26 aa, Staphylococcus
LTKVILMILMFIGRVGLISFIIMIAG

SEQ ID NO: 1881536 - protein, 24 aa, Staphylococcus
LTKVRCPLFLIKAIIFILLPIYTI

SEQ ID NO: 1881537 - protein, 18 aa, Staphylococcus
LTLFAGPLFNFLLTLVLF

SEQ ID NO: 1881538 - protein, 22 aa, Staphylococcus
LTLFCFHVILVIVRRYKAYYVL

SEQ ID NO: 1881539 - protein, 21 aa, Staphylococcus
LTLFFWFFKLNYSFEHIINSK

SEQ ID NO: 1881540 - protein, 24 aa, Staphylococcus
LTLFFWFFQLHYSFGHIINSKIFA

SEQ ID NO: 1881541 - protein, 18 aa, Staphylococcus
LTLFIIFFGFTWGPVLWV

SEQ ID NO: 1881542 - protein, 18 aa, Staphylococcus
LTLIAVILMVWLSNPVVS

SEQ ID NO: 1881543 - protein, 26 aa, Staphylococcus
LTLIHPWIGLKVRWQWYQLKQSSWSI

SEQ ID NO: 1881544 - protein, 26 aa, Staphylococcus
LTLILRDYQPMFGVKPFLFDASRLAP

SEQ ID NO: 1881545 - protein, 22 aa, Staphylococcus
LTLIVVFICMIIFGFIGLVLFV

SEQ ID NO: 1881546 - protein, 17 aa, Staphylococcus
LTLKNVRRLSSASDIFV

SEQ ID NO: 1881547 - protein, 17 aa, Staphylococcus
LTLKQYLLVAIPVFIFG

SEQ ID NO: 1881548 - protein, 18 aa, Staphylococcus
LTLKSFNLYFGIFMIFVA

SEQ ID NO: 1881549 - protein, 19 aa, Staphylococcus
LTLLIRVNRSWKIPYEAAK

SEQ ID NO: 1881550 - protein, 23 aa, Staphylococcus
LTLLLKFDRLIAVLGGVTPFLVA

SEQ ID NO: 1881551 - protein, 17 aa, Staphylococcus
LTLLSIVAYSLLSTKSL

SEQ ID NO: 1881552 - protein, 21 aa, Staphylococcus
LTLNFMISFLFIISATVIGIF

SEQ ID NO: 1881553 - protein, 19 aa, Staphylococcus
LTLNLMEWIFFTYLLLGVF

SEQ ID NO: 1881554 - protein, 19 aa, Staphylococcus
LTLNWITAILWLVAGILLL

SEQ ID NO: 1881555 - protein, 23 aa, Staphylococcus
LTLPELITLIIFQGNVQSQQAKI

SEQ ID NO: 1881556 - protein, 19 aa, Staphylococcus
LTLRVKAVDVIAPSGNLRV

SEQ ID NO: 1881557 - protein, 25 aa, Staphylococcus
LTLSRSEFQDSIFLLNEGDINMNKM

SEQ ID NO: 1881558 - protein, 17 aa, Staphylococcus
LTLSVFLFFKGKKAFWF

SEQ ID NO: 1881559 - protein, 19 aa, Staphylococcus
LTMAFRIAPMPSAAADKPS

SEQ ID NO: 1881560 - protein, 17 aa, Staphylococcus
LTMKQFLFAAVSVFIAG

SEQ ID NO: 1881561 - protein, 19 aa, Staphylococcus
LTMLCTFLIVTLGMSVATY

SEQ ID NO: 1881562 - protein, 21 aa, Staphylococcus
LTMNFMITFLFVISATVIGVF

SEQ ID NO: 1881563 - protein, 27 aa, Staphylococcus
LTMRNIRQNLIWAFGYNIAGIPIAALG

SEQ ID NO: 1881564 - protein, 18 aa, Staphylococcus
LTMRVPMLSMEVLKYSGF

SEQ ID NO: 1881565 - protein, 19 aa, Staphylococcus
LTNFLSLSLAMWIVILIAL

SEQ ID NO: 1881566 - protein, 23 aa, Staphylococcus
LTNKEKYLLIIFMSNAIFGVLQD

SEQ ID NO: 1881567 - protein, 17 aa, Staphylococcus
LTNVIAIKMLFHPFNPY

SEQ ID NO: 1881568 - protein, 31 aa, Staphylococcus
LTNYMIYRFEHAGALPLIIGLFSLMAFIGFF

SEQ ID NO: 1881569 - protein, 18 aa, Staphylococcus
LTPYGILAIMASTIATSD

SEQ ID NO: 1881570 - protein, 18 aa, Staphylococcus
LTPYGILAIMASTLATSD

SEQ ID NO: 1881571 - protein, 17 aa, Staphylococcus
LTPYGILAIMSSTIATS

SEQ ID NO: 1881572 - protein, 23 aa, Staphylococcus
LTQAKQALKVDIQPLKTAMKNIQ

SEQ ID NO: 1881573 - protein, 18 aa, Staphylococcus
LTQLIRLNKTWKVPAEAA

SEQ ID NO: 1881574 - protein, 18 aa, Staphylococcus
LTQLIRLNRSWKVPAEAA

SEQ ID NO: 1881575 - protein, 18 aa, Staphylococcus
LTRFFYKKHLSRNIDYLN

SEQ ID NO: 1881576 - protein, 20 aa, Staphylococcus
LTRIPTFLFSTLWIAINIFT

SEQ ID NO: 1881577 - protein, 22 aa, Staphylococcus
LTRLESTVMFAGIIVDTRNFTL

SEQ ID NO: 1881578 - protein, 21 aa, Staphylococcus
LTSALNINQLETFMGTNGNAT

SEQ ID NO: 1881579 - protein, 18 aa, Staphylococcus
LTSCTGAFVNEVDKQMND

SEQ ID NO: 1881580 - protein, 35 aa, Staphylococcus
LTSMPEYWLAILFVYYFGIRLQWLPFVGSSTWLHF

SEQ ID NO: 1881581 - protein, 25 aa, Staphylococcus
LTSSEIKSLASMYLSDDIEFKKSQL

SEQ ID NO: 1881582 - protein, 22 aa, Staphylococcus
LTSTMALLLGWIAKPISLIFSG

SEQ ID NO: 1881583 - protein, 19 aa, Staphylococcus
LTSVSSFLLIVYWYSKGDS

SEQ ID NO: 1881584 - protein, 17 aa, Staphylococcus
LTTACGLVVAVSEYFHR

SEQ ID NO: 1881585 - protein, 18 aa, Staphylococcus
LTTACGLVVAVSQYFHSI

SEQ ID NO: 1881586 - protein, 22 aa, Staphylococcus
LTTCLLVYMIIVAIYGALTSQK

SEQ ID NO: 1881587 - protein, 19 aa, Staphylococcus
LTTEEIKSIASIYLSDNID

SEQ ID NO: 1881588 - protein, 24 aa, Staphylococcus
LTTGTAFLIWLGDQITQFGVGNGI

SEQ ID NO: 1881589 - protein, 34 aa, Staphylococcus
LTTIILVIAYKLMWFNGHMTLSLSITTMITSCLT

SEQ ID NO: 1881590 - protein, 17 aa, Staphylococcus
LTTMIIMTLLTYRNMEK

SEQ ID NO: 1881591 - protein, 20 aa, Staphylococcus
LTTQIKYIFGITTATYLVAI

SEQ ID NO: 1881592 - protein, 17 aa, Staphylococcus
LTTWKKYHHKVILDTTM

SEQ ID NO: 1881593 - protein, 18 aa, Staphylococcus
LTVFICSLMIGKTPSYLG

SEQ ID NO: 1881594 - protein, 22 aa, Staphylococcus
LTVFLVPGWKSVLMTLLAVVLT

SEQ ID NO: 1881595 - protein, 22 aa, Staphylococcus
LTVIPEIKFNKLLSDYVIINTF

SEQ ID NO: 1881596 - protein, 27 aa, Staphylococcus
LTVKELWISVLTICFILAVSKITTYGG

SEQ ID NO: 1881597 - protein, 27 aa, Staphylococcus
LTVKELWISVLTICFILAVSKVTTYGG

SEQ ID NO: 1881598 - protein, 17 aa, Staphylococcus
LTVKGRHKLGASLLIAA

SEQ ID NO: 1881599 - protein, 24 aa, Staphylococcus
LTVLGSYFFFRSTVSLILKTIQYF

SEQ ID NO: 1881600 - protein, 24 aa, Staphylococcus
LTVRKWLLLWSMPMIMVSLFVFLS

SEQ ID NO: 1881601 - protein, 26 aa, Staphylococcus
LTVRTILTLKGYRYVAAAVSFIEVLI

SEQ ID NO: 1881602 - protein, 27 aa, Staphylococcus
LTVSIAFYYVILFCLFLLATLVVLPPG

SEQ ID NO: 1881603 - protein, 23 aa, Staphylococcus
LTVTLKTYFSYYVDFSLGVKGLV

SEQ ID NO: 1881604 - protein, 18 aa, Staphylococcus
LTVVFKVQEGVVTSCVIL

SEQ ID NO: 1881605 - protein, 24 aa, Staphylococcus
LTVVGGWIGWFVFILLWGTTIWGI

SEQ ID NO: 1881606 - protein, 25 aa, Staphylococcus
LTVVGGWLGWLVFLLLWGTTIWGIL

SEQ ID NO: 1881607 - protein, 19 aa, Staphylococcus
LTYQFGVILLLGFAITTAQ

SEQ ID NO: 1881608 - protein, 17 aa, Staphylococcus
LTYQLFLNGHPTFNDQQ

SEQ ID NO: 1881609 - protein, 17 aa, Staphylococcus
LVACLVGAFVTTGFILL

SEQ ID NO: 1881610 - protein, 25 aa, Staphylococcus
LVAETICSLLAMFIVYLSRNQLTVD

SEQ ID NO: 1881611 - protein, 18 aa, Staphylococcus
LVAFMFVSIAMYRLRKRE

SEQ ID NO: 1881612 - protein, 18 aa, Staphylococcus
LVAIMYWVVCFIISIIQG

SEQ ID NO: 1881613 - protein, 18 aa, Staphylococcus
LVAIMYWVVCFIISVLQG

SEQ ID NO: 1881614 - protein, 17 aa, Staphylococcus
LVALAVYLFRFIWVYVL

SEQ ID NO: 1881615 - protein, 17 aa, Staphylococcus
LVALAVYLFRFLWVYVL

SEQ ID NO: 1881616 - protein, 24 aa, Staphylococcus
LVALCGVLLSLLSIYVLEKISHRN

SEQ ID NO: 1881617 - protein, 22 aa, Staphylococcus
LVALILHFFLIYGGTIKFLAKD

SEQ ID NO: 1881618 - protein, 20 aa, Staphylococcus
LVALIRYYGGIDWIITAMKT

SEQ ID NO: 1881619 - protein, 25 aa, Staphylococcus
LVALLYWVVCFIISVIQSFYESYLE

SEQ ID NO: 1881620 - protein, 25 aa, Staphylococcus
LVALMYWVVCFIISIAQNFYESYLE

SEQ ID NO: 1881621 - protein, 18 aa, Staphylococcus
LVALMYWVVCFIISVIQS

SEQ ID NO: 1881622 - protein, 19 aa, Staphylococcus
LVAMFIPLYFIYKYKQPLF

SEQ ID NO: 1881623 - protein, 20 aa, Staphylococcus
LVAMICFKLPARIAGGATFE

SEQ ID NO: 1881624 - protein, 18 aa, Staphylococcus
LVAMLIPLYFLYKYKQPM

SEQ ID NO: 1881625 - protein, 19 aa, Staphylococcus
LVARYPIALAPGMGLNAFF

SEQ ID NO: 1881626 - protein, 17 aa, Staphylococcus
LVAVMYWVICFIISVIQ

SEQ ID NO: 1881627 - protein, 18 aa, Staphylococcus
LVAVMYWVVCFIISVIQG

SEQ ID NO: 1881628 - protein, 17 aa, Staphylococcus
LVCFFFFAVFGASAVYL

SEQ ID NO: 1881629 - protein, 18 aa, Staphylococcus
LVCFIFFAVFGASAMYLQ

SEQ ID NO: 1881630 - protein, 17 aa, Staphylococcus
LVCFLFFAVFGASAIYL

SEQ ID NO: 1881631 - protein, 24 aa, Staphylococcus
LVDGAREIIGLALNKLGYSLNDSN

SEQ ID NO: 1881632 - protein, 23 aa, Staphylococcus
LVDIIFWSAIFGFIIARIYFVIF

SEQ ID NO: 1881633 - protein, 19 aa, Staphylococcus
LVDLPGIYDLLPISKDESV

SEQ ID NO: 1881634 - protein, 23 aa, Staphylococcus
LVDNASKMAITYTRGRKTSQKEM

SEQ ID NO: 1881635 - protein, 22 aa, Staphylococcus
LVDNASKMAITYTRNRKTTQQE

SEQ ID NO: 1881636 - protein, 20 aa, Staphylococcus
LVDNASKMAITYTRSKKTSQ

SEQ ID NO: 1881637 - protein, 18 aa, Staphylococcus
LVEQRYMDAMAVAQRYYP

SEQ ID NO: 1881638 - protein, 26 aa, Staphylococcus
LVERIHRFKILIYLTFIQLIGVLLIV

SEQ ID NO: 1881639 - protein, 24 aa, Staphylococcus
LVFKSKWLSTRAFSKKFVPVVMAV

SEQ ID NO: 1881640 - protein, 37 aa, Staphylococcus
LVFKYKKEQLAGLKFSFSLKVIERILLALILPLIIFM

SEQ ID NO: 1881641 - protein, 17 aa, Staphylococcus
LVFLIIVGSTLTTKQPN

SEQ ID NO: 1881642 - protein, 21 aa, Staphylococcus
LVFLSCITMLIGAFGVLAYRD

SEQ ID NO: 1881643 - protein, 23 aa, Staphylococcus
LVFSCLVSIPFILFAVAYPIVTM

SEQ ID NO: 1881644 - protein, 17 aa, Staphylococcus
LVFVSGSVGEMFRPFAL

SEQ ID NO: 1881645 - protein, 18 aa, Staphylococcus
LVGAFVTTGFILLVDCLV

SEQ ID NO: 1881646 - protein, 32 aa, Staphylococcus
LVGALCIALSFIPKYGLGQGVFLSIFTSVSAF

SEQ ID NO: 1881647 - protein, 25 aa, Staphylococcus
LVGALGFTCVIGIFSLLSLFLKRNN

SEQ ID NO: 1881648 - protein, 20 aa, Staphylococcus
LVGANYALAMIFITTQVITL

SEQ ID NO: 1881649 - protein, 17 aa, Staphylococcus
LVGCILGAILGAINGLL

SEQ ID NO: 1881650 - protein, 17 aa, Staphylococcus
LVGEQYLSIILPGKTFK

SEQ ID NO: 1881651 - protein, 18 aa, Staphylococcus
LVGILWLSNRILSTFILC

SEQ ID NO: 1881652 - protein, 18 aa, Staphylococcus
LVGILWMNFKVISISLFF

SEQ ID NO: 1881653 - protein, 19 aa, Staphylococcus
LVGLALMAMNTFQPEHYQT

SEQ ID NO: 1881654 - protein, 18 aa, Staphylococcus
LVGLIITTALRWEVVGKN

SEQ ID NO: 1881655 - protein, 18 aa, Staphylococcus
LVGLIPMVVLASVLITIS

SEQ ID NO: 1881656 - protein, 19 aa, Staphylococcus
LVGLLIVLVAAGFIFFTMI

SEQ ID NO: 1881657 - protein, 17 aa, Staphylococcus
LVGLSYLFSQGVLAFLV

SEQ ID NO: 1881658 - protein, 20 aa, Staphylococcus
LVGMPLAALFLTGTGGVSAI

SEQ ID NO: 1881659 - protein, 25 aa, Staphylococcus
LVGMRLRRVSPRKVIAPLIKAHKAG

SEQ ID NO: 1881660 - protein, 25 aa, Staphylococcus
LVGMRLRRVSPRKVIGPLIKAHKAG

SEQ ID NO: 1881661 - protein, 18 aa, Staphylococcus
LVHKRKKSVVVFRRDVTT

SEQ ID NO: 1881662 - protein, 24 aa, Staphylococcus
LVHLTFVPLLFLGRYTNMVYTLAS

SEQ ID NO: 1881663 - protein, 20 aa, Staphylococcus
LVIACPCALGLATPTSIMVG

SEQ ID NO: 1881664 - protein, 19 aa, Staphylococcus
LVIACPCSLGLATPTSIMV

SEQ ID NO: 1881665 - protein, 26 aa, Staphylococcus
LVIAGGILMAIAFMFGTNSFDPKSSD

SEQ ID NO: 1881666 - protein, 19 aa, Staphylococcus
LVIAGGILMAIVFIIGPNS

SEQ ID NO: 1881667 - protein, 21 aa, Staphylococcus
LVIAGGILMAIVFLFGANSFD

SEQ ID NO: 1881668 - protein, 23 aa, Staphylococcus
LVIAGGILMAIVFLFGANSFDPK

SEQ ID NO: 1881669 - protein, 21 aa, Staphylococcus
LVIAGGILMAIVFLFGANSFK

SEQ ID NO: 1881670 - protein, 20 aa, Staphylococcus
LVIAGGILMAIVFLFGPNSF

SEQ ID NO: 1881671 - protein, 21 aa, Staphylococcus
LVIAGSFIFSAGVNAFIISGN

SEQ ID NO: 1881672 - protein, 18 aa, Staphylococcus
LVIFPLSVAWLALNFNLA

SEQ ID NO: 1881673 - protein, 23 aa, Staphylococcus
LVIFPLSVAWLVLNFNLAKVEEN

SEQ ID NO: 1881674 - protein, 25 aa, Staphylococcus
LVIGKLFFKKDIRQFGSGNTGATNS

SEQ ID NO: 1881675 - protein, 23 aa, Staphylococcus
LVIGKLFFKKDIRQYGSGNTGAT

SEQ ID NO: 1881676 - protein, 17 aa, Staphylococcus
LVIGRLVIGLGVGSSTA

SEQ ID NO: 1881677 - protein, 18 aa, Staphylococcus
LVIKSGFTIKMPEQVPSS

SEQ ID NO: 1881678 - protein, 20 aa, Staphylococcus
LVILFAQFDLFRSAVGIGVG

SEQ ID NO: 1881679 - protein, 17 aa, Staphylococcus
LVILGSFIFSAGVNAFV

SEQ ID NO: 1881680 - protein, 25 aa, Staphylococcus
LVILKAAVESPVLFVTIAVFCSLVF

SEQ ID NO: 1881681 - protein, 25 aa, Staphylococcus
LVILKAAVESPVLFVTIAVFSSLVF

SEQ ID NO: 1881682 - protein, 19 aa, Staphylococcus
LVILKVHATNFIWITIGLI

SEQ ID NO: 1881683 - protein, 25 aa, Staphylococcus
LVIMWLIFQATFSWIGTPLSDKLDE

SEQ ID NO: 1881684 - protein, 26 aa, Staphylococcus
LVISGIAIPGWIEWLEAQGIQPYLMK

SEQ ID NO: 1881685 - protein, 20 aa, Staphylococcus
LVIVGSFIFSAGVNAFIISG

SEQ ID NO: 1881686 - protein, 18 aa, Staphylococcus
LVKDIISIFMLKENKYWK

SEQ ID NO: 1881687 - protein, 25 aa, Staphylococcus
LVKEVMSLPAIKVVEHPDLFVETSD

SEQ ID NO: 1881688 - protein, 21 aa, Staphylococcus
LVKIAPWLTNHVFVMISSIME

SEQ ID NO: 1881689 - protein, 20 aa, Staphylococcus
LVKNEAFATLAIFTLLTIMS

SEQ ID NO: 1881690 - protein, 23 aa, Staphylococcus
LVKNEAFAVLAIFTLLTIMSMFL

SEQ ID NO: 1881691 - protein, 22 aa, Staphylococcus
LVKNVVRYVVWFIVLTTILGKF

SEQ ID NO: 1881692 - protein, 17 aa, Staphylococcus
LVKVKWSQNGFVSVKGK

SEQ ID NO: 1881693 - protein, 18 aa, Staphylococcus
LVKVKWSQTGFVSGKLDE

SEQ ID NO: 1881694 - protein, 24 aa, Staphylococcus
LVLCFIVFGITTGTSYAAESQATQ

SEQ ID NO: 1881695 - protein, 28 aa, Staphylococcus
LVLEMISYFFILRLSERQIYKNEKANIF

SEQ ID NO: 1881696 - protein, 18 aa, Staphylococcus
LVLFIIALIVKNATGESD

SEQ ID NO: 1881697 - protein, 27 aa, Staphylococcus
LVLFLDRVGLFLAMLVLVLQLSSSEGM

SEQ ID NO: 1881698 - protein, 20 aa, Staphylococcus
LVLFLIYLFYSPRLKFDVLE

SEQ ID NO: 1881699 - protein, 24 aa, Staphylococcus
LVLHDFKLLPAFIAAYIVAFGIKL

SEQ ID NO: 1881700 - protein, 24 aa, Staphylococcus
LVLHDFKLLPAFIAAYVISFGIKF

SEQ ID NO: 1881701 - protein, 21 aa, Staphylococcus
LVLIIPTWINLLLKTYAFIGI

SEQ ID NO: 1881702 - protein, 17 aa, Staphylococcus
LVLILSFIILYVYSQTP

SEQ ID NO: 1881703 - protein, 23 aa, Staphylococcus
LVLIPVFFICMIFVILFIVSVLL

SEQ ID NO: 1881704 - protein, 17 aa, Staphylococcus
LVLISSILLIILIVIAF

SEQ ID NO: 1881705 - protein, 18 aa, Staphylococcus
LVLKPLMGNSNFKDQMIS

SEQ ID NO: 1881706 - protein, 23 aa, Staphylococcus
LVLLCLVIGTSLLWNLGSILDQF

SEQ ID NO: 1881707 - protein, 19 aa, Staphylococcus
LVLLVVFAMVFFILVVLGI

SEQ ID NO: 1881708 - protein, 17 aa, Staphylococcus
LVLPEAVPVQFNIGTLI

SEQ ID NO: 1881709 - protein, 26 aa, Staphylococcus
LVLPITVLVSGVFVYLTILGTKKYNP

SEQ ID NO: 1881710 - protein, 23 aa, Staphylococcus
LVLPSEFAPVLGLSSDSEPYTPP

SEQ ID NO: 1881711 - protein, 23 aa, Staphylococcus
LVLPSEFAPVLGLSSNSEPYTPP

SEQ ID NO: 1881712 - protein, 17 aa, Staphylococcus
LVLRVSGGFSLFIVGTI

SEQ ID NO: 1881713 - protein, 17 aa, Staphylococcus
LVLSLLIAFFFKKIARV

SEQ ID NO: 1881714 - protein, 22 aa, Staphylococcus
LVLTGLPWSGFMGAKIASVMDN

SEQ ID NO: 1881715 - protein, 19 aa, Staphylococcus
LVLVVVFAMVFFIIVVLGI

SEQ ID NO: 1881716 - protein, 17 aa, Staphylococcus
LVLVVVFAMVFFVVVVL

SEQ ID NO: 1881717 - protein, 18 aa, Staphylococcus
LVLWICLFFYVIAAGIYF

SEQ ID NO: 1881718 - protein, 18 aa, Staphylococcus
LVMLFNVIVALIFSIIEW

SEQ ID NO: 1881719 - protein, 18 aa, Staphylococcus
LVMLPLTFIFGADLLLIS

SEQ ID NO: 1881720 - protein, 19 aa, Staphylococcus
LVNFCRLVPILLLSVWAGA

SEQ ID NO: 1881721 - protein, 19 aa, Staphylococcus
LVNFCRLVPILLLSVWAGS

SEQ ID NO: 1881722 - protein, 21 aa, Staphylococcus
LVNIFLILIYINKVTKSQINE

SEQ ID NO: 1881723 - protein, 17 aa, Staphylococcus
LVNLGVLGFAFLIPFIV

SEQ ID NO: 1881724 - protein, 23 aa, Staphylococcus
LVNRLRITFLPIVVAEILMGIVI

SEQ ID NO: 1881725 - protein, 23 aa, Staphylococcus
LVPAIICLIGIFATMVYRSFQID

SEQ ID NO: 1881726 - protein, 17 aa, Staphylococcus
LVPGILITNAIRDLMAG

SEQ ID NO: 1881727 - protein, 18 aa, Staphylococcus
LVPIIITLLLCYLGFQFG

SEQ ID NO: 1881728 - protein, 25 aa, Staphylococcus
LVPILTAFFCTFLVLVLLVAWPVVY

SEQ ID NO: 1881729 - protein, 18 aa, Staphylococcus
LVPLIITLLLCYLGFQFG

SEQ ID NO: 1881730 - protein, 23 aa, Staphylococcus
LVPTEIPASIILALLGIPVLGYL

SEQ ID NO: 1881731 - protein, 18 aa, Staphylococcus
LVQFPELIIMGLAEGVVP

SEQ ID NO: 1881732 - protein, 18 aa, Staphylococcus
LVQFPELIIMGLSEGVVP

SEQ ID NO: 1881733 - protein, 22 aa, Staphylococcus
LVQNVVKYIVWFIVITTVLSKF

SEQ ID NO: 1881734 - protein, 24 aa, Staphylococcus
LVRVEAMSGIAIECIVTAPAGLIY

SEQ ID NO: 1881735 - protein, 22 aa, Staphylococcus
LVSFVIAALIMKFTKEPKQDLE

SEQ ID NO: 1881736 - protein, 21 aa, Staphylococcus
LVSGITWRLLAPLFISVIVFG

SEQ ID NO: 1881737 - protein, 17 aa, Staphylococcus
LVSIAVIVGLKISIKPA

SEQ ID NO: 1881738 - protein, 24 aa, Staphylococcus
LVSIFLKLKYLRIFVPELSSNSLL

SEQ ID NO: 1881739 - protein, 18 aa, Staphylococcus
LVSIGTAIGLLFTQFGLP

SEQ ID NO: 1881740 - protein, 23 aa, Staphylococcus
LVSILFWKVIKYIVVHYGSQIDS

SEQ ID NO: 1881741 - protein, 20 aa, Staphylococcus
LVSIPGMMSGLIISGVDPLQ

SEQ ID NO: 1881742 - protein, 23 aa, Staphylococcus
LVSIPGMMTGLIIGGMAPLQAIK

SEQ ID NO: 1881743 - protein, 18 aa, Staphylococcus
LVSIVFILFFFVFATKAG

SEQ ID NO: 1881744 - protein, 18 aa, Staphylococcus
LVSLASIAGLLIFGISPI

SEQ ID NO: 1881745 - protein, 18 aa, Staphylococcus
LVSLIPITLSCLVVGFLP

SEQ ID NO: 1881746 - protein, 19 aa, Staphylococcus
LVSLIVFAIAIVFKLIYLA

SEQ ID NO: 1881747 - protein, 23 aa, Staphylococcus
LVSMGTAIGLVFTQFGLPIVDVI

SEQ ID NO: 1881748 - protein, 21 aa, Staphylococcus
LVSSITWRILAPIFITVAILG

SEQ ID NO: 1881749 - protein, 24 aa, Staphylococcus
LVSTARIGRSLGIHLILATQKPSG

SEQ ID NO: 1881750 - protein, 18 aa, Staphylococcus
LVSYGFADMGAWRWMLGL

SEQ ID NO: 1881751 - protein, 23 aa, Staphylococcus
LVTCALLLFAVLLNYFIPNATTV

SEQ ID NO: 1881752 - protein, 23 aa, Staphylococcus
LVTGKVIVHRGATITLSEIESAM

SEQ ID NO: 1881753 - protein, 19 aa, Staphylococcus
LVTHIVFYFTNKVQAQREP

SEQ ID NO: 1881754 - protein, 17 aa, Staphylococcus
LVTIIVFLPLVFVAGSV

SEQ ID NO: 1881755 - protein, 18 aa, Staphylococcus
LVTLCGVILIILIMITVY

SEQ ID NO: 1881756 - protein, 21 aa, Staphylococcus
LVTLFIIFLMKVYKTNHKDTE

SEQ ID NO: 1881757 - protein, 21 aa, Staphylococcus
LVTSMFLHYNFEHILMNMLSL

SEQ ID NO: 1881758 - protein, 26 aa, Staphylococcus
LVTVTCLLLSFALVFGSLGSKVNAAV

SEQ ID NO: 1881759 - protein, 18 aa, Staphylococcus
LVTYCLPINLPHAPEEAL

SEQ ID NO: 1881760 - protein, 19 aa, Staphylococcus
LVVDGQFKSVSALKDLKIP

SEQ ID NO: 1881761 - protein, 25 aa, Staphylococcus
LVVEYCITKKLSLLGLLSGVLAGLV

SEQ ID NO: 1881762 - protein, 29 aa, Staphylococcus
LVVIGIIVSCCFACYHFFLKEGKQTEQTT

SEQ ID NO: 1881763 - protein, 26 aa, Staphylococcus
LVVIVFVIIVLRLGYLQIAQGSHYKQ

SEQ ID NO: 1881764 - protein, 17 aa, Staphylococcus
LVVLAMVVLSLFNHYED

SEQ ID NO: 1881765 - protein, 21 aa, Staphylococcus
LVVLCLYLAYQGILWVYENYQ

SEQ ID NO: 1881766 - protein, 18 aa, Staphylococcus
LVVLFIFRQTRLETPLLD

SEQ ID NO: 1881767 - protein, 23 aa, Staphylococcus
LVVLIAWILYYFVKVRLTNYNTR

SEQ ID NO: 1881768 - protein, 19 aa, Staphylococcus
LVVLIAWILYYFVNIQLTN

SEQ ID NO: 1881769 - protein, 18 aa, Staphylococcus
LVVLIAWVLYYFVNIQLT

SEQ ID NO: 1881770 - protein, 17 aa, Staphylococcus
LVVLSFLFVLPLTNVLF

SEQ ID NO: 1881771 - protein, 17 aa, Staphylococcus
LVVLSFLIVLPVTNVLY

SEQ ID NO: 1881772 - protein, 17 aa, Staphylococcus
LVVLSFLLVLPVSNVLY

SEQ ID NO: 1881773 - protein, 19 aa, Staphylococcus
LVVPVGVLMFYFGKERGHV

SEQ ID NO: 1881774 - protein, 18 aa, Staphylococcus
LVVRIDFFKSPKVQFVML

SEQ ID NO: 1881775 - protein, 17 aa, Staphylococcus
LVVRWTITHVFKETLSS

SEQ ID NO: 1881776 - protein, 25 aa, Staphylococcus
LVVVNLFLAWFFVFFPWGNWFVSKM

SEQ ID NO: 1881777 - protein, 26 aa, Staphylococcus
LVVYAVSAGYKWFFAYPDQKVETVNT

SEQ ID NO: 1881778 - protein, 26 aa, Staphylococcus
LVWLSDLNMRFGIAGPMPIVMISIIR

SEQ ID NO: 1881779 - protein, 20 aa, Staphylococcus
LVYLMVFIMMISRIYLHAHY

SEQ ID NO: 1881780 - protein, 17 aa, Staphylococcus
LVYSMLTAFLFIDKVFV

SEQ ID NO: 1881781 - protein, 18 aa, Staphylococcus
LWAAFLLIRSYLFVYYRL

SEQ ID NO: 1881782 - protein, 20 aa, Staphylococcus
LWGATFICIGLFIGGPIVLG

SEQ ID NO: 1881783 - protein, 18 aa, Staphylococcus
LWGILPIYWRLIGNISAF

SEQ ID NO: 1881784 - protein, 18 aa, Staphylococcus
LWGMERFFQRRKIGLFIF

SEQ ID NO: 1881785 - protein, 23 aa, Staphylococcus
LWHHLPAIILILLMGTIGILIGG

SEQ ID NO: 1881786 - protein, 17 aa, Staphylococcus
LWIAPIAGILLLIIFSL

SEQ ID NO: 1881787 - protein, 19 aa, Staphylococcus
LWIAVRSYRDSVLTFEKGF

SEQ ID NO: 1881788 - protein, 17 aa, Staphylococcus
LWICVCVYVFQLLISTY

SEQ ID NO: 1881789 - protein, 21 aa, Staphylococcus
LWIMMSHDLWESVKQSRNKRI

SEQ ID NO: 1881790 - protein, 17 aa, Staphylococcus
LWITLYIQVMINKQKEQ

SEQ ID NO: 1881791 - protein, 17 aa, Staphylococcus
LWKGFAMGTTDLVPGVS

SEQ ID NO: 1881792 - protein, 17 aa, Staphylococcus
LWLAPIAAILILVIFSL

SEQ ID NO: 1881793 - protein, 18 aa, Staphylococcus
LWLAWDYNNNILFQYQTD

SEQ ID NO: 1881794 - protein, 21 aa, Staphylococcus
LWLNIFGSLLIIVSDYIPLLL

SEQ ID NO: 1881795 - protein, 19 aa, Staphylococcus
LWLNRTLIIVLMFLNGLGI

SEQ ID NO: 1881796 - protein, 18 aa, Staphylococcus
LWSHGGFLPHGWMGFFFA

SEQ ID NO: 1881797 - protein, 18 aa, Staphylococcus
LWSHGGFMPHGIVGFFFA

SEQ ID NO: 1881798 - protein, 26 aa, Staphylococcus
LWSIILRTLHLIGISLWLGALSYLLI

SEQ ID NO: 1881799 - protein, 19 aa, Staphylococcus
LWVAFNFYVVYAIVKYLLF

SEQ ID NO: 1881800 - protein, 23 aa, Staphylococcus
LWWFPYEFAKVAGLHLEQLTYGV

SEQ ID NO: 1881801 - protein, 19 aa, Staphylococcus
LWYFITFGAFVAFGLFLPN

SEQ ID NO: 1881802 - protein, 20 aa, Staphylococcus
LWYFITFGAFVAFGLFLPNY

SEQ ID NO: 1881803 - protein, 20 aa, Staphylococcus
LWYYWIKRRRNIKEMVESDT

SEQ ID NO: 1881804 - protein, 18 aa, Staphylococcus
LYACIKYPTSGGIIEHPH

SEQ ID NO: 1881805 - protein, 18 aa, Staphylococcus
LYAGMAFFNLDALSWLGV

SEQ ID NO: 1881806 - protein, 19 aa, Staphylococcus
LYAIIFVGLIIFLSIIVFI

SEQ ID NO: 1881807 - protein, 28 aa, Staphylococcus
LYAIKQWKFQLSIIILVIISIALFLIYS

SEQ ID NO: 1881808 - protein, 20 aa, Staphylococcus
LYAIYLLCHVKRWLSAKHLI

SEQ ID NO: 1881809 - protein, 18 aa, Staphylococcus
LYATLGYVIIISASYYMF

SEQ ID NO: 1881810 - protein, 18 aa, Staphylococcus
LYAVLLVALIVFLSVVIL

SEQ ID NO: 1881811 - protein, 17 aa, Staphylococcus
LYAVWLVYAAGFDYLLL

SEQ ID NO: 1881812 - protein, 25 aa, Staphylococcus
LYAWQMSRSLLWIYIIVLICVMFAS

SEQ ID NO: 1881813 - protein, 17 aa, Staphylococcus
LYDKCKVDHREMKRDVL

SEQ ID NO: 1881814 - protein, 19 aa, Staphylococcus
LYECDDCSECPLKQQCMNF

SEQ ID NO: 1881815 - protein, 22 aa, Staphylococcus
LYEKLKETFEIEQERKNKRQKM

SEQ ID NO: 1881816 - protein, 18 aa, Staphylococcus
LYFFLFLRLIQGLTAGGS

SEQ ID NO: 1881817 - protein, 23 aa, Staphylococcus
LYFHKVRGLLAFWIGALLIAFTL

SEQ ID NO: 1881818 - protein, 23 aa, Staphylococcus
LYFHKVRGLLAFWIGVLLVAFTL

SEQ ID NO: 1881819 - protein, 21 aa, Staphylococcus
LYFILCFSLSLAFYYVYSAIN

SEQ ID NO: 1881820 - protein, 18 aa, Staphylococcus
LYFIYKYKQPLFGKLSSQ

SEQ ID NO: 1881821 - protein, 18 aa, Staphylococcus
LYFLYKYKQPMFGKLSSQ

SEQ ID NO: 1881822 - protein, 18 aa, Staphylococcus
LYFMYYWLIFGIGCYFGQ

SEQ ID NO: 1881823 - protein, 19 aa, Staphylococcus
LYFVLRYQIGGGITHHPHF

SEQ ID NO: 1881824 - protein, 25 aa, Staphylococcus
LYFVPEWFTGNVFIIGLVGFLWGMC

SEQ ID NO: 1881825 - protein, 17 aa, Staphylococcus
LYFYICIILTTICMGSS

SEQ ID NO: 1881826 - protein, 18 aa, Staphylococcus
LYIKKPLRTLTWIMTIIV

SEQ ID NO: 1881827 - protein, 18 aa, Staphylococcus
LYIMILFAGLFHLMNHAI

SEQ ID NO: 1881828 - protein, 18 aa, Staphylococcus
LYIRERMAMVILNGVIGY

SEQ ID NO: 1881829 - protein, 19 aa, Staphylococcus
LYIRKPLRRLTWIMTGIVY

SEQ ID NO: 1881830 - protein, 22 aa, Staphylococcus
LYITLVSVIAMISIYMLSLKMD

SEQ ID NO: 1881831 - protein, 24 aa, Staphylococcus
LYIYEAPEGYKWNQSVKNSITERS

SEQ ID NO: 1881832 - protein, 19 aa, Staphylococcus
LYIYKRGKTPSLVKLSTIA

SEQ ID NO: 1881833 - protein, 24 aa, Staphylococcus
LYLAYCFLVVYLGQLLDVKKWLKE

SEQ ID NO: 1881834 - protein, 19 aa, Staphylococcus
LYLIARMTPIFAISEGWVW

SEQ ID NO: 1881835 - protein, 19 aa, Staphylococcus
LYLIARMTPIFAVSQGWIW

SEQ ID NO: 1881836 - protein, 17 aa, Staphylococcus
LYLIIGIDFEIFQYQFT

SEQ ID NO: 1881837 - protein, 18 aa, Staphylococcus
LYLILGIDFEIFDYQIQS

SEQ ID NO: 1881838 - protein, 18 aa, Staphylococcus
LYLKGVGYGSSFVAELYH

SEQ ID NO: 1881839 - protein, 18 aa, Staphylococcus
LYLLFVIIGYFAMKSGSG

SEQ ID NO: 1881840 - protein, 17 aa, Staphylococcus
LYLNLSIIFESVATSIW

SEQ ID NO: 1881841 - protein, 19 aa, Staphylococcus
LYLPILFKVVKLQLNLSKG

SEQ ID NO: 1881842 - protein, 27 aa, Staphylococcus
LYLPITGKHPIDFVDAFFIAASAFTVT

SEQ ID NO: 1881843 - protein, 18 aa, Staphylococcus
LYLPVLFKVIQLQLNLSK

SEQ ID NO: 1881844 - protein, 19 aa, Staphylococcus
LYLQNLRGFTPIQSGLLLL

SEQ ID NO: 1881845 - protein, 27 aa, Staphylococcus
LYLVARLTPLFAVSEGWIWTITLVGLI

SEQ ID NO: 1881846 - protein, 18 aa, Staphylococcus
LYLVARMTPIFAVSQGWI

SEQ ID NO: 1881847 - protein, 18 aa, Staphylococcus
LYNVFIFILWVIWIAFFF

SEQ ID NO: 1881848 - protein, 18 aa, Staphylococcus
LYNYDYLIAKSFQLTPII

SEQ ID NO: 1881849 - protein, 22 aa, Staphylococcus
LYPNRLIFQGGITQIKNNQQVE

SEQ ID NO: 1881850 - protein, 17 aa, Staphylococcus
LYRFICLAYLILCLAIR

SEQ ID NO: 1881851 - protein, 22 aa, Staphylococcus
LYRHSCLIFLLICNILGTLYGF

SEQ ID NO: 1881852 - protein, 18 aa, Staphylococcus
LYRIFHSKGLYIYLIVCN

SEQ ID NO: 1881853 - protein, 23 aa, Staphylococcus
LYRRDCKIHGAFKFNGEGISRKL

SEQ ID NO: 1881854 - protein, 28 aa, Staphylococcus
LYRVYKIIKLAVVFLIELIKANIDVLKI

SEQ ID NO: 1881855 - protein, 24 aa, Staphylococcus
LYSHFSRTYLRIMKDVYLNNPLTK

SEQ ID NO: 1881856 - protein, 24 aa, Staphylococcus
LYSNRTEIIIGYMIAIIALILIIM

SEQ ID NO: 1881857 - protein, 24 aa, Staphylococcus
LYSSFIIAVVISFVGGRPAMISAA

SEQ ID NO: 1881858 - protein, 18 aa, Staphylococcus
LYTIAGWDVYITEIVIAT

SEQ ID NO: 1881859 - protein, 24 aa, Staphylococcus
LYTIRILPVGGYVRMAGDGLEEPP

SEQ ID NO: 1881860 - protein, 25 aa, Staphylococcus
LYTWDRFKGKWTHFLISIPVILGGS

SEQ ID NO: 1881861 - protein, 25 aa, Staphylococcus
LYTWDRFKNKWTHFIISIPVIIGGS

SEQ ID NO: 1881862 - protein, 26 aa, Staphylococcus
LYTWERFKNKWIHFVIGLPVIIGGSF

SEQ ID NO: 1881863 - protein, 25 aa, Staphylococcus
LYTWNRFKNQWIHFLISLPVIIGGS

SEQ ID NO: 1881864 - protein, 19 aa, Staphylococcus
LYVMFEIMLISSFVLLTLG

SEQ ID NO: 1881865 - protein, 17 aa, Staphylococcus
LYYKPFLLLLLFCNVLG

SEQ ID NO: 1881866 - protein, 19 aa, Staphylococcus
LYYLIMLIIVGIILATLYF

SEQ ID NO: 1881867 - protein, 35 aa, Staphylococcus
LYYNRYLKRHDEVIDARLGYYSVVKETNVQLLQPN

SEQ ID NO: 1881868 - protein, 17 aa, Staphylococcus
MAAGLVGGMLAISGDSG

SEQ ID NO: 1881869 - protein, 23 aa, Staphylococcus
MAAGNGKGGTNLVIKDANTDTVI

SEQ ID NO: 1881870 - protein, 17 aa, Staphylococcus
MAAIVCYLIIPKPGIAL

SEQ ID NO: 1881871 - protein, 39 aa, Staphylococcus
MADTVRKDFVSGFIAGAFIGSAVGFILNQVKKRKQQEKQ

SEQ ID NO: 1881872 - protein, 25 aa, Staphylococcus
MAEAFKSSFIDYGFHPWAVYGIVAL

SEQ ID NO: 1881873 - protein, 19 aa, Staphylococcus
MAETLGYKESNSFVTNTVI

SEQ ID NO: 1881874 - protein, 18 aa, Staphylococcus
MAFAIPINDVRKIAQQLE

SEQ ID NO: 1881875 - protein, 23 aa, Staphylococcus
MAFALQSAMMGRIFQTLGADPNN

SEQ ID NO: 1881876 - protein, 25 aa, Staphylococcus
MAFATSLTALFGFPADYIVTNEVVS

SEQ ID NO: 1881877 - protein, 35 aa, Staphylococcus
MAFFISRGFVKTGLGRRIALQFVKLFGKKTLGLGY

SEQ ID NO: 1881878 - protein, 36 aa, Staphylococcus
MAFFISRGFVKTGLGRRIALQFVRLFGKKTLGLAYS

SEQ ID NO: 1881879 - protein, 20 aa, Staphylococcus
MAFGSLFLVIWFPFNPYILF

SEQ ID NO: 1881880 - protein, 18 aa, Staphylococcus
MAGIIAAVALMFIYISLG

SEQ ID NO: 1881881 - protein, 25 aa, Staphylococcus
MAGIKGALIGTVWLMITIIPISIIL

SEQ ID NO: 1881882 - protein, 18 aa, Staphylococcus
MAGISYIFSTQLTKPLVT

SEQ ID NO: 1881883 - protein, 17 aa, Staphylococcus
MAGKYTPLVYLIAASFA

SEQ ID NO: 1881884 - protein, 24 aa, Staphylococcus
MAHCATRLRLVLKDESLVDEKVLN

SEQ ID NO: 1881885 - protein, 17 aa, Staphylococcus
MAIAAMVSFASSFINGT

SEQ ID NO: 1881886 - protein, 17 aa, Staphylococcus
MAIALTFVGGYIDAYTF

SEQ ID NO: 1881887 - protein, 25 aa, Staphylococcus
MAIAMDGGIEWYKVPGYIICQMLGG

SEQ ID NO: 1881888 - protein, 24 aa, Staphylococcus
MAIGALYLPVLFKIIKLQINLSQG

SEQ ID NO: 1881889 - protein, 19 aa, Staphylococcus
MAIILFIMIIFWLIQLSGF

SEQ ID NO: 1881890 - protein, 24 aa, Staphylococcus
MAIMIPLALMFGRIADKIGEKKVF

SEQ ID NO: 1881891 - protein, 23 aa, Staphylococcus
MAKKPFRLTIILLLVTILVNMGE

SEQ ID NO: 1881892 - protein, 17 aa, Staphylococcus
MALADFIGSIVIHPIQI

SEQ ID NO: 1881893 - protein, 20 aa, Staphylococcus
MALIMSCHLAPFLYVVLKKV

SEQ ID NO: 1881894 - protein, 17 aa, Staphylococcus
MALSLPLYTVFYSYNID

SEQ ID NO: 1881895 - protein, 17 aa, Staphylococcus
MALSLTLLLLIIAFTLI

SEQ ID NO: 1881896 - protein, 19 aa, Staphylococcus
MALSYSLYTLQFIRLHRRV

SEQ ID NO: 1881897 - protein, 18 aa, Staphylococcus
MAPKEIKATIAKDAMLNG

SEQ ID NO: 1881898 - protein, 19 aa, Staphylococcus
MARLLLKTNAKIWMLDEPT

SEQ ID NO: 1881899 - protein, 23 aa, Staphylococcus
MASELPLLLLVMSIAIAVSYQWK

SEQ ID NO: 1881900 - protein, 25 aa, Staphylococcus
MASMLGCLPVLIQMPIVMGLYFVLR

SEQ ID NO: 1881901 - protein, 17 aa, Staphylococcus
MATIGGIVVLITIGVSF

SEQ ID NO: 1881902 - protein, 28 aa, Staphylococcus
MATTSFILAFPMAWIWPSIQTGLNAFSE

SEQ ID NO: 1881903 - protein, 25 aa, Staphylococcus
MATWVEPFGGIGHRKETHFPQDWTI

SEQ ID NO: 1881904 - protein, 20 aa, Staphylococcus
MAVPVSGWLMNRFNSKAVFI

SEQ ID NO: 1881905 - protein, 17 aa, Staphylococcus
MAVSVALFFLNLAFAET

SEQ ID NO: 1881906 - protein, 19 aa, Staphylococcus
MAVWLYKIATKSGQFAIVQ

SEQ ID NO: 1881907 - protein, 20 aa, Staphylococcus
MAYGVSILGHIDFKHQNNLL

SEQ ID NO: 1881908 - protein, 17 aa, Staphylococcus
MAYVILGVFALIFILLF

SEQ ID NO: 1881909 - protein, 23 aa, Staphylococcus
MCGTIVCFLLMFIFLKFLNLSVY

SEQ ID NO: 1881910 - protein, 17 aa, Staphylococcus
MCIFMTIGGFFLIFETI

SEQ ID NO: 1881911 - protein, 20 aa, Staphylococcus
MCIPLAWFMGMEDFFVKPLM

SEQ ID NO: 1881912 - protein, 17 aa, Staphylococcus
MCIPLGIILYYTYLKTK

SEQ ID NO: 1881913 - protein, 19 aa, Staphylococcus
MCLHFEFSGNPVLQHLGIT

SEQ ID NO: 1881914 - protein, 20 aa, Staphylococcus
MCLISIIPIAIVLLVLKYIG

SEQ ID NO: 1881915 - protein, 18 aa, Staphylococcus
MCLNINWINPFIIVGILG

SEQ ID NO: 1881916 - protein, 31 aa, Staphylococcus
MDALGGLFNFFTWGAFIPLILAIIGGILINK

SEQ ID NO: 1881917 - protein, 20 aa, Staphylococcus
MDASLGGPVLKISADNYNAL

SEQ ID NO: 1881918 - protein, 31 aa, Staphylococcus
MDEHKSVKFRFWKFVVLQLVIILATIAITVC

SEQ ID NO: 1881919 - protein, 17 aa, Staphylococcus
MDFVIGIALAIVILIIF

SEQ ID NO: 1881920 - protein, 19 aa, Staphylococcus
MDIQRSFMVFTMASILTFT

SEQ ID NO: 1881921 - protein, 17 aa, Staphylococcus
MDKGEIDKALANVNQAL

SEQ ID NO: 1881922 - protein, 34 aa, Staphylococcus
MDKVKDFLKLHWLKIVIVVAIILIVILISAIIST

SEQ ID NO: 1881923 - protein, 24 aa, Staphylococcus
MDLNRTGFWLKIPGKEGTVDKTYA

SEQ ID NO: 1881924 - protein, 19 aa, Staphylococcus
MDNVEGMAFAIPINDAQKI

SEQ ID NO: 1881925 - protein, 23 aa, Staphylococcus
MDNVKSIVFWLFLLSSYLSAHYS

SEQ ID NO: 1881926 - protein, 18 aa, Staphylococcus
MDRFHTRSLYIFSMSAFL

SEQ ID NO: 1881927 - protein, 17 aa, Staphylococcus
MDSSEFINSNQSNKESN

SEQ ID NO: 1881928 - protein, 22 aa, Staphylococcus
MEDRTTVVIAHRLSTIMKADQI

SEQ ID NO: 1881929 - protein, 25 aa, Staphylococcus
MEGKETRFGIGLSALFTTITTAFTT

SEQ ID NO: 1881930 - protein, 26 aa, Staphylococcus
MEGKETRFGVGLSALFTTITTAFTTG

SEQ ID NO: 1881931 - protein, 19 aa, Staphylococcus
MEGRTTVVIAHRLSTIKKA

SEQ ID NO: 1881932 - protein, 22 aa, Staphylococcus
MEGYKFAFLFIGIFLAPMICQL

SEQ ID NO: 1881933 - protein, 26 aa, Staphylococcus
MEKKHFRMIMLIEMVYQYVLIALISI

SEQ ID NO: 1881934 - protein, 24 aa, Staphylococcus
MEKSWYWIVSIAMIIAMSMSGHAW

SEQ ID NO: 1881935 - protein, 20 aa, Staphylococcus
MELNEPIIIGLNMVDVATQR

SEQ ID NO: 1881936 - protein, 20 aa, Staphylococcus
MEMIKWIKSAVILWIGASLL

SEQ ID NO: 1881937 - protein, 20 aa, Staphylococcus
MEMKEALIEAGGTRIRPILM

SEQ ID NO: 1881938 - protein, 17 aa, Staphylococcus
MENRISVQFTKDKTLKE

SEQ ID NO: 1881939 - protein, 21 aa, Staphylococcus
MEPKLRYSAIEKGDINLIDAY

SEQ ID NO: 1881940 - protein, 20 aa, Staphylococcus
MEPMIHDFAPFKIVGLTICL

SEQ ID NO: 1881941 - protein, 19 aa, Staphylococcus
MEPMSAKKQIGFALSVSLL

SEQ ID NO: 1881942 - protein, 22 aa, Staphylococcus
MEQASAKLLDWAKNSQVAQKFF

SEQ ID NO: 1881943 - protein, 21 aa, Staphylococcus
MERHKIKPIKLFDKPQYRKSY

SEQ ID NO: 1881944 - protein, 25 aa, Staphylococcus
MERRSAGSIWAWLLVLVLIPILGFI

SEQ ID NO: 1881945 - protein, 30 aa, Staphylococcus
MERRSANSIWAWLLVLVFLPLLGFILYLLF

SEQ ID NO: 1881946 - protein, 27 aa, Staphylococcus
MERRTANSIWAWLLVLVFLPLIGFILY

SEQ ID NO: 1881947 - protein, 26 aa, Staphylococcus
MERYNIPRLLAIAIVFLVIIGGATLI

SEQ ID NO: 1881948 - protein, 26 aa, Staphylococcus
MERYNIPRLLGIIIVFLAIVGGATLI

SEQ ID NO: 1881949 - protein, 26 aa, Staphylococcus
MERYNIPRLLGIVIVFLAIVGLIALI

SEQ ID NO: 1881950 - protein, 19 aa, Staphylococcus
MFAEFGRGITLLGNKQVTI

SEQ ID NO: 1881951 - protein, 20 aa, Staphylococcus
MFALPVWGAYHFSAWLQTAY

SEQ ID NO: 1881952 - protein, 25 aa, Staphylococcus
MFALQRLTGIIAFVFIFVHLWQTRL

SEQ ID NO: 1881953 - protein, 34 aa, Staphylococcus; identical to SEQ ID NO: 1737346

SEQ ID NO: 1881954 - protein, 19 aa, Staphylococcus
MFFEVGLIMLLPLIFTIAK

SEQ ID NO: 1881955 - protein, 26 aa, Staphylococcus
MFFFQRISGILAFIFIAMHLWQTRLQ

SEQ ID NO: 1881956 - protein, 26 aa, Staphylococcus
MFFFQRVSGILAFIFIAMHLWQTRLQ

SEQ ID NO: 1881957 - protein, 21 aa, Staphylococcus
MFFLLAFCMIVPWRIAMLYKF

SEQ ID NO: 1881958 - protein, 21 aa, Staphylococcus
MFFLLAFCMIVPWRLAMFYKY

SEQ ID NO: 1881959 - protein, 21 aa, Staphylococcus
MFFLLAFCMIVPWRLAMYYKY

SEQ ID NO: 1881960 - protein, 17 aa, Staphylococcus
MFFNNLFFWCANQMIVQ

SEQ ID NO: 1881961 - protein, 23 aa, Staphylococcus
MFGEIWPLISVVLGIIILLGLII

SEQ ID NO: 1881962 - protein, 22 aa, Staphylococcus
MFGPIIASIICIRVFKMDIQWP

SEQ ID NO: 1881963 - protein, 25 aa, Staphylococcus
MFIFKRKFTKEQRGSIVPNYVMGLS

SEQ ID NO: 1881964 - protein, 18 aa, Staphylococcus
MFIFSWFMPTYVAILLSA

SEQ ID NO: 1881965 - protein, 19 aa, Staphylococcus
MFINKIINRHEMAAKDVTF

SEQ ID NO: 1881966 - protein, 19 aa, Staphylococcus
MFINKIINRHEMSAKDTTF

SEQ ID NO: 1881967 - protein, 22 aa, Staphylococcus
MFLAKIKLWFLIKGLTPIFIFT

SEQ ID NO: 1881968 - protein, 17 aa, Staphylococcus
MFLNIALSLESYSTHPI

SEQ ID NO: 1881969 - protein, 22 aa, Staphylococcus
MFMLLCKSPELKAVGKASFIPT

SEQ ID NO: 1881970 - protein, 19 aa, Staphylococcus
MFMLWFGVAILLNYPNLSI

SEQ ID NO: 1881971 - protein, 21 aa, Staphylococcus
MFMVSLLFFKLLTEFMNIMVH

SEQ ID NO: 1881972 - protein, 19 aa, Staphylococcus
MFNSSFIVRAFHVVATAGM

SEQ ID NO: 1881973 - protein, 20 aa, Staphylococcus
MFNSSFLVRAFHVVATAGMT

SEQ ID NO: 1881974 - protein, 21 aa, Staphylococcus
MFTAVCLLFSPLILISYSIIN

SEQ ID NO: 1881975 - protein, 22 aa, Staphylococcus
MFTFSISILYIVYLFINILISG

SEQ ID NO: 1881976 - protein, 18 aa, Staphylococcus
MFVALSFVLSIFFSLIRT

SEQ ID NO: 1881977 - protein, 33 aa, Staphylococcus; identical to SEQ ID NO: 1743632

SEQ ID NO: 1881978 - protein, 32 aa, Staphylococcus
MGAGETLWRMAFGFGACIALVLYIMRLKYLQE

SEQ ID NO: 1881979 - protein, 19 aa, Staphylococcus
MGAISFSIYFFVKDILLFI

SEQ ID NO: 1881980 - protein, 23 aa, Staphylococcus
MGALYGPIAFIWIVVGCIFAGAV

SEQ ID NO: 1881981 - protein, 23 aa, Staphylococcus
MGALYGPVAFIWIVVGCIFAGAV

SEQ ID NO: 1881982 - protein, 22 aa, Staphylococcus
MGASPFQIIRYFLMPEALGSLI

SEQ ID NO: 1881983 - protein, 34 aa, Staphylococcus
MGASPLQIIRHFLLPEALGSLVLAITTAIIGLIG

SEQ ID NO: 1881984 - protein, 17 aa, Staphylococcus
MGATLGGAFGIAFNTTI

SEQ ID NO: 1881985 - protein, 18 aa, Staphylococcus
MGDAHLAPMLKMASLSYL

SEQ ID NO: 1881986 - protein, 18 aa, Staphylococcus
MGEKALIVKQFFEQFNDV

SEQ ID NO: 1881987 - protein, 18 aa, Staphylococcus
MGFILSGFYVYSKRIAVP

SEQ ID NO: 1881988 - protein, 24 aa, Staphylococcus
MGFVLRMFLARDAYFKELEQSYGH

SEQ ID NO: 1881989 - protein, 26 aa, Staphylococcus
MGGAVGASFKWYDFVYFIDTIIYLII

SEQ ID NO: 1881990 - protein, 27 aa, Staphylococcus
MGGAVGASFKWYDFVYFIDTIVYLFIL

SEQ ID NO: 1881991 - protein, 17 aa, Staphylococcus
MGGLAAGIFIIGMLFGR

SEQ ID NO: 1881992 - protein, 20 aa, Staphylococcus
MGGLTFLISIIITSIIAIFF

SEQ ID NO: 1881993 - protein, 20 aa, Staphylococcus
MGGLTFLISIIITSIIAIIF

SEQ ID NO: 1881994 - protein, 20 aa, Staphylococcus
MGGLTFLISIIITSILAIIF

SEQ ID NO: 1881995 - protein, 20 aa, Staphylococcus
MGGLTFLISIIITSLIAIFF

SEQ ID NO: 1881996 - protein, 20 aa, Staphylococcus
MGGLTFLISIIITSMIAIFF

SEQ ID NO: 1881997 - protein, 20 aa, Staphylococcus
MGGLTFLISIIITSVVAIIF

SEQ ID NO: 1881998 - protein, 20 aa, Staphylococcus
MGGLTFLISIIITTIIAIIF

SEQ ID NO: 1881999 - protein, 19 aa, Staphylococcus
MGGPINKVAFLFGSALIAE

SEQ ID NO: 1882000 - protein, 17 aa, Staphylococcus
MGGPVNKVAFLFGSALI

SEQ ID NO: 1882001 - protein, 18 aa, Staphylococcus
MGHEEVKKDMDFWTWMML

SEQ ID NO: 1882002 - protein, 24 aa, Staphylococcus
MGIALGFGVLFDAFVVRLLLIPAL

SEQ ID NO: 1882003 - protein, 24 aa, Staphylococcus
MGIALGFGVLFDAFVVRMTLIPAL

SEQ ID NO: 1882004 - protein, 18 aa, Staphylococcus
MGIPWKVGLTGVLFSGIF

SEQ ID NO: 1882005 - protein, 18 aa, Staphylococcus
MGIPWKVGLTGVLFSGVF

SEQ ID NO: 1882006 - protein, 20 aa, Staphylococcus
MGKASFTMGLFGITEGAIPF

SEQ ID NO: 1882007 - protein, 17 aa, Staphylococcus
MGLALVIAFILGLLLLI

SEQ ID NO: 1882008 - protein, 20 aa, Staphylococcus
MGLKELPIIATIALITLFNI

SEQ ID NO: 1882009 - protein, 25 aa, Staphylococcus
MGLSDHFLIWSVLRIIGGITSGTIF

SEQ ID NO: 1882010 - protein, 24 aa, Staphylococcus
MGMALSFGVLFDAFVVRMMIIPAL

SEQ ID NO: 1882011 - protein, 21 aa, Staphylococcus
MGNPLGLEFANSVTSGIISAN

SEQ ID NO: 1882012 - protein, 21 aa, Staphylococcus
MGNPLGLEFANSVTSGIISAS

SEQ ID NO: 1882013 - protein, 37 aa, Staphylococcus
MGNTNWDFIMVWLPLHAKLALWSVMLTILCATITLVT

SEQ ID NO: 1882014 - protein, 18 aa, Staphylococcus
MGPALTAMGQRWEEVNAK

SEQ ID NO: 1882015 - protein, 17 aa, Staphylococcus
MGPHIAKSIIGPRHQLF

SEQ ID NO: 1882016 - protein, 21 aa, Staphylococcus
MGPLVGWLMKKTDEFIQPRTP

SEQ ID NO: 1882017 - protein, 21 aa, Staphylococcus
MGPLVGWLMKKTDEFVQPRTP

SEQ ID NO: 1882018 - protein, 20 aa, Staphylococcus
MGPLVGWLMKKTDEIIQPRT

SEQ ID NO: 1882019 - protein, 21 aa, Staphylococcus
MGPLVGWLMKKVDQFLQPRTP

SEQ ID NO: 1882020 - protein, 21 aa, Staphylococcus
MGPLVGWLMKKVDQFVQPRTP

SEQ ID NO: 1882021 - protein, 18 aa, Staphylococcus
MGRINSWLNPYAYSNGDG

SEQ ID NO: 1882022 - protein, 28 aa, Staphylococcus
MGSIKTLDFVIGIILAIVILRYLHCYSK

SEQ ID NO: 1882023 - protein, 27 aa, Staphylococcus
MGSLITSVILFFAFRTSNLVSRKNRLI

SEQ ID NO: 1882024 - protein, 22 aa, Staphylococcus
MGSRIPKGVLLVGPPGTGKTLL

SEQ ID NO: 1882025 - protein, 24 aa, Staphylococcus
MGSSLKGTYLWPILAISNICQGSA

SEQ ID NO: 1882026 - protein, 20 aa, Staphylococcus
MGSYASSYVDLIDRVPPEKP

SEQ ID NO: 1882027 - protein, 27 aa, Staphylococcus
MGVNLPFQFTFPGSEWVVLILSTILFF

SEQ ID NO: 1882028 - protein, 18 aa, Staphylococcus
MGVRCLWSRPLKVKIQEL

SEQ ID NO: 1882029 - protein, 18 aa, Staphylococcus
MGWDAGFILLTIVSILAM

SEQ ID NO: 1882030 - protein, 19 aa, Staphylococcus
MGYLSSLSIHFFKNNPLIK

SEQ ID NO: 1882031 - protein, 19 aa, Staphylococcus
MHFGHFEFNFIPHLILLYI

SEQ ID NO: 1882032 - protein, 24 aa, Staphylococcus
MHFLPWPTPGPIGIYMASNFSVLS

SEQ ID NO: 1882033 - protein, 28 aa, Staphylococcus
MHILLIGGSRLSWRIFNRTVNRRGRKSK

SEQ ID NO: 1882034 - protein, 20 aa, Staphylococcus
MHKESYRIVERDKDNDIYVL

SEQ ID NO: 1882035 - protein, 26 aa, Staphylococcus
MHLLGVKIGMTFSGGFIDYILYGLLN

SEQ ID NO: 1882036 - protein, 18 aa, Staphylococcus
MHLPSALTTTVSFVIAFI

SEQ ID NO: 1882037 - protein, 19 aa, Staphylococcus
MHLTIWQFILILLSVIIIT

SEQ ID NO: 1882038 - protein, 24 aa, Staphylococcus
MIARVGPIKVLRIILIINALALIL

SEQ ID NO: 1882039 - protein, 19 aa, Staphylococcus
MIASILITYYASIGIANLI

SEQ ID NO: 1882040 - protein, 39 aa, Staphylococcus; identical to SEQ ID NO: 1738320

SEQ ID NO: 1882041 - protein, 39 aa, Staphylococcus
MIAVCGLSLVGIDFLSVMGFASAISVLFAVLAALTLLPA

SEQ ID NO: 1882042 - protein, 17 aa, Staphylococcus
MICQLIWLITNIIVSKG

SEQ ID NO: 1882043 - protein, 26 aa, Staphylococcus
MIDEPLKFAGGLTKHSYFNQDGKVRI

SEQ ID NO: 1882044 - protein, 22 aa, Staphylococcus
MIELPLSLSVIIGGIRIALVVA

SEQ ID NO: 1882045 - protein, 26 aa, Staphylococcus
MIENTDCILIGPGLGCDFKGNNAITF

SEQ ID NO: 1882046 - protein, 19 aa, Staphylococcus
MIETFKVTIWYTAPTALRM

SEQ ID NO: 1882047 - protein, 20 aa, Staphylococcus
MIEYCMKKTTSLIGMLSGML

SEQ ID NO: 1882048 - protein, 30 aa, Staphylococcus
MIFIESFVKYCIISLLSIVGGYLFGALLFM

SEQ ID NO: 1882049 - protein, 17 aa, Staphylococcus
MIFIIDFQYSEYVILIV

SEQ ID NO: 1882050 - protein, 17 aa, Staphylococcus
MIFTMLLGGFFGLLNET

SEQ ID NO: 1882051 - protein, 17 aa, Staphylococcus
MIFYAFAVYFVVLIIAQ

SEQ ID NO: 1882052 - protein, 18 aa, Staphylococcus
MIGCFPVIIQIPILMGLY

SEQ ID NO: 1882053 - protein, 17 aa, Staphylococcus
MIGGAIAADGSFYGSAA

SEQ ID NO: 1882054 - protein, 17 aa, Staphylococcus
MIGGAIAADGSFYGSEA

SEQ ID NO: 1882055 - protein, 26 aa, Staphylococcus
MIGLLCALVIGWLGRYLRYFRNLTRD

SEQ ID NO: 1882056 - protein, 22 aa, Staphylococcus
MIGLSIFRFTPAHAESDSMSET

SEQ ID NO: 1882057 - protein, 19 aa, Staphylococcus
MIGNSIFNHFIPIIITLIL

SEQ ID NO: 1882058 - protein, 32 aa, Staphylococcus
MIGTYCLYLSLGVLLLDWLKRIPKMYYNPKYF

SEQ ID NO: 1882059 - protein, 21 aa, Staphylococcus
MIGVILMRFAATWFVDLLNKY

SEQ ID NO: 1882060 - protein, 30 aa, Staphylococcus
MIGVPFGSFLGGFANWRAVFGVMIGLAIIT

SEQ ID NO: 1882061 - protein, 34 aa, Staphylococcus
MIGVPFGSFLGGFANWRTVFGVMILLAIITMLGM

SEQ ID NO: 1882062 - protein, 18 aa, Staphylococcus
MIGVPLGERISHHQNSEN

SEQ ID NO: 1882063 - protein, 19 aa, Staphylococcus
MIHEHGWSGINFNSPFADM

SEQ ID NO: 1882064 - protein, 20 aa, Staphylococcus
MIHEHGWSGINFNSPFADMA

SEQ ID NO: 1882065 - protein, 18 aa, Staphylococcus
MIIGFRRGLWLNSLHLSS

SEQ ID NO: 1882066 - protein, 17 aa, Staphylococcus
MIIIAPLLFVCLTAFLY

SEQ ID NO: 1882067 - protein, 17 aa, Staphylococcus
MIILCLIIIDLLAKSWL

SEQ ID NO: 1882068 - protein, 18 aa, Staphylococcus
MIILPVFIPVVSGLIGLT

SEQ ID NO: 1882069 - protein, 25 aa, Staphylococcus
MIISCFGSLIGWQFTIAEVFRTSAV

SEQ ID NO: 1882070 - protein, 25 aa, Staphylococcus
MIISIIFAYMFKWFGLIDDVLLMVI

SEQ ID NO: 1882071 - protein, 17 aa, Staphylococcus
MIITMLFGGFFGLLNET

SEQ ID NO: 1882072 - protein, 17 aa, Staphylococcus
MIIVVAFVMFKANPPYA

SEQ ID NO: 1882073 - protein, 17 aa, Staphylococcus
MIIYLIVIFILMRIFGE

SEQ ID NO: 1882074 - protein, 26 aa, Staphylococcus
MIKAYKWRIIGFFAFLLIAILFLTLG

SEQ ID NO: 1882075 - protein, 27 aa, Staphylococcus
MIKGLALKIIFNFGLPLVVSLLHAFFA

SEQ ID NO: 1882076 - protein, 23 aa, Staphylococcus
MIKHHGLLYFVRFLFGVGEAPMY

SEQ ID NO: 1882077 - protein, 25 aa, Staphylococcus
MIKPHFPRRVKLGVAAFLTGVACIL

SEQ ID NO: 1882078 - protein, 18 aa, Staphylococcus
MIKRGYVTQRHIIVPFII

SEQ ID NO: 1882079 - protein, 27 aa, Staphylococcus
MIKSPHPSYPAGYGLSSRPTITRYFVQ

SEQ ID NO: 1882080 - protein, 20 aa, Staphylococcus
MILAGIMWALLAPIIAVGTV

SEQ ID NO: 1882081 - protein, 32 aa, Staphylococcus
MILCEMVGLLLLPRFIKWVGRTKAFNTAVSFI

SEQ ID NO: 1882082 - protein, 20 aa, Staphylococcus
MILFGFGALFYGLELMSGAV

SEQ ID NO: 1882083 - protein, 18 aa, Staphylococcus
MILGVWFTSYFIFIRPMK

SEQ ID NO: 1882084 - protein, 21 aa, Staphylococcus
MILIIPTWINLLLKTYAFIGL

SEQ ID NO: 1882085 - protein, 17 aa, Staphylococcus
MILILLIILLLPFKKQP

SEQ ID NO: 1882086 - protein, 17 aa, Staphylococcus
MILKRRIRTKVKTNAAS

SEQ ID NO: 1882087 - protein, 17 aa, Staphylococcus
MILLCILFIEKVLGYPI

SEQ ID NO: 1882088 - protein, 18 aa, Staphylococcus
MILLPVIIPVVSGFIGLI

SEQ ID NO: 1882089 - protein, 27 aa, Staphylococcus
MILRNKRWLPISISILIAFYVIYTIHP

SEQ ID NO: 1882090 - protein, 27 aa, Staphylococcus
MILTLCIVPWLSAKKARTLKRQVALHQ

SEQ ID NO: 1882091 - protein, 17 aa, Staphylococcus
MIMGPLVGWLMKKTDEF

SEQ ID NO: 1882092 - protein, 24 aa, Staphylococcus
MIMIIPTWINLLLKTYAFIGLLSH

SEQ ID NO: 1882093 - protein, 28 aa, Staphylococcus
MIMLGFLYKYIIAHLIQFYAINPLMMDL

SEQ ID NO: 1882094 - protein, 25 aa, Staphylococcus
MIMLGFLYKYIIAYFIQVYAVNPLQ

SEQ ID NO: 1882095 - protein, 24 aa, Staphylococcus
MIMLGFLYKYIIAYFVNQYGVMPL

SEQ ID NO: 1882096 - protein, 18 aa, Staphylococcus
MIMPVVYVIRLNIQDNIM

SEQ ID NO: 1882097 - protein, 18 aa, Staphylococcus
MIMTWMMGITFSHTLLLF

SEQ ID NO: 1882098 - protein, 26 aa, Staphylococcus
MINKKEFMSVSGIGRMGYNDEYLAGQ

SEQ ID NO: 1882099 - protein, 18 aa, Staphylococcus
MINLNFILFFSMILLGTC

SEQ ID NO: 1882100 - protein, 25 aa, Staphylococcus
MIPKEIYHNLLFNIIVSIVFTLVVG

SEQ ID NO: 1882101 - protein, 23 aa, Staphylococcus
MIPLAKVQVGQHFVVKPGEKIPV

SEQ ID NO: 1882102 - protein, 18 aa, Staphylococcus
MIPLVPAQPSVPVQPSVP

SEQ ID NO: 1882103 - protein, 23 aa, Staphylococcus
MIPPLAIATAMIFFKRKFTKEQR

SEQ ID NO: 1882104 - protein, 20 aa, Staphylococcus
MIRKDGMLLFNFDHGAVLQS

SEQ ID NO: 1882105 - protein, 24 aa, Staphylococcus
MIRTVIVCSLSFTTCMMLGTLTVI

SEQ ID NO: 1882106 - protein, 25 aa, Staphylococcus
MIRTVVLCSLAFAVCMILGTLTAAQ

SEQ ID NO: 1882107 - protein, 21 aa, Staphylococcus
MIRVQFAWKPKIGDLTVNIQD

SEQ ID NO: 1882108 - protein, 19 aa, Staphylococcus
MISEIKYAPLQNQQNRVLL

SEQ ID NO: 1882109 - protein, 20 aa, Staphylococcus
MISGALYERFGVKLLAFIGV

SEQ ID NO: 1882110 - protein, 24 aa, Staphylococcus
MISGFLFYICLPFQSILEKWGFPR

SEQ ID NO: 1882111 - protein, 18 aa, Staphylococcus
MISLFAWGLGYFGQPHII

SEQ ID NO: 1882112 - protein, 27 aa, Staphylococcus
MISSYHIFRIFFILFLIAPLINYFLKY

SEQ ID NO: 1882113 - protein, 26 aa, Staphylococcus
MISSYHIFRIFFILFLVAPVINYFLK

SEQ ID NO: 1882114 - protein, 17 aa, Staphylococcus
MITHWILFFLMVFFLFI

SEQ ID NO: 1882115 - protein, 20 aa, Staphylococcus
MIVFTYKWAFMFTTIHEQTF

SEQ ID NO: 1882116 - protein, 17 aa, Staphylococcus
MIVPQLLRRFYWQYELG

SEQ ID NO: 1882117 - protein, 24 aa, Staphylococcus
MIWSAPFFKNLFLPNGKLSSLVLN

SEQ ID NO: 1882118 - protein, 22 aa, Staphylococcus
MIWSASFFKALFVPGGALESFV

SEQ ID NO: 1882119 - protein, 24 aa, Staphylococcus
MIYIVCLMFIFLLMFNGTQFKITG

SEQ ID NO: 1882120 - protein, 18 aa, Staphylococcus
MIYLGMTIFSLSIVYILY

SEQ ID NO: 1882121 - protein, 18 aa, Staphylococcus
MIYYRKPRDYKRESYTDN

SEQ ID NO: 1882122 - protein, 19 aa, Staphylococcus
MKAILAYYLYYAVTDGGFG

SEQ ID NO: 1882123 - protein, 19 aa, Staphylococcus
MKAILAYYLYYSVSKGGFG

SEQ ID NO: 1882124 - protein, 20 aa, Staphylococcus
MKAILVYYLYYSVAKGGFGL

SEQ ID NO: 1882125 - protein, 17 aa, Staphylococcus
MKALKDIVNNDVPNSEN

SEQ ID NO: 1882126 - protein, 19 aa, Staphylococcus
MKDFHIEYSQVQWLTTAFL

SEQ ID NO: 1882127 - protein, 18 aa, Staphylococcus
MKDHHKAKVYGSKTFGKG

SEQ ID NO: 1882128 - protein, 25 aa, Staphylococcus
MKDVELPLALPLILGGIRLSSVYVI

SEQ ID NO: 1882129 - protein, 24 aa, Staphylococcus
MKDVQMPLALPMIISGIRLSSVYV

SEQ ID NO: 1882130 - protein, 21 aa, Staphylococcus
MKEDLSSVLVSSRANEKKHSI

SEQ ID NO: 1882131 - protein, 19 aa, Staphylococcus
MKETIKIIISLIVAGSVMM

SEQ ID NO: 1882132 - protein, 18 aa, Staphylococcus
MKFAHIMTPEMIQSLTAL

SEQ ID NO: 1882133 - protein, 17 aa, Staphylococcus
MKFAIGAIIAGLSYLIM

SEQ ID NO: 1882134 - protein, 20 aa, Staphylococcus
MKFMEWRVAIQTEEHDYVGR

SEQ ID NO: 1882135 - protein, 19 aa, Staphylococcus
MKGVLGFHFDHPNRVALFI

SEQ ID NO: 1882136 - protein, 20 aa, Staphylococcus
MKHLLQWLGNDVFNNDYGLA

SEQ ID NO: 1882137 - protein, 19 aa, Staphylococcus
MKIGLTALGYKVNNESNQF

SEQ ID NO: 1882138 - protein, 34 aa, Staphylococcus
MKILKSAFLSGLMLEFISLLGIGLVALEAALSLV

SEQ ID NO: 1882139 - protein, 24 aa, Staphylococcus
MKILKSEILLAFSTSSSEAVLPVM

SEQ ID NO: 1882140 - protein, 25 aa, Staphylococcus
MKILKSELLLAFSTSSSEAVLPVIM

SEQ ID NO: 1882141 - protein, 21 aa, Staphylococcus
MKKDFIANVSHELRTPISLLQ

SEQ ID NO: 1882142 - protein, 31 aa, Staphylococcus
MKKDFIANVSHELRTPISLLQGYTESIVDGI

SEQ ID NO: 1882143 - protein, 18 aa, Staphylococcus
MKLFVIAFTLGISLNNDT

SEQ ID NO: 1882144 - protein, 21 aa, Staphylococcus
MKLNPFWTILLCFIFLHEKVR

SEQ ID NO: 1882145 - protein, 21 aa, Staphylococcus
MKLNPFWTILLSLVFLHEKVR

SEQ ID NO: 1882146 - protein, 17 aa, Staphylococcus
MKLPKDKYLVLGDNRQN

SEQ ID NO: 1882147 - protein, 20 aa, Staphylococcus
MKLSIKLSNMNGMYNNAHGE

SEQ ID NO: 1882148 - protein, 38 aa, Staphylococcus
MKLSKFKPLSWIASIYIEFLRGTPLLVQVFIVFFGTTA

SEQ ID NO: 1882149 - protein, 31 aa, Staphylococcus
MKLSSFKPLKWLATVYIEFIRGTPLLVQVFL

SEQ ID NO: 1882150 - protein, 19 aa, Staphylococcus
MKLYATLRGMFKANNKTLI

SEQ ID NO: 1882151 - protein, 20 aa, Staphylococcus
MKLYATLRGMFSIENQSLIK

SEQ ID NO: 1882152 - protein, 26 aa, Staphylococcus
MKMAMRFSIGLLILVCIWTFICSLFI

SEQ ID NO: 1882153 - protein, 28 aa, Staphylococcus
MKMLIIQTFCVLLGMWIYTIDKNESSAI

SEQ ID NO: 1882154 - protein, 32 aa, Staphylococcus
MKPGRRLTKVELPIAMPIIMAGIRTAMVLIIG

SEQ ID NO: 1882155 - protein, 23 aa, Staphylococcus
MKPTRFANQFLQVHIFRNKHFSN

SEQ ID NO: 1882156 - protein, 23 aa, Staphylococcus
MKQGETGRQIGWFISYDKDNPNM

SEQ ID NO: 1882157 - protein, 18 aa, Staphylococcus
MKRDILANRHQYGEAAGP

SEQ ID NO: 1882158 - protein, 25 aa, Staphylococcus
MKRFYREVNSATQIVHENIVEVYDV

SEQ ID NO: 1882159 - protein, 17 aa, Staphylococcus
MKRSNLIVITFIVVSTL

SEQ ID NO: 1882160 - protein, 17 aa, Staphylococcus
MKSDFIYSIQILISLLT

SEQ ID NO: 1882161 - protein, 19 aa, Staphylococcus
MKSNYSKYVDYFNTQLHKP

SEQ ID NO: 1882162 - protein, 26 aa, Staphylococcus
MKTSATLAWNAIKMAVLHPIQSLKLV

SEQ ID NO: 1882163 - protein, 23 aa, Staphylococcus
MKVHAHRLLPVLVAIFIVSNLVG

SEQ ID NO: 1882164 - protein, 24 aa, Staphylococcus
MKVTREGLALGIYIILTGSRSSAI

SEQ ID NO: 1882165 - protein, 18 aa, Staphylococcus
MLAGRILLESGAEGSRVE

SEQ ID NO: 1882166 - protein, 31 aa, Staphylococcus
MLAGSRLLYSFGRDGLLPSWLAKLNDKHLPN

SEQ ID NO: 1882167 - protein, 31 aa, Staphylococcus
MLAGSRLLYSFGRDGLLPSWLGKLNKKNLPN

SEQ ID NO: 1882168 - protein, 18 aa, Staphylococcus
MLAQRPFFQFSWTEYGLW

SEQ ID NO: 1882169 - protein, 27 aa, Staphylococcus
MLFHPYKAHYIFNMRIPFTPGLIPKRR

SEQ ID NO: 1882170 - protein, 20 aa, Staphylococcus
MLFIMDWKMTLLTFITIPIF

SEQ ID NO: 1882171 - protein, 17 aa, Staphylococcus
MLFNIFFGLCILSLILT

SEQ ID NO: 1882172 - protein, 17 aa, Staphylococcus
MLFPAITAIIVWAIYYR

SEQ ID NO: 1882173 - protein, 24 aa, Staphylococcus
MLFQMMFCTIAISILSGSIAERMR

SEQ ID NO: 1882174 - protein, 17 aa, Staphylococcus
MLFVMDWQMTLLTFITI

SEQ ID NO: 1882175 - protein, 24 aa, Staphylococcus
MLGCLPILIQMPIIMGLFFVLKYP

SEQ ID NO: 1882176 - protein, 30 aa, Staphylococcus
MLGCLPILIQMPILFGLYVSLKWPSHGGIT

SEQ ID NO: 1882177 - protein, 24 aa, Staphylococcus
MLGPIFRPVMRPLFTLPGRSTVDN

SEQ ID NO: 1882178 - protein, 20 aa, Staphylococcus
MLIADWIGSVLIHPVQIPAS

SEQ ID NO: 1882179 - protein, 24 aa, Staphylococcus
MLIIFKIGTYIPAPGVNPEPFAHQ

SEQ ID NO: 1882180 - protein, 23 aa, Staphylococcus
MLIKLAQHYRAHIITTDFNLNKV

SEQ ID NO: 1882181 - protein, 18 aa, Staphylococcus
MLIPEILNDLGMTPPPIY

SEQ ID NO: 1882182 - protein, 19 aa, Staphylococcus
MLIPNFFSLFASIIVLWLY

SEQ ID NO: 1882183 - protein, 17 aa, Staphylococcus
MLIPSFKNMVLVVFCYL

SEQ ID NO: 1882184 - protein, 19 aa, Staphylococcus
MLIQGVTFIMLFSYISASP

SEQ ID NO: 1882185 - protein, 17 aa, Staphylococcus
MLISYGVLYGYVQWLEE

SEQ ID NO: 1882186 - protein, 17 aa, Staphylococcus
MLITRPYIGKMIDQIGA

SEQ ID NO: 1882187 - protein, 17 aa, Staphylococcus
MLKDYKDILPMKHEYPK

SEQ ID NO: 1882188 - protein, 27 aa, Staphylococcus
MLKGLTLKIIFNFGLPLIIALLHALFA

SEQ ID NO: 1882189 - protein, 23 aa, Staphylococcus
MLKGTFKAYGSAYGHGVSGVNMG

SEQ ID NO: 1882190 - protein, 24 aa, Staphylococcus
MLKRCKIEALFFVLVMGLSSILNP

SEQ ID NO: 1882191 - protein, 21 aa, Staphylococcus
MLLPFLCALILVFIKNKNQTS

SEQ ID NO: 1882192 - protein, 18 aa, Staphylococcus
MLLPGISGSFMLLVFGAY

SEQ ID NO: 1882193 - protein, 24 aa, Staphylococcus
MLLVRRPKNQYAYNSGTTTDIPPE

SEQ ID NO: 1882194 - protein, 29 aa, Staphylococcus
MLMGYRRGWWLNCLHVMTTMVALWIAHNN

SEQ ID NO: 1882195 - protein, 19 aa, Staphylococcus
MLNGLRLIHKDDIVLPGEH

SEQ ID NO: 1882196 - protein, 18 aa, Staphylococcus
MLNSFLLFNIFLRSLHRD

SEQ ID NO: 1882197 - protein, 22 aa, Staphylococcus
MLNSFRTIWTIIKNVVVGIVRG

SEQ ID NO: 1882198 - protein, 21 aa, Staphylococcus
MLNVLKIEGDFSLEEIQENND

SEQ ID NO: 1882199 - protein, 19 aa, Staphylococcus
MLPELFPMRARGAATGISA

SEQ ID NO: 1882200 - protein, 22 aa, Staphylococcus
MLPKARRLGISWMTVGLLGAVG

SEQ ID NO: 1882201 - protein, 24 aa, Staphylococcus
MLPKFYQRYIVDWNPFVHYATSLK

SEQ ID NO: 1882202 - protein, 18 aa, Staphylococcus
MLQPDGITAYEYNGETYL

SEQ ID NO: 1882203 - protein, 25 aa, Staphylococcus
MLRTVIICTLSFTICMMLGTLTVNQ

SEQ ID NO: 1882204 - protein, 22 aa, Staphylococcus
MLSLPSLGWIDLRRKLRDSLTS

SEQ ID NO: 1882205 - protein, 20 aa, Staphylococcus
MLTIALVWWSAFTILTGVVK

SEQ ID NO: 1882206 - protein, 20 aa, Staphylococcus
MLTMPYVFVSWLILLMSFQF

SEQ ID NO: 1882207 - protein, 22 aa, Staphylococcus
MLVAAFIVGIALFFEVGLVLLI

SEQ ID NO: 1882208 - protein, 18 aa, Staphylococcus
MLVESEVDFASNRNLVIA

SEQ ID NO: 1882209 - protein, 19 aa, Staphylococcus
MLVHLFGIQIPSIFMNPWF

SEQ ID NO: 1882210 - protein, 24 aa, Staphylococcus
MLVIFKIGTYIPAPGVNPAAFDNN

SEQ ID NO: 1882211 - protein, 24 aa, Staphylococcus
MLVIFKIGTYIPAPGVNPAAFDSQ

SEQ ID NO: 1882212 - protein, 23 aa, Staphylococcus
MLVIFKIGTYIPAPGVNPEAFNH

SEQ ID NO: 1882213 - protein, 23 aa, Staphylococcus
MLVIFKIGTYIPAPGVNPEPFEQ

SEQ ID NO: 1882214 - protein, 24 aa, Staphylococcus
MLVIFKIGTYIPAPGVNPEPFEQQ

SEQ ID NO: 1882215 - protein, 23 aa, Staphylococcus
MLVIFKIGTYIPAPGVNPNAFDQ

SEQ ID NO: 1882216 - protein, 18 aa, Staphylococcus
MLVLMVIMGIIFITTMIV

SEQ ID NO: 1882217 - protein, 19 aa, Staphylococcus
MLVTYLFSMRIVKHRVNSS

SEQ ID NO: 1882218 - protein, 27 aa, Staphylococcus
MMAGLMGRWFDKLCMFVADLLLAIPSF

SEQ ID NO: 1882219 - protein, 39 aa, Staphylococcus
MMAVCGLSLVGIDFLAIMGFASAISVLFAVLAALTLLPA

SEQ ID NO: 1882220 - protein, 19 aa, Staphylococcus
MMFGVSIFAFMGYEHVVYN

SEQ ID NO: 1882221 - protein, 27 aa, Staphylococcus
MMFILDVRLAFMAMFFMPIIILVLALY

SEQ ID NO: 1882222 - protein, 19 aa, Staphylococcus
MMFQFILAILLIFIVAHFM

SEQ ID NO: 1882223 - protein, 17 aa, Staphylococcus
MMFVGMIVLLCFGLIFL

SEQ ID NO: 1882224 - protein, 21 aa, Staphylococcus
MMGSMLLKVGQFKTSIARGLT

SEQ ID NO: 1882225 - protein, 29 aa, Staphylococcus
MMGVNLPFQFTFPGSEWVVLILGTILFFY

SEQ ID NO: 1882226 - protein, 25 aa, Staphylococcus
MMIAEGIIAMIWAAAGMSLFHGYEG

SEQ ID NO: 1882227 - protein, 25 aa, Staphylococcus
MMIAEGIIAMIWAAAGMSLFNGYNG

SEQ ID NO: 1882228 - protein, 17 aa, Staphylococcus
MMILPCIVIAVIVTIFM

SEQ ID NO: 1882229 - protein, 24 aa, Staphylococcus
MMILTPFWYVFTIIYVLFILFIIW

SEQ ID NO: 1882230 - protein, 26 aa, Staphylococcus
MMIPNLFSLLASIVVLWLYFRKSIPK

SEQ ID NO: 1882231 - protein, 17 aa, Staphylococcus
MMITMLLGGFFGLLNET

SEQ ID NO: 1882232 - protein, 17 aa, Staphylococcus
MMKIEFYQNLLVNLLII

SEQ ID NO: 1882233 - protein, 17 aa, Staphylococcus
MMKIILVAIAFFVVPFI

SEQ ID NO: 1882234 - protein, 17 aa, Staphylococcus
MMLLTLVLIVVPVIFII

SEQ ID NO: 1882235 - protein, 20 aa, Staphylococcus
MMLMPKIGVITWKGVEKKIP

SEQ ID NO: 1882236 - protein, 18 aa, Staphylococcus
MMMLSGFFLGVGGAIFSV

SEQ ID NO: 1882237 - protein, 23 aa, Staphylococcus
MMPHYLKARFSTLMNPFSSEAGT

SEQ ID NO: 1882238 - protein, 17 aa, Staphylococcus
MMSGLIGAILILFSDGL

SEQ ID NO: 1882239 - protein, 19 aa, Staphylococcus
MMSGLIGAILLTFGDGLAR

SEQ ID NO: 1882240 - protein, 19 aa, Staphylococcus
MMSVWEMLPFLIMALGSTV

SEQ ID NO: 1882241 - protein, 17 aa, Staphylococcus
MMTEGFVAANYAFAVIF

SEQ ID NO: 1882242 - protein, 19 aa, Staphylococcus
MMTLVALGISVAYIYSLYA

SEQ ID NO: 1882243 - protein, 24 aa, Staphylococcus
MMVGGITWRILAPIFIAAIVGGAS

SEQ ID NO: 1882244 - protein, 25 aa, Staphylococcus
MMWGIGGLIGSFSIGFIIDRFKFTN

SEQ ID NO: 1882245 - protein, 17 aa, Staphylococcus
MNAVLAIFYFIVWLGIG

SEQ ID NO: 1882246 - protein, 19 aa, Staphylococcus
MNDRIKSLILVLISVALVA

SEQ ID NO: 1882247 - protein, 17 aa, Staphylococcus
MNELPLGYFQKRQSGKL

SEQ ID NO: 1882248 - protein, 19 aa, Staphylococcus
MNGNTLLSIGSWFFSIMGL

SEQ ID NO: 1882249 - protein, 22 aa, Staphylococcus
MNGSARMIIRIFGIDPDENNDA

SEQ ID NO: 1882250 - protein, 26 aa, Staphylococcus
MNIKESIHLSFSFKAFIATILMLFLA

SEQ ID NO: 1882251 - protein, 27 aa, Staphylococcus
MNIWLDCITIIIALSIMFFLDVKLTLA

SEQ ID NO: 1882252 - protein, 26 aa, Staphylococcus
MNIWLDCITIIIALTIMFFLDVKLTF

SEQ ID NO: 1882253 - protein, 25 aa, Staphylococcus
MNLDDAMKALKDSLINNAAPVQASS

SEQ ID NO: 1882254 - protein, 24 aa, Staphylococcus
MNLLLKCVLTLIFIVFSGITVPTI

SEQ ID NO: 1882255 - protein, 17 aa, Staphylococcus
MNLPLKIFLWMFGILVL

SEQ ID NO: 1882256 - protein, 17 aa, Staphylococcus
MNLRTVMITGDNHSTAQ

SEQ ID NO: 1882257 - protein, 24 aa, Staphylococcus
MNMLPWGGPAARAISSLQVTTEEV

SEQ ID NO: 1882258 - protein, 17 aa, Staphylococcus
MNMLSLFIFGKIVESIV

SEQ ID NO: 1882259 - protein, 17 aa, Staphylococcus
MNMLSLFIFGKIVETIV

SEQ ID NO: 1882260 - protein, 20 aa, Staphylococcus
MNMTPWGGPTARAISSLQLT

SEQ ID NO: 1882261 - protein, 18 aa, Staphylococcus
MNMVPWGGPMARVATVLK

SEQ ID NO: 1882262 - protein, 23 aa, Staphylococcus
MNNSRARLSFNIDNGKATSYKQT

SEQ ID NO: 1882263 - protein, 24 aa, Staphylococcus
MNPLQRFVKMLSDIFVPIIPAIVA

SEQ ID NO: 1882264 - protein, 20 aa, Staphylococcus
MNRKERFAKKIEVFTKNAGH

SEQ ID NO: 1882265 - protein, 18 aa, Staphylococcus
MNRRIEVSLIGKNQLTIP

SEQ ID NO: 1882266 - protein, 22 aa, Staphylococcus
MNRYLGIPIFLVIMWLIFQTTF

SEQ ID NO: 1882267 - protein, 20 aa, Staphylococcus
MNSDIHRSRMLNKKYNEMGG

SEQ ID NO: 1882268 - protein, 22 aa, Staphylococcus
MNSDMHRSRMLNTKYEEMGGEV

SEQ ID NO: 1882269 - protein, 28 aa, Staphylococcus
MNSNFWIYWKTMFAFEPWHSAMEMRRYL

SEQ ID NO: 1882270 - protein, 18 aa, Staphylococcus
MNSSSFWLIFSGAVTAVP

SEQ ID NO: 1882271 - protein, 26 aa, Staphylococcus
MNTMRYCVIMGIAIFIALMFDFDKAY

SEQ ID NO: 1882272 - protein, 19 aa, Staphylococcus
MNVLSWKLVIFSLVMIVLV

SEQ ID NO: 1882273 - protein, 24 aa, Staphylococcus
MNVRAKRLLPILVAIFIGSNVVGM

SEQ ID NO: 1882274 - protein, 36 aa, Staphylococcus
MPAFKLPFYPIMPIIIFVCVFAVFWGLSGQAKLYTL

SEQ ID NO: 1882275 - protein, 25 aa, Staphylococcus
MPAFKMPFYPVMPIITFVSVVVVFW

SEQ ID NO: 1882276 - protein, 18 aa, Staphylococcus
MPAKEVKPQPPVVRSNIE

SEQ ID NO: 1882277 - protein, 17 aa, Staphylococcus
MPASVIGLVLLFILLCT

SEQ ID NO: 1882278 - protein, 19 aa, Staphylococcus
MPAVIGGFFMALTYSLDDF

SEQ ID NO: 1882279 - protein, 18 aa, Staphylococcus
MPEKVYFDKQLNTFDFNK

SEQ ID NO: 1882280 - protein, 17 aa, Staphylococcus
MPFILLLGFLGFTVYHT

SEQ ID NO: 1882281 - protein, 19 aa, Staphylococcus
MPGFLFISGYFAKKAGQAG

SEQ ID NO: 1882282 - protein, 24 aa, Staphylococcus
MPGGKYMAFAILAFFAFIFIILLI

SEQ ID NO: 1882283 - protein, 17 aa, Staphylococcus
MPHYPTLILPRVVAIVG

SEQ ID NO: 1882284 - protein, 20 aa, Staphylococcus
MPIAGLMVMFGFNNALTVIT

SEQ ID NO: 1882285 - protein, 20 aa, Staphylococcus
MPIIMGLFFVLKYPSPGGIT

SEQ ID NO: 1882286 - protein, 19 aa, Staphylococcus
MPIIMGLFFVLKYPSSGGF

SEQ ID NO: 1882287 - protein, 19 aa, Staphylococcus
MPIIMGLYFVLKDKLVNGL

SEQ ID NO: 1882288 - protein, 22 aa, Staphylococcus
MPIPIINGGFLWLTMIAISTCY

SEQ ID NO: 1882289 - protein, 17 aa, Staphylococcus
MPIVMISIIRSIMRQNV

SEQ ID NO: 1882290 - protein, 19 aa, Staphylococcus
MPLLSEKPLFIYISQSGET

SEQ ID NO: 1882291 - protein, 18 aa, Staphylococcus
MPLLTAWSPYLMVVILLL

SEQ ID NO: 1882292 - protein, 19 aa, Staphylococcus
MPMIMVSLFVFLSLRIQNA

SEQ ID NO: 1882293 - protein, 26 aa, Staphylococcus
MPMLNFEVLRFPTFTLTTLINVVVMM

SEQ ID NO: 1882294 - protein, 21 aa, Staphylococcus
MPMLWANFFWVWGHPEVYIVI

SEQ ID NO: 1882295 - protein, 22 aa, Staphylococcus
MPMLWANFFWVWGHPEVYIVVL

SEQ ID NO: 1882296 - protein, 30 aa, Staphylococcus
MPNIGAFIAWGFIAAIFIDGGWWPNKDLSE

SEQ ID NO: 1882297 - protein, 29 aa, Staphylococcus
MPNIGAFIAWGFIAAIFIDNGWFPNKDLS

SEQ ID NO: 1882298 - protein, 29 aa, Staphylococcus
MPNIGAFIAWGFIAAIFIDNGWYPNKELS

SEQ ID NO: 1882299 - protein, 20 aa, Staphylococcus
MPNIVACLFAKDNSQYIYIS

SEQ ID NO: 1882300 - protein, 18 aa, Staphylococcus
MPSFKLKDVADISVGDER

SEQ ID NO: 1882301 - protein, 18 aa, Staphylococcus
MPSFLFISGYFAKHLDKP

SEQ ID NO: 1882302 - protein, 19 aa, Staphylococcus
MPSIIGGFFMALTYSLDDF

SEQ ID NO: 1882303 - protein, 28 aa, Staphylococcus
MPSSLAWPSEWLIVLVWYLIAGVLYLTQ

SEQ ID NO: 1882304 - protein, 34 aa, Staphylococcus
MPTEFKGIRLTSARFIKWLTLLNIVPGYYGINSI

SEQ ID NO: 1882305 - protein, 22 aa, Staphylococcus
MPWELSIQYSIVRFIILMLIAI

SEQ ID NO: 1882306 - protein, 21 aa, Staphylococcus
MPWELSVIYSPIRFIVLMIIS

SEQ ID NO: 1882307 - protein, 18 aa, Staphylococcus
MQEIFKIGIPAFLMVVLM

SEQ ID NO: 1882308 - protein, 27 aa, Staphylococcus
MQFSNTCFNRWQFTTIMLAPLVIISLT

SEQ ID NO: 1882309 - protein, 18 aa, Staphylococcus
MQLPEGIEYVPNSITTSF

SEQ ID NO: 1882310 - protein, 24 aa, Staphylococcus
MQNRKGIQWESLDGSLPQLVFLIA

SEQ ID NO: 1882311 - protein, 17 aa, Staphylococcus
MQPAHLFFMIAAPEGGA

SEQ ID NO: 1882312 - protein, 17 aa, Staphylococcus
MQSNIGWNETHHDVDSS

SEQ ID NO: 1882313 - protein, 17 aa, Staphylococcus
MQTGLVIVPYTIMAVAM

SEQ ID NO: 1882314 - protein, 19 aa, Staphylococcus
MRALLIFYMFYAIKDGGLG

SEQ ID NO: 1882315 - protein, 23 aa, Staphylococcus
MRDLKHIPPLKVNSDISHIASAN

SEQ ID NO: 1882316 - protein, 20 aa, Staphylococcus
MRFIIDMLIVLAVVVPAAQF

SEQ ID NO: 1882317 - protein, 20 aa, Staphylococcus
MRFIPFTIFIFIWVIMIYSP

SEQ ID NO: 1882318 - protein, 17 aa, Staphylococcus
MRGPIGGAIDVLAVIAT

SEQ ID NO: 1882319 - protein, 17 aa, Staphylococcus
MRIPFTPGLIPKRRDEI

SEQ ID NO: 1882320 - protein, 22 aa, Staphylococcus
MRIRLAEKFRKLPLSYLSSRDL

SEQ ID NO: 1882321 - protein, 27 aa, Staphylococcus
MRKGLILKVLFNFGLPLIVGLLHAYFA

SEQ ID NO: 1882322 - protein, 22 aa, Staphylococcus
MRKGRTTLAIAHRLSTIQDADQ

SEQ ID NO: 1882323 - protein, 26 aa, Staphylococcus
MRKRVVKRRIMLFAGILLAIILILSI

SEQ ID NO: 1882324 - protein, 18 aa, Staphylococcus
MRKVMDFAKPEMNAVQEK

SEQ ID NO: 1882325 - protein, 17 aa, Staphylococcus
MRMGMLLTARLLISNML

SEQ ID NO: 1882326 - protein, 25 aa, Staphylococcus
MRMIFPVVRVFVAILRPITLLLDAI

SEQ ID NO: 1882327 - protein, 31 aa, Staphylococcus
MRPDIGETFSEFRIFLAVLLGLLLVISISLV

SEQ ID NO: 1882328 - protein, 31 aa, Staphylococcus
MRPDIGETFSEFRLFLAVLLTLLLLISISLV

SEQ ID NO: 1882329 - protein, 21 aa, Staphylococcus
MRPPIEYLRQYLAQWTSNKIL

SEQ ID NO: 1882330 - protein, 24 aa, Staphylococcus
MRRAELVHWLSILPVIVFVKAPKC

SEQ ID NO: 1882331 - protein, 18 aa, Staphylococcus
MRRLFGIFLAFTINTTMT

SEQ ID NO: 1882332 - protein, 28 aa, Staphylococcus
MRRLTKVELPIAMPVMMAGIRTAMVLII

SEQ ID NO: 1882333 - protein, 28 aa, Staphylococcus
MRRRVIRRRITLFGGILLAIIIILCIML

SEQ ID NO: 1882334 - protein, 18 aa, Staphylococcus
MRSPRKFRKFTSFISFIV

SEQ ID NO: 1882335 - protein, 27 aa, Staphylococcus
MRTILTLKGYRYVAAIVSFLEVLVYVV

SEQ ID NO: 1882336 - protein, 18 aa, Staphylococcus
MRVPYAMAERNRLPFRNF

SEQ ID NO: 1882337 - protein, 18 aa, Staphylococcus
MRYMPGLDGLRAIAVLGI

SEQ ID NO: 1882338 - protein, 17 aa, Staphylococcus
MRYSLISGILIGFIAPL

SEQ ID NO: 1882339 - protein, 18 aa, Staphylococcus
MRYSLISGILIGFIAPLI

SEQ ID NO: 1882340 - protein, 20 aa, Staphylococcus
MSAGSWFFSIVGLLFVIKTI

SEQ ID NO: 1882341 - protein, 23 aa, Staphylococcus
MSAHSPFEYGVYLIMAIALVYVY

SEQ ID NO: 1882342 - protein, 17 aa, Staphylococcus
MSAMAGAILTSRLNSAQ

SEQ ID NO: 1882343 - protein, 25 aa, Staphylococcus
MSASEFWILCLFSIIATLGELIYSP

SEQ ID NO: 1882344 - protein, 25 aa, Staphylococcus
MSCSARLPIYALFVGVFFKTYQSLI

SEQ ID NO: 1882345 - protein, 26 aa, Staphylococcus
MSCSARLPVYAIFVGVFFEKYQSLVV

SEQ ID NO: 1882346 - protein, 26 aa, Staphylococcus
MSCSARLPVYALFAGVFFKENQALVV

SEQ ID NO: 1882347 - protein, 25 aa, Staphylococcus
MSCSARLPVYALFVGVFFKEHQSLV

SEQ ID NO: 1882348 - protein, 25 aa, Staphylococcus
MSCSARLPVYALFVGVFFKEYQSLI

SEQ ID NO: 1882349 - protein, 23 aa, Staphylococcus
MSELKAKLKETVNPVKSSINYIN

SEQ ID NO: 1882350 - protein, 17 aa, Staphylococcus
MSESLSMSDSSSASTSD

SEQ ID NO: 1882351 - protein, 25 aa, Staphylococcus
MSFGARFLLDFPLSYSYLRALTSSI

SEQ ID NO: 1882352 - protein, 19 aa, Staphylococcus
MSFGDAKFISIMYAVVIIT

SEQ ID NO: 1882353 - protein, 17 aa, Staphylococcus
MSFLTLPPKEVFLASVL

SEQ ID NO: 1882354 - protein, 20 aa, Staphylococcus
MSGCNSGIFSASRMIYTLAQ

SEQ ID NO: 1882355 - protein, 20 aa, Staphylococcus
MSGCNSGIFSASRMIYTLAR

SEQ ID NO: 1882356 - protein, 20 aa, Staphylococcus
MSGCNSGIFSASRMIYTLSK

SEQ ID NO: 1882357 - protein, 20 aa, Staphylococcus
MSGIAGLISAVWNSITSVIS

SEQ ID NO: 1882358 - protein, 20 aa, Staphylococcus
MSGLGFPAFLGIILGLFEFI

SEQ ID NO: 1882359 - protein, 21 aa, Staphylococcus
MSGLIAAIALVFIYVSLGFIG

SEQ ID NO: 1882360 - protein, 20 aa, Staphylococcus
MSGLIGGPFVAIIVGIISGL

SEQ ID NO: 1882361 - protein, 21 aa, Staphylococcus
MSGLLFKIIFNVIFIYFMGIL

SEQ ID NO: 1882362 - protein, 25 aa, Staphylococcus
MSGYREYKYLYGLAKREPFFGVAFI

SEQ ID NO: 1882363 - protein, 17 aa, Staphylococcus
MSIALRFIPTLMDELDK

SEQ ID NO: 1882364 - protein, 23 aa, Staphylococcus
MSIGMCAYYIRLIRSNLLEQYQS

SEQ ID NO: 1882365 - protein, 24 aa, Staphylococcus
MSIKDIFINIGFFFLVILCSISAN

SEQ ID NO: 1882366 - protein, 20 aa, Staphylococcus
MSILKYLPRFKVQAPPNLKS

SEQ ID NO: 1882367 - protein, 18 aa, Staphylococcus
MSIPNLYILPPLAFGMAM

SEQ ID NO: 1882368 - protein, 18 aa, Staphylococcus
MSISRFAYTPILPFMQQD

SEQ ID NO: 1882369 - protein, 19 aa, Staphylococcus
MSISRFAYTPILPFMQQDT

SEQ ID NO: 1882370 - protein, 20 aa, Staphylococcus
MSKEEVRTMVAIAGTQGAFN

SEQ ID NO: 1882371 - protein, 27 aa, Staphylococcus
MSKGLLLKILFNFGLPLIIALLHALFA

SEQ ID NO: 1882372 - protein, 18 aa, Staphylococcus
MSLAHSWLSKAILLHTTI

SEQ ID NO: 1882373 - protein, 20 aa, Staphylococcus
MSLIGAKYLFLFALVLEILS

SEQ ID NO: 1882374 - protein, 26 aa, Staphylococcus
MSLVTFLVLVVFKRSIIMPLYMMFSI

SEQ ID NO: 1882375 - protein, 25 aa, Staphylococcus
MSNIHIWKPAIDFFSILSKANMPLS

SEQ ID NO: 1882376 - protein, 22 aa, Staphylococcus
MSPKLVMNIAIAFYIIAALLGI

SEQ ID NO: 1882377 - protein, 22 aa, Staphylococcus
MSPKLVMNIAIVFYIIAALLGI

SEQ ID NO: 1882378 - protein, 17 aa, Staphylococcus
MSPKLVMNLAIAFYIVA

SEQ ID NO: 1882379 - protein, 24 aa, Staphylococcus
MSPSSWFKGIGVIAFAMVIVNGFY

SEQ ID NO: 1882380 - protein, 20 aa, Staphylococcus
MSSAMPFAGSAYSWINVVFG

SEQ ID NO: 1882381 - protein, 19 aa, Staphylococcus
MSSRIGYIVAKTISMILIS

SEQ ID NO: 1882382 - protein, 26 aa, Staphylococcus
MSSVNWRTAVIFGSIFILNALLSGIG

SEQ ID NO: 1882383 - protein, 24 aa, Staphylococcus
MSTLAPFIAAFICIAIFSHRGTQL

SEQ ID NO: 1882384 - protein, 19 aa, Staphylococcus
MSTMGPFIVIVFFAAQMLA

SEQ ID NO: 1882385 - protein, 21 aa, Staphylococcus
MSVSIAGPIGFVGLIVPHIVK

SEQ ID NO: 1882386 - protein, 21 aa, Staphylococcus
MSWSPFVGIFIARISKGRSIR

SEQ ID NO: 1882387 - protein, 23 aa, Staphylococcus
MSYNHTWNILGYVLNGFVFSILG

SEQ ID NO: 1882388 - protein, 20 aa, Staphylococcus
MTAFLLVLIYRTYRVTKEDE

SEQ ID NO: 1882389 - protein, 19 aa, Staphylococcus
MTAFLLVLIYRTYRVTKEY

SEQ ID NO: 1882390 - protein, 20 aa, Staphylococcus
MTAFLLVLVYRTYRVTKEDE

SEQ ID NO: 1882391 - protein, 21 aa, Staphylococcus
MTAFLLVLVYRTYRVTKESEI

SEQ ID NO: 1882392 - protein, 20 aa, Staphylococcus
MTAFLLVLVYRTYRVTKEVE

SEQ ID NO: 1882393 - protein, 21 aa, Staphylococcus
MTARPIISFIHDLKLSNYYRR

SEQ ID NO: 1882394 - protein, 21 aa, Staphylococcus
MTAVSFIAFYIALLNLNTPET

SEQ ID NO: 1882395 - protein, 17 aa, Staphylococcus
MTDSLILDGIKTIERIQ

SEQ ID NO: 1882396 - protein, 18 aa, Staphylococcus
MTELFGVSLNHLVKGDEL

SEQ ID NO: 1882397 - protein, 26 aa, Staphylococcus
MTFGYKRFEILAALFNGVLLFVISIG

SEQ ID NO: 1882398 - protein, 18 aa, Staphylococcus
MTIKSSAMSIVIMNILVS

SEQ ID NO: 1882399 - protein, 23 aa, Staphylococcus
MTILGFKLLAPIMQFIMHILSVA

SEQ ID NO: 1882400 - protein, 26 aa, Staphylococcus
MTILICVGIGVSVTYLIREIDIQPSQ

SEQ ID NO: 1882401 - protein, 22 aa, Staphylococcus
MTISLGILPWLSAKRARVLSER

SEQ ID NO: 1882402 - protein, 27 aa, Staphylococcus
MTKGLALKILFNFGLPLIIALLHALFA

SEQ ID NO: 1882403 - protein, 26 aa, Staphylococcus
MTKGLKLKVTFNFGLPLIIALLHAYF

SEQ ID NO: 1882404 - protein, 19 aa, Staphylococcus
MTKIYYKLINHFVEDIKLE

SEQ ID NO: 1882405 - protein, 25 aa, Staphylococcus
MTKMVRLTGIDGFTEMWKGIREEEA

SEQ ID NO: 1882406 - protein, 24 aa, Staphylococcus
MTLFIPRASTIAFIIDTFSPANIF

SEQ ID NO: 1882407 - protein, 24 aa, Staphylococcus
MTLFLKFERLITVLGMVTPFLVIV

SEQ ID NO: 1882408 - protein, 19 aa, Staphylococcus
MTLFSMIAFYISLFSVMNP

SEQ ID NO: 1882409 - protein, 39 aa, Staphylococcus
MTLIPALTKLFGRASWYLPKWLDRILPKIDVEGHGLQED

SEQ ID NO: 1882410 - protein, 19 aa, Staphylococcus
MTLLDSRGVFFIFLMTVLQ

SEQ ID NO: 1882411 - protein, 17 aa, Staphylococcus
MTLVALGISVAYIYSLY

SEQ ID NO: 1882412 - protein, 27 aa, Staphylococcus
MTMDGKLKIKIDYTVDDSVVEGDYFTV

SEQ ID NO: 1882413 - protein, 17 aa, Staphylococcus
MTMILGFIQTLLSMLAG

SEQ ID NO: 1882414 - protein, 17 aa, Staphylococcus
MTMKELASLGVTKYKVS

SEQ ID NO: 1882415 - protein, 17 aa, Staphylococcus
MTMKTRLADQFLGEIPN

SEQ ID NO: 1882416 - protein, 25 aa, Staphylococcus
MTMTWKIIILLLRMGSGFVILKQGY

SEQ ID NO: 1882417 - protein, 23 aa, Staphylococcus
MTPPYIGSMGWMLTMQRNGLLEQ

SEQ ID NO: 1882418 - protein, 20 aa, Staphylococcus
MTPQAFGWMYAVNGVGLILM

SEQ ID NO: 1882419 - protein, 19 aa, Staphylococcus
MTQGWWFPIMASMFLAFTI

SEQ ID NO: 1882420 - protein, 17 aa, Staphylococcus
MTSFAIFMGLIFGNLFK

SEQ ID NO: 1882421 - protein, 23 aa, Staphylococcus
MTSKKRWTALVVLAVSLFVVTMD

SEQ ID NO: 1882422 - protein, 32 aa, Staphylococcus; identical to SEQ ID NO: 1584130

SEQ ID NO: 1882423 - protein, 17 aa, Staphylococcus
MVAGILFAFFAAYVLGT

SEQ ID NO: 1882424 - protein, 18 aa, Staphylococcus
MVALGFRPMIAVVTALIA

SEQ ID NO: 1882425 - protein, 18 aa, Staphylococcus
MVCDGYLMRIENLTPDNF

SEQ ID NO: 1882426 - protein, 25 aa, Staphylococcus
MVEKYPHIRLRLVKGAYKENASIAY

SEQ ID NO: 1882427 - protein, 24 aa, Staphylococcus
MVFFISRAYKWFVLDKEFTEGIKI

SEQ ID NO: 1882428 - protein, 18 aa, Staphylococcus
MVFGMLINIVIARISNLK

SEQ ID NO: 1882429 - protein, 17 aa, Staphylococcus
MVFNGHTTALLTISAII

SEQ ID NO: 1882430 - protein, 20 aa, Staphylococcus
MVFSGIVAFGEWLVGFGSFG

SEQ ID NO: 1882431 - protein, 18 aa, Staphylococcus
MVFSKGYVTVLMTLVALL

SEQ ID NO: 1882432 - protein, 22 aa, Staphylococcus
MVFYLAYSRRGNIKDSMMVHMI

SEQ ID NO: 1882433 - protein, 26 aa, Staphylococcus
MVGYKEWFINTSILRYPLNKMTSSPF

SEQ ID NO: 1882434 - protein, 19 aa, Staphylococcus
MVIGNLLGGMLFDKLGGYR

SEQ ID NO: 1882435 - protein, 27 aa, Staphylococcus
MVILIWFLFCVFVFQYIKLLFSQPKVK

SEQ ID NO: 1882436 - protein, 31 aa, Staphylococcus
MVIPPIFSLGTWGEWFYKGLELLVIACPCAL

SEQ ID NO: 1882437 - protein, 18 aa, Staphylococcus
MVITDWLGAIIIAPVQIP

SEQ ID NO: 1882438 - protein, 30 aa, Staphylococcus
MVKAEGIGYFWFDVCILLVFIIVFTILNIV

SEQ ID NO: 1882439 - protein, 23 aa, Staphylococcus
MVLAIPMAIAFIFLTINLFIFHN

SEQ ID NO: 1882440 - protein, 19 aa, Staphylococcus
MVLISWNLITHITFTLDNY

SEQ ID NO: 1882441 - protein, 18 aa, Staphylococcus
MVLLCYFVSLTLLTMFIS

SEQ ID NO: 1882442 - protein, 23 aa, Staphylococcus
MVLLVCSSYLVLILVGSLQGNDM

SEQ ID NO: 1882443 - protein, 25 aa, Staphylococcus
MVLMLILISFCLFKHHAILFNSRGR

SEQ ID NO: 1882444 - protein, 19 aa, Staphylococcus
MVLMYRFFGKHGLIAWVAM

SEQ ID NO: 1882445 - protein, 21 aa, Staphylococcus
MVLRYLQIVAIFITALLFLLA

SEQ ID NO: 1882446 - protein, 22 aa, Staphylococcus
MVMIIPTWINLLLKTYAFIGLL

SEQ ID NO: 1882447 - protein, 19 aa, Staphylococcus
MVNFAMAFSMGTLIFSTLL

SEQ ID NO: 1882448 - protein, 18 aa, Staphylococcus
MVPPDWSYLNTITKPMLD

SEQ ID NO: 1882449 - protein, 23 aa, Staphylococcus
MVQAGSPIAYAYNLDDLYITANV

SEQ ID NO: 1882450 - protein, 23 aa, Staphylococcus
MVQNLWWGAGYNIIAVPLAAGVL

SEQ ID NO: 1882451 - protein, 20 aa, Staphylococcus
MVQNLWWGAGYNIVAVPLAA

SEQ ID NO: 1882452 - protein, 21 aa, Staphylococcus
MVQNLWWGAGYNIVAVPLAAG

SEQ ID NO: 1882453 - protein, 22 aa, Staphylococcus
MVQNLWWGAGYNIVAVPLAAGI

SEQ ID NO: 1882454 - protein, 27 aa, Staphylococcus
MVQPAYRASAMALMFMGLSLSNILGVP

SEQ ID NO: 1882455 - protein, 23 aa, Staphylococcus
MVRGKRGTTVTLTIKRGSEEKDI

SEQ ID NO: 1882456 - protein, 19 aa, Staphylococcus
MVSLLIFPFLVKKVGRSAV

SEQ ID NO: 1882457 - protein, 17 aa, Staphylococcus
MVSMGVFCFVISGIFML

SEQ ID NO: 1882458 - protein, 20 aa, Staphylococcus
MVTMCIGVGMGAAGIFEYVR

SEQ ID NO: 1882459 - protein, 29 aa, Staphylococcus
MVTRVISRWASEYNIYFKRYNSDQFVAYL

SEQ ID NO: 1882460 - protein, 23 aa, Staphylococcus
MVVAEFAIKFFIQDKQAVDFGTH

SEQ ID NO: 1882461 - protein, 17 aa, Staphylococcus
MVVAIVCGLTIANITPI

SEQ ID NO: 1882462 - protein, 18 aa, Staphylococcus
MVVALSVTHGFLPPHPGP

SEQ ID NO: 1882463 - protein, 27 aa, Staphylococcus
MVVSVILAYLFKWFGLIDDVLLMVIII

SEQ ID NO: 1882464 - protein, 19 aa, Staphylococcus
MVVVIAIVFMIAFGSKASL

SEQ ID NO: 1882465 - protein, 28 aa, Staphylococcus
MVVYAVSAGYKWFFAYPEQKVETVNTLT

SEQ ID NO: 1882466 - protein, 26 aa, Staphylococcus
MWNIAGWDVYLTWVLIGSIGSIVLTS

SEQ ID NO: 1882467 - protein, 21 aa, Staphylococcus
MWTAIPGFIISFLGYMFIGTP

SEQ ID NO: 1882468 - protein, 26 aa, Staphylococcus
MYAIWNVNIAFSFDFAIYSFLYSFAF

SEQ ID NO: 1882469 - protein, 29 aa, Staphylococcus
MYANHLFIKRRTQEFALFQLIGLTRSNIL

SEQ ID NO: 1882470 - protein, 29 aa, Staphylococcus
MYANHLFIKRRTREFALFELIGLTRGNIL

SEQ ID NO: 1882471 - protein, 21 aa, Staphylococcus
MYCSKIKLFYLLKGLTPILFF

SEQ ID NO: 1882472 - protein, 19 aa, Staphylococcus
MYEIIPGFISSVIVTYLVS

SEQ ID NO: 1882473 - protein, 18 aa, Staphylococcus
MYELFSSRCNELLLGKFD

SEQ ID NO: 1882474 - protein, 18 aa, Staphylococcus
MYFVLTFLLSRLMSLIEG

SEQ ID NO: 1882475 - protein, 17 aa, Staphylococcus
MYGRRHPLTHSKIHSSK

SEQ ID NO: 1882476 - protein, 17 aa, Staphylococcus
MYIFSGILIAFSVILLL

SEQ ID NO: 1882477 - protein, 17 aa, Staphylococcus
MYIILVISIIYIIVHQN

SEQ ID NO: 1882478 - protein, 19 aa, Staphylococcus
MYINKIINRHEMAAKDTTF

SEQ ID NO: 1882479 - protein, 19 aa, Staphylococcus
MYIRFPNRFFETLFNHFEQ

SEQ ID NO: 1882480 - protein, 21 aa, Staphylococcus
MYKEIIAYSIPFVIVSLNFPL

SEQ ID NO: 1882481 - protein, 20 aa, Staphylococcus
MYLFLFKRSFLRGKDAFNII

SEQ ID NO: 1882482 - protein, 18 aa, Staphylococcus
MYLTVGWYYKAIRLNKVI

SEQ ID NO: 1882483 - protein, 18 aa, Staphylococcus
MYPLKWIKVPVHQLSMIM

SEQ ID NO: 1882484 - protein, 25 aa, Staphylococcus
MYRGNELTKFLALLMLVNGVAPVIA

SEQ ID NO: 1882485 - protein, 24 aa, Staphylococcus
MYSGKELTKFLAVLMLVNGIAPVI

SEQ ID NO: 1882486 - protein, 19 aa, Staphylococcus
MYSIFKSPLTYLALLLTIL

SEQ ID NO: 1882487 - protein, 24 aa, Staphylococcus
MYSRDNKIHFSRIVGKPGESIEIK

SEQ ID NO: 1882488 - protein, 18 aa, Staphylococcus
MYTMMGMIFYLAYHRRKN

SEQ ID NO: 1882489 - protein, 29 aa, Staphylococcus
MYTNHLFIKRRTKEFALFQLIGLNKHNIL

SEQ ID NO: 1882490 - protein, 22 aa, Staphylococcus
MYVELFCGAVILFFTFLEFNNR

SEQ ID NO: 1882491 - protein, 20 aa, Staphylococcus
MYVSSLFLIIAMYLLLEVLT

SEQ ID NO: 1882492 - protein, 21 aa, Staphylococcus
MYWVVCFIISVIQGFYESYIE

SEQ ID NO: 1882493 - protein, 20 aa, Staphylococcus
MYWVVCFIISVLQGLYESKI

SEQ ID NO: 1882494 - protein, 19 aa, Staphylococcus
NAACAGFTYGLQLANSLIS

SEQ ID NO: 1882495 - protein, 17 aa, Staphylococcus
NAAFAFTAILMIIGFVL

SEQ ID NO: 1882496 - protein, 19 aa, Staphylococcus
NAAKDVWINGFSPQYTMSV

SEQ ID NO: 1882497 - protein, 19 aa, Staphylococcus
NAAKDVWINGFTPKYTMSI

SEQ ID NO: 1882498 - protein, 22 aa, Staphylococcus
NAAYKLPPLTLLNTPAKQKTTS

SEQ ID NO: 1882499 - protein, 18 aa, Staphylococcus
NADFAGSYVQPFNHSWAQ

SEQ ID NO: 1882500 - protein, 19 aa, Staphylococcus
NADVAKTLHDGLAKLDLIQ

SEQ ID NO: 1882501 - protein, 25 aa, Staphylococcus
NAEELVHLSIHFKKRTSSYEIENIK

SEQ ID NO: 1882502 - protein, 24 aa, Staphylococcus
NAELRTGPNAAYPIIYKIEKGDSF

SEQ ID NO: 1882503 - protein, 23 aa, Staphylococcus
NAELYRKRISILKNAKLIIEDVK

SEQ ID NO: 1882504 - protein, 22 aa, Staphylococcus
NAFNVKIGWLILRILAVVFVWI

SEQ ID NO: 1882505 - protein, 21 aa, Staphylococcus
NAFNVPNWIVAIIVVVILALI

SEQ ID NO: 1882506 - protein, 23 aa, Staphylococcus
NAFVPSVVGLICASYVINDILKD

SEQ ID NO: 1882507 - protein, 22 aa, Staphylococcus
NAGHFNFGFVVALLVGIIVIMM

SEQ ID NO: 1882508 - protein, 22 aa, Staphylococcus
NAGHFSFGFVLIALGSIAVVSM

SEQ ID NO: 1882509 - protein, 17 aa, Staphylococcus
NAGIGFGGIIGGLVVSN

SEQ ID NO: 1882510 - protein, 22 aa, Staphylococcus
NAHSLLSWVVTLFFIALSFYLV

SEQ ID NO: 1882511 - protein, 33 aa, Staphylococcus
NAHVSIKLSLLGGEFDLQFAFDNLREILLKANE

SEQ ID NO: 1882512 - protein, 17 aa, Staphylococcus
NAIELLRLTQFPTDIYE

SEQ ID NO: 1882513 - protein, 25 aa, Staphylococcus
NAIGAYRVGQKLYKSSFIVMSISGI

SEQ ID NO: 1882514 - protein, 18 aa, Staphylococcus
NAIKEAKELIDNHPDTLD

SEQ ID NO: 1882515 - protein, 27 aa, Staphylococcus
NAIKSVFWRILLFYILSIAVISAILPY

SEQ ID NO: 1882516 - protein, 24 aa, Staphylococcus
NAILGELFKLFAPKSSVFTTLLQV

SEQ ID NO: 1882517 - protein, 25 aa, Staphylococcus
NAITHYWWMFAISFIFFLIAGILNM

SEQ ID NO: 1882518 - protein, 24 aa, Staphylococcus
NAIWDEIAKAYGYDGKHFKEKAPK

SEQ ID NO: 1882519 - protein, 24 aa, Staphylococcus
NAIYKDKIRIIPIIADVQNPERIQ

SEQ ID NO: 1882520 - protein, 40 aa, Staphylococcus
NAKANGVSEIKAIQPIGTLRQAALEEFTDVYNDKVSEIET

SEQ ID NO: 1882521 - protein, 23 aa, Staphylococcus
NAKDKRQAIETILATRIEQGKAK

SEQ ID NO: 1882522 - protein, 25 aa, Staphylococcus
NAKEIPSEATIIWYDLNEPTEEESD

SEQ ID NO: 1882523 - protein, 22 aa, Staphylococcus
NAKHFFSWLAWLSIIALIALII

SEQ ID NO: 1882524 - protein, 19 aa, Staphylococcus
NAKRIFFIALIILSIVGLK

SEQ ID NO: 1882525 - protein, 18 aa, Staphylococcus
NALDLVKNALNGTASDLL

SEQ ID NO: 1882526 - protein, 22 aa, Staphylococcus
NALEKMAALLPNKAIKVNKDGN

SEQ ID NO: 1882527 - protein, 22 aa, Staphylococcus
NALELRFILDWNSQSNRDSIEY

SEQ ID NO: 1882528 - protein, 22 aa, Staphylococcus
NALELRFILDWNSQSTRDNIRY

SEQ ID NO: 1882529 - protein, 17 aa, Staphylococcus
NALIPVITVIVPMTASI

SEQ ID NO: 1882530 - protein, 17 aa, Staphylococcus
NALPHTLMLGSIFVLFS

SEQ ID NO: 1882531 - protein, 22 aa, Staphylococcus
NALQLRFILDWNSQAARDNIEY

SEQ ID NO: 1882532 - protein, 22 aa, Staphylococcus
NALQLRFILDWNSQAKRHNITY

SEQ ID NO: 1882533 - protein, 22 aa, Staphylococcus
NALQLRFMLDWNSQSTRDRLSY

SEQ ID NO: 1882534 - protein, 33 aa, Staphylococcus
NANGTFKFGNIGYRERLDFMTKMVRLTGIDGFT

SEQ ID NO: 1882535 - protein, 26 aa, Staphylococcus
NANLFSGMMFYNLDALSWIDVLKNIV

SEQ ID NO: 1882536 - protein, 23 aa, Staphylococcus
NANREIEGLTSLNPQQISAEKNQ

SEQ ID NO: 1882537 - protein, 18 aa, Staphylococcus
NAPKRLLAACGFVGAVAW

SEQ ID NO: 1882538 - protein, 18 aa, Staphylococcus
NAPKRLLVACGFVGAVAW

SEQ ID NO: 1882539 - protein, 24 aa, Staphylococcus
NAPRGEFLHMLLGVVLATLVSFAV

SEQ ID NO: 1882540 - protein, 24 aa, Staphylococcus
NAPRGEFLHMLLGVVLATLVSFVI

SEQ ID NO: 1882541 - protein, 24 aa, Staphylococcus
NARLTELRDSYQIHYDLSQHHTPF

SEQ ID NO: 1882542 - protein, 24 aa, Staphylococcus
NASEVDAIAALIQKDYQNNKNENP

SEQ ID NO: 1882543 - protein, 32 aa, Staphylococcus
NATEVIHGIWLYRLITLFAFIFIMLTFYGCYR

SEQ ID NO: 1882544 - protein, 18 aa, Staphylococcus
NATIWMFIGFMIFGIVSV

SEQ ID NO: 1882545 - protein, 28 aa, Staphylococcus
NATNLKLRRIVPLGIVFFILILIVVLFF

SEQ ID NO: 1882546 - protein, 26 aa, Staphylococcus
NAVIKRGATLPTHLAGGSTTQIPVTI

SEQ ID NO: 1882547 - protein, 23 aa, Staphylococcus
NAVLAEKLIQYGNRYRKDDSSID

SEQ ID NO: 1882548 - protein, 19 aa, Staphylococcus
NAVPLRILVFYVGALAVIM

SEQ ID NO: 1882549 - protein, 20 aa, Staphylococcus
NAWALIPLIVFVGLFLGVGI

SEQ ID NO: 1882550 - protein, 25 aa, Staphylococcus
NCTALRKVHPNGVPSNHPAYTSKFD

SEQ ID NO: 1882551 - protein, 22 aa, Staphylococcus
NDAKTQYLASIENIQPNIVKKP

SEQ ID NO: 1882552 - protein, 19 aa, Staphylococcus
NDAMKQLKENIAEKDKVKA

SEQ ID NO: 1882553 - protein, 20 aa, Staphylococcus
NDAYEFYGKVQPGITTPSQK

SEQ ID NO: 1882554 - protein, 24 aa, Staphylococcus
NDDFEFQMLYGFRSELAEQIAREG

SEQ ID NO: 1882555 - protein, 17 aa, Staphylococcus
NDFPELFTDTLVNSINA

SEQ ID NO: 1882556 - protein, 17 aa, Staphylococcus
NDHLLWDYDMDRMDQVL

SEQ ID NO: 1882557 - protein, 21 aa, Staphylococcus
NDHSICVGIKESGPVIVAAAL

SEQ ID NO: 1882558 - protein, 21 aa, Staphylococcus
NDIAKYFAILPAMFMAAMPAM

SEQ ID NO: 1882559 - protein, 26 aa, Staphylococcus
NDIITVLPFGNLISQIKVKGSDVKKA

SEQ ID NO: 1882560 - protein, 23 aa, Staphylococcus
NDIKDNVDVFVILSHLGVDKSTR

SEQ ID NO: 1882561 - protein, 20 aa, Staphylococcus
NDIKGVNILNILSIGLFVIY

SEQ ID NO: 1882562 - protein, 23 aa, Staphylococcus
NDIKLPPSVLTKDNYVFVVNKNN

SEQ ID NO: 1882563 - protein, 21 aa, Staphylococcus
NDIVLGLIFLVGSFLFFSDKT

SEQ ID NO: 1882564 - protein, 23 aa, Staphylococcus
NDLEHLDRLVLSYFEYHKDDSEI

SEQ ID NO: 1882565 - protein, 17 aa, Staphylococcus
NDLNLVIHIPKDFSSNL

SEQ ID NO: 1882566 - protein, 24 aa, Staphylococcus
NDLNRTGFWLKIPGKEGTVDKTYA

SEQ ID NO: 1882567 - protein, 18 aa, Staphylococcus
NDLSSVLVTSRLNEEKHT

SEQ ID NO: 1882568 - protein, 19 aa, Staphylococcus
NDNEWQYTIGLTDLPIIKN

SEQ ID NO: 1882569 - protein, 24 aa, Staphylococcus
NDNFARATVNLSVENKGHNQSRDT

SEQ ID NO: 1882570 - protein, 19 aa, Staphylococcus
NDNHFAFYIVFAISAIIFP

SEQ ID NO: 1882571 - protein, 17 aa, Staphylococcus
NDPRVDSAFTIFYMGIN

SEQ ID NO: 1882572 - protein, 23 aa, Staphylococcus
NDPVERVRHSIQEIEEAVKEIND

SEQ ID NO: 1882573 - protein, 30 aa, Staphylococcus
NDQQMAAWGWRIPFFFGLILGFVGLYLRTH

SEQ ID NO: 1882574 - protein, 27 aa, Staphylococcus
NDQTPQRKDFVVSFITGAIVGSALGLY

SEQ ID NO: 1882575 - protein, 26 aa, Staphylococcus
NDQVIDARLGYYSVVKETNVQLLQPN

SEQ ID NO: 1882576 - protein, 23 aa, Staphylococcus
NDRVGKAYLEYQYEDILRGKKKQ

SEQ ID NO: 1882577 - protein, 18 aa, Staphylococcus
NDSFLIRSFHVVATALMT

SEQ ID NO: 1882578 - protein, 21 aa, Staphylococcus
NDTASAWSLVQFIALPMILIN

SEQ ID NO: 1882579 - protein, 25 aa, Staphylococcus
NDVKAHLSIKISQLGAEFDLDLAEK

SEQ ID NO: 1882580 - protein, 17 aa, Staphylococcus
NDVVKNFTANGLLSIGA

SEQ ID NO: 1882581 - protein, 18 aa, Staphylococcus
NDVVKNFTANGLLSIGAS

SEQ ID NO: 1882582 - protein, 20 aa, Staphylococcus
NEAPLRYIAAIITVVLVVLG

SEQ ID NO: 1882583 - protein, 17 aa, Staphylococcus
NEATLPLSIYFVVIFLM

SEQ ID NO: 1882584 - protein, 21 aa, Staphylococcus
NEAYGLWLIILSVVTWFYIMD

SEQ ID NO: 1882585 - protein, 24 aa, Staphylococcus
NEDKDAFEFYGRVQAGITTPTQKN

SEQ ID NO: 1882586 - protein, 18 aa, Staphylococcus
NEDNRYLVMPALSDALKI

SEQ ID NO: 1882587 - protein, 30 aa, Staphylococcus
NEEVDKAKALALPKIEAVKVTTEVKPQAKA

SEQ ID NO: 1882588 - protein, 19 aa, Staphylococcus
NEFIEFPIVAANPEDEGTF

SEQ ID NO: 1882589 - protein, 22 aa, Staphylococcus
NEFLRNKFDFNYLEIDDAITGI

SEQ ID NO: 1882590 - protein, 22 aa, Staphylococcus
NEGYRYYPNFYHQTGQGKTSDS

SEQ ID NO: 1882591 - protein, 20 aa, Staphylococcus
NEHKEIKAPLNRLAGKISDE

SEQ ID NO: 1882592 - protein, 27 aa, Staphylococcus
NEIGINFATVFGFVGMCLVLLLFYLMH

SEQ ID NO: 1882593 - protein, 18 aa, Staphylococcus
NEILSFYVNNIYYGDDQY

SEQ ID NO: 1882594 - protein, 22 aa, Staphylococcus
NEIRIELLISGIIFIVASLSDF

SEQ ID NO: 1882595 - protein, 27 aa, Staphylococcus
NEITIIFCIFLLFALIFYLFSLPFSAF

SEQ ID NO: 1882596 - protein, 34 aa, Staphylococcus
NEKLNAWCFWLFMIGFNVCFLPQFILGLDGMPRR

SEQ ID NO: 1882597 - protein, 20 aa, Staphylococcus
NEKLNKWAFWLFMIGFNVCF

SEQ ID NO: 1882598 - protein, 19 aa, Staphylococcus
NEKMRYLLNIAKLEDVLKT

SEQ ID NO: 1882599 - protein, 37 aa, Staphylococcus
NEKNKKSKKWLIAIIAILLIIVAVFATRAILNNNSSD

SEQ ID NO: 1882600 - protein, 25 aa, Staphylococcus
NEKSIKAKHKRVKRDANDTSSNPQT

SEQ ID NO: 1882601 - protein, 17 aa, Staphylococcus
NELILAFSTSSSESVLP

SEQ ID NO: 1882602 - protein, 21 aa, Staphylococcus
NELKITYGLLNVKNITVPIER

SEQ ID NO: 1882603 - protein, 22 aa, Staphylococcus
NELTHINRAFAFDEMKIKDGYL

SEQ ID NO: 1882604 - protein, 22 aa, Staphylococcus
NEMRKLKGLKPLKVNNDIAHIA

SEQ ID NO: 1882605 - protein, 18 aa, Staphylococcus
NEMTFRKFIGLIAIAIGI

SEQ ID NO: 1882606 - protein, 18 aa, Staphylococcus
NENLLLKKYHLPLIDVLK

SEQ ID NO: 1882607 - protein, 26 aa, Staphylococcus
NENPNIRQFFLFDLTSRLIGRDDNVN

SEQ ID NO: 1882608 - protein, 20 aa, Staphylococcus
NEPYTRYPVYDEDIDDIIGV

SEQ ID NO: 1882609 - protein, 20 aa, Staphylococcus
NEQHIPNFITIIISMMSGVI

SEQ ID NO: 1882610 - protein, 25 aa, Staphylococcus
NEQIIFKPNLVFIITDMSLIIDHVI

SEQ ID NO: 1882611 - protein, 17 aa, Staphylococcus
NERRFIYRYSIWCAGLF

SEQ ID NO: 1882612 - protein, 25 aa, Staphylococcus
NESIIKKLFRLPAIKRFDEDEDILE

SEQ ID NO: 1882613 - protein, 19 aa, Staphylococcus
NESLLVQWWHWIIQILHLD

SEQ ID NO: 1882614 - protein, 25 aa, Staphylococcus
NESSIAWLSFILFIRGCSVGGINLG

SEQ ID NO: 1882615 - protein, 24 aa, Staphylococcus
NESVDAQSTDNCIANEQTFDNESV

SEQ ID NO: 1882616 - protein, 18 aa, Staphylococcus
NESVPRGRILDRNGKILV

SEQ ID NO: 1882617 - protein, 18 aa, Staphylococcus
NESVPRGRILDRNGKVLV

SEQ ID NO: 1882618 - protein, 38 aa, Staphylococcus
NETGDKQAKIYFGHIDHPYIVKVTSKIDPNSTADLKTR

SEQ ID NO: 1882619 - protein, 34 aa, Staphylococcus; identical to SEQ ID NO: 1743794

SEQ ID NO: 1882620 - protein, 34 aa, Staphylococcus
NETLNKWCFWLFMIGFNVCFLPQFVLGLDGMPRR

SEQ ID NO: 1882621 - protein, 25 aa, Staphylococcus
NETNPTLSRKALFQSGMRVGREILA

SEQ ID NO: 1882622 - protein, 23 aa, Staphylococcus
NETWRYQFDLRPLSGTSAGQINI

SEQ ID NO: 1882623 - protein, 28 aa, Staphylococcus
NEVKPGQAFCNKCGNTLKKENKQAETSS

SEQ ID NO: 1882624 - protein, 21 aa, Staphylococcus
NEVKQSLFLPTKMSDDLLLDS

SEQ ID NO: 1882625 - protein, 20 aa, Staphylococcus
NEVKRAMSISKKDNDLKYMD

SEQ ID NO: 1882626 - protein, 17 aa, Staphylococcus
NEVSRRFFLKMLGIGGA

SEQ ID NO: 1882627 - protein, 23 aa, Staphylococcus
NEYLRFLGEFLMDKTNRGETLAN

SEQ ID NO: 1882628 - protein, 24 aa, Staphylococcus
NEYREPRMLVGLLVGSSIAISGAV

SEQ ID NO: 1882629 - protein, 25 aa, Staphylococcus
NEYRIPRMFLAIIVGSSLAISGSLI

SEQ ID NO: 1882630 - protein, 24 aa, Staphylococcus
NEYRIPRTLLGLIIGSSLAISGAI

SEQ ID NO: 1882631 - protein, 25 aa, Staphylococcus
NEYRIPRTLLGLVIGSSLAISGAVI

SEQ ID NO: 1882632 - protein, 35 aa, Staphylococcus
NFACLVIGMILCRSRVKIKFDWRGSVNITSLVQQK

SEQ ID NO: 1882633 - protein, 22 aa, Staphylococcus
NFDPRIKIGLMLIISLISLTGG

SEQ ID NO: 1882634 - protein, 24 aa, Staphylococcus
NFEVFKNKQFAVGLAIMSVTMISM

SEQ ID NO: 1882635 - protein, 37 aa, Staphylococcus
NFEYMPELKWHYGYFICLTIMLLISIALILFFKKKKW

SEQ ID NO: 1882636 - protein, 19 aa, Staphylococcus
NFFEMATWLEPFGGIDGRK

SEQ ID NO: 1882637 - protein, 19 aa, Staphylococcus
NFFEMATWLEPFGGIGGRK

SEQ ID NO: 1882638 - protein, 20 aa, Staphylococcus
NFFIKRDITIKMPKEVPPNI

SEQ ID NO: 1882639 - protein, 22 aa, Staphylococcus
NFFIPFLLVFILDGFKGIKETL

SEQ ID NO: 1882640 - protein, 17 aa, Staphylococcus
NFFLEFLTIAIIGVLAV

SEQ ID NO: 1882641 - protein, 24 aa, Staphylococcus
NFFLKHYPPLIIIALMVLIFIIKW

SEQ ID NO: 1882642 - protein, 29 aa, Staphylococcus
NFFSLFASIIVLWLYFRKTIPKHFDHSQL

SEQ ID NO: 1882643 - protein, 21 aa, Staphylococcus
NFFTKYGSFFIKGIKNTILIS

SEQ ID NO: 1882644 - protein, 29 aa, Staphylococcus
NFGKDKFKLFIPWYYLIKYVMPLVIILVF

SEQ ID NO: 1882645 - protein, 28 aa, Staphylococcus
NFIFLIGMFCFLKGFIGFFIGGDSNYLY

SEQ ID NO: 1882646 - protein, 18 aa, Staphylococcus
NFIFLVGIFFFFKGFIGF

SEQ ID NO: 1882647 - protein, 25 aa, Staphylococcus
NFIIVGLFIICMFVSISMGTSVGTI

SEQ ID NO: 1882648 - protein, 17 aa, Staphylococcus
NFILLRIIPTLILNIIL

SEQ ID NO: 1882649 - protein, 38 aa, Staphylococcus
NFIPAPESIYFNWLWQREGWMIFIGWLSYFLLGFYMGY

SEQ ID NO: 1882650 - protein, 23 aa, Staphylococcus
NFIRPNSRFDYQFKLKRDQHNNL

SEQ ID NO: 1882651 - protein, 24 aa, Staphylococcus
NFKAKSAISYAEFRPNLRNVVRAV

SEQ ID NO: 1882652 - protein, 18 aa, Staphylococcus
NFLFLKRRTILSMMKDST

SEQ ID NO: 1882653 - protein, 27 aa, Staphylococcus
NFLWSILYFRYKLRGAALIESYTLFAA

SEQ ID NO: 1882654 - protein, 30 aa, Staphylococcus
NFMFLIGIFCFCKGFIGFFIGGNNNRIYLY

SEQ ID NO: 1882655 - protein, 20 aa, Staphylococcus
NFPHTILWQCIFWGVMIGLV

SEQ ID NO: 1882656 - protein, 24 aa, Staphylococcus
NFRKKGGHVEAFFPSKLPLINLRM

SEQ ID NO: 1882657 - protein, 26 aa, Staphylococcus
NFSHFKGARLFSGLLGKVGDQDIGGA

SEQ ID NO: 1882658 - protein, 24 aa, Staphylococcus
NFSMSETRFMRFLGGNDLIYGLLA

SEQ ID NO: 1882659 - protein, 17 aa, Staphylococcus
NFTEVFGIILAFGYMSL

SEQ ID NO: 1882660 - protein, 30 aa, Staphylococcus
NFTNMPELHWKYSYFVFIGVMALLSIALIV

SEQ ID NO: 1882661 - protein, 19 aa, Staphylococcus
NFVMGASFITEGAIPFAAA

SEQ ID NO: 1882662 - protein, 18 aa, Staphylococcus
NFVVRVKLDKSFRIPLRM

SEQ ID NO: 1882663 - protein, 18 aa, Staphylococcus
NFWITCLVAIAFGFAVAA

SEQ ID NO: 1882664 - protein, 18 aa, Staphylococcus
NFYTISIEIVFFIHPETL

SEQ ID NO: 1882665 - protein, 25 aa, Staphylococcus
NGAFFMFFAFYFKKLSTRQWMFIIG

SEQ ID NO: 1882666 - protein, 20 aa, Staphylococcus
NGAIKIPGLLSFLADNNTNT

SEQ ID NO: 1882667 - protein, 24 aa, Staphylococcus
NGCGASWPLCHGALLPQNLPIATI

SEQ ID NO: 1882668 - protein, 21 aa, Staphylococcus
NGDLFRFYKNPDFKKIDPSKY

SEQ ID NO: 1882669 - protein, 21 aa, Staphylococcus
NGDLFRFYKNPDFKKVDPSKY

SEQ ID NO: 1882670 - protein, 19 aa, Staphylococcus
NGDLFRFYNNPDFKKINPS

SEQ ID NO: 1882671 - protein, 19 aa, Staphylococcus
NGDLFRFYNNPDFKKVNPA

SEQ ID NO: 1882672 - protein, 19 aa, Staphylococcus
NGDLLRFYDNPDFDKIKPS

SEQ ID NO: 1882673 - protein, 26 aa, Staphylococcus
NGDNLPRFFIYLLLFMFSMLGIVISN

SEQ ID NO: 1882674 - protein, 20 aa, Staphylococcus
NGDRKIVFSDHTTVVIPKGD

SEQ ID NO: 1882675 - protein, 19 aa, Staphylococcus
NGDRKLVFSDNTTVIIPKG

SEQ ID NO: 1882676 - protein, 20 aa, Staphylococcus
NGDRKLVFSDNTTVVIPKGA

SEQ ID NO: 1882677 - protein, 20 aa, Staphylococcus
NGDRKLVFSDNTTVVIPKGV

SEQ ID NO: 1882678 - protein, 23 aa, Staphylococcus
NGDYTVHFEKPTGLTQTVVDSGN

SEQ ID NO: 1882679 - protein, 20 aa, Staphylococcus
NGEEAMSFIRSRKEEGAGGD

SEQ ID NO: 1882680 - protein, 22 aa, Staphylococcus
NGEGFSRQTFKVHSVDQKDFDA

SEQ ID NO: 1882681 - protein, 21 aa, Staphylococcus
NGEGFSRQTFKVHSVDQSEFD

SEQ ID NO: 1882682 - protein, 21 aa, Staphylococcus
NGEPFNIIKFRTMKDKRDSEG

SEQ ID NO: 1882683 - protein, 43 aa, Staphylococcus
NGFVDLLKNTLGFVGISSLLAGFWFILAKRRKKEEEDETVDLH

SEQ ID NO: 1882684 - protein, 22 aa, Staphylococcus
NGGGSIALWIVSIFAIIISLVA

SEQ ID NO: 1882685 - protein, 25 aa, Staphylococcus
NGGVKRIKEIIGEDGTTRIEIWTLS

SEQ ID NO: 1882686 - protein, 17 aa, Staphylococcus
NGGVWALNKEVPHIELD

SEQ ID NO: 1882687 - protein, 19 aa, Staphylococcus
NGHGFKMFVYIMLLGAIVA

SEQ ID NO: 1882688 - protein, 26 aa, Staphylococcus
NGHGGFLNEDYRLFSTDNKTGKLTYQ

SEQ ID NO: 1882689 - protein, 24 aa, Staphylococcus
NGHKTWFKFFIAVLLINLIIIIIT

SEQ ID NO: 1882690 - protein, 24 aa, Staphylococcus
NGHKTWLKFFIGILLINLLITIIT

SEQ ID NO: 1882691 - protein, 20 aa, Staphylococcus
NGIFPALLILIIFILSGCIF

SEQ ID NO: 1882692 - protein, 24 aa, Staphylococcus
NGIIGYCVTIFFILMKAPDLALTQ

SEQ ID NO: 1882693 - protein, 23 aa, Staphylococcus
NGISKWVILYGRRKFAAMILTGM

SEQ ID NO: 1882694 - protein, 24 aa, Staphylococcus
NGISKWVILYGRRKFAAMILTGMV

SEQ ID NO: 1882695 - protein, 24 aa, Staphylococcus
NGKIERPSIGIGLLNLSDIPDSYK

SEQ ID NO: 1882696 - protein, 24 aa, Staphylococcus
NGKIERPSIGIGLLNLSEIPDSYR

SEQ ID NO: 1882697 - protein, 19 aa, Staphylococcus
NGKKFLFFDDYQFNVPQHS

SEQ ID NO: 1882698 - protein, 19 aa, Staphylococcus
NGKKYLFFDKYNFNIPQHT

SEQ ID NO: 1882699 - protein, 18 aa, Staphylococcus
NGKLKLNKGYGYQNFQHK

SEQ ID NO: 1882700 - protein, 21 aa, Staphylococcus
NGKLTFLQVFFEVMSAFGTCG

SEQ ID NO: 1882701 - protein, 24 aa, Staphylococcus
NGKPFKYDHHYNITFKFDGKDGGA

SEQ ID NO: 1882702 - protein, 23 aa, Staphylococcus
NGKWEWFKWNPLNMIMLPQQIVD

SEQ ID NO: 1882703 - protein, 18 aa, Staphylococcus
NGLRLHTIYSSFFGSLAL

SEQ ID NO: 1882704 - protein, 18 aa, Staphylococcus
NGLWSFLVTWGILQSKKS

SEQ ID NO: 1882705 - protein, 20 aa, Staphylococcus
NGNLAVFVLFGFYSVIGGWI

SEQ ID NO: 1882706 - protein, 45 aa, Staphylococcus
NGQEPKKSGGLKKLLPLLLGLLIIAAIAIFGGMALTNQGDHKDDS

SEQ ID NO: 1882707 - protein, 18 aa, Staphylococcus
NGQLKLNKGYGLQNIQEN

SEQ ID NO: 1882708 - protein, 18 aa, Staphylococcus
NGQLKPGYNLQIATNSQF

SEQ ID NO: 1882709 - protein, 24 aa, Staphylococcus
NGRKTWFKFFLAILLINLLIIIIT

SEQ ID NO: 1882710 - protein, 34 aa, Staphylococcus
NGTEEIKQARGFFRLAAVMSFTYIWIAIYQSFNT

SEQ ID NO: 1882711 - protein, 24 aa, Staphylococcus
NGTELKITLAFLFATILFALTSSL

SEQ ID NO: 1882712 - protein, 18 aa, Staphylococcus
NGTQFKITGAFILATTFF

SEQ ID NO: 1882713 - protein, 26 aa, Staphylococcus
NGVFTGYLKFDFKYANSNTVDVNEDF

SEQ ID NO: 1882714 - protein, 23 aa, Staphylococcus
NGWAENGTYCIIRRIQIHIETWD

SEQ ID NO: 1882715 - protein, 20 aa, Staphylococcus
NGWFQGMGWPPSGRVLVHWY

SEQ ID NO: 1882716 - protein, 19 aa, Staphylococcus
NGYAAGWFTNAHADYIYHT

SEQ ID NO: 1882717 - protein, 21 aa, Staphylococcus
NGYILRLFQLLILYATPMFVF

SEQ ID NO: 1882718 - protein, 36 aa, Staphylococcus
NHAKPPVFLVRFWTLMVSFILGLALMGIFIFNNLGI

SEQ ID NO: 1882719 - protein, 26 aa, Staphylococcus
NHDNCPLEAAIVIPLYTNHNVVGTLK

SEQ ID NO: 1882720 - protein, 23 aa, Staphylococcus
NHFIGAIAYILGMVIFTILMGNA

SEQ ID NO: 1882721 - protein, 23 aa, Staphylococcus
NHLIGAIAYILGMVLFTMLMGNA

SEQ ID NO: 1882722 - protein, 24 aa, Staphylococcus
NHLQYRFESIIAFIVIAISCKLIL

SEQ ID NO: 1882723 - protein, 24 aa, Staphylococcus
NHLSKRKIATLLAIMDKDDAKEIK

SEQ ID NO: 1882724 - protein, 20 aa, Staphylococcus
NHNAMLPSVLLLIASLILLF

SEQ ID NO: 1882725 - protein, 18 aa, Staphylococcus
NHPLMLLVQGVCFFVLYY

SEQ ID NO: 1882726 - protein, 19 aa, Staphylococcus
NHPNCPLQAAIVIPLHIQD

SEQ ID NO: 1882727 - protein, 24 aa, Staphylococcus
NHRNTYYLLGSVILLAILALIATY

SEQ ID NO: 1882728 - protein, 24 aa, Staphylococcus
NHSKFTLWLSLVITLIFTIVEFAG

SEQ ID NO: 1882729 - protein, 26 aa, Staphylococcus
NHSPRKPMSPLAWVIIALLIAIAIIA

SEQ ID NO: 1882730 - protein, 25 aa, Staphylococcus
NHTNRVALFLTISILGFIGLILGVM

SEQ ID NO: 1882731 - protein, 17 aa, Staphylococcus
NHVEYWFLMQIAMLIGF

SEQ ID NO: 1882732 - protein, 24 aa, Staphylococcus
NIDECLKEQFLSYFNQFDNKSINV

SEQ ID NO: 1882733 - protein, 21 aa, Staphylococcus
NIEEAKKLTVESSSFTQSSNV

SEQ ID NO: 1882734 - protein, 28 aa, Staphylococcus
NIEIYKIFELMGLFSIIIFLFFTFSLIF

SEQ ID NO: 1882735 - protein, 25 aa, Staphylococcus
NIEVKPAAVKVLKELSSQIKTHIND

SEQ ID NO: 1882736 - protein, 18 aa, Staphylococcus
NIFEEFTNTLTLGLRLYG

SEQ ID NO: 1882737 - protein, 19 aa, Staphylococcus
NIFFARVALELGSKKFEKG

SEQ ID NO: 1882738 - protein, 23 aa, Staphylococcus
NIFFGLCILSLILTILTLLFNRT

SEQ ID NO: 1882739 - protein, 19 aa, Staphylococcus
NIFKSLGFGVEEKRNDPNF

SEQ ID NO: 1882740 - protein, 19 aa, Staphylococcus
NIFMLPLFIPALVKSFGAG

SEQ ID NO: 1882741 - protein, 18 aa, Staphylococcus
NIFVFPIIIVAIAFILSF

SEQ ID NO: 1882742 - protein, 23 aa, Staphylococcus
NIGMTAIFLLFAFLKEIKLYQHF

SEQ ID NO: 1882743 - protein, 23 aa, Staphylococcus
NIHKDKIITIPLKIEQGDSAGYT

SEQ ID NO: 1882744 - protein, 19 aa, Staphylococcus
NIIAVAGIIVIVFFALKYA

SEQ ID NO: 1882745 - protein, 23 aa, Staphylococcus
NIIAYCLIIIFVLVVVLGVWLVN

SEQ ID NO: 1882746 - protein, 18 aa, Staphylococcus
NIIFKPYWWLITVFFIIV

SEQ ID NO: 1882747 - protein, 25 aa, Staphylococcus
NIIGAKWVFFSSFIILLFPIFLLSQ

SEQ ID NO: 1882748 - protein, 19 aa, Staphylococcus
NIIGSMVIVVWGSSIWSQI

SEQ ID NO: 1882749 - protein, 23 aa, Staphylococcus
NIIGSWFLLFAIGLLYKTVGTLN

SEQ ID NO: 1882750 - protein, 18 aa, Staphylococcus
NIIIVGAIILLSATWINA

SEQ ID NO: 1882751 - protein, 42 aa, Staphylococcus; identical to SEQ ID NO: 1576967

SEQ ID NO: 1882752 - protein, 43 aa, Staphylococcus
NIIKQNIYFSIIIKMIAFILVFPGLLTLWLAVFSDTGAAILVI

SEQ ID NO: 1882753 - protein, 19 aa, Staphylococcus
NIILPTLVTILAVDMGINV

SEQ ID NO: 1882754 - protein, 23 aa, Staphylococcus
NIIPELIGVLLLTHATYSTVLLI

SEQ ID NO: 1882755 - protein, 22 aa, Staphylococcus
NIIPELIGVVLLTHAYSTALLF

SEQ ID NO: 1882756 - protein, 19 aa, Staphylococcus
NIISWCLIIILSILNIYLI

SEQ ID NO: 1882757 - protein, 18 aa, Staphylococcus
NIKEEIKSRIHIKIPSIH

SEQ ID NO: 1882758 - protein, 23 aa, Staphylococcus
NIKEIKMWVLGLVGTIIGSLIIA

SEQ ID NO: 1882759 - protein, 24 aa, Staphylococcus
NIKGDTKLKEDIKFKKANAQDLNT

SEQ ID NO: 1882760 - protein, 19 aa, Staphylococcus
NIKGVTFTDPIPAVQNTLN

SEQ ID NO: 1882761 - protein, 31 aa, Staphylococcus
NIKLKSFTLIEMLVSLFLTTMMLTFFPQLIK

SEQ ID NO: 1882762 - protein, 19 aa, Staphylococcus
NIKTRVALYLFDNNELTNI

SEQ ID NO: 1882763 - protein, 19 aa, Staphylococcus
NIKVWPLLFLNIVIITPIV

SEQ ID NO: 1882764 - protein, 19 aa, Staphylococcus
NILCYAFVVVELFVTIVLP

SEQ ID NO: 1882765 - protein, 24 aa, Staphylococcus
NILLALLLYRFAYYFVPVAIALVL

SEQ ID NO: 1882766 - protein, 25 aa, Staphylococcus
NILPKVIGGIGWVLAKVTRQPKFES

SEQ ID NO: 1882767 - protein, 19 aa, Staphylococcus
NILRMILIEQIAMFLVTSV

SEQ ID NO: 1882768 - protein, 20 aa, Staphylococcus
NILRSIPFIILLIAIVPFTK

SEQ ID NO: 1882769 - protein, 26 aa, Staphylococcus
NIMIKGEGFNYIWFDITILLVFIIGF

SEQ ID NO: 1882770 - protein, 33 aa, Staphylococcus
NIMIKGQGWSNIWFDVLILFVFIIVFTTMNIIG

SEQ ID NO: 1882771 - protein, 24 aa, Staphylococcus
NIMLILCAFVMVYFVHLFNHMSLN

SEQ ID NO: 1882772 - protein, 23 aa, Staphylococcus
NIMRTRIGQFILLTAVLADLFTM

SEQ ID NO: 1882773 - protein, 20 aa, Staphylococcus
NINMALAFIVLVGLFIVGPT

SEQ ID NO: 1882774 - protein, 20 aa, Staphylococcus
NINMGLAFLVLVGLFIVGPT

SEQ ID NO: 1882775 - protein, 17 aa, Staphylococcus
NIPETYLAKAIELSNDY

SEQ ID NO: 1882776 - protein, 26 aa, Staphylococcus
NIPLTSQRLISWLNSRNIVPGYYGVN

SEQ ID NO: 1882777 - protein, 20 aa, Staphylococcus
NIPSRIAFAVSSQTDSRTII

SEQ ID NO: 1882778 - protein, 23 aa, Staphylococcus
NIQHVPALFALIFKSAFGLQSAF

SEQ ID NO: 1882779 - protein, 23 aa, Staphylococcus
NIQLPQFLGFFAGKRFVPIITSL

SEQ ID NO: 1882780 - protein, 27 aa, Staphylococcus
NIQNIWIYICWLGIFFVFSFMNMASIS

SEQ ID NO: 1882781 - protein, 42 aa, Staphylococcus
NIRQKKSKKWLYIIIALLLIVVAVFVTLAFMGGDSNSDKVSN

SEQ ID NO: 1882782 - protein, 29 aa, Staphylococcus
NISEQIKTIFPEVVSKSNARTILNNLANQ

SEQ ID NO: 1882783 - protein, 17 aa, Staphylococcus
NISFIRYIILVFVLLIS

SEQ ID NO: 1882784 - protein, 20 aa, Staphylococcus
NISMSRWALAGRHIGQDIMG

SEQ ID NO: 1882785 - protein, 24 aa, Staphylococcus
NISSDIFIWFKLVINDTSEYHQIK

SEQ ID NO: 1882786 - protein, 25 aa, Staphylococcus
NISSLKIYGLIFIGIIIFFIALIII

SEQ ID NO: 1882787 - protein, 26 aa, Staphylococcus
NITKITWKAKDKGIGPNEFIEFPLLV

SEQ ID NO: 1882788 - protein, 19 aa, Staphylococcus
NITKITWKATGKGIGPNEF

SEQ ID NO: 1882789 - protein, 27 aa, Staphylococcus
NITKIVLMILMFIGRVGLISFIIMIAG

SEQ ID NO: 1882790 - protein, 24 aa, Staphylococcus
NITPDHYLFEGNITAKAYDQTDET

SEQ ID NO: 1882791 - protein, 18 aa, Staphylococcus
NITYGICGPMPIVLTSLI

SEQ ID NO: 1882792 - protein, 29 aa, Staphylococcus
NIVLLTVVGFCWGAFIAAYVPLSALIPSL

SEQ ID NO: 1882793 - protein, 23 aa, Staphylococcus
NIVTFISFRLLQGFSAGVITTLM

SEQ ID NO: 1882794 - protein, 24 aa, Staphylococcus
NIWGDEWIFVMAFLPWIIIILPYL

SEQ ID NO: 1882795 - protein, 26 aa, Staphylococcus
NIWLDCVTIIIALSIMFFLDIKLTLA

SEQ ID NO: 1882796 - protein, 26 aa, Staphylococcus
NIWLDCVTIIIALSIMFFLDVKLTIA

SEQ ID NO: 1882797 - protein, 26 aa, Staphylococcus
NIWLDCVTIIIALSIMFFLDVKLTLA

SEQ ID NO: 1882798 - protein, 20 aa, Staphylococcus
NIYLCVSVIIITPVIVYITE

SEQ ID NO: 1882799 - protein, 17 aa, Staphylococcus
NIYMFQNFAFKIIQQLR

SEQ ID NO: 1882800 - protein, 19 aa, Staphylococcus
NIYRAGTYVKDARKQNKHV

SEQ ID NO: 1882801 - protein, 22 aa, Staphylococcus
NKAGDEKGWVAGWHTNLNIHAD

SEQ ID NO: 1882802 - protein, 17 aa, Staphylococcus
NKAKRNVDQSINNSNVD

SEQ ID NO: 1882803 - protein, 32 aa, Staphylococcus
NKALGIMLVCFLFNIIGGFILFALMKFTPIMT

SEQ ID NO: 1882804 - protein, 23 aa, Staphylococcus
NKANKGFSFTVVWEYFKNNMQAS

SEQ ID NO: 1882805 - protein, 17 aa, Staphylococcus
NKAQFDKGVVTRQNNQS

SEQ ID NO: 1882806 - protein, 25 aa, Staphylococcus
NKAVLLCYGVSLTLLTMFISMYTVF

SEQ ID NO: 1882807 - protein, 30 aa, Staphylococcus
NKDDIIITGWNRYWIFQRYDLKYLDDPKGS

SEQ ID NO: 1882808 - protein, 24 aa, Staphylococcus
NKDGELIGIVSLKINMPSIEGMGF

SEQ ID NO: 1882809 - protein, 19 aa, Staphylococcus
NKDLIKIYLTSIIDNLHNA

SEQ ID NO: 1882810 - protein, 26 aa, Staphylococcus
NKDSKLPVIFWMHGGGFIAGDKQYKN

SEQ ID NO: 1882811 - protein, 18 aa, Staphylococcus
NKDSRYVVGVTQQPVEML

SEQ ID NO: 1882812 - protein, 18 aa, Staphylococcus
NKDWKISTKHVKNDNILI

SEQ ID NO: 1882813 - protein, 17 aa, Staphylococcus
NKDYLLYWMELGQGDYD

SEQ ID NO: 1882814 - protein, 17 aa, Staphylococcus
NKEFEPIPIPKKEKPNP

SEQ ID NO: 1882815 - protein, 24 aa, Staphylococcus
NKELSIGQLTDWMFQNGYDTRAFV

SEQ ID NO: 1882816 - protein, 23 aa, Staphylococcus
NKEVIKLSVSIGVGYLSPDEYKS

SEQ ID NO: 1882817 - protein, 23 aa, Staphylococcus
NKEVIKLSVSIGVGYLTKDDHKS

SEQ ID NO: 1882818 - protein, 23 aa, Staphylococcus
NKEVIKLSVSIGVGYLTQNDRKS

SEQ ID NO: 1882819 - protein, 23 aa, Staphylococcus
NKEVIKLSVSIGVGYLTTDDYKS

SEQ ID NO: 1882820 - protein, 30 aa, Staphylococcus
NKFDGFKKDLKWELGLGATIVTATIALINV

SEQ ID NO: 1882821 - protein, 23 aa, Staphylococcus
NKFRLPRWITILIPALCSSSLFI

SEQ ID NO: 1882822 - protein, 26 aa, Staphylococcus
NKFSEVELPMALSFFSGKRLVPIMTV

SEQ ID NO: 1882823 - protein, 37 aa, Staphylococcus
NKFSSHPSRKDFVISFITGALIGSAVGLFYKNKAEEK

SEQ ID NO: 1882824 - protein, 20 aa, Staphylococcus
NKFYWVVMAFIIIFLGIFIF

SEQ ID NO: 1882825 - protein, 21 aa, Staphylococcus
NKGDKALTIDSQMFKLKSGDK

SEQ ID NO: 1882826 - protein, 22 aa, Staphylococcus
NKGYKPIWIIISFALLIGILLL

SEQ ID NO: 1882827 - protein, 22 aa, Staphylococcus
NKGYKPLWIVISFIVLVIILLL

SEQ ID NO: 1882828 - protein, 17 aa, Staphylococcus
NKHLLNMSVKSYIEETQ

SEQ ID NO: 1882829 - protein, 18 aa, Staphylococcus
NKHVVAFDINSKNGASLI

SEQ ID NO: 1882830 - protein, 18 aa, Staphylococcus
NKIAADAIEALRTAVNKV

SEQ ID NO: 1882831 - protein, 22 aa, Staphylococcus
NKIAKIFLYHHVKNINIQILKI

SEQ ID NO: 1882832 - protein, 17 aa, Staphylococcus
NKIELPAYLGFFSGSRF

SEQ ID NO: 1882833 - protein, 24 aa, Staphylococcus
NKIFYRLILPLSKRSIIAGIMMSF

SEQ ID NO: 1882834 - protein, 17 aa, Staphylococcus
NKIGYVMQSNSMMSGTI

SEQ ID NO: 1882835 - protein, 33 aa, Staphylococcus
NKIINLLVCLAFLGGIIFGFLSWFRRLGRMKTP

SEQ ID NO: 1882836 - protein, 21 aa, Staphylococcus
NKILLKILIIVIVLVAIFMGA

SEQ ID NO: 1882837 - protein, 23 aa, Staphylococcus
NKIPRWGSITLIFIGLIIIIGVV

SEQ ID NO: 1882838 - protein, 17 aa, Staphylococcus
NKISPKFSLIFLIVIYL

SEQ ID NO: 1882839 - protein, 23 aa, Staphylococcus
NKISPKFSVIFLIIIYLTIGPLF

SEQ ID NO: 1882840 - protein, 22 aa, Staphylococcus
NKISPKFSVVFLVIIYLTIGPL

SEQ ID NO: 1882841 - protein, 31 aa, Staphylococcus
NKIVDFLKEHWIKILIAIALILILVLVKAIF

SEQ ID NO: 1882842 - protein, 21 aa, Staphylococcus
NKKFSSVFIYSAIVVAIVVSI

SEQ ID NO: 1882843 - protein, 21 aa, Staphylococcus
NKKGKAIYINVYKNGSEWSVD

SEQ ID NO: 1882844 - protein, 29 aa, Staphylococcus
NKKPIWIIILSIIFILLIGALLYGAYYYY

SEQ ID NO: 1882845 - protein, 25 aa, Staphylococcus
NKKRLRKLPFIILIILIILISIIVY

SEQ ID NO: 1882846 - protein, 19 aa, Staphylococcus
NKKRSKTLISLVQNVVSYV

SEQ ID NO: 1882847 - protein, 24 aa, Staphylococcus
NKKSKKWYLPFGYDAEDIELNNIN

SEQ ID NO: 1882848 - protein, 24 aa, Staphylococcus
NKKTKKWYLPFGYGADDIDLNNIS

SEQ ID NO: 1882849 - protein, 27 aa, Staphylococcus
NKLEGYTIAISFIGIFATFGGAYLGAK

SEQ ID NO: 1882850 - protein, 23 aa, Staphylococcus
NKLFKSNDYYPIYGSSELNKEDP

SEQ ID NO: 1882851 - protein, 18 aa, Staphylococcus
NKLGSFFSSYSLSLNQAI

SEQ ID NO: 1882852 - protein, 31 aa, Staphylococcus
NKLKSIVEMIPWLACIGFIYVASSFAYAFLF

SEQ ID NO: 1882853 - protein, 18 aa, Staphylococcus
NKLLIGIIIGVLTFWLFA

SEQ ID NO: 1882854 - protein, 17 aa, Staphylococcus
NKLPWGILLLFGGGLSL

SEQ ID NO: 1882855 - protein, 19 aa, Staphylococcus
NKLSAKYLSVWEKATTYQM

SEQ ID NO: 1882856 - protein, 18 aa, Staphylococcus
NKLSYGIILHDEVTLSNH

SEQ ID NO: 1882857 - protein, 19 aa, Staphylococcus
NKMFRRLINGVLFIGIFIY

SEQ ID NO: 1882858 - protein, 23 aa, Staphylococcus
NKNIIKELFDFVNVEDEESYYSH

SEQ ID NO: 1882859 - protein, 18 aa, Staphylococcus
NKPDHIFVYWATITSVAQ

SEQ ID NO: 1882860 - protein, 17 aa, Staphylococcus
NKPFELFITGFFDNETD

SEQ ID NO: 1882861 - protein, 18 aa, Staphylococcus
NKPLRTIMYFGMGIFGIS

SEQ ID NO: 1882862 - protein, 20 aa, Staphylococcus
NKPTAIIFWVIAELAIIATD

SEQ ID NO: 1882863 - protein, 17 aa, Staphylococcus
NKQFTWFREHPYASSAR

SEQ ID NO: 1882864 - protein, 18 aa, Staphylococcus
NKQIKRETCSSKKAKTNK

SEQ ID NO: 1882865 - protein, 19 aa, Staphylococcus
NKQNTEWVGYATPNKAARN

SEQ ID NO: 1882866 - protein, 27 aa, Staphylococcus
NKQVRFKLWQFLLILLGVILITAGITV

SEQ ID NO: 1882867 - protein, 17 aa, Staphylococcus
NKREWDYVVGITDLPMF

SEQ ID NO: 1882868 - protein, 18 aa, Staphylococcus
NKRHEVLFEKGYVETWHH

SEQ ID NO: 1882869 - protein, 24 aa, Staphylococcus
NKSPLLVGIGDDFNVIASDALAMI

SEQ ID NO: 1882870 - protein, 24 aa, Staphylococcus
NKSPLLVGLGDHFNVIASDALAMI

SEQ ID NO: 1882871 - protein, 24 aa, Staphylococcus
NKSWHVLPLGFLFGLGFDTASEIA

SEQ ID NO: 1882872 - protein, 23 aa, Staphylococcus
NKTQWWLVIPVGLVYAAIYYIIF

SEQ ID NO: 1882873 - protein, 23 aa, Staphylococcus
NKTQWWLVIPVGVVYAFIYYFVF

SEQ ID NO: 1882874 - protein, 17 aa, Staphylococcus
NKTRFWIILITILVLFL

SEQ ID NO: 1882875 - protein, 23 aa, Staphylococcus
NKTYPKVEVLNIYGNVEDGTNSD

SEQ ID NO: 1882876 - protein, 23 aa, Staphylococcus
NKVIEFIGFLGISYVTFKSVQLL

SEQ ID NO: 1882877 - protein, 25 aa, Staphylococcus
NKVMYPVLCSFAIGLVLLAITHTSL

SEQ ID NO: 1882878 - protein, 17 aa, Staphylococcus
NKVPIFVVMGIYTIIYS

SEQ ID NO: 1882879 - protein, 18 aa, Staphylococcus
NKVSGLPEGVTFDPRTNT

SEQ ID NO: 1882880 - protein, 18 aa, Staphylococcus
NKWIKGDLNLGILLGIGT

SEQ ID NO: 1882881 - protein, 21 aa, Staphylococcus
NKWVWAIAFANIFVYFVRYGV

SEQ ID NO: 1882882 - protein, 24 aa, Staphylococcus
NKWVWAIAFANIFVYFVRYGVLDW

SEQ ID NO: 1882883 - protein, 23 aa, Staphylococcus
NKYELKAIIAPGMISIMSFFTTL

SEQ ID NO: 1882884 - protein, 23 aa, Staphylococcus
NKYLGIPIFLGIIWLIFQITFTW

SEQ ID NO: 1882885 - protein, 24 aa, Staphylococcus
NKYLGIPIFLGIIWLIFQTTFTWV

SEQ ID NO: 1882886 - protein, 18 aa, Staphylococcus
NKYQCTWWAYQRRVQLGK

SEQ ID NO: 1882887 - protein, 25 aa, Staphylococcus
NKYSHIDLGFSQWGFKQRPDESYID

SEQ ID NO: 1882888 - protein, 26 aa, Staphylococcus
NKYSYRKLFIIGLVLFTFGSLICAIS

SEQ ID NO: 1882889 - protein, 25 aa, Staphylococcus
NLAMEIVGYFLLMNRRLFKMYDRIE

SEQ ID NO: 1882890 - protein, 23 aa, Staphylococcus
NLANEINPWIGLVLTIIMLAVMY

SEQ ID NO: 1882891 - protein, 19 aa, Staphylococcus
NLDAIAHCATRLRLVLNDE

SEQ ID NO: 1882892 - protein, 28 aa, Staphylococcus
NLDKKITRFSIRKYQGFGAASVAIIGFI

SEQ ID NO: 1882893 - protein, 22 aa, Staphylococcus
NLDMMNDLIFYGAHTLVTDRPD

SEQ ID NO: 1882894 - protein, 27 aa, Staphylococcus
NLDPRAKLCFVFFYIILVFFCHNFAMY

SEQ ID NO: 1882895 - protein, 29 aa, Staphylococcus
NLDVYTDVKWCRMMIRQILSNSLKYSQGQ

SEQ ID NO: 1882896 - protein, 18 aa, Staphylococcus
NLEFKFISANSLKQLDTN

SEQ ID NO: 1882897 - protein, 18 aa, Staphylococcus
NLEINLFGIESWGINATN

SEQ ID NO: 1882898 - protein, 18 aa, Staphylococcus
NLEINLFGIESWGREDKI

SEQ ID NO: 1882899 - protein, 18 aa, Staphylococcus
NLEINLFGIESWGSQAKI

SEQ ID NO: 1882900 - protein, 18 aa, Staphylococcus
NLEINLFGIETWGRENQL

SEQ ID NO: 1882901 - protein, 21 aa, Staphylococcus
NLFGHNIILPALRSITIGEKV

SEQ ID NO: 1882902 - protein, 19 aa, Staphylococcus
NLFHLPTFILLLTVGVIGS

SEQ ID NO: 1882903 - protein, 45 aa, Staphylococcus
NLFLAYVPFELCLLLKLFKPKKAFEWPLFIVFGLIFLLLVPNTFY

SEQ ID NO: 1882904 - protein, 18 aa, Staphylococcus
NLGEKWGLVAGGSLLVDY

SEQ ID NO: 1882905 - protein, 19 aa, Staphylococcus
NLGKEIMLHYSYYNDKKPE

SEQ ID NO: 1882906 - protein, 19 aa, Staphylococcus
NLGLKQAKITAVIQPISSV

SEQ ID NO: 1882907 - protein, 18 aa, Staphylococcus
NLHKRLALIVLSIVGNKT

SEQ ID NO: 1882908 - protein, 24 aa, Staphylococcus
NLHTRVALTIIRYIGASTSKILLG

SEQ ID NO: 1882909 - protein, 34 aa, Staphylococcus
NLIITFPILRKFKVATPIFKPLFAWQMNRTLLTI

SEQ ID NO: 1882910 - protein, 25 aa, Staphylococcus
NLIIVGLFIICMFVSISMGTSVGTV

SEQ ID NO: 1882911 - protein, 26 aa, Staphylococcus
NLIIVGLFVICMFVSLSMGTSVGTVA

SEQ ID NO: 1882912 - protein, 20 aa, Staphylococcus
NLILAFIIIFLERNRRSATS

SEQ ID NO: 1882913 - protein, 25 aa, Staphylococcus
NLILFPRLGASLTVIITIAGQIVMG

SEQ ID NO: 1882914 - protein, 18 aa, Staphylococcus
NLIPGWFKTIVQVGNDLI

SEQ ID NO: 1882915 - protein, 18 aa, Staphylococcus
NLISWYVFVFIYDVQQKF

SEQ ID NO: 1882916 - protein, 18 aa, Staphylococcus
NLISYMLIIFGIGVTLGN

SEQ ID NO: 1882917 - protein, 18 aa, Staphylococcus
NLIVAVMLLSAFIAILNQ

SEQ ID NO: 1882918 - protein, 21 aa, Staphylococcus
NLKASKKMGGKTFNGALDITM

SEQ ID NO: 1882919 - protein, 20 aa, Staphylococcus
NLKKAVIALSEFIINKDKVQ

SEQ ID NO: 1882920 - protein, 22 aa, Staphylococcus
NLKKTLFFGLVFSFIAIGLYFL

SEQ ID NO: 1882921 - protein, 22 aa, Staphylococcus
NLKNKYSIRKFTVGTASILLGS

SEQ ID NO: 1882922 - protein, 26 aa, Staphylococcus
NLKVLYCLFISFTLLIMFISMYAILN

SEQ ID NO: 1882923 - protein, 17 aa, Staphylococcus
NLKWLSVLATIIMTFVQ

SEQ ID NO: 1882924 - protein, 30 aa, Staphylococcus; identical to SEQ ID NO: 1743892

SEQ ID NO: 1882925 - protein, 31 aa, Staphylococcus
NLLGARLFGELEFWFSIIKVVTIVAMVIVGL

SEQ ID NO: 1882926 - protein, 26 aa, Staphylococcus
NLLIIGLFVICMFVSISMGTSVGTVA

SEQ ID NO: 1882927 - protein, 18 aa, Staphylococcus
NLLILSFGMMLIGEALLF

SEQ ID NO: 1882928 - protein, 21 aa, Staphylococcus
NLLLLPRLGAALTVVITVTGQ

SEQ ID NO: 1882929 - protein, 25 aa, Staphylococcus
NLLLLPRLGAALTVVMTVTGQIFMG

SEQ ID NO: 1882930 - protein, 25 aa, Staphylococcus
NLLLLPRLGASLTVVMTVSGQIIMG

SEQ ID NO: 1882931 - protein, 18 aa, Staphylococcus
NLLLPFIIITGIFIRLIM

SEQ ID NO: 1882932 - protein, 19 aa, Staphylococcus
NLLNNWKLTEIINFSDQQI

SEQ ID NO: 1882933 - protein, 29 aa, Staphylococcus
NLLSARLFGELEFWFAIIKIATIVGLIVV

SEQ ID NO: 1882934 - protein, 25 aa, Staphylococcus
NLMDGRIALGIIIFVIFVYYTLSTI

SEQ ID NO: 1882935 - protein, 23 aa, Staphylococcus
NLMILKVYAKFHFTDTLVQVAKI

SEQ ID NO: 1882936 - protein, 25 aa, Staphylococcus
NLMIPCKPDHPFVYWATLKNAASLL

SEQ ID NO: 1882937 - protein, 25 aa, Staphylococcus
NLNHARDSLIPDKDPLEIAKQALEN

SEQ ID NO: 1882938 - protein, 20 aa, Staphylococcus
NLNKVCHVHGISALNVNDLS

SEQ ID NO: 1882939 - protein, 18 aa, Staphylococcus
NLNVFKYPMFVLGAAMVF

SEQ ID NO: 1882940 - protein, 18 aa, Staphylococcus
NLPHLLTYTLKRIKSLWK

SEQ ID NO: 1882941 - protein, 18 aa, Staphylococcus
NLQINLFGIESWGRENKS

SEQ ID NO: 1882942 - protein, 18 aa, Staphylococcus
NLSIIGACTVVIISAGVI

SEQ ID NO: 1882943 - protein, 17 aa, Staphylococcus
NLTRANRNFRFFQIFTA

SEQ ID NO: 1882944 - protein, 19 aa, Staphylococcus
NLVKSKGFGSDWINISLGW

SEQ ID NO: 1882945 - protein, 23 aa, Staphylococcus
NLYLIKRLADFQLRISNHNNYLG

SEQ ID NO: 1882946 - protein, 22 aa, Staphylococcus
NLYVMFEIMLLASFVLVTLGQS

SEQ ID NO: 1882947 - protein, 20 aa, Staphylococcus
NMASGLKTLIGRIKGHIGGM

SEQ ID NO: 1882948 - protein, 25 aa, Staphylococcus
NMDLFRGTTFLGIVSLFAWGLGYFG

SEQ ID NO: 1882949 - protein, 18 aa, Staphylococcus
NMGFPAFVGILLGLFELV

SEQ ID NO: 1882950 - protein, 24 aa, Staphylococcus
NMGTYIKYAFFWVWGFAIVLLLIA

SEQ ID NO: 1882951 - protein, 24 aa, Staphylococcus
NMHSRLHYALAFFLFSSMVAIIKF

SEQ ID NO: 1882952 - protein, 23 aa, Staphylococcus
NMIKGSLLANISLLVPAIASVVP

SEQ ID NO: 1882953 - protein, 17 aa, Staphylococcus
NMIKNFFEMATWLEPFG

SEQ ID NO: 1882954 - protein, 26 aa, Staphylococcus
NMKRFYFKLNKVIGMEIRQHPLLERK

SEQ ID NO: 1882955 - protein, 26 aa, Staphylococcus
NMLFVKRRFREFALYQVIGLSKRNLV

SEQ ID NO: 1882956 - protein, 25 aa, Staphylococcus
NMLIPFLLIWIIDGFKGIKETLPAI

SEQ ID NO: 1882957 - protein, 24 aa, Staphylococcus
NMLNQRLGDILAYKVKHDLRQKIV

SEQ ID NO: 1882958 - protein, 17 aa, Staphylococcus
NMLPLVIAGGILMAIAF

SEQ ID NO: 1882959 - protein, 25 aa, Staphylococcus
NMLSYKYRRFVTPVTMRVKASDQLK

SEQ ID NO: 1882960 - protein, 23 aa, Staphylococcus
NMNKIRFISIPGIISALGLIIIM

SEQ ID NO: 1882961 - protein, 18 aa, Staphylococcus
NMNVPFINKFILKMKKDE

SEQ ID NO: 1882962 - protein, 20 aa, Staphylococcus
NMRDFSIKFYKHNMYDPKLK

SEQ ID NO: 1882963 - protein, 19 aa, Staphylococcus
NMRERALEIGATFHIVSLP

SEQ ID NO: 1882964 - protein, 21 aa, Staphylococcus
NMRERALEIGATFHIVSLPDA

SEQ ID NO: 1882965 - protein, 22 aa, Staphylococcus
NMRERALEIGATFHIVSLPDSG

SEQ ID NO: 1882966 - protein, 23 aa, Staphylococcus
NMRERALEIGATFHIVSLPDSGT

SEQ ID NO: 1882967 - protein, 19 aa, Staphylococcus
NMSEIFIAVIVFMITVAVL

SEQ ID NO: 1882968 - protein, 26 aa, Staphylococcus
NMYKEIIKYSIPFVIVSLNFPLFNLV

SEQ ID NO: 1882969 - protein, 26 aa, Staphylococcus
NMYLPFILADAINWLSFTLLHRPSGL

SEQ ID NO: 1882970 - protein, 23 aa, Staphylococcus
NNADSIFSWLFTLSFIILSFYLV

SEQ ID NO: 1882971 - protein, 35 aa, Staphylococcus
NNAIPVFAGVIVLLAFVLLVFVFRSILVPLKAVLG

SEQ ID NO: 1882972 - protein, 24 aa, Staphylococcus
NNAIPVFAGVIVVLAFFLLMFVFR

SEQ ID NO: 1882973 - protein, 35 aa, Staphylococcus
NNAIPVFAGVIVVLAFVLLMIVFRSILVPLKAVLG

SEQ ID NO: 1882974 - protein, 24 aa, Staphylococcus
NNAISEINKLSGLNDAQRQKAIQN

SEQ ID NO: 1882975 - protein, 18 aa, Staphylococcus
NNEAELLLLLISNNGSPD

SEQ ID NO: 1882976 - protein, 25 aa, Staphylococcus
NNEAQRALKHIKIKGQSDKDIANQI

SEQ ID NO: 1882977 - protein, 18 aa, Staphylococcus
NNEIHVRKGIIFINTNII

SEQ ID NO: 1882978 - protein, 18 aa, Staphylococcus
NNEMVVVIAIVFMIAFGS

SEQ ID NO: 1882979 - protein, 28 aa, Staphylococcus
NNFCIYVPYGDDWFSYFMRRLAERPQNL

SEQ ID NO: 1882980 - protein, 17 aa, Staphylococcus
NNFIKSSIIIFIIGSIL

SEQ ID NO: 1882981 - protein, 33 aa, Staphylococcus
NNFKAFTLIEMLFSFSIFCLLLSLIPPLFQTVN

SEQ ID NO: 1882982 - protein, 17 aa, Staphylococcus
NNGAAWGILSGRMSFFF

SEQ ID NO: 1882983 - protein, 17 aa, Staphylococcus
NNGELSWIFYVSMIVLT

SEQ ID NO: 1882984 - protein, 19 aa, Staphylococcus
NNGGPYGVVLARTNNGRDR

SEQ ID NO: 1882985 - protein, 19 aa, Staphylococcus
NNGIEILIHVGLDTVNLKG

SEQ ID NO: 1882986 - protein, 18 aa, Staphylococcus
NNGLNLLGVSSFYQQVVK

SEQ ID NO: 1882987 - protein, 17 aa, Staphylococcus
NNGRISDTILHFSSSLV

SEQ ID NO: 1882988 - protein, 27 aa, Staphylococcus
NNGVMGVIYKAQLVLTPYGAKQYIDNI

SEQ ID NO: 1882989 - protein, 22 aa, Staphylococcus
NNHQVRRLAKVEATNTDNNVTQ

SEQ ID NO: 1882990 - protein, 22 aa, Staphylococcus
NNHWIRRIDWVLIGILVLLAFV

SEQ ID NO: 1882991 - protein, 23 aa, Staphylococcus
NNKDEVRHSSAYINADPTKISAY

SEQ ID NO: 1882992 - protein, 23 aa, Staphylococcus
NNKDIRTFLNFSSIYRWQTTPLE

SEQ ID NO: 1882993 - protein, 18 aa, Staphylococcus
NNKEKGWVAGWHTNLNIQ

SEQ ID NO: 1882994 - protein, 21 aa, Staphylococcus
NNKIFNIYKFRSMKVETPDVA

SEQ ID NO: 1882995 - protein, 26 aa, Staphylococcus
NNKPLRAILYFGLFVCAMSFLYILFN

SEQ ID NO: 1882996 - protein, 26 aa, Staphylococcus
NNKPLRAMIYLGLIVFFISLLYIGYI

SEQ ID NO: 1882997 - protein, 26 aa, Staphylococcus
NNKPLRAMIYLGMFIFGLSIIYIIYL

SEQ ID NO: 1882998 - protein, 21 aa, Staphylococcus
NNKPLRAMIYLGMTIFSLSIV

SEQ ID NO: 1882999 - protein, 20 aa, Staphylococcus
NNKPRPGQEQQQQQPTVKNT

SEQ ID NO: 1883000 - protein, 20 aa, Staphylococcus
NNKVKLNGERNVARTQETNL

SEQ ID NO: 1883001 - protein, 31 aa, Staphylococcus
NNLEEAARTGNPIKLMIGFNARDRHHNPETL

SEQ ID NO: 1883002 - protein, 17 aa, Staphylococcus
NNLFKTIVVYGLALLFH

SEQ ID NO: 1883003 - protein, 26 aa, Staphylococcus
NNLLMFCPLLPLIAFLSIFISPEIGV

SEQ ID NO: 1883004 - protein, 17 aa, Staphylococcus
NNLPRKLVPHGTSMNNT

SEQ ID NO: 1883005 - protein, 36 aa, Staphylococcus
NNLRHPYKIKRLVGQSGMSYGALGGRAITALSQGLA

SEQ ID NO: 1883006 - protein, 17 aa, Staphylococcus
NNLVLGESILVVGNPLG

SEQ ID NO: 1883007 - protein, 24 aa, Staphylococcus
NNMLLRTVILFTITVVFAVSSYTG

SEQ ID NO: 1883008 - protein, 19 aa, Staphylococcus
NNPNCSLTSAIVIPLMINQ

SEQ ID NO: 1883009 - protein, 19 aa, Staphylococcus
NNPSKALSMFVKGLGETEG

SEQ ID NO: 1883010 - protein, 29 aa, Staphylococcus
NNPSMYGYLVKGWLALHEVGHGYDGIMVN

SEQ ID NO: 1883011 - protein, 41 aa, Staphylococcus
NNQEPKTGATHFPPRGSQRRRRRRRETATHKQEEGNKQEEV

SEQ ID NO: 1883012 - protein, 19 aa, Staphylococcus
NNRLYSVATLANFLLNTVA

SEQ ID NO: 1883013 - protein, 19 aa, Staphylococcus
NNRNSLFVSGEWKISQTQY

SEQ ID NO: 1883014 - protein, 23 aa, Staphylococcus
NNSAKIPKHFSFNRILMDKNSKG

SEQ ID NO: 1883015 - protein, 25 aa, Staphylococcus
NNSILFEVRLPRMLEALLAGIGLSI

SEQ ID NO: 1883016 - protein, 23 aa, Staphylococcus
NNSIPPWMLIIFWAASIVILLGT

SEQ ID NO: 1883017 - protein, 20 aa, Staphylococcus
NNSSGFIFILFLFYLIASLF

SEQ ID NO: 1883018 - protein, 25 aa, Staphylococcus
NNTNRVALFLAISILGFIGLILGIM

SEQ ID NO: 1883019 - protein, 19 aa, Staphylococcus
NNTTFNFFTLWMGAVHNIP

SEQ ID NO: 1883020 - protein, 17 aa, Staphylococcus
NNVPIRILLFYVGGLLV

SEQ ID NO: 1883021 - protein, 20 aa, Staphylococcus
NNWFGHCMSDIVGSSGSKGR

SEQ ID NO: 1883022 - protein, 18 aa, Staphylococcus
NNYITFEGNNRYGATTSW

SEQ ID NO: 1883023 - protein, 35 aa, Staphylococcus
NNYLPQVFKSMCIPLVIIIVMCFIHLNTAIIMAVT

SEQ ID NO: 1883024 - protein, 24 aa, Staphylococcus
NNYSIPYFLGTVGILYNKKAYPNE

SEQ ID NO: 1883025 - protein, 28 aa, Staphylococcus
NPEVFTDVKWCRMMIRQILSNSLKYSQG

SEQ ID NO: 1883026 - protein, 25 aa, Staphylococcus
NPEYPMFYTPSAVDYSSFMSNNGGP

SEQ ID NO: 1883027 - protein, 23 aa, Staphylococcus
NPFHRIDYMSAYALNSPFIYHYN

SEQ ID NO: 1883028 - protein, 23 aa, Staphylococcus
NPFQRFVKMLSDIFVPIIPAIVA

SEQ ID NO: 1883029 - protein, 27 aa, Staphylococcus
NPGNYTIWVSGAHKMHKESYRIVERDK

SEQ ID NO: 1883030 - protein, 19 aa, Staphylococcus
NPGPGLGILLAYMIFGKGT

SEQ ID NO: 1883031 - protein, 23 aa, Staphylococcus
NPIMTCFLAMIFLISPVTDNIKH

SEQ ID NO: 1883032 - protein, 19 aa, Staphylococcus
NPIQRLVKLLGDIFIPILP

SEQ ID NO: 1883033 - protein, 27 aa, Staphylococcus
NPKLSLIVYLVMGWVGIIFLPVIIIRT

SEQ ID NO: 1883034 - protein, 24 aa, Staphylococcus
NPKPKHGIGTWIGKDIKFMTKHYG

SEQ ID NO: 1883035 - protein, 24 aa, Staphylococcus
NPKPKKGVGTWIGKDINQLTKKYG

SEQ ID NO: 1883036 - protein, 22 aa, Staphylococcus
NPKRDIPIVIIIATIFVGLLYA

SEQ ID NO: 1883037 - protein, 17 aa, Staphylococcus
NPLGLEFANTVTSGIIS

SEQ ID NO: 1883038 - protein, 18 aa, Staphylococcus
NPLIKDVEIHKQLPNTLN

SEQ ID NO: 1883039 - protein, 18 aa, Staphylococcus
NPLPKHRKTILGILVAVV

SEQ ID NO: 1883040 - protein, 23 aa, Staphylococcus
NPLQRFVKMLSDIFVPIIPAIVA

SEQ ID NO: 1883041 - protein, 17 aa, Staphylococcus
NPLRPDVKICTNCGAPV

SEQ ID NO: 1883042 - protein, 18 aa, Staphylococcus
NPMMGMIFVSTLIAFTFA

SEQ ID NO: 1883043 - protein, 22 aa, Staphylococcus
NPMPKEGIGTWVGQNLKKLTNT

SEQ ID NO: 1883044 - protein, 23 aa, Staphylococcus
NPNEPYFVKYLYDPDNKDISPEG

SEQ ID NO: 1883045 - protein, 20 aa, Staphylococcus
NPNYAEGIIMKYAKAVNTDS

SEQ ID NO: 1883046 - protein, 25 aa, Staphylococcus
NPPFFFSVLLPIVFISAIIGILQYT

SEQ ID NO: 1883047 - protein, 25 aa, Staphylococcus
NPPQEIPVQLEVTRYVDPEGNEVQE

SEQ ID NO: 1883048 - protein, 26 aa, Staphylococcus
NPQIIYDIGFQFSFLISLFLIISSPL

SEQ ID NO: 1883049 - protein, 29 aa, Staphylococcus
NPQVIVLNSLPGFNLINGGKVGVLNAVLE

SEQ ID NO: 1883050 - protein, 24 aa, Staphylococcus
NPRKDLPGAIAIGIGCIMLVYLLI

SEQ ID NO: 1883051 - protein, 17 aa, Staphylococcus
NPSDIILFLTLSNNTMR

SEQ ID NO: 1883052 - protein, 19 aa, Staphylococcus
NQADVHFVIEVINDDNNKK

SEQ ID NO: 1883053 - protein, 17 aa, Staphylococcus
NQAHSLTSWSFTLLMIA

SEQ ID NO: 1883054 - protein, 23 aa, Staphylococcus
NQAMKELKQSIADKNDTLNSSNY

SEQ ID NO: 1883055 - protein, 25 aa, Staphylococcus
NQANECYKRKLFLPAAATLSVALET

SEQ ID NO: 1883056 - protein, 25 aa, Staphylococcus
NQDFYRLFRKQSFNNEYLDYLQKGS

SEQ ID NO: 1883057 - protein, 23 aa, Staphylococcus
NQFKSSIIEQSELERQEADDKVN

SEQ ID NO: 1883058 - protein, 23 aa, Staphylococcus
NQFNLYAALAFFALINMIVLILT

SEQ ID NO: 1883059 - protein, 18 aa, Staphylococcus
NQIKAKAIQDMKAVQTEV

SEQ ID NO: 1883060 - protein, 17 aa, Staphylococcus
NQIWKKHETTIRNYDEN

SEQ ID NO: 1883061 - protein, 22 aa, Staphylococcus
NQKFLKAGWFYQATIIITLLNM

SEQ ID NO: 1883062 - protein, 25 aa, Staphylococcus
NQKIELGFFITFNFISALIFGVVSY

SEQ ID NO: 1883063 - protein, 22 aa, Staphylococcus
NQKNGKSRQGLNTEHYNRDEFV

SEQ ID NO: 1883064 - protein, 24 aa, Staphylococcus
NQKNRKWYLPFGYGAEDIELNKIS

SEQ ID NO: 1883065 - protein, 17 aa, Staphylococcus
NQKWYPASMTKLMTMYL

SEQ ID NO: 1883066 - protein, 26 aa, Staphylococcus
NQLFIKRRTREFALFQLIGLTRQNIL

SEQ ID NO: 1883067 - protein, 25 aa, Staphylococcus
NQMIFFKVRVPRTFEALMVGAILTL

SEQ ID NO: 1883068 - protein, 23 aa, Staphylococcus
NQMILLKVRLPRIIEALLTGAIL

SEQ ID NO: 1883069 - protein, 24 aa, Staphylococcus
NQMRELKGLKPLKINDDIAHIASI

SEQ ID NO: 1883070 - protein, 18 aa, Staphylococcus
NQPGEWKNQDMGNGSGND

SEQ ID NO: 1883071 - protein, 20 aa, Staphylococcus
NQQFPPRNAQRRQRKRQRNI

SEQ ID NO: 1883072 - protein, 20 aa, Staphylococcus
NQSNGIIIFNANSIKPESQV

SEQ ID NO: 1883073 - protein, 30 aa, Staphylococcus
NQSYGMLSSMGTWYIIGFIVLLILAIIATL

SEQ ID NO: 1883074 - protein, 24 aa, Staphylococcus
NQTEPKVMLAIVMWLMGSLTSTMA

SEQ ID NO: 1883075 - protein, 18 aa, Staphylococcus
NQTFKGNITILMTPARSI

SEQ ID NO: 1883076 - protein, 18 aa, Staphylococcus
NQTGFFYNLFVKPMDSLL

SEQ ID NO: 1883077 - protein, 19 aa, Staphylococcus
NQTILLKVRLPRVLEALLT

SEQ ID NO: 1883078 - protein, 28 aa, Staphylococcus
NQTYAFVGLERVGGVMIYNITNPTTPQF

SEQ ID NO: 1883079 - protein, 21 aa, Staphylococcus
NRAVFWANISFFIMVALLIIL

SEQ ID NO: 1883080 - protein, 19 aa, Staphylococcus
NRDKFGIDLSRGTDVNNYI

SEQ ID NO: 1883081 - protein, 21 aa, Staphylococcus
NRFGKFKTWLVVGTLINAVIT

SEQ ID NO: 1883082 - protein, 25 aa, Staphylococcus
NRFHLPSFILFLAVGVIGSFLTSDL

SEQ ID NO: 1883083 - protein, 24 aa, Staphylococcus
NRFSKGLFAWIGFEPKVIEYENVV

SEQ ID NO: 1883084 - protein, 24 aa, Staphylococcus
NRFSKGLFEWIGYNTKIFTYKNVE

SEQ ID NO: 1883085 - protein, 24 aa, Staphylococcus
NRFSKGLFEWIGYNTKIFTYQNVE

SEQ ID NO: 1883086 - protein, 18 aa, Staphylococcus
NRFTDIFILSILILITNL

SEQ ID NO: 1883087 - protein, 18 aa, Staphylococcus
NRGVKWLSNINIILGAVL

SEQ ID NO: 1883088 - protein, 19 aa, Staphylococcus
NRGVKWLSNINVGLGAVLL

SEQ ID NO: 1883089 - protein, 20 aa, Staphylococcus
NRIAIPIGIHMLQNGTVVIM

SEQ ID NO: 1883090 - protein, 34 aa, Staphylococcus
NRIAMGVILIIGGLLNFILMGGFGILSGILILVA

SEQ ID NO: 1883091 - protein, 19 aa, Staphylococcus
NRIGIVISVVCILLVTGIL

SEQ ID NO: 1883092 - protein, 17 aa, Staphylococcus
NRIIGGILLVIAAIVGI

SEQ ID NO: 1883093 - protein, 24 aa, Staphylococcus
NRIKHPLVDFDLFKNKGYTGATVS

SEQ ID NO: 1883094 - protein, 24 aa, Staphylococcus
NRIKRMLFDRETLLKHTDDFLEAA

SEQ ID NO: 1883095 - protein, 23 aa, Staphylococcus
NRIPNFRFSLFAKITTVTYLVLF

SEQ ID NO: 1883096 - protein, 19 aa, Staphylococcus
NRITNFRFSLFTKITTSTY

SEQ ID NO: 1883097 - protein, 25 aa, Staphylococcus
NRIYWLGDQLWYERLFDNIISNVYK

SEQ ID NO: 1883098 - protein, 21 aa, Staphylococcus
NRKDTVLYLMHYHNRISKKEW

SEQ ID NO: 1883099 - protein, 21 aa, Staphylococcus
NRKELIEVLLSTKFDEQEAKA

SEQ ID NO: 1883100 - protein, 22 aa, Staphylococcus
NRKEVMKYLTITFLFLTANSIT

SEQ ID NO: 1883101 - protein, 26 aa, Staphylococcus
NRKHIQWKSILILALLNVFLAWFFVY

SEQ ID NO: 1883102 - protein, 18 aa, Staphylococcus
NRKRKRFGDRVNNDEYSN

SEQ ID NO: 1883103 - protein, 24 aa, Staphylococcus
NRKRRSWVSLIIQIIIFILVAITG

SEQ ID NO: 1883104 - protein, 18 aa, Staphylococcus
NRKRYPLIDFALFRNRFY

SEQ ID NO: 1883105 - protein, 20 aa, Staphylococcus
NRKSEKWITGLAIFCAVMYL

SEQ ID NO: 1883106 - protein, 22 aa, Staphylococcus
NRLEFWTPVLVHIISIFIIALI

SEQ ID NO: 1883107 - protein, 17 aa, Staphylococcus
NRLICKWTNPIINLKPL

SEQ ID NO: 1883108 - protein, 17 aa, Staphylococcus
NRLLLGIILGVITFWLF

SEQ ID NO: 1883109 - protein, 17 aa, Staphylococcus
NRLQSVMEFDQLKVNDV

SEQ ID NO: 1883110 - protein, 22 aa, Staphylococcus
NRMKRGQFSPREMGFNLFINLL

SEQ ID NO: 1883111 - protein, 23 aa, Staphylococcus
NRMKRGQFSPREMGFNLFINLLH

SEQ ID NO: 1883112 - protein, 23 aa, Staphylococcus
NRMKRGQFSPREMGFNLFINLLN

SEQ ID NO: 1883113 - protein, 19 aa, Staphylococcus
NRMYLFLFVRSFVRGRDAF

SEQ ID NO: 1883114 - protein, 26 aa, Staphylococcus
NRNALSYKYRRVVSPVTMRVKASDKL

SEQ ID NO: 1883115 - protein, 18 aa, Staphylococcus
NRNFRIFQIFTAALQSFS

SEQ ID NO: 1883116 - protein, 20 aa, Staphylococcus
NRNGILLKILSVIFTIVLGV

SEQ ID NO: 1883117 - protein, 27 aa, Staphylococcus
NRNLLMRRLKMPILPIVARSGQGVDSI

SEQ ID NO: 1883118 - protein, 23 aa, Staphylococcus
NRNNPDLRKAVEDQRGIFSGWNY

SEQ ID NO: 1883119 - protein, 18 aa, Staphylococcus
NRNYLYLYRICKNVFLKL

SEQ ID NO: 1883120 - protein, 17 aa, Staphylococcus
NRPSLLDRLHADAQRHR

SEQ ID NO: 1883121 - protein, 22 aa, Staphylococcus
NRPYFHMIWHIFIVIASLCHFV

SEQ ID NO: 1883122 - protein, 17 aa, Staphylococcus
NRQITVLAFQYGDAISN

SEQ ID NO: 1883123 - protein, 24 aa, Staphylococcus
NRRSASSTWAWIFVLFVLPVLGFI

SEQ ID NO: 1883124 - protein, 24 aa, Staphylococcus
NRRSATSTWAWLFVLLVLPLIGFV

SEQ ID NO: 1883125 - protein, 23 aa, Staphylococcus
NRTFSLSAFASMVLFIGIVGPAL

SEQ ID NO: 1883126 - protein, 23 aa, Staphylococcus
NRTIRYGYTAAFILIILQVITGA

SEQ ID NO: 1883127 - protein, 23 aa, Staphylococcus
NRTIRYGYTAAFILVILQVTTGA

SEQ ID NO: 1883128 - protein, 23 aa, Staphylococcus
NRTIRYGYTTAFILIILQVITGA

SEQ ID NO: 1883129 - protein, 23 aa, Staphylococcus
NRTLLKIFNLFILAAMLLITLYF

SEQ ID NO: 1883130 - protein, 24 aa, Staphylococcus
NRTLLKLLNFLSIASMLAIVVYFM

SEQ ID NO: 1883131 - protein, 20 aa, Staphylococcus
NRVSGLPEGVTFDSRTNTIS

SEQ ID NO: 1883132 - protein, 20 aa, Staphylococcus
NRVTIGLSIAFFVLMLAITY

SEQ ID NO: 1883133 - protein, 32 aa, Staphylococcus
NRWVISTLFLIGAIILLFGIMYYRSIKTVDLS

SEQ ID NO: 1883134 - protein, 23 aa, Staphylococcus
NRYKSYYRYFAIILNYIPVLTHE

SEQ ID NO: 1883135 - protein, 21 aa, Staphylococcus
NRYQLEQVLLIFLDNAIKYDI

SEQ ID NO: 1883136 - protein, 33 aa, Staphylococcus
NRYRIRKFSVGLASVLFGTFLIYANPANHAEAA

SEQ ID NO: 1883137 - protein, 19 aa, Staphylococcus
NRYYNFFGVGAFDENAIHT

SEQ ID NO: 1883138 - protein, 17 aa, Staphylococcus
NSAHSQSDFSLVSSYLK

SEQ ID NO: 1883139 - protein, 27 aa, Staphylococcus
NSAISRSDFNLVSTFLKDKSSIYKSIK

SEQ ID NO: 1883140 - protein, 20 aa, Staphylococcus
NSDHRRHRDFDQDNDRHEAH

SEQ ID NO: 1883141 - protein, 19 aa, Staphylococcus
NSDIHRSRMLNNKYDEMGG

SEQ ID NO: 1883142 - protein, 20 aa, Staphylococcus
NSDIHRSRMLNSKYNEMGGE

SEQ ID NO: 1883143 - protein, 21 aa, Staphylococcus
NSDIHRSRMLNTKYDEMGGEV

SEQ ID NO: 1883144 - protein, 23 aa, Staphylococcus
NSEFQMIQFIPIVAVPQVFFSGI

SEQ ID NO: 1883145 - protein, 25 aa, Staphylococcus
NSFIHPRTNLKFITFNKIGETNKFG

SEQ ID NO: 1883146 - protein, 26 aa, Staphylococcus
NSGVMLSSILGIIGSAVLLISRKFKQ

SEQ ID NO: 1883147 - protein, 19 aa, Staphylococcus
NSHFLKRAFQHTRWNAYSF

SEQ ID NO: 1883148 - protein, 23 aa, Staphylococcus
NSHSYILLGYPMKAQENANSKYS

SEQ ID NO: 1883149 - protein, 21 aa, Staphylococcus
NSHTFAVLYLWLVKLGEAKSA

SEQ ID NO: 1883150 - protein, 21 aa, Staphylococcus
NSIETKFIIKVVDTTAPTVKG

SEQ ID NO: 1883151 - protein, 24 aa, Staphylococcus
NSIFDVFFFLSWMIISISLVLNII

SEQ ID NO: 1883152 - protein, 23 aa, Staphylococcus
NSIKNIQCNGCFNKEPKAASTLK

SEQ ID NO: 1883153 - protein, 24 aa, Staphylococcus
NSIKPESQVTIISRAGSGNTESSS

SEQ ID NO: 1883154 - protein, 22 aa, Staphylococcus
NSKAMTGYAIMQLVNERKIKLN

SEQ ID NO: 1883155 - protein, 33 aa, Staphylococcus
NSKVSDFLRRNWAKIAVVIGAIILVLLLFAIFH

SEQ ID NO: 1883156 - protein, 17 aa, Staphylococcus
NSLDEFLNIILKESNRI

SEQ ID NO: 1883157 - protein, 23 aa, Staphylococcus
NSLKNKLTQFFSGYSLALNSAMN

SEQ ID NO: 1883158 - protein, 25 aa, Staphylococcus
NSLMILRCTIIIFSIFTLLFGIFNS

SEQ ID NO: 1883159 - protein, 25 aa, Staphylococcus
NSLNKWLFFACIVFALIVLAALLIQ

SEQ ID NO: 1883160 - protein, 26 aa, Staphylococcus
NSLNNFKVEFEKLKLQTHKKANAKRI

SEQ ID NO: 1883161 - protein, 17 aa, Staphylococcus
NSMMRVLFGHALRNALI

SEQ ID NO: 1883162 - protein, 30 aa, Staphylococcus
NSMVTRIISRWATEYNIYFKRYSSDQFVAY

SEQ ID NO: 1883163 - protein, 31 aa, Staphylococcus
NSMVTRVISRWAQEYNIYFKRYNSDQFVAYL

SEQ ID NO: 1883164 - protein, 31 aa, Staphylococcus
NSMVTRVISRWASEYNIYFKRYNSDQFVAYL

SEQ ID NO: 1883165 - protein, 30 aa, Staphylococcus
NSMVTRVISRWASEYNIYFKRYSSDQFVAY

SEQ ID NO: 1883166 - protein, 20 aa, Staphylococcus
NSNIEFTNWQWFISIASIVV

SEQ ID NO: 1883167 - protein, 24 aa, Staphylococcus
NSNWRRDLPYGRSGWGPSGHRRFA

SEQ ID NO: 1883168 - protein, 20 aa, Staphylococcus
NSPFFKGKRTVREGDVVKQP

SEQ ID NO: 1883169 - protein, 20 aa, Staphylococcus
NSSASSWALLPFMTMIISSV

SEQ ID NO: 1883170 - protein, 24 aa, Staphylococcus
NSSDNSVRFIFAIIVIAISIFGLF

SEQ ID NO: 1883171 - protein, 46 aa, Staphylococcus
NSSNKGKYWLIGCGAGCGCLVILIILVLAACVIFMKVSDSISSSDS

SEQ ID NO: 1883172 - protein, 24 aa, Staphylococcus
NSTETRFTIEVVDTTAPTVKGIND

SEQ ID NO: 1883173 - protein, 22 aa, Staphylococcus
NSTMWMLIGFMIFGAVSSLLAA

SEQ ID NO: 1883174 - protein, 23 aa, Staphylococcus
NSVEIKFTIKVVDTTVPTVKGIS

SEQ ID NO: 1883175 - protein, 18 aa, Staphylococcus
NSVPIRILLFYVGALAVM

SEQ ID NO: 1883176 - protein, 37 aa, Staphylococcus
NSWSFVMTWLPSHAKWALFSFYSCIILITILLVIIIL

SEQ ID NO: 1883177 - protein, 38 aa, Staphylococcus
NSYFPQVFKSMMIPLMIIVAMCFIHLNTALIMIVTAPF

SEQ ID NO: 1883178 - protein, 20 aa, Staphylococcus
NTAKKLAKLITMNTDKITKQ

SEQ ID NO: 1883179 - protein, 19 aa, Staphylococcus
NTCIYALVMAVAIFVALAF

SEQ ID NO: 1883180 - protein, 24 aa, Staphylococcus
NTDKSIVVDGQFTSVDAFKNLQIP

SEQ ID NO: 1883181 - protein, 34 aa, Staphylococcus
NTEYLTCYLTAWGVGGLIGSFGIGFLIDKFKNPA

SEQ ID NO: 1883182 - protein, 18 aa, Staphylococcus
NTFGMPWTIFLFHPHHDN

SEQ ID NO: 1883183 - protein, 19 aa, Staphylococcus
NTFILGWIFFFFLGGYIGY

SEQ ID NO: 1883184 - protein, 17 aa, Staphylococcus
NTFKHDYFTGKLFNINP

SEQ ID NO: 1883185 - protein, 17 aa, Staphylococcus
NTFLIVRLIQGICLAGL

SEQ ID NO: 1883186 - protein, 24 aa, Staphylococcus
NTFLKKRIADQLTIQNNFKKKLEI

SEQ ID NO: 1883187 - protein, 17 aa, Staphylococcus
NTHIEIFDKDGQLIGTG

SEQ ID NO: 1883188 - protein, 17 aa, Staphylococcus
NTHVVCLSDGRKIEIPC

SEQ ID NO: 1883189 - protein, 27 aa, Staphylococcus
NTIAVIAIICIIYFALKYAPFLRDQDW

SEQ ID NO: 1883190 - protein, 23 aa, Staphylococcus
NTIEFSRISGIILDNAIEASEVL

SEQ ID NO: 1883191 - protein, 17 aa, Staphylococcus
NTIVVVMLISAFVAMLN

SEQ ID NO: 1883192 - protein, 20 aa, Staphylococcus
NTKKEWRGDYLTEQLSKDKS

SEQ ID NO: 1883193 - protein, 21 aa, Staphylococcus
NTKYRILILSIGFILILGLLH

SEQ ID NO: 1883194 - protein, 18 aa, Staphylococcus
NTLDAAIAVKNDPNANPQ

SEQ ID NO: 1883195 - protein, 20 aa, Staphylococcus
NTLFIISWIQLIGGLTRANQ

SEQ ID NO: 1883196 - protein, 17 aa, Staphylococcus
NTLFSFWYWPGAIILFI

SEQ ID NO: 1883197 - protein, 18 aa, Staphylococcus
NTLIYAVIMAVAIFISLA

SEQ ID NO: 1883198 - protein, 24 aa, Staphylococcus
NTLKGALPVGFLGIGEPLIYGVTL

SEQ ID NO: 1883199 - protein, 22 aa, Staphylococcus
NTLNYRFTFEDVGVKPSDNRNN

SEQ ID NO: 1883200 - protein, 23 aa, Staphylococcus
NTLSHRLFMAVIFALLMAVLYIF

SEQ ID NO: 1883201 - protein, 23 aa, Staphylococcus
NTMKTLTLFTVFLTLPTLVFSFF

SEQ ID NO: 1883202 - protein, 38 aa, Staphylococcus
NTMNRRINFIFGLVVFIFAIMVLRLGYLQIAQGSHYKQ

SEQ ID NO: 1883203 - protein, 30 aa, Staphylococcus
NTPPPRKKFPWFRVVLIALLSGIIGALLVL

SEQ ID NO: 1883204 - protein, 20 aa, Staphylococcus
NTQLIDWGAFLVIGIFLGSY

SEQ ID NO: 1883205 - protein, 33 aa, Staphylococcus
NTRDNKFFVEKEVKNTCNFKEESVQELPNTGIT

SEQ ID NO: 1883206 - protein, 20 aa, Staphylococcus
NTRGMIRLISGMTFANNPFN

SEQ ID NO: 1883207 - protein, 24 aa, Staphylococcus
NTSALRYYFWLTILVIILVVGIIA

SEQ ID NO: 1883208 - protein, 25 aa, Staphylococcus
NTTKPARPGDVAQIDLSGTQLSPLP

SEQ ID NO: 1883209 - protein, 26 aa, Staphylococcus
NTTLRTAIKGALPVGFLGIGEPLIYG

SEQ ID NO: 1883210 - protein, 19 aa, Staphylococcus
NTTTGISYDYTLNFKEGAF

SEQ ID NO: 1883211 - protein, 26 aa, Staphylococcus
NTTYGHLMLIYIIRSFGMSFIMMPIM

SEQ ID NO: 1883212 - protein, 58 aa, Staphylococcus
NTVRPNDGEGFSVTSTFKVNGKVNEGDYFTVDMPDYANFNGIADYTAVDNKIYPTIKD

SEQ ID NO: 1883213 - protein, 23 aa, Staphylococcus
NTVSGLPDGITFDSETNTISGTP

SEQ ID NO: 1883214 - protein, 23 aa, Staphylococcus
NTVSGLPEGITFDPSTNTISGVA

SEQ ID NO: 1883215 - protein, 23 aa, Staphylococcus
NTYIWYIFFCILLLGLLIIPETP

SEQ ID NO: 1883216 - protein, 38 aa, Staphylococcus
NVAGNEVNIPISVQYDNYRDGHVIANATSLITNADIFN

SEQ ID NO: 1883217 - protein, 22 aa, Staphylococcus
NVALWLCMILYFNRFSDIKLLD

SEQ ID NO: 1883218 - protein, 18 aa, Staphylococcus
NVAMEIADKWQYRKQQRE

SEQ ID NO: 1883219 - protein, 24 aa, Staphylococcus
NVAPPEFAFMIGVAIALVINFPNV

SEQ ID NO: 1883220 - protein, 23 aa, Staphylococcus
NVDKIKRANGLNSNNISNGQQLV

SEQ ID NO: 1883221 - protein, 18 aa, Staphylococcus
NVDQINYFQAFVIGLSQA

SEQ ID NO: 1883222 - protein, 21 aa, Staphylococcus
NVDSILRWESIILDPIGPILA

SEQ ID NO: 1883223 - protein, 20 aa, Staphylococcus
NVDSILRWESIILDPIGPML

SEQ ID NO: 1883224 - protein, 17 aa, Staphylococcus
NVEREAGQSKWNFRKLF

SEQ ID NO: 1883225 - protein, 19 aa, Staphylococcus
NVETFPNCTALRKVHPNGV

SEQ ID NO: 1883226 - protein, 20 aa, Staphylococcus
NVFFILCLVSMFITVITIIL

SEQ ID NO: 1883227 - protein, 23 aa, Staphylococcus
NVFGHNILIPALRSVSGVGTQVD

SEQ ID NO: 1883228 - protein, 19 aa, Staphylococcus
NVGKYNFYSFEGLRKHNND

SEQ ID NO: 1883229 - protein, 29 aa, Staphylococcus
NVHIDFNNHPSIVIPRKPIEITKTHQHTN

SEQ ID NO: 1883230 - protein, 17 aa, Staphylococcus
NVHKGDFVLLVKNENSD

SEQ ID NO: 1883231 - protein, 18 aa, Staphylococcus
NVIIGDLDIPVRSGFSMD

SEQ ID NO: 1883232 - protein, 18 aa, Staphylococcus
NVIIVCVMTALIGSFAQL

SEQ ID NO: 1883233 - protein, 24 aa, Staphylococcus
NVKIKEGKTFKVLSKGSNEKIKIH

SEQ ID NO: 1883234 - protein, 29 aa, Staphylococcus
NVKRTIIKIIGFLFIAFIVLLLLGILLFA

SEQ ID NO: 1883235 - protein, 28 aa, Staphylococcus
NVKRTIIKIIGFLLIAFIVLVLLGILLF

SEQ ID NO: 1883236 - protein, 27 aa, Staphylococcus
NVKRTIIKIIGFMIIAFFVLLLLGILL

SEQ ID NO: 1883237 - protein, 18 aa, Staphylococcus
NVKRTSYRLLHWRLRDTF

SEQ ID NO: 1883238 - protein, 22 aa, Staphylococcus
NVKTWFSIKVDYWLLFVRNMIF

SEQ ID NO: 1883239 - protein, 24 aa, Staphylococcus
NVLIKPLKDKYHVTSSSTIQNPIR

SEQ ID NO: 1883240 - protein, 17 aa, Staphylococcus
NVLKEIGNWIPIKYATN

SEQ ID NO: 1883241 - protein, 18 aa, Staphylococcus
NVLKLSGAYMAYLIGSGF

SEQ ID NO: 1883242 - protein, 23 aa, Staphylococcus
NVLMILAALTLCYFDKTENNFPY

SEQ ID NO: 1883243 - protein, 17 aa, Staphylococcus
NVLNLFAFESSDMKLNL

SEQ ID NO: 1883244 - protein, 25 aa, Staphylococcus
NVLPKIIGGIGWLLAKITRQPKFES

SEQ ID NO: 1883245 - protein, 28 aa, Staphylococcus
NVLQFWDVFKVLSPLAWSLIFLTFIFLI

SEQ ID NO: 1883246 - protein, 17 aa, Staphylococcus
NVLSHRLFMAIVYAMVL

SEQ ID NO: 1883247 - protein, 22 aa, Staphylococcus
NVMFYFNFTWSFYGDVLIYFPI

SEQ ID NO: 1883248 - protein, 17 aa, Staphylococcus
NVNEKFWFGTDQLGRDL

SEQ ID NO: 1883249 - protein, 22 aa, Staphylococcus
NVNKIKAANGLTSNNISNGQHL

SEQ ID NO: 1883250 - protein, 18 aa, Staphylococcus
NVNPKAVKNALNRVEDIL

SEQ ID NO: 1883251 - protein, 19 aa, Staphylococcus
NVNVGSLATDYPLTPLSAG

SEQ ID NO: 1883252 - protein, 23 aa, Staphylococcus
NVPKFTTQFLIIFTLFLFAYYTN

SEQ ID NO: 1883253 - protein, 46 aa, Staphylococcus
NVPLPEIFMNPWFQFILATPIQFIIGWQFYVGAYKNLRNGGANMDV

SEQ ID NO: 1883254 - protein, 18 aa, Staphylococcus
NVQWPDVWQAILETLYMT

SEQ ID NO: 1883255 - protein, 19 aa, Staphylococcus
NVQWPEVWQAIYETLYMTV

SEQ ID NO: 1883256 - protein, 21 aa, Staphylococcus
NVRWYFAIAFFIIGVIAYMDR

SEQ ID NO: 1883257 - protein, 19 aa, Staphylococcus
NVSALKLGLPMVTALSVTH

SEQ ID NO: 1883258 - protein, 24 aa, Staphylococcus
NVSDLMPYERNLLKVPEDVQNGIV

SEQ ID NO: 1883259 - protein, 25 aa, Staphylococcus
NVSKLKLGLPMVVALSVTHGFLPPH

SEQ ID NO: 1883260 - protein, 24 aa, Staphylococcus
NVTFMVAAAISFVALILSAKLSDD

SEQ ID NO: 1883261 - protein, 23 aa, Staphylococcus
NVTKTKFTIFVQDTTSPVVNAIQ

SEQ ID NO: 1883262 - protein, 53 aa, Staphylococcus
NVTTAELENAWSYANTAAMGGVSKSAYTVLSGRILPEDGALPSIENQPPVKPT

SEQ ID NO: 1883263 - protein, 18 aa, Staphylococcus
NVVIVCIVTALIGMFAQL

SEQ ID NO: 1883264 - protein, 17 aa, Staphylococcus
NVVSSWFFLIGIAYLYG

SEQ ID NO: 1883265 - protein, 18 aa, Staphylococcus
NVVVVCIMTALLGTIAQL

SEQ ID NO: 1883266 - protein, 25 aa, Staphylococcus
NVYMFKTALKLAGDPYYSGMPLPSD

SEQ ID NO: 1883267 - protein, 22 aa, Staphylococcus
NWAGWLIFFGIVFFSGSLYVLA

SEQ ID NO: 1883268 - protein, 22 aa, Staphylococcus
NWAGWLLFFGIVLFSGSLYILA

SEQ ID NO: 1883269 - protein, 21 aa, Staphylococcus
NWFKIWSVIESGGWTIFNHME

SEQ ID NO: 1883270 - protein, 18 aa, Staphylococcus
NWIFYVFFIYVFIIVMMQ

SEQ ID NO: 1883271 - protein, 22 aa, Staphylococcus
NWLGDLIIMLLIQIGGLGIVTI

SEQ ID NO: 1883272 - protein, 35 aa, Staphylococcus
NWLGHSFKGAGIFALAIICSITFLITIGITVFYVH

SEQ ID NO: 1883273 - protein, 20 aa, Staphylococcus
NWMKRPKWIKPGIVELICGI

SEQ ID NO: 1883274 - protein, 19 aa, Staphylococcus
NWPPLLWMLFIAVICIVVG

SEQ ID NO: 1883275 - protein, 22 aa, Staphylococcus
NWVGWLLFFGIVFFSGSLYILA

SEQ ID NO: 1883276 - protein, 17 aa, Staphylococcus
NYAEALSMMLIPGSLVF

SEQ ID NO: 1883277 - protein, 18 aa, Staphylococcus
NYAIALGLMSIITLFTII

SEQ ID NO: 1883278 - protein, 26 aa, Staphylococcus
NYAKSWLKHLLSYIIGTGILHLIVYL

SEQ ID NO: 1883279 - protein, 25 aa, Staphylococcus
NYASLQIAAAFSFLSVMGGRMQHRQ

SEQ ID NO: 1883280 - protein, 27 aa, Staphylococcus
NYASLRITYLTSRFKYIILPYLCVGCF

SEQ ID NO: 1883281 - protein, 17 aa, Staphylococcus
NYDFISLDHEFRENYGT

SEQ ID NO: 1883282 - protein, 33 aa, Staphylococcus
NYEQIFSLRYFKMFADSIWYAFLITLITLLISY

SEQ ID NO: 1883283 - protein, 17 aa, Staphylococcus
NYKRHGMKPMILGNNDP

SEQ ID NO: 1883284 - protein, 18 aa, Staphylococcus
NYLGGSFYFGLLMSLLSL

SEQ ID NO: 1883285 - protein, 26 aa, Staphylococcus
NYLGLTPIFYFKGLDLTYLEQHGFNN

SEQ ID NO: 1883286 - protein, 19 aa, Staphylococcus
NYLGMAWELLNPALQIMVY

SEQ ID NO: 1883287 - protein, 21 aa, Staphylococcus
NYLIIISIVLVFSFIILYLYS

SEQ ID NO: 1883288 - protein, 18 aa, Staphylococcus
NYLIYRIGKDDASGLAAQ

SEQ ID NO: 1883289 - protein, 17 aa, Staphylococcus
NYLLPHRLMEISDDAYF

SEQ ID NO: 1883290 - protein, 28 aa, Staphylococcus
NYLPFFDIGMGWIVPALIGFIIGLIVYK

SEQ ID NO: 1883291 - protein, 23 aa, Staphylococcus
NYLTCIFFTLFGAIVITLYGYES

SEQ ID NO: 1883292 - protein, 30 aa, Staphylococcus
NYNFKVTGMDCSSCAITIEKALRPLDDVTN

SEQ ID NO: 1883293 - protein, 28 aa, Staphylococcus
NYNSSNRLLTLNVDRIEPGTIKNITYTV

SEQ ID NO: 1883294 - protein, 18 aa, Staphylococcus
NYPVLARVRYFFEKIGPE

SEQ ID NO: 1883295 - protein, 20 aa, Staphylococcus
NYRKYFPLFTLITSFASIAW

SEQ ID NO: 1883296 - protein, 24 aa, Staphylococcus
NYRQVFSMKYLKMMWDSIFYAALI

SEQ ID NO: 1883297 - protein, 17 aa, Staphylococcus
NYRVFLIIIILFIIFLR

SEQ ID NO: 1883298 - protein, 25 aa, Staphylococcus
NYTISYKLKDGVTIEQLQRELSDRL

SEQ ID NO: 1883299 - protein, 24 aa, Staphylococcus
NYYFLCASTLLLLIVAWFVTVKIV

SEQ ID NO: 1883300 - protein, 20 aa, Staphylococcus
PAAICLVGILGSLVYQSFVQ

SEQ ID NO: 1883301 - protein, 29 aa, Staphylococcus
PAALLAIMFDLILRYMEKLSYKKLLITVG

SEQ ID NO: 1883302 - protein, 19 aa, Staphylococcus
PAAMLAIEFGWFLTEQGRQ

SEQ ID NO: 1883303 - protein, 23 aa, Staphylococcus
PAAMLSIEFGWFLTEMGRQPWII

SEQ ID NO: 1883304 - protein, 18 aa, Staphylococcus
PAARRKVVRKETNQDLVF

SEQ ID NO: 1883305 - protein, 24 aa, Staphylococcus
PAAWAQSLNPIFIVVLAPVFANLW

SEQ ID NO: 1883306 - protein, 21 aa, Staphylococcus
PADWLKKGINAFLLAVLPANI

SEQ ID NO: 1883307 - protein, 19 aa, Staphylococcus
PAEWLKKGMNLFLLAVLPA

SEQ ID NO: 1883308 - protein, 17 aa, Staphylococcus
PAGFLMSFQIAVYSFIG

SEQ ID NO: 1883309 - protein, 26 aa, Staphylococcus
PAIGAFCIIMIFALLGFLPYNLNPAK

SEQ ID NO: 1883310 - protein, 18 aa, Staphylococcus
PAIIGGFFMALTYSLDDF

SEQ ID NO: 1883311 - protein, 19 aa, Staphylococcus
PAIILMVMIPIIFFIPNFF

SEQ ID NO: 1883312 - protein, 26 aa, Staphylococcus
PAIVKTRFPFHIGIMTGLYTVVMNVV

SEQ ID NO: 1883313 - protein, 23 aa, Staphylococcus
PAKFSAQMMALWMLSNATAQSLN

SEQ ID NO: 1883314 - protein, 20 aa, Staphylococcus
PAKNKLEVGLGRDISGDPIT

SEQ ID NO: 1883315 - protein, 19 aa, Staphylococcus
PAKNKLEVGLGRDISGEPM

SEQ ID NO: 1883316 - protein, 21 aa, Staphylococcus
PAKVFPIVWPLLYTSMGVAYQ

SEQ ID NO: 1883317 - protein, 33 aa, Staphylococcus
PALGGLILSFAVWRMVFVILTLFGVLMVLGSLF

SEQ ID NO: 1883318 - protein, 21 aa, Staphylococcus
PALIIGASPFYARLVEIAFKE

SEQ ID NO: 1883319 - protein, 20 aa, Staphylococcus
PALIISAAPFYARLVEIAFK

SEQ ID NO: 1883320 - protein, 21 aa, Staphylococcus
PALISFLWFSVFGVLGIEMGK

SEQ ID NO: 1883321 - protein, 19 aa, Staphylococcus
PALLLIIPFLILAFLISKL

SEQ ID NO: 1883322 - protein, 18 aa, Staphylococcus
PALSEYATILAFVGAFIG

SEQ ID NO: 1883323 - protein, 35 aa, Staphylococcus
PALTALFGKASWYLPAWLNRILPKIDIEGHALEDM

SEQ ID NO: 1883324 - protein, 24 aa, Staphylococcus
PALVSSVLPDWAFGLFGAVIFGAI

SEQ ID NO: 1883325 - protein, 19 aa, Staphylococcus
PAMVKMYHFSRKSVSEINQ

SEQ ID NO: 1883326 - protein, 17 aa, Staphylococcus
PANTRRKTSNKKKQQGD

SEQ ID NO: 1883327 - protein, 20 aa, Staphylococcus
PANWLKTGINLFLLAVLPAN

SEQ ID NO: 1883328 - protein, 19 aa, Staphylococcus
PAQNKLEVGLGRDISGDPM

SEQ ID NO: 1883329 - protein, 29 aa, Staphylococcus
PAQTKHKVVPNLVTPKVESAVESTTDKVE

SEQ ID NO: 1883330 - protein, 23 aa, Staphylococcus
PASIKEYNKAIAQINSQINNAKS

SEQ ID NO: 1883331 - protein, 19 aa, Staphylococcus
PASLVIMVMFVLQFILNFF

SEQ ID NO: 1883332 - protein, 25 aa, Staphylococcus
PATICISWISLFLAQAIVENFFEAT

SEQ ID NO: 1883333 - protein, 20 aa, Staphylococcus
PATILISWISLFIAQWIIEN

SEQ ID NO: 1883334 - protein, 17 aa, Staphylococcus
PAVAKMVGIGMILAGIM

SEQ ID NO: 1883335 - protein, 17 aa, Staphylococcus
PAVDVAASFGFGSPNAV

SEQ ID NO: 1883336 - protein, 25 aa, Staphylococcus
PAYVELFCGAILLFFTLIEFNNRNS

SEQ ID NO: 1883337 - protein, 19 aa, Staphylococcus
PDEFMDFPIVVASPKDEGK

SEQ ID NO: 1883338 - protein, 22 aa, Staphylococcus
PDFPGYASTLFANAMVIGQLCG

SEQ ID NO: 1883339 - protein, 22 aa, Staphylococcus
PDFPGYASTLFANAMVIGQLLG

SEQ ID NO: 1883340 - protein, 21 aa, Staphylococcus
PDGEKGPAMAILNLGAGLCVF

SEQ ID NO: 1883341 - protein, 17 aa, Staphylococcus
PDGHTPGAHSVPVTVTY

SEQ ID NO: 1883342 - protein, 21 aa, Staphylococcus
PDHKSIIYRYDATKGSSITLN

SEQ ID NO: 1883343 - protein, 19 aa, Staphylococcus
PDHPFVYWATLKNVASLLE

SEQ ID NO: 1883344 - protein, 25 aa, Staphylococcus
PDILKKVGTIAGIFAGVVATGSILY

SEQ ID NO: 1883345 - protein, 17 aa, Staphylococcus
PDISMRRWALAGCNIGQ

SEQ ID NO: 1883346 - protein, 20 aa, Staphylococcus
PDKDLILAILTGVIGSVVAL

SEQ ID NO: 1883347 - protein, 24 aa, Staphylococcus
PDKEGSFKWKAVQTYDNGDVVKWN

SEQ ID NO: 1883348 - protein, 25 aa, Staphylococcus
PDKIKRRYIIPWAIVGLIVVLIYQV

SEQ ID NO: 1883349 - protein, 17 aa, Staphylococcus
PDKVLKHIATFKQEGEW

SEQ ID NO: 1883350 - protein, 18 aa, Staphylococcus
PDLQYAIMQGFFVAVSAT

SEQ ID NO: 1883351 - protein, 25 aa, Staphylococcus
PDNISRIRVQFESLVNVSHDTYSGH

SEQ ID NO: 1883352 - protein, 19 aa, Staphylococcus
PDSKLVWLAMYGIAGLLIP

SEQ ID NO: 1883353 - protein, 17 aa, Staphylococcus
PDSLIFKLKVSITFYSH

SEQ ID NO: 1883354 - protein, 18 aa, Staphylococcus
PDWFKAFVQVGNDLIWSQ

SEQ ID NO: 1883355 - protein, 19 aa, Staphylococcus
PDWFKSVVQVGNDLIWSQY

SEQ ID NO: 1883356 - protein, 21 aa, Staphylococcus
PEAFKTYARNAVTEFRTSEKL

SEQ ID NO: 1883357 - protein, 30 aa, Staphylococcus
PEANEALTSIAQRVIQDFDRITEATQEEKD

SEQ ID NO: 1883358 - protein, 19 aa, Staphylococcus
PEAPFTLLMIAGFLGALLG

SEQ ID NO: 1883359 - protein, 19 aa, Staphylococcus
PEASRLVLQAGALAQGGEI

SEQ ID NO: 1883360 - protein, 20 aa, Staphylococcus
PEDRKGEGIGYYALSTTVAS

SEQ ID NO: 1883361 - protein, 27 aa, Staphylococcus
PEEKVLLALLLYRFAYYFVPVIIALIL

SEQ ID NO: 1883362 - protein, 20 aa, Staphylococcus
PEGLDLIAVILIAPALVYGL

SEQ ID NO: 1883363 - protein, 22 aa, Staphylococcus
PEGRSIVKLAYKQHIDLLQEVG

SEQ ID NO: 1883364 - protein, 20 aa, Staphylococcus
PEHLELVFDRFYKVEASRTR

SEQ ID NO: 1883365 - protein, 23 aa, Staphylococcus
PEHLNLVFDRFYKVEASRTRGKQ

SEQ ID NO: 1883366 - protein, 31 aa, Staphylococcus
PEHSFWKSIENIGSLSFKFMVPILAGYIAVS

SEQ ID NO: 1883367 - protein, 18 aa, Staphylococcus
PEIFPADKGETFKQLDKK

SEQ ID NO: 1883368 - protein, 27 aa, Staphylococcus
PEILTKKLVILSLFGIGFLLIGVIFKP

SEQ ID NO: 1883369 - protein, 38 aa, Staphylococcus
PEITFDIYNRGTLPTGTYSIRYATIWDENSEIVRPTEE

SEQ ID NO: 1883370 - protein, 21 aa, Staphylococcus
PEIVVKWLSFIPITLFTALVI

SEQ ID NO: 1883371 - protein, 24 aa, Staphylococcus
PEKGLTLGSNDGFLDGLFNDDGNL

SEQ ID NO: 1883372 - protein, 17 aa, Staphylococcus
PEKLAAYEWHFDTQKRA

SEQ ID NO: 1883373 - protein, 17 aa, Staphylococcus
PEKRPVHNFVISILLFV

SEQ ID NO: 1883374 - protein, 25 aa, Staphylococcus
PEKTDDGKWGFSFEDKDGDLAGSYT

SEQ ID NO: 1883375 - protein, 24 aa, Staphylococcus
PEKTDDGKWGFSFTDKDGDLAGSY

SEQ ID NO: 1883376 - protein, 21 aa, Staphylococcus
PEKYDSYFIDDWYVSGDSAYK

SEQ ID NO: 1883377 - protein, 23 aa, Staphylococcus
PELFTKINWKVFITPVILTLVLA

SEQ ID NO: 1883378 - protein, 18 aa, Staphylococcus
PELGKIYIFPALLGSIIL

SEQ ID NO: 1883379 - protein, 21 aa, Staphylococcus
PELRDRLAVRHGRYIEQDAGD

SEQ ID NO: 1883380 - protein, 21 aa, Staphylococcus
PELSDNFIVLDFTYDLPLSTY

SEQ ID NO: 1883381 - protein, 25 aa, Staphylococcus
PELTNHYAVLDFTYDLPLNVYLGQV

SEQ ID NO: 1883382 - protein, 24 aa, Staphylococcus
PELTRNSMDAFPIIAYSLTDKDND

SEQ ID NO: 1883383 - protein, 24 aa, Staphylococcus
PELTRNSMDAFPIVAYSFTNKDGN

SEQ ID NO: 1883384 - protein, 24 aa, Staphylococcus
PELTRNSMDAFPIVAYSFTNKNDD

SEQ ID NO: 1883385 - protein, 24 aa, Staphylococcus
PELTRNSMDAFPIVAYSFTSNKHD

SEQ ID NO: 1883386 - protein, 24 aa, Staphylococcus
PELTRSSMDAFPIVAYSFTTNDND

SEQ ID NO: 1883387 - protein, 17 aa, Staphylococcus
PEMLGVFQGLTFVVTIS

SEQ ID NO: 1883388 - protein, 19 aa, Staphylococcus
PEMMFAPAIAIVIIVMAFN

SEQ ID NO: 1883389 - protein, 22 aa, Staphylococcus
PENDTRIDAGFVIFYMSVNLGA

SEQ ID NO: 1883390 - protein, 22 aa, Staphylococcus
PENDTRIDAGFVIFYMSVNLGG

SEQ ID NO: 1883391 - protein, 21 aa, Staphylococcus
PENDVRIDAGFVIFYMSVNLG

SEQ ID NO: 1883392 - protein, 23 aa, Staphylococcus
PENSCGYLLACSLFNPTLANNSY

SEQ ID NO: 1883393 - protein, 18 aa, Staphylococcus
PENVKVSLLENGKEVAQA

SEQ ID NO: 1883394 - protein, 20 aa, Staphylococcus
PEPFLKTSFAKFIISLGEKY

SEQ ID NO: 1883395 - protein, 67 aa, Staphylococcus
PEQGQGLDSIYSFIGKGDVSYRISFKTNGLPTERLYYAAGGRALEFRQLFNYNQLYVEPMKEYQNRI

SEQ ID NO: 1883396 - protein, 26 aa, Staphylococcus
PEQMLPEFYRKYIVGWNPFSHYAHTL

SEQ ID NO: 1883397 - protein, 23 aa, Staphylococcus
PERKYKFGITIPIALLIAILISA

SEQ ID NO: 1883398 - protein, 17 aa, Staphylococcus
PESHPIPPFFTRKKQYI

SEQ ID NO: 1883399 - protein, 19 aa, Staphylococcus
PESWYSMLEEFKVTIWYTA

SEQ ID NO: 1883400 - protein, 26 aa, Staphylococcus
PESYLRKFPYLVFPDNVAIALGVAEA

SEQ ID NO: 1883401 - protein, 17 aa, Staphylococcus
PETLFVLMGQILFHPLV

SEQ ID NO: 1883402 - protein, 21 aa, Staphylococcus
PETLKKVGIFSAIGISVVSLV

SEQ ID NO: 1883403 - protein, 28 aa, Staphylococcus
PETMLTKIASFIPLLSPFVLFLRASTPE

SEQ ID NO: 1883404 - protein, 19 aa, Staphylococcus
PEVGIGKEFMEGIFTIGPI

SEQ ID NO: 1883405 - protein, 26 aa, Staphylococcus
PEVTKDKRVTGAILVNDQVIASKDYT

SEQ ID NO: 1883406 - protein, 20 aa, Staphylococcus
PEYCAVVDFTGFEKMIDELE

SEQ ID NO: 1883407 - protein, 17 aa, Staphylococcus
PEYIFYAYKRYNFVQKD

SEQ ID NO: 1883408 - protein, 22 aa, Staphylococcus
PEYLKARFSTIYDPFSSSSGTG

SEQ ID NO: 1883409 - protein, 24 aa, Staphylococcus
PFADMAILLGINWLAILLYIEAVV

SEQ ID NO: 1883410 - protein, 24 aa, Staphylococcus
PFADMAILLGINWLAILLYVEAVV

SEQ ID NO: 1883411 - protein, 25 aa, Staphylococcus
PFADMAILLSINWLAILLYIEAVVS

SEQ ID NO: 1883412 - protein, 23 aa, Staphylococcus
PFAGSAYTWISILFGEFFGWIVG

SEQ ID NO: 1883413 - protein, 19 aa, Staphylococcus
PFASAFIIHELCKKIIPGY

SEQ ID NO: 1883414 - protein, 20 aa, Staphylococcus
PFDGDIIFVRIVRDNESIVP

SEQ ID NO: 1883415 - protein, 18 aa, Staphylococcus
PFEMPSFGISVLTATLPV

SEQ ID NO: 1883416 - protein, 24 aa, Staphylococcus
PFFQGRSPYIFAHRGGMAVRPEQT

SEQ ID NO: 1883417 - protein, 19 aa, Staphylococcus
PFFSDVFIGLPLLLYAIEH

SEQ ID NO: 1883418 - protein, 20 aa, Staphylococcus
PFFSHLVKFFPPVVTGSVVT

SEQ ID NO: 1883419 - protein, 19 aa, Staphylococcus
PFFTGKLVDKFSFENMNGM

SEQ ID NO: 1883420 - protein, 19 aa, Staphylococcus
PFGHVPRLPVADMNWPPLL

SEQ ID NO: 1883421 - protein, 19 aa, Staphylococcus
PFGLPALTMPFILATWLML

SEQ ID NO: 1883422 - protein, 20 aa, Staphylococcus
PFHMTRGWTPSGHAGIDYGA

SEQ ID NO: 1883423 - protein, 18 aa, Staphylococcus
PFHQEYLVHLTFVPLLFL

SEQ ID NO: 1883424 - protein, 23 aa, Staphylococcus
PFIFSAIVIFGTWILDLGPVGAF

SEQ ID NO: 1883425 - protein, 19 aa, Staphylococcus
PFIGAFIIHHLCKRFIHSY

SEQ ID NO: 1883426 - protein, 17 aa, Staphylococcus
PFIGNADFKEQIINETQ

SEQ ID NO: 1883427 - protein, 27 aa, Staphylococcus
PFILAPIVNVWIFKFFVDVLNMNSFSI

SEQ ID NO: 1883428 - protein, 20 aa, Staphylococcus
PFIPIFYIIFGLKTRDESKD

SEQ ID NO: 1883429 - protein, 19 aa, Staphylococcus
PFISYGGSALWSLMLGIGV

SEQ ID NO: 1883430 - protein, 17 aa, Staphylococcus
PFISYGGSSLWSLMTGI

SEQ ID NO: 1883431 - protein, 17 aa, Staphylococcus
PFISYGGSSLWSLMVGI

SEQ ID NO: 1883432 - protein, 18 aa, Staphylococcus
PFITACLGGGIGGAVIGG

SEQ ID NO: 1883433 - protein, 28 aa, Staphylococcus
PFKSEYLVHLTFVPLLFLGRYTNMIYTL

SEQ ID NO: 1883434 - protein, 26 aa, Staphylococcus
PFLDLRVFKSSGFVIATIGLIVVTMA

SEQ ID NO: 1883435 - protein, 26 aa, Staphylococcus
PFLGGSVILSFGWQPLLLNAFLYLII

SEQ ID NO: 1883436 - protein, 17 aa, Staphylococcus
PFLKYKNFRYSHSNDEI

SEQ ID NO: 1883437 - protein, 20 aa, Staphylococcus
PFLLLFLLSVKFKFQPTRMI

SEQ ID NO: 1883438 - protein, 20 aa, Staphylococcus
PFLMFMPVWMGSMITSVLLF

SEQ ID NO: 1883439 - protein, 22 aa, Staphylococcus
PFLPIVEFNKSIALVFITDLLI

SEQ ID NO: 1883440 - protein, 25 aa, Staphylococcus
PFLQRARLATINFILAKGAIFQGVT

SEQ ID NO: 1883441 - protein, 18 aa, Staphylococcus
PFNGETAVSIAIKHIQDA

SEQ ID NO: 1883442 - protein, 18 aa, Staphylococcus
PFNGETAVSIAIKHIQDS

SEQ ID NO: 1883443 - protein, 23 aa, Staphylococcus
PFNGETAVSIAIKHIQDSIPNVT

SEQ ID NO: 1883444 - protein, 23 aa, Staphylococcus
PFNGETAVSIAIKHIQDTIPNIT

SEQ ID NO: 1883445 - protein, 18 aa, Staphylococcus
PFRLEYLVHLTFVPLLFL

SEQ ID NO: 1883446 - protein, 24 aa, Staphylococcus
PFRREGLKAFSFNYLKRPKFIRTI

SEQ ID NO: 1883447 - protein, 23 aa, Staphylococcus
PFSGETAVSIAIKHIQETVPNIT

SEQ ID NO: 1883448 - protein, 31 aa, Staphylococcus
PFSYKDVLLVLCFVGIILLSFYLSAHFPITG

SEQ ID NO: 1883449 - protein, 18 aa, Staphylococcus
PFSYRDILFILLFAAILI

SEQ ID NO: 1883450 - protein, 18 aa, Staphylococcus
PFTGETAVSIAIKHIQDP

SEQ ID NO: 1883451 - protein, 18 aa, Staphylococcus
PFTPLIIAACMYFVLTFL

SEQ ID NO: 1883452 - protein, 19 aa, Staphylococcus
PFTPLIIAAIMYFILTFTL

SEQ ID NO: 1883453 - protein, 20 aa, Staphylococcus
PFTPLIVAAILYFILTFTLS

SEQ ID NO: 1883454 - protein, 24 aa, Staphylococcus
PFTPLIVAAVLYFILTFALSRIMS

SEQ ID NO: 1883455 - protein, 18 aa, Staphylococcus
PFTPLLLAAGLYFVLTFS

SEQ ID NO: 1883456 - protein, 18 aa, Staphylococcus
PFTPLLVAAILYFILTFV

SEQ ID NO: 1883457 - protein, 19 aa, Staphylococcus
PFVGGISGFLGVLLVAGFS

SEQ ID NO: 1883458 - protein, 18 aa, Staphylococcus
PFVGGISGFLSVLLVAGF

SEQ ID NO: 1883459 - protein, 23 aa, Staphylococcus
PFVGGLSGFLAVLLVAGFSVGGT

SEQ ID NO: 1883460 - protein, 23 aa, Staphylococcus
PFVGGLSGFLGVLLVAGFSVGGT

SEQ ID NO: 1883461 - protein, 21 aa, Staphylococcus
PFVGSDSWQHFVLPIFTIVVI

SEQ ID NO: 1883462 - protein, 19 aa, Staphylococcus
PFVSAFIIHEICKKLIPSY

SEQ ID NO: 1883463 - protein, 18 aa, Staphylococcus
PFVSYARLSGNSTFKTTV

SEQ ID NO: 1883464 - protein, 20 aa, Staphylococcus
PFWFIFLYFYYKKYKNNAKD

SEQ ID NO: 1883465 - protein, 22 aa, Staphylococcus
PFWMGILGLMYLRYKKESRKAE

SEQ ID NO: 1883466 - protein, 17 aa, Staphylococcus
PFWPLAIINVFEEFSST

SEQ ID NO: 1883467 - protein, 18 aa, Staphylococcus
PFWPLAIINVFEEFSSTL

SEQ ID NO: 1883468 - protein, 22 aa, Staphylococcus
PFYKKHSTLLFATLLIAFGYLS

SEQ ID NO: 1883469 - protein, 25 aa, Staphylococcus
PFYVFTVYFFFGRLRKLTRKRSQAL

SEQ ID NO: 1883470 - protein, 23 aa, Staphylococcus
PGEDVKLTIIRDGKTETINVKLK

SEQ ID NO: 1883471 - protein, 17 aa, Staphylococcus
PGEGAAGARILRKEIQK

SEQ ID NO: 1883472 - protein, 17 aa, Staphylococcus
PGEGAAGGRIIRKEVQR

SEQ ID NO: 1883473 - protein, 21 aa, Staphylococcus
PGFFAGYLIGYVMKYTEKYVP

SEQ ID NO: 1883474 - protein, 19 aa, Staphylococcus
PGFSRSGSTISTGVLMKLD

SEQ ID NO: 1883475 - protein, 19 aa, Staphylococcus
PGGFRHEMIRYPNGKTAIT

SEQ ID NO: 1883476 - protein, 20 aa, Staphylococcus
PGIHEAYLFNFFSRLLTALI

SEQ ID NO: 1883477 - protein, 19 aa, Staphylococcus
PGILTGFILALSRALGETA

SEQ ID NO: 1883478 - protein, 21 aa, Staphylococcus
PGINTTMDWDRKYPYGDSLRG

SEQ ID NO: 1883479 - protein, 18 aa, Staphylococcus
PGLVPGMIGGAIAADGSL

SEQ ID NO: 1883480 - protein, 25 aa, Staphylococcus
PGMHFPGQRLLRKEIISYFNDVGIH

SEQ ID NO: 1883481 - protein, 18 aa, Staphylococcus
PGMHFPGQRLLRKEVIQY

SEQ ID NO: 1883482 - protein, 19 aa, Staphylococcus
PGMLLRSGLIQPEKGMETT

SEQ ID NO: 1883483 - protein, 20 aa, Staphylococcus
PGNDGRSITITNEYLDPSTG

SEQ ID NO: 1883484 - protein, 18 aa, Staphylococcus
PGNVDKLPIAIVNDDTGD

SEQ ID NO: 1883485 - protein, 26 aa, Staphylococcus
PGPGRPSDYPILFKVMDDFYQHIPIL

SEQ ID NO: 1883486 - protein, 25 aa, Staphylococcus
PGRFYLVRIYRIIVLILTFLSELIK

SEQ ID NO: 1883487 - protein, 18 aa, Staphylococcus
PGSFIVYCINAPRGEFLH

SEQ ID NO: 1883488 - protein, 20 aa, Staphylococcus
PGSITFLMFVRLINGIATAI

SEQ ID NO: 1883489 - protein, 22 aa, Staphylococcus
PGSVWFLMIVRLLNGIATAIAT

SEQ ID NO: 1883490 - protein, 17 aa, Staphylococcus
PGTFLPKLLDQMYNIDF

SEQ ID NO: 1883491 - protein, 59 aa, Staphylococcus
PGTIDEKRSWHLQSRGTFLEGVYKFTKEVEKLKNLHFSFSNKDGLRFPEVTKDKRVTGA

SEQ ID NO: 1883492 - protein, 21 aa, Staphylococcus
PGTLENFSSYILLNKKKNYGI

SEQ ID NO: 1883493 - protein, 21 aa, Staphylococcus
PGVALSFLFNIPMFIGALVTG

SEQ ID NO: 1883494 - protein, 26 aa, Staphylococcus
PGVAVSFILHIPFFIGAMISGMLASL

SEQ ID NO: 1883495 - protein, 23 aa, Staphylococcus
PGVNTTMDWDRRYPYGDTLRSIF

SEQ ID NO: 1883496 - protein, 20 aa, Staphylococcus
PGYLQARFSTLVDPFASSAG

SEQ ID NO: 1883497 - protein, 24 aa, Staphylococcus
PHADAGHSYNHWLLIAVGAVIGLV

SEQ ID NO: 1883498 - protein, 17 aa, Staphylococcus
PHADLMANVPLQFKLHM

SEQ ID NO: 1883499 - protein, 21 aa, Staphylococcus
PHASISYLLIIGFIALISFII

SEQ ID NO: 1883500 - protein, 23 aa, Staphylococcus
PHDKRIVPKLSLGNITFEDSVKR

SEQ ID NO: 1883501 - protein, 17 aa, Staphylococcus
PHEPFLFTLPSAIMMIL

SEQ ID NO: 1883502 - protein, 17 aa, Staphylococcus
PHFKYKKGFLLVHISKK

SEQ ID NO: 1883503 - protein, 25 aa, Staphylococcus
PHFLWFNLIHPDIWITIIAGVLYFI

SEQ ID NO: 1883504 - protein, 17 aa, Staphylococcus
PHFLWFNLTKPDIWITI

SEQ ID NO: 1883505 - protein, 19 aa, Staphylococcus
PHGAVFIYQDLKSIDDTNN

SEQ ID NO: 1883506 - protein, 18 aa, Staphylococcus
PHHFKLEIVPIHYIHSDK

SEQ ID NO: 1883507 - protein, 21 aa, Staphylococcus
PHIIVRFMSIKSFKLLPKARR

SEQ ID NO: 1883508 - protein, 44 aa, Staphylococcus
PHILMNPWFQFLLATPIQFMIGWQFYVGAYKNLRHGGANMDVLV

SEQ ID NO: 1883509 - protein, 17 aa, Staphylococcus
PHIPFALFMLFQMMFCT

SEQ ID NO: 1883510 - protein, 25 aa, Staphylococcus
PHNDVTRLDVHYVDLKGQPATITAT

SEQ ID NO: 1883511 - protein, 23 aa, Staphylococcus
PHQKEWERLSGIPIEEQTYERNR

SEQ ID NO: 1883512 - protein, 26 aa, Staphylococcus
PHSTSLRLFQLLLMFSTPMFVFISEF

SEQ ID NO: 1883513 - protein, 17 aa, Staphylococcus
PIAALGLLAPWIAGAAM

SEQ ID NO: 1883514 - protein, 25 aa, Staphylococcus
PIAFGALYLPILFKIIKLQLNLSKG

SEQ ID NO: 1883515 - protein, 18 aa, Staphylococcus
PIAGAIVLFGFNDATKSI

SEQ ID NO: 1883516 - protein, 20 aa, Staphylococcus
PIAGAIVLFGFNKPLPSVIT

SEQ ID NO: 1883517 - protein, 18 aa, Staphylococcus
PIAGAIVLFGFNNAVTSI

SEQ ID NO: 1883518 - protein, 20 aa, Staphylococcus
PIAGAIVLFGFNTPMKAVIT

SEQ ID NO: 1883519 - protein, 20 aa, Staphylococcus
PIAGAVVLFGFNKPVPSIIG

SEQ ID NO: 1883520 - protein, 18 aa, Staphylococcus
PIAHAKWLDFPHIYLPFK

SEQ ID NO: 1883521 - protein, 18 aa, Staphylococcus
PIAKSKMTKVPNLVTKSS

SEQ ID NO: 1883522 - protein, 27 aa, Staphylococcus
PIALAPGMGLNAFFAFTVVLTMGIPWQ

SEQ ID NO: 1883523 - protein, 24 aa, Staphylococcus
PIALLALMWFFMIRPQQKRQKEHR

SEQ ID NO: 1883524 - protein, 20 aa, Staphylococcus
PIAQRLIVFVPFPKTVAYDT

SEQ ID NO: 1883525 - protein, 20 aa, Staphylococcus
PIASILVSIIILKSAIGISR

SEQ ID NO: 1883526 - protein, 22 aa, Staphylococcus
PIASILVSLIILKSAYGIAKSS

SEQ ID NO: 1883527 - protein, 21 aa, Staphylococcus
PIASLFLCIVIICLIFNKHIP

SEQ ID NO: 1883528 - protein, 25 aa, Staphylococcus
PIDVSTDVLTRVEIFDENGKSYGVV

SEQ ID NO: 1883529 - protein, 19 aa, Staphylococcus
PIEIPMIWQGGIAIHGGLI

SEQ ID NO: 1883530 - protein, 22 aa, Staphylococcus
PIFIAICIVVSILSLTPILTII

SEQ ID NO: 1883531 - protein, 18 aa, Staphylococcus
PIFNEVGVVWAFAICYFV

SEQ ID NO: 1883532 - protein, 25 aa, Staphylococcus
PIFTKRFNLNFIINFFVYLCMYLLI

SEQ ID NO: 1883533 - protein, 18 aa, Staphylococcus
PIGALILTCIIFLGFLYQ

SEQ ID NO: 1883534 - protein, 20 aa, Staphylococcus
PIGGVLFIASWVTLLVQALK

SEQ ID NO: 1883535 - protein, 26 aa, Staphylococcus
PIGLNFKSSGLTIIFYIFFFLILITL

SEQ ID NO: 1883536 - protein, 24 aa, Staphylococcus
PIGTFCLVAHAFTGAGLGAIKQLG

SEQ ID NO: 1883537 - protein, 30 aa, Staphylococcus
PIGTLIGDWVGWRFTFIFIVAVSVIVGILM

SEQ ID NO: 1883538 - protein, 18 aa, Staphylococcus
PIHVRWYGIIIACGILLG

SEQ ID NO: 1883539 - protein, 36 aa, Staphylococcus
PIIEECIFRAFIIKGIFRRIPIVGGIVSVIAFAAVH

SEQ ID NO: 1883540 - protein, 26 aa, Staphylococcus
PIIFFYKIMYPFIWLLNGAARLILKI

SEQ ID NO: 1883541 - protein, 25 aa, Staphylococcus
PIILFLLCLTIFKMKGIYAAITTLV

SEQ ID NO: 1883542 - protein, 26 aa, Staphylococcus
PIILFLLCLTVFKMKGVYAAITTLIV

SEQ ID NO: 1883543 - protein, 18 aa, Staphylococcus
PIIMFGWMIIFAIVIAQY

SEQ ID NO: 1883544 - protein, 24 aa, Staphylococcus
PIIMFYKIFYPFIYILNGSARLIL

SEQ ID NO: 1883545 - protein, 18 aa, Staphylococcus
PIIMGLYFVLKDKLVNGL

SEQ ID NO: 1883546 - protein, 17 aa, Staphylococcus
PIIMLSLIVLFFGQQII

SEQ ID NO: 1883547 - protein, 24 aa, Staphylococcus
PIIVVGNPLGVDFKESVSDGIVSG

SEQ ID NO: 1883548 - protein, 25 aa, Staphylococcus
PIIVVGNPLGVDFKGSVSEGIVSGL

SEQ ID NO: 1883549 - protein, 22 aa, Staphylococcus
PIKDPKLAFSIVYTNQPVPPPW

SEQ ID NO: 1883550 - protein, 22 aa, Staphylococcus
PIKDPKLSFSIVYTNQPVPPPW

SEQ ID NO: 1883551 - protein, 23 aa, Staphylococcus
PIKYMKKTFEVMVFAFTSRSSAG

SEQ ID NO: 1883552 - protein, 22 aa, Staphylococcus
PILEEFVFRKVFFGELYNAIKA

SEQ ID NO: 1883553 - protein, 20 aa, Staphylococcus
PILFFIVAIMMFARKDRVET

SEQ ID NO: 1883554 - protein, 21 aa, Staphylococcus
PILFLIVAIMMFARKDKVETV

SEQ ID NO: 1883555 - protein, 17 aa, Staphylococcus
PILIFGFDLNVVGAALG

SEQ ID NO: 1883556 - protein, 17 aa, Staphylococcus
PILIFGFHLDVVGAALG

SEQ ID NO: 1883557 - protein, 22 aa, Staphylococcus
PILLLVLMWFFLIRPQQKKAKE

SEQ ID NO: 1883558 - protein, 22 aa, Staphylococcus
PILLLVLMWFFLIRPQQKRAKE

SEQ ID NO: 1883559 - protein, 22 aa, Staphylococcus
PILLLVLMYFFLIRPQQKRAKE

SEQ ID NO: 1883560 - protein, 21 aa, Staphylococcus
PILNGMFLWIALILFSACYAF

SEQ ID NO: 1883561 - protein, 39 aa, Staphylococcus
PILRKFKIATPIFKPLFAWQFKRSVLWLYVIDLICVMFA

SEQ ID NO: 1883562 - protein, 20 aa, Staphylococcus
PILRKFKIATPIFKPLYAWQ

SEQ ID NO: 1883563 - protein, 18 aa, Staphylococcus
PILTGVLIAGQFKLTQLQ

SEQ ID NO: 1883564 - protein, 18 aa, Staphylococcus
PILTGVLIAIQFNLTQLQ

SEQ ID NO: 1883565 - protein, 19 aa, Staphylococcus
PIMFLIGLVAAHFEQPSIF

SEQ ID NO: 1883566 - protein, 19 aa, Staphylococcus
PINAFKFMHVDSVWLSLLL

SEQ ID NO: 1883567 - protein, 29 aa, Staphylococcus
PINDHSYISWIIVICISLIIVSIVGAFLW

SEQ ID NO: 1883568 - protein, 19 aa, Staphylococcus
PINEVTYATSLLADGYYHV

SEQ ID NO: 1883569 - protein, 18 aa, Staphylococcus
PIPEGNVTAKAYNHSDES

SEQ ID NO: 1883570 - protein, 18 aa, Staphylococcus
PIPMPASVIGLVLLFIAL

SEQ ID NO: 1883571 - protein, 20 aa, Staphylococcus
PIPQELIEMMDMITRNAYKL

SEQ ID NO: 1883572 - protein, 20 aa, Staphylococcus
PIPSEIILTFGGFMTTKSDL

SEQ ID NO: 1883573 - protein, 22 aa, Staphylococcus
PIPSELILTFSGFLTLHSNMNI

SEQ ID NO: 1883574 - protein, 18 aa, Staphylococcus
PIQRLIKLLGDIFIPILP

SEQ ID NO: 1883575 - protein, 19 aa, Staphylococcus
PIQSLKLVITAVWNAIKIG

SEQ ID NO: 1883576 - protein, 18 aa, Staphylococcus
PIRKKGFKAFTFNPKHVK

SEQ ID NO: 1883577 - protein, 19 aa, Staphylococcus
PISEFNKSISLVFITDLLI

SEQ ID NO: 1883578 - protein, 22 aa, Staphylococcus
PISIKAIFIFYEILFMWTTPTL

SEQ ID NO: 1883579 - protein, 20 aa, Staphylococcus
PISKAFLFSFSFMPGDIIKA

SEQ ID NO: 1883580 - protein, 18 aa, Staphylococcus
PISMFRQRFQGLRKDQPV

SEQ ID NO: 1883581 - protein, 23 aa, Staphylococcus
PISPDYNKSVLLKGFIDGYNTLD

SEQ ID NO: 1883582 - protein, 18 aa, Staphylococcus
PITNRPSLFDRINGSASS

SEQ ID NO: 1883583 - protein, 27 aa, Staphylococcus
PITVKQRRALMVKSNYAADTSISDPKV

SEQ ID NO: 1883584 - protein, 22 aa, Staphylococcus
PIVALLKLNGWDTFHEVAQMKP

SEQ ID NO: 1883585 - protein, 19 aa, Staphylococcus
PIVGILVVYYIIRFRMQAI

SEQ ID NO: 1883586 - protein, 18 aa, Staphylococcus
PIVIKVSHKLGIVDQPNF

SEQ ID NO: 1883587 - protein, 27 aa, Staphylococcus
PIVISLCISGGLIIAFIFTITMIKNRK

SEQ ID NO: 1883588 - protein, 24 aa, Staphylococcus
PIVLPPIAAMIFIKLGYHPIAGLV

SEQ ID NO: 1883589 - protein, 18 aa, Staphylococcus
PIVMGLYFVLRYRIGGGI

SEQ ID NO: 1883590 - protein, 19 aa, Staphylococcus
PIVVGLIIWALTPFKPDAL

SEQ ID NO: 1883591 - protein, 20 aa, Staphylococcus
PIWFIFLFFYYKKYKSNAKA

SEQ ID NO: 1883592 - protein, 20 aa, Staphylococcus
PIWFIFMIIMYQKYKNNARA

SEQ ID NO: 1883593 - protein, 19 aa, Staphylococcus
PIWFIILGLMYMRYKQVSK

SEQ ID NO: 1883594 - protein, 26 aa, Staphylococcus
PIYKYEWPLFIIFALIFVFMVPNTLY

SEQ ID NO: 1883595 - protein, 32 aa, Staphylococcus
PIYRGVLAFFFVINVILAFVIVFLDRDRRDAT

SEQ ID NO: 1883596 - protein, 18 aa, Staphylococcus
PKASYAYEDKAEFEKQWS

SEQ ID NO: 1883597 - protein, 18 aa, Staphylococcus
PKDAHVLNIYGDIGNGTH

SEQ ID NO: 1883598 - protein, 17 aa, Staphylococcus
PKDATIVWYDFEDATAK

SEQ ID NO: 1883599 - protein, 22 aa, Staphylococcus
PKDELDFIFDRFYRVDKSRSRK

SEQ ID NO: 1883600 - protein, 17 aa, Staphylococcus
PKDEVSVWVYALYSDEK

SEQ ID NO: 1883601 - protein, 20 aa, Staphylococcus
PKDFASKVGLDYEIDLGPSE

SEQ ID NO: 1883602 - protein, 24 aa, Staphylococcus
PKDHPWAKFIVGKPVIAVIVSLII

SEQ ID NO: 1883603 - protein, 24 aa, Staphylococcus
PKDIKTYRMVFNIINVEKMNSVLF

SEQ ID NO: 1883604 - protein, 21 aa, Staphylococcus
PKEDIEFIFDRFYRVDKSRSR

SEQ ID NO: 1883605 - protein, 20 aa, Staphylococcus
PKELTDYYLSKGYSRNDRVG

SEQ ID NO: 1883606 - protein, 21 aa, Staphylococcus
PKELTEQYLAKGYSRNDRVGK

SEQ ID NO: 1883607 - protein, 23 aa, Staphylococcus
PKEVGKYEFKVTVEDNAKNSTET

SEQ ID NO: 1883608 - protein, 23 aa, Staphylococcus
PKEVTSFVIPIGYSFNLDGSALY

SEQ ID NO: 1883609 - protein, 20 aa, Staphylococcus
PKFESFFGVEMMFLGNTEAL

SEQ ID NO: 1883610 - protein, 21 aa, Staphylococcus
PKFESFFSIEMMFLGNTEALA

SEQ ID NO: 1883611 - protein, 24 aa, Staphylococcus
PKFFNGKAPYIFAHRGGMAVRPEQ

SEQ ID NO: 1883612 - protein, 19 aa, Staphylococcus
PKFGVLIGICVGIIAGFIW

SEQ ID NO: 1883613 - protein, 19 aa, Staphylococcus
PKFSLIFLIVIYLTIGPLF

SEQ ID NO: 1883614 - protein, 25 aa, Staphylococcus
PKFVLPMLIQGFSFIMLFTYISASP

SEQ ID NO: 1883615 - protein, 22 aa, Staphylococcus
PKGEFLHMVLGVLLAAIVSFIV

SEQ ID NO: 1883616 - protein, 17 aa, Staphylococcus
PKGGIRRNAQIIVGIIL

SEQ ID NO: 1883617 - protein, 20 aa, Staphylococcus
PKGKDGKSITVPKGQDGRSV

SEQ ID NO: 1883618 - protein, 23 aa, Staphylococcus
PKGNIALNILIFIGWMILAQLPI

SEQ ID NO: 1883619 - protein, 19 aa, Staphylococcus
PKGPNSFVQVKRTWGDAII

SEQ ID NO: 1883620 - protein, 19 aa, Staphylococcus
PKHSIFIVFQILRMILILL

SEQ ID NO: 1883621 - protein, 24 aa, Staphylococcus
PKIKHLKYLYLMAFLLIVLTILKP

SEQ ID NO: 1883622 - protein, 17 aa, Staphylococcus
PKISLILSGKGNKYKLP

SEQ ID NO: 1883623 - protein, 21 aa, Staphylococcus
PKKAHMPNLYGMTKADALEAL

SEQ ID NO: 1883624 - protein, 22 aa, Staphylococcus
PKKRRVFKLSIRDLILMSLTSG

SEQ ID NO: 1883625 - protein, 17 aa, Staphylococcus
PKKSPHEPFLFTLPSAI

SEQ ID NO: 1883626 - protein, 25 aa, Staphylococcus
PKKVIEWPLFIIFSLIFLLMVPNTF

SEQ ID NO: 1883627 - protein, 22 aa, Staphylococcus
PKLAFEIPLRYKIMGIVGSVWG

SEQ ID NO: 1883628 - protein, 29 aa, Staphylococcus
PKLFINFPRRYRNVFLFMVIVGLFGANAL

SEQ ID NO: 1883629 - protein, 20 aa, Staphylococcus
PKLIIPILLIIGLLINVIPN

SEQ ID NO: 1883630 - protein, 19 aa, Staphylococcus
PKLPKVAGILRGYLNTNMP

SEQ ID NO: 1883631 - protein, 17 aa, Staphylococcus
PKLSFSIVYTNQPVPPP

SEQ ID NO: 1883632 - protein, 26 aa, Staphylococcus
PKLSLIVYLVMGWVGIIFLPIIIMRT

SEQ ID NO: 1883633 - protein, 17 aa, Staphylococcus
PKLSYSYEDRKSFEKQW

SEQ ID NO: 1883634 - protein, 18 aa, Staphylococcus
PKLTKYLFYTFLLLFLTI

SEQ ID NO: 1883635 - protein, 20 aa, Staphylococcus
PKLVINLAIAFYVIAGLLGL

SEQ ID NO: 1883636 - protein, 20 aa, Staphylococcus
PKLVMNLAIAFYIVAALLGI

SEQ ID NO: 1883637 - protein, 19 aa, Staphylococcus
PKMFALVLMIGGFMGLFSE

SEQ ID NO: 1883638 - protein, 17 aa, Staphylococcus
PKMTLPMFMIGLIIFVV

SEQ ID NO: 1883639 - protein, 23 aa, Staphylococcus
PKMYEYKTLSSYDYKKGDQIGTP

SEQ ID NO: 1883640 - protein, 25 aa, Staphylococcus
PKNFLTKRIKFILIPYIFFALFIIF

SEQ ID NO: 1883641 - protein, 23 aa, Staphylococcus
PKNHPWAKFVVGKPIIAIIISLL

SEQ ID NO: 1883642 - protein, 21 aa, Staphylococcus
PKPALIYALGIFLILIVPFAE

SEQ ID NO: 1883643 - protein, 17 aa, Staphylococcus
PKPVVKGSMNGKAGTKD

SEQ ID NO: 1883644 - protein, 21 aa, Staphylococcus
PKQDLDFIFDRFYRVDKSRAR

SEQ ID NO: 1883645 - protein, 21 aa, Staphylococcus
PKQDLEFIFDRFYRVDKSRAR

SEQ ID NO: 1883646 - protein, 54 aa, Staphylococcus
PKQLKHHGDNFFNRVIDDFGKAVGFITLTGLLSGFWLVLAKRRKKEEEEEKLNG

SEQ ID NO: 1883647 - protein, 28 aa, Staphylococcus
PKRKFKLKMPGAFAILFILTILAVLATW

SEQ ID NO: 1883648 - protein, 22 aa, Staphylococcus
PKRVFSALGVGIVFGVVIHLIY

SEQ ID NO: 1883649 - protein, 20 aa, Staphylococcus
PKSAHGYLVLPTAYRNGLYA

SEQ ID NO: 1883650 - protein, 19 aa, Staphylococcus
PKTRKLQCPHCDQDHHCVA

SEQ ID NO: 1883651 - protein, 35 aa, Staphylococcus
PKTRRSIGALVLQLALLCITQLYYHFSKGVSSERE

SEQ ID NO: 1883652 - protein, 19 aa, Staphylococcus
PKVAYAFMAAIRMIPLIIS

SEQ ID NO: 1883653 - protein, 19 aa, Staphylococcus
PKVAYAFMAAIRMVPLIIS

SEQ ID NO: 1883654 - protein, 18 aa, Staphylococcus
PKVAYAFMAAIRMVPLMF

SEQ ID NO: 1883655 - protein, 18 aa, Staphylococcus
PKVMLSVIITLLYTVYIV

SEQ ID NO: 1883656 - protein, 25 aa, Staphylococcus
PKYGKRLLLATAISTLQGMQYYAVG

SEQ ID NO: 1883657 - protein, 20 aa, Staphylococcus
PLAAGILAFIGLILSPAIGA

SEQ ID NO: 1883658 - protein, 19 aa, Staphylococcus
PLAGIFAVGIFTRRANTFG

SEQ ID NO: 1883659 - protein, 20 aa, Staphylococcus
PLAGNIWGLMAIGFICSLPF

SEQ ID NO: 1883660 - protein, 17 aa, Staphylococcus
PLAIAVVACASYVGSGA

SEQ ID NO: 1883661 - protein, 18 aa, Staphylococcus
PLAKDISDEYGVDPRKSA

SEQ ID NO: 1883662 - protein, 20 aa, Staphylococcus
PLALFGIAVMAYGTWELTKL

SEQ ID NO: 1883663 - protein, 18 aa, Staphylococcus
PLALFGIAVMTYGTYELT

SEQ ID NO: 1883664 - protein, 17 aa, Staphylococcus
PLANFLAIASFLLTAYY

SEQ ID NO: 1883665 - protein, 17 aa, Staphylococcus
PLCFLIFTRLINGLATA

SEQ ID NO: 1883666 - protein, 25 aa, Staphylococcus
PLDDHSYISWIIVVGISLILVAIVS

SEQ ID NO: 1883667 - protein, 24 aa, Staphylococcus
PLDKTRLQALYDASYHEYRMIDTD

SEQ ID NO: 1883668 - protein, 21 aa, Staphylococcus
PLEAVKFQLLVVFVHTTSTVM

SEQ ID NO: 1883669 - protein, 19 aa, Staphylococcus
PLFAWQLNRSLLWVYMVVL

SEQ ID NO: 1883670 - protein, 19 aa, Staphylococcus
PLFFIYKYKQPMFGKLRNQ

SEQ ID NO: 1883671 - protein, 24 aa, Staphylococcus
PLFVSMVVGIAFLKLTGIDYANYK

SEQ ID NO: 1883672 - protein, 24 aa, Staphylococcus
PLFVSMVVGIVFLKATGISYANYK

SEQ ID NO: 1883673 - protein, 24 aa, Staphylococcus
PLFVSMVVGIVFLKLTGISYQSYK

SEQ ID NO: 1883674 - protein, 23 aa, Staphylococcus
PLFVSMVVGIVFLKVTGISYQDY

SEQ ID NO: 1883675 - protein, 19 aa, Staphylococcus
PLGATGAMLVGRLLSEMKK

SEQ ID NO: 1883676 - protein, 20 aa, Staphylococcus
PLGDLLCERARVYLSSDKGA

SEQ ID NO: 1883677 - protein, 22 aa, Staphylococcus
PLGEMAIGLGLILGVLAYTASF

SEQ ID NO: 1883678 - protein, 18 aa, Staphylococcus
PLGGILMEQGLKIDESVN

SEQ ID NO: 1883679 - protein, 18 aa, Staphylococcus
PLGKGSRKRLEFYRLYLF

SEQ ID NO: 1883680 - protein, 19 aa, Staphylococcus
PLGTMIGDIVGWRYTFLFI

SEQ ID NO: 1883681 - protein, 22 aa, Staphylococcus
PLHFKGGLTKRSYFNKNDKVRI

SEQ ID NO: 1883682 - protein, 17 aa, Staphylococcus
PLIALSILIVIVGLVIL

SEQ ID NO: 1883683 - protein, 22 aa, Staphylococcus
PLIDFRIFKNKGYTGATVSNFL

SEQ ID NO: 1883684 - protein, 17 aa, Staphylococcus
PLIGLSILILIVGIVIL

SEQ ID NO: 1883685 - protein, 18 aa, Staphylococcus
PLIIPILFLIVAIMMFAR

SEQ ID NO: 1883686 - protein, 17 aa, Staphylococcus
PLIMGILVAVIFGLALT

SEQ ID NO: 1883687 - protein, 17 aa, Staphylococcus
PLIPAFIGAGLIGGIAA

SEQ ID NO: 1883688 - protein, 17 aa, Staphylococcus
PLISLSILIVVVGLVIL

SEQ ID NO: 1883689 - protein, 19 aa, Staphylococcus
PLISVIICVAILVLGSIFS

SEQ ID NO: 1883690 - protein, 28 aa, Staphylococcus
PLITIKLLCVCILVIFAVETQFAPSALR

SEQ ID NO: 1883691 - protein, 24 aa, Staphylococcus
PLIVYLSWWGFAIFLLLYLVGIYA

SEQ ID NO: 1883692 - protein, 26 aa, Staphylococcus
PLKANRLYWAFALCLLPFALMLVGGE

SEQ ID NO: 1883693 - protein, 23 aa, Staphylococcus
PLKEQFPYGFMLQGNGKVFGAIG

SEQ ID NO: 1883694 - protein, 24 aa, Staphylococcus
PLKFFKDFIPAITLGFSASSSTAT

SEQ ID NO: 1883695 - protein, 17 aa, Staphylococcus
PLLAKITGAGCLLGGIV

SEQ ID NO: 1883696 - protein, 17 aa, Staphylococcus
PLLAKITGAGCLLGGVV

SEQ ID NO: 1883697 - protein, 19 aa, Staphylococcus
PLLCPIITIILGLTLKTKK

SEQ ID NO: 1883698 - protein, 17 aa, Staphylococcus
PLLFLGRYTNMIYTLAS

SEQ ID NO: 1883699 - protein, 19 aa, Staphylococcus
PLLIAYVILCLIGLVMVYS

SEQ ID NO: 1883700 - protein, 23 aa, Staphylococcus
PLLILFFSCIGIYSTGCNDAITN

SEQ ID NO: 1883701 - protein, 34 aa, Staphylococcus
PLLLFSSNILKIWKESRRLLYIFLIASVGTLMGT

SEQ ID NO: 1883702 - protein, 19 aa, Staphylococcus
PLLLMDACIIIFSIIMTYA

SEQ ID NO: 1883703 - protein, 18 aa, Staphylococcus
PLMNPLMVFMLWVLLGWK

SEQ ID NO: 1883704 - protein, 27 aa, Staphylococcus
PLMVFMLWVLLGWKVAIVYFIVLAIFS

SEQ ID NO: 1883705 - protein, 19 aa, Staphylococcus
PLMVLKLAIVWTLVQFFEG

SEQ ID NO: 1883706 - protein, 18 aa, Staphylococcus
PLMVSTFDPVFSRMSGLN

SEQ ID NO: 1883707 - protein, 24 aa, Staphylococcus
PLNIETAIDFIKQILNGVKQAHEQ

SEQ ID NO: 1883708 - protein, 26 aa, Staphylococcus
PLNPEVIKWAKDVYDKRVLDTWWMTE

SEQ ID NO: 1883709 - protein, 27 aa, Staphylococcus
PLNPEVIKWSKDVFHKRVLDTWWMTET

SEQ ID NO: 1883710 - protein, 25 aa, Staphylococcus
PLNPEVIKWSKDVYDKRVLDTWWMT

SEQ ID NO: 1883711 - protein, 29 aa, Staphylococcus
PLNQRGVIQIEGYKYIRTETEDGITKYIY

SEQ ID NO: 1883712 - protein, 25 aa, Staphylococcus
PLRANRLFWAFALCLLPFSLMLVGG

SEQ ID NO: 1883713 - protein, 26 aa, Staphylococcus
PLRANRLFWAFALCLLPFSLMLVGGE

SEQ ID NO: 1883714 - protein, 26 aa, Staphylococcus
PLRANRLFWAFALCLLPFSLMLVGGQ

SEQ ID NO: 1883715 - protein, 18 aa, Staphylococcus
PLRQLRTQAINISKGDYS

SEQ ID NO: 1883716 - protein, 22 aa, Staphylococcus
PLSEALSIWQIVFLIVAVAVVY

SEQ ID NO: 1883717 - protein, 26 aa, Staphylococcus
PLSFKIHILLGFTILACWPFTRLVHV

SEQ ID NO: 1883718 - protein, 19 aa, Staphylococcus
PLSFLIFGLLLNYAQASIY

SEQ ID NO: 1883719 - protein, 18 aa, Staphylococcus
PLSIKWYGIIIAFGILLG

SEQ ID NO: 1883720 - protein, 31 aa, Staphylococcus
PLSSLFDVFFFLSWIIICIALVLNVVKVLSF

SEQ ID NO: 1883721 - protein, 24 aa, Staphylococcus
PLSSSDHALGWSLAYQIVAATIVL

SEQ ID NO: 1883722 - protein, 25 aa, Staphylococcus
PLTHIHHLLDLLKFAKTDNAREQYI

SEQ ID NO: 1883723 - protein, 19 aa, Staphylococcus
PLTLLMIVLSLIFALILGF

SEQ ID NO: 1883724 - protein, 18 aa, Staphylococcus
PLTPLSAGNRILVVNPTN

SEQ ID NO: 1883725 - protein, 20 aa, Staphylococcus
PLVEELIFRHLFIHELAKCI

SEQ ID NO: 1883726 - protein, 27 aa, Staphylococcus
PLVFDKMHFGIAFYLMFLILFLFAALT

SEQ ID NO: 1883727 - protein, 19 aa, Staphylococcus
PLVGLIITSAIKWEPVGKN

SEQ ID NO: 1883728 - protein, 21 aa, Staphylococcus
PLVGMVIHWILFFLMLFFIFI

SEQ ID NO: 1883729 - protein, 27 aa, Staphylococcus
PLVIAGGILMAIAFLFGANSFDPKSSE

SEQ ID NO: 1883730 - protein, 22 aa, Staphylococcus
PLVPGILICNAIRDLMAGELLA

SEQ ID NO: 1883731 - protein, 18 aa, Staphylococcus
PLVPGILITNAIRDLMAG

SEQ ID NO: 1883732 - protein, 21 aa, Staphylococcus
PLWFVILGLMYWRYKKASTAS

SEQ ID NO: 1883733 - protein, 19 aa, Staphylococcus
PLWTFGFIFIIANIVTLTI

SEQ ID NO: 1883734 - protein, 21 aa, Staphylococcus
PLYLQDLRGFSALDSGLLMLP

SEQ ID NO: 1883735 - protein, 21 aa, Staphylococcus
PLYLQNLRGFSALDSGLLLLP

SEQ ID NO: 1883736 - protein, 18 aa, Staphylococcus
PLYPVLPAITFVLVFLVF

SEQ ID NO: 1883737 - protein, 17 aa, Staphylococcus
PLYSKRIVQNLTLDSII

SEQ ID NO: 1883738 - protein, 18 aa, Staphylococcus
PLYYLAFVPLTIIFIVMY

SEQ ID NO: 1883739 - protein, 23 aa, Staphylococcus
PLYYRFTVYWPFFSDVFVWMPLL

SEQ ID NO: 1883740 - protein, 18 aa, Staphylococcus
PMAKILHWLGHSVFHDDY

SEQ ID NO: 1883741 - protein, 26 aa, Staphylococcus
PMASSLKWLIIYSIIFMLVIVGVVFV

SEQ ID NO: 1883742 - protein, 17 aa, Staphylococcus
PMDRFFKTLFGFGEYTD

SEQ ID NO: 1883743 - protein, 19 aa, Staphylococcus
PMDSLLHFLGRLFNDNYGL

SEQ ID NO: 1883744 - protein, 18 aa, Staphylococcus
PMGTILSFIAIILVGSFF

SEQ ID NO: 1883745 - protein, 21 aa, Staphylococcus
PMIKTTLLITWLLPVGVAIIP

SEQ ID NO: 1883746 - protein, 25 aa, Staphylococcus
PMLTMPYVFISWMFLFMSFQFEYVN

SEQ ID NO: 1883747 - protein, 27 aa, Staphylococcus
PMQSVPAWVWSCIFLVIIFALNSLSVR

SEQ ID NO: 1883748 - protein, 25 aa, Staphylococcus
PMSPSSWYKGIAVIILSLFAVSFFD

SEQ ID NO: 1883749 - protein, 19 aa, Staphylococcus
PMVIIPLYFQTFKHYTPIE

SEQ ID NO: 1883750 - protein, 21 aa, Staphylococcus
PMYIVMCILGYLIYGIGLGMY

SEQ ID NO: 1883751 - protein, 24 aa, Staphylococcus
PMYVEIFCGVVIFFFTFLEFNNRN

SEQ ID NO: 1883752 - protein, 19 aa, Staphylococcus
PNAIFFEAFLSFIGIGVPA

SEQ ID NO: 1883753 - protein, 20 aa, Staphylococcus
PNAIFFEAFLSFIGIGVPAP

SEQ ID NO: 1883754 - protein, 17 aa, Staphylococcus
PNALASIFGVSYSSVNR

SEQ ID NO: 1883755 - protein, 23 aa, Staphylococcus
PNAMLGELLKFFKEDNQLLESVY

SEQ ID NO: 1883756 - protein, 22 aa, Staphylococcus
PNANGATVYWYKNNQEALAETL

SEQ ID NO: 1883757 - protein, 18 aa, Staphylococcus
PNAVSFYLKNGFKQYDES

SEQ ID NO: 1883758 - protein, 24 aa, Staphylococcus
PNDEMKGRIIGREGRNIRTLETLT

SEQ ID NO: 1883759 - protein, 18 aa, Staphylococcus
PNDKISLVALKEVLEEKF

SEQ ID NO: 1883760 - protein, 19 aa, Staphylococcus
PNETTMLGYFIPGDYKIPA

SEQ ID NO: 1883761 - protein, 29 aa, Staphylococcus
PNGDPKVVIATKIGNQWALNEKPVGISID

SEQ ID NO: 1883762 - protein, 18 aa, Staphylococcus
PNGGFKFKLLNLSGENYK

SEQ ID NO: 1883763 - protein, 18 aa, Staphylococcus
PNHESFPFGKYVFQPLTI

SEQ ID NO: 1883764 - protein, 25 aa, Staphylococcus
PNIESIVAQLIYIVFIVFFILKNRQ

SEQ ID NO: 1883765 - protein, 17 aa, Staphylococcus
PNIKAFLNFSSIYRWDA

SEQ ID NO: 1883766 - protein, 20 aa, Staphylococcus
PNIKKSYGWIILGRALALII

SEQ ID NO: 1883767 - protein, 24 aa, Staphylococcus
PNKEVIKLSVSIGVGYLSQDDHKS

SEQ ID NO: 1883768 - protein, 25 aa, Staphylococcus
PNKHWLKRIDWVLIGILTILAIFSV

SEQ ID NO: 1883769 - protein, 17 aa, Staphylococcus
PNLALPALFAINTQNAA

SEQ ID NO: 1883770 - protein, 27 aa, Staphylococcus
PNLTILLLCRFLMGMAIGMDSPVAFTF

SEQ ID NO: 1883771 - protein, 26 aa, Staphylococcus
PNLYEYKTYSSYNFKQGDKIGTPGFV

SEQ ID NO: 1883772 - protein, 23 aa, Staphylococcus
PNMVRHPIILLPIFTNALITGLV

SEQ ID NO: 1883773 - protein, 21 aa, Staphylococcus
PNMVRYPIIMLPILVNAAISG

SEQ ID NO: 1883774 - protein, 20 aa, Staphylococcus
PNMVRYPIMLLPIITTAAIS

SEQ ID NO: 1883775 - protein, 23 aa, Staphylococcus
PNMVRYPVIMLPILITAAVSGIA

SEQ ID NO: 1883776 - protein, 19 aa, Staphylococcus
PNNKIIIFTTILIFILTII

SEQ ID NO: 1883777 - protein, 19 aa, Staphylococcus
PNNKRIGFKRYAYRHDKNV

SEQ ID NO: 1883778 - protein, 22 aa, Staphylococcus
PNNLCLKNNILLTGSNASGKST

SEQ ID NO: 1883779 - protein, 24 aa, Staphylococcus
PNQLHDIKHVISFDELPQAIDKVI

SEQ ID NO: 1883780 - protein, 39 aa, Staphylococcus
PNRHNKYAIRRFTVGTASILVGATLIFGVNHEAKAAETS

SEQ ID NO: 1883781 - protein, 24 aa, Staphylococcus
PNRKIKLDILSLILSCIGFGLFLW

SEQ ID NO: 1883782 - protein, 17 aa, Staphylococcus
PNRRKEIADKIGQVVEE

SEQ ID NO: 1883783 - protein, 20 aa, Staphylococcus
PNRVALYIMIAFMGFIGLVL

SEQ ID NO: 1883784 - protein, 20 aa, Staphylococcus
PNSKITIKLNDRIVTVETNA

SEQ ID NO: 1883785 - protein, 28 aa, Staphylococcus
PNSNGNLYLRSTLYGYDSNFTRVSMAWD

SEQ ID NO: 1883786 - protein, 26 aa, Staphylococcus
PNSTADLKTRIRMDNKNYRGTTDYYI

SEQ ID NO: 1883787 - protein, 26 aa, Staphylococcus
PNTFEPYNWPTVVIQLVYYILMITGW

SEQ ID NO: 1883788 - protein, 25 aa, Staphylococcus
PNVFGFKWDKEMEGILMKPYNYTMG

SEQ ID NO: 1883789 - protein, 19 aa, Staphylococcus
PNVPIPEGNIFAKATDNAE

SEQ ID NO: 1883790 - protein, 20 aa, Staphylococcus
PNVQWPEVWQAIYETLYMTI

SEQ ID NO: 1883791 - protein, 19 aa, Staphylococcus
PNVYFKKWQYMTIMLAPLV

SEQ ID NO: 1883792 - protein, 18 aa, Staphylococcus
PNVYPGMEDQLLQTLQKH

SEQ ID NO: 1883793 - protein, 23 aa, Staphylococcus
PNWLTALACVLLLMSFNLLSTKL

SEQ ID NO: 1883794 - protein, 34 aa, Staphylococcus
PPDTIYVNWLWHREGWMIFIGWLSYFFLGFYMGY

SEQ ID NO: 1883795 - protein, 25 aa, Staphylococcus
PPERKSEGISMFSLSLVLGTAIGPF

SEQ ID NO: 1883796 - protein, 19 aa, Staphylococcus
PPFFFNVLLPIVFISALIG

SEQ ID NO: 1883797 - protein, 24 aa, Staphylococcus
PPFFFSVLLPIVFISALIGILQYT

SEQ ID NO: 1883798 - protein, 24 aa, Staphylococcus
PPFSGETAVSIAIKHIQDPMPNIT

SEQ ID NO: 1883799 - protein, 19 aa, Staphylococcus
PPIAIALAMIIFKRKFTKA

SEQ ID NO: 1883800 - protein, 19 aa, Staphylococcus
PPIEFLRQYLAQWTSNKIL

SEQ ID NO: 1883801 - protein, 18 aa, Staphylococcus
PPIEYARQYLAQWTSNKI

SEQ ID NO: 1883802 - protein, 21 aa, Staphylococcus
PPIMLMIGFWTIHFNYPSLFL

SEQ ID NO: 1883803 - protein, 17 aa, Staphylococcus
PPIYAMLMSLLIFAGSM

SEQ ID NO: 1883804 - protein, 17 aa, Staphylococcus
PPKRNHYAFIMTMCGIH

SEQ ID NO: 1883805 - protein, 19 aa, Staphylococcus
PPLDIPVGIVIAIVGVPYF

SEQ ID NO: 1883806 - protein, 19 aa, Staphylococcus
PPLHTVVINEIIKEQGQNV

SEQ ID NO: 1883807 - protein, 22 aa, Staphylococcus
PPQELLQILGIPSNVTHLTYSF

SEQ ID NO: 1883808 - protein, 18 aa, Staphylococcus
PPSPEWGAMLSAGRDFLT

SEQ ID NO: 1883809 - protein, 18 aa, Staphylococcus
PPTKTVIVKPKIDTKYEF

SEQ ID NO: 1883810 - protein, 27 aa, Staphylococcus
PPYLIKKDGKYYVFNQYLTKSNYYQNT

SEQ ID NO: 1883811 - protein, 19 aa, Staphylococcus
PQAFPRINRGVEIASNGVD

SEQ ID NO: 1883812 - protein, 18 aa, Staphylococcus
PQALSNVVLKATEKDKTV

SEQ ID NO: 1883813 - protein, 29 aa, Staphylococcus
PQDSYLLIRGIKTLGLRMEQVSSNAVAVT

SEQ ID NO: 1883814 - protein, 19 aa, Staphylococcus
PQFYLLAIMSFIGVIGSIL

SEQ ID NO: 1883815 - protein, 24 aa, Staphylococcus
PQHGIEGLPTIGFIGFYPNIESIV

SEQ ID NO: 1883816 - protein, 19 aa, Staphylococcus
PQIVVLATFILKVTMTSLL

SEQ ID NO: 1883817 - protein, 18 aa, Staphylococcus
PQKDEVILILKLGIPAGL

SEQ ID NO: 1883818 - protein, 21 aa, Staphylococcus
PQLIRRYYFQYSLAIQMTLNL

SEQ ID NO: 1883819 - protein, 29 aa, Staphylococcus
PQLIRRYYWRFELGMQMVLNIIIGAIVMA

SEQ ID NO: 1883820 - protein, 29 aa, Staphylococcus
PQLIRRYYWRFTLGIQMILNILIGATMML

SEQ ID NO: 1883821 - protein, 20 aa, Staphylococcus
PQLLPAIITLIGSIIMLFIM

SEQ ID NO: 1883822 - protein, 19 aa, Staphylococcus
PQLLPAVITLIGSIVMLFI

SEQ ID NO: 1883823 - protein, 17 aa, Staphylococcus
PQLRAKDLKNRECKING

SEQ ID NO: 1883824 - protein, 21 aa, Staphylococcus
PQMTRRSFLKLLGIGSAGAVI

SEQ ID NO: 1883825 - protein, 23 aa, Staphylococcus
PQNEITWLVVIFIVIELVGAATT

SEQ ID NO: 1883826 - protein, 26 aa, Staphylococcus
PQTGELLALVSTPSYDVYPFMYGMSN

SEQ ID NO: 1883827 - protein, 18 aa, Staphylococcus
PQWYKWFFENIVSHSTGL

SEQ ID NO: 1883828 - protein, 18 aa, Staphylococcus
PRALNVFLKNNVLVTYHH

SEQ ID NO: 1883829 - protein, 28 aa, Staphylococcus
PRAVKQVFWRILLFYVLSIVVIAAIIPY

SEQ ID NO: 1883830 - protein, 21 aa, Staphylococcus
PRDTISYIPKVGYYDKITHAH

SEQ ID NO: 1883831 - protein, 22 aa, Staphylococcus
PRDVTSFVIPIGYSFNLDGSAL

SEQ ID NO: 1883832 - protein, 27 aa, Staphylococcus
PREIFMGKAGFFFLLGIVQALIVSIGD

SEQ ID NO: 1883833 - protein, 27 aa, Staphylococcus
PREINAIPPFFSGVAPYLFAHRGGMAV

SEQ ID NO: 1883834 - protein, 20 aa, Staphylococcus
PRFIIPMLLQGLTYVMLFSF

SEQ ID NO: 1883835 - protein, 19 aa, Staphylococcus
PRFLVYRKRHSLWLSMIKV

SEQ ID NO: 1883836 - protein, 18 aa, Staphylococcus
PRHNIRIVTDEDLKNNEN

SEQ ID NO: 1883837 - protein, 23 aa, Staphylococcus
PRILKEIILPQALRNSIPNLTTQ

SEQ ID NO: 1883838 - protein, 26 aa, Staphylococcus
PRKGDNKKTWIIIAVIAVLLIALIVA

SEQ ID NO: 1883839 - protein, 18 aa, Staphylococcus
PRLEDISMEGILFALGQS

SEQ ID NO: 1883840 - protein, 19 aa, Staphylococcus
PRLKLLCDIIGILCILSIL

SEQ ID NO: 1883841 - protein, 22 aa, Staphylococcus
PRLLVIIIVLCLGLYRILHFFF

SEQ ID NO: 1883842 - protein, 17 aa, Staphylococcus
PRQVISLALMLGAIILN

SEQ ID NO: 1883843 - protein, 20 aa, Staphylococcus
PRRVMTFAFIIWMIFHVGFL

SEQ ID NO: 1883844 - protein, 17 aa, Staphylococcus
PRTAMIILFTLVIVVII

SEQ ID NO: 1883845 - protein, 22 aa, Staphylococcus
PRTSTISGVATKVGTYPIVVIS

SEQ ID NO: 1883846 - protein, 19 aa, Staphylococcus
PRVDSAFTIFYMGINAGAL

SEQ ID NO: 1883847 - protein, 17 aa, Staphylococcus
PSAEEIAIAQTAIKKES

SEQ ID NO: 1883848 - protein, 24 aa, Staphylococcus
PSALRAVLTAITFFIIPKAFKISS

SEQ ID NO: 1883849 - protein, 21 aa, Staphylococcus
PSENWWVFVVLLLLVGNVEVT

SEQ ID NO: 1883850 - protein, 17 aa, Staphylococcus
PSEVLGGSSSEFSPTQL

SEQ ID NO: 1883851 - protein, 23 aa, Staphylococcus
PSEWRLIVISLLLLVFWSTEKVL

SEQ ID NO: 1883852 - protein, 19 aa, Staphylococcus
PSFETIGAQIIYIILVIVF

SEQ ID NO: 1883853 - protein, 22 aa, Staphylococcus
PSGLLARFMGNPVFVYLGKRSY

SEQ ID NO: 1883854 - protein, 19 aa, Staphylococcus
PSGVIGLLGIVGYVSFYSI

SEQ ID NO: 1883855 - protein, 18 aa, Staphylococcus
PSGVLGLIGIVGYVSYYS

SEQ ID NO: 1883856 - protein, 19 aa, Staphylococcus
PSHGLGFTINLSFVIITIP

SEQ ID NO: 1883857 - protein, 19 aa, Staphylococcus
PSHIPMMPEKVYFDKQLNT

SEQ ID NO: 1883858 - protein, 22 aa, Staphylococcus
PSHLNMALTVFIFIMIISIVLA

SEQ ID NO: 1883859 - protein, 19 aa, Staphylococcus
PSIEFSKDSAMPWLPAAIG

SEQ ID NO: 1883860 - protein, 20 aa, Staphylococcus
PSIFNFSLALLIGLISGVFS

SEQ ID NO: 1883861 - protein, 18 aa, Staphylococcus
PSILIIIPILIVAFLISK

SEQ ID NO: 1883862 - protein, 17 aa, Staphylococcus
PSIMIKVTWGIAQSLIA

SEQ ID NO: 1883863 - protein, 24 aa, Staphylococcus
PSKHWFRKVDWILVLVITVLAIIS

SEQ ID NO: 1883864 - protein, 27 aa, Staphylococcus
PSKHWLRKIDWILVALLTILAIISVTT

SEQ ID NO: 1883865 - protein, 20 aa, Staphylococcus
PSKLRLVEIGGYSFPSGHAM

SEQ ID NO: 1883866 - protein, 27 aa, Staphylococcus
PSKPKDLKSYRMVFSTMNVERMNSILF

SEQ ID NO: 1883867 - protein, 20 aa, Staphylococcus
PSLATKFVWGAVLAGISYIM

SEQ ID NO: 1883868 - protein, 18 aa, Staphylococcus
PSLFLSAYIIIFIYFLIL

SEQ ID NO: 1883869 - protein, 17 aa, Staphylococcus
PSLLDRIHGNHHNSSQL

SEQ ID NO: 1883870 - protein, 19 aa, Staphylococcus
PSLLDRLHADAQRHRSVLD

SEQ ID NO: 1883871 - protein, 23 aa, Staphylococcus
PSLPVKFALGTFLAGLSYLIMGL

SEQ ID NO: 1883872 - protein, 24 aa, Staphylococcus
PSLSEIYLLIMLINILIAYYLLAY

SEQ ID NO: 1883873 - protein, 24 aa, Staphylococcus
PSLTMPFILATWIMLFAGRPHREI

SEQ ID NO: 1883874 - protein, 18 aa, Staphylococcus
PSNGKWYDHIGIKQERRQ

SEQ ID NO: 1883875 - protein, 25 aa, Staphylococcus
PSSKPALDCPIVFPYAQNAVLIGFF

SEQ ID NO: 1883876 - protein, 22 aa, Staphylococcus
PSSVERYERELNGFKNELDSAK

SEQ ID NO: 1883877 - protein, 25 aa, Staphylococcus
PSTIINKNGIRYGIVGVTTPETKTK

SEQ ID NO: 1883878 - protein, 23 aa, Staphylococcus
PSTRLAVIIAPFWMGILGLMYLR

SEQ ID NO: 1883879 - protein, 22 aa, Staphylococcus
PSVGIPLTIIACIYNMILSGFL

SEQ ID NO: 1883880 - protein, 21 aa, Staphylococcus
PSVIANFAFALGVPLGHTLTH

SEQ ID NO: 1883881 - protein, 21 aa, Staphylococcus
PSVIGNFAFALGVPLGHTLTH

SEQ ID NO: 1883882 - protein, 18 aa, Staphylococcus
PSVIHMFQQLSLFLITIA

SEQ ID NO: 1883883 - protein, 29 aa, Staphylococcus
PSVKGFKRTRISMFIWLVFLLPLPFLLSG

SEQ ID NO: 1883884 - protein, 20 aa, Staphylococcus
PSYVKWKFPLQIGLMTGLYS

SEQ ID NO: 1883885 - protein, 19 aa, Staphylococcus
PSYVKWYFPMQIGLMTGIY

SEQ ID NO: 1883886 - protein, 21 aa, Staphylococcus
PTAVEGVEFKDPLTSVKQAMN

SEQ ID NO: 1883887 - protein, 19 aa, Staphylococcus
PTFGEPVGLNAKYYRDNHV

SEQ ID NO: 1883888 - protein, 19 aa, Staphylococcus
PTFNDEYLNNIKVSWGDKG

SEQ ID NO: 1883889 - protein, 25 aa, Staphylococcus
PTGSSLKPFLAYGPAIENMHWATNH

SEQ ID NO: 1883890 - protein, 30 aa, Staphylococcus
PTIIEIAKYLKARGIYTIAISSSINTELGQ

SEQ ID NO: 1883891 - protein, 19 aa, Staphylococcus
PTINLSRIIGIILDNAIEA

SEQ ID NO: 1883892 - protein, 24 aa, Staphylococcus
PTIPISAILPYLGNIYLKNNKDNI

SEQ ID NO: 1883893 - protein, 23 aa, Staphylococcus
PTKEELFKYTVIVVATVIFFMVF

SEQ ID NO: 1883894 - protein, 23 aa, Staphylococcus
PTKEELFKYTVIVVATVVFFLVF

SEQ ID NO: 1883895 - protein, 23 aa, Staphylococcus
PTKEELFKYTVIVVSTVIFFMVF

SEQ ID NO: 1883896 - protein, 22 aa, Staphylococcus
PTLAGRAEAGWLLKSTLGMQFR

SEQ ID NO: 1883897 - protein, 26 aa, Staphylococcus
PTLFILVALCGAIVFNTIVYTCVSLL

SEQ ID NO: 1883898 - protein, 32 aa, Staphylococcus
PTLGGFIIHFASWRWMFFINIVVSLISVLLMM

SEQ ID NO: 1883899 - protein, 25 aa, Staphylococcus
PTLILPRVVAIVGIISALITIKDKD

SEQ ID NO: 1883900 - protein, 23 aa, Staphylococcus
PTLKRMKFGQSIREEGPESHMKK

SEQ ID NO: 1883901 - protein, 17 aa, Staphylococcus
PTLLFAVDLDETKQTRA

SEQ ID NO: 1883902 - protein, 17 aa, Staphylococcus
PTLLRLIDITGFSFPSG

SEQ ID NO: 1883903 - protein, 21 aa, Staphylococcus
PTLNERAKLILALNDYMPNIE

SEQ ID NO: 1883904 - protein, 25 aa, Staphylococcus
PTLNNELFNIYKFRSMKMDTPNVAT

SEQ ID NO: 1883905 - protein, 20 aa, Staphylococcus
PTLSAAFFGLAFYGQSVKVD

SEQ ID NO: 1883906 - protein, 17 aa, Staphylococcus
PTMIKLAIPGAITSFIG

SEQ ID NO: 1883907 - protein, 23 aa, Staphylococcus
PTMLKLAIPGAISGFIGAGLLTQ

SEQ ID NO: 1883908 - protein, 19 aa, Staphylococcus
PTPFLARVIGWSIALVLGF

SEQ ID NO: 1883909 - protein, 24 aa, Staphylococcus
PTPPSAKRSYSWVVLGRCLAIIIA

SEQ ID NO: 1883910 - protein, 17 aa, Staphylococcus
PTQLASAFAAIANGGTY

SEQ ID NO: 1883911 - protein, 17 aa, Staphylococcus
PTQLASAFASIANGGTY

SEQ ID NO: 1883912 - protein, 18 aa, Staphylococcus
PTQPGGYTPFVPNNSGDQ

SEQ ID NO: 1883913 - protein, 24 aa, Staphylococcus
PTQSVTVFMYKDAINNKISEIETE

SEQ ID NO: 1883914 - protein, 23 aa, Staphylococcus
PTRKVKRKVVVQLTKFEKVLYIS

SEQ ID NO: 1883915 - protein, 20 aa, Staphylococcus
PTSKWLAVWSTIFVGNIIFN

SEQ ID NO: 1883916 - protein, 30 aa, Staphylococcus
PTSLLANKTLNVTFNLRVNNVANPKEVTFS

SEQ ID NO: 1883917 - protein, 19 aa, Staphylococcus
PTTFIWVCVVTLIAQQLEG

SEQ ID NO: 1883918 - protein, 25 aa, Staphylococcus
PTTHWLRKIDWILIALIMILAIISV

SEQ ID NO: 1883919 - protein, 29 aa, Staphylococcus
PTTPEQNGQLGAGVKPGTANPDQNTEVKP

SEQ ID NO: 1883920 - protein, 29 aa, Staphylococcus
PTTPVINTRLVYKAGTLTPIDVSTDPNTQ

SEQ ID NO: 1883921 - protein, 19 aa, Staphylococcus
PTYLAWKLNPAGSISIMIS

SEQ ID NO: 1883922 - protein, 20 aa, Staphylococcus
PVADMNWPPLLWMLFIAVIC

SEQ ID NO: 1883923 - protein, 21 aa, Staphylococcus
PVAHVHIDFQFVITLIAVVII

SEQ ID NO: 1883924 - protein, 23 aa, Staphylococcus
PVAHWVWGGGWIQQLEALDYAGG

SEQ ID NO: 1883925 - protein, 23 aa, Staphylococcus
PVAHWVWGGGWISKLGAIDYAGG

SEQ ID NO: 1883926 - protein, 19 aa, Staphylococcus
PVAMISWMVSVFGFDLSFI

SEQ ID NO: 1883927 - protein, 17 aa, Staphylococcus
PVANFLAGASFLLTAYF

SEQ ID NO: 1883928 - protein, 18 aa, Staphylococcus
PVARVFYSIVSFIVNLFR

SEQ ID NO: 1883929 - protein, 19 aa, Staphylococcus
PVDEFKPGQHYAVEENDLL

SEQ ID NO: 1883930 - protein, 17 aa, Staphylococcus
PVFAVIVGLVLHDFKLL

SEQ ID NO: 1883931 - protein, 19 aa, Staphylococcus
PVFFIPFIFAPIVNVWIFK

SEQ ID NO: 1883932 - protein, 24 aa, Staphylococcus
PVFIIKRWFDLKTTIASGFLLTST

SEQ ID NO: 1883933 - protein, 19 aa, Staphylococcus
PVFLAFFIYHKLRYKTKMI

SEQ ID NO: 1883934 - protein, 19 aa, Staphylococcus
PVFLVFFIYHKLRYKTKII

SEQ ID NO: 1883935 - protein, 20 aa, Staphylococcus
PVGISNLWSHGGFMPNGIVG

SEQ ID NO: 1883936 - protein, 24 aa, Staphylococcus
PVGLVLFCLALVFLQRDVGQTLLI

SEQ ID NO: 1883937 - protein, 22 aa, Staphylococcus
PVHRKCMIGILTVVVLVMGLAA

SEQ ID NO: 1883938 - protein, 18 aa, Staphylococcus
PVKFKVKIIREVDHMERL

SEQ ID NO: 1883939 - protein, 27 aa, Staphylococcus
PVKHHKGKEILYAWSPFVILTIIVMIW

SEQ ID NO: 1883940 - protein, 18 aa, Staphylococcus
PVLATWRGIFQGYKSMGP

SEQ ID NO: 1883941 - protein, 19 aa, Staphylococcus
PVLATWRGIFQGYKSMGPT

SEQ ID NO: 1883942 - protein, 25 aa, Staphylococcus
PVLFALSGLLILLGLILVFSLFAPT

SEQ ID NO: 1883943 - protein, 20 aa, Staphylococcus
PVLFFIVAIMMFARKDRVET

SEQ ID NO: 1883944 - protein, 20 aa, Staphylococcus
PVLFIKRWFDTKTTIASAFL

SEQ ID NO: 1883945 - protein, 20 aa, Staphylococcus
PVLGFFLYILFGRGVSKNKL

SEQ ID NO: 1883946 - protein, 42 aa, Staphylococcus
PVLIQMPVVMGLYFVLRYRIGGGIAEHPHFLWFNLIHPDIWI

SEQ ID NO: 1883947 - protein, 18 aa, Staphylococcus
PVLLELKAYIKNRVTNFR

SEQ ID NO: 1883948 - protein, 19 aa, Staphylococcus
PVLMSMLIALVFSFIIISP

SEQ ID NO: 1883949 - protein, 21 aa, Staphylococcus
PVPDTKVIKGYEQFLYRLMIG

SEQ ID NO: 1883950 - protein, 22 aa, Staphylococcus
PVPEPWLQGGDLGRDVINYYFK

SEQ ID NO: 1883951 - protein, 20 aa, Staphylococcus
PVPVVLFIYFLSFITTTSSG

SEQ ID NO: 1883952 - protein, 20 aa, Staphylococcus
PVPVVLFIYFLSYISTTMSG

SEQ ID NO: 1883953 - protein, 24 aa, Staphylococcus
PVRDYGSGMTPFYTALSIWVGALL

SEQ ID NO: 1883954 - protein, 24 aa, Staphylococcus
PVSDYLPWLHLKYHDKQAKVTVEQ

SEQ ID NO: 1883955 - protein, 25 aa, Staphylococcus
PVSIFKLFVIFLIRTIIALPIISLM

SEQ ID NO: 1883956 - protein, 20 aa, Staphylococcus
PVSLECTKKMGVRREIASFV

SEQ ID NO: 1883957 - protein, 24 aa, Staphylococcus
PVSLIAGAIAIIFILLARQSKAVH

SEQ ID NO: 1883958 - protein, 29 aa, Staphylococcus
PVSRLTEKILGWFSWIFLLLMTIITMFIA

SEQ ID NO: 1883959 - protein, 29 aa, Staphylococcus
PVSRLTEKLLGWFSWIFLLILTVITMFIA

SEQ ID NO: 1883960 - protein, 24 aa, Staphylococcus
PVSRTSYLMSFVWVGLLNSIVMII

SEQ ID NO: 1883961 - protein, 18 aa, Staphylococcus
PVSRVAEKVLGWLNWIGL

SEQ ID NO: 1883962 - protein, 20 aa, Staphylococcus
PVTEIIELGVGTPANAANSV

SEQ ID NO: 1883963 - protein, 24 aa, Staphylococcus
PVTFTARMMSLWMLSNATAQGLNA

SEQ ID NO: 1883964 - protein, 19 aa, Staphylococcus
PVVAFLIGWYRDRTIERIN

SEQ ID NO: 1883965 - protein, 21 aa, Staphylococcus
PVVFISIIGWFWFSGSNFASS

SEQ ID NO: 1883966 - protein, 22 aa, Staphylococcus
PVVGMVVHWILFFLMIFFVFIV

SEQ ID NO: 1883967 - protein, 25 aa, Staphylococcus
PVVVAEIIMGIIIGQSFLNLVHKDS

SEQ ID NO: 1883968 - protein, 25 aa, Staphylococcus
PVVVAEILMGLVIGQSGFHLVERDN

SEQ ID NO: 1883969 - protein, 22 aa, Staphylococcus
PVWELIKPRLIPSFEMGLTAMI

SEQ ID NO: 1883970 - protein, 22 aa, Staphylococcus
PVWELIKPRLIPSMEMGITAMI

SEQ ID NO: 1883971 - protein, 23 aa, Staphylococcus
PVYITLCVIGFLLFGLGLGLFAT

SEQ ID NO: 1883972 - protein, 26 aa, Staphylococcus
PVYMPYICSYFMPRAIGDRPLVVPHQ

SEQ ID NO: 1883973 - protein, 26 aa, Staphylococcus
PVYMPYICSYFMPRAIGDRPLVVPQH

SEQ ID NO: 1883974 - protein, 25 aa, Staphylococcus
PVYMPYICSYFMPRSIGDRPLVVPE

SEQ ID NO: 1883975 - protein, 18 aa, Staphylococcus
PWGEAWIVAQQMSKKIVT

SEQ ID NO: 1883976 - protein, 25 aa, Staphylococcus
PWIGACFTAYFGGRLSDWLRVKTGS

SEQ ID NO: 1883977 - protein, 22 aa, Staphylococcus
PWMPIIDLDFAFRLDGLSMIFA

SEQ ID NO: 1883978 - protein, 23 aa, Staphylococcus
PWRQPQMVKRDFLLILVYVLGNM

SEQ ID NO: 1883979 - protein, 19 aa, Staphylococcus
PWSAFFKHFSFYAIAVQYF

SEQ ID NO: 1883980 - protein, 24 aa, Staphylococcus
PYAQCVYCLISTGILAFINDDLIT

SEQ ID NO: 1883981 - protein, 20 aa, Staphylococcus
PYEHIQHTSIPKEQPKTQTE

SEQ ID NO: 1883982 - protein, 17 aa, Staphylococcus
PYFKIPLFTDFARQKHF

SEQ ID NO: 1883983 - protein, 24 aa, Staphylococcus
PYHFFSIALIKDFLGLMYQYKVIL

SEQ ID NO: 1883984 - protein, 19 aa, Staphylococcus
PYIGTSIDRIGSKKVIYIS

SEQ ID NO: 1883985 - protein, 17 aa, Staphylococcus
PYILIAIVLLFFVQQIM

SEQ ID NO: 1883986 - protein, 23 aa, Staphylococcus
PYKIKRLVGQSGMSYGALGKNAI

SEQ ID NO: 1883987 - protein, 21 aa, Staphylococcus
PYKRHPMIKLMNAMQYDASGI

SEQ ID NO: 1883988 - protein, 19 aa, Staphylococcus
PYKVKRLVGQSGMSYGALG

SEQ ID NO: 1883989 - protein, 25 aa, Staphylococcus
PYLAFFPIIGVLVIYYIVRFKMQSF

SEQ ID NO: 1883990 - protein, 20 aa, Staphylococcus
PYLAFFPIVGILVVYYIIRF

SEQ ID NO: 1883991 - protein, 17 aa, Staphylococcus
PYLCLAIFIIGHIARYK

SEQ ID NO: 1883992 - protein, 17 aa, Staphylococcus
PYLCVAIFIIGHIARYR

SEQ ID NO: 1883993 - protein, 23 aa, Staphylococcus
PYLLRISHFKSRFQVKHYAVVAL

SEQ ID NO: 1883994 - protein, 17 aa, Staphylococcus
PYLLTLLYLAIFIALYL

SEQ ID NO: 1883995 - protein, 18 aa, Staphylococcus
PYMAGVYGGGAFLLMFLV

SEQ ID NO: 1883996 - protein, 25 aa, Staphylococcus
PYMHIMSIYIIRSFGMAFVMMPLMT

SEQ ID NO: 1883997 - protein, 19 aa, Staphylococcus
PYQGAPMFKEKFIKDHPEV

SEQ ID NO: 1883998 - protein, 19 aa, Staphylococcus
PYQGAPMFKEKFLKEHPEI

SEQ ID NO: 1883999 - protein, 19 aa, Staphylococcus
PYQGAPMFKEKFLKEHPEV

SEQ ID NO: 1884000 - protein, 19 aa, Staphylococcus
PYQGAPMFKEKFLKQHPEI

SEQ ID NO: 1884001 - protein, 17 aa, Staphylococcus
PYQGAPMFKEKFLNEHK

SEQ ID NO: 1884002 - protein, 18 aa, Staphylococcus
PYQGAPMFKESYLKEHPE

SEQ ID NO: 1884003 - protein, 32 aa, Staphylococcus
PYRPHYFLKIRIPFTPGLIPKRRGEIATKIGQ

SEQ ID NO: 1884004 - protein, 17 aa, Staphylococcus
PYTGFLVSNQLIYQVMK

SEQ ID NO: 1884005 - protein, 26 aa, Staphylococcus
PYTIVKKNGIRYGIVGVTTPETAVKT

SEQ ID NO: 1884006 - protein, 18 aa, Staphylococcus
PYTRYPVYDEDIDHIIGV

SEQ ID NO: 1884007 - protein, 37 aa, Staphylococcus
PYVEGQKVYNAFVSIEVPKIGYKGNYDIRIINDEPNK

SEQ ID NO: 1884008 - protein, 22 aa, Staphylococcus
QAADQRKATFPNDNNATTEEKE

SEQ ID NO: 1884009 - protein, 28 aa, Staphylococcus
QAFYPKKIWIAIKFLGVYLYQLITSSIS

SEQ ID NO: 1884010 - protein, 25 aa, Staphylococcus
QAIAMWPGFSRSGSTISTGVFMKLN

SEQ ID NO: 1884011 - protein, 24 aa, Staphylococcus
QAICYLIAVALCFPIHIQATHMGD

SEQ ID NO: 1884012 - protein, 21 aa, Staphylococcus
QAIELARTLPTRTTKINKNNR

SEQ ID NO: 1884013 - protein, 26 aa, Staphylococcus
QAIVSRFISCILVLFIGSAIFSLLGQ

SEQ ID NO: 1884014 - protein, 19 aa, Staphylococcus
QAIVSRFVSCFMILIFGSI

SEQ ID NO: 1884015 - protein, 26 aa, Staphylococcus
QAIVSRFVSCILILLFGSLVFSLLGQ

SEQ ID NO: 1884016 - protein, 22 aa, Staphylococcus
QAIWPKVGMVYFGMADIGGAIV

SEQ ID NO: 1884017 - protein, 19 aa, Staphylococcus
QAKALADLIARAQNDKANA

SEQ ID NO: 1884018 - protein, 23 aa, Staphylococcus
QAKHHIIEGFALGQAYSQQGLPV

SEQ ID NO: 1884019 - protein, 20 aa, Staphylococcus
QAKIYCFIDEIFKGTNTTER

SEQ ID NO: 1884020 - protein, 19 aa, Staphylococcus
QAKTGGAVIGFRLKDETKA

SEQ ID NO: 1884021 - protein, 22 aa, Staphylococcus
QAKVKAQKAIEDAIKQKTDEIN

SEQ ID NO: 1884022 - protein, 18 aa, Staphylococcus
QALIAFVLLLAGGGDGSK

SEQ ID NO: 1884023 - protein, 21 aa, Staphylococcus
QALKLFWKNYVNFKGRSRRSE

SEQ ID NO: 1884024 - protein, 20 aa, Staphylococcus
QALKLFWSNYVNFKGRSRRS

SEQ ID NO: 1884025 - protein, 17 aa, Staphylococcus
QALPIFIGICVIVSLLA

SEQ ID NO: 1884026 - protein, 24 aa, Staphylococcus
QALPIRYLQWLGHAFTGDLGTSFS

SEQ ID NO: 1884027 - protein, 18 aa, Staphylococcus
QAMDTMTSFWIPQLGGQK

SEQ ID NO: 1884028 - protein, 20 aa, Staphylococcus
QANNEFLKETSTVIIPNNPV

SEQ ID NO: 1884029 - protein, 17 aa, Staphylococcus
QAPLIKPTFITSVGDAA

SEQ ID NO: 1884030 - protein, 29 aa, Staphylococcus
QAPPNLKSRFKLFLDKHVLSVVFVTLCAA

SEQ ID NO: 1884031 - protein, 17 aa, Staphylococcus
QAQGAKRPLLFGSAFTF

SEQ ID NO: 1884032 - protein, 21 aa, Staphylococcus
QAQGTVLALGRVEGNDPNNHG

SEQ ID NO: 1884033 - protein, 23 aa, Staphylococcus
QAQSFKVIFAIIITLVTVIGSYW

SEQ ID NO: 1884034 - protein, 22 aa, Staphylococcus
QAQTRPDIVATVNKAKPLDTAM

SEQ ID NO: 1884035 - protein, 21 aa, Staphylococcus
QARLSGWSILLIEWVCFTLTY

SEQ ID NO: 1884036 - protein, 20 aa, Staphylococcus
QASIYIAIALLILMTLIYFS

SEQ ID NO: 1884037 - protein, 17 aa, Staphylococcus
QAVDILRQLPNVNEQLK

SEQ ID NO: 1884038 - protein, 17 aa, Staphylococcus
QAVLGFLGDLFGRAQEI

SEQ ID NO: 1884039 - protein, 17 aa, Staphylococcus
QAVPALFALIFKSAFGM

SEQ ID NO: 1884040 - protein, 25 aa, Staphylococcus
QAVWYYRYIGLISLIWTLVTLYFNI

SEQ ID NO: 1884041 - protein, 20 aa, Staphylococcus
QCIRVCVIIIAILMFMFKEW

SEQ ID NO: 1884042 - protein, 21 aa, Staphylococcus
QDAKNSGTIVITGINPDTSVK

SEQ ID NO: 1884043 - protein, 17 aa, Staphylococcus
QDEPINFILNSDTKLKA

SEQ ID NO: 1884044 - protein, 24 aa, Staphylococcus
QDFHEVIESMSLQVGSYIQGQMFV

SEQ ID NO: 1884045 - protein, 22 aa, Staphylococcus
QDFRYYPNFFHQTGQGKTSDSE

SEQ ID NO: 1884046 - protein, 19 aa, Staphylococcus
QDGKEKGWVAGWHTNLNIP

SEQ ID NO: 1884047 - protein, 25 aa, Staphylococcus
QDGKKVLAPSGGFLQVSNSIRVYFN

SEQ ID NO: 1884048 - protein, 26 aa, Staphylococcus
QDGKKVLGANGGFLQVSDSLRVYYDI

SEQ ID NO: 1884049 - protein, 17 aa, Staphylococcus
QDGLKFTVKEEEKQSVF

SEQ ID NO: 1884050 - protein, 18 aa, Staphylococcus
QDGVGLPIFTALPIVTGV

SEQ ID NO: 1884051 - protein, 17 aa, Staphylococcus
QDGVGLPLFTALPIVSG

SEQ ID NO: 1884052 - protein, 25 aa, Staphylococcus
QDHIKFSLFLAMLIACLLIQAATNM

SEQ ID NO: 1884053 - protein, 19 aa, Staphylococcus
QDHRPEDHSTRESEQDFKQ

SEQ ID NO: 1884054 - protein, 26 aa, Staphylococcus
QDITRFIVRVLIPFALIISLFLISQG

SEQ ID NO: 1884055 - protein, 19 aa, Staphylococcus
QDKLTGFVFPIINKDELKD

SEQ ID NO: 1884056 - protein, 23 aa, Staphylococcus
QDLDRAMGALRQSIANQDQVKSE

SEQ ID NO: 1884057 - protein, 24 aa, Staphylococcus
QDNIKFMLFIAMLIACLLIQAATN

SEQ ID NO: 1884058 - protein, 21 aa, Staphylococcus
QDNKLPWIFLYGITGLLIPAA

SEQ ID NO: 1884059 - protein, 25 aa, Staphylococcus
QDPLFKDKEIFVLDGHSHTVIQNGK

SEQ ID NO: 1884060 - protein, 27 aa, Staphylococcus
QDRILFDNRLNGMGPYPTGKLSAMVNI

SEQ ID NO: 1884061 - protein, 25 aa, Staphylococcus
QDSGRFFWPAIIAFSLTGIGLPLLG

SEQ ID NO: 1884062 - protein, 20 aa, Staphylococcus
QDTKLPWIFLYGLTGLLIPA

SEQ ID NO: 1884063 - protein, 21 aa, Staphylococcus
QDTKLPWIIMYGLTGLLIPAS

SEQ ID NO: 1884064 - protein, 18 aa, Staphylococcus
QDYLGMAKQRVGDYQEAT

SEQ ID NO: 1884065 - protein, 23 aa, Staphylococcus
QEADLKTSIGWQEVYHNTDTSES

SEQ ID NO: 1884066 - protein, 23 aa, Staphylococcus
QEAFYLFIPMSLMFWLSKFKIKY

SEQ ID NO: 1884067 - protein, 23 aa, Staphylococcus
QEDQCCGHCGYKLTRQNDHTTTS

SEQ ID NO: 1884068 - protein, 27 aa, Staphylococcus
QEEMPSFRLSVFTALLPVILMLISTIL

SEQ ID NO: 1884069 - protein, 22 aa, Staphylococcus
QEFIYRNDLLFIASFMVLTSLI

SEQ ID NO: 1884070 - protein, 21 aa, Staphylococcus
QEFNLDYGDKIIVRHREPAAR

SEQ ID NO: 1884071 - protein, 30 aa, Staphylococcus
QEFYPKKLWVAFKFLMVYLYQLVTSSISTI

SEQ ID NO: 1884072 - protein, 19 aa, Staphylococcus
QEGNFSKDEFVKLVNQSAI

SEQ ID NO: 1884073 - protein, 18 aa, Staphylococcus
QEIFQFFTSHGIYSLGGI

SEQ ID NO: 1884074 - protein, 21 aa, Staphylococcus
QEIIYLIPISFVVTIASSITF

SEQ ID NO: 1884075 - protein, 23 aa, Staphylococcus
QEKPTSIWRITRKSAAAQSPTIG

SEQ ID NO: 1884076 - protein, 24 aa, Staphylococcus
QEKTNHMFYVWLIIGFIFGFAPPL

SEQ ID NO: 1884077 - protein, 22 aa, Staphylococcus
QELEDGVGLPLFTALPILTALL

SEQ ID NO: 1884078 - protein, 17 aa, Staphylococcus
QELEDGVGLPLLTALPI

SEQ ID NO: 1884079 - protein, 18 aa, Staphylococcus
QELKLKRTKLMISAILSA

SEQ ID NO: 1884080 - protein, 17 aa, Staphylococcus
QENPLVVCYTNDVVKNF

SEQ ID NO: 1884081 - protein, 27 aa, Staphylococcus
QENTGYFKYQYFNPLDAQQYYDNLDVQ

SEQ ID NO: 1884082 - protein, 20 aa, Staphylococcus
QEQIRCFNEISLGTVAIGAS

SEQ ID NO: 1884083 - protein, 19 aa, Staphylococcus
QETPVALEVTRYVDGEGNE

SEQ ID NO: 1884084 - protein, 18 aa, Staphylococcus
QETPVALEVTRYVDSDGN

SEQ ID NO: 1884085 - protein, 18 aa, Staphylococcus
QETPVALEVTRYVDSEGN

SEQ ID NO: 1884086 - protein, 22 aa, Staphylococcus
QEYEPTLPWVVYKLTQAKVHKT

SEQ ID NO: 1884087 - protein, 17 aa, Staphylococcus
QFAFPVFLPIYLSSFGI

SEQ ID NO: 1884088 - protein, 26 aa, Staphylococcus
QFDFSEIRDYIGLGIVLMFFIISLVS

SEQ ID NO: 1884089 - protein, 19 aa, Staphylococcus
QFFKSGGKQQLPYTFNYKS

SEQ ID NO: 1884090 - protein, 27 aa, Staphylococcus
QFFSLCNALWCNVRMFLLQALPIFIGI

SEQ ID NO: 1884091 - protein, 22 aa, Staphylococcus
QFHILRALRFAQILKIKASGIS

SEQ ID NO: 1884092 - protein, 18 aa, Staphylococcus
QFIGQDWQYTGHKIEKDG

SEQ ID NO: 1884093 - protein, 27 aa, Staphylococcus
QFIRLHKRVGSFSIVFLIMNPLLFVVF

SEQ ID NO: 1884094 - protein, 19 aa, Staphylococcus
QFITKKSWHNFLHNQTSIR

SEQ ID NO: 1884095 - protein, 18 aa, Staphylococcus
QFLGLPMTLIWGYVAVAI

SEQ ID NO: 1884096 - protein, 19 aa, Staphylococcus
QFLGLPMVLIWGYIAVAIF

SEQ ID NO: 1884097 - protein, 19 aa, Staphylococcus
QFLGLPMVLIWGYVAVAIF

SEQ ID NO: 1884098 - protein, 23 aa, Staphylococcus
QFLQPRTPQGFEMLFNNFSAGIL

SEQ ID NO: 1884099 - protein, 24 aa, Staphylococcus
QFLSKLNVWLALALAVFILLIGPG

SEQ ID NO: 1884100 - protein, 17 aa, Staphylococcus
QFLTISLVLYIVLIIGM

SEQ ID NO: 1884101 - protein, 19 aa, Staphylococcus
QFMISFFASMLFSILFNAP

SEQ ID NO: 1884102 - protein, 17 aa, Staphylococcus
QFMKGHKAPTVEVKPTT

SEQ ID NO: 1884103 - protein, 32 aa, Staphylococcus; identical to SEQ ID NO: 1575819

SEQ ID NO: 1884104 - protein, 22 aa, Staphylococcus
QFNTPWLWPVLFLTTGILEPIA

SEQ ID NO: 1884105 - protein, 18 aa, Staphylococcus
QFPFHIWLPKAMAAPTPV

SEQ ID NO: 1884106 - protein, 20 aa, Staphylococcus
QFPFHVWLPKAMAAPTPVSA

SEQ ID NO: 1884107 - protein, 24 aa, Staphylococcus
QFQSRLRKLILILIVGGAIGASVV

SEQ ID NO: 1884108 - protein, 26 aa, Staphylococcus
QFSFMPLKHLWSLAIEEQFYLFFPAI

SEQ ID NO: 1884109 - protein, 26 aa, Staphylococcus
QFSFMPLKHLWSLAIEEQFYLFFPFI

SEQ ID NO: 1884110 - protein, 18 aa, Staphylococcus
QFSIRKFTIGVVSIVAGI

SEQ ID NO: 1884111 - protein, 20 aa, Staphylococcus
QFVKRLPIIEDIVPQSKFMG

SEQ ID NO: 1884112 - protein, 35 aa, Staphylococcus
QFVSRKKADHDLKMGDYYAAIYIPEKFTHQITGTL

SEQ ID NO: 1884113 - protein, 26 aa, Staphylococcus
QFYLKKVWVGIKFLAVYLYQLITSSM

SEQ ID NO: 1884114 - protein, 21 aa, Staphylococcus
QGALHPIHFIGGLLGVAFVTA

SEQ ID NO: 1884115 - protein, 26 aa, Staphylococcus
QGDEALYNLGDYVWEDTNKNGIQDSD

SEQ ID NO: 1884116 - protein, 18 aa, Staphylococcus
QGDVKVYLEDGSVRDEEW

SEQ ID NO: 1884117 - protein, 32 aa, Staphylococcus
QGDVKVYLENGGIRDEEWLQKKLNYIDKSTYK

SEQ ID NO: 1884118 - protein, 24 aa, Staphylococcus
QGFDFPDINKIAVFVSIALLGFIG

SEQ ID NO: 1884119 - protein, 23 aa, Staphylococcus
QGFFSVRLLLSIVFINLTSAVGM

SEQ ID NO: 1884120 - protein, 24 aa, Staphylococcus
QGFFSVRLLLSLVFINLTSPVGMH

SEQ ID NO: 1884121 - protein, 35 aa, Staphylococcus
QGFVEGFSSLPGWVRKGAIGMGLFAAALGPVVLGL

SEQ ID NO: 1884122 - protein, 19 aa, Staphylococcus
QGGGSIWLSAILVVFTAIF

SEQ ID NO: 1884123 - protein, 21 aa, Staphylococcus
QGHNYYTWDNENIYLQGSGEA

SEQ ID NO: 1884124 - protein, 21 aa, Staphylococcus
QGHVAWGYSVALIISSIIGAQ

SEQ ID NO: 1884125 - protein, 26 aa, Staphylococcus
QGIAKAGGVFPILSPILGWIGVFMTG

SEQ ID NO: 1884126 - protein, 22 aa, Staphylococcus
QGIPKERIPLLGQISVNSETGT

SEQ ID NO: 1884127 - protein, 25 aa, Staphylococcus
QGIRSWGQFLYLTWFLTYLGFLAGA

SEQ ID NO: 1884128 - protein, 39 aa, Staphylococcus
QGKIAVFIRPDIGKSFSEFRVFLAILIILLLMISMILII

SEQ ID NO: 1884129 - protein, 23 aa, Staphylococcus
QGKLKPIYFIGGILGVVFVTTNI

SEQ ID NO: 1884130 - protein, 20 aa, Staphylococcus
QGKLSFLQVFFEVMSAFGTC

SEQ ID NO: 1884131 - protein, 19 aa, Staphylococcus
QGLELLIHIGIDTVKLNGE

SEQ ID NO: 1884132 - protein, 18 aa, Staphylococcus
QGLIPLFILLCFPFTPNT

SEQ ID NO: 1884133 - protein, 18 aa, Staphylococcus
QGLVPIFILMCFPFTPNT

SEQ ID NO: 1884134 - protein, 24 aa, Staphylococcus
QGMKDEKYYGAAVFNKDFSKNAMS

SEQ ID NO: 1884135 - protein, 23 aa, Staphylococcus
QGNHLKISYGLFNVKNLTVPTDR

SEQ ID NO: 1884136 - protein, 18 aa, Staphylococcus
QGPVPIFILLCFPFTPTT

SEQ ID NO: 1884137 - protein, 24 aa, Staphylococcus
QGSAAFGAWFVYRRRKMVKEQGLA

SEQ ID NO: 1884138 - protein, 23 aa, Staphylococcus
QGSAAFGAWYVYKRRKMVKEEGL

SEQ ID NO: 1884139 - protein, 35 aa, Staphylococcus
QGSALIRLFKYTLPYKWIIVLAFITLILSTIASMM

SEQ ID NO: 1884140 - protein, 20 aa, Staphylococcus
QGSNVLNIFAFKGTDMTINL

SEQ ID NO: 1884141 - protein, 17 aa, Staphylococcus
QGTKVTLTIERGGQAHD

SEQ ID NO: 1884142 - protein, 20 aa, Staphylococcus
QGTYRLSVKGIYGEDYSSLQ

SEQ ID NO: 1884143 - protein, 27 aa, Staphylococcus
QGWIRIASKILPIIILFVILFHIYASI

SEQ ID NO: 1884144 - protein, 27 aa, Staphylococcus
QGWLTAVKIYFGMWKTFITAVWNGIKY

SEQ ID NO: 1884145 - protein, 20 aa, Staphylococcus
QGYAFLRFRSALVPLANLGS

SEQ ID NO: 1884146 - protein, 20 aa, Staphylococcus
QGYAFLRFRTALVPFANIGS

SEQ ID NO: 1884147 - protein, 20 aa, Staphylococcus
QGYAFLRFRTALVPLANIGS

SEQ ID NO: 1884148 - protein, 25 aa, Staphylococcus
QGYFFLRFRNALFPLANIGSNLSYL

SEQ ID NO: 1884149 - protein, 19 aa, Staphylococcus
QGYFFLRFRTSLVPLANIG

SEQ ID NO: 1884150 - protein, 24 aa, Staphylococcus
QGYLSVRLILALVFINLTSPVGGH

SEQ ID NO: 1884151 - protein, 19 aa, Staphylococcus
QGYVFLRFRSALVPVANLG

SEQ ID NO: 1884152 - protein, 17 aa, Staphylococcus
QHFKGLSLYSSIFHHNI

SEQ ID NO: 1884153 - protein, 18 aa, Staphylococcus
QHFNRFTDIFILSILILI

SEQ ID NO: 1884154 - protein, 29 aa, Staphylococcus
QHFVLLIGIFCFLKGFIGFFIGGDSNYLY

SEQ ID NO: 1884155 - protein, 17 aa, Staphylococcus
QHGLFYTVFVKPMDDLL

SEQ ID NO: 1884156 - protein, 23 aa, Staphylococcus
QHKEIVGYIAFWLSVFALSLYYN

SEQ ID NO: 1884157 - protein, 22 aa, Staphylococcus
QHMPEYVRGAFISMEDERFYKH

SEQ ID NO: 1884158 - protein, 18 aa, Staphylococcus
QHPFLERSHLANLYFLIA

SEQ ID NO: 1884159 - protein, 27 aa, Staphylococcus
QHPHFLWFNLMHPDIWLALLAGLLYFI

SEQ ID NO: 1884160 - protein, 20 aa, Staphylococcus
QHPHFLWFNLMHTDIIMTII

SEQ ID NO: 1884161 - protein, 24 aa, Staphylococcus
QHPRFDFISLVGLILLVFSYIVLF

SEQ ID NO: 1884162 - protein, 23 aa, Staphylococcus
QHSLEWFPIAVIATILGYIISYF

SEQ ID NO: 1884163 - protein, 28 aa, Staphylococcus
QHSNKKAGARPGPKVNEGHNNDLTDDNH

SEQ ID NO: 1884164 - protein, 32 aa, Staphylococcus
QHTERVALLYARPLYYFGLIMKPLIWLMNGSA

SEQ ID NO: 1884165 - protein, 17 aa, Staphylococcus
QHTFWFKFWSVIESGGW

SEQ ID NO: 1884166 - protein, 29 aa, Staphylococcus
QHTFWFKFWSVIESGGWVIFNHMEIVFVV

SEQ ID NO: 1884167 - protein, 24 aa, Staphylococcus
QHVVIKFAIMYGLYSLPFYKLLIY

SEQ ID NO: 1884168 - protein, 25 aa, Staphylococcus
QHYVLKRMLVEGVIDKEEYRHAKRY

SEQ ID NO: 1884169 - protein, 25 aa, Staphylococcus
QHYVLKRMLVEGVITKKTYQQAKQY

SEQ ID NO: 1884170 - protein, 24 aa, Staphylococcus
QIATLFLLDIVSYLLLNDTHMHHV

SEQ ID NO: 1884171 - protein, 26 aa, Staphylococcus
QIATTFLMDIVCYLLLNNDYMHKSYQ

SEQ ID NO: 1884172 - protein, 17 aa, Staphylococcus
QIAVYWFVFGLGLRNNA

SEQ ID NO: 1884173 - protein, 26 aa, Staphylococcus
QIESRFSENILNRFNQYAKGAYKYNP

SEQ ID NO: 1884174 - protein, 20 aa, Staphylococcus
QIHHMSAFAVIMVMIALSTT

SEQ ID NO: 1884175 - protein, 17 aa, Staphylococcus
QIIAMIVAILGMLFIVK

SEQ ID NO: 1884176 - protein, 17 aa, Staphylococcus
QIIAMLIAIFGMLFIVK

SEQ ID NO: 1884177 - protein, 18 aa, Staphylococcus
QIIFPYSLSMAIVGLVES

SEQ ID NO: 1884178 - protein, 19 aa, Staphylococcus
QIIMRRSAVEILFATIGLI

SEQ ID NO: 1884179 - protein, 27 aa, Staphylococcus
QIKDKRLPYVIDEAINIFKTLTDGKYN

SEQ ID NO: 1884180 - protein, 25 aa, Staphylococcus
QIKKIEAIKLYFGFDKSPLSHVEPV

SEQ ID NO: 1884181 - protein, 24 aa, Staphylococcus
QIKVKGSDVKKAFEHSLSAPTESK

SEQ ID NO: 1884182 - protein, 19 aa, Staphylococcus
QILFMICVILGVLSGLLSL

SEQ ID NO: 1884183 - protein, 23 aa, Staphylococcus
QINIWRVLVVTGLRGQEASNKVL

SEQ ID NO: 1884184 - protein, 23 aa, Staphylococcus
QINIWRVLVVTGLRGQEIANEMV

SEQ ID NO: 1884185 - protein, 23 aa, Staphylococcus
QINIWRVLVVTGLRGQEVSNKIV

SEQ ID NO: 1884186 - protein, 23 aa, Staphylococcus
QINIWRVLVVTGLRGQEVSNKVL

SEQ ID NO: 1884187 - protein, 23 aa, Staphylococcus
QINIWRVLVVTGLRGQEVSNKVV

SEQ ID NO: 1884188 - protein, 31 aa, Staphylococcus
QINQFVPSIVKKSIATQELDNAADLKQEELD

SEQ ID NO: 1884189 - protein, 23 aa, Staphylococcus
QIQSRLRKFILIILVGGAIGTSV

SEQ ID NO: 1884190 - protein, 25 aa, Staphylococcus
QIRNLKGLKPFKVNNDLGHIASVNL

SEQ ID NO: 1884191 - protein, 30 aa, Staphylococcus
QISNIKFSLKWSKSYAYVFIRLIIGPLIAL

SEQ ID NO: 1884192 - protein, 17 aa, Staphylococcus
QITVLAFQYGDAISNVL

SEQ ID NO: 1884193 - protein, 22 aa, Staphylococcus
QIVGKVVLRFWPFGEWTTKFNP

SEQ ID NO: 1884194 - protein, 20 aa, Staphylococcus
QKAHFKPLIDNADTRAEVKK

SEQ ID NO: 1884195 - protein, 24 aa, Staphylococcus
QKAHGGEISPLFTGGKDNMISSIT

SEQ ID NO: 1884196 - protein, 20 aa, Staphylococcus
QKAKALKEIDDFENKALINI

SEQ ID NO: 1884197 - protein, 20 aa, Staphylococcus
QKAKLIDYLEKLRRDTLKEI

SEQ ID NO: 1884198 - protein, 19 aa, Staphylococcus
QKDIFPVKDYGSASTPFYT

SEQ ID NO: 1884199 - protein, 19 aa, Staphylococcus
QKEAIKGVLDSSNTRTEIS

SEQ ID NO: 1884200 - protein, 24 aa, Staphylococcus
QKEAYEIIGKLVPEMKFNKVENIM

SEQ ID NO: 1884201 - protein, 21 aa, Staphylococcus
QKEVRYTLYLLIASIILVCGP

SEQ ID NO: 1884202 - protein, 19 aa, Staphylococcus
QKFAFGFGAIGKDAIFNIV

SEQ ID NO: 1884203 - protein, 24 aa, Staphylococcus
QKFFEMMGTTGVRIFNNMLNAAGQ

SEQ ID NO: 1884204 - protein, 18 aa, Staphylococcus
QKGAYLSLIVYIILSIVK

SEQ ID NO: 1884205 - protein, 21 aa, Staphylococcus
QKGHGTVSMYDAIRQSFNIPA

SEQ ID NO: 1884206 - protein, 26 aa, Staphylococcus
QKGLGILCLLFFWTGIPHIIAIIDAI

SEQ ID NO: 1884207 - protein, 19 aa, Staphylococcus
QKGMLPKFFGKVMKNGVPI

SEQ ID NO: 1884208 - protein, 18 aa, Staphylococcus
QKHNVAMVGDGINDAPAL

SEQ ID NO: 1884209 - protein, 18 aa, Staphylococcus
QKIAEIHPATTVKSNAKQ

SEQ ID NO: 1884210 - protein, 18 aa, Staphylococcus
QKIFFIVLIINFSFIMCN

SEQ ID NO: 1884211 - protein, 26 aa, Staphylococcus
QKIFMLAPLLPIIALIYTCFDASNGI

SEQ ID NO: 1884212 - protein, 27 aa, Staphylococcus
QKKGLKIAGILSAFVIAILAIIRFINR

SEQ ID NO: 1884213 - protein, 22 aa, Staphylococcus
QKKRLDVRPGITGLAQINGRNT

SEQ ID NO: 1884214 - protein, 23 aa, Staphylococcus
QKKVPMKVVHDIEEFKVPKGIED

SEQ ID NO: 1884215 - protein, 23 aa, Staphylococcus
QKKVPMKVVHEIQDFKVPKGIED

SEQ ID NO: 1884216 - protein, 18 aa, Staphylococcus
QKKVPMKVVHEIQEFKVP

SEQ ID NO: 1884217 - protein, 18 aa, Staphylococcus
QKLKRSNLLVPLDHTKIP

SEQ ID NO: 1884218 - protein, 24 aa, Staphylococcus
QKLLRLAFIALAIIGAALTVFSFV

SEQ ID NO: 1884219 - protein, 19 aa, Staphylococcus
QKLNLATEYELVKSSDLAD

SEQ ID NO: 1884220 - protein, 31 aa, Staphylococcus
QKLPKFYYRPKRFFLISGLRARMKSNAVGLA

SEQ ID NO: 1884221 - protein, 23 aa, Staphylococcus
QKLSPRFQRLLLLHTSAQGLYSE

SEQ ID NO: 1884222 - protein, 19 aa, Staphylococcus
QKLTVFVILAAVVIKIILN

SEQ ID NO: 1884223 - protein, 23 aa, Staphylococcus
QKLTVFVILGAVVLKLALNIPLI

SEQ ID NO: 1884224 - protein, 20 aa, Staphylococcus
QKLTVFVILGSVFVKLILNI

SEQ ID NO: 1884225 - protein, 20 aa, Staphylococcus
QKLTVFVIVAAVVLKAVLNI

SEQ ID NO: 1884226 - protein, 21 aa, Staphylococcus
QKNPKLAFSIVYTNQPVPEPW

SEQ ID NO: 1884227 - protein, 23 aa, Staphylococcus
QKPTRYTIMVGIDLILIVLIAIT

SEQ ID NO: 1884228 - protein, 18 aa, Staphylococcus
QKQFKYRQNEIFTIRLII

SEQ ID NO: 1884229 - protein, 34 aa, Staphylococcus
QKQLNFPIVSSNIYKNGKRVFDPSTTVTKNNVRY

SEQ ID NO: 1884230 - protein, 18 aa, Staphylococcus
QKQRGIDLFLHRLTIILA

SEQ ID NO: 1884231 - protein, 18 aa, Staphylococcus
QKQRGIDLFLHRLTIVLS

SEQ ID NO: 1884232 - protein, 18 aa, Staphylococcus
QKQVYAWFLASSIGAFFV

SEQ ID NO: 1884233 - protein, 21 aa, Staphylococcus
QKREINKLISNAETRPKVQEL

SEQ ID NO: 1884234 - protein, 21 aa, Staphylococcus
QKRIQYIIITVLVLLIVIFLL

SEQ ID NO: 1884235 - protein, 24 aa, Staphylococcus
QKRRFKALILLCIMFSICWIAYIQ

SEQ ID NO: 1884236 - protein, 26 aa, Staphylococcus
QKRTNIRWYFAIAFFIIGVIAYMDRS

SEQ ID NO: 1884237 - protein, 20 aa, Staphylococcus
QKRWWTMNIVLGFVYFIIWI

SEQ ID NO: 1884238 - protein, 39 aa, Staphylococcus
QKSNKKMWMIIGIIALLFIALIIAFSILKSQFSPEKQAS

SEQ ID NO: 1884239 - protein, 19 aa, Staphylococcus
QKSPEIFKDVEAFQDVVKQ

SEQ ID NO: 1884240 - protein, 22 aa, Staphylococcus
QKTWFKFFVGVLLINLIALIIS

SEQ ID NO: 1884241 - protein, 24 aa, Staphylococcus
QKTWFKFYLGLLLLNLIVILLANP

SEQ ID NO: 1884242 - protein, 21 aa, Staphylococcus
QKVKQGDRLLSYDTNNSKRQQ

SEQ ID NO: 1884243 - protein, 26 aa, Staphylococcus
QKWMSIIGFFPLFGIFLKSDNHILKI

SEQ ID NO: 1884244 - protein, 20 aa, Staphylococcus
QKYFRIGSVYNLEKMMFYST

SEQ ID NO: 1884245 - protein, 17 aa, Staphylococcus
QKYGTFFLKGLQNTIII

SEQ ID NO: 1884246 - protein, 22 aa, Staphylococcus
QKYKFIISLILSLPLIYTMVGH

SEQ ID NO: 1884247 - protein, 32 aa, Staphylococcus
QLADPMIKFLIPLLIAFSGGRLIHGLRGGIIA

SEQ ID NO: 1884248 - protein, 17 aa, Staphylococcus
QLASLKLTISLKVIERA

SEQ ID NO: 1884249 - protein, 22 aa, Staphylococcus
QLCWYIGIILFYFIMAILTPLS

SEQ ID NO: 1884250 - protein, 25 aa, Staphylococcus
QLDEFFNKFVFHGRIQYNVDELQNI

SEQ ID NO: 1884251 - protein, 24 aa, Staphylococcus
QLDEFFNKFVFHGRIQYNVEDLQR

SEQ ID NO: 1884252 - protein, 24 aa, Staphylococcus
QLDEVKAGFKMAFNKQDGTGYASF

SEQ ID NO: 1884253 - protein, 24 aa, Staphylococcus
QLDKKKPANMAIQYKTAVGQKEEV

SEQ ID NO: 1884254 - protein, 22 aa, Staphylococcus
QLDPRTKILLTITVSTILISSG

SEQ ID NO: 1884255 - protein, 17 aa, Staphylococcus
QLEHPFKIKRLVGQSGM

SEQ ID NO: 1884256 - protein, 27 aa, Staphylococcus
QLEIELMTLLVGLGLVLKNRRKKQKNN

SEQ ID NO: 1884257 - protein, 17 aa, Staphylococcus
QLEMRALLLHLRPLGLK

SEQ ID NO: 1884258 - protein, 23 aa, Staphylococcus
QLENEFNAIPALNEDTANHIYHL

SEQ ID NO: 1884259 - protein, 17 aa, Staphylococcus
QLFKAPLWSTWLLWGIV

SEQ ID NO: 1884260 - protein, 22 aa, Staphylococcus
QLFKTPLFLPITFILIVIVGPI

SEQ ID NO: 1884261 - protein, 23 aa, Staphylococcus
QLFKVHAFIPFAFLLIVIVGPIV

SEQ ID NO: 1884262 - protein, 25 aa, Staphylococcus
QLFVKRRTREFALYQLIGLTRSNIL

SEQ ID NO: 1884263 - protein, 18 aa, Staphylococcus
QLGHFYCYLLLFMGAMLG

SEQ ID NO: 1884264 - protein, 25 aa, Staphylococcus
QLGRLKVTTSHAFKDADGKYNALVS

SEQ ID NO: 1884265 - protein, 18 aa, Staphylococcus
QLIAVAITIVFSGIMTFI

SEQ ID NO: 1884266 - protein, 17 aa, Staphylococcus
QLIILSVIIGEFSVIAG

SEQ ID NO: 1884267 - protein, 17 aa, Staphylococcus
QLIILSVIIGEFSVIMG

SEQ ID NO: 1884268 - protein, 29 aa, Staphylococcus
QLINILKTFKWRIIGFLAFLLIAILFLTL

SEQ ID NO: 1884269 - protein, 17 aa, Staphylococcus
QLKDMSNRAYIDRLLAT

SEQ ID NO: 1884270 - protein, 23 aa, Staphylococcus
QLKEAKISFLNAFIDSNEDKNAQ

SEQ ID NO: 1884271 - protein, 30 aa, Staphylococcus
QLKLALTLYARDDFIGDITFEMISRSLYEQ

SEQ ID NO: 1884272 - protein, 19 aa, Staphylococcus
QLKLVGFFKNFKDFKDNKI

SEQ ID NO: 1884273 - protein, 36 aa, Staphylococcus
QLKQTIRAIVPWSILYEILVGLFISISYNIIRMGLG

SEQ ID NO: 1884274 - protein, 25 aa, Staphylococcus
QLKSFYRRLWLSAGVIGVIQYTSIV

SEQ ID NO: 1884275 - protein, 18 aa, Staphylococcus
QLLAKWGTVNVVGWAMFI

SEQ ID NO: 1884276 - protein, 18 aa, Staphylococcus
QLLAPIIVLIIWNITTDI

SEQ ID NO: 1884277 - protein, 22 aa, Staphylococcus
QLLATRLGDKEAQRIAKQLANG

SEQ ID NO: 1884278 - protein, 21 aa, Staphylococcus
QLLCVGLGIAFIMNLIMPSLD

SEQ ID NO: 1884279 - protein, 20 aa, Staphylococcus
QLLFIFSLFFLPKILNNKFT

SEQ ID NO: 1884280 - protein, 20 aa, Staphylococcus
QLLFRKKVYLVLSILVPLAL

SEQ ID NO: 1884281 - protein, 23 aa, Staphylococcus
QLLGASLWGVFALGNWPGIANKM

SEQ ID NO: 1884282 - protein, 23 aa, Staphylococcus
QLLGASLWGVFALGNWPGITNKI

SEQ ID NO: 1884283 - protein, 17 aa, Staphylococcus
QLLGLDIEDEMDQREQN

SEQ ID NO: 1884284 - protein, 25 aa, Staphylococcus
QLLIALLILICLSLFMSNINIMAHL

SEQ ID NO: 1884285 - protein, 17 aa, Staphylococcus
QLLKLQKQLNFPIVSSN

SEQ ID NO: 1884286 - protein, 24 aa, Staphylococcus
QLLPKARRLGISWMAVGLLGAVGV

SEQ ID NO: 1884287 - protein, 17 aa, Staphylococcus
QLLQHIDKLALTSSDDI

SEQ ID NO: 1884288 - protein, 17 aa, Staphylococcus
QLLSQWKAVVVALAGTL

SEQ ID NO: 1884289 - protein, 24 aa, Staphylococcus
QLMPLFKWSSQGFQNMSMAFQKWA

SEQ ID NO: 1884290 - protein, 17 aa, Staphylococcus
QLMYVIMSFVIVFFMAF

SEQ ID NO: 1884291 - protein, 22 aa, Staphylococcus
QLNEMPHLLVAGSTGSGKSVCI

SEQ ID NO: 1884292 - protein, 26 aa, Staphylococcus
QLNSVVIKLWLTIIFIVTTVLILLSA

SEQ ID NO: 1884293 - protein, 17 aa, Staphylococcus
QLPESKTAIGHGFDMAT

SEQ ID NO: 1884294 - protein, 23 aa, Staphylococcus
QLPTARRFGIGWMAISLLGAVGV

SEQ ID NO: 1884295 - protein, 27 aa, Staphylococcus
QLPVWFKYRNKYGFPLNAFLATAVVAV

SEQ ID NO: 1884296 - protein, 18 aa, Staphylococcus
QLQFLGVHIICYIIFMAY

SEQ ID NO: 1884297 - protein, 25 aa, Staphylococcus
QLQPGEALVVYSIFGLLLIPFFNLN

SEQ ID NO: 1884298 - protein, 23 aa, Staphylococcus
QLQQRFENIVAFLILATLAKLIL

SEQ ID NO: 1884299 - protein, 31 aa, Staphylococcus
QLRVLKRPLTWLSIIVSILFNAAVFGVYSYL

SEQ ID NO: 1884300 - protein, 26 aa, Staphylococcus
QLSDRIGRRYVLIPGVILSAISALVF

SEQ ID NO: 1884301 - protein, 22 aa, Staphylococcus
QLSELTKALLLLSEIDNGAHLD

SEQ ID NO: 1884302 - protein, 18 aa, Staphylococcus
QLSLLWPTFMKTAGHVIA

SEQ ID NO: 1884303 - protein, 18 aa, Staphylococcus
QLSLRGLSNREFAFVDYD

SEQ ID NO: 1884304 - protein, 18 aa, Staphylococcus
QLSVAFVVNCLLLVLGAS

SEQ ID NO: 1884305 - protein, 28 aa, Staphylococcus
QLTLFFWFFKLNYSFGHIINSKIFAQEF

SEQ ID NO: 1884306 - protein, 24 aa, Staphylococcus
QLTLFFWFFQLHYSFGHILNSKIF

SEQ ID NO: 1884307 - protein, 17 aa, Staphylococcus
QLVSFIIYMLWQAALIM

SEQ ID NO: 1884308 - protein, 18 aa, Staphylococcus
QLWVKTALGNKWGFVVAW

SEQ ID NO: 1884309 - protein, 25 aa, Staphylococcus
QLYLYEHFTQLKGFYDHSFGLGGDY

SEQ ID NO: 1884310 - protein, 17 aa, Staphylococcus
QMGHVYFAWLFGLLLGM

SEQ ID NO: 1884311 - protein, 25 aa, Staphylococcus
QMIDRLNRHYKFVRVDNQLDPTTGH

SEQ ID NO: 1884312 - protein, 18 aa, Staphylococcus
QMIFPTKHAIGLVSDQGL

SEQ ID NO: 1884313 - protein, 18 aa, Staphylococcus
QMILLKVRIPRVLEALIA

SEQ ID NO: 1884314 - protein, 25 aa, Staphylococcus
QMIQWADERFKYYVLKEGNLPEKKT

SEQ ID NO: 1884315 - protein, 22 aa, Staphylococcus
QMKISFIPALGFNQILLIRDKD

SEQ ID NO: 1884316 - protein, 19 aa, Staphylococcus
QMLAWRLDRAVALYFAQEQ

SEQ ID NO: 1884317 - protein, 35 aa, Staphylococcus
QMLDMKYSHWLKFVWPVVAFVFIFGGGMLVTQVLI

SEQ ID NO: 1884318 - protein, 35 aa, Staphylococcus
QMLKALYAGFGIRFCAFIIDLLIIFGVHSLILKPI

SEQ ID NO: 1884319 - protein, 17 aa, Staphylococcus
QMMSLWMLSNATAQGLN

SEQ ID NO: 1884320 - protein, 28 aa, Staphylococcus
QMQAWGWRIPFILGLFLGLFGLYLRRRL

SEQ ID NO: 1884321 - protein, 26 aa, Staphylococcus
QMTTGSFKYNPFVLNQVKQLGSNKEQ

SEQ ID NO: 1884322 - protein, 24 aa, Staphylococcus
QMVTEFIIEFILAYIFGLMFQYFH

SEQ ID NO: 1884323 - protein, 24 aa, Staphylococcus
QMYKEIISYSIPFVIVSLNFPLFN

SEQ ID NO: 1884324 - protein, 18 aa, Staphylococcus
QNAIKYSNPNSMIDVNLF

SEQ ID NO: 1884325 - protein, 20 aa, Staphylococcus
QNALNGQSRFDAAQKEALKE

SEQ ID NO: 1884326 - protein, 18 aa, Staphylococcus
QNAPIWEVDQQPVTHELP

SEQ ID NO: 1884327 - protein, 25 aa, Staphylococcus
QNFDWKEIEKSFSWYETGKINMAYE

SEQ ID NO: 1884328 - protein, 19 aa, Staphylococcus
QNFIEWIFDFVRGIIEGNM

SEQ ID NO: 1884329 - protein, 19 aa, Staphylococcus
QNFIEWIFDFVRGIIESNM

SEQ ID NO: 1884330 - protein, 19 aa, Staphylococcus
QNFIEWIFDFVRSIIESNM

SEQ ID NO: 1884331 - protein, 19 aa, Staphylococcus
QNFIEWVFDFVRGIIESNL

SEQ ID NO: 1884332 - protein, 19 aa, Staphylococcus
QNFIEWVFDFVRGIIESNM

SEQ ID NO: 1884333 - protein, 18 aa, Staphylococcus
QNGIWAVIVYFIICLLIS

SEQ ID NO: 1884334 - protein, 18 aa, Staphylococcus
QNGRFIFYGMMIAEGIIA

SEQ ID NO: 1884335 - protein, 18 aa, Staphylococcus
QNGVWAIIVYFIICLLIS

SEQ ID NO: 1884336 - protein, 17 aa, Staphylococcus
QNGVWAIIVYFIVCLLI

SEQ ID NO: 1884337 - protein, 19 aa, Staphylococcus
QNIARYAIYLLSLIISVVL

SEQ ID NO: 1884338 - protein, 20 aa, Staphylococcus
QNIFTFIILVGFNIWNFDFT

SEQ ID NO: 1884339 - protein, 18 aa, Staphylococcus
QNIFVIIVFIGFNIWNFD

SEQ ID NO: 1884340 - protein, 18 aa, Staphylococcus
QNIIVIIVFLVFNFKDFD

SEQ ID NO: 1884341 - protein, 17 aa, Staphylococcus
QNIKHYGMFLFSLLLSI

SEQ ID NO: 1884342 - protein, 18 aa, Staphylococcus
QNIYLRVYYPPVVIGITA

SEQ ID NO: 1884343 - protein, 18 aa, Staphylococcus
QNLLLMIMIIPTWINLLL

SEQ ID NO: 1884344 - protein, 23 aa, Staphylococcus
QNLMPIIIVFGVLGVHAMITQDP

SEQ ID NO: 1884345 - protein, 23 aa, Staphylococcus
QNLMRISLIILAIIGIGLTVFSF

SEQ ID NO: 1884346 - protein, 17 aa, Staphylococcus
QNLRHYAMYIFSLIVSI

SEQ ID NO: 1884347 - protein, 23 aa, Staphylococcus
QNLTLNFMISFLFVISATVIGVF

SEQ ID NO: 1884348 - protein, 17 aa, Staphylococcus
QNLYKLVLKYLSWYIKI

SEQ ID NO: 1884349 - protein, 29 aa, Staphylococcus
QNNKLGIKDKVDWLGHKMDPVLGQLGQTK

SEQ ID NO: 1884350 - protein, 19 aa, Staphylococcus
QNNRLPFKRLFSSLTPTKA

SEQ ID NO: 1884351 - protein, 25 aa, Staphylococcus
QNQIHYYKSKWISQISHDLKSPLTS

SEQ ID NO: 1884352 - protein, 18 aa, Staphylococcus
QNRHYRRGSANYKANTVA

SEQ ID NO: 1884353 - protein, 24 aa, Staphylococcus
QNRIKIFTKDNIQVIGDITTIADK

SEQ ID NO: 1884354 - protein, 25 aa, Staphylococcus
QNRIKLYTKDDMQVIGNIKTIADKM

SEQ ID NO: 1884355 - protein, 26 aa, Staphylococcus
QNRVKRAKGDLNYILSPIKDRPSLLD

SEQ ID NO: 1884356 - protein, 22 aa, Staphylococcus
QNRYYRRGSANYKANTVADDAN

SEQ ID NO: 1884357 - protein, 18 aa, Staphylococcus
QNVGYDFNDVPTLLHSWL

SEQ ID NO: 1884358 - protein, 24 aa, Staphylococcus
QNVRMPRMIVGILVGGALALAGLL

SEQ ID NO: 1884359 - protein, 17 aa, Staphylococcus
QNYFRIGSVATLESIIF

SEQ ID NO: 1884360 - protein, 17 aa, Staphylococcus
QNYKELLVSSTFSNSDE

SEQ ID NO: 1884361 - protein, 24 aa, Staphylococcus
QPAIYKLLMAMAMQQPIGGAIFSL

SEQ ID NO: 1884362 - protein, 22 aa, Staphylococcus
QPDGRSGIVAIIRDMTNEHNMD

SEQ ID NO: 1884363 - protein, 24 aa, Staphylococcus
QPDIDSLKFLGAWRYQTDKEGKYY

SEQ ID NO: 1884364 - protein, 19 aa, Staphylococcus
QPEIRRALEQLGRGNLFKR

SEQ ID NO: 1884365 - protein, 27 aa, Staphylococcus
QPEIRRALEQLGRGSLFKRYSTNLNSD

SEQ ID NO: 1884366 - protein, 28 aa, Staphylococcus
QPEVTKKAAARKAIDDEVVAKKAAIDTV

SEQ ID NO: 1884367 - protein, 30 aa, Staphylococcus
QPEVVKKSLARQAIDEVAKVKKEKINQMLD

SEQ ID NO: 1884368 - protein, 22 aa, Staphylococcus
QPFLPIVEFNRSITLVFITDFV

SEQ ID NO: 1884369 - protein, 18 aa, Staphylococcus
QPGDAIAVTASKDEQYNI

SEQ ID NO: 1884370 - protein, 18 aa, Staphylococcus
QPISGVVMLLTIAIILGF

SEQ ID NO: 1884371 - protein, 18 aa, Staphylococcus
QPITFKKVLSDFVLINSV

SEQ ID NO: 1884372 - protein, 17 aa, Staphylococcus
QPLFIFGLKDTEVGYTQ

SEQ ID NO: 1884373 - protein, 21 aa, Staphylococcus
QPLILPVIRLLKGNLKYQMLV

SEQ ID NO: 1884374 - protein, 19 aa, Staphylococcus
QPLIRPVIILLKGDLKKQI

SEQ ID NO: 1884375 - protein, 20 aa, Staphylococcus
QPLIYPVIRLLKGNLKMQML

SEQ ID NO: 1884376 - protein, 18 aa, Staphylococcus
QPLLRFDANYIKEQGYEL

SEQ ID NO: 1884377 - protein, 21 aa, Staphylococcus
QPLPRRIKKPMSIGLIITLVI

SEQ ID NO: 1884378 - protein, 30 aa, Staphylococcus
QPLREGVKVCTNCGAPVKATKDQKSNHDNQ

SEQ ID NO: 1884379 - protein, 29 aa, Staphylococcus
QPLREGVKVCTNCGKPVQQSKPNHSNTQQ

SEQ ID NO: 1884380 - protein, 26 aa, Staphylococcus
QPMFRFGNGVSRNVILAAMLFGMFIA

SEQ ID NO: 1884381 - protein, 22 aa, Staphylococcus
QPNGRSGIVVIIRDMTNEHNLD

SEQ ID NO: 1884382 - protein, 23 aa, Staphylococcus
QPPKRSRYAFIMTLCGIHGTISL

SEQ ID NO: 1884383 - protein, 25 aa, Staphylococcus
QPPSRIRYAFIMTMCGIHGTISLSM

SEQ ID NO: 1884384 - protein, 30 aa, Staphylococcus
QPQPGKPKFPWFKTIIVALIAGVIGALLVL

SEQ ID NO: 1884385 - protein, 18 aa, Staphylococcus
QPRIEDISVKGVLFALGQ

SEQ ID NO: 1884386 - protein, 23 aa, Staphylococcus
QPSEFMKIVLILALAKLISRHNQ

SEQ ID NO: 1884387 - protein, 31 aa, Staphylococcus
QPSKKRFKPKFPWFKTIIVALVAGIIGALIV

SEQ ID NO: 1884388 - protein, 25 aa, Staphylococcus
QPSRVRFEMIDFGKGIPEEERHLIY

SEQ ID NO: 1884389 - protein, 23 aa, Staphylococcus
QQAGEAWPKISAAFDSFSSIVLI

SEQ ID NO: 1884390 - protein, 22 aa, Staphylococcus
QQDGRSGIVVIIRDMTNEHNLD

SEQ ID NO: 1884391 - protein, 22 aa, Staphylococcus
QQDLRPVIVVMVVYTIVYLIFA

SEQ ID NO: 1884392 - protein, 28 aa, Staphylococcus
QQFKPSQIKAAIFFGGFYDMKTVKATEF

SEQ ID NO: 1884393 - protein, 27 aa, Staphylococcus
QQGDHPLRYILAIAIFVIIVLGAFQLG

SEQ ID NO: 1884394 - protein, 19 aa, Staphylococcus
QQHCPTCGEPIQVDTTSNQ

SEQ ID NO: 1884395 - protein, 23 aa, Staphylococcus
QQIKDKRLPQVIDEATNIFSRLT

SEQ ID NO: 1884396 - protein, 19 aa, Staphylococcus
QQKAHALAEINKAEKEAIK

SEQ ID NO: 1884397 - protein, 22 aa, Staphylococcus
QQKELNVYLGLVLVSIAIEQLT

SEQ ID NO: 1884398 - protein, 19 aa, Staphylococcus
QQKFQWLQNWTIFYWAWWV

SEQ ID NO: 1884399 - protein, 20 aa, Staphylococcus
QQKQVWGWFLASAISAFVVG

SEQ ID NO: 1884400 - protein, 24 aa, Staphylococcus
QQKRNSVGVGFYFSIGHSTVVFLM

SEQ ID NO: 1884401 - protein, 18 aa, Staphylococcus
QQKVKALPNTGSDNTAPM

SEQ ID NO: 1884402 - protein, 18 aa, Staphylococcus
QQLARFKDLTAYLENQNF

SEQ ID NO: 1884403 - protein, 17 aa, Staphylococcus
QQLIKQLLATRLGDKEA

SEQ ID NO: 1884404 - protein, 18 aa, Staphylococcus
QQLPYFISFLSFYQFSIY

SEQ ID NO: 1884405 - protein, 23 aa, Staphylococcus
QQPQKFFIVDSFFYSHLDNALNL

SEQ ID NO: 1884406 - protein, 22 aa, Staphylococcus
QQRNPLGVGFYFSIGHSTVVFF

SEQ ID NO: 1884407 - protein, 31 aa, Staphylococcus
QQRPSSNHKKPAWLFVVIGLVIALLISGIGY

SEQ ID NO: 1884408 - protein, 23 aa, Staphylococcus
QQRRDPVGVGFYFSIGHSTVVFL

SEQ ID NO: 1884409 - protein, 21 aa, Staphylococcus
QRALSYWSIGSWGGSGICTLF

SEQ ID NO: 1884410 - protein, 21 aa, Staphylococcus
QRALSYWSIGSWGGSGVCTLF

SEQ ID NO: 1884411 - protein, 20 aa, Staphylococcus
QRALSYWSIGSWGGTGICSL

SEQ ID NO: 1884412 - protein, 42 aa, Staphylococcus
QRDTRAHASSIQFVRAELAGFGGFGGYVWFDKNNDGVQNDSN

SEQ ID NO: 1884413 - protein, 23 aa, Staphylococcus
QRESKNFWQDAWAQLKSNKLAVV

SEQ ID NO: 1884414 - protein, 20 aa, Staphylococcus
QRFDYSGLILFVIMMLSINV

SEQ ID NO: 1884415 - protein, 20 aa, Staphylococcus
QRFLTMYDYMLNIIAMVSIF

SEQ ID NO: 1884416 - protein, 20 aa, Staphylococcus
QRFVKMLSDIFVPIIPAIVA

SEQ ID NO: 1884417 - protein, 20 aa, Staphylococcus
QRHHFNIAQKAFFVEHGSLI

SEQ ID NO: 1884418 - protein, 18 aa, Staphylococcus
QRHLMLLSFGGVIGTGLF

SEQ ID NO: 1884419 - protein, 25 aa, Staphylococcus
QRHVIMPFILALSIMFATEFILLSL

SEQ ID NO: 1884420 - protein, 19 aa, Staphylococcus
QRIGDHMATKVKYDLRQQV

SEQ ID NO: 1884421 - protein, 29 aa, Staphylococcus
QRISHLVLTRTGLYIIDSQLLKGHVYNGV

SEQ ID NO: 1884422 - protein, 22 aa, Staphylococcus
QRISIARAFLKQAPIILLDEAT

SEQ ID NO: 1884423 - protein, 18 aa, Staphylococcus
QRKAELNKQITLLNNELT

SEQ ID NO: 1884424 - protein, 21 aa, Staphylococcus
QRLHFYAAIFITPLLITLTLS

SEQ ID NO: 1884425 - protein, 22 aa, Staphylococcus
QRLHFYAALFITPLLITLTISG

SEQ ID NO: 1884426 - protein, 19 aa, Staphylococcus
QRLSMARLLLKTNAKIWML

SEQ ID NO: 1884427 - protein, 21 aa, Staphylococcus
QRLVSFFTLGFKFNQFVIYDH

SEQ ID NO: 1884428 - protein, 22 aa, Staphylococcus
QRMIKHWLIAIVVLAIIVWGFA

SEQ ID NO: 1884429 - protein, 25 aa, Staphylococcus
QRNSEFKPQWYVQYNGEWRAYEDGR

SEQ ID NO: 1884430 - protein, 26 aa, Staphylococcus
QRNSEFMPKWYIEYDGEWYAYENGRL

SEQ ID NO: 1884431 - protein, 24 aa, Staphylococcus
QRNSEFTPQWYVEYDGNWYAYKDG

SEQ ID NO: 1884432 - protein, 18 aa, Staphylococcus
QRPAMFFKVESFFYSHID

SEQ ID NO: 1884433 - protein, 27 aa, Staphylococcus
QRPFFQFSWTEYGLWIIAHLIFTVCMA

SEQ ID NO: 1884434 - protein, 18 aa, Staphylococcus
QRPGMFFKVEGFFYSHLD

SEQ ID NO: 1884435 - protein, 31 aa, Staphylococcus
QRPSYNKKPKFPWFKTIIVALIAGIIGALLV

SEQ ID NO: 1884436 - protein, 24 aa, Staphylococcus
QRQLFTSGMRVGREILATSANTIY

SEQ ID NO: 1884437 - protein, 21 aa, Staphylococcus
QRRDPVGVGFYFSIGHSTVVF

SEQ ID NO: 1884438 - protein, 18 aa, Staphylococcus
QRRVDLIPNLVNTVKGYT

SEQ ID NO: 1884439 - protein, 24 aa, Staphylococcus
QRSKASLYAFILVMVAFVLISVAM

SEQ ID NO: 1884440 - protein, 21 aa, Staphylococcus
QRSLFKFSWNAYALWMEAHIL

SEQ ID NO: 1884441 - protein, 24 aa, Staphylococcus
QRTLGAAVGWFWLVFTGGLNVLGA

SEQ ID NO: 1884442 - protein, 17 aa, Staphylococcus
QRTPVYVYKWEDVQIQH

SEQ ID NO: 1884443 - protein, 23 aa, Staphylococcus
QRVKDYQEAAGRAQEVNGAVNKD

SEQ ID NO: 1884444 - protein, 24 aa, Staphylococcus
QRVYRYIYNFTTIFTLFIITLLNY

SEQ ID NO: 1884445 - protein, 25 aa, Staphylococcus
QRYPLKRAVTLIGLVLTLIVAMVNL

SEQ ID NO: 1884446 - protein, 19 aa, Staphylococcus
QSAFTFKIVIQLGSVFAGA

SEQ ID NO: 1884447 - protein, 18 aa, Staphylococcus
QSATRFMFMVGIDAILLL

SEQ ID NO: 1884448 - protein, 19 aa, Staphylococcus
QSDEPRHNIRIVTDEDLKN

SEQ ID NO: 1884449 - protein, 18 aa, Staphylococcus
QSFFMFVIQTAFTFSVYL

SEQ ID NO: 1884450 - protein, 22 aa, Staphylococcus
QSFHIPTWLGALIMTIVIYLTL

SEQ ID NO: 1884451 - protein, 19 aa, Staphylococcus
QSGMSRFIARASIAITGFV

SEQ ID NO: 1884452 - protein, 29 aa, Staphylococcus
QSILEKWGFPRWASITTIFIGLIAIIAIV

SEQ ID NO: 1884453 - protein, 25 aa, Staphylococcus
QSIMSGSNTNQWHYGDNLQQNHRQS

SEQ ID NO: 1884454 - protein, 19 aa, Staphylococcus
QSISIGIVFAVVIWVSVIQ

SEQ ID NO: 1884455 - protein, 17 aa, Staphylococcus
QSISLAFNTMASFITNT

SEQ ID NO: 1884456 - protein, 21 aa, Staphylococcus
QSKFKITLREAGAGFLSGLVC

SEQ ID NO: 1884457 - protein, 22 aa, Staphylococcus
QSKFKVVLREAGSGLLSGIVCS

SEQ ID NO: 1884458 - protein, 20 aa, Staphylococcus
QSKIPAVLIELGYISNPTDE

SEQ ID NO: 1884459 - protein, 18 aa, Staphylococcus
QSKPMPPIIIWDKEKGSI

SEQ ID NO: 1884460 - protein, 23 aa, Staphylococcus
QSKRKVKIGDRVHQGQIIGLVGN

SEQ ID NO: 1884461 - protein, 19 aa, Staphylococcus
QSLLYEWSRINEMLDKQLY

SEQ ID NO: 1884462 - protein, 17 aa, Staphylococcus
QSMDTMTSFWIPQLGGQ

SEQ ID NO: 1884463 - protein, 17 aa, Staphylococcus
QSNELQRLYLLHNNAEG

SEQ ID NO: 1884464 - protein, 25 aa, Staphylococcus
QSNFVVCLICILLSAVLALFISNIK

SEQ ID NO: 1884465 - protein, 20 aa, Staphylococcus
QSNHPLAISIVDFTKSKNVS

SEQ ID NO: 1884466 - protein, 21 aa, Staphylococcus
QSNHPLAISIVDFVKSKNVSF

SEQ ID NO: 1884467 - protein, 26 aa, Staphylococcus
QSNLKFKKFIPWVIITFIIILIGIVF

SEQ ID NO: 1884468 - protein, 20 aa, Staphylococcus
QSPKPVIIGVILQFTIMPTL

SEQ ID NO: 1884469 - protein, 23 aa, Staphylococcus
QSQLKEVDEIVALHKDSDSIYQQ

SEQ ID NO: 1884470 - protein, 26 aa, Staphylococcus
QSSNYFRFQYFNPLDSKKYYKNLDDQ

SEQ ID NO: 1884471 - protein, 17 aa, Staphylococcus
QSSVKGFATMLLLGILM

SEQ ID NO: 1884472 - protein, 23 aa, Staphylococcus
QSYEDLKNLTINWFNILMLVVIV

SEQ ID NO: 1884473 - protein, 20 aa, Staphylococcus
QSYISIGIVCIIIGAFYLIG

SEQ ID NO: 1884474 - protein, 36 aa, Staphylococcus
QTADGIKPSVANYFRHGAAHGYPFYNTPTVHINSFW

SEQ ID NO: 1884475 - protein, 18 aa, Staphylococcus
QTELAYMQNIFSFDERHA

SEQ ID NO: 1884476 - protein, 18 aa, Staphylococcus
QTELAYMQNIFSFDERQA

SEQ ID NO: 1884477 - protein, 19 aa, Staphylococcus
QTELAYMQNIFSFDERQSK

SEQ ID NO: 1884478 - protein, 27 aa, Staphylococcus
QTESYKEVLSHSGIKPGKNKHNDDDPK

SEQ ID NO: 1884479 - protein, 17 aa, Staphylococcus
QTILLKVRLPRVLEAML

SEQ ID NO: 1884480 - protein, 24 aa, Staphylococcus
QTITDLRPAGIITCDDERIDAVSD

SEQ ID NO: 1884481 - protein, 18 aa, Staphylococcus
QTLIKYGNVYAQVYSDQQ

SEQ ID NO: 1884482 - protein, 30 aa, Staphylococcus
QTLKATSWLPELFMSLVLFTVVGSQINKIA

SEQ ID NO: 1884483 - protein, 24 aa, Staphylococcus
QTLLRLLTCIQIIGVCIVSLTLIQ

SEQ ID NO: 1884484 - protein, 25 aa, Staphylococcus
QTLMPLTLLAMIAFYIAIFSIMKPD

SEQ ID NO: 1884485 - protein, 19 aa, Staphylococcus
QTNIPAVLLELGYISNPTD

SEQ ID NO: 1884486 - protein, 22 aa, Staphylococcus
QTPNILQMILGWLMILLMFALP

SEQ ID NO: 1884487 - protein, 18 aa, Staphylococcus
QTQDFVFGAGITRGKILA

SEQ ID NO: 1884488 - protein, 19 aa, Staphylococcus
QTRLQKLFFGKEISYDMMN

SEQ ID NO: 1884489 - protein, 24 aa, Staphylococcus
QTSFNYTWFVGGLLGVCFLTGNLL

SEQ ID NO: 1884490 - protein, 18 aa, Staphylococcus
QTSFRLKMHLIYQKNVIL

SEQ ID NO: 1884491 - protein, 23 aa, Staphylococcus
QTSLRLKMHLFYQKNVILATVPY

SEQ ID NO: 1884492 - protein, 22 aa, Staphylococcus
QTSLRLKMHLIYQKNVILCTIP

SEQ ID NO: 1884493 - protein, 24 aa, Staphylococcus
QTTGIPSWILVIILTGVTLFLVIR

SEQ ID NO: 1884494 - protein, 20 aa, Staphylococcus
QTTLPVAFLANWLKDLLGPA

SEQ ID NO: 1884495 - protein, 18 aa, Staphylococcus
QTTREFEDGSLLKFTNMK

SEQ ID NO: 1884496 - protein, 17 aa, Staphylococcus
QTTRMAFGPVVLTNSTD

SEQ ID NO: 1884497 - protein, 23 aa, Staphylococcus
QTTWKEHPVVTFVALALLAIAFI

SEQ ID NO: 1884498 - protein, 17 aa, Staphylococcus
QTVFKPTVKQNARDALH

SEQ ID NO: 1884499 - protein, 26 aa, Staphylococcus
QTVKRKVVVQLTRFEKVLYISLITVI

SEQ ID NO: 1884500 - protein, 18 aa, Staphylococcus
QTYWSRNKLNNMELKSPT

SEQ ID NO: 1884501 - protein, 17 aa, Staphylococcus
QVDEVNEILSLHKDNEA

SEQ ID NO: 1884502 - protein, 19 aa, Staphylococcus
QVDVFPVKDYGSGMTPFYT

SEQ ID NO: 1884503 - protein, 21 aa, Staphylococcus
QVDWRRLFMSILIYALSQLIV

SEQ ID NO: 1884504 - protein, 24 aa, Staphylococcus
QVFKDIFPLSAVIIILYALDLIAR

SEQ ID NO: 1884505 - protein, 23 aa, Staphylococcus
QVFKDIFPLSAVILILYGLDLLS

SEQ ID NO: 1884506 - protein, 18 aa, Staphylococcus
QVFLTAILIFLIGTVVAG

SEQ ID NO: 1884507 - protein, 18 aa, Staphylococcus
QVFLTGILIFFVGTIVGG

SEQ ID NO: 1884508 - protein, 22 aa, Staphylococcus
QVFYKNEFTFMSGVSIVVLIVT

SEQ ID NO: 1884509 - protein, 22 aa, Staphylococcus
QVGAALALWVRCRHNQPLRNTL

SEQ ID NO: 1884510 - protein, 22 aa, Staphylococcus
QVGAALALWVRCRKNTKLRNTL

SEQ ID NO: 1884511 - protein, 21 aa, Staphylococcus
QVGAALALWVRCRKNTTLRDT

SEQ ID NO: 1884512 - protein, 21 aa, Staphylococcus
QVGKRGTLYSIVKFNNQTIGR

SEQ ID NO: 1884513 - protein, 17 aa, Staphylococcus
QVGPRLGANKVVAGNTI

SEQ ID NO: 1884514 - protein, 17 aa, Staphylococcus
QVGVAWIMGMSILMSIL

SEQ ID NO: 1884515 - protein, 18 aa, Staphylococcus
QVISLALMLGAIILNVVG

SEQ ID NO: 1884516 - protein, 24 aa, Staphylococcus
QVLDISAKIPKNFNFNRILIDKDP

SEQ ID NO: 1884517 - protein, 24 aa, Staphylococcus
QVLIVGLLCMIIGILTYVLLAAIL

SEQ ID NO: 1884518 - protein, 17 aa, Staphylococcus
QVLKSQQAFSFKLLFSL

SEQ ID NO: 1884519 - protein, 27 aa, Staphylococcus
QVMLFGCIGCGITTLLFYYLPILSGDI

SEQ ID NO: 1884520 - protein, 24 aa, Staphylococcus
QVNDIVLGLVFLVGSFLFFSDKTV

SEQ ID NO: 1884521 - protein, 17 aa, Staphylococcus
QVNEKNNSFILSDDDKK

SEQ ID NO: 1884522 - protein, 26 aa, Staphylococcus
QVNELRYSTALSFLSVNLFSIPIAFS

SEQ ID NO: 1884523 - protein, 24 aa, Staphylococcus
QVQQRFDAIVAFALVAILSKIILY

SEQ ID NO: 1884524 - protein, 26 aa, Staphylococcus
QVSDSLRVYYDINKASGQRINAIKVL

SEQ ID NO: 1884525 - protein, 17 aa, Staphylococcus
QVSWTFMILLAFIAFII

SEQ ID NO: 1884526 - protein, 23 aa, Staphylococcus
QVVPKTSIVWGILKGLQYGGLAF

SEQ ID NO: 1884527 - protein, 17 aa, Staphylococcus
QVVPVKISLDSAPSNSV

SEQ ID NO: 1884528 - protein, 21 aa, Staphylococcus
QVYGFFAIVFIIPFIVHIGYI

SEQ ID NO: 1884529 - protein, 22 aa, Staphylococcus
QVYGFWAIIFIFPFVIHIGYIV

SEQ ID NO: 1884530 - protein, 20 aa, Staphylococcus
QVYSFFAIIFVIPFAIHIGY

SEQ ID NO: 1884531 - protein, 20 aa, Staphylococcus
QVYSFWAIIFIIPFIIHTGY

SEQ ID NO: 1884532 - protein, 17 aa, Staphylococcus
QWFKRMATIGGIVVLIT

SEQ ID NO: 1884533 - protein, 29 aa, Staphylococcus
QWLKFAWKLIALWAIICAIAMSIALLAGY

SEQ ID NO: 1884534 - protein, 23 aa, Staphylococcus
QWSKAEIQMMFAVAQRDGALNEI

SEQ ID NO: 1884535 - protein, 20 aa, Staphylococcus
QYGAKWVVLISVIISMFGSI

SEQ ID NO: 1884536 - protein, 30 aa, Staphylococcus
QYGKALLYILFCWTGIPGVIGMIEGVIAFI

SEQ ID NO: 1884537 - protein, 21 aa, Staphylococcus
QYHNIAHLIGPYQYQSNQELT

SEQ ID NO: 1884538 - protein, 17 aa, Staphylococcus
QYISIIVPSRMYINAFK

SEQ ID NO: 1884539 - protein, 17 aa, Staphylococcus
QYLHWQSIFVLSIILSV

SEQ ID NO: 1884540 - protein, 18 aa, Staphylococcus
QYLKIRYLVITVMVVSVV

SEQ ID NO: 1884541 - protein, 25 aa, Staphylococcus
QYLNEYRIAVTVDCLGEFVETKEES

SEQ ID NO: 1884542 - protein, 26 aa, Staphylococcus
QYLPDEWRMPLSIGLLVLIFSTLIFK

SEQ ID NO: 1884543 - protein, 24 aa, Staphylococcus
QYLPLEWRRPLSIGLTVLILISLF

SEQ ID NO: 1884544 - protein, 24 aa, Staphylococcus
QYMAKRRIGALIVFEKKTGLQDYI

SEQ ID NO: 1884545 - protein, 17 aa, Staphylococcus
QYPAIHIPWMSSIDINV

SEQ ID NO: 1884546 - protein, 23 aa, Staphylococcus
QYPKEYRYGFYVMPTINRVNGVF

SEQ ID NO: 1884547 - protein, 17 aa, Staphylococcus
QYPRTAMIILFTLVIVV

SEQ ID NO: 1884548 - protein, 23 aa, Staphylococcus
QYQDFYITLYIKRGNPDSNYTVN

SEQ ID NO: 1884549 - protein, 26 aa, Staphylococcus
QYQFTSRLRKLILMILVGGAIAASVV

SEQ ID NO: 1884550 - protein, 19 aa, Staphylococcus
QYRPHIAIITNIYSAHLDY

SEQ ID NO: 1884551 - protein, 19 aa, Staphylococcus
QYSLEWLPIAVIATVIGYI

SEQ ID NO: 1884552 - protein, 24 aa, Staphylococcus
QYSLKRLRDFTPYWQNTFAMITGD

SEQ ID NO: 1884553 - protein, 24 aa, Staphylococcus
QYVFREDMLFKSIRLSESIKVHIQ

SEQ ID NO: 1884554 - protein, 23 aa, Staphylococcus
QYVIEWITLLILLFIIIIYIATT

SEQ ID NO: 1884555 - protein, 21 aa, Staphylococcus
QYVIEWVTLLILIFIIIVYIA

SEQ ID NO: 1884556 - protein, 22 aa, Staphylococcus
QYVIEWVTLLLLLFIIIVYIAT

SEQ ID NO: 1884557 - protein, 21 aa, Staphylococcus
QYVKEIQRLFSYETTSHSVDQ

SEQ ID NO: 1884558 - protein, 27 aa, Staphylococcus
QYWSPMKGMPAWGWSILFLLIIFALNS

SEQ ID NO: 1884559 - protein, 20 aa, Staphylococcus
QYYDRKGLLTAERATESNRR

SEQ ID NO: 1884560 - protein, 18 aa, Staphylococcus
QYYFCVAMVLVVLLMFVG

SEQ ID NO: 1884561 - protein, 19 aa, Staphylococcus
RADYVKSYYLLFGAITVIS

SEQ ID NO: 1884562 - protein, 21 aa, Staphylococcus
RAEDKGMLAMEFFDHDPKAHA

SEQ ID NO: 1884563 - protein, 19 aa, Staphylococcus
RAFLLGWLALVLVVVVLYI

SEQ ID NO: 1884564 - protein, 20 aa, Staphylococcus
RAGAVVPILLGMIAAFKASK

SEQ ID NO: 1884565 - protein, 20 aa, Staphylococcus
RAGAVVPILLGMIAAFKMSK

SEQ ID NO: 1884566 - protein, 19 aa, Staphylococcus
RAGTEKGWVAGWHTNLNIH

SEQ ID NO: 1884567 - protein, 17 aa, Staphylococcus
RAHYAFIMTMCGIHGTI

SEQ ID NO: 1884568 - protein, 18 aa, Staphylococcus
RAIACLSIVIIHSITTTF

SEQ ID NO: 1884569 - protein, 17 aa, Staphylococcus
RAIDEVAKAKKQEIDNN

SEQ ID NO: 1884570 - protein, 24 aa, Staphylococcus
RAIGRASVVPTFFGVNEPILFGAP

SEQ ID NO: 1884571 - protein, 27 aa, Staphylococcus
RAIKQVFWRILLFYVLSIAVIAAIIPY

SEQ ID NO: 1884572 - protein, 17 aa, Staphylococcus
RALEIGATFHIVSLPDS

SEQ ID NO: 1884573 - protein, 19 aa, Staphylococcus
RALEKAGAHVKLTRTDDSY

SEQ ID NO: 1884574 - protein, 18 aa, Staphylococcus
RALEKAGATVKLTRSDDT

SEQ ID NO: 1884575 - protein, 20 aa, Staphylococcus
RALEQLGRGSLFKRYTNTYS

SEQ ID NO: 1884576 - protein, 18 aa, Staphylococcus
RALQDKLTEARNIINEQQ

SEQ ID NO: 1884577 - protein, 32 aa, Staphylococcus
RALSFNFAQLIARLGIILGVLMNALGMTIYMA

SEQ ID NO: 1884578 - protein, 29 aa, Staphylococcus
RALTPRRAILLAAIMNFIGALTFTGVAGT

SEQ ID NO: 1884579 - protein, 25 aa, Staphylococcus
RALTPRRAILLAAVMNFIGALTFTG

SEQ ID NO: 1884580 - protein, 25 aa, Staphylococcus
RANEPWKNIFNFKKIISVAFATGTY

SEQ ID NO: 1884581 - protein, 26 aa, Staphylococcus
RANEPWKNLFNFKKIISVAFATGTYV

SEQ ID NO: 1884582 - protein, 22 aa, Staphylococcus
RANRNFRFFQIFTAALQSFSHG

SEQ ID NO: 1884583 - protein, 21 aa, Staphylococcus
RANRNFRFFQVFTAALQSFSH

SEQ ID NO: 1884584 - protein, 19 aa, Staphylococcus
RAPAQAFVDKFAKYYTPII

SEQ ID NO: 1884585 - protein, 19 aa, Staphylococcus
RASDLEMIYDSGSDIEQRV

SEQ ID NO: 1884586 - protein, 20 aa, Staphylococcus
RASPVMHHVFWISFIAIFIG

SEQ ID NO: 1884587 - protein, 19 aa, Staphylococcus
RASPVMHHVFWISFVSIFI

SEQ ID NO: 1884588 - protein, 29 aa, Staphylococcus
RASTTTFVYSFIAFILGVGVISLRRKFSK

SEQ ID NO: 1884589 - protein, 17 aa, Staphylococcus
RATFLIHNVRMPRMIGG

SEQ ID NO: 1884590 - protein, 24 aa, Staphylococcus
RATLLKVMAPLSFVLASLAIYWAM

SEQ ID NO: 1884591 - protein, 20 aa, Staphylococcus
RAVGITSVFLVSFANFSSIG

SEQ ID NO: 1884592 - protein, 17 aa, Staphylococcus
RAVILGIILPLSVILFY

SEQ ID NO: 1884593 - protein, 17 aa, Staphylococcus
RAYLDYIKEEDDLNNVA

SEQ ID NO: 1884594 - protein, 17 aa, Staphylococcus
RCEKCNHTLQFLDLIPI

SEQ ID NO: 1884595 - protein, 18 aa, Staphylococcus
RDAFSIIFRLIVIALVLM

SEQ ID NO: 1884596 - protein, 24 aa, Staphylococcus
RDATATWAWLFLLFVMPVLGFFIY

SEQ ID NO: 1884597 - protein, 18 aa, Staphylococcus
RDAYKHKINFLVLIVPTL

SEQ ID NO: 1884598 - protein, 18 aa, Staphylococcus
RDEFKTDVLQRLKQYDTM

SEQ ID NO: 1884599 - protein, 17 aa, Staphylococcus
RDFAKKFHLTTNETESR

SEQ ID NO: 1884600 - protein, 19 aa, Staphylococcus
RDFIKRLIGKPGDKVEYKG

SEQ ID NO: 1884601 - protein, 18 aa, Staphylococcus
RDFIKRVIGTPGDKVEYE

SEQ ID NO: 1884602 - protein, 18 aa, Staphylococcus
RDFIKRVIGTPGDTVEYK

SEQ ID NO: 1884603 - protein, 17 aa, Staphylococcus
RDFTVSYALSMKKAMSG

SEQ ID NO: 1884604 - protein, 22 aa, Staphylococcus
RDIIKIRWSQHGFISTKKNETP

SEQ ID NO: 1884605 - protein, 22 aa, Staphylococcus
RDIKSKRLLTSIGVGLITALLL

SEQ ID NO: 1884606 - protein, 18 aa, Staphylococcus
RDIYDMLDTFFAEKGKIV

SEQ ID NO: 1884607 - protein, 27 aa, Staphylococcus
RDIYNIFRKETFSGNQYLNSLQQSSNY

SEQ ID NO: 1884608 - protein, 26 aa, Staphylococcus
RDKNGKYNALVSFSGRSFSILKGSDL

SEQ ID NO: 1884609 - protein, 25 aa, Staphylococcus
RDKQSKCGHCGYEVTDNHSEQLTRS

SEQ ID NO: 1884610 - protein, 22 aa, Staphylococcus
RDLGPRIAHAILPIAGKGGSNW

SEQ ID NO: 1884611 - protein, 29 aa, Staphylococcus
RDMAKGLKLKVLFNFSLPLIIALLHAYFA

SEQ ID NO: 1884612 - protein, 18 aa, Staphylococcus
RDNFKQAINNARNVLNKT

SEQ ID NO: 1884613 - protein, 44 aa, Staphylococcus
RDNKKKGGIMKILLPLIAAVLILGAIAIFGGMALNNHNNSKNDD

SEQ ID NO: 1884614 - protein, 25 aa, Staphylococcus
RDNLPRFFLYLLLFMFSMLGIVVSN

SEQ ID NO: 1884615 - protein, 25 aa, Staphylococcus
RDNMFTSFVKICISNLAGVPSIVFG

SEQ ID NO: 1884616 - protein, 17 aa, Staphylococcus
RDNWFLENRDDAVSPHY

SEQ ID NO: 1884617 - protein, 24 aa, Staphylococcus
RDQFEFQMLYGFRSELAEDISRQG

SEQ ID NO: 1884618 - protein, 20 aa, Staphylococcus
RDSWLVVLAIVFVASTLRAP

SEQ ID NO: 1884619 - protein, 25 aa, Staphylococcus
RDTLKGALPVGFLGIGEPLIYGVTL

SEQ ID NO: 1884620 - protein, 19 aa, Staphylococcus
RDTLSLFSLIPIGMILFIL

SEQ ID NO: 1884621 - protein, 19 aa, Staphylococcus
RDTLVVAMTGLFIFIVLWV

SEQ ID NO: 1884622 - protein, 17 aa, Staphylococcus
RDVPKAVGLAVGTAGGA

SEQ ID NO: 1884623 - protein, 25 aa, Staphylococcus
RDYAKVWLFFMYYWIIFGIGCYFGQ

SEQ ID NO: 1884624 - protein, 31 aa, Staphylococcus
RDYANDSVDRMLGQGSANVYQAANKQSVDSN

SEQ ID NO: 1884625 - protein, 26 aa, Staphylococcus
RDYEIRHLRAMFGYVPQDNFLFSTTI

SEQ ID NO: 1884626 - protein, 27 aa, Staphylococcus
RDYPIVHLKLFYFFHAINNSVWFVLSI

SEQ ID NO: 1884627 - protein, 26 aa, Staphylococcus
RDYPLIQGCVLFIGCFVVIINTIADI

SEQ ID NO: 1884628 - protein, 21 aa, Staphylococcus
RDYPVIQGIVLFIGILVILIN

SEQ ID NO: 1884629 - protein, 25 aa, Staphylococcus
RDYTMICILSIISIIVFEIYVAIIY

SEQ ID NO: 1884630 - protein, 20 aa, Staphylococcus
REATKILPIISVVAISLILA

SEQ ID NO: 1884631 - protein, 19 aa, Staphylococcus
REAYSIRKYSIGAASILVG

SEQ ID NO: 1884632 - protein, 34 aa, Staphylococcus
REFEDGSLLKFTNMKWLTPKSHYIHGKGITPDKK

SEQ ID NO: 1884633 - protein, 22 aa, Staphylococcus
REFGDGSLLKYTEMKWLTPDGH

SEQ ID NO: 1884634 - protein, 25 aa, Staphylococcus
REFISGVLLVPAIVSFIWFSVFGVL

SEQ ID NO: 1884635 - protein, 22 aa, Staphylococcus
REFISGVLLVPALISFLWFSVF

SEQ ID NO: 1884636 - protein, 17 aa, Staphylococcus
REFPEIEKAILQESQNA

SEQ ID NO: 1884637 - protein, 19 aa, Staphylococcus
REGLGEAIQDLFKHRIGKL

SEQ ID NO: 1884638 - protein, 17 aa, Staphylococcus
REHFKNFYLIQRLAQFQ

SEQ ID NO: 1884639 - protein, 17 aa, Staphylococcus
REIAGVASIRIGGHPQF

SEQ ID NO: 1884640 - protein, 22 aa, Staphylococcus
REIAQRLIVFLPFPKTVAFDTQ

SEQ ID NO: 1884641 - protein, 17 aa, Staphylococcus
REIDALKLFSKNHSEYI

SEQ ID NO: 1884642 - protein, 17 aa, Staphylococcus
REIDALKLFSKNHSEYV

SEQ ID NO: 1884643 - protein, 18 aa, Staphylococcus
REIDALKLFSKNHSEYVT

SEQ ID NO: 1884644 - protein, 17 aa, Staphylococcus
REIHIMDIQRSFMVFTM

SEQ ID NO: 1884645 - protein, 17 aa, Staphylococcus
REIHVVDIQRSFAVFTM

SEQ ID NO: 1884646 - protein, 26 aa, Staphylococcus
REIYLGKSGLFYTLGIIQALIVSIGD

SEQ ID NO: 1884647 - protein, 25 aa, Staphylococcus
REKEGIADGLIRLSVGIEDTDDLVA

SEQ ID NO: 1884648 - protein, 25 aa, Staphylococcus
REKEGLKSNIGWQTVHHEVDGSEAM

SEQ ID NO: 1884649 - protein, 19 aa, Staphylococcus
REKEVSFTKPYMMTNNIML

SEQ ID NO: 1884650 - protein, 20 aa, Staphylococcus
REKGWSRKLIANAIGGTITF

SEQ ID NO: 1884651 - protein, 21 aa, Staphylococcus
RELFTSALAFICFVGSIMIIV

SEQ ID NO: 1884652 - protein, 20 aa, Staphylococcus
RELIITAMALVVFLVIFFVF

SEQ ID NO: 1884653 - protein, 31 aa, Staphylococcus
RELKYKAKWFPFGPIFAGLLCVIVIIGQDVD

SEQ ID NO: 1884654 - protein, 19 aa, Staphylococcus
RELQDILDRFKASGKLKYY

SEQ ID NO: 1884655 - protein, 17 aa, Staphylococcus
RELRGISKAVIRIITVG

SEQ ID NO: 1884656 - protein, 24 aa, Staphylococcus
RENEPRFEPRLGNQYGGKLYLTLD

SEQ ID NO: 1884657 - protein, 18 aa, Staphylococcus
RENMPRKEATPEAPGIEA

SEQ ID NO: 1884658 - protein, 19 aa, Staphylococcus
REPFFGVAFIVMIFAIGGV

SEQ ID NO: 1884659 - protein, 17 aa, Staphylococcus
REPFFGVAFIVMVFAIG

SEQ ID NO: 1884660 - protein, 22 aa, Staphylococcus
REPRLEPRLGNQYGGKLALIFD

SEQ ID NO: 1884661 - protein, 20 aa, Staphylococcus
REPRVAVACIVRIINQAAQY

SEQ ID NO: 1884662 - protein, 21 aa, Staphylococcus
REQPKWVLNLIIWIIVVVASV

SEQ ID NO: 1884663 - protein, 18 aa, Staphylococcus
RERIAGRVFEHFNGLYRF

SEQ ID NO: 1884664 - protein, 18 aa, Staphylococcus
RERISWRSVGTSSIMVLG

SEQ ID NO: 1884665 - protein, 17 aa, Staphylococcus
RERPKGWQAKLAVNTLG

SEQ ID NO: 1884666 - protein, 23 aa, Staphylococcus
RESIKTRVEMSSDVTPDGQGHNY

SEQ ID NO: 1884667 - protein, 27 aa, Staphylococcus
RESKNFWQDAWAQLKRNKLAIVGMIGL

SEQ ID NO: 1884668 - protein, 28 aa, Staphylococcus
RESKNFWQDAWAQLKRNKLAVIGMIGLI

SEQ ID NO: 1884669 - protein, 23 aa, Staphylococcus
RESKNFWQDAWAQLKRNKLAVVG

SEQ ID NO: 1884670 - protein, 26 aa, Staphylococcus
RETWRAKWQLTIMFVIFALLSNVTGV

SEQ ID NO: 1884671 - protein, 20 aa, Staphylococcus
REVIPLILGTIIMYLVGLID

SEQ ID NO: 1884672 - protein, 21 aa, Staphylococcus
REVMTLPSIKVVEHPDLFVEA

SEQ ID NO: 1884673 - protein, 36 aa, Staphylococcus
REWMSSWTLYYWGWWLSWSPFVGIFIARVSKGRSIR

SEQ ID NO: 1884674 - protein, 22 aa, Staphylococcus
REWRLIAISILLLFFWSTEKIL

SEQ ID NO: 1884675 - protein, 17 aa, Staphylococcus
REWRLIVISILLLLFWS

SEQ ID NO: 1884676 - protein, 24 aa, Staphylococcus
RFAELKWMPQIGMNFNLYVDGLSL

SEQ ID NO: 1884677 - protein, 29 aa, Staphylococcus
RFDFLPNRLNKYSIRKFTNGIASVLIGST

SEQ ID NO: 1884678 - protein, 21 aa, Staphylococcus
RFDGKRLINENVREGIHKPKE

SEQ ID NO: 1884679 - protein, 19 aa, Staphylococcus
RFDIPFYVKMVILVFFLFA

SEQ ID NO: 1884680 - protein, 48 aa, Staphylococcus
RFDLKRIAKTPAVWIIIAGLAILPSFYAWFNLWAMWDPYSKTDHIKVA

SEQ ID NO: 1884681 - protein, 20 aa, Staphylococcus
RFDTILSMISVIIAFIHIAI

SEQ ID NO: 1884682 - protein, 24 aa, Staphylococcus
RFENIKGKVLGIFNFVRYIGMTIG

SEQ ID NO: 1884683 - protein, 19 aa, Staphylococcus
RFFRERKLGWFIFAITFTL

SEQ ID NO: 1884684 - protein, 18 aa, Staphylococcus
RFGEAWFQSINPLFILLF

SEQ ID NO: 1884685 - protein, 20 aa, Staphylococcus
RFHGKRLINENVREGIHHPQ

SEQ ID NO: 1884686 - protein, 26 aa, Staphylococcus
RFIHETEMPEFLIVIYHGGLDQLNKS

SEQ ID NO: 1884687 - protein, 29 aa, Staphylococcus
RFIMRRRQKELAMNMILGMEKKHFRLMLF

SEQ ID NO: 1884688 - protein, 21 aa, Staphylococcus
RFIVKLIPVHYIFRVLSILIF

SEQ ID NO: 1884689 - protein, 19 aa, Staphylococcus
RFKALKKHIPLIIIVMVAL

SEQ ID NO: 1884690 - protein, 20 aa, Staphylococcus
RFKASDLDKATGWFDNHGKK

SEQ ID NO: 1884691 - protein, 43 aa, Staphylococcus
RFKSSEGYVAVFMRPDIGQTFSEFRIFLALLIILLLIISISLI

SEQ ID NO: 1884692 - protein, 20 aa, Staphylococcus
RFKSTFKAKHYIVVLVGIAI

SEQ ID NO: 1884693 - protein, 21 aa, Staphylococcus
RFLIGIGTCAGYPSAMYLISY

SEQ ID NO: 1884694 - protein, 19 aa, Staphylococcus
RFLISVGIILLCIYLAYQG

SEQ ID NO: 1884695 - protein, 21 aa, Staphylococcus
RFNGKRLINENVREGIHHPKE

SEQ ID NO: 1884696 - protein, 17 aa, Staphylococcus
RFNRSSFFDDLKDWIST

SEQ ID NO: 1884697 - protein, 19 aa, Staphylococcus
RFNTIWASITLHFFWNVFQ

SEQ ID NO: 1884698 - protein, 18 aa, Staphylococcus
RFPVTVNIITTWLLLLPG

SEQ ID NO: 1884699 - protein, 18 aa, Staphylococcus
RFQKWMMIGIIILLAATL

SEQ ID NO: 1884700 - protein, 25 aa, Staphylococcus
RFSETELPLALSFFSGKRLVPILTA

SEQ ID NO: 1884701 - protein, 25 aa, Staphylococcus
RFSKEEIRTLLNIAGREGAFNEVEN

SEQ ID NO: 1884702 - protein, 20 aa, Staphylococcus
RFSKGLFAWIGYNTKVFSYK

SEQ ID NO: 1884703 - protein, 18 aa, Staphylococcus
RFSLILSLISLVLVFIHI

SEQ ID NO: 1884704 - protein, 18 aa, Staphylococcus
RFSTLVTAFFLLLTIYVL

SEQ ID NO: 1884705 - protein, 22 aa, Staphylococcus
RFTKRQASGLGLIVLAIILNVY

SEQ ID NO: 1884706 - protein, 27 aa, Staphylococcus
RFTLEMYRFEYPITFATSIFASIFTSA

SEQ ID NO: 1884707 - protein, 30 aa, Staphylococcus
RFTLEMYRFEYPITFVISIFASIFTSAILK

SEQ ID NO: 1884708 - protein, 20 aa, Staphylococcus
RFTTALSIIITFHFVTFGFL

SEQ ID NO: 1884709 - protein, 19 aa, Staphylococcus
RFTTTIWINVARVVLIGAT

SEQ ID NO: 1884710 - protein, 27 aa, Staphylococcus
RFTYGYLRLEVIAAFLNGLALVVISLW

SEQ ID NO: 1884711 - protein, 33 aa, Staphylococcus
RFVDPSLGFALGWNYWFNWVITVAADVTIAAQV

SEQ ID NO: 1884712 - protein, 30 aa, Staphylococcus
RFVDPSLGFTMGWLYYIMWALVSSVDVMVA

SEQ ID NO: 1884713 - protein, 20 aa, Staphylococcus
RFVFDITDLSPFIAAIICLL

SEQ ID NO: 1884714 - protein, 18 aa, Staphylococcus
RFVSILFIFTYVVSFLPV

SEQ ID NO: 1884715 - protein, 19 aa, Staphylococcus
RGAHPCIISMEGLEKEGDT

SEQ ID NO: 1884716 - protein, 23 aa, Staphylococcus
RGEIIKAFISLRQGYKPSDELKA

SEQ ID NO: 1884717 - protein, 22 aa, Staphylococcus
RGESFISHPLLVYMEPYASSTA

SEQ ID NO: 1884718 - protein, 22 aa, Staphylococcus
RGESFISNPLLVYMEPYASSTA

SEQ ID NO: 1884719 - protein, 22 aa, Staphylococcus
RGESFISSPLLVYMEPYASSTA

SEQ ID NO: 1884720 - protein, 21 aa, Staphylococcus
RGETYGILKFDGRILNIHSDE

SEQ ID NO: 1884721 - protein, 20 aa, Staphylococcus
RGFARMKHLIIPLLSQNIRK

SEQ ID NO: 1884722 - protein, 21 aa, Staphylococcus
RGFITRFIAPYFKLISRSWHV

SEQ ID NO: 1884723 - protein, 21 aa, Staphylococcus
RGFITRFIGPYFKLINKSWHV

SEQ ID NO: 1884724 - protein, 20 aa, Staphylococcus
RGFITRFIGPYFKVISRSWH

SEQ ID NO: 1884725 - protein, 20 aa, Staphylococcus
RGFTAWDVVTIRGVLTFIFL

SEQ ID NO: 1884726 - protein, 18 aa, Staphylococcus
RGGSLLIRQMLRSPEMGL

SEQ ID NO: 1884727 - protein, 20 aa, Staphylococcus
RGHNSGRNSSSYFPQNHYDE

SEQ ID NO: 1884728 - protein, 26 aa, Staphylococcus
RGKKPTGLIILLSLIFIGFIAAMLYG

SEQ ID NO: 1884729 - protein, 17 aa, Staphylococcus
RGLEHIGKMSLTFYLIQ

SEQ ID NO: 1884730 - protein, 24 aa, Staphylococcus
RGLFKYLALFSAFMLAIFIIPNFF

SEQ ID NO: 1884731 - protein, 17 aa, Staphylococcus
RGLGLAIRFMTGPIGIV

SEQ ID NO: 1884732 - protein, 19 aa, Staphylococcus
RGLKRLKHLLIPILSQNIR

SEQ ID NO: 1884733 - protein, 18 aa, Staphylococcus
RGLLSLLVSSNFFKKKYW

SEQ ID NO: 1884734 - protein, 18 aa, Staphylococcus
RGLMSIQPYHVVYKPYEH

SEQ ID NO: 1884735 - protein, 20 aa, Staphylococcus
RGMFPMYLLMIISTLGVGFC

SEQ ID NO: 1884736 - protein, 19 aa, Staphylococcus
RGMLLKRRVKTKINSASSL

SEQ ID NO: 1884737 - protein, 18 aa, Staphylococcus
RGSNEYDRNSYFNRNGAS

SEQ ID NO: 1884738 - protein, 21 aa, Staphylococcus
RGSNFRLQNLLAKAHPIIYYY

SEQ ID NO: 1884739 - protein, 18 aa, Staphylococcus
RGTFLITFSILITKILGV

SEQ ID NO: 1884740 - protein, 19 aa, Staphylococcus
RGTFYLHYKDKFDLVEQYQ

SEQ ID NO: 1884741 - protein, 19 aa, Staphylococcus
RGTPMLVQVFIVFFGTTAA

SEQ ID NO: 1884742 - protein, 18 aa, Staphylococcus
RGTYSAIRALSFNFAQLI

SEQ ID NO: 1884743 - protein, 25 aa, Staphylococcus
RGVIPIFILMCFPFTPSALVNIVAS

SEQ ID NO: 1884744 - protein, 20 aa, Staphylococcus
RGYPLKILIITGLMIGALFN

SEQ ID NO: 1884745 - protein, 18 aa, Staphylococcus
RHAHFSKKVKWKGRTFDI

SEQ ID NO: 1884746 - protein, 18 aa, Staphylococcus
RHFFFEKKFHPFVAAIAV

SEQ ID NO: 1884747 - protein, 19 aa, Staphylococcus
RHFFIPSIILILGATIGAY

SEQ ID NO: 1884748 - protein, 21 aa, Staphylococcus
RHFLSKPVAIIFWIIAELAII

SEQ ID NO: 1884749 - protein, 22 aa, Staphylococcus
RHFPFGGDIIFVRIVRNNESIV

SEQ ID NO: 1884750 - protein, 17 aa, Staphylococcus
RHFPKTRRTFGLILLQF

SEQ ID NO: 1884751 - protein, 19 aa, Staphylococcus
RHHFNIAKKAYFVENGSLI

SEQ ID NO: 1884752 - protein, 18 aa, Staphylococcus
RHHYSIAKKAYFVENGSL

SEQ ID NO: 1884753 - protein, 20 aa, Staphylococcus
RHIDKQGHVSADDILNDVLN

SEQ ID NO: 1884754 - protein, 20 aa, Staphylococcus
RHIIIPFILVISTLFGIEFI

SEQ ID NO: 1884755 - protein, 18 aa, Staphylococcus
RHIYLWWFMFAVFVSQIL

SEQ ID NO: 1884756 - protein, 20 aa, Staphylococcus
RHLALEFGKGNGFNVQSFII

SEQ ID NO: 1884757 - protein, 21 aa, Staphylococcus
RHLGYAIKKSIVKELGFDFSV

SEQ ID NO: 1884758 - protein, 18 aa, Staphylococcus
RHLKRYKDIEEILSHGID

SEQ ID NO: 1884759 - protein, 27 aa, Staphylococcus
RHLSGSLKRNWKWLIAPLVTSIILLVV

SEQ ID NO: 1884760 - protein, 20 aa, Staphylococcus
RHLVLFPGILLQGAAISALV

SEQ ID NO: 1884761 - protein, 20 aa, Staphylococcus
RHLVLFPGILLQGAAVSALV

SEQ ID NO: 1884762 - protein, 20 aa, Staphylococcus
RHLVLFPGILLQGASISALL

SEQ ID NO: 1884763 - protein, 21 aa, Staphylococcus
RHMTSHQSILLSFQRKNTKYR

SEQ ID NO: 1884764 - protein, 19 aa, Staphylococcus
RHNGILPKALLRAVGQDLF

SEQ ID NO: 1884765 - protein, 19 aa, Staphylococcus
RHTLSRSKHSTIHSNELTV

SEQ ID NO: 1884766 - protein, 24 aa, Staphylococcus
RHVFPKMHIVMLLAALSMAGVPFL

SEQ ID NO: 1884767 - protein, 22 aa, Staphylococcus
RHVTDTTPPRKPVINTNLVNKV

SEQ ID NO: 1884768 - protein, 23 aa, Staphylococcus
RHYLFERRYHPFVAAIAVGLIAL

SEQ ID NO: 1884769 - protein, 22 aa, Staphylococcus
RIALGIGGAVAAVALSRKDSRD

SEQ ID NO: 1884770 - protein, 30 aa, Staphylococcus
RICIILAISLVVAIAFFFAMKTYQGHRNIK

SEQ ID NO: 1884771 - protein, 17 aa, Staphylococcus
RICIPPPVIGGLLFAIL

SEQ ID NO: 1884772 - protein, 25 aa, Staphylococcus
RIDQAIMGAGDFKHLGGEKERNKMG

SEQ ID NO: 1884773 - protein, 17 aa, Staphylococcus
RIERDLKNNVTNKQLYN

SEQ ID NO: 1884774 - protein, 19 aa, Staphylococcus
RIFATIIIGIIKFGIPMLI

SEQ ID NO: 1884775 - protein, 26 aa, Staphylococcus
RIFETTINGQFVFRPDNADFAGSYVQ

SEQ ID NO: 1884776 - protein, 19 aa, Staphylococcus
RIGEKKVFLIGLIGTAVLS

SEQ ID NO: 1884777 - protein, 23 aa, Staphylococcus
RIGGHPQFVRPLINPMVQGALRT

SEQ ID NO: 1884778 - protein, 19 aa, Staphylococcus
RIGNVSVYLILLVGIILGT

SEQ ID NO: 1884779 - protein, 22 aa, Staphylococcus
RIHAIPKYLFIIVATYIVTLGL

SEQ ID NO: 1884780 - protein, 19 aa, Staphylococcus
RIIATIIVGIIKFGIPMLI

SEQ ID NO: 1884781 - protein, 19 aa, Staphylococcus
RIIDYILVFFLFGISVTMI

SEQ ID NO: 1884782 - protein, 20 aa, Staphylococcus
RIIIILAISLVLAIAFFFGT

SEQ ID NO: 1884783 - protein, 18 aa, Staphylococcus
RIIKALIPEMEFKPAHIG

SEQ ID NO: 1884784 - protein, 20 aa, Staphylococcus
RIIKGPIILIILCLGLVLLQ

SEQ ID NO: 1884785 - protein, 23 aa, Staphylococcus
RIINGRLKKILLKVLPIVIFSAL

SEQ ID NO: 1884786 - protein, 25 aa, Staphylococcus
RIIPEKRKGEGIGYYALSVTTASAI

SEQ ID NO: 1884787 - protein, 18 aa, Staphylococcus
RIIQILLFVFFIVFLVLP

SEQ ID NO: 1884788 - protein, 19 aa, Staphylococcus
RIITIGATIAWILGAIALH

SEQ ID NO: 1884789 - protein, 23 aa, Staphylococcus
RIITVGAAISWVLGAIALHKILD

SEQ ID NO: 1884790 - protein, 18 aa, Staphylococcus
RIKDIFDIKEQGGSKDIQ

SEQ ID NO: 1884791 - protein, 21 aa, Staphylococcus
RIKDILPGRFNANYEDFNDIE

SEQ ID NO: 1884792 - protein, 24 aa, Staphylococcus
RIKQAKAYIWLVIITYIVYLIVDH

SEQ ID NO: 1884793 - protein, 18 aa, Staphylococcus
RIKRMLVDRPTLLKHTDD

SEQ ID NO: 1884794 - protein, 17 aa, Staphylococcus
RIKRPIFVGQLLIILSF

SEQ ID NO: 1884795 - protein, 17 aa, Staphylococcus
RIKSHPEVQKATHATSN

SEQ ID NO: 1884796 - protein, 19 aa, Staphylococcus
RILKDFKAQRDHIIAQAHL

SEQ ID NO: 1884797 - protein, 17 aa, Staphylococcus
RILLPLIVIIILFLTLY

SEQ ID NO: 1884798 - protein, 27 aa, Staphylococcus
RILLPNLMPAIIGGFFMALTYSLDDFT

SEQ ID NO: 1884799 - protein, 24 aa, Staphylococcus
RILSTFILCCLLFILMRKNLLKRY

SEQ ID NO: 1884800 - protein, 33 aa, Staphylococcus
RILTGVIIASFWPFLVVLGVHWGLVPIMIDNFA

SEQ ID NO: 1884801 - protein, 19 aa, Staphylococcus
RILYMANIAAKITVGINII

SEQ ID NO: 1884802 - protein, 17 aa, Staphylococcus
RIMTFAFIIWIIFHVGF

SEQ ID NO: 1884803 - protein, 21 aa, Staphylococcus
RINLPKCKLSYLSVGLLIPII

SEQ ID NO: 1884804 - protein, 19 aa, Staphylococcus
RIQFLKVRLGMQVVVSNIA

SEQ ID NO: 1884805 - protein, 18 aa, Staphylococcus
RIQHELIRLTSHPKAKAI

SEQ ID NO: 1884806 - protein, 18 aa, Staphylococcus
RIRTILCGLVGLVIICCL

SEQ ID NO: 1884807 - protein, 19 aa, Staphylococcus
RIRTLCTLLIPAVLALGNS

SEQ ID NO: 1884808 - protein, 20 aa, Staphylococcus
RISEQQFFMYSGLFTLIIGV

SEQ ID NO: 1884809 - protein, 25 aa, Staphylococcus
RISKNGTRYLFFDNMSFTAPTKQPI

SEQ ID NO: 1884810 - protein, 27 aa, Staphylococcus
RISKYQDFFLQFNWFQPLLIGLAALLI

SEQ ID NO: 1884811 - protein, 24 aa, Staphylococcus
RISNKNNYLGMAWELINPIMQIAV

SEQ ID NO: 1884812 - protein, 24 aa, Staphylococcus
RISNKSRYLVMAMWNIDTPGGIIC

SEQ ID NO: 1884813 - protein, 17 aa, Staphylococcus
RISSVATLEKVVFYNSL

SEQ ID NO: 1884814 - protein, 20 aa, Staphylococcus
RITKGFKQLIVFSIILGEAS

SEQ ID NO: 1884815 - protein, 18 aa, Staphylococcus
RITVVLRGMLLKRRVKTK

SEQ ID NO: 1884816 - protein, 17 aa, Staphylococcus
RIWYVLVSIVMVLTIAM

SEQ ID NO: 1884817 - protein, 18 aa, Staphylococcus
RIYMKQGRIETDDQDISI

SEQ ID NO: 1884818 - protein, 21 aa, Staphylococcus
RKAIEALYYNRYLKRHDEVID

SEQ ID NO: 1884819 - protein, 19 aa, Staphylococcus
RKAKSIAFRDVKNHFVRNE

SEQ ID NO: 1884820 - protein, 26 aa, Staphylococcus
RKAVEALYFNRYLKRNDQVIDARLGY

SEQ ID NO: 1884821 - protein, 25 aa, Staphylococcus
RKAVETLYFNRYLKENDEVIDARLG

SEQ ID NO: 1884822 - protein, 21 aa, Staphylococcus
RKAVETLYFNRYLKSGDEVMD

SEQ ID NO: 1884823 - protein, 24 aa, Staphylococcus
RKDKRQMIGIWAGIVLIIIAAFIL

SEQ ID NO: 1884824 - protein, 22 aa, Staphylococcus
RKDTVLYLMHMHKRISDKEYEK

SEQ ID NO: 1884825 - protein, 21 aa, Staphylococcus
RKEDESPKFAVRAVPKDKSEL

SEQ ID NO: 1884826 - protein, 26 aa, Staphylococcus
RKEEIKRLSIITGIVVVIFAIILLIL

SEQ ID NO: 1884827 - protein, 20 aa, Staphylococcus
RKEIQKMFVQEGIKLPQPMY

SEQ ID NO: 1884828 - protein, 24 aa, Staphylococcus
RKEPKRYIIPWALLGFCLVMVYQV

SEQ ID NO: 1884829 - protein, 26 aa, Staphylococcus
RKETVLYLMHYHHRISDKQWKEAKAT

SEQ ID NO: 1884830 - protein, 24 aa, Staphylococcus
RKFKCPNCGETHYCVEVLDDKKLN

SEQ ID NO: 1884831 - protein, 26 aa, Staphylococcus
RKFSVGITSILIGASVIFGANSEAHT

SEQ ID NO: 1884832 - protein, 23 aa, Staphylococcus
RKFYFCINLILPFLIITSILIFL

SEQ ID NO: 1884833 - protein, 19 aa, Staphylococcus
RKGQLPKIFTKVMKNGVPL

SEQ ID NO: 1884834 - protein, 24 aa, Staphylococcus
RKHAKFSGVFIYQDLKTIEDTNNA

SEQ ID NO: 1884835 - protein, 24 aa, Staphylococcus
RKHALLYEWSRINDMLDRQLFLTR

SEQ ID NO: 1884836 - protein, 17 aa, Staphylococcus
RKHIQWKSIGILVALNL

SEQ ID NO: 1884837 - protein, 27 aa, Staphylococcus
RKHLRIGETFFSYLIWYSIGRFFVEGL

SEQ ID NO: 1884838 - protein, 32 aa, Staphylococcus
RKIDVEPFFRFMKAIWGFPRISVRGINKTKRK

SEQ ID NO: 1884839 - protein, 19 aa, Staphylococcus
RKIEFNRAFTEIYGENEAG

SEQ ID NO: 1884840 - protein, 24 aa, Staphylococcus
RKIFYRLILPLSKRSIIAGIMMSF

SEQ ID NO: 1884841 - protein, 17 aa, Staphylococcus
RKIGLDMYKFWLEMGKI

SEQ ID NO: 1884842 - protein, 19 aa, Staphylococcus
RKIKELFVAHKVEKQYSKN

SEQ ID NO: 1884843 - protein, 17 aa, Staphylococcus
RKIKFGIVLPITVILGI

SEQ ID NO: 1884844 - protein, 24 aa, Staphylococcus
RKIKLNIWYIFALGVAAVVGLLTL

SEQ ID NO: 1884845 - protein, 22 aa, Staphylococcus
RKITIPIAVMFRFIPTIRMESA

SEQ ID NO: 1884846 - protein, 21 aa, Staphylococcus
RKKAFEIIKTLMPNMTFEKAT

SEQ ID NO: 1884847 - protein, 25 aa, Staphylococcus
RKKFEWPIFIIFALIFILLVPNTFY

SEQ ID NO: 1884848 - protein, 19 aa, Staphylococcus
RKKHIKRLSSGECTPEGGL

SEQ ID NO: 1884849 - protein, 18 aa, Staphylococcus
RKKIFKIPLVPYIFLSFL

SEQ ID NO: 1884850 - protein, 25 aa, Staphylococcus
RKKYEWPLFIIFGLIFVLLVPNTFY

SEQ ID NO: 1884851 - protein, 25 aa, Staphylococcus
RKLFPKMHIAMLIAALSMAGVPFLN

SEQ ID NO: 1884852 - protein, 18 aa, Staphylococcus
RKLGRLYKKAGIKHITVQ

SEQ ID NO: 1884853 - protein, 17 aa, Staphylococcus
RKLHAQFIPEFVGSLVI

SEQ ID NO: 1884854 - protein, 19 aa, Staphylococcus
RKLKELFVAHKVEQQYSKN

SEQ ID NO: 1884855 - protein, 19 aa, Staphylococcus
RKLKESRFNLSSHLMIWPM

SEQ ID NO: 1884856 - protein, 24 aa, Staphylococcus
RKLKLLSLIIRLLFGHRTFTHSLL

SEQ ID NO: 1884857 - protein, 21 aa, Staphylococcus
RKLKVPIFPIVARKAKGTNTL

SEQ ID NO: 1884858 - protein, 22 aa, Staphylococcus
RKLSWHKRDTLSLFSLIPIGMI

SEQ ID NO: 1884859 - protein, 17 aa, Staphylococcus
RKMPLVVSMFIFTLASF

SEQ ID NO: 1884860 - protein, 25 aa, Staphylococcus
RKNGYKDLYMLKGGYKKWTGKIKSK

SEQ ID NO: 1884861 - protein, 24 aa, Staphylococcus
RKNHYNFYSFIALRHHAERLHVTS

SEQ ID NO: 1884862 - protein, 36 aa, Staphylococcus
RKNIQWKSILILVILNLFLAWFFIYFPWGRNGVKGA

SEQ ID NO: 1884863 - protein, 37 aa, Staphylococcus
RKNIQWKSILILVVLNLFLAWFFVYFQIGRTIVEGLA

SEQ ID NO: 1884864 - protein, 24 aa, Staphylococcus
RKNKVEIVPAYGYPGYDDNFDYRY

SEQ ID NO: 1884865 - protein, 19 aa, Staphylococcus
RKPAIQVVNIFSLLFIFFS

SEQ ID NO: 1884866 - protein, 24 aa, Staphylococcus
RKQKAKIDALVGLTDEQKNKAKNM

SEQ ID NO: 1884867 - protein, 27 aa, Staphylococcus
RKQKQYRWLKISFIILALISVGLTIFA

SEQ ID NO: 1884868 - protein, 17 aa, Staphylococcus
RKQNEVNQLPNATTDEL

SEQ ID NO: 1884869 - protein, 20 aa, Staphylococcus
RKRIFLSGLVLFGISSLCIG

SEQ ID NO: 1884870 - protein, 22 aa, Staphylococcus
RKSEGISLFSLSLVLGSAIGPF

SEQ ID NO: 1884871 - protein, 21 aa, Staphylococcus
RKSHKIRVFGIYTLGIVWVLQ

SEQ ID NO: 1884872 - protein, 18 aa, Staphylococcus
RKSHYMWIIVTYGISYLI

SEQ ID NO: 1884873 - protein, 21 aa, Staphylococcus
RKSVNVWKSPISWQITILMGG

SEQ ID NO: 1884874 - protein, 17 aa, Staphylococcus
RKTILGILVAVVLAMGI

SEQ ID NO: 1884875 - protein, 19 aa, Staphylococcus
RKVAVKMIHIAPHEKEEMI

SEQ ID NO: 1884876 - protein, 25 aa, Staphylococcus
RKVEIKGVLEASGAVAYIAKDKYLG

SEQ ID NO: 1884877 - protein, 17 aa, Staphylococcus
RKVFAVGLLQDLNFTLK

SEQ ID NO: 1884878 - protein, 17 aa, Staphylococcus
RKVLSAAAMTYVAATAT

SEQ ID NO: 1884879 - protein, 22 aa, Staphylococcus
RKVVRKETNQDLVFPYASNETV

SEQ ID NO: 1884880 - protein, 17 aa, Staphylococcus
RKWSIWANLILPIDPIM

SEQ ID NO: 1884881 - protein, 18 aa, Staphylococcus
RKYLPIAFKYLLIHYGFG

SEQ ID NO: 1884882 - protein, 20 aa, Staphylococcus
RLAKAKAKAQEYVQTLSNLN

SEQ ID NO: 1884883 - protein, 21 aa, Staphylococcus
RLDEMYELIELEVKAKNDVEE

SEQ ID NO: 1884884 - protein, 19 aa, Staphylococcus
RLDLLELRMTHLEENEDTN

SEQ ID NO: 1884885 - protein, 22 aa, Staphylococcus
RLEEFIRPNARYDYQYQSYRSN

SEQ ID NO: 1884886 - protein, 32 aa, Staphylococcus
RLEKNQDGYRYYDFIDNVGIRSGSHLYISGRN

SEQ ID NO: 1884887 - protein, 19 aa, Staphylococcus
RLFLVLILFSGVWQVVEEF

SEQ ID NO: 1884888 - protein, 32 aa, Staphylococcus
RLFVEAFKELWLPILTICFILAISKITTYGGL

SEQ ID NO: 1884889 - protein, 19 aa, Staphylococcus
RLGAALTVVITVTGQILMG

SEQ ID NO: 1884890 - protein, 18 aa, Staphylococcus
RLGELSTLLYLLFPIISI

SEQ ID NO: 1884891 - protein, 22 aa, Staphylococcus
RLGNQYGGKLALIFDDGTEAEV

SEQ ID NO: 1884892 - protein, 20 aa, Staphylococcus
RLIAILPIIICLIVFNSNEA

SEQ ID NO: 1884893 - protein, 26 aa, Staphylococcus
RLIALVIGFGLCWPYVLLPYGFGQIF

SEQ ID NO: 1884894 - protein, 18 aa, Staphylococcus
RLIHFNGYAGLFGGTVAI

SEQ ID NO: 1884895 - protein, 19 aa, Staphylococcus
RLILATTIIFTGTYTYQNV

SEQ ID NO: 1884896 - protein, 20 aa, Staphylococcus
RLINGVLFIGIFIYLSTIPL

SEQ ID NO: 1884897 - protein, 17 aa, Staphylococcus
RLIQGICLAGLPSIAMA

SEQ ID NO: 1884898 - protein, 17 aa, Staphylococcus
RLISHGNAFLNTMRQLA

SEQ ID NO: 1884899 - protein, 23 aa, Staphylococcus
RLKLDPIMALAITFLPLYMAFSV

SEQ ID NO: 1884900 - protein, 26 aa, Staphylococcus
RLLAACGFVGAVAWTIYQFTVDMDLG

SEQ ID NO: 1884901 - protein, 29 aa, Staphylococcus
RLLATSIRRSEIVFGYLIGYGAFAIVQTL

SEQ ID NO: 1884902 - protein, 31 aa, Staphylococcus
RLLLVFYAFFALCIISMILSILTIIFNRSAL

SEQ ID NO: 1884903 - protein, 19 aa, Staphylococcus
RLLPAVLALLIVVGLATLI

SEQ ID NO: 1884904 - protein, 17 aa, Staphylococcus
RLLSNRANLMALWHVED

SEQ ID NO: 1884905 - protein, 24 aa, Staphylococcus
RLLSPKIGIFWLLLFIFLQVTLSL

SEQ ID NO: 1884906 - protein, 20 aa, Staphylococcus
RLLSQRAVCAIAELQENNRF

SEQ ID NO: 1884907 - protein, 19 aa, Staphylococcus
RLLSQRVVRSLAELDEAQR

SEQ ID NO: 1884908 - protein, 20 aa, Staphylococcus
RLLTFLSIFIIANIISLAVY

SEQ ID NO: 1884909 - protein, 25 aa, Staphylococcus
RLLYSGRVSMVFGITTTLGILIIGI

SEQ ID NO: 1884910 - protein, 24 aa, Staphylococcus
RLNGKELLGYARFRHDAEGDFGRV

SEQ ID NO: 1884911 - protein, 17 aa, Staphylococcus
RLNISVVIISIVVIFVL

SEQ ID NO: 1884912 - protein, 17 aa, Staphylococcus
RLNNVSFKYNTEMGHGF

SEQ ID NO: 1884913 - protein, 26 aa, Staphylococcus
RLNSVVIKLWLTIIFIVTTVLILLSA

SEQ ID NO: 1884914 - protein, 17 aa, Staphylococcus
RLPDKKTLRNSVIGGAF

SEQ ID NO: 1884915 - protein, 20 aa, Staphylococcus
RLRFQKWHATLGIIIAIPVF

SEQ ID NO: 1884916 - protein, 20 aa, Staphylococcus
RLRPMKFLYQKTVNGNWEIN

SEQ ID NO: 1884917 - protein, 17 aa, Staphylococcus
RLSGLKKVFPITHIVML

SEQ ID NO: 1884918 - protein, 21 aa, Staphylococcus
RLSNLFGIAGFIVDGYNGIKY

SEQ ID NO: 1884919 - protein, 24 aa, Staphylococcus
RLTGAEILESIILGVIFSSVLIWT

SEQ ID NO: 1884920 - protein, 20 aa, Staphylococcus
RLTGIEILESFVLGVLFSTV

SEQ ID NO: 1884921 - protein, 24 aa, Staphylococcus
RLTGMEIIEAIILGVLFSTVLIWT

SEQ ID NO: 1884922 - protein, 19 aa, Staphylococcus
RLTGMEMLESLILGVLFST

SEQ ID NO: 1884923 - protein, 24 aa, Staphylococcus
RLTGTEILESIILGVLFSSVLIWT

SEQ ID NO: 1884924 - protein, 17 aa, Staphylococcus
RLTIILAVIFFLIMIGI

SEQ ID NO: 1884925 - protein, 19 aa, Staphylococcus
RLTLICFVLSIFISILSYN

SEQ ID NO: 1884926 - protein, 18 aa, Staphylococcus
RLVGQSGMSYGALGRNAI

SEQ ID NO: 1884927 - protein, 24 aa, Staphylococcus
RLVKEKRIRREDMHIMANIFLPSN

SEQ ID NO: 1884928 - protein, 21 aa, Staphylococcus
RLVPILTAFFCTFIAVILLFV

SEQ ID NO: 1884929 - protein, 17 aa, Staphylococcus
RLVPILTAFFSIILAVI

SEQ ID NO: 1884930 - protein, 19 aa, Staphylococcus
RMALFISPIWFIFLFLFYR

SEQ ID NO: 1884931 - protein, 27 aa, Staphylococcus
RMDNKNYRGTTDYYIHDNTVERSGANG

SEQ ID NO: 1884932 - protein, 25 aa, Staphylococcus
RMEHEYSKNEILSFYINNIYYGDNQ

SEQ ID NO: 1884933 - protein, 21 aa, Staphylococcus
RMFKILDHYQPYVVYHAAAHK

SEQ ID NO: 1884934 - protein, 18 aa, Staphylococcus
RMHKRIDVTYSLRNSVSH

SEQ ID NO: 1884935 - protein, 23 aa, Staphylococcus
RMIELPLALSVIIGGLRIALVVA

SEQ ID NO: 1884936 - protein, 24 aa, Staphylococcus
RMIELPLSLSVILGGLRIALVVAI

SEQ ID NO: 1884937 - protein, 18 aa, Staphylococcus
RMIFGTGSVFAFPGSMVG

SEQ ID NO: 1884938 - protein, 20 aa, Staphylococcus
RMILIGVAMYAMLTGVLDLL

SEQ ID NO: 1884939 - protein, 24 aa, Staphylococcus
RMITVGAAIAWILGAVALHYILDF

SEQ ID NO: 1884940 - protein, 22 aa, Staphylococcus
RMKEPFLNVRVFSYKSFTMNMI

SEQ ID NO: 1884941 - protein, 19 aa, Staphylococcus
RMKFFPFIIFIFLWVILIY

SEQ ID NO: 1884942 - protein, 22 aa, Staphylococcus
RMKRGNFSPREMGFNLFINLLN

SEQ ID NO: 1884943 - protein, 22 aa, Staphylococcus
RMKRGQFSPREMGFNLFINLLN

SEQ ID NO: 1884944 - protein, 27 aa, Staphylococcus
RMMIPNLFSLLASIVVLWLYFRKSIPK

SEQ ID NO: 1884945 - protein, 26 aa, Staphylococcus
RMMIPNLFSLLASIVVLWLYFRKVIP

SEQ ID NO: 1884946 - protein, 17 aa, Staphylococcus
RMNEMRVLTLAMMSMSS

SEQ ID NO: 1884947 - protein, 21 aa, Staphylococcus
RMRFFPFMIFIFIWVLVIYSP

SEQ ID NO: 1884948 - protein, 32 aa, Staphylococcus
RMRVVRRRVTVFGGLLLAIIIILSIMLVFQKQ

SEQ ID NO: 1884949 - protein, 24 aa, Staphylococcus
RMSALKGMIISAFIVTFLGVFVWG

SEQ ID NO: 1884950 - protein, 18 aa, Staphylococcus
RMTDEYVDLLNLRKNKTY

SEQ ID NO: 1884951 - protein, 19 aa, Staphylococcus
RMTLIPALTKLFGKASWYL

SEQ ID NO: 1884952 - protein, 20 aa, Staphylococcus
RMTPIFAISEGWVWTITLVG

SEQ ID NO: 1884953 - protein, 24 aa, Staphylococcus
RMTPLFAVSQGWIWTVTLVGLITL

SEQ ID NO: 1884954 - protein, 20 aa, Staphylococcus
RMVSAGADLARGIARGIMNM

SEQ ID NO: 1884955 - protein, 24 aa, Staphylococcus
RMYEYKTTSSFNYKKGDKIGTPGF

SEQ ID NO: 1884956 - protein, 23 aa, Staphylococcus
RMYKEIIAYSIPFVIVSLNFPLF

SEQ ID NO: 1884957 - protein, 19 aa, Staphylococcus
RNALFNHIFTWVFVAIGLL

SEQ ID NO: 1884958 - protein, 18 aa, Staphylococcus
RNDLPGVEKDLAKADKLF

SEQ ID NO: 1884959 - protein, 19 aa, Staphylococcus
RNEKGRYQLPNTGINNDTS

SEQ ID NO: 1884960 - protein, 19 aa, Staphylococcus
RNFAPIIILSIIYFVHKLI

SEQ ID NO: 1884961 - protein, 20 aa, Staphylococcus
RNFGKEAAMIAGFQHSVNVD

SEQ ID NO: 1884962 - protein, 19 aa, Staphylococcus
RNFGKEAAMIAGYQNSTAH

SEQ ID NO: 1884963 - protein, 30 aa, Staphylococcus
RNFIFLIGIFCFFKGFIGFFIGGDNNEVYL

SEQ ID NO: 1884964 - protein, 19 aa, Staphylococcus
RNFLRNIKHYAIYMFSLVI

SEQ ID NO: 1884965 - protein, 24 aa, Staphylococcus
RNGVKGAANGIAWVIESAHKGTGF

SEQ ID NO: 1884966 - protein, 21 aa, Staphylococcus
RNHKLHYSLVLGWLLSLCGAM

SEQ ID NO: 1884967 - protein, 25 aa, Staphylococcus
RNIGPKGKFKPFILYGTVPLAIVTV

SEQ ID NO: 1884968 - protein, 17 aa, Staphylococcus
RNIKGDAFISIHNDSLD

SEQ ID NO: 1884969 - protein, 19 aa, Staphylococcus
RNIKGDAFISIHNDSLDSS

SEQ ID NO: 1884970 - protein, 27 aa, Staphylococcus
RNKAYKQIDVYVMKALNKLAENVTTND

SEQ ID NO: 1884971 - protein, 22 aa, Staphylococcus
RNKIFFTLAMLIIFKIGTYIPA

SEQ ID NO: 1884972 - protein, 18 aa, Staphylococcus
RNKLAVVGMIGLIIIILL

SEQ ID NO: 1884973 - protein, 23 aa, Staphylococcus
RNKRGITFGLFRLSVGLEDPEEI

SEQ ID NO: 1884974 - protein, 17 aa, Staphylococcus
RNLGFFSAISIVMGTVI

SEQ ID NO: 1884975 - protein, 28 aa, Staphylococcus
RNLMDKRINFFFGLVVIVFVIIVLRLGY

SEQ ID NO: 1884976 - protein, 25 aa, Staphylococcus
RNMDHVLSILPWFIVTVPLILFLAQ

SEQ ID NO: 1884977 - protein, 32 aa, Staphylococcus
RNNDKSANTAPSWKGNIYNNLTRTDTESSDEK

SEQ ID NO: 1884978 - protein, 18 aa, Staphylococcus
RNNFKKVQHIIRIVNRQV

SEQ ID NO: 1884979 - protein, 18 aa, Staphylococcus
RNPIVLKLISVLFTVIMG

SEQ ID NO: 1884980 - protein, 27 aa, Staphylococcus
RNPKPRFPLFKTIVIAIVAGIIGALIV

SEQ ID NO: 1884981 - protein, 18 aa, Staphylococcus
RNRAKFANTVLRSMFSFG

SEQ ID NO: 1884982 - protein, 26 aa, Staphylococcus
RNRRSASSTWAWLFVLFVLPLIGFIL

SEQ ID NO: 1884983 - protein, 24 aa, Staphylococcus
RNSIEAMAAFLNSFPMFKDDTRNI

SEQ ID NO: 1884984 - protein, 24 aa, Staphylococcus
RNSLLSESPSDFIIDPDNSTQTID

SEQ ID NO: 1884985 - protein, 19 aa, Staphylococcus
RNTIILVMLSSAFVAMLNQ

SEQ ID NO: 1884986 - protein, 24 aa, Staphylococcus
RNTLKGALPVGFLGIGEPLIYGVT

SEQ ID NO: 1884987 - protein, 27 aa, Staphylococcus
RNTMNHRINFIFGLIVFIFVIIVLRLG

SEQ ID NO: 1884988 - protein, 28 aa, Staphylococcus
RNTMNKRISFIFGIIVFIFAIIVLRLGY

SEQ ID NO: 1884989 - protein, 21 aa, Staphylococcus
RNVDSILRWESIILDPIGPML

SEQ ID NO: 1884990 - protein, 19 aa, Staphylococcus
RNVQGFVDDNGFIDSSKIN

SEQ ID NO: 1884991 - protein, 18 aa, Staphylococcus
RNWLDTRAFSKKFVPVVM

SEQ ID NO: 1884992 - protein, 17 aa, Staphylococcus
RNYKLRYMPGLDGLRAI

SEQ ID NO: 1884993 - protein, 37 aa, Staphylococcus
RNYLYGAIPWALSRAIPVFLGLFFGGGVVKNIVNYLN

SEQ ID NO: 1884994 - protein, 18 aa, Staphylococcus
RPFRFRKLVLMLILSVIV

SEQ ID NO: 1884995 - protein, 19 aa, Staphylococcus
RPFRLKRLIFTIILSMLVL

SEQ ID NO: 1884996 - protein, 26 aa, Staphylococcus
RPIFHFSWSEYSLWLLAHIIFIVCVA

SEQ ID NO: 1884997 - protein, 19 aa, Staphylococcus
RPIGGIVFGVIGDKYGRKV

SEQ ID NO: 1884998 - protein, 19 aa, Staphylococcus
RPKVHPLIKPKAVDPREDE

SEQ ID NO: 1884999 - protein, 20 aa, Staphylococcus
RPLHKKDILTIIVFAILSLI

SEQ ID NO: 1885000 - protein, 20 aa, Staphylococcus
RPLIDELLFRHLLIHELGKK

SEQ ID NO: 1885001 - protein, 20 aa, Staphylococcus
RPLPNELIEMLDFIIDKIRH

SEQ ID NO: 1885002 - protein, 23 aa, Staphylococcus
RPLRMRHIVAMFVVSALMLILNH

SEQ ID NO: 1885003 - protein, 18 aa, Staphylococcus
RPMSAKKQIGFALSVSLL

SEQ ID NO: 1885004 - protein, 24 aa, Staphylococcus
RPNTASKSFGVFTGVFNVPNNVSR

SEQ ID NO: 1885005 - protein, 18 aa, Staphylococcus
RPSIGLGLINLSDIPDRY

SEQ ID NO: 1885006 - protein, 31 aa, Staphylococcus
RPVGRLTEKVLGWFSWVFLLILTIVTMFIAL

SEQ ID NO: 1885007 - protein, 21 aa, Staphylococcus
RPYFHMIWHFFIIVASVFHFV

SEQ ID NO: 1885008 - protein, 21 aa, Staphylococcus
RPYFHMIWHIFILIASFFHLI

SEQ ID NO: 1885009 - protein, 21 aa, Staphylococcus
RPYFHMIWHIFIVIASLFHFI

SEQ ID NO: 1885010 - protein, 21 aa, Staphylococcus
RPYFHMIWHIFIVIASMFHLI

SEQ ID NO: 1885011 - protein, 21 aa, Staphylococcus
RPYFHMIWHIFIVIASVLHMI

SEQ ID NO: 1885012 - protein, 19 aa, Staphylococcus
RQAFSLALILGAILFNVFG

SEQ ID NO: 1885013 - protein, 17 aa, Staphylococcus
RQAMNKIQFVYKTLNND

SEQ ID NO: 1885014 - protein, 17 aa, Staphylococcus
RQHFKIDYGNEIEEAIE

SEQ ID NO: 1885015 - protein, 25 aa, Staphylococcus
RQHGDLKFSRIVGMAGESVEVKQGQ

SEQ ID NO: 1885016 - protein, 25 aa, Staphylococcus
RQIALVIGFGLCFPYFLMPFGFGQI

SEQ ID NO: 1885017 - protein, 26 aa, Staphylococcus
RQIYMGKAGFFFLLGIIQALIVSIGD

SEQ ID NO: 1885018 - protein, 18 aa, Staphylococcus
RQLIKLVVSAVLAAPLLM

SEQ ID NO: 1885019 - protein, 21 aa, Staphylococcus
RQLLPKEVRDDHRFYPTQKEQ

SEQ ID NO: 1885020 - protein, 19 aa, Staphylococcus
RQPFLALIVGGSLTIAMTV

SEQ ID NO: 1885021 - protein, 22 aa, Staphylococcus
RQPKFESFFGVEMMFLGNTEAL

SEQ ID NO: 1885022 - protein, 17 aa, Staphylococcus
RQPKFESFFSIEMMFLG

SEQ ID NO: 1885023 - protein, 25 aa, Staphylococcus
RQPSLPIKFVIGAGLAGISYILIGL

SEQ ID NO: 1885024 - protein, 25 aa, Staphylococcus
RQPSLPMKFVIGALMAGASYIMMGI

SEQ ID NO: 1885025 - protein, 18 aa, Staphylococcus
RQQMLLNIVIGGTIMVLS

SEQ ID NO: 1885026 - protein, 24 aa, Staphylococcus
RQRAERKLPKFVLYALLVIGIVTL

SEQ ID NO: 1885027 - protein, 22 aa, Staphylococcus
RQRALSFWSIGSWGGSGFASLF

SEQ ID NO: 1885028 - protein, 18 aa, Staphylococcus
RQRHPFIDFSLFSNKVYI

SEQ ID NO: 1885029 - protein, 17 aa, Staphylococcus
RQRLTMVVLNGIIGYCV

SEQ ID NO: 1885030 - protein, 35 aa, Staphylococcus
RQSIMKRFKSLAIGSFKYNPFIIEQVNKLGESGNQ

SEQ ID NO: 1885031 - protein, 21 aa, Staphylococcus
RQSKIPAVLLELGYISNPTDE

SEQ ID NO: 1885032 - protein, 18 aa, Staphylococcus
RQSLPISTLYTGVGVLRT

SEQ ID NO: 1885033 - protein, 18 aa, Staphylococcus
RQSLPISTLYTGVGVLST

SEQ ID NO: 1885034 - protein, 17 aa, Staphylococcus
RQTISIWFRHLFTFNPN

SEQ ID NO: 1885035 - protein, 18 aa, Staphylococcus
RQTISIWFRHLFTFSPDA

SEQ ID NO: 1885036 - protein, 17 aa, Staphylococcus
RQTISIWFRHLFTFSPN

SEQ ID NO: 1885037 - protein, 21 aa, Staphylococcus
RQTYNSGISFLAPIIGGILIA

SEQ ID NO: 1885038 - protein, 19 aa, Staphylococcus
RQVFLTAIFIFFIGTIIAG

SEQ ID NO: 1885039 - protein, 20 aa, Staphylococcus
RQVFLTGILIFFIGTMLGGF

SEQ ID NO: 1885040 - protein, 17 aa, Staphylococcus
RQVLRKYWLQIFGGIAV

SEQ ID NO: 1885041 - protein, 19 aa, Staphylococcus
RQYDLKGILAYSTISQLGM

SEQ ID NO: 1885042 - protein, 22 aa, Staphylococcus
RQYDLKGILAYSTISQLGMMMS

SEQ ID NO: 1885043 - protein, 17 aa, Staphylococcus
RQYDLKGILAYSTVSQL

SEQ ID NO: 1885044 - protein, 18 aa, Staphylococcus
RQYFPLFTLITVFASVAW

SEQ ID NO: 1885045 - protein, 19 aa, Staphylococcus
RQYMKVLVGLQIVSTSFFL

SEQ ID NO: 1885046 - protein, 25 aa, Staphylococcus
RQYRIAIHHYLKFMIIIVMVSVMLY

SEQ ID NO: 1885047 - protein, 18 aa, Staphylococcus
RQYRNVFLLMVIVGLFGA

SEQ ID NO: 1885048 - protein, 19 aa, Staphylococcus
RRAEEDEFRNRAQSPNKMN

SEQ ID NO: 1885049 - protein, 22 aa, Staphylococcus
RRALEQLGRGSLFKRYTNTYSH

SEQ ID NO: 1885050 - protein, 22 aa, Staphylococcus
RRALEQLGRGSLFKRYTNTYSR

SEQ ID NO: 1885051 - protein, 22 aa, Staphylococcus
RRDDSGMWWIGPGSGGFGNGSS

SEQ ID NO: 1885052 - protein, 18 aa, Staphylococcus
RREFVANVSHELRTPLTS

SEQ ID NO: 1885053 - protein, 25 aa, Staphylococcus
RREILGGLTTFLSMAYILAVNPQVL

SEQ ID NO: 1885054 - protein, 27 aa, Staphylococcus
RREPELPRPYKVPLYPFIPGIALIAGI

SEQ ID NO: 1885055 - protein, 30 aa, Staphylococcus
RRFIYRYSIWCAGLFILGVLFAFYIGFPLV

SEQ ID NO: 1885056 - protein, 17 aa, Staphylococcus
RRFLLAIWLPTTVASAG

SEQ ID NO: 1885057 - protein, 19 aa, Staphylococcus
RRFREIKGKNINNLQDSTL

SEQ ID NO: 1885058 - protein, 18 aa, Staphylococcus
RRIELCRLLVMQPDLVVL

SEQ ID NO: 1885059 - protein, 25 aa, Staphylococcus
RRIFPWDFKILIGIGLVFCVTTPIA

SEQ ID NO: 1885060 - protein, 20 aa, Staphylococcus
RRIGPVASIIWFFTGITGVA

SEQ ID NO: 1885061 - protein, 20 aa, Staphylococcus
RRKELFKSIIKTLINNSDDE

SEQ ID NO: 1885062 - protein, 24 aa, Staphylococcus
RRKNRKKWYLPYGYDAEDIELNNV

SEQ ID NO: 1885063 - protein, 20 aa, Staphylococcus
RRLPATVIGALFAVIFTYIF

SEQ ID NO: 1885064 - protein, 20 aa, Staphylococcus
RRLPATVIGALFAVLFTFIF

SEQ ID NO: 1885065 - protein, 19 aa, Staphylococcus
RRLPATVIGALFAVVFTFI

SEQ ID NO: 1885066 - protein, 27 aa, Staphylococcus
RRLTKVELPIAMPVIMAGIRTAMVLII

SEQ ID NO: 1885067 - protein, 19 aa, Staphylococcus
RRLYDHLQALSARFYSNNK

SEQ ID NO: 1885068 - protein, 20 aa, Staphylococcus
RRLYVKEGHLIKDDNRISTQ

SEQ ID NO: 1885069 - protein, 17 aa, Staphylococcus
RRNDVDWSSDDRKDNNF

SEQ ID NO: 1885070 - protein, 21 aa, Staphylococcus
RRNKLAVIGMIGLILIIIMAL

SEQ ID NO: 1885071 - protein, 22 aa, Staphylococcus
RRPTTMAGFLADYWWTIFPVGG

SEQ ID NO: 1885072 - protein, 27 aa, Staphylococcus
RRQIAIIIGFGLCWPYVLLPFGFGQIF

SEQ ID NO: 1885073 - protein, 20 aa, Staphylococcus
RRQQELAMNMILGMEKKHFR

SEQ ID NO: 1885074 - protein, 17 aa, Staphylococcus
RRQRRRNQSSSRNKKFN

SEQ ID NO: 1885075 - protein, 20 aa, Staphylococcus
RRRPVLMVMLPLAFIFTISI

SEQ ID NO: 1885076 - protein, 19 aa, Staphylococcus
RRSEYWFMALWNIIFMMPA

SEQ ID NO: 1885077 - protein, 17 aa, Staphylococcus
RRSKCDHCGRKLGWFEL

SEQ ID NO: 1885078 - protein, 21 aa, Staphylococcus
RRVVLPAAIPGILTGFILALS

SEQ ID NO: 1885079 - protein, 18 aa, Staphylococcus
RRYINTLMIISWIQLICG

SEQ ID NO: 1885080 - protein, 20 aa, Staphylococcus
RSAILLAAVMNFIGALTFTG

SEQ ID NO: 1885081 - protein, 27 aa, Staphylococcus
RSAYEILSALILAWSLMVSWNQMVAFS

SEQ ID NO: 1885082 - protein, 19 aa, Staphylococcus
RSAYIKSYFAFYGILIFIG

SEQ ID NO: 1885083 - protein, 34 aa, Staphylococcus
RSDLIYAEMLQWLLDTVVSFGLVFGFVLMFVLKY

SEQ ID NO: 1885084 - protein, 21 aa, Staphylococcus
RSEFWFMQLWHLIFYGPALIL

SEQ ID NO: 1885085 - protein, 23 aa, Staphylococcus
RSEYWFMQLWHLIFMCPAIILMI

SEQ ID NO: 1885086 - protein, 26 aa, Staphylococcus
RSFFHFSWNEYGLWMIAHIIFMILMA

SEQ ID NO: 1885087 - protein, 27 aa, Staphylococcus
RSFISPSVVVGPNFYMGIGTPGGNKIP

SEQ ID NO: 1885088 - protein, 21 aa, Staphylococcus
RSFSILKGSDLSMVYDNGSDI

SEQ ID NO: 1885089 - protein, 33 aa, Staphylococcus
RSHCDYCYRQLRIYEMIPIFSFLFQRGKTTCCN

SEQ ID NO: 1885090 - protein, 21 aa, Staphylococcus
RSIIIPLKAVLGFVLSLAATL

SEQ ID NO: 1885091 - protein, 17 aa, Staphylococcus
RSIIPPLVMIALTVVIF

SEQ ID NO: 1885092 - protein, 34 aa, Staphylococcus
RSIKKRMTLTFSVSVCLLFIFAYLNLATGTLNIQ

SEQ ID NO: 1885093 - protein, 17 aa, Staphylococcus
RSILAGIMMSFARAIGE

SEQ ID NO: 1885094 - protein, 21 aa, Staphylococcus
RSILVPLKAVLGFVLSLLATL

SEQ ID NO: 1885095 - protein, 18 aa, Staphylococcus
RSIPNRHRTRLDVDGNPA

SEQ ID NO: 1885096 - protein, 24 aa, Staphylococcus
RSKKKKFAIALILLLLVASLFGFI

SEQ ID NO: 1885097 - protein, 27 aa, Staphylococcus
RSKLLEYRKPVILMAMALVFTTVIGVG

SEQ ID NO: 1885098 - protein, 25 aa, Staphylococcus
RSKMDGKEAMAFIRSRKEDGAGGDF

SEQ ID NO: 1885099 - protein, 18 aa, Staphylococcus
RSLLITGMAIRFITMCIV

SEQ ID NO: 1885100 - protein, 30 aa, Staphylococcus
RSLLTFICAFYYFRYLKLKQAPLMIATILY

SEQ ID NO: 1885101 - protein, 21 aa, Staphylococcus
RSMGANTWTIIRKVLIPEARP

SEQ ID NO: 1885102 - protein, 19 aa, Staphylococcus
RSMGMVRLVSGMTFANNPL

SEQ ID NO: 1885103 - protein, 26 aa, Staphylococcus
RSPQKRLGAAVGWFWFVFTGGLSVLG

SEQ ID NO: 1885104 - protein, 17 aa, Staphylococcus
RSPVYVYKWEDLQIQHG

SEQ ID NO: 1885105 - protein, 23 aa, Staphylococcus
RSQWQLIIIFGCFSMISNFTGIQ

SEQ ID NO: 1885106 - protein, 17 aa, Staphylococcus
RSRCEKCNHTLQFLDLI

SEQ ID NO: 1885107 - protein, 22 aa, Staphylococcus
RSRGMFRLVSGMTFANNPLNMM

SEQ ID NO: 1885108 - protein, 23 aa, Staphylococcus
RSRKDGFNPMRIILAGAAVSAML

SEQ ID NO: 1885109 - protein, 19 aa, Staphylococcus
RSRLVKVFIAFIVATIIVY

SEQ ID NO: 1885110 - protein, 17 aa, Staphylococcus
RSRYRLVRRPRQARPGA

SEQ ID NO: 1885111 - protein, 20 aa, Staphylococcus
RSSAIAMMFTGLTVATITGA

SEQ ID NO: 1885112 - protein, 18 aa, Staphylococcus
RSSFAIVVGSLWLFINDA

SEQ ID NO: 1885113 - protein, 17 aa, Staphylococcus
RSSFLHYGLHPWAVYGI

SEQ ID NO: 1885114 - protein, 17 aa, Staphylococcus
RSTFFHWGFHAWATYGV

SEQ ID NO: 1885115 - protein, 18 aa, Staphylococcus
RSTIKVILIVSLLLLSMS

SEQ ID NO: 1885116 - protein, 25 aa, Staphylococcus
RSTMLKLAIPGAIFGFLGAAFLTHI

SEQ ID NO: 1885117 - protein, 19 aa, Staphylococcus
RSYSLYLWHFPIIVLMNSY

SEQ ID NO: 1885118 - protein, 27 aa, Staphylococcus
RSYTSPTIIVGPDFYMGIGTPGGNKIP

SEQ ID NO: 1885119 - protein, 20 aa, Staphylococcus
RTAIFLAAIMNFIGALTFTG

SEQ ID NO: 1885120 - protein, 19 aa, Staphylococcus
RTAIFLAAVMNFIGALTFT

SEQ ID NO: 1885121 - protein, 19 aa, Staphylococcus
RTAILLAAVMNFIGALAFT

SEQ ID NO: 1885122 - protein, 19 aa, Staphylococcus
RTAILLASVMNFIGALTFT

SEQ ID NO: 1885123 - protein, 26 aa, Staphylococcus
RTAMFTKEHQEGIRALGPNAEDAYLN

SEQ ID NO: 1885124 - protein, 19 aa, Staphylococcus
RTGIKLLGFVVPVIVTAGL

SEQ ID NO: 1885125 - protein, 18 aa, Staphylococcus
RTGLFYNTFVQPMDRLLH

SEQ ID NO: 1885126 - protein, 31 aa, Staphylococcus
RTGLYIIDSKLLKGHVYNGISGNQFNELPMM

SEQ ID NO: 1885127 - protein, 17 aa, Staphylococcus
RTGSIIGTFVFPIILAT

SEQ ID NO: 1885128 - protein, 28 aa, Staphylococcus
RTIITFICAFYYFRYLKLSSTPLLIATI

SEQ ID NO: 1885129 - protein, 24 aa, Staphylococcus
RTIKEFILGVLFAPALVSFFFFAV

SEQ ID NO: 1885130 - protein, 34 aa, Staphylococcus
RTILICAITVLVGFAALFFVEFSLFRSAMGIAVG

SEQ ID NO: 1885131 - protein, 25 aa, Staphylococcus
RTILTLKGYRYIAAVVSFLEVLVYV

SEQ ID NO: 1885132 - protein, 25 aa, Staphylococcus
RTILTLKGYRYVAAIVSFVEVLIYV

SEQ ID NO: 1885133 - protein, 25 aa, Staphylococcus
RTILTLKGYRYVAAVVSFLEVLVYV

SEQ ID NO: 1885134 - protein, 21 aa, Staphylococcus
RTIMFFPIFYLGYLFTNKHIQ

SEQ ID NO: 1885135 - protein, 24 aa, Staphylococcus
RTITDLRPAGIISCEDDRIDAVSD

SEQ ID NO: 1885136 - protein, 29 aa, Staphylococcus
RTITFPLLRPGIISGWILIFCISMRELVA

SEQ ID NO: 1885137 - protein, 20 aa, Staphylococcus
RTIVFFPIFYVGYLTTRAHT

SEQ ID NO: 1885138 - protein, 21 aa, Staphylococcus
RTIYIAMLFHAAMTFAQVFLF

SEQ ID NO: 1885139 - protein, 23 aa, Staphylococcus
RTKGERGYLTSLIKLLNEVEKQT

SEQ ID NO: 1885140 - protein, 27 aa, Staphylococcus
RTKLLEYRKPIILMAMALVFTTVIGVG

SEQ ID NO: 1885141 - protein, 18 aa, Staphylococcus
RTKLWSLRPHYRVFIDEE

SEQ ID NO: 1885142 - protein, 23 aa, Staphylococcus
RTKWIAMPARFVLNIVRTIPDLL

SEQ ID NO: 1885143 - protein, 18 aa, Staphylococcus
RTMIQFLLSIVIIFVVAH

SEQ ID NO: 1885144 - protein, 22 aa, Staphylococcus
RTNKMDFTVTWKVNPSASASGH

SEQ ID NO: 1885145 - protein, 18 aa, Staphylococcus
RTNRMLAYYFGGFANAEM

SEQ ID NO: 1885146 - protein, 23 aa, Staphylococcus
RTNTISGVATKVGTYPIIVTSTD

SEQ ID NO: 1885147 - protein, 24 aa, Staphylococcus
RTNTISGVVTKVGTYPIIVTSTDA

SEQ ID NO: 1885148 - protein, 27 aa, Staphylococcus
RTNTLGVICGLALGIIFAYIFNGIGGG

SEQ ID NO: 1885149 - protein, 19 aa, Staphylococcus
RTPEIDMTRWALAGRNIGQ

SEQ ID NO: 1885150 - protein, 30 aa, Staphylococcus
RTPTVDIKKILRGVSTFRTATATANPDKGH

SEQ ID NO: 1885151 - protein, 18 aa, Staphylococcus
RTQTYAVNHLDNLNQAQK

SEQ ID NO: 1885152 - protein, 23 aa, Staphylococcus
RTRATSFIIPGFFAIGVSIVVGF

SEQ ID NO: 1885153 - protein, 29 aa, Staphylococcus
RTRGKQGTGLGLFICKMIIEEHGGTITVS

SEQ ID NO: 1885154 - protein, 24 aa, Staphylococcus
RTRGKQGTGLGLFISKMIIQEHGG

SEQ ID NO: 1885155 - protein, 24 aa, Staphylococcus
RTRQDGFNPIRIILTGAAVSAFLT

SEQ ID NO: 1885156 - protein, 26 aa, Staphylococcus
RTRRKEFWPSVLITWGLVIVAYFLIA

SEQ ID NO: 1885157 - protein, 22 aa, Staphylococcus
RTRRRDFWWPFFINAIIEVIVF

SEQ ID NO: 1885158 - protein, 21 aa, Staphylococcus
RTSIDELPQLFNILKGDMSVV

SEQ ID NO: 1885159 - protein, 25 aa, Staphylococcus
RTSISDGITKFIYRKVNTSQTSSTA

SEQ ID NO: 1885160 - protein, 19 aa, Staphylococcus
RTSKVFGIPVSQLNNKNIN

SEQ ID NO: 1885161 - protein, 18 aa, Staphylococcus
RTSNLVSRKNRLIAALSQ

SEQ ID NO: 1885162 - protein, 24 aa, Staphylococcus
RTSNQQSLIRRFNSLAEGSYKYNP

SEQ ID NO: 1885163 - protein, 24 aa, Staphylococcus
RTSTDLRPAGIILINDERIDAVSD

SEQ ID NO: 1885164 - protein, 28 aa, Staphylococcus
RTSYRLLHWRLRDTFALLTLIPIAIILY

SEQ ID NO: 1885165 - protein, 17 aa, Staphylococcus
RTTFFWINVTRVVLIAA

SEQ ID NO: 1885166 - protein, 19 aa, Staphylococcus
RTVGFKLSYAHLIINIALG

SEQ ID NO: 1885167 - protein, 27 aa, Staphylococcus
RTVITFICTFYFFKYIKLKPLAIIVAT

SEQ ID NO: 1885168 - protein, 19 aa, Staphylococcus
RTVRYGYTAAFILIILQVV

SEQ ID NO: 1885169 - protein, 17 aa, Staphylococcus
RTVRYGYTAAFILVILQ

SEQ ID NO: 1885170 - protein, 24 aa, Staphylococcus
RTVTDLRPAGIITLDNERIDAVSD

SEQ ID NO: 1885171 - protein, 19 aa, Staphylococcus
RTWYWAISIIMILALSMSG

SEQ ID NO: 1885172 - protein, 22 aa, Staphylococcus
RTYPFKGHYMNYVFKKDEQYYI

SEQ ID NO: 1885173 - protein, 18 aa, Staphylococcus
RTYYYYAPFSYRDILFIL

SEQ ID NO: 1885174 - protein, 18 aa, Staphylococcus
RVAGCIVGAIFVIGYLYW

SEQ ID NO: 1885175 - protein, 19 aa, Staphylococcus
RVAMGYTFFHWGISQWSIF

SEQ ID NO: 1885176 - protein, 19 aa, Staphylococcus
RVAPKIHPLIHPKAVEPNE

SEQ ID NO: 1885177 - protein, 17 aa, Staphylococcus
RVDGCNDFQIFWKIVLP

SEQ ID NO: 1885178 - protein, 22 aa, Staphylococcus
RVEGFSCANCAGKFEKNVKQIA

SEQ ID NO: 1885179 - protein, 19 aa, Staphylococcus
RVFMLLTLFSGFWELIEEF

SEQ ID NO: 1885180 - protein, 26 aa, Staphylococcus
RVFYLKKVWVIFKFIVVYNVQLFISS

SEQ ID NO: 1885181 - protein, 19 aa, Staphylococcus
RVGEKVLQKVGARKPMLLG

SEQ ID NO: 1885182 - protein, 21 aa, Staphylococcus
RVGETFSLYLIWYSIGRFFVE

SEQ ID NO: 1885183 - protein, 30 aa, Staphylococcus
RVGHFSRWMLCLHPILFIFFSGVFLSSWIQ

SEQ ID NO: 1885184 - protein, 26 aa, Staphylococcus
RVGLSILRFLISVGIVLLCIYLAYQG

SEQ ID NO: 1885185 - protein, 24 aa, Staphylococcus
RVHRRLGGKESYLFYESLPITKKE

SEQ ID NO: 1885186 - protein, 17 aa, Staphylococcus
RVIGTPGDKVEYEGDQL

SEQ ID NO: 1885187 - protein, 17 aa, Staphylococcus
RVILGLGTAAAAVILSR

SEQ ID NO: 1885188 - protein, 20 aa, Staphylococcus
RVILIPIFLLFALANFGFGK

SEQ ID NO: 1885189 - protein, 20 aa, Staphylococcus
RVILIPLFILFALVNFGFGN

SEQ ID NO: 1885190 - protein, 17 aa, Staphylococcus
RVKSKRGAELGIASLVS

SEQ ID NO: 1885191 - protein, 19 aa, Staphylococcus
RVKTGSLRIARSGLAIFGM

SEQ ID NO: 1885192 - protein, 17 aa, Staphylococcus
RVKVIIIVALLAMSIMS

SEQ ID NO: 1885193 - protein, 24 aa, Staphylococcus
RVLSILIFVMAFKMLGVSIQKMQL

SEQ ID NO: 1885194 - protein, 19 aa, Staphylococcus
RVLSILIFVMTFKMLGVSI

SEQ ID NO: 1885195 - protein, 35 aa, Staphylococcus
RVMNVLTIISSIFFPLSFLTGWYGMNFKYMPELNW

SEQ ID NO: 1885196 - protein, 18 aa, Staphylococcus
RVNRFWKVPHEAAKISAK

SEQ ID NO: 1885197 - protein, 17 aa, Staphylococcus
RVPMLLTAMVSFLLLKW

SEQ ID NO: 1885198 - protein, 24 aa, Staphylococcus
RVPSIRTLWRSTWEKAKGFVKKAG

SEQ ID NO: 1885199 - protein, 21 aa, Staphylococcus
RVQLFKVIFAIIITLIIVIGT

SEQ ID NO: 1885200 - protein, 17 aa, Staphylococcus
RVQLLLIGFVFNGFLEG

SEQ ID NO: 1885201 - protein, 23 aa, Staphylococcus
RVQSFKVIFAIIITLAIVIGTYW

SEQ ID NO: 1885202 - protein, 17 aa, Staphylococcus
RVQVIIVAFLFGSLIEG

SEQ ID NO: 1885203 - protein, 17 aa, Staphylococcus
RVRMDIIDYSKVNIEGL

SEQ ID NO: 1885204 - protein, 26 aa, Staphylococcus
RVSELKRLDAGYHFKDINGQFPYRGH

SEQ ID NO: 1885205 - protein, 21 aa, Staphylococcus
RVSFADFFLTMDWNPFSSTPK

SEQ ID NO: 1885206 - protein, 22 aa, Staphylococcus
RVSGLPEGVTFDPLTNTISGIA

SEQ ID NO: 1885207 - protein, 20 aa, Staphylococcus
RVSHFRFSLFTKITTCTYLF

SEQ ID NO: 1885208 - protein, 20 aa, Staphylococcus
RVSHFRFSLFTKITTTTYFF

SEQ ID NO: 1885209 - protein, 24 aa, Staphylococcus
RVSKNGRRYLIFNNMSFTPPTKEV

SEQ ID NO: 1885210 - protein, 26 aa, Staphylococcus
RVTFESPMLFALGFIPNFLIGGVTGV

SEQ ID NO: 1885211 - protein, 21 aa, Staphylococcus
RVTIIASNNGGIWSLNKNVSH

SEQ ID NO: 1885212 - protein, 19 aa, Staphylococcus
RVTKPMSYYIHWINHLAHG

SEQ ID NO: 1885213 - protein, 27 aa, Staphylococcus
RVTLSRRGIENINMFTFIQLVTPFITY

SEQ ID NO: 1885214 - protein, 25 aa, Staphylococcus
RVTLSRRGVESNNMFIFIQLLTPFV

SEQ ID NO: 1885215 - protein, 18 aa, Staphylococcus
RVTNIAVGYDMDDRPNND

SEQ ID NO: 1885216 - protein, 21 aa, Staphylococcus
RVTPLFAISQGWIWTITLVGL

SEQ ID NO: 1885217 - protein, 19 aa, Staphylococcus
RVTSTSFSYSASGHGTIDN

SEQ ID NO: 1885218 - protein, 19 aa, Staphylococcus
RVVKWLSFIPITLFTALII

SEQ ID NO: 1885219 - protein, 17 aa, Staphylococcus
RVYHFFQQALTLAVILF

SEQ ID NO: 1885220 - protein, 17 aa, Staphylococcus
RVYSYKGDFKNYIFKEH

SEQ ID NO: 1885221 - protein, 18 aa, Staphylococcus
RWFFAIAFFLIGVIAYMD

SEQ ID NO: 1885222 - protein, 18 aa, Staphylococcus
RWFFALAFFIIGVIAYMD

SEQ ID NO: 1885223 - protein, 19 aa, Staphylococcus
RWIQIALVLLIFMQQLGIE

SEQ ID NO: 1885224 - protein, 18 aa, Staphylococcus
RWLMISVSIFIIMMLVLN

SEQ ID NO: 1885225 - protein, 25 aa, Staphylococcus
RWSTAQRMLITWVITLPISAVLAAL

SEQ ID NO: 1885226 - protein, 22 aa, Staphylococcus
RWVKIVESFILLPIVLPPTVMG

SEQ ID NO: 1885227 - protein, 18 aa, Staphylococcus
RWWLMNLVLGIVYFIIWI

SEQ ID NO: 1885228 - protein, 19 aa, Staphylococcus
RWYFAIAFFIIGVIAYMDR

SEQ ID NO: 1885229 - protein, 18 aa, Staphylococcus
RWYFAIGFFLIGVIAYMD

SEQ ID NO: 1885230 - protein, 19 aa, Staphylococcus
RWYYIILLALTFVLSFTTL

SEQ ID NO: 1885231 - protein, 20 aa, Staphylococcus
RYAIIIVYLRIRSVFSSVTK

SEQ ID NO: 1885232 - protein, 33 aa, Staphylococcus
RYEKKNIAGLIFVSWYPTIYWIINAAVVIFAFP

SEQ ID NO: 1885233 - protein, 24 aa, Staphylococcus
RYEVIKKLGGGGMSTVYLAEDTIL

SEQ ID NO: 1885234 - protein, 18 aa, Staphylococcus
RYFLPSFILFMLTGVNGS

SEQ ID NO: 1885235 - protein, 33 aa, Staphylococcus
RYGKVYQGIMPDWEPGKKLHLIGHSMGGQTIRL

SEQ ID NO: 1885236 - protein, 23 aa, Staphylococcus
RYIIFKFKPLKIIASDKEVTSPE

SEQ ID NO: 1885237 - protein, 20 aa, Staphylococcus
RYIKPVMLMALGLVFTTVVG

SEQ ID NO: 1885238 - protein, 19 aa, Staphylococcus
RYIKPVMLMALGLVITTVL

SEQ ID NO: 1885239 - protein, 19 aa, Staphylococcus
RYILQPRIEDISVKGVLFA

SEQ ID NO: 1885240 - protein, 23 aa, Staphylococcus
RYKVIDKLGGGGMSMVYLAEDMI

SEQ ID NO: 1885241 - protein, 24 aa, Staphylococcus
RYLDSEALAAFKPYQMLSSQEDKE

SEQ ID NO: 1885242 - protein, 24 aa, Staphylococcus
RYLIFKFKPLKVIASEDEVTSPQF

SEQ ID NO: 1885243 - protein, 20 aa, Staphylococcus
RYLPFFTIGMGWIVPAIIGF

SEQ ID NO: 1885244 - protein, 24 aa, Staphylococcus
RYLPLKKHYPYFILGFIITALMVT

SEQ ID NO: 1885245 - protein, 22 aa, Staphylococcus
RYLVAIIACLLWFFFKDHINII

SEQ ID NO: 1885246 - protein, 19 aa, Staphylococcus
RYLVAIIACVIWFLLKDYV

SEQ ID NO: 1885247 - protein, 19 aa, Staphylococcus
RYLVFKFKPLKIAASEEEV

SEQ ID NO: 1885248 - protein, 20 aa, Staphylococcus
RYLVFKFKPLSIVASEQEVT

SEQ ID NO: 1885249 - protein, 27 aa, Staphylococcus
RYMDIEEILSHGIDVWTTLNIQHIESL

SEQ ID NO: 1885250 - protein, 17 aa, Staphylococcus
RYMPGLDGLRAIAVIGI

SEQ ID NO: 1885251 - protein, 17 aa, Staphylococcus
RYMPGLDGLRAIAVLGI

SEQ ID NO: 1885252 - protein, 19 aa, Staphylococcus
RYNKCLLMTQSFVFNSLAF

SEQ ID NO: 1885253 - protein, 23 aa, Staphylococcus
RYPDRFNVSFDIDRTCYGALVPP

SEQ ID NO: 1885254 - protein, 20 aa, Staphylococcus
RYPDVPDFESSNYFILDSKR

SEQ ID NO: 1885255 - protein, 18 aa, Staphylococcus
RYPVCVNVITTWCLLIPL

SEQ ID NO: 1885256 - protein, 18 aa, Staphylococcus
RYPYGDTLRSIFGSVSTS

SEQ ID NO: 1885257 - protein, 21 aa, Staphylococcus
RYSIGLLVFVCLWTFILSLLL

SEQ ID NO: 1885258 - protein, 17 aa, Staphylococcus
RYSMIAIPITIYGIVYF

SEQ ID NO: 1885259 - protein, 22 aa, Staphylococcus
RYSPPINIKVATRLGHVKDYFI

SEQ ID NO: 1885260 - protein, 18 aa, Staphylococcus
RYTGIMYILAYLAGVIAL

SEQ ID NO: 1885261 - protein, 24 aa, Staphylococcus
RYTKRDFISIIGIIIPSTILFFIF

SEQ ID NO: 1885262 - protein, 19 aa, Staphylococcus
RYVTLTGLVLTLIVAIINL

SEQ ID NO: 1885263 - protein, 19 aa, Staphylococcus
RYYHLKRYTAVIASMLYAA

SEQ ID NO: 1885264 - protein, 19 aa, Staphylococcus
RYYLHPTIAQFFDIVLTLF

SEQ ID NO: 1885265 - protein, 19 aa, Staphylococcus
RYYLPTFILFLTVGVIGSF

SEQ ID NO: 1885266 - protein, 19 aa, Staphylococcus
RYYQGYTQAELDDMVKNGL

SEQ ID NO: 1885267 - protein, 19 aa, Staphylococcus
RYYTVILIIICIALILWLG

SEQ ID NO: 1885268 - protein, 26 aa, Staphylococcus
SAAFFYSIYESIKWLINTNYEPHLYF

SEQ ID NO: 1885269 - protein, 20 aa, Staphylococcus
SAAFGAWFVYKRRKMAKEEG

SEQ ID NO: 1885270 - protein, 23 aa, Staphylococcus
SAAIEIMSNAGLDGSTAGTVLRA

SEQ ID NO: 1885271 - protein, 27 aa, Staphylococcus
SAAYFYSIYEMFKWLNHSKHMPHLYFE

SEQ ID NO: 1885272 - protein, 30 aa, Staphylococcus
SAAYFYSIYEMIRWLLNKVNEPHLYFETSA

SEQ ID NO: 1885273 - protein, 28 aa, Staphylococcus
SAAYFYSLYEMIKWLSKNTYQPHLYFET

SEQ ID NO: 1885274 - protein, 28 aa, Staphylococcus
SAAYFYSLYEMVKWLFNANVMPHLYFET

SEQ ID NO: 1885275 - protein, 17 aa, Staphylococcus
SACYAFIIYLIFSSAFE

SEQ ID NO: 1885276 - protein, 31 aa, Staphylococcus
SADTRVAICISPIWFIFLFLFYKKYKKNAEY

SEQ ID NO: 1885277 - protein, 24 aa, Staphylococcus
SAFAIPFLFKRGVKSIEFMLLISS

SEQ ID NO: 1885278 - protein, 17 aa, Staphylococcus
SAFIGIGMACTYALMFP

SEQ ID NO: 1885279 - protein, 19 aa, Staphylococcus
SAFILAWSISVSWNQLIAL

SEQ ID NO: 1885280 - protein, 19 aa, Staphylococcus
SAFILMFLAFDVKKVLDSL

SEQ ID NO: 1885281 - protein, 19 aa, Staphylococcus
SAFILMFLAFDVKQVLISL

SEQ ID NO: 1885282 - protein, 18 aa, Staphylococcus
SAFILMFLAFDVSEVLAS

SEQ ID NO: 1885283 - protein, 17 aa, Staphylococcus
SAGNLGFTNPIVVISAI

SEQ ID NO: 1885284 - protein, 20 aa, Staphylococcus
SAIEALYYNRYLKRNDEVTN

SEQ ID NO: 1885285 - protein, 21 aa, Staphylococcus
SAIIGCLFMYITLLQMSQFYT

SEQ ID NO: 1885286 - protein, 24 aa, Staphylococcus
SAILAFPLLLTMLVHLFNVPLPEI

SEQ ID NO: 1885287 - protein, 19 aa, Staphylococcus
SAIRPFELIIVVLIITAAS

SEQ ID NO: 1885288 - protein, 23 aa, Staphylococcus
SAKAALVLFMWLPKAYAVLNTEL

SEQ ID NO: 1885289 - protein, 23 aa, Staphylococcus
SAKGMKWTNFIAVIAGLYTLYAI

SEQ ID NO: 1885290 - protein, 26 aa, Staphylococcus
SAKLFGELEFWFAIIKIATIIALIVV

SEQ ID NO: 1885291 - protein, 27 aa, Staphylococcus
SAKLFGELEFWFAIIKIITIIALIVIG

SEQ ID NO: 1885292 - protein, 27 aa, Staphylococcus
SAKLFGELEFWFAIIKIITIIALIVVG

SEQ ID NO: 1885293 - protein, 26 aa, Staphylococcus
SAKLFGELEFWFAIIKVLTILALIIV

SEQ ID NO: 1885294 - protein, 27 aa, Staphylococcus
SAKLFGELEFWFSIIKIVTIIGLIVVG

SEQ ID NO: 1885295 - protein, 26 aa, Staphylococcus
SAKLFGELEFWLAIIKVVTIVALITV

SEQ ID NO: 1885296 - protein, 27 aa, Staphylococcus
SAKLFGELEFWLSIIKVITILALIIVG

SEQ ID NO: 1885297 - protein, 23 aa, Staphylococcus
SAKNFFTTLGWLSVIALLAVVVV

SEQ ID NO: 1885298 - protein, 24 aa, Staphylococcus
SAKVPKNFKFNRIIVSQNPKENLE

SEQ ID NO: 1885299 - protein, 37 aa, Staphylococcus
SALFALLCVTAFLLVRPSHIMGLYLYLILLSSGGVLY

SEQ ID NO: 1885300 - protein, 20 aa, Staphylococcus
SALFPILLVVPLFDILMYLN

SEQ ID NO: 1885301 - protein, 20 aa, Staphylococcus
SALFPILLVVPLFDVLMYFN

SEQ ID NO: 1885302 - protein, 19 aa, Staphylococcus
SALGLYWTVGGLFLIIQMH

SEQ ID NO: 1885303 - protein, 24 aa, Staphylococcus
SALKLTMIVGLIFTLGSILAGDMS

SEQ ID NO: 1885304 - protein, 30 aa, Staphylococcus
SALLGITALICYRWILMLMQVSQDIFELTY

SEQ ID NO: 1885305 - protein, 20 aa, Staphylococcus
SALLMSSWAIFALNMSIDNI

SEQ ID NO: 1885306 - protein, 19 aa, Staphylococcus
SALLVLIGIILVFSIFKPT

SEQ ID NO: 1885307 - protein, 22 aa, Staphylococcus
SALSIFIGMILIWFTKDQTFTS

SEQ ID NO: 1885308 - protein, 26 aa, Staphylococcus
SAMDAASTIPGWQVVNSQQTQIPLVW

SEQ ID NO: 1885309 - protein, 20 aa, Staphylococcus
SAMFQTGISFGVRGDKNVDS

SEQ ID NO: 1885310 - protein, 17 aa, Staphylococcus
SAMIVPVLMFAFFGIIL

SEQ ID NO: 1885311 - protein, 22 aa, Staphylococcus
SAMKYTLLMLAIMMLFLFILNN

SEQ ID NO: 1885312 - protein, 19 aa, Staphylococcus
SAMNLQWGGAAGVLFNAGI

SEQ ID NO: 1885313 - protein, 21 aa, Staphylococcus
SAMVIGLFIKYFSTIRLKTYI

SEQ ID NO: 1885314 - protein, 20 aa, Staphylococcus
SANFMTYINLAWFATSISTV

SEQ ID NO: 1885315 - protein, 24 aa, Staphylococcus
SAPQKRRHFILAFSSSLLIGLYVK

SEQ ID NO: 1885316 - protein, 25 aa, Staphylococcus
SAPQKRWHFILSFNSAILIGLFLKY

SEQ ID NO: 1885317 - protein, 25 aa, Staphylococcus
SAPQKRWHFLLAFNSAMVIGLFIKY

SEQ ID NO: 1885318 - protein, 25 aa, Staphylococcus
SAPQKRWHYLIAFNSAVLIGLYVKY

SEQ ID NO: 1885319 - protein, 20 aa, Staphylococcus
SARLILKMFGMQPAKESELY

SEQ ID NO: 1885320 - protein, 18 aa, Staphylococcus
SARSVAEIILKLMNVSAV

SEQ ID NO: 1885321 - protein, 18 aa, Staphylococcus
SASLQYSFLMNLFAAAIA

SEQ ID NO: 1885322 - protein, 17 aa, Staphylococcus
SAVEILFATIGLIIGLL

SEQ ID NO: 1885323 - protein, 17 aa, Staphylococcus
SAVEILFATLGLVVGLF

SEQ ID NO: 1885324 - protein, 20 aa, Staphylococcus
SAVGLLILTLVTAWFTFGIP

SEQ ID NO: 1885325 - protein, 21 aa, Staphylococcus
SAVNGVIWRILIFYIGAIFVI

SEQ ID NO: 1885326 - protein, 17 aa, Staphylococcus
SAVQYMSSWPWDWAKPM

SEQ ID NO: 1885327 - protein, 26 aa, Staphylococcus
SAVTFVDIWRFFSLVNRYENEDKYDY

SEQ ID NO: 1885328 - protein, 24 aa, Staphylococcus
SAWAQIRLRRGIKRQGKDINTLLP

SEQ ID NO: 1885329 - protein, 28 aa, Staphylococcus
SAYAALIARRVGLKWQDLEEGITKRLST

SEQ ID NO: 1885330 - protein, 18 aa, Staphylococcus
SAYFIYRTIFTYKNDIMT

SEQ ID NO: 1885331 - protein, 19 aa, Staphylococcus
SAYGHGVSGVNMGAKTGTG

SEQ ID NO: 1885332 - protein, 27 aa, Staphylococcus
SCAMKSPGVSIAVGIVFYFATSILSGL

SEQ ID NO: 1885333 - protein, 27 aa, Staphylococcus
SCILSLCIYIPFIYRFITQGIVFSGEG

SEQ ID NO: 1885334 - protein, 22 aa, Staphylococcus
SCLTLLICSIFINPLIQKIKQF

SEQ ID NO: 1885335 - protein, 25 aa, Staphylococcus
SCLVAAIIMPRIWPLNQIPDDFTKE

SEQ ID NO: 1885336 - protein, 24 aa, Staphylococcus
SCNFNSRFIICAWIETSNADIGSS

SEQ ID NO: 1885337 - protein, 17 aa, Staphylococcus
SCSYQIGATLSIFNVAQ

SEQ ID NO: 1885338 - protein, 19 aa, Staphylococcus
SCVGDFYWVLKMIQTPKNS

SEQ ID NO: 1885339 - protein, 18 aa, Staphylococcus
SDAFSLGLALFAFKYGER

SEQ ID NO: 1885340 - protein, 23 aa, Staphylococcus
SDAHLIHPIWLVLSFFLITLGEL

SEQ ID NO: 1885341 - protein, 17 aa, Staphylococcus
SDARLMATLIYVLSFFT

SEQ ID NO: 1885342 - protein, 24 aa, Staphylococcus
SDATGRKKPLWISMFIYTLASLGI

SEQ ID NO: 1885343 - protein, 21 aa, Staphylococcus
SDAYQLTLLRGFKLKHRIYVQ

SEQ ID NO: 1885344 - protein, 25 aa, Staphylococcus
SDDFLSGLFDYEGNFDLPKAGEAAK

SEQ ID NO: 1885345 - protein, 17 aa, Staphylococcus
SDDKLILSMEVLPIIIS

SEQ ID NO: 1885346 - protein, 18 aa, Staphylococcus
SDDLRLMVFCWGLTLFAL

SEQ ID NO: 1885347 - protein, 25 aa, Staphylococcus
SDDPEFKKAMGILLISTVGYVGYVV

SEQ ID NO: 1885348 - protein, 24 aa, Staphylococcus
SDDTRAAIFISPFWFIFLYFYYKK

SEQ ID NO: 1885349 - protein, 24 aa, Staphylococcus
SDEEAVKFIKWIQAKPFYDNTTIV

SEQ ID NO: 1885350 - protein, 18 aa, Staphylococcus
SDEHAVVLGPELKHPYKV

SEQ ID NO: 1885351 - protein, 30 aa, Staphylococcus
SDEKNGVILGSLFAAIGTLLLGKNRRKIND

SEQ ID NO: 1885352 - protein, 20 aa, Staphylococcus
SDEKSIETLKTWYVGGDQRV

SEQ ID NO: 1885353 - protein, 31 aa, Staphylococcus
SDESDYATTVFGTITLAASLLLLRRQRKESK

SEQ ID NO: 1885354 - protein, 23 aa, Staphylococcus
SDESSLRFAGITQNKNSNGSTIT

SEQ ID NO: 1885355 - protein, 21 aa, Staphylococcus
SDFKLPGGIHMARMVQLFFVF

SEQ ID NO: 1885356 - protein, 19 aa, Staphylococcus
SDFQAIWTLGKFMIASYAA

SEQ ID NO: 1885357 - protein, 18 aa, Staphylococcus
SDGAAWSIILSLLIWLGY

SEQ ID NO: 1885358 - protein, 17 aa, Staphylococcus
SDGEIGSGVVYKKVGDS

SEQ ID NO: 1885359 - protein, 31 aa, Staphylococcus
SDGRKIEIPCCPNGQPVIIVGYYYDTVGNIV

SEQ ID NO: 1885360 - protein, 24 aa, Staphylococcus
SDHMKWATLMFVYSLNYLVLFFAL

SEQ ID NO: 1885361 - protein, 25 aa, Staphylococcus
SDIEQRVLDLLPERFNANYESADDI

SEQ ID NO: 1885362 - protein, 17 aa, Staphylococcus
SDIMIKGFIIFGKILDV

SEQ ID NO: 1885363 - protein, 19 aa, Staphylococcus
SDIPEQVDVTKDTTEQAST

SEQ ID NO: 1885364 - protein, 20 aa, Staphylococcus
SDIRSTFIYAVIPVFVGFSM

SEQ ID NO: 1885365 - protein, 44 aa, Staphylococcus
SDKKRMGTGAKVISIITVLLLLGGLVFAVFSFVDHSNRANERLN

SEQ ID NO: 1885366 - protein, 25 aa, Staphylococcus
SDKLGRRKVVFIIAIIYIIGSLLMA

SEQ ID NO: 1885367 - protein, 27 aa, Staphylococcus
SDKVAGYLFYFAVIVGVISFIVWMLIQ

SEQ ID NO: 1885368 - protein, 26 aa, Staphylococcus
SDLDIKFALITLRGGPLLILNQEDYQ

SEQ ID NO: 1885369 - protein, 23 aa, Staphylococcus
SDLLVSFKGGKYISSILLGIISL

SEQ ID NO: 1885370 - protein, 19 aa, Staphylococcus
SDLSIPVLFTISTIASLIG

SEQ ID NO: 1885371 - protein, 23 aa, Staphylococcus
SDLYSGKALTKFLALLMLVNGIA

SEQ ID NO: 1885372 - protein, 18 aa, Staphylococcus
SDMPGVNTTMDWDRKYLY

SEQ ID NO: 1885373 - protein, 24 aa, Staphylococcus
SDMTKAIALITVFLFVVLLIFERS

SEQ ID NO: 1885374 - protein, 17 aa, Staphylococcus
SDNGSSILINRPAIATG

SEQ ID NO: 1885375 - protein, 26 aa, Staphylococcus
SDNTAPMLYGTIFAGLGTAMVFGMKR

SEQ ID NO: 1885376 - protein, 19 aa, Staphylococcus
SDPKVIDYPTPKNSKYSYM

SEQ ID NO: 1885377 - protein, 25 aa, Staphylococcus
SDPMIRTTLFVTWLLPVGVAIIPYA

SEQ ID NO: 1885378 - protein, 17 aa, Staphylococcus
SDPRLKMSKTLGGHITY

SEQ ID NO: 1885379 - protein, 25 aa, Staphylococcus
SDRIGRRRLVLFIALVFIVGSLVLA

SEQ ID NO: 1885380 - protein, 26 aa, Staphylococcus
SDRTWTRFGRRMPYLLIAGPIGAIVL

SEQ ID NO: 1885381 - protein, 22 aa, Staphylococcus
SDSEVESLSLVDSLNASTSLSE

SEQ ID NO: 1885382 - protein, 23 aa, Staphylococcus
SDSHFRNQLSLHLAQIGKSIYPI

SEQ ID NO: 1885383 - protein, 18 aa, Staphylococcus
SDSILNGDLFRFYNNPDF

SEQ ID NO: 1885384 - protein, 23 aa, Staphylococcus
SDSKANVKKGDFVFLVKEKGSDK

SEQ ID NO: 1885385 - protein, 17 aa, Staphylococcus
SDSMSSSTSLSLSNSAD

SEQ ID NO: 1885386 - protein, 19 aa, Staphylococcus
SDSNDLWDLFLLITGLVGV

SEQ ID NO: 1885387 - protein, 23 aa, Staphylococcus
SDSVKINVAMNWYFIAASVILVL

SEQ ID NO: 1885388 - protein, 25 aa, Staphylococcus
SDTHLRFEAIVAFISIFILSKFILY

SEQ ID NO: 1885389 - protein, 26 aa, Staphylococcus
SDTIIARKDGLTWSLSKEITGITIEP

SEQ ID NO: 1885390 - protein, 21 aa, Staphylococcus
SDTKLKADISFDTDKAKDIGE

SEQ ID NO: 1885391 - protein, 27 aa, Staphylococcus
SDVFGRKRIATILMMIYLVATFLSIFT

SEQ ID NO: 1885392 - protein, 21 aa, Staphylococcus
SDVNVWLSFLLLGFVFIVGPT

SEQ ID NO: 1885393 - protein, 17 aa, Staphylococcus
SDVPTLLATFLLGPVAG

SEQ ID NO: 1885394 - protein, 22 aa, Staphylococcus
SDWLLSGLILWIGASTFLSVGV

SEQ ID NO: 1885395 - protein, 18 aa, Staphylococcus
SDYATGWFLNPDQHQVLH

SEQ ID NO: 1885396 - protein, 25 aa, Staphylococcus
SDYLKEKRAKRRKRQKQIQYSIFGV

SEQ ID NO: 1885397 - protein, 21 aa, Staphylococcus
SDYRKVMEFTQSFREMSFIEK

SEQ ID NO: 1885398 - protein, 31 aa, Staphylococcus
SDYRRNFSYVKRRNFTIFKAIAITMSVIGVI

SEQ ID NO: 1885399 - protein, 23 aa, Staphylococcus
SEAAKSYASYLIKARQEEQIQQQ

SEQ ID NO: 1885400 - protein, 18 aa, Staphylococcus
SEAMKSHISDQIKNKQEQ

SEQ ID NO: 1885401 - protein, 17 aa, Staphylococcus
SEARQAIDDLAKLKKAT

SEQ ID NO: 1885402 - protein, 20 aa, Staphylococcus
SEDDHCLYFFDITDEVHTNK

SEQ ID NO: 1885403 - protein, 26 aa, Staphylococcus
SEDHLKFSLFLAMLIACLLIQAATNM

SEQ ID NO: 1885404 - protein, 26 aa, Staphylococcus
SEDHLKFSLFLAMLLACLLIQAATNM

SEQ ID NO: 1885405 - protein, 27 aa, Staphylococcus
SEDHLKLSLFLAMLLACLLIQAATNMF

SEQ ID NO: 1885406 - protein, 26 aa, Staphylococcus
SEDHLKLSLLLAMLIACLLIQAATNM

SEQ ID NO: 1885407 - protein, 21 aa, Staphylococcus
SEDYSRLAGVSDIDSTNDSIV

SEQ ID NO: 1885408 - protein, 21 aa, Staphylococcus
SEDYSRLAGVSDIDSTNDSVI

SEQ ID NO: 1885409 - protein, 21 aa, Staphylococcus
SEDYSRLAGVSDIDSTNDSVV

SEQ ID NO: 1885410 - protein, 21 aa, Staphylococcus
SEDYSRLAGVSDIDSTSDSVI

SEQ ID NO: 1885411 - protein, 23 aa, Staphylococcus
SEEEARAYLNFIKEEDDLTNVAN

SEQ ID NO: 1885412 - protein, 21 aa, Staphylococcus
SEEERCLYFFDITEEVHTNEL

SEQ ID NO: 1885413 - protein, 27 aa, Staphylococcus
SEEIKAEVVKLLFNRETAEKDLYKPQA

SEQ ID NO: 1885414 - protein, 27 aa, Staphylococcus
SEEKILLALLLYRFAYYFVPVIIALIL

SEQ ID NO: 1885415 - protein, 20 aa, Staphylococcus
SEFIMTILMIIDYRRKFENF

SEQ ID NO: 1885416 - protein, 17 aa, Staphylococcus
SEFITTILIGNNIANII

SEQ ID NO: 1885417 - protein, 17 aa, Staphylococcus
SEFMFAVGHSFTILVIS

SEQ ID NO: 1885418 - protein, 20 aa, Staphylococcus
SEGIIKEIIVTIPKDNIKTN

SEQ ID NO: 1885419 - protein, 20 aa, Staphylococcus
SEGISLFSLSLVLGTAIGPF

SEQ ID NO: 1885420 - protein, 38 aa, Staphylococcus
SEGMFPIEMSAAFFRFIHPFLPMSYAIQGFREAIFTNA

SEQ ID NO: 1885421 - protein, 23 aa, Staphylococcus
SEIANFSGLLGRVLTEMRLVKVS

SEQ ID NO: 1885422 - protein, 31 aa, Staphylococcus
SEIELIKIKRLFKINNIELIDATTIQFIQLK

SEQ ID NO: 1885423 - protein, 18 aa, Staphylococcus
SEIIFDFNTMAAGNGKGG

SEQ ID NO: 1885424 - protein, 22 aa, Staphylococcus
SEIIRVMSRFIGSFPIISAVII

SEQ ID NO: 1885425 - protein, 20 aa, Staphylococcus
SEIKKNSSYERIYDKAKAQG

SEQ ID NO: 1885426 - protein, 24 aa, Staphylococcus
SEIKLCIHLQPSRVRFEMIDFGKG

SEQ ID NO: 1885427 - protein, 20 aa, Staphylococcus
SEILVTVLIAVVFAIIYNIW

SEQ ID NO: 1885428 - protein, 18 aa, Staphylococcus
SEIPKIWHGGIAIHGGLI

SEQ ID NO: 1885429 - protein, 20 aa, Staphylococcus
SEIRIPRDLGAVLVGMALSV

SEQ ID NO: 1885430 - protein, 22 aa, Staphylococcus
SEKMMGDGIGFVPEKGEIVAPF

SEQ ID NO: 1885431 - protein, 21 aa, Staphylococcus
SEKMMGDGIGFVPEKGGIVAP

SEQ ID NO: 1885432 - protein, 24 aa, Staphylococcus
SEKYSHLAIAIGIALFIFLIVRPP

SEQ ID NO: 1885433 - protein, 24 aa, Staphylococcus
SELDKGTVVKFIFPNQNEIVAKLS

SEQ ID NO: 1885434 - protein, 22 aa, Staphylococcus
SELLKIAFILYISYVISRKLPQ

SEQ ID NO: 1885435 - protein, 22 aa, Staphylococcus
SELLKIAIILYIPFMIEKKMPA

SEQ ID NO: 1885436 - protein, 20 aa, Staphylococcus
SELLKIAIILYIPYMIEKKR

SEQ ID NO: 1885437 - protein, 25 aa, Staphylococcus
SELLKIAIIMYIPFIIDRKMPRVKK

SEQ ID NO: 1885438 - protein, 21 aa, Staphylococcus
SELLKIALILYISYVLSKKLS

SEQ ID NO: 1885439 - protein, 22 aa, Staphylococcus
SELMLNRILKHLIRAEDKGMLA

SEQ ID NO: 1885440 - protein, 24 aa, Staphylococcus
SELNQKLANMFAINYLVTVITIVF

SEQ ID NO: 1885441 - protein, 19 aa, Staphylococcus
SELSVLIASKVLKKEISEQ

SEQ ID NO: 1885442 - protein, 17 aa, Staphylococcus
SELSVLIASKVLQKEIS

SEQ ID NO: 1885443 - protein, 19 aa, Staphylococcus
SEMGFNLFVNLLNIIINIL

SEQ ID NO: 1885444 - protein, 23 aa, Staphylococcus
SEMNQAGKITGWHVKDNDQTEIP

SEQ ID NO: 1885445 - protein, 23 aa, Staphylococcus
SENDLKLNKEVPETSTSTTETRQ

SEQ ID NO: 1885446 - protein, 22 aa, Staphylococcus
SENTMILGWIFYFFLGGFIGYN

SEQ ID NO: 1885447 - protein, 23 aa, Staphylococcus
SEPDEIRDSLSIVLDETQRLNRL

SEQ ID NO: 1885448 - protein, 20 aa, Staphylococcus
SEPGETFYVNGFPLRGTTTK

SEQ ID NO: 1885449 - protein, 21 aa, Staphylococcus
SEQGLAWLYPFLVLTIIGIII

SEQ ID NO: 1885450 - protein, 23 aa, Staphylococcus
SEQLKSLLLSYIFFVIFTPLVAF

SEQ ID NO: 1885451 - protein, 20 aa, Staphylococcus
SEQVEGIGFAIPSNEVKVTI

SEQ ID NO: 1885452 - protein, 21 aa, Staphylococcus
SEQYFAHRFEKEGITKKPIIA

SEQ ID NO: 1885453 - protein, 17 aa, Staphylococcus
SESEIGSGVVYKKVDGA

SEQ ID NO: 1885454 - protein, 23 aa, Staphylococcus
SESKIFFKLILPLSKRAILSGVM

SEQ ID NO: 1885455 - protein, 23 aa, Staphylococcus
SESMAASISNSIVASESLSGSLS

SEQ ID NO: 1885456 - protein, 21 aa, Staphylococcus
SESMGGLAAGIFIIGMLFGRL

SEQ ID NO: 1885457 - protein, 20 aa, Staphylococcus
SESMKNYVSKTIKTRNEQKV

SEQ ID NO: 1885458 - protein, 20 aa, Staphylococcus
SESSAIILLMFFIGIIVLSI

SEQ ID NO: 1885459 - protein, 23 aa, Staphylococcus
SETELPVALSFFSGKRLVPIMTA

SEQ ID NO: 1885460 - protein, 23 aa, Staphylococcus
SETELPVALSFFSGRRLVPILTA

SEQ ID NO: 1885461 - protein, 18 aa, Staphylococcus
SETLRNALTDAWNAIASS

SEQ ID NO: 1885462 - protein, 22 aa, Staphylococcus
SETMIHIFTLISAFVIATYLHV

SEQ ID NO: 1885463 - protein, 17 aa, Staphylococcus
SETRTAVEHQLEQAKVL

SEQ ID NO: 1885464 - protein, 22 aa, Staphylococcus
SETSISISLVFGIILFVSSVQI

SEQ ID NO: 1885465 - protein, 25 aa, Staphylococcus
SETTRISDALIRMQRERVHISLIID

SEQ ID NO: 1885466 - protein, 24 aa, Staphylococcus
SEVIKWFHKEHDWFKAQLNNETNN

SEQ ID NO: 1885467 - protein, 21 aa, Staphylococcus
SEVKFARLIIVIAGLLSYGIS

SEQ ID NO: 1885468 - protein, 19 aa, Staphylococcus
SEVRFARITIVIAGLLSYC

SEQ ID NO: 1885469 - protein, 25 aa, Staphylococcus
SEVRRDFIPYWGFVVVVNFIVPVIF

SEQ ID NO: 1885470 - protein, 26 aa, Staphylococcus
SEWLQSWTIYYWGWWMSWSPFVGTFI

SEQ ID NO: 1885471 - protein, 21 aa, Staphylococcus
SEYLCLVIIGSFIVMIITMIY

SEQ ID NO: 1885472 - protein, 22 aa, Staphylococcus
SEYLLRHYPIFIFWSPNQTTNF

SEQ ID NO: 1885473 - protein, 18 aa, Staphylococcus
SEYQDYFLQFNWFQPLLI

SEQ ID NO: 1885474 - protein, 18 aa, Staphylococcus
SFAVFTMASILTFVSMIV

SEQ ID NO: 1885475 - protein, 20 aa, Staphylococcus
SFESYLRYFNEKGINEVMQR

SEQ ID NO: 1885476 - protein, 20 aa, Staphylococcus
SFESYNWPTVAIQLTYFVTF

SEQ ID NO: 1885477 - protein, 19 aa, Staphylococcus
SFFITSVILCFTISLINIM

SEQ ID NO: 1885478 - protein, 17 aa, Staphylococcus
SFFKLAISNVGGDLNTL

SEQ ID NO: 1885479 - protein, 18 aa, Staphylococcus
SFGIPFWLSSLILVVLIL

SEQ ID NO: 1885480 - protein, 20 aa, Staphylococcus
SFGIPTWLGALIMTVVIYLT

SEQ ID NO: 1885481 - protein, 18 aa, Staphylococcus
SFGTYLWLFILIISIMKL

SEQ ID NO: 1885482 - protein, 19 aa, Staphylococcus
SFIELSYKGLEERLSKNQT

SEQ ID NO: 1885483 - protein, 17 aa, Staphylococcus
SFIIGWLALLIAVILLY

SEQ ID NO: 1885484 - protein, 18 aa, Staphylococcus
SFIITIASAITFVDIWHF

SEQ ID NO: 1885485 - protein, 23 aa, Staphylococcus
SFILDALIGIGMFFVSYFPTQRL

SEQ ID NO: 1885486 - protein, 19 aa, Staphylococcus
SFILFFTLGFFKVADAHVT

SEQ ID NO: 1885487 - protein, 18 aa, Staphylococcus
SFILLPIVLPPTVMGFIL

SEQ ID NO: 1885488 - protein, 25 aa, Staphylococcus
SFILTNIYYHFNLKASNDAKIMTML

SEQ ID NO: 1885489 - protein, 20 aa, Staphylococcus
SFIPFPMPASVIGLVLLFIL

SEQ ID NO: 1885490 - protein, 25 aa, Staphylococcus
SFIPFPMPASVIGLVLLFILLSAGV

SEQ ID NO: 1885491 - protein, 22 aa, Staphylococcus
SFISIIFSMIYIRYTNSIKRKM

SEQ ID NO: 1885492 - protein, 18 aa, Staphylococcus
SFISLILYRFELNLRSAS

SEQ ID NO: 1885493 - protein, 18 aa, Staphylococcus
SFIVMSITGVIGFLILYF

SEQ ID NO: 1885494 - protein, 19 aa, Staphylococcus
SFIVSFIIVTYLHVVLGEL

SEQ ID NO: 1885495 - protein, 18 aa, Staphylococcus
SFIVYCLNAPKGEFLHMV

SEQ ID NO: 1885496 - protein, 35 aa, Staphylococcus
SFKDLRKDLTLMLSIAVGFTGIFSTVIGIVQYLLI

SEQ ID NO: 1885497 - protein, 22 aa, Staphylococcus
SFKETGTFEVFNFISWAPFTFL

SEQ ID NO: 1885498 - protein, 25 aa, Staphylococcus
SFKLPEIRLLIGFAAKLLVFSHAVL

SEQ ID NO: 1885499 - protein, 19 aa, Staphylococcus
SFKQIRFNVYTEGDYMLDN

SEQ ID NO: 1885500 - protein, 19 aa, Staphylococcus
SFKVTLIFMIIFFLLNYFT

SEQ ID NO: 1885501 - protein, 25 aa, Staphylococcus
SFLAYAPVFWVYRLNGSLLDSFKGH

SEQ ID NO: 1885502 - protein, 17 aa, Staphylococcus
SFLDLFRAVPEGLLTGG

SEQ ID NO: 1885503 - protein, 19 aa, Staphylococcus
SFLFNILNGLAIAIVVGML

SEQ ID NO: 1885504 - protein, 23 aa, Staphylococcus
SFLIGLWLGHPIERAVKPLVIGL

SEQ ID NO: 1885505 - protein, 20 aa, Staphylococcus
SFLLCVLGILTFGIFPHLMP

SEQ ID NO: 1885506 - protein, 17 aa, Staphylococcus
SFLLFLGNWIGQIALNW

SEQ ID NO: 1885507 - protein, 17 aa, Staphylococcus
SFLLFLGNWIGQITLNW

SEQ ID NO: 1885508 - protein, 18 aa, Staphylococcus
SFLLWYFTRGWRRERKEK

SEQ ID NO: 1885509 - protein, 26 aa, Staphylococcus
SFLLYANVVYFRFFSDFLTFSTLNQA

SEQ ID NO: 1885510 - protein, 20 aa, Staphylococcus
SFLPIFAILFGFSMDKLYQS

SEQ ID NO: 1885511 - protein, 22 aa, Staphylococcus
SFLRRLIGYTTIYFVITSDGVN

SEQ ID NO: 1885512 - protein, 18 aa, Staphylococcus
SFLSRYLTLESFNLYFGI

SEQ ID NO: 1885513 - protein, 18 aa, Staphylococcus
SFLSRYLTLNSFNLYFGI

SEQ ID NO: 1885514 - protein, 22 aa, Staphylococcus
SFLTLYLLNLHLGYTFSGGFID

SEQ ID NO: 1885515 - protein, 22 aa, Staphylococcus
SFNAQMMSVWLLTNASAQAING

SEQ ID NO: 1885516 - protein, 22 aa, Staphylococcus
SFRTDLILFFKIIGISLVPMIL

SEQ ID NO: 1885517 - protein, 21 aa, Staphylococcus
SFSDGNKVVIPKGAKGDKGDK

SEQ ID NO: 1885518 - protein, 18 aa, Staphylococcus
SFSPPIIMLILLIFIAIL

SEQ ID NO: 1885519 - protein, 24 aa, Staphylococcus
SFSRNFGKEAAMFAGLENSQDVDA

SEQ ID NO: 1885520 - protein, 18 aa, Staphylococcus
SFSRNFGKEAAMIAGYQN

SEQ ID NO: 1885521 - protein, 18 aa, Staphylococcus
SFSRNFGKEAAMVAGYQH

SEQ ID NO: 1885522 - protein, 24 aa, Staphylococcus
SFSVTAFFLVLAFRSYKELGTDNV

SEQ ID NO: 1885523 - protein, 18 aa, Staphylococcus
SFSWVKVPGYIVCQMLGG

SEQ ID NO: 1885524 - protein, 19 aa, Staphylococcus
SFTTFAWLLLIILAIMICA

SEQ ID NO: 1885525 - protein, 26 aa, Staphylococcus
SFVINAFLIVIGWKYLSKTTAIYTVI

SEQ ID NO: 1885526 - protein, 18 aa, Staphylococcus
SFVLAVLLQYVFSVRLQW

SEQ ID NO: 1885527 - protein, 18 aa, Staphylococcus
SFVLAVLLQYVFSVRLRW

SEQ ID NO: 1885528 - protein, 18 aa, Staphylococcus
SFVLCYFSLFIVLVTVLF

SEQ ID NO: 1885529 - protein, 17 aa, Staphylococcus
SFVRGRDAFSIIFRLIV

SEQ ID NO: 1885530 - protein, 21 aa, Staphylococcus
SFVTIRYVRHININQSFDVIR

SEQ ID NO: 1885531 - protein, 19 aa, Staphylococcus
SFVVAALIMKFTKEPKQDL

SEQ ID NO: 1885532 - protein, 29 aa, Staphylococcus
SFWFPEIPNWISALFCVLILMSFNLLSAK

SEQ ID NO: 1885533 - protein, 29 aa, Staphylococcus
SFWFPHIPNWISALFCVLILMSFNLLSAK

SEQ ID NO: 1885534 - protein, 19 aa, Staphylococcus
SFWILRFPLTGLFSKMFGQ

SEQ ID NO: 1885535 - protein, 24 aa, Staphylococcus
SFWNLFKFIVLEGNFFGWFIIVIF

SEQ ID NO: 1885536 - protein, 25 aa, Staphylococcus
SFYELRYHSSYGYIDHIYVKNQQLI

SEQ ID NO: 1885537 - protein, 18 aa, Staphylococcus
SFYGDLLIFLPLSLWGME

SEQ ID NO: 1885538 - protein, 18 aa, Staphylococcus
SFYGDLLILLPLSLWGME

SEQ ID NO: 1885539 - protein, 18 aa, Staphylococcus
SFYGNLLILLPLSLFAME

SEQ ID NO: 1885540 - protein, 21 aa, Staphylococcus
SGAHLNPAVSIALAMDGGFSW

SEQ ID NO: 1885541 - protein, 25 aa, Staphylococcus
SGATIVFCAFIIYVAIFILNKFNIF

SEQ ID NO: 1885542 - protein, 18 aa, Staphylococcus
SGCNSGIFSASRMTLNLS

SEQ ID NO: 1885543 - protein, 20 aa, Staphylococcus
SGEISFLFHELENLKGKMEN

SEQ ID NO: 1885544 - protein, 27 aa, Staphylococcus
SGEVPAANGAQAFNVDKVIKANGSNNG

SEQ ID NO: 1885545 - protein, 22 aa, Staphylococcus
SGFLFYICLPFQNILERWGFPR

SEQ ID NO: 1885546 - protein, 25 aa, Staphylococcus
SGFTTGRLINKIDISRTDNTIKSIH

SEQ ID NO: 1885547 - protein, 21 aa, Staphylococcus
SGGAFSWLILEYFSNKKLSLL

SEQ ID NO: 1885548 - protein, 25 aa, Staphylococcus
SGGFLESFGAIFVIVIIILIIITKN

SEQ ID NO: 1885549 - protein, 17 aa, Staphylococcus
SGHAMGSTSFFGSIIFI

SEQ ID NO: 1885550 - protein, 26 aa, Staphylococcus
SGHRLLKGPNNFGGGVVADVSVNTGA

SEQ ID NO: 1885551 - protein, 20 aa, Staphylococcus
SGHTGVISFVVKDVDAAKAV

SEQ ID NO: 1885552 - protein, 23 aa, Staphylococcus
SGHVFRLNSKLGHSNAYDFFGSL

SEQ ID NO: 1885553 - protein, 17 aa, Staphylococcus
SGICSLFGGFIASTIGW

SEQ ID NO: 1885554 - protein, 32 aa, Staphylococcus
SGIFPLENMSPWLSNIGYLFPLRYAGHALTNI

SEQ ID NO: 1885555 - protein, 17 aa, Staphylococcus
SGIGLFIVKHIAQHLNL

SEQ ID NO: 1885556 - protein, 17 aa, Staphylococcus
SGIGLFIVKHISQHLHH

SEQ ID NO: 1885557 - protein, 25 aa, Staphylococcus
SGIITRFLPSLAMGYYIFKTTQVEV

SEQ ID NO: 1885558 - protein, 23 aa, Staphylococcus
SGILSVLCSIVLKNKLAPEGLMY

SEQ ID NO: 1885559 - protein, 28 aa, Staphylococcus
SGINHTRFSSFYGMIIYLIVIFILMRIF

SEQ ID NO: 1885560 - protein, 20 aa, Staphylococcus
SGISLLPLIAHQKYLGYIIG

SEQ ID NO: 1885561 - protein, 24 aa, Staphylococcus
SGIYFKRLEFTGIGLLLCQKTIDA

SEQ ID NO: 1885562 - protein, 24 aa, Staphylococcus
SGIYRFYIGGANAFTYFISSILIA

SEQ ID NO: 1885563 - protein, 24 aa, Staphylococcus
SGKDYPLMMALLLFFSFLGLLANL

SEQ ID NO: 1885564 - protein, 17 aa, Staphylococcus
SGKKLSSVFTYSLILTA

SEQ ID NO: 1885565 - protein, 21 aa, Staphylococcus
SGKMLKGDIDSTVNVSDSNFS

SEQ ID NO: 1885566 - protein, 17 aa, Staphylococcus
SGKSVCINGIITSLLLN

SEQ ID NO: 1885567 - protein, 26 aa, Staphylococcus
SGKTYLKHFFWFNGITGIVALILLLT

SEQ ID NO: 1885568 - protein, 18 aa, Staphylococcus
SGLAKWLGEQLKMLDGVH

SEQ ID NO: 1885569 - protein, 19 aa, Staphylococcus
SGLASLAAACFLVRDGQMD

SEQ ID NO: 1885570 - protein, 30 aa, Staphylococcus
SGLFSKRFWPSFKFLLPILLGMGLAIALLS

SEQ ID NO: 1885571 - protein, 30 aa, Staphylococcus
SGLFSKRFWPSLKFLLPILIGMALAIGILS

SEQ ID NO: 1885572 - protein, 31 aa, Staphylococcus
SGLFSKRFWPSLKFLLPILIGMILAIGVLSN

SEQ ID NO: 1885573 - protein, 19 aa, Staphylococcus
SGLIKGYPVLGWTFFIACL

SEQ ID NO: 1885574 - protein, 31 aa, Staphylococcus
SGLKKGIKVLSDWNVILSFVLLGFVLIVGPT

SEQ ID NO: 1885575 - protein, 17 aa, Staphylococcus
SGLLGIAMIVLGYYMAT

SEQ ID NO: 1885576 - protein, 18 aa, Staphylococcus
SGLLGNFISLSFNLHTVS

SEQ ID NO: 1885577 - protein, 24 aa, Staphylococcus
SGLLIPLFTGRLVDKFSTNNINWN

SEQ ID NO: 1885578 - protein, 18 aa, Staphylococcus
SGLLKLGGIMINLMPLLG

SEQ ID NO: 1885579 - protein, 26 aa, Staphylococcus
SGLLSGIVCSIILIIIIISIYRQPLL

SEQ ID NO: 1885580 - protein, 20 aa, Staphylococcus
SGLMKPNISNIVGRLYPQND

SEQ ID NO: 1885581 - protein, 17 aa, Staphylococcus
SGLPEGVTFDPRTNTIS

SEQ ID NO: 1885582 - protein, 17 aa, Staphylococcus
SGLPEGVTFNPTTNTIS

SEQ ID NO: 1885583 - protein, 30 aa, Staphylococcus
SGLPKGLEFKSETLTISGIPKEPGRYDIIV

SEQ ID NO: 1885584 - protein, 19 aa, Staphylococcus
SGLPQGVTFDSRTNTISGV

SEQ ID NO: 1885585 - protein, 20 aa, Staphylococcus
SGLSRLYIGGANAYTYLISS

SEQ ID NO: 1885586 - protein, 20 aa, Staphylococcus
SGMKGKEYLPFVNRSAIAGI

SEQ ID NO: 1885587 - protein, 28 aa, Staphylococcus
SGMLSGSVCAIILFLIIVVVFKQPFLAL

SEQ ID NO: 1885588 - protein, 19 aa, Staphylococcus
SGMMKPNISNIVGRLYTKD

SEQ ID NO: 1885589 - protein, 20 aa, Staphylococcus
SGNGSVWLSAILLVFTAIFY

SEQ ID NO: 1885590 - protein, 18 aa, Staphylococcus
SGNLKKSGYIDLSVGASF

SEQ ID NO: 1885591 - protein, 26 aa, Staphylococcus
SGQLDPNKVYVFLLKNMGVERKVNST

SEQ ID NO: 1885592 - protein, 20 aa, Staphylococcus
SGRKTLPILLGKRASITFMA

SEQ ID NO: 1885593 - protein, 18 aa, Staphylococcus
SGSEHKVPVVPTQYHEMT

SEQ ID NO: 1885594 - protein, 24 aa, Staphylococcus
SGSGAPLPKFWQTADGIKPSVANY

SEQ ID NO: 1885595 - protein, 29 aa, Staphylococcus
SGSLQLGFIISFLSLLGFKNITFFSLFFL

SEQ ID NO: 1885596 - protein, 19 aa, Staphylococcus
SGTIPTIMAYGFKIISVKF

SEQ ID NO: 1885597 - protein, 25 aa, Staphylococcus
SGTLLSIGIICLFKKVYQSHRQNWI

SEQ ID NO: 1885598 - protein, 23 aa, Staphylococcus
SGTNLFLLMSIAIILSTIITLVL

SEQ ID NO: 1885599 - protein, 18 aa, Staphylococcus
SGTSIAIDKIETLPTGAT

SEQ ID NO: 1885600 - protein, 19 aa, Staphylococcus
SGVATKVGIYPIVVTSTDN

SEQ ID NO: 1885601 - protein, 19 aa, Staphylococcus
SGVATKVGTYPIVITSTDA

SEQ ID NO: 1885602 - protein, 18 aa, Staphylococcus
SGVVYKAVDDTFFILTNT

SEQ ID NO: 1885603 - protein, 18 aa, Staphylococcus
SGVVYKIVGDTFFVLTNT

SEQ ID NO: 1885604 - protein, 23 aa, Staphylococcus
SGWGEWKVVTVFWTAGLISGLIG

SEQ ID NO: 1885605 - protein, 24 aa, Staphylococcus
SGWGEWKVVTVFWTVGLISGLIGL

SEQ ID NO: 1885606 - protein, 24 aa, Staphylococcus
SGWNEWKVVSVFWIVGLITGLIGL

SEQ ID NO: 1885607 - protein, 25 aa, Staphylococcus
SGWSEWKVVSVFWLVGLISGLIGLW

SEQ ID NO: 1885608 - protein, 29 aa, Staphylococcus
SGYFVPIVVGIAIFTFIIWISLVQPGQFE

SEQ ID NO: 1885609 - protein, 24 aa, Staphylococcus
SGYLGILCTLVFGLLFSSMFTPFI

SEQ ID NO: 1885610 - protein, 20 aa, Staphylococcus
SGYNAIDVMVIFLREGLEVL

SEQ ID NO: 1885611 - protein, 17 aa, Staphylococcus
SHAFKLTPLHKAGTQTA

SEQ ID NO: 1885612 - protein, 23 aa, Staphylococcus
SHAKNDLNGIARLVEARPKALAY

SEQ ID NO: 1885613 - protein, 26 aa, Staphylococcus
SHAYAKVWLYFMYFWIIFGIGTYFGQ

SEQ ID NO: 1885614 - protein, 21 aa, Staphylococcus
SHAYGKVWLFFVYYWIIFGIG

SEQ ID NO: 1885615 - protein, 25 aa, Staphylococcus
SHCATRLRIVLKRSIPNAKKQVSNL

SEQ ID NO: 1885616 - protein, 24 aa, Staphylococcus
SHDKRKALETMLATKLNDAKAKAL

SEQ ID NO: 1885617 - protein, 18 aa, Staphylococcus
SHDRPIIDGFKGNKKTRI

SEQ ID NO: 1885618 - protein, 18 aa, Staphylococcus
SHFVCSYLGFLPLATFAG

SEQ ID NO: 1885619 - protein, 24 aa, Staphylococcus
SHGLPELIAIFVLVILHVIKRNML

SEQ ID NO: 1885620 - protein, 19 aa, Staphylococcus
SHIAFCIPIVVILVLPQLY

SEQ ID NO: 1885621 - protein, 23 aa, Staphylococcus
SHIALKADFFVPGDVQVKSLTEE

SEQ ID NO: 1885622 - protein, 23 aa, Staphylococcus
SHIKAHAYLTVLIISKFIMIGLV

SEQ ID NO: 1885623 - protein, 19 aa, Staphylococcus
SHIKAMLWTTIPASLVGIV

SEQ ID NO: 1885624 - protein, 17 aa, Staphylococcus
SHIKFNRVLLITIGGII

SEQ ID NO: 1885625 - protein, 20 aa, Staphylococcus
SHIRAMMWTTIPASIIGLIV

SEQ ID NO: 1885626 - protein, 20 aa, Staphylococcus
SHKENRFWGKLGNLSSKHAF

SEQ ID NO: 1885627 - protein, 17 aa, Staphylococcus
SHLELVAYIAFILSSIS

SEQ ID NO: 1885628 - protein, 25 aa, Staphylococcus
SHLKSPRIASGDSWGLGRTLEWSTA

SEQ ID NO: 1885629 - protein, 32 aa, Staphylococcus
SHLMIWPMLIAGILIGPAMYYWGAFGLILEIL

SEQ ID NO: 1885630 - protein, 17 aa, Staphylococcus
SHLPLGTALVIVLLLLT

SEQ ID NO: 1885631 - protein, 18 aa, Staphylococcus
SHLPNYYVLAATHDIELS

SEQ ID NO: 1885632 - protein, 20 aa, Staphylococcus
SHLQLALTVFSLIMVLSIIL

SEQ ID NO: 1885633 - protein, 20 aa, Staphylococcus
SHPIELIVIIIAGYVITINW

SEQ ID NO: 1885634 - protein, 23 aa, Staphylococcus
SHRTTFTMLRNIRVQFVKQLFPR

SEQ ID NO: 1885635 - protein, 19 aa, Staphylococcus
SHRYYNFYGIGAFDENAVH

SEQ ID NO: 1885636 - protein, 21 aa, Staphylococcus
SHSFLVPKLVDGHQVKKTNEV

SEQ ID NO: 1885637 - protein, 24 aa, Staphylococcus
SHSGWLHYFIGMVISFIIAAGLTI

SEQ ID NO: 1885638 - protein, 23 aa, Staphylococcus
SHSNLYIWLIVGFIFGCAPPIQT

SEQ ID NO: 1885639 - protein, 21 aa, Staphylococcus
SHSPVMAGIIALVLGLVILIH

SEQ ID NO: 1885640 - protein, 20 aa, Staphylococcus
SHSSELKVGDIITKVDSKKV

SEQ ID NO: 1885641 - protein, 19 aa, Staphylococcus
SHSWDIPSTILSIAGMIGL

SEQ ID NO: 1885642 - protein, 29 aa, Staphylococcus
SHTFWFKFWSIIEAGGWVIFNHMEIVFVV

SEQ ID NO: 1885643 - protein, 29 aa, Staphylococcus
SHTFWFKFWSVIESGGWVIFNHMEIVFVV

SEQ ID NO: 1885644 - protein, 17 aa, Staphylococcus
SHWWIHPFIQEIKRGNM

SEQ ID NO: 1885645 - protein, 26 aa, Staphylococcus
SIACYFFDFIKRFYKIRNIGFVTLGI

SEQ ID NO: 1885646 - protein, 17 aa, Staphylococcus
SIAERMKFFPFIIFIFL

SEQ ID NO: 1885647 - protein, 22 aa, Staphylococcus
SIAIKLKSSYSMFSPSSQSYID

SEQ ID NO: 1885648 - protein, 20 aa, Staphylococcus
SIALSILSFFLIKHTPETKN

SEQ ID NO: 1885649 - protein, 25 aa, Staphylococcus
SIANEGYHFTVYVPYGDDWFAYFMR

SEQ ID NO: 1885650 - protein, 25 aa, Staphylococcus
SIATGIACGFIFYPITMLMSKRQKE

SEQ ID NO: 1885651 - protein, 25 aa, Staphylococcus
SIATGIACGFIFYPLTMVITKRHKE

SEQ ID NO: 1885652 - protein, 17 aa, Staphylococcus
SICCVIGALLIRDYILF

SEQ ID NO: 1885653 - protein, 20 aa, Staphylococcus
SIDIPSSQFIYFALFPMIVL

SEQ ID NO: 1885654 - protein, 22 aa, Staphylococcus
SIDMMHDLYLKGAHTLVTDRPD

SEQ ID NO: 1885655 - protein, 23 aa, Staphylococcus
SIFIAVPLWGMMKKRQLKKSPDH

SEQ ID NO: 1885656 - protein, 21 aa, Staphylococcus
SIFKACLTFIAAYYLMRYYHL

SEQ ID NO: 1885657 - protein, 17 aa, Staphylococcus
SIFKAMMHFSLPMMIGS

SEQ ID NO: 1885658 - protein, 20 aa, Staphylococcus
SIFLGVIMFFVWPTVQSWIF

SEQ ID NO: 1885659 - protein, 18 aa, Staphylococcus
SIFYLLALLSFPFPVKAI

SEQ ID NO: 1885660 - protein, 19 aa, Staphylococcus
SIGAFIIKLLQGYIPINSA

SEQ ID NO: 1885661 - protein, 25 aa, Staphylococcus
SIGAKWDYIGIFSFLFIISILLFLI

SEQ ID NO: 1885662 - protein, 18 aa, Staphylococcus
SIGDEIKSLIGNFKADIN

SEQ ID NO: 1885663 - protein, 26 aa, Staphylococcus
SIGEFFGHLIAPLGFGSWQAGATLIP

SEQ ID NO: 1885664 - protein, 34 aa, Staphylococcus
SIGIIIYVSLRFEWRMGLSAVLALLHDVFIIVAV

SEQ ID NO: 1885665 - protein, 34 aa, Staphylococcus
SIGIIIYVSLRFEWRMGLSSVLALLHDAFMIVAV

SEQ ID NO: 1885666 - protein, 20 aa, Staphylococcus
SIGIPEAWIHPFTIGGAFVI

SEQ ID NO: 1885667 - protein, 20 aa, Staphylococcus
SIGIPEAWIQPFTIGGAFVI

SEQ ID NO: 1885668 - protein, 18 aa, Staphylococcus
SIGIPFVIAQGGDPIVAG

SEQ ID NO: 1885669 - protein, 18 aa, Staphylococcus
SIGIPFVIAQGGDPVIAG

SEQ ID NO: 1885670 - protein, 26 aa, Staphylococcus
SIGTGSVLLGAFLFVGFQDVAHASEL

SEQ ID NO: 1885671 - protein, 25 aa, Staphylococcus
SIGTIGWRSLPIIFVTLFAAALIVY

SEQ ID NO: 1885672 - protein, 24 aa, Staphylococcus
SIHARKALFNHILTWVCFTLAPLA

SEQ ID NO: 1885673 - protein, 25 aa, Staphylococcus
SIHGFSGDDPIVFVGGKDKKMAKSI

SEQ ID NO: 1885674 - protein, 25 aa, Staphylococcus
SIHHLSRLKAFFVITYIAQLGALLI

SEQ ID NO: 1885675 - protein, 22 aa, Staphylococcus
SIHIGYCLIDIYLTAITIINKF

SEQ ID NO: 1885676 - protein, 25 aa, Staphylococcus
SIHIGYCLIDLYLVGTAWSNRFKYI

SEQ ID NO: 1885677 - protein, 26 aa, Staphylococcus
SIHVICTLASLWIAQQFYREIAQRLI

SEQ ID NO: 1885678 - protein, 20 aa, Staphylococcus
SIIEWVILVKGFKRKIPFLD

SEQ ID NO: 1885679 - protein, 24 aa, Staphylococcus
SIIIPLKAVGGFLLSLTATLGFTT

SEQ ID NO: 1885680 - protein, 20 aa, Staphylococcus
SIIIPLKAVLGFVLSLMATL

SEQ ID NO: 1885681 - protein, 20 aa, Staphylococcus
SIIIPLKAVLGFVLSLVATL

SEQ ID NO: 1885682 - protein, 27 aa, Staphylococcus
SIILFLLVMMSVVLTFMVWNFSPDLNN

SEQ ID NO: 1885683 - protein, 17 aa, Staphylococcus
SIILFTITVIFAISSYT

SEQ ID NO: 1885684 - protein, 28 aa, Staphylococcus
SIILGLLVLISIVLTYLVWNYTPDLNNV

SEQ ID NO: 1885685 - protein, 18 aa, Staphylococcus
SIILILLVLMSVVLTYMI

SEQ ID NO: 1885686 - protein, 18 aa, Staphylococcus
SIILILLVLMSVVLTYMT

SEQ ID NO: 1885687 - protein, 24 aa, Staphylococcus
SIILLLKLRHRDVVKASIDKMRNS

SEQ ID NO: 1885688 - protein, 23 aa, Staphylococcus
SIILLNLMVSFVFIKNQIYFKDH

SEQ ID NO: 1885689 - protein, 17 aa, Staphylococcus
SIILYYFMHGRKAIHYP

SEQ ID NO: 1885690 - protein, 17 aa, Staphylococcus
SIINVIILIASIIFSDK

SEQ ID NO: 1885691 - protein, 24 aa, Staphylococcus
SIIPFLICVAGIFGTMIYQSFVQD

SEQ ID NO: 1885692 - protein, 20 aa, Staphylococcus
SIISGAGWAFGQIITFKAFG

SEQ ID NO: 1885693 - protein, 18 aa, Staphylococcus
SIISRYLTLESFNLYFGI

SEQ ID NO: 1885694 - protein, 24 aa, Staphylococcus
SIISYGIICFCAQPYIIRDLHKNQ

SEQ ID NO: 1885695 - protein, 19 aa, Staphylococcus
SIITLPLVLLFVTLIIPIF

SEQ ID NO: 1885696 - protein, 19 aa, Staphylococcus
SIITMLTVLLFKKNTPANE

SEQ ID NO: 1885697 - protein, 25 aa, Staphylococcus
SIIWLVGSFLFGWYISNFGNYNKTY

SEQ ID NO: 1885698 - protein, 26 aa, Staphylococcus
SIKDESWLKKELNFISKRTYQGIFSF

SEQ ID NO: 1885699 - protein, 28 aa, Staphylococcus
SILAIIEWVILVKWFKRKIPFLDKVVLK

SEQ ID NO: 1885700 - protein, 21 aa, Staphylococcus
SILFFLVAWFFARKPSKILDY

SEQ ID NO: 1885701 - protein, 17 aa, Staphylococcus
SILFSFLIPLMVEGNIL

SEQ ID NO: 1885702 - protein, 17 aa, Staphylococcus
SILFVFKILIFVVPFAI

SEQ ID NO: 1885703 - protein, 22 aa, Staphylococcus
SILGIFICRTLYKRKGHATQFL

SEQ ID NO: 1885704 - protein, 20 aa, Staphylococcus
SILHRPDLSLQDALVTGKVI

SEQ ID NO: 1885705 - protein, 18 aa, Staphylococcus
SILICVTYSLLMVTPISL

SEQ ID NO: 1885706 - protein, 40 aa, Staphylococcus
SILITMAITVNWKLTLIVMLPMPILVILTSYYGRLMSKGF

SEQ ID NO: 1885707 - protein, 18 aa, Staphylococcus
SILIVGNPLGEEFRNTVS

SEQ ID NO: 1885708 - protein, 17 aa, Staphylococcus
SILLFGFIFLIGLFSQC

SEQ ID NO: 1885709 - protein, 24 aa, Staphylococcus
SILLLFCVAHFYKGVDLSVSEWIL

SEQ ID NO: 1885710 - protein, 21 aa, Staphylococcus
SILLLIAHHVFAYIFNLYHRA

SEQ ID NO: 1885711 - protein, 27 aa, Staphylococcus
SILLSISINCVIDIFVIDKFNFITLFT

SEQ ID NO: 1885712 - protein, 19 aa, Staphylococcus
SILNFGLGILYTWVPLKAN

SEQ ID NO: 1885713 - protein, 17 aa, Staphylococcus
SILRPILIQSYPFIKYI

SEQ ID NO: 1885714 - protein, 21 aa, Staphylococcus
SILRRICIPAPVIGGLLFSIL

SEQ ID NO: 1885715 - protein, 22 aa, Staphylococcus
SILVGATLIFGAGHDVAKAAED

SEQ ID NO: 1885716 - protein, 27 aa, Staphylococcus
SILVVGNPLGVDFKGSVSKGIISGLDR

SEQ ID NO: 1885717 - protein, 18 aa, Staphylococcus
SILYLLGVYIVNHVNILK

SEQ ID NO: 1885718 - protein, 19 aa, Staphylococcus
SILYYLAIALIVITIIVVV

SEQ ID NO: 1885719 - protein, 25 aa, Staphylococcus
SIMFPIVLSIGIPPMFFVAMVQTIN

SEQ ID NO: 1885720 - protein, 21 aa, Staphylococcus
SIMGIYILRSFGMAFIMMPIM

SEQ ID NO: 1885721 - protein, 25 aa, Staphylococcus
SIMKLAHIKFWFLIKGLTPIWIFLI

SEQ ID NO: 1885722 - protein, 18 aa, Staphylococcus
SIMLGIAVSPIWVIMLSS

SEQ ID NO: 1885723 - protein, 17 aa, Staphylococcus
SIMLISFIVFIGFDLIR

SEQ ID NO: 1885724 - protein, 17 aa, Staphylococcus
SIMLISFIVFIGFDMIR

SEQ ID NO: 1885725 - protein, 19 aa, Staphylococcus
SINHLWLFLTACLFGQLFI

SEQ ID NO: 1885726 - protein, 21 aa, Staphylococcus
SINKDIVGWIQLKGTSLNYPV

SEQ ID NO: 1885727 - protein, 20 aa, Staphylococcus
SINLIRIVIGISIYTHAGNL

SEQ ID NO: 1885728 - protein, 20 aa, Staphylococcus
SIPERTLKIAVTITLLATIF

SEQ ID NO: 1885729 - protein, 19 aa, Staphylococcus
SIPKFAQGAVIAFVMLIPA

SEQ ID NO: 1885730 - protein, 22 aa, Staphylococcus
SIPMSILIAMVALKLSDVSLNI

SEQ ID NO: 1885731 - protein, 21 aa, Staphylococcus
SIPMSLLIAMIALKLSDVSLN

SEQ ID NO: 1885732 - protein, 23 aa, Staphylococcus
SIPQRRWVYMLALSAAIITALMI

SEQ ID NO: 1885733 - protein, 18 aa, Staphylococcus
SIPSLEIEDASVLDEFYW

SEQ ID NO: 1885734 - protein, 20 aa, Staphylococcus
SIPSNGRWYDHIGIDKDRRE

SEQ ID NO: 1885735 - protein, 17 aa, Staphylococcus
SIQDAHHTWSLDNSISK

SEQ ID NO: 1885736 - protein, 25 aa, Staphylococcus
SIQLIGAITLYFSQYLFQYLAFKVI

SEQ ID NO: 1885737 - protein, 23 aa, Staphylococcus
SIRDESWLNKKLNYITKKTYQGI

SEQ ID NO: 1885738 - protein, 22 aa, Staphylococcus
SIRQFIWFIAIVCILGIWINAA

SEQ ID NO: 1885739 - protein, 19 aa, Staphylococcus
SISEFMFAAGQTFTILMIS

SEQ ID NO: 1885740 - protein, 19 aa, Staphylococcus
SISMILVFIFYYAKLVIET

SEQ ID NO: 1885741 - protein, 18 aa, Staphylococcus
SITMLFVIPTFRYKNFRY

SEQ ID NO: 1885742 - protein, 25 aa, Staphylococcus
SITWDFQTLIGFVFAPFAFLVGVPW

SEQ ID NO: 1885743 - protein, 25 aa, Staphylococcus
SIVCSLFLRYLIKILRQSYLSTNKI

SEQ ID NO: 1885744 - protein, 22 aa, Staphylococcus
SIVGHWRMFVIYLVAGLFGNFA

SEQ ID NO: 1885745 - protein, 25 aa, Staphylococcus
SIVIKIAVILLWIGLIIFALYQNKK

SEQ ID NO: 1885746 - protein, 27 aa, Staphylococcus
SIVKAIKNAPLRTEVKQLLQQAKDLDN

SEQ ID NO: 1885747 - protein, 17 aa, Staphylococcus
SIVLFIFYHFFSDLRYI

SEQ ID NO: 1885748 - protein, 24 aa, Staphylococcus
SIVLGLLLYRFAYYLFPVLVALIL

SEQ ID NO: 1885749 - protein, 18 aa, Staphylococcus
SIVLGVGTAIYLEEYARK

SEQ ID NO: 1885750 - protein, 19 aa, Staphylococcus
SIVLGVVIFFIWPTVQGWI

SEQ ID NO: 1885751 - protein, 17 aa, Staphylococcus
SIVSFIFLLLLLVPGSP

SEQ ID NO: 1885752 - protein, 24 aa, Staphylococcus
SIVSLGTGVGLIFTQFGFPIVDII

SEQ ID NO: 1885753 - protein, 18 aa, Staphylococcus
SIVSWFFFILMINYTVSL

SEQ ID NO: 1885754 - protein, 18 aa, Staphylococcus
SIVSWVFIYVFYNEYISK

SEQ ID NO: 1885755 - protein, 19 aa, Staphylococcus
SIVTHEHYLWWKSPTADAT

SEQ ID NO: 1885756 - protein, 23 aa, Staphylococcus
SIVVLWIYFRKSIPKTFHTENLQ

SEQ ID NO: 1885757 - protein, 22 aa, Staphylococcus
SIVVLWLYFRKVIPNHFEIKNL

SEQ ID NO: 1885758 - protein, 22 aa, Staphylococcus
SIVYRFTTLFTVIAAFFDGIKA

SEQ ID NO: 1885759 - protein, 24 aa, Staphylococcus
SIWSQIRLRRAIKRQGKNPDELLP

SEQ ID NO: 1885760 - protein, 23 aa, Staphylococcus
SIYFYVHNIWLFIVLYAVLQGLF

SEQ ID NO: 1885761 - protein, 22 aa, Staphylococcus
SKAEGIAFWERGLRYFPNSGIL

SEQ ID NO: 1885762 - protein, 25 aa, Staphylococcus
SKAELKFSIDGGKAKAYEQTIMDKI

SEQ ID NO: 1885763 - protein, 19 aa, Staphylococcus
SKAFSILYMWIVRLGDAKL

SEQ ID NO: 1885764 - protein, 17 aa, Staphylococcus
SKAIKWVKVDSEKDAKQ

SEQ ID NO: 1885765 - protein, 17 aa, Staphylococcus
SKALRSAFESDLHVSYQ

SEQ ID NO: 1885766 - protein, 23 aa, Staphylococcus
SKASLVLFMWLPKAYAVLNTELA

SEQ ID NO: 1885767 - protein, 21 aa, Staphylococcus
SKCLQMIVVLFILSTITFILM

SEQ ID NO: 1885768 - protein, 24 aa, Staphylococcus
SKDGIELLIHFGLETVKLDGEGFE

SEQ ID NO: 1885769 - protein, 24 aa, Staphylococcus
SKDGIELLIHFGLETVKLEGKGFD

SEQ ID NO: 1885770 - protein, 24 aa, Staphylococcus
SKDKLAELQKVITIAEKTHTTEYT

SEQ ID NO: 1885771 - protein, 23 aa, Staphylococcus
SKDKSFKQSIIVLDGHSHTVIKN

SEQ ID NO: 1885772 - protein, 26 aa, Staphylococcus
SKDQFKFSLFLAMLLACLLIQAATNM

SEQ ID NO: 1885773 - protein, 18 aa, Staphylococcus
SKDSKYLLVANEEEPSDD

SEQ ID NO: 1885774 - protein, 26 aa, Staphylococcus
SKDTKLPVIFWMHGGGFIAGDKQYKN

SEQ ID NO: 1885775 - protein, 21 aa, Staphylococcus
SKEHLQLMIIIGGIIIITFIL

SEQ ID NO: 1885776 - protein, 25 aa, Staphylococcus
SKENIKKVLLFLSRNTSSSGVESGE

SEQ ID NO: 1885777 - protein, 34 aa, Staphylococcus
SKENKKRFIALILLCAMFSICWIGYIQWETTIAS

SEQ ID NO: 1885778 - protein, 26 aa, Staphylococcus
SKENKTPASIRNFDQAMARAQAQINQ

SEQ ID NO: 1885779 - protein, 25 aa, Staphylococcus
SKENMKRVLAFLSRNTSSSGVEQNQ

SEQ ID NO: 1885780 - protein, 24 aa, Staphylococcus
SKEPRLEPRLGNQYGGKLTLQLDD

SEQ ID NO: 1885781 - protein, 22 aa, Staphylococcus
SKETMQLIMLIGFIVIVSLILW

SEQ ID NO: 1885782 - protein, 17 aa, Staphylococcus
SKFDVIGLILLVITLLS

SEQ ID NO: 1885783 - protein, 20 aa, Staphylococcus
SKFEICMMHDSILLFYIGVW

SEQ ID NO: 1885784 - protein, 17 aa, Staphylococcus
SKFIIKLVGGLFIMSVI

SEQ ID NO: 1885785 - protein, 19 aa, Staphylococcus
SKFMMPLLFIFLIVIVIKS

SEQ ID NO: 1885786 - protein, 19 aa, Staphylococcus
SKFRVALREAGSGMLSGSV

SEQ ID NO: 1885787 - protein, 18 aa, Staphylococcus
SKFVGIIFILLGLVTVLT

SEQ ID NO: 1885788 - protein, 19 aa, Staphylococcus
SKFVSSFSVYGGIVLGLIV

SEQ ID NO: 1885789 - protein, 18 aa, Staphylococcus
SKGEPFTIALFGVDSDAK

SEQ ID NO: 1885790 - protein, 20 aa, Staphylococcus
SKGFFKSAFVAPDEVIKSKH

SEQ ID NO: 1885791 - protein, 22 aa, Staphylococcus
SKGNYRLSVKGIYGEDYSTLKK

SEQ ID NO: 1885792 - protein, 22 aa, Staphylococcus
SKHFEFSQLLSATQSGDIIKAK

SEQ ID NO: 1885793 - protein, 19 aa, Staphylococcus
SKHGRISITDVVFTSSIMH

SEQ ID NO: 1885794 - protein, 23 aa, Staphylococcus
SKHLPVGTVYAFFVGIGAVGTVL

SEQ ID NO: 1885795 - protein, 18 aa, Staphylococcus
SKHLTGFVYPMVSKDKFK

SEQ ID NO: 1885796 - protein, 21 aa, Staphylococcus
SKHSGVFIYKDLKSIEDTNNA

SEQ ID NO: 1885797 - protein, 17 aa, Staphylococcus
SKHYYIMIICMAVLTFA

SEQ ID NO: 1885798 - protein, 17 aa, Staphylococcus
SKIFTFSTITSMIVMMS

SEQ ID NO: 1885799 - protein, 18 aa, Staphylococcus
SKIGYVMQSNSMMTGTIR

SEQ ID NO: 1885800 - protein, 21 aa, Staphylococcus
SKIIERFPKSIIFIAPMIVFV

SEQ ID NO: 1885801 - protein, 18 aa, Staphylococcus
SKIIESFIPFPMPASVIG

SEQ ID NO: 1885802 - protein, 18 aa, Staphylococcus
SKINMPRKEATPDAPIVE

SEQ ID NO: 1885803 - protein, 18 aa, Staphylococcus
SKINMSRKEVTPDSPVIE

SEQ ID NO: 1885804 - protein, 18 aa, Staphylococcus
SKINWKVFLTPIILTLVL

SEQ ID NO: 1885805 - protein, 19 aa, Staphylococcus
SKKANERLNSDKTEQNDKK

SEQ ID NO: 1885806 - protein, 19 aa, Staphylococcus
SKKKVIFIVLIIAVVLAML

SEQ ID NO: 1885807 - protein, 17 aa, Staphylococcus
SKKLKEAKFLNNEMEEL

SEQ ID NO: 1885808 - protein, 39 aa, Staphylococcus
SKKLNEAIPLFAGVIVILAFVLLMIVFRSIIIPLKAVLG

SEQ ID NO: 1885809 - protein, 24 aa, Staphylococcus
SKKNRKWYLPFGYAAEDIELNNIS

SEQ ID NO: 1885810 - protein, 32 aa, Staphylococcus
SKKYYKNLDEQVLALITGEIGSMPELKKPSDR

SEQ ID NO: 1885811 - protein, 20 aa, Staphylococcus
SKLGGTYLWPIVAISNICQG

SEQ ID NO: 1885812 - protein, 20 aa, Staphylococcus
SKLGGTYLWPIVAISNMCQG

SEQ ID NO: 1885813 - protein, 17 aa, Staphylococcus
SKLILQVLFNLIDNALK

SEQ ID NO: 1885814 - protein, 24 aa, Staphylococcus
SKLIPVFFIRRWFDNKTTIASAFL

SEQ ID NO: 1885815 - protein, 18 aa, Staphylococcus
SKLIPVLFIKRWFDTKTT

SEQ ID NO: 1885816 - protein, 24 aa, Staphylococcus
SKLIPVLFIRRWFDTKTTIASAFL

SEQ ID NO: 1885817 - protein, 22 aa, Staphylococcus
SKLKIYIVLIVFVIVMMLSLSW

SEQ ID NO: 1885818 - protein, 20 aa, Staphylococcus
SKLKMPRKETKPEAPDIESN

SEQ ID NO: 1885819 - protein, 19 aa, Staphylococcus
SKLKRFINTYPELHHSLSH

SEQ ID NO: 1885820 - protein, 24 aa, Staphylococcus
SKLLPVLFIRRWFDTKTTIASAFL

SEQ ID NO: 1885821 - protein, 32 aa, Staphylococcus
SKLPGINTSMDWDRKYPYGDLLRGLYGDVSTT

SEQ ID NO: 1885822 - protein, 38 aa, Staphylococcus
SKLSSYLKVSCSALILSSSLVGYGFTKDAFAATQDAET

SEQ ID NO: 1885823 - protein, 21 aa, Staphylococcus
SKLTLTFGISKSFMKKLGLSS

SEQ ID NO: 1885824 - protein, 25 aa, Staphylococcus
SKLTLTFGVSKSFLKKIGMKDKIPK

SEQ ID NO: 1885825 - protein, 21 aa, Staphylococcus
SKLTLTFGVSKSFMKKLGLSD

SEQ ID NO: 1885826 - protein, 21 aa, Staphylococcus
SKLTLTYGVSKSFLKKIGLSS

SEQ ID NO: 1885827 - protein, 19 aa, Staphylococcus
SKMMMPLLFVFLIIVVAKS

SEQ ID NO: 1885828 - protein, 22 aa, Staphylococcus
SKNILPGLVFGVLAYFFAKSKV

SEQ ID NO: 1885829 - protein, 18 aa, Staphylococcus
SKNKLEVGLGRDISGDPI

SEQ ID NO: 1885830 - protein, 43 aa, Staphylococcus
SKNKMSNLAKIVSAIIVVILLFTLAFATFSFVDHSKKGSERLS

SEQ ID NO: 1885831 - protein, 18 aa, Staphylococcus
SKNQNMWLLILIIPTWIN

SEQ ID NO: 1885832 - protein, 17 aa, Staphylococcus
SKNYTRTFYKFAEAVDQ

SEQ ID NO: 1885833 - protein, 22 aa, Staphylococcus
SKPIISTLFLILGIVSSMVSLP

SEQ ID NO: 1885834 - protein, 23 aa, Staphylococcus
SKPLRTMIYFGLFIFAISLIYII

SEQ ID NO: 1885835 - protein, 19 aa, Staphylococcus
SKPQIVFMIVVPNSSNNTH

SEQ ID NO: 1885836 - protein, 18 aa, Staphylococcus
SKPSEFITTILIGNNIAN

SEQ ID NO: 1885837 - protein, 19 aa, Staphylococcus
SKQEFAQLLLSIARSCQSN

SEQ ID NO: 1885838 - protein, 22 aa, Staphylococcus
SKRIAVPICIHILMNSYVVVIQ

SEQ ID NO: 1885839 - protein, 21 aa, Staphylococcus
SKRTTHIFFIIARLALLFATF

SEQ ID NO: 1885840 - protein, 21 aa, Staphylococcus
SKRVFAALGIGIVSGTILHLA

SEQ ID NO: 1885841 - protein, 18 aa, Staphylococcus
SKRWIRFIHETEMPEFLI

SEQ ID NO: 1885842 - protein, 17 aa, Staphylococcus
SKSCFDVNYSLEVPLKE

SEQ ID NO: 1885843 - protein, 22 aa, Staphylococcus
SKSEWRKTLFEIAGSSENKMKN

SEQ ID NO: 1885844 - protein, 22 aa, Staphylococcus
SKSGYKPIWIIISFAILLIILL

SEQ ID NO: 1885845 - protein, 39 aa, Staphylococcus
SKSHPRIIGTLLAAFGAAFIWFIILMIMKKRKKQENEEE

SEQ ID NO: 1885846 - protein, 17 aa, Staphylococcus
SKSKVISSFSIYSSLIL

SEQ ID NO: 1885847 - protein, 19 aa, Staphylococcus
SKSVIIGLILLLIVMILCF

SEQ ID NO: 1885848 - protein, 23 aa, Staphylococcus
SKSWLRRIDWVLIGILIVMAAIS

SEQ ID NO: 1885849 - protein, 22 aa, Staphylococcus
SKTEIILGSTDGEWLINDITII

SEQ ID NO: 1885850 - protein, 21 aa, Staphylococcus
SKTELYFLFYAPIAITLMAVS

SEQ ID NO: 1885851 - protein, 26 aa, Staphylococcus
SKTFGYKRFEVLAALFNGVTLFVISI

SEQ ID NO: 1885852 - protein, 17 aa, Staphylococcus
SKTLISLVQNVVKYIVW

SEQ ID NO: 1885853 - protein, 19 aa, Staphylococcus
SKTSKELPETGSKQESNSN

SEQ ID NO: 1885854 - protein, 24 aa, Staphylococcus
SKTSPEFQRLLLLHNTAQGIHSEL

SEQ ID NO: 1885855 - protein, 21 aa, Staphylococcus
SKTTLWLSLIITLFFTIVEFV

SEQ ID NO: 1885856 - protein, 24 aa, Staphylococcus
SKTVGRYGWKTILYFEIITTIAIA

SEQ ID NO: 1885857 - protein, 21 aa, Staphylococcus
SKVALLAAFIPIISGMSGNSG

SEQ ID NO: 1885858 - protein, 23 aa, Staphylococcus
SKVARIFYSIVSFIVNLFRAIPF

SEQ ID NO: 1885859 - protein, 19 aa, Staphylococcus
SKVELLKLMKSDADSRINQ

SEQ ID NO: 1885860 - protein, 17 aa, Staphylococcus
SKVGLDYEGKIGPSEVL

SEQ ID NO: 1885861 - protein, 21 aa, Staphylococcus
SKVIGIPKWIQFLFIIIVAMV

SEQ ID NO: 1885862 - protein, 20 aa, Staphylococcus
SKVISSFSIYSSLILGIIVA

SEQ ID NO: 1885863 - protein, 25 aa, Staphylococcus
SKVLRPAEVAKFIIITFLILVANSV

SEQ ID NO: 1885864 - protein, 19 aa, Staphylococcus
SKVMMPLLFVFLILIVIKS

SEQ ID NO: 1885865 - protein, 25 aa, Staphylococcus
SKVNRVAVPISIFFGGVKMMMPNMV

SEQ ID NO: 1885866 - protein, 27 aa, Staphylococcus
SKVNVSIIPSGLSTKMEIEYINPEGKS

SEQ ID NO: 1885867 - protein, 25 aa, Staphylococcus
SKVTLMILMFIGRVGLISFIIMIGG

SEQ ID NO: 1885868 - protein, 19 aa, Staphylococcus
SKVTMPRKDVAPEGPVLKS

SEQ ID NO: 1885869 - protein, 18 aa, Staphylococcus
SKWSFSKLLNYGIDGLIS

SEQ ID NO: 1885870 - protein, 25 aa, Staphylococcus
SKWTFRKLLNYGIDGLISFNNKPLR

SEQ ID NO: 1885871 - protein, 22 aa, Staphylococcus
SKYLIHITLTFTIFILSVVFVI

SEQ ID NO: 1885872 - protein, 23 aa, Staphylococcus
SKYPQPYRYGFYSFADKNRINGG

SEQ ID NO: 1885873 - protein, 20 aa, Staphylococcus
SKYSAVFIYQDLKSIEDTNN

SEQ ID NO: 1885874 - protein, 17 aa, Staphylococcus
SKYSYMLHELGYNATTV

SEQ ID NO: 1885875 - protein, 17 aa, Staphylococcus
SKYTVYAVRSMPDEGVS

SEQ ID NO: 1885876 - protein, 19 aa, Staphylococcus
SLAALRSIFHVNVLVVVLL

SEQ ID NO: 1885877 - protein, 23 aa, Staphylococcus
SLAESISKVTELNKAMEDLHNAL

SEQ ID NO: 1885878 - protein, 18 aa, Staphylococcus
SLAIFLGVSFLFIPIFSI

SEQ ID NO: 1885879 - protein, 18 aa, Staphylococcus
SLALILFILLFIERSEYR

SEQ ID NO: 1885880 - protein, 26 aa, Staphylococcus
SLATGSYKYNPYIINQVNRLGNNNEY

SEQ ID NO: 1885881 - protein, 25 aa, Staphylococcus
SLCGVIFKRLEYTAVGLLFSQKTID

SEQ ID NO: 1885882 - protein, 19 aa, Staphylococcus
SLDGSKPQIVFMIVVPNSS

SEQ ID NO: 1885883 - protein, 17 aa, Staphylococcus
SLDQFKSKYDIYKDVAI

SEQ ID NO: 1885884 - protein, 23 aa, Staphylococcus
SLEGLKPTLIFPVLSVSITGLLM

SEQ ID NO: 1885885 - protein, 23 aa, Staphylococcus
SLEGLKPTLIYPLLSVAITGLLM

SEQ ID NO: 1885886 - protein, 21 aa, Staphylococcus
SLEPSIYMPLIKKLKENNDYV

SEQ ID NO: 1885887 - protein, 23 aa, Staphylococcus
SLEQARFPDRFTIKYHIDDAYKQ

SEQ ID NO: 1885888 - protein, 24 aa, Staphylococcus
SLEQARFPNRFHIDYHIDKQYHHI

SEQ ID NO: 1885889 - protein, 25 aa, Staphylococcus
SLEQARFPNRFNINFDIDSACRNAL

SEQ ID NO: 1885890 - protein, 22 aa, Staphylococcus
SLEVEGASVLDEFYWLNKEDPN

SEQ ID NO: 1885891 - protein, 24 aa, Staphylococcus
SLFAALGGLFLVGRRRKNKNNEEK

SEQ ID NO: 1885892 - protein, 17 aa, Staphylococcus
SLFAFAYYQFGKWDQKV

SEQ ID NO: 1885893 - protein, 18 aa, Staphylococcus
SLFAFFLLTVFTITLKTY

SEQ ID NO: 1885894 - protein, 18 aa, Staphylococcus
SLFAFFLLTVFTVTLKTY

SEQ ID NO: 1885895 - protein, 19 aa, Staphylococcus
SLFAFFLMTVFTITLKTYF

SEQ ID NO: 1885896 - protein, 19 aa, Staphylococcus
SLFAFFLMTVFTVTLKTYF

SEQ ID NO: 1885897 - protein, 19 aa, Staphylococcus
SLFIAQWIIENMFKATTEF

SEQ ID NO: 1885898 - protein, 24 aa, Staphylococcus
SLFITGLLGFFIARTITKPITDMR

SEQ ID NO: 1885899 - protein, 19 aa, Staphylococcus
SLFLPINFMFYLFLFTFMI

SEQ ID NO: 1885900 - protein, 17 aa, Staphylococcus
SLFRYLFLFTFIIGGVF

SEQ ID NO: 1885901 - protein, 18 aa, Staphylococcus
SLFVPRILNFMTLNLFLA

SEQ ID NO: 1885902 - protein, 26 aa, Staphylococcus
SLGFDKKAIFPFIIASGFIADTTSLP

SEQ ID NO: 1885903 - protein, 20 aa, Staphylococcus
SLGFTAGWLYWAIWSLVTSV

SEQ ID NO: 1885904 - protein, 25 aa, Staphylococcus
SLGGFSWPIVLVLLILFFFYSHYLF

SEQ ID NO: 1885905 - protein, 26 aa, Staphylococcus
SLGGLSWPVVLVILIIFYFYSHYLFA

SEQ ID NO: 1885906 - protein, 25 aa, Staphylococcus
SLGGTFLFVKLINFIKVKEVIFVPL

SEQ ID NO: 1885907 - protein, 19 aa, Staphylococcus
SLGIFMGRFLRLHTVYLVN

SEQ ID NO: 1885908 - protein, 18 aa, Staphylococcus
SLGMIWIALFSMMLPLFN

SEQ ID NO: 1885909 - protein, 18 aa, Staphylococcus
SLGPRKVLLIGTVLFTIT

SEQ ID NO: 1885910 - protein, 21 aa, Staphylococcus
SLHFPIKVTIFTKCLNILLLI

SEQ ID NO: 1885911 - protein, 21 aa, Staphylococcus
SLHHDAKDELPDTGDSDSNST

SEQ ID NO: 1885912 - protein, 21 aa, Staphylococcus
SLHIYASIIAIVFGFLLHINR

SEQ ID NO: 1885913 - protein, 18 aa, Staphylococcus
SLHMGLRVFMLLTLFSGF

SEQ ID NO: 1885914 - protein, 24 aa, Staphylococcus
SLHSAAAISLYWVVSASFLIVQTH

SEQ ID NO: 1885915 - protein, 43 aa, Staphylococcus
SLIALILSVFLFFKGKKAYWFIFIGGFLLSFLLYANVVYFRFF

SEQ ID NO: 1885916 - protein, 19 aa, Staphylococcus
SLIFIRQRLTMVILNGIIG

SEQ ID NO: 1885917 - protein, 18 aa, Staphylococcus
SLIFLIIGCLIFFYLKIG

SEQ ID NO: 1885918 - protein, 17 aa, Staphylococcus
SLIGAKYLFLFALVLEM

SEQ ID NO: 1885919 - protein, 17 aa, Staphylococcus
SLIGLMFFLTCFPGILL

SEQ ID NO: 1885920 - protein, 23 aa, Staphylococcus
SLIGVLMLIGIVVTNAIVLIDRV

SEQ ID NO: 1885921 - protein, 24 aa, Staphylococcus
SLIGVVCGAIIGSFIALAKLSKFK

SEQ ID NO: 1885922 - protein, 34 aa, Staphylococcus
SLIIGHAAWGWIIGVPGLIAWQAFSIFIGTIQAY

SEQ ID NO: 1885923 - protein, 20 aa, Staphylococcus
SLIIRTILYFFTKRNLDEVE

SEQ ID NO: 1885924 - protein, 24 aa, Staphylococcus
SLIISVVLYFSFVTLKYAHHLHGN

SEQ ID NO: 1885925 - protein, 21 aa, Staphylococcus
SLILATLFFFGLKVYQGKQNL

SEQ ID NO: 1885926 - protein, 19 aa, Staphylococcus
SLILIIASFIGWYFWSTWS

SEQ ID NO: 1885927 - protein, 23 aa, Staphylococcus
SLILSIILYFSFVTLQYTHSLNN

SEQ ID NO: 1885928 - protein, 19 aa, Staphylococcus
SLIPFIIATFLFKKTNGFF

SEQ ID NO: 1885929 - protein, 23 aa, Staphylococcus
SLIPVLCGIIVGYIVAIFMGLVH

SEQ ID NO: 1885930 - protein, 24 aa, Staphylococcus
SLIPYIIAQYFYKKTNGFFLLAPL

SEQ ID NO: 1885931 - protein, 20 aa, Staphylococcus
SLIRTSRFDTILSMISVIIA

SEQ ID NO: 1885932 - protein, 30 aa, Staphylococcus
SLISLPAYGWRPIKKRIKHSISGIIKAIDE

SEQ ID NO: 1885933 - protein, 23 aa, Staphylococcus
SLITNIYIVWGIALFIGLMYGFL

SEQ ID NO: 1885934 - protein, 30 aa, Staphylococcus
SLKLLKLGGKILIFYFIFCGILAICQNLIS

SEQ ID NO: 1885935 - protein, 24 aa, Staphylococcus
SLKLLYNYWQPILYRSSIQKIHLH

SEQ ID NO: 1885936 - protein, 22 aa, Staphylococcus
SLKQLHPDYQFKTHLSKKPLTL

SEQ ID NO: 1885937 - protein, 23 aa, Staphylococcus
SLKTKLSNFFSNYSFTLNSAISR

SEQ ID NO: 1885938 - protein, 21 aa, Staphylococcus
SLLASLLVSITIVPALSATFF

SEQ ID NO: 1885939 - protein, 20 aa, Staphylococcus
SLLASLLVSITIVPALSSTF

SEQ ID NO: 1885940 - protein, 17 aa, Staphylococcus
SLLCLIVGIFSYVLLAA

SEQ ID NO: 1885941 - protein, 31 aa, Staphylococcus
SLLDLVTRLEQTRNSLANVITRSQSGKRDPR

SEQ ID NO: 1885942 - protein, 18 aa, Staphylococcus
SLLEKEGAHVKMTRSNDT

SEQ ID NO: 1885943 - protein, 19 aa, Staphylococcus
SLLGLFQFILGGVISPLVG

SEQ ID NO: 1885944 - protein, 18 aa, Staphylococcus
SLLICFIGFFVTYYLFEL

SEQ ID NO: 1885945 - protein, 18 aa, Staphylococcus
SLLIIIPILILSFIVSKL

SEQ ID NO: 1885946 - protein, 24 aa, Staphylococcus
SLLKMSVKGLDEFDSNQLKSHVIY

SEQ ID NO: 1885947 - protein, 19 aa, Staphylococcus
SLLKQPIIMLSLIVLFFGQ

SEQ ID NO: 1885948 - protein, 17 aa, Staphylococcus
SLLKVKDLWIIIIFITF

SEQ ID NO: 1885949 - protein, 19 aa, Staphylococcus
SLLLGVFLYFIGKDHYANP

SEQ ID NO: 1885950 - protein, 23 aa, Staphylococcus
SLLLITGVLDWKDILNETGAWNT

SEQ ID NO: 1885951 - protein, 19 aa, Staphylococcus
SLLPSMFHTKVRLRTLSLV

SEQ ID NO: 1885952 - protein, 19 aa, Staphylococcus
SLLSILGVFLIAGFSFQGT

SEQ ID NO: 1885953 - protein, 18 aa, Staphylococcus
SLLSRYLTLESFNLYFGI

SEQ ID NO: 1885954 - protein, 20 aa, Staphylococcus
SLLSSFSALIPILGSLVPAV

SEQ ID NO: 1885955 - protein, 27 aa, Staphylococcus
SLLTICTLLLCFLKADTSYIYLIVIYA

SEQ ID NO: 1885956 - protein, 19 aa, Staphylococcus
SLLTILGVFLVAGFSFQGT

SEQ ID NO: 1885957 - protein, 17 aa, Staphylococcus
SLLYISIAVSFVMLIGG

SEQ ID NO: 1885958 - protein, 36 aa, Staphylococcus
SLMARYYLMLKGISFSLDFLLQYLFHGRNMDNNMFL

SEQ ID NO: 1885959 - protein, 18 aa, Staphylococcus
SLMGFCLMQFPLEIIEER

SEQ ID NO: 1885960 - protein, 20 aa, Staphylococcus
SLMKKPRFIIPMLLQGLTYV

SEQ ID NO: 1885961 - protein, 25 aa, Staphylococcus
SLMPYSIALTIVWIAFTLIWFLLGI

SEQ ID NO: 1885962 - protein, 24 aa, Staphylococcus
SLMPYSIALTIVWTLFTLIWFLLG

SEQ ID NO: 1885963 - protein, 17 aa, Staphylococcus
SLMSFCLMQFPIEIIEE

SEQ ID NO: 1885964 - protein, 24 aa, Staphylococcus
SLNFLCAIIAFAMFNDLQRQFLSP

SEQ ID NO: 1885965 - protein, 25 aa, Staphylococcus
SLNGLKWTAVLSVMPLLILALIITM

SEQ ID NO: 1885966 - protein, 26 aa, Staphylococcus
SLNGLKWTQLLAVVPWIIVAVVVTLM

SEQ ID NO: 1885967 - protein, 34 aa, Staphylococcus
SLNGMKWKDVMIICPWVLMGLIILIGFARQLTIM

SEQ ID NO: 1885968 - protein, 17 aa, Staphylococcus
SLNHIFISPSAKFVKKV

SEQ ID NO: 1885969 - protein, 19 aa, Staphylococcus
SLNLIRIIVGISIYTHAGN

SEQ ID NO: 1885970 - protein, 21 aa, Staphylococcus
SLNLIRIVIGISIYTHAGNLI

SEQ ID NO: 1885971 - protein, 23 aa, Staphylococcus
SLNLIRIVIGISIYTHAGNLIIM

SEQ ID NO: 1885972 - protein, 21 aa, Staphylococcus
SLNQKAKLILALNEYMPNIQK

SEQ ID NO: 1885973 - protein, 18 aa, Staphylococcus
SLNRHLNNDGNYEKEKDK

SEQ ID NO: 1885974 - protein, 21 aa, Staphylococcus
SLPALGWINLERKLVKSMTAL

SEQ ID NO: 1885975 - protein, 31 aa, Staphylococcus
SLPASGQVLKTYWPVLAIGMILIGGGLLLLA

SEQ ID NO: 1885976 - protein, 25 aa, Staphylococcus
SLPIDFKKLMIIGSLVSVCTAVVPM

SEQ ID NO: 1885977 - protein, 24 aa, Staphylococcus
SLPIDFRKLMIIGALISLITAIAP

SEQ ID NO: 1885978 - protein, 25 aa, Staphylococcus
SLPLADIGLFVSMFFIIIGSGLMKP

SEQ ID NO: 1885979 - protein, 20 aa, Staphylococcus
SLPQRRWVYFLVLSTSGLIA

SEQ ID NO: 1885980 - protein, 26 aa, Staphylococcus
SLPTSVPIKKDFNANLIYQTEGINMN

SEQ ID NO: 1885981 - protein, 24 aa, Staphylococcus
SLPVDFRKLMILGALISVTTAIVP

SEQ ID NO: 1885982 - protein, 19 aa, Staphylococcus
SLPVKFGLGTLLAGASYIL

SEQ ID NO: 1885983 - protein, 26 aa, Staphylococcus
SLPVKIITWFIGILVVLAIVASIFVV

SEQ ID NO: 1885984 - protein, 20 aa, Staphylococcus
SLQFKYRTMPIIGMTTNMTI

SEQ ID NO: 1885985 - protein, 24 aa, Staphylococcus
SLQNRFLIMVTWNIDEAGGVVKLI

SEQ ID NO: 1885986 - protein, 24 aa, Staphylococcus
SLQSASALSLYWAISATFLIIQMH

SEQ ID NO: 1885987 - protein, 37 aa, Staphylococcus
SLRDEMKFEPEFKPSQIKAAIFFGGFYDMKTVKSTEF

SEQ ID NO: 1885988 - protein, 19 aa, Staphylococcus
SLRGFSLIGIFLANLLIFQ

SEQ ID NO: 1885989 - protein, 20 aa, Staphylococcus
SLRGFSLLGIFLANLLIFQF

SEQ ID NO: 1885990 - protein, 18 aa, Staphylococcus
SLRKGYRRLPATVIGALF

SEQ ID NO: 1885991 - protein, 24 aa, Staphylococcus
SLSLFCLFLGYALLDRNIHRSFEN

SEQ ID NO: 1885992 - protein, 25 aa, Staphylococcus
SLSLGSWRIIFVILTAISMIMLGGV

SEQ ID NO: 1885993 - protein, 20 aa, Staphylococcus
SLTKLSRLINKSMNLDDAMK

SEQ ID NO: 1885994 - protein, 17 aa, Staphylococcus
SLTSEGVQAYKAAVDSL

SEQ ID NO: 1885995 - protein, 19 aa, Staphylococcus
SLTWTILGGIAFIALLRFF

SEQ ID NO: 1885996 - protein, 25 aa, Staphylococcus
SLVEVKNRTMHLGNTKYVYDPSIGK

SEQ ID NO: 1885997 - protein, 21 aa, Staphylococcus
SLVIGAAIGPFFGLLLINSFP

SEQ ID NO: 1885998 - protein, 25 aa, Staphylococcus
SLVIPRVVAILGIISAIITIKDKDL

SEQ ID NO: 1885999 - protein, 21 aa, Staphylococcus
SLVLAFAFFFALKTYQGHKNI

SEQ ID NO: 1886000 - protein, 24 aa, Staphylococcus
SLVLGTAIGPFFGILLLKSFSINL

SEQ ID NO: 1886001 - protein, 20 aa, Staphylococcus
SLVLGTAIGPFFGLLLSSHY

SEQ ID NO: 1886002 - protein, 20 aa, Staphylococcus
SLVLGTAIGPFFGLLLVKSF

SEQ ID NO: 1886003 - protein, 24 aa, Staphylococcus
SLVLGTAIGPFFGMLLMNSFSIQI

SEQ ID NO: 1886004 - protein, 21 aa, Staphylococcus
SLVLGTAVGPFFGILLLNAFS

SEQ ID NO: 1886005 - protein, 19 aa, Staphylococcus
SLVRTVFGLLVGVFTSLSA

SEQ ID NO: 1886006 - protein, 25 aa, Staphylococcus
SLVSDLLGIFAMKKLFVNNKMSGIL

SEQ ID NO: 1886007 - protein, 24 aa, Staphylococcus
SLVSIGTAIGLIFTQIGFPIVDII

SEQ ID NO: 1886008 - protein, 24 aa, Staphylococcus
SLVSIGTAIGLVFTQFGLPIVDII

SEQ ID NO: 1886009 - protein, 24 aa, Staphylococcus
SLVSIGTAVGLVFTQIGFPIIDIV

SEQ ID NO: 1886010 - protein, 24 aa, Staphylococcus
SLVTMMTVLIFKRHTPANEVNAHE

SEQ ID NO: 1886011 - protein, 32 aa, Staphylococcus
SLVTSVLLFFAFRTSNNFKIQHRMIASFGQML

SEQ ID NO: 1886012 - protein, 19 aa, Staphylococcus
SLWGMERFFQRGKIGVFIV

SEQ ID NO: 1886013 - protein, 17 aa, Staphylococcus
SLYDLFGAIGLVMIGTY

SEQ ID NO: 1886014 - protein, 18 aa, Staphylococcus
SLYIFSMSAFLIGSIIAA

SEQ ID NO: 1886015 - protein, 20 aa, Staphylococcus
SLYIIAVVFGLLATVITACI

SEQ ID NO: 1886016 - protein, 29 aa, Staphylococcus
SLYLFIGLAILCFVLYIAFGKYGNVTLGK

SEQ ID NO: 1886017 - protein, 24 aa, Staphylococcus
SLYSEILKAGIEYANEQTSKYTVY

SEQ ID NO: 1886018 - protein, 23 aa, Staphylococcus
SMAAMVIVTFTWVVLGFSLSFGT

SEQ ID NO: 1886019 - protein, 21 aa, Staphylococcus
SMIHSHGWHGINFNSPFADMA

SEQ ID NO: 1886020 - protein, 25 aa, Staphylococcus
SMIHTQGWIKLSFIDSLPLKSYSLE

SEQ ID NO: 1886021 - protein, 17 aa, Staphylococcus
SMIKLIFVCSIINAIIL

SEQ ID NO: 1886022 - protein, 28 aa, Staphylococcus
SMIRTVILCSLSFAVCMILGTLTVTEPI

SEQ ID NO: 1886023 - protein, 21 aa, Staphylococcus
SMKSPYKFRKLTSFVSFIINV

SEQ ID NO: 1886024 - protein, 20 aa, Staphylococcus
SMLIPICFIVANFIIYIISN

SEQ ID NO: 1886025 - protein, 25 aa, Staphylococcus
SMLRTVIICSLSFSLCMMLGTLTII

SEQ ID NO: 1886026 - protein, 22 aa, Staphylococcus
SMMGSMLLKVGNFKTSIARGLT

SEQ ID NO: 1886027 - protein, 19 aa, Staphylococcus
SMMMTFLFITPKYSSSTQV

SEQ ID NO: 1886028 - protein, 21 aa, Staphylococcus
SMPEYWIAIVAIYYMGVKWQL

SEQ ID NO: 1886029 - protein, 19 aa, Staphylococcus
SMVILRPMVEVIIYKHIII

SEQ ID NO: 1886030 - protein, 24 aa, Staphylococcus
SMVLPWKEFGGIFATFPAVFLVSM

SEQ ID NO: 1886031 - protein, 19 aa, Staphylococcus
SMVTLIVLSFYNWQMSAIL

SEQ ID NO: 1886032 - protein, 30 aa, Staphylococcus
SMVTRVISRWASEYDIFFKRYSSDQFVAYL

SEQ ID NO: 1886033 - protein, 17 aa, Staphylococcus
SMYKRRYNKYYGDDAGE

SEQ ID NO: 1886034 - protein, 19 aa, Staphylococcus
SMYSMWKEPIFNLVLVNEP

SEQ ID NO: 1886035 - protein, 17 aa, Staphylococcus
SNAATLVLAEHIDGSSS

SEQ ID NO: 1886036 - protein, 26 aa, Staphylococcus
SNADDNYFRYGGYNEYVKTESNQRRG

SEQ ID NO: 1886037 - protein, 22 aa, Staphylococcus
SNAGGLAIIIGWIITAVGMISL

SEQ ID NO: 1886038 - protein, 19 aa, Staphylococcus
SNAKNALNQKAQEQHNIIF

SEQ ID NO: 1886039 - protein, 24 aa, Staphylococcus
SNAPSGSQFSWVDSPDTWKNTIGE

SEQ ID NO: 1886040 - protein, 22 aa, Staphylococcus
SNAPWNIFLKRFSFYALAAQYF

SEQ ID NO: 1886041 - protein, 20 aa, Staphylococcus
SNASHSFSTSHSVSESNSMS

SEQ ID NO: 1886042 - protein, 23 aa, Staphylococcus
SNAYVPSVVGLICSSYVINDILK

SEQ ID NO: 1886043 - protein, 17 aa, Staphylococcus
SNDKLEVGLGRDISGDP

SEQ ID NO: 1886044 - protein, 18 aa, Staphylococcus
SNDLRLMVICWGLTLFCL

SEQ ID NO: 1886045 - protein, 24 aa, Staphylococcus
SNDPEFKKAMLILVISTIGYVGYV

SEQ ID NO: 1886046 - protein, 19 aa, Staphylococcus
SNDSYRSKLLDQHQQVNQK

SEQ ID NO: 1886047 - protein, 27 aa, Staphylococcus
SNEVPKRKDFVVSFITGAIIGSTIGLL

SEQ ID NO: 1886048 - protein, 26 aa, Staphylococcus
SNFYISLLIFVCLLYFVAIKRLTLIC

SEQ ID NO: 1886049 - protein, 24 aa, Staphylococcus
SNGIWSFLVTWGFLQSKKSQRIFT

SEQ ID NO: 1886050 - protein, 23 aa, Staphylococcus
SNGLWSFFVTWGFLQSKQSQRVF

SEQ ID NO: 1886051 - protein, 33 aa, Staphylococcus
SNHFHTACTFSAIPEDAKLVWIDFENPTKNDQA

SEQ ID NO: 1886052 - protein, 21 aa, Staphylococcus
SNHIAGFIITLLIIALTVIIK

SEQ ID NO: 1886053 - protein, 19 aa, Staphylococcus
SNHPLAISIVDFAKSKNVS

SEQ ID NO: 1886054 - protein, 43 aa, Staphylococcus
SNHQGSLVDPSGFKPSHQNPGEQHLSGSMDSSEFINSNQSNKE

SEQ ID NO: 1886055 - protein, 17 aa, Staphylococcus
SNIGEWFIYGFSGFIFV

SEQ ID NO: 1886056 - protein, 24 aa, Staphylococcus
SNIISYCFLAIFSVILNIIIGKVF

SEQ ID NO: 1886057 - protein, 17 aa, Staphylococcus
SNINMILAFVVLIVLFA

SEQ ID NO: 1886058 - protein, 17 aa, Staphylococcus
SNIWLNRCLVLSLMFLN

SEQ ID NO: 1886059 - protein, 17 aa, Staphylococcus
SNKDIRTFLNFSSIYRW

SEQ ID NO: 1886060 - protein, 23 aa, Staphylococcus
SNKMADDIIHFIDDFSKESIEQQ

SEQ ID NO: 1886061 - protein, 24 aa, Staphylococcus
SNKMLRFILRTALGYGIFAYSLHF

SEQ ID NO: 1886062 - protein, 27 aa, Staphylococcus
SNKRIKFKTWQFILLLLGVVIITAGIT

SEQ ID NO: 1886063 - protein, 23 aa, Staphylococcus
SNKYEMWVGIVIAIIALILVIMQ

SEQ ID NO: 1886064 - protein, 24 aa, Staphylococcus
SNLFKKKYWLFGVKKADRHDISEG

SEQ ID NO: 1886065 - protein, 19 aa, Staphylococcus
SNLLIILGIINIIIGLLIL

SEQ ID NO: 1886066 - protein, 21 aa, Staphylococcus
SNLNKCPNCGNKLDNKDNQIN

SEQ ID NO: 1886067 - protein, 17 aa, Staphylococcus
SNLPLLLIVGRVIQGLS

SEQ ID NO: 1886068 - protein, 20 aa, Staphylococcus
SNLREKNCDLFREATNTIDV

SEQ ID NO: 1886069 - protein, 29 aa, Staphylococcus
SNLTKIVLMILMFIGRVGLISFIIILAGR

SEQ ID NO: 1886070 - protein, 18 aa, Staphylococcus
SNMFDELTNVAALELPNK

SEQ ID NO: 1886071 - protein, 18 aa, Staphylococcus
SNMSLFIFTLIYFIIVLY

SEQ ID NO: 1886072 - protein, 18 aa, Staphylococcus
SNNHWWPIVALMITVAVL

SEQ ID NO: 1886073 - protein, 25 aa, Staphylococcus
SNNKRLSLVVAFLFVMSPLYYRFTV

SEQ ID NO: 1886074 - protein, 25 aa, Staphylococcus
SNNPEFKKAMGILLISTIGYVGYVV

SEQ ID NO: 1886075 - protein, 21 aa, Staphylococcus
SNPGPGFGVLLAYMIFGKGTA

SEQ ID NO: 1886076 - protein, 21 aa, Staphylococcus
SNPGPGIGVLIAYMIFGKGTA

SEQ ID NO: 1886077 - protein, 19 aa, Staphylococcus
SNPKIKAIFDYAVGIILIG

SEQ ID NO: 1886078 - protein, 26 aa, Staphylococcus
SNPLFKITDIRAVARIAKQNNLLLAV

SEQ ID NO: 1886079 - protein, 35 aa, Staphylococcus
SNQHDFGHTTFYLSFGVRPGRSFNSDANEYFHSNR

SEQ ID NO: 1886080 - protein, 27 aa, Staphylococcus
SNQQFPPRNAQRRKRRRDIATNNNRQA

SEQ ID NO: 1886081 - protein, 28 aa, Staphylococcus
SNQQFPPRNAQRRKRRRDVATNHNKQQD

SEQ ID NO: 1886082 - protein, 29 aa, Staphylococcus
SNQYKNKYPVVLVHGFLGLVGDNAPALYP

SEQ ID NO: 1886083 - protein, 26 aa, Staphylococcus
SNRLTPRLLAIYLFILVITAILTYVL

SEQ ID NO: 1886084 - protein, 20 aa, Staphylococcus
SNRNFRFFQIFTASLQSFSH

SEQ ID NO: 1886085 - protein, 24 aa, Staphylococcus
SNSAYLDAWTEYYVSSDDDGSGYP

SEQ ID NO: 1886086 - protein, 20 aa, Staphylococcus
SNSDCDLYADRSLDYDTDST

SEQ ID NO: 1886087 - protein, 17 aa, Staphylococcus
SNSKLSFKEAIFGILGL

SEQ ID NO: 1886088 - protein, 17 aa, Staphylococcus
SNSKLVLISSILLIILI

SEQ ID NO: 1886089 - protein, 19 aa, Staphylococcus
SNSLVFSLIALLSSLLLLK

SEQ ID NO: 1886090 - protein, 20 aa, Staphylococcus
SNSREFEGYKLYQIAEPNHM

SEQ ID NO: 1886091 - protein, 17 aa, Staphylococcus
SNSSLWTISTIIGMSLG

SEQ ID NO: 1886092 - protein, 33 aa, Staphylococcus
SNTTRWAVLLSPVWLGILCLMYLRYRKETKNQE

SEQ ID NO: 1886093 - protein, 20 aa, Staphylococcus
SNVKETKALFVTTNDLARRL

SEQ ID NO: 1886094 - protein, 22 aa, Staphylococcus
SNVKETKALFVTTNDLARRLQK

SEQ ID NO: 1886095 - protein, 22 aa, Staphylococcus
SNVKETRALFVTTNELARRLQK

SEQ ID NO: 1886096 - protein, 27 aa, Staphylococcus
SNVLYYWDIFKFFSPLTWSLIFITIVF

SEQ ID NO: 1886097 - protein, 24 aa, Staphylococcus
SNVSFCVAMAYSLASQIYLGKLIA

SEQ ID NO: 1886098 - protein, 25 aa, Staphylococcus
SNVSTEGWRSFNYVILPLILSLIII

SEQ ID NO: 1886099 - protein, 28 aa, Staphylococcus
SNVYMFKTALKLAGDPYFSGMPLPNNIA

SEQ ID NO: 1886100 - protein, 25 aa, Staphylococcus
SNVYMFKTALKLAGDPYSSGMTLPT

SEQ ID NO: 1886101 - protein, 29 aa, Staphylococcus
SNVYMFKTALKLAGDPYYSGMGLPTDISE

SEQ ID NO: 1886102 - protein, 25 aa, Staphylococcus
SNVYMFKTALKLAGSPYTPNMSLPT

SEQ ID NO: 1886103 - protein, 24 aa, Staphylococcus
SNVYMFKTALRLAGDPYSSGMSLP

SEQ ID NO: 1886104 - protein, 26 aa, Staphylococcus
SNYDRAVELYHYIKGGKVDYGAAHAA

SEQ ID NO: 1886105 - protein, 23 aa, Staphylococcus
SNYEWVFEPSWLILGVGVVVALC

SEQ ID NO: 1886106 - protein, 23 aa, Staphylococcus
SNYFKKKFWLFGVKKKQRHDINE

SEQ ID NO: 1886107 - protein, 23 aa, Staphylococcus
SNYFKKKFWLFGVSKKNRHDINE

SEQ ID NO: 1886108 - protein, 19 aa, Staphylococcus
SNYFKKKYWMFGVNKNNRH

SEQ ID NO: 1886109 - protein, 19 aa, Staphylococcus
SNYGSRIDIIISENANKDS

SEQ ID NO: 1886110 - protein, 23 aa, Staphylococcus
SNYRGVIEYSQFFREASFIKKLS

SEQ ID NO: 1886111 - protein, 20 aa, Staphylococcus
SPAARIFYTIVSFIVNLFRA

SEQ ID NO: 1886112 - protein, 17 aa, Staphylococcus
SPEEAKKAAQRLTNAKL

SEQ ID NO: 1886113 - protein, 26 aa, Staphylococcus
SPEQWYKMIQDFKVTVWYTAPTALRM

SEQ ID NO: 1886114 - protein, 19 aa, Staphylococcus
SPEQWYSMIETFKVTIWYT

SEQ ID NO: 1886115 - protein, 19 aa, Staphylococcus
SPEWYKYFFEHVVAHHLDL

SEQ ID NO: 1886116 - protein, 22 aa, Staphylococcus
SPFFKGKRTVREGAIVKQPALA

SEQ ID NO: 1886117 - protein, 40 aa, Staphylococcus
SPFFKNYLPQVFKSMMIPLMIIIAMCFIHLNTALIMIVTA

SEQ ID NO: 1886118 - protein, 19 aa, Staphylococcus
SPFIAAIICLLVFKHKKEQ

SEQ ID NO: 1886119 - protein, 17 aa, Staphylococcus
SPFKAIFYMLMIILGSL

SEQ ID NO: 1886120 - protein, 18 aa, Staphylococcus
SPFVKVFGLIGIPFAASL

SEQ ID NO: 1886121 - protein, 19 aa, Staphylococcus
SPFVRLFALIGIPFAAGLI

SEQ ID NO: 1886122 - protein, 19 aa, Staphylococcus
SPFVRLFALVGIPFAAGII

SEQ ID NO: 1886123 - protein, 17 aa, Staphylococcus
SPIFIFILLFINALFDG

SEQ ID NO: 1886124 - protein, 22 aa, Staphylococcus
SPIKNRPSIFDRINQQSNQGSR

SEQ ID NO: 1886125 - protein, 25 aa, Staphylococcus
SPIMLLKLIIVWTAVQFIEGHFISP

SEQ ID NO: 1886126 - protein, 25 aa, Staphylococcus
SPIMLLKLLIVWTLVQFFEGHFISP

SEQ ID NO: 1886127 - protein, 21 aa, Staphylococcus
SPIWFIFLFIFYRKYKSNAED

SEQ ID NO: 1886128 - protein, 20 aa, Staphylococcus
SPKEAIKYYYLIEGLEFIVH

SEQ ID NO: 1886129 - protein, 18 aa, Staphylococcus
SPKEGVGTWIGKDIDDLT

SEQ ID NO: 1886130 - protein, 25 aa, Staphylococcus
SPKERLGAAVGWFWFVFTGGLSVFG

SEQ ID NO: 1886131 - protein, 22 aa, Staphylococcus
SPKVMTSIVIWLMGSIITASGL

SEQ ID NO: 1886132 - protein, 18 aa, Staphylococcus
SPKYGIWALVIGTLKITL

SEQ ID NO: 1886133 - protein, 18 aa, Staphylococcus
SPLFPLGPIIVFATLIFL

SEQ ID NO: 1886134 - protein, 26 aa, Staphylococcus
SPLKRLLLYFIICITMFSFMNLMSSK

SEQ ID NO: 1886135 - protein, 19 aa, Staphylococcus
SPLLAKITGAGCLLGSLVA

SEQ ID NO: 1886136 - protein, 24 aa, Staphylococcus
SPLMLLKLAVVWTLVQFIEGHFIS

SEQ ID NO: 1886137 - protein, 25 aa, Staphylococcus
SPLMWINFACIWGLEHTIHINPHDI

SEQ ID NO: 1886138 - protein, 23 aa, Staphylococcus
SPLMWLNFLTIWILENMGLANPH

SEQ ID NO: 1886139 - protein, 26 aa, Staphylococcus
SPLYFRFTAYWPFFGDVFIWLPLLLL

SEQ ID NO: 1886140 - protein, 25 aa, Staphylococcus
SPLYYRFTVYWPFFSDVFIGLPLLL

SEQ ID NO: 1886141 - protein, 25 aa, Staphylococcus
SPLYYRFTVYWPFFSDVFIWMPLLL

SEQ ID NO: 1886142 - protein, 24 aa, Staphylococcus
SPNPEGYKGFKIGTSKSKIEKKFG

SEQ ID NO: 1886143 - protein, 17 aa, Staphylococcus
SPNRFEHIDSLDALLNW

SEQ ID NO: 1886144 - protein, 25 aa, Staphylococcus
SPQFIKQKWFGEQRTPVYVYKWEDV

SEQ ID NO: 1886145 - protein, 37 aa, Staphylococcus
SPQLIYNIGFQFSFFITFCILFALPILKDANIVKSMI

SEQ ID NO: 1886146 - protein, 21 aa, Staphylococcus
SPQYSMSIWMGFNKVKQYGTN

SEQ ID NO: 1886147 - protein, 21 aa, Staphylococcus
SPQYTMSVWMGFNKVKEYGTN

SEQ ID NO: 1886148 - protein, 26 aa, Staphylococcus
SPTGKPMLMVSFELSGTTSTFELNEI

SEQ ID NO: 1886149 - protein, 33 aa, Staphylococcus
SPTMWCNFIMIWLGERLLHWNPHVIGFWPFNQL

SEQ ID NO: 1886150 - protein, 32 aa, Staphylococcus
SPYFKPIHMLLRLFMLLVLISGFWVWIQSFSS

SEQ ID NO: 1886151 - protein, 32 aa, Staphylococcus
SPYFKPLHMALRLFMLLTLFTGFWELIKEFIA

SEQ ID NO: 1886152 - protein, 22 aa, Staphylococcus
SPYLPFTYAIDALRETVGGIVP

SEQ ID NO: 1886153 - protein, 20 aa, Staphylococcus
SPYLPFTYAIDSLRETVGGI

SEQ ID NO: 1886154 - protein, 47 aa, Staphylococcus
SPYLPFTYLIDCLREVVGGIVPEILITKLIIFGLFGLGFFLIGFIAK

SEQ ID NO: 1886155 - protein, 19 aa, Staphylococcus
SPYVKVFGLVGIPFAAGII

SEQ ID NO: 1886156 - protein, 21 aa, Staphylococcus
SQAIAMWPGFSRSGSTISTGV

SEQ ID NO: 1886157 - protein, 17 aa, Staphylococcus
SQFAVGIVIMAFTMIAM

SEQ ID NO: 1886158 - protein, 17 aa, Staphylococcus
SQFHILRALKLAQNLDI

SEQ ID NO: 1886159 - protein, 17 aa, Staphylococcus
SQFHILRALRFAQKLNI

SEQ ID NO: 1886160 - protein, 19 aa, Staphylococcus
SQFNFKIQSIGVVYFNDGT

SEQ ID NO: 1886161 - protein, 26 aa, Staphylococcus
SQINIWKSLLAWRVTIFMGAQSLIFY

SEQ ID NO: 1886162 - protein, 17 aa, Staphylococcus
SQKGLDFKVKEEEKQSV

SEQ ID NO: 1886163 - protein, 24 aa, Staphylococcus
SQKKRFYTYIGRRTMFVYLLHGIV

SEQ ID NO: 1886164 - protein, 28 aa, Staphylococcus
SQKLNEAIPLFAGVIVALAFILLMIVFR

SEQ ID NO: 1886165 - protein, 23 aa, Staphylococcus
SQKYRWLVLVLIYLISILKIPLI

SEQ ID NO: 1886166 - protein, 26 aa, Staphylococcus
SQLAFAMLIAIVIVYLVLVITFKGGL

SEQ ID NO: 1886167 - protein, 18 aa, Staphylococcus
SQLGSEFDIDLAYRNLRE

SEQ ID NO: 1886168 - protein, 18 aa, Staphylococcus
SQLLPIFIGVGNFFMSVL

SEQ ID NO: 1886169 - protein, 17 aa, Staphylococcus
SQLMDEINQFYKHAKDV

SEQ ID NO: 1886170 - protein, 28 aa, Staphylococcus
SQLQFEAWKYIVIIGMFILAVVFLIVRN

SEQ ID NO: 1886171 - protein, 18 aa, Staphylococcus
SQLSILGGFVPYLLGVVM

SEQ ID NO: 1886172 - protein, 23 aa, Staphylococcus
SQMYVVVCVIGYLLYGLGLGFYA

SEQ ID NO: 1886173 - protein, 18 aa, Staphylococcus
SQNALIFCVGNIHGPGGR

SEQ ID NO: 1886174 - protein, 22 aa, Staphylococcus
SQNRWWTMNAVLAIFYFIVWLG

SEQ ID NO: 1886175 - protein, 20 aa, Staphylococcus
SQPMILASILFVFAGPLGGF

SEQ ID NO: 1886176 - protein, 23 aa, Staphylococcus
SQQIWGNICMFVIQAMPIFITIC

SEQ ID NO: 1886177 - protein, 19 aa, Staphylococcus
SQTKNVFKFIDKKEFMEVS

SEQ ID NO: 1886178 - protein, 17 aa, Staphylococcus
SQTRNVFKYIDKKEFMA

SEQ ID NO: 1886179 - protein, 26 aa, Staphylococcus
SQVFKDIFPFSAVILILYGIDLTIRA

SEQ ID NO: 1886180 - protein, 27 aa, Staphylococcus
SQVFLVPNFIGGLFILVGIFIGSRKAG

SEQ ID NO: 1886181 - protein, 26 aa, Staphylococcus
SQVGGFRFSLVFWFIFAVIALILWIP

SEQ ID NO: 1886182 - protein, 17 aa, Staphylococcus
SQVKGIGYELEFDTNPE

SEQ ID NO: 1886183 - protein, 22 aa, Staphylococcus
SQVKSTMLVTVWVFIGIEGAVV

SEQ ID NO: 1886184 - protein, 22 aa, Staphylococcus
SQVKSTMLVTVWVFTGIEGAVV

SEQ ID NO: 1886185 - protein, 25 aa, Staphylococcus
SQVNRLGIPLSIFFGGVKMMMPNMV

SEQ ID NO: 1886186 - protein, 25 aa, Staphylococcus
SQVNRVAVPISIFFGGVKMMMPNMV

SEQ ID NO: 1886187 - protein, 19 aa, Staphylococcus
SQVVPVKISLDSAPSKNVV

SEQ ID NO: 1886188 - protein, 24 aa, Staphylococcus
SQVWKRLTAAIIIFSASHLIVTTW

SEQ ID NO: 1886189 - protein, 18 aa, Staphylococcus
SQWLQIWGFMYIVTIFTN

SEQ ID NO: 1886190 - protein, 22 aa, Staphylococcus
SQYFNRIFPKVSYKAYTIFFTL

SEQ ID NO: 1886191 - protein, 24 aa, Staphylococcus
SQYNWKLPFYLIAIITFLCLLGVL

SEQ ID NO: 1886192 - protein, 23 aa, Staphylococcus
SQYQRQLAINRIRQIELDTMDAI

SEQ ID NO: 1886193 - protein, 17 aa, Staphylococcus
SRALMYRNRDIINGQDE

SEQ ID NO: 1886194 - protein, 32 aa, Staphylococcus
SRDDFEFQMLFGFRTDLAYAIADDNYNFCIYV

SEQ ID NO: 1886195 - protein, 18 aa, Staphylococcus
SRDFIIDIMLSLLIIIIS

SEQ ID NO: 1886196 - protein, 21 aa, Staphylococcus
SRELSRLLLVGNATFTSIDTT

SEQ ID NO: 1886197 - protein, 19 aa, Staphylococcus
SRFIARASIAITGFVVFCI

SEQ ID NO: 1886198 - protein, 19 aa, Staphylococcus
SRFNLSSHLMIWPMLIAGI

SEQ ID NO: 1886199 - protein, 20 aa, Staphylococcus
SRFVSCFMILIFGSIAFSLL

SEQ ID NO: 1886200 - protein, 25 aa, Staphylococcus
SRFYGHLGLLLIVLIICFSGGYHPS

SEQ ID NO: 1886201 - protein, 20 aa, Staphylococcus
SRGQHLLTILISYLPNIILL

SEQ ID NO: 1886202 - protein, 23 aa, Staphylococcus
SRGYPIRVLIILGLMIGALFNAL

SEQ ID NO: 1886203 - protein, 21 aa, Staphylococcus
SRIAMLSIIDILYICIASNDY

SEQ ID NO: 1886204 - protein, 30 aa, Staphylococcus
SRIEVFIFWLICILGQWFAEPLAFYNATII

SEQ ID NO: 1886205 - protein, 29 aa, Staphylococcus
SRIHMPRRSEPRVRIAAGSVGIANNQTGL

SEQ ID NO: 1886206 - protein, 29 aa, Staphylococcus
SRIKSYQDYFLHFNWFQPLLIGLAGLLIL

SEQ ID NO: 1886207 - protein, 17 aa, Staphylococcus
SRILRKEIQKMFVQEGI

SEQ ID NO: 1886208 - protein, 19 aa, Staphylococcus
SRKHIKKKILLLIMTILTI

SEQ ID NO: 1886209 - protein, 31 aa, Staphylococcus
SRKRGKEGTGLGLFICRMIIEAQGGTIDLKS

SEQ ID NO: 1886210 - protein, 30 aa, Staphylococcus
SRKRGKQGTGLGLFICKMIIEEHGGQIDVK

SEQ ID NO: 1886211 - protein, 31 aa, Staphylococcus
SRKRGKQGTGLGLFICKMIIEEHGGTIEVES

SEQ ID NO: 1886212 - protein, 18 aa, Staphylococcus
SRKRYSPDSTYKIYLAMF

SEQ ID NO: 1886213 - protein, 20 aa, Staphylococcus
SRLESTIMYAGIIVDTRNFT

SEQ ID NO: 1886214 - protein, 21 aa, Staphylococcus
SRLIAFPFESPVGIVTSFVGA

SEQ ID NO: 1886215 - protein, 17 aa, Staphylococcus
SRLSRIRVKVIIIVALL

SEQ ID NO: 1886216 - protein, 35 aa, Staphylococcus; identical to SEQ ID NO: 1577008

SEQ ID NO: 1886217 - protein, 19 aa, Staphylococcus
SRMKPFLAGVSKGMEQASK

SEQ ID NO: 1886218 - protein, 24 aa, Staphylococcus
SRNDVRLAYPPGRYSDAYQFKKPN

SEQ ID NO: 1886219 - protein, 25 aa, Staphylococcus
SRNLRFQKWHSIIGIIIAIPMLVLV

SEQ ID NO: 1886220 - protein, 22 aa, Staphylococcus
SRRDGFNPMRIILAGAAISALL

SEQ ID NO: 1886221 - protein, 22 aa, Staphylococcus
SRRDGFNPMRIILAGAAVSAML

SEQ ID NO: 1886222 - protein, 17 aa, Staphylococcus
SRSFGLIDEDQIVGKVS

SEQ ID NO: 1886223 - protein, 17 aa, Staphylococcus
SRSGQLQSFNPFNNNNV

SEQ ID NO: 1886224 - protein, 25 aa, Staphylococcus
SRSQGGNGLGLFIAEKIVQQYGGYI

SEQ ID NO: 1886225 - protein, 23 aa, Staphylococcus
SRSRGMFRLVSGMTFANNPLNMM

SEQ ID NO: 1886226 - protein, 18 aa, Staphylococcus
SRSSELKTGDIITKIDDK

SEQ ID NO: 1886227 - protein, 24 aa, Staphylococcus
SRTGKKRFGLIIPIITLAVIVYMH

SEQ ID NO: 1886228 - protein, 31 aa, Staphylococcus
SRTRGKQGTGLGLFICKMIIEEHGGTIKVES

SEQ ID NO: 1886229 - protein, 24 aa, Staphylococcus
SRTYPFRDGYKNYVFKKKDQYYIV

SEQ ID NO: 1886230 - protein, 23 aa, Staphylococcus
SRVHLRRYIKPVLMMALGLVVTT

SEQ ID NO: 1886231 - protein, 20 aa, Staphylococcus
SRVIERFPKSIIFIAPMIVF

SEQ ID NO: 1886232 - protein, 17 aa, Staphylococcus
SRVKAFIPLFILGMLFW

SEQ ID NO: 1886233 - protein, 25 aa, Staphylococcus
SRVNRVAVPISIFFGGVKMMMPNMV

SEQ ID NO: 1886234 - protein, 22 aa, Staphylococcus
SRYEKINLLTIFYLSWYSTIYW

SEQ ID NO: 1886235 - protein, 17 aa, Staphylococcus
SRYISLNSVVQREVPKE

SEQ ID NO: 1886236 - protein, 19 aa, Staphylococcus
SRYLYLVALIVPSKIDILF

SEQ ID NO: 1886237 - protein, 28 aa, Staphylococcus
SRYNKPKFPWFKTILVALIAGIIGALLV

SEQ ID NO: 1886238 - protein, 18 aa, Staphylococcus
SRYYGVKVVRTMIQFLLS

SEQ ID NO: 1886239 - protein, 28 aa, Staphylococcus
SSAIAKLDIEKGEFVKVQGLPYKDHSLP

SEQ ID NO: 1886240 - protein, 24 aa, Staphylococcus
SSAICGYLGSLVFKNYPIITKYEL

SEQ ID NO: 1886241 - protein, 17 aa, Staphylococcus
SSAKLKLELLPDVENPI

SEQ ID NO: 1886242 - protein, 17 aa, Staphylococcus
SSAKLKLELLPDVENPM

SEQ ID NO: 1886243 - protein, 17 aa, Staphylococcus
SSALGRISTHKQYDLIM

SEQ ID NO: 1886244 - protein, 22 aa, Staphylococcus
SSARLAMGYTFFHWGISQWSIF

SEQ ID NO: 1886245 - protein, 18 aa, Staphylococcus
SSATGHTMDFFWELATLI

SEQ ID NO: 1886246 - protein, 32 aa, Staphylococcus
SSCLALLICSLFLTPLVKRIKVFNRKTKEFAN

SEQ ID NO: 1886247 - protein, 19 aa, Staphylococcus
SSCSYQIGATLSIFSVAGH

SEQ ID NO: 1886248 - protein, 17 aa, Staphylococcus
SSDIKPMLWPIVIVSCL

SEQ ID NO: 1886249 - protein, 22 aa, Staphylococcus
SSDPKYGIWALILGTLKITFIG

SEQ ID NO: 1886250 - protein, 26 aa, Staphylococcus
SSELFLKYIIMSVFLWILWSHQTFYT

SEQ ID NO: 1886251 - protein, 17 aa, Staphylococcus
SSELIGIIVAFVVLLIT

SEQ ID NO: 1886252 - protein, 17 aa, Staphylococcus
SSELYRRDCKIHGAFKF

SEQ ID NO: 1886253 - protein, 22 aa, Staphylococcus
SSEYGNDIIFLFLGGFILAIAM

SEQ ID NO: 1886254 - protein, 20 aa, Staphylococcus
SSFFAIAFYWLMWNIFIILV

SEQ ID NO: 1886255 - protein, 17 aa, Staphylococcus
SSGFLTFYARKAQAMKA

SEQ ID NO: 1886256 - protein, 17 aa, Staphylococcus
SSGFVMAIIAAFYAFTG

SEQ ID NO: 1886257 - protein, 18 aa, Staphylococcus
SSGHVIITPDRVIPEGNV

SEQ ID NO: 1886258 - protein, 20 aa, Staphylococcus
SSGIGLFIVKHISAHLHHKV

SEQ ID NO: 1886259 - protein, 18 aa, Staphylococcus
SSGIGLFIVKHISNHLNH

SEQ ID NO: 1886260 - protein, 22 aa, Staphylococcus
SSHLAFGLLVLFALIALITMVH

SEQ ID NO: 1886261 - protein, 23 aa, Staphylococcus
SSHNLPEAMGIYISGNAFGGAFG

SEQ ID NO: 1886262 - protein, 18 aa, Staphylococcus
SSIEIKHKILLSIPIISK

SEQ ID NO: 1886263 - protein, 20 aa, Staphylococcus
SSIFIRFMPAPLIAIIVVTI

SEQ ID NO: 1886264 - protein, 19 aa, Staphylococcus
SSIFNFSLALLIGLVSGVF

SEQ ID NO: 1886265 - protein, 17 aa, Staphylococcus
SSIIIGILFVIVAILAV

SEQ ID NO: 1886266 - protein, 20 aa, Staphylococcus
SSIILLFNLRHRDVTKKVFE

SEQ ID NO: 1886267 - protein, 21 aa, Staphylococcus
SSIKDEHYHLMYLLEQQDNAF

SEQ ID NO: 1886268 - protein, 17 aa, Staphylococcus
SSIRYIITIIIVIISIL

SEQ ID NO: 1886269 - protein, 19 aa, Staphylococcus
SSIRYIVAIIIVILSVLGM

SEQ ID NO: 1886270 - protein, 33 aa, Staphylococcus
SSISGLFSRRFWPSLKFLLPIIIGMLLAIGILS

SEQ ID NO: 1886271 - protein, 17 aa, Staphylococcus
SSISLGWWFDGINYASL

SEQ ID NO: 1886272 - protein, 27 aa, Staphylococcus
SSITFVDIWRFFTLVQRYESEDRYDYL

SEQ ID NO: 1886273 - protein, 26 aa, Staphylococcus
SSIVASILLFFAFRTSDNIKISHRLI

SEQ ID NO: 1886274 - protein, 19 aa, Staphylococcus
SSIVNLVFLPPKFESKIYY

SEQ ID NO: 1886275 - protein, 17 aa, Staphylococcus
SSIVSQPLFGIWTDKYN

SEQ ID NO: 1886276 - protein, 23 aa, Staphylococcus
SSKAALVIFMWLPKAYAVLNTEL

SEQ ID NO: 1886277 - protein, 20 aa, Staphylococcus
SSKATLWSSLIITLIFTIVE

SEQ ID NO: 1886278 - protein, 28 aa, Staphylococcus
SSKLKYLIFKMTYIFLIVFTLNIISLFY

SEQ ID NO: 1886279 - protein, 23 aa, Staphylococcus
SSKPDRIHVIPNWYTESEDDKVH

SEQ ID NO: 1886280 - protein, 23 aa, Staphylococcus
SSKPWIWMPPAFIITFTILCINF

SEQ ID NO: 1886281 - protein, 32 aa, Staphylococcus
SSLFICIVFLWFALCSFMFTHIKKLFNQPVFR

SEQ ID NO: 1886282 - protein, 17 aa, Staphylococcus
SSLFVIIIAAPVFVITA

SEQ ID NO: 1886283 - protein, 18 aa, Staphylococcus
SSLIAAIVRKHSTKRTEI

SEQ ID NO: 1886284 - protein, 21 aa, Staphylococcus
SSLIAFLFVMSPLYYRFTVYW

SEQ ID NO: 1886285 - protein, 20 aa, Staphylococcus
SSLLGLFQFILGGIIAPLVG

SEQ ID NO: 1886286 - protein, 20 aa, Staphylococcus
SSLLGLFQFILGGIISPLVG

SEQ ID NO: 1886287 - protein, 19 aa, Staphylococcus
SSLLGLFQFILGGIMSPLV

SEQ ID NO: 1886288 - protein, 20 aa, Staphylococcus
SSLLGLFQFILGGMISPLVG

SEQ ID NO: 1886289 - protein, 19 aa, Staphylococcus
SSLLIFLAFIFQNIYVLVT

SEQ ID NO: 1886290 - protein, 29 aa, Staphylococcus
SSLLIGLYVKYFRTVSVKSYITTSLIAQL

SEQ ID NO: 1886291 - protein, 33 aa, Staphylococcus
SSLMPYTIVLSIVWPLFMIIWYLLGWPLGPGGP

SEQ ID NO: 1886292 - protein, 25 aa, Staphylococcus
SSLMPYTIVLSIVWTLFLIIWYLLG

SEQ ID NO: 1886293 - protein, 22 aa, Staphylococcus
SSLNHWGWIWFFWLIIPASVGS

SEQ ID NO: 1886294 - protein, 19 aa, Staphylococcus
SSLPGPMVLISRMFPVAFF

SEQ ID NO: 1886295 - protein, 18 aa, Staphylococcus
SSLRNIAFNFIITLTVSI

SEQ ID NO: 1886296 - protein, 18 aa, Staphylococcus
SSLTIGVIFVIIALLKDT

SEQ ID NO: 1886297 - protein, 19 aa, Staphylococcus
SSLTIGVIFVIIALVKDAT

SEQ ID NO: 1886298 - protein, 19 aa, Staphylococcus
SSLTIGVLFIIIALLKDAN

SEQ ID NO: 1886299 - protein, 18 aa, Staphylococcus
SSLTIGVMLVIIALLKDT

SEQ ID NO: 1886300 - protein, 19 aa, Staphylococcus
SSLVAALVRKHSTKRTEVP

SEQ ID NO: 1886301 - protein, 19 aa, Staphylococcus
SSLWVWPLLLLSLLLIVNF

SEQ ID NO: 1886302 - protein, 25 aa, Staphylococcus
SSLYETRISGVYGVIILIFALAIIA

SEQ ID NO: 1886303 - protein, 17 aa, Staphylococcus
SSMKMRLEMLPDVEEPM

SEQ ID NO: 1886304 - protein, 24 aa, Staphylococcus
SSMKYHKFNFFVMFAMMSGIFELY

SEQ ID NO: 1886305 - protein, 22 aa, Staphylococcus
SSNANGATVYWLQDNQESLAQT

SEQ ID NO: 1886306 - protein, 24 aa, Staphylococcus
SSNEVSWLFGCYGITVAIASWFSG

SEQ ID NO: 1886307 - protein, 24 aa, Staphylococcus
SSNFFKKKYWLFGVKKKDRHDINE

SEQ ID NO: 1886308 - protein, 28 aa, Staphylococcus
SSNTPKRKDFVVSFIASAIVGSALGLFY

SEQ ID NO: 1886309 - protein, 27 aa, Staphylococcus
SSPAYKLASAMGWFWAMYSIGIGVLGS

SEQ ID NO: 1886310 - protein, 20 aa, Staphylococcus
SSPFVKLFTLIGIPFAAGIV

SEQ ID NO: 1886311 - protein, 29 aa, Staphylococcus
SSPNIIFDIGFQFSFLITFFILISSPILK

SEQ ID NO: 1886312 - protein, 27 aa, Staphylococcus
SSPSYKLASAMGWFWAMYSIGIGVLGS

SEQ ID NO: 1886313 - protein, 23 aa, Staphylococcus
SSQMSRRSFLKMLGIGGAGVVIG

SEQ ID NO: 1886314 - protein, 19 aa, Staphylococcus
SSQYKWKIEVVVDALTGSA

SEQ ID NO: 1886315 - protein, 28 aa, Staphylococcus
SSRFPDFGGGLIGFYLLAIFEPLVSIIG

SEQ ID NO: 1886316 - protein, 19 aa, Staphylococcus
SSRKKRRFETTDMNSDTDE

SEQ ID NO: 1886317 - protein, 17 aa, Staphylococcus
SSSAILVVLCIKHTKVH

SEQ ID NO: 1886318 - protein, 25 aa, Staphylococcus
SSSFLKWGSLIAILGYCIKMPFAID

SEQ ID NO: 1886319 - protein, 29 aa, Staphylococcus
SSTFFLVTFCLPSNLPIAPNEALYRGLAI

SEQ ID NO: 1886320 - protein, 18 aa, Staphylococcus
SSTFFLVTFCLSSNLPDA

SEQ ID NO: 1886321 - protein, 18 aa, Staphylococcus
SSTGFILASAGSAIGLGA

SEQ ID NO: 1886322 - protein, 21 aa, Staphylococcus
SSTKDLESWMSRQLNPTQATQ

SEQ ID NO: 1886323 - protein, 17 aa, Staphylococcus
SSTKRRRNRLFSDKDNF

SEQ ID NO: 1886324 - protein, 17 aa, Staphylococcus
SSTMILPLIPWGTSGIY

SEQ ID NO: 1886325 - protein, 17 aa, Staphylococcus
SSTSLSLSNSADTSTSM

SEQ ID NO: 1886326 - protein, 25 aa, Staphylococcus
SSTSSTWAWLFILFIAPVLGFFLYI

SEQ ID NO: 1886327 - protein, 22 aa, Staphylococcus
SSVLPPLLLVWVLSYVEKYLNK

SEQ ID NO: 1886328 - protein, 17 aa, Staphylococcus
SSVSIIFKSLKKLKHGR

SEQ ID NO: 1886329 - protein, 27 aa, Staphylococcus
SSVSRRSFLKMMGIGGAGVVIGASGAG

SEQ ID NO: 1886330 - protein, 22 aa, Staphylococcus
SSWFLTFGYVCVVALNATAFSL

SEQ ID NO: 1886331 - protein, 22 aa, Staphylococcus
SSYIKYVPKFIVFISNYSYCIY

SEQ ID NO: 1886332 - protein, 25 aa, Staphylococcus
SSYPPRIDLFGALLSVVSILLIVLG

SEQ ID NO: 1886333 - protein, 23 aa, Staphylococcus
STAKPTIYLSIIGLFIMSVLMNI

SEQ ID NO: 1886334 - protein, 23 aa, Staphylococcus
STALFLLCFYHLPNLNRHKETRS

SEQ ID NO: 1886335 - protein, 23 aa, Staphylococcus
STALFLLCFYHLPNLNRYNESPA

SEQ ID NO: 1886336 - protein, 21 aa, Staphylococcus
STALFLLCFYYLPNLNRYNET

SEQ ID NO: 1886337 - protein, 17 aa, Staphylococcus
STAMPALFIILAVGIIV

SEQ ID NO: 1886338 - protein, 21 aa, Staphylococcus
STDMSVDLSVADSVKSGDYFT

SEQ ID NO: 1886339 - protein, 22 aa, Staphylococcus
STEALKKIGLVSGLTLGTLTLV

SEQ ID NO: 1886340 - protein, 23 aa, Staphylococcus
STEEIKFPKGLSFLRESTISISI

SEQ ID NO: 1886341 - protein, 25 aa, Staphylococcus
STEEVKRAKGDGINSINDIHAKVNK

SEQ ID NO: 1886342 - protein, 26 aa, Staphylococcus
STFACYIESIILFVILPWILIKVDIP

SEQ ID NO: 1886343 - protein, 25 aa, Staphylococcus
STFKKGKYLKGLKFSLFTLVFVIIA

SEQ ID NO: 1886344 - protein, 19 aa, Staphylococcus
STFLGVLPMGMYLVAIHQL

SEQ ID NO: 1886345 - protein, 30 aa, Staphylococcus
STGLVSAVAAMLAGLGLFGKSRKNKKDKKN

SEQ ID NO: 1886346 - protein, 20 aa, Staphylococcus
STGNVWRYLIVVLACCIWYF

SEQ ID NO: 1886347 - protein, 26 aa, Staphylococcus
STGNVWRYLVAIIACIVWVVFKENVN

SEQ ID NO: 1886348 - protein, 28 aa, Staphylococcus
STHAIARDKARQELDRVIASKMSEIDND

SEQ ID NO: 1886349 - protein, 28 aa, Staphylococcus
STHDLEPWIKFQLHPPKHLKSLVETTHK

SEQ ID NO: 1886350 - protein, 25 aa, Staphylococcus
STHDLRLLPDFDRIIVMIDGEIKEQ

SEQ ID NO: 1886351 - protein, 19 aa, Staphylococcus
STHFSRIIFIFLILFSVIG

SEQ ID NO: 1886352 - protein, 18 aa, Staphylococcus
STHRRVLSFVTIPLGIVI

SEQ ID NO: 1886353 - protein, 18 aa, Staphylococcus
STIALWIVSIVAILLSLI

SEQ ID NO: 1886354 - protein, 25 aa, Staphylococcus
STIILFCLVIIFFLKDTLRDGEIDE

SEQ ID NO: 1886355 - protein, 32 aa, Staphylococcus
STIIVLLLLIGLAFGIFSFVDSSKKANERLNS

SEQ ID NO: 1886356 - protein, 25 aa, Staphylococcus
STIKAALAMYCTYLYSKFISRNTWI

SEQ ID NO: 1886357 - protein, 18 aa, Staphylococcus
STILRILYMANIAAKITV

SEQ ID NO: 1886358 - protein, 17 aa, Staphylococcus
STILSIAGMIGLVWSIK

SEQ ID NO: 1886359 - protein, 25 aa, Staphylococcus
STINAHGWSGINFNSPFADLAILLN

SEQ ID NO: 1886360 - protein, 25 aa, Staphylococcus
STIQWPQIIGVIPWFVLAFIGAIAI

SEQ ID NO: 1886361 - protein, 27 aa, Staphylococcus
STIRNIRQNLFWAFGYNVAGIPIAAIG

SEQ ID NO: 1886362 - protein, 25 aa, Staphylococcus
STIVYKFTTFFTMFAAFFDGVNASP

SEQ ID NO: 1886363 - protein, 23 aa, Staphylococcus
STKGQEAIKSFIEYTKQNLPLIG

SEQ ID NO: 1886364 - protein, 18 aa, Staphylococcus
STLFITVLTLVFTVIIGV

SEQ ID NO: 1886365 - protein, 20 aa, Staphylococcus
STLIFKRARKYGLIISHIYA

SEQ ID NO: 1886366 - protein, 26 aa, Staphylococcus
STLKWGDVLSIMPWLIAAFIAALLMA

SEQ ID NO: 1886367 - protein, 21 aa, Staphylococcus
STLLGIIGMLIIKGRPILAGC

SEQ ID NO: 1886368 - protein, 19 aa, Staphylococcus
STLLIGLFLKYFKTLTTKS

SEQ ID NO: 1886369 - protein, 19 aa, Staphylococcus
STMLLTCITYVILFLYSFI

SEQ ID NO: 1886370 - protein, 32 aa, Staphylococcus
STMWNMGLDFSVWRLFGISVMAILGMLVWIMV

SEQ ID NO: 1886371 - protein, 23 aa, Staphylococcus
STNKGISPHAFKNAKRDLRGILD

SEQ ID NO: 1886372 - protein, 24 aa, Staphylococcus
STNVGIICYILWGIYFKEGVKTEN

SEQ ID NO: 1886373 - protein, 23 aa, Staphylococcus
STPDVKFGRHLRVEKPNYTIEIP

SEQ ID NO: 1886374 - protein, 19 aa, Staphylococcus
STPKYGIWALILGTLKITV

SEQ ID NO: 1886375 - protein, 18 aa, Staphylococcus
STQIGISIISNIQPETIQ

SEQ ID NO: 1886376 - protein, 24 aa, Staphylococcus
STQKTWRGDYLIDQLTKDGSFKQP

SEQ ID NO: 1886377 - protein, 18 aa, Staphylococcus
STQSSGFTTGRLINKIDI

SEQ ID NO: 1886378 - protein, 20 aa, Staphylococcus
STRNIWRSDYLIDQLTQSKL

SEQ ID NO: 1886379 - protein, 33 aa, Staphylococcus
STRVKIGVLAFIFCVFGILTFGIFPQFMPSFNV

SEQ ID NO: 1886380 - protein, 26 aa, Staphylococcus
STSASDRDSISISQSDSLAASTSVSD

SEQ ID NO: 1886381 - protein, 28 aa, Staphylococcus
STSEAIGALKASASIDPVRGIIITGDGK

SEQ ID NO: 1886382 - protein, 26 aa, Staphylococcus
STSLSESRSASLIDSLTQSTSVSEAT

SEQ ID NO: 1886383 - protein, 18 aa, Staphylococcus
STSRILRAIARIYVSIIR

SEQ ID NO: 1886384 - protein, 20 aa, Staphylococcus
STSRILRGIARFYISIIRGT

SEQ ID NO: 1886385 - protein, 23 aa, Staphylococcus
STTEFGTLIAIYGVNNLIVNFLG

SEQ ID NO: 1886386 - protein, 29 aa, Staphylococcus
STTLLNFFHGWPWYAIWLVLLGFGGGMIV

SEQ ID NO: 1886387 - protein, 23 aa, Staphylococcus
STTRFAVLFAPVWAIILVIMYQK

SEQ ID NO: 1886388 - protein, 18 aa, Staphylococcus
STTSEIQLTISFAMIGLA

SEQ ID NO: 1886389 - protein, 24 aa, Staphylococcus
STTVYRFTTFFTMIAALIDGIKAS

SEQ ID NO: 1886390 - protein, 18 aa, Staphylococcus
STTYEYFTIYILVAVMYW

SEQ ID NO: 1886391 - protein, 24 aa, Staphylococcus
STTYEYFTIYILVAVMYWVVCFII

SEQ ID NO: 1886392 - protein, 23 aa, Staphylococcus
STVGALLMALGFMFLVASIVYSF

SEQ ID NO: 1886393 - protein, 18 aa, Staphylococcus
STVLSLICFVIILHKEVL

SEQ ID NO: 1886394 - protein, 30 aa, Staphylococcus
STYAAFIAMRVGLKWKDLEEGITHRLTTAM

SEQ ID NO: 1886395 - protein, 29 aa, Staphylococcus
STYFDKMFPILIGFFVFFFVFLISGIALL

SEQ ID NO: 1886396 - protein, 20 aa, Staphylococcus
STYLVALPIAHNFPLGCPGI

SEQ ID NO: 1886397 - protein, 21 aa, Staphylococcus
STYRYLGNRANLMALWNVQDR

SEQ ID NO: 1886398 - protein, 22 aa, Staphylococcus
SVAGHSWLFIPYLILVLVGGII

SEQ ID NO: 1886399 - protein, 23 aa, Staphylococcus
SVAKLPFDVLDAMGGKDNIKHLD

SEQ ID NO: 1886400 - protein, 23 aa, Staphylococcus
SVAKLPFDVLDAMGGKENIKHLD

SEQ ID NO: 1886401 - protein, 26 aa, Staphylococcus
SVARVCKTEIIILSHILEYLDEAFLN

SEQ ID NO: 1886402 - protein, 20 aa, Staphylococcus
SVAVANGWIQLSVWKNLPLV

SEQ ID NO: 1886403 - protein, 20 aa, Staphylococcus
SVDLIRWLPDVDLPLMDGLY

SEQ ID NO: 1886404 - protein, 26 aa, Staphylococcus
SVDLIRWLPELDLPLMDGLYLHMLLW

SEQ ID NO: 1886405 - protein, 26 aa, Staphylococcus
SVDLIRWLPELDLPLMDGLYLHMLSW

SEQ ID NO: 1886406 - protein, 20 aa, Staphylococcus
SVDSILRWESIILDPIGPML

SEQ ID NO: 1886407 - protein, 18 aa, Staphylococcus
SVEALRGHLDMLGLNHKF

SEQ ID NO: 1886408 - protein, 25 aa, Staphylococcus
SVEKQRLDQVVKMVRGKRGTTVTLT

SEQ ID NO: 1886409 - protein, 24 aa, Staphylococcus
SVEQLRAAIIYVVLNIIGSWIFLL

SEQ ID NO: 1886410 - protein, 18 aa, Staphylococcus
SVEYEKKGNVGVFTINKF

SEQ ID NO: 1886411 - protein, 18 aa, Staphylococcus
SVEYKKKGQIGVITINRF

SEQ ID NO: 1886412 - protein, 17 aa, Staphylococcus
SVFFRLAGDLPVFQKSL

SEQ ID NO: 1886413 - protein, 19 aa, Staphylococcus
SVFGFLKPYIIGIWNGIKT

SEQ ID NO: 1886414 - protein, 30 aa, Staphylococcus
SVFLPFILSGFLFYICLPFQTLLEKFGFPR

SEQ ID NO: 1886415 - protein, 24 aa, Staphylococcus
SVFSESYGSFGYFFSYAFGMICVL

SEQ ID NO: 1886416 - protein, 27 aa, Staphylococcus
SVFSGLVPYWAVYRIILYVVAGHKEIH

SEQ ID NO: 1886417 - protein, 17 aa, Staphylococcus
SVFWKKGFIPVYFIGAL

SEQ ID NO: 1886418 - protein, 19 aa, Staphylococcus
SVGDFIFRVLSGVAIGIVV

SEQ ID NO: 1886419 - protein, 18 aa, Staphylococcus
SVGEIVMIFNFFIFAVAG

SEQ ID NO: 1886420 - protein, 18 aa, Staphylococcus
SVGKLFMIFLIRTLITLP

SEQ ID NO: 1886421 - protein, 26 aa, Staphylococcus
SVGLFICLIGFIGTVIYFNHLTHESS

SEQ ID NO: 1886422 - protein, 25 aa, Staphylococcus
SVGLLGRFYIIFALFLSVLFLNETL

SEQ ID NO: 1886423 - protein, 19 aa, Staphylococcus
SVGLLIFICIWTFILSLIL

SEQ ID NO: 1886424 - protein, 19 aa, Staphylococcus
SVGLLIFICIWTFILSVIL

SEQ ID NO: 1886425 - protein, 23 aa, Staphylococcus
SVGVGGLPAFISIKSEYWGVYLV

SEQ ID NO: 1886426 - protein, 24 aa, Staphylococcus
SVGYRAQLTLSIGVGEGTEDLIEL

SEQ ID NO: 1886427 - protein, 19 aa, Staphylococcus
SVICCLAITGILIYTLNSF

SEQ ID NO: 1886428 - protein, 19 aa, Staphylococcus
SVICCLAITGILMYTLDDF

SEQ ID NO: 1886429 - protein, 18 aa, Staphylococcus
SVIGMFTALIGMMLAGSR

SEQ ID NO: 1886430 - protein, 26 aa, Staphylococcus
SVIHTQGWLQLSFMDHLWLKDYSLEW

SEQ ID NO: 1886431 - protein, 28 aa, Staphylococcus
SVIIAGIILPRFMKRIDYPIPPLLQKKK

SEQ ID NO: 1886432 - protein, 24 aa, Staphylococcus
SVIKSPWLGRTLIVGCIFAIFQQF

SEQ ID NO: 1886433 - protein, 19 aa, Staphylococcus
SVILFLLVMMSIVLTYMIW

SEQ ID NO: 1886434 - protein, 26 aa, Staphylococcus
SVILVITILISFTFYFFNKEDKPDKD

SEQ ID NO: 1886435 - protein, 27 aa, Staphylococcus
SVILVITILISFVFYYFNKEDRPDKDT

SEQ ID NO: 1886436 - protein, 25 aa, Staphylococcus
SVIPFLIATYFFKKTNGFFLLAPLF

SEQ ID NO: 1886437 - protein, 17 aa, Staphylococcus
SVIPRFFASLAAFTVGT

SEQ ID NO: 1886438 - protein, 17 aa, Staphylococcus
SVISRLNEGSTFKVTFF

SEQ ID NO: 1886439 - protein, 24 aa, Staphylococcus
SVISTNGWVKMSFIEALPLKQYSL

SEQ ID NO: 1886440 - protein, 17 aa, Staphylococcus
SVITRSKWVGVIVTLIL

SEQ ID NO: 1886441 - protein, 18 aa, Staphylococcus
SVITRSKWVGVIVTLILI

SEQ ID NO: 1886442 - protein, 24 aa, Staphylococcus
SVIYVVVCIIGYLLYGLGLGFYAT

SEQ ID NO: 1886443 - protein, 26 aa, Staphylococcus
SVKAFGEFEFWFALIKVITIILMIIA

SEQ ID NO: 1886444 - protein, 27 aa, Staphylococcus
SVKAFGEFEFWFAMIKVVTIILMIIAG

SEQ ID NO: 1886445 - protein, 26 aa, Staphylococcus
SVKAFGEFEFWFAMIKVVTIILMIVA

SEQ ID NO: 1886446 - protein, 26 aa, Staphylococcus
SVKAFGEFEFWFAMIKVVTIVLMIIA

SEQ ID NO: 1886447 - protein, 28 aa, Staphylococcus
SVKGFKRTRISMFIWLVFLLPLPFLLSS

SEQ ID NO: 1886448 - protein, 27 aa, Staphylococcus
SVKGFKRTRISMFIWLVLLLPLPFLLS

SEQ ID NO: 1886449 - protein, 26 aa, Staphylococcus
SVKQLRTARRFGIGWMAISLIGAVFV

SEQ ID NO: 1886450 - protein, 27 aa, Staphylococcus
SVKRTIIKIIGFMFIAFIILALLGILL

SEQ ID NO: 1886451 - protein, 17 aa, Staphylococcus
SVLAIIRAFIAGAKAII

SEQ ID NO: 1886452 - protein, 25 aa, Staphylococcus
SVLDLLIVWYVLYLLITVFKGTKAI

SEQ ID NO: 1886453 - protein, 17 aa, Staphylococcus
SVLEILNTFKLIKPLNH

SEQ ID NO: 1886454 - protein, 21 aa, Staphylococcus
SVLGIFVCRLLYKGKGHLTKL

SEQ ID NO: 1886455 - protein, 19 aa, Staphylococcus
SVLGMFQLGIVGRMIDSFF

SEQ ID NO: 1886456 - protein, 21 aa, Staphylococcus
SVLIGSLLGFLFFNFHPAKIF

SEQ ID NO: 1886457 - protein, 19 aa, Staphylococcus
SVLISLWWDLGSLNDAFNQ

SEQ ID NO: 1886458 - protein, 22 aa, Staphylococcus
SVLLAEIDWWKSEMESSENLQL

SEQ ID NO: 1886459 - protein, 18 aa, Staphylococcus
SVLLAVGVSTLIGVVFGW

SEQ ID NO: 1886460 - protein, 19 aa, Staphylococcus
SVLLLKRGILGVIQLIYLY

SEQ ID NO: 1886461 - protein, 30 aa, Staphylococcus
SVLLPLLLSGFLFYICLPFQKILEKNKIPR

SEQ ID NO: 1886462 - protein, 18 aa, Staphylococcus
SVLLYEFDIMPFIVELAG

SEQ ID NO: 1886463 - protein, 20 aa, Staphylococcus
SVLMSIALYFIMMKVMPPEH

SEQ ID NO: 1886464 - protein, 17 aa, Staphylococcus
SVLNHFIPIIITMILCY

SEQ ID NO: 1886465 - protein, 20 aa, Staphylococcus
SVLPPLLLVWALSYVEKYLN

SEQ ID NO: 1886466 - protein, 24 aa, Staphylococcus
SVLREGVEVIIFYMGMIGSIQTID

SEQ ID NO: 1886467 - protein, 24 aa, Staphylococcus
SVLREGVEVIIFYMGMIGSITSMD

SEQ ID NO: 1886468 - protein, 24 aa, Staphylococcus
SVLREGVEVIIFYMGMIGSITTKD

SEQ ID NO: 1886469 - protein, 24 aa, Staphylococcus
SVLREGVEVIIFYMGMMGSIKTLD

SEQ ID NO: 1886470 - protein, 36 aa, Staphylococcus
SVLVIDWLQRIPSIYYRPKYFFTISGLRSRMNSNSI

SEQ ID NO: 1886471 - protein, 20 aa, Staphylococcus
SVLYLLYLLINIMISGVNIP

SEQ ID NO: 1886472 - protein, 19 aa, Staphylococcus
SVLYSRFLNGVPRVFVAWL

SEQ ID NO: 1886473 - protein, 18 aa, Staphylococcus
SVLYYWDTFQFFSPVTWS

SEQ ID NO: 1886474 - protein, 19 aa, Staphylococcus
SVMLSFVFMPGDLLKAIIA

SEQ ID NO: 1886475 - protein, 24 aa, Staphylococcus
SVMREGVEVILFYMGMIGEVSAKD

SEQ ID NO: 1886476 - protein, 17 aa, Staphylococcus
SVMSWLLDGMVTLISGG

SEQ ID NO: 1886477 - protein, 21 aa, Staphylococcus
SVMVVAFVAIWIAWTPNDTIL

SEQ ID NO: 1886478 - protein, 23 aa, Staphylococcus
SVNLIRIVIGISIYTHAGNLIIM

SEQ ID NO: 1886479 - protein, 17 aa, Staphylococcus
SVNLKMSHYLLEDLTSQ

SEQ ID NO: 1886480 - protein, 29 aa, Staphylococcus
SVPEGTPVYMQWIDKDGVVSPIYRAHTNN

SEQ ID NO: 1886481 - protein, 26 aa, Staphylococcus
SVSALKDLKIPLSIAGQGQSSDSNDN

SEQ ID NO: 1886482 - protein, 20 aa, Staphylococcus
SVSIFILFRIFQGFSAGVIT

SEQ ID NO: 1886483 - protein, 24 aa, Staphylococcus
SVSLSALLLYYAFNFMAQKLPKPL

SEQ ID NO: 1886484 - protein, 19 aa, Staphylococcus
SVVAIIFFFVWPFVYDAIV

SEQ ID NO: 1886485 - protein, 24 aa, Staphylococcus
SVVCCIAVTFILMKGISDFYAGLT

SEQ ID NO: 1886486 - protein, 18 aa, Staphylococcus
SVVGSYFLFVIIIVFLMY

SEQ ID NO: 1886487 - protein, 18 aa, Staphylococcus
SVVLLRPLIDELLFRHLL

SEQ ID NO: 1886488 - protein, 20 aa, Staphylococcus
SVVLPWKEFGGIFATFPAVF

SEQ ID NO: 1886489 - protein, 20 aa, Staphylococcus
SVVLPWKEFGGIFATLPAVF

SEQ ID NO: 1886490 - protein, 18 aa, Staphylococcus
SVVTRNKWIGTLVALILI

SEQ ID NO: 1886491 - protein, 24 aa, Staphylococcus
SVVVWLIRRYYRRHTYEHTDKFTT

SEQ ID NO: 1886492 - protein, 19 aa, Staphylococcus
SVWAGAIADKFDRGKLLKM

SEQ ID NO: 1886493 - protein, 20 aa, Staphylococcus
SVYLFLLMMMIWLAINVLTR

SEQ ID NO: 1886494 - protein, 22 aa, Staphylococcus
SVYLMSRPKFILNEQQQSTYVL

SEQ ID NO: 1886495 - protein, 19 aa, Staphylococcus
SWGCTLIGLTLLISLTSAW

SEQ ID NO: 1886496 - protein, 19 aa, Staphylococcus
SWHYIFWISAVLYLVVLGL

SEQ ID NO: 1886497 - protein, 21 aa, Staphylococcus
SWIALAMVRLYIKDHKWAEEE

SEQ ID NO: 1886498 - protein, 23 aa, Staphylococcus
SWKFHLANLHIKYEPRALCRMLV

SEQ ID NO: 1886499 - protein, 18 aa, Staphylococcus
SWLTKTWKNIKNSVVNYA

SEQ ID NO: 1886500 - protein, 20 aa, Staphylococcus
SWSKICIKGKFNHSKSSSDT

SEQ ID NO: 1886501 - protein, 25 aa, Staphylococcus
SWSPFIGGFVARVSRGRTIREFVVG

SEQ ID NO: 1886502 - protein, 19 aa, Staphylococcus
SWTQLPGYILAQMLGGIVG

SEQ ID NO: 1886503 - protein, 25 aa, Staphylococcus
SYAIGGVFHIEFLKEIGDLVGGLSG

SEQ ID NO: 1886504 - protein, 20 aa, Staphylococcus
SYDYTLNFKEGAFHEGDTFK

SEQ ID NO: 1886505 - protein, 19 aa, Staphylococcus
SYEGWIMAMIVGFMAGATI

SEQ ID NO: 1886506 - protein, 26 aa, Staphylococcus
SYFLLREIPTFISLVGGVIILIGVTL

SEQ ID NO: 1886507 - protein, 18 aa, Staphylococcus
SYFLTWVHQIKTPITASQ

SEQ ID NO: 1886508 - protein, 18 aa, Staphylococcus
SYFMRRLAERPQNLNLMF

SEQ ID NO: 1886509 - protein, 24 aa, Staphylococcus
SYFVNPWIKVGFVFNLLYLLISIA

SEQ ID NO: 1886510 - protein, 17 aa, Staphylococcus
SYFWQPLLFNAFLYLVL

SEQ ID NO: 1886511 - protein, 28 aa, Staphylococcus
SYGLINFLLCFSFFVSISMASFIIVTDS

SEQ ID NO: 1886512 - protein, 17 aa, Staphylococcus
SYHAGLVGKEYLEKLSG

SEQ ID NO: 1886513 - protein, 25 aa, Staphylococcus
SYIAAKGSREFAWRLPDKKTLRNSV

SEQ ID NO: 1886514 - protein, 30 aa, Staphylococcus
SYIAARGAHEFKWRLPDIRTIRNSAVGGIC

SEQ ID NO: 1886515 - protein, 17 aa, Staphylococcus
SYIDIKADFLVPNDVQV

SEQ ID NO: 1886516 - protein, 19 aa, Staphylococcus
SYIIYRFIHDGVLFTGPND

SEQ ID NO: 1886517 - protein, 20 aa, Staphylococcus
SYIIYRFIHDGVLFTGPNDG

SEQ ID NO: 1886518 - protein, 17 aa, Staphylococcus
SYILLGYPMQSQDRKHA

SEQ ID NO: 1886519 - protein, 26 aa, Staphylococcus
SYIWGGDILFGYGFSMLFVIPFIHMG

SEQ ID NO: 1886520 - protein, 26 aa, Staphylococcus
SYLGELIRWLFVFGILFQLPTLFMGL

SEQ ID NO: 1886521 - protein, 18 aa, Staphylococcus
SYLGFLPLATFAGWFNLD

SEQ ID NO: 1886522 - protein, 17 aa, Staphylococcus
SYLGFTVIFYIFGFALL

SEQ ID NO: 1886523 - protein, 19 aa, Staphylococcus
SYLHQQLSAKIHAVEANSD

SEQ ID NO: 1886524 - protein, 18 aa, Staphylococcus
SYLIGELLAILPILLIYY

SEQ ID NO: 1886525 - protein, 20 aa, Staphylococcus
SYLIWNFVVGICMVPVFFIY

SEQ ID NO: 1886526 - protein, 17 aa, Staphylococcus
SYLIYRIGKDDASGLAA

SEQ ID NO: 1886527 - protein, 17 aa, Staphylococcus
SYLMFATVVSILACIFA

SEQ ID NO: 1886528 - protein, 17 aa, Staphylococcus
SYLNMFISYMIWCAVPV

SEQ ID NO: 1886529 - protein, 17 aa, Staphylococcus
SYLTYIALICIWGIITA

SEQ ID NO: 1886530 - protein, 20 aa, Staphylococcus
SYNLIKKRMLKEIQNNDNFN

SEQ ID NO: 1886531 - protein, 21 aa, Staphylococcus
SYQLGLMAAFLIELLDALLPE

SEQ ID NO: 1886532 - protein, 18 aa, Staphylococcus
SYSLYLWHFPIISFVHSH

SEQ ID NO: 1886533 - protein, 19 aa, Staphylococcus
SYSLYLWHFPVIIFTHRYF

SEQ ID NO: 1886534 - protein, 19 aa, Staphylococcus
SYSLYLWHFPVISFIHIHF

SEQ ID NO: 1886535 - protein, 19 aa, Staphylococcus
SYSLYLWHFPVISFLHSYY

SEQ ID NO: 1886536 - protein, 20 aa, Staphylococcus
SYTCGIAIYYLRKEEKGKMM

SEQ ID NO: 1886537 - protein, 17 aa, Staphylococcus
SYTEVYIIMAIVAALCT

SEQ ID NO: 1886538 - protein, 26 aa, Staphylococcus
SYTSFRMNRVMQILTIVSMIFLPLTL

SEQ ID NO: 1886539 - protein, 30 aa, Staphylococcus
SYTVEFKATIPKIVNLNGHVSYRTNATFRG

SEQ ID NO: 1886540 - protein, 17 aa, Staphylococcus
SYTVSLPTSVPIKKDFN

SEQ ID NO: 1886541 - protein, 18 aa, Staphylococcus
SYVIARREDNVVGMSARS

SEQ ID NO: 1886542 - protein, 18 aa, Staphylococcus
SYVVYRFYHDGILSTGPN

SEQ ID NO: 1886543 - protein, 21 aa, Staphylococcus
SYYEAIIISAYFIYRTIFTYK

SEQ ID NO: 1886544 - protein, 18 aa, Staphylococcus
SYYEAVVLGFYFIYRLIA

SEQ ID NO: 1886545 - protein, 18 aa, Staphylococcus
SYYGDLLIFLPLSLLGVE

SEQ ID NO: 1886546 - protein, 25 aa, Staphylococcus
SYYLAFGLTLLWIGYFVYQYRKMTA

SEQ ID NO: 1886547 - protein, 22 aa, Staphylococcus
SYYLNCYFVYKVKPTLRKFISF

SEQ ID NO: 1886548 - protein, 21 aa, Staphylococcus
SYYLNCYFVYKVKPTLVKFLS

SEQ ID NO: 1886549 - protein, 23 aa, Staphylococcus
SYYLNCYFVYKVKPTWRKFIQFP

SEQ ID NO: 1886550 - protein, 24 aa, Staphylococcus
SYYLNCYFVYKVKPTWRKFIQFPL

SEQ ID NO: 1886551 - protein, 17 aa, Staphylococcus
TAADGWIGVTLIFGAFA

SEQ ID NO: 1886552 - protein, 18 aa, Staphylococcus
TAADGWIGVTLIFGAFAF

SEQ ID NO: 1886553 - protein, 17 aa, Staphylococcus
TAAIAIILAPEFYNAIK

SEQ ID NO: 1886554 - protein, 17 aa, Staphylococcus
TAAIAIILAPEFYNSIK

SEQ ID NO: 1886555 - protein, 23 aa, Staphylococcus
TAAIELVQLISLPMILINSIGTA

SEQ ID NO: 1886556 - protein, 21 aa, Staphylococcus
TAALSWQGWIALAAMILGTRF

SEQ ID NO: 1886557 - protein, 19 aa, Staphylococcus
TAANGWIGITIIFGAFALF

SEQ ID NO: 1886558 - protein, 18 aa, Staphylococcus
TAAQELNGLMGALKESIK

SEQ ID NO: 1886559 - protein, 24 aa, Staphylococcus
TADVFMCGVATFLQANKVTGTGLP

SEQ ID NO: 1886560 - protein, 21 aa, Staphylococcus
TAFCIFMIAMICLSRIYLGVH

SEQ ID NO: 1886561 - protein, 18 aa, Staphylococcus
TAFFLVLAFRTYKELGTD

SEQ ID NO: 1886562 - protein, 19 aa, Staphylococcus
TAFLLVLVYRTYRVTKEAN

SEQ ID NO: 1886563 - protein, 25 aa, Staphylococcus
TAGAASIIVGITLFGNAHAAQAAEQ

SEQ ID NO: 1886564 - protein, 19 aa, Staphylococcus
TAGALGCGIFAIVAQLIMI

SEQ ID NO: 1886565 - protein, 28 aa, Staphylococcus
TAGTMEWAKLGILIALVFFPHAHILIKL

SEQ ID NO: 1886566 - protein, 28 aa, Staphylococcus
TAGTMEWAKLGILISLIFFPKGHILIKL

SEQ ID NO: 1886567 - protein, 21 aa, Staphylococcus
TAGTMEWAKLGILISLVCFPQ

SEQ ID NO: 1886568 - protein, 26 aa, Staphylococcus
TAGTMEWAKLGILLSLIFFPKGHILI

SEQ ID NO: 1886569 - protein, 22 aa, Staphylococcus
TAHVHITWMNWFLAALVPGLVS

SEQ ID NO: 1886570 - protein, 19 aa, Staphylococcus
TAHVHITWMNWFVAAIVPG

SEQ ID NO: 1886571 - protein, 19 aa, Staphylococcus
TAIALLFAIGCNFYILKKY

SEQ ID NO: 1886572 - protein, 19 aa, Staphylococcus
TAIATKKNQSWSLNNNISG

SEQ ID NO: 1886573 - protein, 23 aa, Staphylococcus
TAIGEMRWFATLRNMFKVNNKQL

SEQ ID NO: 1886574 - protein, 17 aa, Staphylococcus
TAIGLVFTQIGFSIVDI

SEQ ID NO: 1886575 - protein, 24 aa, Staphylococcus
TAIKSELYHSLTLNLVLSALLGIT

SEQ ID NO: 1886576 - protein, 26 aa, Staphylococcus
TAINVLPIFIVPLVVERKKIKSHPDV

SEQ ID NO: 1886577 - protein, 26 aa, Staphylococcus
TAINVLPIIIVPLVVERKRIKSHPEV

SEQ ID NO: 1886578 - protein, 19 aa, Staphylococcus
TAIRYKGIYDRGASFIQMG

SEQ ID NO: 1886579 - protein, 26 aa, Staphylococcus
TAISIFYCIIIFPLSIFINIRIDKKK

SEQ ID NO: 1886580 - protein, 26 aa, Staphylococcus
TAISLFITVILGFFIARTITKPITDM

SEQ ID NO: 1886581 - protein, 22 aa, Staphylococcus
TALFLLCFYHLPNLNRYNESKS

SEQ ID NO: 1886582 - protein, 22 aa, Staphylococcus
TALFLLCFYHLPNLNRYNETRS

SEQ ID NO: 1886583 - protein, 26 aa, Staphylococcus
TALGNKWGFVVAWLLWVQMFPGMVMV

SEQ ID NO: 1886584 - protein, 21 aa, Staphylococcus
TALGRHQWLDILIMIPFMTPP

SEQ ID NO: 1886585 - protein, 18 aa, Staphylococcus
TALGYGIFASGLRYFSKL

SEQ ID NO: 1886586 - protein, 19 aa, Staphylococcus
TALLLLIPIVISYKEGLHI

SEQ ID NO: 1886587 - protein, 17 aa, Staphylococcus
TALLSIIVTFHFVTFGF

SEQ ID NO: 1886588 - protein, 26 aa, Staphylococcus
TALPRIMKDFNIEYSQVQWLTTAFLL

SEQ ID NO: 1886589 - protein, 18 aa, Staphylococcus
TALPSYWIASIFVIYISV

SEQ ID NO: 1886590 - protein, 24 aa, Staphylococcus
TALSQGLARAGTWMNTGEGGLSEY

SEQ ID NO: 1886591 - protein, 31 aa, Staphylococcus
TALSQGVALIFRLNQSLTFWSAGGVSGTTWS

SEQ ID NO: 1886592 - protein, 17 aa, Staphylococcus
TALTWIVNMSSTGVSIA

SEQ ID NO: 1886593 - protein, 17 aa, Staphylococcus
TAMAFFFFIKSLNYLSA

SEQ ID NO: 1886594 - protein, 21 aa, Staphylococcus
TAMAGIFPKAFGANAQHIYNF

SEQ ID NO: 1886595 - protein, 21 aa, Staphylococcus
TAMLFQFFSPILITIYVSIQI

SEQ ID NO: 1886596 - protein, 30 aa, Staphylococcus
TAMLVFLDWRDTYLIYALIALVVLFWNYIV

SEQ ID NO: 1886597 - protein, 24 aa, Staphylococcus
TANERELLNVPGIGPTKVKEIIKY

SEQ ID NO: 1886598 - protein, 23 aa, Staphylococcus
TAPFIPMFYIIFGLKTRDESKDQ

SEQ ID NO: 1886599 - protein, 26 aa, Staphylococcus
TARLFDMVIQWGFLAIIVIFQPEIRR

SEQ ID NO: 1886600 - protein, 19 aa, Staphylococcus
TASGGDGYDMLGGPREEGV

SEQ ID NO: 1886601 - protein, 25 aa, Staphylococcus
TASGRLPSWAIGFSIYATTLSAITF

SEQ ID NO: 1886602 - protein, 22 aa, Staphylococcus
TASLFLCLTLYCFLNNKRCGIV

SEQ ID NO: 1886603 - protein, 21 aa, Staphylococcus
TATLSWQGWIALASMILGTWF

SEQ ID NO: 1886604 - protein, 17 aa, Staphylococcus
TAVEHQLEQAKVLNQAM

SEQ ID NO: 1886605 - protein, 27 aa, Staphylococcus
TAVFLSRWLLSLLISSNFFKKSNWLFG

SEQ ID NO: 1886606 - protein, 20 aa, Staphylococcus
TAVICILGLVPGIPLPFMPV

SEQ ID NO: 1886607 - protein, 17 aa, Staphylococcus
TAVLRIALGSATVAAIS

SEQ ID NO: 1886608 - protein, 26 aa, Staphylococcus
TAVLSYLLCIFIFFVLAKIDLYKKAL

SEQ ID NO: 1886609 - protein, 20 aa, Staphylococcus
TAVVPMFFGKPILYQTEANV

SEQ ID NO: 1886610 - protein, 25 aa, Staphylococcus
TAYAGVGLFAGMAVSALDMLKKGTL

SEQ ID NO: 1886611 - protein, 30 aa, Staphylococcus
TAYKFNSIWPSVFMHMCWNLSDFVHIATHN

SEQ ID NO: 1886612 - protein, 17 aa, Staphylococcus
TCACVKSTIKFAYKVFE

SEQ ID NO: 1886613 - protein, 17 aa, Staphylococcus
TCLMLALLLIFNGLQFK

SEQ ID NO: 1886614 - protein, 19 aa, Staphylococcus
TCLMLCGILVFIGTNSPIF

SEQ ID NO: 1886615 - protein, 22 aa, Staphylococcus
TCMGSSFVNFVLFRTLKIGGPS

SEQ ID NO: 1886616 - protein, 23 aa, Staphylococcus
TCMGSSFVNYVLFSRLHIGGKSK

SEQ ID NO: 1886617 - protein, 24 aa, Staphylococcus
TCVLIAIHFRAIFAPTPPSIKERF

SEQ ID NO: 1886618 - protein, 18 aa, Staphylococcus
TDAINHVQPVVVKKDEAK

SEQ ID NO: 1886619 - protein, 23 aa, Staphylococcus
TDAKKAFQAIMYAGIQYAKEQTS

SEQ ID NO: 1886620 - protein, 20 aa, Staphylococcus
TDFEAVPGRGIKANISGKNL

SEQ ID NO: 1886621 - protein, 17 aa, Staphylococcus
TDFIFSIICEELGLVGG

SEQ ID NO: 1886622 - protein, 17 aa, Staphylococcus
TDGEVLSPLVTVVNSQI

SEQ ID NO: 1886623 - protein, 25 aa, Staphylococcus
TDGYINMQLIFGILFILITGPLSSH

SEQ ID NO: 1886624 - protein, 23 aa, Staphylococcus
TDIAQGRWLFRVTSLIVFGHIVL

SEQ ID NO: 1886625 - protein, 23 aa, Staphylococcus
TDIKWAESNAEIIADFYKEMKTE

SEQ ID NO: 1886626 - protein, 17 aa, Staphylococcus
TDKKIAILISITGQNPT

SEQ ID NO: 1886627 - protein, 17 aa, Staphylococcus
TDLKKDWQIVLLSNLIT

SEQ ID NO: 1886628 - protein, 47 aa, Staphylococcus
TDLKRVAKTPAAWVILGGLAILPSFYAWFNLWAMWDPYSNTGHIKVA

SEQ ID NO: 1886629 - protein, 24 aa, Staphylococcus
TDLNRTGFWLKIPGKEGTVDKTYA

SEQ ID NO: 1886630 - protein, 23 aa, Staphylococcus
TDLNRTGFWLKIPGKNGTVDETY

SEQ ID NO: 1886631 - protein, 24 aa, Staphylococcus
TDLNRTGFWLKIPGKSGGVNKEYA

SEQ ID NO: 1886632 - protein, 25 aa, Staphylococcus
TDNLPRFFFYLLLFMFSMLGIVLSN

SEQ ID NO: 1886633 - protein, 24 aa, Staphylococcus
TDNLPRFFVYLLLFMFSMIGIVIA

SEQ ID NO: 1886634 - protein, 24 aa, Staphylococcus
TDNTIKSIHSFKPDENFLQTDYNW

SEQ ID NO: 1886635 - protein, 25 aa, Staphylococcus
TDNYRYQVPLPRDNWFLENRDDAVS

SEQ ID NO: 1886636 - protein, 17 aa, Staphylococcus
TDPGFNHDVINNNDPTK

SEQ ID NO: 1886637 - protein, 25 aa, Staphylococcus
TDQKMSWMIICFILMVFIALLLFKK

SEQ ID NO: 1886638 - protein, 26 aa, Staphylococcus
TDQLILMEFRFPRMIITILAGAALSM

SEQ ID NO: 1886639 - protein, 25 aa, Staphylococcus
TDRRGRIRIVNDMAIKMLGMAKEDL

SEQ ID NO: 1886640 - protein, 26 aa, Staphylococcus
TDRRGRIRIVNDMALKMLGMAKEDVM

SEQ ID NO: 1886641 - protein, 21 aa, Staphylococcus
TDRRGRVRIVNDMALTMMGTM

SEQ ID NO: 1886642 - protein, 23 aa, Staphylococcus
TDSDYNSDCDYSSDSDSGLDYDS

SEQ ID NO: 1886643 - protein, 27 aa, Staphylococcus
TDSLILLDFRLPRMLITILAGAALSMS

SEQ ID NO: 1886644 - protein, 24 aa, Staphylococcus
TDSYYRIILIAAFISIILSAIPIF

SEQ ID NO: 1886645 - protein, 17 aa, Staphylococcus
TDTKFIIKVVDTTAPTV

SEQ ID NO: 1886646 - protein, 26 aa, Staphylococcus
TDTLRSSPWFPFAVVCILIGAFTKSA

SEQ ID NO: 1886647 - protein, 23 aa, Staphylococcus
TDTRIAVFLTPIWFIILGLMYMR

SEQ ID NO: 1886648 - protein, 24 aa, Staphylococcus
TDTYTTTAGVNWNVVGDRTKLNTG

SEQ ID NO: 1886649 - protein, 23 aa, Staphylococcus
TDVLKIADACFASLVKEGVGLGV

SEQ ID NO: 1886650 - protein, 17 aa, Staphylococcus
TDVPAVLLELGYISNPT

SEQ ID NO: 1886651 - protein, 18 aa, Staphylococcus
TDYIKGVGLAVGTAGSAV

SEQ ID NO: 1886652 - protein, 17 aa, Staphylococcus
TDYITGIVKSRDIMYRN

SEQ ID NO: 1886653 - protein, 26 aa, Staphylococcus
TDYKRIGEELSQFYLGIINNLIRIEE

SEQ ID NO: 1886654 - protein, 22 aa, Staphylococcus
TDYSGPLAGAALLSGLALLSTR

SEQ ID NO: 1886655 - protein, 24 aa, Staphylococcus
TEDELKFAKEWGVKGKASNGSGIG

SEQ ID NO: 1886656 - protein, 34 aa, Staphylococcus
TEDNRFYHHGALDYKRLFGAIGKNLTGGFGAQGA

SEQ ID NO: 1886657 - protein, 17 aa, Staphylococcus
TEEAFSKVVSLLHGSYA

SEQ ID NO: 1886658 - protein, 26 aa, Staphylococcus
TEEIKFSHWQWFISIASIVVLFVANI

SEQ ID NO: 1886659 - protein, 21 aa, Staphylococcus
TEFDLRILMDALYELNDGKNL

SEQ ID NO: 1886660 - protein, 27 aa, Staphylococcus
TEFFSLRIGKLKYWAIYPFTMIIIITL

SEQ ID NO: 1886661 - protein, 17 aa, Staphylococcus
TEFISVGLLPLIKDAFN

SEQ ID NO: 1886662 - protein, 24 aa, Staphylococcus
TEFYYRMMRMGLKGSVSTDAHQMK

SEQ ID NO: 1886663 - protein, 21 aa, Staphylococcus
TEGKKGFSLNQFIALDAVPIA

SEQ ID NO: 1886664 - protein, 21 aa, Staphylococcus
TEGKTPASIHKYNDAIAKIQS

SEQ ID NO: 1886665 - protein, 20 aa, Staphylococcus
TEGTIMLMIMTWMMGITFSH

SEQ ID NO: 1886666 - protein, 24 aa, Staphylococcus
TEGVIKFILGLGYHYHPQADTFQM

SEQ ID NO: 1886667 - protein, 19 aa, Staphylococcus
TEHAFKQYDYRKVISKGEH

SEQ ID NO: 1886668 - protein, 29 aa, Staphylococcus
TEIFKPKYLKRIVLATAISTLQGMQYYGV

SEQ ID NO: 1886669 - protein, 21 aa, Staphylococcus
TEIIIMFIIGVVFIILFAIRE

SEQ ID NO: 1886670 - protein, 36 aa, Staphylococcus
TEILELQKSMWKYLSLIGIIVLLAIYLAVRSINRTY

SEQ ID NO: 1886671 - protein, 18 aa, Staphylococcus
TEIVRMIIGLLVIVLAGM

SEQ ID NO: 1886672 - protein, 21 aa, Staphylococcus
TEKDGIITYVYERIQSEIPNN

SEQ ID NO: 1886673 - protein, 23 aa, Staphylococcus
TEKGKLVIIIACILTFIMTLINT

SEQ ID NO: 1886674 - protein, 21 aa, Staphylococcus
TEKLAAEEQLNDILEQGLSDI

SEQ ID NO: 1886675 - protein, 22 aa, Staphylococcus
TEKLFKIAFFLFPFIFYLNTIT

SEQ ID NO: 1886676 - protein, 19 aa, Staphylococcus
TEKQWSKPLLYILLIVGII

SEQ ID NO: 1886677 - protein, 24 aa, Staphylococcus
TELEKALDAAVAFDNLDMNDPEDK

SEQ ID NO: 1886678 - protein, 19 aa, Staphylococcus
TELFPKRSYLMFATVVSIL

SEQ ID NO: 1886679 - protein, 17 aa, Staphylococcus
TELKPYVLIVTIIAILA

SEQ ID NO: 1886680 - protein, 21 aa, Staphylococcus
TELKSDWAITFLTILIIITPG

SEQ ID NO: 1886681 - protein, 19 aa, Staphylococcus
TELNFVEPMISRLELDNAN

SEQ ID NO: 1886682 - protein, 19 aa, Staphylococcus
TELNFVEPMISRLELQEAN

SEQ ID NO: 1886683 - protein, 17 aa, Staphylococcus
TELQMSFSQIWNTLSYA

SEQ ID NO: 1886684 - protein, 25 aa, Staphylococcus
TELRSEIPQSLSNVVLRATEKKASD

SEQ ID NO: 1886685 - protein, 20 aa, Staphylococcus
TELSFVEPMISRLELDEANE

SEQ ID NO: 1886686 - protein, 20 aa, Staphylococcus
TELSFVEPMISRLELEEANN

SEQ ID NO: 1886687 - protein, 18 aa, Staphylococcus
TELSRLVARKNHYNFYSF

SEQ ID NO: 1886688 - protein, 21 aa, Staphylococcus
TELTHPLWLALSFLFITVGEL

SEQ ID NO: 1886689 - protein, 17 aa, Staphylococcus
TEMFGKFEVLTMVLVTP

SEQ ID NO: 1886690 - protein, 17 aa, Staphylococcus
TEMSPILLAWIVAAVLR

SEQ ID NO: 1886691 - protein, 24 aa, Staphylococcus
TEPEEIKESLSIVLDETNRLNRLV

SEQ ID NO: 1886692 - protein, 24 aa, Staphylococcus
TEPEEIRDSLSIVLDETKRLNRLV

SEQ ID NO: 1886693 - protein, 24 aa, Staphylococcus
TEPNEIKESLSIVLDETKRLNRLV

SEQ ID NO: 1886694 - protein, 17 aa, Staphylococcus
TEPNVPVTIYVGPTTYR

SEQ ID NO: 1886695 - protein, 22 aa, Staphylococcus
TESFGIPTWLGALIMTLVIYGT

SEQ ID NO: 1886696 - protein, 21 aa, Staphylococcus
TESKVTMPRKEVAPEAPDIVA

SEQ ID NO: 1886697 - protein, 21 aa, Staphylococcus
TETKFSIKVVDTTAPTVKGIS

SEQ ID NO: 1886698 - protein, 21 aa, Staphylococcus
TETPFWYVVVIYAIRMISVGL

SEQ ID NO: 1886699 - protein, 19 aa, Staphylococcus
TETQSIRKWNDSHVSNKSG

SEQ ID NO: 1886700 - protein, 25 aa, Staphylococcus
TEVDSNGLSTVGIINDADNWTLDSG

SEQ ID NO: 1886701 - protein, 22 aa, Staphylococcus
TEVHVASEFVYNMPLLSEKPLF

SEQ ID NO: 1886702 - protein, 17 aa, Staphylococcus
TEVYIIMAIVAALCTVL

SEQ ID NO: 1886703 - protein, 23 aa, Staphylococcus
TFAGWTLYGLISYRFDVNKPHEN

SEQ ID NO: 1886704 - protein, 26 aa, Staphylococcus
TFAILLALLKKFAWGPLKEVMDKRER

SEQ ID NO: 1886705 - protein, 28 aa, Staphylococcus
TFAITRLVVRQSISFRKVLSDYVLINSV

SEQ ID NO: 1886706 - protein, 18 aa, Staphylococcus
TFAYSLKFLLKKLKQSYL

SEQ ID NO: 1886707 - protein, 23 aa, Staphylococcus
TFCLCVIIAISLFWDLGSLHQAF

SEQ ID NO: 1886708 - protein, 26 aa, Staphylococcus
TFDIFPRHVAVSLIMMMAYIMSLVLY

SEQ ID NO: 1886709 - protein, 18 aa, Staphylococcus
TFDPRTSTISGVATKVGT

SEQ ID NO: 1886710 - protein, 28 aa, Staphylococcus
TFDSIVFRNALQYTVIMAIAIFIALGFN

SEQ ID NO: 1886711 - protein, 25 aa, Staphylococcus
TFDVFPRHIVVSLIMMMAYLMSLVL

SEQ ID NO: 1886712 - protein, 24 aa, Staphylococcus
TFFKESRLSKHFYKNKEIEEIKHK

SEQ ID NO: 1886713 - protein, 24 aa, Staphylococcus
TFFLEKGKIIGLLQMFMTKESIAE

SEQ ID NO: 1886714 - protein, 25 aa, Staphylococcus
TFFNEKGKIVGMLQMFMTKESIAER

SEQ ID NO: 1886715 - protein, 21 aa, Staphylococcus
TFGARVLSMIGMLIVTITTSY

SEQ ID NO: 1886716 - protein, 32 aa, Staphylococcus
TFGDGFDTRQGVPIPTTVTIVGAPRSQPSTVN

SEQ ID NO: 1886717 - protein, 25 aa, Staphylococcus
TFGISRWVILYGRRKFAAMILTGMV

SEQ ID NO: 1886718 - protein, 34 aa, Staphylococcus
TFGITRLVVVQAIPFKKVLSDFVFINSVTVATLL

SEQ ID NO: 1886719 - protein, 18 aa, Staphylococcus
TFGYEPQEGPGLLFKVLP

SEQ ID NO: 1886720 - protein, 17 aa, Staphylococcus
TFIHRFLEIKVTRYWIE

SEQ ID NO: 1886721 - protein, 26 aa, Staphylococcus
TFIILLALLKKFAWGPLKEVMDKRER

SEQ ID NO: 1886722 - protein, 27 aa, Staphylococcus
TFKELWISIFTICFILAVSKLTTYGGL

SEQ ID NO: 1886723 - protein, 32 aa, Staphylococcus
TFKLYKHYYFRLFAFLTCITILFNFMPIVDQI

SEQ ID NO: 1886724 - protein, 25 aa, Staphylococcus
TFKRDLKHLFSHPIELIVIIIAGYV

SEQ ID NO: 1886725 - protein, 22 aa, Staphylococcus
TFKTWGCVVINDICNRINGCLN

SEQ ID NO: 1886726 - protein, 19 aa, Staphylococcus
TFLHNIIFDIARHFRPDQA

SEQ ID NO: 1886727 - protein, 24 aa, Staphylococcus
TFLIYLCMFTFIFGGFISIFIKLL

SEQ ID NO: 1886728 - protein, 26 aa, Staphylococcus
TFLLYANVVYFRFFSDFLTFSTLNQT

SEQ ID NO: 1886729 - protein, 22 aa, Staphylococcus
TFMNYVKLIWFVSSLGLLAGAM

SEQ ID NO: 1886730 - protein, 19 aa, Staphylococcus
TFNLWPFFVIPILTCIVAN

SEQ ID NO: 1886731 - protein, 19 aa, Staphylococcus
TFQHIKGAPVKRGLVMGLT

SEQ ID NO: 1886732 - protein, 19 aa, Staphylococcus
TFRLTEQILNRFNIKFSTV

SEQ ID NO: 1886733 - protein, 23 aa, Staphylococcus
TFSDGHEIIVPKGTKGDAGDSVT

SEQ ID NO: 1886734 - protein, 17 aa, Staphylococcus
TFSKRKLDISIEDFIAH

SEQ ID NO: 1886735 - protein, 23 aa, Staphylococcus
TFTELFPKMNYLWLATGVAILAC

SEQ ID NO: 1886736 - protein, 17 aa, Staphylococcus
TFTFLIISRMIQGFGAG

SEQ ID NO: 1886737 - protein, 23 aa, Staphylococcus
TFTILVCTKFNLQVGTTVAVLTS

SEQ ID NO: 1886738 - protein, 23 aa, Staphylococcus
TFTKKPSALTHIKQVATTKENEI

SEQ ID NO: 1886739 - protein, 22 aa, Staphylococcus
TFTNYLRLIWFVASLGLLAGAM

SEQ ID NO: 1886740 - protein, 38 aa, Staphylococcus
TFTSHPGDMNFLRWTNIRDDYTISWSNDKIAHRDTDGG

SEQ ID NO: 1886741 - protein, 27 aa, Staphylococcus
TFVAKHKWSSLIAWVVILAAIMIPLSF

SEQ ID NO: 1886742 - protein, 27 aa, Staphylococcus
TFVIHVQWKLLGYFLIIMAVFISLMTA

SEQ ID NO: 1886743 - protein, 19 aa, Staphylococcus
TFVSLRLYFISVILAFSFV

SEQ ID NO: 1886744 - protein, 24 aa, Staphylococcus
TFYKFKFILIMLIILLLSSMVLFI

SEQ ID NO: 1886745 - protein, 25 aa, Staphylococcus
TGAFLPSAVPIKFSATTLLIYGVVL

SEQ ID NO: 1886746 - protein, 20 aa, Staphylococcus
TGAIFPLLSPVLGWIGVFMT

SEQ ID NO: 1886747 - protein, 18 aa, Staphylococcus
TGAISGMLSGAVVVILWI

SEQ ID NO: 1886748 - protein, 24 aa, Staphylococcus
TGASFANFMLFRGLKIGNLGKAFA

SEQ ID NO: 1886749 - protein, 25 aa, Staphylococcus
TGDLDTGLMFICFQKSIQQFIDIQN

SEQ ID NO: 1886750 - protein, 18 aa, Staphylococcus
TGDVFVKSGGNWTNEGNI

SEQ ID NO: 1886751 - protein, 20 aa, Staphylococcus
TGFASYTGFVLIDEMEKSKK

SEQ ID NO: 1886752 - protein, 19 aa, Staphylococcus
TGFWIKVPGKSGGINKEYA

SEQ ID NO: 1886753 - protein, 29 aa, Staphylococcus
TGGFWRYLVAFLACCTWLFFKNQVNIIGV

SEQ ID NO: 1886754 - protein, 18 aa, Staphylococcus
TGGIVAISGGRNYRDVVD

SEQ ID NO: 1886755 - protein, 21 aa, Staphylococcus
TGGLTLLSIVAFSLLATKSLP

SEQ ID NO: 1886756 - protein, 21 aa, Staphylococcus
TGGLTLLSIVAFSLLNTKSLP

SEQ ID NO: 1886757 - protein, 21 aa, Staphylococcus
TGGLTLLSIVAFSLLNTRSLP

SEQ ID NO: 1886758 - protein, 17 aa, Staphylococcus
TGGLVAISGGRDYKNVV

SEQ ID NO: 1886759 - protein, 19 aa, Staphylococcus
TGGLVAISGGRNFRDVVDR

SEQ ID NO: 1886760 - protein, 17 aa, Staphylococcus
TGGLVAISGGRNYKDVV

SEQ ID NO: 1886761 - protein, 21 aa, Staphylococcus
TGGPFPISWTPFGELFAGVFM

SEQ ID NO: 1886762 - protein, 23 aa, Staphylococcus
TGHLTVFLILRLIQGLTSGGAIV

SEQ ID NO: 1886763 - protein, 25 aa, Staphylococcus
TGHVTIIPQQWIPKGDVSAKATRGS

SEQ ID NO: 1886764 - protein, 18 aa, Staphylococcus
TGIALIMLFILIKLFMQV

SEQ ID NO: 1886765 - protein, 18 aa, Staphylococcus
TGIALVILFVLIKLFMEV

SEQ ID NO: 1886766 - protein, 20 aa, Staphylococcus
TGIEGAVVFSGRAKSKKDVG

SEQ ID NO: 1886767 - protein, 20 aa, Staphylococcus
TGIEGAVVFSGRAKTKKDVG

SEQ ID NO: 1886768 - protein, 20 aa, Staphylococcus
TGIEGAVVFSSRAKSKKDVG

SEQ ID NO: 1886769 - protein, 19 aa, Staphylococcus
TGIFIIMLFILIKLFMEVH

SEQ ID NO: 1886770 - protein, 18 aa, Staphylococcus
TGIFLIILFVLIKLFMEV

SEQ ID NO: 1886771 - protein, 17 aa, Staphylococcus
TGIKNFFSIIFGGLKQI

SEQ ID NO: 1886772 - protein, 27 aa, Staphylococcus
TGIPKLIPRRHCDYIYVAKQCAQRCGL

SEQ ID NO: 1886773 - protein, 18 aa, Staphylococcus
TGITAMLVFLDWRDTYLI

SEQ ID NO: 1886774 - protein, 18 aa, Staphylococcus
TGKFREWSEQVGKSEGFK

SEQ ID NO: 1886775 - protein, 19 aa, Staphylococcus
TGKVIWAFATYLMFNAAYS

SEQ ID NO: 1886776 - protein, 20 aa, Staphylococcus
TGLFIFIVLWVGRKVGIQSI

SEQ ID NO: 1886777 - protein, 22 aa, Staphylococcus
TGLFLLCFYHLPNLNRYNEKTS

SEQ ID NO: 1886778 - protein, 25 aa, Staphylococcus
TGLIAGWMGFKFSFGLDQILGAIMY

SEQ ID NO: 1886779 - protein, 19 aa, Staphylococcus
TGLSAIWITIGLTLGAYLN

SEQ ID NO: 1886780 - protein, 18 aa, Staphylococcus
TGLSAIWITIGLTLGAYV

SEQ ID NO: 1886781 - protein, 25 aa, Staphylococcus
TGLSFLMPVSMPFHVTTSNLLLVVG

SEQ ID NO: 1886782 - protein, 19 aa, Staphylococcus
TGLSTIWITIGLTIGAYVN

SEQ ID NO: 1886783 - protein, 26 aa, Staphylococcus
TGLSYLTQMCVITFLMFTSAASGYAV

SEQ ID NO: 1886784 - protein, 20 aa, Staphylococcus
TGLVLFFFKERLMVTRRIAI

SEQ ID NO: 1886785 - protein, 22 aa, Staphylococcus
TGMIYPAILSFILIANSMMGVW

SEQ ID NO: 1886786 - protein, 17 aa, Staphylococcus
TGMKIVINISFAIVLIV

SEQ ID NO: 1886787 - protein, 23 aa, Staphylococcus
TGNALSTYDSWALAKHLKTFPIR

SEQ ID NO: 1886788 - protein, 18 aa, Staphylococcus
TGNIWRYLVAIIACLLWF

SEQ ID NO: 1886789 - protein, 25 aa, Staphylococcus
TGNMWRYLVAIVVCSIWFFFKDHIN

SEQ ID NO: 1886790 - protein, 17 aa, Staphylococcus
TGPLLAFLPVITIGLLF

SEQ ID NO: 1886791 - protein, 22 aa, Staphylococcus
TGQEIFQFFTIHGSGSIPGLII

SEQ ID NO: 1886792 - protein, 22 aa, Staphylococcus
TGQEVMQFFSPYGLWSYIGVIL

SEQ ID NO: 1886793 - protein, 22 aa, Staphylococcus
TGQEVMQFFTPYGLWSYIGVLI

SEQ ID NO: 1886794 - protein, 18 aa, Staphylococcus
TGQNGRDGQSITVQSTAP

SEQ ID NO: 1886795 - protein, 26 aa, Staphylococcus
TGQTHALDLGGFTFGDGFDTRQGVPI

SEQ ID NO: 1886796 - protein, 19 aa, Staphylococcus
TGSAFAFPGSMIGVFLASL

SEQ ID NO: 1886797 - protein, 24 aa, Staphylococcus
TGSHLWRVAVGFGAIIALVLYLLR

SEQ ID NO: 1886798 - protein, 26 aa, Staphylococcus
TGSLYGHSMMNVWVILPWFIIALPII

SEQ ID NO: 1886799 - protein, 18 aa, Staphylococcus
TGSPFAFPGSMIGVLLSS

SEQ ID NO: 1886800 - protein, 18 aa, Staphylococcus
TGSVWRYLVALVVCAFWY

SEQ ID NO: 1886801 - protein, 22 aa, Staphylococcus
TGTFTVPVTVTYPDGTKDHTNV

SEQ ID NO: 1886802 - protein, 27 aa, Staphylococcus
TGTIDLRAFWIRRIKRLIPAVYFMVSA

SEQ ID NO: 1886803 - protein, 25 aa, Staphylococcus
TGTLPRFANGTGFNLLGGGKKPKKH

SEQ ID NO: 1886804 - protein, 21 aa, Staphylococcus
TGVEVLIHIGIDTVKLNGQGF

SEQ ID NO: 1886805 - protein, 20 aa, Staphylococcus
TGVFIPFTLAQFGMVIKWIK

SEQ ID NO: 1886806 - protein, 19 aa, Staphylococcus
TGVLCSGIFFAILTATGLR

SEQ ID NO: 1886807 - protein, 17 aa, Staphylococcus
TGVLGFLILYFLAPFIS

SEQ ID NO: 1886808 - protein, 22 aa, Staphylococcus
TGVLRTLLFLAVLGVVVTGVTL

SEQ ID NO: 1886809 - protein, 17 aa, Staphylococcus
TGYPVRVLILLGLMIGA

SEQ ID NO: 1886810 - protein, 18 aa, Staphylococcus
TGYYLSTRFVEIVDDVIL

SEQ ID NO: 1886811 - protein, 22 aa, Staphylococcus
THCVTRLRLVLKDDDKVDKDRL

SEQ ID NO: 1886812 - protein, 22 aa, Staphylococcus
THCVTRLRLVLKDDNKVDKEAL

SEQ ID NO: 1886813 - protein, 26 aa, Staphylococcus
THFPQDWTIFYWSWWLVYAPFIGLFI

SEQ ID NO: 1886814 - protein, 24 aa, Staphylococcus
THFVPWMIWSTLGFVFFYMPITFV

SEQ ID NO: 1886815 - protein, 20 aa, Staphylococcus
THGNIFKGLVLFSGPIMLTN

SEQ ID NO: 1886816 - protein, 25 aa, Staphylococcus
THIFAPKAPEAMKSYHTIYNRISVD

SEQ ID NO: 1886817 - protein, 26 aa, Staphylococcus
THIKDVKIIITGGLGSTIISVSGLPK

SEQ ID NO: 1886818 - protein, 17 aa, Staphylococcus
THITALVSIIFYTLTKV

SEQ ID NO: 1886819 - protein, 17 aa, Staphylococcus
THIWMWAQLAVFLHVFV

SEQ ID NO: 1886820 - protein, 22 aa, Staphylococcus
THLRLLQRLSKALMHDDTRDNL

SEQ ID NO: 1886821 - protein, 25 aa, Staphylococcus
THLVKADRVCLERIINNLISNILKY

SEQ ID NO: 1886822 - protein, 22 aa, Staphylococcus
THPHALPFVWVSMVVLRPLVEE

SEQ ID NO: 1886823 - protein, 18 aa, Staphylococcus
THQPPGIIGDKWQYTGKV

SEQ ID NO: 1886824 - protein, 19 aa, Staphylococcus
THQPPGIIGDKWQYTGQTT

SEQ ID NO: 1886825 - protein, 22 aa, Staphylococcus
THSIPFTLLWPILITLLVFTFS

SEQ ID NO: 1886826 - protein, 20 aa, Staphylococcus
THTGCGCTIGCFSIMFISFL

SEQ ID NO: 1886827 - protein, 31 aa, Staphylococcus
THVVNGQNLYRIAIQYYGEGTPENVEKIREA

SEQ ID NO: 1886828 - protein, 17 aa, Staphylococcus
TIAIFLIVFMAFILIIT

SEQ ID NO: 1886829 - protein, 18 aa, Staphylococcus
TIAKLLLRFWDVTRGDIL

SEQ ID NO: 1886830 - protein, 18 aa, Staphylococcus
TIAKRLANDHLTNSQIVD

SEQ ID NO: 1886831 - protein, 23 aa, Staphylococcus
TIEFWPGNQLFFSIFKACLTFIA

SEQ ID NO: 1886832 - protein, 19 aa, Staphylococcus
TIEKDGILYVLSKVPADAP

SEQ ID NO: 1886833 - protein, 20 aa, Staphylococcus
TIFCGYAFAGILEKSGCLNV

SEQ ID NO: 1886834 - protein, 19 aa, Staphylococcus
TIFIWVCIITLIAQQLEGN

SEQ ID NO: 1886835 - protein, 19 aa, Staphylococcus
TIFTKCLNILLLIHDYFVS

SEQ ID NO: 1886836 - protein, 26 aa, Staphylococcus
TIFVIEFIGALLLAFYFYRDNPDLKY

SEQ ID NO: 1886837 - protein, 31 aa, Staphylococcus
TIFVMIWSMPFFKKLFLPGGALSFLTAAIPL

SEQ ID NO: 1886838 - protein, 21 aa, Staphylococcus
TIGDAVAPIVSFLADKLTGLF

SEQ ID NO: 1886839 - protein, 26 aa, Staphylococcus
TIGLCLKPILDPMMRKVTKKVNKSNV

SEQ ID NO: 1886840 - protein, 25 aa, Staphylococcus
TIGSLVCAISFNFPIMMGGRVLQAI

SEQ ID NO: 1886841 - protein, 19 aa, Staphylococcus
TIGSVLITLAFLVVCNQPL

SEQ ID NO: 1886842 - protein, 26 aa, Staphylococcus
TIGTYCLFISLSVLVIDWLQRIPSIY

SEQ ID NO: 1886843 - protein, 25 aa, Staphylococcus
TIHIKSILSHDGFAMIMNDAIKNFS

SEQ ID NO: 1886844 - protein, 18 aa, Staphylococcus
TIHYPVVLIFIFFLILLI

SEQ ID NO: 1886845 - protein, 17 aa, Staphylococcus
TIIDLRLPRIIIALCVG

SEQ ID NO: 1886846 - protein, 18 aa, Staphylococcus
TIIFARFTTIKAKKMVAT

SEQ ID NO: 1886847 - protein, 23 aa, Staphylococcus
TIIFGAFAFFWFVGIHGPSIVEP

SEQ ID NO: 1886848 - protein, 19 aa, Staphylococcus
TIIIGHIFMAFFAEFGFRS

SEQ ID NO: 1886849 - protein, 23 aa, Staphylococcus
TIIKDICERFSLKLNIKSDSNGT

SEQ ID NO: 1886850 - protein, 18 aa, Staphylococcus
TIILVLLVLMSIVLTYMV

SEQ ID NO: 1886851 - protein, 19 aa, Staphylococcus
TIINRKYILPSMSIGHIKF

SEQ ID NO: 1886852 - protein, 27 aa, Staphylococcus
TIIPAIICLAGIFGTMIWRSFQIDHGY

SEQ ID NO: 1886853 - protein, 23 aa, Staphylococcus
TIIPNRPIPEGDVTAKATDNAEH

SEQ ID NO: 1886854 - protein, 24 aa, Staphylococcus
TIITKNNIRYGVVGVTTPETKTKT

SEQ ID NO: 1886855 - protein, 24 aa, Staphylococcus
TIIVFFCVFLIFSPIGKLKLGKPD

SEQ ID NO: 1886856 - protein, 24 aa, Staphylococcus
TIIVFFCVFLIFSPIGKLKLGKPN

SEQ ID NO: 1886857 - protein, 24 aa, Staphylococcus
TIKDEAWLNAKLNHINKKTYQGIF

SEQ ID NO: 1886858 - protein, 20 aa, Staphylococcus
TIKIKHAFLPESPEVKTIKL

SEQ ID NO: 1886859 - protein, 32 aa, Staphylococcus
TIKQFEPEYHKKRNAILKLYDIVDAQEAIINA

SEQ ID NO: 1886860 - protein, 17 aa, Staphylococcus
TILFSWSAWSGIDKGIK

SEQ ID NO: 1886861 - protein, 18 aa, Staphylococcus
TILGMKLSPEEAKKAAQR

SEQ ID NO: 1886862 - protein, 23 aa, Staphylococcus
TILLFCLVIIFFLKDTLKDGELD

SEQ ID NO: 1886863 - protein, 24 aa, Staphylococcus
TILNFPISVSFVMGGLFLITGPTV

SEQ ID NO: 1886864 - protein, 28 aa, Staphylococcus
TILNRKVAIKAIRIPAGEKEETIKRFER

SEQ ID NO: 1886865 - protein, 19 aa, Staphylococcus
TILSLFYCIVIFPITIFIH

SEQ ID NO: 1886866 - protein, 26 aa, Staphylococcus
TILTIEFIGALLLAFYFYRDNPDLKN

SEQ ID NO: 1886867 - protein, 20 aa, Staphylococcus
TIMFLSILVILSFIIFIHKK

SEQ ID NO: 1886868 - protein, 23 aa, Staphylococcus
TIMKTLTLFTVFLTLPTLVFSFF

SEQ ID NO: 1886869 - protein, 24 aa, Staphylococcus
TIMVYAGLMLIFFIVFNYASQVAM

SEQ ID NO: 1886870 - protein, 18 aa, Staphylococcus
TIMYFGMGIFGISILYLL

SEQ ID NO: 1886871 - protein, 25 aa, Staphylococcus
TINEREVIGIFALDKFAWLVGAFVL

SEQ ID NO: 1886872 - protein, 25 aa, Staphylococcus
TINGREVIGIFALDKLAWLVGAFVL

SEQ ID NO: 1886873 - protein, 25 aa, Staphylococcus
TINKEIQPIMPLLRKIQLKYRQQAQ

SEQ ID NO: 1886874 - protein, 19 aa, Staphylococcus
TINQFKPVANDLAKHKNNA

SEQ ID NO: 1886875 - protein, 25 aa, Staphylococcus
TIPASIIGLIVWFFAGLKYQSHTNP

SEQ ID NO: 1886876 - protein, 20 aa, Staphylococcus
TIPGLWKQRLRWAQGGQEVL

SEQ ID NO: 1886877 - protein, 20 aa, Staphylococcus
TIPSRFILNIVRTIPDLLLA

SEQ ID NO: 1886878 - protein, 17 aa, Staphylococcus
TIPVLMVIFKIRKEMAI

SEQ ID NO: 1886879 - protein, 21 aa, Staphylococcus
TIQYPIVLIIVFLGILTTLKL

SEQ ID NO: 1886880 - protein, 18 aa, Staphylococcus
TIRARFEIDDNGSLEDRR

SEQ ID NO: 1886881 - protein, 18 aa, Staphylococcus
TIRKRLAQKLMRLPLGVV

SEQ ID NO: 1886882 - protein, 19 aa, Staphylococcus
TISDSWRNIFVFPIIIVAI

SEQ ID NO: 1886883 - protein, 22 aa, Staphylococcus
TISGIAKKVGTYPIVVTSTDAE

SEQ ID NO: 1886884 - protein, 18 aa, Staphylococcus
TISLILKTIRYLKGGNVS

SEQ ID NO: 1886885 - protein, 32 aa, Staphylococcus
TISSICINLFIPLIVIYMLTRFFYKKHLSRNI

SEQ ID NO: 1886886 - protein, 19 aa, Staphylococcus
TISTILFLLVFHHLPNVQR

SEQ ID NO: 1886887 - protein, 20 aa, Staphylococcus
TITLKTYFSYYVDFSLGVKG

SEQ ID NO: 1886888 - protein, 22 aa, Staphylococcus
TITLKTYFSYYVDFSLGVKGLV

SEQ ID NO: 1886889 - protein, 19 aa, Staphylococcus
TITLNLTKWNSATTNLNNG

SEQ ID NO: 1886890 - protein, 17 aa, Staphylococcus
TITRFSGKLNYANFQDM

SEQ ID NO: 1886891 - protein, 18 aa, Staphylococcus
TIVFFPIFYLGYLMNKHQ

SEQ ID NO: 1886892 - protein, 19 aa, Staphylococcus
TIVFFPIFYLGYLMTKKNT

SEQ ID NO: 1886893 - protein, 17 aa, Staphylococcus
TIVFGFFALTFVTPLLR

SEQ ID NO: 1886894 - protein, 17 aa, Staphylococcus
TIVFGFFALTFVTPMLR

SEQ ID NO: 1886895 - protein, 18 aa, Staphylococcus
TIVFGFFALTFVTPVLRT

SEQ ID NO: 1886896 - protein, 17 aa, Staphylococcus
TIVGAYFFFRSTVSLLF

SEQ ID NO: 1886897 - protein, 17 aa, Staphylococcus
TIVGAYLFFRSSVSLIF

SEQ ID NO: 1886898 - protein, 26 aa, Staphylococcus
TIVGFKILAPIMEFIMHILSLAVEAL

SEQ ID NO: 1886899 - protein, 18 aa, Staphylococcus
TIVGGLFATIGVLILPYV

SEQ ID NO: 1886900 - protein, 23 aa, Staphylococcus
TIVIGCLFMYITLLQMSQFYTQQ

SEQ ID NO: 1886901 - protein, 25 aa, Staphylococcus
TIVLFFAIGCFKYADAHVTLNPNQS

SEQ ID NO: 1886902 - protein, 25 aa, Staphylococcus
TIVLQEMIIRLSLVTREGLGEAIQD

SEQ ID NO: 1886903 - protein, 18 aa, Staphylococcus
TIVNLFMRFYEFHHGEIL

SEQ ID NO: 1886904 - protein, 24 aa, Staphylococcus
TIVPALSATFFKKGVIQHKQETSL

SEQ ID NO: 1886905 - protein, 19 aa, Staphylococcus
TIVPYMASVSLFVGAVSFS

SEQ ID NO: 1886906 - protein, 24 aa, Staphylococcus
TIVVLVLIGIGGFYYYNQATGYIK

SEQ ID NO: 1886907 - protein, 25 aa, Staphylococcus
TIVYFEIITTIAIALGVLFANLFKP

SEQ ID NO: 1886908 - protein, 20 aa, Staphylococcus
TIWFIIPVIIVIALAIPTVN

SEQ ID NO: 1886909 - protein, 20 aa, Staphylococcus
TIWFVVPILIVIALAVPTVK

SEQ ID NO: 1886910 - protein, 19 aa, Staphylococcus
TIWPKNGMIYFGMADIGGA

SEQ ID NO: 1886911 - protein, 23 aa, Staphylococcus
TIYRLILKYLRWYIKTVKGSVRR

SEQ ID NO: 1886912 - protein, 24 aa, Staphylococcus
TKAFPIVWPILYLLMGVSYLITTK

SEQ ID NO: 1886913 - protein, 20 aa, Staphylococcus
TKAFTGYAILQLENEGKLHL

SEQ ID NO: 1886914 - protein, 17 aa, Staphylococcus
TKAKLGLDQPVIIQYVQ

SEQ ID NO: 1886915 - protein, 26 aa, Staphylococcus
TKAKNTVSGQVWLETGTGVDLANSAS

SEQ ID NO: 1886916 - protein, 19 aa, Staphylococcus
TKDAFKHTLTDVDVRNTNS

SEQ ID NO: 1886917 - protein, 27 aa, Staphylococcus
TKDGLPLLKTRGLKNIVEPLALSDEEF

SEQ ID NO: 1886918 - protein, 22 aa, Staphylococcus
TKDGSFKQPIFVLDGHSHTVID

SEQ ID NO: 1886919 - protein, 26 aa, Staphylococcus
TKDMIICLIGSFISAIAVNCFILGSN

SEQ ID NO: 1886920 - protein, 36 aa, Staphylococcus
TKDPIEIITEPYIKVEILDKDGHVIGSGKTDKNGHV

SEQ ID NO: 1886921 - protein, 25 aa, Staphylococcus
TKEKKRYVIVWAIVGYFVVMIYQIL

SEQ ID NO: 1886922 - protein, 43 aa, Staphylococcus
TKELLYIALRISLIKILRPYYPFPIIIDDAFVHFDKQRKSMML

SEQ ID NO: 1886923 - protein, 43 aa, Staphylococcus
TKELLYISLRLSLIKILRPYYSMPIIIDDAFVHFDKQRKAAMM

SEQ ID NO: 1886924 - protein, 43 aa, Staphylococcus
TKELLYISLRLSLIKVLKPYYPFPIIIDDAFVHFDKQRKSMML

SEQ ID NO: 1886925 - protein, 17 aa, Staphylococcus
TKELLYVALRLSLIKVL

SEQ ID NO: 1886926 - protein, 21 aa, Staphylococcus
TKESAGFGIIGLVGPISAFRF

SEQ ID NO: 1886927 - protein, 22 aa, Staphylococcus
TKEVLHDLNFEIPKGKVTAFVG

SEQ ID NO: 1886928 - protein, 17 aa, Staphylococcus
TKFIIKVVDTTAPTVKE

SEQ ID NO: 1886929 - protein, 27 aa, Staphylococcus
TKFSHVWPILIFLPFVVLVLLKIRSHY

SEQ ID NO: 1886930 - protein, 24 aa, Staphylococcus
TKFSHVWPILIFLPLIVIVFLRIK

SEQ ID NO: 1886931 - protein, 26 aa, Staphylococcus
TKFSHVWPILLFLPFFVSVFVRIKIH

SEQ ID NO: 1886932 - protein, 18 aa, Staphylococcus
TKFSIKVVDTTAPTVKEI

SEQ ID NO: 1886933 - protein, 22 aa, Staphylococcus
TKGELLPIIFFAVFFGLGLAAI

SEQ ID NO: 1886934 - protein, 21 aa, Staphylococcus
TKGNKRPSAFSSKSVQTNNND

SEQ ID NO: 1886935 - protein, 34 aa, Staphylococcus
TKGRTIYIATLFHFAMSFGLVFLFNEELGEVFAM

SEQ ID NO: 1886936 - protein, 18 aa, Staphylococcus
TKHAIGLVSDQGLELLIH

SEQ ID NO: 1886937 - protein, 18 aa, Staphylococcus
TKHKIFILLIGIAFICSF

SEQ ID NO: 1886938 - protein, 18 aa, Staphylococcus
TKHYDRDSFATSNTGSDL

SEQ ID NO: 1886939 - protein, 25 aa, Staphylococcus
TKIEAIKSLMNFKKVPLEHVKPVTS

SEQ ID NO: 1886940 - protein, 26 aa, Staphylococcus
TKIKIGDKFAKIGIYIFIFLIGTVAI

SEQ ID NO: 1886941 - protein, 18 aa, Staphylococcus
TKINWKVFLTPVILTLVL

SEQ ID NO: 1886942 - protein, 18 aa, Staphylococcus
TKISKFSNRIEVIDTLKL

SEQ ID NO: 1886943 - protein, 26 aa, Staphylococcus
TKITSFIPLLSPFVMFVRSASPDVAV

SEQ ID NO: 1886944 - protein, 17 aa, Staphylococcus
TKKEYRNIYIGQYVGSV

SEQ ID NO: 1886945 - protein, 18 aa, Staphylococcus
TKKNQSWSLNNNISGISI

SEQ ID NO: 1886946 - protein, 27 aa, Staphylococcus
TKKQINFKRSHFIIILIVTILVTAMIA

SEQ ID NO: 1886947 - protein, 23 aa, Staphylococcus
TKKRSWVSIIIHFIVLVLTAISG

SEQ ID NO: 1886948 - protein, 23 aa, Staphylococcus
TKKVRPGTYLGISGGDPGEDGAG

SEQ ID NO: 1886949 - protein, 19 aa, Staphylococcus
TKLEDKINEIVHTEGMTQQ

SEQ ID NO: 1886950 - protein, 25 aa, Staphylococcus
TKLFGELEFWFAIIKVVTIVALIIV

SEQ ID NO: 1886951 - protein, 23 aa, Staphylococcus
TKLGEVWAMVCLSLMLVAYLMLK

SEQ ID NO: 1886952 - protein, 18 aa, Staphylococcus
TKLHRLNISVVIISIVVI

SEQ ID NO: 1886953 - protein, 19 aa, Staphylococcus
TKLIDWGVLLILGIFLGSY

SEQ ID NO: 1886954 - protein, 19 aa, Staphylococcus
TKLIHYFVMLLLALVTVAS

SEQ ID NO: 1886955 - protein, 27 aa, Staphylococcus
TKLLEYKKPIILMAMALVFTTVIGVGF

SEQ ID NO: 1886956 - protein, 27 aa, Staphylococcus
TKLLEYRKPIVLMAMALVFATVIGVGF

SEQ ID NO: 1886957 - protein, 21 aa, Staphylococcus
TKLPAFVLLLTFCSIVIYIII

SEQ ID NO: 1886958 - protein, 19 aa, Staphylococcus
TKLPGAETVRSELANNPEI

SEQ ID NO: 1886959 - protein, 24 aa, Staphylococcus
TKLYPGEVYTIAELLQITVSNSSN

SEQ ID NO: 1886960 - protein, 17 aa, Staphylococcus
TKLYYKLINSFVEDIEF

SEQ ID NO: 1886961 - protein, 17 aa, Staphylococcus
TKLYYLSIILIVIAILI

SEQ ID NO: 1886962 - protein, 25 aa, Staphylococcus
TKMFGELEFWFAIIKVVTIIALIVI

SEQ ID NO: 1886963 - protein, 19 aa, Staphylococcus
TKMHSLTAIVSRLVSCLLI

SEQ ID NO: 1886964 - protein, 17 aa, Staphylococcus
TKMHSVQAIVSRFISCI

SEQ ID NO: 1886965 - protein, 19 aa, Staphylococcus
TKNKVLKWVFFSCTLIGLL

SEQ ID NO: 1886966 - protein, 21 aa, Staphylococcus
TKNNVRYGIVGVTTPETKTKT

SEQ ID NO: 1886967 - protein, 18 aa, Staphylococcus
TKNYFKGYIQPFWPLAII

SEQ ID NO: 1886968 - protein, 28 aa, Staphylococcus
TKPDAAIGICFTAFLALGVIMISLIQSS

SEQ ID NO: 1886969 - protein, 22 aa, Staphylococcus
TKPEIAQIISLIIWIMIVALIV

SEQ ID NO: 1886970 - protein, 24 aa, Staphylococcus
TKQKDLKGILAFSTVSQLGMIMSM

SEQ ID NO: 1886971 - protein, 22 aa, Staphylococcus
TKQLLAPIVVLIVWNLSTHLTF

SEQ ID NO: 1886972 - protein, 21 aa, Staphylococcus
TKQLLAPIVVLVIWNLTTHHT

SEQ ID NO: 1886973 - protein, 26 aa, Staphylococcus
TKQPRFYLWLIIGLIFGFAPPLQTTI

SEQ ID NO: 1886974 - protein, 19 aa, Staphylococcus
TKQSLSFILILIIIVLMLR

SEQ ID NO: 1886975 - protein, 23 aa, Staphylococcus
TKQTDLKGILAFSTVSQLGMIMS

SEQ ID NO: 1886976 - protein, 23 aa, Staphylococcus
TKRISVPILIHIFQNGFVVVMQF

SEQ ID NO: 1886977 - protein, 24 aa, Staphylococcus
TKSLKKVSAIIGISALLLLITKII

SEQ ID NO: 1886978 - protein, 27 aa, Staphylococcus
TKTFGYKRFEVLAALFNGITLLIISGV

SEQ ID NO: 1886979 - protein, 18 aa, Staphylococcus
TKTILKKENSVFVIELPP

SEQ ID NO: 1886980 - protein, 25 aa, Staphylococcus
TKVELLDKDFHVIGSGVTDEKGNAI

SEQ ID NO: 1886981 - protein, 23 aa, Staphylococcus
TKVKRDARDALNQTTETKMNALS

SEQ ID NO: 1886982 - protein, 22 aa, Staphylococcus
TKVSGLPEGVTFDSRTNIISGV

SEQ ID NO: 1886983 - protein, 20 aa, Staphylococcus
TLAKRWSKGYTITVAVGVVT

SEQ ID NO: 1886984 - protein, 24 aa, Staphylococcus
TLANDIHPWIGLVLSIIMLAVMYN

SEQ ID NO: 1886985 - protein, 21 aa, Staphylococcus
TLCLACILYLIGQTIINHVSI

SEQ ID NO: 1886986 - protein, 21 aa, Staphylococcus
TLCLACVLYLIGQSIINHVSI

SEQ ID NO: 1886987 - protein, 19 aa, Staphylococcus
TLDNIKSRLEVTSKSNQKF

SEQ ID NO: 1886988 - protein, 17 aa, Staphylococcus
TLDSFIFRNTIRYTVIM

SEQ ID NO: 1886989 - protein, 17 aa, Staphylococcus
TLDSFNLYFGIFMICVA

SEQ ID NO: 1886990 - protein, 26 aa, Staphylococcus
TLEELKRLDAGYHFTDINGATPYRND

SEQ ID NO: 1886991 - protein, 18 aa, Staphylococcus
TLEMKKFFKSGGKQQIPY

SEQ ID NO: 1886992 - protein, 19 aa, Staphylococcus
TLEMKQFFKSGGKQQLPYT

SEQ ID NO: 1886993 - protein, 17 aa, Staphylococcus
TLFDDMTHVISLNTGRS

SEQ ID NO: 1886994 - protein, 26 aa, Staphylococcus
TLFFWFFKLNYSFGHIINAKIFTEEF

SEQ ID NO: 1886995 - protein, 21 aa, Staphylococcus
TLFGFSSVFAYFTYISTVLID

SEQ ID NO: 1886996 - protein, 32 aa, Staphylococcus
TLFGGLMATNFGWRSIFIISIILTILAMFLMK

SEQ ID NO: 1886997 - protein, 18 aa, Staphylococcus
TLFGIEFILLSLNMNTSL

SEQ ID NO: 1886998 - protein, 19 aa, Staphylococcus
TLFIKRARKYGLIISHIYA

SEQ ID NO: 1886999 - protein, 27 aa, Staphylococcus
TLFIKSLRRFAGYIALLAPILASGYFL

SEQ ID NO: 1887000 - protein, 21 aa, Staphylococcus
TLFIVCSITMLFVIPTFRYKN

SEQ ID NO: 1887001 - protein, 24 aa, Staphylococcus
TLFIYAAGIALIFTYHKWVKVIES

SEQ ID NO: 1887002 - protein, 17 aa, Staphylococcus
TLFKAVGIVLLLIGILL

SEQ ID NO: 1887003 - protein, 24 aa, Staphylococcus
TLFLNENWAGILITIVATVLTLPI

SEQ ID NO: 1887004 - protein, 21 aa, Staphylococcus
TLFLVPKWYSLIIILVAIIIT

SEQ ID NO: 1887005 - protein, 25 aa, Staphylococcus
TLFMKSRFWLPLIISSVVFSSQHLS

SEQ ID NO: 1887006 - protein, 24 aa, Staphylococcus
TLFTLDFYKPIFGKRASDQHIARV

SEQ ID NO: 1887007 - protein, 23 aa, Staphylococcus
TLFTYRAPMGMRAMGALANAAIA

SEQ ID NO: 1887008 - protein, 18 aa, Staphylococcus
TLFVPVDLFNSWTSAKAQ

SEQ ID NO: 1887009 - protein, 22 aa, Staphylococcus
TLGFKEKLSYGFGDLGNGMMFD

SEQ ID NO: 1887010 - protein, 17 aa, Staphylococcus
TLGHIALIFGLGAILGK

SEQ ID NO: 1887011 - protein, 17 aa, Staphylococcus
TLGHIALIFGLGAMLGK

SEQ ID NO: 1887012 - protein, 20 aa, Staphylococcus
TLGLTWIALWLMVYPLFERI

SEQ ID NO: 1887013 - protein, 17 aa, Staphylococcus
TLGSAFGSTALWVGAGL

SEQ ID NO: 1887014 - protein, 18 aa, Staphylococcus
TLHFFWNVFQVVYITTKE

SEQ ID NO: 1887015 - protein, 23 aa, Staphylococcus
TLICNMLGYFGFQYVNFLILTWT

SEQ ID NO: 1887016 - protein, 23 aa, Staphylococcus
TLIGAIFVWIGWYGFNVGSALSF

SEQ ID NO: 1887017 - protein, 23 aa, Staphylococcus
TLIGGIFVWIGWYGFNTGSAFTL

SEQ ID NO: 1887018 - protein, 19 aa, Staphylococcus
TLIIPIFFFITAIMMFARR

SEQ ID NO: 1887019 - protein, 25 aa, Staphylococcus
TLIKDVIMLAGRILLESGAEGTRVE

SEQ ID NO: 1887020 - protein, 23 aa, Staphylococcus
TLILHKWFFASIVTFVVLAILAF

SEQ ID NO: 1887021 - protein, 23 aa, Staphylococcus
TLILMEFRLPRMIITILAGAALA

SEQ ID NO: 1887022 - protein, 41 aa, Staphylococcus
TLILNNFFSIRKLKFGVASITLGSALIIGAHHEAQAAESNN

SEQ ID NO: 1887023 - protein, 22 aa, Staphylococcus
TLIMFITWMFTMYKWKEAGRKL

SEQ ID NO: 1887024 - protein, 30 aa, Staphylococcus
TLIMFTTIILFCLIIIFFLKDTLREGEVEE

SEQ ID NO: 1887025 - protein, 25 aa, Staphylococcus
TLISIICAYFIRFLINKLKKTYLYF

SEQ ID NO: 1887026 - protein, 18 aa, Staphylococcus
TLITGIYGMNFINMPELK

SEQ ID NO: 1887027 - protein, 22 aa, Staphylococcus
TLIVSCLIALGLLINHAIYTTI

SEQ ID NO: 1887028 - protein, 19 aa, Staphylococcus
TLKKRGISNLDYIIITHPH

SEQ ID NO: 1887029 - protein, 24 aa, Staphylococcus
TLKLSIPLNKVFRLSYIINAFNAI

SEQ ID NO: 1887030 - protein, 25 aa, Staphylococcus
TLLALFCSITLLSWLYLTKSHTEHP

SEQ ID NO: 1887031 - protein, 22 aa, Staphylococcus
TLLCGWLSDKLFKGRRGPAGFF

SEQ ID NO: 1887032 - protein, 17 aa, Staphylococcus
TLLCHIQNLILFVGLPW

SEQ ID NO: 1887033 - protein, 19 aa, Staphylococcus
TLLGCLCMIQILPNTFEPY

SEQ ID NO: 1887034 - protein, 18 aa, Staphylococcus
TLLHSWLNSDTHRSRLLN

SEQ ID NO: 1887035 - protein, 17 aa, Staphylococcus
TLLLGVLLAFMWPPFKL

SEQ ID NO: 1887036 - protein, 21 aa, Staphylococcus
TLLMPMQIMISIFIILSPFNI

SEQ ID NO: 1887037 - protein, 24 aa, Staphylococcus
TLLNEFFKKLGFDTQLLAKPGTTD

SEQ ID NO: 1887038 - protein, 26 aa, Staphylococcus
TLLNREWWESYKFYQHDKELKVKIVN

SEQ ID NO: 1887039 - protein, 18 aa, Staphylococcus
TLLPKLFLNFPRQYRNVF

SEQ ID NO: 1887040 - protein, 24 aa, Staphylococcus
TLLVCSINILLSVFLKRTYEKDLK

SEQ ID NO: 1887041 - protein, 24 aa, Staphylococcus
TLLVFSLFVAYGFLRVGFPKLHLM

SEQ ID NO: 1887042 - protein, 25 aa, Staphylococcus
TLLYRLNILLNHGFTLIECFTFLNM

SEQ ID NO: 1887043 - protein, 25 aa, Staphylococcus
TLMGKYKYLFYLAILLSVVSSVISL

SEQ ID NO: 1887044 - protein, 17 aa, Staphylococcus
TLMKLNPFWTILLCFIF

SEQ ID NO: 1887045 - protein, 24 aa, Staphylococcus
TLMPLTLFAMIAFYIAIFSMFKPE

SEQ ID NO: 1887046 - protein, 26 aa, Staphylococcus
TLMWQRINRILALVVLMFLIVIPLCL

SEQ ID NO: 1887047 - protein, 23 aa, Staphylococcus
TLNALKFSILLLIFGIWITLLPP

SEQ ID NO: 1887048 - protein, 24 aa, Staphylococcus
TLNMINLRLGDMLAGKVKHQLRRE

SEQ ID NO: 1887049 - protein, 24 aa, Staphylococcus
TLNPSGFIKIVWGLALAAIAYVLL

SEQ ID NO: 1887050 - protein, 17 aa, Staphylococcus
TLPDGRTPGTYTVPATV

SEQ ID NO: 1887051 - protein, 29 aa, Staphylococcus
TLPIGSAIREWLKPYGIAMLTAPFVIVTW

SEQ ID NO: 1887052 - protein, 18 aa, Staphylococcus
TLPLGRPFFTACIGGGIG

SEQ ID NO: 1887053 - protein, 18 aa, Staphylococcus
TLPLGRPFFTACLGGGIG

SEQ ID NO: 1887054 - protein, 18 aa, Staphylococcus
TLPLGRPFITACIGGGIG

SEQ ID NO: 1887055 - protein, 18 aa, Staphylococcus
TLPLGRPFITACLGGGIG

SEQ ID NO: 1887056 - protein, 23 aa, Staphylococcus
TLPPKEVFLASVIVGTLGAVMDV

SEQ ID NO: 1887057 - protein, 17 aa, Staphylococcus
TLQEIIYLIPISFVVTI

SEQ ID NO: 1887058 - protein, 26 aa, Staphylococcus
TLQFIRLHRRVGRFSILFLAINSILF

SEQ ID NO: 1887059 - protein, 34 aa, Staphylococcus
TLQMLDMKYSHWFKFVWPIVVFVFIFGGGLLVAQ

SEQ ID NO: 1887060 - protein, 33 aa, Staphylococcus
TLQMLDMKYSHWFRFVWPVVVFVLVFGGAMLIT

SEQ ID NO: 1887061 - protein, 37 aa, Staphylococcus
TLQMLNMRYSHWFRFVWPVVVFVLVFGGGMLVAQVLL

SEQ ID NO: 1887062 - protein, 21 aa, Staphylococcus
TLQYRFDMMRQSLKQVDEMRQ

SEQ ID NO: 1887063 - protein, 24 aa, Staphylococcus
TLQYYDRRGLLIAHRQTDSNRRYY

SEQ ID NO: 1887064 - protein, 21 aa, Staphylococcus
TLREKIILILFILPFPIMVWG

SEQ ID NO: 1887065 - protein, 20 aa, Staphylococcus
TLRLDKERAKLDVDQAAKSR

SEQ ID NO: 1887066 - protein, 20 aa, Staphylococcus
TLRVKDFLALGVGTIVSTAI

SEQ ID NO: 1887067 - protein, 19 aa, Staphylococcus
TLSGDWLKQVVSVLSVIKD

SEQ ID NO: 1887068 - protein, 18 aa, Staphylococcus
TLSGWVVSQYSWKVIFYI

SEQ ID NO: 1887069 - protein, 18 aa, Staphylococcus
TLSIGTFIFDWHTVVAAV

SEQ ID NO: 1887070 - protein, 27 aa, Staphylococcus
TLSIKLWKKCLAAGVISLSFLYLQGGN

SEQ ID NO: 1887071 - protein, 25 aa, Staphylococcus
TLTAGTAFLIWLGDQITQFGVGNGI

SEQ ID NO: 1887072 - protein, 32 aa, Staphylococcus
TLTGLLIDFFSWRMPFYIVAAIALIAFAIGFF

SEQ ID NO: 1887073 - protein, 22 aa, Staphylococcus
TLTILACTKLNLQVGTTVAVLT

SEQ ID NO: 1887074 - protein, 26 aa, Staphylococcus
TLTIPKDRPVVFKLQAMDTMTSFWIP

SEQ ID NO: 1887075 - protein, 25 aa, Staphylococcus
TLTIPKDRPVVFKLQSMDTMTSFWI

SEQ ID NO: 1887076 - protein, 25 aa, Staphylococcus
TLTIPKNRPVVFKLQAMDTMTSFWI

SEQ ID NO: 1887077 - protein, 24 aa, Staphylococcus
TLTIPKNRPVVFKLQSMDTMTSFW

SEQ ID NO: 1887078 - protein, 24 aa, Staphylococcus
TLVELLDKHGHVIGKATTDGNGNA

SEQ ID NO: 1887079 - protein, 18 aa, Staphylococcus
TLVGMMFGIATYRFNTIW

SEQ ID NO: 1887080 - protein, 26 aa, Staphylococcus
TLVLVTGWQKRTWVTIIATLSGTFLC

SEQ ID NO: 1887081 - protein, 22 aa, Staphylococcus
TLVMHLSMWLLFIGFVILVAPV

SEQ ID NO: 1887082 - protein, 27 aa, Staphylococcus
TLVPAIICLAGIFGTMIWRSFQIDHGY

SEQ ID NO: 1887083 - protein, 19 aa, Staphylococcus
TLVRKVADGEVTLKLYGQE

SEQ ID NO: 1887084 - protein, 30 aa, Staphylococcus
TLVTFLILLALLKKFAWGPLKDVMDKREHD

SEQ ID NO: 1887085 - protein, 18 aa, Staphylococcus
TLVTIVVFLPLVFVSGSV

SEQ ID NO: 1887086 - protein, 24 aa, Staphylococcus
TLYESFQFLNLHFIYRDKNISKII

SEQ ID NO: 1887087 - protein, 19 aa, Staphylococcus
TLYLSFILIGSLQGKDMTN

SEQ ID NO: 1887088 - protein, 17 aa, Staphylococcus
TLYNLLYNFSFSMIIGE

SEQ ID NO: 1887089 - protein, 25 aa, Staphylococcus
TLYTIRLLPVGGYVRMAGDGIDEVP

SEQ ID NO: 1887090 - protein, 25 aa, Staphylococcus
TLYTIRLLPVGGYVRMAGDGLEELP

SEQ ID NO: 1887091 - protein, 25 aa, Staphylococcus
TLYTYASIMLLTWLIIIFILLILAY

SEQ ID NO: 1887092 - protein, 31 aa, Staphylococcus; identical to SEQ ID NO: 1580534

SEQ ID NO: 1887093 - protein, 25 aa, Staphylococcus
TMHLLIVGVICFIIGIISYTILGTI

SEQ ID NO: 1887094 - protein, 21 aa, Staphylococcus
TMIRAASLSFLFVGVLGVLRG

SEQ ID NO: 1887095 - protein, 35 aa, Staphylococcus
TMKILKSAFLSGLMLEFINMLGIGLIALEATLSLV

SEQ ID NO: 1887096 - protein, 35 aa, Staphylococcus
TMKILKSAFLSGLMLEFISMLGIGLVALEAALSLV

SEQ ID NO: 1887097 - protein, 35 aa, Staphylococcus
TMKILRSAFLSGLMLEFISLLGIGLVALEAGLGLV

SEQ ID NO: 1887098 - protein, 22 aa, Staphylococcus
TMLAGAGSLVFLGKDPIKKAIP

SEQ ID NO: 1887099 - protein, 17 aa, Staphylococcus
TMLIGAFGVIAYRDIKK

SEQ ID NO: 1887100 - protein, 20 aa, Staphylococcus
TMLIPLIMLISMLLRGLIVL

SEQ ID NO: 1887101 - protein, 22 aa, Staphylococcus
TMLKVMAPLSFVLASLAIYWAM

SEQ ID NO: 1887102 - protein, 30 aa, Staphylococcus
TMLLQFTETCFNRWQFSTIMLAPLVLISSL

SEQ ID NO: 1887103 - protein, 18 aa, Staphylococcus
TMLMPLIYLGVIVISYPV

SEQ ID NO: 1887104 - protein, 17 aa, Staphylococcus
TMMLTFFPQLIKLTHSY

SEQ ID NO: 1887105 - protein, 17 aa, Staphylococcus
TMNGRRYIFFDNIGFST

SEQ ID NO: 1887106 - protein, 23 aa, Staphylococcus
TMPNVQWPEVWTAIYETLYMTII

SEQ ID NO: 1887107 - protein, 17 aa, Staphylococcus
TMQISIVGIVSLIIGIL

SEQ ID NO: 1887108 - protein, 17 aa, Staphylococcus
TMRAPMLNLEVLKSSTF

SEQ ID NO: 1887109 - protein, 35 aa, Staphylococcus
TMRILKSAFLSGLMLEFISMLGIGLVALEAGLGLI

SEQ ID NO: 1887110 - protein, 35 aa, Staphylococcus
TMRILKSAFLSSLMLEFISMLGIGLVALEAALSLV

SEQ ID NO: 1887111 - protein, 28 aa, Staphylococcus
TMRKIFPWDFKILIGIGLLFCLATPMAS

SEQ ID NO: 1887112 - protein, 25 aa, Staphylococcus
TMRTILTLKGYRYMAAAVSFLEVLV

SEQ ID NO: 1887113 - protein, 26 aa, Staphylococcus
TMRTILTLKGYRYMAAVVSFLEVLIY

SEQ ID NO: 1887114 - protein, 18 aa, Staphylococcus
TMSFLTLPPKEVFLASVI

SEQ ID NO: 1887115 - protein, 19 aa, Staphylococcus
TMSFLTLPPKEVFLASVLI

SEQ ID NO: 1887116 - protein, 18 aa, Staphylococcus
TMSFLTLPPKEVFLASVM

SEQ ID NO: 1887117 - protein, 25 aa, Staphylococcus
TMSICYCIILFPLTVLLHFRIEAKN

SEQ ID NO: 1887118 - protein, 31 aa, Staphylococcus
TMSSYNYKQGDKIGVPGFVRGMHDMHEKEGK

SEQ ID NO: 1887119 - protein, 25 aa, Staphylococcus
TMSVGMCAYLIRLIRSNLLDLYQSP

SEQ ID NO: 1887120 - protein, 19 aa, Staphylococcus
TMTFLTLPPKDVFLASVLI

SEQ ID NO: 1887121 - protein, 26 aa, Staphylococcus
TNAANTLSGRAWVVDQGTPATMSNGL

SEQ ID NO: 1887122 - protein, 30 aa, Staphylococcus
TNAEVAKAKIEWEILIKSIKPIVKVKPEAN

SEQ ID NO: 1887123 - protein, 18 aa, Staphylococcus
TNAKNAIDGLTYLNDAQR

SEQ ID NO: 1887124 - protein, 24 aa, Staphylococcus
TNASLKITLLISVAAGIGLINILP

SEQ ID NO: 1887125 - protein, 23 aa, Staphylococcus
TNFGYLMGLFFKHLLMSVYGVLF

SEQ ID NO: 1887126 - protein, 19 aa, Staphylococcus
TNFLLADAEAWRWMIGLAV

SEQ ID NO: 1887127 - protein, 28 aa, Staphylococcus
TNFLWVIPIGIVWFVLYYVIFRYLITKF

SEQ ID NO: 1887128 - protein, 32 aa, Staphylococcus
TNFPNFGGGLLGHYLLSISIPLISIVGIIIVT

SEQ ID NO: 1887129 - protein, 26 aa, Staphylococcus
TNFPQDWTIFYWSWWLVYAPFIGLFI

SEQ ID NO: 1887130 - protein, 17 aa, Staphylococcus
TNHPIIDLRLFKNVSFS

SEQ ID NO: 1887131 - protein, 27 aa, Staphylococcus
TNIKIRKIVPVAIIFFIIILLVILFFL

SEQ ID NO: 1887132 - protein, 33 aa, Staphylococcus
TNIMIKSQGFEFIWFDIGILFVFIFVFTVLNIV

SEQ ID NO: 1887133 - protein, 26 aa, Staphylococcus
TNKARLATAIGWFWAMFSVGMGVIGT

SEQ ID NO: 1887134 - protein, 30 aa, Staphylococcus
TNKFFNKWIACILVAFPIFTSFTTYCNSHF

SEQ ID NO: 1887135 - protein, 26 aa, Staphylococcus
TNKMKRKHLLIGIMLIFIIANALAAF

SEQ ID NO: 1887136 - protein, 23 aa, Staphylococcus
TNKRPDLDGGIYSYARAGFGDFV

SEQ ID NO: 1887137 - protein, 19 aa, Staphylococcus
TNKSLRKEMNFKQQFKPSQ

SEQ ID NO: 1887138 - protein, 25 aa, Staphylococcus
TNLDLFKGTTFIGIISFFAWGLGYF

SEQ ID NO: 1887139 - protein, 28 aa, Staphylococcus
TNMDLFRGTTFLGMISLFAWGLGYFGQP

SEQ ID NO: 1887140 - protein, 18 aa, Staphylococcus
TNNKIAAVLSKYPNNLGG

SEQ ID NO: 1887141 - protein, 28 aa, Staphylococcus
TNNKIGAVLSKYSDNLSYGRPDNNVGPI

SEQ ID NO: 1887142 - protein, 23 aa, Staphylococcus
TNPKADIPGIIYSTIGFGALLYG

SEQ ID NO: 1887143 - protein, 23 aa, Staphylococcus
TNPKADVPGIIFSTIGFGALLYG

SEQ ID NO: 1887144 - protein, 19 aa, Staphylococcus
TNQDLVFPYASNETVTYTL

SEQ ID NO: 1887145 - protein, 23 aa, Staphylococcus
TNQFPIFIVMAVYTAIYAVFALT

SEQ ID NO: 1887146 - protein, 21 aa, Staphylococcus
TNQKIVMKWAIGSSLFMILVA

SEQ ID NO: 1887147 - protein, 25 aa, Staphylococcus
TNRYPARPVLLWTLVIFVVGNGIIA

SEQ ID NO: 1887148 - protein, 25 aa, Staphylococcus
TNSIKPAALKQILAKLDAQKAFISE

SEQ ID NO: 1887149 - protein, 17 aa, Staphylococcus
TNSQFVLSYNVYQNPTD

SEQ ID NO: 1887150 - protein, 23 aa, Staphylococcus
TNTISGVATKVGIYPIVVTSTDN

SEQ ID NO: 1887151 - protein, 28 aa, Staphylococcus
TNTLLMIPICISFLFGPIVDAIALRKTL

SEQ ID NO: 1887152 - protein, 25 aa, Staphylococcus
TNVKKLPDKTIVTFSDNYEVTIPGG

SEQ ID NO: 1887153 - protein, 17 aa, Staphylococcus
TNVPAVLLELGYISNPT

SEQ ID NO: 1887154 - protein, 28 aa, Staphylococcus
TNYKKEILGGLTTFLSMAYILAVNPQVL

SEQ ID NO: 1887155 - protein, 28 aa, Staphylococcus
TNYLWVIPIGIVWFVLYYVIFRTLITVF

SEQ ID NO: 1887156 - protein, 30 aa, Staphylococcus
TNYLWVLPIGIVWFCLYYIIFRFLIIKFNF

SEQ ID NO: 1887157 - protein, 18 aa, Staphylococcus
TNYREMKRDVLANRHQFG

SEQ ID NO: 1887158 - protein, 19 aa, Staphylococcus
TNYREMKRDVLANRHQYGE

SEQ ID NO: 1887159 - protein, 31 aa, Staphylococcus
TPASERVPVKIPGYQHFRTSISDGITKFIYR

SEQ ID NO: 1887160 - protein, 25 aa, Staphylococcus
TPASNANLGLIGSVTNSPIIITLKN

SEQ ID NO: 1887161 - protein, 18 aa, Staphylococcus
TPEHPLKLILPIITLVGG

SEQ ID NO: 1887162 - protein, 24 aa, Staphylococcus
TPEKAIKGGADFIHKHFLSHDDQN

SEQ ID NO: 1887163 - protein, 24 aa, Staphylococcus
TPEKAIKGGADFIHQHFLSHDDQN

SEQ ID NO: 1887164 - protein, 23 aa, Staphylococcus
TPFLLLAAICFSRSSKKFNRWLV

SEQ ID NO: 1887165 - protein, 18 aa, Staphylococcus
TPGAHSVPVTVTYPDGSK

SEQ ID NO: 1887166 - protein, 23 aa, Staphylococcus
TPGEYTVPVTVTYPDGTKDHVNV

SEQ ID NO: 1887167 - protein, 19 aa, Staphylococcus
TPGTFTVPATVTYPDGTKD

SEQ ID NO: 1887168 - protein, 18 aa, Staphylococcus
TPHTYAILMFIILVAWLM

SEQ ID NO: 1887169 - protein, 17 aa, Staphylococcus
TPIAYAYNLDDSYITAN

SEQ ID NO: 1887170 - protein, 25 aa, Staphylococcus
TPISVLICLSAIFGLPQGLLNLANQ

SEQ ID NO: 1887171 - protein, 17 aa, Staphylococcus
TPITFYMSFVITAIILL

SEQ ID NO: 1887172 - protein, 19 aa, Staphylococcus
TPIVEGNVIAKAYDPANNV

SEQ ID NO: 1887173 - protein, 24 aa, Staphylococcus
TPKNRITLRKCIGLSCIAIGIILL

SEQ ID NO: 1887174 - protein, 18 aa, Staphylococcus
TPKYGIWALILGTLKVTF

SEQ ID NO: 1887175 - protein, 17 aa, Staphylococcus
TPLSAYAFMIFILLYVP

SEQ ID NO: 1887176 - protein, 23 aa, Staphylococcus
TPLTAKQSYSWIVLGRLLAVVIA

SEQ ID NO: 1887177 - protein, 26 aa, Staphylococcus
TPMAGIPAWLWSCIFLVIIFSLNSLS

SEQ ID NO: 1887178 - protein, 17 aa, Staphylococcus
TPMRIVFLAVVLNAILA

SEQ ID NO: 1887179 - protein, 23 aa, Staphylococcus
TPNFKLSHFIGYSLLQFLIGFIA

SEQ ID NO: 1887180 - protein, 18 aa, Staphylococcus
TPPIGLGLATFIQKRKFN

SEQ ID NO: 1887181 - protein, 23 aa, Staphylococcus
TPPKRVHYAFIMTMCGIHGTISL

SEQ ID NO: 1887182 - protein, 23 aa, Staphylococcus
TPPNVKRSYAWTVLGRTLAVVIA

SEQ ID NO: 1887183 - protein, 24 aa, Staphylococcus
TPPTKPRVTSPLGGKAGTTDPVTV

SEQ ID NO: 1887184 - protein, 25 aa, Staphylococcus
TPPTKPRVTTPLGGKATTLTPIEVT

SEQ ID NO: 1887185 - protein, 25 aa, Staphylococcus
TPPTKPRVTTPLGGKATTLTPVEVT

SEQ ID NO: 1887186 - protein, 19 aa, Staphylococcus
TPQEFGAFILLLTLVNIIS

SEQ ID NO: 1887187 - protein, 17 aa, Staphylococcus
TPQGFEMLFNNFSAGIL

SEQ ID NO: 1887188 - protein, 17 aa, Staphylococcus
TPQKAISGGANFIHGHF

SEQ ID NO: 1887189 - protein, 20 aa, Staphylococcus
TPRVKVVAFSKEVTYDEAYE

SEQ ID NO: 1887190 - protein, 23 aa, Staphylococcus
TPSFYGLVLARFLIGIGTCAGYP

SEQ ID NO: 1887191 - protein, 21 aa, Staphylococcus
TPSYDVYPFMYGMSNEEYNKL

SEQ ID NO: 1887192 - protein, 17 aa, Staphylococcus
TPWDISLDYDYWRFILL

SEQ ID NO: 1887193 - protein, 25 aa, Staphylococcus
TPYLHIMGIYVLRSFGMAFIMMPIM

SEQ ID NO: 1887194 - protein, 17 aa, Staphylococcus
TQFKLPTWLIILITALC

SEQ ID NO: 1887195 - protein, 22 aa, Staphylococcus
TQFRKEGLKAFTLKRKYKPALI

SEQ ID NO: 1887196 - protein, 18 aa, Staphylococcus
TQHFLKDDIDTYINRSEL

SEQ ID NO: 1887197 - protein, 17 aa, Staphylococcus
TQHFLKDDLDTYINRTE

SEQ ID NO: 1887198 - protein, 25 aa, Staphylococcus
TQIATLFLIDIVSYLLLDDDYMHNV

SEQ ID NO: 1887199 - protein, 22 aa, Staphylococcus
TQIFGIPVFLFLNIIVILLCII

SEQ ID NO: 1887200 - protein, 22 aa, Staphylococcus
TQIFGIPVFLFLNILIILLCII

SEQ ID NO: 1887201 - protein, 22 aa, Staphylococcus
TQIFGIPVFLFLNLVIILLCII

SEQ ID NO: 1887202 - protein, 24 aa, Staphylococcus
TQIFGIPVLLFLNLMVILLCIIVG

SEQ ID NO: 1887203 - protein, 19 aa, Staphylococcus
TQIIYHFQKGAASEREPVL

SEQ ID NO: 1887204 - protein, 33 aa, Staphylococcus
TQIRNAICLGLWLFSFILGWFVLPKLVSKIKTS

SEQ ID NO: 1887205 - protein, 17 aa, Staphylococcus
TQIRRFVEYSNDEIAVG

SEQ ID NO: 1887206 - protein, 17 aa, Staphylococcus
TQISLVIGIVAALLDIF

SEQ ID NO: 1887207 - protein, 26 aa, Staphylococcus
TQLAFAMLVAIVIVYLVLVITFKGGL

SEQ ID NO: 1887208 - protein, 20 aa, Staphylococcus
TQLAGLKFSVDIRVIERILL

SEQ ID NO: 1887209 - protein, 32 aa, Staphylococcus
TQLFGKASWYIPGWLNRILPHVDIEGHALQDK

SEQ ID NO: 1887210 - protein, 35 aa, Staphylococcus
TQLFGKASWYLPGWLSRIIPHIDIEGHALESMKTP

SEQ ID NO: 1887211 - protein, 19 aa, Staphylococcus
TQLFHVLQGTKFVNGAIKA

SEQ ID NO: 1887212 - protein, 25 aa, Staphylococcus
TQLFKLSWLVIILLLSGYLISEFTG

SEQ ID NO: 1887213 - protein, 26 aa, Staphylococcus
TQLMEFGSPILLCLNMGDVASKRGIE

SEQ ID NO: 1887214 - protein, 17 aa, Staphylococcus
TQNDIITVLPFGNLISQ

SEQ ID NO: 1887215 - protein, 24 aa, Staphylococcus
TQPHIMMLIILWMVGCITSFSGLA

SEQ ID NO: 1887216 - protein, 17 aa, Staphylococcus
TQQFLKDDVDTYINRSE

SEQ ID NO: 1887217 - protein, 17 aa, Staphylococcus
TQSAFGYIGLGVLAIAI

SEQ ID NO: 1887218 - protein, 17 aa, Staphylococcus
TQYPTFLSISICTLLKI

SEQ ID NO: 1887219 - protein, 24 aa, Staphylococcus
TQYVIEWITLFFLMIIIIIYILTT

SEQ ID NO: 1887220 - protein, 17 aa, Staphylococcus
TRALFVTTNELARRLQK

SEQ ID NO: 1887221 - protein, 20 aa, Staphylococcus
TRATNVVNYAANQSGRNVNH

SEQ ID NO: 1887222 - protein, 18 aa, Staphylococcus
TRCGKPTGYSEQSMSRND

SEQ ID NO: 1887223 - protein, 17 aa, Staphylococcus
TREVFKPILSSTIVTII

SEQ ID NO: 1887224 - protein, 21 aa, Staphylococcus
TRFMFMVGIDAILLLLIITTL

SEQ ID NO: 1887225 - protein, 24 aa, Staphylococcus
TRFYAEVEFYFSLVKVVTIIVFII

SEQ ID NO: 1887226 - protein, 19 aa, Staphylococcus
TRGATGAIFMGIFYALVML

SEQ ID NO: 1887227 - protein, 19 aa, Staphylococcus
TRGLYIFSMAAFLIGSLVA

SEQ ID NO: 1887228 - protein, 29 aa, Staphylococcus
TRHGLKNWLTLVVVIAFILFIILLFMFLN

SEQ ID NO: 1887229 - protein, 18 aa, Staphylococcus
TRIEIWTLSVDHMSESAK

SEQ ID NO: 1887230 - protein, 19 aa, Staphylococcus
TRIIKAYSSNAIWQLIVLL

SEQ ID NO: 1887231 - protein, 17 aa, Staphylococcus
TRIIPFVMISKVHLSER

SEQ ID NO: 1887232 - protein, 21 aa, Staphylococcus
TRKIKELFVAHKVEQQYNKNE

SEQ ID NO: 1887233 - protein, 21 aa, Staphylococcus
TRKIKELFVAHRVEKEYDKNE

SEQ ID NO: 1887234 - protein, 21 aa, Staphylococcus
TRKLKELFVAHKVEQQYSKNQ

SEQ ID NO: 1887235 - protein, 20 aa, Staphylococcus
TRKLYIFSMAAFLIGSIIAA

SEQ ID NO: 1887236 - protein, 21 aa, Staphylococcus
TRKMGGTGLGLAISKEIVEAH

SEQ ID NO: 1887237 - protein, 23 aa, Staphylococcus
TRKSEGISLFSLSLVLGTAVGPF

SEQ ID NO: 1887238 - protein, 34 aa, Staphylococcus
TRLETPLLDFRVFKEGQFAVGILIMALTMIAMIG

SEQ ID NO: 1887239 - protein, 17 aa, Staphylococcus
TRLQKAFFGKEVNYDMM

SEQ ID NO: 1887240 - protein, 22 aa, Staphylococcus
TRLQMSYNHTWNILGYALNGFV

SEQ ID NO: 1887241 - protein, 23 aa, Staphylococcus
TRMKHIPFLILIMLYLTCVDNIV

SEQ ID NO: 1887242 - protein, 19 aa, Staphylococcus
TRMKMPMLNFEVLRFPTFT

SEQ ID NO: 1887243 - protein, 19 aa, Staphylococcus
TRNHKRLLLGSVFLMATSA

SEQ ID NO: 1887244 - protein, 22 aa, Staphylococcus
TRPTSFAVPGFFVITVSIIIGF

SEQ ID NO: 1887245 - protein, 21 aa, Staphylococcus
TRQVFLVGIAVFFIGTIIGGF

SEQ ID NO: 1887246 - protein, 21 aa, Staphylococcus
TRQVFLVGIFIFFLGTMLGGF

SEQ ID NO: 1887247 - protein, 19 aa, Staphylococcus
TRSDQWWWFDAINYGSLQI

SEQ ID NO: 1887248 - protein, 18 aa, Staphylococcus
TRSGKIMRRVLKAWELNL

SEQ ID NO: 1887249 - protein, 23 aa, Staphylococcus
TRSNRNFRFFQIFTAALQSFSHG

SEQ ID NO: 1887250 - protein, 28 aa, Staphylococcus
TRSVALARFPWLSANIEYTVTREPYFST

SEQ ID NO: 1887251 - protein, 18 aa, Staphylococcus
TRTIKYVDAENTSKVLHA

SEQ ID NO: 1887252 - protein, 24 aa, Staphylococcus
TRTLANKIRIAAAAVAEDNSKIID

SEQ ID NO: 1887253 - protein, 24 aa, Staphylococcus
TRTRLQLSYNHTWNILGYALNGFV

SEQ ID NO: 1887254 - protein, 19 aa, Staphylococcus
TRTVAFPYVEGQKVYNAFV

SEQ ID NO: 1887255 - protein, 26 aa, Staphylococcus
TRTVNIPVMVYPTVSAVTPNRDKFGI

SEQ ID NO: 1887256 - protein, 24 aa, Staphylococcus
TRTWKGAQISLFIGIVAAALDIFI

SEQ ID NO: 1887257 - protein, 24 aa, Staphylococcus
TRTWKGAQISLFIGIVAAILDIFI

SEQ ID NO: 1887258 - protein, 19 aa, Staphylococcus
TRTWKGTQISLVIGIVAAL

SEQ ID NO: 1887259 - protein, 25 aa, Staphylococcus
TRVLYRLTFVGSIFLAVIAILPIIA

SEQ ID NO: 1887260 - protein, 31 aa, Staphylococcus
TRVNPKLSLIVYLVMGWVGVIFLPIILMRTS

SEQ ID NO: 1887261 - protein, 18 aa, Staphylococcus
TRYDEVQPHLSLDEAHRY

SEQ ID NO: 1887262 - protein, 17 aa, Staphylococcus
TSAWKGIFWGLVYGGLA

SEQ ID NO: 1887263 - protein, 17 aa, Staphylococcus
TSDRTSKVFGIPVSQLN

SEQ ID NO: 1887264 - protein, 30 aa, Staphylococcus
TSDSLSVSDSMRNVYSISNSESVSASTSLN

SEQ ID NO: 1887265 - protein, 26 aa, Staphylococcus
TSEQDINKVLERNNFASNRELNNLQE

SEQ ID NO: 1887266 - protein, 17 aa, Staphylococcus
TSESFRNYLSLKLSKVG

SEQ ID NO: 1887267 - protein, 18 aa, Staphylococcus
TSESLRQSESLSQSLSLS

SEQ ID NO: 1887268 - protein, 18 aa, Staphylococcus
TSFARFIISLGEKYLPFF

SEQ ID NO: 1887269 - protein, 28 aa, Staphylococcus
TSFFLVLLICAKWIAALMGDVNLAPMLS

SEQ ID NO: 1887270 - protein, 17 aa, Staphylococcus
TSFITAMIKSRDLMYQN

SEQ ID NO: 1887271 - protein, 17 aa, Staphylococcus
TSFRMNSIMQILTLVSV

SEQ ID NO: 1887272 - protein, 19 aa, Staphylococcus
TSGLLYLLSFGNKKMTRIA

SEQ ID NO: 1887273 - protein, 18 aa, Staphylococcus
TSGVQWGTIIVTLVTFLI

SEQ ID NO: 1887274 - protein, 18 aa, Staphylococcus
TSHSRMYTFSKRKAINNL

SEQ ID NO: 1887275 - protein, 25 aa, Staphylococcus
TSIAKIFPWFIVWFVIASLISTIFN

SEQ ID NO: 1887276 - protein, 23 aa, Staphylococcus
TSIALLFAIGCNFFILKKYAQFK

SEQ ID NO: 1887277 - protein, 26 aa, Staphylococcus
TSIGLFCIIMIFALLGFLPFNLNPAK

SEQ ID NO: 1887278 - protein, 24 aa, Staphylococcus
TSIIATKTNDNWSLNNSVPGINIE

SEQ ID NO: 1887279 - protein, 17 aa, Staphylococcus
TSIILGWILAKLINKIN

SEQ ID NO: 1887280 - protein, 17 aa, Staphylococcus
TSIKEKIEESSPVTKEE

SEQ ID NO: 1887281 - protein, 24 aa, Staphylococcus
TSILGGILLRIPIQNVMESIEKGI

SEQ ID NO: 1887282 - protein, 21 aa, Staphylococcus
TSILSRFGISVSAILAGAGVV

SEQ ID NO: 1887283 - protein, 25 aa, Staphylococcus
TSILSRFGISVSAILAGAGVVGLAV

SEQ ID NO: 1887284 - protein, 22 aa, Staphylococcus
TSIRLKMHLFYQKNVILATIPY

SEQ ID NO: 1887285 - protein, 22 aa, Staphylococcus
TSIRLKMHLFYQKNVILATVPF

SEQ ID NO: 1887286 - protein, 17 aa, Staphylococcus
TSITFSIIFAILTVIFL

SEQ ID NO: 1887287 - protein, 26 aa, Staphylococcus
TSKLSKKASIIWAVVALVLTIGSGLI

SEQ ID NO: 1887288 - protein, 19 aa, Staphylococcus
TSLAWLKIVALIVALVLLT

SEQ ID NO: 1887289 - protein, 19 aa, Staphylococcus
TSLDLSFGLIIKYFLAGAC

SEQ ID NO: 1887290 - protein, 21 aa, Staphylococcus
TSLHHELPMTGERASTTTFVY

SEQ ID NO: 1887291 - protein, 21 aa, Staphylococcus
TSLICFFILYMANFTSLWLSS

SEQ ID NO: 1887292 - protein, 23 aa, Staphylococcus
TSLKQAFGKLLLYLVQGAVSALL

SEQ ID NO: 1887293 - protein, 22 aa, Staphylococcus
TSMAWLKVIALIIGMILLTVGA

SEQ ID NO: 1887294 - protein, 20 aa, Staphylococcus
TSMGMTRLQLMKDVQLPLAL

SEQ ID NO: 1887295 - protein, 17 aa, Staphylococcus
TSNGGGSIALWIVSIFA

SEQ ID NO: 1887296 - protein, 22 aa, Staphylococcus
TSNIIFPFIVGVILFICGLVVF

SEQ ID NO: 1887297 - protein, 31 aa, Staphylococcus
TSNIRIRKFIPWAIVAFIIVLLIIVFVLVRN

SEQ ID NO: 1887298 - protein, 19 aa, Staphylococcus
TSNYIAWISHGQLRMDGSL

SEQ ID NO: 1887299 - protein, 27 aa, Staphylococcus
TSPAFIKQKWFGEQRTPVYVYKWEDVQ

SEQ ID NO: 1887300 - protein, 25 aa, Staphylococcus
TSPFMLLKLIIVWTLVQFIEGHFIS

SEQ ID NO: 1887301 - protein, 25 aa, Staphylococcus
TSPFMLLKLIVVWTLVQFIEGHFIS

SEQ ID NO: 1887302 - protein, 25 aa, Staphylococcus
TSPHEMKRMMSFYSLSKNLGNSIGS

SEQ ID NO: 1887303 - protein, 20 aa, Staphylococcus
TSPHFSHFNTMSFFHDVNQW

SEQ ID NO: 1887304 - protein, 20 aa, Staphylococcus
TSPIFIKQKWFGEQRTPVYV

SEQ ID NO: 1887305 - protein, 23 aa, Staphylococcus
TSPIYMKKMMSFYALTKNLGSSV

SEQ ID NO: 1887306 - protein, 20 aa, Staphylococcus
TSPLTWINFIFVWFSEILFN

SEQ ID NO: 1887307 - protein, 27 aa, Staphylococcus
TSPQFIKQKWFGEQRTPVYVYKWEDVQ

SEQ ID NO: 1887308 - protein, 26 aa, Staphylococcus
TSQVNRAGVPISIFFGGVKMMMPNMV

SEQ ID NO: 1887309 - protein, 18 aa, Staphylococcus
TSRFDMLVLYALSTFVCT

SEQ ID NO: 1887310 - protein, 28 aa, Staphylococcus
TSRFFWLICSLAVLILAVFIFTFFNDRL

SEQ ID NO: 1887311 - protein, 20 aa, Staphylococcus
TSSLIYNWIFGVLMTVSIIS

SEQ ID NO: 1887312 - protein, 23 aa, Staphylococcus
TSSLKMYGLIFIGIILFFTVLII

SEQ ID NO: 1887313 - protein, 18 aa, Staphylococcus
TSSSESFSTSTSTSNSDS

SEQ ID NO: 1887314 - protein, 24 aa, Staphylococcus
TSTDLRPAGIITLNNERIDAVSDG

SEQ ID NO: 1887315 - protein, 21 aa, Staphylococcus
TSTGIPAWIFVIGLVAVTGYL

SEQ ID NO: 1887316 - protein, 18 aa, Staphylococcus
TSTIKWTGPSVIFAYLIV

SEQ ID NO: 1887317 - protein, 20 aa, Staphylococcus
TSTINWNIVLLFAGIFIANA

SEQ ID NO: 1887318 - protein, 25 aa, Staphylococcus
TSTISWRSGFLINVPFTIILIILTL

SEQ ID NO: 1887319 - protein, 19 aa, Staphylococcus
TSVILCFTISLINIMTMTL

SEQ ID NO: 1887320 - protein, 26 aa, Staphylococcus
TSVRFYYKDIIVCFVMVVFFNVTNYM

SEQ ID NO: 1887321 - protein, 19 aa, Staphylococcus
TSVSLPWMPIIDLDFAFRL

SEQ ID NO: 1887322 - protein, 17 aa, Staphylococcus
TSVSSFLLISYWYDNGN

SEQ ID NO: 1887323 - protein, 18 aa, Staphylococcus
TSWIILIILLIGYLTSEF

SEQ ID NO: 1887324 - protein, 24 aa, Staphylococcus
TSYEYLTIYLLVALMYWVVCFIIS

SEQ ID NO: 1887325 - protein, 19 aa, Staphylococcus
TSYGAGIIHFLGGIHEIYF

SEQ ID NO: 1887326 - protein, 21 aa, Staphylococcus
TSYIGGILFCWFGVKLGGQPT

SEQ ID NO: 1887327 - protein, 20 aa, Staphylococcus
TSYRLLQWRLRDTLILLLLI

SEQ ID NO: 1887328 - protein, 24 aa, Staphylococcus
TSYRRLEWQFKDTITLILIIPIAI

SEQ ID NO: 1887329 - protein, 24 aa, Staphylococcus
TSYVIEWITLFLLLVVIIIYIITT

SEQ ID NO: 1887330 - protein, 26 aa, Staphylococcus
TSYVLCGGCALIIMEMLTIDHLYNVF

SEQ ID NO: 1887331 - protein, 22 aa, Staphylococcus
TSYYPKMMLKVILYAYTQSVFS

SEQ ID NO: 1887332 - protein, 24 aa, Staphylococcus
TTAGTMEWAKLGILISLTVFPESP

SEQ ID NO: 1887333 - protein, 25 aa, Staphylococcus
TTAGTMEWAKLGILLSLILFPKGHI

SEQ ID NO: 1887334 - protein, 17 aa, Staphylococcus
TTALSVVITFHFVAFGF

SEQ ID NO: 1887335 - protein, 17 aa, Staphylococcus
TTAMPAIFIILAVGIIV

SEQ ID NO: 1887336 - protein, 18 aa, Staphylococcus
TTAMPAIFIILAVGIIVG

SEQ ID NO: 1887337 - protein, 17 aa, Staphylococcus
TTDSWRALQDKLTEARN

SEQ ID NO: 1887338 - protein, 26 aa, Staphylococcus
TTDVFPVKDYGSGMTPFYTALSIWVG

SEQ ID NO: 1887339 - protein, 30 aa, Staphylococcus
TTDVFPVKDYGSGMTPFYTALSIWVGGLLM

SEQ ID NO: 1887340 - protein, 25 aa, Staphylococcus
TTDVQRSFAVFTMAGILTFAATIFI

SEQ ID NO: 1887341 - protein, 18 aa, Staphylococcus
TTEEKSPEKTKEATTEER

SEQ ID NO: 1887342 - protein, 24 aa, Staphylococcus
TTELDIIPGHIKKASFDLGNEHIQ

SEQ ID NO: 1887343 - protein, 25 aa, Staphylococcus
TTFLGWKYIFIFSIIVALTALFLIK

SEQ ID NO: 1887344 - protein, 24 aa, Staphylococcus
TTGNFYAAAFFRFILVMIGVFSSF

SEQ ID NO: 1887345 - protein, 29 aa, Staphylococcus
TTGQQVSRFFVPDGLPGNDGRSITITNEY

SEQ ID NO: 1887346 - protein, 23 aa, Staphylococcus
TTGTAFLIWLGDQITQFGVGNGI

SEQ ID NO: 1887347 - protein, 23 aa, Staphylococcus
TTGTAFLLWLGEQITQYGVGNGI

SEQ ID NO: 1887348 - protein, 24 aa, Staphylococcus
TTIELPVAMIISWILWGPLPNFMK

SEQ ID NO: 1887349 - protein, 18 aa, Staphylococcus
TTIGGLLSAIGIAGMDRV

SEQ ID NO: 1887350 - protein, 17 aa, Staphylococcus
TTILIIAILVIFGILFL

SEQ ID NO: 1887351 - protein, 21 aa, Staphylococcus
TTINELFKYIEVQNEEQYYQH

SEQ ID NO: 1887352 - protein, 24 aa, Staphylococcus
TTIPASIIGLIVWFFAGLTSKGSV

SEQ ID NO: 1887353 - protein, 21 aa, Staphylococcus
TTKANHFIKVMDHLNKEMQKY

SEQ ID NO: 1887354 - protein, 21 aa, Staphylococcus
TTKNKDWRIVTKHRKDNNILL

SEQ ID NO: 1887355 - protein, 24 aa, Staphylococcus
TTKRGKFRINQVILGVGDYNNLGG

SEQ ID NO: 1887356 - protein, 32 aa, Staphylococcus
TTLEGFSEVFILPSIWAGLLILIGILIDSRKA

SEQ ID NO: 1887357 - protein, 18 aa, Staphylococcus
TTLFSVIFLGEWSTMVQV

SEQ ID NO: 1887358 - protein, 31 aa, Staphylococcus
TTLITFTTILLFCLIIIFFLKDTLRNSELDE

SEQ ID NO: 1887359 - protein, 19 aa, Staphylococcus
TTLKQSRKLVQEKSQQDTT

SEQ ID NO: 1887360 - protein, 27 aa, Staphylococcus
TTLKSFKSKVWISAGIIGIIQYTGLIT

SEQ ID NO: 1887361 - protein, 17 aa, Staphylococcus
TTLLFARIVQALGSGIM

SEQ ID NO: 1887362 - protein, 17 aa, Staphylococcus
TTLLITWLLPVGVAIIP

SEQ ID NO: 1887363 - protein, 19 aa, Staphylococcus
TTLPVAFLANWLKDIVGGA

SEQ ID NO: 1887364 - protein, 19 aa, Staphylococcus
TTLPVAFLANWLKGLLGDA

SEQ ID NO: 1887365 - protein, 19 aa, Staphylococcus
TTLTLLLVTGWRMRTLITI

SEQ ID NO: 1887366 - protein, 17 aa, Staphylococcus
TTLTVAFLANWLKELLG

SEQ ID NO: 1887367 - protein, 18 aa, Staphylococcus
TTMFGCLPMLIQIPILFG

SEQ ID NO: 1887368 - protein, 31 aa, Staphylococcus
TTMHILSVLLMRFSPKWLKYDKRIVIIILKA

SEQ ID NO: 1887369 - protein, 22 aa, Staphylococcus
TTMIICAFLTYITHHDYVYTMI

SEQ ID NO: 1887370 - protein, 28 aa, Staphylococcus
TTMLNFFHGWPWYAVWLVMLGFGGGMIV

SEQ ID NO: 1887371 - protein, 32 aa, Staphylococcus
TTMWQMSLEFSMWRLFGISIIAVLGMLLWIMM

SEQ ID NO: 1887372 - protein, 17 aa, Staphylococcus
TTNIILLAFGYFIIPFV

SEQ ID NO: 1887373 - protein, 20 aa, Staphylococcus
TTQFVIWLQNGVWAIIVYFI

SEQ ID NO: 1887374 - protein, 24 aa, Staphylococcus
TTREFKDGSLLKYTQMKWLTPDGH

SEQ ID NO: 1887375 - protein, 17 aa, Staphylococcus
TTSEIQLTLSFAMIGLA

SEQ ID NO: 1887376 - protein, 24 aa, Staphylococcus
TTSITFLIIFIFSLVIIYFLSITL

SEQ ID NO: 1887377 - protein, 23 aa, Staphylococcus
TTTDLRPAGIITLDDKRIDAVSD

SEQ ID NO: 1887378 - protein, 18 aa, Staphylococcus
TTTFAILILFALNFSNNE

SEQ ID NO: 1887379 - protein, 24 aa, Staphylococcus
TTTIPWRRLMLAVMVFAISQLLVI

SEQ ID NO: 1887380 - protein, 17 aa, Staphylococcus
TTTISFIVSFIIVTYLH

SEQ ID NO: 1887381 - protein, 35 aa, Staphylococcus
TTVIGVGFFIHWIWPDLPMPAAFAIAAILCPTDAV

SEQ ID NO: 1887382 - protein, 18 aa, Staphylococcus
TTVRMFDRAFARGIGTIL

SEQ ID NO: 1887383 - protein, 33 aa, Staphylococcus
TTVVGVGFFIHWVWPNLPMPAGFALAAILCPTD

SEQ ID NO: 1887384 - protein, 17 aa, Staphylococcus
TTVYFFIVLAVYNFYIK

SEQ ID NO: 1887385 - protein, 18 aa, Staphylococcus
TTWLNIWGTIFIANIIFN

SEQ ID NO: 1887386 - protein, 17 aa, Staphylococcus
TTYEYFTIYILVAIMYW

SEQ ID NO: 1887387 - protein, 18 aa, Staphylococcus
TTYILGFQPEKEHTLIKP

SEQ ID NO: 1887388 - protein, 24 aa, Staphylococcus
TVAELKKLDAGYHFTDINGTTPYR

SEQ ID NO: 1887389 - protein, 18 aa, Staphylococcus
TVALKQAKHDLVPDKTLL

SEQ ID NO: 1887390 - protein, 28 aa, Staphylococcus
TVATIRKETCSWKWTLIAVIYPVLTAYI

SEQ ID NO: 1887391 - protein, 34 aa, Staphylococcus
TVCDVFLLLFIMKFGFRKIEAIVGTLIFTVLAIF

SEQ ID NO: 1887392 - protein, 25 aa, Staphylococcus
TVDFAESWSFMGIKYGMFVQSIIDF

SEQ ID NO: 1887393 - protein, 20 aa, Staphylococcus
TVDLSRIIGIIIDNAIEASE

SEQ ID NO: 1887394 - protein, 24 aa, Staphylococcus
TVFAICIYLSIGALYGIPRAANVA

SEQ ID NO: 1887395 - protein, 22 aa, Staphylococcus
TVFCTLVLKKWFSATVITFVVL

SEQ ID NO: 1887396 - protein, 23 aa, Staphylococcus
TVGFLWGMCLAGFVPISALVPSL

SEQ ID NO: 1887397 - protein, 24 aa, Staphylococcus
TVGFNMPTFWLLFSGAITAIPLIS

SEQ ID NO: 1887398 - protein, 34 aa, Staphylococcus
TVGGIVPEILITKMIILILFGLGFFILGILVKPV

SEQ ID NO: 1887399 - protein, 32 aa, Staphylococcus
TVGGIVPEILITKVVVLTLFGLGFIIFGICMK

SEQ ID NO: 1887400 - protein, 24 aa, Staphylococcus
TVGIPRFVMVTAYQFGQYAMLFLA

SEQ ID NO: 1887401 - protein, 19 aa, Staphylococcus
TVGRYGLKTIVYFEIITTI

SEQ ID NO: 1887402 - protein, 17 aa, Staphylococcus
TVHRVRIDFIGAILSVI

SEQ ID NO: 1887403 - protein, 23 aa, Staphylococcus
TVIAGFIAALALIFIYVSLGYIG

SEQ ID NO: 1887404 - protein, 17 aa, Staphylococcus
TVIFRFFPTISEEYRNI

SEQ ID NO: 1887405 - protein, 28 aa, Staphylococcus
TVIGAYFFFRSSVSLILKIIKSFKSGNV

SEQ ID NO: 1887406 - protein, 34 aa, Staphylococcus
TVIGVGFFIHWIWPELPTGAAFAIAAILCPTDAV

SEQ ID NO: 1887407 - protein, 34 aa, Staphylococcus
TVIGVGFFIHWIWPNLPMPAAFAIAGILCPTDAV

SEQ ID NO: 1887408 - protein, 21 aa, Staphylococcus
TVIIFSALVSFFIANIHYHFN

SEQ ID NO: 1887409 - protein, 18 aa, Staphylococcus
TVIIPVLFVLNSLFGLTG

SEQ ID NO: 1887410 - protein, 33 aa, Staphylococcus
TVIISCLVCAFILPRIWPLKSIKDEYAKEVSEE

SEQ ID NO: 1887411 - protein, 22 aa, Staphylococcus
TVILFSAFISFVLTNIYYHFNL

SEQ ID NO: 1887412 - protein, 19 aa, Staphylococcus
TVILFSFLIGIWISHPMER

SEQ ID NO: 1887413 - protein, 17 aa, Staphylococcus
TVILFSFLIGIWLGHPI

SEQ ID NO: 1887414 - protein, 27 aa, Staphylococcus
TVILIITIIISFVFYYFTSDEKVDKDK

SEQ ID NO: 1887415 - protein, 17 aa, Staphylococcus
TVILLSFLIGLWLGHPI

SEQ ID NO: 1887416 - protein, 19 aa, Staphylococcus
TVIMVCIFLGSALTGLNRG

SEQ ID NO: 1887417 - protein, 20 aa, Staphylococcus
TVISNVFIVLGIIFLIMMQM

SEQ ID NO: 1887418 - protein, 20 aa, Staphylococcus
TVITGVVSLLAWWKNNNFTQ

SEQ ID NO: 1887419 - protein, 22 aa, Staphylococcus
TVITLFNFITLFLLLTISTLLF

SEQ ID NO: 1887420 - protein, 19 aa, Staphylococcus
TVITLKFYIIVLIGILYIL

SEQ ID NO: 1887421 - protein, 24 aa, Staphylococcus
TVIVFFCIFLIFSPIGKLKLGKPN

SEQ ID NO: 1887422 - protein, 26 aa, Staphylococcus
TVKAFGEFEFWFALIKVITILLMIVA

SEQ ID NO: 1887423 - protein, 24 aa, Staphylococcus
TVKLDSLLLRPAISSISIFAVVMI

SEQ ID NO: 1887424 - protein, 19 aa, Staphylococcus
TVKLILEIVRTIFVIEFIG

SEQ ID NO: 1887425 - protein, 19 aa, Staphylococcus
TVKLILEIVRTIFVIELVG

SEQ ID NO: 1887426 - protein, 19 aa, Staphylococcus
TVKRKVVVQLTKFEKILYI

SEQ ID NO: 1887427 - protein, 31 aa, Staphylococcus
TVLAAAVLFFFGESAVKGFATMLLLAILMSF

SEQ ID NO: 1887428 - protein, 19 aa, Staphylococcus
TVLNILFLVGLTFLVQSEN

SEQ ID NO: 1887429 - protein, 17 aa, Staphylococcus
TVLPMFVQNLLGRTPID

SEQ ID NO: 1887430 - protein, 18 aa, Staphylococcus
TVLPMFVQNLLNRTPLDS

SEQ ID NO: 1887431 - protein, 18 aa, Staphylococcus
TVLPMFVQNVLHRSALDS

SEQ ID NO: 1887432 - protein, 17 aa, Staphylococcus
TVLSYPVYLFIIGLIIM

SEQ ID NO: 1887433 - protein, 17 aa, Staphylococcus
TVLSYPVYLFIIGLIVL

SEQ ID NO: 1887434 - protein, 17 aa, Staphylococcus
TVLSYPVYLFIVGLIVM

SEQ ID NO: 1887435 - protein, 17 aa, Staphylococcus
TVLWTFLFFYIIVASID

SEQ ID NO: 1887436 - protein, 21 aa, Staphylococcus
TVMGIDNGWLYEGHQESTQRD

SEQ ID NO: 1887437 - protein, 17 aa, Staphylococcus
TVMIFSAVASFLCTNII

SEQ ID NO: 1887438 - protein, 17 aa, Staphylococcus
TVMKKMERFGVPRDIAS

SEQ ID NO: 1887439 - protein, 19 aa, Staphylococcus
TVMNIFKNRMAKLSKQKKG

SEQ ID NO: 1887440 - protein, 27 aa, Staphylococcus
TVNGKENLYRIAIQYYGEGTQQNVDKI

SEQ ID NO: 1887441 - protein, 27 aa, Staphylococcus
TVNGKENLYRIAIQYYGSGSPANVEKI

SEQ ID NO: 1887442 - protein, 17 aa, Staphylococcus
TVPESFAGYAGIGHTIL

SEQ ID NO: 1887443 - protein, 17 aa, Staphylococcus
TVPKAKDGKSITVQSTA

SEQ ID NO: 1887444 - protein, 17 aa, Staphylococcus
TVRDLPSGVTFDPSTNT

SEQ ID NO: 1887445 - protein, 21 aa, Staphylococcus
TVRGLPEGVAFDPRTSTISGV

SEQ ID NO: 1887446 - protein, 23 aa, Staphylococcus
TVSAGLIAFIVWVLITHNIDFAL

SEQ ID NO: 1887447 - protein, 17 aa, Staphylococcus
TVSIGGPVLKVSPDNFN

SEQ ID NO: 1887448 - protein, 32 aa, Staphylococcus
TVTKKVVVQLTRFEKFLYITLVTAIAVLAIYM

SEQ ID NO: 1887449 - protein, 26 aa, Staphylococcus
TVTKKVVVQLTRFEKYLYITLVTAIA

SEQ ID NO: 1887450 - protein, 18 aa, Staphylococcus
TVTPELIHFIMVFFIGIL

SEQ ID NO: 1887451 - protein, 27 aa, Staphylococcus
TVVDPYLRGGSIPGTNSNVIIDEQNTS

SEQ ID NO: 1887452 - protein, 24 aa, Staphylococcus
TVVGRDMWSDIAVLKATIKNKNMQ

SEQ ID NO: 1887453 - protein, 27 aa, Staphylococcus
TVVPALASTFFKKGIKLKRNSQRQNDR

SEQ ID NO: 1887454 - protein, 27 aa, Staphylococcus
TVVPALASTFFKNGIKINGNVNEENKL

SEQ ID NO: 1887455 - protein, 27 aa, Staphylococcus
TVVPALASTFFKRGLKQQRQVKQNNES

SEQ ID NO: 1887456 - protein, 26 aa, Staphylococcus
TVVPALGSTLFRKGIQTKPEKQAQGV

SEQ ID NO: 1887457 - protein, 27 aa, Staphylococcus
TVVPALGSTLFRKGVKTKRQREGLGVI

SEQ ID NO: 1887458 - protein, 17 aa, Staphylococcus
TVWTILRLISGITSGTV

SEQ ID NO: 1887459 - protein, 21 aa, Staphylococcus
TVYIYLTLVAFNFISGVLTLP

SEQ ID NO: 1887460 - protein, 21 aa, Staphylococcus
TVYKFAIGVIVAGLSYLVMII

SEQ ID NO: 1887461 - protein, 19 aa, Staphylococcus
TWDYGNAKVYGPYPKNKDI

SEQ ID NO: 1887462 - protein, 21 aa, Staphylococcus
TWFSLCTLVFNYIKIIFEKPK

SEQ ID NO: 1887463 - protein, 18 aa, Staphylococcus
TWIIRIISIVVVFIPLLA

SEQ ID NO: 1887464 - protein, 21 aa, Staphylococcus
TWLNILIKGIFCNFFINIGIY

SEQ ID NO: 1887465 - protein, 20 aa, Staphylococcus
TWLSILIKGIFCNFFINIGI

SEQ ID NO: 1887466 - protein, 30 aa, Staphylococcus
TWNVLKSPWLRPTLIIGCIFALLQQIIGIN

SEQ ID NO: 1887467 - protein, 26 aa, Staphylococcus
TWNVLKSPWLRPTLIIGSVFALFQQI

SEQ ID NO: 1887468 - protein, 20 aa, Staphylococcus
TYETLAIKIIMILIYIVAAI

SEQ ID NO: 1887469 - protein, 20 aa, Staphylococcus
TYEVPILYVTVWLDDQGNII

SEQ ID NO: 1887470 - protein, 18 aa, Staphylococcus
TYFFFRSTISLILKTIRY

SEQ ID NO: 1887471 - protein, 22 aa, Staphylococcus
TYFWSAWSFFIALMIIIVMMSH

SEQ ID NO: 1887472 - protein, 17 aa, Staphylococcus
TYGDFWGFLSGWAQAFI

SEQ ID NO: 1887473 - protein, 25 aa, Staphylococcus
TYGFLRLEIIVAFLNGLALIVISLG

SEQ ID NO: 1887474 - protein, 24 aa, Staphylococcus
TYGFMRLEIIVAFLNGLALIVISL

SEQ ID NO: 1887475 - protein, 25 aa, Staphylococcus
TYGISRWVILYGRRKFAAMILTGMV

SEQ ID NO: 1887476 - protein, 19 aa, Staphylococcus
TYHYHVPPVFAFFATFGIG

SEQ ID NO: 1887477 - protein, 19 aa, Staphylococcus
TYIVSRYLYLVALIVPSKI

SEQ ID NO: 1887478 - protein, 21 aa, Staphylococcus
TYKYRRFVSPVTMRVTSSDLL

SEQ ID NO: 1887479 - protein, 21 aa, Staphylococcus
TYKYRRFVTPVTMRVKAADKL

SEQ ID NO: 1887480 - protein, 19 aa, Staphylococcus
TYLNVVPFGRDYNGSNITG

SEQ ID NO: 1887481 - protein, 19 aa, Staphylococcus
TYMIWNFTPDLTHLDSTDS

SEQ ID NO: 1887482 - protein, 23 aa, Staphylococcus
TYMPSDGWFLLNFISTIGALLMA

SEQ ID NO: 1887483 - protein, 24 aa, Staphylococcus
TYMPSDGWFLLNFISTIGALLMTV

SEQ ID NO: 1887484 - protein, 24 aa, Staphylococcus
TYMPSDGWWLLNFISTIGALMMAV

SEQ ID NO: 1887485 - protein, 22 aa, Staphylococcus
TYRYLGNRANLMALWGVEDRLR

SEQ ID NO: 1887486 - protein, 26 aa, Staphylococcus
TYSRKANEIILAMRLEKILSKNEIIY

SEQ ID NO: 1887487 - protein, 24 aa, Staphylococcus
TYSRKANELILAMRLENLLSKNEI

SEQ ID NO: 1887488 - protein, 18 aa, Staphylococcus
TYTIKELLQITVSNSSNA

SEQ ID NO: 1887489 - protein, 26 aa, Staphylococcus
TYTISMNWSLEIARALIGGIGIVLTI

SEQ ID NO: 1887490 - protein, 26 aa, Staphylococcus
TYTISMNWSLEISRAITGGIGIVLTI

SEQ ID NO: 1887491 - protein, 30 aa, Staphylococcus
TYTLKRIKSLWKWFTLSFIVGLVFILIAEL

SEQ ID NO: 1887492 - protein, 45 aa, Staphylococcus
TYVSWKLNPAGSISIMFNFSLFFLLGVLIHLIGRWITGDTQYRPP

SEQ ID NO: 1887493 - protein, 17 aa, Staphylococcus
TYYLKGLITAATKSKAE

SEQ ID NO: 1887494 - protein, 18 aa, Staphylococcus
TYYLKGLITATKSSKAEA

SEQ ID NO: 1887495 - protein, 19 aa, Staphylococcus
TYYLSFWYFITFGSFVAFG

SEQ ID NO: 1887496 - protein, 19 aa, Staphylococcus
VAACVTFFFGSLRVNSVGV

SEQ ID NO: 1887497 - protein, 17 aa, Staphylococcus
VAAISLFPLRTLLKEAD

SEQ ID NO: 1887498 - protein, 23 aa, Staphylococcus
VAALCLLLLFLGFLINGDVNLIS

SEQ ID NO: 1887499 - protein, 19 aa, Staphylococcus
VAALEGEHKLQVAKENANN

SEQ ID NO: 1887500 - protein, 18 aa, Staphylococcus
VAATFRFILVMIGVLSAS

SEQ ID NO: 1887501 - protein, 19 aa, Staphylococcus
VAAVLRIALGSATVAAVST

SEQ ID NO: 1887502 - protein, 18 aa, Staphylococcus
VAAVLRIALGSSTVAAIS

SEQ ID NO: 1887503 - protein, 18 aa, Staphylococcus
VAAYRRAKVLKRPFRLHQ

SEQ ID NO: 1887504 - protein, 21 aa, Staphylococcus
VADASKLGFKLGHDPDKEHSV

SEQ ID NO: 1887505 - protein, 35 aa, Staphylococcus
VADSVKSGDYFTVQFPKYLNYFGNSTPQSTKIPDL

SEQ ID NO: 1887506 - protein, 22 aa, Staphylococcus
VAEGFLKFFSGTARSFHPQANT

SEQ ID NO: 1887507 - protein, 26 aa, Staphylococcus
VAEIYGGTFFYRFRKIIAPLFASGYS

SEQ ID NO: 1887508 - protein, 26 aa, Staphylococcus
VAELPMFSGWGLRTIIYLFILAAAIS

SEQ ID NO: 1887509 - protein, 26 aa, Staphylococcus
VAELPMFSGWGLRTIIYLFILTAAIS

SEQ ID NO: 1887510 - protein, 26 aa, Staphylococcus
VAELPMFSGWGLRTIIYLLILATAIT

SEQ ID NO: 1887511 - protein, 24 aa, Staphylococcus
VAERKPSIWPFIIVGLVVIGIIVS

SEQ ID NO: 1887512 - protein, 17 aa, Staphylococcus
VAFIVPNIYKFCIGRNI

SEQ ID NO: 1887513 - protein, 17 aa, Staphylococcus
VAFPVLNNVSFWLFFSG

SEQ ID NO: 1887514 - protein, 22 aa, Staphylococcus
VAFVVNCLLLVLGASLFYGVNQ

SEQ ID NO: 1887515 - protein, 24 aa, Staphylococcus
VAGFLAGYIAKWIKNVKVPKAMAP

SEQ ID NO: 1887516 - protein, 24 aa, Staphylococcus
VAGFLAGYIAKWIKQIKVPKAMAP

SEQ ID NO: 1887517 - protein, 19 aa, Staphylococcus
VAGLFIAFGTIITFRKHFK

SEQ ID NO: 1887518 - protein, 19 aa, Staphylococcus
VAGLLSYYIVKALDQTGVT

SEQ ID NO: 1887519 - protein, 22 aa, Staphylococcus
VAGWNLALYIIFRLISGIIVAG

SEQ ID NO: 1887520 - protein, 19 aa, Staphylococcus
VAGYLFYFAVSVGVISFIV

SEQ ID NO: 1887521 - protein, 19 aa, Staphylococcus
VAHGGPIVAILGGIDEIVW

SEQ ID NO: 1887522 - protein, 27 aa, Staphylococcus
VAIAFGLLATFIMAGISYIFSTQLTKP

SEQ ID NO: 1887523 - protein, 17 aa, Staphylococcus
VAICIAILMFSMFSQIP

SEQ ID NO: 1887524 - protein, 18 aa, Staphylococcus
VAIFISPVWFILLGFMYW

SEQ ID NO: 1887525 - protein, 19 aa, Staphylococcus
VAIHLWQTRIQRALGHEVN

SEQ ID NO: 1887526 - protein, 20 aa, Staphylococcus
VAIICLILFLVTLKSKNNIK

SEQ ID NO: 1887527 - protein, 26 aa, Staphylococcus
VAIIPVVGMVTHWILFFLMILFLIVV

SEQ ID NO: 1887528 - protein, 25 aa, Staphylococcus
VAIIVAMCYVHLSTAIIMMVTAPFI

SEQ ID NO: 1887529 - protein, 18 aa, Staphylococcus
VAIKLIWRNYRRLKVNNN

SEQ ID NO: 1887530 - protein, 19 aa, Staphylococcus
VAILPAAGILLAFGNAMHN

SEQ ID NO: 1887531 - protein, 20 aa, Staphylococcus
VAILPAAGILLAFGNAMHNE

SEQ ID NO: 1887532 - protein, 19 aa, Staphylococcus
VAILPAAGILLTFGNAMHN

SEQ ID NO: 1887533 - protein, 18 aa, Staphylococcus
VAIPPLIVATGVLAHSIV

SEQ ID NO: 1887534 - protein, 25 aa, Staphylococcus
VAIQALVAIMFLMIKPFIGNADFKE

SEQ ID NO: 1887535 - protein, 21 aa, Staphylococcus
VAISFKLSEIIQHVIPQSNVL

SEQ ID NO: 1887536 - protein, 20 aa, Staphylococcus
VAIVGALLSFIKVVKVDPIE

SEQ ID NO: 1887537 - protein, 23 aa, Staphylococcus
VAKICGVSIFALMKILKNELILA

SEQ ID NO: 1887538 - protein, 27 aa, Staphylococcus
VAKISSFHIFRIFFILFLVAPIINYFL

SEQ ID NO: 1887539 - protein, 18 aa, Staphylococcus
VAKKDGISGLLYSGVGLG

SEQ ID NO: 1887540 - protein, 23 aa, Staphylococcus
VAKTDAISLLSVINPEVQVKPFA

SEQ ID NO: 1887541 - protein, 20 aa, Staphylococcus
VALACLTTACGLIVAVSEYF

SEQ ID NO: 1887542 - protein, 18 aa, Staphylococcus
VALACLTTACGLIVAVSQ

SEQ ID NO: 1887543 - protein, 18 aa, Staphylococcus
VALACLTTACGLIVSVSQ

SEQ ID NO: 1887544 - protein, 20 aa, Staphylococcus
VALACLTTACGLIVSVSQYF

SEQ ID NO: 1887545 - protein, 20 aa, Staphylococcus
VALACLTTACGLVVAVSEYF

SEQ ID NO: 1887546 - protein, 20 aa, Staphylococcus
VALACLTTACGLVVAVSQYF

SEQ ID NO: 1887547 - protein, 17 aa, Staphylococcus
VALEAALSLVVFNKINF

SEQ ID NO: 1887548 - protein, 17 aa, Staphylococcus
VALEAGLGLILFHNIDF

SEQ ID NO: 1887549 - protein, 18 aa, Staphylococcus
VALILLVFAMTSQKIEPV

SEQ ID NO: 1887550 - protein, 21 aa, Staphylococcus
VALLEMKEEFGVIKAQAPIAI

SEQ ID NO: 1887551 - protein, 22 aa, Staphylococcus
VALLEMKHEFGVIKAQAPIAIA

SEQ ID NO: 1887552 - protein, 20 aa, Staphylococcus
VALLEMKQEFGVIKAQAPIA

SEQ ID NO: 1887553 - protein, 18 aa, Staphylococcus
VALLIFICIWTFILSMFM

SEQ ID NO: 1887554 - protein, 22 aa, Staphylococcus
VALLIKRYYLMGLWLLATVGLG

SEQ ID NO: 1887555 - protein, 19 aa, Staphylococcus
VALLKLNGLDTFDQVTDLK

SEQ ID NO: 1887556 - protein, 18 aa, Staphylococcus
VALLKLNGLDTFHQVADM

SEQ ID NO: 1887557 - protein, 24 aa, Staphylococcus
VALLQMIVMPLIFISIVSAFSKIE

SEQ ID NO: 1887558 - protein, 24 aa, Staphylococcus
VALLQMIVMPLIFISIVSAFSKIQ

SEQ ID NO: 1887559 - protein, 18 aa, Staphylococcus
VALLQMIVMPLIFVSIVA

SEQ ID NO: 1887560 - protein, 20 aa, Staphylococcus
VALLVFKLPLNIAGGATFEG

SEQ ID NO: 1887561 - protein, 28 aa, Staphylococcus
VALNEIFIRIFWSIKEIFYHKRSVKDIL

SEQ ID NO: 1887562 - protein, 18 aa, Staphylococcus
VALSAIWNAIKSAASGAW

SEQ ID NO: 1887563 - protein, 17 aa, Staphylococcus
VALSYALLGGFAALISY

SEQ ID NO: 1887564 - protein, 17 aa, Staphylococcus
VALVGVIVGCFVFPPFG

SEQ ID NO: 1887565 - protein, 20 aa, Staphylococcus
VALVRLRVTLSRRGVESNNM

SEQ ID NO: 1887566 - protein, 17 aa, Staphylococcus
VAMCIPLGIILYYTYLK

SEQ ID NO: 1887567 - protein, 17 aa, Staphylococcus
VAMFIPLFFIFKYKQPM

SEQ ID NO: 1887568 - protein, 21 aa, Staphylococcus
VAMIIKGFVDFGGNPSSPGSE

SEQ ID NO: 1887569 - protein, 17 aa, Staphylococcus
VAMWPGFSRSGSTISTG

SEQ ID NO: 1887570 - protein, 25 aa, Staphylococcus
VANAILIVIGYKFLSKKSTILTIIA

SEQ ID NO: 1887571 - protein, 23 aa, Staphylococcus
VAQAGSPIAYAYNLDDLYITANI

SEQ ID NO: 1887572 - protein, 24 aa, Staphylococcus
VAQIKLKEVQLIEHIQPVIEVKPS

SEQ ID NO: 1887573 - protein, 17 aa, Staphylococcus
VAQKFFEMMGTTGVRIF

SEQ ID NO: 1887574 - protein, 17 aa, Staphylococcus
VASDCWIAILAGGAAFL

SEQ ID NO: 1887575 - protein, 25 aa, Staphylococcus
VASFKLTGKRIFKMSPLHHHFELSG

SEQ ID NO: 1887576 - protein, 18 aa, Staphylococcus
VASGIYPTIHIIQLLLYV

SEQ ID NO: 1887577 - protein, 18 aa, Staphylococcus
VASIPTLIVVILFVLIFE

SEQ ID NO: 1887578 - protein, 20 aa, Staphylococcus
VASLDMFLNIILKESNRIES

SEQ ID NO: 1887579 - protein, 17 aa, Staphylococcus
VASLNLFGLNGYNVKTQ

SEQ ID NO: 1887580 - protein, 19 aa, Staphylococcus
VASNIFKYRTRIMDKANSD

SEQ ID NO: 1887581 - protein, 28 aa, Staphylococcus
VASNVLFYWDVFKIFSPLVWSLIFITII

SEQ ID NO: 1887582 - protein, 21 aa, Staphylococcus
VATAILLPLGFAIGYVVGVNP

SEQ ID NO: 1887583 - protein, 17 aa, Staphylococcus
VATALWTILALWVATSL

SEQ ID NO: 1887584 - protein, 23 aa, Staphylococcus
VATEPMPHLFLISDEFAELKSEQ

SEQ ID NO: 1887585 - protein, 18 aa, Staphylococcus
VATFVALAIMGFVGLILG

SEQ ID NO: 1887586 - protein, 28 aa, Staphylococcus
VATIRKETCSWKWTLIALFYPIVTAYLL

SEQ ID NO: 1887587 - protein, 18 aa, Staphylococcus
VATMIRVQFAWKPKIGDL

SEQ ID NO: 1887588 - protein, 37 aa, Staphylococcus
VATVVRLSKKLKCKGFQDLKLKIAYDLNEPGNIQRGY

SEQ ID NO: 1887589 - protein, 18 aa, Staphylococcus
VAVDEKGNKLVVLTIKND

SEQ ID NO: 1887590 - protein, 18 aa, Staphylococcus
VAVMCFLNTFDIVKLSES

SEQ ID NO: 1887591 - protein, 19 aa, Staphylococcus
VAVMGAVFQPIWFSLLDQN

SEQ ID NO: 1887592 - protein, 25 aa, Staphylococcus
VAVPLAAGALAFIGLILSPAVGAIL

SEQ ID NO: 1887593 - protein, 22 aa, Staphylococcus
VAVSEYFHRIIPKISYKTFVII

SEQ ID NO: 1887594 - protein, 19 aa, Staphylococcus
VAVSMRITKGFKQLIILSV

SEQ ID NO: 1887595 - protein, 19 aa, Staphylococcus
VAVVPRFFASFAAFVIGSF

SEQ ID NO: 1887596 - protein, 17 aa, Staphylococcus
VAWISHGQLRMEGSINQ

SEQ ID NO: 1887597 - protein, 19 aa, Staphylococcus
VAWMICGILIFKNKAAVKE

SEQ ID NO: 1887598 - protein, 23 aa, Staphylococcus
VAYKYMRQWFIFWGPPMIIISLF

SEQ ID NO: 1887599 - protein, 24 aa, Staphylococcus
VAYMIRIGIQISKLLSDLKGRVAV

SEQ ID NO: 1887600 - protein, 23 aa, Staphylococcus
VCAHKRWLFISSTLIKQTVRSSL

SEQ ID NO: 1887601 - protein, 17 aa, Staphylococcus
VCCYFVINYIKGKLHYN

SEQ ID NO: 1887602 - protein, 18 aa, Staphylococcus
VCDQIFKFSDDKLILSME

SEQ ID NO: 1887603 - protein, 33 aa, Staphylococcus
VCDVFLLLFIMKFGFRKIEAIVGTLIFTVLAIF

SEQ ID NO: 1887604 - protein, 26 aa, Staphylococcus
VCFPQGHILLKLAFAVLCSLFGTFLF

SEQ ID NO: 1887605 - protein, 20 aa, Staphylococcus
VCIGLVFGLIAGIERKWLDQ

SEQ ID NO: 1887606 - protein, 18 aa, Staphylococcus
VCILLVTGILCYTLDHLY

SEQ ID NO: 1887607 - protein, 22 aa, Staphylococcus
VCKFEPDCILLLGHGENSIYLI

SEQ ID NO: 1887608 - protein, 25 aa, Staphylococcus
VCLFILPIPIHFKFDSEVFMFAVIA

SEQ ID NO: 1887609 - protein, 27 aa, Staphylococcus
VCLIAALVIEHVWLHWLSNTPFKITCI

SEQ ID NO: 1887610 - protein, 23 aa, Staphylococcus
VCLPLLLCLFIMIPRIKLLQVGD

SEQ ID NO: 1887611 - protein, 23 aa, Staphylococcus
VCLSLPFQMFGLFASMFFIIVGS

SEQ ID NO: 1887612 - protein, 28 aa, Staphylococcus
VCRIVSAIIQIFALLLWFIFDVVTFSTG

SEQ ID NO: 1887613 - protein, 21 aa, Staphylococcus
VCSLALLIVSFFFRNRKTNHP

SEQ ID NO: 1887614 - protein, 17 aa, Staphylococcus
VDAARELGQKADDRSDE

SEQ ID NO: 1887615 - protein, 24 aa, Staphylococcus
VDAGIRAGIFIAIATFLRPLGGII

SEQ ID NO: 1887616 - protein, 23 aa, Staphylococcus
VDALQVRFILDWNSQAHRTQFEY

SEQ ID NO: 1887617 - protein, 21 aa, Staphylococcus
VDCKKELNRYYVGNIKSTELP

SEQ ID NO: 1887618 - protein, 23 aa, Staphylococcus
VDELIKWLANQVVTFILFTLIPL

SEQ ID NO: 1887619 - protein, 19 aa, Staphylococcus
VDFRLPRMLITILAGAALS

SEQ ID NO: 1887620 - protein, 17 aa, Staphylococcus
VDFTADVVFGRVVTDLV

SEQ ID NO: 1887621 - protein, 17 aa, Staphylococcus
VDFVALVVVVDFLDVDD

SEQ ID NO: 1887622 - protein, 21 aa, Staphylococcus
VDGDTAMAFIRSRKEEGAGGD

SEQ ID NO: 1887623 - protein, 20 aa, Staphylococcus
VDGPGGLIIMNNFNDKPHAS

SEQ ID NO: 1887624 - protein, 22 aa, Staphylococcus
VDIFKSLGFEIEEKRNDPNFGS

SEQ ID NO: 1887625 - protein, 22 aa, Staphylococcus
VDIFMCGIATFLQANKVTGTGL

SEQ ID NO: 1887626 - protein, 23 aa, Staphylococcus
VDIFMCGIATFLQVNKVTGTGLP

SEQ ID NO: 1887627 - protein, 23 aa, Staphylococcus
VDIFMCGVATFLQVWKGTGTGLP

SEQ ID NO: 1887628 - protein, 18 aa, Staphylococcus
VDIMKMLIIQTFCVLLGM

SEQ ID NO: 1887629 - protein, 17 aa, Staphylococcus
VDIPLSIFYVIFIVFWQ

SEQ ID NO: 1887630 - protein, 18 aa, Staphylococcus
VDKAAKARENVINSNTEA

SEQ ID NO: 1887631 - protein, 25 aa, Staphylococcus
VDKAMKHLIDEIADNLDIKHSVNYS

SEQ ID NO: 1887632 - protein, 17 aa, Staphylococcus
VDKFFKVFYRDHTMLFS

SEQ ID NO: 1887633 - protein, 23 aa, Staphylococcus
VDKFSFENMNGMFVAGFISIFIV

SEQ ID NO: 1887634 - protein, 17 aa, Staphylococcus
VDKFSVSSINWGMIGIF

SEQ ID NO: 1887635 - protein, 24 aa, Staphylococcus
VDLFLHRLTIILAIIFFVLMFCIS

SEQ ID NO: 1887636 - protein, 20 aa, Staphylococcus
VDLFLHRLTIILAVIFFLIM

SEQ ID NO: 1887637 - protein, 19 aa, Staphylococcus
VDLFLHRLTIILSVIFFLL

SEQ ID NO: 1887638 - protein, 24 aa, Staphylococcus
VDLFLHRLTIVLAIIFFLIMIGIS

SEQ ID NO: 1887639 - protein, 23 aa, Staphylococcus
VDLGDIGTLGYIIRSKPNTLPDF

SEQ ID NO: 1887640 - protein, 24 aa, Staphylococcus
VDLIRWLPEIELPLMDGLYLHMLL

SEQ ID NO: 1887641 - protein, 20 aa, Staphylococcus
VDLSVKMSNMIQVYQSASGE

SEQ ID NO: 1887642 - protein, 17 aa, Staphylococcus
VDNKIYPTIKDGEQVVA

SEQ ID NO: 1887643 - protein, 19 aa, Staphylococcus
VDPFLKYIGEFTIQNIENG

SEQ ID NO: 1887644 - protein, 25 aa, Staphylococcus
VDPRKSASILDIFGGCFQGLLPYSP

SEQ ID NO: 1887645 - protein, 29 aa, Staphylococcus
VDPRKSASILDMFASCFQGLLPYSPQLIA

SEQ ID NO: 1887646 - protein, 29 aa, Staphylococcus
VDPRKSASLLDIFAGCFQGFLPYSPQVIA

SEQ ID NO: 1887647 - protein, 24 aa, Staphylococcus
VDRIERRQLLKIVTYIQVLGVVIV

SEQ ID NO: 1887648 - protein, 23 aa, Staphylococcus
VDSELERSLKLFGSDIDRNSPFF

SEQ ID NO: 1887649 - protein, 23 aa, Staphylococcus
VDSELERSLKLYGSDIDRNSPFF

SEQ ID NO: 1887650 - protein, 18 aa, Staphylococcus
VDSPGYFTTIFAVLFLGS

SEQ ID NO: 1887651 - protein, 21 aa, Staphylococcus
VDSQSKYAYVILQEVSAIAKV

SEQ ID NO: 1887652 - protein, 24 aa, Staphylococcus
VDSWKMVWFVLGIVSLVLGLIVLV

SEQ ID NO: 1887653 - protein, 21 aa, Staphylococcus
VDTAIDFTNQILKGVAQAHEK

SEQ ID NO: 1887654 - protein, 24 aa, Staphylococcus
VDTKRFKLFYAVTVIVGLCLSFVG

SEQ ID NO: 1887655 - protein, 17 aa, Staphylococcus
VDTKYEFKSGGKRKKVI

SEQ ID NO: 1887656 - protein, 23 aa, Staphylococcus
VDTSLLRYYFWVTILIVIILVGL

SEQ ID NO: 1887657 - protein, 18 aa, Staphylococcus
VDTTHIWLWAQLAVFLHV

SEQ ID NO: 1887658 - protein, 20 aa, Staphylococcus
VDTVLRWESIILDPLGPILA

SEQ ID NO: 1887659 - protein, 20 aa, Staphylococcus
VDVAASFGFGSPNAVLFGFV

SEQ ID NO: 1887660 - protein, 17 aa, Staphylococcus
VDVFPVRDYGSGMTPFY

SEQ ID NO: 1887661 - protein, 17 aa, Staphylococcus
VDVFQGRMDRIAKSIRT

SEQ ID NO: 1887662 - protein, 21 aa, Staphylococcus
VDVKGAVKLPDVYEMKKNDRV

SEQ ID NO: 1887663 - protein, 30 aa, Staphylococcus
VDWFFNYLGNMPWWNVILLYTIRILSGTIL

SEQ ID NO: 1887664 - protein, 24 aa, Staphylococcus
VDWLIDRIPIAVVIGFMNALALLL

SEQ ID NO: 1887665 - protein, 18 aa, Staphylococcus
VDYKYVWLGIILIGVASG

SEQ ID NO: 1887666 - protein, 23 aa, Staphylococcus
VDYSMILPMANWMFLFFGLLVVI

SEQ ID NO: 1887667 - protein, 20 aa, Staphylococcus
VEAIKNDIINKILNIEPTNS

SEQ ID NO: 1887668 - protein, 21 aa, Staphylococcus
VEAIYFYPRFKVTMTGFLVAL

SEQ ID NO: 1887669 - protein, 17 aa, Staphylococcus
VEALPIIGVVIAFMTLF

SEQ ID NO: 1887670 - protein, 17 aa, Staphylococcus
VEAQTGYNYLTGNGSNP

SEQ ID NO: 1887671 - protein, 24 aa, Staphylococcus
VEAYRSAVLHKEWYFITHWELTLY

SEQ ID NO: 1887672 - protein, 20 aa, Staphylococcus
VEDDAGITLPTFRKEGDQQA

SEQ ID NO: 1887673 - protein, 18 aa, Staphylococcus
VEDDGKVIGMPKVKGLKD

SEQ ID NO: 1887674 - protein, 17 aa, Staphylococcus
VEDGRNPIVLKLISVLF

SEQ ID NO: 1887675 - protein, 23 aa, Staphylococcus
VEDNLRYRQIIFSHKDDLDTLPA

SEQ ID NO: 1887676 - protein, 22 aa, Staphylococcus
VEDNLRYRQIIFSHRDDLKTLT

SEQ ID NO: 1887677 - protein, 29 aa, Staphylococcus
VEDQRGIFSGWNYGIGIQVDPNHPEGANR

SEQ ID NO: 1887678 - protein, 17 aa, Staphylococcus
VEDSRNFVVAKLYSVLF

SEQ ID NO: 1887679 - protein, 23 aa, Staphylococcus
VEEMKETLDYVGDVKSIPTLLMH

SEQ ID NO: 1887680 - protein, 18 aa, Staphylococcus
VEEPGGMVRFIRQLVIYS

SEQ ID NO: 1887681 - protein, 17 aa, Staphylococcus
VEFDLLNFILLRIIPTL

SEQ ID NO: 1887682 - protein, 21 aa, Staphylococcus
VEFPLYMAIIVMLFGIVIIFV

SEQ ID NO: 1887683 - protein, 23 aa, Staphylococcus
VEFWIPDLPNWVTSLSCILILMA

SEQ ID NO: 1887684 - protein, 19 aa, Staphylococcus
VEGAIKIPGMLSFLADNNV

SEQ ID NO: 1887685 - protein, 21 aa, Staphylococcus
VEGITSRKTVMRAYYKHEGNS

SEQ ID NO: 1887686 - protein, 23 aa, Staphylococcus
VEIFKVGFPAFLMSILMGVTGLV

SEQ ID NO: 1887687 - protein, 19 aa, Staphylococcus
VEIKGHRLGLGTDLFSKEP

SEQ ID NO: 1887688 - protein, 21 aa, Staphylococcus
VEILAILLLCGMYYGENKNIL

SEQ ID NO: 1887689 - protein, 17 aa, Staphylococcus
VEKAGCLDVLLKTVSKG

SEQ ID NO: 1887690 - protein, 22 aa, Staphylococcus
VEKIREANNIQGNDIHNGQRLV

SEQ ID NO: 1887691 - protein, 25 aa, Staphylococcus
VELGSWKAPYSIVFVLDVFSALLII

SEQ ID NO: 1887692 - protein, 25 aa, Staphylococcus
VELGSWPAPYGIIFLLDSFSAMLIV

SEQ ID NO: 1887693 - protein, 25 aa, Staphylococcus
VELGSWPAPYGIIFLLDTLGAMLIV

SEQ ID NO: 1887694 - protein, 17 aa, Staphylococcus
VELMQDFDVNKAFKASL

SEQ ID NO: 1887695 - protein, 29 aa, Staphylococcus
VENIKMFIKRSTIRFCLLIVATAVLISGL

SEQ ID NO: 1887696 - protein, 18 aa, Staphylococcus
VENVNKLKQANGLSSNNI

SEQ ID NO: 1887697 - protein, 27 aa, Staphylococcus
VENVNKLKRANGLTSNNIVNGQKLVIP

SEQ ID NO: 1887698 - protein, 18 aa, Staphylococcus
VENYYKFLAEPYHLEHSA

SEQ ID NO: 1887699 - protein, 24 aa, Staphylococcus
VEPDNIKFLILISLLIALAIYVVR

SEQ ID NO: 1887700 - protein, 18 aa, Staphylococcus
VEPMISRLELEEANNKLI

SEQ ID NO: 1887701 - protein, 24 aa, Staphylococcus
VEPMKEYQNRIQSLVEVKNRTMHL

SEQ ID NO: 1887702 - protein, 23 aa, Staphylococcus
VEPNGNRKLVFSDNTTVVIPKGD

SEQ ID NO: 1887703 - protein, 23 aa, Staphylococcus
VEQLRAAIIYVVLNIIGSWFLLF

SEQ ID NO: 1887704 - protein, 23 aa, Staphylococcus
VEQLRAAIIYVVLNIIGSWLFLL

SEQ ID NO: 1887705 - protein, 23 aa, Staphylococcus
VEQLRAAIIYVVLNILGSWLLLL

SEQ ID NO: 1887706 - protein, 24 aa, Staphylococcus
VEQLRAAIIYVVLNIVGSWLFLLG

SEQ ID NO: 1887707 - protein, 23 aa, Staphylococcus
VEQLRASVIYVVMNVVSSWFFLI

SEQ ID NO: 1887708 - protein, 18 aa, Staphylococcus
VEQVFLIFAVIGICALIF

SEQ ID NO: 1887709 - protein, 17 aa, Staphylococcus
VEREAGESKWTFTKLLN

SEQ ID NO: 1887710 - protein, 25 aa, Staphylococcus
VERLPAMVLPSWAYNMIAPVAIEDV

SEQ ID NO: 1887711 - protein, 23 aa, Staphylococcus
VESPLLFVLVALFGAIVFNTIVY

SEQ ID NO: 1887712 - protein, 23 aa, Staphylococcus
VESVDFASAFVLLIKTIFMLDYL

SEQ ID NO: 1887713 - protein, 23 aa, Staphylococcus
VETPFRKQGFKAFAINKRFKPQF

SEQ ID NO: 1887714 - protein, 18 aa, Staphylococcus
VEVLGIFVGGLIIFTNSN

SEQ ID NO: 1887715 - protein, 17 aa, Staphylococcus
VEVLIQKIIYTFVLVDI

SEQ ID NO: 1887716 - protein, 17 aa, Staphylococcus
VEVRAMILKRRIRTKVK

SEQ ID NO: 1887717 - protein, 24 aa, Staphylococcus
VEVTLEKEIEPVVFCNTRDNKFFV

SEQ ID NO: 1887718 - protein, 19 aa, Staphylococcus
VEYINRYLLLILLTLIQIA

SEQ ID NO: 1887719 - protein, 18 aa, Staphylococcus
VEYINWRALFYVVAPISA

SEQ ID NO: 1887720 - protein, 19 aa, Staphylococcus
VEYLDWRALFHVVAPIAAF

SEQ ID NO: 1887721 - protein, 19 aa, Staphylococcus
VEYLNWRSLFHVVAPIAAI

SEQ ID NO: 1887722 - protein, 26 aa, Staphylococcus
VEYLSRMLIPNIFSLLASIIVLWIYF

SEQ ID NO: 1887723 - protein, 26 aa, Staphylococcus
VFACLGALIFWWPKMTGFKLNETLNK

SEQ ID NO: 1887724 - protein, 27 aa, Staphylococcus
VFAHRFGRKRILSISLLALVITSLGAA

SEQ ID NO: 1887725 - protein, 21 aa, Staphylococcus
VFCMLLNLTPIFAILTAIVTI

SEQ ID NO: 1887726 - protein, 22 aa, Staphylococcus
VFCMLLNLTPIFAILTAIVTIE

SEQ ID NO: 1887727 - protein, 23 aa, Staphylococcus
VFDNLPLLFAIGTALGLAGGDGV

SEQ ID NO: 1887728 - protein, 17 aa, Staphylococcus
VFDYQRSLLKSSVQLNS

SEQ ID NO: 1887729 - protein, 23 aa, Staphylococcus
VFFILYYVIFRIMIKVLNLNTIG

SEQ ID NO: 1887730 - protein, 17 aa, Staphylococcus
VFFIPFIFAPIVNVWIF

SEQ ID NO: 1887731 - protein, 17 aa, Staphylococcus
VFFKEHQSLVVLSLYVL

SEQ ID NO: 1887732 - protein, 17 aa, Staphylococcus
VFFKENQALVVLSLYVI

SEQ ID NO: 1887733 - protein, 25 aa, Staphylococcus
VFFTKGGAILLHWHFISIESKGILE

SEQ ID NO: 1887734 - protein, 18 aa, Staphylococcus
VFFTLTWIIISLSLILNL

SEQ ID NO: 1887735 - protein, 23 aa, Staphylococcus
VFFVIRYPKIKAMNNDELSRLIL

SEQ ID NO: 1887736 - protein, 17 aa, Staphylococcus
VFFVSRLNKPAKYTKKS

SEQ ID NO: 1887737 - protein, 24 aa, Staphylococcus
VFGAAIKDVEWGTIIVTLATFAIL

SEQ ID NO: 1887738 - protein, 24 aa, Staphylococcus
VFGEVFGWVAGWALLAEYFIAVAF

SEQ ID NO: 1887739 - protein, 30 aa, Staphylococcus
VFGGPKRSKLRIVLFSSLGLSIAMILGTLT

SEQ ID NO: 1887740 - protein, 20 aa, Staphylococcus
VFGIFKFGWGFNEMSANFLL

SEQ ID NO: 1887741 - protein, 23 aa, Staphylococcus
VFGSSFMNFVLFKRMKFGDRKTT

SEQ ID NO: 1887742 - protein, 22 aa, Staphylococcus
VFHHLPMGFVLSIIALLLIASF

SEQ ID NO: 1887743 - protein, 18 aa, Staphylococcus
VFHLIEFSTSINIPFTNF

SEQ ID NO: 1887744 - protein, 18 aa, Staphylococcus
VFHLVEFSTNLNIPFTNI

SEQ ID NO: 1887745 - protein, 22 aa, Staphylococcus
VFIACTTYLALILIGSLQGNDM

SEQ ID NO: 1887746 - protein, 23 aa, Staphylococcus
VFIAVIVIACPCALGLATPTSIM

SEQ ID NO: 1887747 - protein, 25 aa, Staphylococcus
VFIHHFKRIMILSLILTILSLVLFG

SEQ ID NO: 1887748 - protein, 18 aa, Staphylococcus
VFIILTFISLFVLLGVAT

SEQ ID NO: 1887749 - protein, 24 aa, Staphylococcus
VFILIAELFFKFTNATEVIHGIWL

SEQ ID NO: 1887750 - protein, 20 aa, Staphylococcus
VFIMMISRIYLHAHYFSDTI

SEQ ID NO: 1887751 - protein, 22 aa, Staphylococcus
VFIPLLATWRGVFQGYQSMGPT

SEQ ID NO: 1887752 - protein, 17 aa, Staphylococcus
VFIVLGIIFLIMMQMVL

SEQ ID NO: 1887753 - protein, 24 aa, Staphylococcus
VFKGLPDSFSVMLYHSLKADESCV

SEQ ID NO: 1887754 - protein, 25 aa, Staphylococcus
VFKGRRGPAGFLFMLGVTVFVLIYW

SEQ ID NO: 1887755 - protein, 17 aa, Staphylococcus
VFLAFFIYHKLRYRTKK

SEQ ID NO: 1887756 - protein, 17 aa, Staphylococcus
VFLAFFIYHKVRYKTKK

SEQ ID NO: 1887757 - protein, 17 aa, Staphylococcus
VFLAFFIYHKVRYKTKM

SEQ ID NO: 1887758 - protein, 18 aa, Staphylococcus
VFLMSRIHEEYSRTHDNK

SEQ ID NO: 1887759 - protein, 20 aa, Staphylococcus
VFLMSSYCLLVIGTTKIQLQ

SEQ ID NO: 1887760 - protein, 20 aa, Staphylococcus
VFLPIIGFILYLLLGRQIQR

SEQ ID NO: 1887761 - protein, 19 aa, Staphylococcus
VFLPIVGFILYLLLGRQIQ

SEQ ID NO: 1887762 - protein, 18 aa, Staphylococcus
VFLSLGLILTVIINLLLG

SEQ ID NO: 1887763 - protein, 18 aa, Staphylococcus
VFLVSCLIFLVFFLSVNQ

SEQ ID NO: 1887764 - protein, 17 aa, Staphylococcus
VFLYKYRIGNTDESGKM

SEQ ID NO: 1887765 - protein, 19 aa, Staphylococcus
VFMFAFWFIFSSVIGLFTL

SEQ ID NO: 1887766 - protein, 32 aa, Staphylococcus
VFMRPDIGKTFGEFRIFLLVLLIFLLLISISL

SEQ ID NO: 1887767 - protein, 18 aa, Staphylococcus
VFMTWNIFTYILSQKIGL

SEQ ID NO: 1887768 - protein, 30 aa, Staphylococcus
VFNALLIAIGYKFLSKRSMYLTIVATILIS

SEQ ID NO: 1887769 - protein, 25 aa, Staphylococcus
VFNATEWIWWLLAHIVFMVFMYICI

SEQ ID NO: 1887770 - protein, 21 aa, Staphylococcus
VFNLFKFGKYIVGGIGKVNYT

SEQ ID NO: 1887771 - protein, 23 aa, Staphylococcus
VFNYWWMFVISFIFFLVAGALTI

SEQ ID NO: 1887772 - protein, 22 aa, Staphylococcus
VFPIMGLFGFILLIPIFYKGLK

SEQ ID NO: 1887773 - protein, 21 aa, Staphylococcus
VFPIMGLFGFILLIPILYKGV

SEQ ID NO: 1887774 - protein, 25 aa, Staphylococcus
VFPLSMGIVSMFLAITVVVQNISIA

SEQ ID NO: 1887775 - protein, 21 aa, Staphylococcus
VFQILRMILILLIILLLPFKK

SEQ ID NO: 1887776 - protein, 24 aa, Staphylococcus
VFQLSSYYLFNWFFVIYNIGVLTT

SEQ ID NO: 1887777 - protein, 22 aa, Staphylococcus
VFQVFFFDKFMKYMTELTFIIW

SEQ ID NO: 1887778 - protein, 17 aa, Staphylococcus
VFRGLLMGYIEKKTNIV

SEQ ID NO: 1887779 - protein, 25 aa, Staphylococcus
VFRNTLRYTVIIAVAIFVALFFGFD

SEQ ID NO: 1887780 - protein, 17 aa, Staphylococcus
VFSALLIITSIIITVIV

SEQ ID NO: 1887781 - protein, 18 aa, Staphylococcus
VFSLFIMYIWRKKIFKIP

SEQ ID NO: 1887782 - protein, 24 aa, Staphylococcus
VFSLFRIEIDITFIAAVLTIIGYS

SEQ ID NO: 1887783 - protein, 25 aa, Staphylococcus
VFSLLRLEVDLTFIAAILTIVGYSI

SEQ ID NO: 1887784 - protein, 17 aa, Staphylococcus
VFSRFYGHLGLLLIVLI

SEQ ID NO: 1887785 - protein, 18 aa, Staphylococcus
VFTAQFAASFAFAILLSI

SEQ ID NO: 1887786 - protein, 26 aa, Staphylococcus
VFTPIKLRRRVWRRLARDLKPNQLHD

SEQ ID NO: 1887787 - protein, 24 aa, Staphylococcus
VFTVTLKTYFSYYVDFSLGVKGLV

SEQ ID NO: 1887788 - protein, 18 aa, Staphylococcus
VFVGFSMLGLFTAISPNF

SEQ ID NO: 1887789 - protein, 17 aa, Staphylococcus
VFVIFTILRPVQENQKL

SEQ ID NO: 1887790 - protein, 25 aa, Staphylococcus
VFVIPTLKFMEWRIAIQTDEHDYVG

SEQ ID NO: 1887791 - protein, 20 aa, Staphylococcus
VFVKSGGNWTNEGNIKGPKG

SEQ ID NO: 1887792 - protein, 23 aa, Staphylococcus
VFVLDIFSALLIITSIIITALII

SEQ ID NO: 1887793 - protein, 19 aa, Staphylococcus
VFVPMVFKKTFPMPEEATR

SEQ ID NO: 1887794 - protein, 21 aa, Staphylococcus
VFWFALAICTIFVAFGAIFPK

SEQ ID NO: 1887795 - protein, 17 aa, Staphylococcus
VGAAFALWVKCRKNKKI

SEQ ID NO: 1887796 - protein, 25 aa, Staphylococcus
VGAALALWMRCKRNKQLANVIKGAL

SEQ ID NO: 1887797 - protein, 17 aa, Staphylococcus
VGAFLYGFFNRLLIPTG

SEQ ID NO: 1887798 - protein, 24 aa, Staphylococcus
VGARIFYSIVSFVVNLFRAIPFII

SEQ ID NO: 1887799 - protein, 26 aa, Staphylococcus
VGASSYRKQFCKRFLEQIEVSVIKGN

SEQ ID NO: 1887800 - protein, 24 aa, Staphylococcus
VGASTYRKQFCESFLSEINVSVIK

SEQ ID NO: 1887801 - protein, 26 aa, Staphylococcus
VGAYFFFRSTVSLLFKTLKKRKGGNV

SEQ ID NO: 1887802 - protein, 25 aa, Staphylococcus
VGAYLFFRSSVSIIFKSLKKSKHGR

SEQ ID NO: 1887803 - protein, 25 aa, Staphylococcus
VGAYLFFRSSVSIIFKSLKKSKQGR

SEQ ID NO: 1887804 - protein, 17 aa, Staphylococcus
VGCGVLFGFLCSSKLIQ

SEQ ID NO: 1887805 - protein, 24 aa, Staphylococcus
VGDFRLLSQRAIREVVNLGEYNRF

SEQ ID NO: 1887806 - protein, 18 aa, Staphylococcus
VGDFRLLSQRAVKAMSSL

SEQ ID NO: 1887807 - protein, 18 aa, Staphylococcus
VGDFRLLSQRVVRSLAEL

SEQ ID NO: 1887808 - protein, 17 aa, Staphylococcus
VGDSIFILTNAHVVGDK

SEQ ID NO: 1887809 - protein, 18 aa, Staphylococcus
VGEFPVISLMLAFSFGIY

SEQ ID NO: 1887810 - protein, 23 aa, Staphylococcus
VGESEFSFHLGVNLRDHGIPVMM

SEQ ID NO: 1887811 - protein, 19 aa, Staphylococcus
VGFAILRFIISAALILLGL

SEQ ID NO: 1887812 - protein, 23 aa, Staphylococcus
VGFFLAATLVWFVHDKDEYKKLK

SEQ ID NO: 1887813 - protein, 18 aa, Staphylococcus
VGFILYLLLGRQIQRKHI

SEQ ID NO: 1887814 - protein, 22 aa, Staphylococcus
VGFVLTNHWSFWILIIGLIVLV

SEQ ID NO: 1887815 - protein, 18 aa, Staphylococcus
VGGFFLARKYMMDYLKKN

SEQ ID NO: 1887816 - protein, 20 aa, Staphylococcus
VGGFFLARKYMMDYLKKNPP

SEQ ID NO: 1887817 - protein, 20 aa, Staphylococcus
VGGIIGWIAGLIMGKDIPGG

SEQ ID NO: 1887818 - protein, 27 aa, Staphylococcus
VGGIVPEILITKVIILALFGLGFIIVG

SEQ ID NO: 1887819 - protein, 24 aa, Staphylococcus
VGGLAGFLGSLAFKKYPIVTKQDM

SEQ ID NO: 1887820 - protein, 20 aa, Staphylococcus
VGGLIGWIAGMIMGKDIPGG

SEQ ID NO: 1887821 - protein, 18 aa, Staphylococcus
VGGLIGWLAGAILGKDIP

SEQ ID NO: 1887822 - protein, 32 aa, Staphylococcus
VGGSLLSLGSWRWIFWMNIPFIVVGLVGCLIL

SEQ ID NO: 1887823 - protein, 30 aa, Staphylococcus
VGGYVPEILTRKVITLSLFGIIFLLIGIIF

SEQ ID NO: 1887824 - protein, 17 aa, Staphylococcus
VGHFSVYFILLIGVILG

SEQ ID NO: 1887825 - protein, 20 aa, Staphylococcus
VGIALLTFIIWITVVHTGQF

SEQ ID NO: 1887826 - protein, 17 aa, Staphylococcus
VGIDYALFILFRYRQII

SEQ ID NO: 1887827 - protein, 17 aa, Staphylococcus
VGIDYALFILFRYRQVM

SEQ ID NO: 1887828 - protein, 29 aa, Staphylococcus
VGIDYSLFILFRFKELKKKGVDTVEAIAT

SEQ ID NO: 1887829 - protein, 32 aa, Staphylococcus
VGIDYSLFILFRFKELKKKGVDTVEAIATAVG

SEQ ID NO: 1887830 - protein, 24 aa, Staphylococcus
VGIFTKRANTFGVFVGLISGVIFA

SEQ ID NO: 1887831 - protein, 24 aa, Staphylococcus
VGIFTKRANTFGVIVGLLTGVVVA

SEQ ID NO: 1887832 - protein, 24 aa, Staphylococcus
VGIFTKRANTFGVLVGLVAGVIIA

SEQ ID NO: 1887833 - protein, 19 aa, Staphylococcus
VGIFTRRANTFGVIVGLFA

SEQ ID NO: 1887834 - protein, 18 aa, Staphylococcus
VGIGFRLIQTGAPIPELN

SEQ ID NO: 1887835 - protein, 30 aa, Staphylococcus
VGIGTLIGMRLRRVSPRKVIAPLIKAHKAG

SEQ ID NO: 1887836 - protein, 17 aa, Staphylococcus
VGIGTLVGMRLRRVSPR

SEQ ID NO: 1887837 - protein, 19 aa, Staphylococcus
VGIGVVLSIHFHQRQTMPN

SEQ ID NO: 1887838 - protein, 17 aa, Staphylococcus
VGIIFLPIIIMRTSWLF

SEQ ID NO: 1887839 - protein, 33 aa, Staphylococcus
VGIIIYVSLRFEWRMGLSSVLALLHDVFIIVAV

SEQ ID NO: 1887840 - protein, 19 aa, Staphylococcus
VGILACINLGVSPVFAIIV

SEQ ID NO: 1887841 - protein, 25 aa, Staphylococcus
VGILCILYTFLGGFEGVVWSDFIQG

SEQ ID NO: 1887842 - protein, 29 aa, Staphylococcus
VGILKFGIPMLIPLLIKYVIDDIINNGAI

SEQ ID NO: 1887843 - protein, 19 aa, Staphylococcus
VGIPRFVIVTTYQFGQYAM

SEQ ID NO: 1887844 - protein, 24 aa, Staphylococcus
VGIPRYTIVSAYQFGQYAMLFLAP

SEQ ID NO: 1887845 - protein, 18 aa, Staphylococcus
VGISMWFFVNQGVLEGTK

SEQ ID NO: 1887846 - protein, 18 aa, Staphylococcus
VGIYAVFRHQHLQAQKPS

SEQ ID NO: 1887847 - protein, 23 aa, Staphylococcus
VGKDKWSDIAVIKAEAPKDDALT

SEQ ID NO: 1887848 - protein, 22 aa, Staphylococcus
VGKDKWSDIAVVKAKLSDESMK

SEQ ID NO: 1887849 - protein, 22 aa, Staphylococcus
VGKLFPFVFVFAIGGASIATFL

SEQ ID NO: 1887850 - protein, 21 aa, Staphylococcus
VGKSYLEYQYESILRGKKKEM

SEQ ID NO: 1887851 - protein, 20 aa, Staphylococcus
VGKVSFRFWPFSEFKFNFNP

SEQ ID NO: 1887852 - protein, 30 aa, Staphylococcus
VGLCLALMIGWLGRYLRYFRNLARDVQTQP

SEQ ID NO: 1887853 - protein, 24 aa, Staphylococcus
VGLDFKQIIGYIFAPIAFIMGVPW

SEQ ID NO: 1887854 - protein, 17 aa, Staphylococcus
VGLFLIWLPTYVMEQYH

SEQ ID NO: 1887855 - protein, 18 aa, Staphylococcus
VGLICLGISHWFKSQDNT

SEQ ID NO: 1887856 - protein, 18 aa, Staphylococcus
VGLILGFIVYRKPRNYVQ

SEQ ID NO: 1887857 - protein, 22 aa, Staphylococcus
VGLIVPHIVRFLIGTDYAKVIP

SEQ ID NO: 1887858 - protein, 17 aa, Staphylococcus
VGLKPLALFGIAVMTYG

SEQ ID NO: 1887859 - protein, 17 aa, Staphylococcus
VGLLGVIDLCINLKRII

SEQ ID NO: 1887860 - protein, 23 aa, Staphylococcus
VGLMAWLNIIAIWILHKPALEAL

SEQ ID NO: 1887861 - protein, 41 aa, Staphylococcus
VGLNAKYYRDNHVSFSIPVTENHGGSGLNQVRVEGLPSGWT

SEQ ID NO: 1887862 - protein, 17 aa, Staphylococcus
VGLSADYAPFEFEKTVK

SEQ ID NO: 1887863 - protein, 17 aa, Staphylococcus
VGLSADYAPLEFEKTKN

SEQ ID NO: 1887864 - protein, 18 aa, Staphylococcus
VGLSQGWLLAPITSAGIH

SEQ ID NO: 1887865 - protein, 18 aa, Staphylococcus
VGLTICLFMFGLGGVLGN

SEQ ID NO: 1887866 - protein, 17 aa, Staphylococcus
VGLTIFAFITTSITFSI

SEQ ID NO: 1887867 - protein, 26 aa, Staphylococcus
VGLVLKDFSLLPAFIASYIVAFIIKL

SEQ ID NO: 1887868 - protein, 21 aa, Staphylococcus
VGLYYNFTWSFYGDLLIFLPL

SEQ ID NO: 1887869 - protein, 17 aa, Staphylococcus
VGMGFRLIQTGAHIPEI

SEQ ID NO: 1887870 - protein, 23 aa, Staphylococcus
VGMMAWLNIIAIWILHRPAVDAL

SEQ ID NO: 1887871 - protein, 24 aa, Staphylococcus
VGMRLRRVSPRKVIGPLIKAHKAG

SEQ ID NO: 1887872 - protein, 25 aa, Staphylococcus
VGNMGGGVLDFLATNWIPLGQKHWM

SEQ ID NO: 1887873 - protein, 26 aa, Staphylococcus
VGNQNLYRIAIQYYGNGSPENVNKIK

SEQ ID NO: 1887874 - protein, 21 aa, Staphylococcus
VGNYFKPFWPLAIINVFEEFS

SEQ ID NO: 1887875 - protein, 23 aa, Staphylococcus
VGPDIVSFFALFSIFLLIISLIF

SEQ ID NO: 1887876 - protein, 17 aa, Staphylococcus
VGPRHQLFLPIAILVGA

SEQ ID NO: 1887877 - protein, 21 aa, Staphylococcus
VGPVANFLAASSFLLTAYFVT

SEQ ID NO: 1887878 - protein, 24 aa, Staphylococcus
VGPVANFLAGISFLLTAYYVNKRG

SEQ ID NO: 1887879 - protein, 21 aa, Staphylococcus
VGPVANFLAGTSFLLSAYYVY

SEQ ID NO: 1887880 - protein, 24 aa, Staphylococcus
VGPVANFLAGVSFLLSAYYVTKRQ

SEQ ID NO: 1887881 - protein, 19 aa, Staphylococcus
VGRQPWIVRGYMRVSEAAT

SEQ ID NO: 1887882 - protein, 26 aa, Staphylococcus
VGSALGLYYKMKVFEKADQAIAKEKE

SEQ ID NO: 1887883 - protein, 18 aa, Staphylococcus
VGSALSFNKIAMISFVNT

SEQ ID NO: 1887884 - protein, 17 aa, Staphylococcus
VGSASWQNYLLPVGIMI

SEQ ID NO: 1887885 - protein, 25 aa, Staphylococcus
VGSFCIGLLMGMCLNINWINPFIIV

SEQ ID NO: 1887886 - protein, 20 aa, Staphylococcus
VGSLIMLFIMDWQMTLLTFI

SEQ ID NO: 1887887 - protein, 19 aa, Staphylococcus
VGSLVMLFIMDWKMTLLTF

SEQ ID NO: 1887888 - protein, 19 aa, Staphylococcus
VGSTMFSPIYALKHMFTFD

SEQ ID NO: 1887889 - protein, 20 aa, Staphylococcus
VGSYGWKAILYFEIITTVAI

SEQ ID NO: 1887890 - protein, 17 aa, Staphylococcus
VGTEAASGFLALIEAGP

SEQ ID NO: 1887891 - protein, 20 aa, Staphylococcus
VGTILTLLAGLGIITNPNTK

SEQ ID NO: 1887892 - protein, 18 aa, Staphylococcus
VGTITLQVALLFISQLYY

SEQ ID NO: 1887893 - protein, 23 aa, Staphylococcus
VGTLFTLLFSWLIVLAIARIFKS

SEQ ID NO: 1887894 - protein, 18 aa, Staphylococcus
VGVATSFSFSQLLVIVST

SEQ ID NO: 1887895 - protein, 25 aa, Staphylococcus
VGVFFKEYQSLIVLSLYLIGILIAL

SEQ ID NO: 1887896 - protein, 19 aa, Staphylococcus
VGVFIPFTLAQFGMVLKWV

SEQ ID NO: 1887897 - protein, 19 aa, Staphylococcus
VGVFIPFTLAQFGMVLKWY

SEQ ID NO: 1887898 - protein, 19 aa, Staphylococcus
VGVFIPFTLAQYGMVLKWI

SEQ ID NO: 1887899 - protein, 26 aa, Staphylococcus
VGVGDPKLLGGIGIKTITFFLTTTAI

SEQ ID NO: 1887900 - protein, 33 aa, Staphylococcus
VGVGGWPAFISIKSEFWWIYLPATLIATVVPAV

SEQ ID NO: 1887901 - protein, 20 aa, Staphylococcus
VGVGMPLMFAIAEFLGIKNK

SEQ ID NO: 1887902 - protein, 22 aa, Staphylococcus
VGVIFIALFVWRQYQLDVPLLN

SEQ ID NO: 1887903 - protein, 19 aa, Staphylococcus
VGVIFLITFLIYLFYSPRL

SEQ ID NO: 1887904 - protein, 18 aa, Staphylococcus
VGVISFIVWMLIQNDVDF

SEQ ID NO: 1887905 - protein, 19 aa, Staphylococcus
VGVLMFYFGKERGHVLDNV

SEQ ID NO: 1887906 - protein, 24 aa, Staphylococcus
VGVSTLIGVVFGWIPARAAAKKEL

SEQ ID NO: 1887907 - protein, 22 aa, Staphylococcus
VGVVMKDMFEDMGLDRSNLSRT

SEQ ID NO: 1887908 - protein, 19 aa, Staphylococcus
VGVVWAFAICYFVGAVITY

SEQ ID NO: 1887909 - protein, 19 aa, Staphylococcus
VGWGMLIAGVFSFLLNLNL

SEQ ID NO: 1887910 - protein, 17 aa, Staphylococcus
VGYAVSVLFVFFKAPDL

SEQ ID NO: 1887911 - protein, 17 aa, Staphylococcus
VGYFIAWIWPELPMPAA

SEQ ID NO: 1887912 - protein, 18 aa, Staphylococcus
VGYLTFSFKGSNSETVDV

SEQ ID NO: 1887913 - protein, 18 aa, Staphylococcus
VGYLYWYAKKIKKDPKAS

SEQ ID NO: 1887914 - protein, 17 aa, Staphylococcus
VGYLYWYSQKIKKDPKA

SEQ ID NO: 1887915 - protein, 17 aa, Staphylococcus
VGYSVSVLFVFFKAPDL

SEQ ID NO: 1887916 - protein, 26 aa, Staphylococcus
VHDLKTAFEKWNFVKLAKPLIGVSIL

SEQ ID NO: 1887917 - protein, 25 aa, Staphylococcus
VHDLKTSFEKWNFVKLAKPLIALSI

SEQ ID NO: 1887918 - protein, 25 aa, Staphylococcus
VHDLKTSFEKWNFVKLAKPLISLSI

SEQ ID NO: 1887919 - protein, 18 aa, Staphylococcus
VHGVTLFLLLKAFSSGAS

SEQ ID NO: 1887920 - protein, 26 aa, Staphylococcus
VHHLDPRAKLIFVFMFIVYIFFCHSF

SEQ ID NO: 1887921 - protein, 17 aa, Staphylococcus
VHHLNWHWVYFTLTVLY

SEQ ID NO: 1887922 - protein, 20 aa, Staphylococcus
VHHYRNRPGLAVTDIILNYI

SEQ ID NO: 1887923 - protein, 21 aa, Staphylococcus
VHIGWKGWVYVDQQIAKHMDG

SEQ ID NO: 1887924 - protein, 22 aa, Staphylococcus
VHLLFFLPFYKSFRIHKLTRKK

SEQ ID NO: 1887925 - protein, 27 aa, Staphylococcus
VHLMIPCKPDHPFVYWATFSYAAELLN

SEQ ID NO: 1887926 - protein, 19 aa, Staphylococcus
VHLSETFKPISFKHLLGTD

SEQ ID NO: 1887927 - protein, 17 aa, Staphylococcus
VHLSIPLVSIVGVVVFT

SEQ ID NO: 1887928 - protein, 18 aa, Staphylococcus
VHNKMDFEVKYYATEGTG

SEQ ID NO: 1887929 - protein, 38 aa, Staphylococcus
VHNLKVIIVSGIIPFNIIKGIVISIIFYFIFNRIKNNI

SEQ ID NO: 1887930 - protein, 20 aa, Staphylococcus
VHNVWEFLNAFFAEIIKVMS

SEQ ID NO: 1887931 - protein, 23 aa, Staphylococcus
VHRKIEFNREFTEIFGENEAGKS

SEQ ID NO: 1887932 - protein, 18 aa, Staphylococcus
VHVINWIIGVGGIFSGFI

SEQ ID NO: 1887933 - protein, 24 aa, Staphylococcus
VHVVLRLLLTFIITVILLFFFWWL

SEQ ID NO: 1887934 - protein, 26 aa, Staphylococcus
VHWIWPELPIGAAFALAAILCPTDAV

SEQ ID NO: 1887935 - protein, 24 aa, Staphylococcus
VHWKWQMLVTLAFVIPCHELYMRT

SEQ ID NO: 1887936 - protein, 18 aa, Staphylococcus
VIAAGWGLAVTMGVYAVG

SEQ ID NO: 1887937 - protein, 27 aa, Staphylococcus
VIAASGGAFGWLVFEYIITKKLSLLGL

SEQ ID NO: 1887938 - protein, 17 aa, Staphylococcus
VIAFAMVIVNGFYHVDD

SEQ ID NO: 1887939 - protein, 25 aa, Staphylococcus
VIAFICYQFWLKRIDMSELERLFKV

SEQ ID NO: 1887940 - protein, 25 aa, Staphylococcus
VIAFKDIKKIAAYQVILSIGFIILG

SEQ ID NO: 1887941 - protein, 24 aa, Staphylococcus
VIAFWNRHMYLWWFMFAVFVSNAI

SEQ ID NO: 1887942 - protein, 27 aa, Staphylococcus
VIAIIKMDWWFHLVIMLASIAWYILTM

SEQ ID NO: 1887943 - protein, 17 aa, Staphylococcus
VIANFWFIQALGAAYLI

SEQ ID NO: 1887944 - protein, 24 aa, Staphylococcus
VIAQFGAVMGVFFKTRNKDLKRVS

SEQ ID NO: 1887945 - protein, 18 aa, Staphylococcus
VIASIDFGAGVFLLQAKL

SEQ ID NO: 1887946 - protein, 18 aa, Staphylococcus
VIATGWGLAVAMGAFAVG

SEQ ID NO: 1887947 - protein, 17 aa, Staphylococcus
VIAWILGSMALHFVLGF

SEQ ID NO: 1887948 - protein, 25 aa, Staphylococcus
VIAYKDIKKIAAYQVILSIGFIILG

SEQ ID NO: 1887949 - protein, 17 aa, Staphylococcus
VICAVGAVQQFKIEHKK

SEQ ID NO: 1887950 - protein, 25 aa, Staphylococcus
VIDALQIRFILDWNSQAHRPQFEYD

SEQ ID NO: 1887951 - protein, 18 aa, Staphylococcus
VIDGHIGYVGGFNVGDEY

SEQ ID NO: 1887952 - protein, 24 aa, Staphylococcus
VIDKWEWLKWNPINMMNIMVQIID

SEQ ID NO: 1887953 - protein, 24 aa, Staphylococcus
VIDKWEWLKWNPLNMMNIMIQITD

SEQ ID NO: 1887954 - protein, 23 aa, Staphylococcus
VIDLSSLVYLIFAVIPLFTFDLK

SEQ ID NO: 1887955 - protein, 20 aa, Staphylococcus
VIEAIKRFFAPPEVQSKEMF

SEQ ID NO: 1887956 - protein, 21 aa, Staphylococcus
VIEALSFMALGLFGSLIIGLI

SEQ ID NO: 1887957 - protein, 18 aa, Staphylococcus
VIEHGRYYGANNVLTQTG

SEQ ID NO: 1887958 - protein, 23 aa, Staphylococcus
VIEQRYMDAMSIAQNYYPQFKQS

SEQ ID NO: 1887959 - protein, 17 aa, Staphylococcus
VIESGGWTIFNHMEIVF

SEQ ID NO: 1887960 - protein, 19 aa, Staphylococcus
VIESLPSILNRELDTDAEW

SEQ ID NO: 1887961 - protein, 22 aa, Staphylococcus
VIFAAFIGFAFLRVMRKQPESG

SEQ ID NO: 1887962 - protein, 18 aa, Staphylococcus
VIFLESWLKEKNHISSLI

SEQ ID NO: 1887963 - protein, 24 aa, Staphylococcus
VIFLREGLEVLLIVMALVAMTRQS

SEQ ID NO: 1887964 - protein, 17 aa, Staphylococcus
VIFLVGLFFSKNKDIDY

SEQ ID NO: 1887965 - protein, 18 aa, Staphylococcus
VIFTIILLCIGFYDGFLG

SEQ ID NO: 1887966 - protein, 24 aa, Staphylococcus
VIFTPLVAFMLMRIMESSYKAMII

SEQ ID NO: 1887967 - protein, 19 aa, Staphylococcus
VIFTSSLVYRVRKNAFSLT

SEQ ID NO: 1887968 - protein, 23 aa, Staphylococcus
VIGAASGVEWGTVIVQIVTFIIL

SEQ ID NO: 1887969 - protein, 21 aa, Staphylococcus
VIGAVFPFGFLAQLISAGALV

SEQ ID NO: 1887970 - protein, 18 aa, Staphylococcus
VIGDKGGTLTIHLPQSLR

SEQ ID NO: 1887971 - protein, 25 aa, Staphylococcus
VIGFGASYLFNWFIRQDMIPQNLMP

SEQ ID NO: 1887972 - protein, 18 aa, Staphylococcus
VIGFLKIRMHYRDIAEQL

SEQ ID NO: 1887973 - protein, 22 aa, Staphylococcus
VIGGFVLEHFSIISTPYFGFLM

SEQ ID NO: 1887974 - protein, 24 aa, Staphylococcus
VIGGKGGTIKLHLPKQIRDKYDDF

SEQ ID NO: 1887975 - protein, 25 aa, Staphylococcus
VIGGLACAFSMLFLSKMIDNNSRNF

SEQ ID NO: 1887976 - protein, 31 aa, Staphylococcus
VIGIIKFGIPMLIPLLIKYAIDGVINNHSLT

SEQ ID NO: 1887977 - protein, 20 aa, Staphylococcus
VIGMTCAACSNRIEKVLNKT

SEQ ID NO: 1887978 - protein, 27 aa, Staphylococcus
VIGMTCAACSNRIEKVLNRTDGVDQAT

SEQ ID NO: 1887979 - protein, 17 aa, Staphylococcus
VIGSLIIHDYILLVVSI

SEQ ID NO: 1887980 - protein, 19 aa, Staphylococcus
VIGSLLFVIFHLGRIAIVI

SEQ ID NO: 1887981 - protein, 19 aa, Staphylococcus
VIGSYILKVPMTYTKSDSK

SEQ ID NO: 1887982 - protein, 21 aa, Staphylococcus
VIGVGLFVHWIWPELPIGAAF

SEQ ID NO: 1887983 - protein, 21 aa, Staphylococcus
VIGVGYFIHWIWPDLPMPAAF

SEQ ID NO: 1887984 - protein, 21 aa, Staphylococcus
VIGVGYFIHWIWTDLPMPAAF

SEQ ID NO: 1887985 - protein, 17 aa, Staphylococcus
VIGVILMNEWSRTKHKI

SEQ ID NO: 1887986 - protein, 20 aa, Staphylococcus
VIGVVRGYKLFPFQEPVNIY

SEQ ID NO: 1887987 - protein, 24 aa, Staphylococcus
VIGWSIALVLGFIITAALLFTNQG

SEQ ID NO: 1887988 - protein, 18 aa, Staphylococcus
VIGYLYWYSKKIKKDPTA

SEQ ID NO: 1887989 - protein, 20 aa, Staphylococcus
VIIACLLFLILSGRLGSLEM

SEQ ID NO: 1887990 - protein, 20 aa, Staphylococcus
VIIAIVFFKLPVNIASGAVV

SEQ ID NO: 1887991 - protein, 18 aa, Staphylococcus
VIICLIIFNGNAAKIEQL

SEQ ID NO: 1887992 - protein, 18 aa, Staphylococcus
VIIDGKIGYVGGFNVGDE

SEQ ID NO: 1887993 - protein, 17 aa, Staphylococcus
VIIEILAGIVLSAIITA

SEQ ID NO: 1887994 - protein, 18 aa, Staphylococcus
VIIGGLFGLNAYSDQHPN

SEQ ID NO: 1887995 - protein, 18 aa, Staphylococcus
VIIGGSFSAFFITSVNSF

SEQ ID NO: 1887996 - protein, 18 aa, Staphylococcus
VIIGLKISIKPADKNHPY

SEQ ID NO: 1887997 - protein, 17 aa, Staphylococcus
VIIGPSLADRVVALDAM

SEQ ID NO: 1887998 - protein, 24 aa, Staphylococcus
VIIHDIYYFFSIGICSMIIKTIVK

SEQ ID NO: 1887999 - protein, 28 aa, Staphylococcus
VIIISMFCSLWLVPWLSAKRVGKLKQQV

SEQ ID NO: 1888000 - protein, 25 aa, Staphylococcus
VIIIVYELGVSWLLFKINTLSHRLF

SEQ ID NO: 1888001 - protein, 23 aa, Staphylococcus
VIILFCILVLISIGMHQPLSIWF

SEQ ID NO: 1888002 - protein, 27 aa, Staphylococcus
VIILFICSIMIKWQPNYSMISPTSQNY

SEQ ID NO: 1888003 - protein, 24 aa, Staphylococcus
VIILIAVGIMFYLRSNKRQLVEKA

SEQ ID NO: 1888004 - protein, 17 aa, Staphylococcus
VIIPVLFFIVAIMMFAR

SEQ ID NO: 1888005 - protein, 24 aa, Staphylococcus
VIIPWKEFGGIFAVFPAVFLISLI

SEQ ID NO: 1888006 - protein, 29 aa, Staphylococcus
VIISCLIAAVIMPRIWPLNKIPDEYAKDV

SEQ ID NO: 1888007 - protein, 31 aa, Staphylococcus
VIIVIALLVLFSFVPVGLWISAIAAGVKVGI

SEQ ID NO: 1888008 - protein, 19 aa, Staphylococcus
VIIVLPFVLSALFILINVL

SEQ ID NO: 1888009 - protein, 24 aa, Staphylococcus
VIIVVCVLLFQFINHTGPFSGSKS

SEQ ID NO: 1888010 - protein, 23 aa, Staphylococcus
VIKAKFPLHIGIMTGYYTVVMNV

SEQ ID NO: 1888011 - protein, 24 aa, Staphylococcus
VIKQFGAGIKAVFSNDTGKGLNIF

SEQ ID NO: 1888012 - protein, 29 aa, Staphylococcus
VIKTASKRLPWLIVLTFLGMITATILGSF

SEQ ID NO: 1888013 - protein, 29 aa, Staphylococcus
VIKTATKRLPWLIILTFLGMITATILGSF

SEQ ID NO: 1888014 - protein, 20 aa, Staphylococcus
VILALVGVIVYLWKTNEDFR

SEQ ID NO: 1888015 - protein, 22 aa, Staphylococcus
VILCYLISLSLLTMFISMYTIF

SEQ ID NO: 1888016 - protein, 18 aa, Staphylococcus
VILFKVGFALLRFLISAT

SEQ ID NO: 1888017 - protein, 24 aa, Staphylococcus
VILFLIEFARGMFVLSYLPILPTV

SEQ ID NO: 1888018 - protein, 27 aa, Staphylococcus
VILFLMEFARGMYILSYINFLPTVTSI

SEQ ID NO: 1888019 - protein, 26 aa, Staphylococcus
VILFLMEFARGMYILSYINYLPTVTS

SEQ ID NO: 1888020 - protein, 18 aa, Staphylococcus
VILFSAFISFILTNIYYH

SEQ ID NO: 1888021 - protein, 24 aa, Staphylococcus
VILFSSLFLLIAFVPNVFGFKWDK

SEQ ID NO: 1888022 - protein, 18 aa, Staphylococcus
VILGGSFSAFFITAVNSF

SEQ ID NO: 1888023 - protein, 17 aa, Staphylococcus
VILICIIFIPGSFVVTR

SEQ ID NO: 1888024 - protein, 26 aa, Staphylococcus
VILIIALSCFIIFGLPHVDFGVFNMH

SEQ ID NO: 1888025 - protein, 19 aa, Staphylococcus
VILILKLGIPAGLQMAVIQ

SEQ ID NO: 1888026 - protein, 18 aa, Staphylococcus
VILLAILTMAFRIAPMPS

SEQ ID NO: 1888027 - protein, 21 aa, Staphylococcus
VILLFRVGFAILRFIISAALI

SEQ ID NO: 1888028 - protein, 26 aa, Staphylococcus
VILLFRVGISIIRFLISVGIILLCIY

SEQ ID NO: 1888029 - protein, 25 aa, Staphylococcus
VILLIIVAIFVTRAVLNHNNNKVNN

SEQ ID NO: 1888030 - protein, 18 aa, Staphylococcus
VILLVYFSFTDVHGHFSF

SEQ ID NO: 1888031 - protein, 24 aa, Staphylococcus
VILLWFIFCVYIFQYIKLLFTNRK

SEQ ID NO: 1888032 - protein, 24 aa, Staphylococcus
VILPPLAAMIFIKIGYHPIAGLAM

SEQ ID NO: 1888033 - protein, 17 aa, Staphylococcus
VILPPVVDPKLSGENVV

SEQ ID NO: 1888034 - protein, 17 aa, Staphylococcus
VILPWKELGGVFATLPA

SEQ ID NO: 1888035 - protein, 20 aa, Staphylococcus
VILVKGFKRKIPFLDKVVLK

SEQ ID NO: 1888036 - protein, 18 aa, Staphylococcus
VILVSFYAMHLKDRLIPI

SEQ ID NO: 1888037 - protein, 17 aa, Staphylococcus
VILVVVNLFLAWFFVFF

SEQ ID NO: 1888038 - protein, 21 aa, Staphylococcus
VIMFFVWPTVQSWIFNAGGLV

SEQ ID NO: 1888039 - protein, 17 aa, Staphylococcus
VIMQVCFGDVLKHLQTQ

SEQ ID NO: 1888040 - protein, 19 aa, Staphylococcus
VINFGDWQPPFGIQFVGDT

SEQ ID NO: 1888041 - protein, 19 aa, Staphylococcus
VINIPKWIQFLFITIVAMV

SEQ ID NO: 1888042 - protein, 31 aa, Staphylococcus
VINSGYKKLLYWSLNHKWIVIIISIVLLVGS

SEQ ID NO: 1888043 - protein, 23 aa, Staphylococcus
VIPAQPTLLFAVELDETGRTRPT

SEQ ID NO: 1888044 - protein, 23 aa, Staphylococcus
VIQGLRMLLPPVGRLGSLIELLI

SEQ ID NO: 1888045 - protein, 17 aa, Staphylococcus
VIQKWMSIIGFFPLFGI

SEQ ID NO: 1888046 - protein, 18 aa, Staphylococcus
VIRELTMRAPMLNLEVLK

SEQ ID NO: 1888047 - protein, 17 aa, Staphylococcus
VIRELTMRVPMLSMEVL

SEQ ID NO: 1888048 - protein, 24 aa, Staphylococcus
VISACKYLPVGTVYAVFVGIGAVG

SEQ ID NO: 1888049 - protein, 27 aa, Staphylococcus
VISAILIAIGWRQIWKRKIESHKKVML

SEQ ID NO: 1888050 - protein, 23 aa, Staphylococcus
VISAILIAIGWWQIWHRHVNAHK

SEQ ID NO: 1888051 - protein, 21 aa, Staphylococcus
VISFLCTFMLKKRTKKEKEQT

SEQ ID NO: 1888052 - protein, 18 aa, Staphylococcus
VISGCIIALFTHWLRNRK

SEQ ID NO: 1888053 - protein, 35 aa, Staphylococcus
VISKEYRRILKWSLNHKWIVIVISIVILIGSIGLG

SEQ ID NO: 1888054 - protein, 19 aa, Staphylococcus
VISMVVMFIPLLATWRGVF

SEQ ID NO: 1888055 - protein, 18 aa, Staphylococcus
VISNIFKYRQRIIDKANS

SEQ ID NO: 1888056 - protein, 21 aa, Staphylococcus
VISVVLYFSFITLKYAHHLHG

SEQ ID NO: 1888057 - protein, 19 aa, Staphylococcus
VITACISYFISKNITKPLV

SEQ ID NO: 1888058 - protein, 19 aa, Staphylococcus
VITDNLFRAKEMNYTLQTE

SEQ ID NO: 1888059 - protein, 17 aa, Staphylococcus
VITDPNTHIEIFDKDGQ

SEQ ID NO: 1888060 - protein, 25 aa, Staphylococcus
VITFIFISPMHSFLITLSMILTLCI

SEQ ID NO: 1888061 - protein, 17 aa, Staphylococcus
VITFIFVAIHLWQTRIQ

SEQ ID NO: 1888062 - protein, 32 aa, Staphylococcus
VITFKGGLAPFTILFSLPFTAIGIVFALLITR

SEQ ID NO: 1888063 - protein, 31 aa, Staphylococcus
VITFKGGLAPFTILFSLPFTIIGVVLALLIT

SEQ ID NO: 1888064 - protein, 32 aa, Staphylococcus
VITFKGGLAPFTILFSLPFTIVGVVLSLVITG

SEQ ID NO: 1888065 - protein, 32 aa, Staphylococcus
VITFKGGLAPFTILFSLPFTVVGVVLALVITG

SEQ ID NO: 1888066 - protein, 30 aa, Staphylococcus
VITFKGGLAPFTILFSLPYTVIGVVLALLI

SEQ ID NO: 1888067 - protein, 18 aa, Staphylococcus
VITLEILIIPSLVLQLLI

SEQ ID NO: 1888068 - protein, 27 aa, Staphylococcus
VIVALAFILLMIVFRSIIIPLKAVLGF

SEQ ID NO: 1888069 - protein, 25 aa, Staphylococcus
VIVAMCLIMIQSFIFLRKRSILSMM

SEQ ID NO: 1888070 - protein, 24 aa, Staphylococcus
VIVCAIPSITAFVLASFVVDISII

SEQ ID NO: 1888071 - protein, 17 aa, Staphylococcus
VIVGATFAITRLVVRQS

SEQ ID NO: 1888072 - protein, 27 aa, Staphylococcus
VIVILAFILLMIVFRSILVPLKAVLGF

SEQ ID NO: 1888073 - protein, 17 aa, Staphylococcus
VIVLIGFVLMYLVLFKM

SEQ ID NO: 1888074 - protein, 19 aa, Staphylococcus
VIVLLFLTWLYLRFIAFKQ

SEQ ID NO: 1888075 - protein, 24 aa, Staphylococcus
VIVQNGREVYKWAVTTVPREVNRL

SEQ ID NO: 1888076 - protein, 20 aa, Staphylococcus
VIVSFGWQPLLFNAFLYLIL

SEQ ID NO: 1888077 - protein, 33 aa, Staphylococcus
VIVVGLFVHWIWPELPMAAAFALAAILCPTDAV

SEQ ID NO: 1888078 - protein, 27 aa, Staphylococcus
VIVVLAFFLLMFVFRSILVPLKAVLGF

SEQ ID NO: 1888079 - protein, 43 aa, Staphylococcus
VIVYFIVCLLLSFLALISMNIRILSGFLFLLATVITLPLVLLF

SEQ ID NO: 1888080 - protein, 17 aa, Staphylococcus
VIWFPFNPYILFISAIL

SEQ ID NO: 1888081 - protein, 24 aa, Staphylococcus
VIYDKRKVPFITFLLIITLFVILS

SEQ ID NO: 1888082 - protein, 19 aa, Staphylococcus
VIYHFKQQRISKRFNSKLI

SEQ ID NO: 1888083 - protein, 25 aa, Staphylococcus
VIYMIRIGLQIAHLLGDLKGRIAIA

SEQ ID NO: 1888084 - protein, 24 aa, Staphylococcus
VIYMIRIGLQIAHLLNDLKGRIAV

SEQ ID NO: 1888085 - protein, 24 aa, Staphylococcus
VIYMIRIGLQIAKLLDQMKGRIAV

SEQ ID NO: 1888086 - protein, 24 aa, Staphylococcus
VIYMIRIGLQIANLLSDLKGRIAV

SEQ ID NO: 1888087 - protein, 24 aa, Staphylococcus
VIYMIRIGLQIAQLLGDLKGRIAI

SEQ ID NO: 1888088 - protein, 19 aa, Staphylococcus
VIYYVIFRFLIKKLNFKTP

SEQ ID NO: 1888089 - protein, 26 aa, Staphylococcus
VIYYVVFRLAIKVLKLNTPGRGDNLL

SEQ ID NO: 1888090 - protein, 17 aa, Staphylococcus
VKAETPIQIEGKAAPQS

SEQ ID NO: 1888091 - protein, 21 aa, Staphylococcus
VKAFIPLFILGMIFWSIQEQG

SEQ ID NO: 1888092 - protein, 21 aa, Staphylococcus
VKAFIPLFILGMVFWAIQEQG

SEQ ID NO: 1888093 - protein, 21 aa, Staphylococcus
VKAGFVLNIFAIIVISLFAYF

SEQ ID NO: 1888094 - protein, 17 aa, Staphylococcus
VKAGIFLLFKFTPILGL

SEQ ID NO: 1888095 - protein, 21 aa, Staphylococcus
VKASLFLLIGVMYKITKSTDL

SEQ ID NO: 1888096 - protein, 21 aa, Staphylococcus
VKASLFLLIGVMYKITKTTDL

SEQ ID NO: 1888097 - protein, 27 aa, Staphylococcus
VKAVDVIAPSGNLRVYRLNPSTLSDEE

SEQ ID NO: 1888098 - protein, 25 aa, Staphylococcus
VKAYGEIEFWFAIIKVIAILFLIVI

SEQ ID NO: 1888099 - protein, 22 aa, Staphylococcus
VKDESLCTFTELVHPLIDGAVP

SEQ ID NO: 1888100 - protein, 18 aa, Staphylococcus
VKDFLKSGVPLTIVGYIL

SEQ ID NO: 1888101 - protein, 18 aa, Staphylococcus
VKDFLKTGVPLTIIGYIL

SEQ ID NO: 1888102 - protein, 18 aa, Staphylococcus
VKDFLKTGVPLTIVGYIL

SEQ ID NO: 1888103 - protein, 26 aa, Staphylococcus
VKDKPRPAQWGLLSLQHLFAMFGSTV

SEQ ID NO: 1888104 - protein, 23 aa, Staphylococcus
VKDNLRKARIEKLTKEEIQQQQN

SEQ ID NO: 1888105 - protein, 23 aa, Staphylococcus
VKDNLRKARIEKLTQEEIHQQHS

SEQ ID NO: 1888106 - protein, 21 aa, Staphylococcus
VKDNLRKARIEKLTQEEIQHQ

SEQ ID NO: 1888107 - protein, 23 aa, Staphylococcus
VKDNLRKARIEKLTQEEIQQQHE

SEQ ID NO: 1888108 - protein, 23 aa, Staphylococcus
VKDNLRKARIEKLTQEEIQQQQH

SEQ ID NO: 1888109 - protein, 24 aa, Staphylococcus
VKDNMRKARIEKLTQEEIHQQQHL

SEQ ID NO: 1888110 - protein, 20 aa, Staphylococcus
VKDRAKADVVAKSNEKQNEI

SEQ ID NO: 1888111 - protein, 19 aa, Staphylococcus
VKDTSAWIYNGGFYLISGM

SEQ ID NO: 1888112 - protein, 19 aa, Staphylococcus
VKECIPTLLGYAGVGISFG

SEQ ID NO: 1888113 - protein, 22 aa, Staphylococcus
VKECIPTLLGYVGIGLSFGIVA

SEQ ID NO: 1888114 - protein, 21 aa, Staphylococcus
VKEGLAKVAYVYPPNTRYLET

SEQ ID NO: 1888115 - protein, 21 aa, Staphylococcus
VKEKLSICVRIHSELDKGTVV

SEQ ID NO: 1888116 - protein, 21 aa, Staphylococcus
VKEKRIRPEDMHIMANIFLPK

SEQ ID NO: 1888117 - protein, 21 aa, Staphylococcus
VKEKRIRPEDMHIMANIFLPS

SEQ ID NO: 1888118 - protein, 25 aa, Staphylococcus
VKEMIRLDKYPSFITVDGGEGGTGA

SEQ ID NO: 1888119 - protein, 22 aa, Staphylococcus
VKENLRKARIEKLTQEEIQQQQ

SEQ ID NO: 1888120 - protein, 38 aa, Staphylococcus
VKESALKQLKAINVVAVVKPEARNTIANLVQKQIDKIN

SEQ ID NO: 1888121 - protein, 23 aa, Staphylococcus
VKESIKLSLAFMPGDIIKAIIAS

SEQ ID NO: 1888122 - protein, 21 aa, Staphylococcus
VKFSNQFLRTHVFQQKMISSF

SEQ ID NO: 1888123 - protein, 24 aa, Staphylococcus
VKFTRTPIVNVVNGRIVGYDEDGN

SEQ ID NO: 1888124 - protein, 27 aa, Staphylococcus
VKGLKMQLLTARSFDFSSYAKSRSEIS

SEQ ID NO: 1888125 - protein, 21 aa, Staphylococcus
VKGSDVEKAFEHSLSADTETQ

SEQ ID NO: 1888126 - protein, 23 aa, Staphylococcus
VKHPLFEYARSFDFIIVTDVGLI

SEQ ID NO: 1888127 - protein, 25 aa, Staphylococcus
VKHQWLDMMIMIPFMVPPYIGAMGW

SEQ ID NO: 1888128 - protein, 25 aa, Staphylococcus
VKIAISIYLAMVLLVCSSYLVLILV

SEQ ID NO: 1888129 - protein, 19 aa, Staphylococcus
VKIAVGIYLALVLLACSSY

SEQ ID NO: 1888130 - protein, 29 aa, Staphylococcus
VKIFVAPTMKFMKWRVAIQTENYDYVGRA

SEQ ID NO: 1888131 - protein, 21 aa, Staphylococcus
VKIIKYKGVDYLAITERIHTQ

SEQ ID NO: 1888132 - protein, 18 aa, Staphylococcus
VKIIREVDHMERLIPNVF

SEQ ID NO: 1888133 - protein, 18 aa, Staphylococcus
VKILESFIILPIVLPPTV

SEQ ID NO: 1888134 - protein, 18 aa, Staphylococcus
VKKAVTVPNYPSDKPAPK

SEQ ID NO: 1888135 - protein, 18 aa, Staphylococcus
VKKAVTVPNYPSNKPTPE

SEQ ID NO: 1888136 - protein, 24 aa, Staphylococcus
VKKHFFKATFVISMGILIIIHYTS

SEQ ID NO: 1888137 - protein, 22 aa, Staphylococcus
VKKKEVMASLQIPKDFDRKLKD

SEQ ID NO: 1888138 - protein, 18 aa, Staphylococcus
VKKPMSIPLVIILVILGI

SEQ ID NO: 1888139 - protein, 18 aa, Staphylococcus
VKLALAGMTVHLFFTSLT

SEQ ID NO: 1888140 - protein, 18 aa, Staphylococcus
VKLAQAFAGLSVGIGLSF

SEQ ID NO: 1888141 - protein, 20 aa, Staphylococcus
VKLDKGYGFKNFENGEKNSA

SEQ ID NO: 1888142 - protein, 17 aa, Staphylococcus
VKLFGLIGMLLALAAGR

SEQ ID NO: 1888143 - protein, 17 aa, Staphylococcus
VKLFLSGTLEAVFWMIN

SEQ ID NO: 1888144 - protein, 19 aa, Staphylococcus
VKLGCTFLIELIKANIDVI

SEQ ID NO: 1888145 - protein, 17 aa, Staphylococcus
VKLKQHKQTLEVIKPTK

SEQ ID NO: 1888146 - protein, 20 aa, Staphylococcus
VKLTIAAIFIFPFYILTVYF

SEQ ID NO: 1888147 - protein, 19 aa, Staphylococcus
VKLTLAAILIFPFYILTVY

SEQ ID NO: 1888148 - protein, 27 aa, Staphylococcus
VKLTNRFAVRPVLLWTLFTFIIGNGII

SEQ ID NO: 1888149 - protein, 27 aa, Staphylococcus
VKLTNRFAVRPVLLWTLVAFIIGNAMI

SEQ ID NO: 1888150 - protein, 24 aa, Staphylococcus
VKLTSDIFVWFRLVLNDTSDYHQI

SEQ ID NO: 1888151 - protein, 19 aa, Staphylococcus
VKMIFPTKHAIGLESKDGI

SEQ ID NO: 1888152 - protein, 36 aa, Staphylococcus
VKMLFHPFKTYYIFKKRVPFTPGLIPNRRKEIADKI

SEQ ID NO: 1888153 - protein, 35 aa, Staphylococcus
VKNIFKLDDTAAWAKRIIISIAFFVFYVFFIHITY

SEQ ID NO: 1888154 - protein, 18 aa, Staphylococcus
VKNIHDFHVWSVTSGLNA

SEQ ID NO: 1888155 - protein, 25 aa, Staphylococcus
VKNLKIIIVSGIIPFNIIKGIAVSA

SEQ ID NO: 1888156 - protein, 25 aa, Staphylococcus
VKNLKIVIVSGVIPFNIIKGIIISI

SEQ ID NO: 1888157 - protein, 18 aa, Staphylococcus
VKPLILGAIIMYLVGLID

SEQ ID NO: 1888158 - protein, 17 aa, Staphylococcus
VKPTLKKFLSFPLTQVV

SEQ ID NO: 1888159 - protein, 24 aa, Staphylococcus
VKPTLRKFISFPLTQVVNMGMQTV

SEQ ID NO: 1888160 - protein, 19 aa, Staphylococcus
VKPTWRKFIQFPFTQVVNM

SEQ ID NO: 1888161 - protein, 17 aa, Staphylococcus
VKPTWRKFIQFPLTQVV

SEQ ID NO: 1888162 - protein, 20 aa, Staphylococcus
VKPYKWRIIATILVGILKFG

SEQ ID NO: 1888163 - protein, 25 aa, Staphylococcus
VKPYKWRIVATIIIGIIKFGIPMLI

SEQ ID NO: 1888164 - protein, 20 aa, Staphylococcus
VKPYKYRIFATIIIGIIKFG

SEQ ID NO: 1888165 - protein, 26 aa, Staphylococcus
VKPYKYRIFATIVIGIIKFGIPMLIP

SEQ ID NO: 1888166 - protein, 20 aa, Staphylococcus
VKPYKYRIIATIIIGIIKFG

SEQ ID NO: 1888167 - protein, 19 aa, Staphylococcus
VKPYKYRIIATIIVGIIKF

SEQ ID NO: 1888168 - protein, 20 aa, Staphylococcus
VKPYRYRIIATIIVGIIKFG

SEQ ID NO: 1888169 - protein, 18 aa, Staphylococcus
VKQGEKLKKGDKVAEVVA

SEQ ID NO: 1888170 - protein, 17 aa, Staphylococcus
VKQNARDALHQLVEHQQ

SEQ ID NO: 1888171 - protein, 25 aa, Staphylococcus
VKQRPRMFFKVESFFYSHIDNALNL

SEQ ID NO: 1888172 - protein, 25 aa, Staphylococcus
VKQVFWRILLFYVLSIFVISAIIPY

SEQ ID NO: 1888173 - protein, 25 aa, Staphylococcus
VKQVFWRILLFYVLSIGVIAAIIPY

SEQ ID NO: 1888174 - protein, 21 aa, Staphylococcus
VKRKVKGNVLNKVNNSQKEID

SEQ ID NO: 1888175 - protein, 22 aa, Staphylococcus
VKRPKLKLFRRAFFLMIIGGLH

SEQ ID NO: 1888176 - protein, 23 aa, Staphylococcus
VKRRTKEFALFQLIGLTRGNILR

SEQ ID NO: 1888177 - protein, 27 aa, Staphylococcus
VKRTIIKIIGFMFIAFIVLLLLGILLF

SEQ ID NO: 1888178 - protein, 21 aa, Staphylococcus
VKRVKEAGGHIPVDLDALVKG

SEQ ID NO: 1888179 - protein, 18 aa, Staphylococcus
VKSIEFMLLISSMITCII

SEQ ID NO: 1888180 - protein, 19 aa, Staphylococcus
VKSTFFFKRQDITKVERLQ

SEQ ID NO: 1888181 - protein, 23 aa, Staphylococcus
VKSTIKFAYKVFEIYVLVKKYDS

SEQ ID NO: 1888182 - protein, 25 aa, Staphylococcus
VKSWKQKTFYHFDLPTSDHLEGNDQ

SEQ ID NO: 1888183 - protein, 28 aa, Staphylococcus
VKTAAKRLPWLIILTFLGMITATILGNF

SEQ ID NO: 1888184 - protein, 28 aa, Staphylococcus
VKTATKRLPWLIILTFLGMITATILGSF

SEQ ID NO: 1888185 - protein, 19 aa, Staphylococcus
VKTEAVKSLINDKEKQKDN

SEQ ID NO: 1888186 - protein, 20 aa, Staphylococcus
VKTIMAQKRFDVTYASNNGE

SEQ ID NO: 1888187 - protein, 18 aa, Staphylococcus
VKTIPWGTIIVFGVGISL

SEQ ID NO: 1888188 - protein, 25 aa, Staphylococcus
VKTKFKSVYPGAIFTSIVWLLGSFA

SEQ ID NO: 1888189 - protein, 26 aa, Staphylococcus
VKTKLRSVLPGALFTSIIWLVGSFLF

SEQ ID NO: 1888190 - protein, 25 aa, Staphylococcus
VKVAWEIIKAVIKISMEVILSTIVA

SEQ ID NO: 1888191 - protein, 25 aa, Staphylococcus
VKVEHVAHWGKLLVGAATMIGGVLL

SEQ ID NO: 1888192 - protein, 26 aa, Staphylococcus
VKVFKLSSYYLFNWFFIVYNIGVLTT

SEQ ID NO: 1888193 - protein, 23 aa, Staphylococcus
VKVKDMRNGYVVKKPKNATGYVI

SEQ ID NO: 1888194 - protein, 17 aa, Staphylococcus
VKVKIIIIIALLVMSIM

SEQ ID NO: 1888195 - protein, 19 aa, Staphylococcus
VKVKKERNGYMITKNKNDN

SEQ ID NO: 1888196 - protein, 17 aa, Staphylococcus
VKVLRGLPKLSDNLDNF

SEQ ID NO: 1888197 - protein, 32 aa, Staphylococcus
VKVNIGTLIGMRLRRVSPRKVIAPLIKAHKAG

SEQ ID NO: 1888198 - protein, 26 aa, Staphylococcus
VKWNTAQRMIITWIITLPISAILAAI

SEQ ID NO: 1888199 - protein, 26 aa, Staphylococcus
VKWNTAQRMIITWVITLPISALLAAL

SEQ ID NO: 1888200 - protein, 25 aa, Staphylococcus
VKWPEVIAITPWLVVAMIVTMLMGR

SEQ ID NO: 1888201 - protein, 27 aa, Staphylococcus
VKWSTAQRMVITWVITLPISALLAGIV

SEQ ID NO: 1888202 - protein, 26 aa, Staphylococcus
VKWSTAQRMVITWVITLPISAVLAAI

SEQ ID NO: 1888203 - protein, 17 aa, Staphylococcus
VKYVPKFILFISNYSFC

SEQ ID NO: 1888204 - protein, 17 aa, Staphylococcus
VKYYGDNDVKVYRTKDT

SEQ ID NO: 1888205 - protein, 17 aa, Staphylococcus
VLAICLMVYHTYFNQPK

SEQ ID NO: 1888206 - protein, 24 aa, Staphylococcus
VLAITVWIAIWWITEAIPIAATSF

SEQ ID NO: 1888207 - protein, 22 aa, Staphylococcus
VLAIYREMMAGSTLNPQTIKNS

SEQ ID NO: 1888208 - protein, 22 aa, Staphylococcus
VLALLICFLFGFGTFGTTPLLN

SEQ ID NO: 1888209 - protein, 26 aa, Staphylococcus
VLAPKWINYRRGVILAAVLSVVIMPW

SEQ ID NO: 1888210 - protein, 17 aa, Staphylococcus
VLASLPVDFRKLMILGA

SEQ ID NO: 1888211 - protein, 17 aa, Staphylococcus
VLASLTLLPAFISIFHK

SEQ ID NO: 1888212 - protein, 17 aa, Staphylococcus
VLCAVFVGPWYGLAQAL

SEQ ID NO: 1888213 - protein, 25 aa, Staphylococcus
VLCCIVITVLLFKPLGSFYDNLDGF

SEQ ID NO: 1888214 - protein, 21 aa, Staphylococcus
VLCVICILVTIGMGLTVFNKD

SEQ ID NO: 1888215 - protein, 18 aa, Staphylococcus
VLCYVSYRLASLDFVSEK

SEQ ID NO: 1888216 - protein, 23 aa, Staphylococcus
VLDAGDAFQGLPVSNKSKGEEMA

SEQ ID NO: 1888217 - protein, 31 aa, Staphylococcus
VLDGLSFLILYLLDLHLGYTFSGGFIDFFLL

SEQ ID NO: 1888218 - protein, 19 aa, Staphylococcus
VLDGLSFLTLYLLNLHLGY

SEQ ID NO: 1888219 - protein, 24 aa, Staphylococcus
VLDLLIVWYVLYLLITVFKGTKAI

SEQ ID NO: 1888220 - protein, 32 aa, Staphylococcus
VLDNAQMPFGRYYKLDIVGVIKDSAKASKDIT

SEQ ID NO: 1888221 - protein, 21 aa, Staphylococcus
VLDRLKGEFRNVGTVIQAYLY

SEQ ID NO: 1888222 - protein, 33 aa, Staphylococcus
VLDVFLLLFIMKFGFRKIEAIVGTLIFTVLIIF

SEQ ID NO: 1888223 - protein, 25 aa, Staphylococcus
VLEKKELESMLALLSNPLIDCVGSI

SEQ ID NO: 1888224 - protein, 19 aa, Staphylococcus
VLFALILFQFMFKVGNFSV

SEQ ID NO: 1888225 - protein, 17 aa, Staphylococcus
VLFICKEIFYPDSKNLN

SEQ ID NO: 1888226 - protein, 24 aa, Staphylococcus
VLFIICILLLIGPYFFFRSSVSLV

SEQ ID NO: 1888227 - protein, 22 aa, Staphylococcus
VLFKALMLYAREHNQHVYDKYQ

SEQ ID NO: 1888228 - protein, 26 aa, Staphylococcus
VLFLFNILRFVFAWFEARFHLNFGID

SEQ ID NO: 1888229 - protein, 18 aa, Staphylococcus
VLFSLVLFQGMFKLGHFS

SEQ ID NO: 1888230 - protein, 21 aa, Staphylococcus
VLFTYKWAYKVTHLIEQNIVM

SEQ ID NO: 1888231 - protein, 18 aa, Staphylococcus
VLFYIGIALLAYVLQVIF

SEQ ID NO: 1888232 - protein, 24 aa, Staphylococcus
VLGAAAGGVEWGTTIVTIITFIIL

SEQ ID NO: 1888233 - protein, 24 aa, Staphylococcus
VLGAAGGGVEWGSVLVTLITFLIL

SEQ ID NO: 1888234 - protein, 20 aa, Staphylococcus
VLGACYLIYLGVRSILSARQ

SEQ ID NO: 1888235 - protein, 19 aa, Staphylococcus
VLGAFKIGSIITDQANKGS

SEQ ID NO: 1888236 - protein, 21 aa, Staphylococcus
VLGAGVEWGTTIVTLVTFVIL

SEQ ID NO: 1888237 - protein, 20 aa, Staphylococcus
VLGFILYLFFGRTVSKRKME

SEQ ID NO: 1888238 - protein, 18 aa, Staphylococcus
VLGFLSPFLFLVSIAIKL

SEQ ID NO: 1888239 - protein, 32 aa, Staphylococcus
VLGGFIIHFASWRWIFFINIFIVIIAIPLMNK

SEQ ID NO: 1888240 - protein, 17 aa, Staphylococcus
VLGGVALAVIWMMLFLA

SEQ ID NO: 1888241 - protein, 19 aa, Staphylococcus
VLGIHPYFAFFPIVAILVI

SEQ ID NO: 1888242 - protein, 18 aa, Staphylococcus
VLGLIAAVWIIRPKLHYI

SEQ ID NO: 1888243 - protein, 24 aa, Staphylococcus
VLGRCLAIIIAILFWLGSDRSAYE

SEQ ID NO: 1888244 - protein, 25 aa, Staphylococcus
VLGSWKMLAIYLFAGIFGNFVSLSF

SEQ ID NO: 1888245 - protein, 25 aa, Staphylococcus
VLGTKEIDKVISYYKNIELGSGDIT

SEQ ID NO: 1888246 - protein, 22 aa, Staphylococcus
VLHKRIIFTILILVIYILGSNI

SEQ ID NO: 1888247 - protein, 20 aa, Staphylococcus
VLHLVFFWTLIPTIISIIHG

SEQ ID NO: 1888248 - protein, 18 aa, Staphylococcus
VLHYEGFTKIIVVLLVSP

SEQ ID NO: 1888249 - protein, 22 aa, Staphylococcus
VLIAVILIFSYQLFKTYLEDKA

SEQ ID NO: 1888250 - protein, 22 aa, Staphylococcus
VLICLPILLIIISILKGTPDSF

SEQ ID NO: 1888251 - protein, 18 aa, Staphylococcus
VLIFFISGIYKWNELDSQ

SEQ ID NO: 1888252 - protein, 17 aa, Staphylococcus
VLIFYSFLIYRRERNIQ

SEQ ID NO: 1888253 - protein, 20 aa, Staphylococcus
VLIIALIVFIVWFSLITPLD

SEQ ID NO: 1888254 - protein, 25 aa, Staphylococcus
VLIIKYFLKRIDVYKQIQFITHIPI

SEQ ID NO: 1888255 - protein, 24 aa, Staphylococcus
VLIIRLVLMPLMFIQVKNIHIMRG

SEQ ID NO: 1888256 - protein, 22 aa, Staphylococcus
VLIIVGIMFYLRSNKRKIVEEA

SEQ ID NO: 1888257 - protein, 25 aa, Staphylococcus
VLIPEARPALISGITVTAIALVGST

SEQ ID NO: 1888258 - protein, 24 aa, Staphylococcus
VLIPILGFIIYLFIGRQIQRDHIF

SEQ ID NO: 1888259 - protein, 23 aa, Staphylococcus
VLIQCVFIYFLIKSIIPYVVDFL

SEQ ID NO: 1888260 - protein, 25 aa, Staphylococcus
VLIQLPNCFEFIFVLFALFKIGAIP

SEQ ID NO: 1888261 - protein, 17 aa, Staphylococcus
VLISILLLTLISVGIYA

SEQ ID NO: 1888262 - protein, 17 aa, Staphylococcus
VLISLPIDFKKLMIIGS

SEQ ID NO: 1888263 - protein, 17 aa, Staphylococcus
VLITICLTKEKPEDQAI

SEQ ID NO: 1888264 - protein, 18 aa, Staphylococcus
VLITLAFLVVCNQPLSAA

SEQ ID NO: 1888265 - protein, 19 aa, Staphylococcus
VLITLFIRPLRHYAGYISL

SEQ ID NO: 1888266 - protein, 18 aa, Staphylococcus
VLKELSSQIKTHINDTNE

SEQ ID NO: 1888267 - protein, 21 aa, Staphylococcus
VLKFRIASFTLIEMLLTLFIT

SEQ ID NO: 1888268 - protein, 22 aa, Staphylococcus
VLKGRLTTRQIYLGKAGLFLLL

SEQ ID NO: 1888269 - protein, 33 aa, Staphylococcus
VLKHLDRYKHPGTWKNLDMGTGVGNSSIEVTVK

SEQ ID NO: 1888270 - protein, 25 aa, Staphylococcus
VLKKQNFADNAFLNELQKDTNYFKF

SEQ ID NO: 1888271 - protein, 26 aa, Staphylococcus
VLKKTVLRSIWFNVIQSLIIMVCVLV

SEQ ID NO: 1888272 - protein, 29 aa, Staphylococcus
VLKTGHSAWRYLIVTLYLAPYILFSLLIY

SEQ ID NO: 1888273 - protein, 18 aa, Staphylococcus
VLKWYRERPKGWQAKLAV

SEQ ID NO: 1888274 - protein, 22 aa, Staphylococcus
VLLCSIVALAIGSSWSTMATVG

SEQ ID NO: 1888275 - protein, 19 aa, Staphylococcus
VLLFFAFRTSGNIKIAHRL

SEQ ID NO: 1888276 - protein, 17 aa, Staphylococcus
VLLFITLIIPIFFFITA

SEQ ID NO: 1888277 - protein, 17 aa, Staphylococcus
VLLFVTLIIPIFFFIIA

SEQ ID NO: 1888278 - protein, 24 aa, Staphylococcus
VLLIIIIVPLTWLILNINDIKENM

SEQ ID NO: 1888279 - protein, 18 aa, Staphylococcus
VLLKGGLILMLFSYLLAF

SEQ ID NO: 1888280 - protein, 18 aa, Staphylococcus
VLLLVYFSFIDINGHFSF

SEQ ID NO: 1888281 - protein, 22 aa, Staphylococcus
VLLPAQLFTGLITDKTLANNRI

SEQ ID NO: 1888282 - protein, 18 aa, Staphylococcus
VLLPFMFGPIIASIIVIK

SEQ ID NO: 1888283 - protein, 17 aa, Staphylococcus
VLLPLVFISVLIGILNY

SEQ ID NO: 1888284 - protein, 18 aa, Staphylococcus
VLLSGCSNLEVFNAKGPV

SEQ ID NO: 1888285 - protein, 18 aa, Staphylococcus
VLLSGWFMNQFNGKKVFI

SEQ ID NO: 1888286 - protein, 18 aa, Staphylococcus
VLLSISVILNAVFKDATK

SEQ ID NO: 1888287 - protein, 17 aa, Staphylococcus
VLLSRYGQINNFELSLK

SEQ ID NO: 1888288 - protein, 17 aa, Staphylococcus
VLLVVTLIIPILFFIVA

SEQ ID NO: 1888289 - protein, 18 aa, Staphylococcus
VLMMEMYNKMGLDRSNLS

SEQ ID NO: 1888290 - protein, 19 aa, Staphylococcus
VLMSIVLTYMVWNFSPDLS

SEQ ID NO: 1888291 - protein, 18 aa, Staphylococcus
VLMVCIFLGSAITGLNRG

SEQ ID NO: 1888292 - protein, 17 aa, Staphylococcus
VLMYGMIIAIPVAIISG

SEQ ID NO: 1888293 - protein, 18 aa, Staphylococcus
VLMYVVGIWMHRRSNAQR

SEQ ID NO: 1888294 - protein, 31 aa, Staphylococcus
VLNAILIVIGYKFLSKRSMFLTIIATVLISV

SEQ ID NO: 1888295 - protein, 19 aa, Staphylococcus
VLNAYPWLTNKYIISLIGI

SEQ ID NO: 1888296 - protein, 17 aa, Staphylococcus
VLNFMLVYFSLKLLGYS

SEQ ID NO: 1888297 - protein, 22 aa, Staphylococcus
VLNIVGSWLFLLGIGLLYKTVG

SEQ ID NO: 1888298 - protein, 25 aa, Staphylococcus
VLNVRFYPWVKMWAMNIETLNKIFP

SEQ ID NO: 1888299 - protein, 18 aa, Staphylococcus
VLPEVDYDAARVVKDEDS

SEQ ID NO: 1888300 - protein, 24 aa, Staphylococcus
VLPGRFYLITVYKIIKLFLVFLIE

SEQ ID NO: 1888301 - protein, 24 aa, Staphylococcus
VLPKSIHYIPGFLGLFIASTGLIP

SEQ ID NO: 1888302 - protein, 22 aa, Staphylococcus
VLQEPWFLVILAFFSLLTGLII

SEQ ID NO: 1888303 - protein, 25 aa, Staphylococcus
VLQIVFKLPIIVSVVVALLLGILVG

SEQ ID NO: 1888304 - protein, 24 aa, Staphylococcus
VLQPRLKNQPGFFIYHTDLKHDWQ

SEQ ID NO: 1888305 - protein, 22 aa, Staphylococcus
VLREGVEVIIFYMGMIGSIKTQ

SEQ ID NO: 1888306 - protein, 18 aa, Staphylococcus
VLSFVTIPLGIVIGNGVI

SEQ ID NO: 1888307 - protein, 19 aa, Staphylococcus
VLSFYNWQMSAILFLIMPI

SEQ ID NO: 1888308 - protein, 23 aa, Staphylococcus
VLSGEWVSAAGFIGSIVAFLIGG

SEQ ID NO: 1888309 - protein, 26 aa, Staphylococcus
VLSGLSFSCAMAFSAACQIYLGHFIA

SEQ ID NO: 1888310 - protein, 27 aa, Staphylococcus
VLSISNWRMIFAFLTLIAFIVLIGIFL

SEQ ID NO: 1888311 - protein, 25 aa, Staphylococcus
VLSKGLDSGTAFEILSIDIADVDIG

SEQ ID NO: 1888312 - protein, 36 aa, Staphylococcus
VLSLCLFAGVLQWRAFRFYRFRHLRTFVMKLIISMV

SEQ ID NO: 1888313 - protein, 21 aa, Staphylococcus
VLSVSIGLIFGMMAGLMGRWF

SEQ ID NO: 1888314 - protein, 17 aa, Staphylococcus
VLSWIGNILHLLYLGFI

SEQ ID NO: 1888315 - protein, 27 aa, Staphylococcus
VLTAIAIVIVGFIFKPLMATFTAIALI

SEQ ID NO: 1888316 - protein, 27 aa, Staphylococcus
VLTAIALVILGFIFKPLVAGIAAAILF

SEQ ID NO: 1888317 - protein, 17 aa, Staphylococcus
VLTAYILTLMFYQVSHL

SEQ ID NO: 1888318 - protein, 18 aa, Staphylococcus
VLTDAQWTSILIEQILNN

SEQ ID NO: 1888319 - protein, 27 aa, Staphylococcus
VLTFKGALAPFTILFSLPYTIIGVVVA

SEQ ID NO: 1888320 - protein, 27 aa, Staphylococcus
VLTFKGGLAPFTILFSLPYTVIGVVLA

SEQ ID NO: 1888321 - protein, 17 aa, Staphylococcus
VLTIIGFGFVVAALAII

SEQ ID NO: 1888322 - protein, 30 aa, Staphylococcus
VLTIISSIFFPLSFLTGWYGMNFSYMPELD

SEQ ID NO: 1888323 - protein, 18 aa, Staphylococcus
VLTWIGFILHTLYVIFLV

SEQ ID NO: 1888324 - protein, 23 aa, Staphylococcus
VLTWSGIILHAVYFFILLLMSLI

SEQ ID NO: 1888325 - protein, 29 aa, Staphylococcus
VLVALAVYLFRFVWVYVLYPYFYLSVSPF

SEQ ID NO: 1888326 - protein, 24 aa, Staphylococcus
VLVFFVSGVYKWRELDSQFVEGIK

SEQ ID NO: 1888327 - protein, 18 aa, Staphylococcus
VLVFIIWIIFVHPGQFED

SEQ ID NO: 1888328 - protein, 20 aa, Staphylococcus
VLVFTGLPWSGFMGDKINKI

SEQ ID NO: 1888329 - protein, 21 aa, Staphylococcus
VLVIACPCALGLATPTSIMVG

SEQ ID NO: 1888330 - protein, 19 aa, Staphylococcus
VLVIVRRYNPMIVLGTSLL

SEQ ID NO: 1888331 - protein, 18 aa, Staphylococcus
VLVMHLFDIFKRRYNRYY

SEQ ID NO: 1888332 - protein, 25 aa, Staphylococcus
VLVSHIFLIFKRRYNKYYGDDAGDY

SEQ ID NO: 1888333 - protein, 25 aa, Staphylococcus
VLVSHIFLLFKRRYNKYYGDDAGQY

SEQ ID NO: 1888334 - protein, 20 aa, Staphylococcus
VLVSHIFLLFKRRYNRYYGE

SEQ ID NO: 1888335 - protein, 19 aa, Staphylococcus
VLVSHLFLLFKRRYNKYYG

SEQ ID NO: 1888336 - protein, 18 aa, Staphylococcus
VLVSTVFIRNQIYFEDHV

SEQ ID NO: 1888337 - protein, 28 aa, Staphylococcus
VLVTCLWFLFCVFIFQYIKLLFSKPKFK

SEQ ID NO: 1888338 - protein, 21 aa, Staphylococcus
VLVTGWQWRTLITIISTLLGT

SEQ ID NO: 1888339 - protein, 17 aa, Staphylococcus
VLWLYFRKSIPIRFDTE

SEQ ID NO: 1888340 - protein, 18 aa, Staphylococcus
VLYAWSPFYILTIFVMIW

SEQ ID NO: 1888341 - protein, 20 aa, Staphylococcus
VLYIILAFVIHRQIPESPVK

SEQ ID NO: 1888342 - protein, 23 aa, Staphylococcus
VLYRLTFVGSIFLAVIAILPILA

SEQ ID NO: 1888343 - protein, 22 aa, Staphylococcus
VMADRTPMRYALKAMMAGFLLS

SEQ ID NO: 1888344 - protein, 18 aa, Staphylococcus
VMAIIRVWFTMMKASFAM

SEQ ID NO: 1888345 - protein, 18 aa, Staphylococcus
VMAKRSFFHFSWNEYGLW

SEQ ID NO: 1888346 - protein, 25 aa, Staphylococcus
VMASTAWIAVWWITEAIPIPATSLM

SEQ ID NO: 1888347 - protein, 18 aa, Staphylococcus
VMATEFDIRVLLDAMYEL

SEQ ID NO: 1888348 - protein, 22 aa, Staphylococcus
VMAYGVSILGHIDFKNQNNLLI

SEQ ID NO: 1888349 - protein, 25 aa, Staphylococcus
VMDRCFKIFYKDKVMIFIIILVSTI

SEQ ID NO: 1888350 - protein, 29 aa, Staphylococcus
VMEGFLRLRLPNWLRRLITRSLAVIPVII

SEQ ID NO: 1888351 - protein, 19 aa, Staphylococcus
VMFAICWIAYIQWESTIAS

SEQ ID NO: 1888352 - protein, 19 aa, Staphylococcus
VMFAICWIAYIQWETTIAS

SEQ ID NO: 1888353 - protein, 25 aa, Staphylococcus
VMFRKKLYLFMSIFLPLAFYLLFTS

SEQ ID NO: 1888354 - protein, 22 aa, Staphylococcus
VMFVFQFFLNFFIPSGSGQALT

SEQ ID NO: 1888355 - protein, 25 aa, Staphylococcus
VMFVFRCLVVLLVFVGSVVKTETVW

SEQ ID NO: 1888356 - protein, 19 aa, Staphylococcus
VMFVLQFILNFFIPSGSGQ

SEQ ID NO: 1888357 - protein, 17 aa, Staphylococcus
VMGFILLIVFSPRSYIG

SEQ ID NO: 1888358 - protein, 18 aa, Staphylococcus
VMIACFLYLLFQGKLGSF

SEQ ID NO: 1888359 - protein, 35 aa, Staphylococcus
VMIGVPFGSFLGGFANWRFVFGVMILLAVITMLGM

SEQ ID NO: 1888360 - protein, 24 aa, Staphylococcus
VMIGVPFGSFLGGLANWRVVFGIM

SEQ ID NO: 1888361 - protein, 23 aa, Staphylococcus
VMIIISIVLVRQALLKMDNYVDN

SEQ ID NO: 1888362 - protein, 29 aa, Staphylococcus
VMIKGLGWQDIWLDLTIIVIFMLAFILLN

SEQ ID NO: 1888363 - protein, 20 aa, Staphylococcus
VMILLLWIAVRSYRDSVLTF

SEQ ID NO: 1888364 - protein, 18 aa, Staphylococcus
VMILPFIKQHEAYRILAD

SEQ ID NO: 1888365 - protein, 22 aa, Staphylococcus
VMKEPYTRYPIYDEDIDHVIGV

SEQ ID NO: 1888366 - protein, 25 aa, Staphylococcus
VMKTFKWMPHIGMNFNLYVDGLGLL

SEQ ID NO: 1888367 - protein, 19 aa, Staphylococcus
VMLAARILLESGAEGTRVE

SEQ ID NO: 1888368 - protein, 24 aa, Staphylococcus
VMLNFKIERHFLPIAVKYLLAHYG

SEQ ID NO: 1888369 - protein, 18 aa, Staphylococcus
VMLNRILKHLISAEDKGM

SEQ ID NO: 1888370 - protein, 20 aa, Staphylococcus
VMLPELFPMRARGAATGAAA

SEQ ID NO: 1888371 - protein, 20 aa, Staphylococcus
VMLPELFPMRARGAATGIAA

SEQ ID NO: 1888372 - protein, 18 aa, Staphylococcus
VMLPELFPTRARGAATGI

SEQ ID NO: 1888373 - protein, 19 aa, Staphylococcus
VMLPELFPTRARGAATGIA

SEQ ID NO: 1888374 - protein, 21 aa, Staphylococcus
VMLPHLMPAVIGGFFMALTYS

SEQ ID NO: 1888375 - protein, 20 aa, Staphylococcus
VMLSRILKRLLEAENEGTLA

SEQ ID NO: 1888376 - protein, 25 aa, Staphylococcus
VMLTIKWNRKYLLIVLMGIFIIGNL

SEQ ID NO: 1888377 - protein, 17 aa, Staphylococcus
VMLWAAFFALTFFIIYS

SEQ ID NO: 1888378 - protein, 17 aa, Staphylococcus
VMLWAAVFALTFFIIYA

SEQ ID NO: 1888379 - protein, 18 aa, Staphylococcus
VMMSHDLWESTKQSSNKR

SEQ ID NO: 1888380 - protein, 17 aa, Staphylococcus
VMPHLYFETSAVLITLI

SEQ ID NO: 1888381 - protein, 25 aa, Staphylococcus
VMPVLGFFIYIFFGRGIRKKRERGF

SEQ ID NO: 1888382 - protein, 20 aa, Staphylococcus
VMQEGFMKRLFGVHETAPVL

SEQ ID NO: 1888383 - protein, 24 aa, Staphylococcus
VMQRTRFCLAGGFRDMYVQKSNKM

SEQ ID NO: 1888384 - protein, 20 aa, Staphylococcus
VMQVVFKFPTIVSAVVALFL

SEQ ID NO: 1888385 - protein, 23 aa, Staphylococcus
VMRKGRTTLAIAHRLSTIQDADQ

SEQ ID NO: 1888386 - protein, 17 aa, Staphylococcus
VMRRIIQEYQDGQGNLK

SEQ ID NO: 1888387 - protein, 18 aa, Staphylococcus
VMSQGWWFPTMASAFLIF

SEQ ID NO: 1888388 - protein, 24 aa, Staphylococcus
VMSQGWWFPVMAAMFLSFTIAIMF

SEQ ID NO: 1888389 - protein, 24 aa, Staphylococcus
VMSTSGWIKMPFIAHLPLKQYSLE

SEQ ID NO: 1888390 - protein, 27 aa, Staphylococcus
VMTQGWWFPIMASMFLAFTIVIMLMVA

SEQ ID NO: 1888391 - protein, 20 aa, Staphylococcus
VMTQGWWLPVMASAFLIFTI

SEQ ID NO: 1888392 - protein, 18 aa, Staphylococcus
VMVVSIFALIIGLIIFIP

SEQ ID NO: 1888393 - protein, 22 aa, Staphylococcus
VMWILSLFTSFIGPLIIWLMKK

SEQ ID NO: 1888394 - protein, 18 aa, Staphylococcus
VNAFNWQAVFYIFGAVGI

SEQ ID NO: 1888395 - protein, 19 aa, Staphylococcus
VNAKLNFSIENKGHSSSNK

SEQ ID NO: 1888396 - protein, 26 aa, Staphylococcus
VNALKNLKIPLSIAGQGNQSSDDSNN

SEQ ID NO: 1888397 - protein, 23 aa, Staphylococcus
VNALQIRFILDWNSQAHRPQFEY

SEQ ID NO: 1888398 - protein, 23 aa, Staphylococcus
VNALQLRFILDWNSQSTRDNITY

SEQ ID NO: 1888399 - protein, 23 aa, Staphylococcus
VNALQLRFILDWNSQSTRDNLTY

SEQ ID NO: 1888400 - protein, 22 aa, Staphylococcus
VNDIKLFINDKVDERFDENKVY

SEQ ID NO: 1888401 - protein, 23 aa, Staphylococcus
VNEAGQLVGVFSLRDLITAENDS

SEQ ID NO: 1888402 - protein, 23 aa, Staphylococcus
VNEARDHALQELQNVAPDEVKKP

SEQ ID NO: 1888403 - protein, 19 aa, Staphylococcus
VNEAVPRGRILDRNGKVLV

SEQ ID NO: 1888404 - protein, 18 aa, Staphylococcus
VNEILSLHKDNEAIYEKC

SEQ ID NO: 1888405 - protein, 23 aa, Staphylococcus
VNEKRIRPEDMHIMANIFLPSNE

SEQ ID NO: 1888406 - protein, 21 aa, Staphylococcus
VNEKRIRPEDMHIMANIFLPT

SEQ ID NO: 1888407 - protein, 26 aa, Staphylococcus
VNFCSRIDAFYQYRPPLERILTNLLD

SEQ ID NO: 1888408 - protein, 17 aa, Staphylococcus
VNFFLLVIICMGLYSTL

SEQ ID NO: 1888409 - protein, 17 aa, Staphylococcus
VNFGWYYLLLVLFILIV

SEQ ID NO: 1888410 - protein, 21 aa, Staphylococcus
VNFSDGKSIIVPKGAKGDKGQ

SEQ ID NO: 1888411 - protein, 19 aa, Staphylococcus
VNFSDGKSIVVPKGAKGDK

SEQ ID NO: 1888412 - protein, 17 aa, Staphylococcus
VNGKWYDHLGIERSTRE

SEQ ID NO: 1888413 - protein, 18 aa, Staphylococcus
VNGVPYQVNIVMNKDDLQ

SEQ ID NO: 1888414 - protein, 20 aa, Staphylococcus
VNIAGTFNGIIGINDEPGKV

SEQ ID NO: 1888415 - protein, 27 aa, Staphylococcus
VNIASDIFIWFKLVLNDASDYHQIKED

SEQ ID NO: 1888416 - protein, 18 aa, Staphylococcus
VNIGKLFVIFLIRTIITL

SEQ ID NO: 1888417 - protein, 17 aa, Staphylococcus
VNIISWSLIIILSILNV

SEQ ID NO: 1888418 - protein, 17 aa, Staphylococcus
VNIIVAIIMFKSGDTSH

SEQ ID NO: 1888419 - protein, 20 aa, Staphylococcus
VNIPLKYPFVAAILTSCVLG

SEQ ID NO: 1888420 - protein, 19 aa, Staphylococcus
VNIVLTWLLYNSLKSEDNI

SEQ ID NO: 1888421 - protein, 20 aa, Staphylococcus
VNIVVALIMFKGGDTNHNLN

SEQ ID NO: 1888422 - protein, 17 aa, Staphylococcus
VNKHLKFIQPFIFIILG

SEQ ID NO: 1888423 - protein, 23 aa, Staphylococcus
VNKPGLVDLGFRSFQNARLELKH

SEQ ID NO: 1888424 - protein, 26 aa, Staphylococcus
VNKVKPVPVNFEFKVTKKLEGGQLKG

SEQ ID NO: 1888425 - protein, 19 aa, Staphylococcus
VNLAHEFMKTFQHKYILPA

SEQ ID NO: 1888426 - protein, 17 aa, Staphylococcus
VNLAHEFMKTYEHKYIL

SEQ ID NO: 1888427 - protein, 19 aa, Staphylococcus
VNLEFPLYMAIAVSLSGIV

SEQ ID NO: 1888428 - protein, 27 aa, Staphylococcus
VNLKFHSRFALDILLTISNHYNRNLRL

SEQ ID NO: 1888429 - protein, 34 aa, Staphylococcus
VNLLEGRAKPGYPKGYALESRPFLTDTAITNGGY

SEQ ID NO: 1888430 - protein, 22 aa, Staphylococcus
VNLPDVLIRWLSFIPITLFTAL

SEQ ID NO: 1888431 - protein, 19 aa, Staphylococcus
VNLPLILSVTVIVLGVVLA

SEQ ID NO: 1888432 - protein, 27 aa, Staphylococcus
VNLPLKVPFFAAICTSGILGAVIGANR

SEQ ID NO: 1888433 - protein, 26 aa, Staphylococcus
VNLPLKVPFFAAICTSSVLGAIIGAN

SEQ ID NO: 1888434 - protein, 35 aa, Staphylococcus
VNLQKELWKYIALIGVVVLIAIYLAVRSIKRTYIR

SEQ ID NO: 1888435 - protein, 17 aa, Staphylococcus
VNLRFKKPFIIACISGG

SEQ ID NO: 1888436 - protein, 19 aa, Staphylococcus
VNNAASFVRNDLPDIEQRL

SEQ ID NO: 1888437 - protein, 45 aa, Staphylococcus
VNNKQNIEGGFKLPQYIDRKTATQSGDYNLNYNVAGNEVNIPISV

SEQ ID NO: 1888438 - protein, 24 aa, Staphylococcus
VNPETRIGVILAPLWLIVLALMYR

SEQ ID NO: 1888439 - protein, 19 aa, Staphylococcus
VNPGHKWGLMLRSIAQILT

SEQ ID NO: 1888440 - protein, 21 aa, Staphylococcus
VNRINGVFFGQIFTVYFNEDY

SEQ ID NO: 1888441 - protein, 17 aa, Staphylococcus
VNRNIFWILLITLLVLF

SEQ ID NO: 1888442 - protein, 17 aa, Staphylococcus
VNRRIEVSLIGKNQLTI

SEQ ID NO: 1888443 - protein, 24 aa, Staphylococcus
VNSAFKIVFVITVALIIVSYIVGT

SEQ ID NO: 1888444 - protein, 18 aa, Staphylococcus
VNSPNRFDFIDSPEDLLQ

SEQ ID NO: 1888445 - protein, 35 aa, Staphylococcus
VNSQQTQIPLVWGPKVLPSYTYVTFDKTNNKIGAV

SEQ ID NO: 1888446 - protein, 20 aa, Staphylococcus
VNTSMDWDRKYPYGETLRSI

SEQ ID NO: 1888447 - protein, 17 aa, Staphylococcus
VNTYIAVACCAALVSPD

SEQ ID NO: 1888448 - protein, 17 aa, Staphylococcus
VNVEFPLYMAIIVMLFG

SEQ ID NO: 1888449 - protein, 19 aa, Staphylococcus
VNVWLSFLLLGFVFIVGPT

SEQ ID NO: 1888450 - protein, 23 aa, Staphylococcus
VNWAGWLLFFGIVFFSGSLYILA

SEQ ID NO: 1888451 - protein, 19 aa, Staphylococcus
VNYDARYAKDLGLSSDDIK

SEQ ID NO: 1888452 - protein, 19 aa, Staphylococcus
VNYRLKLQYNKILKLNILI

SEQ ID NO: 1888453 - protein, 27 aa, Staphylococcus
VPAIPAICVGIVLGFFAQIFVQGGSLT

SEQ ID NO: 1888454 - protein, 20 aa, Staphylococcus
VPALIGFIIGLIVYKVRGNK

SEQ ID NO: 1888455 - protein, 19 aa, Staphylococcus
VPAQPSVPVQPSVPAQPSV

SEQ ID NO: 1888456 - protein, 23 aa, Staphylococcus
VPASIIGLVVWFFAGRQFGGNTN

SEQ ID NO: 1888457 - protein, 21 aa, Staphylococcus
VPAVTMFITFIILYIILHKTI

SEQ ID NO: 1888458 - protein, 23 aa, Staphylococcus
VPDPEGIKFKMINEAGTATSNVY

SEQ ID NO: 1888459 - protein, 23 aa, Staphylococcus
VPDVRRPDYFKSMTQLFAHTKEG

SEQ ID NO: 1888460 - protein, 26 aa, Staphylococcus
VPENTYRANAITAINRAAAKQREQID

SEQ ID NO: 1888461 - protein, 21 aa, Staphylococcus
VPEPWLNGGDLGRDVINYYFK

SEQ ID NO: 1888462 - protein, 25 aa, Staphylococcus
VPETRMGVVLSPLWFILLGLIYLRY

SEQ ID NO: 1888463 - protein, 23 aa, Staphylococcus
VPFAEPFLPMIPKIGDNIQDSLK

SEQ ID NO: 1888464 - protein, 23 aa, Staphylococcus
VPFAEPFLPMIPKIGDNIQKSLK

SEQ ID NO: 1888465 - protein, 20 aa, Staphylococcus
VPFAYIFTCAVAFVTSTLGV

SEQ ID NO: 1888466 - protein, 24 aa, Staphylococcus
VPFFKKLHVTSAYEYLEARFGPSI

SEQ ID NO: 1888467 - protein, 23 aa, Staphylococcus
VPFFSFVVLMALGVDYAIFLVNR

SEQ ID NO: 1888468 - protein, 26 aa, Staphylococcus
VPFGDDWFAYFMRRLAERPQNLSLAF

SEQ ID NO: 1888469 - protein, 20 aa, Staphylococcus
VPFIYWLIVGISMWFFINEG

SEQ ID NO: 1888470 - protein, 19 aa, Staphylococcus
VPFSFNFKNINTIHIYEMI

SEQ ID NO: 1888471 - protein, 24 aa, Staphylococcus
VPFYSFILFPSIIFFFIMTHIVSN

SEQ ID NO: 1888472 - protein, 18 aa, Staphylococcus
VPGKSGGINKEYAGQMDV

SEQ ID NO: 1888473 - protein, 28 aa, Staphylococcus
VPHWFKQRTKQGFPFIAFLTTCIVAAVL

SEQ ID NO: 1888474 - protein, 19 aa, Staphylococcus
VPIFNEYTLYLSFVPILFL

SEQ ID NO: 1888475 - protein, 31 aa, Staphylococcus
VPIGTILGGWLGWRATFVFIIVISVLAAGLM

SEQ ID NO: 1888476 - protein, 32 aa, Staphylococcus
VPIGTMIGDWIGWRFTFVFIIVISLIAGLLML

SEQ ID NO: 1888477 - protein, 27 aa, Staphylococcus
VPIILFLLCLTVFKMKGVYAALTTLIV

SEQ ID NO: 1888478 - protein, 23 aa, Staphylococcus
VPIKDVQVGDHIVIKPGEKIPVD

SEQ ID NO: 1888479 - protein, 19 aa, Staphylococcus
VPISGWLMNQFNSKRVFIS

SEQ ID NO: 1888480 - protein, 22 aa, Staphylococcus
VPITNWRNKIGYVMQSNSMMSG

SEQ ID NO: 1888481 - protein, 25 aa, Staphylococcus
VPIVLFLLCLTIFKMKGIYASITTV

SEQ ID NO: 1888482 - protein, 17 aa, Staphylococcus
VPIVSLIGLMVLIIKDR

SEQ ID NO: 1888483 - protein, 22 aa, Staphylococcus
VPKELTEQYLAKGYSRNDRVGK

SEQ ID NO: 1888484 - protein, 17 aa, Staphylococcus
VPKKFKIFRNGGEEFSV

SEQ ID NO: 1888485 - protein, 23 aa, Staphylococcus
VPKKHIHEPWLFSLPAMIFAVML

SEQ ID NO: 1888486 - protein, 23 aa, Staphylococcus
VPKNMKNAVLATEDNRFYEHGAL

SEQ ID NO: 1888487 - protein, 19 aa, Staphylococcus
VPLFTGRMVDKFTGSQFNM

SEQ ID NO: 1888488 - protein, 24 aa, Staphylococcus
VPLGEIAIGLGLLFGIMSQIASFF

SEQ ID NO: 1888489 - protein, 17 aa, Staphylococcus
VPLLFIFTFMMISFIIT

SEQ ID NO: 1888490 - protein, 19 aa, Staphylococcus
VPLLVGALIAMRFKLSPLA

SEQ ID NO: 1888491 - protein, 18 aa, Staphylococcus
VPLMTYLIMFGLNMSNIH

SEQ ID NO: 1888492 - protein, 20 aa, Staphylococcus
VPLPTLFFGMFFNNLFFWCA

SEQ ID NO: 1888493 - protein, 22 aa, Staphylococcus
VPLSEVKEGDYLVIKPGEKIPV

SEQ ID NO: 1888494 - protein, 27 aa, Staphylococcus
VPLSFKIHILLGFTILACWPFTRLVHV

SEQ ID NO: 1888495 - protein, 18 aa, Staphylococcus
VPLYCSLLIPELSKEIYF

SEQ ID NO: 1888496 - protein, 17 aa, Staphylococcus
VPMIFGVIGIIAALITI

SEQ ID NO: 1888497 - protein, 20 aa, Staphylococcus
VPMKVVHEIQEFKVPKGIED

SEQ ID NO: 1888498 - protein, 27 aa, Staphylococcus
VPNIYRKFRSSDLISRMVNKVESLQNI

SEQ ID NO: 1888499 - protein, 19 aa, Staphylococcus
VPNNFKFDRLIIDNNKDGN

SEQ ID NO: 1888500 - protein, 29 aa, Staphylococcus
VPNNVSRLRFMFETFEKRSYESANGGRIL

SEQ ID NO: 1888501 - protein, 18 aa, Staphylococcus
VPPKRMASLLDIFACCAL

SEQ ID NO: 1888502 - protein, 19 aa, Staphylococcus
VPQALSNVVLKATEKDRAD

SEQ ID NO: 1888503 - protein, 24 aa, Staphylococcus
VPRGRILDRNGKILVDNASKKSIT

SEQ ID NO: 1888504 - protein, 24 aa, Staphylococcus
VPRGRILDRNGKILVDNASKLAIT

SEQ ID NO: 1888505 - protein, 25 aa, Staphylococcus
VPRGRILDRNGKVLVDNASKKAITY

SEQ ID NO: 1888506 - protein, 25 aa, Staphylococcus
VPRGRILDRNGKVLVDNASKLTITY

SEQ ID NO: 1888507 - protein, 23 aa, Staphylococcus
VPRKNIHEPWLFSIPAVILGLLI

SEQ ID NO: 1888508 - protein, 17 aa, Staphylococcus
VPSEIILTFAGLMSVKS

SEQ ID NO: 1888509 - protein, 19 aa, Staphylococcus
VPSGVLGLFGIVGYVSYYS

SEQ ID NO: 1888510 - protein, 20 aa, Staphylococcus
VPSGVLGLIGIVGYVSYYSI

SEQ ID NO: 1888511 - protein, 22 aa, Staphylococcus
VPSHLNLALTVFAFIMIISVIL

SEQ ID NO: 1888512 - protein, 20 aa, Staphylococcus
VPTKSIFKMSFKQLLFMAMT

SEQ ID NO: 1888513 - protein, 21 aa, Staphylococcus
VPVDYYVRVNMDAFVEAVDEL

SEQ ID NO: 1888514 - protein, 17 aa, Staphylococcus
VPVEFNFDTELFMVTLI

SEQ ID NO: 1888515 - protein, 21 aa, Staphylococcus
VPVFTGLFIWFSLIAISTLTT

SEQ ID NO: 1888516 - protein, 17 aa, Staphylococcus
VPVTIYVGPTTYRTTSD

SEQ ID NO: 1888517 - protein, 17 aa, Staphylococcus
VPVVLFIYFLTYISTTQ

SEQ ID NO: 1888518 - protein, 24 aa, Staphylococcus
VPVVMAASIALFFLNLAFAESDRP

SEQ ID NO: 1888519 - protein, 24 aa, Staphylococcus
VPVVMAASIALFFLNLAFAETDRP

SEQ ID NO: 1888520 - protein, 29 aa, Staphylococcus
VPWSFKLHIFLGFSIFALWPFTRLVHVWS

SEQ ID NO: 1888521 - protein, 27 aa, Staphylococcus
VPYGNDWFSYFMRRLAERPQNLSLAVK

SEQ ID NO: 1888522 - protein, 24 aa, Staphylococcus
VQARTRDAARNAVVQKVADQILTI

SEQ ID NO: 1888523 - protein, 26 aa, Staphylococcus
VQATPPRTFARFSSLSQPASTSSNAS

SEQ ID NO: 1888524 - protein, 25 aa, Staphylococcus
VQDGKLGANGGFLHISKSIRVYYDM

SEQ ID NO: 1888525 - protein, 19 aa, Staphylococcus
VQDKPKIGQWAFLSTQHLF

SEQ ID NO: 1888526 - protein, 18 aa, Staphylococcus
VQELKRKRNKLIISAILA

SEQ ID NO: 1888527 - protein, 18 aa, Staphylococcus
VQFFKKLLPVIPDVYRKF

SEQ ID NO: 1888528 - protein, 29 aa, Staphylococcus
VQFLVESVILCLIGGIIGLILGIGLATLI

SEQ ID NO: 1888529 - protein, 17 aa, Staphylococcus
VQFPELIIMGLCEGVVP

SEQ ID NO: 1888530 - protein, 17 aa, Staphylococcus
VQFPELIIMGLSEGVVP

SEQ ID NO: 1888531 - protein, 17 aa, Staphylococcus
VQHPIEIPMIWQGGIAI

SEQ ID NO: 1888532 - protein, 19 aa, Staphylococcus
VQKAVTVPDYPSSKGTPVV

SEQ ID NO: 1888533 - protein, 18 aa, Staphylococcus
VQKGFDMAFNKVPGTGYQ

SEQ ID NO: 1888534 - protein, 18 aa, Staphylococcus
VQLHSGKQVKAKLIGKDT

SEQ ID NO: 1888535 - protein, 19 aa, Staphylococcus
VQLLIYVPMTFFFTASVAL

SEQ ID NO: 1888536 - protein, 26 aa, Staphylococcus
VQLMPRYDSQNQVLGPVRKSNSYDQS

SEQ ID NO: 1888537 - protein, 19 aa, Staphylococcus
VQLPSFIIITVFILVLINL

SEQ ID NO: 1888538 - protein, 18 aa, Staphylococcus
VQLPSYIIIIVFLLVLIN

SEQ ID NO: 1888539 - protein, 22 aa, Staphylococcus
VQLPSYLIIIVFLFVLINLIIT

SEQ ID NO: 1888540 - protein, 17 aa, Staphylococcus
VQLSTWALGGFLMSLIG

SEQ ID NO: 1888541 - protein, 25 aa, Staphylococcus
VQMIQLRSLIAMSFILLSYTVLSKN

SEQ ID NO: 1888542 - protein, 33 aa, Staphylococcus
VQMVCIIVDILLYYPFYRTMEKYNLQLEQKEAD

SEQ ID NO: 1888543 - protein, 26 aa, Staphylococcus
VQNMLKWGLLVALGFVIIASFMLILH

SEQ ID NO: 1888544 - protein, 17 aa, Staphylococcus
VQPHLFDRFYKRNAEDN

SEQ ID NO: 1888545 - protein, 19 aa, Staphylococcus
VQPNKLVFKLVSGQLDPNK

SEQ ID NO: 1888546 - protein, 25 aa, Staphylococcus
VQRNSEFTPRWYVEYDGKWYAYKDG

SEQ ID NO: 1888547 - protein, 24 aa, Staphylococcus
VQRNSVFIPTWYVEYDGEWYVYQD

SEQ ID NO: 1888548 - protein, 18 aa, Staphylococcus
VQTFPIWLQKISKITPTY

SEQ ID NO: 1888549 - protein, 19 aa, Staphylococcus
VQVKRTWGDAIIKDSKEFA

SEQ ID NO: 1888550 - protein, 18 aa, Staphylococcus
VQWPEVWQAIVETLYMTV

SEQ ID NO: 1888551 - protein, 19 aa, Staphylococcus
VQWWHWMSHLLHFNLGTSF

SEQ ID NO: 1888552 - protein, 25 aa, Staphylococcus
VQYMSSWPWDWAKPMGSLMKDGSIS

SEQ ID NO: 1888553 - protein, 27 aa, Staphylococcus
VQYMSSWPWEWAKPMGALMKDGSISTI

SEQ ID NO: 1888554 - protein, 18 aa, Staphylococcus
VQYVSIPSNGRWYDHIGI

SEQ ID NO: 1888555 - protein, 18 aa, Staphylococcus
VRAQWIINKSEIKNSNVT

SEQ ID NO: 1888556 - protein, 17 aa, Staphylococcus
VRATKKAAAKQAIEAAL

SEQ ID NO: 1888557 - protein, 17 aa, Staphylococcus
VRDDHRFYPTQKEQSRL

SEQ ID NO: 1888558 - protein, 25 aa, Staphylococcus
VRDKPKPAQWAFLSLQHLFAMFGST

SEQ ID NO: 1888559 - protein, 18 aa, Staphylococcus
VRDTIKPVVNPISNQKKE

SEQ ID NO: 1888560 - protein, 18 aa, Staphylococcus
VREDHRFYPTKKEQNRLE

SEQ ID NO: 1888561 - protein, 23 aa, Staphylococcus
VREVMTLPSIKVVEHPDLFVESG

SEQ ID NO: 1888562 - protein, 22 aa, Staphylococcus
VRFAIICAIVILVIITVIRNKK

SEQ ID NO: 1888563 - protein, 18 aa, Staphylococcus
VRFKRPVIDLIEERMPNT

SEQ ID NO: 1888564 - protein, 21 aa, Staphylococcus
VRFLDAEALVLFNPYQMTKVS

SEQ ID NO: 1888565 - protein, 22 aa, Staphylococcus
VRGRLKFIIMSLIGIILFLMPI

SEQ ID NO: 1888566 - protein, 21 aa, Staphylococcus
VRHKIKPFKIFDKEKYRKTYV

SEQ ID NO: 1888567 - protein, 24 aa, Staphylococcus
VRKSHKIRVLGIYALGIVWFLQTI

SEQ ID NO: 1888568 - protein, 17 aa, Staphylococcus
VRLFKKRSFSAGTIAAF

SEQ ID NO: 1888569 - protein, 17 aa, Staphylococcus
VRNGLWFVKVVKMPLFR

SEQ ID NO: 1888570 - protein, 21 aa, Staphylococcus
VRNIKFIWLAIFFSILGLTQP

SEQ ID NO: 1888571 - protein, 23 aa, Staphylococcus
VRNKIFFTLAMLVIFKIGTYIPA

SEQ ID NO: 1888572 - protein, 25 aa, Staphylococcus
VRPEKRASAMALMFMGLSMSNILGV

SEQ ID NO: 1888573 - protein, 19 aa, Staphylococcus
VRRAFKNYDYRKVLSKGQH

SEQ ID NO: 1888574 - protein, 30 aa, Staphylococcus
VRRANDWFKRYGAWAVLLCRFIPVLRVLIT

SEQ ID NO: 1888575 - protein, 22 aa, Staphylococcus
VRREIASFVQPLGATINMDGTA

SEQ ID NO: 1888576 - protein, 17 aa, Staphylococcus
VRRLEKNQDGYRYYDFI

SEQ ID NO: 1888577 - protein, 18 aa, Staphylococcus
VRSYIPLYITSVAFWMIQ

SEQ ID NO: 1888578 - protein, 17 aa, Staphylococcus
VRTTRLAYEVLNRMSRY

SEQ ID NO: 1888579 - protein, 26 aa, Staphylococcus
VRVKLDKSFRIPLRMYMMNEEKMQST

SEQ ID NO: 1888580 - protein, 20 aa, Staphylococcus
VRYEASFFYYLFSKNAYIAH

SEQ ID NO: 1888581 - protein, 17 aa, Staphylococcus
VRYGYTAAFILVILQVI

SEQ ID NO: 1888582 - protein, 21 aa, Staphylococcus
VRYSNWHMVYFILTLLYILIA

SEQ ID NO: 1888583 - protein, 25 aa, Staphylococcus
VRYYYKDIIVCFVAVAFFNCTNYML

SEQ ID NO: 1888584 - protein, 18 aa, Staphylococcus
VSALCFATKISNVVVTYE

SEQ ID NO: 1888585 - protein, 19 aa, Staphylococcus
VSALDMLKKGTLEATAETR

SEQ ID NO: 1888586 - protein, 21 aa, Staphylococcus
VSALFPILLIVPLFDILMYFN

SEQ ID NO: 1888587 - protein, 19 aa, Staphylococcus
VSALICGTIALIINSSAYI

SEQ ID NO: 1888588 - protein, 20 aa, Staphylococcus
VSATLEFTASGNAKAAKEKA

SEQ ID NO: 1888589 - protein, 20 aa, Staphylococcus
VSCLIFLVFFLSVNQSAHSE

SEQ ID NO: 1888590 - protein, 17 aa, Staphylococcus
VSEGWIWTITLVGLITL

SEQ ID NO: 1888591 - protein, 20 aa, Staphylococcus
VSELSVLIASKVLQKEISEQ

SEQ ID NO: 1888592 - protein, 24 aa, Staphylococcus
VSFCILMFQSIYFVLVFWKLKNKK

SEQ ID NO: 1888593 - protein, 23 aa, Staphylococcus
VSFFIANIHYHFNLKENNDTKIM

SEQ ID NO: 1888594 - protein, 22 aa, Staphylococcus
VSFIVAALILKFTKEPEEDLEA

SEQ ID NO: 1888595 - protein, 17 aa, Staphylococcus
VSFKEKILTIVILTTVL

SEQ ID NO: 1888596 - protein, 26 aa, Staphylococcus
VSFREWRLIIISVLLLFFWSTEKILH

SEQ ID NO: 1888597 - protein, 23 aa, Staphylococcus
VSFSFWPLNEMKFGFNPDTDYGK

SEQ ID NO: 1888598 - protein, 17 aa, Staphylococcus
VSFVLTIASAVTFVDIW

SEQ ID NO: 1888599 - protein, 21 aa, Staphylococcus
VSFVVSALILKFTKDPKQDLA

SEQ ID NO: 1888600 - protein, 25 aa, Staphylococcus
VSGILCILSFLLAVSITFTDMFWYL

SEQ ID NO: 1888601 - protein, 25 aa, Staphylococcus
VSGILCLLSFLLVVSIMFTSMFWFL

SEQ ID NO: 1888602 - protein, 19 aa, Staphylococcus
VSGISWKILAPLFIAGIVI

SEQ ID NO: 1888603 - protein, 20 aa, Staphylococcus
VSGITWKILAPIFLTIMFVG

SEQ ID NO: 1888604 - protein, 21 aa, Staphylococcus
VSGLPSGVTFDSRTNTISGVA

SEQ ID NO: 1888605 - protein, 25 aa, Staphylococcus
VSGNLRLLSGMTFANNPLRLMQSMN

SEQ ID NO: 1888606 - protein, 31 aa, Staphylococcus
VSGSVGEMFRPFALAIAFSLLASLLVSITIV

SEQ ID NO: 1888607 - protein, 27 aa, Staphylococcus
VSGSVGEMFRPFALAITFSLLASLLVS

SEQ ID NO: 1888608 - protein, 17 aa, Staphylococcus
VSHKLGIVDQPNFRKVH

SEQ ID NO: 1888609 - protein, 19 aa, Staphylococcus
VSHLFTPYPWIKWLMYVVA

SEQ ID NO: 1888610 - protein, 26 aa, Staphylococcus
VSIAIKLESKGPIVFKQKRPGINNKI

SEQ ID NO: 1888611 - protein, 19 aa, Staphylococcus
VSIFMKFSTLKWFTPELSS

SEQ ID NO: 1888612 - protein, 19 aa, Staphylococcus
VSIFSRPVCGRLMDAKNEN

SEQ ID NO: 1888613 - protein, 29 aa, Staphylococcus
VSIGTFDWRSFKFIKKAPRTDAFVMILTV

SEQ ID NO: 1888614 - protein, 21 aa, Staphylococcus
VSIISFFIAFIFGYIVSLFVP

SEQ ID NO: 1888615 - protein, 20 aa, Staphylococcus
VSIISFLVAFIFSYLIRIVI

SEQ ID NO: 1888616 - protein, 18 aa, Staphylococcus
VSIISVAVANGWIQLSVW

SEQ ID NO: 1888617 - protein, 21 aa, Staphylococcus
VSIIVPEWILDFDNYDIEFDN

SEQ ID NO: 1888618 - protein, 17 aa, Staphylococcus
VSILFLGFIVFFFEMYI

SEQ ID NO: 1888619 - protein, 23 aa, Staphylococcus
VSILRRICIPAPVIGGLIFAILV

SEQ ID NO: 1888620 - protein, 24 aa, Staphylococcus
VSILSIIISWLFIKYIYPKKRKKR

SEQ ID NO: 1888621 - protein, 19 aa, Staphylococcus
VSIPGMMTGLIIGGTPPLE

SEQ ID NO: 1888622 - protein, 22 aa, Staphylococcus
VSIPGMMTGLIIGGVEPLQAVK

SEQ ID NO: 1888623 - protein, 19 aa, Staphylococcus
VSIPGMMTGLIIGGVLPLQ

SEQ ID NO: 1888624 - protein, 22 aa, Staphylococcus
VSIPGMMTGLIIGGVPPLQAIK

SEQ ID NO: 1888625 - protein, 20 aa, Staphylococcus
VSIRLKKEFETLSMFHVSID

SEQ ID NO: 1888626 - protein, 17 aa, Staphylococcus
VSISYHFILGVLLGEVL

SEQ ID NO: 1888627 - protein, 23 aa, Staphylococcus
VSKDIKTNVAMNWYFIAASVVVL

SEQ ID NO: 1888628 - protein, 17 aa, Staphylococcus
VSKIYAYIFTIGLYLVI

SEQ ID NO: 1888629 - protein, 17 aa, Staphylococcus
VSKIYAYLFTIGLYLVI

SEQ ID NO: 1888630 - protein, 19 aa, Staphylococcus
VSKKDYKAIAKELSISEDY

SEQ ID NO: 1888631 - protein, 20 aa, Staphylococcus
VSKLFPFVLIASSGGAYLAT

SEQ ID NO: 1888632 - protein, 25 aa, Staphylococcus
VSKNGTRYLIFDNMSFNAPTKQPVV

SEQ ID NO: 1888633 - protein, 17 aa, Staphylococcus
VSLCLTIISILLIFISL

SEQ ID NO: 1888634 - protein, 17 aa, Staphylococcus
VSLFLVIWFPASPFVII

SEQ ID NO: 1888635 - protein, 17 aa, Staphylococcus
VSLFPWERMIRIEQRHH

SEQ ID NO: 1888636 - protein, 27 aa, Staphylococcus
VSLFTSEAKIVFSIIFSLIILLAAIVG

SEQ ID NO: 1888637 - protein, 17 aa, Staphylococcus
VSLIAGIVAIIFLLLAR

SEQ ID NO: 1888638 - protein, 20 aa, Staphylococcus
VSLLCHMFLYTLTVHLTFFF

SEQ ID NO: 1888639 - protein, 17 aa, Staphylococcus
VSLLIIKSSWGITKSSL

SEQ ID NO: 1888640 - protein, 20 aa, Staphylococcus
VSLLLIKSVTAFFTKKLLEY

SEQ ID NO: 1888641 - protein, 19 aa, Staphylococcus
VSLSESISASTSDSTAESN

SEQ ID NO: 1888642 - protein, 19 aa, Staphylococcus
VSLTALFCGMFVVGAGGLA

SEQ ID NO: 1888643 - protein, 18 aa, Staphylococcus
VSLTALFCGMFVVGAGSL

SEQ ID NO: 1888644 - protein, 17 aa, Staphylococcus
VSLVIESLINFIIISCI

SEQ ID NO: 1888645 - protein, 35 aa, Staphylococcus
VSMCLKLSCSALLISGSMIGYGFASDMTAQAKETS

SEQ ID NO: 1888646 - protein, 21 aa, Staphylococcus
VSMLMTLWLVPLLSSKRARRL

SEQ ID NO: 1888647 - protein, 19 aa, Staphylococcus
VSMSGRTSSSDSMSTSIST

SEQ ID NO: 1888648 - protein, 19 aa, Staphylococcus
VSMTDYCYRNYKQYLEQAV

SEQ ID NO: 1888649 - protein, 25 aa, Staphylococcus
VSMTLINHWNFWLLAFGFVILVAPV

SEQ ID NO: 1888650 - protein, 19 aa, Staphylococcus
VSNIIPWKSITEEMTHLAN

SEQ ID NO: 1888651 - protein, 23 aa, Staphylococcus
VSNSFLKWFLRTIAGCGIFSAGL

SEQ ID NO: 1888652 - protein, 24 aa, Staphylococcus
VSNSIRVYFNLDKESGQRVSAIKI

SEQ ID NO: 1888653 - protein, 17 aa, Staphylococcus
VSPLHFKTGGLVDLSLA

SEQ ID NO: 1888654 - protein, 17 aa, Staphylococcus
VSPLHFSWMFAGVGITL

SEQ ID NO: 1888655 - protein, 20 aa, Staphylococcus
VSQFPEWMRKIAYVTPTYHL

SEQ ID NO: 1888656 - protein, 17 aa, Staphylococcus
VSQGWIWTVTAVGLITL

SEQ ID NO: 1888657 - protein, 28 aa, Staphylococcus
VSRLAEKVLGWLSWVFLLLLTVITMFIA

SEQ ID NO: 1888658 - protein, 28 aa, Staphylococcus
VSRLTEKLLGWISWIFLLILTVITMFIA

SEQ ID NO: 1888659 - protein, 30 aa, Staphylococcus
VSRLTEKVLGWLSWVFLLILTIVTMFIALV

SEQ ID NO: 1888660 - protein, 20 aa, Staphylococcus
VSRRSFLKMLGIGGAGVVIG

SEQ ID NO: 1888661 - protein, 19 aa, Staphylococcus
VSRTGSIIGTFIFPIILAA

SEQ ID NO: 1888662 - protein, 17 aa, Staphylococcus
VSSFSIYGGLLFGIIIA

SEQ ID NO: 1888663 - protein, 19 aa, Staphylococcus
VSSINWGMIGIFGAIFLVN

SEQ ID NO: 1888664 - protein, 18 aa, Staphylococcus
VSTAYALLFFDLIVVAIS

SEQ ID NO: 1888665 - protein, 18 aa, Staphylococcus
VSTAYALLFFDLIVVLIS

SEQ ID NO: 1888666 - protein, 19 aa, Staphylococcus
VSTESKINMPRKEATPDAP

SEQ ID NO: 1888667 - protein, 26 aa, Staphylococcus
VSTFVGWRSIFIISIIVALAAMYLMK

SEQ ID NO: 1888668 - protein, 25 aa, Staphylococcus
VSTILRILYMANIAAKITVGINIIN

SEQ ID NO: 1888669 - protein, 18 aa, Staphylococcus
VSTPIASWFYGKNFFTHT

SEQ ID NO: 1888670 - protein, 18 aa, Staphylococcus
VSVGSAIGVIPPIMVRTI

SEQ ID NO: 1888671 - protein, 28 aa, Staphylococcus
VSVKAFGEFEFWFALIKVVTIILMIIAG

SEQ ID NO: 1888672 - protein, 28 aa, Staphylococcus
VSVKAFGEFEFWFAMIKIVTIILMIIAG

SEQ ID NO: 1888673 - protein, 18 aa, Staphylococcus
VSVLFIFFKAPDLALTQF

SEQ ID NO: 1888674 - protein, 18 aa, Staphylococcus
VSVLFVFFKAPDLALTQF

SEQ ID NO: 1888675 - protein, 20 aa, Staphylococcus
VSVLLLRSSYGLIKDSLTIL

SEQ ID NO: 1888676 - protein, 23 aa, Staphylococcus
VSVNTGAYLKVSPAQTEYQANST

SEQ ID NO: 1888677 - protein, 19 aa, Staphylococcus
VSVSLLLYIIGVFVLGVVV

SEQ ID NO: 1888678 - protein, 23 aa, Staphylococcus
VSVSTLIGIIFGWVPARAAAKKE

SEQ ID NO: 1888679 - protein, 17 aa, Staphylococcus
VSWLRHVLAYLIGTGLL

SEQ ID NO: 1888680 - protein, 17 aa, Staphylococcus
VSWVRWILYVVALFLPL

SEQ ID NO: 1888681 - protein, 19 aa, Staphylococcus
VSYHAQWHLGLTLTIYAVF

SEQ ID NO: 1888682 - protein, 24 aa, Staphylococcus
VSYVTRLYAKWTIISLALLFWIGI

SEQ ID NO: 1888683 - protein, 20 aa, Staphylococcus
VTAFVTFSFVGPITRTLGYW

SEQ ID NO: 1888684 - protein, 41 aa, Staphylococcus
VTDPKIATIFVPKGSRYEIGRDLRKYFSLSNGQDIPTNTTF

SEQ ID NO: 1888685 - protein, 21 aa, Staphylococcus
VTEAFIKFNTFRGNTYHPKAN

SEQ ID NO: 1888686 - protein, 21 aa, Staphylococcus
VTELKPYILVVTVIAILATFI

SEQ ID NO: 1888687 - protein, 18 aa, Staphylococcus
VTEMFGIDLSHQLTQISG

SEQ ID NO: 1888688 - protein, 29 aa, Staphylococcus
VTFDSRTNIISGVATKVGTYPIVVTSTDA

SEQ ID NO: 1888689 - protein, 20 aa, Staphylococcus
VTFFGGDVLSIFGGAVITET

SEQ ID NO: 1888690 - protein, 19 aa, Staphylococcus
VTFLDIFKGFIVVFFPLLF

SEQ ID NO: 1888691 - protein, 18 aa, Staphylococcus
VTFLDIFKGFIVVFFPLW

SEQ ID NO: 1888692 - protein, 24 aa, Staphylococcus
VTFLLCIPALLPLYKALNMSRYLL

SEQ ID NO: 1888693 - protein, 17 aa, Staphylococcus
VTFSKGYVTVLMTLVAL

SEQ ID NO: 1888694 - protein, 27 aa, Staphylococcus
VTFVISFYFFRYLKFKNYATLLAAMLY

SEQ ID NO: 1888695 - protein, 19 aa, Staphylococcus
VTFVLRLTPYGIIAIMAST

SEQ ID NO: 1888696 - protein, 20 aa, Staphylococcus
VTFVLRLTPYGIIAIMASTI

SEQ ID NO: 1888697 - protein, 24 aa, Staphylococcus
VTFVLRLTPYGILAIMASTIATSD

SEQ ID NO: 1888698 - protein, 20 aa, Staphylococcus
VTFVLRLTPYGILAIMASTL

SEQ ID NO: 1888699 - protein, 20 aa, Staphylococcus
VTFVLRLTPYGILAIMSSTI

SEQ ID NO: 1888700 - protein, 20 aa, Staphylococcus
VTFVSAFIGLLGLIIVITLK

SEQ ID NO: 1888701 - protein, 20 aa, Staphylococcus
VTGICFLLALFFSPLIEIVT

SEQ ID NO: 1888702 - protein, 20 aa, Staphylococcus
VTGICFLLALFFSPLIEVVT

SEQ ID NO: 1888703 - protein, 17 aa, Staphylococcus
VTGILCYTLDHLYSNFN

SEQ ID NO: 1888704 - protein, 24 aa, Staphylococcus
VTGMTCAACSNRIEKKLNRLDHVT

SEQ ID NO: 1888705 - protein, 25 aa, Staphylococcus
VTHELPKASAQQVLVNGEIIVQRDE

SEQ ID NO: 1888706 - protein, 19 aa, Staphylococcus
VTHYYRNKRAKKWYLPFGY

SEQ ID NO: 1888707 - protein, 28 aa, Staphylococcus
VTIAGPLLEEFVFRKVIFGNIFEKLKGN

SEQ ID NO: 1888708 - protein, 24 aa, Staphylococcus
VTIAIICGLIWGSLLEERAYDKRS

SEQ ID NO: 1888709 - protein, 23 aa, Staphylococcus
VTIFCGYAFAGIVEKAGCLDVLL

SEQ ID NO: 1888710 - protein, 23 aa, Staphylococcus
VTIFCGYAFAGIVEKAGCLDVML

SEQ ID NO: 1888711 - protein, 23 aa, Staphylococcus
VTIFCGYAFAGIVEKSGCLDVML

SEQ ID NO: 1888712 - protein, 23 aa, Staphylococcus
VTIFCGYAFAGIVEKSGCLTVLL

SEQ ID NO: 1888713 - protein, 30 aa, Staphylococcus
VTIFCGYAFAGIVERAGCLDVILQKISKNI

SEQ ID NO: 1888714 - protein, 21 aa, Staphylococcus
VTIFCGYAFAGIVEVSGCLDV

SEQ ID NO: 1888715 - protein, 18 aa, Staphylococcus
VTIIFGFAFIQAALQLLM

SEQ ID NO: 1888716 - protein, 18 aa, Staphylococcus
VTIIFGFAFIQAAVQLLM

SEQ ID NO: 1888717 - protein, 17 aa, Staphylococcus
VTIKDHDDFTIDNGYFE

SEQ ID NO: 1888718 - protein, 24 aa, Staphylococcus
VTILYCIVKYTLTTTIEFHKVFSD

SEQ ID NO: 1888719 - protein, 22 aa, Staphylococcus
VTISQFRSGYTFTKPKGTSGYL

SEQ ID NO: 1888720 - protein, 23 aa, Staphylococcus
VTITGLLMIYAFNPPAAWLNNLL

SEQ ID NO: 1888721 - protein, 18 aa, Staphylococcus
VTITPGAVREVPIEGTTS

SEQ ID NO: 1888722 - protein, 24 aa, Staphylococcus
VTKEEKDAAILLVDDLIKQSEVRL

SEQ ID NO: 1888723 - protein, 27 aa, Staphylococcus
VTKIVLMVLMFIGRVGLISFIIMIAGR

SEQ ID NO: 1888724 - protein, 18 aa, Staphylococcus
VTLFLGWFPRGLFFFFAT

SEQ ID NO: 1888725 - protein, 19 aa, Staphylococcus
VTLIIPILFFIVAIMMFAR

SEQ ID NO: 1888726 - protein, 31 aa, Staphylococcus
VTLITFLILLALLKKFAWGPLKQVMDKREQD

SEQ ID NO: 1888727 - protein, 22 aa, Staphylococcus
VTLKCFFFLYQQKLRTIYQRLS

SEQ ID NO: 1888728 - protein, 24 aa, Staphylococcus
VTLLQMIVMPLIFISIVSAFSKIQ

SEQ ID NO: 1888729 - protein, 20 aa, Staphylococcus
VTLPLGRPFFTACIGGGIGG

SEQ ID NO: 1888730 - protein, 20 aa, Staphylococcus
VTLPVLFLILTRQKLKHPNQ

SEQ ID NO: 1888731 - protein, 17 aa, Staphylococcus
VTMPFHLEVSNMLVVLI

SEQ ID NO: 1888732 - protein, 17 aa, Staphylococcus
VTNFRFSLFTKITTSTY

SEQ ID NO: 1888733 - protein, 23 aa, Staphylococcus
VTNQLPIFIVMALYTGIYAVFAI

SEQ ID NO: 1888734 - protein, 25 aa, Staphylococcus
VTPIAALTFLLSLKFIKNVGTTRKV

SEQ ID NO: 1888735 - protein, 17 aa, Staphylococcus
VTQEAFGYIGLAVLAIA

SEQ ID NO: 1888736 - protein, 26 aa, Staphylococcus
VTQRFKAKSVLLWTLVTFIIGNLIIA

SEQ ID NO: 1888737 - protein, 25 aa, Staphylococcus
VTSDVKITFPEKGIYQINFNTEDDQ

SEQ ID NO: 1888738 - protein, 23 aa, Staphylococcus
VTSEYGNDIIFLFLGGFILAIAM

SEQ ID NO: 1888739 - protein, 25 aa, Staphylococcus
VTSFKLTGKRIFKMSPLHHHFELVG

SEQ ID NO: 1888740 - protein, 26 aa, Staphylococcus
VTSLPEYWLAIIFIYYFGVKWHLFPF

SEQ ID NO: 1888741 - protein, 26 aa, Staphylococcus
VTSLPEYWLAIIFIYYFGVKWHLLPF

SEQ ID NO: 1888742 - protein, 18 aa, Staphylococcus
VTSLSCILILMAFNLTST

SEQ ID NO: 1888743 - protein, 20 aa, Staphylococcus
VTSPEFIKQKWFGNQKTPVY

SEQ ID NO: 1888744 - protein, 33 aa, Staphylococcus
VTSYKIYEVRNGQEMYPSYYLDENNPNLVDVTD

SEQ ID NO: 1888745 - protein, 25 aa, Staphylococcus
VTTDPNTRVDLIDKNGHIIGTGTTD

SEQ ID NO: 1888746 - protein, 17 aa, Staphylococcus
VTTEVKPQAKAQILDVA

SEQ ID NO: 1888747 - protein, 19 aa, Staphylococcus
VTTTFCFVLIPLLTDAIKV

SEQ ID NO: 1888748 - protein, 19 aa, Staphylococcus
VTTTFCFVLIPLLTNAFRE

SEQ ID NO: 1888749 - protein, 20 aa, Staphylococcus
VTVILLIAILFKFNLAHVAT

SEQ ID NO: 1888750 - protein, 25 aa, Staphylococcus
VTVILLIAILFRFNLAHVATLASVT

SEQ ID NO: 1888751 - protein, 25 aa, Staphylococcus
VTVILLIAVLFRFNLAHVATLASVT

SEQ ID NO: 1888752 - protein, 23 aa, Staphylococcus
VTVVCCLMLVFAAGVASIVIIMV

SEQ ID NO: 1888753 - protein, 21 aa, Staphylococcus
VTWKSADLFDLDAITEVMEGI

SEQ ID NO: 1888754 - protein, 17 aa, Staphylococcus
VTWLKPFGLPVFTLPFI

SEQ ID NO: 1888755 - protein, 18 aa, Staphylococcus
VVAALMFRGGDTSHNLNM

SEQ ID NO: 1888756 - protein, 21 aa, Staphylococcus
VVAEFELFHGLTLAFISTLVI

SEQ ID NO: 1888757 - protein, 17 aa, Staphylococcus
VVAEILMGVIIGNSFLN

SEQ ID NO: 1888758 - protein, 18 aa, Staphylococcus
VVALIFIGLINFFVVKSR

SEQ ID NO: 1888759 - protein, 17 aa, Staphylococcus
VVARGAKPCIISMEGLE

SEQ ID NO: 1888760 - protein, 20 aa, Staphylococcus
VVAVALFLSMWFFAVMPILI

SEQ ID NO: 1888761 - protein, 30 aa, Staphylococcus
VVAVSEYFHRIFPRISYKIYVIIFTLISFI

SEQ ID NO: 1888762 - protein, 22 aa, Staphylococcus
VVAYLRARKAGAFKDVKQSFKS

SEQ ID NO: 1888763 - protein, 17 aa, Staphylococcus
VVCFLFFAVFGASAIYL

SEQ ID NO: 1888764 - protein, 25 aa, Staphylococcus
VVDKDGRLIGIISLKIDMENVEGMA

SEQ ID NO: 1888765 - protein, 23 aa, Staphylococcus
VVDKWEWLKWNPISMMNIMVQIV

SEQ ID NO: 1888766 - protein, 18 aa, Staphylococcus
VVEELFFRNVIIGELGKK

SEQ ID NO: 1888767 - protein, 17 aa, Staphylococcus
VVEELLFRHLLIHELGK

SEQ ID NO: 1888768 - protein, 18 aa, Staphylococcus
VVEEMVCRGLLMGYIEKK

SEQ ID NO: 1888769 - protein, 28 aa, Staphylococcus
VVEGDYFTVDFGKYIHPGTSRKPYRVNN

SEQ ID NO: 1888770 - protein, 18 aa, Staphylococcus
VVERKRIKSHPEVQKATH

SEQ ID NO: 1888771 - protein, 17 aa, Staphylococcus
VVFLPLAFVSGSVGEMF

SEQ ID NO: 1888772 - protein, 17 aa, Staphylococcus
VVFLPLVFVSGSVGEMF

SEQ ID NO: 1888773 - protein, 17 aa, Staphylococcus
VVFPISVAWLLINFNLH

SEQ ID NO: 1888774 - protein, 22 aa, Staphylococcus
VVFSDGRGLTIPKGAKGDKGDA

SEQ ID NO: 1888775 - protein, 20 aa, Staphylococcus
VVFVGWKFLSKTVAVYTVIS

SEQ ID NO: 1888776 - protein, 18 aa, Staphylococcus
VVFYRPLMISTFDATFSR

SEQ ID NO: 1888777 - protein, 17 aa, Staphylococcus
VVGAFVIHDYVLLGVSL

SEQ ID NO: 1888778 - protein, 24 aa, Staphylococcus
VVGAKWVFFSSFIVLLFPIYFLSL

SEQ ID NO: 1888779 - protein, 17 aa, Staphylococcus
VVGCIFAGAVHDYLTGM

SEQ ID NO: 1888780 - protein, 20 aa, Staphylococcus
VVGIFKFEWTFGEMSANFLL

SEQ ID NO: 1888781 - protein, 17 aa, Staphylococcus
VVGIVIYLLYGLKHSKK

SEQ ID NO: 1888782 - protein, 19 aa, Staphylococcus
VVGLICLGISHWFNSQDNT

SEQ ID NO: 1888783 - protein, 17 aa, Staphylococcus
VVGNLLGGVLFDKLGGY

SEQ ID NO: 1888784 - protein, 18 aa, Staphylococcus
VVGPRPALYNQYDLIAKR

SEQ ID NO: 1888785 - protein, 17 aa, Staphylococcus
VVIAAIFYFFLNRFNVP

SEQ ID NO: 1888786 - protein, 24 aa, Staphylococcus
VVIAVCLFLRVSTVPSMLISSLSA

SEQ ID NO: 1888787 - protein, 27 aa, Staphylococcus
VVIFFIWPTVQGWIFGIGGLVDKTGVI

SEQ ID NO: 1888788 - protein, 19 aa, Staphylococcus
VVIFICGVLKSGPPSSNQL

SEQ ID NO: 1888789 - protein, 25 aa, Staphylococcus
VVIFLMCVGNIYALEERKMKEKLTE

SEQ ID NO: 1888790 - protein, 25 aa, Staphylococcus
VVIFTLPIPMHFEFDSEVFMMAVIA

SEQ ID NO: 1888791 - protein, 21 aa, Staphylococcus
VVIGGACIRFGTGTLVGINTV

SEQ ID NO: 1888792 - protein, 22 aa, Staphylococcus
VVIIACAIYMFLQGKLGSLEMI

SEQ ID NO: 1888793 - protein, 28 aa, Staphylococcus
VVIIEAFSISSYVLWIFPPISDFMMMLN

SEQ ID NO: 1888794 - protein, 17 aa, Staphylococcus
VVIIWIAWIKPLASVNE

SEQ ID NO: 1888795 - protein, 22 aa, Staphylococcus
VVILCTIIALPLSYIMTKTSLS

SEQ ID NO: 1888796 - protein, 19 aa, Staphylococcus
VVILGPIVGFIPMAVLASV

SEQ ID NO: 1888797 - protein, 17 aa, Staphylococcus
VVINFKIFEKGIYYEKK

SEQ ID NO: 1888798 - protein, 17 aa, Staphylococcus
VVISIIWFSAFGVTGIT

SEQ ID NO: 1888799 - protein, 18 aa, Staphylococcus
VVISVIFGLSADWLQPII

SEQ ID NO: 1888800 - protein, 17 aa, Staphylococcus
VVIVQSFKLAGISDSKK

SEQ ID NO: 1888801 - protein, 18 aa, Staphylococcus
VVKDAKALDAKQAPKKDP

SEQ ID NO: 1888802 - protein, 27 aa, Staphylococcus
VVKFLKLNIKWPFWFSQVGLILLGVQI

SEQ ID NO: 1888803 - protein, 26 aa, Staphylococcus
VVKKAEARKAIDEAATLRKNLIDQDN

SEQ ID NO: 1888804 - protein, 23 aa, Staphylococcus
VVKSLEYYDRLQAKENRFLTFYD

SEQ ID NO: 1888805 - protein, 25 aa, Staphylococcus
VVKVLKLNIKWPFWISQIGLILLGV

SEQ ID NO: 1888806 - protein, 25 aa, Staphylococcus
VVKWIRERPKGWLLKLSANALGGTI

SEQ ID NO: 1888807 - protein, 26 aa, Staphylococcus
VVKYYRFNRMRTFIVKLMSALVIMSV

SEQ ID NO: 1888808 - protein, 28 aa, Staphylococcus
VVLIIRYLIYKFKPLKVIATDEEVTSPI

SEQ ID NO: 1888809 - protein, 17 aa, Staphylococcus
VVLILGTILFFYGGKPF

SEQ ID NO: 1888810 - protein, 25 aa, Staphylococcus
VVLIPIIIGFIFQKIAHQFAHKAAT

SEQ ID NO: 1888811 - protein, 20 aa, Staphylococcus
VVLIVWNLSTHLTFTLDNYI

SEQ ID NO: 1888812 - protein, 19 aa, Staphylococcus
VVLLAWIFLPKYLQYGVTT

SEQ ID NO: 1888813 - protein, 18 aa, Staphylococcus
VVLLAWIFLPKYLRYGVD

SEQ ID NO: 1888814 - protein, 20 aa, Staphylococcus
VVLRYWPFNKWEAGFNPGTF

SEQ ID NO: 1888815 - protein, 29 aa, Staphylococcus
VVLVTCCWFLFCVFIFQYIKLLFSNPKIK

SEQ ID NO: 1888816 - protein, 25 aa, Staphylococcus
VVLVVVGIVGFYLYHNATSFVTTDN

SEQ ID NO: 1888817 - protein, 18 aa, Staphylococcus
VVLYEMLIGKPPFSGETA

SEQ ID NO: 1888818 - protein, 17 aa, Staphylococcus
VVLYLKWDMAILKKEKL

SEQ ID NO: 1888819 - protein, 20 aa, Staphylococcus
VVMLAARILLESGAEGTRVE

SEQ ID NO: 1888820 - protein, 17 aa, Staphylococcus
VVMLFIFNLIRGIKLLS

SEQ ID NO: 1888821 - protein, 24 aa, Staphylococcus
VVNRVGELVGLVSLKINMPNIEGM

SEQ ID NO: 1888822 - protein, 26 aa, Staphylococcus
VVNSEMKANLSAFDKAERSMDQYKAK

SEQ ID NO: 1888823 - protein, 18 aa, Staphylococcus
VVQIPMPILAGIMVMVSI

SEQ ID NO: 1888824 - protein, 28 aa, Staphylococcus
VVRLKEAFEPLHFLGFYIDGVRMFTVIM

SEQ ID NO: 1888825 - protein, 17 aa, Staphylococcus
VVSDLGINTYPIITNHY

SEQ ID NO: 1888826 - protein, 33 aa, Staphylococcus; identical to SEQ ID NO: 1579452

SEQ ID NO: 1888827 - protein, 32 aa, Staphylococcus
VVSGNDNLYRIAIQYYGEGTVENVNKLKRANG

SEQ ID NO: 1888828 - protein, 20 aa, Staphylococcus
VVSILACIFANVGLTKIIMY

SEQ ID NO: 1888829 - protein, 31 aa, Staphylococcus
VVSKSYRKILNWSLNHKWIVLVISVVILVGS

SEQ ID NO: 1888830 - protein, 21 aa, Staphylococcus
VVSLILSFFINIEFKTTPIAI

SEQ ID NO: 1888831 - protein, 26 aa, Staphylococcus
VVSQYSWKVIFYILLVVTIIDLLFAL

SEQ ID NO: 1888832 - protein, 23 aa, Staphylococcus
VVSSCIMLPLGYMVGYFIGTRPH

SEQ ID NO: 1888833 - protein, 21 aa, Staphylococcus
VVSVLACIFANVGLTKIIMYS

SEQ ID NO: 1888834 - protein, 22 aa, Staphylococcus
VVTFVLRLTPYGILAIMASTIA

SEQ ID NO: 1888835 - protein, 20 aa, Staphylococcus
VVTFVVAFVFDYFNINNDRH

SEQ ID NO: 1888836 - protein, 18 aa, Staphylococcus
VVTLPKFFQNISPYLPFT

SEQ ID NO: 1888837 - protein, 24 aa, Staphylococcus
VVVAEILMGIIIGNSFLGLVHKDE

SEQ ID NO: 1888838 - protein, 24 aa, Staphylococcus
VVVAEILMGIIIGNSFLNLVTKDS

SEQ ID NO: 1888839 - protein, 28 aa, Staphylococcus
VVVAEILMGIVIGHSFLNIVERDSVLNI

SEQ ID NO: 1888840 - protein, 19 aa, Staphylococcus
VVVAFSFALFIKEPRNKNK

SEQ ID NO: 1888841 - protein, 18 aa, Staphylococcus
VVVASVWLSFSFSNITEQ

SEQ ID NO: 1888842 - protein, 17 aa, Staphylococcus
VVVGIMFYLRSSKRQVV

SEQ ID NO: 1888843 - protein, 28 aa, Staphylococcus
VVVGISLITFIIWIIFIHFGQFEPALLA

SEQ ID NO: 1888844 - protein, 37 aa, Staphylococcus
VVVGKVGSHSYAFVGLERVGGIMIYDITNPNEPYFVK

SEQ ID NO: 1888845 - protein, 22 aa, Staphylococcus
VVVIACAIYMFLEGKLGSFEMI

SEQ ID NO: 1888846 - protein, 21 aa, Staphylococcus
VVVLAMFAFFIFKYSYNKNDE

SEQ ID NO: 1888847 - protein, 23 aa, Staphylococcus
VVVPIIFAIILLKSSQGAFESSF

SEQ ID NO: 1888848 - protein, 18 aa, Staphylococcus
VVVSVAFLLVLIIVFKLN

SEQ ID NO: 1888849 - protein, 17 aa, Staphylococcus
VVVYPAFIALIITFIIL

SEQ ID NO: 1888850 - protein, 17 aa, Staphylococcus
VVVYVLLIIIGMQIIGL

SEQ ID NO: 1888851 - protein, 25 aa, Staphylococcus
VVYMIRIGLQIARLLSDLKGRIAVA

SEQ ID NO: 1888852 - protein, 18 aa, Staphylococcus
VVYYFLFDFAIRKFNLKT

SEQ ID NO: 1888853 - protein, 19 aa, Staphylococcus
VWAIILWIMYQKYKKESDK

SEQ ID NO: 1888854 - protein, 20 aa, Staphylococcus
VWELIKPRLVPSLEMGLTAM

SEQ ID NO: 1888855 - protein, 18 aa, Staphylococcus
VWFIILGLMYYRYKQMAK

SEQ ID NO: 1888856 - protein, 32 aa, Staphylococcus
VWFTMMKASFAMWKAVITAVWNAIKTVSIAIW

SEQ ID NO: 1888857 - protein, 35 aa, Staphylococcus
VWIGSLVISILLFFAFRTSNNFAIQHRVIASFGQM

SEQ ID NO: 1888858 - protein, 21 aa, Staphylococcus
VWSLIRPRLIPSMEMGITAMI

SEQ ID NO: 1888859 - protein, 18 aa, Staphylococcus
VWYARRVIKDPSKSVMNT

SEQ ID NO: 1888860 - protein, 21 aa, Staphylococcus
VYAEKLIQYGNRYRKDHNSVD

SEQ ID NO: 1888861 - protein, 18 aa, Staphylococcus
VYAVRSMPDEGVSYSTRS

SEQ ID NO: 1888862 - protein, 18 aa, Staphylococcus
VYFKHLIIAVPLVINGII

SEQ ID NO: 1888863 - protein, 28 aa, Staphylococcus
VYFVPSDNVKPVISFGNYNNHVVFSGET

SEQ ID NO: 1888864 - protein, 17 aa, Staphylococcus
VYIIMAIVAALCTVLYF

SEQ ID NO: 1888865 - protein, 18 aa, Staphylococcus
VYILLAFWILRAIPKSPY

SEQ ID NO: 1888866 - protein, 18 aa, Staphylococcus
VYILLRIRKWITQRNLIY

SEQ ID NO: 1888867 - protein, 17 aa, Staphylococcus
VYISLRLIFIVMIATVM

SEQ ID NO: 1888868 - protein, 17 aa, Staphylococcus
VYITLWFIIRKKETFKL

SEQ ID NO: 1888869 - protein, 19 aa, Staphylococcus
VYKHALKVFALATIILMIT

SEQ ID NO: 1888870 - protein, 19 aa, Staphylococcus
VYKRRKMVKEEGLALTSSI

SEQ ID NO: 1888871 - protein, 28 aa, Staphylococcus
VYLEDGSVRDEEWLQKKLNYISKKTYQG

SEQ ID NO: 1888872 - protein, 28 aa, Staphylococcus
VYLFMGLAIFCFVLYIAFGKYGNVTLGK

SEQ ID NO: 1888873 - protein, 17 aa, Staphylococcus
VYLIFSILLPLFFYLIF

SEQ ID NO: 1888874 - protein, 18 aa, Staphylococcus
VYLKHLIIAIPLIINGAI

SEQ ID NO: 1888875 - protein, 19 aa, Staphylococcus
VYLSVKFGHLQGFATEQQD

SEQ ID NO: 1888876 - protein, 19 aa, Staphylococcus
VYLSYKFYRKDYMVMKSFH

SEQ ID NO: 1888877 - protein, 19 aa, Staphylococcus
VYLVMGWVGVIFAPIIVLR

SEQ ID NO: 1888878 - protein, 27 aa, Staphylococcus
VYLWKTNDGFREACINAWNVIKTTVST

SEQ ID NO: 1888879 - protein, 21 aa, Staphylococcus
VYNIWEFLNAFFAEIIKVMSR

SEQ ID NO: 1888880 - protein, 18 aa, Staphylococcus
VYPAFLALIITFVLLVFS

SEQ ID NO: 1888881 - protein, 18 aa, Staphylococcus
VYPYEINIGLTIGVFGTI

SEQ ID NO: 1888882 - protein, 20 aa, Staphylococcus
VYPYEINIGLTIGVFGTIIF

SEQ ID NO: 1888883 - protein, 18 aa, Staphylococcus
VYPYEINIGLTLGVFGTF

SEQ ID NO: 1888884 - protein, 19 aa, Staphylococcus
VYQPTRYTLGRMNKIINIY

SEQ ID NO: 1888885 - protein, 18 aa, Staphylococcus
VYRRRKMVKEQGLAMTSG

SEQ ID NO: 1888886 - protein, 17 aa, Staphylococcus
VYRTYRVTKEVEINLLR

SEQ ID NO: 1888887 - protein, 25 aa, Staphylococcus
VYTDTKWCRMMIRQVLSNAVKYSEE

SEQ ID NO: 1888888 - protein, 22 aa, Staphylococcus
VYTFFIGMILKIFALYQGHHTV

SEQ ID NO: 1888889 - protein, 18 aa, Staphylococcus
VYVAVIVLLGFILLYYAL

SEQ ID NO: 1888890 - protein, 18 aa, Staphylococcus
VYVFLKVLMPIIIVFGVY

SEQ ID NO: 1888891 - protein, 19 aa, Staphylococcus
VYVNMQLIIGIIFVFITGP

SEQ ID NO: 1888892 - protein, 23 aa, Staphylococcus
VYVYLTLVAFNFISGVLTLPGLA

SEQ ID NO: 1888893 - protein, 17 aa, Staphylococcus
VYYHTWLDRLIRILTSA

SEQ ID NO: 1888894 - protein, 24 aa, Staphylococcus
VYYIIRFRMQAIIKQQALRQIKQE

SEQ ID NO: 1888895 - protein, 20 aa, Staphylococcus
VYYKTLLVITSIAFLVVLLL

SEQ ID NO: 1888896 - protein, 23 aa, Staphylococcus
VYYRDHTMVFFGIWIFIIIFEIY

SEQ ID NO: 1888897 - protein, 17 aa, Staphylococcus
VYYRELTKAYDFTGDTQ

SEQ ID NO: 1888898 - protein, 25 aa, Staphylococcus
WADFAKLGWKTVVVGIVILISTYIG

SEQ ID NO: 1888899 - protein, 18 aa, Staphylococcus
WAEASIVVILFAISEALE

SEQ ID NO: 1888900 - protein, 20 aa, Staphylococcus
WAESNASIIADFYKNMKTEG

SEQ ID NO: 1888901 - protein, 19 aa, Staphylococcus
WAESNATIIADFYKDMKTE

SEQ ID NO: 1888902 - protein, 18 aa, Staphylococcus
WAESNATIIADFYQEMKT

SEQ ID NO: 1888903 - protein, 21 aa, Staphylococcus
WAFFACTMIGLLVLAALIIDT

SEQ ID NO: 1888904 - protein, 17 aa, Staphylococcus
WAFGQIITFKAFGLVGS

SEQ ID NO: 1888905 - protein, 17 aa, Staphylococcus
WAGFGAAFGPLVVMSLY

SEQ ID NO: 1888906 - protein, 25 aa, Staphylococcus
WAGQDFRPAYIMTVVLMFTITFQLS

SEQ ID NO: 1888907 - protein, 20 aa, Staphylococcus
WAGVPTEVHVASEFVYNMPL

SEQ ID NO: 1888908 - protein, 19 aa, Staphylococcus
WAGVPTEVHVSSEFVYNTP

SEQ ID NO: 1888909 - protein, 18 aa, Staphylococcus
WAGWLLFLGVVFFSGSLY

SEQ ID NO: 1888910 - protein, 18 aa, Staphylococcus
WAIIIAFLIFGFILLTKM

SEQ ID NO: 1888911 - protein, 24 aa, Staphylococcus
WAIYSRPFLLFALVCNILGTIYGY

SEQ ID NO: 1888912 - protein, 25 aa, Staphylococcus
WALLGWKVAVVYFILLAIFSVLTGL

SEQ ID NO: 1888913 - protein, 20 aa, Staphylococcus
WALLGWKVAVVYFIVLAIFS

SEQ ID NO: 1888914 - protein, 19 aa, Staphylococcus
WALLGWKVAVVYFVVLAIF

SEQ ID NO: 1888915 - protein, 20 aa, Staphylococcus
WALSSVRLGQFFKKGYALQV

SEQ ID NO: 1888916 - protein, 18 aa, Staphylococcus
WALVLLQMVNFVLNSLNG

SEQ ID NO: 1888917 - protein, 18 aa, Staphylococcus
WATKMFIYSLNYLVVFFA

SEQ ID NO: 1888918 - protein, 21 aa, Staphylococcus
WATSFKLSYIVNLSYVLLMSV

SEQ ID NO: 1888919 - protein, 19 aa, Staphylococcus
WATVLMLPLGVGLGYCVGM

SEQ ID NO: 1888920 - protein, 37 aa, Staphylococcus
WDISLDYDYWRFILLMFMSIFGMVGWLIYSYNLWERK

SEQ ID NO: 1888921 - protein, 19 aa, Staphylococcus
WDLIQPRLIPSMEMGLTAM

SEQ ID NO: 1888922 - protein, 19 aa, Staphylococcus
WDLISPRLIPSLEMGLIAV

SEQ ID NO: 1888923 - protein, 24 aa, Staphylococcus
WDSIDNICTVVWIVLVIILSFKFL

SEQ ID NO: 1888924 - protein, 25 aa, Staphylococcus
WDVVTIRGVLTFIFLIVFMLVSNPK

SEQ ID NO: 1888925 - protein, 18 aa, Staphylococcus
WDYVLAITDLPIFHHRRV

SEQ ID NO: 1888926 - protein, 17 aa, Staphylococcus
WEFWGIKYGLFIQSIID

SEQ ID NO: 1888927 - protein, 21 aa, Staphylococcus
WEIIVSVLLSLIVMILLLWIA

SEQ ID NO: 1888928 - protein, 17 aa, Staphylococcus
WELSVQYSTLRFIVLMI

SEQ ID NO: 1888929 - protein, 17 aa, Staphylococcus
WERMIAIEQQKHTNYYK

SEQ ID NO: 1888930 - protein, 17 aa, Staphylococcus
WESIILDPLGPILALAA

SEQ ID NO: 1888931 - protein, 17 aa, Staphylococcus
WETIVPQLIFVILIAVY

SEQ ID NO: 1888932 - protein, 26 aa, Staphylococcus
WEVAKDLPWGVLILFGGGLALAKGIS

SEQ ID NO: 1888933 - protein, 26 aa, Staphylococcus
WEVAKELPWGVLILFGGGLALAKGIS

SEQ ID NO: 1888934 - protein, 24 aa, Staphylococcus
WFAQETMKWILIIGAVIILLYIIV

SEQ ID NO: 1888935 - protein, 17 aa, Staphylococcus
WFCTAFTGIIVYILLYV

SEQ ID NO: 1888936 - protein, 29 aa, Staphylococcus
WFFKQEKAEYLLGLLVLLGIALIQLVPPQ

SEQ ID NO: 1888937 - protein, 17 aa, Staphylococcus
WFFLIGIAYLYGTLGTL

SEQ ID NO: 1888938 - protein, 34 aa, Staphylococcus
WFIAILAVIVFRWKQLKFAYKEGVALVTTMQHRL

SEQ ID NO: 1888939 - protein, 17 aa, Staphylococcus
WFILLGLIYLRYTRKAR

SEQ ID NO: 1888940 - protein, 26 aa, Staphylococcus
WFNLAKPDIWITIIAGILYFLQAYVS

SEQ ID NO: 1888941 - protein, 25 aa, Staphylococcus
WFNLTKPDIWITIIAGVLYFVQAYV

SEQ ID NO: 1888942 - protein, 21 aa, Staphylococcus
WFPNIPNWMSALFCVLVLMSL

SEQ ID NO: 1888943 - protein, 18 aa, Staphylococcus
WFSIAYFCEGAGYIITGT

SEQ ID NO: 1888944 - protein, 20 aa, Staphylococcus
WFSLPQPFRFSTFSFDLGAT

SEQ ID NO: 1888945 - protein, 19 aa, Staphylococcus
WFSVFGVLGIEMGKKHSEL

SEQ ID NO: 1888946 - protein, 20 aa, Staphylococcus
WFVLDKEFTEGIKIMAYIGV

SEQ ID NO: 1888947 - protein, 18 aa, Staphylococcus
WFYNLSLSISFVLAQGLV

SEQ ID NO: 1888948 - protein, 17 aa, Staphylococcus
WGDDWTFVLAFIPWIMV

SEQ ID NO: 1888949 - protein, 20 aa, Staphylococcus
WGGPMARVASVLKVKSVNEL

SEQ ID NO: 1888950 - protein, 20 aa, Staphylococcus
WGGPMARVATVLKVKSVNEL

SEQ ID NO: 1888951 - protein, 19 aa, Staphylococcus
WGGPTARAISSLQLTTEEV

SEQ ID NO: 1888952 - protein, 19 aa, Staphylococcus
WGIASLLFKVNTLSHRLFM

SEQ ID NO: 1888953 - protein, 20 aa, Staphylococcus
WGILPIYWKLIGGVSAFEIL

SEQ ID NO: 1888954 - protein, 17 aa, Staphylococcus
WGILSGKMGFFYIITLV

SEQ ID NO: 1888955 - protein, 27 aa, Staphylococcus
WGLMAIGFICSLPFLSPLLGPGGVIGQ

SEQ ID NO: 1888956 - protein, 17 aa, Staphylococcus
WGLSGPMIQWLFQHSSI

SEQ ID NO: 1888957 - protein, 20 aa, Staphylococcus
WGLVEAFFWPAVLNGVVFYT

SEQ ID NO: 1888958 - protein, 24 aa, Staphylococcus
WGPLPNFMKILGLIITLVSIIWLV

SEQ ID NO: 1888959 - protein, 24 aa, Staphylococcus
WGQYFKIGIIITIPVLFITLLGLY

SEQ ID NO: 1888960 - protein, 21 aa, Staphylococcus
WGREAVKLIIAFLMALFVMTF

SEQ ID NO: 1888961 - protein, 18 aa, Staphylococcus
WGSILGYFGYGYMLGSLF

SEQ ID NO: 1888962 - protein, 19 aa, Staphylococcus
WGSLLFHLGIIPVFFGHVV

SEQ ID NO: 1888963 - protein, 26 aa, Staphylococcus
WGSVRSFTSFTFIKAIIFSIMFIILG

SEQ ID NO: 1888964 - protein, 17 aa, Staphylococcus
WGTIIVFGVGISLGNVL

SEQ ID NO: 1888965 - protein, 20 aa, Staphylococcus
WGTLFALAGSLCWSINTIVT

SEQ ID NO: 1888966 - protein, 18 aa, Staphylococcus
WGVILVVGWGMLIAGVFS

SEQ ID NO: 1888967 - protein, 18 aa, Staphylococcus
WHATLGIIIAIPVFVLVL

SEQ ID NO: 1888968 - protein, 19 aa, Staphylococcus
WHFPIIVLMNSYYVQGQIP

SEQ ID NO: 1888969 - protein, 24 aa, Staphylococcus
WHLFPFVGSNSWAYFVLPITILVL

SEQ ID NO: 1888970 - protein, 25 aa, Staphylococcus
WHLGLTLTIYAVFVILFAEVIPKSI

SEQ ID NO: 1888971 - protein, 18 aa, Staphylococcus
WHLLFIMSILGIFLSIAF

SEQ ID NO: 1888972 - protein, 24 aa, Staphylococcus
WHLLPFVGSYSFEYFILPIAILVL

SEQ ID NO: 1888973 - protein, 21 aa, Staphylococcus
WHVLPLGFLFGLGFDTASEIS

SEQ ID NO: 1888974 - protein, 23 aa, Staphylococcus
WIAALFWIIAGIMLLVRKNKDNH

SEQ ID NO: 1888975 - protein, 18 aa, Staphylococcus
WIAFTLIWFLLGIPVGPG

SEQ ID NO: 1888976 - protein, 17 aa, Staphylococcus
WIALWLMVYPLFERIKF

SEQ ID NO: 1888977 - protein, 25 aa, Staphylococcus
WIDKKEFMSVSGIYRMGYSDDYLAG

SEQ ID NO: 1888978 - protein, 18 aa, Staphylococcus
WIENDHFVLATGIFTKER

SEQ ID NO: 1888979 - protein, 18 aa, Staphylococcus
WIGACFTAYFGGQMSDWL

SEQ ID NO: 1888980 - protein, 17 aa, Staphylococcus
WIGITIIFGAFALFWFV

SEQ ID NO: 1888981 - protein, 21 aa, Staphylococcus
WIGVLCCRLYFHAHYITDVVG

SEQ ID NO: 1888982 - protein, 17 aa, Staphylococcus
WIGWSSMVVLWGITIWG

SEQ ID NO: 1888983 - protein, 17 aa, Staphylococcus
WIICLLIQVATRGLNKY

SEQ ID NO: 1888984 - protein, 25 aa, Staphylococcus
WIIGLPGLVVWQGFSIFIGTIQAYI

SEQ ID NO: 1888985 - protein, 18 aa, Staphylococcus
WIIRVISMVVMFIPLLAT

SEQ ID NO: 1888986 - protein, 17 aa, Staphylococcus
WIISIIVVIAIACSIIF

SEQ ID NO: 1888987 - protein, 24 aa, Staphylococcus
WIISIPGLIIWQGFSIFVGTIQAY

SEQ ID NO: 1888988 - protein, 25 aa, Staphylococcus
WIISIPGLIVWQAFSIFVGSIQAYI

SEQ ID NO: 1888989 - protein, 20 aa, Staphylococcus
WIISVFEVLSFFGFAFLLWQ

SEQ ID NO: 1888990 - protein, 17 aa, Staphylococcus
WILFFLMVFFLFIVLSA

SEQ ID NO: 1888991 - protein, 17 aa, Staphylococcus
WIMQRSAVEILFATLGL

SEQ ID NO: 1888992 - protein, 18 aa, Staphylococcus
WIMVFLRFVQGFTGGAGA

SEQ ID NO: 1888993 - protein, 17 aa, Staphylococcus
WIMVLAIFIINVFYVTF

SEQ ID NO: 1888994 - protein, 18 aa, Staphylococcus
WINGFSPQYSMSIWMGFN

SEQ ID NO: 1888995 - protein, 19 aa, Staphylococcus
WINGFSPQYTMSVWMGFNK

SEQ ID NO: 1888996 - protein, 30 aa, Staphylococcus
WINGFTPKYSMSVWMGFKEVKQYGTNSFVG

SEQ ID NO: 1888997 - protein, 35 aa, Staphylococcus
WINGFTPKYTMSIWMGFSEIKEGGVNSFLGHSEQE

SEQ ID NO: 1888998 - protein, 22 aa, Staphylococcus
WIRTASKFLPYLLLITIILHIA

SEQ ID NO: 1888999 - protein, 23 aa, Staphylococcus
WISHGQLRMDGSLNQVLPAFREH

SEQ ID NO: 1889000 - protein, 21 aa, Staphylococcus
WISHGQLRMEGSINQVIPKFR

SEQ ID NO: 1889001 - protein, 22 aa, Staphylococcus
WISIPARFILNIVRTIPDLLLA

SEQ ID NO: 1889002 - protein, 18 aa, Staphylococcus
WITFLFPMINWFVPKRYA

SEQ ID NO: 1889003 - protein, 24 aa, Staphylococcus
WIWADLPMPAAFAIAAILCPTDAV

SEQ ID NO: 1889004 - protein, 17 aa, Staphylococcus
WKAPAFNESKLQDPKPA

SEQ ID NO: 1889005 - protein, 22 aa, Staphylococcus
WKARIYCQFKVIFAPLMTIVVN

SEQ ID NO: 1889006 - protein, 24 aa, Staphylococcus
WKDLTRAGAVSGMIAGSLVVIIWI

SEQ ID NO: 1889007 - protein, 18 aa, Staphylococcus
WKENGASIVNAFKVIKVG

SEQ ID NO: 1889008 - protein, 17 aa, Staphylococcus
WKEPIFNLVLVNEPIHF

SEQ ID NO: 1889009 - protein, 19 aa, Staphylococcus
WKFLSKTVAVYTVISNTAL

SEQ ID NO: 1889010 - protein, 19 aa, Staphylococcus
WKGLHYFQRFFTDSRCVQI

SEQ ID NO: 1889011 - protein, 19 aa, Staphylococcus
WKISTKHVKNDNILITAIH

SEQ ID NO: 1889012 - protein, 19 aa, Staphylococcus
WKKKYVIGAGLGIAAIVIV

SEQ ID NO: 1889013 - protein, 20 aa, Staphylococcus
WKKQWLYQPYILIAIVLLFF

SEQ ID NO: 1889014 - protein, 18 aa, Staphylococcus
WKKVPAIPTLLVGSTIAI

SEQ ID NO: 1889015 - protein, 23 aa, Staphylococcus
WKLNPAGSISIMISLSVYVLLNN

SEQ ID NO: 1889016 - protein, 27 aa, Staphylococcus
WKLNPGGSIAIMISFAAFFVLNSAVNL

SEQ ID NO: 1889017 - protein, 17 aa, Staphylococcus
WKLTEIINFSDQQIFEQ

SEQ ID NO: 1889018 - protein, 18 aa, Staphylococcus
WKLTLLTFITIPIFVFIM

SEQ ID NO: 1889019 - protein, 21 aa, Staphylococcus
WKNIFNFKKIISVAFATGTYI

SEQ ID NO: 1889020 - protein, 21 aa, Staphylococcus
WKNIFNFKKIISVAFATGTYV

SEQ ID NO: 1889021 - protein, 22 aa, Staphylococcus
WKNKYYRYLFDFGKEDKELIKE

SEQ ID NO: 1889022 - protein, 18 aa, Staphylococcus
WKNLPLVEHSLEWFPMAI

SEQ ID NO: 1889023 - protein, 24 aa, Staphylococcus
WKNLTRTGALSGMIAGAVVVIIWI

SEQ ID NO: 1889024 - protein, 20 aa, Staphylococcus
WKNNETFRNFVISAWNAIKN

SEQ ID NO: 1889025 - protein, 24 aa, Staphylococcus
WKNPEKFNSYFIGDWYVSGDSAYK

SEQ ID NO: 1889026 - protein, 18 aa, Staphylococcus
WKPVPVIIGAVIFATIYW

SEQ ID NO: 1889027 - protein, 19 aa, Staphylococcus
WKRDGRLTHGYGTYNHGLE

SEQ ID NO: 1889028 - protein, 17 aa, Staphylococcus
WKSGLKTVIDMWFVILP

SEQ ID NO: 1889029 - protein, 19 aa, Staphylococcus
WKSPISWQITILMGGQSLI

SEQ ID NO: 1889030 - protein, 19 aa, Staphylococcus
WKVAVVYFIVLAIFSVLTG

SEQ ID NO: 1889031 - protein, 18 aa, Staphylococcus
WKYFSMIWDSVIFAAVIT

SEQ ID NO: 1889032 - protein, 18 aa, Staphylococcus
WKYVALLLVIQFIFAFIL

SEQ ID NO: 1889033 - protein, 18 aa, Staphylococcus
WKYVGILLVIQFIFAFLL

SEQ ID NO: 1889034 - protein, 18 aa, Staphylococcus
WLCNRKKQSLIIIKDTVN

SEQ ID NO: 1889035 - protein, 21 aa, Staphylococcus
WLDFPDIYLPFKDYVPSIHIG

SEQ ID NO: 1889036 - protein, 18 aa, Staphylococcus
WLDGRNEMHFSVGQFTQP

SEQ ID NO: 1889037 - protein, 17 aa, Staphylococcus
WLEDEFSGGGGYNPYTK

SEQ ID NO: 1889038 - protein, 17 aa, Staphylococcus
WLEPFGGIDGRKITHFP

SEQ ID NO: 1889039 - protein, 17 aa, Staphylococcus
WLFYFVLGFYIGKYYDA

SEQ ID NO: 1889040 - protein, 20 aa, Staphylococcus
WLGITFAVLITVTFAFVFNT

SEQ ID NO: 1889041 - protein, 17 aa, Staphylococcus
WLGLQLKSLDGVSPMII

SEQ ID NO: 1889042 - protein, 20 aa, Staphylococcus
WLGRYLRYFRNLARDAQKQP

SEQ ID NO: 1889043 - protein, 18 aa, Staphylococcus
WLIAAFIAALLMARNISI

SEQ ID NO: 1889044 - protein, 17 aa, Staphylococcus
WLIPTYLVMNIVFPLIL

SEQ ID NO: 1889045 - protein, 20 aa, Staphylococcus
WLIYSYNLWERKNPKTQKLY

SEQ ID NO: 1889046 - protein, 19 aa, Staphylococcus
WLKAGMHYIHVAPFLQNLI

SEQ ID NO: 1889047 - protein, 27 aa, Staphylococcus
WLKRYRQGPLEALWRKWTYKNVPKKVK

SEQ ID NO: 1889048 - protein, 17 aa, Staphylococcus
WLLNLVFGWSILHLFFN

SEQ ID NO: 1889049 - protein, 17 aa, Staphylococcus
WLLPALLIISIVDIIIS

SEQ ID NO: 1889050 - protein, 18 aa, Staphylococcus
WLLPIALVGIFAFSGLEM

SEQ ID NO: 1889051 - protein, 24 aa, Staphylococcus
WLMNGSARMIIRMFGVDPDANNDA

SEQ ID NO: 1889052 - protein, 17 aa, Staphylococcus
WLMVLAIFIINVAYVTC

SEQ ID NO: 1889053 - protein, 18 aa, Staphylococcus
WLMYGLLAYVFSQLSSTT

SEQ ID NO: 1889054 - protein, 18 aa, Staphylococcus
WLNILVKAIFCNFFINIG

SEQ ID NO: 1889055 - protein, 17 aa, Staphylococcus
WLNSRNIVPGYYGVNSI

SEQ ID NO: 1889056 - protein, 17 aa, Staphylococcus
WLPLALAGGSLIIFIVF

SEQ ID NO: 1889057 - protein, 21 aa, Staphylococcus
WLPQVPNWISVLFVVLVLIAF

SEQ ID NO: 1889058 - protein, 18 aa, Staphylococcus
WLPVMASAFLIFTIIIMF

SEQ ID NO: 1889059 - protein, 18 aa, Staphylococcus
WLQFPEVYIPFKDYTPSF

SEQ ID NO: 1889060 - protein, 21 aa, Staphylococcus
WLQNGIWAIIVYFIICLLISF

SEQ ID NO: 1889061 - protein, 17 aa, Staphylococcus
WLQNGVWAIIVYFIICL

SEQ ID NO: 1889062 - protein, 27 aa, Staphylococcus
WLQNWTIFYWAWWVSWAPFVGIFIARV

SEQ ID NO: 1889063 - protein, 18 aa, Staphylococcus
WLRKNEHIERIQFFEYVL

SEQ ID NO: 1889064 - protein, 17 aa, Staphylococcus
WLSGGFLGVDTFFVISG

SEQ ID NO: 1889065 - protein, 18 aa, Staphylococcus
WLSILATVIMAWVQLGGA

SEQ ID NO: 1889066 - protein, 17 aa, Staphylococcus
WLTIATIIFITMMLLLN

SEQ ID NO: 1889067 - protein, 20 aa, Staphylococcus
WLTPDDHYIHGKGIRPDVTI

SEQ ID NO: 1889068 - protein, 19 aa, Staphylococcus
WLTPFWDRVMAVVSIICYG

SEQ ID NO: 1889069 - protein, 20 aa, Staphylococcus
WLTYVFQIIIGLVFTAIYYF

SEQ ID NO: 1889070 - protein, 17 aa, Staphylococcus
WLVIGMAINITGASFLW

SEQ ID NO: 1889071 - protein, 17 aa, Staphylococcus
WLVIGMALNITGASFLW

SEQ ID NO: 1889072 - protein, 18 aa, Staphylococcus
WLVLIISIVILIASIGIG

SEQ ID NO: 1889073 - protein, 19 aa, Staphylococcus
WLVVMFILLVLAYRRAQVL

SEQ ID NO: 1889074 - protein, 19 aa, Staphylococcus
WLYEGELLLLLLKDESAYI

SEQ ID NO: 1889075 - protein, 17 aa, Staphylococcus
WLYETFGAKVLAIIGMS

SEQ ID NO: 1889076 - protein, 21 aa, Staphylococcus
WLYHRKKRWVKIVESFILLPI

SEQ ID NO: 1889077 - protein, 20 aa, Staphylococcus
WLYITCFIIIIGAEINAIIH

SEQ ID NO: 1889078 - protein, 19 aa, Staphylococcus
WLYVIDLICVMFATQPSIF

SEQ ID NO: 1889079 - protein, 19 aa, Staphylococcus
WMAQLKDGVPFTAGAFTTG

SEQ ID NO: 1889080 - protein, 19 aa, Staphylococcus
WMAQLKDGVPFTAGTFTTG

SEQ ID NO: 1889081 - protein, 26 aa, Staphylococcus
WMFLLQRITGVLAFIFIAIHFYQTKI

SEQ ID NO: 1889082 - protein, 25 aa, Staphylococcus
WMIDVFCILGAVAGTIGTIGFFGFQ

SEQ ID NO: 1889083 - protein, 17 aa, Staphylococcus
WMITLGLLLLMAVLLII

SEQ ID NO: 1889084 - protein, 19 aa, Staphylococcus
WMKKPKWIKPAYVELFCGA

SEQ ID NO: 1889085 - protein, 21 aa, Staphylococcus
WMKLVAVFTLGWLVIYAARTI

SEQ ID NO: 1889086 - protein, 18 aa, Staphylococcus
WMLATSFLVHGTLKFVDL

SEQ ID NO: 1889087 - protein, 17 aa, Staphylococcus
WMLIGFMIFGAISSLVA

SEQ ID NO: 1889088 - protein, 17 aa, Staphylococcus
WMLIIIIFIWNIMQWST

SEQ ID NO: 1889089 - protein, 17 aa, Staphylococcus
WMLVFGIIAVIVTIITG

SEQ ID NO: 1889090 - protein, 17 aa, Staphylococcus
WMLVFGIVAVIVTIITG

SEQ ID NO: 1889091 - protein, 36 aa, Staphylococcus
WMNGFTPKYTMSIWMGFSQIKPGGEDSFLGHSEQEY

SEQ ID NO: 1889092 - protein, 18 aa, Staphylococcus
WMPHFGMNFNLYVDGLGL

SEQ ID NO: 1889093 - protein, 26 aa, Staphylococcus
WMQNWTIFYWAWWISWAPFVGIFIAR

SEQ ID NO: 1889094 - protein, 20 aa, Staphylococcus
WMRKPKWVKPVFVEIFCGII

SEQ ID NO: 1889095 - protein, 18 aa, Staphylococcus
WMRRPKWIKPAYVEIFCG

SEQ ID NO: 1889096 - protein, 19 aa, Staphylococcus
WMRRPKWIKPAYVEIFCGF

SEQ ID NO: 1889097 - protein, 24 aa, Staphylococcus
WMSALFCVLVLMSLNLLSAKLFGE

SEQ ID NO: 1889098 - protein, 20 aa, Staphylococcus
WMSHLLHFNLGTSFQTNEPV

SEQ ID NO: 1889099 - protein, 18 aa, Staphylococcus
WMTITTLIMFTTIILFCL

SEQ ID NO: 1889100 - protein, 24 aa, Staphylococcus
WNAESFIVFRIIQGMSAGIITTLM

SEQ ID NO: 1889101 - protein, 25 aa, Staphylococcus
WNAIKIGAVLAWTGIKTAVMLIIQG

SEQ ID NO: 1889102 - protein, 31 aa, Staphylococcus
WNMNFAYDIGFQFSFIISFFILLSKPLFNNQ

SEQ ID NO: 1889103 - protein, 24 aa, Staphylococcus
WNMSCLNAGIGFGGIVGGLVISHI

SEQ ID NO: 1889104 - protein, 24 aa, Staphylococcus
WNMSCLNAGIGLGGIIGGLVVSNM

SEQ ID NO: 1889105 - protein, 18 aa, Staphylococcus
WNMSSLNAGIGIGGIVGG

SEQ ID NO: 1889106 - protein, 17 aa, Staphylococcus
WNPHVIGFWPFNQLIVA

SEQ ID NO: 1889107 - protein, 17 aa, Staphylococcus
WNQIMMILPCIVIAVIV

SEQ ID NO: 1889108 - protein, 24 aa, Staphylococcus
WNTAQRMIVTWVITLPISAIVAAI

SEQ ID NO: 1889109 - protein, 18 aa, Staphylococcus
WNVIKSVSIRIWNAIKNS

SEQ ID NO: 1889110 - protein, 19 aa, Staphylococcus
WNVMFYMMFILGLLAFLFG

SEQ ID NO: 1889111 - protein, 17 aa, Staphylococcus
WNWIAVIVYLVAMLLVG

SEQ ID NO: 1889112 - protein, 20 aa, Staphylococcus
WNWVAVIGYLVIMLLIGAYF

SEQ ID NO: 1889113 - protein, 17 aa, Staphylococcus
WNWVAVIVYLVLMLLVG

SEQ ID NO: 1889114 - protein, 19 aa, Staphylococcus
WPGFVLVIIGAVFWGVGGT

SEQ ID NO: 1889115 - protein, 21 aa, Staphylococcus
WPIGNLLPFYFMRNSYLAFIQ

SEQ ID NO: 1889116 - protein, 19 aa, Staphylococcus
WPISILVIIVIVLSLIFAP

SEQ ID NO: 1889117 - protein, 19 aa, Staphylococcus
WPPFKLKTQPPKALRATID

SEQ ID NO: 1889118 - protein, 24 aa, Staphylococcus
WPTKEELFKYTVIVVSTVLFFMAF

SEQ ID NO: 1889119 - protein, 20 aa, Staphylococcus
WPTVQSWIFNAGGLVEKTGA

SEQ ID NO: 1889120 - protein, 18 aa, Staphylococcus
WQFIMTWLPAPAKVTILG

SEQ ID NO: 1889121 - protein, 29 aa, Staphylococcus
WQMANNFSMWRLFGISIIAIIGMLIWIMM

SEQ ID NO: 1889122 - protein, 28 aa, Staphylococcus
WQMANNFSMWRLFGISIIAILGMLLWVM

SEQ ID NO: 1889123 - protein, 26 aa, Staphylococcus
WQMSIEFSNLRFLLITILAIGGMALW

SEQ ID NO: 1889124 - protein, 29 aa, Staphylococcus
WQMTWIILGAFSLILGLLVIFFMKENPPV

SEQ ID NO: 1889125 - protein, 17 aa, Staphylococcus
WQPNYSMISPTSQNYLD

SEQ ID NO: 1889126 - protein, 25 aa, Staphylococcus
WQSVIYVSVAFMFYGLALLLSHIVA

SEQ ID NO: 1889127 - protein, 18 aa, Staphylococcus
WQTAVSICEKALDDYMED

SEQ ID NO: 1889128 - protein, 18 aa, Staphylococcus
WQYTIGLTDLPIIKNKHV

SEQ ID NO: 1889129 - protein, 17 aa, Staphylococcus
WRAFMYPILIDKLGTKK

SEQ ID NO: 1889130 - protein, 20 aa, Staphylococcus
WRHIPDSLSNILFGLSYSGL

SEQ ID NO: 1889131 - protein, 20 aa, Staphylococcus
WRIAGCIIGALFVIGYLYWY

SEQ ID NO: 1889132 - protein, 19 aa, Staphylococcus
WRIAGCIIGTIFVVGYLYW

SEQ ID NO: 1889133 - protein, 19 aa, Staphylococcus
WRIGACVVGTIFVVCYLYW

SEQ ID NO: 1889134 - protein, 20 aa, Staphylococcus
WRIIATILVGILKFGIPMLI

SEQ ID NO: 1889135 - protein, 17 aa, Staphylococcus
WRILAPIFITVAILGSS

SEQ ID NO: 1889136 - protein, 20 aa, Staphylococcus
WRLLACYVTSVTVIIVALII

SEQ ID NO: 1889137 - protein, 28 aa, Staphylococcus
WRMLVIYFVSGLFGNFVSLSFNTSTISV

SEQ ID NO: 1889138 - protein, 17 aa, Staphylococcus
WRNKIGYVMQSNSMMSG

SEQ ID NO: 1889139 - protein, 23 aa, Staphylococcus
WRQERLDTPLLSFKVFKNKEFAV

SEQ ID NO: 1889140 - protein, 17 aa, Staphylococcus
WRTAITIASTLVGTFLC

SEQ ID NO: 1889141 - protein, 19 aa, Staphylococcus
WRVPFIIIVGIALIAFIFG

SEQ ID NO: 1889142 - protein, 20 aa, Staphylococcus
WRYLIVVLACCIWYFYKDEI

SEQ ID NO: 1889143 - protein, 20 aa, Staphylococcus
WSAPSFKNLFLPKGKLSSLV

SEQ ID NO: 1889144 - protein, 20 aa, Staphylococcus
WSATFFKNLFAPNGPLSALV

SEQ ID NO: 1889145 - protein, 18 aa, Staphylococcus
WSEGFSRHNMQTMMNNKL

SEQ ID NO: 1889146 - protein, 19 aa, Staphylococcus
WSFYGDLLIILPLSLWGME

SEQ ID NO: 1889147 - protein, 21 aa, Staphylococcus
WSFYGNLLIMLPMSIWAMERF

SEQ ID NO: 1889148 - protein, 17 aa, Staphylococcus
WSGINFNSPFADMAILL

SEQ ID NO: 1889149 - protein, 20 aa, Staphylococcus
WSGLCILIGLFIANWKIGLG

SEQ ID NO: 1889150 - protein, 21 aa, Staphylococcus
WSGNLAVFVLFGFYSVVGGWI

SEQ ID NO: 1889151 - protein, 21 aa, Staphylococcus
WSIIFLCLLFLLNIFSVKAFG

SEQ ID NO: 1889152 - protein, 18 aa, Staphylococcus
WSIILSLLIWLGYMAFAI

SEQ ID NO: 1889153 - protein, 24 aa, Staphylococcus
WSILYFKKKVRGIAFIESIMLFIS

SEQ ID NO: 1889154 - protein, 19 aa, Staphylococcus
WSITNKPSYVSFNQSNGII

SEQ ID NO: 1889155 - protein, 17 aa, Staphylococcus
WSLEITRAISGGIGIVL

SEQ ID NO: 1889156 - protein, 18 aa, Staphylococcus
WSLEITRALTGGIGIVLT

SEQ ID NO: 1889157 - protein, 21 aa, Staphylococcus
WSLPAFKALFEKGGALSALVV

SEQ ID NO: 1889158 - protein, 22 aa, Staphylococcus
WSLPAFKGLFEKGGALSALVVN

SEQ ID NO: 1889159 - protein, 26 aa, Staphylococcus
WSLTFVMPVTMPFYIHLTNILVILGG

SEQ ID NO: 1889160 - protein, 17 aa, Staphylococcus
WSLVQFIALPMILINSI

SEQ ID NO: 1889161 - protein, 25 aa, Staphylococcus
WSLWRTRPVTLQSYRPMSAKKQIGF

SEQ ID NO: 1889162 - protein, 19 aa, Staphylococcus
WSMVLAIFVINVFYVTFLT

SEQ ID NO: 1889163 - protein, 19 aa, Staphylococcus
WSMVLGYIVCQMLGGIFGG

SEQ ID NO: 1889164 - protein, 18 aa, Staphylococcus
WSPFVGTFIARISKGRSI

SEQ ID NO: 1889165 - protein, 17 aa, Staphylococcus
WSSPIVVISLILGVIFI

SEQ ID NO: 1889166 - protein, 27 aa, Staphylococcus
WSSPSFKGLFLPKGKLSSLVFNFNLPG

SEQ ID NO: 1889167 - protein, 28 aa, Staphylococcus
WSSPSFKGLFLPKGKLSSLVLNFSLPGT

SEQ ID NO: 1889168 - protein, 19 aa, Staphylococcus
WSSSFFKGLFEKKGLLHSL

SEQ ID NO: 1889169 - protein, 28 aa, Staphylococcus
WSVLKSKWLRPTLIIGCTFAILQQFIGI

SEQ ID NO: 1889170 - protein, 21 aa, Staphylococcus
WSVLMSIALYFIMIKVMPPER

SEQ ID NO: 1889171 - protein, 17 aa, Staphylococcus
WTAGFAFSAGLIDFVLS

SEQ ID NO: 1889172 - protein, 17 aa, Staphylococcus
WTAGFAFSAGLIDYSLS

SEQ ID NO: 1889173 - protein, 18 aa, Staphylococcus
WTAGFSFSAGLIDFVLSL

SEQ ID NO: 1889174 - protein, 17 aa, Staphylococcus
WTAGFSFSAGLIDYILS

SEQ ID NO: 1889175 - protein, 18 aa, Staphylococcus
WTAGFSFSAGLIDYVLSL

SEQ ID NO: 1889176 - protein, 20 aa, Staphylococcus
WTAPKIAHKLAVEQKITTEN

SEQ ID NO: 1889177 - protein, 17 aa, Staphylococcus
WTGPSVIFAYLIVGLFL

SEQ ID NO: 1889178 - protein, 20 aa, Staphylococcus
WTGRLIDFFSLLPNTVPGII

SEQ ID NO: 1889179 - protein, 17 aa, Staphylococcus
WTIMFISFIVFIGFDLI

SEQ ID NO: 1889180 - protein, 17 aa, Staphylococcus
WTIYQAGALAILASALG

SEQ ID NO: 1889181 - protein, 19 aa, Staphylococcus
WTKGFKQLIVLSIIIGELS

SEQ ID NO: 1889182 - protein, 23 aa, Staphylococcus
WTMAICLYVGIYTGALVRHTKSS

SEQ ID NO: 1889183 - protein, 19 aa, Staphylococcus
WTNIIGWSGNLAVFVLFGF

SEQ ID NO: 1889184 - protein, 19 aa, Staphylococcus
WTPFGELFAGVFMGLIIIL

SEQ ID NO: 1889185 - protein, 28 aa, Staphylococcus
WTPMAGIPAWVWSCIFIVIIFALNSLSV

SEQ ID NO: 1889186 - protein, 28 aa, Staphylococcus
WTPMAGIPAWVWSCIFLVIIFALNSLSV

SEQ ID NO: 1889187 - protein, 19 aa, Staphylococcus
WTTIPASLIGMIVWFVLGL

SEQ ID NO: 1889188 - protein, 21 aa, Staphylococcus
WTTPGPLGIVMGTGFAFWSFV

SEQ ID NO: 1889189 - protein, 25 aa, Staphylococcus
WTVPCYLCAILAVFYGFTGIGIKKN

SEQ ID NO: 1889190 - protein, 24 aa, Staphylococcus
WTVPCYLCAVLAIIYGFTGIGIRK

SEQ ID NO: 1889191 - protein, 17 aa, Staphylococcus
WTWRTHVGMDRLKSFFY

SEQ ID NO: 1889192 - protein, 18 aa, Staphylococcus
WVAFVLWLIASIMLFARK

SEQ ID NO: 1889193 - protein, 25 aa, Staphylococcus
WVFDLVRIVLPLIIIIILFTVLYSV

SEQ ID NO: 1889194 - protein, 24 aa, Staphylococcus
WVFFSCTLIGLLVLATLLGDTLIK

SEQ ID NO: 1889195 - protein, 18 aa, Staphylococcus
WVFQLHVDLMIGSAEDVH

SEQ ID NO: 1889196 - protein, 22 aa, Staphylococcus
WVGLPLPFRFSGFGFDLSSTLV

SEQ ID NO: 1889197 - protein, 20 aa, Staphylococcus
WVGVIFLPIILMRTSLWFIL

SEQ ID NO: 1889198 - protein, 18 aa, Staphylococcus
WVHLKLFSILIFTIILII

SEQ ID NO: 1889199 - protein, 19 aa, Staphylococcus
WVIAIVVALIVIWGFAGMP

SEQ ID NO: 1889200 - protein, 29 aa, Staphylococcus
WVICVYSPVAHWVWGGGWIDQLGAIDYAG

SEQ ID NO: 1889201 - protein, 18 aa, Staphylococcus
WVLIGILVLLAFVSVTII

SEQ ID NO: 1889202 - protein, 18 aa, Staphylococcus
WVNIISWTLIVILSGLNV

SEQ ID NO: 1889203 - protein, 27 aa, Staphylococcus
WVQNWTIFYWAWWVSWAPFVGIFIARV

SEQ ID NO: 1889204 - protein, 19 aa, Staphylococcus
WVSALFCVLLLMAFNLFSA

SEQ ID NO: 1889205 - protein, 17 aa, Staphylococcus
WVVLISVIISMFGSIPL

SEQ ID NO: 1889206 - protein, 19 aa, Staphylococcus
WVVQIPMPILAAIMVMVSI

SEQ ID NO: 1889207 - protein, 22 aa, Staphylococcus
WWFPIMASMFLAFTIVIMLIVA

SEQ ID NO: 1889208 - protein, 18 aa, Staphylococcus
WWMFALSFICFVVAGILN

SEQ ID NO: 1889209 - protein, 21 aa, Staphylococcus
WWMIFPIGGFLSWLIPQLLGK

SEQ ID NO: 1889210 - protein, 18 aa, Staphylococcus
WYDHLGIERSTREPVYKK

SEQ ID NO: 1889211 - protein, 18 aa, Staphylococcus
WYFITFGAFVAFGLFLPN

SEQ ID NO: 1889212 - protein, 19 aa, Staphylococcus
WYFITFGAFVAFGLFLPNY

SEQ ID NO: 1889213 - protein, 18 aa, Staphylococcus
WYLEYEIIVNRAGLLGDV

SEQ ID NO: 1889214 - protein, 25 aa, Staphylococcus
WYNIAEGGYPEWVIPTDPARRNDAM

SEQ ID NO: 1889215 - protein, 25 aa, Staphylococcus
WYNIAEGGYPEWVIPTDPNRRTDAM

SEQ ID NO: 1889216 - protein, 26 aa, Staphylococcus
WYRLVTSMFLHFNFEHILMNMLSLFI

SEQ ID NO: 1889217 - protein, 24 aa, Staphylococcus
WYSYLCPMLNWFIPIKYTELSYKE

SEQ ID NO: 1889218 - protein, 28 aa, Staphylococcus
YAACIAYRVGLRWEDLEEGISKRLNTAM

SEQ ID NO: 1889219 - protein, 26 aa, Staphylococcus
YAALIGIRVGLKWNDIEEGITHRLTT

SEQ ID NO: 1889220 - protein, 18 aa, Staphylococcus
YADKRLNQLATLKENVTN

SEQ ID NO: 1889221 - protein, 17 aa, Staphylococcus
YADLIRYNKCLLMTKSF

SEQ ID NO: 1889222 - protein, 23 aa, Staphylococcus
YAEGFIRRYASVVNMDVNQLIKV

SEQ ID NO: 1889223 - protein, 20 aa, Staphylococcus
YAEKLIQYGNRYRKDHQSVD

SEQ ID NO: 1889224 - protein, 17 aa, Staphylococcus
YAELIKELTRTGVYYKW

SEQ ID NO: 1889225 - protein, 17 aa, Staphylococcus
YAFSNAGSLGFTSWMFY

SEQ ID NO: 1889226 - protein, 26 aa, Staphylococcus
YAGAQFALRQGVGYVKALFVIVTSAL

SEQ ID NO: 1889227 - protein, 17 aa, Staphylococcus
YAGLLMLPYVIWLSYAS

SEQ ID NO: 1889228 - protein, 23 aa, Staphylococcus
YAIGGVFHIEFLQTIGDLAGSLA

SEQ ID NO: 1889229 - protein, 17 aa, Staphylococcus
YAIKFVMHIFFGKHRPD

SEQ ID NO: 1889230 - protein, 18 aa, Staphylococcus
YAILVKAIFCNFFINIGI

SEQ ID NO: 1889231 - protein, 31 aa, Staphylococcus
YAIRSVVWAHIIRLRMRFFDINESGQLMSRL

SEQ ID NO: 1889232 - protein, 20 aa, Staphylococcus
YAIYLLKIEVAGSIWWVLLV

SEQ ID NO: 1889233 - protein, 26 aa, Staphylococcus
YAKKESWTSPRKAILGGAKFVRNQYF

SEQ ID NO: 1889234 - protein, 18 aa, Staphylococcus
YAKQQSWTTPSKAIMGGA

SEQ ID NO: 1889235 - protein, 27 aa, Staphylococcus
YAKSFAVIFIYEWGIASLLFKVNTLSH

SEQ ID NO: 1889236 - protein, 20 aa, Staphylococcus
YALDILFRRVLKLYDSNIFK

SEQ ID NO: 1889237 - protein, 20 aa, Staphylococcus
YALFILFRYRQIIKEERDVP

SEQ ID NO: 1889238 - protein, 25 aa, Staphylococcus
YALFILFRYRQVMKTETDYIKGVGL

SEQ ID NO: 1889239 - protein, 19 aa, Staphylococcus
YALTMGYEIIFYQASDRYM

SEQ ID NO: 1889240 - protein, 18 aa, Staphylococcus
YALVLGIPTLQTGVFGGI

SEQ ID NO: 1889241 - protein, 22 aa, Staphylococcus
YANAKFGTVSVGYEIKDSNEKL

SEQ ID NO: 1889242 - protein, 20 aa, Staphylococcus
YANASLKITILISSAAGIGL

SEQ ID NO: 1889243 - protein, 17 aa, Staphylococcus
YANRFARHMPFANQLAK

SEQ ID NO: 1889244 - protein, 17 aa, Staphylococcus
YAPLRFRSALVPLANIG

SEQ ID NO: 1889245 - protein, 27 aa, Staphylococcus
YAQFKFSYSWIHFGKIFLYSFIMMLGV

SEQ ID NO: 1889246 - protein, 27 aa, Staphylococcus
YASKKFSHRPDFAITNGGGIRASIDKG

SEQ ID NO: 1889247 - protein, 24 aa, Staphylococcus
YASLQIAAAFSFFSVMGGRLKYRQ

SEQ ID NO: 1889248 - protein, 24 aa, Staphylococcus
YASLQIAAAFSFLSVMGGRLHDQR

SEQ ID NO: 1889249 - protein, 24 aa, Staphylococcus
YASLQIAAAFSFLSVMGGRLQYKS

SEQ ID NO: 1889250 - protein, 24 aa, Staphylococcus
YASLQIAAAFSFLTVMGGKLKFQK

SEQ ID NO: 1889251 - protein, 21 aa, Staphylococcus
YASSCLGLFIITCWLTLNILN

SEQ ID NO: 1889252 - protein, 28 aa, Staphylococcus
YATAISRLLGCLLAFIALLKIYRPKLHY

SEQ ID NO: 1889253 - protein, 18 aa, Staphylococcus
YATGGLIKNAGWYNIAEG

SEQ ID NO: 1889254 - protein, 25 aa, Staphylococcus
YATSAGYKWFFSYPEEKIETVNHLT

SEQ ID NO: 1889255 - protein, 36 aa, Staphylococcus
YAVFMRPDIGKTFSEFRIFLAILITLLLLFSIILVI

SEQ ID NO: 1889256 - protein, 20 aa, Staphylococcus
YAVSVLFVFFKAPDLALTQF

SEQ ID NO: 1889257 - protein, 21 aa, Staphylococcus
YCIGLVFLLYMAWSLWRTRPV

SEQ ID NO: 1889258 - protein, 17 aa, Staphylococcus
YCIVIFPITIFIHIQIA

SEQ ID NO: 1889259 - protein, 17 aa, Staphylococcus
YDATYKFKSDDKQKTVT

SEQ ID NO: 1889260 - protein, 28 aa, Staphylococcus
YDDFYSYLWPGIMTLIFLITFFYNIFKV

SEQ ID NO: 1889261 - protein, 22 aa, Staphylococcus
YDFDLVKVIPYLLVLILALIGI

SEQ ID NO: 1889262 - protein, 20 aa, Staphylococcus
YDFLVIIVLALVFYRIGITS

SEQ ID NO: 1889263 - protein, 24 aa, Staphylococcus
YDGKEAVFRLLLIDTPETKHPTKG

SEQ ID NO: 1889264 - protein, 22 aa, Staphylococcus
YDIKIELLISGLIFIIASLSDF

SEQ ID NO: 1889265 - protein, 18 aa, Staphylococcus
YDIRRRLYDHLQALSARF

SEQ ID NO: 1889266 - protein, 30 aa, Staphylococcus
YDIRSILWEHIIKLKMPFFDKNESGQLMSR

SEQ ID NO: 1889267 - protein, 26 aa, Staphylococcus
YDKYGPRLLILIGFIILIVTTASLSF

SEQ ID NO: 1889268 - protein, 26 aa, Staphylococcus
YDKYGPRPLIYAGFSLLTICTLLLCF

SEQ ID NO: 1889269 - protein, 25 aa, Staphylococcus
YDKYGVRPLIMIGFTLLIILTGVLA

SEQ ID NO: 1889270 - protein, 17 aa, Staphylococcus
YDLFGAIGLVMIGTYCL

SEQ ID NO: 1889271 - protein, 17 aa, Staphylococcus
YDLNFDLDQQFQLRERW

SEQ ID NO: 1889272 - protein, 24 aa, Staphylococcus
YDLTELIILIPISFVLTITSAVTF

SEQ ID NO: 1889273 - protein, 18 aa, Staphylococcus
YDNEMRGTIGMMMASLNI

SEQ ID NO: 1889274 - protein, 47 aa, Staphylococcus
YDNQGKKGMSCIAKIISIIIVLLLLGGLTFAIFSFVDHSKKANERLN

SEQ ID NO: 1889275 - protein, 17 aa, Staphylococcus
YDNTKLYGPYPVTDEIE

SEQ ID NO: 1889276 - protein, 18 aa, Staphylococcus
YDRIKGNRIIAFLIASTV

SEQ ID NO: 1889277 - protein, 17 aa, Staphylococcus
YDRKANELVLSMRAENL

SEQ ID NO: 1889278 - protein, 20 aa, Staphylococcus
YDRLDELVQIVGKNAKHNLT

SEQ ID NO: 1889279 - protein, 17 aa, Staphylococcus
YDRLVLYAISKDRHDAI

SEQ ID NO: 1889280 - protein, 28 aa, Staphylococcus
YDRNQFIWNRSGSVINHRSNSQNFNKDE

SEQ ID NO: 1889281 - protein, 17 aa, Staphylococcus
YDSELMLNRILKQLLKA

SEQ ID NO: 1889282 - protein, 20 aa, Staphylococcus
YDSIVCVGAIFLASSIGTTF

SEQ ID NO: 1889283 - protein, 30 aa, Staphylococcus
YDSNFTRVSMAWDNEVEYHAGSGNGDGIDK

SEQ ID NO: 1889284 - protein, 28 aa, Staphylococcus
YDSNRFMWQRPESIFNNQKGFERTSNQQ

SEQ ID NO: 1889285 - protein, 27 aa, Staphylococcus
YDVDTKKLKYTFTDYVNNKQNIEGGFK

SEQ ID NO: 1889286 - protein, 18 aa, Staphylococcus
YDVFDYWLIIIIANVISL

SEQ ID NO: 1889287 - protein, 18 aa, Staphylococcus
YDVKSILNDVSFNIPQGQ

SEQ ID NO: 1889288 - protein, 19 aa, Staphylococcus
YDVKTILDHISFRIPQGDI

SEQ ID NO: 1889289 - protein, 18 aa, Staphylococcus
YDYDISVFFLVIGILFFI

SEQ ID NO: 1889290 - protein, 21 aa, Staphylococcus
YDYDLIKVVPYLFVLILALFG

SEQ ID NO: 1889291 - protein, 21 aa, Staphylococcus
YDYLIAKSFQLTPIITPILNA

SEQ ID NO: 1889292 - protein, 24 aa, Staphylococcus
YDYNGETYLLIANEGDSQDYEGYS

SEQ ID NO: 1889293 - protein, 17 aa, Staphylococcus
YEAPKKFIISEPTFSKS

SEQ ID NO: 1889294 - protein, 24 aa, Staphylococcus
YEDIIKHYDEWVGLNDDINSVHYN

SEQ ID NO: 1889295 - protein, 17 aa, Staphylococcus
YEDKLAYGIALKGSSKL

SEQ ID NO: 1889296 - protein, 21 aa, Staphylococcus
YEDLLSLKVNWFNGLMLVLIV

SEQ ID NO: 1889297 - protein, 17 aa, Staphylococcus
YEEEFELIIKSLVKDII

SEQ ID NO: 1889298 - protein, 22 aa, Staphylococcus
YEEKLAYGIVLKDAISLENMSN

SEQ ID NO: 1889299 - protein, 24 aa, Staphylococcus
YEELKSEYLSDVTFKSETDTEVIV

SEQ ID NO: 1889300 - protein, 24 aa, Staphylococcus
YEELKSEYLSDVTFQSETDTEVIV

SEQ ID NO: 1889301 - protein, 20 aa, Staphylococcus
YEERGIEGVTVTLTHPDGTV

SEQ ID NO: 1889302 - protein, 21 aa, Staphylococcus
YEFDIMPFIVELAGSTSTGKT

SEQ ID NO: 1889303 - protein, 18 aa, Staphylococcus
YEHFASFKGFYDASFGLG

SEQ ID NO: 1889304 - protein, 20 aa, Staphylococcus
YEHYTQLKGFYDHSFGLGGD

SEQ ID NO: 1889305 - protein, 19 aa, Staphylococcus
YEIIPGFLTSLIVTVVVSK

SEQ ID NO: 1889306 - protein, 20 aa, Staphylococcus
YEIIPGFLTSLIVTYIVSLI

SEQ ID NO: 1889307 - protein, 20 aa, Staphylococcus
YEIIPGFLTSLIVTYIVSLM

SEQ ID NO: 1889308 - protein, 19 aa, Staphylococcus
YEIIPGFLVSVIVTYIVSK

SEQ ID NO: 1889309 - protein, 18 aa, Staphylococcus
YEILDMKSAIITSQKHYS

SEQ ID NO: 1889310 - protein, 17 aa, Staphylococcus
YEINGGLIFIGTVVSII

SEQ ID NO: 1889311 - protein, 21 aa, Staphylococcus
YEINIGLTLGVFGTFIFLAML

SEQ ID NO: 1889312 - protein, 18 aa, Staphylococcus
YEKEKDKLPDTGNEDKHN

SEQ ID NO: 1889313 - protein, 24 aa, Staphylococcus
YEKFLYRLMIIIGLILTITFSIMN

SEQ ID NO: 1889314 - protein, 25 aa, Staphylococcus
YEKFLYRLMIMIGIIFAIIFIIFYM

SEQ ID NO: 1889315 - protein, 26 aa, Staphylococcus
YEKFLYRLMLIIGIIFSIAFISIYPQ

SEQ ID NO: 1889316 - protein, 21 aa, Staphylococcus
YEKKLKVLFFNTLNTPLENRK

SEQ ID NO: 1889317 - protein, 24 aa, Staphylococcus
YELFASRCYELLLGKFDSDNSNTS

SEQ ID NO: 1889318 - protein, 20 aa, Staphylococcus
YELMVNIALFITATMTALVV

SEQ ID NO: 1889319 - protein, 33 aa, Staphylococcus
YEMVILLLICGCIPKLGALANIIPLPVLGGAMI

SEQ ID NO: 1889320 - protein, 20 aa, Staphylococcus
YENLAIKIALIIIYIIVALI

SEQ ID NO: 1889321 - protein, 21 aa, Staphylococcus
YEPQEGPGLLFKVLPLVFSQM

SEQ ID NO: 1889322 - protein, 17 aa, Staphylococcus
YEQEILERLGLFDRDIV

SEQ ID NO: 1889323 - protein, 26 aa, Staphylococcus
YEQFLYRLMFMIGILFIIVYAISFPL

SEQ ID NO: 1889324 - protein, 25 aa, Staphylococcus
YEQFLYRLMLVIGLIFSITFVYLYP

SEQ ID NO: 1889325 - protein, 19 aa, Staphylococcus
YEQPFFKTFMVITFIGIII

SEQ ID NO: 1889326 - protein, 19 aa, Staphylococcus
YEREHIALVGPSGAGKTTL

SEQ ID NO: 1889327 - protein, 21 aa, Staphylococcus
YERGKVLSIIMMDRGMIPLGS

SEQ ID NO: 1889328 - protein, 21 aa, Staphylococcus
YERGKVLSIVMMDRGMIPLGS

SEQ ID NO: 1889329 - protein, 21 aa, Staphylococcus
YERNIFKIVPILFINDNDLSI

SEQ ID NO: 1889330 - protein, 50 aa, Staphylococcus
YERNLESYEVPEYFTKGARNEFVYGFIVGAVIGSAVGLVSISKSRATNKS

SEQ ID NO: 1889331 - protein, 17 aa, Staphylococcus
YERNRLQSVMEFDQLKV

SEQ ID NO: 1889332 - protein, 18 aa, Staphylococcus
YESGRLIFYKDISRIRLY

SEQ ID NO: 1889333 - protein, 20 aa, Staphylococcus
YESLGFLLVYSIIFLSIALL

SEQ ID NO: 1889334 - protein, 19 aa, Staphylococcus
YESLGVRQVYVSDFENKSY

SEQ ID NO: 1889335 - protein, 17 aa, Staphylococcus
YETFGARVLSMIGMLIV

SEQ ID NO: 1889336 - protein, 20 aa, Staphylococcus
YETMSFLTLPPKDIFLASVL

SEQ ID NO: 1889337 - protein, 21 aa, Staphylococcus
YETMSFLTLPPKDVFMSSVLI

SEQ ID NO: 1889338 - protein, 17 aa, Staphylococcus
YETMSFLTLPPKEVFLA

SEQ ID NO: 1889339 - protein, 20 aa, Staphylococcus
YETPNFWFGLFRYIAEGATI

SEQ ID NO: 1889340 - protein, 21 aa, Staphylococcus
YEYFTIYILVAIMYWVVCFII

SEQ ID NO: 1889341 - protein, 21 aa, Staphylococcus
YEYFTIYILVAVMYWVICFII

SEQ ID NO: 1889342 - protein, 17 aa, Staphylococcus
YEYKTLSSYNYKKGDEI

SEQ ID NO: 1889343 - protein, 19 aa, Staphylococcus
YEYKTMSSYNYKQGDKIGV

SEQ ID NO: 1889344 - protein, 22 aa, Staphylococcus
YEYLTIYLLVALMYWVVCFIIS

SEQ ID NO: 1889345 - protein, 23 aa, Staphylococcus
YEYNGETYLLIANEGDAQDYDGY

SEQ ID NO: 1889346 - protein, 18 aa, Staphylococcus
YFAFFPIVAILVIYYVIR

SEQ ID NO: 1889347 - protein, 25 aa, Staphylococcus
YFAWLLGLLVGWAFMNVLVKLHPTR

SEQ ID NO: 1889348 - protein, 26 aa, Staphylococcus
YFDKMFPILIGFFVFLFVFLISGIGL

SEQ ID NO: 1889349 - protein, 26 aa, Staphylococcus
YFDKMFPILMGFFVFLFVFLISGIAL

SEQ ID NO: 1889350 - protein, 19 aa, Staphylococcus
YFDKNGHATADDILNGVLN

SEQ ID NO: 1889351 - protein, 17 aa, Staphylococcus
YFDTACVPILSRNKKRL

SEQ ID NO: 1889352 - protein, 17 aa, Staphylococcus
YFDVSCIPILSKAKKKL

SEQ ID NO: 1889353 - protein, 19 aa, Staphylococcus
YFFFRSSVSLVLKLLKRFK

SEQ ID NO: 1889354 - protein, 19 aa, Staphylococcus
YFFICYAIASLITRPIAGR

SEQ ID NO: 1889355 - protein, 17 aa, Staphylococcus
YFFTSWVPSIRESKFGE

SEQ ID NO: 1889356 - protein, 18 aa, Staphylococcus
YFFTVPRFTLEMYRFEYP

SEQ ID NO: 1889357 - protein, 18 aa, Staphylococcus
YFFVKDILLFIILYALFQ

SEQ ID NO: 1889358 - protein, 19 aa, Staphylococcus
YFHKVRGLLSFWIGALLIA

SEQ ID NO: 1889359 - protein, 28 aa, Staphylococcus
YFHYQEMPGRLSAGWAYVKKHWLFLVIV

SEQ ID NO: 1889360 - protein, 18 aa, Staphylococcus
YFIAVAFVASGFSANLRG

SEQ ID NO: 1889361 - protein, 21 aa, Staphylococcus
YFIAVLLCIPLTFKTVGEANK

SEQ ID NO: 1889362 - protein, 20 aa, Staphylococcus
YFIEHWRLLLYNIVIIIVFF

SEQ ID NO: 1889363 - protein, 18 aa, Staphylococcus
YFILIPLTFIVGANLLLL

SEQ ID NO: 1889364 - protein, 24 aa, Staphylococcus
YFILTEMPPFIGGLLIAAIFAAAQ

SEQ ID NO: 1889365 - protein, 21 aa, Staphylococcus
YFKGDTPAAYMISSTTDMIPW

SEQ ID NO: 1889366 - protein, 24 aa, Staphylococcus
YFKILPFIIKVVGYIINKITRMGK

SEQ ID NO: 1889367 - protein, 25 aa, Staphylococcus
YFKYVPRFIIFISNYSFSIYLIHYF

SEQ ID NO: 1889368 - protein, 28 aa, Staphylococcus
YFLAEGYRAALLHKEWYFINHWHLTVYN

SEQ ID NO: 1889369 - protein, 18 aa, Staphylococcus
YFLHHHFYTTFALITGFV

SEQ ID NO: 1889370 - protein, 24 aa, Staphylococcus
YFLIPEALGSLVLAITTAIIGLIG

SEQ ID NO: 1889371 - protein, 20 aa, Staphylococcus
YFLIYICGTILVLSSYKFWS

SEQ ID NO: 1889372 - protein, 24 aa, Staphylococcus
YFLLPEALGSLILAITTAIIGLIG

SEQ ID NO: 1889373 - protein, 24 aa, Staphylococcus
YFLMPEALGSLILAITTAIIGLIG

SEQ ID NO: 1889374 - protein, 17 aa, Staphylococcus
YFLVSAFIICAVTSVAT

SEQ ID NO: 1889375 - protein, 18 aa, Staphylococcus
YFMFDFSFWLFLIFLLAP

SEQ ID NO: 1889376 - protein, 27 aa, Staphylococcus
YFNIERRKFWITLGIFILITIILIIRI

SEQ ID NO: 1889377 - protein, 19 aa, Staphylococcus
YFNPAGLYEKHSFKTLSPY

SEQ ID NO: 1889378 - protein, 21 aa, Staphylococcus
YFNRIAIQLVILIILFPLFSK

SEQ ID NO: 1889379 - protein, 17 aa, Staphylococcus
YFNRYLKAGDEVLDARL

SEQ ID NO: 1889380 - protein, 23 aa, Staphylococcus
YFPQYGHYCMFLLALNFGFSVLD

SEQ ID NO: 1889381 - protein, 19 aa, Staphylococcus
YFTQFNWFEPTLIGLAALL

SEQ ID NO: 1889382 - protein, 19 aa, Staphylococcus
YFTRGWRRERKEKQLEKEM

SEQ ID NO: 1889383 - protein, 23 aa, Staphylococcus
YFTTFKLSLPRINYNNGSSDKNA

SEQ ID NO: 1889384 - protein, 17 aa, Staphylococcus
YFVSLTLLTMFISMYDI

SEQ ID NO: 1889385 - protein, 17 aa, Staphylococcus
YFWIAIVGVIIAFLILK

SEQ ID NO: 1889386 - protein, 25 aa, Staphylococcus
YFYIFCVVEFLILPIIYMPKTHLTL

SEQ ID NO: 1889387 - protein, 25 aa, Staphylococcus
YFYIHEIWIFIAMYAIFQGCFAPAM

SEQ ID NO: 1889388 - protein, 19 aa, Staphylococcus
YFYKLICVGVASYIGSQTF

SEQ ID NO: 1889389 - protein, 17 aa, Staphylococcus
YGALGSRAITALSKGLG

SEQ ID NO: 1889390 - protein, 18 aa, Staphylococcus
YGCRDLKMNGYDLDHVKI

SEQ ID NO: 1889391 - protein, 18 aa, Staphylococcus
YGDAKRVYVYAFIGGIIL

SEQ ID NO: 1889392 - protein, 18 aa, Staphylococcus
YGDKIIVRHREPAARRKV

SEQ ID NO: 1889393 - protein, 17 aa, Staphylococcus
YGEFGKYLLGIIVALAC

SEQ ID NO: 1889394 - protein, 17 aa, Staphylococcus
YGFFMIITWLPYYLETE

SEQ ID NO: 1889395 - protein, 19 aa, Staphylococcus
YGFFNRLLIPTGLHHALNA

SEQ ID NO: 1889396 - protein, 20 aa, Staphylococcus
YGFFNRLLIPTGLHHALNNV

SEQ ID NO: 1889397 - protein, 17 aa, Staphylococcus
YGFTVGIIISWLGIVAG

SEQ ID NO: 1889398 - protein, 17 aa, Staphylococcus
YGFWAIIFVIPFVIHTG

SEQ ID NO: 1889399 - protein, 19 aa, Staphylococcus
YGGRAIMYGVFLIVTLLYV

SEQ ID NO: 1889400 - protein, 18 aa, Staphylococcus
YGGSSLWSLMTGIGVILS

SEQ ID NO: 1889401 - protein, 31 aa, Staphylococcus
YGGTFRVLTKVFKRLGIDADFVDTTHTENIE

SEQ ID NO: 1889402 - protein, 20 aa, Staphylococcus
YGHYFMFLLALNFGISVMDF

SEQ ID NO: 1889403 - protein, 18 aa, Staphylococcus
YGIFGMLLALLAGRLSDR

SEQ ID NO: 1889404 - protein, 26 aa, Staphylococcus
YGIPTSKWLAVWSVIFFGNIVFNLIW

SEQ ID NO: 1889405 - protein, 28 aa, Staphylococcus
YGIRSLLWEHMIKLKMPFFDKNESGQLM

SEQ ID NO: 1889406 - protein, 20 aa, Staphylococcus
YGISRLVVRQPITFKKVLSD

SEQ ID NO: 1889407 - protein, 17 aa, Staphylococcus
YGLFSSIMGMGFVAAFL

SEQ ID NO: 1889408 - protein, 23 aa, Staphylococcus
YGLGCIAGLLVHFFLPTSDDMIK

SEQ ID NO: 1889409 - protein, 17 aa, Staphylococcus
YGLKTIVYFEIITTIAI

SEQ ID NO: 1889410 - protein, 28 aa, Staphylococcus
YGLLGAFIFRFIALFLISIIVNFWFIQA

SEQ ID NO: 1889411 - protein, 23 aa, Staphylococcus
YGPDSKFSWLLIYSVAGLLIPPS

SEQ ID NO: 1889412 - protein, 18 aa, Staphylococcus
YGPLMGMLVARVSKGRTI

SEQ ID NO: 1889413 - protein, 17 aa, Staphylococcus
YGPSHGYENQYYPRDEY

SEQ ID NO: 1889414 - protein, 24 aa, Staphylococcus
YGQNQRIVIKWAIGSSLFMIIVAC

SEQ ID NO: 1889415 - protein, 24 aa, Staphylococcus
YGSLQIAAAFSFLSVMGGRLKFKS

SEQ ID NO: 1889416 - protein, 26 aa, Staphylococcus
YGTNFKREILGGITTFLSMAYILAVN

SEQ ID NO: 1889417 - protein, 20 aa, Staphylococcus
YGVFNRLLIPTGLHHALNAV

SEQ ID NO: 1889418 - protein, 18 aa, Staphylococcus
YGVKVVRTMIQFLLSIVI

SEQ ID NO: 1889419 - protein, 25 aa, Staphylococcus
YGVLSKVFIIWLFKRYSNNMRGSVG

SEQ ID NO: 1889420 - protein, 19 aa, Staphylococcus
YGVSTPGYFTTIVAVLFLG

SEQ ID NO: 1889421 - protein, 17 aa, Staphylococcus
YGVYILLRIRKWITQRN

SEQ ID NO: 1889422 - protein, 17 aa, Staphylococcus
YGYRTMRRYTYPTVLMG

SEQ ID NO: 1889423 - protein, 18 aa, Staphylococcus
YGYTAAFILIILQVVTGA

SEQ ID NO: 1889424 - protein, 17 aa, Staphylococcus
YGYTAAFILVILQVITG

SEQ ID NO: 1889425 - protein, 18 aa, Staphylococcus
YGYWTIFFCRFVPLLRSL

SEQ ID NO: 1889426 - protein, 18 aa, Staphylococcus
YHDFKENLPVILIIEQSW

SEQ ID NO: 1889427 - protein, 18 aa, Staphylococcus
YHFDPHFSGIGSYFIAIA

SEQ ID NO: 1889428 - protein, 25 aa, Staphylococcus
YHFELHSLWYLGMLPWIGACFTAYF

SEQ ID NO: 1889429 - protein, 24 aa, Staphylococcus
YHGARPTEWMYFTFLVSGVLFALY

SEQ ID NO: 1889430 - protein, 23 aa, Staphylococcus
YHHKHSLIGLFILILVILLARAT

SEQ ID NO: 1889431 - protein, 17 aa, Staphylococcus
YHHRYYRLDGNNIEIKK

SEQ ID NO: 1889432 - protein, 29 aa, Staphylococcus
YHIGQLNGWGWVWFWWLVFPASIGSFGLW

SEQ ID NO: 1889433 - protein, 18 aa, Staphylococcus
YHIIPSLKKRGVSKLDEV

SEQ ID NO: 1889434 - protein, 17 aa, Staphylococcus
YHIMVAIGLILSITYVI

SEQ ID NO: 1889435 - protein, 17 aa, Staphylococcus
YHLKILWNSIVLGISVL

SEQ ID NO: 1889436 - protein, 18 aa, Staphylococcus
YHMDKKWYPASMTKLMTM

SEQ ID NO: 1889437 - protein, 17 aa, Staphylococcus
YHNIFALLFDWLVIFGS

SEQ ID NO: 1889438 - protein, 27 aa, Staphylococcus
YHRLKSQWMWLVIPFIVSMVVLLIMML

SEQ ID NO: 1889439 - protein, 21 aa, Staphylococcus
YHSLKNRMNSIAKDWASLSYL

SEQ ID NO: 1889440 - protein, 19 aa, Staphylococcus
YHYHVPPLVAFVATLFIGI

SEQ ID NO: 1889441 - protein, 17 aa, Staphylococcus
YHYSVPPLFAFVATLFI

SEQ ID NO: 1889442 - protein, 30 aa, Staphylococcus
YIAARGAKEFKWRLPDKITIRNSAIGGICM

SEQ ID NO: 1889443 - protein, 26 aa, Staphylococcus
YIAGICASSAMLLPGISGSFMLLIFG

SEQ ID NO: 1889444 - protein, 24 aa, Staphylococcus
YIALICIWGIITAMTVLLAKNTDK

SEQ ID NO: 1889445 - protein, 25 aa, Staphylococcus
YIALLQMIVMPLIFISIVSAFTKIK

SEQ ID NO: 1889446 - protein, 32 aa, Staphylococcus
YIALTWIHAFLLKYLFKIVGELIKPLEIQSQN

SEQ ID NO: 1889447 - protein, 18 aa, Staphylococcus
YIDGSGNLLISADPAVEH

SEQ ID NO: 1889448 - protein, 28 aa, Staphylococcus
YIDYVKRVANSKIWKTQDSAVYDLTTEG

SEQ ID NO: 1889449 - protein, 25 aa, Staphylococcus
YIFANLAGIFAIWNRHIYLWWFMFA

SEQ ID NO: 1889450 - protein, 18 aa, Staphylococcus
YIFFEKIGFLLVLLLGCI

SEQ ID NO: 1889451 - protein, 18 aa, Staphylococcus
YIFFEKIGFLLVLLLGCV

SEQ ID NO: 1889452 - protein, 18 aa, Staphylococcus
YIFFEKIGFLLVLLLGII

SEQ ID NO: 1889453 - protein, 18 aa, Staphylococcus
YIFFEKIGYLFILLLGCI

SEQ ID NO: 1889454 - protein, 18 aa, Staphylococcus
YIFFEKIGYLFVLLLGCI

SEQ ID NO: 1889455 - protein, 20 aa, Staphylococcus
YIFGILLCYLGGKIGGALSH

SEQ ID NO: 1889456 - protein, 23 aa, Staphylococcus
YIFIIGVLLVWGVKIFVKNASLG

SEQ ID NO: 1889457 - protein, 24 aa, Staphylococcus
YIFILWCLGIVLWAFGLNAYVVFI

SEQ ID NO: 1889458 - protein, 25 aa, Staphylococcus
YIFLFCFIGNIIGGFILFLLMKGTH

SEQ ID NO: 1889459 - protein, 18 aa, Staphylococcus
YIFLKKRSILALMKDRRQ

SEQ ID NO: 1889460 - protein, 25 aa, Staphylococcus
YIFSLIVSIVLYFSFVTLKYTDSIN

SEQ ID NO: 1889461 - protein, 22 aa, Staphylococcus
YIFVNFFLFDTWVCQSSEKQIN

SEQ ID NO: 1889462 - protein, 18 aa, Staphylococcus
YIGFLPLAILAGWFPLTL

SEQ ID NO: 1889463 - protein, 27 aa, Staphylococcus
YIGNAFMSIFIVIFVLYANRFVMRHRQ

SEQ ID NO: 1889464 - protein, 26 aa, Staphylococcus
YIGVWLYHFLERVLIPTGLHHFIYAP

SEQ ID NO: 1889465 - protein, 20 aa, Staphylococcus
YIHGKGIRPDVTIDSPKYQS

SEQ ID NO: 1889466 - protein, 19 aa, Staphylococcus
YIHHIWLFIIVYAIFQGLF

SEQ ID NO: 1889467 - protein, 24 aa, Staphylococcus
YIIFAFLVVRLFIKHVLKDRLNAY

SEQ ID NO: 1889468 - protein, 18 aa, Staphylococcus
YIIFRFLIVKFNFKTPGR

SEQ ID NO: 1889469 - protein, 25 aa, Staphylococcus
YIIFTMIIRYFIYRTTDQSLDEVDP

SEQ ID NO: 1889470 - protein, 20 aa, Staphylococcus
YIIGAIINFIKYFGYTLTQE

SEQ ID NO: 1889471 - protein, 20 aa, Staphylococcus
YIIISTLCGYSLSISCSSVY

SEQ ID NO: 1889472 - protein, 25 aa, Staphylococcus
YIILSLIIRACLYYFTKDSLEEVAP

SEQ ID NO: 1889473 - protein, 35 aa, Staphylococcus
YIIRSKPNTLPDFSGIGVLKSEYTFTNNKNQRDTR

SEQ ID NO: 1889474 - protein, 17 aa, Staphylococcus
YIISKLFGNWIISMICI

SEQ ID NO: 1889475 - protein, 23 aa, Staphylococcus
YIKIDFWVIMLIIGFLYMCKIVF

SEQ ID NO: 1889476 - protein, 25 aa, Staphylococcus
YIKKHWKFLIVMFIISICASKAYEW

SEQ ID NO: 1889477 - protein, 25 aa, Staphylococcus
YIKLSCSALLISSVFVNYSSIENVH

SEQ ID NO: 1889478 - protein, 18 aa, Staphylococcus
YIKNELNNNLLAVSNEIT

SEQ ID NO: 1889479 - protein, 17 aa, Staphylococcus
YIKYIKNEIGLKKFDKE

SEQ ID NO: 1889480 - protein, 25 aa, Staphylococcus
YIKYTITCLLVFIIIYFLYVNYGTN

SEQ ID NO: 1889481 - protein, 17 aa, Staphylococcus
YILALAIAIPFSGWLMN

SEQ ID NO: 1889482 - protein, 22 aa, Staphylococcus
YILDFPLSVSLVMGGLFLITGP

SEQ ID NO: 1889483 - protein, 19 aa, Staphylococcus
YILENKFATPILFLTIPFI

SEQ ID NO: 1889484 - protein, 26 aa, Staphylococcus
YILHSYRFASFILMLSIILLVVSGVY

SEQ ID NO: 1889485 - protein, 26 aa, Staphylococcus
YIMLGFLYKYIIAYLIQVYAINPLLL

SEQ ID NO: 1889486 - protein, 18 aa, Staphylococcus
YIMYSIVKIVFKNANLTR

SEQ ID NO: 1889487 - protein, 17 aa, Staphylococcus
YINIQAMMDDLSSALID

SEQ ID NO: 1889488 - protein, 17 aa, Staphylococcus
YINRFKLMIYLTLIQVV

SEQ ID NO: 1889489 - protein, 24 aa, Staphylococcus
YIPFELCLLLKLFKPKKVIEWPLF

SEQ ID NO: 1889490 - protein, 18 aa, Staphylococcus
YIPIIWKEASWQFMMFIL

SEQ ID NO: 1889491 - protein, 18 aa, Staphylococcus
YIPKEFSHEITGTLRKQP

SEQ ID NO: 1889492 - protein, 22 aa, Staphylococcus
YIPLELCLLLKLFKPKETKEWP

SEQ ID NO: 1889493 - protein, 19 aa, Staphylococcus
YIPMMLMLLLGAFTKSAQF

SEQ ID NO: 1889494 - protein, 24 aa, Staphylococcus
YIPYELCLLLKLFKPIKKFEWPLF

SEQ ID NO: 1889495 - protein, 21 aa, Staphylococcus
YIRKLFGFTAIHVLITSDFEE

SEQ ID NO: 1889496 - protein, 20 aa, Staphylococcus
YISGFFLFFHYARLKELKCD

SEQ ID NO: 1889497 - protein, 23 aa, Staphylococcus
YITHRGSASFLVLPGIQKGGYIG

SEQ ID NO: 1889498 - protein, 23 aa, Staphylococcus
YITHRGSASFLVLPGVKKGGYIG

SEQ ID NO: 1889499 - protein, 21 aa, Staphylococcus
YITLITVIAMISIYMLSLKMD

SEQ ID NO: 1889500 - protein, 17 aa, Staphylococcus
YITLLFAKPIIFFYKIM

SEQ ID NO: 1889501 - protein, 17 aa, Staphylococcus
YITLLFAKPIIFFYKLM

SEQ ID NO: 1889502 - protein, 18 aa, Staphylococcus
YITPTRPIPEGNVTAKAY

SEQ ID NO: 1889503 - protein, 23 aa, Staphylococcus
YIVITALILIIILFLLYMFTPIS

SEQ ID NO: 1889504 - protein, 17 aa, Staphylococcus
YIYHNFIFLIGMFCFLK

SEQ ID NO: 1889505 - protein, 17 aa, Staphylococcus
YIYIPFMILPIFNSMKA

SEQ ID NO: 1889506 - protein, 17 aa, Staphylococcus
YIYQHFVLLIGIFCFLK

SEQ ID NO: 1889507 - protein, 27 aa, Staphylococcus
YKDFDWKSVEQAFSWSKTGKINMAYEC

SEQ ID NO: 1889508 - protein, 18 aa, Staphylococcus
YKDGFYIRNTMFPLQRNE

SEQ ID NO: 1889509 - protein, 19 aa, Staphylococcus
YKDGSLLKYTEMKWLTPKG

SEQ ID NO: 1889510 - protein, 20 aa, Staphylococcus
YKDIYMLKGGYKKWTGKIKT

SEQ ID NO: 1889511 - protein, 22 aa, Staphylococcus
YKDNKLLFDPYTIVKKNGIRYG

SEQ ID NO: 1889512 - protein, 20 aa, Staphylococcus
YKEAHHCTGFFKTTLPGFYS

SEQ ID NO: 1889513 - protein, 19 aa, Staphylococcus
YKEALKYHIKSHLLTKPNK

SEQ ID NO: 1889514 - protein, 21 aa, Staphylococcus
YKEIISYSIPFVIVSLNFPLF

SEQ ID NO: 1889515 - protein, 21 aa, Staphylococcus
YKEIISYSIPFVIVSLNFSLY

SEQ ID NO: 1889516 - protein, 23 aa, Staphylococcus
YKEKLHIIKDLLIATVRAIIQLI

SEQ ID NO: 1889517 - protein, 19 aa, Staphylococcus
YKELQRFNKEASFKNDVLE

SEQ ID NO: 1889518 - protein, 25 aa, Staphylococcus
YKEPKRYILPWALLGFVVVMIYQMV

SEQ ID NO: 1889519 - protein, 18 aa, Staphylococcus
YKETAAGAFGGWQGIYAG

SEQ ID NO: 1889520 - protein, 21 aa, Staphylococcus
YKEVIPLSIILGGWFVVTTDL

SEQ ID NO: 1889521 - protein, 20 aa, Staphylococcus
YKFAALIFIVMYLFFTISPA

SEQ ID NO: 1889522 - protein, 19 aa, Staphylococcus
YKFLSKRSTYLTILATILI

SEQ ID NO: 1889523 - protein, 20 aa, Staphylococcus
YKGIYDRGASFIQMGLIVTT

SEQ ID NO: 1889524 - protein, 23 aa, Staphylococcus
YKGKELTKFLSLLMLVNGVAPVI

SEQ ID NO: 1889525 - protein, 19 aa, Staphylococcus
YKGKLIFSAVVGMIASIFT

SEQ ID NO: 1889526 - protein, 23 aa, Staphylococcus
YKGNELTKFLSLLMLVNGVAPVI

SEQ ID NO: 1889527 - protein, 19 aa, Staphylococcus
YKGNSDASIAISIKAPTKV

SEQ ID NO: 1889528 - protein, 33 aa, Staphylococcus
YKGTPKTSSQPFGIFKGVFNVPDNISRIRVQFE

SEQ ID NO: 1889529 - protein, 21 aa, Staphylococcus
YKHHGFDIKGTVRALFSTIGE

SEQ ID NO: 1889530 - protein, 20 aa, Staphylococcus
YKHHGFDLKGTTRALFSTIS

SEQ ID NO: 1889531 - protein, 19 aa, Staphylococcus
YKHHGFDVKGTSRALFSTL

SEQ ID NO: 1889532 - protein, 22 aa, Staphylococcus
YKHKGILPKALVRAMIQDVFNL

SEQ ID NO: 1889533 - protein, 25 aa, Staphylococcus
YKHVKVPDFIVKFWTLLVSTLIVLV

SEQ ID NO: 1889534 - protein, 18 aa, Staphylococcus
YKHYYYKIFAIITWFLLI

SEQ ID NO: 1889535 - protein, 23 aa, Staphylococcus
YKIIKLFLVFLIELIKANIDVIR

SEQ ID NO: 1889536 - protein, 27 aa, Staphylococcus
YKIKNKPTMIALISFILFLILLFLFLN

SEQ ID NO: 1889537 - protein, 17 aa, Staphylococcus
YKIKSSKVKLNVRSNEM

SEQ ID NO: 1889538 - protein, 19 aa, Staphylococcus
YKIPVPNFFKTLIGQGDDT

SEQ ID NO: 1889539 - protein, 21 aa, Staphylococcus
YKIVDKLGGGGMSTVYLAEDT

SEQ ID NO: 1889540 - protein, 17 aa, Staphylococcus
YKKAVGASHRIYEIMQE

SEQ ID NO: 1889541 - protein, 25 aa, Staphylococcus
YKKEIIGGITTFLSMAYILAVNPHV

SEQ ID NO: 1889542 - protein, 25 aa, Staphylococcus
YKKEIIGGITTFLSMAYILAVNPQV

SEQ ID NO: 1889543 - protein, 21 aa, Staphylococcus
YKKERLETAFSNFFTYENLTE

SEQ ID NO: 1889544 - protein, 21 aa, Staphylococcus
YKKEVTHTIQPLPREEIVIDE

SEQ ID NO: 1889545 - protein, 24 aa, Staphylococcus
YKKLRLQVFLGIFIGYAGYYLLRK

SEQ ID NO: 1889546 - protein, 23 aa, Staphylococcus
YKKLYNWSRWLGALFGLLSALIS

SEQ ID NO: 1889547 - protein, 25 aa, Staphylococcus
YKKYFPWFTCTTVFASIAWLSDDLR

SEQ ID NO: 1889548 - protein, 19 aa, Staphylococcus
YKLAHLHLSTAGGECNIEL

SEQ ID NO: 1889549 - protein, 17 aa, Staphylococcus
YKLFEPMMKIEFYQNLL

SEQ ID NO: 1889550 - protein, 18 aa, Staphylococcus
YKLINAFVEDVQFVDGVG

SEQ ID NO: 1889551 - protein, 18 aa, Staphylococcus
YKLLLTIYFGLLFIASML

SEQ ID NO: 1889552 - protein, 20 aa, Staphylococcus
YKLTQELYNQRGLIIKFKEG

SEQ ID NO: 1889553 - protein, 29 aa, Staphylococcus
YKMQGMGRFFIKLLASMLVMSLVVQAVMW

SEQ ID NO: 1889554 - protein, 25 aa, Staphylococcus
YKNFSFPLLFLVIIFIFREEISSLL

SEQ ID NO: 1889555 - protein, 22 aa, Staphylococcus
YKNLDKQVLALITGDIGSMPDL

SEQ ID NO: 1889556 - protein, 20 aa, Staphylococcus
YKNLYMLKGGYKKWTGKIKS

SEQ ID NO: 1889557 - protein, 17 aa, Staphylococcus
YKNNAIAELENVANQRK

SEQ ID NO: 1889558 - protein, 22 aa, Staphylococcus
YKPQATLPRKEDESPKFAVRAV

SEQ ID NO: 1889559 - protein, 24 aa, Staphylococcus
YKQEWFIVLTLIFIFPLGLFVMWR

SEQ ID NO: 1889560 - protein, 25 aa, Staphylococcus
YKQLKHIIVTIFLIGLMFMIIILLA

SEQ ID NO: 1889561 - protein, 23 aa, Staphylococcus
YKRGTGFALICWLVISLGIFVVR

SEQ ID NO: 1889562 - protein, 20 aa, Staphylococcus
YKRHPMIKLMNAMQYDASGI

SEQ ID NO: 1889563 - protein, 18 aa, Staphylococcus
YKSLAFIFAIMISCSLFI

SEQ ID NO: 1889564 - protein, 21 aa, Staphylococcus
YKTCQAFAIVALIVAILSLVS

SEQ ID NO: 1889565 - protein, 19 aa, Staphylococcus
YKTERLIRAKVIATVSICC

SEQ ID NO: 1889566 - protein, 19 aa, Staphylococcus
YKTEWKKKYVIGAGLGIAA

SEQ ID NO: 1889567 - protein, 17 aa, Staphylococcus
YKTFCLASELSLFYKNG

SEQ ID NO: 1889568 - protein, 17 aa, Staphylococcus
YKTLSSYNYKKGDEIGT

SEQ ID NO: 1889569 - protein, 17 aa, Staphylococcus
YKVASALVINIGTLTHD

SEQ ID NO: 1889570 - protein, 18 aa, Staphylococcus
YKVFEIYVLVKKYDSNTM

SEQ ID NO: 1889571 - protein, 23 aa, Staphylococcus
YKVIDKLGGGGMSIVYLAEDLIL

SEQ ID NO: 1889572 - protein, 23 aa, Staphylococcus
YKVIDKLGGGGMSIVYLAEDTIL

SEQ ID NO: 1889573 - protein, 23 aa, Staphylococcus
YKVINYKGIILILVFLLLMMVSN

SEQ ID NO: 1889574 - protein, 17 aa, Staphylococcus
YKVKRLVGQSGMSYGAL

SEQ ID NO: 1889575 - protein, 21 aa, Staphylococcus
YKWMIITTLIMFLTILLFCLV

SEQ ID NO: 1889576 - protein, 21 aa, Staphylococcus
YKWMIITTLITFTTILLFCLI

SEQ ID NO: 1889577 - protein, 19 aa, Staphylococcus
YKYFEMFWDSILYAALITM

SEQ ID NO: 1889578 - protein, 23 aa, Staphylococcus
YKYKGKTYFGRVIGLPGQSVEFK

SEQ ID NO: 1889579 - protein, 24 aa, Staphylococcus
YKYKRYPILMLLVCATLAVAVVVQ

SEQ ID NO: 1889580 - protein, 22 aa, Staphylococcus
YKYLDEVLKCYDYIGQLDNHYA

SEQ ID NO: 1889581 - protein, 18 aa, Staphylococcus
YKYNPFLINQVRNLDTEN

SEQ ID NO: 1889582 - protein, 20 aa, Staphylococcus
YKYRRFVSPVTMRVKASPDL

SEQ ID NO: 1889583 - protein, 27 aa, Staphylococcus
YKYSFFCALLFIIGVAFAFFVGFPMII

SEQ ID NO: 1889584 - protein, 25 aa, Staphylococcus
YLALVLLACSSYLIFILIGSLQGND

SEQ ID NO: 1889585 - protein, 20 aa, Staphylococcus
YLARKWNLVTNMGKFLDPLA

SEQ ID NO: 1889586 - protein, 23 aa, Staphylococcus
YLAVSLTDFFQGVVMIIAMVMVP

SEQ ID NO: 1889587 - protein, 21 aa, Staphylococcus
YLCVGCFYCYSESRKLGDPFW

SEQ ID NO: 1889588 - protein, 28 aa, Staphylococcus
YLDIFKYYWKDVVVCFAGVAFLNVANYM

SEQ ID NO: 1889589 - protein, 21 aa, Staphylococcus
YLDKFKFSAAQTEIDDAHELM

SEQ ID NO: 1889590 - protein, 22 aa, Staphylococcus
YLEHLDRLRLSFFTYHRNDTDI

SEQ ID NO: 1889591 - protein, 19 aa, Staphylococcus
YLEKLRRDTLKEIDKSHID

SEQ ID NO: 1889592 - protein, 19 aa, Staphylococcus
YLEMLKVLTPILVAIFVYK

SEQ ID NO: 1889593 - protein, 23 aa, Staphylococcus
YLFAHEWLHVSFLSMLWSVIQVV

SEQ ID NO: 1889594 - protein, 24 aa, Staphylococcus
YLFFPAILILLLLTIKKYRNVAVI

SEQ ID NO: 1889595 - protein, 19 aa, Staphylococcus
YLFGASRYLTYILVSLITI

SEQ ID NO: 1889596 - protein, 20 aa, Staphylococcus
YLFGMSRYLTYILLSLITVY

SEQ ID NO: 1889597 - protein, 18 aa, Staphylococcus
YLFIALRLIQGFSAGVIT

SEQ ID NO: 1889598 - protein, 27 aa, Staphylococcus
YLFKKLSWPVGLIIIAVLISSLGSITG

SEQ ID NO: 1889599 - protein, 18 aa, Staphylococcus
YLFLKRRSILTMMKDSSQ

SEQ ID NO: 1889600 - protein, 25 aa, Staphylococcus
YLFWELTSFSSFLLISFWRTRQASI

SEQ ID NO: 1889601 - protein, 25 aa, Staphylococcus
YLGELIRWLLVFGFIFQLPILFMGL

SEQ ID NO: 1889602 - protein, 22 aa, Staphylococcus
YLGKAGLFLLLGVVQALIVTLG

SEQ ID NO: 1889603 - protein, 24 aa, Staphylococcus
YLGKSGLFYLIGIVQALIVSIGDI

SEQ ID NO: 1889604 - protein, 17 aa, Staphylococcus
YLGMAWEILNPALQIMV

SEQ ID NO: 1889605 - protein, 17 aa, Staphylococcus
YLGMAWELINPAMQIMV

SEQ ID NO: 1889606 - protein, 18 aa, Staphylococcus
YLGMAWELLNPALQIMVY

SEQ ID NO: 1889607 - protein, 27 aa, Staphylococcus
YLGMLVWPLLALGFFFNIIQRGNASYE

SEQ ID NO: 1889608 - protein, 26 aa, Staphylococcus
YLGMLVWPLLALGLFFNIVQRAKASY

SEQ ID NO: 1889609 - protein, 26 aa, Staphylococcus
YLHELIRWLFIFGVVFQLPMFCMGLV

SEQ ID NO: 1889610 - protein, 24 aa, Staphylococcus
YLHIMSIYVIRSFGMAFVMMPLMT

SEQ ID NO: 1889611 - protein, 18 aa, Staphylococcus
YLIACLFAGVGYVHDHIS

SEQ ID NO: 1889612 - protein, 18 aa, Staphylococcus
YLIAVSFVASGFSANLRG

SEQ ID NO: 1889613 - protein, 17 aa, Staphylococcus
YLIHHGVESNHIMLEDQ

SEQ ID NO: 1889614 - protein, 22 aa, Staphylococcus
YLILMMCAFLTALLVVQYVNQD

SEQ ID NO: 1889615 - protein, 18 aa, Staphylococcus
YLILRFHNYFAIIFIFIV

SEQ ID NO: 1889616 - protein, 32 aa, Staphylococcus
YLINYAFAGIEGWRWMLGLAVVPSLILLIGVA

SEQ ID NO: 1889617 - protein, 22 aa, Staphylococcus
YLIPIASLFVLITISVLSFKLK

SEQ ID NO: 1889618 - protein, 23 aa, Staphylococcus
YLIRRLAEFQLRISNKNNYLGMA

SEQ ID NO: 1889619 - protein, 17 aa, Staphylococcus
YLISHAILETGAVKSDL

SEQ ID NO: 1889620 - protein, 18 aa, Staphylococcus
YLISIYLIVGLFYMMVIE

SEQ ID NO: 1889621 - protein, 17 aa, Staphylococcus
YLIVIAILIIVSLFSLS

SEQ ID NO: 1889622 - protein, 18 aa, Staphylococcus
YLIYLGVRSILSARQSMS

SEQ ID NO: 1889623 - protein, 17 aa, Staphylococcus
YLIYWKDQVNFSIDKVV

SEQ ID NO: 1889624 - protein, 24 aa, Staphylococcus
YLKKVGRFSIIPSIFNINEPLIFG

SEQ ID NO: 1889625 - protein, 24 aa, Staphylococcus
YLKYKRISKYLVYGFVSLFIGAIA

SEQ ID NO: 1889626 - protein, 20 aa, Staphylococcus
YLLGHFSFGLLVATGTLAHT

SEQ ID NO: 1889627 - protein, 20 aa, Staphylococcus
YLLKVSRFKSTFKAKHYIVV

SEQ ID NO: 1889628 - protein, 25 aa, Staphylococcus
YLLNLPEHWVAPVIGIIILLIGLFG

SEQ ID NO: 1889629 - protein, 19 aa, Staphylococcus
YLLVIGAILALLSSILGFY

SEQ ID NO: 1889630 - protein, 24 aa, Staphylococcus
YLMILPCLLFFLIFNYIPMTSLIL

SEQ ID NO: 1889631 - protein, 19 aa, Staphylococcus
YLMLKRLRIETLFFIIVMS

SEQ ID NO: 1889632 - protein, 20 aa, Staphylococcus
YLMQLRVAIQKEPLDIKKVD

SEQ ID NO: 1889633 - protein, 23 aa, Staphylococcus
YLNFKDAHLWDDSAVNAIDTLID

SEQ ID NO: 1889634 - protein, 27 aa, Staphylococcus
YLNILPKFIGAVGWLLAKVTRQPKFES

SEQ ID NO: 1889635 - protein, 17 aa, Staphylococcus
YLNKKINSFMIKDQKFI

SEQ ID NO: 1889636 - protein, 24 aa, Staphylococcus
YLNLDLPLLIATAVIFAGLSFGFV

SEQ ID NO: 1889637 - protein, 34 aa, Staphylococcus
YLNNIKVSWGDKGVFSYARALLKANVTIDSGGNE

SEQ ID NO: 1889638 - protein, 17 aa, Staphylococcus
YLPFFMIGMGWIIPALI

SEQ ID NO: 1889639 - protein, 24 aa, Staphylococcus
YLPKRLGSVNKRFGTPHWLLLLFY

SEQ ID NO: 1889640 - protein, 35 aa, Staphylococcus
YLPQVFKAVMIPLFIIIAMCFIHLNTALIMMVTAP

SEQ ID NO: 1889641 - protein, 26 aa, Staphylococcus
YLPQVFKSMMIPVAIIVAMCYVHLST

SEQ ID NO: 1889642 - protein, 23 aa, Staphylococcus
YLQTRISFHAGFLAAAIGMFCGL

SEQ ID NO: 1889643 - protein, 17 aa, Staphylococcus
YLRDFAKKFHLTTNETE

SEQ ID NO: 1889644 - protein, 17 aa, Staphylococcus
YLRELAKDYQVLYFTCM

SEQ ID NO: 1889645 - protein, 19 aa, Staphylococcus
YLRELSRNYQVLYFTCTKD

SEQ ID NO: 1889646 - protein, 20 aa, Staphylococcus
YLRRIHSLLGIIPIGAFLIV

SEQ ID NO: 1889647 - protein, 19 aa, Staphylococcus
YLRRIHSLLGVIPIGAFLL

SEQ ID NO: 1889648 - protein, 19 aa, Staphylococcus
YLRRLFGYTSIHFYITSDV

SEQ ID NO: 1889649 - protein, 20 aa, Staphylococcus
YLRRLHSLLGVIPIGGFLLV

SEQ ID NO: 1889650 - protein, 20 aa, Staphylococcus
YLSASFAIAVSTQVISPHIT

SEQ ID NO: 1889651 - protein, 25 aa, Staphylococcus
YLSAYPFDFKAMWITLLLLSIVMIF

SEQ ID NO: 1889652 - protein, 25 aa, Staphylococcus
YLSCGFVGACGWMVYILFFDGLQVH

SEQ ID NO: 1889653 - protein, 27 aa, Staphylococcus
YLSDHKMYFIMGALFIFLMIFYVMNSN

SEQ ID NO: 1889654 - protein, 17 aa, Staphylococcus
YLSDVSFISETDTEVIV

SEQ ID NO: 1889655 - protein, 25 aa, Staphylococcus
YLSELLRWLLIFGLLFQLPVLLFGL

SEQ ID NO: 1889656 - protein, 35 aa, Staphylococcus
YLSFFKRIIFSLAVLTMFVCVAFWSYFTAIGKPSS

SEQ ID NO: 1889657 - protein, 25 aa, Staphylococcus
YLSFTLRFLIVFIIALGFSIFSYYF

SEQ ID NO: 1889658 - protein, 17 aa, Staphylococcus
YLSPKISDELIIESITS

SEQ ID NO: 1889659 - protein, 18 aa, Staphylococcus
YLSSCLFGLALVGVIIHN

SEQ ID NO: 1889660 - protein, 19 aa, Staphylococcus
YLSVRLGHLQGFTTEQQDE

SEQ ID NO: 1889661 - protein, 21 aa, Staphylococcus
YLTLDSFNLYFGIFLIFVSII

SEQ ID NO: 1889662 - protein, 21 aa, Staphylococcus
YLTLESFNLYFGIFLILVAIL

SEQ ID NO: 1889663 - protein, 20 aa, Staphylococcus
YLTLESFNLYFGIFMIIVSI

SEQ ID NO: 1889664 - protein, 20 aa, Staphylococcus
YLTLESFNLYFGIFMILVSI

SEQ ID NO: 1889665 - protein, 20 aa, Staphylococcus
YLTLNSFNLYFGIFMICVSI

SEQ ID NO: 1889666 - protein, 20 aa, Staphylococcus
YLTLVAFNFISGVLTLPGLA

SEQ ID NO: 1889667 - protein, 18 aa, Staphylococcus
YLTYILVSLITIYIAMQR

SEQ ID NO: 1889668 - protein, 18 aa, Staphylococcus
YLVARFTPIFALSEGWIW

SEQ ID NO: 1889669 - protein, 17 aa, Staphylococcus
YLVARVTPLFAISQGWI

SEQ ID NO: 1889670 - protein, 24 aa, Staphylococcus
YLVELTACWTVFMILSGIYMMFRK

SEQ ID NO: 1889671 - protein, 27 aa, Staphylococcus
YLVEYYDWRSLFHVVTPIAALTFLLSL

SEQ ID NO: 1889672 - protein, 25 aa, Staphylococcus
YLVFFPIIGVLIIYYIVRFKMQSII

SEQ ID NO: 1889673 - protein, 26 aa, Staphylococcus
YLVGLFICGGSAMILLSLYDLILVKG

SEQ ID NO: 1889674 - protein, 25 aa, Staphylococcus
YLVHLTFVPLLFLGRFTNMGYTLVS

SEQ ID NO: 1889675 - protein, 21 aa, Staphylococcus
YLVHPLVKWLVLKISIFDNRD

SEQ ID NO: 1889676 - protein, 25 aa, Staphylococcus
YLVKIWVAIKFLAIYLYQLITSSLS

SEQ ID NO: 1889677 - protein, 20 aa, Staphylococcus
YLVLCLRWIGYQLDVSTWLM

SEQ ID NO: 1889678 - protein, 18 aa, Staphylococcus
YLVMPALSDALKIVGLKT

SEQ ID NO: 1889679 - protein, 29 aa, Staphylococcus
YLVSKRLTKPLSYYIDWISNLSHEKLHQP

SEQ ID NO: 1889680 - protein, 17 aa, Staphylococcus
YLVTFIFCIVIAAVNLF

SEQ ID NO: 1889681 - protein, 22 aa, Staphylococcus
YLVVPIVGAFLIDLAGVPIVMG

SEQ ID NO: 1889682 - protein, 19 aa, Staphylococcus
YLYIRRTMQQINHINTLFM

SEQ ID NO: 1889683 - protein, 20 aa, Staphylococcus
YLYQHKKPREKVTLTIIRDG

SEQ ID NO: 1889684 - protein, 19 aa, Staphylococcus
YLYRICKNVFLKLIVILLK

SEQ ID NO: 1889685 - protein, 26 aa, Staphylococcus
YLYSNRIDVLLGWMIIIIAAVLVGLH

SEQ ID NO: 1889686 - protein, 26 aa, Staphylococcus
YLYSNRYEMIGGFIIAAIALILIIMQ

SEQ ID NO: 1889687 - protein, 20 aa, Staphylococcus
YMFQNFAFKIIQQLRIDAFD

SEQ ID NO: 1889688 - protein, 20 aa, Staphylococcus
YMHTDLWSIIFLSGEIFAVI

SEQ ID NO: 1889689 - protein, 17 aa, Staphylococcus
YMIIWVVSFLKNRRYVN

SEQ ID NO: 1889690 - protein, 24 aa, Staphylococcus
YMLALSAMFGMEFILLSLGFNDDV

SEQ ID NO: 1889691 - protein, 19 aa, Staphylococcus
YMMFRKRLLTQNSRNLRFQ

SEQ ID NO: 1889692 - protein, 23 aa, Staphylococcus
YMPSDGWWLLNFISTIGALLMGI

SEQ ID NO: 1889693 - protein, 18 aa, Staphylococcus
YMSCIPGGWIADRITGTR

SEQ ID NO: 1889694 - protein, 23 aa, Staphylococcus
YMSRMIIPNLFSLIASIVVLWIY

SEQ ID NO: 1889695 - protein, 24 aa, Staphylococcus
YMTPSDMGKLILGLQNNRILNSHI

SEQ ID NO: 1889696 - protein, 26 aa, Staphylococcus
YNAFNVKLGWLILRVLSVVFVWLTYL

SEQ ID NO: 1889697 - protein, 19 aa, Staphylococcus
YNAIKANRVVSFLIASIVS

SEQ ID NO: 1889698 - protein, 19 aa, Staphylococcus
YNAIKGNRIVAFLIASIVS

SEQ ID NO: 1889699 - protein, 19 aa, Staphylococcus
YNDADFKGIITLENILEEI

SEQ ID NO: 1889700 - protein, 18 aa, Staphylococcus
YNDRDFRREQQLEEDNIR

SEQ ID NO: 1889701 - protein, 18 aa, Staphylococcus
YNEGEVILKTYEKLTEIL

SEQ ID NO: 1889702 - protein, 18 aa, Staphylococcus
YNEGEVVLKTYEKLTEIL

SEQ ID NO: 1889703 - protein, 19 aa, Staphylococcus
YNFFLNVLLPLVFISVLIG

SEQ ID NO: 1889704 - protein, 22 aa, Staphylococcus
YNFIEMLMVLFILSILLVCTIS

SEQ ID NO: 1889705 - protein, 17 aa, Staphylococcus
YNFMALNLFLAYIPFEL

SEQ ID NO: 1889706 - protein, 18 aa, Staphylococcus
YNIGHTYVLPSLVTTLYL

SEQ ID NO: 1889707 - protein, 18 aa, Staphylococcus
YNLGEKMSLLAGGSLLVD

SEQ ID NO: 1889708 - protein, 20 aa, Staphylococcus
YNLGLKQAKISAVIQPISGL

SEQ ID NO: 1889709 - protein, 18 aa, Staphylococcus
YNLLKSCILIFAIINILI

SEQ ID NO: 1889710 - protein, 20 aa, Staphylococcus
YNLVKVIPYILVLVLAVIGV

SEQ ID NO: 1889711 - protein, 18 aa, Staphylococcus
YNLWISILTLLSIIIMTF

SEQ ID NO: 1889712 - protein, 18 aa, Staphylococcus
YNNHVVFSGETFRNNMTV

SEQ ID NO: 1889713 - protein, 24 aa, Staphylococcus
YNNSFAYPLAMLIQDKAELERIKQ

SEQ ID NO: 1889714 - protein, 19 aa, Staphylococcus
YNPDLMVDSGDAFQGLPVS

SEQ ID NO: 1889715 - protein, 26 aa, Staphylococcus
YNQKEEWKRLAIALDIADEIMKGILP

SEQ ID NO: 1889716 - protein, 25 aa, Staphylococcus
YNRFSKGLFEWIGYNTKIFTYENVT

SEQ ID NO: 1889717 - protein, 20 aa, Staphylococcus
YNRIALQLIILVVLYPLFSK

SEQ ID NO: 1889718 - protein, 17 aa, Staphylococcus
YNRVSGMFNGQNFTGFS

SEQ ID NO: 1889719 - protein, 17 aa, Staphylococcus
YNWNYIISLTDLPLFHD

SEQ ID NO: 1889720 - protein, 24 aa, Staphylococcus
YNYHGNKKWYLASMTKLMTMYLTL

SEQ ID NO: 1889721 - protein, 17 aa, Staphylococcus
YNYRSFIELSYKGLEER

SEQ ID NO: 1889722 - protein, 21 aa, Staphylococcus
YPDIRLVILHSEYRSVARPLA

SEQ ID NO: 1889723 - protein, 17 aa, Staphylococcus
YPDLKADKQFTGLRDEL

SEQ ID NO: 1889724 - protein, 31 aa, Staphylococcus; identical to SEQ ID NO: 1738687

SEQ ID NO: 1889725 - protein, 21 aa, Staphylococcus
YPELRLRMVKGAYKENEVIAF

SEQ ID NO: 1889726 - protein, 26 aa, Staphylococcus
YPESYRYGFYSTPQVNRINGVFFGQI

SEQ ID NO: 1889727 - protein, 17 aa, Staphylococcus
YPFIAAILTSSVLGAFI

SEQ ID NO: 1889728 - protein, 18 aa, Staphylococcus
YPFIAIFKMLSYFIPLLI

SEQ ID NO: 1889729 - protein, 28 aa, Staphylococcus
YPIALAPGMGLNAFFAFTVVLTMGIPWQ

SEQ ID NO: 1889730 - protein, 26 aa, Staphylococcus
YPIHKCIHLLFFISYYKSFKIHQLSK

SEQ ID NO: 1889731 - protein, 18 aa, Staphylococcus
YPKALAIWERSVIATHDF

SEQ ID NO: 1889732 - protein, 24 aa, Staphylococcus
YPLGKATSHLLGYVGPINSEELKQ

SEQ ID NO: 1889733 - protein, 20 aa, Staphylococcus
YPLLISYVILCFIGLVMVYS

SEQ ID NO: 1889734 - protein, 17 aa, Staphylococcus
YPLMLKFLRKIQIKIDS

SEQ ID NO: 1889735 - protein, 20 aa, Staphylococcus
YPNEDFSSWQALYQPKYKND

SEQ ID NO: 1889736 - protein, 17 aa, Staphylococcus
YPNLRLRLVKGAYKEDE

SEQ ID NO: 1889737 - protein, 22 aa, Staphylococcus
YPRILKDIIIPQALRNSIPNLT

SEQ ID NO: 1889738 - protein, 26 aa, Staphylococcus
YPSLMIPRLVAIIGVLSAAITFRDKD

SEQ ID NO: 1889739 - protein, 29 aa, Staphylococcus
YPTFLSISICTLLKIITLVLGKHRRLDWL

SEQ ID NO: 1889740 - protein, 22 aa, Staphylococcus
YPTGKLSAMVNIPSDMNRVRIS

SEQ ID NO: 1889741 - protein, 24 aa, Staphylococcus
YPTMLKLAIPGAISAFLGAAVLTR

SEQ ID NO: 1889742 - protein, 20 aa, Staphylococcus
YPTNYRYGFYTFPKYNRVSG

SEQ ID NO: 1889743 - protein, 17 aa, Staphylococcus
YPTSVGIPTITVDNPNQ

SEQ ID NO: 1889744 - protein, 25 aa, Staphylococcus
YPVKGGYTDYIFKRKQQYYIVTTKH

SEQ ID NO: 1889745 - protein, 19 aa, Staphylococcus
YPVLGWTFFIACLNLAGIP

SEQ ID NO: 1889746 - protein, 17 aa, Staphylococcus
YPVRVLILLGLMIGALF

SEQ ID NO: 1889747 - protein, 17 aa, Staphylococcus
YPYDFLVIIVLALVFYR

SEQ ID NO: 1889748 - protein, 24 aa, Staphylococcus
YQFNDVVLGLVFLIGSILFFNSST

SEQ ID NO: 1889749 - protein, 21 aa, Staphylococcus
YQFQSRFRKFILIILVGGAIG

SEQ ID NO: 1889750 - protein, 28 aa, Staphylococcus
YQHPIVPIMFTFGISIFVSSLKRRKKVS

SEQ ID NO: 1889751 - protein, 33 aa, Staphylococcus
YQHSRPPKPKFPWFRIIIIALIAGIIGALIVLE

SEQ ID NO: 1889752 - protein, 24 aa, Staphylococcus
YQLLDKLGGGGMSMVYLAEDTILE

SEQ ID NO: 1889753 - protein, 25 aa, Staphylococcus
YQLQSRLRKALLILLVGGSIGKAVV

SEQ ID NO: 1889754 - protein, 19 aa, Staphylococcus
YQMAIEWMQSLLNLKPEMV

SEQ ID NO: 1889755 - protein, 18 aa, Staphylococcus
YQMPIGKIIDVQRLSTQH

SEQ ID NO: 1889756 - protein, 17 aa, Staphylococcus
YQNTRTSGTIEHSPVNV

SEQ ID NO: 1889757 - protein, 23 aa, Staphylococcus
YQNYFLFLGCLAVVIGLITLAFV

SEQ ID NO: 1889758 - protein, 25 aa, Staphylococcus
YQPPYWKTMMFISFISIIFSMIYIR

SEQ ID NO: 1889759 - protein, 27 aa, Staphylococcus
YQSIWASACLHICWNLSDLCHISTNNE

SEQ ID NO: 1889760 - protein, 17 aa, Staphylococcus
YQTAAFLLAKTGAVALL

SEQ ID NO: 1889761 - protein, 19 aa, Staphylococcus
YQTKYYYRLSKPYDDSNDV

SEQ ID NO: 1889762 - protein, 18 aa, Staphylococcus
YQYGHERYEFIIGNQQYT

SEQ ID NO: 1889763 - protein, 18 aa, Staphylococcus
YRAKRYVTLTGLVLTLIV

SEQ ID NO: 1889764 - protein, 17 aa, Staphylococcus
YRDLKAIQNNADILNQA

SEQ ID NO: 1889765 - protein, 24 aa, Staphylococcus
YREFESYSGYGIRSLMSAKLNYYI

SEQ ID NO: 1889766 - protein, 18 aa, Staphylococcus
YRFFGKHGLIAWVAMGTI

SEQ ID NO: 1889767 - protein, 20 aa, Staphylococcus
YRGGLTHQQILVRNVPNNAN

SEQ ID NO: 1889768 - protein, 17 aa, Staphylococcus
YRGLLSVAIFAVVLCVV

SEQ ID NO: 1889769 - protein, 27 aa, Staphylococcus
YRHQLLTFAWFLPVLFALSGLLILLGL

SEQ ID NO: 1889770 - protein, 20 aa, Staphylococcus
YRIIATIIIGIIKFGIPMLI

SEQ ID NO: 1889771 - protein, 20 aa, Staphylococcus
YRIIATIIVGIIKFGIPMLI

SEQ ID NO: 1889772 - protein, 19 aa, Staphylococcus
YRIILSMIFMIIMIYILKQ

SEQ ID NO: 1889773 - protein, 23 aa, Staphylococcus
YRILADLVPEMDFIKIDKGMPLR

SEQ ID NO: 1889774 - protein, 22 aa, Staphylococcus
YRKFKSSDLISRMVSSVEALQN

SEQ ID NO: 1889775 - protein, 26 aa, Staphylococcus
YRKLKWHWKDTLLILLLIPIAVILFA

SEQ ID NO: 1889776 - protein, 17 aa, Staphylococcus
YRKLQWHIGDTMCLISI

SEQ ID NO: 1889777 - protein, 27 aa, Staphylococcus
YRKSLLKRKWIAIGLVILFLVEQVIMV

SEQ ID NO: 1889778 - protein, 19 aa, Staphylococcus
YRLTGIMYLIAYMCGLIAI

SEQ ID NO: 1889779 - protein, 23 aa, Staphylococcus
YRLVSGLILAWSLSVSWTQLVAF

SEQ ID NO: 1889780 - protein, 19 aa, Staphylococcus
YRMFGKQGLLAWVAIGTII

SEQ ID NO: 1889781 - protein, 22 aa, Staphylococcus
YRNEILGGITTFLSMAYILAVN

SEQ ID NO: 1889782 - protein, 27 aa, Staphylococcus
YRNGIEFSSKRLLKLAIVLYGLKLNIN

SEQ ID NO: 1889783 - protein, 26 aa, Staphylococcus
YRNKRAKKWYLPFGYGAEDINLNNIS

SEQ ID NO: 1889784 - protein, 17 aa, Staphylococcus
YRNVTLILWIISLVSLL

SEQ ID NO: 1889785 - protein, 37 aa, Staphylococcus
YRQASLLRRIWIRIKASFLRRRVRIQTNASSSLDIKE

SEQ ID NO: 1889786 - protein, 18 aa, Staphylococcus
YRQNEIFTIRLIIFGVIF

SEQ ID NO: 1889787 - protein, 29 aa, Staphylococcus
YRRKANELVLSLRLEKILTKDEIVYTYLN

SEQ ID NO: 1889788 - protein, 23 aa, Staphylococcus
YRRKSKESLQVVVIIGLVILVTL

SEQ ID NO: 1889789 - protein, 20 aa, Staphylococcus
YRRLPATIIGALFAVIFTFI

SEQ ID NO: 1889790 - protein, 19 aa, Staphylococcus
YRSVYQWFERYSGQSIRKL

SEQ ID NO: 1889791 - protein, 22 aa, Staphylococcus
YRTGHKPKRYAIMQSTAGYYGH

SEQ ID NO: 1889792 - protein, 18 aa, Staphylococcus
YRTMPIIGMTTNMTILIS

SEQ ID NO: 1889793 - protein, 17 aa, Staphylococcus
YRTMRRYTYPTVLMGAI

SEQ ID NO: 1889794 - protein, 25 aa, Staphylococcus
YRVPSIRTLWRSTWEKAKGFVKKAG

SEQ ID NO: 1889795 - protein, 23 aa, Staphylococcus
YRVQGFSCANCAGKFEKNVKKIP

SEQ ID NO: 1889796 - protein, 17 aa, Staphylococcus
YSALFPFTFKFGPENSN

SEQ ID NO: 1889797 - protein, 23 aa, Staphylococcus
YSASNPLGGVLMLQGLKIDESAN

SEQ ID NO: 1889798 - protein, 17 aa, Staphylococcus
YSDHKLEQLRQLEQQVK

SEQ ID NO: 1889799 - protein, 26 aa, Staphylococcus
YSDLLRYNKCILMTKSFIFNSLAFNE

SEQ ID NO: 1889800 - protein, 24 aa, Staphylococcus
YSEDKSFRLNVSYILSKIGKTVYP

SEQ ID NO: 1889801 - protein, 21 aa, Staphylococcus
YSEKEHVLYFFDITKEVYTNE

SEQ ID NO: 1889802 - protein, 23 aa, Staphylococcus
YSESNSLSLANSVSKSTSESIEA

SEQ ID NO: 1889803 - protein, 19 aa, Staphylococcus
YSFGKAGAFLTNYTYGLSL

SEQ ID NO: 1889804 - protein, 18 aa, Staphylococcus
YSGHTIDYHWWVGGLLGV

SEQ ID NO: 1889805 - protein, 25 aa, Staphylococcus
YSGIYPTKFASIYGIIIYQFVLMVI

SEQ ID NO: 1889806 - protein, 17 aa, Staphylococcus
YSGKQLTKFLALLMLVN

SEQ ID NO: 1889807 - protein, 19 aa, Staphylococcus
YSGQMIRGLMNNRLNHYNI

SEQ ID NO: 1889808 - protein, 21 aa, Staphylococcus
YSHRTTFTMLRNVRVQFFRGL

SEQ ID NO: 1889809 - protein, 23 aa, Staphylococcus
YSIKELKKGITIGKYEIKIYKNT

SEQ ID NO: 1889810 - protein, 17 aa, Staphylococcus
YSIWGVIITGCIVTLGG

SEQ ID NO: 1889811 - protein, 26 aa, Staphylococcus
YSKPGARSGFFYNTFVDPMKHLLQWL

SEQ ID NO: 1889812 - protein, 17 aa, Staphylococcus
YSKRINFVGIIASLALL

SEQ ID NO: 1889813 - protein, 22 aa, Staphylococcus
YSKTFPELHTSLSTLNQQLLQD

SEQ ID NO: 1889814 - protein, 22 aa, Staphylococcus
YSKVIGIPKWIQFLFIIIVAMV

SEQ ID NO: 1889815 - protein, 22 aa, Staphylococcus
YSKVIGIPKWIQFLFIVIVAMV

SEQ ID NO: 1889816 - protein, 18 aa, Staphylococcus
YSLAMYRRILDTYCEPTA

SEQ ID NO: 1889817 - protein, 30 aa, Staphylococcus
YSLFDKFIWKWKILHKLGIIKIPNLNGKWK

SEQ ID NO: 1889818 - protein, 18 aa, Staphylococcus
YSLFILFRYKEVRKRGLE

SEQ ID NO: 1889819 - protein, 17 aa, Staphylococcus
YSLILACIAAVTSVVPY

SEQ ID NO: 1889820 - protein, 17 aa, Staphylococcus
YSLIYSYLGRILMQVAA

SEQ ID NO: 1889821 - protein, 21 aa, Staphylococcus
YSLLCTALFIIGVGFAYTIGF

SEQ ID NO: 1889822 - protein, 18 aa, Staphylococcus
YSLYWKNLTRTGALSGMI

SEQ ID NO: 1889823 - protein, 26 aa, Staphylococcus
YSMLEEFKVTIWYTAPTALRMLMSAG

SEQ ID NO: 1889824 - protein, 20 aa, Staphylococcus
YSMYKQPLFIFGLKDTEVGY

SEQ ID NO: 1889825 - protein, 26 aa, Staphylococcus
YSNTNPVYFTHTWTLNDGSIAPESIQ

SEQ ID NO: 1889826 - protein, 24 aa, Staphylococcus
YSPIKRLLLYFIILITLFSFLNLI

SEQ ID NO: 1889827 - protein, 25 aa, Staphylococcus
YSPLKRLLLYAVILTSMFAFLNLTS

SEQ ID NO: 1889828 - protein, 25 aa, Staphylococcus
YSPLKRLLLYFVIFVAMFSFLNLMS

SEQ ID NO: 1889829 - protein, 18 aa, Staphylococcus
YSPLKRLLLYVIILTTML

SEQ ID NO: 1889830 - protein, 25 aa, Staphylococcus
YSPTFKIPVLFFGLYVLFYIPTFIL

SEQ ID NO: 1889831 - protein, 18 aa, Staphylococcus
YSQPKVGVATSFSLSQLL

SEQ ID NO: 1889832 - protein, 23 aa, Staphylococcus
YSQRKIDVEPVFGFMKAILGFTR

SEQ ID NO: 1889833 - protein, 26 aa, Staphylococcus
YSQRKIDVEPVFGFMKAILGFTRMSV

SEQ ID NO: 1889834 - protein, 28 aa, Staphylococcus
YSQRKIDVEPVFGFMKAILGFTRMSVRG

SEQ ID NO: 1889835 - protein, 32 aa, Staphylococcus
YSQRKIDVEPVFGFMKAILVFTRMSVRGLNKV

SEQ ID NO: 1889836 - protein, 17 aa, Staphylococcus
YSRHTRINDQTPQRKDF

SEQ ID NO: 1889837 - protein, 24 aa, Staphylococcus
YSRKANEIILAMRLEKLLSKNEII

SEQ ID NO: 1889838 - protein, 18 aa, Staphylococcus
YSRRFDARLPKIAEKHYT

SEQ ID NO: 1889839 - protein, 53 aa, Staphylococcus
YSSFTSPQFRSPMANSSFVPQSRPGQNLIVNPMWYNLNFALVPQNDVKIDITN

SEQ ID NO: 1889840 - protein, 18 aa, Staphylococcus
YSSIDVMIIFLREGLEVL

SEQ ID NO: 1889841 - protein, 21 aa, Staphylococcus
YSSILSMANWMFLFFGLLVVI

SEQ ID NO: 1889842 - protein, 26 aa, Staphylococcus
YSTIFAFICYISWSSAYGSHLFSKNV

SEQ ID NO: 1889843 - protein, 29 aa, Staphylococcus
YSVNHTLRFASFYSVMIFFVIIGFALHLF

SEQ ID NO: 1889844 - protein, 27 aa, Staphylococcus
YSVNSDVRFSSFYGVMIYIIIIFLFIS

SEQ ID NO: 1889845 - protein, 19 aa, Staphylococcus
YSVSCMFYGIISDKFGKKK

SEQ ID NO: 1889846 - protein, 20 aa, Staphylococcus
YSVSVLFVFFKAPDLALTQF

SEQ ID NO: 1889847 - protein, 17 aa, Staphylococcus
YTAEGIAIVIGSLFNAF

SEQ ID NO: 1889848 - protein, 18 aa, Staphylococcus
YTALVGVIVGCFVFPPFG

SEQ ID NO: 1889849 - protein, 18 aa, Staphylococcus
YTAYGILVFFAFIFVILL

SEQ ID NO: 1889850 - protein, 17 aa, Staphylococcus
YTCGIAIYYMRKEKEKL

SEQ ID NO: 1889851 - protein, 18 aa, Staphylococcus
YTCGIAIYYMRQEKQKLM

SEQ ID NO: 1889852 - protein, 28 aa, Staphylococcus
YTDFKYNILNIPSWLELDPDAKGNRFWT

SEQ ID NO: 1889853 - protein, 18 aa, Staphylococcus
YTEMSAIFFQNRRTGDLM

SEQ ID NO: 1889854 - protein, 22 aa, Staphylococcus
YTFGTVILILSFVILVTSGVYL

SEQ ID NO: 1889855 - protein, 18 aa, Staphylococcus
YTFSKSKAINNLKKNSLI

SEQ ID NO: 1889856 - protein, 19 aa, Staphylococcus
YTGIIGFIGMIVPQLIRRT

SEQ ID NO: 1889857 - protein, 19 aa, Staphylococcus
YTGIIGFIGMIVPQLIRRY

SEQ ID NO: 1889858 - protein, 17 aa, Staphylococcus
YTGIMYILAYLAGVIAL

SEQ ID NO: 1889859 - protein, 25 aa, Staphylococcus
YTGKVFDRFGLRVLVIPDFTLLIIM

SEQ ID NO: 1889860 - protein, 25 aa, Staphylococcus
YTGYNFLYTFAFSMIVGELIHDTNG

SEQ ID NO: 1889861 - protein, 19 aa, Staphylococcus
YTIITAMIFIVIAGIIGAI

SEQ ID NO: 1889862 - protein, 17 aa, Staphylococcus
YTIVCAKITMIYFSTFI

SEQ ID NO: 1889863 - protein, 18 aa, Staphylococcus
YTKYKSFFIKGLQNTILI

SEQ ID NO: 1889864 - protein, 20 aa, Staphylococcus
YTLDQCVKLSESIRGGVEQS

SEQ ID NO: 1889865 - protein, 23 aa, Staphylococcus
YTLIWFLVGIVIYVFYGIKHSKK

SEQ ID NO: 1889866 - protein, 19 aa, Staphylococcus
YTLSEACLFLIQYTNIKNR

SEQ ID NO: 1889867 - protein, 19 aa, Staphylococcus
YTLTMHLAYMILRFYAHGA

SEQ ID NO: 1889868 - protein, 27 aa, Staphylococcus
YTLYLSFVPILFLGRYTNMFYTVLSAF

SEQ ID NO: 1889869 - protein, 19 aa, Staphylococcus
YTMTEAMAQYRDVVTKRYA

SEQ ID NO: 1889870 - protein, 18 aa, Staphylococcus
YTNLATKLAMVIIYILVG

SEQ ID NO: 1889871 - protein, 26 aa, Staphylococcus
YTNMLFIKRRSYEFGLLQTIGLGKKS

SEQ ID NO: 1889872 - protein, 18 aa, Staphylococcus
YTNMQLIIGIIFVLITGP

SEQ ID NO: 1889873 - protein, 17 aa, Staphylococcus
YTNRIAIPIGIHMLQNG

SEQ ID NO: 1889874 - protein, 20 aa, Staphylococcus
YTNYWYHWLIYIAAIYLVLM

SEQ ID NO: 1889875 - protein, 23 aa, Staphylococcus
YTPPHFYKLLILSIIGIISSIIF

SEQ ID NO: 1889876 - protein, 23 aa, Staphylococcus
YTPPHFYLLIVISIIGVVLSMIF

SEQ ID NO: 1889877 - protein, 23 aa, Staphylococcus
YTQAELDKLVANGLFDDDQLGRL

SEQ ID NO: 1889878 - protein, 25 aa, Staphylococcus
YTQAQTWKATWIILGVVALMAGIII

SEQ ID NO: 1889879 - protein, 25 aa, Staphylococcus
YTQAQTWKATWIILGVVTLMAGIII

SEQ ID NO: 1889880 - protein, 31 aa, Staphylococcus
YTQWIKFVWKLILLWVIICAVAMSIALIISY

SEQ ID NO: 1889881 - protein, 19 aa, Staphylococcus
YTRIFDVLIGIVIAVIGIL

SEQ ID NO: 1889882 - protein, 20 aa, Staphylococcus
YTWDRFKNKWTHFIISLPVI

SEQ ID NO: 1889883 - protein, 26 aa, Staphylococcus
YTYGFLRLEIIVAFLNGLALIVISLG

SEQ ID NO: 1889884 - protein, 22 aa, Staphylococcus
YTYKELTKVLARDSELHHYDYD

SEQ ID NO: 1889885 - protein, 19 aa, Staphylococcus
YTYLNIVPFGRDYEGNNIT

SEQ ID NO: 1889886 - protein, 20 aa, Staphylococcus
YTYLNIVPFGRDYNGANITG

SEQ ID NO: 1889887 - protein, 19 aa, Staphylococcus
YVAAFFRFVLVMIGVLSSS

SEQ ID NO: 1889888 - protein, 25 aa, Staphylococcus
YVALLQMIVMPLIFISIVAAFTKIQ

SEQ ID NO: 1889889 - protein, 25 aa, Staphylococcus
YVALLQMIVMPLIFISIVSAFSKIQ

SEQ ID NO: 1889890 - protein, 18 aa, Staphylococcus
YVETPFRKKGFKALSIGN

SEQ ID NO: 1889891 - protein, 24 aa, Staphylococcus
YVFTKRIAVPIGIHMLQNGTVVLM

SEQ ID NO: 1889892 - protein, 17 aa, Staphylococcus
YVFWELTSVSSFLLISY

SEQ ID NO: 1889893 - protein, 18 aa, Staphylococcus
YVFWELTSVSSFLLIVYW

SEQ ID NO: 1889894 - protein, 24 aa, Staphylococcus
YVFYPIVVFFLFKRFKPQKITLIL

SEQ ID NO: 1889895 - protein, 25 aa, Staphylococcus
YVGILTCCLVFLLVLVSNESELAKF

SEQ ID NO: 1889896 - protein, 18 aa, Staphylococcus
YVGNYFKPFWPLVIINVF

SEQ ID NO: 1889897 - protein, 25 aa, Staphylococcus
YVIGKLFFKKDIRQFGSGNTGATNS

SEQ ID NO: 1889898 - protein, 23 aa, Staphylococcus
YVIGKLFFKKDIRQYGSGNTGAT

SEQ ID NO: 1889899 - protein, 19 aa, Staphylococcus
YVILCFIGLVMVYSASMVA

SEQ ID NO: 1889900 - protein, 17 aa, Staphylococcus
YVILGVFALIFILLFFS

SEQ ID NO: 1889901 - protein, 17 aa, Staphylococcus
YVIYRFIHDGILFTGPN

SEQ ID NO: 1889902 - protein, 17 aa, Staphylococcus
YVLPIPLHFEFDSEVFM

SEQ ID NO: 1889903 - protein, 20 aa, Staphylococcus
YVMFEVMLLASFVLITLGQS

SEQ ID NO: 1889904 - protein, 17 aa, Staphylococcus
YVMGASFITEGAIPFAA

SEQ ID NO: 1889905 - protein, 24 aa, Staphylococcus
YVMSRARALASRAVSAIKSALRIH

SEQ ID NO: 1889906 - protein, 31 aa, Staphylococcus
YVNPQSVNSYDTWLTIQGYQNQVNDSSAIFN

SEQ ID NO: 1889907 - protein, 17 aa, Staphylococcus
YVPEKWVLGLLGLIPIY

SEQ ID NO: 1889908 - protein, 20 aa, Staphylococcus
YVPFELCLLLNLFKPIYKYE

SEQ ID NO: 1889909 - protein, 25 aa, Staphylococcus
YVPFFKKLRVTSAYEYLEARFGPSI

SEQ ID NO: 1889910 - protein, 18 aa, Staphylococcus
YVPHQFKIFRNGGEEFSI

SEQ ID NO: 1889911 - protein, 24 aa, Staphylococcus
YVPNVFGFFWSKTVEGMLMKPYNY

SEQ ID NO: 1889912 - protein, 23 aa, Staphylococcus
YVPNVWGFHWPKNIEDIIMKVYN

SEQ ID NO: 1889913 - protein, 28 aa, Staphylococcus
YVPYGDDWFAYFMRRLAERPQNLSLAVK

SEQ ID NO: 1889914 - protein, 27 aa, Staphylococcus
YVPYGNDWFAYFMRRLAERPQNLSLAY

SEQ ID NO: 1889915 - protein, 17 aa, Staphylococcus
YVSLKWPSHGGITAHPN

SEQ ID NO: 1889916 - protein, 18 aa, Staphylococcus
YVSWLVIVGISLILVTIV

SEQ ID NO: 1889917 - protein, 19 aa, Staphylococcus
YVTAAFRFILVMIGVVSAS

SEQ ID NO: 1889918 - protein, 24 aa, Staphylococcus
YVTHSKLAWFVFIVCLFISLLLLI

SEQ ID NO: 1889919 - protein, 22 aa, Staphylococcus
YVVALVFCIIATIITAGISYIF

SEQ ID NO: 1889920 - protein, 18 aa, Staphylococcus
YVVFRAVIQIFNLNTPGR

SEQ ID NO: 1889921 - protein, 25 aa, Staphylococcus
YVVGKLFFKKDIRQFGSGNTGATNS

SEQ ID NO: 1889922 - protein, 19 aa, Staphylococcus
YVYFMKGVLGFHFDHPNRV

SEQ ID NO: 1889923 - protein, 29 aa, Staphylococcus
YVYNIGFQFSFLICFFILLSQPYLKKLTS

SEQ ID NO: 1889924 - protein, 19 aa, Staphylococcus
YWDTFKFFSPLTWSLIFIT

SEQ ID NO: 1889925 - protein, 18 aa, Staphylococcus
YWFLMQIAMLIGFMTSYP

SEQ ID NO: 1889926 - protein, 25 aa, Staphylococcus
YWKGLSRTGAIFGMISGSVVVIIWI

SEQ ID NO: 1889927 - protein, 29 aa, Staphylococcus
YWSPMQGIPAWVWSCIFLVIIFALNSLSV

SEQ ID NO: 1889928 - protein, 20 aa, Staphylococcus
YWVICFIISVIQSFYESYIE

SEQ ID NO: 1889929 - protein, 20 aa, Staphylococcus
YWVVCFIISVIQSFYESYIE

SEQ ID NO: 1889930 - protein, 18 aa, Staphylococcus
YYAAPILDDVYKAKNNEL

SEQ ID NO: 1889931 - protein, 17 aa, Staphylococcus
YYAIFRFVIQVFNLNTI

SEQ ID NO: 1889932 - protein, 28 aa, Staphylococcus
YYDQLILMEFRFPRMLITILAGAALSLS

SEQ ID NO: 1889933 - protein, 24 aa, Staphylococcus
YYEITEVLFLIPISFVLTITSSIT

SEQ ID NO: 1889934 - protein, 17 aa, Staphylococcus
YYFCVAMVIVVLLMFFG

SEQ ID NO: 1889935 - protein, 19 aa, Staphylococcus
YYIFFEKIGFLFVLLLGCI

SEQ ID NO: 1889936 - protein, 19 aa, Staphylococcus
YYIFFEKIGFLLVLLLGCV

SEQ ID NO: 1889937 - protein, 28 aa, Staphylococcus
YYIQYGIKGRLGKIYGLVFAIVTVISVG

SEQ ID NO: 1889938 - protein, 26 aa, Staphylococcus
YYLCLIGAGYILLRIIFKHSKDIIPR

SEQ ID NO: 1889939 - protein, 21 aa, Staphylococcus
YYLCLIGGGYILIRVIFRHPK

SEQ ID NO: 1889940 - protein, 23 aa, Staphylococcus
YYLKARRYPPVLLGALIGASLEI

SEQ ID NO: 1889941 - protein, 18 aa, Staphylococcus
YYLLRKNFSLAMPALIEQ

SEQ ID NO: 1889942 - protein, 18 aa, Staphylococcus
YYLLRKNFSLAMPDLIDQ

SEQ ID NO: 1889943 - protein, 17 aa, Staphylococcus
YYLNCYFVYKVRPTLKK

SEQ ID NO: 1889944 - protein, 17 aa, Staphylococcus
YYLPSFILFLTVGVIGS

SEQ ID NO: 1889945 - protein, 18 aa, Staphylococcus
YYLSFWYFITFGAFVAFG

SEQ ID NO: 1889946 - protein, 17 aa, Staphylococcus
YYLSLWYFITFGAFVAF

SEQ ID NO: 1889947 - protein, 23 aa, Staphylococcus
YYLSNDGEVIFKLPSDKSDAGSK

SEQ ID NO: 1889948 - protein, 22 aa, Staphylococcus
YYLSNKGEVIFKLPNNDDDSKS

SEQ ID NO: 1889949 - protein, 23 aa, Staphylococcus
YYLSNNGEIIFKLPNDKSSSNSK

SEQ ID NO: 1889950 - protein, 17 aa, Staphylococcus
YYMSIPYLSPVFFLMGA

SEQ ID NO: 1889951 - protein, 17 aa, Staphylococcus
YYNFYGVGALDKDPIKT

SEQ ID NO: 1889952 - protein, 18 aa, Staphylococcus
YYNFYGVGALDSDPIKTG

SEQ ID NO: 1889953 - protein, 20 aa, Staphylococcus
YYPFFKKYEREMLAQEQSLN

SEQ ID NO: 1889954 - protein, 20 aa, Staphylococcus
YYPQMSESLSRSDSGDLKTD

SEQ ID NO: 1889955 - protein, 33 aa, Staphylococcus
YYRDKKFWKFFGLRLGKIKYWFIHPLMMLLALI

SEQ ID NO: 1889956 - protein, 24 aa, Staphylococcus
YYRVIKPWRVFKIFMLCFLGNILG

SEQ ID NO: 1889957 - protein, 18 aa, Staphylococcus
YYTSLWYFITFGAFVAFG

SEQ ID NO: 1889958 - protein, 18 aa, Staphylococcus
YYVIEPIVNHIERGATTI

SEQ ID NO: 1889959 - protein, 19 aa, Staphylococcus
YYVPHIVPETTYYRVVTKN

SEQ ID NO: 1889960 - protein, 27 aa, Staphylococcus
YYWDTFQFFSPVTWSIIFLCLLFLLNI

SEQ ID NO: 1889961 - protein, 25 aa, Staphylococcus
YYWIKYSLYFVIEFIVLSVLTYFWY

SEQ ID NO: 1889962 - protein, 19 aa, Staphylococcus
YYWKKRKPHIQKMVESDRT

SEQ ID NO: 1889963 - protein, 24 aa, Staphylococcus
YYWRKRKPHIDKMVASDQTGMNVT

SEQ ID NO: 1889964 - protein, 18 aa, Staphylococcus
YYWRKRKSNIERMVATDH

SEQ ID NO: 1889965 - protein, 19 aa, Staphylococcus
YYYALVIGLIITIIALFSA

SEQ ID NO: 1889966 - protein, 22 aa, Staphylococcus
VFPEIVMALIFIKAVGPGSFSG

SEQ ID NO: 1889967 - protein, 24 aa, Staphylococcus
FGFIKRLLIPFGLHHIFHAPFWFE

SEQ ID NO: 1889968 - protein, 21 aa, Staphylococcus
RAGIMCPEFAIGMGPKIFSFR

SEQ ID NO: 1889969 - protein, 17 aa, Staphylococcus
FESFFGIEMMFLGNTEA

SEQ ID NO: 1889970 - protein, 20 aa, Staphylococcus
GGPGAVFWMWIIAFIGAASA

SEQ ID NO: 1889971 - protein, 17 aa, Staphylococcus
IPMLIPLLIKYAIDGVI

SEQ ID NO: 1889972 - protein, 17 aa, Staphylococcus
LDPALLRPGRFDRQIQV

SEQ ID NO: 1889973 - protein, 17 aa, Staphylococcus
LFWAFALCLLPFSLMLV

SEQ ID NO: 1889974 - protein, 21 aa, Staphylococcus
LGWNYWFNWVITVAADVTIAA

SEQ ID NO: 1889975 - protein, 17 aa, Staphylococcus
SFMPLKHLWSLAIEEQF

SEQ ID NO: 1889976 - protein, 21 aa, Staphylococcus
SQRKIDVEPVFGFMKAILGFT

SEQ ID NO: 1889977 - protein, 17 aa, Staphylococcus
TSTISGVATKVGTYPIV

SEQ ID NO: 1889978 - protein, 18 aa, Staphylococcus
VIDKRLKYIILHEYAHAK

SEQ ID NO: 1889979 - protein, 18 aa, Staphylococcus
VTGWTYWLCWIITGMAEV

SEQ ID NO: 1889980 - protein, 21 aa, Staphylococcus
YMAKRRIGALIVFEKETGLQD

SEQ ID NO: 1889981 - protein, 20 aa, Staphylococcus
EFAIGMGPKIFSFRKNETLY

SEQ ID NO: 1889982 - protein, 17 aa, Staphylococcus
FVGFLGISYVTFKSVQL

SEQ ID NO: 1889983 - protein, 17 aa, Staphylococcus
FVIVTAYQFGQYAMLFL

SEQ ID NO: 1889984 - protein, 22 aa, Staphylococcus
GIHEIYFPYVLMRPLLFIAVIL

SEQ ID NO: 1889985 - protein, 18 aa, Staphylococcus
GLLAPWIAGAAMALSSVS

SEQ ID NO: 1889986 - protein, 20 aa, Staphylococcus
GSVGEMFRPFALAIAFSLLA

SEQ ID NO: 1889987 - protein, 20 aa, Staphylococcus
GSVGEMFRPFALAITFSLLA

SEQ ID NO: 1889988 - protein, 18 aa, Staphylococcus
IACGFIFYPITMLITKKH

SEQ ID NO: 1889989 - protein, 17 aa, Staphylococcus
IEFVGFLGISYVTFKSV

SEQ ID NO: 1889990 - protein, 18 aa, Staphylococcus
IFCEIAFWFVILLGLVTR

SEQ ID NO: 1889991 - protein, 18 aa, Staphylococcus
IGFGLCWPYVLLPYGFGQ

SEQ ID NO: 1889992 - protein, 17 aa, Staphylococcus
IVLGCTFTAVAPMILIG

SEQ ID NO: 1889993 - protein, 24 aa, Staphylococcus
KQSKLILIFICIFTFLLMVIQSQF

SEQ ID NO: 1889994 - protein, 18 aa, Staphylococcus
LDPALLRPGRFDRQIQVG

SEQ ID NO: 1889995 - protein, 18 aa, Staphylococcus
LFVICMFVSISMGTSVGT

SEQ ID NO: 1889996 - protein, 18 aa, Staphylococcus
LKHLWSLAIEEQFYLFFP

SEQ ID NO: 1889997 - protein, 18 aa, Staphylococcus
LLPVGGYVRMAGDGLEEP

SEQ ID NO: 1889998 - protein, 17 aa, Staphylococcus
LPIAMPVIMAGIRTAMV

SEQ ID NO: 1889999 - protein, 19 aa, Staphylococcus
MFRPFALAIAFSLLASLLV

SEQ ID NO: 1890000 - protein, 21 aa, Staphylococcus
MRRYLMRFVHHIGGLADFSAL

SEQ ID NO: 1890001 - protein, 23 aa, Staphylococcus
NFWIYWKTMFAFEPWHSAMEMRR

SEQ ID NO: 1890002 - protein, 20 aa, Staphylococcus
PRGLGVLFFVEFWERFSYYG

SEQ ID NO: 1890003 - protein, 17 aa, Staphylococcus
TSTGFILASAGSAIGLG

SEQ ID NO: 1890004 - protein, 20 aa, Staphylococcus
VELPLALPLIISGIRLSSVY

SEQ ID NO: 1890005 - protein, 20 aa, Staphylococcus
VGIPRFVIVTAYQFGQYAML

SEQ ID NO: 1890006 - protein, 18 aa, Staphylococcus
VMGTGFAFWSFVLAIVLI

SEQ ID NO: 1890007 - protein, 20 aa, Staphylococcus
WFKFWSVIESGGWVIFNHME

SEQ ID NO: 1890008 - protein, 19 aa, Staphylococcus
AFFISRGFVKTGLGRRIAL

SEQ ID NO: 1890009 - protein, 20 aa, Staphylococcus
AFFISRGFVKTGLGRRIALQ

SEQ ID NO: 1890010 - protein, 20 aa, Staphylococcus
AGKAIPHWDIFGLHINQVGY

SEQ ID NO: 1890011 - protein, 22 aa, Staphylococcus
ALGWNYWFNWVITVAADVTIAA

SEQ ID NO: 1890012 - protein, 23 aa, Staphylococcus
AVRLRWFPVAGWEGFSTAVLPSL

SEQ ID NO: 1890013 - protein, 22 aa, Staphylococcus
AYVEIFCGFILFLFTFIEFNNR

SEQ ID NO: 1890014 - protein, 19 aa, Staphylococcus
DCVTIIIALSIMFFLDVKL

SEQ ID NO: 1890015 - protein, 17 aa, Staphylococcus
DIVIQWGVLALIVIFQP

SEQ ID NO: 1890016 - protein, 20 aa, Staphylococcus
EAYLSYRLEQEYSKDEIFQV

SEQ ID NO: 1890017 - protein, 18 aa, Staphylococcus
EGHKLIGIRGMPRVGKTE

SEQ ID NO: 1890018 - protein, 19 aa, Staphylococcus
EVLRLPRIILAILAGMALG

SEQ ID NO: 1890019 - protein, 19 aa, Staphylococcus
FALLFRFIVKLIPIYYIFR

SEQ ID NO: 1890020 - protein, 18 aa, Staphylococcus
FFNKFVFHGRIQYNVDDL

SEQ ID NO: 1890021 - protein, 19 aa, Staphylococcus
FFWFFKLNYSFGHIINSKI

SEQ ID NO: 1890022 - protein, 24 aa, Staphylococcus
FGFILRLLGPFGLHHIFYLPFWQT

SEQ ID NO: 1890023 - protein, 18 aa, Staphylococcus
FGLIIGILVLISYLLFLL

SEQ ID NO: 1890024 - protein, 18 aa, Staphylococcus
FHTIMFSSYLWKNVGWDS

SEQ ID NO: 1890025 - protein, 19 aa, Staphylococcus
FIMKFGFRKIEAIVGTLIF

SEQ ID NO: 1890026 - protein, 19 aa, Staphylococcus
FKLFLPWYYLIKFVMPVVI

SEQ ID NO: 1890027 - protein, 22 aa, Staphylococcus
FKRTRISMFIWLVFLLPLPFLL

SEQ ID NO: 1890028 - protein, 17 aa, Staphylococcus
FKTREDFETEALLADYN

SEQ ID NO: 1890029 - protein, 17 aa, Staphylococcus
FLLLFIMKFGFRKIEAI

SEQ ID NO: 1890030 - protein, 25 aa, Staphylococcus
FLLLFIMRFGFRKIEAIVGTLIFTV

SEQ ID NO: 1890031 - protein, 18 aa, Staphylococcus
FLPKEVPAGIFIAAFGAP

SEQ ID NO: 1890032 - protein, 18 aa, Staphylococcus
FNMIWKAMLIPSLGYIVG

SEQ ID NO: 1890033 - protein, 17 aa, Staphylococcus
FSSYLWKNVGWDSIIYF

SEQ ID NO: 1890034 - protein, 23 aa, Staphylococcus
FWNRWHMTLSFWFRDCIYMRSLF

SEQ ID NO: 1890035 - protein, 18 aa, Staphylococcus
GKILAAMLFGMFIAILNQ

SEQ ID NO: 1890036 - protein, 18 aa, Staphylococcus
GLAPFTILFSLPYTVIGV

SEQ ID NO: 1890037 - protein, 19 aa, Staphylococcus
GNVFPVLSPILGWIGVFMT

SEQ ID NO: 1890038 - protein, 18 aa, Staphylococcus
GTRIRPILMTAIATIGAL

SEQ ID NO: 1890039 - protein, 24 aa, Staphylococcus
GVTFKELWLPVLTICFILAISKIT

SEQ ID NO: 1890040 - protein, 17 aa, Staphylococcus
GVWLYHFLERVLIPTGL

SEQ ID NO: 1890041 - protein, 19 aa, Staphylococcus
GVWLYHFLERVLIPTGLHH

SEQ ID NO: 1890042 - protein, 25 aa, Staphylococcus
HATLWASLVAILGGIMFLIRPKKKH

SEQ ID NO: 1890043 - protein, 20 aa, Staphylococcus
IDLRFPRIFIALFVGAILAV

SEQ ID NO: 1890044 - protein, 19 aa, Staphylococcus
IEARIHIVIPELNYDHHYT

SEQ ID NO: 1890045 - protein, 20 aa, Staphylococcus
IFHAPFWFEFGSWKNAAGEI

SEQ ID NO: 1890046 - protein, 19 aa, Staphylococcus
IGFGLCWPYVLLPYGFGQI

SEQ ID NO: 1890047 - protein, 18 aa, Staphylococcus
IIIDDAFVHFDKQRKSMM

SEQ ID NO: 1890048 - protein, 18 aa, Staphylococcus
IIVACLKTAIGLITAFSE

SEQ ID NO: 1890049 - protein, 17 aa, Staphylococcus
IMFSVFIAFVFQDDSAI

SEQ ID NO: 1890050 - protein, 18 aa, Staphylococcus
IMKFGFRKIEAIVGTLIF

SEQ ID NO: 1890051 - protein, 17 aa, Staphylococcus
IQSFKVIIVIAFLGAII

SEQ ID NO: 1890052 - protein, 17 aa, Staphylococcus
ISMGMSWAAANDIGRNF

SEQ ID NO: 1890053 - protein, 24 aa, Staphylococcus
IVSFCFIFLLLLFFRYILKRYFNY

SEQ ID NO: 1890054 - protein, 23 aa, Staphylococcus
IYVSLRFEWRMGLSAVLALLHDV

SEQ ID NO: 1890055 - protein, 23 aa, Staphylococcus
IYVSLRFEWRMGLSSVLALLHDV

SEQ ID NO: 1890056 - protein, 17 aa, Staphylococcus
KAIFPFIIASGFIADTT

SEQ ID NO: 1890057 - protein, 19 aa, Staphylococcus
KEVPAGIFIAAFGAPFFIY

SEQ ID NO: 1890058 - protein, 19 aa, Staphylococcus
KIIGGIGWLLAKITRQPKF

SEQ ID NO: 1890059 - protein, 19 aa, Staphylococcus
KIVLMILMFIGRVGLISFI

SEQ ID NO: 1890060 - protein, 19 aa, Staphylococcus
KKLFRLPAIKRFEEDEDLL

SEQ ID NO: 1890061 - protein, 20 aa, Staphylococcus
KLFGELEFWFAIIKIITIIA

SEQ ID NO: 1890062 - protein, 18 aa, Staphylococcus
KLSLIVYLVMGWVGIIFL

SEQ ID NO: 1890063 - protein, 22 aa, Staphylococcus
KQGTGLGLFICKMIIEEHGGTI

SEQ ID NO: 1890064 - protein, 20 aa, Staphylococcus
KRLPEMLGVFQGLTFVVTIS

SEQ ID NO: 1890065 - protein, 19 aa, Staphylococcus
KSYKWRIIGFFAFLIIAIL

SEQ ID NO: 1890066 - protein, 19 aa, Staphylococcus
KVFGCLGIALAMYSTTPKE

SEQ ID NO: 1890067 - protein, 20 aa, Staphylococcus
KVHLMKECLERGIDMISSMG

SEQ ID NO: 1890068 - protein, 18 aa, Staphylococcus
KWLTGGFIGVDTFFVISG

SEQ ID NO: 1890069 - protein, 23 aa, Staphylococcus
KYHKYRLEVLSAYQTTTKDNYIQ

SEQ ID NO: 1890070 - protein, 21 aa, Staphylococcus
LATSLIFSWSVVTGSYSNAAM

SEQ ID NO: 1890071 - protein, 18 aa, Staphylococcus
LFIICMFVSISMGTSVGT

SEQ ID NO: 1890072 - protein, 18 aa, Staphylococcus
LFLRNIRTTAISIVSIPL

SEQ ID NO: 1890073 - protein, 18 aa, Staphylococcus
LFLRNIRTTAISIVSIPM

SEQ ID NO: 1890074 - protein, 22 aa, Staphylococcus
LGLKTASTWKKFEVYENNKKLP

SEQ ID NO: 1890075 - protein, 17 aa, Staphylococcus
LLLPRLGAALTVVMTVA

SEQ ID NO: 1890076 - protein, 18 aa, Staphylococcus
LPLALPLILGGIRLSSVY

SEQ ID NO: 1890077 - protein, 18 aa, Staphylococcus
LSLPFAMFGLFASMFFII

SEQ ID NO: 1890078 - protein, 20 aa, Staphylococcus
LTHIDWWQSYQFYHQNTKLQ

SEQ ID NO: 1890079 - protein, 18 aa, Staphylococcus
LTVKETFLTWSLLETIIS

SEQ ID NO: 1890080 - protein, 18 aa, Staphylococcus
LTVKETFLTWSLLETVIS

SEQ ID NO: 1890081 - protein, 22 aa, Staphylococcus
LWEHIIKLKMPFFDKNESGQLM

SEQ ID NO: 1890082 - protein, 20 aa, Staphylococcus
MAKRRIGALIVFEKETGLQD

SEQ ID NO: 1890083 - protein, 19 aa, Staphylococcus
MDFFWELATLILIMLLGHW

SEQ ID NO: 1890084 - protein, 23 aa, Staphylococcus
MLGFYRLPGLVAIIALTTYIYLT

SEQ ID NO: 1890085 - protein, 17 aa, Staphylococcus
MSSWTLYYWGWWLSWSP

SEQ ID NO: 1890086 - protein, 17 aa, Staphylococcus
MSTWTLYYWGWWLSWSP

SEQ ID NO: 1890087 - protein, 20 aa, Staphylococcus
MVLTAIALVIVWFIFNQIVA

SEQ ID NO: 1890088 - protein, 22 aa, Staphylococcus
MYIPHFLSWVVVVGIFQKVLAP

SEQ ID NO: 1890089 - protein, 22 aa, Staphylococcus
NARPNQHFSIRKFSIGAASITL

SEQ ID NO: 1890090 - protein, 18 aa, Staphylococcus
NRNFRFFQIFTAALQSFS

SEQ ID NO: 1890091 - protein, 17 aa, Staphylococcus
NRVAVPISIFFGGVKMM

SEQ ID NO: 1890092 - protein, 21 aa, Staphylococcus
PEFAIGMGPKIFSFRKDETLY

SEQ ID NO: 1890093 - protein, 19 aa, Staphylococcus
PVIFAIGVAIGLARSDKGT

SEQ ID NO: 1890094 - protein, 18 aa, Staphylococcus
QNLFWAFGYNIAGIPIAA

SEQ ID NO: 1890095 - protein, 21 aa, Staphylococcus
RDEAWLKKKLNYISKKTYQGI

SEQ ID NO: 1890096 - protein, 19 aa, Staphylococcus
RGIENINMFTFIQLLTPFV

SEQ ID NO: 1890097 - protein, 19 aa, Staphylococcus
RISDALIRMQREHVHISLI

SEQ ID NO: 1890098 - protein, 18 aa, Staphylococcus
RISDALVRMQREHVHISL

SEQ ID NO: 1890099 - protein, 17 aa, Staphylococcus
RKIEAIVGTLIFTVLAI

SEQ ID NO: 1890100 - protein, 18 aa, Staphylococcus
RNKLKFGLIIGILVLISY

SEQ ID NO: 1890101 - protein, 18 aa, Staphylococcus
RVVKWLIILLISMLASIS

SEQ ID NO: 1890102 - protein, 19 aa, Staphylococcus
RYGAWAVLLCRFIPVLRVL

SEQ ID NO: 1890103 - protein, 22 aa, Staphylococcus
SFIFLCIFSFGILSSSSAFAEG

SEQ ID NO: 1890104 - protein, 21 aa, Staphylococcus
SKRLPEMLGVFQGLTFVVTIS

SEQ ID NO: 1890105 - protein, 18 aa, Staphylococcus
SMFSFGFLFGPLIGAYLI

SEQ ID NO: 1890106 - protein, 17 aa, Staphylococcus
SVLTICFILAVSKITTY

SEQ ID NO: 1890107 - protein, 25 aa, Staphylococcus
TATKRLPWLIILTFLGMITATILGS

SEQ ID NO: 1890108 - protein, 25 aa, Staphylococcus
TIRNIRQNLFWAFGYNVAGIPIAAL

SEQ ID NO: 1890109 - protein, 26 aa, Staphylococcus
TTSFILAFPMAWIWPFIQNGLNAFST

SEQ ID NO: 1890110 - protein, 17 aa, Staphylococcus
TVELGLKTASTWKKFEV

SEQ ID NO: 1890111 - protein, 17 aa, Staphylococcus
VAVPISIFFGGVKMMMP

SEQ ID NO: 1890112 - protein, 17 aa, Staphylococcus
VEKKIPWGTIIVFGVGI

SEQ ID NO: 1890113 - protein, 17 aa, Staphylococcus
VELPIAMPVIMAGIRTA

SEQ ID NO: 1890114 - protein, 18 aa, Staphylococcus
VFIAFVFQDDSAIKSMGI

SEQ ID NO: 1890115 - protein, 18 aa, Staphylococcus
VILIPVFILFALVDFGFG

SEQ ID NO: 1890116 - protein, 18 aa, Staphylococcus
VILIPVFILFALVNFGFG

SEQ ID NO: 1890117 - protein, 18 aa, Staphylococcus
VKDYGSGMTPFYTALSIW

SEQ ID NO: 1890118 - protein, 22 aa, Staphylococcus
VRLRWFPVAGWEGFSTAVLPSL

SEQ ID NO: 1890119 - protein, 19 aa, Staphylococcus
VSAGYKWFFAYPDQHIETV

SEQ ID NO: 1890120 - protein, 17 aa, Staphylococcus
VSHELRTPISLLQGYTE

SEQ ID NO: 1890121 - protein, 18 aa, Staphylococcus
VTGWTYWFCWIITGMAEV

SEQ ID NO: 1890122 - protein, 27 aa, Staphylococcus
VTLKNADWWKSFQFFTPQNKELTTTVV

SEQ ID NO: 1890123 - protein, 17 aa, Staphylococcus
VVYFRFFSDFLTFSTLN

SEQ ID NO: 1890124 - protein, 25 aa, Staphylococcus
VYFIICLLISFLALISMNIRILSGI

SEQ ID NO: 1890125 - protein, 18 aa, Staphylococcus
WMSSWTLYYWGWWLSWSP

SEQ ID NO: 1890126 - protein, 17 aa, Staphylococcus
WWQSYQFYHQNTKLQHE

SEQ ID NO: 1890127 - protein, 22 aa, Staphylococcus
YMPYICSYFMPRAIGDRPLVVP

SEQ ID NO: 1890128 - protein, 17 aa, Staphylococcus
YTTQIAFAKPVPQPAKA

SEQ ID NO: 1890129 - protein, 17 aa, Staphylococcus
YYAVIDFTGFEKMIDEL

SEQ ID NO: 1890130 - protein, 30 aa, Staphylococcus
YYFEAELNHAKWWKSFEFYDENNNKLNTVV

SEQ ID NO: 1890131 - protein, 26 aa, Staphylococcus
AACIAYRVGLRWEDLEEGISKRLNTA

SEQ ID NO: 1890132 - protein, 24 aa, Staphylococcus
AAFFYSIYESIKWLINTNYEPHLY

SEQ ID NO: 1890133 - protein, 19 aa, Staphylococcus
AAFGAWFIYKRRKMVKEEG

SEQ ID NO: 1890134 - protein, 19 aa, Staphylococcus
AAFGAWFVYRRRKMVKEQG

SEQ ID NO: 1890135 - protein, 18 aa, Staphylococcus
AAFGAWLIYKRRKMAKEE

SEQ ID NO: 1890136 - protein, 25 aa, Staphylococcus
AAFIAYRVGLRWEDLEEGITKRLTT

SEQ ID NO: 1890137 - protein, 17 aa, Staphylococcus
AAGALAFIGLILSPAVG

SEQ ID NO: 1890138 - protein, 18 aa, Staphylococcus
AAIFHWTAGFSFSAGLID

SEQ ID NO: 1890139 - protein, 20 aa, Staphylococcus
AAIGICFTAFLALGVIMISL

SEQ ID NO: 1890140 - protein, 19 aa, Staphylococcus
AAIKDVEWGTIIVTLATFA

SEQ ID NO: 1890141 - protein, 17 aa, Staphylococcus
AALGGLFLVGRRRKNEN

SEQ ID NO: 1890142 - protein, 20 aa, Staphylococcus
AALIARRVGLKWQDLEEGIT

SEQ ID NO: 1890143 - protein, 22 aa, Staphylococcus
AANTLSGRAWVVDQGTPATMSN

SEQ ID NO: 1890144 - protein, 24 aa, Staphylococcus
AARTGNPIKLMIGFNARDRHHNPE

SEQ ID NO: 1890145 - protein, 18 aa, Staphylococcus
AATFHWTAGFSFSAGLID

SEQ ID NO: 1890146 - protein, 18 aa, Staphylococcus
AAVSKILALKAMLRSIPN

SEQ ID NO: 1890147 - protein, 20 aa, Staphylococcus
ACGFVGAMGWIIYVIAMDMN

SEQ ID NO: 1890148 - protein, 22 aa, Staphylococcus
ACLVIGMILCRSRVKIKFDWRG

SEQ ID NO: 1890149 - protein, 19 aa, Staphylococcus
ADGKWGFSFTDKDGDLAGS

SEQ ID NO: 1890150 - protein, 21 aa, Staphylococcus
ADGKYNALVSYGGRSFSILRA

SEQ ID NO: 1890151 - protein, 24 aa, Staphylococcus
ADGNRTDTKFSIKVVDTTAPTVKG

SEQ ID NO: 1890152 - protein, 18 aa, Staphylococcus
ADHDLKMGDYYAAIYIPE

SEQ ID NO: 1890153 - protein, 19 aa, Staphylococcus
ADHDLKMGKYYAAMYIPEK

SEQ ID NO: 1890154 - protein, 23 aa, Staphylococcus
ADHEIRMGKYYAGIYIPKKFTHQ

SEQ ID NO: 1890155 - protein, 20 aa, Staphylococcus
ADMGAWRWMLGLAVVPSIIL

SEQ ID NO: 1890156 - protein, 17 aa, Staphylococcus
ADMKRLNRYGVDGVFTN

SEQ ID NO: 1890157 - protein, 25 aa, Staphylococcus
ADPMIKFLIPLLIAFSGGRLIHGLR

SEQ ID NO: 1890158 - protein, 17 aa, Staphylococcus
ADRVCLERIINNLISNI

SEQ ID NO: 1890159 - protein, 24 aa, Staphylococcus
ADTVRKDFVSGFIAGAFIGSAVGF

SEQ ID NO: 1890160 - protein, 17 aa, Staphylococcus
AEAWRWMIGLAVVPAII

SEQ ID NO: 1890161 - protein, 20 aa, Staphylococcus
AEFYASFAFAILISILIDIG

SEQ ID NO: 1890162 - protein, 25 aa, Staphylococcus
AEGIGYFWFDVCILLVFIIVFTILN

SEQ ID NO: 1890163 - protein, 21 aa, Staphylococcus
AEGYRAALLHKEWYFINHWHL

SEQ ID NO: 1890164 - protein, 23 aa, Staphylococcus
AEILYKLILKYLRWNLKIIKGSI

SEQ ID NO: 1890165 - protein, 18 aa, Staphylococcus
AEIPYNLMKAMFGKLKEA

SEQ ID NO: 1890166 - protein, 19 aa, Staphylococcus
AELFFDLVFVYVLSTINQT

SEQ ID NO: 1890167 - protein, 17 aa, Staphylococcus
AELFFKFTNATEVIHGI

SEQ ID NO: 1890168 - protein, 22 aa, Staphylococcus
AELPLFSGWGLRTIIYVFILTA

SEQ ID NO: 1890169 - protein, 20 aa, Staphylococcus
AELPMFSGWGLRSIIYIFIL

SEQ ID NO: 1890170 - protein, 22 aa, Staphylococcus
AELPMFSGWGLRSIIYIFILIA

SEQ ID NO: 1890171 - protein, 22 aa, Staphylococcus
AELPMFSGWGLRTIIYLFILAA

SEQ ID NO: 1890172 - protein, 23 aa, Staphylococcus
AELPMFSGWGLRTIIYLFILTAA

SEQ ID NO: 1890173 - protein, 23 aa, Staphylococcus
AELPMFSGWGLRTIIYLLILATA

SEQ ID NO: 1890174 - protein, 22 aa, Staphylococcus
AELVYRLILKYLRWNIRTIKGS

SEQ ID NO: 1890175 - protein, 19 aa, Staphylococcus
AERKLPKFVLYALLVIGIV

SEQ ID NO: 1890176 - protein, 18 aa, Staphylococcus
AETIDIILLLAFLILMIF

SEQ ID NO: 1890177 - protein, 18 aa, Staphylococcus
AEVKKVFPNKLSVKVTEK

SEQ ID NO: 1890178 - protein, 21 aa, Staphylococcus
AEVPFKRFVFDMSTLAPFIAA

SEQ ID NO: 1890179 - protein, 19 aa, Staphylococcus
AFAGSFAYIYFMKDVLGFD

SEQ ID NO: 1890180 - protein, 28 aa, Staphylococcus
AFFKEHWPKLLIIIGIILLLLILNAIFT

SEQ ID NO: 1890181 - protein, 22 aa, Staphylococcus
AFKELWLPIITICFILVISKLM

SEQ ID NO: 1890182 - protein, 17 aa, Staphylococcus
AFLRIPVGLNHNPIVEY

SEQ ID NO: 1890183 - protein, 17 aa, Staphylococcus
AFLSFLFLLFFVGSVSG

SEQ ID NO: 1890184 - protein, 23 aa, Staphylococcus
AFNKLSPRFSVVFLIIIYLTIGP

SEQ ID NO: 1890185 - protein, 19 aa, Staphylococcus
AFRLFPFVFIFAVGGASLA

SEQ ID NO: 1890186 - protein, 20 aa, Staphylococcus
AGIFSLLSIHGFIITIGAFG

SEQ ID NO: 1890187 - protein, 20 aa, Staphylococcus
AGIKGALIGTVWLMITIIPI

SEQ ID NO: 1890188 - protein, 19 aa, Staphylococcus
AGKAIPHWDVFGLHINQVG

SEQ ID NO: 1890189 - protein, 19 aa, Staphylococcus
AGLAALGGLSIFGRRRKKN

SEQ ID NO: 1890190 - protein, 19 aa, Staphylococcus
AGPMISYLIPLLIAYSGGR

SEQ ID NO: 1890191 - protein, 29 aa, Staphylococcus
AGTIATYVGWRWIFILSIIFAFIAIILLR

SEQ ID NO: 1890192 - protein, 19 aa, Staphylococcus
AGVPLTIFLGGVKMMIPNM

SEQ ID NO: 1890193 - protein, 19 aa, Staphylococcus
AGWMGFKFSFGLDQILGAI

SEQ ID NO: 1890194 - protein, 25 aa, Staphylococcus
AHHPIEMGMIWKAMIIPSLGYIVGL

SEQ ID NO: 1890195 - protein, 18 aa, Staphylococcus
AHMSWRIVYFILTVVYIL

SEQ ID NO: 1890196 - protein, 17 aa, Staphylococcus
AHRFGRKRILSISLLIL

SEQ ID NO: 1890197 - protein, 24 aa, Staphylococcus
AIAAIVISCYFIRKVTAFFTKKLL

SEQ ID NO: 1890198 - protein, 17 aa, Staphylococcus
AIACGFFLFMFGGVASD

SEQ ID NO: 1890199 - protein, 17 aa, Staphylococcus
AIACGFFLFMFGGVIND

SEQ ID NO: 1890200 - protein, 17 aa, Staphylococcus
AIASMLIVYALRDRLTV

SEQ ID NO: 1890201 - protein, 17 aa, Staphylococcus
AIEALYYNRYLKRHDEV

SEQ ID NO: 1890202 - protein, 31 aa, Staphylococcus
AIFKNKNYLKMLAMAIIIILLSMLALGIHKV

SEQ ID NO: 1890203 - protein, 24 aa, Staphylococcus
AIGAFCIIMIFALLGFLPYNLNPA

SEQ ID NO: 1890204 - protein, 18 aa, Staphylococcus
AIIGFFVFVHFKYGDQSG

SEQ ID NO: 1890205 - protein, 18 aa, Staphylococcus
AIILLFGIMYYRSIKTVD

SEQ ID NO: 1890206 - protein, 23 aa, Staphylococcus
AIKWDFQTLIGFVFAPFAFLAGV

SEQ ID NO: 1890207 - protein, 17 aa, Staphylococcus
AILACIFANVGLTKIIM

SEQ ID NO: 1890208 - protein, 23 aa, Staphylococcus
AILCFLSFKMGELPIYIILIYAC

SEQ ID NO: 1890209 - protein, 17 aa, Staphylococcus
AILFKFNLAHVATLASV

SEQ ID NO: 1890210 - protein, 20 aa, Staphylococcus
AILLICRFIMGFAIGMDSPV

SEQ ID NO: 1890211 - protein, 19 aa, Staphylococcus
AILYFEIITTIAIGLGLII

SEQ ID NO: 1890212 - protein, 18 aa, Staphylococcus
AILYFGLFVCAMSFLYIL

SEQ ID NO: 1890213 - protein, 17 aa, Staphylococcus
AIMVLRLGYLQIAQGSH

SEQ ID NO: 1890214 - protein, 19 aa, Staphylococcus
AIPETGGGFVFVKKAFSPG

SEQ ID NO: 1890215 - protein, 17 aa, Staphylococcus
AIREILKPYGLPMLTFP

SEQ ID NO: 1890216 - protein, 17 aa, Staphylococcus
AIRSVLWRHIIHLKMPF

SEQ ID NO: 1890217 - protein, 22 aa, Staphylococcus
AITRLVVRQSISFRKVLSDYVL

SEQ ID NO: 1890218 - protein, 20 aa, Staphylococcus
AITVCITLAISHKVSGLTKD

SEQ ID NO: 1890219 - protein, 19 aa, Staphylococcus
AIVKTRFPFHIGIMTGLYT

SEQ ID NO: 1890220 - protein, 19 aa, Staphylococcus
AIVVIFGIIVLRLGYLQIA

SEQ ID NO: 1890221 - protein, 21 aa, Staphylococcus
AKDGLFPKWFAKENKNKAPIN

SEQ ID NO: 1890222 - protein, 19 aa, Staphylococcus
AKDMKVSILINEGSASASE

SEQ ID NO: 1890223 - protein, 18 aa, Staphylococcus
AKEFKWRLPDKITIRNSA

SEQ ID NO: 1890224 - protein, 18 aa, Staphylococcus
AKELPWGLLILFGGGLAL

SEQ ID NO: 1890225 - protein, 19 aa, Staphylococcus
AKELPWGVLILFGGGLALA

SEQ ID NO: 1890226 - protein, 18 aa, Staphylococcus
AKGDLNYILSPIKDRPSL

SEQ ID NO: 1890227 - protein, 23 aa, Staphylococcus
AKGLKLKVIFNFGLPLIIALLHG

SEQ ID NO: 1890228 - protein, 18 aa, Staphylococcus
AKGLKLKVLFNFSLPLII

SEQ ID NO: 1890229 - protein, 17 aa, Staphylococcus
AKIIVIWCFRKYNNQMR

SEQ ID NO: 1890230 - protein, 33 aa, Staphylococcus
AKIVSGLIVLLLVGGLIFAIFAFVDHSNKANER

SEQ ID NO: 1890231 - protein, 19 aa, Staphylococcus
AKKKRSWVSLIIHIIVLIL

SEQ ID NO: 1890232 - protein, 17 aa, Staphylococcus
AKLIFVFMFIVYIFFCH

SEQ ID NO: 1890233 - protein, 21 aa, Staphylococcus
AKNKWLSVIGWLVILGVIITP

SEQ ID NO: 1890234 - protein, 22 aa, Staphylococcus
AKNTVSGQVWLETGTGVDLANS

SEQ ID NO: 1890235 - protein, 32 aa, Staphylococcus
AKPKSKKPWIWVGVGCLVFFILIIIGIVALTF

SEQ ID NO: 1890236 - protein, 19 aa, Staphylococcus
AKPPVALVRFWTLFIVFLL

SEQ ID NO: 1890237 - protein, 22 aa, Staphylococcus
AKQARLNIERGVHNDDVKVAKD

SEQ ID NO: 1890238 - protein, 19 aa, Staphylococcus
AKQMIKLLFEKAKIEIEKA

SEQ ID NO: 1890239 - protein, 17 aa, Staphylococcus
AKRSGAMSSRIAMLSII

SEQ ID NO: 1890240 - protein, 18 aa, Staphylococcus
AKVSELFKEAPVKSSAFA

SEQ ID NO: 1890241 - protein, 19 aa, Staphylococcus
AKWDYIGIFSFLFIISILL

SEQ ID NO: 1890242 - protein, 18 aa, Staphylococcus
AKYLKARGIYTIAISSSI

SEQ ID NO: 1890243 - protein, 18 aa, Staphylococcus
ALAPFTILFSLPYTIIGV

SEQ ID NO: 1890244 - protein, 21 aa, Staphylococcus
ALARFPWLSANIEYTVTREPY

SEQ ID NO: 1890245 - protein, 20 aa, Staphylococcus
ALASTFFKKGIKLKRNSQRQ

SEQ ID NO: 1890246 - protein, 18 aa, Staphylococcus
ALASTFFKRGLKQQRQVK

SEQ ID NO: 1890247 - protein, 18 aa, Staphylococcus
ALCYILWGIYLKDGLHKD

SEQ ID NO: 1890248 - protein, 17 aa, Staphylococcus
ALFASWLLIPQKLSRYI

SEQ ID NO: 1890249 - protein, 19 aa, Staphylococcus
ALFCSITLLSWLYLTKSHT

SEQ ID NO: 1890250 - protein, 19 aa, Staphylococcus
ALFLLCFYFLPNLNRYNET

SEQ ID NO: 1890251 - protein, 19 aa, Staphylococcus
ALFLLCFYHLPNLNRHKET

SEQ ID NO: 1890252 - protein, 19 aa, Staphylococcus
ALFLLCFYHLPNLNRYNES

SEQ ID NO: 1890253 - protein, 19 aa, Staphylococcus
ALFLLCFYHLPNLNRYNET

SEQ ID NO: 1890254 - protein, 23 aa, Staphylococcus
ALGGLFNFFTWGAFIPLILAIIG

SEQ ID NO: 1890255 - protein, 19 aa, Staphylococcus
ALGLYYKMKVFEKADQAIA

SEQ ID NO: 1890256 - protein, 17 aa, Staphylococcus
ALICIWGIITAMTVLLA

SEQ ID NO: 1890257 - protein, 18 aa, Staphylococcus
ALIGIRVGLKWNDIEEGI

SEQ ID NO: 1890258 - protein, 17 aa, Staphylococcus
ALKNLKIPLSIAGQGNQ

SEQ ID NO: 1890259 - protein, 18 aa, Staphylococcus
ALLFAAQLYLVFTKGAAG

SEQ ID NO: 1890260 - protein, 27 aa, Staphylococcus
ALLLVLAALAIFLGMYLNKDHGDNQAD

SEQ ID NO: 1890261 - protein, 23 aa, Staphylococcus
ALLYLLFCWTGIPGVIGMVEGVL

SEQ ID NO: 1890262 - protein, 25 aa, Staphylococcus
ALLYSRPLYYFGVVMKPLIWLMNGS

SEQ ID NO: 1890263 - protein, 20 aa, Staphylococcus
ALMSNWISVILWIVAGIMLL

SEQ ID NO: 1890264 - protein, 17 aa, Staphylococcus
ALQRLTGIIAFVFIFVH

SEQ ID NO: 1890265 - protein, 18 aa, Staphylococcus
ALSMMVSFVFIKNQIYFQ

SEQ ID NO: 1890266 - protein, 17 aa, Staphylococcus
ALVFCIIATIITAGISY

SEQ ID NO: 1890267 - protein, 25 aa, Staphylococcus
ALVIIACLLFRFSTVPAMLVSSVAA

SEQ ID NO: 1890268 - protein, 22 aa, Staphylococcus
ALVLLLAICCYKFLNVSNTDDN

SEQ ID NO: 1890269 - protein, 17 aa, Staphylococcus
ALVRFRLTLTRRGIENI

SEQ ID NO: 1890270 - protein, 19 aa, Staphylococcus
ALVRFWTLFIVFLLGMVIM

SEQ ID NO: 1890271 - protein, 17 aa, Staphylococcus
ALVVYSIFGLLLIPFFN

SEQ ID NO: 1890272 - protein, 17 aa, Staphylococcus
ALVYGYQRFDTMVIIIT

SEQ ID NO: 1890273 - protein, 21 aa, Staphylococcus
ALYAGFGIRFCAFIIDLLIIF

SEQ ID NO: 1890274 - protein, 17 aa, Staphylococcus
AMIGGILLLFKRRKNDE

SEQ ID NO: 1890275 - protein, 22 aa, Staphylococcus
AMMAAMCGFLFLAADPAKDGGF

SEQ ID NO: 1890276 - protein, 23 aa, Staphylococcus
ANDGYRIQPHIGLAIHDATNSDD

SEQ ID NO: 1890277 - protein, 17 aa, Staphylococcus
ANDWFKRYGAWAVLLCR

SEQ ID NO: 1890278 - protein, 18 aa, Staphylococcus
ANDWFKRYGAWAVLLCRF

SEQ ID NO: 1890279 - protein, 19 aa, Staphylococcus
ANECYKRKLFLPAAATLSV

SEQ ID NO: 1890280 - protein, 17 aa, Staphylococcus
ANGAQAFNVDKVIKANG

SEQ ID NO: 1890281 - protein, 20 aa, Staphylococcus
ANIEGWRWMLGLAVVPSVIL

SEQ ID NO: 1890282 - protein, 29 aa, Staphylococcus
ANKELKLIMSLGFILGGIIGFFQGIVAIF

SEQ ID NO: 1890283 - protein, 24 aa, Staphylococcus
ANKELKLIMSLGFILGGIIGIFQG

SEQ ID NO: 1890284 - protein, 23 aa, Staphylococcus
ANNGYRIQPHIGLAIHDSTNTDE

SEQ ID NO: 1890285 - protein, 23 aa, Staphylococcus
ANNGYRIQPHIGLAIHESTNKDD

SEQ ID NO: 1890286 - protein, 21 aa, Staphylococcus
ANNGYRIQPHIGLSIHDATNK

SEQ ID NO: 1890287 - protein, 23 aa, Staphylococcus
ANNGYRVQPHIGLAIHDATNSDQ

SEQ ID NO: 1890288 - protein, 20 aa, Staphylococcus
ANSIWAWLLVLVFLPLIGFI

SEQ ID NO: 1890289 - protein, 19 aa, Staphylococcus
ANSIWAWLLVLVFLPLLGF

SEQ ID NO: 1890290 - protein, 18 aa, Staphylococcus
APEGYKWNQSVKNSITER

SEQ ID NO: 1890291 - protein, 17 aa, Staphylococcus
APFFKNLFLPNGKLSSL

SEQ ID NO: 1890292 - protein, 19 aa, Staphylococcus
APFISAVICILIFKNKRAQ

SEQ ID NO: 1890293 - protein, 23 aa, Staphylococcus
APQKRWHFIIAFNSAMLIGLYVK

SEQ ID NO: 1890294 - protein, 18 aa, Staphylococcus
APQKRWHFILSFNSAILI

SEQ ID NO: 1890295 - protein, 23 aa, Staphylococcus
APQKRWHFLLAFNSAMVIGLFIK

SEQ ID NO: 1890296 - protein, 18 aa, Staphylococcus
APQKRWHYLIAFNSAVLI

SEQ ID NO: 1890297 - protein, 24 aa, Staphylococcus
AQFIPEFLGSLVIGIIAVIGHSLV

SEQ ID NO: 1890298 - protein, 24 aa, Staphylococcus
AQFIPEFLGSLVIGIISVLGHYLL

SEQ ID NO: 1890299 - protein, 19 aa, Staphylococcus
AQFIPEFVGSLVIGIIAVF

SEQ ID NO: 1890300 - protein, 21 aa, Staphylococcus
AQFIPEFVGSLVIGMIAVTGH

SEQ ID NO: 1890301 - protein, 19 aa, Staphylococcus
AQLIARLGIILGVLMNALG

SEQ ID NO: 1890302 - protein, 18 aa, Staphylococcus
AQLYLVFTKGAAGDREPV

SEQ ID NO: 1890303 - protein, 19 aa, Staphylococcus
AQRALKHIKIKGQSDKDIA

SEQ ID NO: 1890304 - protein, 20 aa, Staphylococcus
AQVEHVGWFIGLTVLISIVF

SEQ ID NO: 1890305 - protein, 20 aa, Staphylococcus
AQWIYRMIAFYTFVTIAYII

SEQ ID NO: 1890306 - protein, 24 aa, Staphylococcus
ARLFDMVIQWGFLAIIVIFQPEIR

SEQ ID NO: 1890307 - protein, 22 aa, Staphylococcus
ARLFGELEFWFAIIKIATIVGL

SEQ ID NO: 1890308 - protein, 22 aa, Staphylococcus
ARLFGELEFWFSIIKVVTIVAM

SEQ ID NO: 1890309 - protein, 18 aa, Staphylococcus
ARLTELRDSYQIHYDLSQ

SEQ ID NO: 1890310 - protein, 17 aa, Staphylococcus
ARPTEWMYFTFLVSGVL

SEQ ID NO: 1890311 - protein, 19 aa, Staphylococcus
ARPVAEIILRLMKVSAVAI

SEQ ID NO: 1890312 - protein, 18 aa, Staphylococcus
ARRICWFGSITVTLILAV

SEQ ID NO: 1890313 - protein, 23 aa, Staphylococcus
ARVKRLKMVLLILSVMLAGASIS

SEQ ID NO: 1890314 - protein, 17 aa, Staphylococcus
ASAKWGILAPIFVPMLI

SEQ ID NO: 1890315 - protein, 17 aa, Staphylococcus
ASAKWGILAPIFVPMMI

SEQ ID NO: 1890316 - protein, 20 aa, Staphylococcus
ASALLLSWLIVMFAILVAAY

SEQ ID NO: 1890317 - protein, 21 aa, Staphylococcus
ASDVKGIAYITAKRVKDGYEW

SEQ ID NO: 1890318 - protein, 19 aa, Staphylococcus
ASFFLCLVLSLGVVAPIKN

SEQ ID NO: 1890319 - protein, 26 aa, Staphylococcus
ASGQVLKTYWPVLAIGMILIGGGLLL

SEQ ID NO: 1890320 - protein, 17 aa, Staphylococcus
ASHLEIGHISREYNDDY

SEQ ID NO: 1890321 - protein, 23 aa, Staphylococcus
ASILVGATLIFGVANDQAEAAEN

SEQ ID NO: 1890322 - protein, 21 aa, Staphylococcus
ASINQAINVARLTAAKEHAIE

SEQ ID NO: 1890323 - protein, 21 aa, Staphylococcus
ASLISIIAMCFVRPGEKNMSR

SEQ ID NO: 1890324 - protein, 17 aa, Staphylococcus
ASLKITLLISVAAGIGL

SEQ ID NO: 1890325 - protein, 20 aa, Staphylococcus
ASLPRILKFPALQQQIKEFD

SEQ ID NO: 1890326 - protein, 18 aa, Staphylococcus
ASSTWAWIFVLFVLPVLG

SEQ ID NO: 1890327 - protein, 18 aa, Staphylococcus
ASVGSVFLFIIIVIFLMY

SEQ ID NO: 1890328 - protein, 25 aa, Staphylococcus
ASVIAWRVGLRWKDLEEGITARLGT

SEQ ID NO: 1890329 - protein, 18 aa, Staphylococcus
ATATWAWLFLLFVMPVLG

SEQ ID NO: 1890330 - protein, 20 aa, Staphylococcus
ATFLERFSYFLIIPFLSIYL

SEQ ID NO: 1890331 - protein, 24 aa, Staphylococcus
ATFLSWRWIFVFSIIVSLIAVLLI

SEQ ID NO: 1890332 - protein, 21 aa, Staphylococcus
ATFVGWRWIYILSIIIALLAM

SEQ ID NO: 1890333 - protein, 24 aa, Staphylococcus
ATIRLKKIVPWAIGGFIIILLIIV

SEQ ID NO: 1890334 - protein, 20 aa, Staphylococcus
ATLFGSLFAALGGLFLVGRR

SEQ ID NO: 1890335 - protein, 22 aa, Staphylococcus
ATMVLCAIFILSAYNNANSEQT

SEQ ID NO: 1890336 - protein, 25 aa, Staphylococcus
ATNLKLRRIVPLGIVFFILILIVVL

SEQ ID NO: 1890337 - protein, 17 aa, Staphylococcus
ATPPRTFARFSSLSQPA

SEQ ID NO: 1890338 - protein, 23 aa, Staphylococcus
ATPVQFIIGWQFYVGAYKNLRNG

SEQ ID NO: 1890339 - protein, 17 aa, Staphylococcus
ATQSGDYNLNYNVAGNE

SEQ ID NO: 1890340 - protein, 18 aa, Staphylococcus
ATQYEMYHSLGLIGIGIL

SEQ ID NO: 1890341 - protein, 17 aa, Staphylococcus
ATSHLLGYVGPINSEEL

SEQ ID NO: 1890342 - protein, 25 aa, Staphylococcus
ATSIRRSEIVFGYLIGYGAFAIVQT

SEQ ID NO: 1890343 - protein, 18 aa, Staphylococcus
ATSTWAWLFVLLVLPLIG

SEQ ID NO: 1890344 - protein, 17 aa, Staphylococcus
AVDKTKPGHVVFYGSNG

SEQ ID NO: 1890345 - protein, 17 aa, Staphylococcus
AVEALYFNRYLKRNDQV

SEQ ID NO: 1890346 - protein, 17 aa, Staphylococcus
AVETLYFNRYLKENDEV

SEQ ID NO: 1890347 - protein, 17 aa, Staphylococcus
AVETLYFNRYLKSGDEV

SEQ ID NO: 1890348 - protein, 24 aa, Staphylococcus
AVFTAEFYASFAFAILISIIIDIG

SEQ ID NO: 1890349 - protein, 18 aa, Staphylococcus
AVGYKFLSKRSMYLTIVA

SEQ ID NO: 1890350 - protein, 18 aa, Staphylococcus
AVICLILFIVALKSKKKA

SEQ ID NO: 1890351 - protein, 19 aa, Staphylococcus
AVIMPRIWPLNTIPDEYAK

SEQ ID NO: 1890352 - protein, 21 aa, Staphylococcus
AVIYRLFYKGAFDTMSVVAIV

SEQ ID NO: 1890353 - protein, 18 aa, Staphylococcus
AVLFRFIVHLIPIRYIFR

SEQ ID NO: 1890354 - protein, 18 aa, Staphylococcus
AVLLSPVWLGILCLMYLR

SEQ ID NO: 1890355 - protein, 20 aa, Staphylococcus
AVSFILHIPFFIGAMISGML

SEQ ID NO: 1890356 - protein, 20 aa, Staphylococcus
AVSIACGFFLFMFGGVAQDF

SEQ ID NO: 1890357 - protein, 25 aa, Staphylococcus
AVVSYLLYRVCKNAGWIKDGDQKIN

SEQ ID NO: 1890358 - protein, 19 aa, Staphylococcus
AVYLFRFVWVYVLYPYFYL

SEQ ID NO: 1890359 - protein, 21 aa, Staphylococcus
AWGILSGRMSFFFIVTIVVLG

SEQ ID NO: 1890360 - protein, 18 aa, Staphylococcus
AYCYHKFLPWLILVPVVS

SEQ ID NO: 1890361 - protein, 23 aa, Staphylococcus
AYELISALILAWSLMVSWNQLVA

SEQ ID NO: 1890362 - protein, 25 aa, Staphylococcus
AYFYSIYEMIKWFSGATNMPHLYFE

SEQ ID NO: 1890363 - protein, 25 aa, Staphylococcus
AYFYSIYEMIRWLLNKVNEPHLYFE

SEQ ID NO: 1890364 - protein, 24 aa, Staphylococcus
AYFYSLYEMIKWLSKNTYQPHLYF

SEQ ID NO: 1890365 - protein, 24 aa, Staphylococcus
AYFYSLYEMVKWLFNANVMPHLYF

SEQ ID NO: 1890366 - protein, 21 aa, Staphylococcus
AYGEIEFWFAIIKVIAILFLI

SEQ ID NO: 1890367 - protein, 21 aa, Staphylococcus
AYGWRPIKKRIKHSISGIIKA

SEQ ID NO: 1890368 - protein, 18 aa, Staphylococcus
AYGWRPLTKRLEKTIVTV

SEQ ID NO: 1890369 - protein, 19 aa, Staphylococcus
AYLSYRLEQEYSKDDIFQM

SEQ ID NO: 1890370 - protein, 25 aa, Staphylococcus
AYMPELNWHYGYFICLFVMLIISII

SEQ ID NO: 1890371 - protein, 18 aa, Staphylococcus
CAFLAMFIVYSLRNRLTV

SEQ ID NO: 1890372 - protein, 17 aa, Staphylococcus
CATRLRIVLKRSIPDAK

SEQ ID NO: 1890373 - protein, 22 aa, Staphylococcus
CCAGDFYWVWKMIKAPKNATIE

SEQ ID NO: 1890374 - protein, 22 aa, Staphylococcus
CCIPEGSWLRNAKTGSLIDDSP

SEQ ID NO: 1890375 - protein, 17 aa, Staphylococcus
CGAHIRQSYQNHPPHYN

SEQ ID NO: 1890376 - protein, 19 aa, Staphylococcus
CGFVGAVAWTIYQFTVGMD

SEQ ID NO: 1890377 - protein, 21 aa, Staphylococcus
CHWILKLTIMYLKWNISIVKG

SEQ ID NO: 1890378 - protein, 19 aa, Staphylococcus
CIGVALWAFGVHPYLAFFP

SEQ ID NO: 1890379 - protein, 18 aa, Staphylococcus
CILIGPGLGCDFKGNNAI

SEQ ID NO: 1890380 - protein, 21 aa, Staphylococcus
CLYLSLGVLLLDWLKRIPKMY

SEQ ID NO: 1890381 - protein, 18 aa, Staphylococcus
CMLLHLTPIFAILTAIVT

SEQ ID NO: 1890382 - protein, 21 aa, Staphylococcus
CNFIMIWLGERLLHWNPHVIG

SEQ ID NO: 1890383 - protein, 23 aa, Staphylococcus
CNNPNCPLREAIVVPLMTHGNVA

SEQ ID NO: 1890384 - protein, 17 aa, Staphylococcus
CRFWLPLIFSSLIFSSQ

SEQ ID NO: 1890385 - protein, 19 aa, Staphylococcus
CSIMIKWQPNYSMISPTSQ

SEQ ID NO: 1890386 - protein, 19 aa, Staphylococcus
CTLASLWIAQQFYREIAQR

SEQ ID NO: 1890387 - protein, 17 aa, Staphylococcus
CVFIIIAAMGFRRGIWL

SEQ ID NO: 1890388 - protein, 25 aa, Staphylococcus
CVRVFRLEIEWPFWLSQIGLVLLGV

SEQ ID NO: 1890389 - protein, 37 aa, Staphylococcus
DADNWTLDSGFYKTPVKYSLGDYVWYDSNQDGIQDYE

SEQ ID NO: 1890390 - protein, 23 aa, Staphylococcus
DALEALKKLGFEKISMNQEYSKM

SEQ ID NO: 1890391 - protein, 21 aa, Staphylococcus
DAYDQVRIFGADELNPVEIES

SEQ ID NO: 1890392 - protein, 19 aa, Staphylococcus
DCITIVIALSIMFFLDVKL

SEQ ID NO: 1890393 - protein, 19 aa, Staphylococcus
DCVTIIIALSIMFFLDIKL

SEQ ID NO: 1890394 - protein, 19 aa, Staphylococcus
DDERFAIMLYDWRVIENEL

SEQ ID NO: 1890395 - protein, 17 aa, Staphylococcus
DDFEFQMLFGFRTDLAY

SEQ ID NO: 1890396 - protein, 17 aa, Staphylococcus
DDFEFQMLYGFRSELAE

SEQ ID NO: 1890397 - protein, 23 aa, Staphylococcus
DDLPTNGFLFYWNPKTTGSNTSQ

SEQ ID NO: 1890398 - protein, 20 aa, Staphylococcus
DDNYFRYGGYNEYVKTESNQ

SEQ ID NO: 1890399 - protein, 20 aa, Staphylococcus
DDTWLLWAIIIVWATVSLFL

SEQ ID NO: 1890400 - protein, 20 aa, Staphylococcus
DDVSNAWSLVKFIALPMILI

SEQ ID NO: 1890401 - protein, 17 aa, Staphylococcus
DDWFAYFMRRLAERPQN

SEQ ID NO: 1890402 - protein, 23 aa, Staphylococcus
DEALRFIIMYFRWRNDKWRARMK

SEQ ID NO: 1890403 - protein, 31 aa, Staphylococcus
DEKRSWHLQSRGTFLEGVYKFTKEVEKLKNL

SEQ ID NO: 1890404 - protein, 17 aa, Staphylococcus
DELKFAKEWGVKGKASN

SEQ ID NO: 1890405 - protein, 18 aa, Staphylococcus
DEMLNILSTLGFIFLMFL

SEQ ID NO: 1890406 - protein, 21 aa, Staphylococcus
DESSLRFAGITQNKNSNGSTI

SEQ ID NO: 1890407 - protein, 21 aa, Staphylococcus
DESWLKKELNFISKRTYQGIF

SEQ ID NO: 1890408 - protein, 36 aa, Staphylococcus
DETNRGGLVSIVLTMLAGLGLIRRSKKDKNKDRKNN

SEQ ID NO: 1890409 - protein, 22 aa, Staphylococcus
DEVIDARLGYYSVVKETNVQLL

SEQ ID NO: 1890410 - protein, 17 aa, Staphylococcus
DFAESWSFMGIKYGMFV

SEQ ID NO: 1890411 - protein, 24 aa, Staphylococcus
DFGDLRYSTAIAFIFVNFLSIPIA

SEQ ID NO: 1890412 - protein, 23 aa, Staphylococcus
DFKYNILNIPSWLELDPDAKGNR

SEQ ID NO: 1890413 - protein, 19 aa, Staphylococcus
DFLSGLFDYEGNFDLPKAG

SEQ ID NO: 1890414 - protein, 21 aa, Staphylococcus
DFLSQKWWFVLILVVIVCGTI

SEQ ID NO: 1890415 - protein, 18 aa, Staphylococcus
DGKWGFSFEDKDGDLAGS

SEQ ID NO: 1890416 - protein, 18 aa, Staphylococcus
DGLFPKWFAKENENGAPV

SEQ ID NO: 1890417 - protein, 17 aa, Staphylococcus
DGLLPPWLSKLNHKHLP

SEQ ID NO: 1890418 - protein, 28 aa, Staphylococcus
DGRKIEIPCCPNGQPVIIVGYYYDTVGN

SEQ ID NO: 1890419 - protein, 19 aa, Staphylococcus
DGSFGWKGLLKAISEGIIG

SEQ ID NO: 1890420 - protein, 18 aa, Staphylococcus
DGSFNWKGLLTAISKGII

SEQ ID NO: 1890421 - protein, 25 aa, Staphylococcus
DGVKVCTNCGTPVYQQGSNQSHHQY

SEQ ID NO: 1890422 - protein, 23 aa, Staphylococcus
DHIKFSLFLAMLIACLLIQAATN

SEQ ID NO: 1890423 - protein, 22 aa, Staphylococcus
DHKMYFIMGALFIFLMIFYVMN

SEQ ID NO: 1890424 - protein, 18 aa, Staphylococcus
DHLWLKDYSLEWFPIAVI

SEQ ID NO: 1890425 - protein, 20 aa, Staphylococcus
DIFIWFKLVLNDASDYHQIK

SEQ ID NO: 1890426 - protein, 22 aa, Staphylococcus
DINELKQRIALLEEINGGLKKY

SEQ ID NO: 1890427 - protein, 17 aa, Staphylococcus
DINKVLERNNFASNREL

SEQ ID NO: 1890428 - protein, 17 aa, Staphylococcus
DIQRSFAVFIMASILTF

SEQ ID NO: 1890429 - protein, 19 aa, Staphylococcus
DIVGWRYTFLFIIVVSVLA

SEQ ID NO: 1890430 - protein, 17 aa, Staphylococcus
DKAMKHLIDEIADNLDI

SEQ ID NO: 1890431 - protein, 21 aa, Staphylococcus
DKDAFEFYGRVQAGITTPTQK

SEQ ID NO: 1890432 - protein, 19 aa, Staphylococcus
DKDGRLIGIISLKIDMENV

SEQ ID NO: 1890433 - protein, 20 aa, Staphylococcus
DKFELGEAFPVTIAIKDNDK

SEQ ID NO: 1890434 - protein, 20 aa, Staphylococcus
DKLVLGESILIVGNPLGEEF

SEQ ID NO: 1890435 - protein, 23 aa, Staphylococcus
DKMFPILIGFFVFFFVFLISGIA

SEQ ID NO: 1890436 - protein, 19 aa, Staphylococcus
DKSTLKAKVYRDGKVINID

SEQ ID NO: 1890437 - protein, 24 aa, Staphylococcus
DKYGPRLLILIGFIILIVTTASLS

SEQ ID NO: 1890438 - protein, 20 aa, Staphylococcus
DLDTGLMFICFQKSIQQFID

SEQ ID NO: 1890439 - protein, 19 aa, Staphylococcus
DLFNRNSILDGIKDISNPS

SEQ ID NO: 1890440 - protein, 19 aa, Staphylococcus
DLICFRWFNIVLKIMLALM

SEQ ID NO: 1890441 - protein, 17 aa, Staphylococcus
DLILRYMEKLSYKKIII

SEQ ID NO: 1890442 - protein, 18 aa, Staphylococcus
DLKGRVAVAIAFQNIMLI

SEQ ID NO: 1890443 - protein, 18 aa, Staphylococcus
DLSVNGFVMMYPNGNGYS

SEQ ID NO: 1890444 - protein, 18 aa, Staphylococcus
DLTRAGAVSGMIAGSLVV

SEQ ID NO: 1890445 - protein, 19 aa, Staphylococcus
DMGAWRWMLGLAVVPSLIL

SEQ ID NO: 1890446 - protein, 24 aa, Staphylococcus
DMIPFAFSVSFFWIVDIVVRAFSK

SEQ ID NO: 1890447 - protein, 19 aa, Staphylococcus
DMRSYRMVYDTIPVETMNA

SEQ ID NO: 1890448 - protein, 41 aa, Staphylococcus
DNKKKGGIMKILLPLIAAVLILGAIAIFGGMALNNHNNSKN

SEQ ID NO: 1890449 - protein, 22 aa, Staphylococcus
DNLPRFFFYLLLFMFSMLGIVL

SEQ ID NO: 1890450 - protein, 23 aa, Staphylococcus
DNLPRFFIYLLLFMFAMLGIVVS

SEQ ID NO: 1890451 - protein, 23 aa, Staphylococcus
DNLPRFFIYLLLFMFSMLGIVIS

SEQ ID NO: 1890452 - protein, 23 aa, Staphylococcus
DNLPRFFLYLLLFMFSMLGIVVS

SEQ ID NO: 1890453 - protein, 24 aa, Staphylococcus
DNMPELRWHYSYYICLVVMLVIAI

SEQ ID NO: 1890454 - protein, 45 aa, Staphylococcus
DNQGKKGMSCIAKIISIIIVLLLLGGLTFAIFSFVDHSKKANERL

SEQ ID NO: 1890455 - protein, 27 aa, Staphylococcus
DNRFYHHGALDYKRLFGAIGKNLTGGF

SEQ ID NO: 1890456 - protein, 22 aa, Staphylococcus
DPLFKDKEIFVLDGHSHTVIQN

SEQ ID NO: 1890457 - protein, 19 aa, Staphylococcus
DPNKVYVFLLKNMGVERKV

SEQ ID NO: 1890458 - protein, 17 aa, Staphylococcus
DPSGFKPSHQNPGEQHL

SEQ ID NO: 1890459 - protein, 24 aa, Staphylococcus
DPSRIAKVRVESVQPNKLVFKLVS

SEQ ID NO: 1890460 - protein, 18 aa, Staphylococcus
DPYLRGGSIPGTNSNVII

SEQ ID NO: 1890461 - protein, 17 aa, Staphylococcus
DQFEFQMLYGFRSELAE

SEQ ID NO: 1890462 - protein, 18 aa, Staphylococcus
DQISKWIIASSMKIGDSY

SEQ ID NO: 1890463 - protein, 23 aa, Staphylococcus
DQKMSWMIICFILMVFIALLLFK

SEQ ID NO: 1890464 - protein, 20 aa, Staphylococcus
DQLIALLLIELANQMDKDKV

SEQ ID NO: 1890465 - protein, 20 aa, Staphylococcus
DQLTKWLIVKSMSIGDSYEV

SEQ ID NO: 1890466 - protein, 27 aa, Staphylococcus
DQMATWGWRIPFILGLFLGIFGFYLRR

SEQ ID NO: 1890467 - protein, 22 aa, Staphylococcus
DQMKGRIAVAIAFQNVLLILLA

SEQ ID NO: 1890468 - protein, 25 aa, Staphylococcus
DQTPQRKDFVVSFITGAIVGSALGL

SEQ ID NO: 1890469 - protein, 19 aa, Staphylococcus
DQVTKWIIASSMKIGDSYE

SEQ ID NO: 1890470 - protein, 17 aa, Staphylococcus
DQWRVLMRLIRYTFSFK

SEQ ID NO: 1890471 - protein, 18 aa, Staphylococcus
DRFSEIYTPIVFILALLV

SEQ ID NO: 1890472 - protein, 17 aa, Staphylococcus
DRIGRRYVLIPGVILSA

SEQ ID NO: 1890473 - protein, 17 aa, Staphylococcus
DRLKQAFNQHGLVSSDD

SEQ ID NO: 1890474 - protein, 19 aa, Staphylococcus
DRYEFQMLYGFRSDLAEQI

SEQ ID NO: 1890475 - protein, 21 aa, Staphylococcus
DRYGRTLAYVWLDKDHMYNKE

SEQ ID NO: 1890476 - protein, 21 aa, Staphylococcus
DRYGRTLAYVWLSKNRMFNRE

SEQ ID NO: 1890477 - protein, 21 aa, Staphylococcus
DRYKIIEFLGGGGMSNVYLAE

SEQ ID NO: 1890478 - protein, 20 aa, Staphylococcus
DSDGRYTLRFPDGTLNDKYM

SEQ ID NO: 1890479 - protein, 19 aa, Staphylococcus
DSIFSWLFTLSFIILSFYL

SEQ ID NO: 1890480 - protein, 24 aa, Staphylococcus
DSIKITIPQALNLNGVTATAKAPN

SEQ ID NO: 1890481 - protein, 17 aa, Staphylococcus
DSIVFRNALQYTVIMAI

SEQ ID NO: 1890482 - protein, 18 aa, Staphylococcus
DSLFPKWFAKENKNKAPV

SEQ ID NO: 1890483 - protein, 21 aa, Staphylococcus
DSLNHIAKIVIWDTDQQPSIL

SEQ ID NO: 1890484 - protein, 25 aa, Staphylococcus
DSNRFMWQRPESIFNNQKGFERTSN

SEQ ID NO: 1890485 - protein, 20 aa, Staphylococcus
DSYYRIILIAAFISIILSAI

SEQ ID NO: 1890486 - protein, 21 aa, Staphylococcus
DTLHIPNWILVILITLITLIL

SEQ ID NO: 1890487 - protein, 49 aa, Staphylococcus
DTPVEVPVKVWVYKFDFANSVYKIQIGQTFPGGTWVKKYVHLENGDDLP

SEQ ID NO: 1890488 - protein, 17 aa, Staphylococcus
DVFPRHIVVSLIMMMAY

SEQ ID NO: 1890489 - protein, 17 aa, Staphylococcus
DVIPWDWITDEFSQISQ

SEQ ID NO: 1890490 - protein, 20 aa, Staphylococcus
DVSFTHWQWFISIASIVVLF

SEQ ID NO: 1890491 - protein, 18 aa, Staphylococcus
DVTSFVIPIGYSFNLDGS

SEQ ID NO: 1890492 - protein, 21 aa, Staphylococcus
DWVGWRFTFLFIMAVSVLVGI

SEQ ID NO: 1890493 - protein, 19 aa, Staphylococcus
DYLPWLHLKYHDKQAKVTV

SEQ ID NO: 1890494 - protein, 26 aa, Staphylococcus
DYMPELKWHYAYFICLGVMLVITIVL

SEQ ID NO: 1890495 - protein, 19 aa, Staphylococcus
DYPLMMALLLFFSFLGLLA

SEQ ID NO: 1890496 - protein, 18 aa, Staphylococcus
EAFILFWKNYINFTGRAR

SEQ ID NO: 1890497 - protein, 19 aa, Staphylococcus
EAFKLFWKNYFNFKGRSRR

SEQ ID NO: 1890498 - protein, 22 aa, Staphylococcus
EAIPVFAGVIVLLAFVLLVFVF

SEQ ID NO: 1890499 - protein, 22 aa, Staphylococcus
EALTSIAQRVIQDFDRITEATQ

SEQ ID NO: 1890500 - protein, 18 aa, Staphylococcus
EANEALTSIAQRVIQDFD

SEQ ID NO: 1890501 - protein, 18 aa, Staphylococcus
EANRLGVKLEEEIPTINK

SEQ ID NO: 1890502 - protein, 18 aa, Staphylococcus
EANRLGVKLENEIPTINK

SEQ ID NO: 1890503 - protein, 18 aa, Staphylococcus
EARVEITLANGSKVIVHV

SEQ ID NO: 1890504 - protein, 22 aa, Staphylococcus
EAYLSYRLEQEYSKDDIFQMYL

SEQ ID NO: 1890505 - protein, 20 aa, Staphylococcus
EAYLSYRLEQEYSKDEIFQM

SEQ ID NO: 1890506 - protein, 17 aa, Staphylococcus
EDAKLVWIDFENPTKND

SEQ ID NO: 1890507 - protein, 24 aa, Staphylococcus
EDHLKFSLFLAMLIACLLIQAATN

SEQ ID NO: 1890508 - protein, 24 aa, Staphylococcus
EDHLKFSLFLAMLLACLLIQAATN

SEQ ID NO: 1890509 - protein, 24 aa, Staphylococcus
EDHLKLSLFLAMLLACLLIQAATN

SEQ ID NO: 1890510 - protein, 24 aa, Staphylococcus
EDHLKLSLLLAMLIACLLIQAATN

SEQ ID NO: 1890511 - protein, 18 aa, Staphylococcus
EDIIKHYDEWVGLNDDIN

SEQ ID NO: 1890512 - protein, 17 aa, Staphylococcus
EDILKRFNIEFTTVDAT

SEQ ID NO: 1890513 - protein, 24 aa, Staphylococcus
EDILLRFVLSLAIILAIHIGITYA

SEQ ID NO: 1890514 - protein, 20 aa, Staphylococcus
EEGHKLIGIRGMPRVGKTES

SEQ ID NO: 1890515 - protein, 20 aa, Staphylococcus
EEIKESLSIVLDETNRLNRL

SEQ ID NO: 1890516 - protein, 22 aa, Staphylococcus
EEKDRIKVIIEQIVKKSFKDID

SEQ ID NO: 1890517 - protein, 20 aa, Staphylococcus
EFAIGMGPKIFSFRKDETLY

SEQ ID NO: 1890518 - protein, 17 aa, Staphylococcus
EFARGMYVLSYVNYLPT

SEQ ID NO: 1890519 - protein, 19 aa, Staphylococcus
EFFGHLIAPLGFGSWQAGA

SEQ ID NO: 1890520 - protein, 19 aa, Staphylococcus
EFMAVSGLRRMGYNDDYIA

SEQ ID NO: 1890521 - protein, 17 aa, Staphylococcus
EFRLPRMIITILAGAAL

SEQ ID NO: 1890522 - protein, 24 aa, Staphylococcus
EGDYFTVDFGKYIHPGTSRKPYRV

SEQ ID NO: 1890523 - protein, 25 aa, Staphylococcus
EGFLRLRLPNWLRRLITRSLAVIPV

SEQ ID NO: 1890524 - protein, 26 aa, Staphylococcus
EGFSSLPGWVRKGAIGMGLFAAALGP

SEQ ID NO: 1890525 - protein, 18 aa, Staphylococcus
EGIADGLIRLSVGIEDTD

SEQ ID NO: 1890526 - protein, 17 aa, Staphylococcus
EGKYFKWYVYKDDDKHK

SEQ ID NO: 1890527 - protein, 19 aa, Staphylococcus
EGNSKYLVYDVFFNNDGVN

SEQ ID NO: 1890528 - protein, 21 aa, Staphylococcus
EGRKWLFFKDYKFDIPRYNIY

SEQ ID NO: 1890529 - protein, 19 aa, Staphylococcus
EGSFKWKAVQTYDNGDVVK

SEQ ID NO: 1890530 - protein, 27 aa, Staphylococcus
EGTEGNTWQREAVGTVNTAGQPSTTSQ

SEQ ID NO: 1890531 - protein, 18 aa, Staphylococcus
EGVEVIIFYMGMIGSIQT

SEQ ID NO: 1890532 - protein, 19 aa, Staphylococcus
EGVEVIIFYMGMIGSITSM

SEQ ID NO: 1890533 - protein, 17 aa, Staphylococcus
EGVEVILFYMGMIGEVS

SEQ ID NO: 1890534 - protein, 23 aa, Staphylococcus
EGVKVCTNCGAPVKATKDQKSNH

SEQ ID NO: 1890535 - protein, 17 aa, Staphylococcus
EHNHAFKGMSWHQSLFY

SEQ ID NO: 1890536 - protein, 19 aa, Staphylococcus
EIESAMTLADGLKVRIISL

SEQ ID NO: 1890537 - protein, 22 aa, Staphylococcus
EIFMGKAGFFFLLGIVQALIVS

SEQ ID NO: 1890538 - protein, 23 aa, Staphylococcus
EIGRDLRKYFSLSNGQDIPTNTT

SEQ ID NO: 1890539 - protein, 25 aa, Staphylococcus
EILFKRTRFWLPFILSSLIFASQHG

SEQ ID NO: 1890540 - protein, 19 aa, Staphylococcus
EILITKLIIFGLFGLGFFL

SEQ ID NO: 1890541 - protein, 17 aa, Staphylococcus
EILRFIIVGGINTLNYY

SEQ ID NO: 1890542 - protein, 18 aa, Staphylococcus
EIPQALSNVILKATEKNR

SEQ ID NO: 1890543 - protein, 25 aa, Staphylococcus
EITIIFCIFLLFALIFYLFSLPFSA

SEQ ID NO: 1890544 - protein, 18 aa, Staphylococcus
EKFLYRLMIIIGLILTIT

SEQ ID NO: 1890545 - protein, 21 aa, Staphylococcus
EKFLYRLMLIIGIIFSIAFIS

SEQ ID NO: 1890546 - protein, 20 aa, Staphylococcus
EKILGWFSWIFLLLMTIITM

SEQ ID NO: 1890547 - protein, 19 aa, Staphylococcus
EKILLALLLYRFAYYFVPV

SEQ ID NO: 1890548 - protein, 21 aa, Staphylococcus
EKLLGWFSWIFLLILTVITMF

SEQ ID NO: 1890549 - protein, 23 aa, Staphylococcus
EKNGVILGSLFAAIGTLLLGKNR

SEQ ID NO: 1890550 - protein, 25 aa, Staphylococcus
EKNKKSKRWLIAIIAILLLIIGIFA

SEQ ID NO: 1890551 - protein, 21 aa, Staphylococcus
EKVLGWFSWVFLLILTIVTMF

SEQ ID NO: 1890552 - protein, 20 aa, Staphylococcus
ELATLILIMLLGHWIEMNAV

SEQ ID NO: 1890553 - protein, 20 aa, Staphylococcus
ELENAWSYANTAAMGGVSKS

SEQ ID NO: 1890554 - protein, 19 aa, Staphylococcus
ELFIRKPLRIYTWIMALIV

SEQ ID NO: 1890555 - protein, 23 aa, Staphylococcus
ELFKTRWIWPILFLDIVIVTPIV

SEQ ID NO: 1890556 - protein, 20 aa, Staphylococcus
ELFLKYIIMSVFLWILWSHQ

SEQ ID NO: 1890557 - protein, 21 aa, Staphylococcus
ELGSWPAPYGIIFLLDSFSAM

SEQ ID NO: 1890558 - protein, 18 aa, Staphylococcus
ELIKSAEVKKVFPNKLSV

SEQ ID NO: 1890559 - protein, 21 aa, Staphylococcus
ELKYARWDTVISISIGGIISA

SEQ ID NO: 1890560 - protein, 27 aa, Staphylococcus
ELQKSMWKYLSLIGIIVLLAIYLAVRS

SEQ ID NO: 1890561 - protein, 17 aa, Staphylococcus
ELTRTGVYYKWQMLVTL

SEQ ID NO: 1890562 - protein, 20 aa, Staphylococcus
ELVGALLLAFYFYRDNPDLK

SEQ ID NO: 1890563 - protein, 19 aa, Staphylococcus
ELVPIFSFFILKGKSHCCN

SEQ ID NO: 1890564 - protein, 19 aa, Staphylococcus
EMKMHYPLIDFKLFNNKAY

SEQ ID NO: 1890565 - protein, 21 aa, Staphylococcus
EMLFSFSIFCLLLSLIPPLFQ

SEQ ID NO: 1890566 - protein, 19 aa, Staphylococcus
EMMSYRMVFDTINVEVMNA

SEQ ID NO: 1890567 - protein, 19 aa, Staphylococcus
EMPSFRLSVFTALLPVILM

SEQ ID NO: 1890568 - protein, 27 aa, Staphylococcus
EMVGLLLLPRFIKWVGRTKAFNTAVSF

SEQ ID NO: 1890569 - protein, 18 aa, Staphylococcus
ENGAHCYEIFQYLDYAND

SEQ ID NO: 1890570 - protein, 18 aa, Staphylococcus
ENIKKVLLFLSRNTSSSG

SEQ ID NO: 1890571 - protein, 17 aa, Staphylococcus
ENILNRFNQYAKGAYKY

SEQ ID NO: 1890572 - protein, 17 aa, Staphylococcus
ENIPFQIEYVVSKDLPV

SEQ ID NO: 1890573 - protein, 23 aa, Staphylococcus
ENMPELKWHYGYYATLVIMVLIS

SEQ ID NO: 1890574 - protein, 20 aa, Staphylococcus
ENTYRANAITAINRAAAKQR

SEQ ID NO: 1890575 - protein, 17 aa, Staphylococcus
EPEEIRDSLSIVLDETK

SEQ ID NO: 1890576 - protein, 19 aa, Staphylococcus
EPELKFVKVERVPNLVTKP

SEQ ID NO: 1890577 - protein, 40 aa, Staphylococcus
EPKKSGGLKKLLPLLLGLLIIAAIAIFGGMALTNQGDHKD

SEQ ID NO: 1890578 - protein, 18 aa, Staphylococcus
EPQKKWIVIISNFKEFIN

SEQ ID NO: 1890579 - protein, 19 aa, Staphylococcus
EQFLYRLMFMIGILFIIVY

SEQ ID NO: 1890580 - protein, 19 aa, Staphylococcus
ERFNKFEWLAILFAFIGVL

SEQ ID NO: 1890581 - protein, 17 aa, Staphylococcus
ERINGRFNIYGGNTISN

SEQ ID NO: 1890582 - protein, 24 aa, Staphylococcus
ERRSPGSIWAWLFVLAFLPILGFI

SEQ ID NO: 1890583 - protein, 23 aa, Staphylococcus
ERYNIPRLLAIAIVFLVIIGGAT

SEQ ID NO: 1890584 - protein, 24 aa, Staphylococcus
ERYNIPRLLGIVIVFLAIVGLIAL

SEQ ID NO: 1890585 - protein, 22 aa, Staphylococcus
ERYRIPRLLGITIIYVAVVGII

SEQ ID NO: 1890586 - protein, 23 aa, Staphylococcus
ERYRIPRLVGIMIIYIAIVGIIA

SEQ ID NO: 1890587 - protein, 17 aa, Staphylococcus
ERYSYRRLYLFSLVIFT

SEQ ID NO: 1890588 - protein, 17 aa, Staphylococcus
ESFEFINLYFKYRDKEL

SEQ ID NO: 1890589 - protein, 18 aa, Staphylococcus
ESFIVFRIIQGMSAGIIT

SEQ ID NO: 1890590 - protein, 17 aa, Staphylococcus
ESFKQKRFNVYVDNGYA

SEQ ID NO: 1890591 - protein, 19 aa, Staphylococcus
ESFQFLNLHFIYRDKNISK

SEQ ID NO: 1890592 - protein, 24 aa, Staphylococcus
ESIEAKKALLTEYVTSNSDVSEEE

SEQ ID NO: 1890593 - protein, 20 aa, Staphylococcus
ESIISWKLFIFCAVMIILVR

SEQ ID NO: 1890594 - protein, 27 aa, Staphylococcus
ESITKFFKKHWVKVVIVVALIILILLL

SEQ ID NO: 1890595 - protein, 17 aa, Staphylococcus
ESLNMFLNIILKESNRI

SEQ ID NO: 1890596 - protein, 20 aa, Staphylococcus
ESRFSENILNRFNQYAKGAY

SEQ ID NO: 1890597 - protein, 18 aa, Staphylococcus
ESVILCLIGGIIGLILGI

SEQ ID NO: 1890598 - protein, 19 aa, Staphylococcus
ESVVLCLIGGIIGLIIGIA

SEQ ID NO: 1890599 - protein, 18 aa, Staphylococcus
ESVVLCLLGGIIGLILGI

SEQ ID NO: 1890600 - protein, 23 aa, Staphylococcus
ESYKEVLSHSGIKPGKNKHNDDD

SEQ ID NO: 1890601 - protein, 20 aa, Staphylococcus
ESYRAAILFHEWYFIEHWKL

SEQ ID NO: 1890602 - protein, 17 aa, Staphylococcus
ETCFNRWQFSTIMLAPL

SEQ ID NO: 1890603 - protein, 17 aa, Staphylococcus
ETFPLENLWIFIVLWII

SEQ ID NO: 1890604 - protein, 20 aa, Staphylococcus
ETFSEFRIFLAVLLGLLLVI

SEQ ID NO: 1890605 - protein, 18 aa, Staphylococcus
ETLWRMAFGFGACIALVL

SEQ ID NO: 1890606 - protein, 22 aa, Staphylococcus
ETTRNAFFIGRAMDYNVSLEGA

SEQ ID NO: 1890607 - protein, 17 aa, Staphylococcus
ETVLYLMHYHHRISDKQ

SEQ ID NO: 1890608 - protein, 23 aa, Staphylococcus
EVDKAKALALPKIEAVKVTTEVK

SEQ ID NO: 1890609 - protein, 18 aa, Staphylococcus
EVFILPSIWAGLLILIGI

SEQ ID NO: 1890610 - protein, 20 aa, Staphylococcus
EVHPIMYFLMVLFILYFVFV

SEQ ID NO: 1890611 - protein, 23 aa, Staphylococcus
EVIDARLGYYSVVRETNVQLLQP

SEQ ID NO: 1890612 - protein, 18 aa, Staphylococcus
EVIGNLLLSLAIFVCMIV

SEQ ID NO: 1890613 - protein, 18 aa, Staphylococcus
EVIKGVILGIILGFMGYF

SEQ ID NO: 1890614 - protein, 17 aa, Staphylococcus
EVIKLSVSIGIGYLTAD

SEQ ID NO: 1890615 - protein, 17 aa, Staphylococcus
EVIKLSVSIGVGYLSQD

SEQ ID NO: 1890616 - protein, 23 aa, Staphylococcus
EVIKWFYKEHDWFKAQLNNETNN

SEQ ID NO: 1890617 - protein, 23 aa, Staphylococcus
EVLDARLGYYSVVRETNVQLLQA

SEQ ID NO: 1890618 - protein, 23 aa, Staphylococcus
EVMDARLGYYSVVRETNVQLLQA

SEQ ID NO: 1890619 - protein, 17 aa, Staphylococcus
EVSRGIFIISFLSVVVI

SEQ ID NO: 1890620 - protein, 26 aa, Staphylococcus
EVVKKSWLPVTVLLVIAGGTLIGLGR

SEQ ID NO: 1890621 - protein, 17 aa, Staphylococcus
EVWNDCALITVSIVLCI

SEQ ID NO: 1890622 - protein, 26 aa, Staphylococcus
EYMPELKWHYGYFICLTIMLLISIAL

SEQ ID NO: 1890623 - protein, 19 aa, Staphylococcus
EYPLIEWLLIFIIFHLLLP

SEQ ID NO: 1890624 - protein, 19 aa, Staphylococcus
EYRIPRMFLAIIVGSSLAI

SEQ ID NO: 1890625 - protein, 17 aa, Staphylococcus
FADSIWYAFLITLITLL

SEQ ID NO: 1890626 - protein, 17 aa, Staphylococcus
FAFLTCITILFNFMPIV

SEQ ID NO: 1890627 - protein, 21 aa, Staphylococcus
FAGIEGWRWMLGLAVVPSLIL

SEQ ID NO: 1890628 - protein, 18 aa, Staphylococcus
FAKLGWKTVVVGIVILIS

SEQ ID NO: 1890629 - protein, 18 aa, Staphylococcus
FANGTGFNLLGGGKKPKK

SEQ ID NO: 1890630 - protein, 17 aa, Staphylococcus
FASRCYELLLGKFDSDN

SEQ ID NO: 1890631 - protein, 17 aa, Staphylococcus
FATFAWVILLILCFMKM

SEQ ID NO: 1890632 - protein, 21 aa, Staphylococcus
FATWRMVFVILTLFGVSMVIG

SEQ ID NO: 1890633 - protein, 17 aa, Staphylococcus
FCGYAFAGIVERAGCLD

SEQ ID NO: 1890634 - protein, 17 aa, Staphylococcus
FCVAMAYSLASQIYLGK

SEQ ID NO: 1890635 - protein, 19 aa, Staphylococcus
FDFILRYMAKLSYKKLLIT

SEQ ID NO: 1890636 - protein, 18 aa, Staphylococcus
FDFSEIRDYIGLGIVLMF

SEQ ID NO: 1890637 - protein, 23 aa, Staphylococcus
FDIGMGWMLPALIGFIIGLIVYK

SEQ ID NO: 1890638 - protein, 19 aa, Staphylococcus
FDIILRFMEKLSYKKLLIV

SEQ ID NO: 1890639 - protein, 18 aa, Staphylococcus
FDLVIQWGVLALIVIFQP

SEQ ID NO: 1890640 - protein, 18 aa, Staphylococcus
FDMIWKALLIPSIGYIVG

SEQ ID NO: 1890641 - protein, 19 aa, Staphylococcus
FEDGSLLKFTNMKWLTPKS

SEQ ID NO: 1890642 - protein, 23 aa, Staphylococcus
FEGNNRYGATTSWKDNRQPDKNV

SEQ ID NO: 1890643 - protein, 17 aa, Staphylococcus
FELLWFFLMFHLFFGLL

SEQ ID NO: 1890644 - protein, 19 aa, Staphylococcus
FENSGKFYLTVLMIYVLLS

SEQ ID NO: 1890645 - protein, 18 aa, Staphylococcus
FETLIRCYWFYKQKFYYG

SEQ ID NO: 1890646 - protein, 17 aa, Staphylococcus
FFALCIISMILSILTII

SEQ ID NO: 1890647 - protein, 20 aa, Staphylococcus
FFFQRISGILAFIFIAMHLW

SEQ ID NO: 1890648 - protein, 25 aa, Staphylococcus
FFGFILRLLGPFGLHHIFYLPFWQT

SEQ ID NO: 1890649 - protein, 18 aa, Staphylococcus
FFGLCILSLILTILTLLF

SEQ ID NO: 1890650 - protein, 20 aa, Staphylococcus
FFITFCILFALPILKDANIV

SEQ ID NO: 1890651 - protein, 17 aa, Staphylococcus
FFKPFGVPMLTMPYVFV

SEQ ID NO: 1890652 - protein, 19 aa, Staphylococcus
FFLQFNWFQPLLIGLAALL

SEQ ID NO: 1890653 - protein, 23 aa, Staphylococcus
FFLVLLICAKWIAALMGDVNLAP

SEQ ID NO: 1890654 - protein, 18 aa, Staphylococcus
FFNDGHTAILPKGDKGDK

SEQ ID NO: 1890655 - protein, 27 aa, Staphylococcus
FFNHWILRWKVVLVISIAILPFYKFFI

SEQ ID NO: 1890656 - protein, 17 aa, Staphylococcus
FFNKFVFHGRIQYNVDE

SEQ ID NO: 1890657 - protein, 18 aa, Staphylococcus
FFNKFVFHGRIQYNVDEL

SEQ ID NO: 1890658 - protein, 17 aa, Staphylococcus
FFNKFVFHGRIQYNVED

SEQ ID NO: 1890659 - protein, 18 aa, Staphylococcus
FFQFSWTEYGLWIIAHLI

SEQ ID NO: 1890660 - protein, 25 aa, Staphylococcus
FFQIIHPFIPFSYAVDALREAVGGY

SEQ ID NO: 1890661 - protein, 19 aa, Staphylococcus
FFRWIHPFSPMSYAIQGYR

SEQ ID NO: 1890662 - protein, 18 aa, Staphylococcus
FFVFKRKIGFPIFILIGL

SEQ ID NO: 1890663 - protein, 17 aa, Staphylococcus
FFVYLLLFMFSMIGIVI

SEQ ID NO: 1890664 - protein, 21 aa, Staphylococcus
FFYKIMYPFIWLLNGAARLIL

SEQ ID NO: 1890665 - protein, 21 aa, Staphylococcus
FGARFLLDFPLSYSYLRALTS

SEQ ID NO: 1890666 - protein, 18 aa, Staphylococcus
FGDGSLLKYTEMKWLTPD

SEQ ID NO: 1890667 - protein, 28 aa, Staphylococcus
FGEPEKKKMSGISKLISTIIVLLLLSGL

SEQ ID NO: 1890668 - protein, 17 aa, Staphylococcus
FGFKRNYLFFVFLFLIG

SEQ ID NO: 1890669 - protein, 17 aa, Staphylococcus
FGGAFGRIFTGFISSIY

SEQ ID NO: 1890670 - protein, 17 aa, Staphylococcus
FGGGIIGFYLLKLFVPL

SEQ ID NO: 1890671 - protein, 19 aa, Staphylococcus
FGIPMLIPLLIKYVIDDII

SEQ ID NO: 1890672 - protein, 17 aa, Staphylococcus
FGIPTWLGALIMTLVIY

SEQ ID NO: 1890673 - protein, 18 aa, Staphylococcus
FGISRWVILYGRRKFAAM

SEQ ID NO: 1890674 - protein, 24 aa, Staphylococcus
FGKASWYLPAWLNRILPKIDIEGH

SEQ ID NO: 1890675 - protein, 22 aa, Staphylococcus
FGKASWYLPGWLSRIIPHIDIE

SEQ ID NO: 1890676 - protein, 18 aa, Staphylococcus
FGKDKFKLFVPWYILIKY

SEQ ID NO: 1890677 - protein, 18 aa, Staphylococcus
FGLAIFRKSRKDKKDRKE

SEQ ID NO: 1890678 - protein, 18 aa, Staphylococcus
FGMALLLFKVNVLSHRLF

SEQ ID NO: 1890679 - protein, 17 aa, Staphylococcus
FGMSRFLTYILVILGTV

SEQ ID NO: 1890680 - protein, 17 aa, Staphylococcus
FGNSRFLTYILILIGTI

SEQ ID NO: 1890681 - protein, 18 aa, Staphylococcus
FGRRMPYLLIAGPIGAIV

SEQ ID NO: 1890682 - protein, 20 aa, Staphylococcus
FGSLICAISMNFPIMMTGRV

SEQ ID NO: 1890683 - protein, 17 aa, Staphylococcus
FGVFFRFLLNKLKQSYL

SEQ ID NO: 1890684 - protein, 22 aa, Staphylococcus
FGYKRFEILAALFNGVLLFVIS

SEQ ID NO: 1890685 - protein, 19 aa, Staphylococcus
FHSRFALDILLTISNHYNR

SEQ ID NO: 1890686 - protein, 17 aa, Staphylococcus
FHSRFALEILLTIANHY

SEQ ID NO: 1890687 - protein, 18 aa, Staphylococcus
FHTIMFSSYIWKNVGWDS

SEQ ID NO: 1890688 - protein, 17 aa, Staphylococcus
FIACGFFLFMFGGTASD

SEQ ID NO: 1890689 - protein, 24 aa, Staphylococcus
FIAKNKWLSVIAWIILLLMIVVPL

SEQ ID NO: 1890690 - protein, 18 aa, Staphylococcus
FIARFKKLAWPVITIANV

SEQ ID NO: 1890691 - protein, 18 aa, Staphylococcus
FICLTIMLLISIALILFF

SEQ ID NO: 1890692 - protein, 18 aa, Staphylococcus
FICSLPFLSPLLGPGGVI

SEQ ID NO: 1890693 - protein, 18 aa, Staphylococcus
FICYISWSSAYGSHLFSK

SEQ ID NO: 1890694 - protein, 25 aa, Staphylococcus
FIFLIGIFCFFKGFIGFFIGGDNNE

SEQ ID NO: 1890695 - protein, 24 aa, Staphylococcus
FIFWLICILGQWFAEPLAFYNATI

SEQ ID NO: 1890696 - protein, 22 aa, Staphylococcus
FIGKGDVSYRISFKTNGLPTER

SEQ ID NO: 1890697 - protein, 25 aa, Staphylococcus
FIGRKYKSVLNWSLNHKWIVIIVST

SEQ ID NO: 1890698 - protein, 17 aa, Staphylococcus
FIIACGFIADTTSLPFT

SEQ ID NO: 1890699 - protein, 17 aa, Staphylococcus
FIIAKGFENKKIGLKYT

SEQ ID NO: 1890700 - protein, 20 aa, Staphylococcus
FIIGWTYWFCWIISSMSDLT

SEQ ID NO: 1890701 - protein, 19 aa, Staphylococcus
FIKRRTREFALFELIGLTR

SEQ ID NO: 1890702 - protein, 18 aa, Staphylococcus
FILGIGIALVILAIFAVL

SEQ ID NO: 1890703 - protein, 19 aa, Staphylococcus
FIMKFGFRKIEAIVGALIF

SEQ ID NO: 1890704 - protein, 17 aa, Staphylococcus
FIPIFSFLILKGKSRCC

SEQ ID NO: 1890705 - protein, 17 aa, Staphylococcus
FIPMFYIIFGLKTRDES

SEQ ID NO: 1890706 - protein, 18 aa, Staphylococcus
FIPYWGFVVVVNFIVPVI

SEQ ID NO: 1890707 - protein, 18 aa, Staphylococcus
FISAFALRNGFLRLDNYV

SEQ ID NO: 1890708 - protein, 22 aa, Staphylococcus
FISKLKALVNRIHMQVNDSETN

SEQ ID NO: 1890709 - protein, 17 aa, Staphylococcus
FISLSVLVIDWLQRIPS

SEQ ID NO: 1890710 - protein, 17 aa, Staphylococcus
FISPSVVVGPNFYMGIG

SEQ ID NO: 1890711 - protein, 21 aa, Staphylococcus
FISYPCYIIWINPTSHKRSKY

SEQ ID NO: 1890712 - protein, 18 aa, Staphylococcus
FIVFFIFLIRLIYLAIKG

SEQ ID NO: 1890713 - protein, 25 aa, Staphylococcus
FIVHLIPIRYIFRVLSILIFVMAFK

SEQ ID NO: 1890714 - protein, 17 aa, Staphylococcus
FIVRVLIPFALIISLFL

SEQ ID NO: 1890715 - protein, 17 aa, Staphylococcus
FIWGFSIAYFCEGAGYI

SEQ ID NO: 1890716 - protein, 19 aa, Staphylococcus
FIWKWKILHKLGIIKIPNL

SEQ ID NO: 1890717 - protein, 25 aa, Staphylococcus
FIWTVPCYLCIVFAIFYGFSGIGIK

SEQ ID NO: 1890718 - protein, 19 aa, Staphylococcus
FKAFKWRIIGFLAFLLIAI

SEQ ID NO: 1890719 - protein, 19 aa, Staphylococcus
FKAGEFFVQMPLYIIENQN

SEQ ID NO: 1890720 - protein, 18 aa, Staphylococcus
FKFMIPLFIVWLVVGSIV

SEQ ID NO: 1890721 - protein, 18 aa, Staphylococcus
FKFRMPGAFAILFILTVV

SEQ ID NO: 1890722 - protein, 22 aa, Staphylococcus
FKGIRLTSARFIKWLTLLNIVP

SEQ ID NO: 1890723 - protein, 18 aa, Staphylococcus
FKHRIGKLIIVWFTLIAV

SEQ ID NO: 1890724 - protein, 20 aa, Staphylococcus
FKITDIRAVARIAKQNNLLL

SEQ ID NO: 1890725 - protein, 22 aa, Staphylococcus
FKKLNWPVGLIIGAVIITSLGS

SEQ ID NO: 1890726 - protein, 23 aa, Staphylococcus
FKKLSWPVGLIIIAVLISSLGSI

SEQ ID NO: 1890727 - protein, 19 aa, Staphylococcus
FKLFMPWYYLVKFILPVII

SEQ ID NO: 1890728 - protein, 18 aa, Staphylococcus
FKLFYAVTVIVGLCLSFV

SEQ ID NO: 1890729 - protein, 21 aa, Staphylococcus
FKLHIFLGFSIFALWPFTRLV

SEQ ID NO: 1890730 - protein, 20 aa, Staphylococcus
FKLPEIRLLIGFAAKLLVFS

SEQ ID NO: 1890731 - protein, 19 aa, Staphylococcus
FKNKEFAVGLAIMAATMIS

SEQ ID NO: 1890732 - protein, 26 aa, Staphylococcus
FKPLKWLATVYIEFIRGTPLLVQVFL

SEQ ID NO: 1890733 - protein, 26 aa, Staphylococcus
FKPLSWIASIYIEFLRGTPLLVQVFI

SEQ ID NO: 1890734 - protein, 25 aa, Staphylococcus
FKPLSWLASIYIEFLRGTPMLVQVF

SEQ ID NO: 1890735 - protein, 18 aa, Staphylococcus
FKPQWYVQYNGEWRAYED

SEQ ID NO: 1890736 - protein, 19 aa, Staphylococcus
FKPYYIFKMRIPFTPGLIP

SEQ ID NO: 1890737 - protein, 19 aa, Staphylococcus
FKQKRFNVYVDNGYALDHI

SEQ ID NO: 1890738 - protein, 17 aa, Staphylococcus
FKRSVLWLYVIDLICVM

SEQ ID NO: 1890739 - protein, 17 aa, Staphylococcus
FKSLGFEIEEKRNDPNF

SEQ ID NO: 1890740 - protein, 19 aa, Staphylococcus
FKTARYLSGILAKVESVDF

SEQ ID NO: 1890741 - protein, 20 aa, Staphylococcus
FKTDGFIKVNLDWQTIGRLP

SEQ ID NO: 1890742 - protein, 19 aa, Staphylococcus
FKYYWKDVVVCFAGVAFLN

SEQ ID NO: 1890743 - protein, 17 aa, Staphylococcus
FLACTLIGLLFLAALLI

SEQ ID NO: 1890744 - protein, 19 aa, Staphylococcus
FLAPEPFKQLILLGITLES

SEQ ID NO: 1890745 - protein, 24 aa, Staphylococcus
FLDLRVFKSSGFVIATIGLIVVTM

SEQ ID NO: 1890746 - protein, 24 aa, Staphylococcus
FLFKRLSWPYALIITAVIISSLGS

SEQ ID NO: 1890747 - protein, 24 aa, Staphylococcus
FLFKRLSWPYGLIIAAVIISSLGS

SEQ ID NO: 1890748 - protein, 25 aa, Staphylococcus
FLFKRLSWPYGLIIAAVIITSLGSL

SEQ ID NO: 1890749 - protein, 17 aa, Staphylococcus
FLGCLWGLFAGVSFATN

SEQ ID NO: 1890750 - protein, 18 aa, Staphylococcus
FLGGSIIVSFGWQPLLIN

SEQ ID NO: 1890751 - protein, 17 aa, Staphylococcus
FLGSAVIGAIAIFGHSM

SEQ ID NO: 1890752 - protein, 25 aa, Staphylococcus
FLIIWLAQRYIRFMPAPLIAIIILT

SEQ ID NO: 1890753 - protein, 20 aa, Staphylococcus
FLILYLLDLHLGYTFSGGFI

SEQ ID NO: 1890754 - protein, 20 aa, Staphylococcus
FLKYMTIFVLLNFTITCTLI

SEQ ID NO: 1890755 - protein, 17 aa, Staphylococcus
FLLFKFTPILGLSDSYI

SEQ ID NO: 1890756 - protein, 17 aa, Staphylococcus
FLLFKFTPLLGLSDSYI

SEQ ID NO: 1890757 - protein, 17 aa, Staphylococcus
FLLKRFGAKPVLTLGFL

SEQ ID NO: 1890758 - protein, 21 aa, Staphylococcus
FLMEFARGMYILSYINFLPTV

SEQ ID NO: 1890759 - protein, 21 aa, Staphylococcus
FLMEFARGMYILSYINYLPTV

SEQ ID NO: 1890760 - protein, 17 aa, Staphylococcus
FLQFNWFQPLLIGLAAF

SEQ ID NO: 1890761 - protein, 17 aa, Staphylococcus
FLQFNWFQPLLIGLAGL

SEQ ID NO: 1890762 - protein, 17 aa, Staphylococcus
FLRTTRNAFFIGRTGDY

SEQ ID NO: 1890763 - protein, 17 aa, Staphylococcus
FLSGLVCSVVLFLIIVV

SEQ ID NO: 1890764 - protein, 17 aa, Staphylococcus
FLTHFSFYAIAIQYFVV

SEQ ID NO: 1890765 - protein, 17 aa, Staphylococcus
FLTPLVKRIKVFNRKTK

SEQ ID NO: 1890766 - protein, 26 aa, Staphylococcus
FLTQFLSWRWIFFINIFVVIIAVPLM

SEQ ID NO: 1890767 - protein, 17 aa, Staphylococcus
FLVPISFVLTIASAITF

SEQ ID NO: 1890768 - protein, 17 aa, Staphylococcus
FLVPNFIGGLFILVGIF

SEQ ID NO: 1890769 - protein, 23 aa, Staphylococcus
FLYSNRFEMILGYIVAIIALILI

SEQ ID NO: 1890770 - protein, 19 aa, Staphylococcus
FMFVGGFLLTFLLYANVVY

SEQ ID NO: 1890771 - protein, 19 aa, Staphylococcus
FMLKKGFKSKYFITFVIAM

SEQ ID NO: 1890772 - protein, 22 aa, Staphylococcus
FNATEWIWWLLAHIVFMVFMYI

SEQ ID NO: 1890773 - protein, 18 aa, Staphylococcus
FNIIKGAIISIIFILLYR

SEQ ID NO: 1890774 - protein, 19 aa, Staphylococcus
FNIQLPLIKKFILKMTRHN

SEQ ID NO: 1890775 - protein, 19 aa, Staphylococcus
FNKDYWKFVLIMFPTIPIS

SEQ ID NO: 1890776 - protein, 20 aa, Staphylococcus
FNLAKPDIWITIIAGILYFL

SEQ ID NO: 1890777 - protein, 27 aa, Staphylococcus
FNPDYLYDIGFQFSFIISFFIILSFPL

SEQ ID NO: 1890778 - protein, 20 aa, Staphylococcus
FNYKHILSIIMLWIGSFILI

SEQ ID NO: 1890779 - protein, 20 aa, Staphylococcus
FPDFGGGLIGFYLLAIFEPL

SEQ ID NO: 1890780 - protein, 17 aa, Staphylococcus
FPIKLLFTICLLCGIIS

SEQ ID NO: 1890781 - protein, 18 aa, Staphylococcus
FPILIGFFVFLFVFLISG

SEQ ID NO: 1890782 - protein, 21 aa, Staphylococcus
FPIVSSNIYKNGKRVFDPSTT

SEQ ID NO: 1890783 - protein, 18 aa, Staphylococcus
FPLEANLALVWLTGSLFG

SEQ ID NO: 1890784 - protein, 21 aa, Staphylococcus
FPLENLWIFIVLWIILFFVII

SEQ ID NO: 1890785 - protein, 28 aa, Staphylococcus
FPLGLFVMWRYSKWPSIAKTIVTVAIVV

SEQ ID NO: 1890786 - protein, 18 aa, Staphylococcus
FPLLFLVIIFIFREEISS

SEQ ID NO: 1890787 - protein, 21 aa, Staphylococcus
FPNFGGGLIGYYLLELFIPLI

SEQ ID NO: 1890788 - protein, 17 aa, Staphylococcus
FPYEFAKVAGLHLEQLT

SEQ ID NO: 1890789 - protein, 17 aa, Staphylococcus
FQFSFFITFCILFALPI

SEQ ID NO: 1890790 - protein, 27 aa, Staphylococcus
FQHILLFIGIFCFLKGFIGFFIGAKRL

SEQ ID NO: 1890791 - protein, 18 aa, Staphylococcus
FQIEYVVSKDLPVGQQEV

SEQ ID NO: 1890792 - protein, 18 aa, Staphylococcus
FQNILLMVMIIPTWINLL

SEQ ID NO: 1890793 - protein, 19 aa, Staphylococcus
FQSRLRKLILILIVGGAIG

SEQ ID NO: 1890794 - protein, 17 aa, Staphylococcus
FQWALTIFVFFIVTMAL

SEQ ID NO: 1890795 - protein, 17 aa, Staphylococcus
FRFDTGIIGGDWKGLHY

SEQ ID NO: 1890796 - protein, 20 aa, Staphylococcus
FRFGNGVSRNVILAAMLFGM

SEQ ID NO: 1890797 - protein, 17 aa, Staphylococcus
FRFVWPVVVFVLVFGGA

SEQ ID NO: 1890798 - protein, 17 aa, Staphylococcus
FRFVWPVVVFVLVFGGG

SEQ ID NO: 1890799 - protein, 18 aa, Staphylococcus
FRIFLAVLLGLLLVISIS

SEQ ID NO: 1890800 - protein, 18 aa, Staphylococcus
FRKIEAIVGTLIFTVLAI

SEQ ID NO: 1890801 - protein, 17 aa, Staphylococcus
FRTSKNFAIQHRIIASV

SEQ ID NO: 1890802 - protein, 17 aa, Staphylococcus
FRVFKEGQFAVGILIMA

SEQ ID NO: 1890803 - protein, 20 aa, Staphylococcus
FRYILIMLIIFLLGSMVLFI

SEQ ID NO: 1890804 - protein, 18 aa, Staphylococcus
FRYLKLCLSFIMGALVLY

SEQ ID NO: 1890805 - protein, 17 aa, Staphylococcus
FSGLLGRVNTNDETSIF

SEQ ID NO: 1890806 - protein, 23 aa, Staphylococcus
FSGLVPYWAVYRIILYVVAGHKE

SEQ ID NO: 1890807 - protein, 17 aa, Staphylococcus
FSGQAPFLFAHRGGMAV

SEQ ID NO: 1890808 - protein, 23 aa, Staphylococcus
FSGQLKFDFRYGKSNTVEVNENF

SEQ ID NO: 1890809 - protein, 17 aa, Staphylococcus
FSGWGLRSIIYIFILIA

SEQ ID NO: 1890810 - protein, 19 aa, Staphylococcus
FSIGLLIFACIWTFMLSLF

SEQ ID NO: 1890811 - protein, 17 aa, Staphylococcus
FSIIFGVLFFILNYFSG

SEQ ID NO: 1890812 - protein, 25 aa, Staphylococcus
FSIRKFKVGIFSTLIATVAFLSSPI

SEQ ID NO: 1890813 - protein, 31 aa, Staphylococcus
FSIRKFNVGIFSALIATVAFLGVNPNSADAA

SEQ ID NO: 1890814 - protein, 27 aa, Staphylococcus
FSIRKFSVGIFSTVIATLTFLSHPGHA

SEQ ID NO: 1890815 - protein, 27 aa, Staphylococcus
FSIRLLGRLLFIWFLRKMNAINENYGY

SEQ ID NO: 1890816 - protein, 17 aa, Staphylococcus
FSISSYVLWIFPPISDF

SEQ ID NO: 1890817 - protein, 19 aa, Staphylococcus
FSIWLLWIHPGSFEDALVA

SEQ ID NO: 1890818 - protein, 19 aa, Staphylococcus
FSKEEIRQMVTIAGSEGAF

SEQ ID NO: 1890819 - protein, 17 aa, Staphylococcus
FSKRFWPSLKFLLPILI

SEQ ID NO: 1890820 - protein, 18 aa, Staphylococcus
FSLLPAFIASYIVAFIIK

SEQ ID NO: 1890821 - protein, 23 aa, Staphylococcus
FSMGRSGIMPRVFSKLHPVYKTP

SEQ ID NO: 1890822 - protein, 23 aa, Staphylococcus
FSRWMLCLHPILFIFFSGVFLSS

SEQ ID NO: 1890823 - protein, 20 aa, Staphylococcus
FSSDVSWIFDVAQILTHPLM

SEQ ID NO: 1890824 - protein, 27 aa, Staphylococcus
FSSHPSRKDFVISFITGALIGSAVGLF

SEQ ID NO: 1890825 - protein, 17 aa, Staphylococcus
FSSYIWKNVGWDSIIYF

SEQ ID NO: 1890826 - protein, 20 aa, Staphylococcus
FSTLIATLVFLGTHTDQAHA

SEQ ID NO: 1890827 - protein, 23 aa, Staphylococcus
FSVISDFSWFIGFIVAGGSYIIL

SEQ ID NO: 1890828 - protein, 26 aa, Staphylococcus
FSVPVRDWNGDLSFNGKVLMFDNNVT

SEQ ID NO: 1890829 - protein, 18 aa, Staphylococcus
FTAGFLKSIAILIGLIVG

SEQ ID NO: 1890830 - protein, 18 aa, Staphylococcus
FTAYWPFFGDVFIWLPLL

SEQ ID NO: 1890831 - protein, 21 aa, Staphylococcus
FTEGIKIMAYIGVVILTANGF

SEQ ID NO: 1890832 - protein, 18 aa, Staphylococcus
FTFLKLCGIILLFFGIFI

SEQ ID NO: 1890833 - protein, 21 aa, Staphylococcus
FTGYLKFDFKYANSNTVDVNE

SEQ ID NO: 1890834 - protein, 17 aa, Staphylococcus
FTKRIAVPIGIHMLQNG

SEQ ID NO: 1890835 - protein, 18 aa, Staphylococcus
FTLDFYKPIFGKRASDQH

SEQ ID NO: 1890836 - protein, 18 aa, Staphylococcus
FTLIEMLFSFSIFCLLLS

SEQ ID NO: 1890837 - protein, 19 aa, Staphylococcus
FTLPIPMHFEFDSEVFMMA

SEQ ID NO: 1890838 - protein, 23 aa, Staphylococcus
FTNGGKILFHWGILTIESDGVLE

SEQ ID NO: 1890839 - protein, 27 aa, Staphylococcus
FTNMPELHWKYSYFVFIGVMALLSIAL

SEQ ID NO: 1890840 - protein, 17 aa, Staphylococcus
FTPIFALSEGWIWTVTA

SEQ ID NO: 1890841 - protein, 24 aa, Staphylococcus
FTPSQIKGAIFFGGFYDMKTVRET

SEQ ID NO: 1890842 - protein, 20 aa, Staphylococcus
FTRTPIVNVVNGRIVGYDED

SEQ ID NO: 1890843 - protein, 18 aa, Staphylococcus
FTSPQFRSPMANSSFVPQ

SEQ ID NO: 1890844 - protein, 20 aa, Staphylococcus
FTSRLRKLILMILVGGAIAA

SEQ ID NO: 1890845 - protein, 19 aa, Staphylococcus
FTTGFFKSIAILIGLIVGT

SEQ ID NO: 1890846 - protein, 18 aa, Staphylococcus
FTTGFLKSIAILIGLIIG

SEQ ID NO: 1890847 - protein, 17 aa, Staphylococcus
FTVYWPFFSDVFIGLPL

SEQ ID NO: 1890848 - protein, 17 aa, Staphylococcus
FTVYWPFFSDVFIWLPL

SEQ ID NO: 1890849 - protein, 22 aa, Staphylococcus
FTYLIDCLREVVGGIVPEILIT

SEQ ID NO: 1890850 - protein, 26 aa, Staphylococcus
FVEAFKELWLPILTICFILAISKITT

SEQ ID NO: 1890851 - protein, 24 aa, Staphylococcus
FVEFKIPWMPAIDVNLDFRLDGLG

SEQ ID NO: 1890852 - protein, 21 aa, Staphylococcus
FVFRCLVVLLVFVGSVVKTET

SEQ ID NO: 1890853 - protein, 20 aa, Staphylococcus
FVFRCLVVVLVFIGAVAKTE

SEQ ID NO: 1890854 - protein, 18 aa, Staphylococcus
FVGACGWMVYILFFDGLQ

SEQ ID NO: 1890855 - protein, 17 aa, Staphylococcus
FVGAMGWIIYKLSFDAD

SEQ ID NO: 1890856 - protein, 18 aa, Staphylococcus
FVGAVAWTIYQFTVDMDL

SEQ ID NO: 1890857 - protein, 17 aa, Staphylococcus
FVGAVAWTIYQYTVDLD

SEQ ID NO: 1890858 - protein, 18 aa, Staphylococcus
FVGSLVIGIIAVFGHWLA

SEQ ID NO: 1890859 - protein, 17 aa, Staphylococcus
FVGSLVIGMIAVTGHHF

SEQ ID NO: 1890860 - protein, 18 aa, Staphylococcus
FVIAIVIGFGASYLFMML

SEQ ID NO: 1890861 - protein, 23 aa, Staphylococcus
FVIEFIGALLLAFYFYRDNPDLK

SEQ ID NO: 1890862 - protein, 22 aa, Staphylococcus
FVIGWTYWICWIVSSMSDLTAM

SEQ ID NO: 1890863 - protein, 23 aa, Staphylococcus
FVIGWTYWICWVVSSMSDLTAMG

SEQ ID NO: 1890864 - protein, 21 aa, Staphylococcus
FVIGWTYWLSWIVSSMSDLTA

SEQ ID NO: 1890865 - protein, 20 aa, Staphylococcus
FVKRRFREFALYQVIGLSKR

SEQ ID NO: 1890866 - protein, 18 aa, Staphylococcus
FVKYCIISLLSIVGGYLF

SEQ ID NO: 1890867 - protein, 17 aa, Staphylococcus
FVLMIAFASFFKPSIWN

SEQ ID NO: 1890868 - protein, 17 aa, Staphylococcus
FVLPVIVVLIAFMVLYT

SEQ ID NO: 1890869 - protein, 18 aa, Staphylococcus
FVPDGLPGNDGRSITITN

SEQ ID NO: 1890870 - protein, 19 aa, Staphylococcus
FVPQSRPGQNLIVNPMWYN

SEQ ID NO: 1890871 - protein, 23 aa, Staphylococcus
FVPSDNVKPVISFGNYNNHVVFS

SEQ ID NO: 1890872 - protein, 28 aa, Staphylococcus
FVRAELAGFGGFGGYVWFDKNNDGVQND

SEQ ID NO: 1890873 - protein, 17 aa, Staphylococcus
FVSCLLMLFFGSFIFNL

SEQ ID NO: 1890874 - protein, 24 aa, Staphylococcus
FVTIAVFCSLVFNSIIYTCVSLLG

SEQ ID NO: 1890875 - protein, 20 aa, Staphylococcus
FVYRFYKRIHLGWFVLPIPV

SEQ ID NO: 1890876 - protein, 23 aa, Staphylococcus
FWFPEIPNWISALFCVLILMSFN

SEQ ID NO: 1890877 - protein, 17 aa, Staphylococcus
FWNRWHMSLSFWFRDCV

SEQ ID NO: 1890878 - protein, 24 aa, Staphylococcus
FWNRWHMTLSFWFRDCIYMRSLFY

SEQ ID NO: 1890879 - protein, 24 aa, Staphylococcus
FYDHGAIDYKRLFGAIGKNLTGGF

SEQ ID NO: 1890880 - protein, 17 aa, Staphylococcus
FYGIPFLGGTVILSFGW

SEQ ID NO: 1890881 - protein, 22 aa, Staphylococcus
FYIFCVVEFLILPIIYMPKTHL

SEQ ID NO: 1890882 - protein, 23 aa, Staphylococcus
FYIHEIWIFIAMYAIFQGCFAPA

SEQ ID NO: 1890883 - protein, 17 aa, Staphylococcus
FYILIGLQFLYTAYRAL

SEQ ID NO: 1890884 - protein, 21 aa, Staphylococcus
FYILTVYFFFGRLRKLTRKRS

SEQ ID NO: 1890885 - protein, 22 aa, Staphylococcus
FYILTVYFFFGRLRKLTRVRSQ

SEQ ID NO: 1890886 - protein, 20 aa, Staphylococcus
FYILTVYFFFGRLRQLTRVR

SEQ ID NO: 1890887 - protein, 17 aa, Staphylococcus
FYISLLIFVCLLYFVAI

SEQ ID NO: 1890888 - protein, 22 aa, Staphylococcus
FYKFRFILIMLIVFLMSTMVLF

SEQ ID NO: 1890889 - protein, 18 aa, Staphylococcus
FYKFRYILIMLIIFLLGS

SEQ ID NO: 1890890 - protein, 18 aa, Staphylococcus
FYLKKIWVAIKFLAIYLY

SEQ ID NO: 1890891 - protein, 18 aa, Staphylococcus
FYPKKIWIAIKFLGVYLY

SEQ ID NO: 1890892 - protein, 24 aa, Staphylococcus
FYPKKLWVAFKFLMVYLYQLVTSS

SEQ ID NO: 1890893 - protein, 18 aa, Staphylococcus
FYPRFKISLLGGIVSILW

SEQ ID NO: 1890894 - protein, 23 aa, Staphylococcus
FYSLPILFLIAFNRFNFQWATVE

SEQ ID NO: 1890895 - protein, 20 aa, Staphylococcus
FYVFTVYFFFGRLRKLTRKR

SEQ ID NO: 1890896 - protein, 25 aa, Staphylococcus
FYYRPKRFFLISGLRARMKSNAVGL

SEQ ID NO: 1890897 - protein, 19 aa, Staphylococcus
GAFIFRFIALFLISIIANF

SEQ ID NO: 1890898 - protein, 19 aa, Staphylococcus
GAFIFRFLALFLISIIANF

SEQ ID NO: 1890899 - protein, 19 aa, Staphylococcus
GAFVFRFISLFLISIIAHF

SEQ ID NO: 1890900 - protein, 19 aa, Staphylococcus
GAFVFRFLALFLISVIANF

SEQ ID NO: 1890901 - protein, 18 aa, Staphylococcus
GAGCGCLVILIILVLAAC

SEQ ID NO: 1890902 - protein, 19 aa, Staphylococcus
GAGVSYCYTIYLFDYYPFI

SEQ ID NO: 1890903 - protein, 17 aa, Staphylococcus
GAILLHWHFISIESKGI

SEQ ID NO: 1890904 - protein, 18 aa, Staphylococcus
GAIPIMFVASAMNLLVNS

SEQ ID NO: 1890905 - protein, 20 aa, Staphylococcus
GAISSIVGWFAQLWASIQQT

SEQ ID NO: 1890906 - protein, 17 aa, Staphylococcus
GALLKRRVKTTINSASS

SEQ ID NO: 1890907 - protein, 17 aa, Staphylococcus
GASFKWYDFVYFIDTII

SEQ ID NO: 1890908 - protein, 17 aa, Staphylococcus
GASFVNYVMFSRLNIGG

SEQ ID NO: 1890909 - protein, 24 aa, Staphylococcus
GASSYRKAFCQKFLSEVKVSVIKG

SEQ ID NO: 1890910 - protein, 23 aa, Staphylococcus
GASSYRKQFCKRFLEQIEVSVIK

SEQ ID NO: 1890911 - protein, 18 aa, Staphylococcus
GASWPLCHGALLPQNLPI

SEQ ID NO: 1890912 - protein, 18 aa, Staphylococcus
GAYLKVSLFLGEAKSYNE

SEQ ID NO: 1890913 - protein, 17 aa, Staphylococcus
GCLLFVFIAIFTIVHFK

SEQ ID NO: 1890914 - protein, 17 aa, Staphylococcus
GCLVLLILIIIGVTACT

SEQ ID NO: 1890915 - protein, 22 aa, Staphylococcus
GDAIGWRFTFLFIIIVSVIAGV

SEQ ID NO: 1890916 - protein, 21 aa, Staphylococcus
GDEALYNLGDYVWEDTNKNGI

SEQ ID NO: 1890917 - protein, 20 aa, Staphylococcus
GDILFGYGFSMLFVIPFIHM

SEQ ID NO: 1890918 - protein, 18 aa, Staphylococcus
GDLFRFYKNPDFKKVDPS

SEQ ID NO: 1890919 - protein, 17 aa, Staphylococcus
GDLKGRIAIAIMYQNIS

SEQ ID NO: 1890920 - protein, 17 aa, Staphylococcus
GDPKLLGGIGIKTITFF

SEQ ID NO: 1890921 - protein, 17 aa, Staphylococcus
GDTKLKEDIKFKKANAQ

SEQ ID NO: 1890922 - protein, 19 aa, Staphylococcus
GDYTVHFEKPTGLTQTVVD

SEQ ID NO: 1890923 - protein, 34 aa, Staphylococcus
GEAIKKNWIPIAAVIAITGGALVWFSRRKHHQSN

SEQ ID NO: 1890924 - protein, 17 aa, Staphylococcus
GELEFWFAIIKVVTIVA

SEQ ID NO: 1890925 - protein, 24 aa, Staphylococcus
GETFSEFRLFLAVLLTLLLLISIS

SEQ ID NO: 1890926 - protein, 17 aa, Staphylococcus
GFANWRAVFGVMIGLAI

SEQ ID NO: 1890927 - protein, 18 aa, Staphylococcus
GFANWRFVFGVMILLAVI

SEQ ID NO: 1890928 - protein, 18 aa, Staphylococcus
GFFKSAFVDPDREIKSIH

SEQ ID NO: 1890929 - protein, 22 aa, Staphylococcus
GFGASFIFNWLIQRDFIPQNLM

SEQ ID NO: 1890930 - protein, 21 aa, Staphylococcus
GFGASYLFNWFIRQDMIPQNL

SEQ ID NO: 1890931 - protein, 17 aa, Staphylococcus
GFGLCWPYVLLPFGFGQ

SEQ ID NO: 1890932 - protein, 17 aa, Staphylococcus
GFIKIVWGLALAAIAYV

SEQ ID NO: 1890933 - protein, 19 aa, Staphylococcus
GFLPHGWMGFFFALSIVIG

SEQ ID NO: 1890934 - protein, 22 aa, Staphylococcus
GFLRLSIPNWLRRLITRSLAVI

SEQ ID NO: 1890935 - protein, 20 aa, Staphylococcus
GFLSGLVCALLLFIIIMVLY

SEQ ID NO: 1890936 - protein, 17 aa, Staphylococcus
GFQEVYHSLLLLIAVSS

SEQ ID NO: 1890937 - protein, 19 aa, Staphylococcus
GFSSAWGYWFAAFLGNVAY

SEQ ID NO: 1890938 - protein, 17 aa, Staphylococcus
GFSSFSWVVFLMIIQAS

SEQ ID NO: 1890939 - protein, 17 aa, Staphylococcus
GFTEQYLIWSIFRLISG

SEQ ID NO: 1890940 - protein, 17 aa, Staphylococcus
GFYRLPGIVAVIALTVY

SEQ ID NO: 1890941 - protein, 21 aa, Staphylococcus
GGALLIVGIVLKFIGTSYTVS

SEQ ID NO: 1890942 - protein, 24 aa, Staphylococcus
GGIHEIYFPYVLMRPLLFVSVILG

SEQ ID NO: 1890943 - protein, 21 aa, Staphylococcus
GGLACAFSMLFLSKMIDNNSR

SEQ ID NO: 1890944 - protein, 22 aa, Staphylococcus
GGLAPFTILFSLPFTAIGIVFA

SEQ ID NO: 1890945 - protein, 22 aa, Staphylococcus
GGLAPFTILFSLPFTIIGVVLA

SEQ ID NO: 1890946 - protein, 21 aa, Staphylococcus
GGLAPFTILFSLPFTIVGVVL

SEQ ID NO: 1890947 - protein, 26 aa, Staphylococcus
GGLAPFTILFSLPFTVVGVVLALVIT

SEQ ID NO: 1890948 - protein, 18 aa, Staphylococcus
GGLFTLAGTFIALIFQFR

SEQ ID NO: 1890949 - protein, 20 aa, Staphylococcus
GGLLIKISMMMLTFTLILAI

SEQ ID NO: 1890950 - protein, 17 aa, Staphylococcus
GGLLNFILMGGFGILSG

SEQ ID NO: 1890951 - protein, 17 aa, Staphylococcus
GGMGISMGMSWAAANDI

SEQ ID NO: 1890952 - protein, 18 aa, Staphylococcus
GGMVATFVGWRWIYILSI

SEQ ID NO: 1890953 - protein, 22 aa, Staphylococcus
GGNCYEVLKLLTFSPGILSQIY

SEQ ID NO: 1890954 - protein, 19 aa, Staphylococcus
GGPGAVFWMWVIAFIGAAS

SEQ ID NO: 1890955 - protein, 20 aa, Staphylococcus
GGPGAVFWMWVIAFIGAASA

SEQ ID NO: 1890956 - protein, 23 aa, Staphylococcus
GGTRIRPILMTALATIGALAPML

SEQ ID NO: 1890957 - protein, 18 aa, Staphylococcus
GGVFPILSPILGWIGVFM

SEQ ID NO: 1890958 - protein, 20 aa, Staphylococcus
GGWLGWRATFVFIIVISVLA

SEQ ID NO: 1890959 - protein, 19 aa, Staphylococcus
GHFFWPAILAFALTGIGLP

SEQ ID NO: 1890960 - protein, 20 aa, Staphylococcus
GHFFWPAVIAFCLTGIGLPL

SEQ ID NO: 1890961 - protein, 21 aa, Staphylococcus
GHSAWRYLIVTLYLAPYILFS

SEQ ID NO: 1890962 - protein, 17 aa, Staphylococcus
GHVAWGYAIILIIASYF

SEQ ID NO: 1890963 - protein, 20 aa, Staphylococcus
GHWWLFFPIAGMIWWMLRYF

SEQ ID NO: 1890964 - protein, 19 aa, Staphylococcus
GHYFWPAILAFVITGIGLP

SEQ ID NO: 1890965 - protein, 30 aa, Staphylococcus
GIDVLGSFFSFLTWGAVISLILAIIGGILI

SEQ ID NO: 1890966 - protein, 23 aa, Staphylococcus
GIEGRWFDKSCMFLADLLLAIPS

SEQ ID NO: 1890967 - protein, 20 aa, Staphylococcus
GIFCFCKGFIGFFIGGNNNR

SEQ ID NO: 1890968 - protein, 19 aa, Staphylococcus
GIFCFLKGFIGFFIGGDSN

SEQ ID NO: 1890969 - protein, 20 aa, Staphylococcus
GIFSGWNYGIGIQVDPNHPE

SEQ ID NO: 1890970 - protein, 21 aa, Staphylococcus
GIGRLPAIIALVVYALLPILR

SEQ ID NO: 1890971 - protein, 23 aa, Staphylococcus
GIHEIYFPYVLMRPMLFISVILG

SEQ ID NO: 1890972 - protein, 19 aa, Staphylococcus
GIIAAIAFLVLCIGIVVVL

SEQ ID NO: 1890973 - protein, 19 aa, Staphylococcus
GILIARYSKIAWPVITIAN

SEQ ID NO: 1890974 - protein, 19 aa, Staphylococcus
GILISRYTKLSWPIITIAN

SEQ ID NO: 1890975 - protein, 24 aa, Staphylococcus
GILLLWRSRWMKVYNRIPSILSIN

SEQ ID NO: 1890976 - protein, 18 aa, Staphylococcus
GILLRWTLFYQKNCILAM

SEQ ID NO: 1890977 - protein, 25 aa, Staphylococcus
GINHTRFSSFYGMIIYLIVIFILMR

SEQ ID NO: 1890978 - protein, 18 aa, Staphylococcus
GIPAWVWSCIFIVIIFAL

SEQ ID NO: 1890979 - protein, 19 aa, Staphylococcus
GIPMLIPLLIKYAIDGVIN

SEQ ID NO: 1890980 - protein, 20 aa, Staphylococcus
GIRIRPILMTAIATIGALLP

SEQ ID NO: 1890981 - protein, 17 aa, Staphylococcus
GISRWVILYGRRKFAAM

SEQ ID NO: 1890982 - protein, 28 aa, Staphylococcus
GITLFLIACIVIIFGIIAIFKNKNYLKM

SEQ ID NO: 1890983 - protein, 17 aa, Staphylococcus
GIVPEILITKVIILALF

SEQ ID NO: 1890984 - protein, 17 aa, Staphylococcus
GIVPEILITKVVVLTLF

SEQ ID NO: 1890985 - protein, 18 aa, Staphylococcus
GIVTWLTRIIPFVMISKV

SEQ ID NO: 1890986 - protein, 18 aa, Staphylococcus
GKAGFFFLLGIIQALIVS

SEQ ID NO: 1890987 - protein, 17 aa, Staphylococcus
GKAIPHWDLFGLHINQV

SEQ ID NO: 1890988 - protein, 27 aa, Staphylococcus
GKAYRSAKQFFSAVVIPLSYSMKTLSD

SEQ ID NO: 1890989 - protein, 18 aa, Staphylococcus
GKEGIYFSGEKIVIKEML

SEQ ID NO: 1890990 - protein, 26 aa, Staphylococcus
GKEGTGLGLFICRMIIEAQGGTIDLK

SEQ ID NO: 1890991 - protein, 21 aa, Staphylococcus
GKETRFGIGLSALFTTITTAF

SEQ ID NO: 1890992 - protein, 22 aa, Staphylococcus
GKETRFGVGLSALFTTITTAFT

SEQ ID NO: 1890993 - protein, 25 aa, Staphylococcus
GKGLFFKIVIGLIIIVAIFFGVMYA

SEQ ID NO: 1890994 - protein, 18 aa, Staphylococcus
GKHPIDFVDAFFIAASAF

SEQ ID NO: 1890995 - protein, 25 aa, Staphylococcus
GKKALRPVPVLGMLQPDGITAYEYN

SEQ ID NO: 1890996 - protein, 17 aa, Staphylococcus
GKKRFGLIIPIITLAVI

SEQ ID NO: 1890997 - protein, 18 aa, Staphylococcus
GKLFFKKDIRQYGSGNTG

SEQ ID NO: 1890998 - protein, 18 aa, Staphylococcus
GKMSFFFIITIIILVVLI

SEQ ID NO: 1890999 - protein, 23 aa, Staphylococcus
GKQGTGLGLFICKMIIEEHGGTI

SEQ ID NO: 1891000 - protein, 22 aa, Staphylococcus
GKQGTGLGLFICRMIIHEHGGT

SEQ ID NO: 1891001 - protein, 23 aa, Staphylococcus
GKSELRRAPVLGLLQPDGIDTYD

SEQ ID NO: 1891002 - protein, 19 aa, Staphylococcus
GKSTLSKLACRFWDLKTGD

SEQ ID NO: 1891003 - protein, 22 aa, Staphylococcus
GKTETYRFLLIDTPETKHPRVG

SEQ ID NO: 1891004 - protein, 25 aa, Staphylococcus
GKTFSEFRIFLAILITLLLLFSIIL

SEQ ID NO: 1891005 - protein, 21 aa, Staphylococcus
GKTYLKHFFWFNGITGIVALI

SEQ ID NO: 1891006 - protein, 20 aa, Staphylococcus
GLAIFCFVLYIAFGKYGNVT

SEQ ID NO: 1891007 - protein, 21 aa, Staphylococcus
GLAIFCFVLYIAFGKYGNVTL

SEQ ID NO: 1891008 - protein, 21 aa, Staphylococcus
GLAILCFVLYIAFGKYGNVTL

SEQ ID NO: 1891009 - protein, 19 aa, Staphylococcus
GLAILPSFYAWFNLWAMWD

SEQ ID NO: 1891010 - protein, 19 aa, Staphylococcus
GLANWRVVFGIMIILAVIT

SEQ ID NO: 1891011 - protein, 18 aa, Staphylococcus
GLASVLFGTFLIYANPAN

SEQ ID NO: 1891012 - protein, 19 aa, Staphylococcus
GLDLLPGFFAGYIVGYLMK

SEQ ID NO: 1891013 - protein, 22 aa, Staphylococcus
GLFICGGASMLLLSLYDVILVK

SEQ ID NO: 1891014 - protein, 18 aa, Staphylococcus
GLFICLIGFIGTVIYFNH

SEQ ID NO: 1891015 - protein, 19 aa, Staphylococcus
GLFLLCFYHLPNLNRYNEK

SEQ ID NO: 1891016 - protein, 25 aa, Staphylococcus
GLFSKRFWPSFKFLLPILLGMGLAI

SEQ ID NO: 1891017 - protein, 24 aa, Staphylococcus
GLFSKRFWPSLKFLLPILTGMLLA

SEQ ID NO: 1891018 - protein, 22 aa, Staphylococcus
GLFTGDFSLMWQGIKQVFSGAL

SEQ ID NO: 1891019 - protein, 19 aa, Staphylococcus
GLFVICMFVSISMGTSVGT

SEQ ID NO: 1891020 - protein, 19 aa, Staphylococcus
GLFVICMFVSLSMGTSVGT

SEQ ID NO: 1891021 - protein, 23 aa, Staphylococcus
GLGRRIALQFVRLFGKKTLGLAY

SEQ ID NO: 1891022 - protein, 20 aa, Staphylococcus
GLGWQDIWLDLTIIVIFMLA

SEQ ID NO: 1891023 - protein, 18 aa, Staphylococcus
GLIAALAFLVLVIGIVLV

SEQ ID NO: 1891024 - protein, 18 aa, Staphylococcus
GLILAIGTSMLGHESIVK

SEQ ID NO: 1891025 - protein, 22 aa, Staphylococcus
GLILQYVFKLPLLVTAVIGVLM

SEQ ID NO: 1891026 - protein, 25 aa, Staphylococcus
GLILWYKRLIPIVLVSGAIGGAIIA

SEQ ID NO: 1891027 - protein, 24 aa, Staphylococcus
GLINFLLCFSFFVSISMASFIIVT

SEQ ID NO: 1891028 - protein, 18 aa, Staphylococcus
GLKKGIKVLSDWNVILSF

SEQ ID NO: 1891029 - protein, 19 aa, Staphylococcus
GLLAPWIAGAAMALSSVSV

SEQ ID NO: 1891030 - protein, 20 aa, Staphylococcus
GLLAPWIAGTAMAFSSVSVV

SEQ ID NO: 1891031 - protein, 18 aa, Staphylococcus
GLLAPWVAGAAMALSSVS

SEQ ID NO: 1891032 - protein, 18 aa, Staphylococcus
GLLIAIGAFFVTKRKKEN

SEQ ID NO: 1891033 - protein, 19 aa, Staphylococcus
GLLLVWVMVNFVAKSYTIK

SEQ ID NO: 1891034 - protein, 18 aa, Staphylococcus
GLLMYRFAYYFIPLLISM

SEQ ID NO: 1891035 - protein, 21 aa, Staphylococcus
GLLSLIFGLAIFRKSRKDKKD

SEQ ID NO: 1891036 - protein, 19 aa, Staphylococcus
GLMMCLISLFGKRLAMVSG

SEQ ID NO: 1891037 - protein, 21 aa, Staphylococcus
GLVAIIVGMFWFKLYQRTTNP

SEQ ID NO: 1891038 - protein, 18 aa, Staphylococcus
GLVFFFSLGLFKYADAHV

SEQ ID NO: 1891039 - protein, 18 aa, Staphylococcus
GLVGFIGMGVFGSKYEEM

SEQ ID NO: 1891040 - protein, 17 aa, Staphylococcus
GLVGLVIICCLIGFVRS

SEQ ID NO: 1891041 - protein, 19 aa, Staphylococcus
GLVLFCLALVFLQRDVGQT

SEQ ID NO: 1891042 - protein, 17 aa, Staphylococcus
GLVLISGLVLLGIATNR

SEQ ID NO: 1891043 - protein, 18 aa, Staphylococcus
GLWLFSFILGWFVLPKLV

SEQ ID NO: 1891044 - protein, 17 aa, Staphylococcus
GLWSFGVTWGFLQSPKS

SEQ ID NO: 1891045 - protein, 17 aa, Staphylococcus
GMGWILPALIGFIIGLI

SEQ ID NO: 1891046 - protein, 17 aa, Staphylococcus
GMLTVLLVWLMVKFQKK

SEQ ID NO: 1891047 - protein, 17 aa, Staphylococcus
GMTCAACANRIEKNLNK

SEQ ID NO: 1891048 - protein, 19 aa, Staphylococcus
GNIALNILIFIGWMILAQL

SEQ ID NO: 1891049 - protein, 18 aa, Staphylococcus
GNIILNILIFIGWMLLSQ

SEQ ID NO: 1891050 - protein, 17 aa, Staphylococcus
GNIYNNLTRTDTESSDE

SEQ ID NO: 1891051 - protein, 17 aa, Staphylococcus
GNKSAFMFIIPILAGYI

SEQ ID NO: 1891052 - protein, 22 aa, Staphylococcus
GNRTETKFIIKVVDTTAPTVKE

SEQ ID NO: 1891053 - protein, 23 aa, Staphylococcus
GNTKYVYDPSIGKNTDRAILDSD

SEQ ID NO: 1891054 - protein, 18 aa, Staphylococcus
GNVVLRYYPWNKFGISFN

SEQ ID NO: 1891055 - protein, 18 aa, Staphylococcus
GPAGFLFMLGVTVFVLIY

SEQ ID NO: 1891056 - protein, 18 aa, Staphylococcus
GPAGRDGVSITITNTETT

SEQ ID NO: 1891057 - protein, 20 aa, Staphylococcus
GPIFRPVMRPLFTLPGRSTV

SEQ ID NO: 1891058 - protein, 20 aa, Staphylococcus
GPLFRPVMRPLFTLPGRSTV

SEQ ID NO: 1891059 - protein, 18 aa, Staphylococcus
GQAPFLFAHRGGMAVRPE

SEQ ID NO: 1891060 - protein, 20 aa, Staphylococcus
GQQVSRFFVPDGLPGNDGRS

SEQ ID NO: 1891061 - protein, 25 aa, Staphylococcus
GQTFSEFRIFLALLIILLLIISISL

SEQ ID NO: 1891062 - protein, 17 aa, Staphylococcus
GRDDFIGSIAIEIISRS

SEQ ID NO: 1891063 - protein, 17 aa, Staphylococcus
GRDGLLPSWLAKLNDKH

SEQ ID NO: 1891064 - protein, 25 aa, Staphylococcus
GREVCVPCIQGTRATIKYYYIDQAG

SEQ ID NO: 1891065 - protein, 17 aa, Staphylococcus
GRFFIKLLASMLVMSLV

SEQ ID NO: 1891066 - protein, 20 aa, Staphylococcus
GRFFWPAIIAFSLTGIGLPL

SEQ ID NO: 1891067 - protein, 19 aa, Staphylococcus
GRIALGIIIFVIFVYYTLS

SEQ ID NO: 1891068 - protein, 17 aa, Staphylococcus
GRILDRNGKILVDNASK

SEQ ID NO: 1891069 - protein, 19 aa, Staphylococcus
GRILKGKKNFGGSGLADVK

SEQ ID NO: 1891070 - protein, 27 aa, Staphylococcus
GRISKEYKRVLGWSLNHKWLVLIISIV

SEQ ID NO: 1891071 - protein, 21 aa, Staphylococcus
GRKRMGLIILCIFFLATLSGV

SEQ ID NO: 1891072 - protein, 25 aa, Staphylococcus
GRLLKRPKFIIPMFLQGLTYVMLFS

SEQ ID NO: 1891073 - protein, 18 aa, Staphylococcus
GRMSFFFIVTIVVLGLLV

SEQ ID NO: 1891074 - protein, 17 aa, Staphylococcus
GRRRLVLFIAIIFALGA

SEQ ID NO: 1891075 - protein, 18 aa, Staphylococcus
GRSGIVIIIRDMTNEHNL

SEQ ID NO: 1891076 - protein, 17 aa, Staphylococcus
GRVAVAIAFQNIMLILC

SEQ ID NO: 1891077 - protein, 17 aa, Staphylococcus
GRVSMVFGITTTLGILI

SEQ ID NO: 1891078 - protein, 21 aa, Staphylococcus
GSAFREFFKPFGVPMLTMPYV

SEQ ID NO: 1891079 - protein, 21 aa, Staphylococcus
GSAIREWLKPYGIAMLTAPFV

SEQ ID NO: 1891080 - protein, 26 aa, Staphylococcus
GSFIAKHKWWAIVAWVVLIAAVLTPI

SEQ ID NO: 1891081 - protein, 18 aa, Staphylococcus
GSIFPLLSPVLGWIGVFM

SEQ ID NO: 1891082 - protein, 18 aa, Staphylococcus
GSIWAWLLVLVFLPIIGF

SEQ ID NO: 1891083 - protein, 21 aa, Staphylococcus
GSLEHGIAIILVVAGTGLIYI

SEQ ID NO: 1891084 - protein, 20 aa, Staphylococcus
GSLFAISGTILFLARRRKHH

SEQ ID NO: 1891085 - protein, 21 aa, Staphylococcus
GSLKRNWKWLIAPLVTSIILL

SEQ ID NO: 1891086 - protein, 23 aa, Staphylococcus
GSMCMIFVAVMVYWFINRQKEKE

SEQ ID NO: 1891087 - protein, 18 aa, Staphylococcus
GSNTNQWHYGDNLQQNHR

SEQ ID NO: 1891088 - protein, 23 aa, Staphylococcus
GSNYFRFEYFNPLNSKKYYKNLD

SEQ ID NO: 1891089 - protein, 17 aa, Staphylococcus
GSNYFRFEYFNPTNSSK

SEQ ID NO: 1891090 - protein, 26 aa, Staphylococcus
GSQQRLGMALLLPYKVMKLNSDGSFA

SEQ ID NO: 1891091 - protein, 23 aa, Staphylococcus
GSRISWRVTRKFVVGKHQKKKPT

SEQ ID NO: 1891092 - protein, 21 aa, Staphylococcus
GSSLKGTYLWPIVAISNICQG

SEQ ID NO: 1891093 - protein, 18 aa, Staphylococcus
GSSLKPFLAYGPAIENMQ

SEQ ID NO: 1891094 - protein, 18 aa, Staphylococcus
GSVFPILSPILGWIGVFM

SEQ ID NO: 1891095 - protein, 19 aa, Staphylococcus
GSVGEMFRPFALAITFSLL

SEQ ID NO: 1891096 - protein, 24 aa, Staphylococcus
GSWYIPKWLGGILPKIDIEGKALE

SEQ ID NO: 1891097 - protein, 17 aa, Staphylococcus
GTFPIQVTPEFFQVIHP

SEQ ID NO: 1891098 - protein, 25 aa, Staphylococcus
GTFRVLTKVFKRLGIDADFVDTTHT

SEQ ID NO: 1891099 - protein, 23 aa, Staphylococcus
GTGEHLWRFAVGFGALIALVLYI

SEQ ID NO: 1891100 - protein, 18 aa, Staphylococcus
GTLFIDWKYLRLGMLKTA

SEQ ID NO: 1891101 - protein, 17 aa, Staphylococcus
GTLPNYSSFVLLNSKEK

SEQ ID NO: 1891102 - protein, 20 aa, Staphylococcus
GTLPRFANGTGFNLLGGGKK

SEQ ID NO: 1891103 - protein, 25 aa, Staphylococcus
GTNMQRTGIYMGVKPTSDYMTTSKD

SEQ ID NO: 1891104 - protein, 24 aa, Staphylococcus
GTPSSRTPGAFTRVATVIYPNGER

SEQ ID NO: 1891105 - protein, 20 aa, Staphylococcus
GTRIRPILMTAIATIGALVP

SEQ ID NO: 1891106 - protein, 20 aa, Staphylococcus
GTRIRPILMTALATIGALIP

SEQ ID NO: 1891107 - protein, 17 aa, Staphylococcus
GVFHIEFLKEIGDLVGG

SEQ ID NO: 1891108 - protein, 18 aa, Staphylococcus
GVFLSSWIQSYCKRSVIW

SEQ ID NO: 1891109 - protein, 17 aa, Staphylococcus
GVGDWKAIFIVNFPLSI

SEQ ID NO: 1891110 - protein, 18 aa, Staphylococcus
GVIIEFTRYYGYTLKEEN

SEQ ID NO: 1891111 - protein, 19 aa, Staphylococcus
GVIKFILGLGYHYHPQADT

SEQ ID NO: 1891112 - protein, 18 aa, Staphylococcus
GVILICFTLIFHLPLWVL

SEQ ID NO: 1891113 - protein, 23 aa, Staphylococcus
GVKVCTNCGKPVQQSKPNHSNTQ

SEQ ID NO: 1891114 - protein, 19 aa, Staphylococcus
GVMLSSILGIIGSAVLLIS

SEQ ID NO: 1891115 - protein, 19 aa, Staphylococcus
GVQHFYDWINHVLKTGHSA

SEQ ID NO: 1891116 - protein, 24 aa, Staphylococcus
GVTFKELWLPILTICFILAISKIT

SEQ ID NO: 1891117 - protein, 25 aa, Staphylococcus
GVTFKELWLPILTICFILAISKITT

SEQ ID NO: 1891118 - protein, 18 aa, Staphylococcus
GVWLYHFLERVLIPTGLH

SEQ ID NO: 1891119 - protein, 17 aa, Staphylococcus
GWLLCLFATIPGIILWN

SEQ ID NO: 1891120 - protein, 19 aa, Staphylococcus
GWLSRIIPHIDIEGHALES

SEQ ID NO: 1891121 - protein, 17 aa, Staphylococcus
GWSLKLGSWHVIFIVLT

SEQ ID NO: 1891122 - protein, 23 aa, Staphylococcus
GYDLRFATTLAIPVALNEIFIRI

SEQ ID NO: 1891123 - protein, 17 aa, Staphylococcus
GYKEWFINTSILRYPLN

SEQ ID NO: 1891124 - protein, 17 aa, Staphylococcus
GYLGFAIIFGFMAFFWF

SEQ ID NO: 1891125 - protein, 24 aa, Staphylococcus
GYLQTRLGFHFGFAVAAIGMFIGL

SEQ ID NO: 1891126 - protein, 20 aa, Staphylococcus
GYRYYDFIDNVGIRSGSHLY

SEQ ID NO: 1891127 - protein, 19 aa, Staphylococcus
GYTIAISFIGIFATFGGAY

SEQ ID NO: 1891128 - protein, 23 aa, Staphylococcus
HAFLLKYLFKIVGELIKPLEIQS

SEQ ID NO: 1891129 - protein, 20 aa, Staphylococcus
HAIARDKARQELDRVIASKM

SEQ ID NO: 1891130 - protein, 18 aa, Staphylococcus
HCATRLRIVLKRSIPNAK

SEQ ID NO: 1891131 - protein, 42 aa, Staphylococcus
HDGKKKGGFMKIILPIIAAVLILGAIAIFAGMALNNHSNSGN

SEQ ID NO: 1891132 - protein, 23 aa, Staphylococcus
HDLEPWIKFQLHPPKHLKSLVET

SEQ ID NO: 1891133 - protein, 24 aa, Staphylococcus
HDLKTAFEKWNFVKLAKPLIGVSI

SEQ ID NO: 1891134 - protein, 23 aa, Staphylococcus
HELDPRAKLIFVFLFIITIFFAH

SEQ ID NO: 1891135 - protein, 22 aa, Staphylococcus
HELIRWLFIFGVVFQLPMFCMG

SEQ ID NO: 1891136 - protein, 17 aa, Staphylococcus
HELPKASAQQVLVNGEI

SEQ ID NO: 1891137 - protein, 20 aa, Staphylococcus
HFHSRFALNILLTISNHYNR

SEQ ID NO: 1891138 - protein, 19 aa, Staphylococcus
HFHTACTFSAIPEDAKLVW

SEQ ID NO: 1891139 - protein, 18 aa, Staphylococcus
HFHYTLVCGVVFACFAAL

SEQ ID NO: 1891140 - protein, 17 aa, Staphylococcus
HFLLFNGLMGGLSFVLL

SEQ ID NO: 1891141 - protein, 18 aa, Staphylococcus
HFLWPAILAFALTGIGLP

SEQ ID NO: 1891142 - protein, 20 aa, Staphylococcus
HFPPRGSQRRRRRRRETATH

SEQ ID NO: 1891143 - protein, 22 aa, Staphylococcus
HFTGQMKFDFRYAKGNTVEVNE

SEQ ID NO: 1891144 - protein, 31 aa, Staphylococcus
HGDNFFNRVIDDFGKAVGFITLTGLLSGFWL

SEQ ID NO: 1891145 - protein, 19 aa, Staphylococcus
HGFGWKGSFGLNQILGVFM

SEQ ID NO: 1891146 - protein, 21 aa, Staphylococcus
HGNFKVKFFVSLIFAIPIILL

SEQ ID NO: 1891147 - protein, 17 aa, Staphylococcus
HHFKRIMILSLILTILS

SEQ ID NO: 1891148 - protein, 17 aa, Staphylococcus
HHFYEWLNHVLKTGHTA

SEQ ID NO: 1891149 - protein, 26 aa, Staphylococcus
HHILFLLGIFCFFKGFIGFFIGEKPL

SEQ ID NO: 1891150 - protein, 18 aa, Staphylococcus
HIGYCLIDLYLVGITFTN

SEQ ID NO: 1891151 - protein, 18 aa, Staphylococcus
HIIQLKMPFFDKNESGQL

SEQ ID NO: 1891152 - protein, 22 aa, Staphylococcus
HIKWDFQTLIGFVFAPFAFLTG

SEQ ID NO: 1891153 - protein, 20 aa, Staphylococcus
HIMMLIILWMVGCITSFSGL

SEQ ID NO: 1891154 - protein, 18 aa, Staphylococcus
HIVSWRWMFFINVLVVII

SEQ ID NO: 1891155 - protein, 18 aa, Staphylococcus
HKAYSGAVLSNFALNAVA

SEQ ID NO: 1891156 - protein, 17 aa, Staphylococcus
HKRVGSFSIVFLIMNPL

SEQ ID NO: 1891157 - protein, 18 aa, Staphylococcus
HLDRLRLSYFTYHRTDAD

SEQ ID NO: 1891158 - protein, 17 aa, Staphylococcus
HLDRLVLSYFEYHKDDS

SEQ ID NO: 1891159 - protein, 20 aa, Staphylococcus
HLFFFLPYIHAFRWHKLNKK

SEQ ID NO: 1891160 - protein, 18 aa, Staphylococcus
HLIHPIWLVLSFFLITLG

SEQ ID NO: 1891161 - protein, 17 aa, Staphylococcus
HLNRKWLTGGFIGVDTF

SEQ ID NO: 1891162 - protein, 24 aa, Staphylococcus
HNIRMPRMIGGLLIGAALAVAGLF

SEQ ID NO: 1891163 - protein, 20 aa, Staphylococcus
HNSPIIPISLILLGAGTLYY

SEQ ID NO: 1891164 - protein, 30 aa, Staphylococcus
HNSPKIFKIKRWKFIILLIAIILITVILTV

SEQ ID NO: 1891165 - protein, 17 aa, Staphylococcus
HPGCPLEAAIVVPLRVK

SEQ ID NO: 1891166 - protein, 21 aa, Staphylococcus
HPIEFSMIWKAMLIPSMGYIV

SEQ ID NO: 1891167 - protein, 24 aa, Staphylococcus
HPILGLRLKWQWYRARLSQWILNV

SEQ ID NO: 1891168 - protein, 18 aa, Staphylococcus
HPWAKFIVGKPVIAVIVS

SEQ ID NO: 1891169 - protein, 18 aa, Staphylococcus
HPWAKFVVGKPVLAIIIS

SEQ ID NO: 1891170 - protein, 20 aa, Staphylococcus
HPYLPFSYSIDALREAVGGP

SEQ ID NO: 1891171 - protein, 17 aa, Staphylococcus
HRIDYMSAYALNSPFLY

SEQ ID NO: 1891172 - protein, 18 aa, Staphylococcus
HRRLGGKESYLFYESLPI

SEQ ID NO: 1891173 - protein, 23 aa, Staphylococcus
HSKIVYRFTIFFTMIASFIDGVK

SEQ ID NO: 1891174 - protein, 23 aa, Staphylococcus
HSKMKITVLSLIFALLLAGLVGF

SEQ ID NO: 1891175 - protein, 26 aa, Staphylococcus
HSNHENMIYWFGIPRDQTPVGQVTFS

SEQ ID NO: 1891176 - protein, 17 aa, Staphylococcus
HSTKYSESVSMSESLSM

SEQ ID NO: 1891177 - protein, 25 aa, Staphylococcus
HTMNKRISFVFGAIVVIFGIIVLRL

SEQ ID NO: 1891178 - protein, 19 aa, Staphylococcus
HVFILKLLYYIKCRETKEE

SEQ ID NO: 1891179 - protein, 25 aa, Staphylococcus
HVFLCGLCLFLLFSITTGLATNTMM

SEQ ID NO: 1891180 - protein, 20 aa, Staphylococcus
HVIMPFILALSIMFATEFIL

SEQ ID NO: 1891181 - protein, 18 aa, Staphylococcus
HVLGDLFGSIGAIVAAIL

SEQ ID NO: 1891182 - protein, 18 aa, Staphylococcus
HVLGDLFGSIGAIVAALL

SEQ ID NO: 1891183 - protein, 17 aa, Staphylococcus
HVSIKLSLLGGEFDLQF

SEQ ID NO: 1891184 - protein, 19 aa, Staphylococcus
HWFILGCILIIYWIITFLN

SEQ ID NO: 1891185 - protein, 19 aa, Staphylococcus
HWFKQRTKQGFPFIAFLTT

SEQ ID NO: 1891186 - protein, 19 aa, Staphylococcus
HWIWPELPTGAAFAIAAIL

SEQ ID NO: 1891187 - protein, 19 aa, Staphylococcus
HYHFRRMSLFIIKLIGGLV

SEQ ID NO: 1891188 - protein, 22 aa, Staphylococcus
HYLQEFNKIVLIDKVKLKAKSQ

SEQ ID NO: 1891189 - protein, 24 aa, Staphylococcus
HYQEMPGRLSAGWAYVKKHWLFLV

SEQ ID NO: 1891190 - protein, 19 aa, Staphylococcus
IAALFHWTAGFAFSAGLID

SEQ ID NO: 1891191 - protein, 19 aa, Staphylococcus
IAALFHWTAGFSFSAGLID

SEQ ID NO: 1891192 - protein, 18 aa, Staphylococcus
IACGFIFYPITMLISKRH

SEQ ID NO: 1891193 - protein, 18 aa, Staphylococcus
IACGFIFYPITMLMSKRQ

SEQ ID NO: 1891194 - protein, 21 aa, Staphylococcus
IAEGGYPEWVIPTDPARRNDA

SEQ ID NO: 1891195 - protein, 21 aa, Staphylococcus
IAEGGYPEWVIPTDPNRRTDA

SEQ ID NO: 1891196 - protein, 25 aa, Staphylococcus
IAGAFIGSAVGFILNQVKKRKQQEK

SEQ ID NO: 1891197 - protein, 18 aa, Staphylococcus
IAGAGAFAFGGMAISALK

SEQ ID NO: 1891198 - protein, 18 aa, Staphylococcus
IAGICASSAMLLPGISGS

SEQ ID NO: 1891199 - protein, 17 aa, Staphylococcus
IAIGLGLLFGIMSQIAS

SEQ ID NO: 1891200 - protein, 21 aa, Staphylococcus
IAIICFILFLVALKSKNNMKH

SEQ ID NO: 1891201 - protein, 17 aa, Staphylococcus
IAISMRITKGFKQLIAL

SEQ ID NO: 1891202 - protein, 17 aa, Staphylococcus
IAISMRITNGFKQLIIS

SEQ ID NO: 1891203 - protein, 19 aa, Staphylococcus
IAKIFPWFIVWFVIASLIS

SEQ ID NO: 1891204 - protein, 17 aa, Staphylococcus
IAQGRWLFRVTSLIVFG

SEQ ID NO: 1891205 - protein, 17 aa, Staphylococcus
IAQRLIVFLPFPKTVAF

SEQ ID NO: 1891206 - protein, 23 aa, Staphylococcus
IASFWPFLVVLGVHWGLVPIMID

SEQ ID NO: 1891207 - protein, 19 aa, Staphylococcus
IASLFQWTAGFSFSAGLID

SEQ ID NO: 1891208 - protein, 17 aa, Staphylococcus
IASLLLCISICLIILNK

SEQ ID NO: 1891209 - protein, 18 aa, Staphylococcus
IASMCASSAMLLPGISGS

SEQ ID NO: 1891210 - protein, 19 aa, Staphylococcus
IASPEWRGVMSMYIFGTIF

SEQ ID NO: 1891211 - protein, 18 aa, Staphylococcus
IATICFITLFLLLIIQEG

SEQ ID NO: 1891212 - protein, 17 aa, Staphylococcus
IAVAIAFQNIMLIISAF

SEQ ID NO: 1891213 - protein, 17 aa, Staphylococcus
IAVAIAFQNIMLILSAF

SEQ ID NO: 1891214 - protein, 17 aa, Staphylococcus
IAVIAIICIIYFALKYA

SEQ ID NO: 1891215 - protein, 30 aa, Staphylococcus
IAYITAKRVKDGYEWDILFNKGHSNHENMI

SEQ ID NO: 1891216 - protein, 18 aa, Staphylococcus
ICAYFIRFLINKLKKTYL

SEQ ID NO: 1891217 - protein, 17 aa, Staphylococcus
ICFSMYIATFILGLFFR

SEQ ID NO: 1891218 - protein, 19 aa, Staphylococcus
ICGCIPKLGALANMIPLPV

SEQ ID NO: 1891219 - protein, 17 aa, Staphylococcus
ICIALILWLGIKEKNRH

SEQ ID NO: 1891220 - protein, 17 aa, Staphylococcus
ICLIGSFISAIAVNCFI

SEQ ID NO: 1891221 - protein, 24 aa, Staphylococcus
ICLLCGIISFIISFFIKLQFEVES

SEQ ID NO: 1891222 - protein, 23 aa, Staphylococcus
ICQEWLYHMGLPIDQIECLATQH

SEQ ID NO: 1891223 - protein, 17 aa, Staphylococcus
ICQEWLYHMGVPTNQIK

SEQ ID NO: 1891224 - protein, 18 aa, Staphylococcus
ICSLLAMFIVYLSRNQLT

SEQ ID NO: 1891225 - protein, 17 aa, Staphylococcus
ICVGIGVSVTYLIREID

SEQ ID NO: 1891226 - protein, 19 aa, Staphylococcus
ICYYFFNRFALFIVILAAI

SEQ ID NO: 1891227 - protein, 17 aa, Staphylococcus
IDFKKLMIIGSLVSVCT

SEQ ID NO: 1891228 - protein, 17 aa, Staphylococcus
IDFKQLMIIGSLISLAT

SEQ ID NO: 1891229 - protein, 20 aa, Staphylococcus
IDGKKFKGAITIDMSDNTST

SEQ ID NO: 1891230 - protein, 20 aa, Staphylococcus
IDGKKFKGALMINMSDDATA

SEQ ID NO: 1891231 - protein, 19 aa, Staphylococcus
IDKWEWLKWNPLNMMNIMI

SEQ ID NO: 1891232 - protein, 27 aa, Staphylococcus
IDLQREMWKYLSIIGVIVLFTVYLASR

SEQ ID NO: 1891233 - protein, 17 aa, Staphylococcus
IDLRLFKNVSFSSPIFA

SEQ ID NO: 1891234 - protein, 24 aa, Staphylococcus
IDLTFLFDYDELFYGNKLYFERTL

SEQ ID NO: 1891235 - protein, 26 aa, Staphylococcus
IDTAIGWRWIYIISIIVAILAILLIK

SEQ ID NO: 1891236 - protein, 23 aa, Staphylococcus
IEAKANRYTFVWKKSIQNHESKM

SEQ ID NO: 1891237 - protein, 19 aa, Staphylococcus
IEAMAAFLNSFPMFKDDTR

SEQ ID NO: 1891238 - protein, 26 aa, Staphylococcus
IEFIIKWKIYLIIGLVVLAMVVLSLF

SEQ ID NO: 1891239 - protein, 17 aa, Staphylococcus
IEHVPWLVIILVSLVTI

SEQ ID NO: 1891240 - protein, 23 aa, Staphylococcus
IEIARLRTWLSIIVEEQNSDTIH

SEQ ID NO: 1891241 - protein, 21 aa, Staphylococcus
IEIVGALLLAFYFYRDNPDLK

SEQ ID NO: 1891242 - protein, 17 aa, Staphylococcus
IEKGEFVKVQGLPYKDH

SEQ ID NO: 1891243 - protein, 18 aa, Staphylococcus
IELPMLIMMAIFSFVIFD

SEQ ID NO: 1891244 - protein, 17 aa, Staphylococcus
IELPVAMIISWILWGPL

SEQ ID NO: 1891245 - protein, 18 aa, Staphylococcus
IENTDCILIGPGLGCDFK

SEQ ID NO: 1891246 - protein, 18 aa, Staphylococcus
IERRKFWITLGIFILITI

SEQ ID NO: 1891247 - protein, 18 aa, Staphylococcus
IESIKDIQPIIVKKPAAR

SEQ ID NO: 1891248 - protein, 19 aa, Staphylococcus
IFEFFGSPIIAMFVGVLYA

SEQ ID NO: 1891249 - protein, 22 aa, Staphylococcus
IFFIWPTVQGWIFGIGGLVDKT

SEQ ID NO: 1891250 - protein, 17 aa, Staphylococcus
IFFKVRVPRTFEALMVG

SEQ ID NO: 1891251 - protein, 18 aa, Staphylococcus
IFGELEFWFAIIKVTTII

SEQ ID NO: 1891252 - protein, 20 aa, Staphylococcus
IFHAPFWFEFGAWKNAAGEM

SEQ ID NO: 1891253 - protein, 21 aa, Staphylococcus
IFHAPFWFEFGSWKNAAGHIV

SEQ ID NO: 1891254 - protein, 22 aa, Staphylococcus
IFIACLNLRMSIQSIPPVINLI

SEQ ID NO: 1891255 - protein, 19 aa, Staphylococcus
IFIGICVIVSLLALTPILT

SEQ ID NO: 1891256 - protein, 17 aa, Staphylococcus
IFKKRVPFTPGLIPNRR

SEQ ID NO: 1891257 - protein, 23 aa, Staphylococcus
IFLFFKGKKAFWFIFIGGFILTF

SEQ ID NO: 1891258 - protein, 19 aa, Staphylococcus
IFLFFKGKKAYWFIFIGGF

SEQ ID NO: 1891259 - protein, 19 aa, Staphylococcus
IFLLFRFTPLLGLSDIYVY

SEQ ID NO: 1891260 - protein, 19 aa, Staphylococcus
IFLLFRFTPVLGLSDAYIY

SEQ ID NO: 1891261 - protein, 19 aa, Staphylococcus
IFLLFRFTPVLGLSNSYIY

SEQ ID NO: 1891262 - protein, 22 aa, Staphylococcus
IFLMCVGNIYALEERKMKEKLT

SEQ ID NO: 1891263 - protein, 18 aa, Staphylococcus
IFLVLGVMIVLVLARFIT

SEQ ID NO: 1891264 - protein, 20 aa, Staphylococcus
IFQGHVAWHYAIVLVISSYF

SEQ ID NO: 1891265 - protein, 17 aa, Staphylococcus
IFSDLIPFLGMGAILQG

SEQ ID NO: 1891266 - protein, 17 aa, Staphylococcus
IFTKRANTFGVFVGLIS

SEQ ID NO: 1891267 - protein, 20 aa, Staphylococcus
IGAIIPMFFIFKSKVVDVKI

SEQ ID NO: 1891268 - protein, 17 aa, Staphylococcus
IGAKWVFFSSFIILLFP

SEQ ID NO: 1891269 - protein, 17 aa, Staphylococcus
IGAKWVFFSSFIVLLFP

SEQ ID NO: 1891270 - protein, 17 aa, Staphylococcus
IGALCYILWGIYLKDGL

SEQ ID NO: 1891271 - protein, 25 aa, Staphylococcus
IGDWIGWRFTFVFIIVISLIAGLLM

SEQ ID NO: 1891272 - protein, 21 aa, Staphylococcus
IGFASAWGYWFSAFLGNVAYA

SEQ ID NO: 1891273 - protein, 23 aa, Staphylococcus
IGFGASFFFNWLIQRDVIPQNLM

SEQ ID NO: 1891274 - protein, 23 aa, Staphylococcus
IGFGASFLFNWLIKHDLIPQSLM

SEQ ID NO: 1891275 - protein, 23 aa, Staphylococcus
IGFGASFLFNWLIKLDFISQGLM

SEQ ID NO: 1891276 - protein, 17 aa, Staphylococcus
IGFIAWGMLSDKYTEMP

SEQ ID NO: 1891277 - protein, 18 aa, Staphylococcus
IGFLYKYIIAYFIQVYAI

SEQ ID NO: 1891278 - protein, 18 aa, Staphylococcus
IGFNVCFMPQFILGLDGM

SEQ ID NO: 1891279 - protein, 23 aa, Staphylococcus
IGFQFSFLICFFILLSQPYLKKL

SEQ ID NO: 1891280 - protein, 20 aa, Staphylococcus
IGFSSAWGYWFAAFLGNVAY

SEQ ID NO: 1891281 - protein, 20 aa, Staphylococcus
IGGILVWLGWYGFNVGSAFT

SEQ ID NO: 1891282 - protein, 17 aa, Staphylococcus
IGGVFHIEFLKEIGDLV

SEQ ID NO: 1891283 - protein, 23 aa, Staphylococcus
IGIFCIIMVFALLGFLPYNLNPA

SEQ ID NO: 1891284 - protein, 20 aa, Staphylococcus
IGKLFFKKDIRQFGSGNTGA

SEQ ID NO: 1891285 - protein, 21 aa, Staphylococcus
IGKLFFKKDIRQFGSGNTGAT

SEQ ID NO: 1891286 - protein, 26 aa, Staphylococcus
IGKSFSEFRVFLAILIILLLMISMIL

SEQ ID NO: 1891287 - protein, 23 aa, Staphylococcus
IGLGCSLPFFFPAIQSFFNNRRT

SEQ ID NO: 1891288 - protein, 20 aa, Staphylococcus
IGPKGKFKPFILYGTVPLAI

SEQ ID NO: 1891289 - protein, 18 aa, Staphylococcus
IGQIALNWYVYELYHNAF

SEQ ID NO: 1891290 - protein, 17 aa, Staphylococcus
IGQLTDWMFQNGYDTRA

SEQ ID NO: 1891291 - protein, 20 aa, Staphylococcus
IGSFKYNPFIIEQVNKLGES

SEQ ID NO: 1891292 - protein, 21 aa, Staphylococcus
IGSFLTLLGIISFYSAAIYII

SEQ ID NO: 1891293 - protein, 22 aa, Staphylococcus
IGTFCIIMIFALLGFLPYNLNP

SEQ ID NO: 1891294 - protein, 23 aa, Staphylococcus
IGTFCVIMIFALLGFLPFNLNPA

SEQ ID NO: 1891295 - protein, 18 aa, Staphylococcus
IGTFCVIMVFALIGFLPY

SEQ ID NO: 1891296 - protein, 19 aa, Staphylococcus
IGTFDWRSFKFIKKAPRTD

SEQ ID NO: 1891297 - protein, 24 aa, Staphylococcus
IGTFSTVIATLVFIGFNTGQAQAN

SEQ ID NO: 1891298 - protein, 23 aa, Staphylococcus
IGTLRQAALEEFTDVYNDKVSEI

SEQ ID NO: 1891299 - protein, 18 aa, Staphylococcus
IGTMIGDWIGWRFTFVFI

SEQ ID NO: 1891300 - protein, 18 aa, Staphylococcus
IGTMIGDWVGWRFTFLFI

SEQ ID NO: 1891301 - protein, 17 aa, Staphylococcus
IGTYCLYLSLGVLLLDW

SEQ ID NO: 1891302 - protein, 17 aa, Staphylococcus
IGWKYSKALPVALTALY

SEQ ID NO: 1891303 - protein, 17 aa, Staphylococcus
IHETEMPEFLIVIYHGG

SEQ ID NO: 1891304 - protein, 24 aa, Staphylococcus
IHFASWRWIFFINIFIVIIAIPLM

SEQ ID NO: 1891305 - protein, 20 aa, Staphylococcus
IHFASWRWMFFINIVVSLIS

SEQ ID NO: 1891306 - protein, 23 aa, Staphylococcus
IHGFSGDDPIVFVGGKDKKMAKS

SEQ ID NO: 1891307 - protein, 18 aa, Staphylococcus
IHHYRYHPVLAYLDILLN

SEQ ID NO: 1891308 - protein, 19 aa, Staphylococcus
IHIGYCLIDLYLVGTAWSN

SEQ ID NO: 1891309 - protein, 18 aa, Staphylococcus
IHLLFFISYYKSFKIHQL

SEQ ID NO: 1891310 - protein, 17 aa, Staphylococcus
IHSHGWHGINFNSPFAD

SEQ ID NO: 1891311 - protein, 18 aa, Staphylococcus
IHYIPGFLGLFIASTGLI

SEQ ID NO: 1891312 - protein, 17 aa, Staphylococcus
IIAAIAFLILCIGIVVV

SEQ ID NO: 1891313 - protein, 20 aa, Staphylococcus
IIALSCFIIFGLPHVDFGVF

SEQ ID NO: 1891314 - protein, 18 aa, Staphylococcus
IICSITFLITIGITVFYV

SEQ ID NO: 1891315 - protein, 17 aa, Staphylococcus
IICSLSFSLCMMLGTLT

SEQ ID NO: 1891316 - protein, 22 aa, Staphylococcus
IIFAFAFRFIVKLIPVRFIFRV

SEQ ID NO: 1891317 - protein, 20 aa, Staphylococcus
IIFAYMFKWFGLIDDVLLMV

SEQ ID NO: 1891318 - protein, 19 aa, Staphylococcus
IIFFRWGWADPLASVIVAI

SEQ ID NO: 1891319 - protein, 23 aa, Staphylococcus
IIFFYKLMYPFIWLLNGAARLIL

SEQ ID NO: 1891320 - protein, 17 aa, Staphylococcus
IIFICFNFIPFIDQLFN

SEQ ID NO: 1891321 - protein, 17 aa, Staphylococcus
IIGYCVTIFFILMKAPD

SEQ ID NO: 1891322 - protein, 17 aa, Staphylococcus
IIIAMCFIHLNTALIMM

SEQ ID NO: 1891323 - protein, 17 aa, Staphylococcus
IIIDDAFVHFDKQRKAA

SEQ ID NO: 1891324 - protein, 18 aa, Staphylococcus
IIIDDAFVHFDKQRKEIM

SEQ ID NO: 1891325 - protein, 19 aa, Staphylococcus
IIIFVCVFAVFWGLSGQAK

SEQ ID NO: 1891326 - protein, 19 aa, Staphylococcus
IIIISGVIPFNIIKGIVIS

SEQ ID NO: 1891327 - protein, 18 aa, Staphylococcus
IIISFIFFMITKKDNYDK

SEQ ID NO: 1891328 - protein, 17 aa, Staphylococcus
IIISWLFIKYIYPKKRK

SEQ ID NO: 1891329 - protein, 27 aa, Staphylococcus
IIIYITFRFEWRMGLSSVLALLHDAFM

SEQ ID NO: 1891330 - protein, 18 aa, Staphylococcus
IIKIIGFMFIAFIVLLLL

SEQ ID NO: 1891331 - protein, 17 aa, Staphylococcus
IILCGIVTWLTRIIPFV

SEQ ID NO: 1891332 - protein, 18 aa, Staphylococcus
IILILFAIVAVFKNKNYF

SEQ ID NO: 1891333 - protein, 19 aa, Staphylococcus
IILLLAFLILMIFSIYKLV

SEQ ID NO: 1891334 - protein, 17 aa, Staphylococcus
IILPRFMKRIDYPIPPL

SEQ ID NO: 1891335 - protein, 18 aa, Staphylococcus
IILQTGICILPIYKIFIY

SEQ ID NO: 1891336 - protein, 21 aa, Staphylococcus
IILSFALRFVIAIVIGFGASY

SEQ ID NO: 1891337 - protein, 17 aa, Staphylococcus
IILSGIIPFNIIKGCVI

SEQ ID NO: 1891338 - protein, 17 aa, Staphylococcus
IIMKSAYNWAFFNPIRK

SEQ ID NO: 1891339 - protein, 17 aa, Staphylococcus
IIPRFKSFMSLFIASVI

SEQ ID NO: 1891340 - protein, 23 aa, Staphylococcus
IITFICAFYYFRYLKLSSTPLLI

SEQ ID NO: 1891341 - protein, 18 aa, Staphylococcus
IITTIAIGLGIIFANIFK

SEQ ID NO: 1891342 - protein, 18 aa, Staphylococcus
IIVDDAFVHFDKDRKERM

SEQ ID NO: 1891343 - protein, 18 aa, Staphylococcus
IIVDDAFVHFDKHRKERM

SEQ ID NO: 1891344 - protein, 18 aa, Staphylococcus
IIVDDAFVHFDKKRKRIM

SEQ ID NO: 1891345 - protein, 20 aa, Staphylococcus
IIVDILLYYPFYRTMEKYNL

SEQ ID NO: 1891346 - protein, 17 aa, Staphylococcus
IIVGPDFYMGIGTPGGN

SEQ ID NO: 1891347 - protein, 18 aa, Staphylococcus
IIVGPDFYMGIGTPGGNK

SEQ ID NO: 1891348 - protein, 19 aa, Staphylococcus
IIVGYKFLSKKSMLLTIVA

SEQ ID NO: 1891349 - protein, 17 aa, Staphylococcus
IIVLRLGYLQIAQGSHY

SEQ ID NO: 1891350 - protein, 19 aa, Staphylococcus
IIVPFIIAVSIMFGIEYIL

SEQ ID NO: 1891351 - protein, 20 aa, Staphylococcus
IIVSCCFACYHFFLKEGKQT

SEQ ID NO: 1891352 - protein, 17 aa, Staphylococcus
IIVSGIIPFNIIKGIVI

SEQ ID NO: 1891353 - protein, 26 aa, Staphylococcus
IIVYVVAAWIILRFVNKAIAQFFKIQ

SEQ ID NO: 1891354 - protein, 17 aa, Staphylococcus
IIWLVPRWIKFIPAPLI

SEQ ID NO: 1891355 - protein, 26 aa, Staphylococcus
IIYISLRFEWRMGLSSILALLHDAFM

SEQ ID NO: 1891356 - protein, 21 aa, Staphylococcus
IKDEAWLNAKLNHINKKTYQG

SEQ ID NO: 1891357 - protein, 17 aa, Staphylococcus
IKDHLFGAIGLDKQVAW

SEQ ID NO: 1891358 - protein, 20 aa, Staphylococcus
IKDKRLPQVIKEATNIFNKL

SEQ ID NO: 1891359 - protein, 24 aa, Staphylococcus
IKEIIKRTLGEFGVKTSDIQIEQL

SEQ ID NO: 1891360 - protein, 19 aa, Staphylococcus
IKEMLTEPVTIYFSEIEEV

SEQ ID NO: 1891361 - protein, 17 aa, Staphylococcus
IKFPFTFKTGGFLDASL

SEQ ID NO: 1891362 - protein, 20 aa, Staphylococcus
IKFSHWQWFISIASIVVLFV

SEQ ID NO: 1891363 - protein, 24 aa, Staphylococcus
IKGQGWSNIWFDVLILFVFIIVFT

SEQ ID NO: 1891364 - protein, 17 aa, Staphylococcus
IKHYDEWVGLNDDINSV

SEQ ID NO: 1891365 - protein, 17 aa, Staphylococcus
IKIIGFMFIAFIILALL

SEQ ID NO: 1891366 - protein, 22 aa, Staphylococcus
IKIRKIVPVAIIFFIIILLVIL

SEQ ID NO: 1891367 - protein, 21 aa, Staphylococcus
IKKDGKYYVFNQYLTKSNYYQ

SEQ ID NO: 1891368 - protein, 23 aa, Staphylococcus
IKKRMTLTFSVSVCLLFIFAYLN

SEQ ID NO: 1891369 - protein, 17 aa, Staphylococcus
IKLELDSLIAFHEQILK

SEQ ID NO: 1891370 - protein, 26 aa, Staphylococcus
IKLLSWLASAYIEFLRGTPLLVQVFL

SEQ ID NO: 1891371 - protein, 17 aa, Staphylococcus
IKLVFVFSVVQIFTGFF

SEQ ID NO: 1891372 - protein, 17 aa, Staphylococcus
IKLWLTIIFIVTTVLIL

SEQ ID NO: 1891373 - protein, 22 aa, Staphylococcus
IKPHFPRRVKLGVAAFLTGVAC

SEQ ID NO: 1891374 - protein, 21 aa, Staphylococcus
IKRGATLPTHLAGGSTTQIPV

SEQ ID NO: 1891375 - protein, 17 aa, Staphylococcus
IKSELYHSLTLNLVLSA

SEQ ID NO: 1891376 - protein, 29 aa, Staphylococcus
IKSFFKEHWPKIAIIIGVILLIIILNAIF

SEQ ID NO: 1891377 - protein, 21 aa, Staphylococcus
IKSLRRFAGYIALLAPILASG

SEQ ID NO: 1891378 - protein, 17 aa, Staphylococcus
IKVEILDKDGHVIGSGK

SEQ ID NO: 1891379 - protein, 24 aa, Staphylococcus
IKVFKLEVKWPFWLSQIGLILLGV

SEQ ID NO: 1891380 - protein, 19 aa, Staphylococcus
IKVLSDWNVILSFVLLGFV

SEQ ID NO: 1891381 - protein, 18 aa, Staphylococcus
IKVWKLIQFISFFPTISS

SEQ ID NO: 1891382 - protein, 21 aa, Staphylococcus
IKWDFQTLIGFVFAPFAFLAG

SEQ ID NO: 1891383 - protein, 21 aa, Staphylococcus
IKWDFQTLIGFVFAPLAFLAG

SEQ ID NO: 1891384 - protein, 17 aa, Staphylococcus
ILADLVPEMDFIKIDKG

SEQ ID NO: 1891385 - protein, 17 aa, Staphylococcus
ILAPLAPMFQQVWSQIV

SEQ ID NO: 1891386 - protein, 25 aa, Staphylococcus
ILATPIQFIIGWQFYVGAYKNLRNG

SEQ ID NO: 1891387 - protein, 18 aa, Staphylococcus
ILCIDFYLGPSWHKTAIQ

SEQ ID NO: 1891388 - protein, 19 aa, Staphylococcus
ILCLLRLNVIISLFISSLV

SEQ ID NO: 1891389 - protein, 25 aa, Staphylococcus
ILCRSRVKIKFDWRGSVNITSLVQQ

SEQ ID NO: 1891390 - protein, 18 aa, Staphylococcus
ILCSLSFAVCMILGTLTV

SEQ ID NO: 1891391 - protein, 18 aa, Staphylococcus
ILCTLVFGLLFSSMFTPF

SEQ ID NO: 1891392 - protein, 17 aa, Staphylococcus
ILFPRLGASLTVIITIA

SEQ ID NO: 1891393 - protein, 18 aa, Staphylococcus
ILFSLPFTAIGIVFALLI

SEQ ID NO: 1891394 - protein, 18 aa, Staphylococcus
ILFSLPFTIIGVVLALLI

SEQ ID NO: 1891395 - protein, 18 aa, Staphylococcus
ILFSLPFTIVGVVLSLVI

SEQ ID NO: 1891396 - protein, 18 aa, Staphylococcus
ILFVFMILLFYGRIRGFS

SEQ ID NO: 1891397 - protein, 19 aa, Staphylococcus
ILIAIGWRQIWKRKIESHK

SEQ ID NO: 1891398 - protein, 20 aa, Staphylococcus
ILIFKRQWLSTKAFSKKFVP

SEQ ID NO: 1891399 - protein, 22 aa, Staphylococcus
ILIICLFSGLTLEHFHNEYNLN

SEQ ID NO: 1891400 - protein, 23 aa, Staphylococcus
ILIITIIISFVFYYFTSDEKVDK

SEQ ID NO: 1891401 - protein, 17 aa, Staphylococcus
ILILLLLTIKKYRNVAV

SEQ ID NO: 1891402 - protein, 19 aa, Staphylococcus
ILIMLICLGFINHPIQAAE

SEQ ID NO: 1891403 - protein, 22 aa, Staphylococcus
ILIRILHAWVYFKCSGMAQNDS

SEQ ID NO: 1891404 - protein, 18 aa, Staphylococcus
ILITKVIILALFGLGFII

SEQ ID NO: 1891405 - protein, 18 aa, Staphylococcus
ILITKVVVLTLFGLGFII

SEQ ID NO: 1891406 - protein, 18 aa, Staphylococcus
ILIWIMICSVAMSIALVI

SEQ ID NO: 1891407 - protein, 18 aa, Staphylococcus
ILIWKYVPKNGIAADENH

SEQ ID NO: 1891408 - protein, 25 aa, Staphylococcus
ILKDRRYRINLSYIFGISIILLNLM

SEQ ID NO: 1891409 - protein, 23 aa, Staphylococcus
ILKEKRLWLTLAVTLFGFSSVFA

SEQ ID NO: 1891410 - protein, 17 aa, Staphylococcus
ILKPYGLPMLTFPFVFM

SEQ ID NO: 1891411 - protein, 18 aa, Staphylococcus
ILKSELLLAFSTSSSEAV

SEQ ID NO: 1891412 - protein, 20 aa, Staphylococcus
ILKSELLLAFSTSSSEAVLP

SEQ ID NO: 1891413 - protein, 22 aa, Staphylococcus
ILLAGLITFLAFGMFGDKYTET

SEQ ID NO: 1891414 - protein, 17 aa, Staphylococcus
ILLGFTIFACWPFTRLV

SEQ ID NO: 1891415 - protein, 19 aa, Staphylococcus
ILLIFRFLMGIAIGMDSPV

SEQ ID NO: 1891416 - protein, 24 aa, Staphylococcus
ILLIISVVIFKYILRDHKQQHSGY

SEQ ID NO: 1891417 - protein, 19 aa, Staphylococcus
ILLSILVSIVFIKNQIYYK

SEQ ID NO: 1891418 - protein, 17 aa, Staphylococcus
ILMGIVIGHSFLNIVER

SEQ ID NO: 1891419 - protein, 17 aa, Staphylococcus
ILMGIVIGHSFLNLVER

SEQ ID NO: 1891420 - protein, 17 aa, Staphylococcus
ILMGLVIGQSGFHLVER

SEQ ID NO: 1891421 - protein, 23 aa, Staphylococcus
ILMKSAYNWAFLKPVRKIYYNIT

SEQ ID NO: 1891422 - protein, 22 aa, Staphylococcus
ILNLFLAWFFIYFPWGRNGVKG

SEQ ID NO: 1891423 - protein, 25 aa, Staphylococcus
ILQSFYFKRYLLRAIMAGFILGVIT

SEQ ID NO: 1891424 - protein, 19 aa, Staphylococcus
ILRALRFAQKLNIKVIGLG

SEQ ID NO: 1891425 - protein, 17 aa, Staphylococcus
ILSHDGFAYIMNNAIKN

SEQ ID NO: 1891426 - protein, 18 aa, Staphylococcus
ILSTLGFIFLMFLSGLEI

SEQ ID NO: 1891427 - protein, 18 aa, Staphylococcus
ILTCCLVFLLVLVSNESE

SEQ ID NO: 1891428 - protein, 23 aa, Staphylococcus
ILTCLKLNISPVFAVIVGLVLHD

SEQ ID NO: 1891429 - protein, 24 aa, Staphylococcus
ILTIEFIGALLLAFYFYRDNPDLK

SEQ ID NO: 1891430 - protein, 18 aa, Staphylococcus
ILTLCIVPWLSAKKARTL

SEQ ID NO: 1891431 - protein, 25 aa, Staphylococcus
ILTYVLRYVWRLSIFGTSQKLGKIL

SEQ ID NO: 1891432 - protein, 17 aa, Staphylococcus
ILVCTKFNLQVGTTVAV

SEQ ID NO: 1891433 - protein, 17 aa, Staphylococcus
ILVGATLIFGVNHEAKA

SEQ ID NO: 1891434 - protein, 18 aa, Staphylococcus
ILVITILISFTFYFFNKE

SEQ ID NO: 1891435 - protein, 23 aa, Staphylococcus
ILVITILISFVFYYFNKEDRPDK

SEQ ID NO: 1891436 - protein, 18 aa, Staphylococcus
ILYFEIITTIAIGLGLII

SEQ ID NO: 1891437 - protein, 19 aa, Staphylococcus
ILYRFFKRIHIGWFVLPVP

SEQ ID NO: 1891438 - protein, 17 aa, Staphylococcus
IMFSVFIAFIFQDDTAI

SEQ ID NO: 1891439 - protein, 17 aa, Staphylococcus
IMFSVFIAFVFQDDITV

SEQ ID NO: 1891440 - protein, 17 aa, Staphylococcus
IMFSVFIAFVFQDDMQI

SEQ ID NO: 1891441 - protein, 22 aa, Staphylococcus
IMFSVFIAFVFQDDVMIKSMGI

SEQ ID NO: 1891442 - protein, 19 aa, Staphylococcus
IMLGIPIYVVLVIFCIVVA

SEQ ID NO: 1891443 - protein, 18 aa, Staphylococcus
IMMAIVFYYFERKYTHPL

SEQ ID NO: 1891444 - protein, 23 aa, Staphylococcus
IMTYILRYTWRVLIFGTSNKLGK

SEQ ID NO: 1891445 - protein, 17 aa, Staphylococcus
INAHGWSGINFNSPFAD

SEQ ID NO: 1891446 - protein, 17 aa, Staphylococcus
INDKWLLILCVLVIIIN

SEQ ID NO: 1891447 - protein, 23 aa, Staphylococcus
INEEKARLLADVISRVSKDKKDV

SEQ ID NO: 1891448 - protein, 23 aa, Staphylococcus
INEREVIGIFALDKFAWLVGAFV

SEQ ID NO: 1891449 - protein, 23 aa, Staphylococcus
INFFPRKIWYLFIIMTITILLTM

SEQ ID NO: 1891450 - protein, 21 aa, Staphylococcus
INFKRSHFIIILIVTILVTAM

SEQ ID NO: 1891451 - protein, 23 aa, Staphylococcus
INGREVIGIFALDKLAWLVGAFV

SEQ ID NO: 1891452 - protein, 17 aa, Staphylococcus
INIGIYVSMLFKEGLAR

SEQ ID NO: 1891453 - protein, 17 aa, Staphylococcus
INIIVAWIMLRGSDVEE

SEQ ID NO: 1891454 - protein, 18 aa, Staphylococcus
INLLVCIALLAAVGLGLT

SEQ ID NO: 1891455 - protein, 25 aa, Staphylococcus
INMPELKWHYGYYIVLGIMLAISAG

SEQ ID NO: 1891456 - protein, 17 aa, Staphylococcus
INMPSIEGMGFAIPINE

SEQ ID NO: 1891457 - protein, 22 aa, Staphylococcus
INPAELFIFLGIAHGIEKLGLP

SEQ ID NO: 1891458 - protein, 17 aa, Staphylococcus
INPSFYVNDSNYRNVTS

SEQ ID NO: 1891459 - protein, 17 aa, Staphylococcus
INWLWPVLFLDIVIITP

SEQ ID NO: 1891460 - protein, 17 aa, Staphylococcus
IPALKTWQATRSQAGNN

SEQ ID NO: 1891461 - protein, 20 aa, Staphylococcus
IPEKRKGEGIGYYALSVTTA

SEQ ID NO: 1891462 - protein, 17 aa, Staphylococcus
IPFAFLGARNMVKLRPV

SEQ ID NO: 1891463 - protein, 17 aa, Staphylococcus
IPFLLIWIIDGFKGIKE

SEQ ID NO: 1891464 - protein, 19 aa, Staphylococcus
IPGLLSFLADDSFKTKVKG

SEQ ID NO: 1891465 - protein, 17 aa, Staphylococcus
IPGWIEWLEAQGIQPYL

SEQ ID NO: 1891466 - protein, 21 aa, Staphylococcus
IPISLILLGAGTLYYNRKKDA

SEQ ID NO: 1891467 - protein, 26 aa, Staphylococcus
IPKSRRTSGIFLLQFVLLLIAQLNFH

SEQ ID NO: 1891468 - protein, 17 aa, Staphylococcus
IPLAWILNLQNFFVKPL

SEQ ID NO: 1891469 - protein, 18 aa, Staphylococcus
IPLSWILGLQHFFIKPLM

SEQ ID NO: 1891470 - protein, 17 aa, Staphylococcus
IPMFIIILILVVFAILF

SEQ ID NO: 1891471 - protein, 20 aa, Staphylococcus
IPNFRILRKIGYTHQDMLKG

SEQ ID NO: 1891472 - protein, 24 aa, Staphylococcus
IPPFFSRTAPYIFAHRGGMAVRPE

SEQ ID NO: 1891473 - protein, 21 aa, Staphylococcus
IPTRSRYAFIMTMCGIHGTIS

SEQ ID NO: 1891474 - protein, 17 aa, Staphylococcus
IPVLFLFPFVQKHFVKG

SEQ ID NO: 1891475 - protein, 21 aa, Staphylococcus
IPVTENHGGSGLNQVRVEGLP

SEQ ID NO: 1891476 - protein, 18 aa, Staphylococcus
IPVVLFIYFLSYISTTMS

SEQ ID NO: 1891477 - protein, 17 aa, Staphylococcus
IQCNGCFNKEPKAASTL

SEQ ID NO: 1891478 - protein, 17 aa, Staphylococcus
IQIILSFALRFVIAIVI

SEQ ID NO: 1891479 - protein, 17 aa, Staphylococcus
IQIPHIFMNPWFQFVLA

SEQ ID NO: 1891480 - protein, 24 aa, Staphylococcus
IQLGEKFAKIGFFIFVFLIGTVAV

SEQ ID NO: 1891481 - protein, 18 aa, Staphylococcus
IQPIMPLLRKIQLKYRQQ

SEQ ID NO: 1891482 - protein, 17 aa, Staphylococcus
IRDSLSIVLDETKRLNR

SEQ ID NO: 1891483 - protein, 19 aa, Staphylococcus
IRDYIGLGIVLMFFIISLV

SEQ ID NO: 1891484 - protein, 20 aa, Staphylococcus
IRFLDKEALAFLKPYPLANE

SEQ ID NO: 1891485 - protein, 20 aa, Staphylococcus
IRHIKRWVKSYLIFTFALAS

SEQ ID NO: 1891486 - protein, 18 aa, Staphylococcus
IRIGERFMQKKGPQIPLM

SEQ ID NO: 1891487 - protein, 22 aa, Staphylococcus
IRIKASFLRRRVRIQTNASSSL

SEQ ID NO: 1891488 - protein, 23 aa, Staphylococcus
IRKETCSWKWTLIALFYPIVTAY

SEQ ID NO: 1891489 - protein, 22 aa, Staphylococcus
IRKETCSWKWTLIAVIYPVLTA

SEQ ID NO: 1891490 - protein, 17 aa, Staphylococcus
IRLAISIGIALFIFAVV

SEQ ID NO: 1891491 - protein, 20 aa, Staphylococcus
IRLLPVGGYVRMAGDGLEEP

SEQ ID NO: 1891492 - protein, 19 aa, Staphylococcus
IRLVILRSEYRSVIRPISR

SEQ ID NO: 1891493 - protein, 17 aa, Staphylococcus
IRPILMTAIATIGALLP

SEQ ID NO: 1891494 - protein, 17 aa, Staphylococcus
IRTLLNIAGREGAFNEV

SEQ ID NO: 1891495 - protein, 18 aa, Staphylococcus
IRVPIYGHRMLKNLTLDS

SEQ ID NO: 1891496 - protein, 18 aa, Staphylococcus
IRVSRLVKDTTLSKIIHM

SEQ ID NO: 1891497 - protein, 17 aa, Staphylococcus
IRWYYRLASALYFIVFT

SEQ ID NO: 1891498 - protein, 22 aa, Staphylococcus
ISAILVAIGWRLIWKKQIDKHK

SEQ ID NO: 1891499 - protein, 17 aa, Staphylococcus
ISDALIRMQRERVHISL

SEQ ID NO: 1891500 - protein, 22 aa, Staphylococcus
ISEKEFFLYSGLFTLLIGVILV

SEQ ID NO: 1891501 - protein, 17 aa, Staphylococcus
ISFCLFKHHAILFNSRG

SEQ ID NO: 1891502 - protein, 17 aa, Staphylococcus
ISFKLAWMPAIDLNLDL

SEQ ID NO: 1891503 - protein, 17 aa, Staphylococcus
ISFKTNGLPTERLYYAA

SEQ ID NO: 1891504 - protein, 23 aa, Staphylococcus
ISFPKRVFTALAIGIILGIAMHL

SEQ ID NO: 1891505 - protein, 19 aa, Staphylococcus
ISGFTYLISMIFLLFTLAF

SEQ ID NO: 1891506 - protein, 21 aa, Staphylococcus
ISGFYRWTAILGLAFTMLFIG

SEQ ID NO: 1891507 - protein, 18 aa, Staphylococcus
ISGGIGALVASFFNPKYY

SEQ ID NO: 1891508 - protein, 21 aa, Staphylococcus
ISGMTCAACSARIERVLNRTE

SEQ ID NO: 1891509 - protein, 20 aa, Staphylococcus
ISIIISVVFVRFVNTKKRKM

SEQ ID NO: 1891510 - protein, 22 aa, Staphylococcus
ISIILAYAFKWLGLVDDVLLMV

SEQ ID NO: 1891511 - protein, 18 aa, Staphylococcus
ISILSLFISMIWIFNNDY

SEQ ID NO: 1891512 - protein, 21 aa, Staphylococcus
ISKIIPVFAIRPWFDQKTTIS

SEQ ID NO: 1891513 - protein, 29 aa, Staphylococcus
ISLIKILRPYYPFPIIIDDAFVHFDKQRK

SEQ ID NO: 1891514 - protein, 20 aa, Staphylococcus
ISLIKVLKPYYPFPIIVDDA

SEQ ID NO: 1891515 - protein, 17 aa, Staphylococcus
ISLIRFFYVPVVNYHFL

SEQ ID NO: 1891516 - protein, 20 aa, Staphylococcus
ISLWLGALIYLFSSVFTKKR

SEQ ID NO: 1891517 - protein, 19 aa, Staphylococcus
ISLYLKWWIVFGVAIVLLI

SEQ ID NO: 1891518 - protein, 24 aa, Staphylococcus
ISPNEFKFGLSFFSRAVSLSRFPW

SEQ ID NO: 1891519 - protein, 23 aa, Staphylococcus
ISPNEFKFGLSFLTRSVALARFP

SEQ ID NO: 1891520 - protein, 18 aa, Staphylococcus
ISRAYKWFVLDKEFTEGI

SEQ ID NO: 1891521 - protein, 26 aa, Staphylococcus
ISVGNWRWIFWINIPFIFIGLIGCLF

SEQ ID NO: 1891522 - protein, 21 aa, Staphylococcus
ISVLICLSAIFGLPQGLLNLA

SEQ ID NO: 1891523 - protein, 17 aa, Staphylococcus
ISVPSMIGMLMLIGIVV

SEQ ID NO: 1891524 - protein, 18 aa, Staphylococcus
ISYLIPLLIAYSGGRLIH

SEQ ID NO: 1891525 - protein, 25 aa, Staphylococcus
ISYTEWVKFVWKPILIWIMICSVAM

SEQ ID NO: 1891526 - protein, 17 aa, Staphylococcus
ITADGKWGFSFTDKDGD

SEQ ID NO: 1891527 - protein, 17 aa, Staphylococcus
ITIIFGFAFIQAAVQLL

SEQ ID NO: 1891528 - protein, 20 aa, Staphylococcus
ITILISFTFYFFNKEDKPDK

SEQ ID NO: 1891529 - protein, 17 aa, Staphylococcus
ITLAFLFATILFALTSS

SEQ ID NO: 1891530 - protein, 18 aa, Staphylococcus
ITLCSIAFFICWLGLQFY

SEQ ID NO: 1891531 - protein, 28 aa, Staphylococcus
ITLDNASWWKSFRFFDENETELPTTVVD

SEQ ID NO: 1891532 - protein, 18 aa, Staphylococcus
ITLFNFITLFLLLTISTL

SEQ ID NO: 1891533 - protein, 17 aa, Staphylococcus
ITLISVFIFLKHQLSPE

SEQ ID NO: 1891534 - protein, 17 aa, Staphylococcus
ITLLISVAAGIGLINIL

SEQ ID NO: 1891535 - protein, 17 aa, Staphylococcus
ITLSEIESAMTLADGLK

SEQ ID NO: 1891536 - protein, 18 aa, Staphylococcus
ITMILCYFGFQFGLKKRD

SEQ ID NO: 1891537 - protein, 18 aa, Staphylococcus
ITRFSIRKYQGFGAASVA

SEQ ID NO: 1891538 - protein, 17 aa, Staphylococcus
ITTIAIGLGIIFGNLFK

SEQ ID NO: 1891539 - protein, 17 aa, Staphylococcus
ITVLPFGNLISQIQVKG

SEQ ID NO: 1891540 - protein, 17 aa, Staphylococcus
ITYLIPLLIAFSGGRLI

SEQ ID NO: 1891541 - protein, 18 aa, Staphylococcus
ITYLIPLLIAFSGGRLIH

SEQ ID NO: 1891542 - protein, 18 aa, Staphylococcus
ITYLTSRFKYIILPYLCV

SEQ ID NO: 1891543 - protein, 17 aa, Staphylococcus
IVACLKTAIGLITAFSE

SEQ ID NO: 1891544 - protein, 17 aa, Staphylococcus
IVAGITFFISEHDVQAA

SEQ ID NO: 1891545 - protein, 18 aa, Staphylococcus
IVAIAVGLLLVWLVVTFV

SEQ ID NO: 1891546 - protein, 17 aa, Staphylococcus
IVALPPLLAFIGLLFTS

SEQ ID NO: 1891547 - protein, 24 aa, Staphylococcus
IVALVIIGVVGFYFYHNATSYVTT

SEQ ID NO: 1891548 - protein, 23 aa, Staphylococcus
IVASILLFFAFRTSDNIKISHRL

SEQ ID NO: 1891549 - protein, 19 aa, Staphylococcus
IVCMICILISTLIKNLNVI

SEQ ID NO: 1891550 - protein, 17 aa, Staphylococcus
IVFFCIFLIFSPIGKLK

SEQ ID NO: 1891551 - protein, 18 aa, Staphylococcus
IVFIIEALLYWKDRRKAK

SEQ ID NO: 1891552 - protein, 19 aa, Staphylococcus
IVFPYEINIGLTIGVFGTI

SEQ ID NO: 1891553 - protein, 17 aa, Staphylococcus
IVGFIFKPLMATFTAIA

SEQ ID NO: 1891554 - protein, 18 aa, Staphylococcus
IVGVICFIIGIISYTILG

SEQ ID NO: 1891555 - protein, 18 aa, Staphylococcus
IVGYFLLMNRRLFKMYDR

SEQ ID NO: 1891556 - protein, 18 aa, Staphylococcus
IVIGIAVLVFIIWIIFVH

SEQ ID NO: 1891557 - protein, 19 aa, Staphylococcus
IVIGYKFLSKRSMFLTIIA

SEQ ID NO: 1891558 - protein, 18 aa, Staphylococcus
IVIPLCLILWKGFAPTTD

SEQ ID NO: 1891559 - protein, 22 aa, Staphylococcus
IVIPVVFCSLALSISGVGESKT

SEQ ID NO: 1891560 - protein, 23 aa, Staphylococcus
IVIPVVFCSLALSISGVGESKTV

SEQ ID NO: 1891561 - protein, 23 aa, Staphylococcus
IVIPVVFCSLALSISNVGESKTV

SEQ ID NO: 1891562 - protein, 22 aa, Staphylococcus
IVITCILLFLLIFFLFNLPLSA

SEQ ID NO: 1891563 - protein, 18 aa, Staphylococcus
IVKLIPIYYIFRVLSIFI

SEQ ID NO: 1891564 - protein, 18 aa, Staphylococcus
IVKLIPIYYIFRVLSILI

SEQ ID NO: 1891565 - protein, 18 aa, Staphylococcus
IVLGCTFTAVAPMILIGQ

SEQ ID NO: 1891566 - protein, 19 aa, Staphylococcus
IVLGLYGWVVVKSLIYAGR

SEQ ID NO: 1891567 - protein, 17 aa, Staphylococcus
IVLLAFVLLVFVFRSIL

SEQ ID NO: 1891568 - protein, 22 aa, Staphylococcus
IVLQEMIIRLSLVTREGLGEAI

SEQ ID NO: 1891569 - protein, 17 aa, Staphylococcus
IVLSIGIPPMFFVAMVQ

SEQ ID NO: 1891570 - protein, 17 aa, Staphylococcus
IVLYFSFVTIRYVRHIN

SEQ ID NO: 1891571 - protein, 17 aa, Staphylococcus
IVPWRLAMLYKYKNVKK

SEQ ID NO: 1891572 - protein, 23 aa, Staphylococcus
IVSFCFIFLLLLFFRYILKRYFN

SEQ ID NO: 1891573 - protein, 17 aa, Staphylococcus
IVSFCLFIIWELKTNHP

SEQ ID NO: 1891574 - protein, 18 aa, Staphylococcus
IVVACLKTAIGLITAFSE

SEQ ID NO: 1891575 - protein, 18 aa, Staphylococcus
IVVDGQFTSVDAFKNLQI

SEQ ID NO: 1891576 - protein, 18 aa, Staphylococcus
IVVDGQFTSVNAFKNLKI

SEQ ID NO: 1891577 - protein, 17 aa, Staphylococcus
IVVEPFFQWFVWIGGAG

SEQ ID NO: 1891578 - protein, 18 aa, Staphylococcus
IVVGIAVLTFIIWIAFVQ

SEQ ID NO: 1891579 - protein, 17 aa, Staphylococcus
IVVGPDFYMGIGTPGGN

SEQ ID NO: 1891580 - protein, 17 aa, Staphylococcus
IVVGWKFLSRTTAIYTA

SEQ ID NO: 1891581 - protein, 17 aa, Staphylococcus
IVVIYRQPFLALIVGGS

SEQ ID NO: 1891582 - protein, 18 aa, Staphylococcus
IVVLRLILYFVLMMGAVQ

SEQ ID NO: 1891583 - protein, 19 aa, Staphylococcus
IVYRFIKRIHIGWFVLPVP

SEQ ID NO: 1891584 - protein, 18 aa, Staphylococcus
IWGGDILFGYGFSMLFVI

SEQ ID NO: 1891585 - protein, 24 aa, Staphylococcus
IWTVPCYLCIVFALFYAFTGWTVK

SEQ ID NO: 1891586 - protein, 19 aa, Staphylococcus
IWWLYLMLFIRGCSVGGIM

SEQ ID NO: 1891587 - protein, 18 aa, Staphylococcus
IYEMSKWLLDSNAQPHLY

SEQ ID NO: 1891588 - protein, 20 aa, Staphylococcus
IYGGTFFYRFRKIIAPLFAS

SEQ ID NO: 1891589 - protein, 17 aa, Staphylococcus
IYGLIFIGIIIFFIALI

SEQ ID NO: 1891590 - protein, 24 aa, Staphylococcus
IYHSFLLKKWHLFFYLILMMCAFL

SEQ ID NO: 1891591 - protein, 21 aa, Staphylococcus
IYHSFLLKKWYLFLYLFLMII

SEQ ID NO: 1891592 - protein, 22 aa, Staphylococcus
IYIFRFIWVYVLFKDFYYPKNV

SEQ ID NO: 1891593 - protein, 17 aa, Staphylococcus
IYILICFTFLIMIPSGV

SEQ ID NO: 1891594 - protein, 18 aa, Staphylococcus
IYKAQLVLTPYGAKQYID

SEQ ID NO: 1891595 - protein, 23 aa, Staphylococcus
IYMIRIGLQIAHLLGDLKGRIAI

SEQ ID NO: 1891596 - protein, 18 aa, Staphylococcus
IYNIGFQFSFFITFCILF

SEQ ID NO: 1891597 - protein, 18 aa, Staphylococcus
IYQNLTFDSIVFRNALQY

SEQ ID NO: 1891598 - protein, 17 aa, Staphylococcus
IYTPIVFILALLVMVIP

SEQ ID NO: 1891599 - protein, 23 aa, Staphylococcus
IYVFRFIWVFILFKQFYYPNNIQ

SEQ ID NO: 1891600 - protein, 23 aa, Staphylococcus
IYVFRFVWVYLLFKDFYYPNNVQ

SEQ ID NO: 1891601 - protein, 23 aa, Staphylococcus
IYVFRYIWVYIWFKDFYAPKNVQ

SEQ ID NO: 1891602 - protein, 23 aa, Staphylococcus
IYVSLRFEWRMGLSSVLALLHDA

SEQ ID NO: 1891603 - protein, 20 aa, Staphylococcus
KAALVMFMWLPKAYAALNTE

SEQ ID NO: 1891604 - protein, 22 aa, Staphylococcus
KAFGEFEFWFALIKVITIILMI

SEQ ID NO: 1891605 - protein, 22 aa, Staphylococcus
KAFGEFEFWFALIKVITILLMI

SEQ ID NO: 1891606 - protein, 22 aa, Staphylococcus
KAFGEFEFWFALIKVVTIILMI

SEQ ID NO: 1891607 - protein, 21 aa, Staphylococcus
KAFGEFEFWFAMIKIVTIILM

SEQ ID NO: 1891608 - protein, 21 aa, Staphylococcus
KAFGEFEFWFAMIKVVTIILM

SEQ ID NO: 1891609 - protein, 17 aa, Staphylococcus
KAFTLIEMLLVLLIISV

SEQ ID NO: 1891610 - protein, 19 aa, Staphylococcus
KAIESLYFNRYLKAGDEVL

SEQ ID NO: 1891611 - protein, 18 aa, Staphylococcus
KAKSAISYAEFRPNLRNV

SEQ ID NO: 1891612 - protein, 25 aa, Staphylococcus
KALKRLPWLIILTFLGMITATILGG

SEQ ID NO: 1891613 - protein, 20 aa, Staphylococcus
KANEIILAMRLEKILSKNEI

SEQ ID NO: 1891614 - protein, 19 aa, Staphylococcus
KANEIILAMRLEKLLSKNE

SEQ ID NO: 1891615 - protein, 23 aa, Staphylococcus
KAPGFRLFFKSGFKTVIDMWFVI

SEQ ID NO: 1891616 - protein, 18 aa, Staphylococcus
KARQELDRVIASKMSEID

SEQ ID NO: 1891617 - protein, 25 aa, Staphylococcus
KASWYLPKWLGAVLPNIDVEGKALE

SEQ ID NO: 1891618 - protein, 24 aa, Staphylococcus
KASWYLPKWLGAVLPNVDVEGKAL

SEQ ID NO: 1891619 - protein, 18 aa, Staphylococcus
KATIPKIVNLNGHVSYRT

SEQ ID NO: 1891620 - protein, 18 aa, Staphylococcus
KAYKWRIIGFFAFLLIAI

SEQ ID NO: 1891621 - protein, 17 aa, Staphylococcus
KCIHLLFFISYYKSFKI

SEQ ID NO: 1891622 - protein, 19 aa, Staphylococcus
KDGELIGIVSLKINMPSIE

SEQ ID NO: 1891623 - protein, 18 aa, Staphylococcus
KDGHLIFKPSTIITKNNI

SEQ ID NO: 1891624 - protein, 17 aa, Staphylococcus
KDGSLLKYTQMKWLTPK

SEQ ID NO: 1891625 - protein, 20 aa, Staphylococcus
KDIHEPWLFSMPSLVLMILI

SEQ ID NO: 1891626 - protein, 21 aa, Staphylococcus
KDIKRVVCILVILGSTIGLKL

SEQ ID NO: 1891627 - protein, 23 aa, Staphylococcus
KDKPRPAQWGLLSLQHLFAMFGS

SEQ ID NO: 1891628 - protein, 21 aa, Staphylococcus
KDKRLPQVINEAILIFTNLTN

SEQ ID NO: 1891629 - protein, 21 aa, Staphylococcus
KDKRLPQVINEAVNIFTALTQ

SEQ ID NO: 1891630 - protein, 20 aa, Staphylococcus
KDKRVTGAILVNDQVIASKD

SEQ ID NO: 1891631 - protein, 18 aa, Staphylococcus
KDKSELPETGLSDESDYA

SEQ ID NO: 1891632 - protein, 20 aa, Staphylococcus
KDLKSYRMVFSTMNVERMNS

SEQ ID NO: 1891633 - protein, 29 aa, Staphylococcus
KDLRKDLTLMLSIAVGFTGIFSTVIGIVQ

SEQ ID NO: 1891634 - protein, 17 aa, Staphylococcus
KDNNLKAALPLYGRDDF

SEQ ID NO: 1891635 - protein, 24 aa, Staphylococcus
KDQFKFSLFLAMLLACLLIQAATN

SEQ ID NO: 1891636 - protein, 18 aa, Staphylococcus
KDRGELRVGLSADYAPLE

SEQ ID NO: 1891637 - protein, 18 aa, Staphylococcus
KDRPVVFKLQAMDTMTSF

SEQ ID NO: 1891638 - protein, 19 aa, Staphylococcus
KDTVLYLMHMHKRISDKEY

SEQ ID NO: 1891639 - protein, 26 aa, Staphylococcus
KDVMIICPWVLMGLIILIGFARQLTI

SEQ ID NO: 1891640 - protein, 48 aa, Staphylococcus
KDYEAHEKKKMSGISKIISTLIVLLLLGGLVFAVFAFVDNSNRVNERL

SEQ ID NO: 1891641 - protein, 22 aa, Staphylococcus
KDYKSGTVFAILCWLVISVAIF

SEQ ID NO: 1891642 - protein, 19 aa, Staphylococcus
KDYTAYMLAEILKGTFKAY

SEQ ID NO: 1891643 - protein, 19 aa, Staphylococcus
KDYTAYMLAEMLKGTFSAY

SEQ ID NO: 1891644 - protein, 19 aa, Staphylococcus
KEAFSKIAWIGSLIALSGV

SEQ ID NO: 1891645 - protein, 21 aa, Staphylococcus
KEAPVKSSAFATVPVLVTVTK

SEQ ID NO: 1891646 - protein, 20 aa, Staphylococcus
KEAVFRLLLIDTPETKHPTK

SEQ ID NO: 1891647 - protein, 24 aa, Staphylococcus
KEDRYGRTLAYVWLDDKTMYNEQL

SEQ ID NO: 1891648 - protein, 24 aa, Staphylococcus
KEEIKRLSIITGIVVVIFAIILLI

SEQ ID NO: 1891649 - protein, 18 aa, Staphylococcus
KEFMAVSGLGRMGYNENY

SEQ ID NO: 1891650 - protein, 19 aa, Staphylococcus
KEFMSVSGIGRMGYNDEYL

SEQ ID NO: 1891651 - protein, 21 aa, Staphylococcus
KEIPSEATIIWYDLNEPTEEE

SEQ ID NO: 1891652 - protein, 22 aa, Staphylococcus
KEKKRYVIVWAIVGYFVVMIYQ

SEQ ID NO: 1891653 - protein, 22 aa, Staphylococcus
KELEIAKILVMKALTNEEVAQI

SEQ ID NO: 1891654 - protein, 19 aa, Staphylococcus
KELKKVIAYKNNNFKAFTL

SEQ ID NO: 1891655 - protein, 22 aa, Staphylococcus
KELKLIMSLGFLLGGIIGFFQG

SEQ ID NO: 1891656 - protein, 17 aa, Staphylococcus
KELLAIMGVLLTFNLCL

SEQ ID NO: 1891657 - protein, 17 aa, Staphylococcus
KELTKFLAVLMLVNGIA

SEQ ID NO: 1891658 - protein, 21 aa, Staphylococcus
KENIKRVLLFLSRNTSSSGVE

SEQ ID NO: 1891659 - protein, 21 aa, Staphylococcus
KENMKRVLAFLSRNTSSSGVE

SEQ ID NO: 1891660 - protein, 18 aa, Staphylococcus
KEPKRYILPWALLGFVVV

SEQ ID NO: 1891661 - protein, 17 aa, Staphylococcus
KEPRSVIIGVILQFTIM

SEQ ID NO: 1891662 - protein, 26 aa, Staphylococcus
KEQEFNPALLMLLAGLGLIGIFRNKI

SEQ ID NO: 1891663 - protein, 18 aa, Staphylococcus
KESKRYIISWALLGFCIV

SEQ ID NO: 1891664 - protein, 20 aa, Staphylococcus
KEVMSLPAIKVVEHPDLFVE

SEQ ID NO: 1891665 - protein, 17 aa, Staphylococcus
KEWPLFIVFALIFILLV

SEQ ID NO: 1891666 - protein, 19 aa, Staphylococcus
KEYYKNCTLMRKKYPNGVK

SEQ ID NO: 1891667 - protein, 27 aa, Staphylococcus
KFDGFKKDLKWELGLGATIVTATIALI

SEQ ID NO: 1891668 - protein, 18 aa, Staphylococcus
KFEWPLFIVFAVIFILIL

SEQ ID NO: 1891669 - protein, 20 aa, Staphylococcus
KFEWPLFVVFGMIFLLLVPN

SEQ ID NO: 1891670 - protein, 19 aa, Staphylococcus
KFFKDFIPAITLGFSASSS

SEQ ID NO: 1891671 - protein, 26 aa, Staphylococcus
KFFVEKEVKNTCNFKEESVQELPNTG

SEQ ID NO: 1891672 - protein, 20 aa, Staphylococcus
KFHSRFALDILLTISNHYNR

SEQ ID NO: 1891673 - protein, 20 aa, Staphylococcus
KFHSRFALNILLTIANHYNR

SEQ ID NO: 1891674 - protein, 18 aa, Staphylococcus
KFHVWRVAIQTDKHDYVG

SEQ ID NO: 1891675 - protein, 18 aa, Staphylococcus
KFLYRLMIMIGIIFAIIF

SEQ ID NO: 1891676 - protein, 18 aa, Staphylococcus
KFMKWRVAIQTENYDYVG

SEQ ID NO: 1891677 - protein, 18 aa, Staphylococcus
KFSYSWIHFGKIFLYSFI

SEQ ID NO: 1891678 - protein, 24 aa, Staphylococcus
KFTNMKWLTPKSHYIHGKGITPDK

SEQ ID NO: 1891679 - protein, 19 aa, Staphylococcus
KFTRLGIALGIAVFIFVIV

SEQ ID NO: 1891680 - protein, 19 aa, Staphylococcus
KFYKFRYVLIMLIIVLLSL

SEQ ID NO: 1891681 - protein, 25 aa, Staphylococcus
KFYRFRYTLIMLIIFLLGSMVLFIS

SEQ ID NO: 1891682 - protein, 18 aa, Staphylococcus
KGIFRRIPIVGGIVSVIA

SEQ ID NO: 1891683 - protein, 24 aa, Staphylococcus
KGIGFKILFNFGLPLLIALLHALF

SEQ ID NO: 1891684 - protein, 24 aa, Staphylococcus
KGIILKLLIPILIIIGIIIGVMYA

SEQ ID NO: 1891685 - protein, 18 aa, Staphylococcus
KGIPILIAILLGLMIYLL

SEQ ID NO: 1891686 - protein, 23 aa, Staphylococcus
KGIPLSSTHFIQWLNLLNIVPGY

SEQ ID NO: 1891687 - protein, 23 aa, Staphylococcus
KGIYDYKRALLRSSVPLEGATTS

SEQ ID NO: 1891688 - protein, 23 aa, Staphylococcus
KGIYDYKRALLRSSVPLEGKTKS

SEQ ID NO: 1891689 - protein, 23 aa, Staphylococcus
KGLGILCLLFFWTGIPHIIAIID

SEQ ID NO: 1891690 - protein, 18 aa, Staphylococcus
KGLGVLFFVEFWERFSYY

SEQ ID NO: 1891691 - protein, 19 aa, Staphylococcus
KGLGVLFFVEFWERFSYYG

SEQ ID NO: 1891692 - protein, 18 aa, Staphylococcus
KGLILKVLFNFGLPLIVG

SEQ ID NO: 1891693 - protein, 23 aa, Staphylococcus
KGLKLKVAFNFSIPLIIALLHSY

SEQ ID NO: 1891694 - protein, 17 aa, Staphylococcus
KGLKLKVTFNFGLPLII

SEQ ID NO: 1891695 - protein, 23 aa, Staphylococcus
KGLLLKILFNFGLPLIIALLHAL

SEQ ID NO: 1891696 - protein, 17 aa, Staphylococcus
KGREFLLIFFVSILMVL

SEQ ID NO: 1891697 - protein, 19 aa, Staphylococcus
KGRREMLGMTLAELEERTQ

SEQ ID NO: 1891698 - protein, 25 aa, Staphylococcus
KGSWYLPKWLGSILPELDIEGKALE

SEQ ID NO: 1891699 - protein, 18 aa, Staphylococcus
KGTAFAFICWLVISIAIF

SEQ ID NO: 1891700 - protein, 26 aa, Staphylococcus
KGTNFRFTTLNGRWNAGRNVIVYQRN

SEQ ID NO: 1891701 - protein, 18 aa, Staphylococcus
KHAFSFKLLLSLLIAGFL

SEQ ID NO: 1891702 - protein, 17 aa, Staphylococcus
KHFYYRLFAILTLAFIL

SEQ ID NO: 1891703 - protein, 21 aa, Staphylococcus
KHLKLGESILVVGNPLGNDFK

SEQ ID NO: 1891704 - protein, 17 aa, Staphylococcus
KHREYEDNDGFQAHNGN

SEQ ID NO: 1891705 - protein, 19 aa, Staphylococcus
KHYYFRLFAIMTWIFLIGS

SEQ ID NO: 1891706 - protein, 19 aa, Staphylococcus
KHYYYRLFAIATWIMLIGS

SEQ ID NO: 1891707 - protein, 20 aa, Staphylococcus
KIATPIFKPLFAWQFKRSVL

SEQ ID NO: 1891708 - protein, 20 aa, Staphylococcus
KIAVTVAIMLLAFISLMKGI

SEQ ID NO: 1891709 - protein, 19 aa, Staphylococcus
KIDLPRVEQFGVNPTNLSY

SEQ ID NO: 1891710 - protein, 18 aa, Staphylococcus
KIDQVWILLIAVLVIIIN

SEQ ID NO: 1891711 - protein, 17 aa, Staphylococcus
KIEAIKSLFSFKKPPLA

SEQ ID NO: 1891712 - protein, 22 aa, Staphylococcus
KIFIFYCILVIFFVFVNCNQVI

SEQ ID NO: 1891713 - protein, 18 aa, Staphylococcus
KIFYRIVLPLSKRYILSG

SEQ ID NO: 1891714 - protein, 19 aa, Staphylococcus
KIGAVLAWTGIKTAVMLII

SEQ ID NO: 1891715 - protein, 21 aa, Staphylococcus
KIISLPATIYIEFLRGTPMLV

SEQ ID NO: 1891716 - protein, 18 aa, Staphylococcus
KIISWIAAAYIEIIRGTP

SEQ ID NO: 1891717 - protein, 17 aa, Staphylococcus
KILDEFISSNSFPEDEV

SEQ ID NO: 1891718 - protein, 17 aa, Staphylococcus
KILRGVSTFRTATATAN

SEQ ID NO: 1891719 - protein, 23 aa, Staphylococcus
KILVWCVGILFILALLAMIYVIA

SEQ ID NO: 1891720 - protein, 18 aa, Staphylococcus
KINEKWLLMLCVLVIIIN

SEQ ID NO: 1891721 - protein, 17 aa, Staphylococcus
KIPKHFSFNRILMDKNS

SEQ ID NO: 1891722 - protein, 18 aa, Staphylococcus
KISLLGGIVSILWIFHND

SEQ ID NO: 1891723 - protein, 28 aa, Staphylococcus
KIVDFLKEHWIKILIAIALILILVLVKA

SEQ ID NO: 1891724 - protein, 33 aa, Staphylococcus
KIVSAIIVVILLFTLAFATFSFVDHSKKGSERL

SEQ ID NO: 1891725 - protein, 19 aa, Staphylococcus
KIWIAIKFLGVYLYQLITS

SEQ ID NO: 1891726 - protein, 19 aa, Staphylococcus
KIWVAIKFLAIYLYQLLTS

SEQ ID NO: 1891727 - protein, 26 aa, Staphylococcus
KIYEVRNGQEMYPSYYLDENNPNLVD

SEQ ID NO: 1891728 - protein, 19 aa, Staphylococcus
KKAAARKAIDDAATAKKQE

SEQ ID NO: 1891729 - protein, 20 aa, Staphylococcus
KKAAARKAIDDEVVAKKAAI

SEQ ID NO: 1891730 - protein, 19 aa, Staphylococcus
KKAEARKAIDEAATLRKNL

SEQ ID NO: 1891731 - protein, 26 aa, Staphylococcus
KKALLYLLFCWTEIPGVIGMIEGVLT

SEQ ID NO: 1891732 - protein, 19 aa, Staphylococcus
KKASIIWAVVALVLTIGSG

SEQ ID NO: 1891733 - protein, 19 aa, Staphylococcus
KKAYRIARFLAHPSEAMTA

SEQ ID NO: 1891734 - protein, 22 aa, Staphylococcus
KKFEMPGAFAILFIITVVAVIA

SEQ ID NO: 1891735 - protein, 19 aa, Staphylococcus
KKFEWPIFIIFALIFILLV

SEQ ID NO: 1891736 - protein, 17 aa, Staphylococcus
KKFKFRMPGAFAILFIL

SEQ ID NO: 1891737 - protein, 17 aa, Staphylococcus
KKFLFAFIFALLLIGLI

SEQ ID NO: 1891738 - protein, 18 aa, Staphylococcus
KKGWPSMMYSIWKNPEKY

SEQ ID NO: 1891739 - protein, 21 aa, Staphylococcus
KKGYKLLWIIISFIVLIAILL

SEQ ID NO: 1891740 - protein, 19 aa, Staphylococcus
KKIEAIKLYFGFDKSPLSH

SEQ ID NO: 1891741 - protein, 22 aa, Staphylococcus
KKIKAICLTLIFLLISLFLNEP

SEQ ID NO: 1891742 - protein, 40 aa, Staphylococcus
KKKGGLLGKLLPIIAAILILAAIGIFGGMALTGNNDDKGS

SEQ ID NO: 1891743 - protein, 20 aa, Staphylococcus
KKLILRLAVPGSMFAFIGAA

SEQ ID NO: 1891744 - protein, 22 aa, Staphylococcus
KKLRKLPFVILIIVVLLIVMIT

SEQ ID NO: 1891745 - protein, 22 aa, Staphylococcus
KKPKIAGILLIIAGLIALMSNW

SEQ ID NO: 1891746 - protein, 30 aa, Staphylococcus
KKRGLAGILLPLIALLLILAALAIFIGMYL

SEQ ID NO: 1891747 - protein, 21 aa, Staphylococcus
KKRKLKSIPIFIALIALIVLI

SEQ ID NO: 1891748 - protein, 41 aa, Staphylococcus
KKRMGTGAKVISIITVLLLLGGLVFAVFSFVDHSNRANERL

SEQ ID NO: 1891749 - protein, 19 aa, Staphylococcus
KKSGVLGFIFTRPVSSIQY

SEQ ID NO: 1891750 - protein, 33 aa, Staphylococcus
KKSKRKKGWFFGCGGCLVLLILIVIGISACTAT

SEQ ID NO: 1891751 - protein, 27 aa, Staphylococcus
KKSKRLFLRMLIIFIIIFALFTGLMYF

SEQ ID NO: 1891752 - protein, 19 aa, Staphylococcus
KKSLARQAIDEVAKVKKEK

SEQ ID NO: 1891753 - protein, 21 aa, Staphylococcus
KKVALPFGASMIIMGGGIVWY

SEQ ID NO: 1891754 - protein, 18 aa, Staphylococcus
KKVGRFSIIPSIFNINEP

SEQ ID NO: 1891755 - protein, 25 aa, Staphylococcus
KKWVNICAWGLIIILSFLNIYLIIE

SEQ ID NO: 1891756 - protein, 20 aa, Staphylococcus
KKYEWPLFIIFGLIFVLLVP

SEQ ID NO: 1891757 - protein, 23 aa, Staphylococcus
KLANEIHPWLGLVLTVIMLAVMY

SEQ ID NO: 1891758 - protein, 28 aa, Staphylococcus
KLATPRAISRIASPVMLAATDNVAAQES

SEQ ID NO: 1891759 - protein, 20 aa, Staphylococcus
KLDKSFRIPLRMYMMNEEKM

SEQ ID NO: 1891760 - protein, 20 aa, Staphylococcus
KLFGEIEFWFAIIKIITIVA

SEQ ID NO: 1891761 - protein, 20 aa, Staphylococcus
KLFGELEFWFAIIKIATIIA

SEQ ID NO: 1891762 - protein, 19 aa, Staphylococcus
KLFGELEFWFAIIKVLTIL

SEQ ID NO: 1891763 - protein, 20 aa, Staphylococcus
KLFGELEFWFALIKIITILA

SEQ ID NO: 1891764 - protein, 20 aa, Staphylococcus
KLFGELEFWFSIIKIITIIA

SEQ ID NO: 1891765 - protein, 20 aa, Staphylococcus
KLFGELEFWFSIIKIVTIIA

SEQ ID NO: 1891766 - protein, 18 aa, Staphylococcus
KLFRLPAIKRFEDDEELL

SEQ ID NO: 1891767 - protein, 18 aa, Staphylococcus
KLFRLPAIKRFEEDEDLL

SEQ ID NO: 1891768 - protein, 17 aa, Staphylococcus
KLFRLPAIKRFEEDEEL

SEQ ID NO: 1891769 - protein, 22 aa, Staphylococcus
KLIEFIGFLGISYVTFKSVQLI

SEQ ID NO: 1891770 - protein, 19 aa, Staphylococcus
KLIIEIVRAILLIELVGAL

SEQ ID NO: 1891771 - protein, 30 aa, Staphylococcus
KLIKILKKNLKWLIILPLVFLVVGMILTFF

SEQ ID NO: 1891772 - protein, 33 aa, Staphylococcus
KLISTIIVLLLLSGLAFAIFAFVDHSNRSSERL

SEQ ID NO: 1891773 - protein, 21 aa, Staphylococcus
KLKRIVYLILWIVYLVLIANI

SEQ ID NO: 1891774 - protein, 20 aa, Staphylococcus
KLLCVCILVIFAVETQFAPS

SEQ ID NO: 1891775 - protein, 24 aa, Staphylococcus
KLLEYKKPIILMAMALVFTTVIGV

SEQ ID NO: 1891776 - protein, 17 aa, Staphylococcus
KLLEYRKPIILMAMALV

SEQ ID NO: 1891777 - protein, 18 aa, Staphylococcus
KLLFTICLLCGIISFIIS

SEQ ID NO: 1891778 - protein, 19 aa, Staphylococcus
KLLGWISWIFLLILTVITM

SEQ ID NO: 1891779 - protein, 18 aa, Staphylococcus
KLLHIFILIICLFSGLTL

SEQ ID NO: 1891780 - protein, 19 aa, Staphylococcus
KLLLFGFGGGLAYSGLVIE

SEQ ID NO: 1891781 - protein, 23 aa, Staphylococcus
KLMRRLRVPVLPVIARNGKGTAH

SEQ ID NO: 1891782 - protein, 24 aa, Staphylococcus
KLNAWCFWLFMIGFNVCFLPQFIL

SEQ ID NO: 1891783 - protein, 19 aa, Staphylococcus
KLNIKWPFWFSQVGLILLG

SEQ ID NO: 1891784 - protein, 22 aa, Staphylococcus
KLNPAGSISIMFNFSLFFLLGV

SEQ ID NO: 1891785 - protein, 18 aa, Staphylococcus
KLPSFTFIEMIFSLMITT

SEQ ID NO: 1891786 - protein, 25 aa, Staphylococcus
KLQTHKKANAKRIIQNKADEIIRNI

SEQ ID NO: 1891787 - protein, 20 aa, Staphylococcus
KLSLICLIPVILGFLLLKFM

SEQ ID NO: 1891788 - protein, 18 aa, Staphylococcus
KLSLSFKVIERLLLALIL

SEQ ID NO: 1891789 - protein, 21 aa, Staphylococcus
KLSSYYLFNWFFIVYNIGVLT

SEQ ID NO: 1891790 - protein, 18 aa, Staphylococcus
KLSWLVIILLLSGYLISE

SEQ ID NO: 1891791 - protein, 18 aa, Staphylococcus
KLYRHFYYRVFAILTIIF

SEQ ID NO: 1891792 - protein, 19 aa, Staphylococcus
KLYTKDDMQVIGNIKTIAD

SEQ ID NO: 1891793 - protein, 21 aa, Staphylococcus
KMFIKRSTIRFCLLIVATAVL

SEQ ID NO: 1891794 - protein, 17 aa, Staphylococcus
KMFPILIGFFVFLFVFL

SEQ ID NO: 1891795 - protein, 18 aa, Staphylococcus
KMHIVMLLAALSMAGVPF

SEQ ID NO: 1891796 - protein, 19 aa, Staphylococcus
KMISIALLWWSAFTILTGM

SEQ ID NO: 1891797 - protein, 22 aa, Staphylococcus
KMKRKHLLIGIMLIFIIANALA

SEQ ID NO: 1891798 - protein, 20 aa, Staphylococcus
KMLRITFVLLAIVGAGLAVF

SEQ ID NO: 1891799 - protein, 18 aa, Staphylococcus
KMNVWSLVMIIGFTLSSI

SEQ ID NO: 1891800 - protein, 19 aa, Staphylococcus
KMPFYPVMPIITFVSVVVV

SEQ ID NO: 1891801 - protein, 24 aa, Staphylococcus
KMRIVRRRITVFGGILLAIILMLI

SEQ ID NO: 1891802 - protein, 24 aa, Staphylococcus
KMRVVRRRITVFGGILLAIILILL

SEQ ID NO: 1891803 - protein, 17 aa, Staphylococcus
KNATYCIARKIQIHIET

SEQ ID NO: 1891804 - protein, 17 aa, Staphylococcus
KNFFPYILLSIGAFLTI

SEQ ID NO: 1891805 - protein, 17 aa, Staphylococcus
KNGGAWLLNKQVPHIVI

SEQ ID NO: 1891806 - protein, 22 aa, Staphylococcus
KNGKYNALVSFSGRSFSILKGS

SEQ ID NO: 1891807 - protein, 18 aa, Staphylococcus
KNGSEWSVDQVIEGIILN

SEQ ID NO: 1891808 - protein, 18 aa, Staphylococcus
KNHKGMIVQQDWTGKASR

SEQ ID NO: 1891809 - protein, 22 aa, Staphylococcus
KNKIRSSGYLLRFLFLSTSFSY

SEQ ID NO: 1891810 - protein, 17 aa, Staphylococcus
KNKLEYFNPAALYEEHK

SEQ ID NO: 1891811 - protein, 20 aa, Staphylococcus
KNKPTMIALISFILFLILLF

SEQ ID NO: 1891812 - protein, 17 aa, Staphylococcus
KNLKIVIVSGVIPFNII

SEQ ID NO: 1891813 - protein, 18 aa, Staphylococcus
KNNVDVFVILSHLGVDKS

SEQ ID NO: 1891814 - protein, 17 aa, Staphylococcus
KNQDGYRYYDFIDNVGI

SEQ ID NO: 1891815 - protein, 18 aa, Staphylococcus
KNTLGFVGISSLLAGFWF

SEQ ID NO: 1891816 - protein, 24 aa, Staphylococcus
KNVIFCLLGTLIIALGVNCFVIPG

SEQ ID NO: 1891817 - protein, 18 aa, Staphylococcus
KPANMAIQYKTAVGQKEE

SEQ ID NO: 1891818 - protein, 18 aa, Staphylococcus
KPDARNTIDHAYEQKKQA

SEQ ID NO: 1891819 - protein, 17 aa, Staphylococcus
KPDRIHVIPNWYTESED

SEQ ID NO: 1891820 - protein, 17 aa, Staphylococcus
KPGHVVFYGSNGDYINN

SEQ ID NO: 1891821 - protein, 20 aa, Staphylococcus
KPKLAGILLIIAGILAIATN

SEQ ID NO: 1891822 - protein, 18 aa, Staphylococcus
KPLRTMIYFGLFIFAISL

SEQ ID NO: 1891823 - protein, 17 aa, Staphylococcus
KPLSCISVGFLLIQALV

SEQ ID NO: 1891824 - protein, 26 aa, Staphylococcus
KPNTLPDFSGIGVLKSEYTFTNNKNQ

SEQ ID NO: 1891825 - protein, 28 aa, Staphylococcus
KPSVANYFRHGAAHGYPFYNTPTVHINS

SEQ ID NO: 1891826 - protein, 41 aa, Staphylococcus
KPTQKNHYSIRKFTVGTASIIVGSFLFFGQAHAEEGTEGNT

SEQ ID NO: 1891827 - protein, 19 aa, Staphylococcus
KPYLKRLTLATAISTLQGM

SEQ ID NO: 1891828 - protein, 21 aa, Staphylococcus
KPYYPFPIIVDDAFVHFDKHR

SEQ ID NO: 1891829 - protein, 21 aa, Staphylococcus
KQFWLRRIKRLIPAVLVLVVT

SEQ ID NO: 1891830 - protein, 20 aa, Staphylococcus
KQGDKIGVPGFVRGMHDMHE

SEQ ID NO: 1891831 - protein, 20 aa, Staphylococcus
KQGTGLGLFICKMIIEEHGG

SEQ ID NO: 1891832 - protein, 18 aa, Staphylococcus
KQMFSWKYFSMIWDSVIF

SEQ ID NO: 1891833 - protein, 18 aa, Staphylococcus
KQRGELRVGLSADYAPLE

SEQ ID NO: 1891834 - protein, 23 aa, Staphylococcus
KQTIRAIVPWSILYEILVGLFIS

SEQ ID NO: 1891835 - protein, 18 aa, Staphylococcus
KQVAWIFDLIRVILPFII

SEQ ID NO: 1891836 - protein, 21 aa, Staphylococcus
KQVFWRILLFYVLSIAVIAAI

SEQ ID NO: 1891837 - protein, 23 aa, Staphylococcus
KQVFWRILLFYVLSIFVISAIIP

SEQ ID NO: 1891838 - protein, 21 aa, Staphylococcus
KQVFWRILLFYVLSIGVIAAI

SEQ ID NO: 1891839 - protein, 19 aa, Staphylococcus
KQVFWRILLFYVLSIVVIA

SEQ ID NO: 1891840 - protein, 22 aa, Staphylococcus
KQWQYKDISSFNFKQKDEIGTP

SEQ ID NO: 1891841 - protein, 21 aa, Staphylococcus
KQYLWPGFLLILFIASFIINA

SEQ ID NO: 1891842 - protein, 17 aa, Staphylococcus
KRAKRRKRQKQIQYSIF

SEQ ID NO: 1891843 - protein, 17 aa, Staphylococcus
KRANGLTSNNIVNGQKL

SEQ ID NO: 1891844 - protein, 19 aa, Staphylococcus
KRFKLRMPGAFMILFLLTV

SEQ ID NO: 1891845 - protein, 23 aa, Staphylococcus
KRFWESLKFLLPIGIGMVVAIGL

SEQ ID NO: 1891846 - protein, 21 aa, Staphylococcus
KRFWPSLKFLLPILIGMALAI

SEQ ID NO: 1891847 - protein, 24 aa, Staphylococcus
KRGGWRAAIILSFISGIIQVTFGA

SEQ ID NO: 1891848 - protein, 20 aa, Staphylococcus
KRIIFSLAVLTMFVCVAFWS

SEQ ID NO: 1891849 - protein, 21 aa, Staphylococcus
KRIKSLWKWFTLSFIVGLVFI

SEQ ID NO: 1891850 - protein, 21 aa, Staphylococcus
KRIPVAYVRIHICIVALPPLL

SEQ ID NO: 1891851 - protein, 17 aa, Staphylococcus
KRKAVSFYSTIAGIGAS

SEQ ID NO: 1891852 - protein, 30 aa, Staphylococcus
KRKKGWLWGCGGCLVLLILLIIGLTSCTGA

SEQ ID NO: 1891853 - protein, 21 aa, Staphylococcus
KRLLLYFIICITMFSFMNLMS

SEQ ID NO: 1891854 - protein, 21 aa, Staphylococcus
KRLPQVIQEAVSIFKYLTNGA

SEQ ID NO: 1891855 - protein, 19 aa, Staphylococcus
KRLPYVIDEAINIFKTLTD

SEQ ID NO: 1891856 - protein, 21 aa, Staphylococcus
KRLRKLPFIILIILIILISII

SEQ ID NO: 1891857 - protein, 17 aa, Staphylococcus
KRLTGFSALCIISVYNL

SEQ ID NO: 1891858 - protein, 21 aa, Staphylococcus
KRLTKPLSYYIDWISNLSHEK

SEQ ID NO: 1891859 - protein, 21 aa, Staphylococcus
KRLTRPLSFYIDWIGNLSLGK

SEQ ID NO: 1891860 - protein, 23 aa, Staphylococcus
KRLVPIMTVFYCTFLIAILLFAW

SEQ ID NO: 1891861 - protein, 24 aa, Staphylococcus
KRNKLKFSLIIGVLIMISYLLFLL

SEQ ID NO: 1891862 - protein, 18 aa, Staphylococcus
KRQIYCFIDEIFKGTNTT

SEQ ID NO: 1891863 - protein, 24 aa, Staphylococcus
KRSKLRIVLFSSLGLSIAMILGTL

SEQ ID NO: 1891864 - protein, 23 aa, Staphylococcus
KRTNIRWYFAIAFFIIGVIAYMD

SEQ ID NO: 1891865 - protein, 19 aa, Staphylococcus
KRTTLAYIVSVCFLFICIY

SEQ ID NO: 1891866 - protein, 20 aa, Staphylococcus
KRVFSALGVGIVFGVVIHLI

SEQ ID NO: 1891867 - protein, 20 aa, Staphylococcus
KRVPFTPGLIPNRRKEIADK

SEQ ID NO: 1891868 - protein, 20 aa, Staphylococcus
KRWHFILSFNSAILIGLFLK

SEQ ID NO: 1891869 - protein, 19 aa, Staphylococcus
KRWHYLIAFNSAVLIGLYV

SEQ ID NO: 1891870 - protein, 18 aa, Staphylococcus
KRWLSAKHLIYFNIILFC

SEQ ID NO: 1891871 - protein, 20 aa, Staphylococcus
KRYFSLIIMMAIITFICTFI

SEQ ID NO: 1891872 - protein, 23 aa, Staphylococcus
KRYIFPFIIACGFIADTTSLPLI

SEQ ID NO: 1891873 - protein, 20 aa, Staphylococcus
KRYIIPWAILGFFIVMLYQV

SEQ ID NO: 1891874 - protein, 20 aa, Staphylococcus
KRYIISWALLGFCIVMVYQV

SEQ ID NO: 1891875 - protein, 19 aa, Staphylococcus
KRYILPWALLGFVVVMIYQ

SEQ ID NO: 1891876 - protein, 18 aa, Staphylococcus
KSADFEVGSTNHAKDYTE

SEQ ID NO: 1891877 - protein, 19 aa, Staphylococcus
KSAFLSGLMLEFINMLGIG

SEQ ID NO: 1891878 - protein, 19 aa, Staphylococcus
KSAFLSGLMLEFISLLGIG

SEQ ID NO: 1891879 - protein, 20 aa, Staphylococcus
KSAFLSGLMLEFISMLGIGL

SEQ ID NO: 1891880 - protein, 19 aa, Staphylococcus
KSAFLSSLMLEFISMLGIG

SEQ ID NO: 1891881 - protein, 18 aa, Staphylococcus
KSASILDIFGGCFQGLLP

SEQ ID NO: 1891882 - protein, 19 aa, Staphylococcus
KSASLLDIFAGCFQGFLPY

SEQ ID NO: 1891883 - protein, 20 aa, Staphylococcus
KSAYNWAFFNPIRKIYYNIT

SEQ ID NO: 1891884 - protein, 20 aa, Staphylococcus
KSFYRRLWLSAGVIGVIQYT

SEQ ID NO: 1891885 - protein, 28 aa, Staphylococcus
KSGDYFTVQFPKYLNYFGNSTPQSTKIP

SEQ ID NO: 1891886 - protein, 22 aa, Staphylococcus
KSGRTKKWLIAIIVILLIIVAI

SEQ ID NO: 1891887 - protein, 22 aa, Staphylococcus
KSHKIKGIMLIKDSKIKTNKNF

SEQ ID NO: 1891888 - protein, 19 aa, Staphylococcus
KSIENIGSLSFKFMVPILA

SEQ ID NO: 1891889 - protein, 17 aa, Staphylococcus
KSIRVYYDMNKAPGSRV

SEQ ID NO: 1891890 - protein, 24 aa, Staphylococcus
KSKIVCGFLNWLGHLFSDVAGSSG

SEQ ID NO: 1891891 - protein, 24 aa, Staphylococcus
KSLLKRKWIAIGLVILFLVEQVIM

SEQ ID NO: 1891892 - protein, 25 aa, Staphylococcus
KSMMIPLMIIIAMCFIHLNTALIMI

SEQ ID NO: 1891893 - protein, 20 aa, Staphylococcus
KSPWLRPTLIIGCIFAIFQQ

SEQ ID NO: 1891894 - protein, 20 aa, Staphylococcus
KSPWLRPTLIIGCIFALLQQ

SEQ ID NO: 1891895 - protein, 18 aa, Staphylococcus
KSPWLRPTLIIGSVFALF

SEQ ID NO: 1891896 - protein, 21 aa, Staphylococcus
KSRFSKIFIPYIIWTVFYLLY

SEQ ID NO: 1891897 - protein, 18 aa, Staphylococcus
KSRSRLPEMSYNFKRVER

SEQ ID NO: 1891898 - protein, 19 aa, Staphylococcus
KSSEGYVAVFMRPDIGQTF

SEQ ID NO: 1891899 - protein, 21 aa, Staphylococcus
KSVFWRILLFYILSIAVISAI

SEQ ID NO: 1891900 - protein, 18 aa, Staphylococcus
KTALKLAGDPYFSGMPLP

SEQ ID NO: 1891901 - protein, 20 aa, Staphylococcus
KTFKAIEHWIMQRSAVEILF

SEQ ID NO: 1891902 - protein, 17 aa, Staphylococcus
KTFPELHTSLSTLNQQL

SEQ ID NO: 1891903 - protein, 24 aa, Staphylococcus
KTIRLDGLLLRPAIGMLSIFATVM

SEQ ID NO: 1891904 - protein, 20 aa, Staphylococcus
KTKFFFEMLIELMKKSMTMK

SEQ ID NO: 1891905 - protein, 20 aa, Staphylococcus
KTKKRTALTFIVSVCALFVI

SEQ ID NO: 1891906 - protein, 19 aa, Staphylococcus
KTRRLTGSIVLQFALLFAA

SEQ ID NO: 1891907 - protein, 18 aa, Staphylococcus
KTSILRRAYNYMDGTNED

SEQ ID NO: 1891908 - protein, 18 aa, Staphylococcus
KTSPEFQRLLLLHNTAQG

SEQ ID NO: 1891909 - protein, 18 aa, Staphylococcus
KTWFKFFLAILLINLLII

SEQ ID NO: 1891910 - protein, 19 aa, Staphylococcus
KTYIKHFLLFNGLMGGLSF

SEQ ID NO: 1891911 - protein, 25 aa, Staphylococcus
KVFGRDRLKLFVPWYYLVKYVLPVV

SEQ ID NO: 1891912 - protein, 32 aa, Staphylococcus
KVGSHSYAFVGLERVGGIMIYDITNPNEPYFV

SEQ ID NO: 1891913 - protein, 17 aa, Staphylococcus
KVIFPFIIACGFIADTT

SEQ ID NO: 1891914 - protein, 31 aa, Staphylococcus
KVKDFLKLHWLKIVIVVAIILIVILISAIIS

SEQ ID NO: 1891915 - protein, 19 aa, Staphylococcus
KVLGWLSWVFLLLLTVITM

SEQ ID NO: 1891916 - protein, 18 aa, Staphylococcus
KVLYCLFISFTLLIMFIS

SEQ ID NO: 1891917 - protein, 30 aa, Staphylococcus
KVSCSVLLMSGTLVGYGFTKDGFAQSNDRI

SEQ ID NO: 1891918 - protein, 18 aa, Staphylococcus
KVSFRFWPLNNFKFNFNP

SEQ ID NO: 1891919 - protein, 18 aa, Staphylococcus
KVSLRYWPFTSFKVNFNP

SEQ ID NO: 1891920 - protein, 19 aa, Staphylococcus
KVSRLFCIIAMGILVALLT

SEQ ID NO: 1891921 - protein, 20 aa, Staphylococcus
KVVIATKIGNQWALNEKPVG

SEQ ID NO: 1891922 - protein, 19 aa, Staphylococcus
KWGFPRWASILTIFVVLIA

SEQ ID NO: 1891923 - protein, 19 aa, Staphylococcus
KWGFPRWASITTIFIGLIA

SEQ ID NO: 1891924 - protein, 17 aa, Staphylococcus
KWGSLLFHLGIIPVAAG

SEQ ID NO: 1891925 - protein, 24 aa, Staphylococcus
KWNTAQRMIITWVITLPISALVAA

SEQ ID NO: 1891926 - protein, 17 aa, Staphylococcus
KYEWPLFIIFALIFVFM

SEQ ID NO: 1891927 - protein, 18 aa, Staphylococcus
KYFEQLRWFIGELNHVYV

SEQ ID NO: 1891928 - protein, 18 aa, Staphylococcus
KYGPRPLIYAGFSLLTIC

SEQ ID NO: 1891929 - protein, 18 aa, Staphylococcus
KYKAKWFPFGPIFAGILC

SEQ ID NO: 1891930 - protein, 24 aa, Staphylococcus
KYMPELNWHYSYFAFIGISLIVTI

SEQ ID NO: 1891931 - protein, 17 aa, Staphylococcus
KYNQVFMTMDGKLKIKI

SEQ ID NO: 1891932 - protein, 21 aa, Staphylococcus
KYRKDFCKYFLKKIKPTVIKG

SEQ ID NO: 1891933 - protein, 17 aa, Staphylococcus
KYSAFLFSKSRQRLSDL

SEQ ID NO: 1891934 - protein, 20 aa, Staphylococcus
KYSESVSMSESLSMSDSSSA

SEQ ID NO: 1891935 - protein, 18 aa, Staphylococcus
KYSIPFVIVSLNFPLFNL

SEQ ID NO: 1891936 - protein, 21 aa, Staphylococcus
KYTITCLLVFIIIYFLYVNYG

SEQ ID NO: 1891937 - protein, 22 aa, Staphylococcus
KYTLPYKWIIVLAFITLILSTI

SEQ ID NO: 1891938 - protein, 18 aa, Staphylococcus
KYVPRFIIFISNYSFSIY

SEQ ID NO: 1891939 - protein, 17 aa, Staphylococcus
KYYKFRYILIMLIILLL

SEQ ID NO: 1891940 - protein, 27 aa, Staphylococcus
LAAAILPLWGWRALFLIGVIPVILAFY

SEQ ID NO: 1891941 - protein, 19 aa, Staphylococcus
LAFAMLIAIVIVYLVLVIT

SEQ ID NO: 1891942 - protein, 18 aa, Staphylococcus
LAFEIPFRYKIMGIVGSV

SEQ ID NO: 1891943 - protein, 18 aa, Staphylococcus
LAGFIAWGVFGDKYEETP

SEQ ID NO: 1891944 - protein, 22 aa, Staphylococcus
LAGLAILPSFYAWFNLWAMWDP

SEQ ID NO: 1891945 - protein, 19 aa, Staphylococcus
LAGLFPYYLVKALDKTGVT

SEQ ID NO: 1891946 - protein, 17 aa, Staphylococcus
LAISIGIALFIFAVVRP

SEQ ID NO: 1891947 - protein, 21 aa, Staphylococcus
LAKAKFKAETFINQLKDLNNA

SEQ ID NO: 1891948 - protein, 21 aa, Staphylococcus
LALLICSLFLTPLVKRIKVFN

SEQ ID NO: 1891949 - protein, 20 aa, Staphylococcus
LALLKKFAWGPLKQVMDKRE

SEQ ID NO: 1891950 - protein, 17 aa, Staphylococcus
LALTLYARDDFIGDITF

SEQ ID NO: 1891951 - protein, 20 aa, Staphylococcus
LAMLCVIPFISLSTKAFKWF

SEQ ID NO: 1891952 - protein, 20 aa, Staphylococcus
LANFKFIIAKGFENKKIGLK

SEQ ID NO: 1891953 - protein, 33 aa, Staphylococcus
LAPVHPIYATLMFAIGGLMMFFRKRKNEDKDST

SEQ ID NO: 1891954 - protein, 17 aa, Staphylococcus
LASILAVLGSALFMRRR

SEQ ID NO: 1891955 - protein, 18 aa, Staphylococcus
LASTFFKNGIKINGNVNE

SEQ ID NO: 1891956 - protein, 17 aa, Staphylococcus
LATINFILAKGAIFQGV

SEQ ID NO: 1891957 - protein, 19 aa, Staphylococcus
LATLILIMLLGHWIEMNAV

SEQ ID NO: 1891958 - protein, 24 aa, Staphylococcus
LATPIQFIIGWQFYVGAYKNLRNG

SEQ ID NO: 1891959 - protein, 24 aa, Staphylococcus
LATPIQFMIGWQFYVGAYKNLRHG

SEQ ID NO: 1891960 - protein, 24 aa, Staphylococcus
LATPVQFILGWQFYKGAYSSLRNK

SEQ ID NO: 1891961 - protein, 24 aa, Staphylococcus
LATPVQFVIGWQFYVGAYKNLRNG

SEQ ID NO: 1891962 - protein, 18 aa, Staphylococcus
LAVMGFASAISVLFAVLA

SEQ ID NO: 1891963 - protein, 17 aa, Staphylococcus
LAVVVIICCSYLIMILV

SEQ ID NO: 1891964 - protein, 17 aa, Staphylococcus
LAYAFKWLGLVDDVLLM

SEQ ID NO: 1891965 - protein, 20 aa, Staphylococcus
LCFLGNILGALAFFLILRMS

SEQ ID NO: 1891966 - protein, 20 aa, Staphylococcus
LCLACLLFLLGEFVVKHVSF

SEQ ID NO: 1891967 - protein, 21 aa, Staphylococcus
LCLKPILDPMMRKVTKKVNKS

SEQ ID NO: 1891968 - protein, 19 aa, Staphylococcus
LCLTVVIAMLFFIFIVLGI

SEQ ID NO: 1891969 - protein, 17 aa, Staphylococcus
LCNALWCNVRMFLLQAL

SEQ ID NO: 1891970 - protein, 19 aa, Staphylococcus
LCYYFWLPFGPVLYSYLDG

SEQ ID NO: 1891971 - protein, 21 aa, Staphylococcus
LDCITIIIALSIMFFLDVKLT

SEQ ID NO: 1891972 - protein, 20 aa, Staphylococcus
LDCITIIIALTIMFFLDVKL

SEQ ID NO: 1891973 - protein, 18 aa, Staphylococcus
LDDTAAWAKRIIISIAFF

SEQ ID NO: 1891974 - protein, 18 aa, Staphylococcus
LDELKAFLVEQFDKQQSD

SEQ ID NO: 1891975 - protein, 17 aa, Staphylococcus
LDFDVHFTKSLVGRPLN

SEQ ID NO: 1891976 - protein, 24 aa, Staphylococcus
LDFLPNIYNKYSIRKFTVGTASIL

SEQ ID NO: 1891977 - protein, 34 aa, Staphylococcus
LDFLPNKLNKYSIRRFTVGTASILVGATLIFGVA

SEQ ID NO: 1891978 - protein, 26 aa, Staphylococcus
LDFLPNRLNKYSIRKFTVGTASILVG

SEQ ID NO: 1891979 - protein, 21 aa, Staphylococcus
LDIKWGAAITAIFSILIFVSK

SEQ ID NO: 1891980 - protein, 21 aa, Staphylococcus
LDIKWGAAITAVFSILIFVSR

SEQ ID NO: 1891981 - protein, 17 aa, Staphylococcus
LDIVGVIKDSAKASKDI

SEQ ID NO: 1891982 - protein, 17 aa, Staphylococcus
LDKGTVVKFIFPNQNEI

SEQ ID NO: 1891983 - protein, 20 aa, Staphylococcus
LDLIPIISFIFLKGKCRYCN

SEQ ID NO: 1891984 - protein, 26 aa, Staphylococcus
LDLQKEMWKYLSIVGVIVLITVYLAS

SEQ ID NO: 1891985 - protein, 21 aa, Staphylococcus
LDMKYSHWFRFVWPVVVFVLV

SEQ ID NO: 1891986 - protein, 27 aa, Staphylococcus
LDMKYSHWLKFVWPVVAFVFIFGGGML

SEQ ID NO: 1891987 - protein, 22 aa, Staphylococcus
LDPRAKLIFVFLFIVLIFFAHS

SEQ ID NO: 1891988 - protein, 21 aa, Staphylococcus
LDPRAKLIFVFVFIIFIFFAH

SEQ ID NO: 1891989 - protein, 18 aa, Staphylococcus
LDQQVAWIFDLVRILLPL

SEQ ID NO: 1891990 - protein, 17 aa, Staphylococcus
LDSGDAFQGLPVSNNSK

SEQ ID NO: 1891991 - protein, 18 aa, Staphylococcus
LDSLIAFHEQILKSLSKK

SEQ ID NO: 1891992 - protein, 23 aa, Staphylococcus
LDVLPRFDKIIVMIDGEIKESGS

SEQ ID NO: 1891993 - protein, 23 aa, Staphylococcus
LEELKRLDAGYHFTDINGATPYR

SEQ ID NO: 1891994 - protein, 22 aa, Staphylococcus
LEGARFGFAFGSGVAAISAVVM

SEQ ID NO: 1891995 - protein, 23 aa, Staphylococcus
LEGRAKPGYPKGYALESRPFLTD

SEQ ID NO: 1891996 - protein, 17 aa, Staphylococcus
LEIIVAFLNGLALIVIS

SEQ ID NO: 1891997 - protein, 22 aa, Staphylococcus
LEKKELESMLALLSNPLIDCVG

SEQ ID NO: 1891998 - protein, 17 aa, Staphylococcus
LEQEYSKDEIFQMYLNK

SEQ ID NO: 1891999 - protein, 17 aa, Staphylococcus
LESKGPIVFKQKRPGIN

SEQ ID NO: 1892000 - protein, 20 aa, Staphylococcus
LESWKGFALLLLTGIIMILA

SEQ ID NO: 1892001 - protein, 22 aa, Staphylococcus
LFAFLCYLIWSSVFGSRHFNQS

SEQ ID NO: 1892002 - protein, 18 aa, Staphylococcus
LFAGVLQWRAFRFYRFRH

SEQ ID NO: 1892003 - protein, 24 aa, Staphylococcus
LFALLCVTAFLLVRPSHIMGLYLY

SEQ ID NO: 1892004 - protein, 17 aa, Staphylococcus
LFALSGLLILLGLILVF

SEQ ID NO: 1892005 - protein, 18 aa, Staphylococcus
LFCIFTFLANNRNYFMVN

SEQ ID NO: 1892006 - protein, 19 aa, Staphylococcus
LFFVLAFFVLFHVSAFAAE

SEQ ID NO: 1892007 - protein, 20 aa, Staphylococcus
LFFWFFKLHYSFGHIINSKI

SEQ ID NO: 1892008 - protein, 18 aa, Staphylococcus
LFGAIGLDKQVAWIFDLI

SEQ ID NO: 1892009 - protein, 19 aa, Staphylococcus
LFGELEFWFSIIKIVTIIG

SEQ ID NO: 1892010 - protein, 19 aa, Staphylococcus
LFGELEFWLAIIKVVTIVA

SEQ ID NO: 1892011 - protein, 18 aa, Staphylococcus
LFGELEFWLSIIKVITIL

SEQ ID NO: 1892012 - protein, 19 aa, Staphylococcus
LFGELEFWLSIIKVITIVA

SEQ ID NO: 1892013 - protein, 25 aa, Staphylococcus
LFGKASWYIPGWLNRILPHVDIEGH

SEQ ID NO: 1892014 - protein, 18 aa, Staphylococcus
LFGLLFILYANRFIMRRR

SEQ ID NO: 1892015 - protein, 19 aa, Staphylococcus
LFGPLGLDQQVAWIFDLVR

SEQ ID NO: 1892016 - protein, 21 aa, Staphylococcus
LFHFAMSFGLVFLFNEELGEV

SEQ ID NO: 1892017 - protein, 19 aa, Staphylococcus
LFHPFKPYYIFKMRIPFTP

SEQ ID NO: 1892018 - protein, 28 aa, Staphylococcus
LFICIVFLWFALCSFMFTHIKKLFNQPV

SEQ ID NO: 1892019 - protein, 18 aa, Staphylococcus
LFIFCAVMIILVRPISIL

SEQ ID NO: 1892020 - protein, 17 aa, Staphylococcus
LFIFLIIIIILFLGLMF

SEQ ID NO: 1892021 - protein, 20 aa, Staphylococcus
LFIIRLSLSLLWKDTKSKKQ

SEQ ID NO: 1892022 - protein, 18 aa, Staphylococcus
LFIKTRKNWVLWFLFLNL

SEQ ID NO: 1892023 - protein, 18 aa, Staphylococcus
LFIMDWKLTLLTFITIPI

SEQ ID NO: 1892024 - protein, 17 aa, Staphylococcus
LFIPFPKTRAFDLNYAI

SEQ ID NO: 1892025 - protein, 17 aa, Staphylococcus
LFISLTLLIMFISMYSI

SEQ ID NO: 1892026 - protein, 24 aa, Staphylococcus
LFKNKELLAIIGVILAFNLCGQMI

SEQ ID NO: 1892027 - protein, 18 aa, Staphylococcus
LFLCVWLGIIQVQNGNMD

SEQ ID NO: 1892028 - protein, 19 aa, Staphylococcus
LFLKFERLITVLGMVTPFL

SEQ ID NO: 1892029 - protein, 24 aa, Staphylococcus
LFLKTRSNWIFWIIFLQFVFLGMA

SEQ ID NO: 1892030 - protein, 18 aa, Staphylococcus
LFLLCFYHLPNLNRYNES

SEQ ID NO: 1892031 - protein, 19 aa, Staphylococcus
LFLLCIIVIISFLALGAII

SEQ ID NO: 1892032 - protein, 18 aa, Staphylococcus
LFLNENWAGILITIVATV

SEQ ID NO: 1892033 - protein, 19 aa, Staphylococcus
LFMKCRFWLPLIFSSLIFS

SEQ ID NO: 1892034 - protein, 19 aa, Staphylococcus
LFMKSRFWLPLIISSVVFS

SEQ ID NO: 1892035 - protein, 17 aa, Staphylococcus
LFMSLVLFTVVGSQINK

SEQ ID NO: 1892036 - protein, 18 aa, Staphylococcus
LFNISSKRQIYCFIDEIF

SEQ ID NO: 1892037 - protein, 28 aa, Staphylococcus
LFSKRFWPSLKFLLPILIGMILAIGVLS

SEQ ID NO: 1892038 - protein, 23 aa, Staphylococcus
LFTSEAKIVFSIIFSLIILLAAI

SEQ ID NO: 1892039 - protein, 17 aa, Staphylococcus
LFVSMVVGIVFLKATGI

SEQ ID NO: 1892040 - protein, 18 aa, Staphylococcus
LFVSMVVGIVFLKLTGIS

SEQ ID NO: 1892041 - protein, 17 aa, Staphylococcus
LFVVFGMIFLLLVPNTF

SEQ ID NO: 1892042 - protein, 17 aa, Staphylococcus
LFYICLPFQKILEKNKI

SEQ ID NO: 1892043 - protein, 20 aa, Staphylococcus
LGAFIFRFIALFLISIIANF

SEQ ID NO: 1892044 - protein, 20 aa, Staphylococcus
LGAFIFRFIALFLISIIVNF

SEQ ID NO: 1892045 - protein, 21 aa, Staphylococcus
LGAFVFRFASLFLISYLVNFW

SEQ ID NO: 1892046 - protein, 17 aa, Staphylococcus
LGAIAFSLALVLIVLTH

SEQ ID NO: 1892047 - protein, 19 aa, Staphylococcus
LGALLLKIGRFESSIAKGM

SEQ ID NO: 1892048 - protein, 19 aa, Staphylococcus
LGCIAGLLVHFFLPTSDDM

SEQ ID NO: 1892049 - protein, 23 aa, Staphylococcus
LGELIRWLFVFGILFQLPTLFMG

SEQ ID NO: 1892050 - protein, 23 aa, Staphylococcus
LGELIRWLLVFGFIFQLPILFMG

SEQ ID NO: 1892051 - protein, 21 aa, Staphylococcus
LGELIRWLLVFGFLFQIPVLF

SEQ ID NO: 1892052 - protein, 17 aa, Staphylococcus
LGFFIYIFFGRGIRKKR

SEQ ID NO: 1892053 - protein, 18 aa, Staphylococcus
LGFHVGFAAAAVGMFLGL

SEQ ID NO: 1892054 - protein, 19 aa, Staphylococcus
LGFLYKYIIAHLIQFYAIN

SEQ ID NO: 1892055 - protein, 18 aa, Staphylococcus
LGFLYKYIIAYFIQVYAV

SEQ ID NO: 1892056 - protein, 18 aa, Staphylococcus
LGFLYKYIIAYFVNQYGV

SEQ ID NO: 1892057 - protein, 18 aa, Staphylococcus
LGFLYKYIIAYLINVYAI

SEQ ID NO: 1892058 - protein, 18 aa, Staphylococcus
LGFLYKYIIAYLIQVYAI

SEQ ID NO: 1892059 - protein, 18 aa, Staphylococcus
LGFMPGFPYLGGLDSRIH

SEQ ID NO: 1892060 - protein, 29 aa, Staphylococcus
LGFVGISSLLAGFWFILAKRRKKEEEDET

SEQ ID NO: 1892061 - protein, 22 aa, Staphylococcus
LGFYRLPGLVAVIALTTYIYLT

SEQ ID NO: 1892062 - protein, 19 aa, Staphylococcus
LGGFSWPIVLVLLILFFFY

SEQ ID NO: 1892063 - protein, 22 aa, Staphylococcus
LGGLAILPSFYAWFNLWAMWDP

SEQ ID NO: 1892064 - protein, 24 aa, Staphylococcus
LGGLALLPSFYAWFNLEATWDPYG

SEQ ID NO: 1892065 - protein, 20 aa, Staphylococcus
LGGLSWPVVLVILIIFYFYS

SEQ ID NO: 1892066 - protein, 17 aa, Staphylococcus
LGGSQSYLFFGSLPVSR

SEQ ID NO: 1892067 - protein, 17 aa, Staphylococcus
LGGSVIVSFGWQPLLFN

SEQ ID NO: 1892068 - protein, 17 aa, Staphylococcus
LGGTVILSFGWQPLLLN

SEQ ID NO: 1892069 - protein, 19 aa, Staphylococcus
LGHSFKGAGIFALAIICSI

SEQ ID NO: 1892070 - protein, 20 aa, Staphylococcus
LGIKDKVDWLGHKMDPVLGQ

SEQ ID NO: 1892071 - protein, 21 aa, Staphylococcus
LGILCGFLFSSRIIKYFLTHH

SEQ ID NO: 1892072 - protein, 18 aa, Staphylococcus
LGIPEFVLMIAFASFFKP

SEQ ID NO: 1892073 - protein, 23 aa, Staphylococcus
LGIPRPFRFSGFGFDFGATLVFT

SEQ ID NO: 1892074 - protein, 17 aa, Staphylococcus
LGISITLVIASTYSIIK

SEQ ID NO: 1892075 - protein, 23 aa, Staphylococcus
LGLDSEVKWVFNLIRVVLPLIII

SEQ ID NO: 1892076 - protein, 19 aa, Staphylococcus
LGLTLTIYAVFVILFAEVI

SEQ ID NO: 1892077 - protein, 23 aa, Staphylococcus
LGRLKVTTSHAFKDADGKYNALV

SEQ ID NO: 1892078 - protein, 20 aa, Staphylococcus
LGRRRVVFIIAIVYIIGALI

SEQ ID NO: 1892079 - protein, 18 aa, Staphylococcus
LGSWKAPYSIVFVLDVFS

SEQ ID NO: 1892080 - protein, 20 aa, Staphylococcus
LGSWPAPYGIIFLLDTLGAM

SEQ ID NO: 1892081 - protein, 18 aa, Staphylococcus
LGTKEIDKVISYYKNIEL

SEQ ID NO: 1892082 - protein, 17 aa, Staphylococcus
LGTKLVLTLGFLLAFAS

SEQ ID NO: 1892083 - protein, 18 aa, Staphylococcus
LGVPLTIFLGGVKMMLPN

SEQ ID NO: 1892084 - protein, 20 aa, Staphylococcus
LGWNYWFNWVITVAADVTIA

SEQ ID NO: 1892085 - protein, 22 aa, Staphylococcus
LHALCITILFGLIAYFILLMLR

SEQ ID NO: 1892086 - protein, 19 aa, Staphylococcus
LHFSFSNKDGLRFPEVTKD

SEQ ID NO: 1892087 - protein, 20 aa, Staphylococcus
LHGLSWPIVIVLLILFFFYS

SEQ ID NO: 1892088 - protein, 18 aa, Staphylococcus
LHMALRLFMLLTLFTGFW

SEQ ID NO: 1892089 - protein, 22 aa, Staphylococcus
LHRELINPIWLVLSFLLITIGE

SEQ ID NO: 1892090 - protein, 22 aa, Staphylococcus
LHSYRFASFILMLSIILLVVSG

SEQ ID NO: 1892091 - protein, 18 aa, Staphylococcus
LHYIFKIDQAWILMLAVL

SEQ ID NO: 1892092 - protein, 20 aa, Staphylococcus
LIAALVIEHVWLHWLSNTPF

SEQ ID NO: 1892093 - protein, 18 aa, Staphylococcus
LIAAWVLTILKKSPGTAF

SEQ ID NO: 1892094 - protein, 18 aa, Staphylococcus
LIAICLWLLIGALFYLAN

SEQ ID NO: 1892095 - protein, 20 aa, Staphylococcus
LIAIGYKFLSKRSMYLTIVA

SEQ ID NO: 1892096 - protein, 18 aa, Staphylococcus
LIAIHFRAIFAPTPPSIK

SEQ ID NO: 1892097 - protein, 18 aa, Staphylococcus
LIAIIIGFIWFRLYQRTT

SEQ ID NO: 1892098 - protein, 19 aa, Staphylococcus
LIALLLILAALAIFIGMYL

SEQ ID NO: 1892099 - protein, 18 aa, Staphylococcus
LIASILVLWLYFRKSIPI

SEQ ID NO: 1892100 - protein, 17 aa, Staphylococcus
LICFFVFDISDMLKGFK

SEQ ID NO: 1892101 - protein, 18 aa, Staphylococcus
LICIFAFDLKKLFKNFDI

SEQ ID NO: 1892102 - protein, 25 aa, Staphylococcus
LIDFFSWRMPFYIVAAIALIAFAIG

SEQ ID NO: 1892103 - protein, 19 aa, Staphylococcus
LIEFARGMFVLSYLPILPT

SEQ ID NO: 1892104 - protein, 17 aa, Staphylococcus
LIFKRSWLDKRVFSKKF

SEQ ID NO: 1892105 - protein, 17 aa, Staphylococcus
LIFWWPKMTGFKLNETL

SEQ ID NO: 1892106 - protein, 18 aa, Staphylococcus
LIGIVSLKINMPSIEGMG

SEQ ID NO: 1892107 - protein, 17 aa, Staphylococcus
LIGPLLYYLSWWGVAIT

SEQ ID NO: 1892108 - protein, 17 aa, Staphylococcus
LIGVLLLTHATYSTVLL

SEQ ID NO: 1892109 - protein, 18 aa, Staphylococcus
LIHRISFFIFSRGEQPHF

SEQ ID NO: 1892110 - protein, 17 aa, Staphylococcus
LIIIFFLKDTLRNSELD

SEQ ID NO: 1892111 - protein, 17 aa, Staphylococcus
LIIISVLLLFFWSTEKI

SEQ ID NO: 1892112 - protein, 17 aa, Staphylococcus
LIILGLFGLGFLTIGLC

SEQ ID NO: 1892113 - protein, 17 aa, Staphylococcus
LIILIPISFVLTITSAV

SEQ ID NO: 1892114 - protein, 18 aa, Staphylococcus
LIIRRWDKGHWKMKLAQI

SEQ ID NO: 1892115 - protein, 17 aa, Staphylococcus
LIIVGLFVICMFVSLSM

SEQ ID NO: 1892116 - protein, 22 aa, Staphylococcus
LILAALAIFIGMYLNNDHKEKN

SEQ ID NO: 1892117 - protein, 22 aa, Staphylococcus
LILAALAIFIGMYLNNDKKDSN

SEQ ID NO: 1892118 - protein, 17 aa, Staphylococcus
LILFSFVPIGLWISAIA

SEQ ID NO: 1892119 - protein, 17 aa, Staphylococcus
LILGVMVWLGMKAIPIF

SEQ ID NO: 1892120 - protein, 22 aa, Staphylococcus
LILQRFTKGFLKSIAILIGLVA

SEQ ID NO: 1892121 - protein, 17 aa, Staphylococcus
LILRDYQPMFGVKPFLF

SEQ ID NO: 1892122 - protein, 19 aa, Staphylococcus
LILYLLHLHLGYTFSGGFI

SEQ ID NO: 1892123 - protein, 18 aa, Staphylococcus
LINYAFAGIEGWRWMLGL

SEQ ID NO: 1892124 - protein, 23 aa, Staphylococcus
LIPEARPALISGITVTAIALVGS

SEQ ID NO: 1892125 - protein, 18 aa, Staphylococcus
LIPIAVIVVFGWFNSSNV

SEQ ID NO: 1892126 - protein, 22 aa, Staphylococcus
LIPRIALGSIIAYIIGQHVDVF

SEQ ID NO: 1892127 - protein, 19 aa, Staphylococcus
LIPVIIFETLIRCYWFYKQ

SEQ ID NO: 1892128 - protein, 25 aa, Staphylococcus
LIRRYYWRFTLGIQMILNILIGATM

SEQ ID NO: 1892129 - protein, 17 aa, Staphylococcus
LISKCLFFVIFALVNSI

SEQ ID NO: 1892130 - protein, 17 aa, Staphylococcus
LITKMIILILFGLGFFI

SEQ ID NO: 1892131 - protein, 25 aa, Staphylococcus
LITLPVAIAMRWTKGFKQLIVLSII

SEQ ID NO: 1892132 - protein, 17 aa, Staphylococcus
LITPRFVLPMLIQGVTF

SEQ ID NO: 1892133 - protein, 19 aa, Staphylococcus
LITTQGWFKISFIDHLPLK

SEQ ID NO: 1892134 - protein, 22 aa, Staphylococcus
LIWFLFCVFVFQYIKLLFSQPK

SEQ ID NO: 1892135 - protein, 20 aa, Staphylococcus
LKAALPLYGRDDFIGSIAIE

SEQ ID NO: 1892136 - protein, 20 aa, Staphylococcus
LKDYSLEWFPIAVITTIIAY

SEQ ID NO: 1892137 - protein, 19 aa, Staphylococcus
LKEKIGLVLQDAFMFYGTI

SEQ ID NO: 1892138 - protein, 19 aa, Staphylococcus
LKFFEWRVAIQTETHDYVG

SEQ ID NO: 1892139 - protein, 19 aa, Staphylococcus
LKFSFSLKVIERILLALIL

SEQ ID NO: 1892140 - protein, 20 aa, Staphylococcus
LKFSLIIGILVLISYLLFLL

SEQ ID NO: 1892141 - protein, 17 aa, Staphylococcus
LKFTISLTVINRLLLAL

SEQ ID NO: 1892142 - protein, 18 aa, Staphylococcus
LKGRIAIAIIYQNVLLII

SEQ ID NO: 1892143 - protein, 17 aa, Staphylococcus
LKGRIAVAIIYQNVFLI

SEQ ID NO: 1892144 - protein, 17 aa, Staphylococcus
LKGVMAFSNLKIKDVNT

SEQ ID NO: 1892145 - protein, 19 aa, Staphylococcus
LKHLWSLAIEEQFYIVFPI

SEQ ID NO: 1892146 - protein, 19 aa, Staphylococcus
LKIIFNFGLPLVVSLLHAF

SEQ ID NO: 1892147 - protein, 19 aa, Staphylococcus
LKILFNFGLPLIIALLHAL

SEQ ID NO: 1892148 - protein, 20 aa, Staphylococcus
LKIPNWLRRLITRLIAILPI

SEQ ID NO: 1892149 - protein, 17 aa, Staphylococcus
LKITLLISVAAGIGLIN

SEQ ID NO: 1892150 - protein, 24 aa, Staphylococcus
LKKNWKLFILIPVVFVVISLLITI

SEQ ID NO: 1892151 - protein, 17 aa, Staphylococcus
LKLASIFYFSYIIDRKL

SEQ ID NO: 1892152 - protein, 23 aa, Staphylococcus
LKLDIPLIRVFKISYIINALNAI

SEQ ID NO: 1892153 - protein, 21 aa, Staphylococcus
LKLKVAFNFGLPLAIALLHAY

SEQ ID NO: 1892154 - protein, 19 aa, Staphylococcus
LKLNIKWPFWISQIGLILL

SEQ ID NO: 1892155 - protein, 19 aa, Staphylococcus
LKLPIILLIVVCPFFSNYI

SEQ ID NO: 1892156 - protein, 18 aa, Staphylococcus
LKLRSWITIASTLLGTLL

SEQ ID NO: 1892157 - protein, 19 aa, Staphylococcus
LKMPGAFTILFILTIIAVL

SEQ ID NO: 1892158 - protein, 17 aa, Staphylococcus
LKMSVKGLDEFDSNQLK

SEQ ID NO: 1892159 - protein, 21 aa, Staphylococcus
LKNKLTEFFSGYSMAINSAFN

SEQ ID NO: 1892160 - protein, 17 aa, Staphylococcus
LKPFLAYGPAIENMQWA

SEQ ID NO: 1892161 - protein, 17 aa, Staphylococcus
LKPFLSYGPAIENMQWA

SEQ ID NO: 1892162 - protein, 23 aa, Staphylococcus
LKPYYPFPIIIDDAFVHFDKQRK

SEQ ID NO: 1892163 - protein, 23 aa, Staphylococcus
LKPYYPFPIIVDDAFVHFDKDRK

SEQ ID NO: 1892164 - protein, 23 aa, Staphylococcus
LKRVAKTPAAWVILGGLAILPSF

SEQ ID NO: 1892165 - protein, 27 aa, Staphylococcus
LKSAFLSGLMLEFISMLGIGLVALEAA

SEQ ID NO: 1892166 - protein, 17 aa, Staphylococcus
LKSEILLAFSTSSSEAV

SEQ ID NO: 1892167 - protein, 26 aa, Staphylococcus
LKSIVEMIPWLACIGFIYVASSFAYA

SEQ ID NO: 1892168 - protein, 22 aa, Staphylococcus
LKSKWLRPTLIIGCTFAILQQF

SEQ ID NO: 1892169 - protein, 18 aa, Staphylococcus
LKSNIGWQTVHHEVDGSE

SEQ ID NO: 1892170 - protein, 19 aa, Staphylococcus
LKSNVGWKEMHDNVDVSES

SEQ ID NO: 1892171 - protein, 18 aa, Staphylococcus
LKSPRIASGDSWGLGRTL

SEQ ID NO: 1892172 - protein, 19 aa, Staphylococcus
LKTFKWRIIGFLAFLLIAI

SEQ ID NO: 1892173 - protein, 20 aa, Staphylococcus
LKTTEIITVILILAILFLVF

SEQ ID NO: 1892174 - protein, 19 aa, Staphylococcus
LKVLFNFGLPLIVGLLHAY

SEQ ID NO: 1892175 - protein, 17 aa, Staphylococcus
LKVLFNFSLPLIIALLH

SEQ ID NO: 1892176 - protein, 21 aa, Staphylococcus
LKWGLLVALGFVIIASFMLIL

SEQ ID NO: 1892177 - protein, 17 aa, Staphylococcus
LKWHWKDTLLILLLIPI

SEQ ID NO: 1892178 - protein, 17 aa, Staphylococcus
LKWTQLLAVVPWIIVAV

SEQ ID NO: 1892179 - protein, 19 aa, Staphylococcus
LKYDHEYTTHIELESVIPT

SEQ ID NO: 1892180 - protein, 19 aa, Staphylococcus
LLAACGFVGAVAWTIYQFT

SEQ ID NO: 1892181 - protein, 18 aa, Staphylococcus
LLACSSYLIFILIGSLQG

SEQ ID NO: 1892182 - protein, 18 aa, Staphylococcus
LLAFLFGLAWFKIYQKTI

SEQ ID NO: 1892183 - protein, 17 aa, Staphylococcus
LLAPWIAGAAMALSSVS

SEQ ID NO: 1892184 - protein, 20 aa, Staphylococcus
LLDFRLPRMLITILAGAALS

SEQ ID NO: 1892185 - protein, 19 aa, Staphylococcus
LLESFKFLNFYYLSKNVQL

SEQ ID NO: 1892186 - protein, 17 aa, Staphylococcus
LLFCLVIIFFLKDTLKD

SEQ ID NO: 1892187 - protein, 20 aa, Staphylococcus
LLFFAFRTSNNFAIQHRVIA

SEQ ID NO: 1892188 - protein, 19 aa, Staphylococcus
LLFFAFRTSNNFKIQHRII

SEQ ID NO: 1892189 - protein, 22 aa, Staphylococcus
LLFLKRRGREFALLQTIGLSRF

SEQ ID NO: 1892190 - protein, 20 aa, Staphylococcus
LLFYAFRTSKNFAIQHRIIA

SEQ ID NO: 1892191 - protein, 17 aa, Staphylococcus
LLFYGRIRGFSWDEIQS

SEQ ID NO: 1892192 - protein, 19 aa, Staphylococcus
LLGICGLVAIILRVPRLKD

SEQ ID NO: 1892193 - protein, 18 aa, Staphylococcus
LLGLLSIMYQKLVMKIYW

SEQ ID NO: 1892194 - protein, 19 aa, Staphylococcus
LLGSLVAGFLFRNTHPSLQ

SEQ ID NO: 1892195 - protein, 19 aa, Staphylococcus
LLHYIFKINDKWLLILCVL

SEQ ID NO: 1892196 - protein, 19 aa, Staphylococcus
LLHYIFKINEKWLLMLCVL

SEQ ID NO: 1892197 - protein, 17 aa, Staphylococcus
LLICFLFGFGTFGTTPL

SEQ ID NO: 1892198 - protein, 17 aa, Staphylococcus
LLIIGLFVICMFVSISM

SEQ ID NO: 1892199 - protein, 24 aa, Staphylococcus
LLKKLKWPIGLIIVAVSISSLGSI

SEQ ID NO: 1892200 - protein, 19 aa, Staphylococcus
LLLFCVAHFYKGVDLSVSE

SEQ ID NO: 1892201 - protein, 21 aa, Staphylococcus
LLLIVVAVFVTLAFMGGDSNS

SEQ ID NO: 1892202 - protein, 19 aa, Staphylococcus
LLLLCTITIISFIGLGAIL

SEQ ID NO: 1892203 - protein, 18 aa, Staphylococcus
LLLLRLFLTIVFTILLIL

SEQ ID NO: 1892204 - protein, 17 aa, Staphylococcus
LLLPRLGAALTVVITVT

SEQ ID NO: 1892205 - protein, 17 aa, Staphylococcus
LLLPRLGAALTVVMTVT

SEQ ID NO: 1892206 - protein, 18 aa, Staphylococcus
LLLYAVILTSMFAFLNLT

SEQ ID NO: 1892207 - protein, 24 aa, Staphylococcus
LLMIPICISFLFGPIVDAIALRKT

SEQ ID NO: 1892208 - protein, 18 aa, Staphylococcus
LLNASWVAFVLWLIASIM

SEQ ID NO: 1892209 - protein, 18 aa, Staphylococcus
LLPFILSGFLFYVFLPLQ

SEQ ID NO: 1892210 - protein, 18 aa, Staphylococcus
LLSGIVCSIILIIIIISI

SEQ ID NO: 1892211 - protein, 19 aa, Staphylococcus
LLVACGFVGAVAWTIYQYT

SEQ ID NO: 1892212 - protein, 18 aa, Staphylococcus
LLVLPATVMIYFRIVKKN

SEQ ID NO: 1892213 - protein, 19 aa, Staphylococcus
LLVMFDWKGQFSIKTDHGT

SEQ ID NO: 1892214 - protein, 25 aa, Staphylococcus
LMATNFGWRSIFIISIILTILAMFL

SEQ ID NO: 1892215 - protein, 19 aa, Staphylococcus
LMEFARGMYTLSYINYLPT

SEQ ID NO: 1892216 - protein, 22 aa, Staphylococcus
LMEFGSPILLCLNMGDVASKRG

SEQ ID NO: 1892217 - protein, 20 aa, Staphylococcus
LMEFRFPRMLITILAGAALS

SEQ ID NO: 1892218 - protein, 18 aa, Staphylococcus
LMIGWLGRYLRYFRNLAR

SEQ ID NO: 1892219 - protein, 21 aa, Staphylococcus
LMILRCTIIIFSIFTLLFGIF

SEQ ID NO: 1892220 - protein, 20 aa, Staphylococcus
LMLDSGDAFQGLPISNNTKG

SEQ ID NO: 1892221 - protein, 17 aa, Staphylococcus
LMLIIGIIFSIAFISIY

SEQ ID NO: 1892222 - protein, 18 aa, Staphylococcus
LMLIYIIRSFGMSFIMMP

SEQ ID NO: 1892223 - protein, 26 aa, Staphylococcus
LMLPGFALILSTSFLSPSVFAAENSN

SEQ ID NO: 1892224 - protein, 24 aa, Staphylococcus
LMSTHFGWRTIFIVSIVLTLLSMY

SEQ ID NO: 1892225 - protein, 23 aa, Staphylococcus
LMVLTAIAIVVVWFVFNQLIAGI

SEQ ID NO: 1892226 - protein, 19 aa, Staphylococcus
LMWFNGHMTLSLSITTMIT

SEQ ID NO: 1892227 - protein, 23 aa, Staphylococcus
LNAEHPVGMAMLILAVLAIIGFI

SEQ ID NO: 1892228 - protein, 21 aa, Staphylococcus
LNAFMPVTMPFYLSYSQVLLM

SEQ ID NO: 1892229 - protein, 21 aa, Staphylococcus
LNEAIPLFAGVIVALAFILLM

SEQ ID NO: 1892230 - protein, 22 aa, Staphylococcus
LNEAIPLFAGVIVILAFVLLMI

SEQ ID NO: 1892231 - protein, 21 aa, Staphylococcus
LNFFHGWPWYAVWLVALGFGG

SEQ ID NO: 1892232 - protein, 22 aa, Staphylococcus
LNFFHGWPWYAVWLVMLGFGGG

SEQ ID NO: 1892233 - protein, 20 aa, Staphylococcus
LNGLKWTAVLSVMPLLILAL

SEQ ID NO: 1892234 - protein, 18 aa, Staphylococcus
LNGLKWTQLLAVVPWIIV

SEQ ID NO: 1892235 - protein, 18 aa, Staphylococcus
LNGMKWKDVMIICPWVLM

SEQ ID NO: 1892236 - protein, 22 aa, Staphylococcus
LNIFHGWPWYAVWLVLLGFGGG

SEQ ID NO: 1892237 - protein, 18 aa, Staphylococcus
LNILLNHGFTLIECFTFL

SEQ ID NO: 1892238 - protein, 17 aa, Staphylococcus
LNKCPNCGNKLDNKDNQ

SEQ ID NO: 1892239 - protein, 23 aa, Staphylococcus
LNKLIKGVNWVAGKLSMDKLPYI

SEQ ID NO: 1892240 - protein, 23 aa, Staphylococcus
LNKWCFWFFMIGFNVCFLPQFIL

SEQ ID NO: 1892241 - protein, 19 aa, Staphylococcus
LNLFFSFTIVFLERRSPGS

SEQ ID NO: 1892242 - protein, 21 aa, Staphylococcus
LNLFHGWPWYAIWLVLLGFGG

SEQ ID NO: 1892243 - protein, 20 aa, Staphylococcus
LNLFLAWFFIYFPWGKSGIK

SEQ ID NO: 1892244 - protein, 21 aa, Staphylococcus
LNLFLAWFFVYFQIGRTIVEG

SEQ ID NO: 1892245 - protein, 20 aa, Staphylococcus
LNLIMSLGFLLGGIIGLLQG

SEQ ID NO: 1892246 - protein, 27 aa, Staphylococcus
LNMKYSHWLRFVWPVVVFVMVFGGAML

SEQ ID NO: 1892247 - protein, 36 aa, Staphylococcus
LNNFFSIRKLKFGVASITLGSALIIGAHHEAQAAES

SEQ ID NO: 1892248 - protein, 24 aa, Staphylococcus
LNNSQFRDSFSPDYANLTQVRNPK

SEQ ID NO: 1892249 - protein, 17 aa, Staphylococcus
LNPAGSMSIMISLSLFL

SEQ ID NO: 1892250 - protein, 19 aa, Staphylococcus
LNPEVIKWAKDVYDKRVLD

SEQ ID NO: 1892251 - protein, 17 aa, Staphylococcus
LNPSGFVKIVWGVMLSA

SEQ ID NO: 1892252 - protein, 19 aa, Staphylococcus
LNREWWESYKFYQHDKELK

SEQ ID NO: 1892253 - protein, 24 aa, Staphylococcus
LNSARGSLDHNVFYGTLGQSRNYT

SEQ ID NO: 1892254 - protein, 17 aa, Staphylococcus
LNVIISLFISSLVGGLI

SEQ ID NO: 1892255 - protein, 17 aa, Staphylococcus
LNWSRWLPHTTLKALNI

SEQ ID NO: 1892256 - protein, 18 aa, Staphylococcus
LPFKVLDAMGGKANIKHL

SEQ ID NO: 1892257 - protein, 22 aa, Staphylococcus
LPFRRIISFFLVFTMLFSAGVV

SEQ ID NO: 1892258 - protein, 18 aa, Staphylococcus
LPGAIAIGIGCIMLVYLL

SEQ ID NO: 1892259 - protein, 17 aa, Staphylococcus
LPGWLSRIIPHIDIEGH

SEQ ID NO: 1892260 - protein, 17 aa, Staphylococcus
LPIAMPVMMAGIRTAMV

SEQ ID NO: 1892261 - protein, 17 aa, Staphylococcus
LPIEGMILFSPLLELQK

SEQ ID NO: 1892262 - protein, 17 aa, Staphylococcus
LPIGAAFAIAAILCPTD

SEQ ID NO: 1892263 - protein, 23 aa, Staphylococcus
LPIIPIWLSRFWVRLISQVPKEM

SEQ ID NO: 1892264 - protein, 17 aa, Staphylococcus
LPIMIIIMLGIMTTFGP

SEQ ID NO: 1892265 - protein, 17 aa, Staphylococcus
LPLALSVIIGGLRIALV

SEQ ID NO: 1892266 - protein, 17 aa, Staphylococcus
LPLFFQRFQHFNAIETA

SEQ ID NO: 1892267 - protein, 18 aa, Staphylococcus
LPLIINWLGWLISKINGM

SEQ ID NO: 1892268 - protein, 18 aa, Staphylococcus
LPLSFAYVIFIIFWQVGF

SEQ ID NO: 1892269 - protein, 17 aa, Staphylococcus
LPLSLSVIIGGIRIALV

SEQ ID NO: 1892270 - protein, 18 aa, Staphylococcus
LPMIFALGVAIGLAGGDG

SEQ ID NO: 1892271 - protein, 17 aa, Staphylococcus
LPMIFAMGVAIGLASGD

SEQ ID NO: 1892272 - protein, 17 aa, Staphylococcus
LPPSVLTKDNYVFVVNK

SEQ ID NO: 1892273 - protein, 26 aa, Staphylococcus
LPQVFKSMCIPLVIIIVMCFIHLNTA

SEQ ID NO: 1892274 - protein, 18 aa, Staphylococcus
LPRAIPLAILVIGIVYIG

SEQ ID NO: 1892275 - protein, 17 aa, Staphylococcus
LPSGIGILLMVLGLLLT

SEQ ID NO: 1892276 - protein, 17 aa, Staphylococcus
LPSILKVGLIYGLVILV

SEQ ID NO: 1892277 - protein, 17 aa, Staphylococcus
LPTGAAFAIAAILCPTD

SEQ ID NO: 1892278 - protein, 18 aa, Staphylococcus
LPVALSFFSGRRLVPILT

SEQ ID NO: 1892279 - protein, 19 aa, Staphylococcus
LPVAMIISWILWGPLPNFM

SEQ ID NO: 1892280 - protein, 17 aa, Staphylococcus
LPVEWRRPLSITLFVIV

SEQ ID NO: 1892281 - protein, 18 aa, Staphylococcus
LQFDNAINIANNVLNKKD

SEQ ID NO: 1892282 - protein, 25 aa, Staphylococcus
LQFEAWKYIVIIGMFILAVVFLIVR

SEQ ID NO: 1892283 - protein, 19 aa, Staphylococcus
LQIQMWKYIALIGLFVIII

SEQ ID NO: 1892284 - protein, 26 aa, Staphylococcus
LQKNMWKYLSLIGIIVLIAIYLAVRS

SEQ ID NO: 1892285 - protein, 18 aa, Staphylococcus
LQLAIGFIAIFFIALGNA

SEQ ID NO: 1892286 - protein, 25 aa, Staphylococcus
LQMLNMRYSHWFRFVWPVVVFVLVF

SEQ ID NO: 1892287 - protein, 23 aa, Staphylococcus
LQRELSDRLTFSSWLETDYLDSR

SEQ ID NO: 1892288 - protein, 19 aa, Staphylococcus
LQSRLRKALLILLVGGSIG

SEQ ID NO: 1892289 - protein, 17 aa, Staphylococcus
LQTRLGFHVGFAAAAVG

SEQ ID NO: 1892290 - protein, 22 aa, Staphylococcus
LQWLLDTVVSFGLVFGFVLMFV

SEQ ID NO: 1892291 - protein, 17 aa, Staphylococcus
LQYLKRRWFIIIIAFLL

SEQ ID NO: 1892292 - protein, 17 aa, Staphylococcus
LQYRFESIIAFIVIAIS

SEQ ID NO: 1892293 - protein, 18 aa, Staphylococcus
LRAFWIRRIKRLIPAVYF

SEQ ID NO: 1892294 - protein, 18 aa, Staphylococcus
LRALRFAQKFGLPVQGIG

SEQ ID NO: 1892295 - protein, 17 aa, Staphylococcus
LRDRLAVRHGRYIEQDA

SEQ ID NO: 1892296 - protein, 17 aa, Staphylococcus
LRFDLLIYSCLSFLLVI

SEQ ID NO: 1892297 - protein, 17 aa, Staphylococcus
LRFVIAIVIGFGASYLF

SEQ ID NO: 1892298 - protein, 17 aa, Staphylococcus
LRIVLKRSIPDAKKKVA

SEQ ID NO: 1892299 - protein, 17 aa, Staphylococcus
LRIVLKRSIPNAKKQVS

SEQ ID NO: 1892300 - protein, 18 aa, Staphylococcus
LRIVWWCAVGFTLCIILG

SEQ ID NO: 1892301 - protein, 18 aa, Staphylococcus
LRKEILKLFKLKEIKTPQ

SEQ ID NO: 1892302 - protein, 17 aa, Staphylococcus
LRLLQRLSKALMHDDTR

SEQ ID NO: 1892303 - protein, 21 aa, Staphylococcus
LRLSFPETRFMKFMGGKDLLF

SEQ ID NO: 1892304 - protein, 20 aa, Staphylococcus
LRLSIILFMFILIILIVLLC

SEQ ID NO: 1892305 - protein, 21 aa, Staphylococcus
LRNIPTLIVVVAFVLFVFMTI

SEQ ID NO: 1892306 - protein, 17 aa, Staphylococcus
LRPAGIISCEDDRIDAV

SEQ ID NO: 1892307 - protein, 17 aa, Staphylococcus
LRPAGIITCDDERIDAV

SEQ ID NO: 1892308 - protein, 17 aa, Staphylococcus
LRPAGIITLDDKRIDAV

SEQ ID NO: 1892309 - protein, 17 aa, Staphylococcus
LRPAGIITLNNERIDAV

SEQ ID NO: 1892310 - protein, 24 aa, Staphylococcus
LRQSFNIPALKAWQQVSSNAGKDA

SEQ ID NO: 1892311 - protein, 17 aa, Staphylococcus
LRRIGFTNTDMIKGLAL

SEQ ID NO: 1892312 - protein, 17 aa, Staphylococcus
LRTGPNAAYPVIYKIEK

SEQ ID NO: 1892313 - protein, 17 aa, Staphylococcus
LRTGPNAAYPVIYQVEK

SEQ ID NO: 1892314 - protein, 25 aa, Staphylococcus
LRVLKRPLTWLSIIVSILFNAAVFG

SEQ ID NO: 1892315 - protein, 17 aa, Staphylococcus
LRWTLFYQKNCILAMIP

SEQ ID NO: 1892316 - protein, 18 aa, Staphylococcus
LSALAFILSLFLKGKDHY

SEQ ID NO: 1892317 - protein, 22 aa, Staphylococcus
LSDIQLSWLLPFIILLFIGLII

SEQ ID NO: 1892318 - protein, 23 aa, Staphylococcus
LSELLRWLLIFGLLFQLPVLLFG

SEQ ID NO: 1892319 - protein, 17 aa, Staphylococcus
LSFANPIGIMFYIVLQI

SEQ ID NO: 1892320 - protein, 23 aa, Staphylococcus
LSFFISNVYYHFNLKPKNDQKIM

SEQ ID NO: 1892321 - protein, 18 aa, Staphylococcus
LSFFKRIIFSLAVLTMFV

SEQ ID NO: 1892322 - protein, 21 aa, Staphylococcus
LSFLMPVSMPFHVTTSNLLLV

SEQ ID NO: 1892323 - protein, 20 aa, Staphylococcus
LSFRIEKQFLPIAVKYLIVH

SEQ ID NO: 1892324 - protein, 20 aa, Staphylococcus
LSFSCAMAFSAACQIYLGHF

SEQ ID NO: 1892325 - protein, 25 aa, Staphylococcus
LSFWFRDCIYMRSLFFMSKKKLMKS

SEQ ID NO: 1892326 - protein, 21 aa, Staphylococcus
LSGLMLEFINMLGIGLIALEA

SEQ ID NO: 1892327 - protein, 25 aa, Staphylococcus
LSGLMLEFISLLGIGLVALEAALSL

SEQ ID NO: 1892328 - protein, 25 aa, Staphylococcus
LSGLMLEFISLLGIGLVALEAGLGL

SEQ ID NO: 1892329 - protein, 18 aa, Staphylococcus
LSILALGIHKMIESNNPS

SEQ ID NO: 1892330 - protein, 17 aa, Staphylococcus
LSILIFVMAFKMLGVSI

SEQ ID NO: 1892331 - protein, 17 aa, Staphylococcus
LSIPEFVIMIALASFFH

SEQ ID NO: 1892332 - protein, 18 aa, Staphylococcus
LSIPEFVLMIALASFFKP

SEQ ID NO: 1892333 - protein, 28 aa, Staphylococcus
LSKFKLLSWIASIYIEFLRGTPMLVQVF

SEQ ID NO: 1892334 - protein, 23 aa, Staphylococcus
LSKVELPIAMPVIMAGIRTAMVL

SEQ ID NO: 1892335 - protein, 18 aa, Staphylococcus
LSKWRTKIGYVMQSNSMM

SEQ ID NO: 1892336 - protein, 19 aa, Staphylococcus
LSLCIYIPFIYRFITQGIV

SEQ ID NO: 1892337 - protein, 18 aa, Staphylococcus
LSLFCLFLGYALLDRNIH

SEQ ID NO: 1892338 - protein, 25 aa, Staphylococcus
LSLGSWRWIFWMNIPFIVVGLVGCL

SEQ ID NO: 1892339 - protein, 21 aa, Staphylococcus
LSLIKVLKPYYPFPIIIDDAF

SEQ ID NO: 1892340 - protein, 21 aa, Staphylococcus
LSLIKVLKPYYPFPIIVDDAF

SEQ ID NO: 1892341 - protein, 25 aa, Staphylococcus
LSLIMPVTMPFYLGYGTILLMIVIF

SEQ ID NO: 1892342 - protein, 25 aa, Staphylococcus
LSLLGGEFDLQFAFDNLREILLKAN

SEQ ID NO: 1892343 - protein, 18 aa, Staphylococcus
LSLPFAMVGLFASMFFII

SEQ ID NO: 1892344 - protein, 17 aa, Staphylococcus
LSLRLNDWYTIAMSMFI

SEQ ID NO: 1892345 - protein, 17 aa, Staphylococcus
LSLSLLWKDTKSKKQIL

SEQ ID NO: 1892346 - protein, 24 aa, Staphylococcus
LSRQFKISSAILVITSSLIGSNIV

SEQ ID NO: 1892347 - protein, 19 aa, Staphylococcus
LSSYYLFNWFFIVYHLGVI

SEQ ID NO: 1892348 - protein, 19 aa, Staphylococcus
LSSYYLFNWFFIVYNIGVI

SEQ ID NO: 1892349 - protein, 19 aa, Staphylococcus
LSSYYLFNWFFIVYNISVI

SEQ ID NO: 1892350 - protein, 17 aa, Staphylococcus
LSSYYLFNWFFVIYHIG

SEQ ID NO: 1892351 - protein, 21 aa, Staphylococcus
LSVFLVWYLNIFVLKTFSITG

SEQ ID NO: 1892352 - protein, 22 aa, Staphylococcus
LSVLLMRFSPKWLKYDKRIVII

SEQ ID NO: 1892353 - protein, 17 aa, Staphylococcus
LSVPSMIGLLMLIGIVV

SEQ ID NO: 1892354 - protein, 22 aa, Staphylococcus
LSYLTQMCVITFLMFTSAASGY

SEQ ID NO: 1892355 - protein, 17 aa, Staphylococcus
LTAAIIIFSASHLIVTT

SEQ ID NO: 1892356 - protein, 17 aa, Staphylococcus
LTACWTVFMILSGTYML

SEQ ID NO: 1892357 - protein, 18 aa, Staphylococcus
LTDEFLILDFSYDMPLAT

SEQ ID NO: 1892358 - protein, 20 aa, Staphylococcus
LTDWCNLAFVTKLVLGQSEQ

SEQ ID NO: 1892359 - protein, 18 aa, Staphylococcus
LTEFYKYILVLIVVLLID

SEQ ID NO: 1892360 - protein, 18 aa, Staphylococcus
LTGFSALCIISVYNLTFT

SEQ ID NO: 1892361 - protein, 17 aa, Staphylococcus
LTGICYYSSIKLTNPSI

SEQ ID NO: 1892362 - protein, 18 aa, Staphylococcus
LTGIDGFTEMWKGIREEE

SEQ ID NO: 1892363 - protein, 22 aa, Staphylococcus
LTGLAILPSFYAWFNLWAMWDP

SEQ ID NO: 1892364 - protein, 25 aa, Staphylococcus
LTGLLSGFWLVLAKRRKKEEEEEKL

SEQ ID NO: 1892365 - protein, 18 aa, Staphylococcus
LTIASWRLLFVILGILGL

SEQ ID NO: 1892366 - protein, 25 aa, Staphylococcus
LTIISSIFFPLSFLTGWYGMNFKYM

SEQ ID NO: 1892367 - protein, 18 aa, Staphylococcus
LTIKETFLTWSLLETIIS

SEQ ID NO: 1892368 - protein, 18 aa, Staphylococcus
LTIKETFLTWSLLETILS

SEQ ID NO: 1892369 - protein, 17 aa, Staphylococcus
LTILSSIFFPLTLLTGW

SEQ ID NO: 1892370 - protein, 17 aa, Staphylococcus
LTIPVLFLFPFVQKHFV

SEQ ID NO: 1892371 - protein, 17 aa, Staphylococcus
LTIYLLVALMYWVVCFI

SEQ ID NO: 1892372 - protein, 22 aa, Staphylococcus
LTKKRWLNVIGWNGNLAVFILF

SEQ ID NO: 1892373 - protein, 18 aa, Staphylococcus
LTLATAISTLQGMQYYAV

SEQ ID NO: 1892374 - protein, 17 aa, Staphylococcus
LTLLAMIAFYIAIFSIM

SEQ ID NO: 1892375 - protein, 17 aa, Staphylococcus
LTLLPIYYFFIFKQFEL

SEQ ID NO: 1892376 - protein, 18 aa, Staphylococcus
LTLLTGWFGMNFTNMPEL

SEQ ID NO: 1892377 - protein, 17 aa, Staphylococcus
LTLTFGVSKSFLKKIGM

SEQ ID NO: 1892378 - protein, 17 aa, Staphylococcus
LTLTFGVSKSFMKKLGL

SEQ ID NO: 1892379 - protein, 17 aa, Staphylococcus
LTMIVGLIFTLGSILAG

SEQ ID NO: 1892380 - protein, 20 aa, Staphylococcus
LTNIYYHFNLKASNDAKIMT

SEQ ID NO: 1892381 - protein, 22 aa, Staphylococcus
LTNRFAVRPVLLWTLFTFIIGN

SEQ ID NO: 1892382 - protein, 22 aa, Staphylococcus
LTNRFAVRPVLLWTLVAFIIGN

SEQ ID NO: 1892383 - protein, 22 aa, Staphylococcus
LTPRRAILLAAIMNFIGALTFT

SEQ ID NO: 1892384 - protein, 17 aa, Staphylococcus
LTSKRFIQWLNLLNIVP

SEQ ID NO: 1892385 - protein, 25 aa, Staphylococcus
LTSSFLAGILWIIAGIMLLARKPKN

SEQ ID NO: 1892386 - protein, 20 aa, Staphylococcus
LTVVGFCWGAFIAAYVPLSA

SEQ ID NO: 1892387 - protein, 18 aa, Staphylococcus
LVACGFVGAVAWTIYQFT

SEQ ID NO: 1892388 - protein, 17 aa, Staphylococcus
LVAVAPWLAGLLIGAFW

SEQ ID NO: 1892389 - protein, 17 aa, Staphylococcus
LVEARPKALAYINSLDK

SEQ ID NO: 1892390 - protein, 17 aa, Staphylococcus
LVFRLNQSLTFWSAGGV

SEQ ID NO: 1892391 - protein, 19 aa, Staphylococcus
LVGALLLAFYFYRDNPDLK

SEQ ID NO: 1892392 - protein, 18 aa, Staphylococcus
LVGALLLAFYFYRDSSDI

SEQ ID NO: 1892393 - protein, 20 aa, Staphylococcus
LVIIVGCALVLLLAICCYKF

SEQ ID NO: 1892394 - protein, 17 aa, Staphylococcus
LVIPDFTLLIIMTILHT

SEQ ID NO: 1892395 - protein, 20 aa, Staphylococcus
LVIPRVVAILGIISAIITIK

SEQ ID NO: 1892396 - protein, 19 aa, Staphylococcus
LVIQTICVLLGIWVYNLDK

SEQ ID NO: 1892397 - protein, 17 aa, Staphylococcus
LVISTLFGIEFILLSLN

SEQ ID NO: 1892398 - protein, 19 aa, Staphylococcus
LVLCFIVFGITTGTSYAAE

SEQ ID NO: 1892399 - protein, 17 aa, Staphylococcus
LVLFSFVPVGLWISAIA

SEQ ID NO: 1892400 - protein, 18 aa, Staphylococcus
LVLISIVLTYLVWNYTPD

SEQ ID NO: 1892401 - protein, 19 aa, Staphylococcus
LVLKRPFKLTAFKAQNIER

SEQ ID NO: 1892402 - protein, 17 aa, Staphylococcus
LVLLLPLFVPKRKFEWP

SEQ ID NO: 1892403 - protein, 19 aa, Staphylococcus
LVPRIALGSIIAYIIGQHV

SEQ ID NO: 1892404 - protein, 20 aa, Staphylococcus
LVPRWIKFIPAPLISIVILT

SEQ ID NO: 1892405 - protein, 24 aa, Staphylococcus
LVPYICFFCFFSVYYYLTGKSSNL

SEQ ID NO: 1892406 - protein, 19 aa, Staphylococcus
LVRILTLFASFLIGLTLMG

SEQ ID NO: 1892407 - protein, 18 aa, Staphylococcus
LVSIGTAVGLVFTQIGFP

SEQ ID NO: 1892408 - protein, 24 aa, Staphylococcus
LVTCCWFLFCVFIFQYIKLLFSNP

SEQ ID NO: 1892409 - protein, 24 aa, Staphylococcus
LVTCLWFLFCVFIFQYIKLLFSKP

SEQ ID NO: 1892410 - protein, 20 aa, Staphylococcus
LVTFCLPSNLPIAPNEALYR

SEQ ID NO: 1892411 - protein, 17 aa, Staphylococcus
LVTFLVLVVFKRSIIMP

SEQ ID NO: 1892412 - protein, 19 aa, Staphylococcus
LVVAIAFFFAMKTYQGHRN

SEQ ID NO: 1892413 - protein, 20 aa, Staphylococcus
LVWPDLPIGAAFAIAAILCP

SEQ ID NO: 1892414 - protein, 29 aa, Staphylococcus
LWEIIKRNLKWLIILPIVCLLLSVLVTAV

SEQ ID NO: 1892415 - protein, 20 aa, Staphylococcus
LWFIFCVYIFQYIKLLFTNR

SEQ ID NO: 1892416 - protein, 17 aa, Staphylococcus
LWIGALVYLVWYAMIKK

SEQ ID NO: 1892417 - protein, 21 aa, Staphylococcus
LWISIFTICFILAVSKLTTYG

SEQ ID NO: 1892418 - protein, 17 aa, Staphylococcus
LYCWKAFHWPHFIFYIL

SEQ ID NO: 1892419 - protein, 19 aa, Staphylococcus
LYESFKFLNLHFKYKGTKT

SEQ ID NO: 1892420 - protein, 19 aa, Staphylococcus
LYEYKTYSSYNFKQGDKIG

SEQ ID NO: 1892421 - protein, 17 aa, Staphylococcus
LYFEIITTIAIALGIIL

SEQ ID NO: 1892422 - protein, 17 aa, Staphylococcus
LYFEIITTIAIGLGIIF

SEQ ID NO: 1892423 - protein, 18 aa, Staphylococcus
LYFISVILAFSFVLINLW

SEQ ID NO: 1892424 - protein, 19 aa, Staphylococcus
LYFRYKLRGAALIESYTLF

SEQ ID NO: 1892425 - protein, 18 aa, Staphylococcus
LYHFCFISKILFTKDELK

SEQ ID NO: 1892426 - protein, 19 aa, Staphylococcus
LYILFCWTGIPGVIGMIEG

SEQ ID NO: 1892427 - protein, 22 aa, Staphylococcus
LYIPHFLSWVVVIGIFKKLLAP

SEQ ID NO: 1892428 - protein, 33 aa, Staphylococcus
LYISLRLSLIKILRPYYSMPIIIDDAFVHFDKQ

SEQ ID NO: 1892429 - protein, 21 aa, Staphylococcus
LYISLRLSLIKVLKPYYHLPI

SEQ ID NO: 1892430 - protein, 20 aa, Staphylococcus
LYISLRLSLIKVLKPYYPFP

SEQ ID NO: 1892431 - protein, 26 aa, Staphylococcus
LYKHYYYRLFAILTFVFIIFSFIPFI

SEQ ID NO: 1892432 - protein, 19 aa, Staphylococcus
LYLLFCWTGIPGVIGIYEG

SEQ ID NO: 1892433 - protein, 19 aa, Staphylococcus
LYLLFCWTGIPGVIGMVEG

SEQ ID NO: 1892434 - protein, 19 aa, Staphylococcus
LYLLFRFTPILSYASWVGY

SEQ ID NO: 1892435 - protein, 17 aa, Staphylococcus
LYMLIQFFINRRAVTEL

SEQ ID NO: 1892436 - protein, 18 aa, Staphylococcus
LYNTVGIVGACGWMVYTI

SEQ ID NO: 1892437 - protein, 18 aa, Staphylococcus
LYQSEFILHLPIFNEMHI

SEQ ID NO: 1892438 - protein, 18 aa, Staphylococcus
LYRFFKKIHLGWFVLPIP

SEQ ID NO: 1892439 - protein, 18 aa, Staphylococcus
LYRFFKKIHLGWFVLPVP

SEQ ID NO: 1892440 - protein, 24 aa, Staphylococcus
LYRKRTVIWPFYFYTIIRTLSIKV

SEQ ID NO: 1892441 - protein, 18 aa, Staphylococcus
LYSFGRDGLLPSWLAKLN

SEQ ID NO: 1892442 - protein, 23 aa, Staphylococcus
LYSFGRDGLLPSWLGKLNKKNLP

SEQ ID NO: 1892443 - protein, 18 aa, Staphylococcus
LYSGRVSMVFGITTTLGI

SEQ ID NO: 1892444 - protein, 24 aa, Staphylococcus
LYSNRIDVLLGWMIIIIAAVLVGL

SEQ ID NO: 1892445 - protein, 24 aa, Staphylococcus
LYSNRYEMIGGFIIAAIALILIIM

SEQ ID NO: 1892446 - protein, 19 aa, Staphylococcus
LYVALRLSLIKVLKPYYPF

SEQ ID NO: 1892447 - protein, 22 aa, Staphylococcus
LYVKPALKQKISYWHNNEGQSI

SEQ ID NO: 1892448 - protein, 19 aa, Staphylococcus
LYYWSAWALFIVCIMILAL

SEQ ID NO: 1892449 - protein, 17 aa, Staphylococcus
MACWLLYAHKLIERKTA

SEQ ID NO: 1892450 - protein, 20 aa, Staphylococcus
MAKRRIGALIVFEKKTGLQD

SEQ ID NO: 1892451 - protein, 19 aa, Staphylococcus
MALLYARPLYYFGNVMKPL

SEQ ID NO: 1892452 - protein, 20 aa, Staphylococcus
MCASSAMLLPGISGSFMLLV

SEQ ID NO: 1892453 - protein, 22 aa, Staphylococcus
MDAASTIPGWQVVNSQQTQIPL

SEQ ID NO: 1892454 - protein, 20 aa, Staphylococcus
MDGKEAMAFIRSRKEDGAGG

SEQ ID NO: 1892455 - protein, 23 aa, Staphylococcus
MDGKLKIKIDYTVDDSVVEGDYF

SEQ ID NO: 1892456 - protein, 17 aa, Staphylococcus
MDIQWPFWISQLGLILL

SEQ ID NO: 1892457 - protein, 23 aa, Staphylococcus
MDLFRGTTFLGMISLFAWGLGYF

SEQ ID NO: 1892458 - protein, 25 aa, Staphylococcus
MEAWGWRIPFILGLFLGLFGLYLRR

SEQ ID NO: 1892459 - protein, 18 aa, Staphylococcus
MEFRFPRMIITILAGAAL

SEQ ID NO: 1892460 - protein, 17 aa, Staphylococcus
MFCFLKGFIGFFIGGDS

SEQ ID NO: 1892461 - protein, 17 aa, Staphylococcus
MFGEIWPLISVVLGIII

SEQ ID NO: 1892462 - protein, 21 aa, Staphylococcus
MFGELEFWFAIIKVVTIIALI

SEQ ID NO: 1892463 - protein, 24 aa, Staphylococcus
MFILDVRLAFMAMFFMPIIILVLA

SEQ ID NO: 1892464 - protein, 23 aa, Staphylococcus
MFLLQRITGVLAFIFIAIHFYQT

SEQ ID NO: 1892465 - protein, 18 aa, Staphylococcus
MGFSEHFLIWSVLRIIAG

SEQ ID NO: 1892466 - protein, 19 aa, Staphylococcus
MGICGEWFLDFARQAAEFN

SEQ ID NO: 1892467 - protein, 17 aa, Staphylococcus
MGISMGMSWAAANDIGR

SEQ ID NO: 1892468 - protein, 17 aa, Staphylococcus
MGIYVLRSFGMAFIMMP

SEQ ID NO: 1892469 - protein, 18 aa, Staphylococcus
MGKYKYLFYLAILLSVVS

SEQ ID NO: 1892470 - protein, 21 aa, Staphylococcus
MGLDFSVWRLFGISVMAILGM

SEQ ID NO: 1892471 - protein, 20 aa, Staphylococcus
MGVSLYAFWRSRKIKTDSAD

SEQ ID NO: 1892472 - protein, 17 aa, Staphylococcus
MGVVLSPLWFILLGLIY

SEQ ID NO: 1892473 - protein, 22 aa, Staphylococcus
MHLVFFLPFYKSFRVHKLVKKK

SEQ ID NO: 1892474 - protein, 17 aa, Staphylococcus
MIFMLWILLGWKVAVVY

SEQ ID NO: 1892475 - protein, 18 aa, Staphylococcus
MIHTQGWIKLSFIDSLPL

SEQ ID NO: 1892476 - protein, 24 aa, Staphylococcus
MIKSQGFEFIWFDIGILFVFIFVF

SEQ ID NO: 1892477 - protein, 17 aa, Staphylococcus
MILHFPIAVAIVVAGLF

SEQ ID NO: 1892478 - protein, 22 aa, Staphylococcus
MILPRLLPLVIVFLIYWLLGRK

SEQ ID NO: 1892479 - protein, 17 aa, Staphylococcus
MIPFLGIGIIISALIYC

SEQ ID NO: 1892480 - protein, 17 aa, Staphylococcus
MIQDFKVTVWYTAPTAL

SEQ ID NO: 1892481 - protein, 18 aa, Staphylococcus
MITIALVWWSAFTIFTGM

SEQ ID NO: 1892482 - protein, 18 aa, Staphylococcus
MITIALVWWSAFTILTGM

SEQ ID NO: 1892483 - protein, 17 aa, Staphylococcus
MIVPWRLAMLYKFKKIE

SEQ ID NO: 1892484 - protein, 24 aa, Staphylococcus
MIVSIILAFAFKWFGLIDDVLLMV

SEQ ID NO: 1892485 - protein, 22 aa, Staphylococcus
MIWSMPFFKKLFLPGGALSFLT

SEQ ID NO: 1892486 - protein, 18 aa, Staphylococcus
MKDFNIEYSQVQWLTTAF

SEQ ID NO: 1892487 - protein, 17 aa, Staphylococcus
MKFGQSIREEGPQSHMK

SEQ ID NO: 1892488 - protein, 17 aa, Staphylococcus
MKFVIGALMAGASYIMM

SEQ ID NO: 1892489 - protein, 17 aa, Staphylococcus
MKHGRFTSREMGFNLFL

SEQ ID NO: 1892490 - protein, 21 aa, Staphylococcus
MKLAHIKFWFLIKGLTPIWIF

SEQ ID NO: 1892491 - protein, 21 aa, Staphylococcus
MKSAYNWAFFNPIRKIYYNIT

SEQ ID NO: 1892492 - protein, 27 aa, Staphylococcus
MLDMKYSHWFKFVWPIVVFVFIFGGGL

SEQ ID NO: 1892493 - protein, 18 aa, Staphylococcus
MLFFIVAWFFARKPSKIL

SEQ ID NO: 1892494 - protein, 25 aa, Staphylococcus
MLFHPFKPYYIFKMRIPFTPGLIPK

SEQ ID NO: 1892495 - protein, 25 aa, Staphylococcus
MLIIQTFCVLLGMWIYTIDKNESSA

SEQ ID NO: 1892496 - protein, 18 aa, Staphylococcus
MLLIMLVAILGMMLWVIV

SEQ ID NO: 1892497 - protein, 17 aa, Staphylococcus
MLLRTVILFTITVVFAV

SEQ ID NO: 1892498 - protein, 28 aa, Staphylococcus
MLNMRYSHWLKFVWPVVAFVLVFGGGLL

SEQ ID NO: 1892499 - protein, 20 aa, Staphylococcus
MLVAILGMMLWVIVAHGLWE

SEQ ID NO: 1892500 - protein, 17 aa, Staphylococcus
MLVEGVIDKEEYRHAKR

SEQ ID NO: 1892501 - protein, 24 aa, Staphylococcus
MLVFLDWRDTYLIYALIALVVLFW

SEQ ID NO: 1892502 - protein, 24 aa, Staphylococcus
MMHLKVGVSIGFEFPALIQTIVML

SEQ ID NO: 1892503 - protein, 22 aa, Staphylococcus
MMPYCIYSILLGICGILAIVFR

SEQ ID NO: 1892504 - protein, 26 aa, Staphylococcus
MMVSLYLKWWVAFGIAIAMLFVVAVA

SEQ ID NO: 1892505 - protein, 25 aa, Staphylococcus
MNFAYDIGFQFSFIISFFILLSKPL

SEQ ID NO: 1892506 - protein, 22 aa, Staphylococcus
MNIRILSGFLFLLAAIVTIPLV

SEQ ID NO: 1892507 - protein, 22 aa, Staphylococcus
MNIRILSGFLFLLATVITLPLV

SEQ ID NO: 1892508 - protein, 22 aa, Staphylococcus
MNIRILSGFLFLLSAIITIPLV

SEQ ID NO: 1892509 - protein, 21 aa, Staphylococcus
MNKRIRFIFGAIVLIFVLIVL

SEQ ID NO: 1892510 - protein, 18 aa, Staphylococcus
MNMSSFWLLFSGAITAIP

SEQ ID NO: 1892511 - protein, 26 aa, Staphylococcus
MNQYEVMAGYRAKFVGLIILTMIVFV

SEQ ID NO: 1892512 - protein, 23 aa, Staphylococcus
MNRLTLIVVICFVLFLILLFMFL

SEQ ID NO: 1892513 - protein, 23 aa, Staphylococcus
MNRRINFIFGLVVFIFAIMVLRL

SEQ ID NO: 1892514 - protein, 17 aa, Staphylococcus
MPGAFAILFILTILAVL

SEQ ID NO: 1892515 - protein, 19 aa, Staphylococcus
MPLYMMFSILITYYVSMGI

SEQ ID NO: 1892516 - protein, 20 aa, Staphylococcus
MPSIEGMGFAIPINEGKSIA

SEQ ID NO: 1892517 - protein, 17 aa, Staphylococcus
MPYSVAFGIFWTLLLIV

SEQ ID NO: 1892518 - protein, 25 aa, Staphylococcus
MQAWGWRIPFILGLFLGLFGLYLRR

SEQ ID NO: 1892519 - protein, 18 aa, Staphylococcus
MQLLTARSFDFSSYAKSR

SEQ ID NO: 1892520 - protein, 25 aa, Staphylococcus
MQSWGWRIPFILGLFLGLFGLYLRR

SEQ ID NO: 1892521 - protein, 25 aa, Staphylococcus
MRSEVPFYSKSMLLNRLNSLATGSY

SEQ ID NO: 1892522 - protein, 24 aa, Staphylococcus
MRVVRRRIALFGGIMLAIIILLCI

SEQ ID NO: 1892523 - protein, 18 aa, Staphylococcus
MSAICFFIVPILFIPKTH

SEQ ID NO: 1892524 - protein, 17 aa, Staphylococcus
MSLRFSVGILVFICIWT

SEQ ID NO: 1892525 - protein, 23 aa, Staphylococcus
MSNYRILRRIGFTHIDMMKGIGF

SEQ ID NO: 1892526 - protein, 20 aa, Staphylococcus
MSSWPWEWAKFTSGLMDGST

SEQ ID NO: 1892527 - protein, 22 aa, Staphylococcus
MSTFVGWRWIFIISIIVALLAM

SEQ ID NO: 1892528 - protein, 23 aa, Staphylococcus
MSVGMCAYLIRLIRSNLLDLYQS

SEQ ID NO: 1892529 - protein, 19 aa, Staphylococcus
MTGERASTTTFVYSFIAFI

SEQ ID NO: 1892530 - protein, 20 aa, Staphylococcus
MTLINHWNFWLLAFGFVILV

SEQ ID NO: 1892531 - protein, 19 aa, Staphylococcus
MTLLVGLGLVLKNRRKKQK

SEQ ID NO: 1892532 - protein, 19 aa, Staphylococcus
MTLTAIALVVVWFVFNQLV

SEQ ID NO: 1892533 - protein, 18 aa, Staphylococcus
MTPIFAVSQGWIWTVTAV

SEQ ID NO: 1892534 - protein, 18 aa, Staphylococcus
MTPIFAVSQGWIWTVTLV

SEQ ID NO: 1892535 - protein, 22 aa, Staphylococcus
MTPWKYRYVAGIFILALVVISY

SEQ ID NO: 1892536 - protein, 17 aa, Staphylococcus
MTRRSFLKLLGIGSAGA

SEQ ID NO: 1892537 - protein, 17 aa, Staphylococcus
MVEDVIVGTAFPEGLQG

SEQ ID NO: 1892538 - protein, 26 aa, Staphylococcus
MVILKAQVESVVWFIAISVFSSLVFI

SEQ ID NO: 1892539 - protein, 17 aa, Staphylococcus
MVILLLICGCIPKLGAL

SEQ ID NO: 1892540 - protein, 17 aa, Staphylococcus
MWCNFIMIWLGERLLHW

SEQ ID NO: 1892541 - protein, 26 aa, Staphylococcus
MYKFWLEMGKIWLPMIIITAAYYFVY

SEQ ID NO: 1892542 - protein, 23 aa, Staphylococcus
MYLPFILADAINWLSFTLLHRPS

SEQ ID NO: 1892543 - protein, 26 aa, Staphylococcus
NADKGIVLKAPFILYGVNADGSTTKL

SEQ ID NO: 1892544 - protein, 24 aa, Staphylococcus
NAEVAKAKIEWEILIKSIKPIVKV

SEQ ID NO: 1892545 - protein, 17 aa, Staphylococcus
NAFGGAFGRIFTGFISS

SEQ ID NO: 1892546 - protein, 21 aa, Staphylococcus
NAFMSIFIVIFVLYANRFVMR

SEQ ID NO: 1892547 - protein, 18 aa, Staphylococcus
NAIIPWGVSGTFIMGALK

SEQ ID NO: 1892548 - protein, 19 aa, Staphylococcus
NAKNPNFWLLILIIPTWIN

SEQ ID NO: 1892549 - protein, 23 aa, Staphylococcus
NAKYYRDNHVSFSIPVTENHGGS

SEQ ID NO: 1892550 - protein, 18 aa, Staphylococcus
NALHIWAQVALFFTTVGS

SEQ ID NO: 1892551 - protein, 17 aa, Staphylococcus
NALKPTWILMSWATVLM

SEQ ID NO: 1892552 - protein, 17 aa, Staphylococcus
NALTRLFSFNAIFNNKA

SEQ ID NO: 1892553 - protein, 26 aa, Staphylococcus
NAQMPFGRYYKLDIVGVIKDSAKASK

SEQ ID NO: 1892554 - protein, 26 aa, Staphylococcus
NASWYLPKWLGVILPKIDVEGKALEE

SEQ ID NO: 1892555 - protein, 33 aa, Staphylococcus
NATYSIVAAGFFFPCVSLNVLAAESKDVEQSNQ

SEQ ID NO: 1892556 - protein, 21 aa, Staphylococcus
NDLKGRIAVAIAFQNIMLIIS

SEQ ID NO: 1892557 - protein, 18 aa, Staphylococcus
NDLLRLFIMFTLASLAFV

SEQ ID NO: 1892558 - protein, 25 aa, Staphylococcus
NDQTEIPLVWGPKALPPYNPYVFDK

SEQ ID NO: 1892559 - protein, 17 aa, Staphylococcus
NEDYRLFSTDNKTGKLT

SEQ ID NO: 1892560 - protein, 20 aa, Staphylococcus
NEFFKKLGFDTQLLAKPGTT

SEQ ID NO: 1892561 - protein, 17 aa, Staphylococcus
NEFYVWCTFIFLFYLLI

SEQ ID NO: 1892562 - protein, 17 aa, Staphylococcus
NEGRWIVQNGEPNVRGV

SEQ ID NO: 1892563 - protein, 20 aa, Staphylococcus
NEIKESLSIVLDETKRLNRL

SEQ ID NO: 1892564 - protein, 23 aa, Staphylococcus
NESPLRYIIAIVIIILVVLGAFQ

SEQ ID NO: 1892565 - protein, 23 aa, Staphylococcus
NEVKPGQAFCNKCGNTLKKENKQ

SEQ ID NO: 1892566 - protein, 25 aa, Staphylococcus
NEVPKRKDFVVSFITGAIIGSTIGL

SEQ ID NO: 1892567 - protein, 26 aa, Staphylococcus
NFCIYVPFGDDWFGYFMRRLAERPQN

SEQ ID NO: 1892568 - protein, 20 aa, Staphylococcus
NFFHGWPWYAIWLVLLGFGG

SEQ ID NO: 1892569 - protein, 20 aa, Staphylococcus
NFFHGWPWYAVWLVLLGFGG

SEQ ID NO: 1892570 - protein, 21 aa, Staphylococcus
NFFHGWPWYAVWLVMLGFGGG

SEQ ID NO: 1892571 - protein, 18 aa, Staphylococcus
NFFMCLFGLLFILYANRF

SEQ ID NO: 1892572 - protein, 19 aa, Staphylococcus
NFLPIKFNKVGTYIYQITE

SEQ ID NO: 1892573 - protein, 19 aa, Staphylococcus
NFLWVIPIGIVWFVLYYVI

SEQ ID NO: 1892574 - protein, 23 aa, Staphylococcus
NFTRVSMAWDNEVEYHAGSGNGD

SEQ ID NO: 1892575 - protein, 25 aa, Staphylococcus
NGDIQAGDMLRLFKVPDNVSNIKIQ

SEQ ID NO: 1892576 - protein, 18 aa, Staphylococcus
NGKRFGVFDHYTFNIPKY

SEQ ID NO: 1892577 - protein, 27 aa, Staphylococcus
NGNKKRGLMGILLPLIALLLILAALAI

SEQ ID NO: 1892578 - protein, 20 aa, Staphylococcus
NGNLYLRSTLYGYDSNFTRV

SEQ ID NO: 1892579 - protein, 21 aa, Staphylococcus
NGQAIPGYGTSSFRDGGNTVS

SEQ ID NO: 1892580 - protein, 28 aa, Staphylococcus
NGTFKFGNIGYRERLDFMTKMVRLTGID

SEQ ID NO: 1892581 - protein, 19 aa, Staphylococcus
NGTRFLIFNNMSYRPPTKT

SEQ ID NO: 1892582 - protein, 19 aa, Staphylococcus
NGTRYLIFDNMSFNAPTKQ

SEQ ID NO: 1892583 - protein, 24 aa, Staphylococcus
NGVSEIKAIQPIGTLRQAALEEFT

SEQ ID NO: 1892584 - protein, 18 aa, Staphylococcus
NHAFKGLSWHQALFDSLF

SEQ ID NO: 1892585 - protein, 22 aa, Staphylococcus
NHHTRFSSFYGVIIYIIVFFLF

SEQ ID NO: 1892586 - protein, 18 aa, Staphylococcus
NIDLPIRAGFSLEAKIPL

SEQ ID NO: 1892587 - protein, 23 aa, Staphylococcus
NIEGMGFAIPIDAAREIAEELEK

SEQ ID NO: 1892588 - protein, 18 aa, Staphylococcus
NIGKYDFYSFQGLLPADN

SEQ ID NO: 1892589 - protein, 18 aa, Staphylococcus
NIGSLSFKFMVPILAGYI

SEQ ID NO: 1892590 - protein, 18 aa, Staphylococcus
NIHIWKPAIDFFSILSKA

SEQ ID NO: 1892591 - protein, 19 aa, Staphylococcus
NIYKFCIGRNITIKMPPQV

SEQ ID NO: 1892592 - protein, 20 aa, Staphylococcus
NIYRKFRSSDLISRMVNKVE

SEQ ID NO: 1892593 - protein, 17 aa, Staphylococcus
NIYYHFNLKASNDAKIM

SEQ ID NO: 1892594 - protein, 24 aa, Staphylococcus
NKARLATAIGWFWAMFSVGMGVIG

SEQ ID NO: 1892595 - protein, 18 aa, Staphylococcus
NKDGLRFPEVTKDKRVTG

SEQ ID NO: 1892596 - protein, 22 aa, Staphylococcus
NKELKLIMFLGFLLGGIIGLFQ

SEQ ID NO: 1892597 - protein, 23 aa, Staphylococcus
NKELKLIMLLGFLLGGIIGCLQG

SEQ ID NO: 1892598 - protein, 23 aa, Staphylococcus
NKELKLITLLGFILGGIIGLFQG

SEQ ID NO: 1892599 - protein, 22 aa, Staphylococcus
NKFAFTLTCIFVSWIWFIFLAL

SEQ ID NO: 1892600 - protein, 17 aa, Staphylococcus
NKIHFSRIVGKPGESIE

SEQ ID NO: 1892601 - protein, 24 aa, Staphylococcus
NKKAGARPGPKVNEGHNNDLTDDN

SEQ ID NO: 1892602 - protein, 17 aa, Staphylococcus
NKKEAIETILATRLNQD

SEQ ID NO: 1892603 - protein, 23 aa, Staphylococcus
NKKMWMIIGIIALLFIALIIAFS

SEQ ID NO: 1892604 - protein, 24 aa, Staphylococcus
NKKSKKWLIAIIAILLIIVAVFAT

SEQ ID NO: 1892605 - protein, 23 aa, Staphylococcus
NKNYRGTTDYYIHDNTVERSGAN

SEQ ID NO: 1892606 - protein, 19 aa, Staphylococcus
NKPLRAILYFGLFVCAMSF

SEQ ID NO: 1892607 - protein, 24 aa, Staphylococcus
NKPLRAMIYLGLIVFFISLLYIGY

SEQ ID NO: 1892608 - protein, 24 aa, Staphylococcus
NKPLRAMIYLGMFIFGLSIIYIIY

SEQ ID NO: 1892609 - protein, 30 aa, Staphylococcus
NKQNIEGGFKLPQYIDRKTATQSGDYNLNY

SEQ ID NO: 1892610 - protein, 19 aa, Staphylococcus
NKRAKKWYLPFGYGAEDIN

SEQ ID NO: 1892611 - protein, 25 aa, Staphylococcus
NKRIFLRLFIIFVFIYALFIGLMYY

SEQ ID NO: 1892612 - protein, 22 aa, Staphylococcus
NKVENIMPWNGFHRHFFIPSII

SEQ ID NO: 1892613 - protein, 19 aa, Staphylococcus
NKVKLVFFLAIAQRDIELT

SEQ ID NO: 1892614 - protein, 18 aa, Staphylococcus
NKVKPVPVNFEFKVTKKL

SEQ ID NO: 1892615 - protein, 18 aa, Staphylococcus
NKVRTGAYVGRFIFMMAM

SEQ ID NO: 1892616 - protein, 21 aa, Staphylococcus
NKWCFWLFMIGFNVCFIPQFI

SEQ ID NO: 1892617 - protein, 22 aa, Staphylococcus
NKWCFWLFMIGFNVCFLPQFIL

SEQ ID NO: 1892618 - protein, 21 aa, Staphylococcus
NKWCFWLFMIGFNVCFLPQFV

SEQ ID NO: 1892619 - protein, 17 aa, Staphylococcus
NKWKMFFWLAGLIILTL

SEQ ID NO: 1892620 - protein, 21 aa, Staphylococcus
NKWTWCMLVTFVIAAVLIGPM

SEQ ID NO: 1892621 - protein, 25 aa, Staphylococcus
NKYAIRRFTVGTASILVGATLIFGV

SEQ ID NO: 1892622 - protein, 19 aa, Staphylococcus
NKYSYRKLFLIALLLFTIG

SEQ ID NO: 1892623 - protein, 23 aa, Staphylococcus
NKYSYRKLFLVAMTLFTIGSLVC

SEQ ID NO: 1892624 - protein, 18 aa, Staphylococcus
NKYYRYLFDFGKEDKELI

SEQ ID NO: 1892625 - protein, 17 aa, Staphylococcus
NLAKPDIWITVIAGVLY

SEQ ID NO: 1892626 - protein, 19 aa, Staphylococcus
NLFLAWFLMYFPWGKTAVQ

SEQ ID NO: 1892627 - protein, 17 aa, Staphylococcus
NLFMICPFIPFIGLIIC

SEQ ID NO: 1892628 - protein, 17 aa, Staphylococcus
NLFSFLASIFVLWLYFK

SEQ ID NO: 1892629 - protein, 21 aa, Staphylococcus
NLKAFITRTWTAIKNTTVKLA

SEQ ID NO: 1892630 - protein, 17 aa, Staphylococcus
NLKLRYPFIGAVVGSGL

SEQ ID NO: 1892631 - protein, 21 aa, Staphylococcus
NLKSRFKLFLDKHVLSVVFVT

SEQ ID NO: 1892632 - protein, 25 aa, Staphylococcus
NLMDKRINFFFGLVVIVFVIIVLRL

SEQ ID NO: 1892633 - protein, 22 aa, Staphylococcus
NLNRRLDGLFGYEASLQIHSDH

SEQ ID NO: 1892634 - protein, 17 aa, Staphylococcus
NLPEHWVAPVIGIIILL

SEQ ID NO: 1892635 - protein, 21 aa, Staphylococcus
NLYQFRAALRFTYKNEDKYFK

SEQ ID NO: 1892636 - protein, 17 aa, Staphylococcus
NMLKWGLLVALGFVIIA

SEQ ID NO: 1892637 - protein, 17 aa, Staphylococcus
NMSCLNAGIGLGGIIGG

SEQ ID NO: 1892638 - protein, 28 aa, Staphylococcus
NNDKSANTAPSWKGNIYNNLTRTDTESS

SEQ ID NO: 1892639 - protein, 27 aa, Staphylococcus
NNGTLFGGILAALGSLLLVGSKRRSKK

SEQ ID NO: 1892640 - protein, 24 aa, Staphylococcus
NNKPLRMMIYLGMFTFSISILYIV

SEQ ID NO: 1892641 - protein, 24 aa, Staphylococcus
NNKPLRMMIYLGMFTFSLSVLYLL

SEQ ID NO: 1892642 - protein, 22 aa, Staphylococcus
NNKRLSLVVAFLFVMSPLYYRF

SEQ ID NO: 1892643 - protein, 17 aa, Staphylococcus
NNLKIIIISGVIPFNII

SEQ ID NO: 1892644 - protein, 23 aa, Staphylococcus
NNYLRYGGNNEFIIAESDQRQGT

SEQ ID NO: 1892645 - protein, 17 aa, Staphylococcus
NNYRILRRIGFTHTDMT

SEQ ID NO: 1892646 - protein, 17 aa, Staphylococcus
NNYRILRRIGFTNTDMI

SEQ ID NO: 1892647 - protein, 19 aa, Staphylococcus
NPEVIKWSKDVFHKRVLDT

SEQ ID NO: 1892648 - protein, 18 aa, Staphylococcus
NPEVIKWSKDVYDKRVLD

SEQ ID NO: 1892649 - protein, 22 aa, Staphylococcus
NPFKRSKFNIHITIPPDKLKQL

SEQ ID NO: 1892650 - protein, 23 aa, Staphylococcus
NPKPRFPLFKTIVIAIVAGIIGA

SEQ ID NO: 1892651 - protein, 23 aa, Staphylococcus
NQKEEWKRLAIALDIADEIMKGI

SEQ ID NO: 1892652 - protein, 22 aa, Staphylococcus
NQNLYRIAIQYYGNGSPENVNK

SEQ ID NO: 1892653 - protein, 25 aa, Staphylococcus
NQQMADWGWRIPFILAAPLGIIGII

SEQ ID NO: 1892654 - protein, 17 aa, Staphylococcus
NQRVIDYYGTLVPLTEL

SEQ ID NO: 1892655 - protein, 24 aa, Staphylococcus
NQSIRKMVPWGIGTFIIILLIILF

SEQ ID NO: 1892656 - protein, 17 aa, Staphylococcus
NQSLTFWSAGGVSGTTW

SEQ ID NO: 1892657 - protein, 21 aa, Staphylococcus
NRAELTGVFALGGASILLLSF

SEQ ID NO: 1892658 - protein, 23 aa, Staphylococcus
NREVIGYWLGFAGIVLVPLISLV

SEQ ID NO: 1892659 - protein, 27 aa, Staphylococcus
NRFYEHGALDYKRLFGAIGKNLTGGFG

SEQ ID NO: 1892660 - protein, 17 aa, Staphylococcus
NRIQGVMDFEQLKITDI

SEQ ID NO: 1892661 - protein, 24 aa, Staphylococcus
NRISYCFIAILLLLISVWLFDLKR

SEQ ID NO: 1892662 - protein, 22 aa, Staphylococcus
NRKVAIKAIRIPAGEKEETIKR

SEQ ID NO: 1892663 - protein, 17 aa, Staphylococcus
NRNFRFFQMFTAALQSF

SEQ ID NO: 1892664 - protein, 25 aa, Staphylococcus
NRVHPKFGFIFAVCIYLSIGALYGI

SEQ ID NO: 1892665 - protein, 21 aa, Staphylococcus
NRWHMSLSFWFRDCIYMRALF

SEQ ID NO: 1892666 - protein, 21 aa, Staphylococcus
NRWHMSLSFWFRDCIYMRSLF

SEQ ID NO: 1892667 - protein, 21 aa, Staphylococcus
NRWHMSLSFWFRDCIYMRTLF

SEQ ID NO: 1892668 - protein, 22 aa, Staphylococcus
NRWHMSLSFWFRDCVYMRTLFY

SEQ ID NO: 1892669 - protein, 22 aa, Staphylococcus
NRWQKCYLLIIGVLLSVMSSIL

SEQ ID NO: 1892670 - protein, 22 aa, Staphylococcus
NSEFMPKWYIEYDGEWYAYENG

SEQ ID NO: 1892671 - protein, 20 aa, Staphylococcus
NSEFTPRWYVEYDGKWYAYK

SEQ ID NO: 1892672 - protein, 19 aa, Staphylococcus
NSFAYPLAMLIQDKAELER

SEQ ID NO: 1892673 - protein, 17 aa, Staphylococcus
NSFPIKLLFTICLLCGI

SEQ ID NO: 1892674 - protein, 18 aa, Staphylococcus
NSGHAWSLVSFIALPMIL

SEQ ID NO: 1892675 - protein, 23 aa, Staphylococcus
NSGYKKLLYWSLNHKWIVIIISI

SEQ ID NO: 1892676 - protein, 19 aa, Staphylococcus
NSHWIWWFNYCIIALLVVA

SEQ ID NO: 1892677 - protein, 19 aa, Staphylococcus
NSHWVWWLTYGVIALLLIT

SEQ ID NO: 1892678 - protein, 21 aa, Staphylococcus
NSVVIKLWLTIIFIVTTVLIL

SEQ ID NO: 1892679 - protein, 17 aa, Staphylococcus
NTCFNRWQFTTIMLAPL

SEQ ID NO: 1892680 - protein, 24 aa, Staphylococcus
NTGYFKYQYFNPLDAQQYYDNLDV

SEQ ID NO: 1892681 - protein, 24 aa, Staphylococcus
NTIFCLLGTLLIALGVNCFVIPGN

SEQ ID NO: 1892682 - protein, 25 aa, Staphylococcus
NTMNKRISFIFGIIVFIFAIIVLRL

SEQ ID NO: 1892683 - protein, 24 aa, Staphylococcus
NTNWDFIMVWLPLHAKLALWSVML

SEQ ID NO: 1892684 - protein, 22 aa, Staphylococcus
NTPTVHINSFWDFARGSNEYDR

SEQ ID NO: 1892685 - protein, 17 aa, Staphylococcus
NTTMDWDRRYPYGDTLR

SEQ ID NO: 1892686 - protein, 18 aa, Staphylococcus
NTWISIIMAFLFVMSPLY

SEQ ID NO: 1892687 - protein, 22 aa, Staphylococcus
NVLFYWDVFKIFSPLVWSLIFI

SEQ ID NO: 1892688 - protein, 19 aa, Staphylococcus
NVNHLVFANTSYEILGGGK

SEQ ID NO: 1892689 - protein, 24 aa, Staphylococcus
NVRMPRMIGGLIIGGALALAGLLM

SEQ ID NO: 1892690 - protein, 23 aa, Staphylococcus
NVRMPRMIGGLLIGGALALAGLL

SEQ ID NO: 1892691 - protein, 23 aa, Staphylococcus
NVRMPRMLAALFIGAALGVAGLL

SEQ ID NO: 1892692 - protein, 18 aa, Staphylococcus
NVSFCVAMAYSLASQIYL

SEQ ID NO: 1892693 - protein, 20 aa, Staphylococcus
NVSTEGWRSFNYVILPLILS

SEQ ID NO: 1892694 - protein, 18 aa, Staphylococcus
NVVYFRFFTDFLTFSTLN

SEQ ID NO: 1892695 - protein, 17 aa, Staphylococcus
NVWIFKFFVDVIGMNSF

SEQ ID NO: 1892696 - protein, 20 aa, Staphylococcus
NWINFCSWSLIIILSLLNVY

SEQ ID NO: 1892697 - protein, 23 aa, Staphylococcus
NYGNRTVPVISDINYLTKDFAEF

SEQ ID NO: 1892698 - protein, 17 aa, Staphylococcus
PAARVELDKALKRKQNE

SEQ ID NO: 1892699 - protein, 24 aa, Staphylococcus
PALYPNYWGGTKFPVKKRLEKLGY

SEQ ID NO: 1892700 - protein, 29 aa, Staphylococcus
PAPESIYFNWLWQREGWMIFIGWLSYFLL

SEQ ID NO: 1892701 - protein, 19 aa, Staphylococcus
PAVCALGLVFIRTHSRLSR

SEQ ID NO: 1892702 - protein, 17 aa, Staphylococcus
PCYLCAVLAIIYGFTGI

SEQ ID NO: 1892703 - protein, 18 aa, Staphylococcus
PDGSRKVFFNDGHTAILP

SEQ ID NO: 1892704 - protein, 17 aa, Staphylococcus
PDIRRAAKAIGVRVSNA

SEQ ID NO: 1892705 - protein, 18 aa, Staphylococcus
PDKDLILAILTGVIGSVV

SEQ ID NO: 1892706 - protein, 22 aa, Staphylococcus
PDKIKAAIFFGGFYDMKTVKAT

SEQ ID NO: 1892707 - protein, 22 aa, Staphylococcus
PDNRLDYITGILKSRALMYRNR

SEQ ID NO: 1892708 - protein, 22 aa, Staphylococcus
PDVKGREAILYVHARNKPLDET

SEQ ID NO: 1892709 - protein, 24 aa, Staphylococcus
PDVKICTNCGAPVNGSSNATQSTQ

SEQ ID NO: 1892710 - protein, 17 aa, Staphylococcus
PEFKKAMGILLISTIGY

SEQ ID NO: 1892711 - protein, 20 aa, Staphylococcus
PEFKKAMLILVISTIGYVGY

SEQ ID NO: 1892712 - protein, 18 aa, Staphylococcus
PEKRASAMALMFMGLSMS

SEQ ID NO: 1892713 - protein, 21 aa, Staphylococcus
PEQNGQLGAGVKPGTANPDQN

SEQ ID NO: 1892714 - protein, 20 aa, Staphylococcus
PETRYGMVTMCIGVGMGAAG

SEQ ID NO: 1892715 - protein, 17 aa, Staphylococcus
PFLLFALVCNILGTIYG

SEQ ID NO: 1892716 - protein, 18 aa, Staphylococcus
PFMLLKLIIVWTLVQFIE

SEQ ID NO: 1892717 - protein, 18 aa, Staphylococcus
PFMLLKLIVVWTLVQFIE

SEQ ID NO: 1892718 - protein, 17 aa, Staphylococcus
PGAVFWMWISAFLGASS

SEQ ID NO: 1892719 - protein, 19 aa, Staphylococcus
PGIVTILFLFSFIAQVLKV

SEQ ID NO: 1892720 - protein, 18 aa, Staphylococcus
PGTSRKPYRVNNIHDANG

SEQ ID NO: 1892721 - protein, 17 aa, Staphylococcus
PHYFKLEIVPIYYINSN

SEQ ID NO: 1892722 - protein, 24 aa, Staphylococcus
PIAACGLLAPWVAGAAMALSSVSV

SEQ ID NO: 1892723 - protein, 17 aa, Staphylococcus
PIAVAIVVAGLFLITGP

SEQ ID NO: 1892724 - protein, 19 aa, Staphylococcus
PIDFKKLMIVGAIISALTA

SEQ ID NO: 1892725 - protein, 23 aa, Staphylococcus
PIEIITEPYIKVEILDKDGHVIG

SEQ ID NO: 1892726 - protein, 18 aa, Staphylococcus
PIFYFKGLDLTYLEQHGF

SEQ ID NO: 1892727 - protein, 21 aa, Staphylococcus
PIGEIAIGLGLLFGVLSYTAS

SEQ ID NO: 1892728 - protein, 17 aa, Staphylococcus
PILIQMPILFGLYVSLK

SEQ ID NO: 1892729 - protein, 24 aa, Staphylococcus
PILYRFVKRIHLGWFVLPVPILLF

SEQ ID NO: 1892730 - protein, 25 aa, Staphylococcus
PILYRFVPRIHLGWFVLPVPIVLFI

SEQ ID NO: 1892731 - protein, 17 aa, Staphylococcus
PIMLLKLIIVWTAVQFI

SEQ ID NO: 1892732 - protein, 19 aa, Staphylococcus
PITNWRSKIGYVMQSNSMM

SEQ ID NO: 1892733 - protein, 18 aa, Staphylococcus
PIVVGIAIFTFIIWISLV

SEQ ID NO: 1892734 - protein, 18 aa, Staphylococcus
PIWFIFLFLFYKKYKKNA

SEQ ID NO: 1892735 - protein, 18 aa, Staphylococcus
PIYFRFTVYWPFFSDVFI

SEQ ID NO: 1892736 - protein, 23 aa, Staphylococcus
PKERLGAAVGWFWFVFTGGLSVF

SEQ ID NO: 1892737 - protein, 20 aa, Staphylococcus
PKFIGAVGWLLAKVTRQPKF

SEQ ID NO: 1892738 - protein, 17 aa, Staphylococcus
PKHMKYAVLATEDNRFY

SEQ ID NO: 1892739 - protein, 17 aa, Staphylococcus
PKIEAITPQARKKRSAI

SEQ ID NO: 1892740 - protein, 20 aa, Staphylococcus
PKIIGGIGFVLAKITRQPKF

SEQ ID NO: 1892741 - protein, 21 aa, Staphylococcus
PKIIGGIGWVLAKITRQPKFE

SEQ ID NO: 1892742 - protein, 23 aa, Staphylococcus
PKKAFEWPLFIVFGLIFLLLVPN

SEQ ID NO: 1892743 - protein, 21 aa, Staphylococcus
PKLIGAIGWVLAKITRQPKFE

SEQ ID NO: 1892744 - protein, 18 aa, Staphylococcus
PKLIPRRHCDYIYVAKQC

SEQ ID NO: 1892745 - protein, 18 aa, Staphylococcus
PKLKLFRRSLGLLTLGFL

SEQ ID NO: 1892746 - protein, 20 aa, Staphylococcus
PKLLGGIGIKTITFFLTTTA

SEQ ID NO: 1892747 - protein, 19 aa, Staphylococcus
PKLSLIVYLVMGWVGVIFL

SEQ ID NO: 1892748 - protein, 20 aa, Staphylococcus
PKMHIAMLIAALSMAGVPFL

SEQ ID NO: 1892749 - protein, 18 aa, Staphylococcus
PKTGATHFPPRGSQRRRR

SEQ ID NO: 1892750 - protein, 20 aa, Staphylococcus
PKVIGGIGWVLAKVTRQPKF

SEQ ID NO: 1892751 - protein, 18 aa, Staphylococcus
PKYLKRIVLATAISTLQG

SEQ ID NO: 1892752 - protein, 17 aa, Staphylococcus
PKYLTYFVLFMFAIFTI

SEQ ID NO: 1892753 - protein, 21 aa, Staphylococcus
PLDSPGGWQIIGRTPIRVFNK

SEQ ID NO: 1892754 - protein, 20 aa, Staphylococcus
PLFAWQFKRSVLWLYVIDLI

SEQ ID NO: 1892755 - protein, 19 aa, Staphylococcus
PLFRPIMRPLFTLPGRSAV

SEQ ID NO: 1892756 - protein, 18 aa, Staphylococcus
PLFTGRIVDKFSVSSINW

SEQ ID NO: 1892757 - protein, 19 aa, Staphylococcus
PLISFTFVSGLFLILRSMR

SEQ ID NO: 1892758 - protein, 22 aa, Staphylococcus
PLLTALGGIILLRRRRNNEIQD

SEQ ID NO: 1892759 - protein, 17 aa, Staphylococcus
PLMLLKLAVVWTLVQFI

SEQ ID NO: 1892760 - protein, 17 aa, Staphylococcus
PLPEIFMNPWFQFILAT

SEQ ID NO: 1892761 - protein, 17 aa, Staphylococcus
PLPKFWQTADGIKPSVA

SEQ ID NO: 1892762 - protein, 18 aa, Staphylococcus
PLSDWRNKIGYVMQSNAM

SEQ ID NO: 1892763 - protein, 18 aa, Staphylococcus
PLSIAYVIFIVFWQVGFS

SEQ ID NO: 1892764 - protein, 22 aa, Staphylococcus
PLSMGIVSMFLAITVVVQNISI

SEQ ID NO: 1892765 - protein, 17 aa, Staphylococcus
PLWSTWLLWGIVTIIII

SEQ ID NO: 1892766 - protein, 17 aa, Staphylococcus
PLWTFGFIFIIANIVTL

SEQ ID NO: 1892767 - protein, 18 aa, Staphylococcus
PLYYFGNVMKPLIWLMNG

SEQ ID NO: 1892768 - protein, 25 aa, Staphylococcus
PMASSLKWLIIYSIIFMLVIVGVVF

SEQ ID NO: 1892769 - protein, 17 aa, Staphylococcus
PMFRFGNGVSRNVILAA

SEQ ID NO: 1892770 - protein, 20 aa, Staphylococcus
PMIHYFSWLGLFIILILYMI

SEQ ID NO: 1892771 - protein, 19 aa, Staphylococcus
PMIRTTLFVTWLLPVGVAI

SEQ ID NO: 1892772 - protein, 18 aa, Staphylococcus
PMKGYVMRGGREMENHFE

SEQ ID NO: 1892773 - protein, 19 aa, Staphylococcus
PNCHTRFKPGMWSFIKARH

SEQ ID NO: 1892774 - protein, 18 aa, Staphylococcus
PNDATIVWLDFEDATSEE

SEQ ID NO: 1892775 - protein, 24 aa, Staphylococcus
PNDGEGFSVTSTFKVNGKVNEGDY

SEQ ID NO: 1892776 - protein, 19 aa, Staphylococcus
PNERIRFIAIQYLLDNVKI

SEQ ID NO: 1892777 - protein, 25 aa, Staphylococcus
PNFGGGLIGFYLFKLLIPLISIAGV

SEQ ID NO: 1892778 - protein, 21 aa, Staphylococcus
PNFGGGLIGFYLLKIFIPLIS

SEQ ID NO: 1892779 - protein, 23 aa, Staphylococcus
PNFGGGLLGHYLLSISIPLISIV

SEQ ID NO: 1892780 - protein, 22 aa, Staphylococcus
PNGKPMLIASFELSGTTSAWEL

SEQ ID NO: 1892781 - protein, 25 aa, Staphylococcus
PNIIFDIGFQFSFLITFFILISSPI

SEQ ID NO: 1892782 - protein, 26 aa, Staphylococcus
PPIFSLGTWGEWFYKGLELLVIACPC

SEQ ID NO: 1892783 - protein, 26 aa, Staphylococcus
PPPRKKFPWFRVVLIALLSGIIGALL

SEQ ID NO: 1892784 - protein, 24 aa, Staphylococcus
PPQRLASAMGWFWAMYSVGIGVLG

SEQ ID NO: 1892785 - protein, 22 aa, Staphylococcus
PPSRIRYAFIMTMCGIHGTISL

SEQ ID NO: 1892786 - protein, 18 aa, Staphylococcus
PPWKRFLSHFSFYAIALQ

SEQ ID NO: 1892787 - protein, 18 aa, Staphylococcus
PPWKRFLTHFSFYAIAIQ

SEQ ID NO: 1892788 - protein, 25 aa, Staphylococcus
PQVFKAVMIPLFIIIAMCFIHLNTA

SEQ ID NO: 1892789 - protein, 22 aa, Staphylococcus
PQVFKSMMIPVAIIVAMCYVHL

SEQ ID NO: 1892790 - protein, 21 aa, Staphylococcus
PRFYLWLIIGLIFGFAPPLQT

SEQ ID NO: 1892791 - protein, 21 aa, Staphylococcus
PRGLGVLFFVEFWERFSYYGM

SEQ ID NO: 1892792 - protein, 20 aa, Staphylococcus
PRKPMSPLAWVIIALLIAIA

SEQ ID NO: 1892793 - protein, 21 aa, Staphylococcus
PRKSASILDIFGGCFQGLLPY

SEQ ID NO: 1892794 - protein, 20 aa, Staphylococcus
PRKSASILDIFGSCFQGLLP

SEQ ID NO: 1892795 - protein, 21 aa, Staphylococcus
PRKSASILDMFASCFQGLLPY

SEQ ID NO: 1892796 - protein, 21 aa, Staphylococcus
PRKSASLLDIFAGCFQGLLPY

SEQ ID NO: 1892797 - protein, 18 aa, Staphylococcus
PRLKLLRRAIFLLILGFI

SEQ ID NO: 1892798 - protein, 17 aa, Staphylococcus
PRSVIIGVILQFTIMPT

SEQ ID NO: 1892799 - protein, 18 aa, Staphylococcus
PRTNLKFITFNKIGETNK

SEQ ID NO: 1892800 - protein, 19 aa, Staphylococcus
PSDYPILFKVMDDFYQHIP

SEQ ID NO: 1892801 - protein, 23 aa, Staphylococcus
PSFYAWFNLWAMWDPYGNTGHIK

SEQ ID NO: 1892802 - protein, 25 aa, Staphylococcus
PSIVWPRYTDLASLTKSVTRTIKYV

SEQ ID NO: 1892803 - protein, 24 aa, Staphylococcus
PSIYYRPKYFFTISGLRSRMNSNS

SEQ ID NO: 1892804 - protein, 28 aa, Staphylococcus
PSKKRFKPKFPWFKTIIVALVAGIIGAL

SEQ ID NO: 1892805 - protein, 20 aa, Staphylococcus
PSKRLRFIAIQYLLDNPEIE

SEQ ID NO: 1892806 - protein, 17 aa, Staphylococcus
PSLPIKFVIGAGLAGIS

SEQ ID NO: 1892807 - protein, 17 aa, Staphylococcus
PSNGRWYDHIGIDKDRR

SEQ ID NO: 1892808 - protein, 22 aa, Staphylococcus
PSQIKAAIFFGGFYDMKTVKAT

SEQ ID NO: 1892809 - protein, 22 aa, Staphylococcus
PSQIKAAIFFGGFYDMKTVKST

SEQ ID NO: 1892810 - protein, 17 aa, Staphylococcus
PSTLPNWFVAGVNYASF

SEQ ID NO: 1892811 - protein, 17 aa, Staphylococcus
PTSIWRITRKSAAAQSP

SEQ ID NO: 1892812 - protein, 20 aa, Staphylococcus
PVAIAMRLTKGFKQLIILSI

SEQ ID NO: 1892813 - protein, 20 aa, Staphylococcus
PVFAGVIVLLAFVLLVFVFR

SEQ ID NO: 1892814 - protein, 19 aa, Staphylococcus
PVILVPLIVERKRIKDHPD

SEQ ID NO: 1892815 - protein, 18 aa, Staphylococcus
PVLLYALLVFIVGNMIIA

SEQ ID NO: 1892816 - protein, 19 aa, Staphylococcus
PVSTLRAGLIIGAKGSSYP

SEQ ID NO: 1892817 - protein, 18 aa, Staphylococcus
PVWFKYRNKYGFPLNAFL

SEQ ID NO: 1892818 - protein, 17 aa, Staphylococcus
PVWKLVFIWFIRVALTL

SEQ ID NO: 1892819 - protein, 17 aa, Staphylococcus
PWLPAAIGFILGGFFIR

SEQ ID NO: 1892820 - protein, 18 aa, Staphylococcus
QALKLFWKNYVNFKGRSR

SEQ ID NO: 1892821 - protein, 26 aa, Staphylococcus
QAVKQHWMPIALVIAIIGGSMIWFSQ

SEQ ID NO: 1892822 - protein, 20 aa, Staphylococcus
QDFYRLFRKQSFNNEYLDYL

SEQ ID NO: 1892823 - protein, 22 aa, Staphylococcus
QESFKVPIWLGALIMTVVIYGT

SEQ ID NO: 1892824 - protein, 19 aa, Staphylococcus
QFIPEFIGSVVIAIIAVAG

SEQ ID NO: 1892825 - protein, 23 aa, Staphylococcus
QFIPEFMGALVIGLVTIIGHNLI

SEQ ID NO: 1892826 - protein, 18 aa, Staphylococcus
QGAVIAIIIGIVISTIVL

SEQ ID NO: 1892827 - protein, 25 aa, Staphylococcus
QGDHPLRYILAIAIFVIIVLGAFQL

SEQ ID NO: 1892828 - protein, 17 aa, Staphylococcus
QGGNGLGLFIAEKIVQQ

SEQ ID NO: 1892829 - protein, 19 aa, Staphylococcus
QGIPAWVWSCIFLVIIFAL

SEQ ID NO: 1892830 - protein, 32 aa, Staphylococcus
QHDFGHTTFYLSFGVRPGRSFNSDANEYFHSN

SEQ ID NO: 1892831 - protein, 21 aa, Staphylococcus
QHGDLKFSRIVGMAGESVEVK

SEQ ID NO: 1892832 - protein, 18 aa, Staphylococcus
QHLSGSMDSSEFINSNQS

SEQ ID NO: 1892833 - protein, 17 aa, Staphylococcus
QIFSLRYFKMFADSIWY

SEQ ID NO: 1892834 - protein, 22 aa, Staphylococcus
QIIYDIGFQFSFLISLFLIISS

SEQ ID NO: 1892835 - protein, 24 aa, Staphylococcus
QINIWKSLLAWRVTIFMGAQSLIF

SEQ ID NO: 1892836 - protein, 18 aa, Staphylococcus
QIYIPGYNIPFLIQPASA

SEQ ID NO: 1892837 - protein, 19 aa, Staphylococcus
QKIELGFFITFNFISALIF

SEQ ID NO: 1892838 - protein, 22 aa, Staphylococcus
QKMLRMVFILLAIVGAALTVFA

SEQ ID NO: 1892839 - protein, 20 aa, Staphylococcus
QKTNRLLMTLGTSIIAIFIG

SEQ ID NO: 1892840 - protein, 26 aa, Staphylococcus
QKTRKSKKWLIAIIVILLIIVAIFVT

SEQ ID NO: 1892841 - protein, 18 aa, Staphylococcus
QLAGLKFSFSLKVIERIL

SEQ ID NO: 1892842 - protein, 27 aa, Staphylococcus
QLHSIRKFKVGTASILIGVTLIFGVPK

SEQ ID NO: 1892843 - protein, 19 aa, Staphylococcus
QLLTKWKTHIIILIAVVLL

SEQ ID NO: 1892844 - protein, 17 aa, Staphylococcus
QLNFPIVSSNIYKNGKR

SEQ ID NO: 1892845 - protein, 19 aa, Staphylococcus
QLPLALPMIISGIRLSSVY

SEQ ID NO: 1892846 - protein, 19 aa, Staphylococcus
QLRIYEMIPIFSFLFQRGK

SEQ ID NO: 1892847 - protein, 26 aa, Staphylococcus
QMAAWGWRIPFFFGLILGFVGLYLRT

SEQ ID NO: 1892848 - protein, 18 aa, Staphylococcus
QMLFGFRTDLAYAIADDN

SEQ ID NO: 1892849 - protein, 22 aa, Staphylococcus
QMLPEFYRKYIVGWNPFSHYAH

SEQ ID NO: 1892850 - protein, 26 aa, Staphylococcus
QMQSWGWRIPFILGLFLGLFGLYLRR

SEQ ID NO: 1892851 - protein, 18 aa, Staphylococcus
QNINLHFHSRFALNILLT

SEQ ID NO: 1892852 - protein, 17 aa, Staphylococcus
QNPGEQHLSGSMDSSEF

SEQ ID NO: 1892853 - protein, 18 aa, Staphylococcus
QNRMSALFLKRLYYVAFK

SEQ ID NO: 1892854 - protein, 19 aa, Staphylococcus
QPAYRASAMALMFMGLSLS

SEQ ID NO: 1892855 - protein, 28 aa, Staphylococcus
QPFNHSWAQGMNFEWGDNLGTPSSRTPG

SEQ ID NO: 1892856 - protein, 19 aa, Staphylococcus
QPFTKRYFSLIIMMAIITF

SEQ ID NO: 1892857 - protein, 25 aa, Staphylococcus
QPGKPKFPWFKTIIVALIAGVIGAL

SEQ ID NO: 1892858 - protein, 19 aa, Staphylococcus
QQAFSFKLLFSLIIVGLLV

SEQ ID NO: 1892859 - protein, 21 aa, Staphylococcus
QRIGKCFALLQLTGEILNDID

SEQ ID NO: 1892860 - protein, 17 aa, Staphylococcus
QRIPSIYYRPKYFFTIS

SEQ ID NO: 1892861 - protein, 19 aa, Staphylococcus
QRIVIKWAIGSSLFMIIVA

SEQ ID NO: 1892862 - protein, 20 aa, Staphylococcus
QRKFWYSFGLIFGGLGLISM

SEQ ID NO: 1892863 - protein, 19 aa, Staphylococcus
QRKIDVEPVFGFMKAILGF

SEQ ID NO: 1892864 - protein, 19 aa, Staphylococcus
QRLDQVVKMVRGKRGTTVT

SEQ ID NO: 1892865 - protein, 17 aa, Staphylococcus
QRLGDILAYKVKHDLRQ

SEQ ID NO: 1892866 - protein, 20 aa, Staphylococcus
QRLHFYAAIFITPLLITLTL

SEQ ID NO: 1892867 - protein, 21 aa, Staphylococcus
QRLHFYAALFITPLLITLTIS

SEQ ID NO: 1892868 - protein, 18 aa, Staphylococcus
QRMIITWVITLPISALLA

SEQ ID NO: 1892869 - protein, 19 aa, Staphylococcus
QRMLITWVITLPISAVLAA

SEQ ID NO: 1892870 - protein, 22 aa, Staphylococcus
QRWFPEIPEYIFAASAIILVLI

SEQ ID NO: 1892871 - protein, 23 aa, Staphylococcus
QSIKDIESILSLISKKPQAKLEV

SEQ ID NO: 1892872 - protein, 18 aa, Staphylococcus
QSKCGHCGYEVTDNHSEQ

SEQ ID NO: 1892873 - protein, 25 aa, Staphylococcus
QSKFFSQIESISFDGTNMITDNNGQ

SEQ ID NO: 1892874 - protein, 24 aa, Staphylococcus
QSKLIPIFICIFTFLLMVIQSQFL

SEQ ID NO: 1892875 - protein, 17 aa, Staphylococcus
QSLDMFLNIILKESNRI

SEQ ID NO: 1892876 - protein, 23 aa, Staphylococcus
QSLKRLKLILLLKELELSLDDIK

SEQ ID NO: 1892877 - protein, 17 aa, Staphylococcus
QSLRKAYSFMMIATVGG

SEQ ID NO: 1892878 - protein, 18 aa, Staphylococcus
QSMTLRLGIATSHDLAQM

SEQ ID NO: 1892879 - protein, 19 aa, Staphylococcus
QSVPAWVWSCIFLVIIFAL

SEQ ID NO: 1892880 - protein, 17 aa, Staphylococcus
QSWTIYYWGWWMSWSPF

SEQ ID NO: 1892881 - protein, 27 aa, Staphylococcus
QTGFISSILLFLGGLLFLNRRRSKKED

SEQ ID NO: 1892882 - protein, 22 aa, Staphylococcus
QTMWKYLLVIVIIFVLFLVMIS

SEQ ID NO: 1892883 - protein, 18 aa, Staphylococcus
QTPEGYTPTKSYQGMNTE

SEQ ID NO: 1892884 - protein, 29 aa, Staphylococcus
QVFKSMMIPLMIIVAMCFIHLNTALIMIV

SEQ ID NO: 1892885 - protein, 17 aa, Staphylococcus
QVFWRILIFYILAIFVI

SEQ ID NO: 1892886 - protein, 18 aa, Staphylococcus
QVFWRILLFYILAIFIIG

SEQ ID NO: 1892887 - protein, 18 aa, Staphylococcus
QVFWRILLFYVLSIAVIA

SEQ ID NO: 1892888 - protein, 21 aa, Staphylococcus
QVIDARLGYYSVVKETNVQLL

SEQ ID NO: 1892889 - protein, 23 aa, Staphylococcus
QVLKAVTAFAGWVAKLFETHPAV

SEQ ID NO: 1892890 - protein, 23 aa, Staphylococcus
QVNRLGIPLSIFFGGVKMMMPNM

SEQ ID NO: 1892891 - protein, 25 aa, Staphylococcus
QVSKSIRIGFDMDKKSGDRVTDIQI

SEQ ID NO: 1892892 - protein, 18 aa, Staphylococcus
QVWKRLTAAIIIFSASHL

SEQ ID NO: 1892893 - protein, 28 aa, Staphylococcus
QWIKFAWKLIVIWVLICAIAMSIALFVG

SEQ ID NO: 1892894 - protein, 18 aa, Staphylococcus
QYLIWSIFRLISGITSGT

SEQ ID NO: 1892895 - protein, 17 aa, Staphylococcus
RAAILFHEWYFIQHWRL

SEQ ID NO: 1892896 - protein, 27 aa, Staphylococcus
RAGIMCPEFAIGMGPKIFSFRKNETLY

SEQ ID NO: 1892897 - protein, 17 aa, Staphylococcus
RAIKRLPIGMVVLDADD

SEQ ID NO: 1892898 - protein, 24 aa, Staphylococcus
RALEFRQLFNYNQLYVEPMKEYQN

SEQ ID NO: 1892899 - protein, 17 aa, Staphylococcus
RALSFWSIGSWGGSGFA

SEQ ID NO: 1892900 - protein, 19 aa, Staphylococcus
RAQIELTILFSLFAIISNF

SEQ ID NO: 1892901 - protein, 19 aa, Staphylococcus
RASLQYSFFMNFLAAFIAC

SEQ ID NO: 1892902 - protein, 18 aa, Staphylococcus
RDATTRPGVQSVAKLANQ

SEQ ID NO: 1892903 - protein, 17 aa, Staphylococcus
RDNKIHFSRIVGKPGES

SEQ ID NO: 1892904 - protein, 26 aa, Staphylococcus
RDTRAHASSIQFVRAELAGFGGFGGY

SEQ ID NO: 1892905 - protein, 17 aa, Staphylococcus
REFLLIFFVSILMVLGG

SEQ ID NO: 1892906 - protein, 20 aa, Staphylococcus
REGVEVIIFYMGMMGSIKTL

SEQ ID NO: 1892907 - protein, 20 aa, Staphylococcus
REIQSLKSNVGWKEMHDNVD

SEQ ID NO: 1892908 - protein, 21 aa, Staphylococcus
RENYGTLGIEFFKQYQSKKDK

SEQ ID NO: 1892909 - protein, 20 aa, Staphylococcus
REPLPLGKIYARATDGAETP

SEQ ID NO: 1892910 - protein, 27 aa, Staphylococcus
RFDFLPNRLNKYSIRKFTNGIASVLIG

SEQ ID NO: 1892911 - protein, 26 aa, Staphylococcus
RFDLKRIAKTPAVWIIIAGLAILPSF

SEQ ID NO: 1892912 - protein, 20 aa, Staphylococcus
RFEHAGALPLIIGLFSLMAF

SEQ ID NO: 1892913 - protein, 25 aa, Staphylococcus
RFFWLICSLAVLILAVFIFTFFNDR

SEQ ID NO: 1892914 - protein, 26 aa, Staphylococcus
RFIVKLIPVRFIFRVLSILIFVMTFK

SEQ ID NO: 1892915 - protein, 18 aa, Staphylococcus
RFKALILLCIMFSICWIA

SEQ ID NO: 1892916 - protein, 18 aa, Staphylococcus
RFNLNFIINFFVYLCMYL

SEQ ID NO: 1892917 - protein, 23 aa, Staphylococcus
RFSARSVLLWTLLIFIIGNAMIA

SEQ ID NO: 1892918 - protein, 21 aa, Staphylococcus
RFSIGLLVFVCIWTFLLSLLI

SEQ ID NO: 1892919 - protein, 19 aa, Staphylococcus
RFSPRPVLLYALLVFIVGN

SEQ ID NO: 1892920 - protein, 17 aa, Staphylococcus
RFVSRLFIATGFVLLVL

SEQ ID NO: 1892921 - protein, 24 aa, Staphylococcus
RFYDHGALDYKRLFGAVGKNLTGG

SEQ ID NO: 1892922 - protein, 24 aa, Staphylococcus
RFYEHGALDYKRLFGAVGKNLTGG

SEQ ID NO: 1892923 - protein, 19 aa, Staphylococcus
RFYREVNSATQIVHENIVE

SEQ ID NO: 1892924 - protein, 18 aa, Staphylococcus
RFYSCFFIGVIITGLLKM

SEQ ID NO: 1892925 - protein, 18 aa, Staphylococcus
RGGPAFYIEYGIKGKLGK

SEQ ID NO: 1892926 - protein, 18 aa, Staphylococcus
RGIENINMFTFIQLLTPF

SEQ ID NO: 1892927 - protein, 18 aa, Staphylococcus
RGIENINMFTFLQLLTPF

SEQ ID NO: 1892928 - protein, 21 aa, Staphylococcus
RGNELTKFLALLMLVNGVAPV

SEQ ID NO: 1892929 - protein, 22 aa, Staphylococcus
RGQGLPAPFWSYLQKLNFGKVK

SEQ ID NO: 1892930 - protein, 17 aa, Staphylococcus
RGWSGGFGNHVEITNGS

SEQ ID NO: 1892931 - protein, 22 aa, Staphylococcus
RGYKKVLKWSLNHKWIVLILTT

SEQ ID NO: 1892932 - protein, 24 aa, Staphylococcus
RHGLKNWLTLVVVIAFILFIILLF

SEQ ID NO: 1892933 - protein, 18 aa, Staphylococcus
RHVAIMIGIVIAWTCYDR

SEQ ID NO: 1892934 - protein, 25 aa, Staphylococcus
RIAYSKLKFERRVGEFVENMRDFSI

SEQ ID NO: 1892935 - protein, 21 aa, Staphylococcus
RICIILAISLVVAIAFFFAMK

SEQ ID NO: 1892936 - protein, 24 aa, Staphylococcus
RIDRFKIAFDMFKDSPIYGKGIDS

SEQ ID NO: 1892937 - protein, 20 aa, Staphylococcus
RIENRWIVFLIFLISSIIVL

SEQ ID NO: 1892938 - protein, 19 aa, Staphylococcus
RIGEELSQFYLGIINNLIR

SEQ ID NO: 1892939 - protein, 19 aa, Staphylococcus
RIGETFFSYLIWYSIGRFF

SEQ ID NO: 1892940 - protein, 17 aa, Staphylococcus
RIHICIVALPPLLAFIG

SEQ ID NO: 1892941 - protein, 17 aa, Staphylococcus
RIHLGWFVLPIPVVLFI

SEQ ID NO: 1892942 - protein, 17 aa, Staphylococcus
RIIFKYRYDIVSRWEKF

SEQ ID NO: 1892943 - protein, 23 aa, Staphylococcus
RIISRWATEYNIYFKRYSSDQFV

SEQ ID NO: 1892944 - protein, 18 aa, Staphylococcus
RIKLLSLRPHYKVYLDKT

SEQ ID NO: 1892945 - protein, 22 aa, Staphylococcus
RILFDNRLNGMGPYPTGKLSAM

SEQ ID NO: 1892946 - protein, 18 aa, Staphylococcus
RILKEIILPQALRNSIPN

SEQ ID NO: 1892947 - protein, 19 aa, Staphylococcus
RIVYPVIHLFVVILSPITK

SEQ ID NO: 1892948 - protein, 19 aa, Staphylococcus
RKDFWWPVLFNMICLLMIA

SEQ ID NO: 1892949 - protein, 18 aa, Staphylococcus
RKDGLTWSLSKEITGITI

SEQ ID NO: 1892950 - protein, 17 aa, Staphylococcus
RKIEAIVGTLIFTVLVI

SEQ ID NO: 1892951 - protein, 19 aa, Staphylococcus
RKIGFPIFILIGLLFIYNQ

SEQ ID NO: 1892952 - protein, 19 aa, Staphylococcus
RKIWVAVKFLVVYLYQLIT

SEQ ID NO: 1892953 - protein, 18 aa, Staphylococcus
RKKILSIVLYCFILVVSF

SEQ ID NO: 1892954 - protein, 17 aa, Staphylococcus
RKLKGLKPLKVNNDIAH

SEQ ID NO: 1892955 - protein, 18 aa, Staphylococcus
RKNIRWQYIGLLLVIQLV

SEQ ID NO: 1892956 - protein, 26 aa, Staphylococcus
RKQKRNWWLRLSFIVLSIVGLGLTLF

SEQ ID NO: 1892957 - protein, 30 aa, Staphylococcus
RKRLEFYRLYLFMVHLLKFGGMYASSVNRS

SEQ ID NO: 1892958 - protein, 26 aa, Staphylococcus
RKSNKGKKWLAAIVVILLIVVAIFIV

SEQ ID NO: 1892959 - protein, 19 aa, Staphylococcus
RKVKNIGMILFGFGALFYG

SEQ ID NO: 1892960 - protein, 20 aa, Staphylococcus
RLEQTRNSLANVITRSQSGK

SEQ ID NO: 1892961 - protein, 19 aa, Staphylococcus
RLFAEKIIKLFEVEDNIEE

SEQ ID NO: 1892962 - protein, 21 aa, Staphylococcus
RLFGELEFWFSIIKIVTIIAM

SEQ ID NO: 1892963 - protein, 21 aa, Staphylococcus
RLFGELEFWFSIIKVVTIVAM

SEQ ID NO: 1892964 - protein, 19 aa, Staphylococcus
RLFIATGFVLLVLALLQVI

SEQ ID NO: 1892965 - protein, 18 aa, Staphylococcus
RLFMLLTLFTGFWELIKE

SEQ ID NO: 1892966 - protein, 18 aa, Staphylococcus
RLFWAFALCLLPFSLMLV

SEQ ID NO: 1892967 - protein, 18 aa, Staphylococcus
RLGLKQAKISAVVQPISG

SEQ ID NO: 1892968 - protein, 19 aa, Staphylococcus
RLLLYFVIFVAMFSFLNLM

SEQ ID NO: 1892969 - protein, 19 aa, Staphylococcus
RLLPVGGYVRMAGDGIDEV

SEQ ID NO: 1892970 - protein, 19 aa, Staphylococcus
RLLPVGGYVRMAGDGLEEL

SEQ ID NO: 1892971 - protein, 23 aa, Staphylococcus
RLNSVVIKLWLTIIFIVTTVLIL

SEQ ID NO: 1892972 - protein, 17 aa, Staphylococcus
RLPSWAIGFSIYATTLS

SEQ ID NO: 1892973 - protein, 18 aa, Staphylococcus
RLPSWAIGFSIYATTLSA

SEQ ID NO: 1892974 - protein, 20 aa, Staphylococcus
RLTPLFAVSEGWIWTITLVG

SEQ ID NO: 1892975 - protein, 23 aa, Staphylococcus
RLTPRLLAIYLFILVITAILTYV

SEQ ID NO: 1892976 - protein, 18 aa, Staphylococcus
RLVSCLLILFLGSAIFSI

SEQ ID NO: 1892977 - protein, 18 aa, Staphylococcus
RLVSCLLILFLGSAIFSL

SEQ ID NO: 1892978 - protein, 19 aa, Staphylococcus
RLYWAFALCLLPFALMLVG

SEQ ID NO: 1892979 - protein, 17 aa, Staphylococcus
RMIITWIITLPISAILA

SEQ ID NO: 1892980 - protein, 18 aa, Staphylococcus
RMLVEGVITKKTYQQAKQ

SEQ ID NO: 1892981 - protein, 21 aa, Staphylococcus
RMNIVGWARFGLAAFKETLNV

SEQ ID NO: 1892982 - protein, 17 aa, Staphylococcus
RNAICLGLWLFSFILGW

SEQ ID NO: 1892983 - protein, 18 aa, Staphylococcus
RNKLKFSLIIGILVLISY

SEQ ID NO: 1892984 - protein, 17 aa, Staphylococcus
RNLPRAIPLAILVIGIV

SEQ ID NO: 1892985 - protein, 19 aa, Staphylococcus
RNLYRFVNRYGKFLRVKTK

SEQ ID NO: 1892986 - protein, 26 aa, Staphylococcus
RPDTKYGMVSMCIGAGMGAAGIFEYV

SEQ ID NO: 1892987 - protein, 19 aa, Staphylococcus
RPHIKRYVALVGTIITLII

SEQ ID NO: 1892988 - protein, 18 aa, Staphylococcus
RPKALAYINSLDKINDAQ

SEQ ID NO: 1892989 - protein, 19 aa, Staphylococcus
RPLYYFGNVMKPLIWLMNG

SEQ ID NO: 1892990 - protein, 28 aa, Staphylococcus
RPPKPKFPWFRIIIIALIAGIIGALIVL

SEQ ID NO: 1892991 - protein, 19 aa, Staphylococcus
RPRHEPAYEKRDRELAEEE

SEQ ID NO: 1892992 - protein, 26 aa, Staphylococcus
RPSSNHKKPAWLFVVIGLVIALLISG

SEQ ID NO: 1892993 - protein, 17 aa, Staphylococcus
RPVEIIKFLAITLLILI

SEQ ID NO: 1892994 - protein, 24 aa, Staphylococcus
RPVIKRYVALIGCVLTLVAAIVNF

SEQ ID NO: 1892995 - protein, 26 aa, Staphylococcus
RQKKSKKWLYIIIALLLIVVAVFVTL

SEQ ID NO: 1892996 - protein, 23 aa, Staphylococcus
RQKRIQYVIITFLVLLIILFLLY

SEQ ID NO: 1892997 - protein, 23 aa, Staphylococcus
RQQWLRFSFVLLAIVGIALAVFS

SEQ ID NO: 1892998 - protein, 21 aa, Staphylococcus
RQREFAVYMILGMEKKHIKVS

SEQ ID NO: 1892999 - protein, 23 aa, Staphylococcus
RQSFNIPALKAWQQTKEHAGNDA

SEQ ID NO: 1893000 - protein, 20 aa, Staphylococcus
RQSFNIPALKTWQATRSQAG

SEQ ID NO: 1893001 - protein, 20 aa, Staphylococcus
RQSFNIPALKTWQQVKKQAG

SEQ ID NO: 1893002 - protein, 19 aa, Staphylococcus
RQSFNIPALKTWQQVNSQA

SEQ ID NO: 1893003 - protein, 21 aa, Staphylococcus
RQVFWRILLFYVLSIAVISAI

SEQ ID NO: 1893004 - protein, 22 aa, Staphylococcus
RRAEYWWCVLWAAFLFLPLLGL

SEQ ID NO: 1893005 - protein, 18 aa, Staphylococcus
RRDCKIHGAFKFNGEGIS

SEQ ID NO: 1893006 - protein, 20 aa, Staphylococcus
RRGIENINMFTFIQLVTPFI

SEQ ID NO: 1893007 - protein, 18 aa, Staphylococcus
RRRLILLYLITLLFIFPL

SEQ ID NO: 1893008 - protein, 19 aa, Staphylococcus
RRRQKELAMNMILGMEKKH

SEQ ID NO: 1893009 - protein, 25 aa, Staphylococcus
RRRVIRRRITLFGGILLAIIIILCI

SEQ ID NO: 1893010 - protein, 17 aa, Staphylococcus
RRSEPRVRIAAGSVGIA

SEQ ID NO: 1893011 - protein, 17 aa, Staphylococcus
RRSWVSLIIQIIIFILV

SEQ ID NO: 1893012 - protein, 17 aa, Staphylococcus
RRTREFALFQLIGLTRQ

SEQ ID NO: 1893013 - protein, 18 aa, Staphylococcus
RRVGLKWQDLEEGITKRL

SEQ ID NO: 1893014 - protein, 17 aa, Staphylococcus
RRYLIFDNMSFTAPTKE

SEQ ID NO: 1893015 - protein, 17 aa, Staphylococcus
RRYRNVFLFMVIVGLFG

SEQ ID NO: 1893016 - protein, 22 aa, Staphylococcus
RRYSVFCAFFFFLGIAFAYFIG

SEQ ID NO: 1893017 - protein, 17 aa, Staphylococcus
RRYYWRFELGMQMVLNI

SEQ ID NO: 1893018 - protein, 19 aa, Staphylococcus
RSAFLSGLMLEFISLLGIG

SEQ ID NO: 1893019 - protein, 17 aa, Staphylococcus
RSHEIMSIFGVQTKYSI

SEQ ID NO: 1893020 - protein, 17 aa, Staphylococcus
RSKRLTVVTNVDNWHSY

SEQ ID NO: 1893021 - protein, 18 aa, Staphylococcus
RSLLHISTIALSGLLFTN

SEQ ID NO: 1893022 - protein, 22 aa, Staphylococcus
RSLLWEHMIKLKMPFFDKNESG

SEQ ID NO: 1893023 - protein, 19 aa, Staphylococcus
RSQWQLLIIFGLFAITSNF

SEQ ID NO: 1893024 - protein, 19 aa, Staphylococcus
RSQWQLTILFALFAITSNF

SEQ ID NO: 1893025 - protein, 20 aa, Staphylococcus
RSSPWFPFAVVCILIGAFTK

SEQ ID NO: 1893026 - protein, 19 aa, Staphylococcus
RTDTKFNIKVVDTTAPTVK

SEQ ID NO: 1893027 - protein, 17 aa, Staphylococcus
RTFLAVLLICLLGISIT

SEQ ID NO: 1893028 - protein, 20 aa, Staphylococcus
RTIIKIIGFLFIAFIVLLLL

SEQ ID NO: 1893029 - protein, 21 aa, Staphylococcus
RTIIKIIGFLLIAFIVLVLLG

SEQ ID NO: 1893030 - protein, 17 aa, Staphylococcus
RTLILTAILTLLSGAAF

SEQ ID NO: 1893031 - protein, 19 aa, Staphylococcus
RTLTLFFPKADWAQNIAEY

SEQ ID NO: 1893032 - protein, 19 aa, Staphylococcus
RTLTLFFPKADWAQTISEY

SEQ ID NO: 1893033 - protein, 19 aa, Staphylococcus
RTLTLFFPKADWAQTISQT

SEQ ID NO: 1893034 - protein, 19 aa, Staphylococcus
RTLTLFFPKAEWAQNIADT

SEQ ID NO: 1893035 - protein, 19 aa, Staphylococcus
RTLTLFFPKAEWAQQIADT

SEQ ID NO: 1893036 - protein, 19 aa, Staphylococcus
RTNIISGVATKVGTYPIVV

SEQ ID NO: 1893037 - protein, 19 aa, Staphylococcus
RTRISMFIWLVLLLPLPFL

SEQ ID NO: 1893038 - protein, 18 aa, Staphylococcus
RTTLTYIVGVCFLFISIY

SEQ ID NO: 1893039 - protein, 19 aa, Staphylococcus
RTTRNAFFIGRTGDYNVSL

SEQ ID NO: 1893040 - protein, 22 aa, Staphylococcus
RTVEHILTWLGVVLQALAAIMF

SEQ ID NO: 1893041 - protein, 21 aa, Staphylococcus
RTVNIPVMVYPTVSAVTPNRD

SEQ ID NO: 1893042 - protein, 20 aa, Staphylococcus
RTWTRFGRRMPYLLIAGPIG

SEQ ID NO: 1893043 - protein, 21 aa, Staphylococcus
RTYRFKLSYLYNISIILLSIL

SEQ ID NO: 1893044 - protein, 18 aa, Staphylococcus
RVGLKWKDLEEGITHRLT

SEQ ID NO: 1893045 - protein, 17 aa, Staphylococcus
RVGSFSIVFLIMNPLLF

SEQ ID NO: 1893046 - protein, 24 aa, Staphylococcus
RVISRWASEYDIFFKRYSSDQFVA

SEQ ID NO: 1893047 - protein, 19 aa, Staphylococcus
RVNFKIVLPGAILTIIILF

SEQ ID NO: 1893048 - protein, 19 aa, Staphylococcus
RVPRWGSITIIFVILIGII

SEQ ID NO: 1893049 - protein, 20 aa, Staphylococcus
RVRFEMIDFGKGIPEEERHL

SEQ ID NO: 1893050 - protein, 18 aa, Staphylococcus
RVRKLPFIILFILIILIV

SEQ ID NO: 1893051 - protein, 17 aa, Staphylococcus
RVYRTEIEMEQDLNQLG

SEQ ID NO: 1893052 - protein, 18 aa, Staphylococcus
RYAIIIVYLRIRSVFSSV

SEQ ID NO: 1893053 - protein, 17 aa, Staphylococcus
RYEVIKKLGGGGMSTVY

SEQ ID NO: 1893054 - protein, 27 aa, Staphylococcus
RYFVQRGGRVEYHFSVPVRDWNGDLSF

SEQ ID NO: 1893055 - protein, 18 aa, Staphylococcus
RYGAWAVLLCRFIPVLRV

SEQ ID NO: 1893056 - protein, 22 aa, Staphylococcus
RYNIPRLLGIIIVFLAIVGGAT

SEQ ID NO: 1893057 - protein, 18 aa, Staphylococcus
RYPARPVLLWTLVIFVVG

SEQ ID NO: 1893058 - protein, 17 aa, Staphylococcus
RYYPNFFHQTGQGKTSD

SEQ ID NO: 1893059 - protein, 19 aa, Staphylococcus
SAFNVKWGWLILRVLAVCF

SEQ ID NO: 1893060 - protein, 18 aa, Staphylococcus
SAGFKWFFAYPEQKIETV

SEQ ID NO: 1893061 - protein, 22 aa, Staphylococcus
SAILVAIGWRLIWKRQIDKHKK

SEQ ID NO: 1893062 - protein, 17 aa, Staphylococcus
SAKDFILGIGIALVILA

SEQ ID NO: 1893063 - protein, 18 aa, Staphylococcus
SALFLKRLYYVAFKLVVF

SEQ ID NO: 1893064 - protein, 19 aa, Staphylococcus
SALKDLKIPLSIAGQGQSS

SEQ ID NO: 1893065 - protein, 26 aa, Staphylococcus
SALKQLKAINVVAVVKPEARNTIANL

SEQ ID NO: 1893066 - protein, 17 aa, Staphylococcus
SALRYYFWLTILVIILV

SEQ ID NO: 1893067 - protein, 28 aa, Staphylococcus
SANIKARKIIPWGIAFFIIILLIIIFFL

SEQ ID NO: 1893068 - protein, 24 aa, Staphylococcus
SAPQKRWHFILAFNSTLLIGLFLK

SEQ ID NO: 1893069 - protein, 18 aa, Staphylococcus
SASAKWGILAPIFVPMLI

SEQ ID NO: 1893070 - protein, 19 aa, Staphylococcus
SASAKWGILAPIFVPMMLL

SEQ ID NO: 1893071 - protein, 22 aa, Staphylococcus
SASDRDSISISQSDSLAASTSV

SEQ ID NO: 1893072 - protein, 20 aa, Staphylococcus
SASSTWAWLFVLFVLPLIGF

SEQ ID NO: 1893073 - protein, 24 aa, Staphylococcus
SAYEILSALILAWSLMVSWNQMVA

SEQ ID NO: 1893074 - protein, 18 aa, Staphylococcus
SAYNWAFFNPIRKIYYNI

SEQ ID NO: 1893075 - protein, 24 aa, Staphylococcus
SDDIIPNILPYIVVKENARSMINQ

SEQ ID NO: 1893076 - protein, 20 aa, Staphylococcus
SDEQFPPRNAQRRQRRRDTA

SEQ ID NO: 1893077 - protein, 20 aa, Staphylococcus
SDLIPFLGMGAILQGILYII

SEQ ID NO: 1893078 - protein, 21 aa, Staphylococcus
SDLKGRIAVAIAFQNIMLILS

SEQ ID NO: 1893079 - protein, 26 aa, Staphylococcus
SEEIKAEVVKLLFNRETAEKDLYKPQ

SEQ ID NO: 1893080 - protein, 17 aa, Staphylococcus
SEFLKLASIFYFSYIID

SEQ ID NO: 1893081 - protein, 20 aa, Staphylococcus
SEFWILCLFSIIATLGELIY

SEQ ID NO: 1893082 - protein, 17 aa, Staphylococcus
SEGISMFSLSLVLGTAI

SEQ ID NO: 1893083 - protein, 17 aa, Staphylococcus
SEILLAFSTSSSEAVLP

SEQ ID NO: 1893084 - protein, 18 aa, Staphylococcus
SEIVFGYLAGYGLFAILQ

SEQ ID NO: 1893085 - protein, 19 aa, Staphylococcus
SEIVFGYLAGYGMFAVLQT

SEQ ID NO: 1893086 - protein, 19 aa, Staphylococcus
SEIVFGYLVGYGIFAVLQT

SEQ ID NO: 1893087 - protein, 22 aa, Staphylococcus
SELKRLDAGYHFKDINGQFPYR

SEQ ID NO: 1893088 - protein, 17 aa, Staphylococcus
SELLLAFSTSSSEAVLP

SEQ ID NO: 1893089 - protein, 20 aa, Staphylococcus
SELPETGLSDESDYATTVFG

SEQ ID NO: 1893090 - protein, 18 aa, Staphylococcus
SELQFHFIGTSMGNISGF

SEQ ID NO: 1893091 - protein, 19 aa, Staphylococcus
SETRVAAYLQTRAGENVLR

SEQ ID NO: 1893092 - protein, 21 aa, Staphylococcus
SEVELPMALSFFSGKRLVPIM

SEQ ID NO: 1893093 - protein, 20 aa, Staphylococcus
SEYLRIMFLSAPFVILFFIL

SEQ ID NO: 1893094 - protein, 25 aa, Staphylococcus
SFFNYLFGWSRYMTYILISLISLYI

SEQ ID NO: 1893095 - protein, 20 aa, Staphylococcus
SFILAFPMAIIWPSIQGGLN

SEQ ID NO: 1893096 - protein, 20 aa, Staphylococcus
SFIPLLSPFVMFVRSASPDV

SEQ ID NO: 1893097 - protein, 19 aa, Staphylococcus
SFISPSIIVGTDFYMGIGT

SEQ ID NO: 1893098 - protein, 19 aa, Staphylococcus
SFKGGFSSFSWVVFLMIIQ

SEQ ID NO: 1893099 - protein, 18 aa, Staphylococcus
SFTAPSIVVGPDYYMGIG

SEQ ID NO: 1893100 - protein, 17 aa, Staphylococcus
SFTLRFLIVFIIALGFS

SEQ ID NO: 1893101 - protein, 25 aa, Staphylococcus
SFVAKHKWWSVVAWVIILAAIIIPL

SEQ ID NO: 1893102 - protein, 22 aa, Staphylococcus
SFVLAFPMAYVWPMIQSGLNAF

SEQ ID NO: 1893103 - protein, 24 aa, Staphylococcus
SFWFRDCIYMRALFYMSKKKLLKS

SEQ ID NO: 1893104 - protein, 24 aa, Staphylococcus
SFWFRDCIYMRSLFFMSKKRLLKS

SEQ ID NO: 1893105 - protein, 24 aa, Staphylococcus
SFWFRDCIYMRSLFYMSRKKLLKS

SEQ ID NO: 1893106 - protein, 25 aa, Staphylococcus
SFWFRDCIYMRSLFYMSRKKMFKSQ

SEQ ID NO: 1893107 - protein, 24 aa, Staphylococcus
SFWFRDCIYMRTLFYMSRKKTFKS

SEQ ID NO: 1893108 - protein, 22 aa, Staphylococcus
SFWFRDCVYMRTLFYMSRKKIM

SEQ ID NO: 1893109 - protein, 22 aa, Staphylococcus
SFWKSIEKIGALSFSFMVPILA

SEQ ID NO: 1893110 - protein, 19 aa, Staphylococcus
SFYAWFNLWAMWDPYGNTG

SEQ ID NO: 1893111 - protein, 18 aa, Staphylococcus
SFYAWFNLWAMWDPYSHT

SEQ ID NO: 1893112 - protein, 18 aa, Staphylococcus
SFYAWFNLWAMWDPYSKT

SEQ ID NO: 1893113 - protein, 19 aa, Staphylococcus
SFYAWFNLWAMWDPYSNTG

SEQ ID NO: 1893114 - protein, 19 aa, Staphylococcus
SFYFFRYLKFKNYATLLAA

SEQ ID NO: 1893115 - protein, 19 aa, Staphylococcus
SGIILALAINWKSLTHRMI

SEQ ID NO: 1893116 - protein, 18 aa, Staphylococcus
SGIKAAATGISWVIESAN

SEQ ID NO: 1893117 - protein, 23 aa, Staphylococcus
SGILCILSFLLAVSITFTDMFWY

SEQ ID NO: 1893118 - protein, 26 aa, Staphylococcus
SGLFSRRFWPSLKFLLPIIIGMLLAI

SEQ ID NO: 1893119 - protein, 19 aa, Staphylococcus
SGLIFQWFINRNIRIKMPD

SEQ ID NO: 1893120 - protein, 17 aa, Staphylococcus
SGLIGAGLAALGGLSIF

SEQ ID NO: 1893121 - protein, 17 aa, Staphylococcus
SGLKFTISLTVINRLLL

SEQ ID NO: 1893122 - protein, 21 aa, Staphylococcus
SGLMLEFISMLGIGLVALEAG

SEQ ID NO: 1893123 - protein, 17 aa, Staphylococcus
SGLSFSCAMAFSAACQI

SEQ ID NO: 1893124 - protein, 17 aa, Staphylococcus
SGLVCSVVLFLIIVVIY

SEQ ID NO: 1893125 - protein, 24 aa, Staphylococcus
SGNDNLYRIAIQYYGEGTVENVNK

SEQ ID NO: 1893126 - protein, 20 aa, Staphylococcus
SGRLPSWAIGFSIYATTLSA

SEQ ID NO: 1893127 - protein, 21 aa, Staphylococcus
SGSVCAIILFLIIVVVFKQPF

SEQ ID NO: 1893128 - protein, 17 aa, Staphylococcus
SGTIFSIVCWLVISIAI

SEQ ID NO: 1893129 - protein, 23 aa, Staphylococcus
SHFKGARLFSGLLGKVGDQDIGG

SEQ ID NO: 1893130 - protein, 19 aa, Staphylococcus
SHIDLGFSQWGFKQRPDES

SEQ ID NO: 1893131 - protein, 17 aa, Staphylococcus
SIDELPQLFNILKGDMS

SEQ ID NO: 1893132 - protein, 23 aa, Staphylococcus
SIFCLIVLIRFCFDTTFRHWFIE

SEQ ID NO: 1893133 - protein, 24 aa, Staphylococcus
SIGLFCIIMIFALLGFLPFNLNPA

SEQ ID NO: 1893134 - protein, 18 aa, Staphylococcus
SIILGLLVLISIVLTYLV

SEQ ID NO: 1893135 - protein, 17 aa, Staphylococcus
SIKRSEIVFGYLVGYGI

SEQ ID NO: 1893136 - protein, 20 aa, Staphylococcus
SIQHQFWWPVYLPITIAALV

SEQ ID NO: 1893137 - protein, 24 aa, Staphylococcus
SIRKHKFGVSSILVGSIIGLTMLM

SEQ ID NO: 1893138 - protein, 17 aa, Staphylococcus
SIVKKSIATQELDNAAD

SEQ ID NO: 1893139 - protein, 23 aa, Staphylococcus
SKARWLYRIVAMITFATMFATIF

SEQ ID NO: 1893140 - protein, 19 aa, Staphylococcus
SKEEIRTLLNIAGREGAFN

SEQ ID NO: 1893141 - protein, 24 aa, Staphylococcus
SKEYRRILKWSLNHKWIVIVISIV

SEQ ID NO: 1893142 - protein, 28 aa, Staphylococcus
SKFGRICNFFSLFLMFIFKMPKMLKYNH

SEQ ID NO: 1893143 - protein, 17 aa, Staphylococcus
SKFQNIWLLILIIPTWI

SEQ ID NO: 1893144 - protein, 23 aa, Staphylococcus
SKIVYRFTTFFTMIAAFIDGVKA

SEQ ID NO: 1893145 - protein, 22 aa, Staphylococcus
SKKFSHRPDFAITNGGGIRASI

SEQ ID NO: 1893146 - protein, 18 aa, Staphylococcus
SKLAWAIAFMMGFQSMIF

SEQ ID NO: 1893147 - protein, 17 aa, Staphylococcus
SKLLKGHVYNGISGNQF

SEQ ID NO: 1893148 - protein, 22 aa, Staphylococcus
SKRLFLRLFIFLIIIIILFLGL

SEQ ID NO: 1893149 - protein, 17 aa, Staphylococcus
SKSFGVFTGVFNVPNNV

SEQ ID NO: 1893150 - protein, 19 aa, Staphylococcus
SKSWLRRIDWVLIGILIVM

SEQ ID NO: 1893151 - protein, 25 aa, Staphylococcus
SKVSDFLRRNWAKIAVVIGAIILVL

SEQ ID NO: 1893152 - protein, 20 aa, Staphylococcus
SKYTNWRFSILIIVLIGLIG

SEQ ID NO: 1893153 - protein, 25 aa, Staphylococcus
SLAEGSYKYNPFVINQIHQLDNSNG

SEQ ID NO: 1893154 - protein, 19 aa, Staphylococcus
SLAWPSEWLIVLVWYLIAG

SEQ ID NO: 1893155 - protein, 18 aa, Staphylococcus
SLDYDYWRFILLMFMSIF

SEQ ID NO: 1893156 - protein, 17 aa, Staphylococcus
SLFAFFLMTVFTVTLKT

SEQ ID NO: 1893157 - protein, 18 aa, Staphylococcus
SLFLRYLIKILRQSYLST

SEQ ID NO: 1893158 - protein, 18 aa, Staphylococcus
SLICKRIILNLPYVSQVI

SEQ ID NO: 1893159 - protein, 28 aa, Staphylococcus
SLIKTLKPYYPFPIIIDDAFVHFDKQRK

SEQ ID NO: 1893160 - protein, 24 aa, Staphylococcus
SLLLDRIGLFISMVLLILQLSASE

SEQ ID NO: 1893161 - protein, 24 aa, Staphylococcus
SLLQRPKFVLPMLLQGMTFVILFS

SEQ ID NO: 1893162 - protein, 17 aa, Staphylococcus
SLLSWVVTLFFIALSFY

SEQ ID NO: 1893163 - protein, 24 aa, Staphylococcus
SLLTFICAFYYFRYLKLKQAPLMI

SEQ ID NO: 1893164 - protein, 19 aa, Staphylococcus
SLMIPRLVAIIGVLSAAIT

SEQ ID NO: 1893165 - protein, 23 aa, Staphylococcus
SLPEYWLAIIFIYYFGVKWHLFP

SEQ ID NO: 1893166 - protein, 23 aa, Staphylococcus
SLPEYWLAIIFIYYFGVKWHLLP

SEQ ID NO: 1893167 - protein, 18 aa, Staphylococcus
SLPVKIITWFIGILVVLA

SEQ ID NO: 1893168 - protein, 17 aa, Staphylococcus
SLQRGSNYFRFEYFNPT

SEQ ID NO: 1893169 - protein, 22 aa, Staphylococcus
SLSESRSASLIDSLTQSTSVSE

SEQ ID NO: 1893170 - protein, 22 aa, Staphylococcus
SLSRFPWLSANIEYKKTREPYF

SEQ ID NO: 1893171 - protein, 23 aa, Staphylococcus
SLVSDLLGIFAMKKLFVNNKMSG

SEQ ID NO: 1893172 - protein, 26 aa, Staphylococcus
SLVSWRLCFLINIPMCIIFILLAIKL

SEQ ID NO: 1893173 - protein, 21 aa, Staphylococcus
SLVVAIAFFFGMKMYQSHKNI

SEQ ID NO: 1893174 - protein, 18 aa, Staphylococcus
SLYNKWLLLLAIILSVLL

SEQ ID NO: 1893175 - protein, 17 aa, Staphylococcus
SLYRFVDKYGKWVKLKS

SEQ ID NO: 1893176 - protein, 22 aa, Staphylococcus
SMFCSLWLVPWLSAKRVGKLKQ

SEQ ID NO: 1893177 - protein, 18 aa, Staphylococcus
SMFSFGFLFGPLIGALLL

SEQ ID NO: 1893178 - protein, 17 aa, Staphylococcus
SMFSFGFLFGPLIGSLL

SEQ ID NO: 1893179 - protein, 18 aa, Staphylococcus
SMFSFGFLFGPLIGSRLI

SEQ ID NO: 1893180 - protein, 26 aa, Staphylococcus
SMGGQTIRLLEHFLRHGNQEEIDYQK

SEQ ID NO: 1893181 - protein, 22 aa, Staphylococcus
SMGRSGIMPSVFSKLHKKYKTP

SEQ ID NO: 1893182 - protein, 22 aa, Staphylococcus
SMGRSGIMPSVFSRIHSKYKTP

SEQ ID NO: 1893183 - protein, 18 aa, Staphylococcus
SMIGMLMLIGIVVTNAIV

SEQ ID NO: 1893184 - protein, 20 aa, Staphylococcus
SMKTAWEVIKQAVIIVWEFI

SEQ ID NO: 1893185 - protein, 23 aa, Staphylococcus
SMPEYWLAILFVYYFGIRLQWLP

SEQ ID NO: 1893186 - protein, 19 aa, Staphylococcus
SMSRFYYKMINTFVEDIQF

SEQ ID NO: 1893187 - protein, 17 aa, Staphylococcus
SNANLGLIGSVTNSPII

SEQ ID NO: 1893188 - protein, 20 aa, Staphylococcus
SNAPFGLAFSHMFNPTVGSI

SEQ ID NO: 1893189 - protein, 29 aa, Staphylococcus
SNGNFSVSIPSGFNLTGKETISITAIDKG

SEQ ID NO: 1893190 - protein, 25 aa, Staphylococcus
SNIRIRKFIPWAIVAFIIVLLIIVF

SEQ ID NO: 1893191 - protein, 24 aa, Staphylococcus
SNKGKYWLIGCGAGCGCLVILIIL

SEQ ID NO: 1893192 - protein, 27 aa, Staphylococcus
SNKRGIKGLLLPLLALLLVLAALAIFL

SEQ ID NO: 1893193 - protein, 18 aa, Staphylococcus
SNLFSEKILDEFISSNSF

SEQ ID NO: 1893194 - protein, 23 aa, Staphylococcus
SNLKFKKFIPWVIITFIIILIGI

SEQ ID NO: 1893195 - protein, 19 aa, Staphylococcus
SNTNPVYFTHTWTLNDGSI

SEQ ID NO: 1893196 - protein, 25 aa, Staphylococcus
SNTPKRKDFVVSFIASAIVGSALGL

SEQ ID NO: 1893197 - protein, 25 aa, Staphylococcus
SPAYKLASAMGWFWAMYSIGIGVLG

SEQ ID NO: 1893198 - protein, 22 aa, Staphylococcus
SPHEMKRMMSFYSLSKNLGNSI

SEQ ID NO: 1893199 - protein, 19 aa, Staphylococcus
SPLKGLVLISGLVLLGIAT

SEQ ID NO: 1893200 - protein, 17 aa, Staphylococcus
SPLLVGIGDDFNVIASD

SEQ ID NO: 1893201 - protein, 17 aa, Staphylococcus
SPLRYIIAIIVVILVIL

SEQ ID NO: 1893202 - protein, 24 aa, Staphylococcus
SPQKRLGAAVGWFWFVFTGGLSVL

SEQ ID NO: 1893203 - protein, 25 aa, Staphylococcus
SPSYKLASAMGWFWAMYSIGIGVLG

SEQ ID NO: 1893204 - protein, 20 aa, Staphylococcus
SPWMLLKLVIVWTLVQFFEG

SEQ ID NO: 1893205 - protein, 22 aa, Staphylococcus
SQHCKDVIKFPVQINPKDNFYN

SEQ ID NO: 1893206 - protein, 18 aa, Staphylococcus
SQLLKGHVYNGVSAAQFK

SEQ ID NO: 1893207 - protein, 31 aa, Staphylococcus
SQQTQIPLVWGPKVLPSYTYVTFDKTNNKIG

SEQ ID NO: 1893208 - protein, 20 aa, Staphylococcus
SQRKIDVEPVFGFMKAILVF

SEQ ID NO: 1893209 - protein, 21 aa, Staphylococcus
SQRKIDVEPVFGFMKAILVFT

SEQ ID NO: 1893210 - protein, 23 aa, Staphylococcus
SQTTIWASLLAFLGSTLLINRKN

SEQ ID NO: 1893211 - protein, 23 aa, Staphylococcus
SQVNRAGVPISIFFGGVKMMMPN

SEQ ID NO: 1893212 - protein, 18 aa, Staphylococcus
SQYLVPFTTMNLAEERFG

SEQ ID NO: 1893213 - protein, 19 aa, Staphylococcus
SQYSWKVIFYILLVVTIID

SEQ ID NO: 1893214 - protein, 21 aa, Staphylococcus
SRFSKKSSIIWSIVYLVVVIG

SEQ ID NO: 1893215 - protein, 18 aa, Staphylococcus
SRGMFRLVSGMTFANNPL

SEQ ID NO: 1893216 - protein, 24 aa, Staphylococcus
SRILKNLRYAHAVSNKKGTYMVYF

SEQ ID NO: 1893217 - protein, 18 aa, Staphylococcus
SRIYWILWLLFLHFIFLG

SEQ ID NO: 1893218 - protein, 18 aa, Staphylococcus
SRKNRYSIRKMTAGAASI

SEQ ID NO: 1893219 - protein, 17 aa, Staphylococcus
SRLKAFFVITYIAQLGA

SEQ ID NO: 1893220 - protein, 17 aa, Staphylococcus
SRLSWRIFNRTVNRRGR

SEQ ID NO: 1893221 - protein, 21 aa, Staphylococcus
SRPGQNLIVNPMWYNLNFALV

SEQ ID NO: 1893222 - protein, 19 aa, Staphylococcus
SRSDFNLVSTFLKDKSSIY

SEQ ID NO: 1893223 - protein, 20 aa, Staphylococcus
SRSYILLGYPMKAQKGSHSH

SEQ ID NO: 1893224 - protein, 17 aa, Staphylococcus
SRWASEYNIYFKRYNSD

SEQ ID NO: 1893225 - protein, 19 aa, Staphylococcus
SRWASEYNIYFKRYNSDQF

SEQ ID NO: 1893226 - protein, 19 aa, Staphylococcus
SRWASEYNIYFKRYSSDQF

SEQ ID NO: 1893227 - protein, 18 aa, Staphylococcus
SSEIKSLASMYLSDDIEF

SEQ ID NO: 1893228 - protein, 25 aa, Staphylococcus
SSFHAIRIPVFFGILLYIALQLIVL

SEQ ID NO: 1893229 - protein, 20 aa, Staphylococcus
SSFHIFRIFFILFIVAPIIS

SEQ ID NO: 1893230 - protein, 20 aa, Staphylococcus
SSFHIFRIFFILFLIAPAIK

SEQ ID NO: 1893231 - protein, 19 aa, Staphylococcus
SSFHIFRIFFILFLVAPII

SEQ ID NO: 1893232 - protein, 19 aa, Staphylococcus
SSFHIFRIFFILFVVAPVI

SEQ ID NO: 1893233 - protein, 18 aa, Staphylococcus
SSFWLPFILSSLIFASQH

SEQ ID NO: 1893234 - protein, 18 aa, Staphylococcus
SSIAWLSFILFIRGCSVG

SEQ ID NO: 1893235 - protein, 20 aa, Staphylococcus
SSIFFPLSFLTGWYGMNFSY

SEQ ID NO: 1893236 - protein, 21 aa, Staphylococcus
SSIFFPLTLLTGWFGMNFTNM

SEQ ID NO: 1893237 - protein, 17 aa, Staphylococcus
SSIIEQSELERQEADDK

SEQ ID NO: 1893238 - protein, 23 aa, Staphylococcus
SSKPALDCPIVFPYAQNAVLIGF

SEQ ID NO: 1893239 - protein, 21 aa, Staphylococcus
SSKSQFSSSMVEPTSTSLPEF

SEQ ID NO: 1893240 - protein, 18 aa, Staphylococcus
SSLFDVFFFLSWIIICIA

SEQ ID NO: 1893241 - protein, 17 aa, Staphylococcus
SSLKPFLAYGPAIENMH

SEQ ID NO: 1893242 - protein, 17 aa, Staphylococcus
SSLKPFLAYGPAIENMQ

SEQ ID NO: 1893243 - protein, 20 aa, Staphylococcus
SSLMLEFISMLGIGLVALEA

SEQ ID NO: 1893244 - protein, 18 aa, Staphylococcus
SSMGTWYIIGFIVLLILA

SEQ ID NO: 1893245 - protein, 22 aa, Staphylococcus
SSNRLLTLNVDRIEPGTIKNIT

SEQ ID NO: 1893246 - protein, 24 aa, Staphylococcus
SSNYFRFQYFNPLDSKKYYKNLDD

SEQ ID NO: 1893247 - protein, 18 aa, Staphylococcus
SSRYLSGILVKLDANDIG

SEQ ID NO: 1893248 - protein, 24 aa, Staphylococcus
SSTARYYGDENFAFLNGEKPEQGQ

SEQ ID NO: 1893249 - protein, 19 aa, Staphylococcus
SSYHIFRIFFILFLVAPVI

SEQ ID NO: 1893250 - protein, 19 aa, Staphylococcus
STFMKAIAINLILAQTIET

SEQ ID NO: 1893251 - protein, 19 aa, Staphylococcus
STFMKALAINLILAQTIET

SEQ ID NO: 1893252 - protein, 17 aa, Staphylococcus
STIFDFKKIISVSFATG

SEQ ID NO: 1893253 - protein, 17 aa, Staphylococcus
STIGWQWIFIISIALSI

SEQ ID NO: 1893254 - protein, 17 aa, Staphylococcus
STIGWQWIFIVSIALSI

SEQ ID NO: 1893255 - protein, 21 aa, Staphylococcus
STIILFCLVIIFFLKDTLRDG

SEQ ID NO: 1893256 - protein, 31 aa, Staphylococcus
STIIVLLLLIGLAFGIFSFVDSSKKANERLN

SEQ ID NO: 1893257 - protein, 17 aa, Staphylococcus
STLWGGLCGGLIVTFLI

SEQ ID NO: 1893258 - protein, 26 aa, Staphylococcus
STSLPEFDLPSYLASESISASTSMSS

SEQ ID NO: 1893259 - protein, 23 aa, Staphylococcus
STTFLMKCDFCFKSFAFEREGDF

SEQ ID NO: 1893260 - protein, 21 aa, Staphylococcus
STYKGIYSFDVLGLQNINRNM

SEQ ID NO: 1893261 - protein, 18 aa, Staphylococcus
SVFIPTWYVEYDGEWYVY

SEQ ID NO: 1893262 - protein, 22 aa, Staphylococcus
SVILAYLFKWFGLIDDVLLMVI

SEQ ID NO: 1893263 - protein, 17 aa, Staphylococcus
SVILFLLVMMSIVLTYM

SEQ ID NO: 1893264 - protein, 17 aa, Staphylococcus
SVLSWSITLLIIALSFA

SEQ ID NO: 1893265 - protein, 17 aa, Staphylococcus
SVMGFASAISVLFAVLA

SEQ ID NO: 1893266 - protein, 24 aa, Staphylococcus
SVMPYCIYSFLLGICGIIAIILRY

SEQ ID NO: 1893267 - protein, 20 aa, Staphylococcus
SVNFGYLWDLFIKHLLMSVY

SEQ ID NO: 1893268 - protein, 18 aa, Staphylococcus
SVPVKNWNSDLSVNGFVM

SEQ ID NO: 1893269 - protein, 18 aa, Staphylococcus
SVQLRWFPVAGWEGLPTI

SEQ ID NO: 1893270 - protein, 20 aa, Staphylococcus
SVRLRWFPVAGWEGISTAIL

SEQ ID NO: 1893271 - protein, 17 aa, Staphylococcus
SVSLGTLVFLGGAQAAN

SEQ ID NO: 1893272 - protein, 22 aa, Staphylococcus
SWLFGCGGCLVLLILIIIGVTA

SEQ ID NO: 1893273 - protein, 36 aa, Staphylococcus
SYEVPEYFTKGARNEFVYGFIVGAVIGSAVGLVSIS

SEQ ID NO: 1893274 - protein, 18 aa, Staphylococcus
SYGSFGYFFSYAFGMICV

SEQ ID NO: 1893275 - protein, 19 aa, Staphylococcus
SYHIFRIFFILFLIAPLIN

SEQ ID NO: 1893276 - protein, 19 aa, Staphylococcus
SYHIFRIFFILFLIAPLLG

SEQ ID NO: 1893277 - protein, 18 aa, Staphylococcus
SYISWIIVVGISLILVAI

SEQ ID NO: 1893278 - protein, 23 aa, Staphylococcus
SYLGLYIRWQWYLGQKSSWTINT

SEQ ID NO: 1893279 - protein, 33 aa, Staphylococcus
SYLKVSCSALILSSSLVGYGFTKDAFAATQDAE

SEQ ID NO: 1893280 - protein, 24 aa, Staphylococcus
SYMPELDWHYSYFVFIAISLVVVV

SEQ ID NO: 1893281 - protein, 19 aa, Staphylococcus
SYSKFMVMFVILLATFAGA

SEQ ID NO: 1893282 - protein, 19 aa, Staphylococcus
SYTSPSIIVGPDFYMGIGT

SEQ ID NO: 1893283 - protein, 19 aa, Staphylococcus
SYTSPSIVVGPDFYMGIGT

SEQ ID NO: 1893284 - protein, 25 aa, Staphylococcus
TAAKRLPWLIILTFLGMITATILGN

SEQ ID NO: 1893285 - protein, 26 aa, Staphylococcus
TAAWAKRIIISIAFFVFYVFFIHITY

SEQ ID NO: 1893286 - protein, 18 aa, Staphylococcus
TADLKTRIRMDNKNYRGT

SEQ ID NO: 1893287 - protein, 25 aa, Staphylococcus
TAKKRLPWLIILTFLGMITATILGS

SEQ ID NO: 1893288 - protein, 20 aa, Staphylococcus
TALICYRWILMLMQVSQDIF

SEQ ID NO: 1893289 - protein, 22 aa, Staphylococcus
TALICYRWILMLMQVSQDIFEL

SEQ ID NO: 1893290 - protein, 19 aa, Staphylococcus
TALITVVALWEFSFAHTLL

SEQ ID NO: 1893291 - protein, 17 aa, Staphylococcus
TALTFIVSVCALFVIIY

SEQ ID NO: 1893292 - protein, 25 aa, Staphylococcus
TASKRLPWLIVLTFLGMITATILGS

SEQ ID NO: 1893293 - protein, 24 aa, Staphylococcus
TASKRLPWLLILTFLGMITATILG

SEQ ID NO: 1893294 - protein, 18 aa, Staphylococcus
TAVKRSEIVFGYLAGYGM

SEQ ID NO: 1893295 - protein, 17 aa, Staphylococcus
TCFPGILLIFIRKVAYF

SEQ ID NO: 1893296 - protein, 17 aa, Staphylococcus
TCLYFEFAGNPELHHLG

SEQ ID NO: 1893297 - protein, 25 aa, Staphylococcus
TDLKKIAKTPAVWIILAGLAILPSF

SEQ ID NO: 1893298 - protein, 25 aa, Staphylococcus
TDLKRVAKTPAVWVILTGLAILPSF

SEQ ID NO: 1893299 - protein, 25 aa, Staphylococcus
TDLKRVAKTPGVWVILAGLAILPSF

SEQ ID NO: 1893300 - protein, 17 aa, Staphylococcus
TDLRPAGIISCEDDRID

SEQ ID NO: 1893301 - protein, 17 aa, Staphylococcus
TDLRPAGIITLNNERID

SEQ ID NO: 1893302 - protein, 17 aa, Staphylococcus
TDWRANLSYWKRRMASG

SEQ ID NO: 1893303 - protein, 31 aa, Staphylococcus
TEEIKQARGFFRLAAVMSFTYIWIAIYQSFN

SEQ ID NO: 1893304 - protein, 17 aa, Staphylococcus
TELIILIPISFVLTITS

SEQ ID NO: 1893305 - protein, 20 aa, Staphylococcus
TELPTALSFFSGKRLVPIMT

SEQ ID NO: 1893306 - protein, 18 aa, Staphylococcus
TEMFGVFKSLTKTSATPF

SEQ ID NO: 1893307 - protein, 21 aa, Staphylococcus
TEPKVMLAIVMWLMGSLTSTM

SEQ ID NO: 1893308 - protein, 17 aa, Staphylococcus
TESPLRYIIAIIVVILV

SEQ ID NO: 1893309 - protein, 22 aa, Staphylococcus
TETPLRYSIPFNEDNRYLVMPA

SEQ ID NO: 1893310 - protein, 19 aa, Staphylococcus
TETPLRYVLPFNNENKYLV

SEQ ID NO: 1893311 - protein, 29 aa, Staphylococcus
TEVIHGIWLYRLITLFAFIFIMLTFYGCY

SEQ ID NO: 1893312 - protein, 18 aa, Staphylococcus
TEYRLPYLDVMDVSSRRE

SEQ ID NO: 1893313 - protein, 23 aa, Staphylococcus
TFFPFFLCIGILYLSISIQYSLH

SEQ ID NO: 1893314 - protein, 18 aa, Staphylococcus
TFFSFLIVIIIKFILAWI

SEQ ID NO: 1893315 - protein, 24 aa, Staphylococcus
TFGYKRFEILAALFNGVTLFVIGI

SEQ ID NO: 1893316 - protein, 23 aa, Staphylococcus
TFGYKRFEVLAALFNGITLLIIS

SEQ ID NO: 1893317 - protein, 22 aa, Staphylococcus
TFGYKRFEVLAALFNGVTLFII

SEQ ID NO: 1893318 - protein, 22 aa, Staphylococcus
TFGYKRFEVLAALFNGVTLFVI

SEQ ID NO: 1893319 - protein, 24 aa, Staphylococcus
TFIAKHKWLSIIIWLVVLGVVIAP

SEQ ID NO: 1893320 - protein, 23 aa, Staphylococcus
TFLGWKYIFIFSIIVALTALFLI

SEQ ID NO: 1893321 - protein, 22 aa, Staphylococcus
TFPLLRPGIISGWILIFCISMR

SEQ ID NO: 1893322 - protein, 19 aa, Staphylococcus
TFSAIPEDAKLVWIDFENP

SEQ ID NO: 1893323 - protein, 22 aa, Staphylococcus
TFVDIWRFFTLVQRYESEDRYD

SEQ ID NO: 1893324 - protein, 19 aa, Staphylococcus
TFVGWRSIFIISIIVALAA

SEQ ID NO: 1893325 - protein, 18 aa, Staphylococcus
TGASLAFYDVTSRYIDGS

SEQ ID NO: 1893326 - protein, 33 aa, Staphylococcus
TGDKQAKIYFGHIDHPYIVKVTSKIDPNSTADL

SEQ ID NO: 1893327 - protein, 17 aa, Staphylococcus
TGFVCAVILFLIIVIIY

SEQ ID NO: 1893328 - protein, 21 aa, Staphylococcus
TGHTAWRYLIVVLYLVPYAFF

SEQ ID NO: 1893329 - protein, 20 aa, Staphylococcus
TGIACGFIFYPITMLISKRH

SEQ ID NO: 1893330 - protein, 20 aa, Staphylococcus
TGIACGFIFYPLTMVITKRH

SEQ ID NO: 1893331 - protein, 18 aa, Staphylococcus
TGIFIIMLFILIKLFMEV

SEQ ID NO: 1893332 - protein, 18 aa, Staphylococcus
TGIPSWILVIILTGVTLF

SEQ ID NO: 1893333 - protein, 17 aa, Staphylococcus
TGLWMKIPGKPGGVDHT

SEQ ID NO: 1893334 - protein, 19 aa, Staphylococcus
TGSIVLQFALLFAAQLYLV

SEQ ID NO: 1893335 - protein, 32 aa, Staphylococcus
TGSKVRLSGQGFKFTSPDEIEVYKVLNNSQFR

SEQ ID NO: 1893336 - protein, 23 aa, Staphylococcus
TGTYSIRYATIWDENSEIVRPTE

SEQ ID NO: 1893337 - protein, 17 aa, Staphylococcus
TGWTYWLCWIITGMAEV

SEQ ID NO: 1893338 - protein, 23 aa, Staphylococcus
THDLRLLPDFDRIIVMIDGEIKE

SEQ ID NO: 1893339 - protein, 23 aa, Staphylococcus
THDLRLLPHFDRIIVMQDGVILE

SEQ ID NO: 1893340 - protein, 18 aa, Staphylococcus
THQPRYIIGDKWRYSGVT

SEQ ID NO: 1893341 - protein, 20 aa, Staphylococcus
THYWWMFAISFIFFLIAGIL

SEQ ID NO: 1893342 - protein, 18 aa, Staphylococcus
TIALCLILFMALVLIITN

SEQ ID NO: 1893343 - protein, 17 aa, Staphylococcus
TIIARKDGLTWSLSKEI

SEQ ID NO: 1893344 - protein, 23 aa, Staphylococcus
TIILFCLIIIFFLKDTLREGEVE

SEQ ID NO: 1893345 - protein, 18 aa, Staphylococcus
TIISSIFFPLSFLTGWYG

SEQ ID NO: 1893346 - protein, 20 aa, Staphylococcus
TILLLCRFLMGMAIGMDSPV

SEQ ID NO: 1893347 - protein, 22 aa, Staphylococcus
TIPCYICAIIAVIYGFTGIGIK

SEQ ID NO: 1893348 - protein, 23 aa, Staphylococcus
TIPKLSYKFVWLIMMLIFLFSIL

SEQ ID NO: 1893349 - protein, 23 aa, Staphylococcus
TIPMAIIIAMFWIHLNTALIMLV

SEQ ID NO: 1893350 - protein, 24 aa, Staphylococcus
TIQLFSFFIGYHFDKFDLGVQQLF

SEQ ID NO: 1893351 - protein, 25 aa, Staphylococcus
TIRNIRQNLFWAFGYNVAGIPIAAI

SEQ ID NO: 1893352 - protein, 18 aa, Staphylococcus
TISMNWSLEISRAITGGI

SEQ ID NO: 1893353 - protein, 22 aa, Staphylococcus
TITATKVGNGWTINKNISNIKL

SEQ ID NO: 1893354 - protein, 17 aa, Staphylococcus
TITRYFVQRGGRVEYHF

SEQ ID NO: 1893355 - protein, 21 aa, Staphylococcus
TIVLFCLVIIFFLKDALHDSE

SEQ ID NO: 1893356 - protein, 21 aa, Staphylococcus
TKEHKRLLLGSVFLMATSAIG

SEQ ID NO: 1893357 - protein, 19 aa, Staphylococcus
TKEYWVWKNKYYRYLFDFG

SEQ ID NO: 1893358 - protein, 17 aa, Staphylococcus
TKFKFEYQCLAFNMNIS

SEQ ID NO: 1893359 - protein, 18 aa, Staphylococcus
TKHLLSALIIQILITTMI

SEQ ID NO: 1893360 - protein, 20 aa, Staphylococcus
TKIGEVWAMLCLSLTLVAYL

SEQ ID NO: 1893361 - protein, 27 aa, Staphylococcus
TKLFGRASWYLPKWLDRILPKIDVEGH

SEQ ID NO: 1893362 - protein, 18 aa, Staphylococcus
TKLGLKYTFKSQIDDKTV

SEQ ID NO: 1893363 - protein, 23 aa, Staphylococcus
TKLRSVLPGALFTSIIWLVGSFL

SEQ ID NO: 1893364 - protein, 18 aa, Staphylococcus
TKLSNFFSNYSFTLNSAI

SEQ ID NO: 1893365 - protein, 20 aa, Staphylococcus
TKPARPGDVAQIDLSGTQLS

SEQ ID NO: 1893366 - protein, 17 aa, Staphylococcus
TKQGFPFIAFLTTCIVA

SEQ ID NO: 1893367 - protein, 25 aa, Staphylococcus
TKQRIIDTWKRFAILFIAELVLVLI

SEQ ID NO: 1893368 - protein, 22 aa, Staphylococcus
TKVELPIAMPIIMAGIRTAMVL

SEQ ID NO: 1893369 - protein, 21 aa, Staphylococcus
TKVELPIAMPVIMAGIRTAMV

SEQ ID NO: 1893370 - protein, 21 aa, Staphylococcus
TLADLRHRFHILKNKVNAEAK

SEQ ID NO: 1893371 - protein, 17 aa, Staphylococcus
TLAFPAYLLKISRSFEV

SEQ ID NO: 1893372 - protein, 20 aa, Staphylococcus
TLAKRWAKGYAITVAVGVVT

SEQ ID NO: 1893373 - protein, 23 aa, Staphylococcus
TLEMYRFEYPITFATSIFASIFT

SEQ ID NO: 1893374 - protein, 26 aa, Staphylococcus
TLEMYRFEYPITFVISIFASIFTSAI

SEQ ID NO: 1893375 - protein, 19 aa, Staphylococcus
TLFIPEFLGSAVIGAIAIF

SEQ ID NO: 1893376 - protein, 21 aa, Staphylococcus
TLFLKFDRLIAVLGIVTPFLV

SEQ ID NO: 1893377 - protein, 21 aa, Staphylococcus
TLFLKFERLIAILGMVTPFLV

SEQ ID NO: 1893378 - protein, 24 aa, Staphylococcus
TLKSFKSKVWISAGIIGIIQYTGL

SEQ ID NO: 1893379 - protein, 18 aa, Staphylococcus
TLLLKFDRLIAVLGGVTP

SEQ ID NO: 1893380 - protein, 19 aa, Staphylococcus
TLNVTFNLRVNNVANPKEV

SEQ ID NO: 1893381 - protein, 23 aa, Staphylococcus
TLSRSEFQDSIFLLNEGDINMNK

SEQ ID NO: 1893382 - protein, 23 aa, Staphylococcus
TLTELRPAGIISLNDERIDAVSD

SEQ ID NO: 1893383 - protein, 18 aa, Staphylococcus
TMKDVLKNIAFFILAIIC

SEQ ID NO: 1893384 - protein, 22 aa, Staphylococcus
TMLASICGFLFLAADPAKEGGF

SEQ ID NO: 1893385 - protein, 17 aa, Staphylococcus
TMLKLAIPGAIFGFLGA

SEQ ID NO: 1893386 - protein, 22 aa, Staphylococcus
TMMAAMCGFLFLAADPVKDGGF

SEQ ID NO: 1893387 - protein, 23 aa, Staphylococcus
TMMKASFAMWKAVITAVWNAIKT

SEQ ID NO: 1893388 - protein, 23 aa, Staphylococcus
TMNHRINFIFGLIVFIFVIIVLR

SEQ ID NO: 1893389 - protein, 35 aa, Staphylococcus
TMNLAEERFGHLIQGSFKYNPFVVNQISRMSEDGN

SEQ ID NO: 1893390 - protein, 24 aa, Staphylococcus
TMRNIRQNLIWAFGYNIAGIPIAA

SEQ ID NO: 1893391 - protein, 19 aa, Staphylococcus
TMRYCVIMGIAIFIALMFD

SEQ ID NO: 1893392 - protein, 17 aa, Staphylococcus
TMSGGLLIKISMMMLTF

SEQ ID NO: 1893393 - protein, 18 aa, Staphylococcus
TNFSEIFLVTSIGGSVLI

SEQ ID NO: 1893394 - protein, 27 aa, Staphylococcus
TNGCLSCLGCFGIIFLILLLIGGCSAI

SEQ ID NO: 1893395 - protein, 21 aa, Staphylococcus
TNGDWKALILVLINLLIAIVL

SEQ ID NO: 1893396 - protein, 20 aa, Staphylococcus
TNGLPTERLYYAAGGRALEF

SEQ ID NO: 1893397 - protein, 24 aa, Staphylococcus
TNYFKFQYFNPLKSRDYYKNLDKQ

SEQ ID NO: 1893398 - protein, 19 aa, Staphylococcus
TPASIRNFDQAMARAQAQI

SEQ ID NO: 1893399 - protein, 18 aa, Staphylococcus
TPDSAGFGLIGLVGPIKS

SEQ ID NO: 1893400 - protein, 19 aa, Staphylococcus
TPDSAGFGLIGLVGPIKSL

SEQ ID NO: 1893401 - protein, 20 aa, Staphylococcus
TPIEGWRWMLGLAVVPSLIL

SEQ ID NO: 1893402 - protein, 25 aa, Staphylococcus
TPIKRSEIVFGYLIGYGIFAIIQTL

SEQ ID NO: 1893403 - protein, 17 aa, Staphylococcus
TPLFAISQGWIWTITLV

SEQ ID NO: 1893404 - protein, 17 aa, Staphylococcus
TPLFAVSQGWIWTVTLV

SEQ ID NO: 1893405 - protein, 22 aa, Staphylococcus
TPVQFIIGWQFYKGAYKNLKNG

SEQ ID NO: 1893406 - protein, 22 aa, Staphylococcus
TPVQFIIGWQFYVGAYKNLRNG

SEQ ID NO: 1893407 - protein, 22 aa, Staphylococcus
TQEIRIYWILGTVIAIICFSAH

SEQ ID NO: 1893408 - protein, 23 aa, Staphylococcus
TQHKRKAQALAHKRNKLIVSAIL

SEQ ID NO: 1893409 - protein, 19 aa, Staphylococcus
TQKTWRGDYLIDQLTKDGS

SEQ ID NO: 1893410 - protein, 24 aa, Staphylococcus
TQLSPLPTHIEWRDKNGNVVSKTD

SEQ ID NO: 1893411 - protein, 29 aa, Staphylococcus
TQWLKFAWKIILTWVLICCIGMSIALIVG

SEQ ID NO: 1893412 - protein, 20 aa, Staphylococcus
TRFPFHIGIMTGLYTVVMNV

SEQ ID NO: 1893413 - protein, 20 aa, Staphylococcus
TRISDALVRMQREHVHISLI

SEQ ID NO: 1893414 - protein, 17 aa, Staphylococcus
TRLGFHVGFAAAAVGMF

SEQ ID NO: 1893415 - protein, 20 aa, Staphylococcus
TRLSIKLKLYIGTFGALVTM

SEQ ID NO: 1893416 - protein, 17 aa, Staphylococcus
TRNAFFIGRTMDYNVSL

SEQ ID NO: 1893417 - protein, 18 aa, Staphylococcus
TRNAFFIGRTMDYNVSLE

SEQ ID NO: 1893418 - protein, 24 aa, Staphylococcus
TRRKEFWPSVLITWGLVIVAYFLI

SEQ ID NO: 1893419 - protein, 19 aa, Staphylococcus
TRVALTIIRYIGASTSKIL

SEQ ID NO: 1893420 - protein, 19 aa, Staphylococcus
TSAGYKWFFSYPEEKIETV

SEQ ID NO: 1893421 - protein, 19 aa, Staphylococcus
TSFEKWNFVKLAKPLIALS

SEQ ID NO: 1893422 - protein, 19 aa, Staphylococcus
TSFEKWNFVKLAKPLISLS

SEQ ID NO: 1893423 - protein, 29 aa, Staphylococcus
TSHPGDMNFLRWTNIRDDYTISWSNDKIA

SEQ ID NO: 1893424 - protein, 23 aa, Staphylococcus
TSHRLNPTFMRWFSIAYFCEGAG

SEQ ID NO: 1893425 - protein, 17 aa, Staphylococcus
TSKNFAIQHRIIASVGQ

SEQ ID NO: 1893426 - protein, 18 aa, Staphylococcus
TSLLLKRKHHSHSYLSTE

SEQ ID NO: 1893427 - protein, 24 aa, Staphylococcus
TSLPEYWLAIIFIYYFGVKWHLFP

SEQ ID NO: 1893428 - protein, 24 aa, Staphylococcus
TSMPEYWLAILFIYYLGVRWQLLP

SEQ ID NO: 1893429 - protein, 22 aa, Staphylococcus
TSSQPFGIFKGVFNVPDNISRI

SEQ ID NO: 1893430 - protein, 19 aa, Staphylococcus
TSWLPELFMSLVLFTVVGS

SEQ ID NO: 1893431 - protein, 18 aa, Staphylococcus
TTARRFSGLLGRVNTNDE

SEQ ID NO: 1893432 - protein, 17 aa, Staphylococcus
TTFLMDIVCYLLLNNDY

SEQ ID NO: 1893433 - protein, 22 aa, Staphylococcus
TTGSFKYNPFVLNQVKQLGSNK

SEQ ID NO: 1893434 - protein, 22 aa, Staphylococcus
TTILLFCLIIIFFLKDTLRNSE

SEQ ID NO: 1893435 - protein, 25 aa, Staphylococcus
TTLFAGLFAALATAMFVSRKRRKDN

SEQ ID NO: 1893436 - protein, 24 aa, Staphylococcus
TTSFILAFPMAWIWPSIQTGLNAF

SEQ ID NO: 1893437 - protein, 18 aa, Staphylococcus
TTVYRFTTFFTMIAALID

SEQ ID NO: 1893438 - protein, 26 aa, Staphylococcus
TVDMPDYANFNGIADYTAVDNKIYPT

SEQ ID NO: 1893439 - protein, 17 aa, Staphylococcus
TVIICSLSFSLCMMLGT

SEQ ID NO: 1893440 - protein, 17 aa, Staphylococcus
TVILLIAILFKFNLAHV

SEQ ID NO: 1893441 - protein, 23 aa, Staphylococcus
TVITFICTFYFFKYIKLKPLAII

SEQ ID NO: 1893442 - protein, 19 aa, Staphylococcus
TVKRKVVVQLTRFEKVLYI

SEQ ID NO: 1893443 - protein, 18 aa, Staphylococcus
TVLPYMASVGLFVGAVSF

SEQ ID NO: 1893444 - protein, 17 aa, Staphylococcus
TVLRSMFSFGFLFGPLI

SEQ ID NO: 1893445 - protein, 18 aa, Staphylococcus
TVLSCAIIMFFSNFVTVI

SEQ ID NO: 1893446 - protein, 18 aa, Staphylococcus
TVLVSGVFVYLTILGTKK

SEQ ID NO: 1893447 - protein, 22 aa, Staphylococcus
TVLYRFPSFITFIVPFISLSIV

SEQ ID NO: 1893448 - protein, 23 aa, Staphylococcus
TVPCYLCAILAVFYGFTGIGIKK

SEQ ID NO: 1893449 - protein, 24 aa, Staphylococcus
TVTMLRQAGGFFPGSYVNSVTSNN

SEQ ID NO: 1893450 - protein, 27 aa, Staphylococcus
TVYGKENLYRIAIRYYGEGTQANVDKI

SEQ ID NO: 1893451 - protein, 17 aa, Staphylococcus
TWAWLFILFIAPVLGFF

SEQ ID NO: 1893452 - protein, 18 aa, Staphylococcus
TWILWAIIIVWATVSIFL

SEQ ID NO: 1893453 - protein, 19 aa, Staphylococcus
TWIQLKWSAPIIIVTVILI

SEQ ID NO: 1893454 - protein, 19 aa, Staphylococcus
TWISFCVGRGIFIFSKGVF

SEQ ID NO: 1893455 - protein, 19 aa, Staphylococcus
TWRNPSVYLMPLLVIGLTL

SEQ ID NO: 1893456 - protein, 23 aa, Staphylococcus
TYGYKRFEVLAALFNGVTLFIIS

SEQ ID NO: 1893457 - protein, 21 aa, Staphylococcus
TYGYKRFEVLAALFNGVTLFV

SEQ ID NO: 1893458 - protein, 24 aa, Staphylococcus
TYKRLRWQVFLGIFIGYAGYYLLR

SEQ ID NO: 1893459 - protein, 18 aa, Staphylococcus
VAAVHVMFNVIGASIFLI

SEQ ID NO: 1893460 - protein, 23 aa, Staphylococcus
VAAVIMPRIWPLRNIPDEYAVEN

SEQ ID NO: 1893461 - protein, 21 aa, Staphylococcus
VAAYIASFGMKWMEEKLPDGL

SEQ ID NO: 1893462 - protein, 18 aa, Staphylococcus
VACTIAFIIFFIWYPLTD

SEQ ID NO: 1893463 - protein, 18 aa, Staphylococcus
VAGGIEFMGAVPMGGNEP

SEQ ID NO: 1893464 - protein, 18 aa, Staphylococcus
VAIAMRITKGFKQLIVFS

SEQ ID NO: 1893465 - protein, 17 aa, Staphylococcus
VAIAVGFFWFRLYQRTT

SEQ ID NO: 1893466 - protein, 19 aa, Staphylococcus
VAICISPIWFIFLFLFYKK

SEQ ID NO: 1893467 - protein, 21 aa, Staphylococcus
VAILVLRSGFYVTKSSLHVLM

SEQ ID NO: 1893468 - protein, 20 aa, Staphylococcus
VAKDLPWGVLILFGGGLALA

SEQ ID NO: 1893469 - protein, 21 aa, Staphylococcus
VAKELPWGVLILFGGGLALAK

SEQ ID NO: 1893470 - protein, 24 aa, Staphylococcus
VAKHKWSSLIAWVVILAAIMIPLS

SEQ ID NO: 1893471 - protein, 18 aa, Staphylococcus
VALAFILLMIVFRSIIIP

SEQ ID NO: 1893472 - protein, 19 aa, Staphylococcus
VALAFVLLMFVFRSIIIPL

SEQ ID NO: 1893473 - protein, 18 aa, Staphylococcus
VALFLAISILGFIGLILG

SEQ ID NO: 1893474 - protein, 19 aa, Staphylococcus
VALIFRLNQSLTFWSAGGI

SEQ ID NO: 1893475 - protein, 21 aa, Staphylococcus
VALIFRLNQSLTFWSAGGVSG

SEQ ID NO: 1893476 - protein, 21 aa, Staphylococcus
VALLFRLNQSLTFWSAGGVSG

SEQ ID NO: 1893477 - protein, 26 aa, Staphylococcus
VALLYARPLYYFGLIMKPLIWLMNGS

SEQ ID NO: 1893478 - protein, 22 aa, Staphylococcus
VALNLFLAWFFVYFEQGRKVVR

SEQ ID NO: 1893479 - protein, 18 aa, Staphylococcus
VALVRFRLTLTRRGIENI

SEQ ID NO: 1893480 - protein, 17 aa, Staphylococcus
VAMAYSLASQIYLGKLI

SEQ ID NO: 1893481 - protein, 23 aa, Staphylococcus
VANKRKAYIKGLTNISEYNRNKA

SEQ ID NO: 1893482 - protein, 19 aa, Staphylococcus
VANSKIWKTQDSAVYDLTT

SEQ ID NO: 1893483 - protein, 21 aa, Staphylococcus
VASCITFLWGSLRVNKLGVNL

SEQ ID NO: 1893484 - protein, 18 aa, Staphylococcus
VATPIFKPLFAWQLNRSL

SEQ ID NO: 1893485 - protein, 18 aa, Staphylococcus
VATPIFKPLFAWQMNRTL

SEQ ID NO: 1893486 - protein, 17 aa, Staphylococcus
VAVFAVELMQDFDVNKA

SEQ ID NO: 1893487 - protein, 18 aa, Staphylococcus
VAVPISIFFGGVKMMMPN

SEQ ID NO: 1893488 - protein, 20 aa, Staphylococcus
VAVSEYFHRIFPRISYKIYV

SEQ ID NO: 1893489 - protein, 17 aa, Staphylococcus
VAWGYAIILIIASYFGA

SEQ ID NO: 1893490 - protein, 19 aa, Staphylococcus
VCFFVLYYVIFRVVIQVFN

SEQ ID NO: 1893491 - protein, 17 aa, Staphylococcus
VCIKLVFVFSVVQIFTG

SEQ ID NO: 1893492 - protein, 20 aa, Staphylococcus
VCNIKWCFKKYIERKIEIKG

SEQ ID NO: 1893493 - protein, 19 aa, Staphylococcus
VDAIAALIQKDYQNNKNEN

SEQ ID NO: 1893494 - protein, 19 aa, Staphylococcus
VDSNGLSTVGIINDADNWT

SEQ ID NO: 1893495 - protein, 24 aa, Staphylococcus
VDTKKLKYTFTDYVNNKQNIEGGF

SEQ ID NO: 1893496 - protein, 19 aa, Staphylococcus
VDVLHFWPAVINIIAAFIG

SEQ ID NO: 1893497 - protein, 17 aa, Staphylococcus
VDVPEGLILEHNDVTLI

SEQ ID NO: 1893498 - protein, 23 aa, Staphylococcus
VEANRRLDIQLSDITVNNPTSGG

SEQ ID NO: 1893499 - protein, 21 aa, Staphylococcus
VEGLPSGWTQTFVKNSNNETG

SEQ ID NO: 1893500 - protein, 18 aa, Staphylococcus
VEKQRLDQVVKMVRGKRG

SEQ ID NO: 1893501 - protein, 20 aa, Staphylococcus
VELICGIILFLFTLLELNNR

SEQ ID NO: 1893502 - protein, 18 aa, Staphylococcus
VELYHYIKGGKVDYGAAH

SEQ ID NO: 1893503 - protein, 17 aa, Staphylococcus
VEPFFQWFVWIGGAGAT

SEQ ID NO: 1893504 - protein, 17 aa, Staphylococcus
VEVKPTTHWGMIFLYVC

SEQ ID NO: 1893505 - protein, 18 aa, Staphylococcus
VEYYDWRSLFHVVTPIAA

SEQ ID NO: 1893506 - protein, 17 aa, Staphylococcus
VFAALGIGIVSGTILHL

SEQ ID NO: 1893507 - protein, 18 aa, Staphylococcus
VFAILTIIFICFNFIPFI

SEQ ID NO: 1893508 - protein, 19 aa, Staphylococcus
VFFFLSWIIICIALVLNVV

SEQ ID NO: 1893509 - protein, 17 aa, Staphylococcus
VFFKEYQSLIVLSLYLI

SEQ ID NO: 1893510 - protein, 18 aa, Staphylococcus
VFFSCTLIGLLVLATLLG

SEQ ID NO: 1893511 - protein, 18 aa, Staphylococcus
VFGFKWDKEMEGILMKPY

SEQ ID NO: 1893512 - protein, 23 aa, Staphylococcus
VFGRKRIATILMMIYLVATFLSI

SEQ ID NO: 1893513 - protein, 17 aa, Staphylococcus
VFHLIRLASKINSQYNK

SEQ ID NO: 1893514 - protein, 18 aa, Staphylococcus
VFIAFVFQDDITVKAMGI

SEQ ID NO: 1893515 - protein, 17 aa, Staphylococcus
VFIAFVFQDDMQIKSMG

SEQ ID NO: 1893516 - protein, 18 aa, Staphylococcus
VFIAFVFQEDSAIKSMGI

SEQ ID NO: 1893517 - protein, 27 aa, Staphylococcus
VFKNKNYFKYFAMAITIILLSILALGI

SEQ ID NO: 1893518 - protein, 19 aa, Staphylococcus
VFLAWFFVYFQIGRSIVEG

SEQ ID NO: 1893519 - protein, 19 aa, Staphylococcus
VFLFFKGKKAFWFIFVGGF

SEQ ID NO: 1893520 - protein, 19 aa, Staphylococcus
VFLFFKGKKAFWFMFIGGF

SEQ ID NO: 1893521 - protein, 19 aa, Staphylococcus
VFLFFKGKKAFWFMFVGGF

SEQ ID NO: 1893522 - protein, 19 aa, Staphylococcus
VFLFFKGKKAYWFIFIAGF

SEQ ID NO: 1893523 - protein, 18 aa, Staphylococcus
VFLFFKGKKAYWFIFIGG

SEQ ID NO: 1893524 - protein, 19 aa, Staphylococcus
VFLVRFWTLMVSFILGLAL

SEQ ID NO: 1893525 - protein, 17 aa, Staphylococcus
VFMCGVATFLQANKVTG

SEQ ID NO: 1893526 - protein, 19 aa, Staphylococcus
VFMLFRFDWKSEFSVKHHG

SEQ ID NO: 1893527 - protein, 18 aa, Staphylococcus
VFTAEFYASFAFAILISI

SEQ ID NO: 1893528 - protein, 23 aa, Staphylococcus
VFTAEFYASFAFAILISILIDIG

SEQ ID NO: 1893529 - protein, 20 aa, Staphylococcus
VFTDVKWCRMMIRQILSNSL

SEQ ID NO: 1893530 - protein, 22 aa, Staphylococcus
VFVEIFCGIIIFLFTFIEFNNR

SEQ ID NO: 1893531 - protein, 17 aa, Staphylococcus
VFVTLAFMGGDSNSDKV

SEQ ID NO: 1893532 - protein, 17 aa, Staphylococcus
VGAKWVFFSSFIVLLFP

SEQ ID NO: 1893533 - protein, 19 aa, Staphylococcus
VGASFKWYDFVYFIDTIIY

SEQ ID NO: 1893534 - protein, 19 aa, Staphylococcus
VGASFKWYDFVYFIDTIVY

SEQ ID NO: 1893535 - protein, 17 aa, Staphylococcus
VGATLIFGVNHEAKAAE

SEQ ID NO: 1893536 - protein, 20 aa, Staphylococcus
VGFSSAWGYWFAAFLGNVAY

SEQ ID NO: 1893537 - protein, 21 aa, Staphylococcus
VGFYRLPGFVAIIALTTYIYL

SEQ ID NO: 1893538 - protein, 19 aa, Staphylococcus
VGFYRLPGIIAVITLTTYI

SEQ ID NO: 1893539 - protein, 22 aa, Staphylococcus
VGFYRLPGLVAIIALTVYIYLT

SEQ ID NO: 1893540 - protein, 19 aa, Staphylococcus
VGIAWLFGRRFERPHQFQE

SEQ ID NO: 1893541 - protein, 17 aa, Staphylococcus
VGIFTWLIAEWRMLSYR

SEQ ID NO: 1893542 - protein, 20 aa, Staphylococcus
VGKLFFKKDIRQFGSGNTGA

SEQ ID NO: 1893543 - protein, 19 aa, Staphylococcus
VGLLGRFYIIFALFLSVLF

SEQ ID NO: 1893544 - protein, 18 aa, Staphylococcus
VGLLLKWQWYTYKLESWS

SEQ ID NO: 1893545 - protein, 19 aa, Staphylococcus
VGLLLVWLVVTFVAKSYTI

SEQ ID NO: 1893546 - protein, 26 aa, Staphylococcus
VGMPWRGFHRHFWKQALLLIMVAAVI

SEQ ID NO: 1893547 - protein, 17 aa, Staphylococcus
VGRGYKKVLKWSLNHKW

SEQ ID NO: 1893548 - protein, 23 aa, Staphylococcus
VGTFCIIMVFALLGFLIYNVNPA

SEQ ID NO: 1893549 - protein, 24 aa, Staphylococcus
VGTFSTVIATLSFITHTGHAAELD

SEQ ID NO: 1893550 - protein, 18 aa, Staphylococcus
VGVLTAFIGGFGYVYFMS

SEQ ID NO: 1893551 - protein, 17 aa, Staphylococcus
VGWRFTFIFIVAVSVIV

SEQ ID NO: 1893552 - protein, 17 aa, Staphylococcus
VGWTYWFTWIISGMAEV

SEQ ID NO: 1893553 - protein, 22 aa, Staphylococcus
VIALICLILFFVALRNNKKIKR

SEQ ID NO: 1893554 - protein, 18 aa, Staphylococcus
VIATLTFLSHPGHAATQE

SEQ ID NO: 1893555 - protein, 17 aa, Staphylococcus
VIDGEFTSVDALKNFEI

SEQ ID NO: 1893556 - protein, 18 aa, Staphylococcus
VIEWPLFIIFSLIFLLMV

SEQ ID NO: 1893557 - protein, 22 aa, Staphylococcus
VIFEKNKLVIIVGCALVLLLAI

SEQ ID NO: 1893558 - protein, 19 aa, Staphylococcus
VIFIYEWGIASLLFKVNTL

SEQ ID NO: 1893559 - protein, 20 aa, Staphylococcus
VIHVQWKLLGYFLIIMAVFI

SEQ ID NO: 1893560 - protein, 18 aa, Staphylococcus
VIIEQIVKKSFKDIDLAS

SEQ ID NO: 1893561 - protein, 26 aa, Staphylococcus
VIISCLVCAFILPRIWPLKSIKDEYA

SEQ ID NO: 1893562 - protein, 19 aa, Staphylococcus
VIIVLRLGYLQIAQGSHYK

SEQ ID NO: 1893563 - protein, 21 aa, Staphylococcus
VIKQAVIIVWEFIKTYVQVAI

SEQ ID NO: 1893564 - protein, 21 aa, Staphylococcus
VILFSALVSFLFANVYYHFNL

SEQ ID NO: 1893565 - protein, 17 aa, Staphylococcus
VIMVFALIGFLPYNLNP

SEQ ID NO: 1893566 - protein, 17 aa, Staphylococcus
VINAFLIVIGWKYLSKT

SEQ ID NO: 1893567 - protein, 18 aa, Staphylococcus
VINIPKWIQFLFIVIVAM

SEQ ID NO: 1893568 - protein, 20 aa, Staphylococcus
VINTRLVYKAGTLTPIDVST

SEQ ID NO: 1893569 - protein, 19 aa, Staphylococcus
VIQIEGYKYIRTETEDGIT

SEQ ID NO: 1893570 - protein, 18 aa, Staphylococcus
VISLCISGGLIIAFIFTI

SEQ ID NO: 1893571 - protein, 23 aa, Staphylococcus
VISRWAQEYNIYFKRYNSDQFVA

SEQ ID NO: 1893572 - protein, 17 aa, Staphylococcus
VIVSGVIPFNIIKGIII

SEQ ID NO: 1893573 - protein, 23 aa, Staphylococcus
VKAFGEFEFWFAMIKVVTIILMI

SEQ ID NO: 1893574 - protein, 23 aa, Staphylococcus
VKAFGEFEFWFAMIKVVTIVLMI

SEQ ID NO: 1893575 - protein, 23 aa, Staphylococcus
VKAFKLEIKWPFWLSQIGLIFLG

SEQ ID NO: 1893576 - protein, 18 aa, Staphylococcus
VKAGFKMAFNKQDGTGYA

SEQ ID NO: 1893577 - protein, 18 aa, Staphylococcus
VKDYGSGMTPFYTSLSIW

SEQ ID NO: 1893578 - protein, 23 aa, Staphylococcus
VKEIPETATIVWFDFENATQAEN

SEQ ID NO: 1893579 - protein, 18 aa, Staphylococcus
VKFIKWIQAKPFYDNTTI

SEQ ID NO: 1893580 - protein, 23 aa, Staphylococcus
VKHHKGKEILYAWSPFVILTIIV

SEQ ID NO: 1893581 - protein, 24 aa, Staphylococcus
VKHISRSIFGFMRYNDAYDQVRIF

SEQ ID NO: 1893582 - protein, 19 aa, Staphylococcus
VKILGRLNYRTSYGQNVLK

SEQ ID NO: 1893583 - protein, 19 aa, Staphylococcus
VKINARQLLLNAINNKKQE

SEQ ID NO: 1893584 - protein, 19 aa, Staphylococcus
VKKAAARKAIDDAATAKKE

SEQ ID NO: 1893585 - protein, 22 aa, Staphylococcus
VKKLPDKTIVTFSDNYEVTIPG

SEQ ID NO: 1893586 - protein, 18 aa, Staphylococcus
VKNYGSGMTPFYTALSIW

SEQ ID NO: 1893587 - protein, 23 aa, Staphylococcus
VKPTTHWGMIFLYVCMAIAGLVL

SEQ ID NO: 1893588 - protein, 18 aa, Staphylococcus
VKPYKWRIIATILVGILK

SEQ ID NO: 1893589 - protein, 20 aa, Staphylococcus
VKPYKWRIVATIIIGIIKFG

SEQ ID NO: 1893590 - protein, 17 aa, Staphylococcus
VKQGFKMAFNEKDGTGY

SEQ ID NO: 1893591 - protein, 23 aa, Staphylococcus
VKQIRWFGCIGMALSTLAFYYIP

SEQ ID NO: 1893592 - protein, 20 aa, Staphylococcus
VKQLRTARRFGIGWMAISLI

SEQ ID NO: 1893593 - protein, 17 aa, Staphylococcus
VKRKVVVQLTRFEKVLY

SEQ ID NO: 1893594 - protein, 17 aa, Staphylococcus
VKWGAAITAIFAILIFV

SEQ ID NO: 1893595 - protein, 17 aa, Staphylococcus
VKWGAAITAIFSILIFV

SEQ ID NO: 1893596 - protein, 29 aa, Staphylococcus
VKYFFKEHWAKVLIVLAVILLIVLINAIF

SEQ ID NO: 1893597 - protein, 21 aa, Staphylococcus
VKYNPKNGYAYSVNGDKEALD

SEQ ID NO: 1893598 - protein, 18 aa, Staphylococcus
VLCSLAFAVCMILGTLTA

SEQ ID NO: 1893599 - protein, 25 aa, Staphylococcus
VLFLDRVGLFLAMLVLVLQLSSSEG

SEQ ID NO: 1893600 - protein, 17 aa, Staphylococcus
VLFLFPFVQKHFVKGIN

SEQ ID NO: 1893601 - protein, 18 aa, Staphylococcus
VLGWLSWVFLLILTIVTM

SEQ ID NO: 1893602 - protein, 17 aa, Staphylococcus
VLHDLNFEIPKGKVTAF

SEQ ID NO: 1893603 - protein, 17 aa, Staphylococcus
VLIPLTFIIGADLLLLS

SEQ ID NO: 1893604 - protein, 19 aa, Staphylococcus
VLIVLRLGYLQIAQGAHYS

SEQ ID NO: 1893605 - protein, 18 aa, Staphylococcus
VLIVPPLISFVWIAGFGG

SEQ ID NO: 1893606 - protein, 18 aa, Staphylococcus
VLIVPPLISFVWICGFGG

SEQ ID NO: 1893607 - protein, 30 aa, Staphylococcus
VLIYIFFCYKKLKILFLFVIVFIVLCVFNV

SEQ ID NO: 1893608 - protein, 21 aa, Staphylococcus
VLLFFAFRTSNNFKIQHRMIA

SEQ ID NO: 1893609 - protein, 17 aa, Staphylococcus
VLLGGLGLAFIRKRKAS

SEQ ID NO: 1893610 - protein, 25 aa, Staphylococcus
VLLICGIGGAAAYYFTKNTPKNTYL

SEQ ID NO: 1893611 - protein, 18 aa, Staphylococcus
VLLIIAIILILFAIVAVF

SEQ ID NO: 1893612 - protein, 17 aa, Staphylococcus
VLLLDWLKRIPKMYYNP

SEQ ID NO: 1893613 - protein, 30 aa, Staphylococcus
VLLRKRLYLIMSICLPLFFYLLFTSILDLP

SEQ ID NO: 1893614 - protein, 18 aa, Staphylococcus
VLLVLCFVGIILLSFYLS

SEQ ID NO: 1893615 - protein, 17 aa, Staphylococcus
VLMYIVGIWMHRRSSAK

SEQ ID NO: 1893616 - protein, 21 aa, Staphylococcus
VLNSLPGFNLINGGKVGVLNA

SEQ ID NO: 1893617 - protein, 18 aa, Staphylococcus
VLRPAEVAKFIIITFLIL

SEQ ID NO: 1893618 - protein, 18 aa, Staphylococcus
VLSIFIFLMAFKMLGVSI

SEQ ID NO: 1893619 - protein, 23 aa, Staphylococcus
VLSIILAFAFKWLGFVDDVLLMV

SEQ ID NO: 1893620 - protein, 21 aa, Staphylococcus
VLSKVFIIWLFKRYSNNMRGS

SEQ ID NO: 1893621 - protein, 18 aa, Staphylococcus
VLTMFAVFIFKYSYNKND

SEQ ID NO: 1893622 - protein, 21 aa, Staphylococcus
VLTMFAVFIFKYSYNKNDESG

SEQ ID NO: 1893623 - protein, 21 aa, Staphylococcus
VLTSIALVVVWFIFKPLVATI

SEQ ID NO: 1893624 - protein, 23 aa, Staphylococcus
VLVTGWQKRTWVTIIATLSGTFL

SEQ ID NO: 1893625 - protein, 22 aa, Staphylococcus
VLWRHIIHLKMPFFDQNESGQL

SEQ ID NO: 1893626 - protein, 22 aa, Staphylococcus
VLYYWDIFKFFSPLTWSLIFIT

SEQ ID NO: 1893627 - protein, 18 aa, Staphylococcus
VMCLLRWLFNMFGIGPTQ

SEQ ID NO: 1893628 - protein, 19 aa, Staphylococcus
VMGTGFAFWSFVLAIVLIV

SEQ ID NO: 1893629 - protein, 18 aa, Staphylococcus
VMIIPTWINLLLKTYAFI

SEQ ID NO: 1893630 - protein, 22 aa, Staphylococcus
VMNGWDHLDFVGLDATDYKRIG

SEQ ID NO: 1893631 - protein, 17 aa, Staphylococcus
VNDVIWRILIFYIGAIF

SEQ ID NO: 1893632 - protein, 24 aa, Staphylococcus
VNELRYSTALSFLSVNLFSIPIAF

SEQ ID NO: 1893633 - protein, 17 aa, Staphylococcus
VNGFVMMYPNGNGYSNN

SEQ ID NO: 1893634 - protein, 22 aa, Staphylococcus
VNGIKSGLSWVVDAARNVAQSA

SEQ ID NO: 1893635 - protein, 20 aa, Staphylococcus
VNGKALRVYINFRNNNDDQV

SEQ ID NO: 1893636 - protein, 25 aa, Staphylococcus
VNGKENLYRIAIQYYGEGTQQNVDK

SEQ ID NO: 1893637 - protein, 24 aa, Staphylococcus
VNGKENLYRIAIQYYGSGSPANVE

SEQ ID NO: 1893638 - protein, 25 aa, Staphylococcus
VNGQNLYRIAIQYYGEGTPENVEKI

SEQ ID NO: 1893639 - protein, 25 aa, Staphylococcus
VNHTLRFASFYSVMIFFVIIGFALH

SEQ ID NO: 1893640 - protein, 18 aa, Staphylococcus
VNIPISVQYDNYRDGHVI

SEQ ID NO: 1893641 - protein, 20 aa, Staphylococcus
VNLFLAWFFVFFPWGNWFVS

SEQ ID NO: 1893642 - protein, 19 aa, Staphylococcus
VNLKLRYPFIGAIIGSAIG

SEQ ID NO: 1893643 - protein, 19 aa, Staphylococcus
VNLKLRYPFIGAIVGSAFG

SEQ ID NO: 1893644 - protein, 19 aa, Staphylococcus
VNLKLRYPFIGAIVGSGIG

SEQ ID NO: 1893645 - protein, 19 aa, Staphylococcus
VNLKLRYPFIGAIVGSGLG

SEQ ID NO: 1893646 - protein, 20 aa, Staphylococcus
VNLPFQFTFPGSEWVVLILG

SEQ ID NO: 1893647 - protein, 27 aa, Staphylococcus
VNLQKELWKYIALIGVVVLIAIYLAVR

SEQ ID NO: 1893648 - protein, 20 aa, Staphylococcus
VNPMWYNLNFALVPQNDVKI

SEQ ID NO: 1893649 - protein, 26 aa, Staphylococcus
VNPQSVNSYDTWLTIQGYQNQVNDSS

SEQ ID NO: 1893650 - protein, 18 aa, Staphylococcus
VNSDVRFSSFYGVMIYII

SEQ ID NO: 1893651 - protein, 18 aa, Staphylococcus
VNVWIFKFFVDVLGMNSF

SEQ ID NO: 1893652 - protein, 18 aa, Staphylococcus
VNVWIFKFFVDVLKMNSF

SEQ ID NO: 1893653 - protein, 17 aa, Staphylococcus
VNVWIFKFFVDVLNMNS

SEQ ID NO: 1893654 - protein, 22 aa, Staphylococcus
VPALGSTLFRKGIQTKPEKQAQ

SEQ ID NO: 1893655 - protein, 23 aa, Staphylococcus
VPALGSTLFRKGVKTKRQREGLG

SEQ ID NO: 1893656 - protein, 23 aa, Staphylococcus
VPEGTPVYMQWIDKDGVVSPIYR

SEQ ID NO: 1893657 - protein, 19 aa, Staphylococcus
VPFFKKLRVTSAYEYLEAR

SEQ ID NO: 1893658 - protein, 17 aa, Staphylococcus
VPMTVKIAYYIAAAVLL

SEQ ID NO: 1893659 - protein, 17 aa, Staphylococcus
VPSIVKKSIATQELDNA

SEQ ID NO: 1893660 - protein, 17 aa, Staphylococcus
VPSMIGMLMLIGIVVTN

SEQ ID NO: 1893661 - protein, 18 aa, Staphylococcus
VPVKIPGYQHFRTSISDG

SEQ ID NO: 1893662 - protein, 18 aa, Staphylococcus
VPVNFEFKVTKKLEGGQL

SEQ ID NO: 1893663 - protein, 31 aa, Staphylococcus
VQAFCYLVSLILCLPLNFSEHIIAKENTDVS

SEQ ID NO: 1893664 - protein, 21 aa, Staphylococcus
VQLRWIPEMFRAIGEKPETLD

SEQ ID NO: 1893665 - protein, 26 aa, Staphylococcus
VQPDFLYDIGFQFSFLISLFLILAQP

SEQ ID NO: 1893666 - protein, 18 aa, Staphylococcus
VQVLGLITGDIGSMPDLK

SEQ ID NO: 1893667 - protein, 19 aa, Staphylococcus
VRAITRFEIPDGYSIKDVT

SEQ ID NO: 1893668 - protein, 18 aa, Staphylococcus
VRDYGSGMTPFYTALSIW

SEQ ID NO: 1893669 - protein, 19 aa, Staphylococcus
VRFKLWQFLLILLGVILIT

SEQ ID NO: 1893670 - protein, 20 aa, Staphylococcus
VRFYPWVKMWAMNIETLNKI

SEQ ID NO: 1893671 - protein, 18 aa, Staphylococcus
VRHFKRTLILTAILTLLS

SEQ ID NO: 1893672 - protein, 25 aa, Staphylococcus
VRLKEAFEPLHFLGFYIDGVRMFTV

SEQ ID NO: 1893673 - protein, 21 aa, Staphylococcus
VRMPRMLAGLVIGGALGIAGL

SEQ ID NO: 1893674 - protein, 17 aa, Staphylococcus
VRRERMIILFAAVALSS

SEQ ID NO: 1893675 - protein, 18 aa, Staphylococcus
VSAGYKWFFAYPDQKVET

SEQ ID NO: 1893676 - protein, 19 aa, Staphylococcus
VSAGYKWFFAYPDQKVETV

SEQ ID NO: 1893677 - protein, 19 aa, Staphylococcus
VSAGYKWFFAYPEQKVETV

SEQ ID NO: 1893678 - protein, 19 aa, Staphylococcus
VSASFKWYDFVYFIDTIVY

SEQ ID NO: 1893679 - protein, 19 aa, Staphylococcus
VSASFKWYDFVYFLDTIVY

SEQ ID NO: 1893680 - protein, 23 aa, Staphylococcus
VSAVAAMLAGLGLFGKSRKNKKD

SEQ ID NO: 1893681 - protein, 17 aa, Staphylococcus
VSDSMRNVYSISNSESV

SEQ ID NO: 1893682 - protein, 23 aa, Staphylococcus
VSFPKRVFTALGIGIVLGIALHL

SEQ ID NO: 1893683 - protein, 24 aa, Staphylococcus
VSFPKRVFTALGIGIVYGIVLHLS

SEQ ID NO: 1893684 - protein, 24 aa, Staphylococcus
VSFPKRVFTALGLGIVFGIALHLI

SEQ ID NO: 1893685 - protein, 23 aa, Staphylococcus
VSFPKRVFTALGLGIVYGIILHL

SEQ ID NO: 1893686 - protein, 17 aa, Staphylococcus
VSGAISSIVGWFAQLWA

SEQ ID NO: 1893687 - protein, 23 aa, Staphylococcus
VSGILCLLSFLLVVSIMFTSMFW

SEQ ID NO: 1893688 - protein, 19 aa, Staphylococcus
VSGITWRLLAPIFIAAIVI

SEQ ID NO: 1893689 - protein, 25 aa, Staphylococcus
VSGNENLYRIAIQYYGEGTVENVNK

SEQ ID NO: 1893690 - protein, 17 aa, Staphylococcus
VSIVAGITFFISEHDVQ

SEQ ID NO: 1893691 - protein, 17 aa, Staphylococcus
VSKRLTKPLSYYIDWIS

SEQ ID NO: 1893692 - protein, 18 aa, Staphylococcus
VSKSAYTVLSGRILPEDG

SEQ ID NO: 1893693 - protein, 17 aa, Staphylococcus
VSLGTGVGLIFTQFGFP

SEQ ID NO: 1893694 - protein, 20 aa, Staphylococcus
VSLMTAYLFYSYERHKGQVN

SEQ ID NO: 1893695 - protein, 18 aa, Staphylococcus
VSLSAGITGIFGITEPSM

SEQ ID NO: 1893696 - protein, 27 aa, Staphylococcus
VSMCLKLSCSALLISGSMIGYGFASDM

SEQ ID NO: 1893697 - protein, 20 aa, Staphylococcus
VSRLRFMFETFEKRSYESAN

SEQ ID NO: 1893698 - protein, 23 aa, Staphylococcus
VSRWQKCYLLIIGAMFALLSSIL

SEQ ID NO: 1893699 - protein, 20 aa, Staphylococcus
VSTDVLTRVEIFDENGKSYG

SEQ ID NO: 1893700 - protein, 18 aa, Staphylococcus
VSTLRAGLIIGSKGSSYP

SEQ ID NO: 1893701 - protein, 20 aa, Staphylococcus
VSVCLLFIFAYLNLATGTLN

SEQ ID NO: 1893702 - protein, 19 aa, Staphylococcus
VSWGEWFLFAAPWSILMSI

SEQ ID NO: 1893703 - protein, 19 aa, Staphylococcus
VSWGEWFLYAAPWSILMSI

SEQ ID NO: 1893704 - protein, 20 aa, Staphylococcus
VSWGEWFLYAAPWSILMSIA

SEQ ID NO: 1893705 - protein, 19 aa, Staphylococcus
VSWGEWFLYAAPWSILMSV

SEQ ID NO: 1893706 - protein, 17 aa, Staphylococcus
VSYLLLRKMKIDALFFA

SEQ ID NO: 1893707 - protein, 19 aa, Staphylococcus
VSYLNWHWVYFILTILYLT

SEQ ID NO: 1893708 - protein, 19 aa, Staphylococcus
VTASFKWYDFVYFIDTFIY

SEQ ID NO: 1893709 - protein, 19 aa, Staphylococcus
VTASFKWYDFVYFIDTIIY

SEQ ID NO: 1893710 - protein, 23 aa, Staphylococcus
VTFVDIWRFFSLVNRYENEDKYD

SEQ ID NO: 1893711 - protein, 24 aa, Staphylococcus
VTGMDCSSCAITIEKALRPLDDVT

SEQ ID NO: 1893712 - protein, 23 aa, Staphylococcus
VTGSFNLPLWADRNNAKDSGNYP

SEQ ID NO: 1893713 - protein, 19 aa, Staphylococcus
VTIIPQQWIPKGDVSAKAT

SEQ ID NO: 1893714 - protein, 20 aa, Staphylococcus
VTNARLGYYTVVKEPNVQVL

SEQ ID NO: 1893715 - protein, 23 aa, Staphylococcus
VTPGSEVQLYFIGTSMGNTNGIN

SEQ ID NO: 1893716 - protein, 17 aa, Staphylococcus
VTPIARFVGYKAVGVDP

SEQ ID NO: 1893717 - protein, 17 aa, Staphylococcus
VTSFVIPIGYSFNLDGS

SEQ ID NO: 1893718 - protein, 23 aa, Staphylococcus
VTVTCLLLSFALVFGSLGSKVNA

SEQ ID NO: 1893719 - protein, 17 aa, Staphylococcus
VVAEILMGLVIGQSGFH

SEQ ID NO: 1893720 - protein, 17 aa, Staphylococcus
VVAILGIISAIITIKDK

SEQ ID NO: 1893721 - protein, 18 aa, Staphylococcus
VVCSCYLAFILIGSLQGK

SEQ ID NO: 1893722 - protein, 25 aa, Staphylococcus
VVFENGRYIAHVTIKDADNMTIDAG

SEQ ID NO: 1893723 - protein, 21 aa, Staphylococcus
VVISLYFILRRLFAIKHGKYK

SEQ ID NO: 1893724 - protein, 23 aa, Staphylococcus
VVLAFFLLMFVFRSILVPLKAVL

SEQ ID NO: 1893725 - protein, 18 aa, Staphylococcus
VVLIPVFILFALVNFGFG

SEQ ID NO: 1893726 - protein, 18 aa, Staphylococcus
VVLMLLMFIGRVGLISFI

SEQ ID NO: 1893727 - protein, 17 aa, Staphylococcus
VVLPEGVQFISAQNARA

SEQ ID NO: 1893728 - protein, 25 aa, Staphylococcus
VVLVIIGVVGFHFYNQATGFVSTDN

SEQ ID NO: 1893729 - protein, 18 aa, Staphylococcus
VVMFSRMNIVGWARFGLA

SEQ ID NO: 1893730 - protein, 19 aa, Staphylococcus
VVNPWLKYKNFRYSLEADV

SEQ ID NO: 1893731 - protein, 18 aa, Staphylococcus
VVQFFNWFALMYLWTYST

SEQ ID NO: 1893732 - protein, 23 aa, Staphylococcus
VVSFCFIFLLLVFFKYILKRYFN

SEQ ID NO: 1893733 - protein, 26 aa, Staphylococcus
VVSKSYRKILNWSLNHKWIVLVISVV

SEQ ID NO: 1893734 - protein, 17 aa, Staphylococcus
VVVELFVTIVLPYASIF

SEQ ID NO: 1893735 - protein, 17 aa, Staphylococcus
VVVFKQPFLALIVAASL

SEQ ID NO: 1893736 - protein, 18 aa, Staphylococcus
VVVGPNFYMGIGTPGGNK

SEQ ID NO: 1893737 - protein, 17 aa, Staphylococcus
VVYEFGMALLLFKVNVL

SEQ ID NO: 1893738 - protein, 17 aa, Staphylococcus
VWMTLRILAVVFVWMTY

SEQ ID NO: 1893739 - protein, 18 aa, Staphylococcus
VWPILLFLPFFVSVFVRI

SEQ ID NO: 1893740 - protein, 18 aa, Staphylococcus
VWVGIKFLAVYLYQLITS

SEQ ID NO: 1893741 - protein, 18 aa, Staphylococcus
VWVIFKFIVVYNVQLFIS

SEQ ID NO: 1893742 - protein, 26 aa, Staphylococcus
VYFIICLLISFLALISMNIRILSGFL

SEQ ID NO: 1893743 - protein, 25 aa, Staphylococcus
VYFIVCLLISFLALISMNIRILSGF

SEQ ID NO: 1893744 - protein, 26 aa, Staphylococcus
VYFIVCLLISFLALISMNMRILSGFL

SEQ ID NO: 1893745 - protein, 25 aa, Staphylococcus
VYFIVCLLLSFLALISMNIRILSGF

SEQ ID NO: 1893746 - protein, 17 aa, Staphylococcus
VYFKWQILVTLLFVIPC

SEQ ID NO: 1893747 - protein, 19 aa, Staphylococcus
VYFTHTWTLNDGSIAPESI

SEQ ID NO: 1893748 - protein, 20 aa, Staphylococcus
VYILTVYFFFGRLRNLTRKR

SEQ ID NO: 1893749 - protein, 23 aa, Staphylococcus
VYMIRIGLQIARLLSDLKGRIAV

SEQ ID NO: 1893750 - protein, 21 aa, Staphylococcus
VYTDVKWCRMMIRQILSNSLK

SEQ ID NO: 1893751 - protein, 24 aa, Staphylococcus
VYTDVKWCRMMIRQILSNSLKYSQ

SEQ ID NO: 1893752 - protein, 19 aa, Staphylococcus
VYVVISIIYWLLALIIQGT

SEQ ID NO: 1893753 - protein, 22 aa, Staphylococcus
VYYDMNKAPGSRVLKIEVLNKQ

SEQ ID NO: 1893754 - protein, 17 aa, Staphylococcus
VYYKTLLVITSIAFLVV

SEQ ID NO: 1893755 - protein, 17 aa, Staphylococcus
WAFVLAFLPWIVIILPY

SEQ ID NO: 1893756 - protein, 17 aa, Staphylococcus
WAKNATYCIARKIQIHI

SEQ ID NO: 1893757 - protein, 17 aa, Staphylococcus
WASEYNIYFKRYNSDQF

SEQ ID NO: 1893758 - protein, 23 aa, Staphylococcus
WAVPCYLCAILAIIYGFTGIGIR

SEQ ID NO: 1893759 - protein, 17 aa, Staphylococcus
WCALLFIIGVAFAFFIG

SEQ ID NO: 1893760 - protein, 17 aa, Staphylococcus
WCICLIGAIGLYLLWDL

SEQ ID NO: 1893761 - protein, 25 aa, Staphylococcus
WDFLSQKWWFVLAIVVIVCGTLSQI

SEQ ID NO: 1893762 - protein, 19 aa, Staphylococcus
WDFVICITDLPSISGNKVV

SEQ ID NO: 1893763 - protein, 17 aa, Staphylococcus
WDVFKVLSPLAWSLIFL

SEQ ID NO: 1893764 - protein, 17 aa, Staphylococcus
WELIKPRLIPSFEMGLT

SEQ ID NO: 1893765 - protein, 18 aa, Staphylococcus
WFEARFHLNFGIDLLLHN

SEQ ID NO: 1893766 - protein, 24 aa, Staphylococcus
WFELPRPFRFAGFGFDLDATLVFF

SEQ ID NO: 1893767 - protein, 17 aa, Staphylococcus
WFGCIGMALSTLAFYYL

SEQ ID NO: 1893768 - protein, 24 aa, Staphylococcus
WFGIPRPMRFAGFGFDFGATLVFF

SEQ ID NO: 1893769 - protein, 24 aa, Staphylococcus
WFIGLTVLISIVFVTIVYTLVSLL

SEQ ID NO: 1893770 - protein, 18 aa, Staphylococcus
WFINTSILRYPLNKMTSS

SEQ ID NO: 1893771 - protein, 17 aa, Staphylococcus
WFIVCGLTLLPIYYFFI

SEQ ID NO: 1893772 - protein, 23 aa, Staphylococcus
WFKFWSIIEAGGWVIFNHMEIVF

SEQ ID NO: 1893773 - protein, 19 aa, Staphylococcus
WFKFWSVIESGGWVIFNHM

SEQ ID NO: 1893774 - protein, 17 aa, Staphylococcus
WFKISFIDHLPLKQHSL

SEQ ID NO: 1893775 - protein, 18 aa, Staphylococcus
WFNLWAMWDPYSHTGHIK

SEQ ID NO: 1893776 - protein, 18 aa, Staphylococcus
WFNYCIIALLVVALFYVF

SEQ ID NO: 1893777 - protein, 18 aa, Staphylococcus
WFPFGPIFAGILCVIVII

SEQ ID NO: 1893778 - protein, 18 aa, Staphylococcus
WFPFGPIFAGILCVIVIV

SEQ ID NO: 1893779 - protein, 18 aa, Staphylococcus
WFPFGPIFAGLLCVIVII

SEQ ID NO: 1893780 - protein, 19 aa, Staphylococcus
WFPHIPNWISALFCVLILM

SEQ ID NO: 1893781 - protein, 18 aa, Staphylococcus
WFPVAGWEGLPTIVLPSL

SEQ ID NO: 1893782 - protein, 17 aa, Staphylococcus
WGFPRWASILTIFIGLI

SEQ ID NO: 1893783 - protein, 18 aa, Staphylococcus
WGFPRWASILTIFIVLIA

SEQ ID NO: 1893784 - protein, 17 aa, Staphylococcus
WGFVVAWLLWVQMFPGM

SEQ ID NO: 1893785 - protein, 18 aa, Staphylococcus
WGILSGKMSFFFIITIII

SEQ ID NO: 1893786 - protein, 18 aa, Staphylococcus
WHREGWMIFIGWLSYFFL

SEQ ID NO: 1893787 - protein, 17 aa, Staphylococcus
WIACILVAFPIFTSFTT

SEQ ID NO: 1893788 - protein, 18 aa, Staphylococcus
WIAGTAMAFSSVSVVLNA

SEQ ID NO: 1893789 - protein, 18 aa, Staphylococcus
WIALFAMILGVWFTSYFI

SEQ ID NO: 1893790 - protein, 18 aa, Staphylococcus
WIASIGYLFPLRYAGDAL

SEQ ID NO: 1893791 - protein, 18 aa, Staphylococcus
WIFIISIIVALLAMYLMR

SEQ ID NO: 1893792 - protein, 17 aa, Staphylococcus
WIIVLAFITLILSTIAS

SEQ ID NO: 1893793 - protein, 25 aa, Staphylococcus
WIPNRLVLLTIHFSFFVVIALIIAY

SEQ ID NO: 1893794 - protein, 19 aa, Staphylococcus
WIRERPKGWLLKLSANALG

SEQ ID NO: 1893795 - protein, 17 aa, Staphylococcus
WIRRIKRLLPAVIALLI

SEQ ID NO: 1893796 - protein, 17 aa, Staphylococcus
WIRRIKRLLPAVLALLI

SEQ ID NO: 1893797 - protein, 18 aa, Staphylococcus
WIWPELPIGAAFAIAAIL

SEQ ID NO: 1893798 - protein, 18 aa, Staphylococcus
WIWPELPMPAAFAIAAIL

SEQ ID NO: 1893799 - protein, 18 aa, Staphylococcus
WIYILSIIIALLAMYLIK

SEQ ID NO: 1893800 - protein, 17 aa, Staphylococcus
WKAPYSIVFVLDIFSAL

SEQ ID NO: 1893801 - protein, 19 aa, Staphylococcus
WKFFGLRLGKIKYWFIHPL

SEQ ID NO: 1893802 - protein, 23 aa, Staphylococcus
WKGLSRTGAIFGMISGSVVVIIW

SEQ ID NO: 1893803 - protein, 17 aa, Staphylococcus
WKILHKLGIIKIPNLNG

SEQ ID NO: 1893804 - protein, 17 aa, Staphylococcus
WKMTWIVLSLFSLIMGS

SEQ ID NO: 1893805 - protein, 20 aa, Staphylococcus
WKTHIIILIAVVLLFIVILM

SEQ ID NO: 1893806 - protein, 17 aa, Staphylococcus
WKVDVPEGLILEHNDVT

SEQ ID NO: 1893807 - protein, 21 aa, Staphylococcus
WLIIDACLIPGMIEENKEKVR

SEQ ID NO: 1893808 - protein, 18 aa, Staphylococcus
WLIVKSMSIGDSYEVIPG

SEQ ID NO: 1893809 - protein, 17 aa, Staphylococcus
WLLSLLISSNFFKKSNW

SEQ ID NO: 1893810 - protein, 17 aa, Staphylococcus
WLLVFGFLFQIPVLFLG

SEQ ID NO: 1893811 - protein, 17 aa, Staphylococcus
WLMIALRFVQGFCGGAG

SEQ ID NO: 1893812 - protein, 17 aa, Staphylococcus
WLNRILVIILMFLNGLG

SEQ ID NO: 1893813 - protein, 25 aa, Staphylococcus
WLPLHAKLALWSVMLTILCATITLV

SEQ ID NO: 1893814 - protein, 23 aa, Staphylococcus
WLPSHAKWALFSFYSCIILITIL

SEQ ID NO: 1893815 - protein, 17 aa, Staphylococcus
WLQLSFMDHLWLKDYSL

SEQ ID NO: 1893816 - protein, 19 aa, Staphylococcus
WLQQWTIFYWAWWISWAPF

SEQ ID NO: 1893817 - protein, 17 aa, Staphylococcus
WLSGLLVGWAFMNVLVK

SEQ ID NO: 1893818 - protein, 19 aa, Staphylococcus
WLVGSFLFGWYISNFGNYN

SEQ ID NO: 1893819 - protein, 17 aa, Staphylococcus
WNLFKFIVLEGNFFGWF

SEQ ID NO: 1893820 - protein, 17 aa, Staphylococcus
WNTAQRMIITWIITLPI

SEQ ID NO: 1893821 - protein, 19 aa, Staphylococcus
WNTAQRMIITWVITLPISA

SEQ ID NO: 1893822 - protein, 17 aa, Staphylococcus
WPGFVLVIIGAVFWGVG

SEQ ID NO: 1893823 - protein, 18 aa, Staphylococcus
WPISILVIIVIVLSLIFA

SEQ ID NO: 1893824 - protein, 17 aa, Staphylococcus
WPLFIVFALIFILLVPN

SEQ ID NO: 1893825 - protein, 17 aa, Staphylococcus
WPLFIVFAVIFILILPN

SEQ ID NO: 1893826 - protein, 22 aa, Staphylococcus
WQMSLEFSMWRLFGISIIAVLG

SEQ ID NO: 1893827 - protein, 20 aa, Staphylococcus
WRANLSYWKRRMASGLTGWG

SEQ ID NO: 1893828 - protein, 17 aa, Staphylococcus
WRFTFIFIVAVSVIVGI

SEQ ID NO: 1893829 - protein, 17 aa, Staphylococcus
WRILLFYVLSIAVIAAI

SEQ ID NO: 1893830 - protein, 20 aa, Staphylococcus
WRIPFTPGLVPKRREEIAYK

SEQ ID NO: 1893831 - protein, 19 aa, Staphylococcus
WRIVATIIIGIIKFGIPML

SEQ ID NO: 1893832 - protein, 19 aa, Staphylococcus
WRLLFVILGILGLVWVIIW

SEQ ID NO: 1893833 - protein, 17 aa, Staphylococcus
WRMGLSSVLALLHDVFI

SEQ ID NO: 1893834 - protein, 19 aa, Staphylococcus
WRMIFAFLTLIAFIVLIGI

SEQ ID NO: 1893835 - protein, 17 aa, Staphylococcus
WRSVFYVVFPIAIIIII

SEQ ID NO: 1893836 - protein, 33 aa, Staphylococcus
WRVLMRLIRYTFSFKWLIALAFLMLAISTAASV

SEQ ID NO: 1893837 - protein, 17 aa, Staphylococcus
WRVVFGIMIILAVITML

SEQ ID NO: 1893838 - protein, 17 aa, Staphylococcus
WRYTFLFIIVVSVLAGI

SEQ ID NO: 1893839 - protein, 19 aa, Staphylococcus
WSASFFKALFVPGGALESF

SEQ ID NO: 1893840 - protein, 17 aa, Staphylococcus
WSEWKVVSVFWLVGLIS

SEQ ID NO: 1893841 - protein, 17 aa, Staphylococcus
WSFKLHIFLGFSIFALW

SEQ ID NO: 1893842 - protein, 17 aa, Staphylococcus
WSLEVARAMTGGIGIVL

SEQ ID NO: 1893843 - protein, 17 aa, Staphylococcus
WSLVSFIALPMILINSI

SEQ ID NO: 1893844 - protein, 20 aa, Staphylococcus
WSNSKFKLALKVQDRQDSNE

SEQ ID NO: 1893845 - protein, 24 aa, Staphylococcus
WSPMKGMPAWGWSILFLLIIFALN

SEQ ID NO: 1893846 - protein, 23 aa, Staphylococcus
WSTAQRMVITWVITLPISALLAG

SEQ ID NO: 1893847 - protein, 23 aa, Staphylococcus
WSTAQRMVITWVITLPISAVLAA

SEQ ID NO: 1893848 - protein, 26 aa, Staphylococcus
WTAPFKARMILGFVMSFLNAIFIAMP

SEQ ID NO: 1893849 - protein, 17 aa, Staphylococcus
WTFRKLLNYGIDGLISF

SEQ ID NO: 1893850 - protein, 19 aa, Staphylococcus
WTLFYQKNCILAMIPMKLK

SEQ ID NO: 1893851 - protein, 23 aa, Staphylococcus
WTVPCYLCALIAITYGFTGIGIK

SEQ ID NO: 1893852 - protein, 17 aa, Staphylococcus
WVFFSSFIVLLFPIYFL

SEQ ID NO: 1893853 - protein, 17 aa, Staphylococcus
WVFNLIRVVLPLIIILV

SEQ ID NO: 1893854 - protein, 18 aa, Staphylococcus
WVNYCSWILIIVLSVLNV

SEQ ID NO: 1893855 - protein, 17 aa, Staphylococcus
WVSVLTICFILAVSKIT

SEQ ID NO: 1893856 - protein, 17 aa, Staphylococcus
WVVCFIISIAQNFYESY

SEQ ID NO: 1893857 - protein, 17 aa, Staphylococcus
WVWSCIFLVIIFALNSL

SEQ ID NO: 1893858 - protein, 18 aa, Staphylococcus
WWESYKFYQHDKELKVKI

SEQ ID NO: 1893859 - protein, 19 aa, Staphylococcus
WYYRYIGLISLIWTLVTLY

SEQ ID NO: 1893860 - protein, 26 aa, Staphylococcus
YAALIAWRVGLKWKDLEEGITRRLTT

SEQ ID NO: 1893861 - protein, 26 aa, Staphylococcus
YAIKQWKFQLSIIILVIISIALFLIY

SEQ ID NO: 1893862 - protein, 18 aa, Staphylococcus
YAKEASWTSPRKAILGGA

SEQ ID NO: 1893863 - protein, 17 aa, Staphylococcus
YAKVWLYFMYFWIIFGI

SEQ ID NO: 1893864 - protein, 20 aa, Staphylococcus
YCLFISFTLLIMFISMYAIL

SEQ ID NO: 1893865 - protein, 25 aa, Staphylococcus
YCVRRLKKIWKWFAMSLVIGIILVL

SEQ ID NO: 1893866 - protein, 17 aa, Staphylococcus
YDMIGLWAPALLLLARI

SEQ ID NO: 1893867 - protein, 19 aa, Staphylococcus
YDQLILMEFRFPRMLITIL

SEQ ID NO: 1893868 - protein, 19 aa, Staphylococcus
YDRAVELYHYIKGGKVDYG

SEQ ID NO: 1893869 - protein, 19 aa, Staphylococcus
YDVKDILKDVSFRIPQGQV

SEQ ID NO: 1893870 - protein, 21 aa, Staphylococcus
YDYHLVKVIPYVLVLVLALIG

SEQ ID NO: 1893871 - protein, 20 aa, Staphylococcus
YEIRHLRAMFGYVPQDNFLF

SEQ ID NO: 1893872 - protein, 17 aa, Staphylococcus
YFASWAFLKLMGSNDHS

SEQ ID NO: 1893873 - protein, 18 aa, Staphylococcus
YFFILRLSERQIYKNEKA

SEQ ID NO: 1893874 - protein, 19 aa, Staphylococcus
YFHRIFPRISYKIYVIIFT

SEQ ID NO: 1893875 - protein, 19 aa, Staphylococcus
YFLHFNWFQPLLIGLAGLL

SEQ ID NO: 1893876 - protein, 24 aa, Staphylococcus
YFLLREIPTFISLVGGVIILIGVT

SEQ ID NO: 1893877 - protein, 18 aa, Staphylococcus
YFLNFVVLYLKWDMAILK

SEQ ID NO: 1893878 - protein, 18 aa, Staphylococcus
YFLQFNWFQPLLIGLSAL

SEQ ID NO: 1893879 - protein, 25 aa, Staphylococcus
YFVLRYRIGGGIAEHPHFLWFNLIH

SEQ ID NO: 1893880 - protein, 23 aa, Staphylococcus
YFVLRYRIGGGITEHPHFLWFNL

SEQ ID NO: 1893881 - protein, 18 aa, Staphylococcus
YFVPEWFTGNVFIIGLVG

SEQ ID NO: 1893882 - protein, 17 aa, Staphylococcus
YFYSIYEMFKWLNHSKH

SEQ ID NO: 1893883 - protein, 18 aa, Staphylococcus
YGFLRLEIIVAFLNGLAL

SEQ ID NO: 1893884 - protein, 20 aa, Staphylococcus
YGFLRLEIIVAFLNGLALIV

SEQ ID NO: 1893885 - protein, 21 aa, Staphylococcus
YGHSMMNVWVILPWFIIALPI

SEQ ID NO: 1893886 - protein, 17 aa, Staphylococcus
YGKRLLLATAISTLQGM

SEQ ID NO: 1893887 - protein, 18 aa, Staphylococcus
YGNDWFGYFMRRLAERPQ

SEQ ID NO: 1893888 - protein, 19 aa, Staphylococcus
YGYLVKGWLALHEVGHGYD

SEQ ID NO: 1893889 - protein, 19 aa, Staphylococcus
YHDIFPFSNLRKIRTYADE

SEQ ID NO: 1893890 - protein, 19 aa, Staphylococcus
YHSFLLKKWYLFVYLILIV

SEQ ID NO: 1893891 - protein, 18 aa, Staphylococcus
YIALRISLIKILRPYYPF

SEQ ID NO: 1893892 - protein, 17 aa, Staphylococcus
YIICFSMYIATFILGLF

SEQ ID NO: 1893893 - protein, 19 aa, Staphylococcus
YIIGDKWRYSGVTVTENGI

SEQ ID NO: 1893894 - protein, 17 aa, Staphylococcus
YILTVYFFFGKLRSLTR

SEQ ID NO: 1893895 - protein, 20 aa, Staphylococcus
YIPFELCLLLKLFKPKKVIE

SEQ ID NO: 1893896 - protein, 20 aa, Staphylococcus
YIPFELVLLLPLFVPKRKFE

SEQ ID NO: 1893897 - protein, 22 aa, Staphylococcus
YISSWPWDWAKFTSVLMEDGSI

SEQ ID NO: 1893898 - protein, 24 aa, Staphylococcus
YIVTLLGSFALLISRKRERKDNNR

SEQ ID NO: 1893899 - protein, 18 aa, Staphylococcus
YKEIIKYSIPFVIVSLNF

SEQ ID NO: 1893900 - protein, 18 aa, Staphylococcus
YKGILNWKGNEYKFLYKV

SEQ ID NO: 1893901 - protein, 22 aa, Staphylococcus
YKGKRYYNFFGIGAFDEDAMKH

SEQ ID NO: 1893902 - protein, 23 aa, Staphylococcus
YKKLRLQVFLGIFIGYAGYYLLR

SEQ ID NO: 1893903 - protein, 21 aa, Staphylococcus
YKKPIVLMAMALVFATVIGVG

SEQ ID NO: 1893904 - protein, 24 aa, Staphylococcus
YKNKYPVVLVHGFLGLVGDNAPAL

SEQ ID NO: 1893905 - protein, 23 aa, Staphylococcus
YKQEWFIVLTLIFIFPLGLFVMW

SEQ ID NO: 1893906 - protein, 21 aa, Staphylococcus
YKVVLPEGATFVTAENATGSF

SEQ ID NO: 1893907 - protein, 17 aa, Staphylococcus
YKWMIITTLITFTTILL

SEQ ID NO: 1893908 - protein, 17 aa, Staphylococcus
YKYSIFCAVLFILGVIF

SEQ ID NO: 1893909 - protein, 18 aa, Staphylococcus
YLASESISASTSMSSSES

SEQ ID NO: 1893910 - protein, 17 aa, Staphylococcus
YLAWKLNPAGSMSIMIS

SEQ ID NO: 1893911 - protein, 17 aa, Staphylococcus
YLCAVLAIIYGFTGIGI

SEQ ID NO: 1893912 - protein, 18 aa, Staphylococcus
YLENGGIRDEEWLQKKLN

SEQ ID NO: 1893913 - protein, 17 aa, Staphylococcus
YLFLGLAIFCFVLYIAF

SEQ ID NO: 1893914 - protein, 25 aa, Staphylococcus
YLHELIRWLLIFGVLFQLPTLFMGL

SEQ ID NO: 1893915 - protein, 19 aa, Staphylococcus
YLIFKFKPLKVIASEDEVT

SEQ ID NO: 1893916 - protein, 24 aa, Staphylococcus
YLIVCLLISFLALISMNIRVLSGI

SEQ ID NO: 1893917 - protein, 17 aa, Staphylococcus
YLLCIFIFFVLAKIDLY

SEQ ID NO: 1893918 - protein, 24 aa, Staphylococcus
YLPDEWRMPLSIGLLVLIFSTLIF

SEQ ID NO: 1893919 - protein, 18 aa, Staphylococcus
YLPFTYLIDCLREVVGGI

SEQ ID NO: 1893920 - protein, 19 aa, Staphylococcus
YLPLEWRRPLSIGLTVLIL

SEQ ID NO: 1893921 - protein, 18 aa, Staphylococcus
YLPLKKHYPYFILGFIIT

SEQ ID NO: 1893922 - protein, 18 aa, Staphylococcus
YLPPHWIVMLLLSSISIL

SEQ ID NO: 1893923 - protein, 17 aa, Staphylococcus
YLRKIWVAVKFLVVYLY

SEQ ID NO: 1893924 - protein, 19 aa, Staphylococcus
YLSLNKRYLFIITIVLLVS

SEQ ID NO: 1893925 - protein, 21 aa, Staphylococcus
YLVEFFDWRSLFHVVAPIAAI

SEQ ID NO: 1893926 - protein, 17 aa, Staphylococcus
YLWVIPIGIVWFVLYYV

SEQ ID NO: 1893927 - protein, 17 aa, Staphylococcus
YMIRIGLQIAHLLNDLK

SEQ ID NO: 1893928 - protein, 26 aa, Staphylococcus
YMPELKWQYSYPICMIVMLIIAIALI

SEQ ID NO: 1893929 - protein, 22 aa, Staphylococcus
YMPYICSYFMPRSIGDRPLVVP

SEQ ID NO: 1893930 - protein, 23 aa, Staphylococcus
YMSSWPWDWAKFMGKLMHNGTIS

SEQ ID NO: 1893931 - protein, 18 aa, Staphylococcus
YMSSWPWDWAKPMGSLMK

SEQ ID NO: 1893932 - protein, 22 aa, Staphylococcus
YMSSWPWEWAKPMGALMKDGSI

SEQ ID NO: 1893933 - protein, 19 aa, Staphylococcus
YNGETYLLIANEGDSQDYE

SEQ ID NO: 1893934 - protein, 22 aa, Staphylococcus
YNIFRKETFSGNQYLNSLQQSS

SEQ ID NO: 1893935 - protein, 24 aa, Staphylococcus
YNKKPKFPWFKTIIVALIAGIIGA

SEQ ID NO: 1893936 - protein, 23 aa, Staphylococcus
YNKPKFPWFKTILVALIAGIIGA

SEQ ID NO: 1893937 - protein, 29 aa, Staphylococcus
YNNVRGSFSLLSWPFKELVTTDKQSVPVG

SEQ ID NO: 1893938 - protein, 17 aa, Staphylococcus
YNSDCDYSSDSDSGLDY

SEQ ID NO: 1893939 - protein, 17 aa, Staphylococcus
YNTEMGHGFALESTHLD

SEQ ID NO: 1893940 - protein, 18 aa, Staphylococcus
YNVWWGFEDDKLYKFAKD

SEQ ID NO: 1893941 - protein, 17 aa, Staphylococcus
YPFIGAIVGSAFGAAYI

SEQ ID NO: 1893942 - protein, 21 aa, Staphylococcus
YPIVHLKLFYFFHAINNSVWF

SEQ ID NO: 1893943 - protein, 21 aa, Staphylococcus
YPKERIRFIAIQYLLDNNQIY

SEQ ID NO: 1893944 - protein, 17 aa, Staphylococcus
YPKGYALESRPFLTDTA

SEQ ID NO: 1893945 - protein, 17 aa, Staphylococcus
YPLKRAVTLIGLVLTLI

SEQ ID NO: 1893946 - protein, 21 aa, Staphylococcus
YPMIYRRLSFLLVIGVIHGMF

SEQ ID NO: 1893947 - protein, 18 aa, Staphylococcus
YQHIPILGVCLGFQMIYQ

SEQ ID NO: 1893948 - protein, 17 aa, Staphylococcus
YQRRIYIVIAFILILMM

SEQ ID NO: 1893949 - protein, 17 aa, Staphylococcus
YRAALLYHKWYFIEHWE

SEQ ID NO: 1893950 - protein, 21 aa, Staphylococcus
YRDKKFWKFFGLRLGKIKYWF

SEQ ID NO: 1893951 - protein, 17 aa, Staphylococcus
YRFESIIAFIVIAISCK

SEQ ID NO: 1893952 - protein, 18 aa, Staphylococcus
YRFTTFFTMIAALIDGIK

SEQ ID NO: 1893953 - protein, 19 aa, Staphylococcus
YRGGPAYYIQYGIKGRLGK

SEQ ID NO: 1893954 - protein, 17 aa, Staphylococcus
YRIPRTLLGLVIGSSLA

SEQ ID NO: 1893955 - protein, 18 aa, Staphylococcus
YRKPIILMAMALVFTTVI

SEQ ID NO: 1893956 - protein, 19 aa, Staphylococcus
YRKPIVLMAMALVFATVIG

SEQ ID NO: 1893957 - protein, 19 aa, Staphylococcus
YRKPVVLMAMGLVFTTVIG

SEQ ID NO: 1893958 - protein, 22 aa, Staphylococcus
YRQFELYSGYSIRMLMKNKLNH

SEQ ID NO: 1893959 - protein, 19 aa, Staphylococcus
YRWLKISFIILALISVGLT

SEQ ID NO: 1893960 - protein, 17 aa, Staphylococcus
YRYLIIILVLLVIILLI

SEQ ID NO: 1893961 - protein, 20 aa, Staphylococcus
YRYQVPLPRDNWFLENRDDA

SEQ ID NO: 1893962 - protein, 25 aa, Staphylococcus
YSATSGQYYKLWIEDYQTKNGNTVT

SEQ ID NO: 1893963 - protein, 17 aa, Staphylococcus
YSFGRDGLLPSWLAKLN

SEQ ID NO: 1893964 - protein, 17 aa, Staphylococcus
YSFGRDGLLPSWLGKLN

SEQ ID NO: 1893965 - protein, 17 aa, Staphylococcus
YSFGRDGLLPSWLSQLN

SEQ ID NO: 1893966 - protein, 17 aa, Staphylococcus
YSGYGIRSLMSAKLNYY

SEQ ID NO: 1893967 - protein, 20 aa, Staphylococcus
YSIFCAVLFILGVIFAFFIG

SEQ ID NO: 1893968 - protein, 20 aa, Staphylococcus
YSIYEMFKWLNHSKHMPHLY

SEQ ID NO: 1893969 - protein, 17 aa, Staphylococcus
YSLFILFRFKELKKKGV

SEQ ID NO: 1893970 - protein, 18 aa, Staphylococcus
YSLKRLRDFTPYWQNTFA

SEQ ID NO: 1893971 - protein, 19 aa, Staphylococcus
YSVAFGIFWTLLLIVWYLL

SEQ ID NO: 1893972 - protein, 20 aa, Staphylococcus
YSYLCPMLNWFIPIKYTELS

SEQ ID NO: 1893973 - protein, 23 aa, Staphylococcus
YTEMKWLTPDGHYIHGKGIKPDI

SEQ ID NO: 1893974 - protein, 23 aa, Staphylococcus
YTEMKWLTPDGHYIHGKGIQPDT

SEQ ID NO: 1893975 - protein, 22 aa, Staphylococcus
YTEMKWLTPKGHYIHGKGIQPD

SEQ ID NO: 1893976 - protein, 17 aa, Staphylococcus
YTIRLLPVGGYVRMAGD

SEQ ID NO: 1893977 - protein, 19 aa, Staphylococcus
YTISMNWSLEIARALTGGI

SEQ ID NO: 1893978 - protein, 18 aa, Staphylococcus
YTISMNWSLEITRALTGG

SEQ ID NO: 1893979 - protein, 21 aa, Staphylococcus
YTISMNWSLEVARAMTGGIGI

SEQ ID NO: 1893980 - protein, 21 aa, Staphylococcus
YTLVCGVVFACFAALIFWYPK

SEQ ID NO: 1893981 - protein, 18 aa, Staphylococcus
YTQMKWLTPDGHNIHGKG

SEQ ID NO: 1893982 - protein, 30 aa, Staphylococcus
YTQWLKFAWKLIVVWIIICATAMSIALMIG

SEQ ID NO: 1893983 - protein, 17 aa, Staphylococcus
YTSPTIIVGPDFYMGIG

SEQ ID NO: 1893984 - protein, 25 aa, Staphylococcus
YTYRLTSEGKLYFMTKYDGKEYFIS

SEQ ID NO: 1893985 - protein, 18 aa, Staphylococcus
YVALRISLIKVLKPYYPF

SEQ ID NO: 1893986 - protein, 17 aa, Staphylococcus
YVFRFIWVFVWYKDFYF

SEQ ID NO: 1893987 - protein, 17 aa, Staphylococcus
YVFRFIWVYVLYPYFYL

SEQ ID NO: 1893988 - protein, 23 aa, Staphylococcus
YVLCGGCALIIMEMLTIDHLYNV

SEQ ID NO: 1893989 - protein, 25 aa, Staphylococcus
YVPEILTRKVITLSLFGIIFLLIGI

SEQ ID NO: 1893990 - protein, 19 aa, Staphylococcus
YVPFELCLLLKLFKPKKAF

SEQ ID NO: 1893991 - protein, 17 aa, Staphylococcus
YVVFRLAIKVLKLNTPG

SEQ ID NO: 1893992 - protein, 17 aa, Staphylococcus
YWWMFVISFIFFLIAGV

SEQ ID NO: 1893993 - protein, 17 aa, Staphylococcus
YWWMFVISFIFFLVAGA

SEQ ID NO: 1893994 - protein, 18 aa, Staphylococcus
YYAILDFTGFEKMIDELE

SEQ ID NO: 1893995 - protein, 18 aa, Staphylococcus
YYAVIDFTGFEKMIDELA

SEQ ID NO: 1893996 - protein, 18 aa, Staphylococcus
YYHLPIIVDDAFVHFDKK

SEQ ID NO: 1893997 - protein, 17 aa, Staphylococcus
YYIFRVLSIFIFLMAFK

SEQ ID NO: 1893998 - protein, 19 aa, Staphylococcus
YYMATEMFGVFKSLTKTSA

SEQ ID NO: 1893999 - protein, 19 aa, Staphylococcus
YYPFYRTMEKYNLQLEQKE

SEQ ID NO: 1894000 - protein, 19 aa, Staphylococcus
DTTPPTAPVVTSDLTGKAT

SEQ ID NO: 1894001 - protein, 25 aa, Staphylococcus
GALMTPLMLIVFRFPPHVAVGTSMM

SEQ ID NO: 1894002 - protein, 23 aa, Staphylococcus
GMPMLWANFFWVWGHPEVYIVIL

SEQ ID NO: 1894003 - protein, 20 aa, Staphylococcus
GRVTITPTVPIPEGNVRAKA

SEQ ID NO: 1894004 - protein, 24 aa, Staphylococcus
IKGAPWNIVLFSIGMYLVVFGLKN

SEQ ID NO: 1894005 - protein, 24 aa, Staphylococcus
KVKRELGFVLMALNIRKVVAQRAE

SEQ ID NO: 1894006 - protein, 23 aa, Staphylococcus
GANGHVIITPTQPIPEGNVTAKA

SEQ ID NO: 1894007 - protein, 18 aa, Staphylococcus
LYRLTFVGSIFLAVIAIL

SEQ ID NO: 1894008 - protein, 24 aa, Staphylococcus
SGTGWLMHLLPPVVVGPVIMVIGL

SEQ ID NO: 1894009 - protein, 27 aa, Staphylococcus
SVCAHKRWLFISSTLIKQTVRSSLIKG

SEQ ID NO: 1894010 - protein, 24 aa, Staphylococcus
VRNKIFFTLAMLVIFKIGTYIPAP

SEQ ID NO: 1894011 - protein, 25 aa, Staphylococcus
YHPKMMLKVILYAYTQSVFSGRKIE

SEQ ID NO: 1894012 - protein, 17 aa, Staphylococcus
AIYWAMWPTTAEVILII

SEQ ID NO: 1894013 - protein, 28 aa, Staphylococcus
AVLLQYVFAVRLRWFPVAGWEGFSTAVL

SEQ ID NO: 1894014 - protein, 21 aa, Staphylococcus
FALGWNYWFNWVITVAADVTI

SEQ ID NO: 1894015 - protein, 17 aa, Staphylococcus
GAVTIPDYPSEKGKPTI

SEQ ID NO: 1894016 - protein, 18 aa, Staphylococcus
GVWLYHFLERVLIPTGLH

SEQ ID NO: 1894017 - protein, 24 aa, Staphylococcus
GYLEQLFGPLRRLVSSFTTLTQSF

SEQ ID NO: 1894018 - protein, 18 aa, Staphylococcus
ILMYVFWELTSVSSFLLI

SEQ ID NO: 1894019 - protein, 24 aa, Staphylococcus
LEAVFWMINKILKLAPIGVFAFIC

SEQ ID NO: 1894020 - protein, 17 aa, Staphylococcus
MTEPELLDKICGLLGGR

SEQ ID NO: 1894021 - protein, 26 aa, Staphylococcus
PTTAEVILIIILGLPIYFFYEYKMNW

SEQ ID NO: 1894022 - protein, 22 aa, Staphylococcus
SAQFPFHIWLPKAMAAPTPVSA

SEQ ID NO: 1894023 - protein, 17 aa, Staphylococcus
SIRMMWLSQNQKPSYKT

SEQ ID NO: 1894024 - protein, 24 aa, Staphylococcus
SLIGMLMLIGIVVTNAIVLIDRVI

SEQ ID NO: 1894025 - protein, 24 aa, Staphylococcus
TDTTPPTVPTLDTDLGGKAGTQTP

SEQ ID NO: 1894026 - protein, 24 aa, Staphylococcus
VEPVFGFMKAILGFTRMSVRGLNK

SEQ ID NO: 1894027 - protein, 24 aa, Staphylococcus
AIVAQLIMIFGFQLPPGSAPVTAV

SEQ ID NO: 1894028 - protein, 22 aa, Staphylococcus
ALAIAFLLRPIGGIVFGIIGDK

SEQ ID NO: 1894029 - protein, 21 aa, Staphylococcus
ALITLFNILIHLGFASATSLS

SEQ ID NO: 1894030 - protein, 24 aa, Staphylococcus
ATGIACGFIFYPITMLITKKHKEV

SEQ ID NO: 1894031 - protein, 20 aa, Staphylococcus
DFMRYSLISGILIGFIAPLI

SEQ ID NO: 1894032 - protein, 28 aa, Staphylococcus
DPKNPPFFFNVLLPIVFISALIGILQYT

SEQ ID NO: 1894033 - protein, 26 aa, Staphylococcus
DSFGYGFFIPIFFIMVGVDLNIPSLI

SEQ ID NO: 1894034 - protein, 23 aa, Staphylococcus
EDSKPIIATLFLDNYDEITQNMN

SEQ ID NO: 1894035 - protein, 28 aa, Staphylococcus
EMFRPFALAITFSLLASLLVSITVVPAL

SEQ ID NO: 1894036 - protein, 26 aa, Staphylococcus
EMRRYLMRFVHHIGGLADFSALKFTK

SEQ ID NO: 1894037 - protein, 27 aa, Staphylococcus
EPLEFTFLFIAPYLFVLHALLAATMDT

SEQ ID NO: 1894038 - protein, 18 aa, Staphylococcus
EVEKSLVYFLAALKGNDT

SEQ ID NO: 1894039 - protein, 19 aa, Staphylococcus
FFSSWFLTFGYVCVVALNA

SEQ ID NO: 1894040 - protein, 24 aa, Staphylococcus
FHKVRGLLAFWIGALLIAFTLLSN

SEQ ID NO: 1894041 - protein, 18 aa, Staphylococcus
FILMGQILFHPLVGGFLL

SEQ ID NO: 1894042 - protein, 18 aa, Staphylococcus
FIVSLYWHFLDVVWIFIF

SEQ ID NO: 1894043 - protein, 27 aa, Staphylococcus
FPQDWTIFYWSWWLVYAPFIGLFIARI

SEQ ID NO: 1894044 - protein, 24 aa, Staphylococcus
GHGFKMFVYIMLLGAIVAAFFAND

SEQ ID NO: 1894045 - protein, 23 aa, Staphylococcus
GKTPGEYTVPVTVTYPDGSKDHV

SEQ ID NO: 1894046 - protein, 19 aa, Staphylococcus
GSTALWIGAGLMSLAVLFS

SEQ ID NO: 1894047 - protein, 19 aa, Staphylococcus
GTYTVPATVTYPDGSKDHV

SEQ ID NO: 1894048 - protein, 23 aa, Staphylococcus
GYLEQLFGPLRRLVSSFTTLTQS

SEQ ID NO: 1894049 - protein, 31 aa, Staphylococcus; identical to SEQ ID NO: 1748050

SEQ ID NO: 1894050 - protein, 18 aa, Staphylococcus
IALVVYALLPILRNTYTG

SEQ ID NO: 1894051 - protein, 29 aa, Staphylococcus
IFANAPFTLLPILIGFSAAKRFGGNPFLG

SEQ ID NO: 1894052 - protein, 18 aa, Staphylococcus
ISTLLVSFIIMFVGIQVV

SEQ ID NO: 1894053 - protein, 33 aa, Staphylococcus; identical to SEQ ID NO: 1590493

SEQ ID NO: 1894054 - protein, 19 aa, Staphylococcus
KFEVAVPAFITIIMMPLSY

SEQ ID NO: 1894055 - protein, 30 aa, Staphylococcus; identical to SEQ ID NO: 1590833

SEQ ID NO: 1894056 - protein, 32 aa, Staphylococcus; identical to SEQ ID NO: 1590732

SEQ ID NO: 1894057 - protein, 22 aa, Staphylococcus
LAGLIPFIPIKFSLFKFNNVNN

SEQ ID NO: 1894058 - protein, 17 aa, Staphylococcus
LAVLAIMIPIFGVGKTP

SEQ ID NO: 1894059 - protein, 27 aa, Staphylococcus
LFFSSVLIIFIILLSGLTFLPDLMLGP

SEQ ID NO: 1894060 - protein, 20 aa, Staphylococcus
LFIVSLYWHFLDVVWIFIFT

SEQ ID NO: 1894061 - protein, 23 aa, Staphylococcus
LIAVITYFKLWKYLYKEWFTSVD

SEQ ID NO: 1894062 - protein, 27 aa, Staphylococcus
LKANRLFWAFALCLLPFSLMLVGGERA

SEQ ID NO: 1894063 - protein, 20 aa, Staphylococcus
LPIAMPVIMAGIRTAMVLII

SEQ ID NO: 1894064 - protein, 18 aa, Staphylococcus
LSKVALLAAFIPIISGMS

SEQ ID NO: 1894065 - protein, 22 aa, Staphylococcus
LVIFFLLIALTTVFVGSEFALV

SEQ ID NO: 1894066 - protein, 17 aa, Staphylococcus
LYILITKAKIPAYLGSS

SEQ ID NO: 1894067 - protein, 17 aa, Staphylococcus
MIRLVNDLLQLSKMDNE

SEQ ID NO: 1894068 - protein, 40 aa, Staphylococcus; identical to SEQ ID NO: 1590369

SEQ ID NO: 1894069 - protein, 27 aa, Staphylococcus
NIMKTLTLFTVLLTLPTLVFSFFGMNV

SEQ ID NO: 1894070 - protein, 34 aa, Staphylococcus; identical to SEQ ID NO: 1748290

SEQ ID NO: 1894071 - protein, 29 aa, Staphylococcus
NTGPLLAFLPVITIGLLFGLAIDYELFLM

SEQ ID NO: 1894072 - protein, 20 aa, Staphylococcus
NVVYFRFFSDFLTFSTLNQA

SEQ ID NO: 1894073 - protein, 17 aa, Staphylococcus
NVYNGIPHLLIPVVTNP

SEQ ID NO: 1894074 - protein, 24 aa, Staphylococcus
QGFFKGFLSLIPVLIGIIVGYIVS

SEQ ID NO: 1894075 - protein, 19 aa, Staphylococcus
QILFHPLVGGFLLAAILAA

SEQ ID NO: 1894076 - protein, 21 aa, Staphylococcus
RGQLMSIMFIGIGLVEALPII

SEQ ID NO: 1894077 - protein, 18 aa, Staphylococcus
RTGLYIIDSQLLKGHVYN

SEQ ID NO: 1894078 - protein, 22 aa, Staphylococcus
SAWGYWFAAFLGNVAYATLLMS

SEQ ID NO: 1894079 - protein, 19 aa, Staphylococcus
SFGRYVSFFSSWFLTFGYV

SEQ ID NO: 1894080 - protein, 17 aa, Staphylococcus
SLILYRFELNLRSASIL

SEQ ID NO: 1894081 - protein, 29 aa, Staphylococcus
TAISLFITVILGFFIARTITRPITDMRNQ

SEQ ID NO: 1894082 - protein, 37 aa, Staphylococcus; identical to SEQ ID NO: 1591204

SEQ ID NO: 1894083 - protein, 21 aa, Staphylococcus
TPMLLGAMIMGPLVGWLMKKT

SEQ ID NO: 1894084 - protein, 26 aa, Staphylococcus
VIGIPKWIQFLFIIIVAMVISASMRV

SEQ ID NO: 1894085 - protein, 25 aa, Staphylococcus
WGPIAWAIYVLPALPIGYLVFVKKQ

SEQ ID NO: 1894086 - protein, 17 aa, Staphylococcus
WLLYLQYSVLLARFLRG

SEQ ID NO: 1894087 - protein, 24 aa, Staphylococcus
YQGFTKIIIVLIISPIIAFCVGFI

SEQ ID NO: 1894088 - protein, 18 aa, Staphylococcus
AFEIPLRYKIMGIVGSVW

SEQ ID NO: 1894089 - protein, 19 aa, Staphylococcus
AFIAWGFIAAIFIDNGWFP

SEQ ID NO: 1894090 - protein, 20 aa, Staphylococcus
AFIFGLILGVLLFLSAKSNS

SEQ ID NO: 1894091 - protein, 18 aa, Staphylococcus
AFIPIVIPPLLSLFNDLK

SEQ ID NO: 1894092 - protein, 25 aa, Staphylococcus
AIALFLVVFCWQPIHFYALAIKRSD

SEQ ID NO: 1894093 - protein, 25 aa, Staphylococcus
AIIYIGMVLVILLLNIDQIVPMIGT

SEQ ID NO: 1894094 - protein, 29 aa, Staphylococcus
ALGTIVAIIVILLFLRNIRTTAISIVSIP

SEQ ID NO: 1894095 - protein, 19 aa, Staphylococcus
ALGWNYWFNWVITVAADVT

SEQ ID NO: 1894096 - protein, 23 aa, Staphylococcus
ALLITFILVPVLIPTLKRMKFGQ

SEQ ID NO: 1894097 - protein, 34 aa, Staphylococcus
ALVVRSLVLLLFPGLYFYAPFLSFIGGVIPFMVL

SEQ ID NO: 1894098 - protein, 23 aa, Staphylococcus
AMGQYFAFWYPQVPHWLTVLFIV

SEQ ID NO: 1894099 - protein, 17 aa, Staphylococcus
AMTAFLLVLVYRTYRVT

SEQ ID NO: 1894100 - protein, 22 aa, Staphylococcus
APTIFNFSLALLIGLISGVFSS

SEQ ID NO: 1894101 - protein, 21 aa, Staphylococcus
ARKLLLQLSQFFRSNLQGARN

SEQ ID NO: 1894102 - protein, 25 aa, Staphylococcus
ASFSPLVLFSLYWKGLTRAGAISGM

SEQ ID NO: 1894103 - protein, 23 aa, Staphylococcus
ASKFKLIFKHILPNTLGAIVVTS

SEQ ID NO: 1894104 - protein, 23 aa, Staphylococcus
ASTWKKFEVYENNKKLPIELVTY

SEQ ID NO: 1894105 - protein, 25 aa, Staphylococcus
ATIGALLPLLFGQDSSILISKGMAA

SEQ ID NO: 1894106 - protein, 25 aa, Staphylococcus
ATLVVPFMFMWLTKSKRNKAIGRAS

SEQ ID NO: 1894107 - protein, 18 aa, Staphylococcus
ATTAFFLVLAFRTYKELG

SEQ ID NO: 1894108 - protein, 24 aa, Staphylococcus
AVIDLRFPRIFIALFVGAILAVSG

SEQ ID NO: 1894109 - protein, 27 aa, Staphylococcus
AWIQQWTVFYWAWVISWSPFIGGFVAR

SEQ ID NO: 1894110 - protein, 21 aa, Staphylococcus
CATFLPQAFLSYAIGGVFHIE

SEQ ID NO: 1894111 - protein, 19 aa, Staphylococcus
DAFVVRMTLIPALTKLFGK

SEQ ID NO: 1894112 - protein, 21 aa, Staphylococcus
DAPGIIADKWQYTGQTAAENG

SEQ ID NO: 1894113 - protein, 18 aa, Staphylococcus
DEDGYYWFQGRVDDVIMT

SEQ ID NO: 1894114 - protein, 20 aa, Staphylococcus
DFMRYSLLSGILIGFIAPLI

SEQ ID NO: 1894115 - protein, 24 aa, Staphylococcus
DFYYLIIALIFLIVISVISMMAGS

SEQ ID NO: 1894116 - protein, 32 aa, Staphylococcus
DGDLQFYHYASTISPANVYFNKDKNKTTVELG

SEQ ID NO: 1894117 - protein, 24 aa, Staphylococcus
DGKKYIKLTTTIDSIWKDFQVEGQ

SEQ ID NO: 1894118 - protein, 17 aa, Staphylococcus
DHKYLVKYLGPYNFTVY

SEQ ID NO: 1894119 - protein, 18 aa, Staphylococcus
DIFIPILPAIVTAGLLMG

SEQ ID NO: 1894120 - protein, 27 aa, Staphylococcus
DIYSIGIVLYEMLVGEPPFNGETAVSI

SEQ ID NO: 1894121 - protein, 32 aa, Staphylococcus; identical to SEQ ID NO: 1589171

SEQ ID NO: 1894122 - protein, 27 aa, Staphylococcus
DLIWSQYLIGLLLTVGFFFTISSKFVQ

SEQ ID NO: 1894123 - protein, 25 aa, Staphylococcus
DNSNPIILLLFVTIGFGLIGFIDDY

SEQ ID NO: 1894124 - protein, 24 aa, Staphylococcus
DNTGHVMITPTKPIPEGNVTAKAY

SEQ ID NO: 1894125 - protein, 24 aa, Staphylococcus
DSNNLWDLFLLITGLFGVPLAGIF

SEQ ID NO: 1894126 - protein, 22 aa, Staphylococcus
DTFWVYIIPSLYSVYNILIMRT

SEQ ID NO: 1894127 - protein, 19 aa, Staphylococcus
DWQIFWKIILPMSKPVIAT

SEQ ID NO: 1894128 - protein, 17 aa, Staphylococcus
EDALVAAISVLVIACPC

SEQ ID NO: 1894129 - protein, 19 aa, Staphylococcus
EFNMIWKAMLIPSLGYIVG

SEQ ID NO: 1894130 - protein, 25 aa, Staphylococcus
EHIQISFIALLIATIIAVPLGILLT

SEQ ID NO: 1894131 - protein, 27 aa, Staphylococcus
EIYNSIVKVDFPTIGYSGQYHVRIKNN

SEQ ID NO: 1894132 - protein, 23 aa, Staphylococcus
EKKILNYVIPLAEDGFEVDSELE

SEQ ID NO: 1894133 - protein, 27 aa, Staphylococcus
EMFRPFALAIAFSLLASLLVSITVVPA

SEQ ID NO: 1894134 - protein, 32 aa, Staphylococcus
ENVSRTYLFSIFFILLLTLIFANFSEALAEGR

SEQ ID NO: 1894135 - protein, 22 aa, Staphylococcus
EPLKFQGGLTKRSYFNKNGRVT

SEQ ID NO: 1894136 - protein, 22 aa, Staphylococcus
EREDLGLLVDFLAELFKEEGHK

SEQ ID NO: 1894137 - protein, 25 aa, Staphylococcus
ERKIYELNRVKDQLPEKLRAQYSQK

SEQ ID NO: 1894138 - protein, 26 aa, Staphylococcus
FATMLLLGILMIFVTAVFLSRGLLSL

SEQ ID NO: 1894139 - protein, 18 aa, Staphylococcus
FAVIFITTQVILLNGLAS

SEQ ID NO: 1894140 - protein, 18 aa, Staphylococcus
FEPFIIIFNTIAAPIIVS

SEQ ID NO: 1894141 - protein, 17 aa, Staphylococcus
FFASKFPLINFRMNNRN

SEQ ID NO: 1894142 - protein, 25 aa, Staphylococcus
FFFEAIFLSIYLYTWDRFKNKWTHF

SEQ ID NO: 1894143 - protein, 24 aa, Staphylococcus
FFSVRLLLSIVFINLTSPVGMHLV

SEQ ID NO: 1894144 - protein, 23 aa, Staphylococcus
FGKSFMLPIAILPAVGLLLGIGG

SEQ ID NO: 1894145 - protein, 17 aa, Staphylococcus
FIASFLPDNVGLKSVAG

SEQ ID NO: 1894146 - protein, 36 aa, Staphylococcus
FIDFVLLGILPNKTPWWLVIPVGLVYAVIYYVVFRF

SEQ ID NO: 1894147 - protein, 24 aa, Staphylococcus
FIQDFFMLAFFTTIGLGASLKLFK

SEQ ID NO: 1894148 - protein, 21 aa, Staphylococcus
FISLKQQLPYIPKQRLYTLTA

SEQ ID NO: 1894149 - protein, 27 aa, Staphylococcus
FIVISTLIFLFIGKPVSLLIIAGAING

SEQ ID NO: 1894150 - protein, 33 aa, Staphylococcus; identical to SEQ ID NO: 1750924

SEQ ID NO: 1894151 - protein, 22 aa, Staphylococcus
FLLTLMFVIWQPKGLDIGITAL

SEQ ID NO: 1894152 - protein, 21 aa, Staphylococcus
FLSFGRYVSFFSSWFLTFGYV

SEQ ID NO: 1894153 - protein, 25 aa, Staphylococcus
FNPVFALWFLLTLFFFHVVLVIVRR

SEQ ID NO: 1894154 - protein, 25 aa, Staphylococcus
FRRTISFFLVFTMLFSAGVVPLYIL

SEQ ID NO: 1894155 - protein, 26 aa, Staphylococcus
FSLLASIVVLWLYFRKSIPKTFDTEN

SEQ ID NO: 1894156 - protein, 23 aa, Staphylococcus
FVGSLFMGLIARYPIALAPGMGL

SEQ ID NO: 1894157 - protein, 25 aa, Staphylococcus
GAFLLMFLIFTIFVGLPLLIMEFTV

SEQ ID NO: 1894158 - protein, 17 aa, Staphylococcus
GAVTIPNYPSEKGKPTI

SEQ ID NO: 1894159 - protein, 19 aa, Staphylococcus
GDIFIPILPALVTAGLLMG

SEQ ID NO: 1894160 - protein, 27 aa, Staphylococcus
GEALSTLWIFILAPLLGAVIAALTHKI

SEQ ID NO: 1894161 - protein, 17 aa, Staphylococcus
GFTLFAMFFGAGNLIFP

SEQ ID NO: 1894162 - protein, 25 aa, Staphylococcus
GGVIPFMVLFVLIAKYKLAPVRMIL

SEQ ID NO: 1894163 - protein, 19 aa, Staphylococcus
GIDFLAVMGFASAISVLFA

SEQ ID NO: 1894164 - protein, 30 aa, Staphylococcus; identical to SEQ ID NO: 1589945

SEQ ID NO: 1894165 - protein, 29 aa, Staphylococcus
GIIAAIAFLILCIGIVVVLISVKKNLDHV

SEQ ID NO: 1894166 - protein, 30 aa, Staphylococcus; identical to SEQ ID NO: 1751148

SEQ ID NO: 1894167 - protein, 22 aa, Staphylococcus
GKALMLPVAILPAAGILLAFGN

SEQ ID NO: 1894168 - protein, 19 aa, Staphylococcus
GKQMGYVYFSWLLGLLVGM

SEQ ID NO: 1894169 - protein, 24 aa, Staphylococcus
GKTPGTYTIPVTVTYPDGSKDHVN

SEQ ID NO: 1894170 - protein, 27 aa, Staphylococcus
GLIISVLGAWLGWTLLAGELPFIVAKD

SEQ ID NO: 1894171 - protein, 27 aa, Staphylococcus
GLIISVLGAWLGWTLLAGELPFVVAKD

SEQ ID NO: 1894172 - protein, 27 aa, Staphylococcus
GLSLIPQNLIIVGLFVICMFVSISMGT

SEQ ID NO: 1894173 - protein, 25 aa, Staphylococcus
GLVQNLILLMNPYSLIALVLSVFLF

SEQ ID NO: 1894174 - protein, 28 aa, Staphylococcus
GMTPFYTALSIWVGGLLMVSLLSVDNKH

SEQ ID NO: 1894175 - protein, 20 aa, Staphylococcus
GQILFHPLVGGFLLAAILAA

SEQ ID NO: 1894176 - protein, 29 aa, Staphylococcus
GSLAAFYYAVVAPYKRHPMIKLMNAMQYD

SEQ ID NO: 1894177 - protein, 26 aa, Staphylococcus
GTLIAMIFYVIQLSMPLINLSTLVTD

SEQ ID NO: 1894178 - protein, 27 aa, Staphylococcus
GVIGTFFFGFILRLLGPFGLHHIFYLP

SEQ ID NO: 1894179 - protein, 21 aa, Staphylococcus
GVTLFLLLKAFSSGASSLTGV

SEQ ID NO: 1894180 - protein, 20 aa, Staphylococcus
HIIVPVINYDHEYTTQIAFA

SEQ ID NO: 1894181 - protein, 24 aa, Staphylococcus
HIQMTLLDWMMLLGTLSLVILYYV

SEQ ID NO: 1894182 - protein, 18 aa, Staphylococcus
HYVTIQGKRYFEMTLTHI

SEQ ID NO: 1894183 - protein, 17 aa, Staphylococcus
IAALFYVSNWWYIAKDV

SEQ ID NO: 1894184 - protein, 26 aa, Staphylococcus
IALTTYIYLTLVAFNFISGVLTLPGL

SEQ ID NO: 1894185 - protein, 17 aa, Staphylococcus
IENNVILGVIYLKDVIK

SEQ ID NO: 1894186 - protein, 26 aa, Staphylococcus
IFCEIAFWFVILLGLVTRYILNQQTL

SEQ ID NO: 1894187 - protein, 20 aa, Staphylococcus
IFMLLLPAMIGFLGAIPIML

SEQ ID NO: 1894188 - protein, 27 aa, Staphylococcus
IFSGFIIGAFFLPLVMLGLHHIFTPIH

SEQ ID NO: 1894189 - protein, 24 aa, Staphylococcus
IFVLTLIFVIWQPKGLDIGITALI

SEQ ID NO: 1894190 - protein, 17 aa, Staphylococcus
IGATFHIVSLPDSGTRI

SEQ ID NO: 1894191 - protein, 24 aa, Staphylococcus
IGKALMLPVAILPAAGLLLAIGTA

SEQ ID NO: 1894192 - protein, 17 aa, Staphylococcus
IGLIAVITYFKLWKYLY

SEQ ID NO: 1894193 - protein, 22 aa, Staphylococcus
IGRVPAIIALVVYALLPILRNT

SEQ ID NO: 1894194 - protein, 17 aa, Staphylococcus
IGTLLYILITKAKIPAY

SEQ ID NO: 1894195 - protein, 23 aa, Staphylococcus
IGTLVGMRLRRVSPRKVIGPLIK

SEQ ID NO: 1894196 - protein, 18 aa, Staphylococcus
IGVIIFGVFSYINGNGNT

SEQ ID NO: 1894197 - protein, 22 aa, Staphylococcus
IIRRIQIHIETWDRTALEEQEA

SEQ ID NO: 1894198 - protein, 19 aa, Staphylococcus
ILCILYTFLGGFEGVVWSD

SEQ ID NO: 1894199 - protein, 23 aa, Staphylococcus
ILPPLAAMLFIKIGYHPIAGLAM

SEQ ID NO: 1894200 - protein, 19 aa, Staphylococcus
ILPSFLSLILYRFELNLRS

SEQ ID NO: 1894201 - protein, 33 aa, Staphylococcus; identical to SEQ ID NO: 1593761

SEQ ID NO: 1894202 - protein, 18 aa, Staphylococcus
IPFLGPWLSFTPAAILGI

SEQ ID NO: 1894203 - protein, 33 aa, Staphylococcus
IQGKRYFEMTLTHIDWWQSYQFYHQNTKLQHEV

SEQ ID NO: 1894204 - protein, 25 aa, Staphylococcus
IRVVKWLIILLISMLASISVAVAGS

SEQ ID NO: 1894205 - protein, 19 aa, Staphylococcus
ISAFLFNKYSYRKLFIIAL

SEQ ID NO: 1894206 - protein, 18 aa, Staphylococcus
ISATREVFKPILSSTIVT

SEQ ID NO: 1894207 - protein, 24 aa, Staphylococcus
ISGMKLVLALPFPIALAIMFNEIS

SEQ ID NO: 1894208 - protein, 18 aa, Staphylococcus
ISILFFKLLTEFINIMIH

SEQ ID NO: 1894209 - protein, 20 aa, Staphylococcus
ISLKKQLPYIPKQRLYTLTA

SEQ ID NO: 1894210 - protein, 26 aa, Staphylococcus
ITFISLFFPIVILAVPFIDTLFAMIR

SEQ ID NO: 1894211 - protein, 17 aa, Staphylococcus
ITKVLYRLTFVGSIFLA

SEQ ID NO: 1894212 - protein, 18 aa, Staphylococcus
ITKVLYRLTFVGSIFLAV

SEQ ID NO: 1894213 - protein, 19 aa, Staphylococcus
ITPMMPYLPLLLSYAQKYD

SEQ ID NO: 1894214 - protein, 27 aa, Staphylococcus
ITVFDVFLLLFIMRFGFRKIEAIVGTL

SEQ ID NO: 1894215 - protein, 22 aa, Staphylococcus
IVPVLMFAFFGIVLGFATLFKN

SEQ ID NO: 1894216 - protein, 37 aa, Staphylococcus
IWQHKVLYLMLLPCLLFFLIFNYIPMAGLVLAFKEFR

SEQ ID NO: 1894217 - protein, 26 aa, Staphylococcus
IYSIGIVLYEMLVGEPPFNGETAVSI

SEQ ID NO: 1894218 - protein, 25 aa, Staphylococcus
KAFIPLFILGMLFWAIQEQGSNVLN

SEQ ID NO: 1894219 - protein, 27 aa, Staphylococcus
KAFTLIEMLLVLLIISLLLILIIPNIA

SEQ ID NO: 1894220 - protein, 28 aa, Staphylococcus
KAFTLIEMLLVLLIISVLLILIIPNIAK

SEQ ID NO: 1894221 - protein, 17 aa, Staphylococcus
KALMLYARENNKGVYDR

SEQ ID NO: 1894222 - protein, 22 aa, Staphylococcus
KARKLLLQLSQFFRSNLQGARN

SEQ ID NO: 1894223 - protein, 30 aa, Staphylococcus; identical to SEQ ID NO: 1751842

SEQ ID NO: 1894224 - protein, 24 aa, Staphylococcus
KDKKLFNISWIVLTVLLVGYLISE

SEQ ID NO: 1894225 - protein, 24 aa, Staphylococcus
KDPKLAFSIVYTNQPVPPPWLNGG

SEQ ID NO: 1894226 - protein, 26 aa, Staphylococcus
KDSKLFKLSWIVLAVLLVGYLVSEFI

SEQ ID NO: 1894227 - protein, 23 aa, Staphylococcus
KELPWGVLILFGGGLALAKGISE

SEQ ID NO: 1894228 - protein, 38 aa, Staphylococcus
KENGKTYFEVTLKNADWWKSFQFFTPQNKELTTTVVKH

SEQ ID NO: 1894229 - protein, 39 aa, Staphylococcus; identical to SEQ ID NO: 1751890

SEQ ID NO: 1894230 - protein, 26 aa, Staphylococcus
KGELLPIIFFAVFFGLGLAAIGEKAE

SEQ ID NO: 1894231 - protein, 25 aa, Staphylococcus
KGKKLTFIISPQWFTNHGLTNQNFD

SEQ ID NO: 1894232 - protein, 22 aa, Staphylococcus
KIYYTIFLVFHINLATIGGVLG

SEQ ID NO: 1894233 - protein, 17 aa, Staphylococcus
KLIINYTNSDGQPDSII

SEQ ID NO: 1894234 - protein, 21 aa, Staphylococcus
KNETLYTIRLLPVGGYVRMAG

SEQ ID NO: 1894235 - protein, 25 aa, Staphylococcus
KPVIAVIVSLIILILAAIPVSGMRL

SEQ ID NO: 1894236 - protein, 21 aa, Staphylococcus
KQGIIALTYYTALLSVNLGIM

SEQ ID NO: 1894237 - protein, 23 aa, Staphylococcus
KQNLMMFWMILTVLLGLVFVGFE

SEQ ID NO: 1894238 - protein, 39 aa, Staphylococcus
KQSVFVSMLTTLIPVLIIAFLFIFFLSQAQGGGGGGRMM

SEQ ID NO: 1894239 - protein, 31 aa, Staphylococcus; identical to SEQ ID NO: 1752024

SEQ ID NO: 1894240 - protein, 20 aa, Staphylococcus
KRFEVAVPAFITIIMMPLSY

SEQ ID NO: 1894241 - protein, 24 aa, Staphylococcus
KRFVSILFIFTYVVSFLPVVLYSG

SEQ ID NO: 1894242 - protein, 22 aa, Staphylococcus
KVVQGFLWLVFPANIYAARKNI

SEQ ID NO: 1894243 - protein, 23 aa, Staphylococcus
LAHIPFYLLGFLAAFIVGLIAIK

SEQ ID NO: 1894244 - protein, 20 aa, Staphylococcus
LATSLIFSWSVVTGSYSNAA

SEQ ID NO: 1894245 - protein, 18 aa, Staphylococcus
LDMQPAHLFFMIAAPEGG

SEQ ID NO: 1894246 - protein, 19 aa, Staphylococcus
LEMRALLLHLRPLGLKDKS

SEQ ID NO: 1894247 - protein, 26 aa, Staphylococcus
LENGLIRDEAWLKKKLNYISKKTYQG

SEQ ID NO: 1894248 - protein, 17 aa, Staphylococcus
LFGEFFGWVAGWALLAE

SEQ ID NO: 1894249 - protein, 17 aa, Staphylococcus
LFGHALRNALIPVITII

SEQ ID NO: 1894250 - protein, 25 aa, Staphylococcus
LFLCTLLVWLMTPGLSLFYGGLVQS

SEQ ID NO: 1894251 - protein, 21 aa, Staphylococcus
LGFTTLVIQHGFMGSLFGIEN

SEQ ID NO: 1894252 - protein, 29 aa, Staphylococcus
LGLHKYPRLFLMLIPVCLLIGVGYYYKGL

SEQ ID NO: 1894253 - protein, 21 aa, Staphylococcus
LGLLIVAIVGFLLFMYIKDSR

SEQ ID NO: 1894254 - protein, 19 aa, Staphylococcus
LGLPIYFFYEYKMNWKNTK

SEQ ID NO: 1894255 - protein, 17 aa, Staphylococcus
LHDAFMIVAVFSLFRIE

SEQ ID NO: 1894256 - protein, 24 aa, Staphylococcus
LIAIKTFLHLINKVKLVPFAIYRI

SEQ ID NO: 1894257 - protein, 25 aa, Staphylococcus
LIAIVPLLLVIIPKMKISALTDPLA

SEQ ID NO: 1894258 - protein, 17 aa, Staphylococcus
LIIIAFVISFVALADLI

SEQ ID NO: 1894259 - protein, 21 aa, Staphylococcus
LIKMIIIPIVFCALALSISNL

SEQ ID NO: 1894260 - protein, 21 aa, Staphylococcus
LILVYSMLTAFLFIDKVFVNI

SEQ ID NO: 1894261 - protein, 25 aa, Staphylococcus
LKIHPLTIIFILLSAGNLLGIVGVI

SEQ ID NO: 1894262 - protein, 25 aa, Staphylococcus
LLIIFTLIFGIIAFFHESRLGKWID

SEQ ID NO: 1894263 - protein, 17 aa, Staphylococcus
LLIPIFISYKEGLHIIK

SEQ ID NO: 1894264 - protein, 27 aa, Staphylococcus
LLTTLIVFLVLIFFLVFTAQKLARIPG

SEQ ID NO: 1894265 - protein, 17 aa, Staphylococcus
LMQILIATILVSIAISL

SEQ ID NO: 1894266 - protein, 28 aa, Staphylococcus
LNDAWAFLYPMLPYLFIGVFIGAFIYGF

SEQ ID NO: 1894267 - protein, 22 aa, Staphylococcus
LNNISLHIYQGESLGIIGEPGS

SEQ ID NO: 1894268 - protein, 19 aa, Staphylococcus
LPITGIPLPFISYGGSSLW

SEQ ID NO: 1894269 - protein, 27 aa, Staphylococcus
LRANRLFWAFALCLLPFSLMLVGGERA

SEQ ID NO: 1894270 - protein, 27 aa, Staphylococcus
LSSTIVTIIVFLPLAFVSGSVGEMFRP

SEQ ID NO: 1894271 - protein, 19 aa, Staphylococcus
LSVNLGLMNLLPIPALDGG

SEQ ID NO: 1894272 - protein, 29 aa, Staphylococcus
LTMYPLATFLHFNLSIAMLIALTVCLIPT

SEQ ID NO: 1894273 - protein, 20 aa, Staphylococcus
LVEVILTFVFVFIVLSVTTT

SEQ ID NO: 1894274 - protein, 26 aa, Staphylococcus
LVIAIIGVIIFGLFSFLNGNGNMPKQ

SEQ ID NO: 1894275 - protein, 18 aa, Staphylococcus
LVIGPFFALPRLATTSYE

SEQ ID NO: 1894276 - protein, 18 aa, Staphylococcus
LVLGIALPIIYFTTMIRS

SEQ ID NO: 1894277 - protein, 17 aa, Staphylococcus
LVPFLTGLPISAALLAS

SEQ ID NO: 1894278 - protein, 19 aa, Staphylococcus
LVQIFLISMLFTDSAYQFA

SEQ ID NO: 1894279 - protein, 18 aa, Staphylococcus
LVSFIIMFVGIQVVIENA

SEQ ID NO: 1894280 - protein, 17 aa, Staphylococcus
LWHFFGDLLNSVGVIVA

SEQ ID NO: 1894281 - protein, 27 aa, Staphylococcus
MFDMGQIYLMMFFTDILGISAFYGGLV

SEQ ID NO: 1894282 - protein, 17 aa, Staphylococcus
MGSRIPKGVLLVGPPGT

SEQ ID NO: 1894283 - protein, 18 aa, Staphylococcus
MIAATNRPDILDPALLRP

SEQ ID NO: 1894284 - protein, 32 aa, Staphylococcus; identical to SEQ ID NO: 1588916

SEQ ID NO: 1894285 - protein, 25 aa, Staphylococcus
MIKTTLLITWLLPVGVAIIPYSIQF

SEQ ID NO: 1894286 - protein, 24 aa, Staphylococcus
MIVLLIIPVLLLFPFVQKHFVKGV

SEQ ID NO: 1894287 - protein, 19 aa, Staphylococcus
MLFVLLMFGFDFLSAAGNA

SEQ ID NO: 1894288 - protein, 24 aa, Staphylococcus
MLTPTIIILFILSLGDILKAGFDQ

SEQ ID NO: 1894289 - protein, 33 aa, Staphylococcus
MMATTSFILAFPMAWIWPFIQNGLNAFSTGLLD

SEQ ID NO: 1894290 - protein, 25 aa, Staphylococcus
MQGEFPVMMFGLPAAALAIYHTAKP

SEQ ID NO: 1894291 - protein, 36 aa, Staphylococcus
NARPNQHFSIRKFSIGAASITLGTCLFLNAEHQAQA

SEQ ID NO: 1894292 - protein, 20 aa, Staphylococcus
NETLYTIRLLPVGGYVRMAG

SEQ ID NO: 1894293 - protein, 24 aa, Staphylococcus
NGVIWRILIFYLGAIFVIVSVYPW

SEQ ID NO: 1894294 - protein, 31 aa, Staphylococcus
NNKYYFEAELNHAKWWKSFEFYDENNNKLNT

SEQ ID NO: 1894295 - protein, 24 aa, Staphylococcus
NNVPFRILIFYIGSLAVIMSVVPW

SEQ ID NO: 1894296 - protein, 18 aa, Staphylococcus
NPLGLEFANSVTSGIISA

SEQ ID NO: 1894297 - protein, 25 aa, Staphylococcus
NTMRKMVQNLWWGAGYNIVAVPLAA

SEQ ID NO: 1894298 - protein, 24 aa, Staphylococcus
NVIYGMVILLLICGCIPKLGALAN

SEQ ID NO: 1894299 - protein, 28 aa, Staphylococcus
NYDHEYTTQIAFAKPVPQPAKAQASKAQ

SEQ ID NO: 1894300 - protein, 17 aa, Staphylococcus
PALFWGSVVLINVLVGG

SEQ ID NO: 1894301 - protein, 20 aa, Staphylococcus
PALTKLFGKASWYLPKWLGA

SEQ ID NO: 1894302 - protein, 17 aa, Staphylococcus
PGMKQLISRVHIVVPAI

SEQ ID NO: 1894303 - protein, 23 aa, Staphylococcus
PGVTLFLLLKAFSSGASSLTGVE

SEQ ID NO: 1894304 - protein, 25 aa, Staphylococcus
PHWLTVLFIVLILISFNLLGARLFG

SEQ ID NO: 1894305 - protein, 26 aa, Staphylococcus
PIILIIVFYFFLIRPQQKRAKEHREM

SEQ ID NO: 1894306 - protein, 25 aa, Staphylococcus
PNLIVVILFVLIFEPSIWTIILAMS

SEQ ID NO: 1894307 - protein, 22 aa, Staphylococcus
PNYKYLIPFNALAGANLMLLSD

SEQ ID NO: 1894308 - protein, 26 aa, Staphylococcus
PQDWTIFYWSWWLVYAPFIGLFIARI

SEQ ID NO: 1894309 - protein, 18 aa, Staphylococcus
PRLEPRLGNQYGGKLTLI

SEQ ID NO: 1894310 - protein, 24 aa, Staphylococcus
PSQPTKDYVLLPLNKQQTHYKVNV

SEQ ID NO: 1894311 - protein, 27 aa, Staphylococcus
PVSLGKLFMIFLIRTAITLPIIALMAH

SEQ ID NO: 1894312 - protein, 21 aa, Staphylococcus
PYTIVFYFSLFSVVVLIPFSI

SEQ ID NO: 1894313 - protein, 23 aa, Staphylococcus
QIILIAVIVISVYQIYHLHLADK

SEQ ID NO: 1894314 - protein, 21 aa, Staphylococcus
QLISKVHIIVPVINYDHEYTT

SEQ ID NO: 1894315 - protein, 17 aa, Staphylococcus
QLPYIPKQRLYTLTASA

SEQ ID NO: 1894316 - protein, 18 aa, Staphylococcus
QMGSRIPKGVLLVGPPGT

SEQ ID NO: 1894317 - protein, 28 aa, Staphylococcus
QNVVKYIVWFIVITTILSKFGISVEGII

SEQ ID NO: 1894318 - protein, 20 aa, Staphylococcus
QRLIKLLGDIFIPILPALVT

SEQ ID NO: 1894319 - protein, 25 aa, Staphylococcus
QSKKEEVYRRLLASNLTSVPERFII

SEQ ID NO: 1894320 - protein, 20 aa, Staphylococcus
QVFLAIFLAILLGLGISYFQ

SEQ ID NO: 1894321 - protein, 30 aa, Staphylococcus; identical to SEQ ID NO: 1588622

SEQ ID NO: 1894322 - protein, 17 aa, Staphylococcus
RFDSFMFVLPLLNILLI

SEQ ID NO: 1894323 - protein, 20 aa, Staphylococcus
RGQLMGIMFIGVGLVEALPI

SEQ ID NO: 1894324 - protein, 19 aa, Staphylococcus
RIHIGWFVLPVPVVLFIYF

SEQ ID NO: 1894325 - protein, 20 aa, Staphylococcus
RIHIVIPELNYDHHYTTYIV

SEQ ID NO: 1894326 - protein, 23 aa, Staphylococcus
RIYSYIPLFITSVAFWMIQEQGS

SEQ ID NO: 1894327 - protein, 18 aa, Staphylococcus
RLLPPNYKYLIPFNALAG

SEQ ID NO: 1894328 - protein, 17 aa, Staphylococcus
RPVMRPLFTLPGRSTVD

SEQ ID NO: 1894329 - protein, 23 aa, Staphylococcus
RTLTWLMAIIVYLTIYTGALVRH

SEQ ID NO: 1894330 - protein, 31 aa, Staphylococcus
SAGTPAYVYLIPVVAVVFLMLSVAILKRNRK

SEQ ID NO: 1894331 - protein, 26 aa, Staphylococcus
SAISVLFAVLAALTLLPALISIFHKS

SEQ ID NO: 1894332 - protein, 37 aa, Staphylococcus; identical to SEQ ID NO: 1753226

SEQ ID NO: 1894333 - protein, 24 aa, Staphylococcus
SFGMAFVMMPLMTAAINALPPRLI

SEQ ID NO: 1894334 - protein, 25 aa, Staphylococcus
SFIFLCIFSFGILSSSSAFAEGQSL

SEQ ID NO: 1894335 - protein, 20 aa, Staphylococcus
SGRFITMMFGLCGAALAIYH

SEQ ID NO: 1894336 - protein, 27 aa, Staphylococcus
SIAGIIILLIWLYLTSFIIIIGAEINA

SEQ ID NO: 1894337 - protein, 19 aa, Staphylococcus
SILNYFVLLPLYGMIFNLG

SEQ ID NO: 1894338 - protein, 17 aa, Staphylococcus
SINFFDPGDKEDAAVLD

SEQ ID NO: 1894339 - protein, 22 aa, Staphylococcus
SKAALVIFMWLPKAYAVLNTEL

SEQ ID NO: 1894340 - protein, 26 aa, Staphylococcus
SLALLGLMIPIFGIGRVPAIIALVVY

SEQ ID NO: 1894341 - protein, 34 aa, Staphylococcus; identical to SEQ ID NO: 1747853

SEQ ID NO: 1894342 - protein, 34 aa, Staphylococcus
SLHTKLVIVYVLLIIIGMQIIGLYFTNSLEKELT

SEQ ID NO: 1894343 - protein, 25 aa, Staphylococcus
SQPKKATDLTPPVKPSVVGTLDGKA

SEQ ID NO: 1894344 - protein, 22 aa, Staphylococcus
SSDIFVWFKLVLNDTSEFHNIK

SEQ ID NO: 1894345 - protein, 20 aa, Staphylococcus
STAFIFLPALIGWSSMKVFG

SEQ ID NO: 1894346 - protein, 22 aa, Staphylococcus
STQMILIKNILIYGIGGMIVPF

SEQ ID NO: 1894347 - protein, 21 aa, Staphylococcus
SVLDEFYWLNKEDPNYSRCRV

SEQ ID NO: 1894348 - protein, 17 aa, Staphylococcus
SVNLGIMNLLPIPALDG

SEQ ID NO: 1894349 - protein, 28 aa, Staphylococcus
TAISLFITVILGFFIARTITKPITDMRN

SEQ ID NO: 1894350 - protein, 20 aa, Staphylococcus
TFILLLVLTAFFVATEFAIV

SEQ ID NO: 1894351 - protein, 32 aa, Staphylococcus
TGLAVFLFGFIKRLLIPFGLHHIFHAPFWFEF

SEQ ID NO: 1894352 - protein, 18 aa, Staphylococcus
TGWTYWFCWIITGMAEVT

SEQ ID NO: 1894353 - protein, 21 aa, Staphylococcus
TIEVLRLPRIILAILAGMALG

SEQ ID NO: 1894354 - protein, 26 aa, Staphylococcus
TKAGAFPMYVWLPGSYYAPPFAIIAF

SEQ ID NO: 1894355 - protein, 24 aa, Staphylococcus
TLVLVLIVMTLFLNFAPYGKQGLQ

SEQ ID NO: 1894356 - protein, 26 aa, Staphylococcus
TLVVTLLIAIPFFKLPVGIASGAVVE

SEQ ID NO: 1894357 - protein, 28 aa, Staphylococcus
TNKFGFIANHYSIRKFSVGTASIIVGSL

SEQ ID NO: 1894358 - protein, 28 aa, Staphylococcus
TNRPDILDPALLRPGRFDRQIQVGRPDV

SEQ ID NO: 1894359 - protein, 23 aa, Staphylococcus
TPMIVQLFIIFYGIPELGRLLTN

SEQ ID NO: 1894360 - protein, 35 aa, Staphylococcus
TPNEIALFTLLMTLTIVFLAVILTMYPLATFLHFN

SEQ ID NO: 1894361 - protein, 25 aa, Staphylococcus
TTGKYPFMMFGLPAAAFAIYKNARP

SEQ ID NO: 1894362 - protein, 24 aa, Staphylococcus
TTIVGIISFFAWGLGYFGQPHIIV

SEQ ID NO: 1894363 - protein, 26 aa, Staphylococcus
TTQKLPRLVMFGFSINEKYIKSLGNA

SEQ ID NO: 1894364 - protein, 18 aa, Staphylococcus
TVGTLPFLGLIVPNIISI

SEQ ID NO: 1894365 - protein, 26 aa, Staphylococcus
TVNDKRTVLFPYVEGKEIYNSIVKVD

SEQ ID NO: 1894366 - protein, 22 aa, Staphylococcus
VAKYFAILPAMFMSAMPAMNHL

SEQ ID NO: 1894367 - protein, 25 aa, Staphylococcus
VCTATAIMILLYSGLKFGENAPQGV

SEQ ID NO: 1894368 - protein, 17 aa, Staphylococcus
VFPEIVMALIFIKAVGP

SEQ ID NO: 1894369 - protein, 23 aa, Staphylococcus
VGALLLAFYFYRDNPDLKNALMQ

SEQ ID NO: 1894370 - protein, 25 aa, Staphylococcus
VGIDYSLFILFRFKELKKKGVDTVE

SEQ ID NO: 1894371 - protein, 26 aa, Staphylococcus
VGIVTAFIILLITFGSLIAAGMPIVS

SEQ ID NO: 1894372 - protein, 26 aa, Staphylococcus
VGIVVAFVILLITFGSLIAAGMPIIS

SEQ ID NO: 1894373 - protein, 27 aa, Staphylococcus
VGTASIIVGSLLFLGNPAHAAEANTTQ

SEQ ID NO: 1894374 - protein, 27 aa, Staphylococcus
VGVTIIFGAFAFFWFVGIHGPSIVEPA

SEQ ID NO: 1894375 - protein, 17 aa, Staphylococcus
VIAFLWVLFQDEDEFKF

SEQ ID NO: 1894376 - protein, 17 aa, Staphylococcus
VIIAMFILQFMLNFFIP

SEQ ID NO: 1894377 - protein, 28 aa, Staphylococcus
VIMIIFMAMPFIFGLWNIVVPLQIGARD

SEQ ID NO: 1894378 - protein, 19 aa, Staphylococcus
VIMLIAMVMVPIVALLKLN

SEQ ID NO: 1894379 - protein, 17 aa, Staphylococcus
VKHDIIAALFYVSNWWY

SEQ ID NO: 1894380 - protein, 30 aa, Staphylococcus; identical to SEQ ID NO: 1597990

SEQ ID NO: 1894381 - protein, 30 aa, Staphylococcus; identical to SEQ ID NO: 1748475

SEQ ID NO: 1894382 - protein, 20 aa, Staphylococcus
VLLIPLVFTIAKRAKVSPLK

SEQ ID NO: 1894383 - protein, 30 aa, Staphylococcus
VLSALIFNALIIVLLIPIAMKGVKFKGVST

SEQ ID NO: 1894384 - protein, 18 aa, Staphylococcus
VMFEIMLLASFVLVTLGQ

SEQ ID NO: 1894385 - protein, 19 aa, Staphylococcus
VMLLARYIPIILQLSIVSS

SEQ ID NO: 1894386 - protein, 23 aa, Staphylococcus
VNTFFIIMWLLGQMSIWNFLFLR

SEQ ID NO: 1894387 - protein, 21 aa, Staphylococcus
VPEKWILGLLGLIPIYLGIKV

SEQ ID NO: 1894388 - protein, 23 aa, Staphylococcus
VPEKWILGLLGLIPIYLGIKVAI

SEQ ID NO: 1894389 - protein, 34 aa, Staphylococcus
VSLRNIWDMTWIIPLILILILIAFSMGAHINILM

SEQ ID NO: 1894390 - protein, 20 aa, Staphylococcus
VTLILFIFVANMLGLPFAIV

SEQ ID NO: 1894391 - protein, 21 aa, Staphylococcus
VTRYFAIILAFIQSIGMAFQF

SEQ ID NO: 1894392 - protein, 23 aa, Staphylococcus
VVLTMFAVFIFKYSYNKNDESGK

SEQ ID NO: 1894393 - protein, 20 aa, Staphylococcus
VYNILIMRTFFNQIPISVIE

SEQ ID NO: 1894394 - protein, 24 aa, Staphylococcus
WGPIAWAIYVLPALPIGYLVFVKK

SEQ ID NO: 1894395 - protein, 18 aa, Staphylococcus
YAYSFYLFFDFAGYSLFA

SEQ ID NO: 1894396 - protein, 19 aa, Staphylococcus
YAYSFYLFFDFAGYSLFAI

SEQ ID NO: 1894397 - protein, 26 aa, Staphylococcus
YDNKYQTTLLFETPVPELTTAKPETP

SEQ ID NO: 1894398 - protein, 25 aa, Staphylococcus
YFETSAVLITLILFGKYLEARAKSQ

SEQ ID NO: 1894399 - protein, 21 aa, Staphylococcus
YFNIFLIFLGIGLVIPVLPVY

SEQ ID NO: 1894400 - protein, 19 aa, Staphylococcus
YFVILMVIPMWAQHKVKSN

SEQ ID NO: 1894401 - protein, 23 aa, Staphylococcus
YFVQTIVMFLIVLGSIGFPVLLE

SEQ ID NO: 1894402 - protein, 19 aa, Staphylococcus
YIVIIMLIPMWAQHKVKSN

SEQ ID NO: 1894403 - protein, 18 aa, Staphylococcus
YLLIGIMLYFLMSSIGEL

SEQ ID NO: 1894404 - protein, 20 aa, Staphylococcus
YLWVILVLVFLEGLLAADNA

SEQ ID NO: 1894405 - protein, 20 aa, Staphylococcus
YLWVLLVLVFLEGLLAADNA

SEQ ID NO: 1894406 - protein, 18 aa, Staphylococcus
YSGQYHVRIKNNAISKKA

SEQ ID NO: 1894407 - protein, 22 aa, Staphylococcus
YSIPFVIVSLNFPLFNLVDQFT

SEQ ID NO: 1894408 - protein, 18 aa, Staphylococcus
YVISDAVHIGWKGWVYVD

SEQ ID NO: 1894409 - protein, 23 aa, Staphylococcus
YVVSFLPVVLYSGSLVFNKMFNI

SEQ ID NO: 1894410 - protein, 30 aa, Staphylococcus
AAAAGITVNLLDPTGIRLATTTTDITGHYN

SEQ ID NO: 1894411 - protein, 30 aa, Staphylococcus
AAAGWTLLVYIIFAVLFFAAPIAFISGELS

SEQ ID NO: 1894412 - protein, 19 aa, Staphylococcus
AAAIIAISFLYLQDGKLVD

SEQ ID NO: 1894413 - protein, 23 aa, Staphylococcus
AACAGFTYGLQLANSLISSGMHH

SEQ ID NO: 1894414 - protein, 31 aa, Staphylococcus
AADEPAYTPNSFAPLKVAAVEGQSILDDPSS

SEQ ID NO: 1894415 - protein, 25 aa, Staphylococcus
AADISYMGEALKYAGTPAKALGVSI

SEQ ID NO: 1894416 - protein, 25 aa, Staphylococcus
AAFGLFLVVFCWQPIHFYALAIKRK

SEQ ID NO: 1894417 - protein, 26 aa, Staphylococcus
AAFGPLVLLSLYWKGLSRTGAIFGMI

SEQ ID NO: 1894418 - protein, 25 aa, Staphylococcus
AAFGPLVLLSLYWKGLSRTGAISGM

SEQ ID NO: 1894419 - protein, 25 aa, Staphylococcus
AAFGPLVLLSLYWKGLSRTGAVSGM

SEQ ID NO: 1894420 - protein, 28 aa, Staphylococcus
AAFPSLYHFKVLIACLLVLFILIMNLRG

SEQ ID NO: 1894421 - protein, 24 aa, Staphylococcus
AAFSPLVLFSLYWKDLTRAGAVSG

SEQ ID NO: 1894422 - protein, 20 aa, Staphylococcus
AAGAPWIAMFLLILCGGAIS

SEQ ID NO: 1894423 - protein, 17 aa, Staphylococcus
AAGFIFFSMISDQIFFK

SEQ ID NO: 1894424 - protein, 23 aa, Staphylococcus
AAGILAFIGLILSPAIGAILMSL

SEQ ID NO: 1894425 - protein, 30 aa, Staphylococcus
AAGILLVMIIASGFLLRQAFMKMDSYVDGL

SEQ ID NO: 1894426 - protein, 17 aa, Staphylococcus
AAGIVGGAAAKHQKDKN

SEQ ID NO: 1894427 - protein, 18 aa, Staphylococcus
AAHHSWLFAPYLLLVFAG

SEQ ID NO: 1894428 - protein, 25 aa, Staphylococcus
AAIACGFFLFMFGGVASDCWIAILA

SEQ ID NO: 1894429 - protein, 25 aa, Staphylococcus
AAIACGFFLFMFGGVASDCWIAVIA

SEQ ID NO: 1894430 - protein, 26 aa, Staphylococcus
AAIACGFFLFMFGGVINDFIFAIIAG

SEQ ID NO: 1894431 - protein, 24 aa, Staphylococcus
AAIAWNLITWLYGIPSSSSHALIG

SEQ ID NO: 1894432 - protein, 30 aa, Staphylococcus
AAIGIAVIYLFMLGFYRLPGLVAVIALTTY

SEQ ID NO: 1894433 - protein, 17 aa, Staphylococcus
AAIGMALGLVWYMIFNK

SEQ ID NO: 1894434 - protein, 25 aa, Staphylococcus
AAIIILLVILLLMNAVAIFLRNKFS

SEQ ID NO: 1894435 - protein, 18 aa, Staphylococcus
AAIISISFLYLQTGNFID

SEQ ID NO: 1894436 - protein, 23 aa, Staphylococcus
AAIIWNLVTWLYGIPSSSSHALI

SEQ ID NO: 1894437 - protein, 21 aa, Staphylococcus
AAIPIILFLLCLTVFKMKGIY

SEQ ID NO: 1894438 - protein, 18 aa, Staphylococcus
AAIQLLILGFLLHYIFKI

SEQ ID NO: 1894439 - protein, 21 aa, Staphylococcus
AAKALLSDHPEYISATVYGET

SEQ ID NO: 1894440 - protein, 23 aa, Staphylococcus
AAKDIWMNGFTPKYTMSIWMGFS

SEQ ID NO: 1894441 - protein, 18 aa, Staphylococcus
AAKDVWINGFSPQYTMSV

SEQ ID NO: 1894442 - protein, 24 aa, Staphylococcus
AAKDVWINGFTPKYTMSIWMGFSE

SEQ ID NO: 1894443 - protein, 20 aa, Staphylococcus
AAKQLRKLSSLTSPQSGDIA

SEQ ID NO: 1894444 - protein, 18 aa, Staphylococcus
AALFLPFLMEYGLLEFLG

SEQ ID NO: 1894445 - protein, 41 aa, Staphylococcus
AALTVFSFVTTNMIFGIVFAILTVIFIVGIFLAKTKDVDYG

SEQ ID NO: 1894446 - protein, 21 aa, Staphylococcus
AALVAVVPPLFFGGNWDTWVY

SEQ ID NO: 1894447 - protein, 21 aa, Staphylococcus
AAMIAISFLYLQGGSLIDILT

SEQ ID NO: 1894448 - protein, 25 aa, Staphylococcus
AAPLFLIGVCLFLVLLQGDIGQTLL

SEQ ID NO: 1894449 - protein, 55 aa, Staphylococcus
AAPLLLTMLVHLFGIQIPSIFMNPWFQFILATPVQFIIGWQFYVGAYKNLRNGSA

SEQ ID NO: 1894450 - protein, 17 aa, Staphylococcus
AAPLSLENALPRSQYLI

SEQ ID NO: 1894451 - protein, 22 aa, Staphylococcus
AAPWSILMSIALFFIMMKVMPP

SEQ ID NO: 1894452 - protein, 24 aa, Staphylococcus
AASVSFLIFLRLDQINWGLVAALS

SEQ ID NO: 1894453 - protein, 22 aa, Staphylococcus
AATADIPGIVQDAKAVNAQVEL

SEQ ID NO: 1894454 - protein, 23 aa, Staphylococcus
AATSFLPLILLPIGHVLSPEAVS

SEQ ID NO: 1894455 - protein, 24 aa, Staphylococcus
AAVIAIFVALWNSSETLRNALTDA

SEQ ID NO: 1894456 - protein, 28 aa, Staphylococcus
AAVIIIMIFPSAPLFVLPLGSFVGALMI

SEQ ID NO: 1894457 - protein, 24 aa, Staphylococcus
AAVLILIRILHAWVYFKCSGMAQN

SEQ ID NO: 1894458 - protein, 22 aa, Staphylococcus
AAVPIILFLLCLTVFKMKGVYA

SEQ ID NO: 1894459 - protein, 26 aa, Staphylococcus
AAVQYLLIRFPLEANLALVWLTGSLF

SEQ ID NO: 1894460 - protein, 21 aa, Staphylococcus
AAWYTLPIAVAVLILLAALTL

SEQ ID NO: 1894461 - protein, 20 aa, Staphylococcus
AAYFYSIYLAIIHYGESHIP

SEQ ID NO: 1894462 - protein, 24 aa, Staphylococcus
AAYKLPPLTLLNTPAKQKTTSRAE

SEQ ID NO: 1894463 - protein, 26 aa, Staphylococcus
AAYPIPFRLEYLVHLTFVPLLFLGRY

SEQ ID NO: 1894464 - protein, 22 aa, Staphylococcus
ACGFFLLMFGGVVSDCWIAILA

SEQ ID NO: 1894465 - protein, 21 aa, Staphylococcus
ACILGYLLFGLGLGLFATPST

SEQ ID NO: 1894466 - protein, 22 aa, Staphylococcus
ACYAFIIYLIFSSAFERAKTHK

SEQ ID NO: 1894467 - protein, 32 aa, Staphylococcus
ADALRRKLDLKYTPMALLYFNPKNEGAVTISN

SEQ ID NO: 1894468 - protein, 20 aa, Staphylococcus
ADASKLGFKLGHDPDKEHSV

SEQ ID NO: 1894469 - protein, 24 aa, Staphylococcus
ADDGTTFAIRDSYKSLYNNPNTNQ

SEQ ID NO: 1894470 - protein, 36 aa, Staphylococcus
ADDNYNFCIYVPFGDDWFGYFMRRLAERPQNLNLAV

SEQ ID NO: 1894471 - protein, 35 aa, Staphylococcus
ADFAGSYVQPFNHSWAQGMNFEWGDNLGTPSSRTP

SEQ ID NO: 1894472 - protein, 18 aa, Staphylococcus
ADFTTDSWRALQDKLTEA

SEQ ID NO: 1894473 - protein, 42 aa, Staphylococcus
ADIISGYFVPIVIAIALLTFLIWITLVHPGQFEDALVAAISV

SEQ ID NO: 1894474 - protein, 17 aa, Staphylococcus
ADKFIEGLNHINKAQLT

SEQ ID NO: 1894475 - protein, 17 aa, Staphylococcus
ADKTELEKALDAAVAFD

SEQ ID NO: 1894476 - protein, 30 aa, Staphylococcus
ADMAILLGINWLAILLYIEAVVSPFGTGVS

SEQ ID NO: 1894477 - protein, 29 aa, Staphylococcus
ADMAILLGLNWLAILLYIEAVVSPFGTGV

SEQ ID NO: 1894478 - protein, 26 aa, Staphylococcus
ADMNWPPLLWMLFIAVICIVVGMLGF

SEQ ID NO: 1894479 - protein, 24 aa, Staphylococcus
ADPEYIFYAYKRFNFELKDPNFTD

SEQ ID NO: 1894480 - protein, 22 aa, Staphylococcus
ADPEYIFYAYKRYNFVQKDPNF

SEQ ID NO: 1894481 - protein, 37 aa, Staphylococcus
ADSVWYIVVLNLGMSVLFIIFTFFKESRLSKHFYKNK

SEQ ID NO: 1894482 - protein, 27 aa, Staphylococcus
ADVAKTLHDGLAKLDLIQINAHKKSDA

SEQ ID NO: 1894483 - protein, 17 aa, Staphylococcus
ADYRLMVPLTMVIGADL

SEQ ID NO: 1894484 - protein, 18 aa, Staphylococcus
AEDTILNREVAIKAISIP

SEQ ID NO: 1894485 - protein, 19 aa, Staphylococcus
AEFPSVKSVIWEDDNQILK

SEQ ID NO: 1894486 - protein, 24 aa, Staphylococcus
AEFSFNFIFLANLIMYVLFGIVAF

SEQ ID NO: 1894487 - protein, 22 aa, Staphylococcus
AEGHTVMLIAYDGKLRGMIAVA

SEQ ID NO: 1894488 - protein, 20 aa, Staphylococcus
AEHRHLLFGLFLAANLISWY

SEQ ID NO: 1894489 - protein, 21 aa, Staphylococcus
AEIVFYIFLVGGAFGIVHKTG

SEQ ID NO: 1894490 - protein, 24 aa, Staphylococcus
AEKFMIGVFIIALLLWVVGSFIGV

SEQ ID NO: 1894491 - protein, 31 aa, Staphylococcus
AEKMKFIPYLIFVFLWVICVYSPVAHWVWGG

SEQ ID NO: 1894492 - protein, 30 aa, Staphylococcus
AEKVLGWLSWVFLLLLTVITMFIALVSFSS

SEQ ID NO: 1894493 - protein, 23 aa, Staphylococcus
AEQLLKEKHLKLGNISRSYSDKY

SEQ ID NO: 1894494 - protein, 33 aa, Staphylococcus
AERMRFFPFMIFIFIWVLVIYSPVAHWVWGGGW

SEQ ID NO: 1894495 - protein, 20 aa, Staphylococcus
AFAAIFYVSNWWYIATDVNY

SEQ ID NO: 1894496 - protein, 18 aa, Staphylococcus
AFAEQLWNIGKNSAFALI

SEQ ID NO: 1894497 - protein, 25 aa, Staphylococcus
AFALFLVVFCWQPIHFYALAIKRSD

SEQ ID NO: 1894498 - protein, 21 aa, Staphylococcus
AFAVFSALTLLPALISIFHNQ

SEQ ID NO: 1894499 - protein, 19 aa, Staphylococcus
AFAVLYLWLVKLGEAKTKS

SEQ ID NO: 1894500 - protein, 20 aa, Staphylococcus
AFCMILPWRIAMLMKYKKLK

SEQ ID NO: 1894501 - protein, 24 aa, Staphylococcus
AFCVGFIMYTIVKIVFKNANLTRA

SEQ ID NO: 1894502 - protein, 30 aa, Staphylococcus
AFFCTFIAVILLFVWPVVYNAIVTFGTWIV

SEQ ID NO: 1894503 - protein, 26 aa, Staphylococcus
AFFFEAIFLSIYFYTWNRFKNKWTHM

SEQ ID NO: 1894504 - protein, 17 aa, Staphylococcus
AFFLVLAFRTYKELGTD

SEQ ID NO: 1894505 - protein, 20 aa, Staphylococcus
AFFLVLAFRTYKELGTDNIE

SEQ ID NO: 1894506 - protein, 41 aa, Staphylococcus
AFFSIILAVIMLFVWPFIFSAIVIFGTWILDLGPVGAFLYG

SEQ ID NO: 1894507 - protein, 24 aa, Staphylococcus
AFGGWLVIGLIFFIVRYPKLKRMD

SEQ ID NO: 1894508 - protein, 17 aa, Staphylococcus
AFGLLVLFALIALITMV

SEQ ID NO: 1894509 - protein, 27 aa, Staphylococcus
AFHWPHFIFYILLVLTICSFIRFILQP

SEQ ID NO: 1894510 - protein, 22 aa, Staphylococcus
AFIALIIAFVFLLLASRSKAVN

SEQ ID NO: 1894511 - protein, 19 aa, Staphylococcus
AFIAWGFIAAIFIDNGWLP

SEQ ID NO: 1894512 - protein, 17 aa, Staphylococcus
AFICGIIALIINSSAYI

SEQ ID NO: 1894513 - protein, 20 aa, Staphylococcus
AFIFGLILGVLLFLSAKSHS

SEQ ID NO: 1894514 - protein, 24 aa, Staphylococcus
AFIFPLAFYLLFTSLIDMPADAKK

SEQ ID NO: 1894515 - protein, 21 aa, Staphylococcus
AFIFRFIALFLISIIANFWFI

SEQ ID NO: 1894516 - protein, 21 aa, Staphylococcus
AFIFRFLALFLISIIANFWFI

SEQ ID NO: 1894517 - protein, 21 aa, Staphylococcus
AFIIMTVIISLLIIGGANANK

SEQ ID NO: 1894518 - protein, 24 aa, Staphylococcus
AFILGLLLLIPSLILILRLFVFDK

SEQ ID NO: 1894519 - protein, 18 aa, Staphylococcus
AFILIMFQNFLFLKRRTI

SEQ ID NO: 1894520 - protein, 20 aa, Staphylococcus
AFILIVALLIVGMGFTYKNV

SEQ ID NO: 1894521 - protein, 19 aa, Staphylococcus
AFILIVAVLFVGMGLTYKN

SEQ ID NO: 1894522 - protein, 23 aa, Staphylococcus
AFILLIVLLFAGMGLTYKNVIKN

SEQ ID NO: 1894523 - protein, 20 aa, Staphylococcus
AFILLVALLFTGMGLTYKNV

SEQ ID NO: 1894524 - protein, 22 aa, Staphylococcus
AFILLVVLLFAGMGLTYKNVVK

SEQ ID NO: 1894525 - protein, 18 aa, Staphylococcus
AFIPIVIPPLISLFNDLK

SEQ ID NO: 1894526 - protein, 18 aa, Staphylococcus
AFIPIVIPPLISLFNELN

SEQ ID NO: 1894527 - protein, 18 aa, Staphylococcus
AFIPIVIPPLLSLFNDLN

SEQ ID NO: 1894528 - protein, 19 aa, Staphylococcus
AFIPIVIPPLLSLFNDLRI

SEQ ID NO: 1894529 - protein, 18 aa, Staphylococcus
AFIQIVLGMILYLTPIPV

SEQ ID NO: 1894530 - protein, 25 aa, Staphylococcus
AFISIFILVLLLRLLNQFGDTNYLI

SEQ ID NO: 1894531 - protein, 28 aa, Staphylococcus
AFISIHSEFWFIYIPVTLLAMVIPAILT

SEQ ID NO: 1894532 - protein, 22 aa, Staphylococcus
AFISYVILMVLFKKGKLNKWLP

SEQ ID NO: 1894533 - protein, 17 aa, Staphylococcus
AFITIIMMPLSYSIATG

SEQ ID NO: 1894534 - protein, 19 aa, Staphylococcus
AFKLINNIGPPIFQNLLNA

SEQ ID NO: 1894535 - protein, 17 aa, Staphylococcus
AFLFALFIKEPNRKSQN

SEQ ID NO: 1894536 - protein, 20 aa, Staphylococcus
AFLIFTIIIMLLTATGPNGL

SEQ ID NO: 1894537 - protein, 26 aa, Staphylococcus
AFLITLILVPILIPTLKRMKFGQSIR

SEQ ID NO: 1894538 - protein, 19 aa, Staphylococcus
AFLLGWLALVLVVVVLYIG

SEQ ID NO: 1894539 - protein, 28 aa, Staphylococcus
AFLLIRSYLFVYYRLDFRFKSLLYISIA

SEQ ID NO: 1894540 - protein, 25 aa, Staphylococcus
AFLLLFLIFTIFVGLPLLIMEFTVG

SEQ ID NO: 1894541 - protein, 23 aa, Staphylococcus
AFLLLVILLFAGMGLTYKNVIKN

SEQ ID NO: 1894542 - protein, 20 aa, Staphylococcus
AFLLLVVLLFAGMAATYKSV

SEQ ID NO: 1894543 - protein, 19 aa, Staphylococcus
AFLLVGIVGLAYWYGVMPE

SEQ ID NO: 1894544 - protein, 20 aa, Staphylococcus
AFLRIPVGLNHNPIVEYYVE

SEQ ID NO: 1894545 - protein, 25 aa, Staphylococcus
AFLSLFLLFTIFVGLPLLIMEFTVG

SEQ ID NO: 1894546 - protein, 20 aa, Staphylococcus
AFLTFSFVQRYIQIKFFSEF

SEQ ID NO: 1894547 - protein, 21 aa, Staphylococcus
AFMILFLLTVVAVIATWLIPA

SEQ ID NO: 1894548 - protein, 24 aa, Staphylococcus
AFMVLFSIFVLFRGLGKDYDAAVM

SEQ ID NO: 1894549 - protein, 29 aa, Staphylococcus
AFNIILRLIIIALILMIWLANPFVTIVIG

SEQ ID NO: 1894550 - protein, 20 aa, Staphylococcus
AFNQTILLKVRLPRVLEAML

SEQ ID NO: 1894551 - protein, 18 aa, Staphylococcus
AFNTGSKVRLSGQGFKFT

SEQ ID NO: 1894552 - protein, 20 aa, Staphylococcus
AFPIILISLLVIRTFIKVIV

SEQ ID NO: 1894553 - protein, 17 aa, Staphylococcus
AFQLFGRGYFLGIPVPA

SEQ ID NO: 1894554 - protein, 28 aa, Staphylococcus
AFRLEPWIIAIFLAVLLALIIFGGIKWI

SEQ ID NO: 1894555 - protein, 20 aa, Staphylococcus
AFRLFPFVFIFAVGGASLAT

SEQ ID NO: 1894556 - protein, 18 aa, Staphylococcus
AFSIVYTNQPVPPPWLNG

SEQ ID NO: 1894557 - protein, 23 aa, Staphylococcus
AFSPLVIFSLYWKGLSRTGALAG

SEQ ID NO: 1894558 - protein, 22 aa, Staphylococcus
AFSPLVLYSLYWKNLTRTGALS

SEQ ID NO: 1894559 - protein, 46 aa, Staphylococcus
AFTIIFMERRTANSIWAWLLVLVFLPLIGFILYLLLGRQIQRDQIF

SEQ ID NO: 1894560 - protein, 25 aa, Staphylococcus
AFTLIEMLLVLLIISLLLILIIPNI

SEQ ID NO: 1894561 - protein, 30 aa, Staphylococcus
AFTLTCIFVSWIWFIFLALVGKSVGTIDKS

SEQ ID NO: 1894562 - protein, 20 aa, Staphylococcus
AFTQLLHDSIRRKFDYDISC

SEQ ID NO: 1894563 - protein, 17 aa, Staphylococcus
AFTQVIMIILTALICIF

SEQ ID NO: 1894564 - protein, 17 aa, Staphylococcus
AFVIIFMERRSAGSIWA

SEQ ID NO: 1894565 - protein, 29 aa, Staphylococcus
AFVLISVAMYLLPYFVLGNNSWSFVMTWL

SEQ ID NO: 1894566 - protein, 17 aa, Staphylococcus
AFVLLFAGGGNGAEALN

SEQ ID NO: 1894567 - protein, 29 aa, Staphylococcus
AFVVLAFFFFVFILLFFSADTRAAIFISP

SEQ ID NO: 1894568 - protein, 24 aa, Staphylococcus
AFVVLLITFGSFIAAGLPIVSALI

SEQ ID NO: 1894569 - protein, 18 aa, Staphylococcus
AFVVRMTLIPALTKLFGK

SEQ ID NO: 1894570 - protein, 18 aa, Staphylococcus
AFWLPLILSSLIFALQHS

SEQ ID NO: 1894571 - protein, 17 aa, Staphylococcus
AFYPVLVPIFIAMGYDS

SEQ ID NO: 1894572 - protein, 25 aa, Staphylococcus
AGALVVIIWIAWIKPLASINEIFGM

SEQ ID NO: 1894573 - protein, 17 aa, Staphylococcus
AGALWYSNFYISLLIFV

SEQ ID NO: 1894574 - protein, 26 aa, Staphylococcus
AGCLLGGIVASFLFREENPTLQVLEE

SEQ ID NO: 1894575 - protein, 24 aa, Staphylococcus
AGDSIKITIPQALNLNGVTATAKA

SEQ ID NO: 1894576 - protein, 25 aa, Staphylococcus
AGDSKWYFFKLLDYGVDGVISFNNK

SEQ ID NO: 1894577 - protein, 24 aa, Staphylococcus
AGESKWTFRKLLNYGIDGLISFNN

SEQ ID NO: 1894578 - protein, 25 aa, Staphylococcus
AGFFLAFISLFLVIWVPANPIIIIL

SEQ ID NO: 1894579 - protein, 23 aa, Staphylococcus
AGFFPIMMFGIPAAALAMYHSAE

SEQ ID NO: 1894580 - protein, 20 aa, Staphylococcus
AGFFPIMMFGMPAAALAMYH

SEQ ID NO: 1894581 - protein, 18 aa, Staphylococcus
AGFIILYLRAIIPVFPLT

SEQ ID NO: 1894582 - protein, 18 aa, Staphylococcus
AGFLFLYPVVAYLIGLVR

SEQ ID NO: 1894583 - protein, 19 aa, Staphylococcus
AGFLFMYPVITYLIGLVRD

SEQ ID NO: 1894584 - protein, 26 aa, Staphylococcus
AGGIRIRPILMTAIATIGALLPLLFG

SEQ ID NO: 1894585 - protein, 27 aa, Staphylococcus
AGGTRIRPILMTAIATIGALIPLLFGQ

SEQ ID NO: 1894586 - protein, 26 aa, Staphylococcus
AGGTRIRPILMTAIATIGALLPLLFG

SEQ ID NO: 1894587 - protein, 26 aa, Staphylococcus
AGGTRIRPILMTAIATIGALVPLLFG

SEQ ID NO: 1894588 - protein, 29 aa, Staphylococcus
AGGTRIRPILMTALATIGALIPLLFGQDS

SEQ ID NO: 1894589 - protein, 23 aa, Staphylococcus
AGHSYNHWLLIAVGAVIGLVAGI

SEQ ID NO: 1894590 - protein, 29 aa, Staphylococcus
AGHWWQSSILFFCYNILAGTIFFTQLGQQ

SEQ ID NO: 1894591 - protein, 34 aa, Staphylococcus; identical to SEQ ID NO: 1750322

SEQ ID NO: 1894592 - protein, 18 aa, Staphylococcus
AGIAAGILLVMIIASGFL

SEQ ID NO: 1894593 - protein, 34 aa, Staphylococcus
AGIASAVLLVMIFISAFALRNGFLRLDNYVDDLS

SEQ ID NO: 1894594 - protein, 26 aa, Staphylococcus
AGIATIVLVIIIIGTAFMVRQALQKL

SEQ ID NO: 1894595 - protein, 31 aa, Staphylococcus
AGIIVTLAFLLLMLVFRSIIIPLKAVGGFLL

SEQ ID NO: 1894596 - protein, 23 aa, Staphylococcus
AGILTLWYYWRKRKKNIDKMVLS

SEQ ID NO: 1894597 - protein, 24 aa, Staphylococcus
AGINVYIIRILKLPFTISLHFYLF

SEQ ID NO: 1894598 - protein, 25 aa, Staphylococcus
AGISPFMLMPYSIYPIILGVSGLVA

SEQ ID NO: 1894599 - protein, 26 aa, Staphylococcus
AGIVFSIIIVILAILSLILLLANKKK

SEQ ID NO: 1894600 - protein, 22 aa, Staphylococcus
AGIYQDIDVVPGSELNVNFIST

SEQ ID NO: 1894601 - protein, 23 aa, Staphylococcus
AGKLILIIVAFVISFVALSDLID

SEQ ID NO: 1894602 - protein, 24 aa, Staphylococcus
AGLIGLLILPYTKLITLGLGDVIN

SEQ ID NO: 1894603 - protein, 22 aa, Staphylococcus
AGLLIILLIIRAILYVRYSGYY

SEQ ID NO: 1894604 - protein, 28 aa, Staphylococcus
AGLLILIGLILVLSIFKPTYRKPGLYKE

SEQ ID NO: 1894605 - protein, 18 aa, Staphylococcus
AGLLLLFFLIRQAALKEP

SEQ ID NO: 1894606 - protein, 23 aa, Staphylococcus
AGLYLLFRFTPILSYASWVGYIV

SEQ ID NO: 1894607 - protein, 17 aa, Staphylococcus
AGMILFNLSFIVGGSPA

SEQ ID NO: 1894608 - protein, 29 aa, Staphylococcus
AGNEVNIPISVQYDNYRDGHVIANATSLI

SEQ ID NO: 1894609 - protein, 27 aa, Staphylococcus
AGPMITYLIPLLIAFSGGRLIHDLRGG

SEQ ID NO: 1894610 - protein, 27 aa, Staphylococcus
AGPMITYLIPLLIAFSGGRLIHGLRGG

SEQ ID NO: 1894611 - protein, 27 aa, Staphylococcus
AGSFGWLFLVIIFVLDVFLIALAISRY

SEQ ID NO: 1894612 - protein, 29 aa, Staphylococcus
AGSLGFTSWMFYVPLILSLIVIAIFIKRQ

SEQ ID NO: 1894613 - protein, 24 aa, Staphylococcus
AGSLVVIIWIAWIKPLASVNELFG

SEQ ID NO: 1894614 - protein, 18 aa, Staphylococcus
AGVFAIYLFAFQLNLFPF

SEQ ID NO: 1894615 - protein, 30 aa, Staphylococcus
AGVIPVIFAMAFFLLPRTLTLFFPDASWAQ

SEQ ID NO: 1894616 - protein, 30 aa, Staphylococcus
AGVIPVIFAMAFFLLPRTLTLFFPKADWAQ

SEQ ID NO: 1894617 - protein, 31 aa, Staphylococcus
AGVIPVIFAMAFFLLPRTLTLFFPKADWAQN

SEQ ID NO: 1894618 - protein, 31 aa, Staphylococcus
AGVIPVIFAMAFFLLPRTLTLFFPKADWAQT

SEQ ID NO: 1894619 - protein, 31 aa, Staphylococcus; identical to SEQ ID NO: 1749089

SEQ ID NO: 1894620 - protein, 31 aa, Staphylococcus
AGVIPVIFAMAFFLLPRTLTLFFPKAEWAQQ

SEQ ID NO: 1894621 - protein, 31 aa, Staphylococcus
AGVIPVIFAMAFFLLPRTLTMFFPKADWAQQ

SEQ ID NO: 1894622 - protein, 23 aa, Staphylococcus
AGVISLSFLYLQGGNFQNIVITF

SEQ ID NO: 1894623 - protein, 26 aa, Staphylococcus
AGVSVVLILIFFLPAFNAVFRHHFVY

SEQ ID NO: 1894624 - protein, 26 aa, Staphylococcus
AGVVTASSLALAAKNKNKALDDNTSV

SEQ ID NO: 1894625 - protein, 25 aa, Staphylococcus
AHAGWLHYFIGMLVAFIVSVAITLI

SEQ ID NO: 1894626 - protein, 17 aa, Staphylococcus
AHAKWLDFPHIYLPFKD

SEQ ID NO: 1894627 - protein, 22 aa, Staphylococcus
AHIPFYLIGFLAAFIVGLIAIK

SEQ ID NO: 1894628 - protein, 26 aa, Staphylococcus
AHLIHPIWLVLSFFLITLGELCISPV

SEQ ID NO: 1894629 - protein, 48 aa, Staphylococcus
AHNGNKKRGLMGILLPLIALLLILAALAIFIGMYLNNDHKEKNNNTAD

SEQ ID NO: 1894630 - protein, 18 aa, Staphylococcus
AHNLKTRRQINYAGLGSS

SEQ ID NO: 1894631 - protein, 33 aa, Staphylococcus
AHVKKRLFWVIPVYVFLKVLMPIIIVFGVYGIW

SEQ ID NO: 1894632 - protein, 24 aa, Staphylococcus
AHWVGLPLPFRFSGFGFDLSSTLV

SEQ ID NO: 1894633 - protein, 27 aa, Staphylococcus
AIAAAILIWLFNFTLADPIASMLVSVL

SEQ ID NO: 1894634 - protein, 25 aa, Staphylococcus
AIAAIPLLYVALFVGSMWSPYDKTD

SEQ ID NO: 1894635 - protein, 25 aa, Staphylococcus
AIAGILTLWYYWRKRKPFIDEMTAS

SEQ ID NO: 1894636 - protein, 26 aa, Staphylococcus
AIAGLLTLWYYWRKRKPHIQKLVASD

SEQ ID NO: 1894637 - protein, 24 aa, Staphylococcus
AIAILISLTLIYIQPMALADEDAT

SEQ ID NO: 1894638 - protein, 25 aa, Staphylococcus
AIALFLVIFCWQPIHFYALAIKRQD

SEQ ID NO: 1894639 - protein, 25 aa, Staphylococcus
AIALFLVVFCWQPVHFYALAIKRSD

SEQ ID NO: 1894640 - protein, 24 aa, Staphylococcus
AIALLMMFLFLFVPSMTKIASAHA

SEQ ID NO: 1894641 - protein, 28 aa, Staphylococcus
AIALTLFLVPKWYSLIIILVAIIITMPI

SEQ ID NO: 1894642 - protein, 24 aa, Staphylococcus
AIAPILMIYIAKLPQYFLMFASIA

SEQ ID NO: 1894643 - protein, 20 aa, Staphylococcus
AIARLFLKHAPIWILDEPTT

SEQ ID NO: 1894644 - protein, 23 aa, Staphylococcus
AIASWYTLPIACAVLVLLAALIL

SEQ ID NO: 1894645 - protein, 23 aa, Staphylococcus
AIAVFLIIVALILFVHKHYFLFL

SEQ ID NO: 1894646 - protein, 27 aa, Staphylococcus
AICAVLLMQLGFKALPAAMYCLVANAA

SEQ ID NO: 1894647 - protein, 17 aa, Staphylococcus
AICCYKFLNVSNTDDNS

SEQ ID NO: 1894648 - protein, 17 aa, Staphylococcus
AIDNAEHPNISISKPVK

SEQ ID NO: 1894649 - protein, 20 aa, Staphylococcus
AIEAALTDRKVFIDSHYDAT

SEQ ID NO: 1894650 - protein, 28 aa, Staphylococcus
AIEEQFYLFFPFVLITLLLTIKKYRNIT

SEQ ID NO: 1894651 - protein, 29 aa, Staphylococcus
AIEEQFYLFFPFVLVILLLTIKKYRNVTL

SEQ ID NO: 1894652 - protein, 22 aa, Staphylococcus
AIEILFAAIGLIMGLLISVMIS

SEQ ID NO: 1894653 - protein, 20 aa, Staphylococcus
AIELVQLISLPMILINSIGT

SEQ ID NO: 1894654 - protein, 26 aa, Staphylococcus
AIEQLNPIEQNAIELIKATPSDSEVK

SEQ ID NO: 1894655 - protein, 27 aa, Staphylococcus
AIFAAIFWNLLTWYFGIPSSSSHALIG

SEQ ID NO: 1894656 - protein, 17 aa, Staphylococcus
AIFIFFIGTIIAGFSPN

SEQ ID NO: 1894657 - protein, 18 aa, Staphylococcus
AIFILILLENVLPVVPSE

SEQ ID NO: 1894658 - protein, 28 aa, Staphylococcus
AIFISPFWFIFLYFYYKKYKNNAKDLAD

SEQ ID NO: 1894659 - protein, 28 aa, Staphylococcus
AIFISPIWFIFLFFYYKKYKSNAKALAE

SEQ ID NO: 1894660 - protein, 28 aa, Staphylococcus
AIFISPIWFIFLFIFYRKYKSNAEDLAE

SEQ ID NO: 1894661 - protein, 26 aa, Staphylococcus
AIFKSPILYNIILYGALISMFGINIA

SEQ ID NO: 1894662 - protein, 21 aa, Staphylococcus
AIFLLFGTFLYFIGTEGYANM

SEQ ID NO: 1894663 - protein, 19 aa, Staphylococcus
AIFQIFFFDKFISYMSELT

SEQ ID NO: 1894664 - protein, 17 aa, Staphylococcus
AIFSILIFVSKSGQKIM

SEQ ID NO: 1894665 - protein, 18 aa, Staphylococcus
AIFTVIVLWFLTNGAQID

SEQ ID NO: 1894666 - protein, 41 aa, Staphylococcus
AIFVCMIVIDWRMACAMLITIPISFFAFKKLMSGFNDTYAA

SEQ ID NO: 1894667 - protein, 18 aa, Staphylococcus
AIFVVIIMVLVTWNDIQR

SEQ ID NO: 1894668 - protein, 33 aa, Staphylococcus
AIGKWHWWMSTVLIFILMIALVLLLRGKQNFWI

SEQ ID NO: 1894669 - protein, 25 aa, Staphylococcus
AIGLLFTQFGLPIIDVILATVLGCL

SEQ ID NO: 1894670 - protein, 26 aa, Staphylococcus
AIGMALGLVWYLLFNRKNLGSVGMKP

SEQ ID NO: 1894671 - protein, 26 aa, Staphylococcus
AIGTFFFGFILRLLGPFGLHHIFYLP

SEQ ID NO: 1894672 - protein, 26 aa, Staphylococcus
AIIAAILWNLITWYYGIPSSSSHALI

SEQ ID NO: 1894673 - protein, 29 aa, Staphylococcus
AIIALTVYIYLTLVAFNFISGVLTLPGLA

SEQ ID NO: 1894674 - protein, 27 aa, Staphylococcus
AIIASILIWTFNFTIADPIASIVVSLL

SEQ ID NO: 1894675 - protein, 25 aa, Staphylococcus
AIIEWVILVKWFKRKIPFLDKVVLK

SEQ ID NO: 1894676 - protein, 18 aa, Staphylococcus
AIIFFSGLVTLIIRIVPF

SEQ ID NO: 1894677 - protein, 17 aa, Staphylococcus
AIIFIFIVGVLLLILKM

SEQ ID NO: 1894678 - protein, 21 aa, Staphylococcus
AIIFMVTGIIPLVPGGLAFDA

SEQ ID NO: 1894679 - protein, 20 aa, Staphylococcus
AIIFMVTGIIPLVPGGLAYY

SEQ ID NO: 1894680 - protein, 20 aa, Staphylococcus
AIIIAFLIFGFILLTKMHLP

SEQ ID NO: 1894681 - protein, 17 aa, Staphylococcus
AIIIFYNMKLISGIRYT

SEQ ID NO: 1894682 - protein, 32 aa, Staphylococcus
AIIIMIVIGLLLYRKSLLKRKWIAIGLVILFL

SEQ ID NO: 1894683 - protein, 18 aa, Staphylococcus
AIIIVWATVSLFLEQRYR

SEQ ID NO: 1894684 - protein, 17 aa, Staphylococcus
AIILGLLFILIYATFWT

SEQ ID NO: 1894685 - protein, 22 aa, Staphylococcus
AIILLFIMTWLTTIILNLENIE

SEQ ID NO: 1894686 - protein, 24 aa, Staphylococcus
AIILLIGVIFMPESPRWLLENKSE

SEQ ID NO: 1894687 - protein, 29 aa, Staphylococcus
AIILMVMIPIIFFIPNFFTEHLVLPALRN

SEQ ID NO: 1894688 - protein, 17 aa, Staphylococcus
AIILNFFFNGIKYKQND

SEQ ID NO: 1894689 - protein, 21 aa, Staphylococcus
AIIMIFVFGGKAALVMFMWLP

SEQ ID NO: 1894690 - protein, 20 aa, Staphylococcus
AIISLMISFLLWYFTRGWRR

SEQ ID NO: 1894691 - protein, 31 aa, Staphylococcus
AIISSFHIFRIFFILFLIAPAIKYFLNYTER

SEQ ID NO: 1894692 - protein, 18 aa, Staphylococcus
AIITPTKPIPEGNVYVKA

SEQ ID NO: 1894693 - protein, 20 aa, Staphylococcus
AIIVSIVWALLLSACYYVYQ

SEQ ID NO: 1894694 - protein, 41 aa, Staphylococcus
AIIVSSLIHSLFLPKVPLAFIQIILGALLFLTPIPVSFDFD

SEQ ID NO: 1894695 - protein, 24 aa, Staphylococcus
AIIWNLLTWFYGIPSSSSHALIGS

SEQ ID NO: 1894696 - protein, 26 aa, Staphylococcus
AIKRAWIPILAYLFVDGLSVLTGSRS

SEQ ID NO: 1894697 - protein, 36 aa, Staphylococcus
AIKRNNLFMICPFIPFIGLIICFISPSTGVLITLFS

SEQ ID NO: 1894698 - protein, 26 aa, Staphylococcus
AIKSVFWRILLFYILSIAVISAILPY

SEQ ID NO: 1894699 - protein, 18 aa, Staphylococcus
AILAFAVIMWVTEAVSYP

SEQ ID NO: 1894700 - protein, 29 aa, Staphylococcus
AILEFATWHWLFFINIPIAIIAIVLVLMT

SEQ ID NO: 1894701 - protein, 29 aa, Staphylococcus
AILEFATWHWLFFINIPIAVIAIILAFIT

SEQ ID NO: 1894702 - protein, 20 aa, Staphylococcus
AILFALVAIILIFGITLYLN

SEQ ID NO: 1894703 - protein, 17 aa, Staphylococcus
AILFIITVVAVIATWII

SEQ ID NO: 1894704 - protein, 20 aa, Staphylococcus
AILFLIVIGLWMIFTGFTSA

SEQ ID NO: 1894705 - protein, 21 aa, Staphylococcus
AILIPLIVFIFIGYPLIAGTI

SEQ ID NO: 1894706 - protein, 17 aa, Staphylococcus
AILSTIPEWTSAQRTKN

SEQ ID NO: 1894707 - protein, 20 aa, Staphylococcus
AILVFFFLVFCLLFVNETTR

SEQ ID NO: 1894708 - protein, 22 aa, Staphylococcus
AILYTFIFGALFFFLNRMGSHA

SEQ ID NO: 1894709 - protein, 17 aa, Staphylococcus
AIMILFAYKTQFGHASL

SEQ ID NO: 1894710 - protein, 17 aa, Staphylococcus
AIMILLYSGLEFGENAS

SEQ ID NO: 1894711 - protein, 20 aa, Staphylococcus
AIMILLYSGLKFGESAPQGV

SEQ ID NO: 1894712 - protein, 21 aa, Staphylococcus
AIMRILFYMSPILWMPKDHGV

SEQ ID NO: 1894713 - protein, 21 aa, Staphylococcus
AIMRIRLAEKFRKLPLSYLSS

SEQ ID NO: 1894714 - protein, 23 aa, Staphylococcus
AIMYGVFLIVTLLYVVWYARRVI

SEQ ID NO: 1894715 - protein, 21 aa, Staphylococcus
AINDIKQILPSTKVKRDARDA

SEQ ID NO: 1894716 - protein, 21 aa, Staphylococcus
AINGWILPITLGAILIASKKK

SEQ ID NO: 1894717 - protein, 21 aa, Staphylococcus
AINGWILPITLGAILIASRKK

SEQ ID NO: 1894718 - protein, 23 aa, Staphylococcus
AINIAFHEYLLPRVGLTPEIDEL

SEQ ID NO: 1894719 - protein, 18 aa, Staphylococcus
AINIGALCYILWGIYLKD

SEQ ID NO: 1894720 - protein, 20 aa, Staphylococcus
AIPIFMAIMIPLGRKMQKIS

SEQ ID NO: 1894721 - protein, 17 aa, Staphylococcus
AIPIILFLLCLTVFKMK

SEQ ID NO: 1894722 - protein, 22 aa, Staphylococcus
AIPKYLFIIVATYIVTLGLNSL

SEQ ID NO: 1894723 - protein, 19 aa, Staphylococcus
AIQSINKALADKLNDIDNA

SEQ ID NO: 1894724 - protein, 25 aa, Staphylococcus
AIRQVFWRILLFYVLSIAVISAIIP

SEQ ID NO: 1894725 - protein, 22 aa, Staphylococcus
AISAIILNFFFNGLKYKQSEEN

SEQ ID NO: 1894726 - protein, 22 aa, Staphylococcus
AISAIILNFFFNGLKYQQNEEN

SEQ ID NO: 1894727 - protein, 31 aa, Staphylococcus
AISIFIALMFDFEKAYWIPLSTHTVLLGSTT

SEQ ID NO: 1894728 - protein, 22 aa, Staphylococcus
AISIFLCHWILKLTIMYLKWNI

SEQ ID NO: 1894729 - protein, 24 aa, Staphylococcus
AISIFYCIIIFPLSIFINIRIDKK

SEQ ID NO: 1894730 - protein, 24 aa, Staphylococcus
AISQLLVILWQFIDSFTVVHMLKS

SEQ ID NO: 1894731 - protein, 31 aa, Staphylococcus
AISRIVYPVIHLFVVILSPITKVLNALTGLI

SEQ ID NO: 1894732 - protein, 27 aa, Staphylococcus
AISSLPWLFMFFLILSAGAISDKILNS

SEQ ID NO: 1894733 - protein, 23 aa, Staphylococcus
AISTILFIVILLGIIGYYLMQHF

SEQ ID NO: 1894734 - protein, 26 aa, Staphylococcus
AISVLFAVFAALTLLPALISVFHKRI

SEQ ID NO: 1894735 - protein, 24 aa, Staphylococcus
AISVLFAVLAALTLLPALISIFHK

SEQ ID NO: 1894736 - protein, 21 aa, Staphylococcus
AISVLFIFFKAPDLALTQFVV

SEQ ID NO: 1894737 - protein, 18 aa, Staphylococcus
AITFFIIPKAFKISSISV

SEQ ID NO: 1894738 - protein, 19 aa, Staphylococcus
AITFLPLYMAFSVSPSGMA

SEQ ID NO: 1894739 - protein, 19 aa, Staphylococcus
AITIFSKLKPEIPTCHVIF

SEQ ID NO: 1894740 - protein, 25 aa, Staphylococcus
AIVAAILIWTLGWSIADPIASILVS

SEQ ID NO: 1894741 - protein, 30 aa, Staphylococcus; identical to SEQ ID NO: 1588463

SEQ ID NO: 1894742 - protein, 25 aa, Staphylococcus
AIVAQLIMIFIFGLPPGSAPVTAVL

SEQ ID NO: 1894743 - protein, 17 aa, Staphylococcus
AIVFFLIALILYILNII

SEQ ID NO: 1894744 - protein, 24 aa, Staphylococcus
AIVLIVRFILLPFMLIQVKNMHIM

SEQ ID NO: 1894745 - protein, 19 aa, Staphylococcus
AIVLYYAFHLSPAITNFVV

SEQ ID NO: 1894746 - protein, 25 aa, Staphylococcus
AIVTILFFIILWFISKRVEKHFMGS

SEQ ID NO: 1894747 - protein, 21 aa, Staphylococcus
AIVWNLVTWLYGIPSSSSHAL

SEQ ID NO: 1894748 - protein, 19 aa, Staphylococcus
AIWNRHIYLWWFMFAVFVS

SEQ ID NO: 1894749 - protein, 21 aa, Staphylococcus
AIYFYPRFKVTMTGFLVALIW

SEQ ID NO: 1894750 - protein, 19 aa, Staphylococcus
AIYFYPRLKIRISGLLVAM

SEQ ID NO: 1894751 - protein, 17 aa, Staphylococcus
AIYLLCHVKRWLSAKHL

SEQ ID NO: 1894752 - protein, 26 aa, Staphylococcus
AIYRIVLVIIIAILYFGFGIGQGITG

SEQ ID NO: 1894753 - protein, 30 aa, Staphylococcus
AKDRGLDAILDISPIPVVKQAAREAIANNA

SEQ ID NO: 1894754 - protein, 17 aa, Staphylococcus
AKDVWINGFSPQYSMSI

SEQ ID NO: 1894755 - protein, 17 aa, Staphylococcus
AKDVWINGFTPKYSMSV

SEQ ID NO: 1894756 - protein, 30 aa, Staphylococcus
AKFVLPIFSILFFLVAWFFARKPSKILDYI

SEQ ID NO: 1894757 - protein, 27 aa, Staphylococcus
AKGDLLPIIFFAVFFGLGLAAIGEKAE

SEQ ID NO: 1894758 - protein, 21 aa, Staphylococcus
AKINFMFLIKGLTPIFVFLIF

SEQ ID NO: 1894759 - protein, 30 aa, Staphylococcus
AKISSFHIFRIFFILFLVAPIINYFLKRKK

SEQ ID NO: 1894760 - protein, 30 aa, Staphylococcus
AKIYLPIFSIIFFLLAWFFARKPSKILDYI

SEQ ID NO: 1894761 - protein, 22 aa, Staphylococcus
AKKMPIFIILISIVGPILEEFV

SEQ ID NO: 1894762 - protein, 25 aa, Staphylococcus
AKKSIYIQTPYFIPDRAYINALKMA

SEQ ID NO: 1894763 - protein, 18 aa, Staphylococcus
AKMPNVIGMKKVDALDKL

SEQ ID NO: 1894764 - protein, 17 aa, Staphylococcus
AKNAIDGLTYLNDAQRA

SEQ ID NO: 1894765 - protein, 29 aa, Staphylococcus
AKNFSWYYLLLVLLIFFVCVYLLFSRYAS

SEQ ID NO: 1894766 - protein, 24 aa, Staphylococcus
AKNIWSILGDYLKQSWQNIVDGFS

SEQ ID NO: 1894767 - protein, 31 aa, Staphylococcus
AKNYKLYYLSFWYFITFGAFVAFGLFLPNYL

SEQ ID NO: 1894768 - protein, 34 aa, Staphylococcus
AKRFTLVLKSIRQFIWFIAIVCILGIWINAANSV

SEQ ID NO: 1894769 - protein, 19 aa, Staphylococcus
AKVALAGLTPFISGVSKGM

SEQ ID NO: 1894770 - protein, 18 aa, Staphylococcus
AKVFPIVWPLLYTSMGVA

SEQ ID NO: 1894771 - protein, 17 aa, Staphylococcus
AKYDLDGKYQVELAKQK

SEQ ID NO: 1894772 - protein, 25 aa, Staphylococcus
AKYGYILLFIILVSSLSAMLLQSMT

SEQ ID NO: 1894773 - protein, 32 aa, Staphylococcus
AKYKNINIALITSIIMIFVGVTGRFIYRKIKN

SEQ ID NO: 1894774 - protein, 24 aa, Staphylococcus
ALAAILPMWGVYKTVVGGASLVTG

SEQ ID NO: 1894775 - protein, 17 aa, Staphylococcus
ALAAMLIVYLLRNKLTV

SEQ ID NO: 1894776 - protein, 50 aa, Staphylococcus
ALAFGVFFDAFIVRLLMIPALTALFGKASWYLPAWLNRILPKIDIEGHAL

SEQ ID NO: 1894777 - protein, 24 aa, Staphylococcus
ALAGWLIIGLVFFVIRYPKIKAMN

SEQ ID NO: 1894778 - protein, 18 aa, Staphylococcus
ALAIPILCLCPPENSCGY

SEQ ID NO: 1894779 - protein, 30 aa, Staphylococcus
ALAKLSKFKLLSWIASIYIEFLRGTPMLVQ

SEQ ID NO: 1894780 - protein, 30 aa, Staphylococcus
ALAKLSKIKIISWIAAAYIEIIRGTPLLVQ

SEQ ID NO: 1894781 - protein, 42 aa, Staphylococcus
ALAVFSFMTQNMIFTVVFAVLTLIFIVGIFLAKAKTVDYSET

SEQ ID NO: 1894782 - protein, 24 aa, Staphylococcus
ALCIALLSLLFPLKGLSVSEAEET

SEQ ID NO: 1894783 - protein, 22 aa, Staphylococcus
ALDLIFGIPLIVGALITVFDVF

SEQ ID NO: 1894784 - protein, 19 aa, Staphylococcus
ALDLLFGIPLIVGAIITVL

SEQ ID NO: 1894785 - protein, 29 aa, Staphylococcus
ALDNARSQLVLDRQPFITHINGEGNLNAP

SEQ ID NO: 1894786 - protein, 19 aa, Staphylococcus
ALERLVTVLVIACPHALGL

SEQ ID NO: 1894787 - protein, 24 aa, Staphylococcus
ALETGLLFISFQKATQQFIDIQNH

SEQ ID NO: 1894788 - protein, 22 aa, Staphylococcus
ALFALIFIPLLFVLNVTHFSFI

SEQ ID NO: 1894789 - protein, 19 aa, Staphylococcus
ALFILLISISRVYLGVHYP

SEQ ID NO: 1894790 - protein, 19 aa, Staphylococcus
ALFILLISTSRVYLGVHYP

SEQ ID NO: 1894791 - protein, 17 aa, Staphylococcus
ALFITYLFGMIAYFILL

SEQ ID NO: 1894792 - protein, 18 aa, Staphylococcus
ALFITYLFGMIAYFILLM

SEQ ID NO: 1894793 - protein, 17 aa, Staphylococcus
ALFLFIINVTRLATSYR

SEQ ID NO: 1894794 - protein, 17 aa, Staphylococcus
ALFLLCFYYLPNLNRYN

SEQ ID NO: 1894795 - protein, 23 aa, Staphylococcus
ALFLSMWFFAVMPILIKAGSISK

SEQ ID NO: 1894796 - protein, 18 aa, Staphylococcus
ALFMLSILLIVVSGVYMI

SEQ ID NO: 1894797 - protein, 27 aa, Staphylococcus
ALFMSGVMYVLIGLAIRLSGTGWLMHL

SEQ ID NO: 1894798 - protein, 25 aa, Staphylococcus
ALFNAFLYVLIIFNQEKMNNIVNYM

SEQ ID NO: 1894799 - protein, 26 aa, Staphylococcus
ALFTSIIWLVGSFLFGWYISNFGNYN

SEQ ID NO: 1894800 - protein, 26 aa, Staphylococcus
ALFVAIFFVFIGTYLLFISLSVLLIE

SEQ ID NO: 1894801 - protein, 20 aa, Staphylococcus
ALFVLVLFQAGLRSIFNMII

SEQ ID NO: 1894802 - protein, 20 aa, Staphylococcus
ALFVLVLFQYGLQSIFDMIL

SEQ ID NO: 1894803 - protein, 53 aa, Staphylococcus
ALFVPYILMVLTAIALVILGFIFKPLVAGIAAAILFVIIVISAVLARQAMIKM

SEQ ID NO: 1894804 - protein, 26 aa, Staphylococcus
ALGAHLLWGILPIYWRLIGNISAFEI

SEQ ID NO: 1894805 - protein, 23 aa, Staphylococcus
ALGDDNLYYFYPDKNSLKKVNEK

SEQ ID NO: 1894806 - protein, 49 aa, Staphylococcus
ALGFGVLFDAFVVRLLLIPALTQLFGKASWYIPGWLNRILPHVDIEGHA

SEQ ID NO: 1894807 - protein, 27 aa, Staphylococcus
ALGFLAASLFLIWKRPFRFQWQWREND

SEQ ID NO: 1894808 - protein, 19 aa, Staphylococcus
ALGFNIQKAYWVPLSAHTV

SEQ ID NO: 1894809 - protein, 24 aa, Staphylococcus
ALGGWLVIGLIFFVIRYPKLKRMD

SEQ ID NO: 1894810 - protein, 29 aa, Staphylococcus
ALGIVLLIIFIHWWVKYLGFKRNEDLKEK

SEQ ID NO: 1894811 - protein, 18 aa, Staphylococcus
ALGLFLSLALMSIQLTQV

SEQ ID NO: 1894812 - protein, 21 aa, Staphylococcus
ALGLVWYVLFNRKNLGSVGMK

SEQ ID NO: 1894813 - protein, 19 aa, Staphylococcus
ALGLYWTVGGLFLIIQMHF

SEQ ID NO: 1894814 - protein, 26 aa, Staphylococcus
ALGSGLYFIGIVSTILIVIIQYVFRE

SEQ ID NO: 1894815 - protein, 24 aa, Staphylococcus
ALGSWLVIGLIFFVVRYPKLKNMN

SEQ ID NO: 1894816 - protein, 30 aa, Staphylococcus
ALGTIVAIIVILLFLRNIKTTAISIVSIPL

SEQ ID NO: 1894817 - protein, 22 aa, Staphylococcus
ALGWLILEYALKKTTSLLGLLS

SEQ ID NO: 1894818 - protein, 18 aa, Staphylococcus
ALGWNYWFNWVITVAADV

SEQ ID NO: 1894819 - protein, 25 aa, Staphylococcus
ALHDQLVYFFLKLNNYQWNIPQLSN

SEQ ID NO: 1894820 - protein, 24 aa, Staphylococcus
ALHLPLYVLLIAFFINISPVTSIA

SEQ ID NO: 1894821 - protein, 18 aa, Staphylococcus
ALIGGILVWMGWYGFNTG

SEQ ID NO: 1894822 - protein, 17 aa, Staphylococcus
ALIIFIFANIMTSLAVN

SEQ ID NO: 1894823 - protein, 17 aa, Staphylococcus
ALIIIFLKEILDKRIKT

SEQ ID NO: 1894824 - protein, 30 aa, Staphylococcus
ALIILSFLPILLFSVYFLISLSVVHPISIK

SEQ ID NO: 1894825 - protein, 17 aa, Staphylococcus
ALIILVLNIIWLTVYTP

SEQ ID NO: 1894826 - protein, 17 aa, Staphylococcus
ALIIPVLAGFIARSIAD

SEQ ID NO: 1894827 - protein, 18 aa, Staphylococcus
ALIIVGLVTKFLFTSYTV

SEQ ID NO: 1894828 - protein, 24 aa, Staphylococcus
ALILIILFVVFRSVVTPFIPLFIV

SEQ ID NO: 1894829 - protein, 39 aa, Staphylococcus
ALILPFVIMTLTAIALVVVWFVFNQLVAGIATIVLVIII

SEQ ID NO: 1894830 - protein, 27 aa, Staphylococcus
ALIPLLKLFLVVIGAMIFFVVVILGIV

SEQ ID NO: 1894831 - protein, 31 aa, Staphylococcus
ALIQTMIMLLLAFIMIFLQNRRFLKKRSILD

SEQ ID NO: 1894832 - protein, 25 aa, Staphylococcus
ALIQTMIMLMLAFILIMLENAIFLK

SEQ ID NO: 1894833 - protein, 20 aa, Staphylococcus
ALITLFNILIHLGFASATSL

SEQ ID NO: 1894834 - protein, 18 aa, Staphylococcus
ALIVVLIQWIAGLSVTDY

SEQ ID NO: 1894835 - protein, 28 aa, Staphylococcus
ALKDLRLFRISWIVLVVLMIGYFVSEWL

SEQ ID NO: 1894836 - protein, 24 aa, Staphylococcus
ALKQAKHDLVPDKTLLNNAKNNLE

SEQ ID NO: 1894837 - protein, 27 aa, Staphylococcus
ALLAIIFDLILRYMEKLSYKKIIITLG

SEQ ID NO: 1894838 - protein, 18 aa, Staphylococcus
ALLFHTFLYTLITHLTYF

SEQ ID NO: 1894839 - protein, 17 aa, Staphylococcus
ALLFIAGLLLLINGICA

SEQ ID NO: 1894840 - protein, 21 aa, Staphylococcus
ALLFWIGILSCRLYFHAHYVG

SEQ ID NO: 1894841 - protein, 17 aa, Staphylococcus
ALLGFLFFNFHPATIFL

SEQ ID NO: 1894842 - protein, 20 aa, Staphylococcus
ALLHDVFIIVAVFSLFRLEV

SEQ ID NO: 1894843 - protein, 17 aa, Staphylococcus
ALLIGRTISMTLLTVLV

SEQ ID NO: 1894844 - protein, 18 aa, Staphylococcus
ALLILMTLIYFSISIKKT

SEQ ID NO: 1894845 - protein, 39 aa, Staphylococcus
ALLIPFIIMVLTAIALVIVWFIFNQIVAGIAAGILLVMI

SEQ ID NO: 1894846 - protein, 40 aa, Staphylococcus; identical to SEQ ID NO: 1750389

SEQ ID NO: 1894847 - protein, 54 aa, Staphylococcus
ALLIPFILMVLTSIALVVVWFIFKPLVATIAAAILVVMIIISIVLVRQALLKMD

SEQ ID NO: 1894848 - protein, 53 aa, Staphylococcus
ALLIPYILMVLTAIAIVIVGFIFKPLMATFTAIALIIMIVISAVLIKQALSKM

SEQ ID NO: 1894849 - protein, 21 aa, Staphylococcus
ALLISLFAVTLFLAGHYTPGG

SEQ ID NO: 1894850 - protein, 24 aa, Staphylococcus
ALLITFILVPVLIPTLKRMKFGQS

SEQ ID NO: 1894851 - protein, 17 aa, Staphylococcus
ALLITGFLAFIVIGPVA

SEQ ID NO: 1894852 - protein, 19 aa, Staphylococcus
ALLLFLRKHLRIGETFFTY

SEQ ID NO: 1894853 - protein, 17 aa, Staphylococcus
ALLLIIGMVLITLFIRP

SEQ ID NO: 1894854 - protein, 19 aa, Staphylococcus
ALLLLFLGFLINGDVNVLS

SEQ ID NO: 1894855 - protein, 23 aa, Staphylococcus
ALLLSGILYFHPHTMIAVILMGA

SEQ ID NO: 1894856 - protein, 23 aa, Staphylococcus
ALLPALFWGSLVLINVFVGGGPY

SEQ ID NO: 1894857 - protein, 20 aa, Staphylococcus
ALLPALFWGSVVIINVFVGG

SEQ ID NO: 1894858 - protein, 21 aa, Staphylococcus
ALLPALFWGSVVIINVFVGGG

SEQ ID NO: 1894859 - protein, 20 aa, Staphylococcus
ALLPALFWGSVVLINVFVGG

SEQ ID NO: 1894860 - protein, 25 aa, Staphylococcus
ALLPLLKLVLVVVFAMVFFVVVVLG

SEQ ID NO: 1894861 - protein, 34 aa, Staphylococcus
ALLSNLIMIIVYVVAAWIILRFVNKAIAQFFKIQ

SEQ ID NO: 1894862 - protein, 23 aa, Staphylococcus
ALLSSLFMILYGDGTHMLFEWGI

SEQ ID NO: 1894863 - protein, 23 aa, Staphylococcus
ALLSSLFMILYGDGTHMLFKWGI

SEQ ID NO: 1894864 - protein, 20 aa, Staphylococcus
ALLTFYFYRDNPDLQYAIMQ

SEQ ID NO: 1894865 - protein, 39 aa, Staphylococcus
ALLTISAIISSCLALLICSLFLTPLVKRIKVFNRKTKEF

SEQ ID NO: 1894866 - protein, 17 aa, Staphylococcus
ALLVWRKKWLYHPLVLL

SEQ ID NO: 1894867 - protein, 23 aa, Staphylococcus
ALMIFFCVFLIFSPIGKLKLGKP

SEQ ID NO: 1894868 - protein, 39 aa, Staphylococcus
ALMIPFLLMVLTAIAIVVVWFVFNQLIAGIASAVLLVMI

SEQ ID NO: 1894869 - protein, 26 aa, Staphylococcus
ALMLAFIFIFILFKFESKIKNPFIPI

SEQ ID NO: 1894870 - protein, 18 aa, Staphylococcus
ALMLILNHYVIKFVLNAL

SEQ ID NO: 1894871 - protein, 21 aa, Staphylococcus
ALNILIFIGWMILAQLPIIII

SEQ ID NO: 1894872 - protein, 25 aa, Staphylococcus
ALNMSRYLLILLLALSAAVMNMVPW

SEQ ID NO: 1894873 - protein, 17 aa, Staphylococcus
ALQLMRQSLPISTLYTG

SEQ ID NO: 1894874 - protein, 17 aa, Staphylococcus
ALRLLLGATLASIVSAS

SEQ ID NO: 1894875 - protein, 20 aa, Staphylococcus
ALRQSFNIPALKAWQQVSSN

SEQ ID NO: 1894876 - protein, 24 aa, Staphylococcus
ALSAVLLFFLLIPSLKLKSHSQIT

SEQ ID NO: 1894877 - protein, 27 aa, Staphylococcus
ALSFLIHPLLILFFSALAFIVPGATDA

SEQ ID NO: 1894878 - protein, 23 aa, Staphylococcus
ALSFLIHPLLILFFSCIGIYSTG

SEQ ID NO: 1894879 - protein, 21 aa, Staphylococcus
ALSLAGIPPFSGFYGKYFIVK

SEQ ID NO: 1894880 - protein, 24 aa, Staphylococcus
ALSQLLVILWQFIDSFTIVHTLQS

SEQ ID NO: 1894881 - protein, 25 aa, Staphylococcus
ALSSFIINAILIVVGWKFLSRTTAI

SEQ ID NO: 1894882 - protein, 31 aa, Staphylococcus
ALSTYDSWALAKHLKTFPIRFKQSVANAEKL

SEQ ID NO: 1894883 - protein, 20 aa, Staphylococcus
ALSVDIMKMLIIQTFCVLLG

SEQ ID NO: 1894884 - protein, 18 aa, Staphylococcus
ALTFLPTVIYVISSVLGY

SEQ ID NO: 1894885 - protein, 20 aa, Staphylococcus
ALTIFVFFVVTMALSLILRD

SEQ ID NO: 1894886 - protein, 18 aa, Staphylococcus
ALTLLPALISIFHKSIKI

SEQ ID NO: 1894887 - protein, 24 aa, Staphylococcus
ALTLVPALISIFHKAIRPKVERKS

SEQ ID NO: 1894888 - protein, 23 aa, Staphylococcus
ALTPIVWIVPFLSSLIFGVSYIF

SEQ ID NO: 1894889 - protein, 26 aa, Staphylococcus
ALTRNNFAVLKAFLSALWNSIKNTAI

SEQ ID NO: 1894890 - protein, 21 aa, Staphylococcus
ALTTTISFVISFIAVTYLHVV

SEQ ID NO: 1894891 - protein, 26 aa, Staphylococcus
ALTTYIYLTLVAFNFISGVLTLPGLA

SEQ ID NO: 1894892 - protein, 35 aa, Staphylococcus
ALTYARPLYYFGNIMKPLIWLMNGSARVIIRMLGV

SEQ ID NO: 1894893 - protein, 21 aa, Staphylococcus
ALTYVIMILYTGWLGTNNANF

SEQ ID NO: 1894894 - protein, 20 aa, Staphylococcus
ALVAAISVLVIACPCALGLA

SEQ ID NO: 1894895 - protein, 21 aa, Staphylococcus
ALVAAISVLVIACPCALGLAT

SEQ ID NO: 1894896 - protein, 26 aa, Staphylococcus
ALVASIVVLWIYFRKSIPKTFHTENL

SEQ ID NO: 1894897 - protein, 28 aa, Staphylococcus
ALVFFPHAHILIKLLFAMLLSIAGTFFF

SEQ ID NO: 1894898 - protein, 24 aa, Staphylococcus
ALVPLLKLLLVVVGAMIFFVVVVL

SEQ ID NO: 1894899 - protein, 19 aa, Staphylococcus
ALVQQLKKEFGLNGKANAD

SEQ ID NO: 1894900 - protein, 23 aa, Staphylococcus
ALVTLFVVVAFSFALFIKEPRNK

SEQ ID NO: 1894901 - protein, 19 aa, Staphylococcus
ALVVFYIFEKGRPTPFIDF

SEQ ID NO: 1894902 - protein, 20 aa, Staphylococcus
ALVVILLFIFLGYQLIAGAI

SEQ ID NO: 1894903 - protein, 28 aa, Staphylococcus
ALVVISLWIFYEAIMRMIFPKPIEDGIM

SEQ ID NO: 1894904 - protein, 20 aa, Staphylococcus
ALVVLLLPAWFIHQKIINHS

SEQ ID NO: 1894905 - protein, 21 aa, Staphylococcus
ALYIFAFTCLMLCGILVFIGT

SEQ ID NO: 1894906 - protein, 18 aa, Staphylococcus
ALYLITMINAVFAGIFLM

SEQ ID NO: 1894907 - protein, 17 aa, Staphylococcus
ALYLLFTSILDLPEEAK

SEQ ID NO: 1894908 - protein, 17 aa, Staphylococcus
ALYLPILFKIIKLQLNL

SEQ ID NO: 1894909 - protein, 22 aa, Staphylococcus
AMACFLPMIFLLSPVTDNLKRE

SEQ ID NO: 1894910 - protein, 51 aa, Staphylococcus
AMALVVFLVIFFVFNLPYYAYFLGSGIMLFIMVIYWFIALSEFKKQQRLTS

SEQ ID NO: 1894911 - protein, 19 aa, Staphylococcus
AMFFIVALVMIAFLVLSPL

SEQ ID NO: 1894912 - protein, 21 aa, Staphylococcus
AMFILQFLLNFFIPSGSGQAL

SEQ ID NO: 1894913 - protein, 28 aa, Staphylococcus
AMFVVLLIIVLLYLFKMGKHFMYIDINA

SEQ ID NO: 1894914 - protein, 25 aa, Staphylococcus
AMGYTFFHWGISQWSIFAISGLTVA

SEQ ID NO: 1894915 - protein, 26 aa, Staphylococcus
AMGYTFFHWGISQWSIFAMAGLIVAY

SEQ ID NO: 1894916 - protein, 18 aa, Staphylococcus
AMIILFTLVIVVIIDYVS

SEQ ID NO: 1894917 - protein, 24 aa, Staphylococcus
AMINVLILFVLCQFLPKLYLSKVS

SEQ ID NO: 1894918 - protein, 19 aa, Staphylococcus
AMISFWFNALMALSSFLVV

SEQ ID NO: 1894919 - protein, 25 aa, Staphylococcus
AMIVPVLMFAFFGIVLGFATLFKNP

SEQ ID NO: 1894920 - protein, 18 aa, Staphylococcus
AMIYPFVGYVGLAVVIII

SEQ ID NO: 1894921 - protein, 32 aa, Staphylococcus
AMKALIYAAIGIIIYVSLRFEWRMGLSAVLAL

SEQ ID NO: 1894922 - protein, 31 aa, Staphylococcus
AMKALIYAAIGIIIYVSLRFEWRMGLSSVLA

SEQ ID NO: 1894923 - protein, 17 aa, Staphylococcus
AMKPNILDQYYGAGNLY

SEQ ID NO: 1894924 - protein, 46 aa, Staphylococcus
AMLAAIIIVYLILVITFKGGLAPFTILFSLPFTIVGVVLSLVITGE

SEQ ID NO: 1894925 - protein, 46 aa, Staphylococcus
AMLAAIIIVYLILVITFKGGLAPFTILFSLPFTVVGVVLALVITGE

SEQ ID NO: 1894926 - protein, 46 aa, Staphylococcus
AMLAAIIIVYLILVITFKGGLAPFTILFSLPYTVIGVVLALLITGE

SEQ ID NO: 1894927 - protein, 18 aa, Staphylococcus
AMLAILMLALGLGPSTVV

SEQ ID NO: 1894928 - protein, 17 aa, Staphylococcus
AMLMLDNLGYDVIASTG

SEQ ID NO: 1894929 - protein, 18 aa, Staphylococcus
AMNVLDPRKNEAYNNIDQ

SEQ ID NO: 1894930 - protein, 19 aa, Staphylococcus
AMNWYFIAASVLVLLPAVY

SEQ ID NO: 1894931 - protein, 27 aa, Staphylococcus
AMPVILFSSLFLLIAFVPNVFGFKWDK

SEQ ID NO: 1894932 - protein, 21 aa, Staphylococcus
AMQFAFFHWGVHAWAVYGIVA

SEQ ID NO: 1894933 - protein, 20 aa, Staphylococcus
AMQIMVYWFVFGLGIRSNNP

SEQ ID NO: 1894934 - protein, 21 aa, Staphylococcus
AMRFSIGLLILVCIWTFICSL

SEQ ID NO: 1894935 - protein, 22 aa, Staphylococcus
AMRSKYYLFITDPVVLGIDGLD

SEQ ID NO: 1894936 - protein, 18 aa, Staphylococcus
AMSLLFGAFLYFIVKDGY

SEQ ID NO: 1894937 - protein, 28 aa, Staphylococcus
AMSSRIAMLSIIDILYICIASNDYLSNR

SEQ ID NO: 1894938 - protein, 24 aa, Staphylococcus
AMTGLFIFIVLWVGRKVGIQSILS

SEQ ID NO: 1894939 - protein, 32 aa, Staphylococcus
AMTYAFYPEAPFLLLMISGFLGALLGGFIVLM

SEQ ID NO: 1894940 - protein, 19 aa, Staphylococcus
AMVCLSLLLVAYLMLKRLN

SEQ ID NO: 1894941 - protein, 27 aa, Staphylococcus
ANAKLVGMPLAALFLTGTGGVSAIGIT

SEQ ID NO: 1894942 - protein, 24 aa, Staphylococcus
ANALLIVILIIFLYCLIQTVLYRF

SEQ ID NO: 1894943 - protein, 28 aa, Staphylococcus
ANFLDYYFLNYQFSLLILSALLLTFINT

SEQ ID NO: 1894944 - protein, 27 aa, Staphylococcus
ANFYYIFFEKIGFLFVLLLGCILVYVG

SEQ ID NO: 1894945 - protein, 31 aa, Staphylococcus; identical to SEQ ID NO: 1749771

SEQ ID NO: 1894946 - protein, 32 aa, Staphylococcus
ANFYYIFFEKIGYLFILLLGCILIYVGYLYFH

SEQ ID NO: 1894947 - protein, 25 aa, Staphylococcus
ANFYYIFFEKIGYLFVLLLGCILVY

SEQ ID NO: 1894948 - protein, 30 aa, Staphylococcus
ANGPLFILVLLIIFFFLGFIIPSSSGLAVL

SEQ ID NO: 1894949 - protein, 18 aa, Staphylococcus
ANIFVPLIPAFVGAGLIG

SEQ ID NO: 1894950 - protein, 22 aa, Staphylococcus
ANLLTFIAWLISGISILRYNKT

SEQ ID NO: 1894951 - protein, 23 aa, Staphylococcus
ANNFSMWRLFGISIIAIIGMLIW

SEQ ID NO: 1894952 - protein, 18 aa, Staphylococcus
ANRNFRFFQMFTAALQSF

SEQ ID NO: 1894953 - protein, 23 aa, Staphylococcus
ANRNFRFFQVFTAALQSFSHGTN

SEQ ID NO: 1894954 - protein, 24 aa, Staphylococcus
ANTKRPIEILTSPNTDVALLDKDG

SEQ ID NO: 1894955 - protein, 22 aa, Staphylococcus
ANVVYFRFFSDFLTFSTLNQAG

SEQ ID NO: 1894956 - protein, 27 aa, Staphylococcus
ANWQTYIMIAAYFIILLVIGFYGYKQA

SEQ ID NO: 1894957 - protein, 31 aa, Staphylococcus
ANWQTYIMIAIYFIILLIIGFYGYKQATGNL

SEQ ID NO: 1894958 - protein, 24 aa, Staphylococcus
ANWQTYIMIGVYFLILVIIGIYGY

SEQ ID NO: 1894959 - protein, 21 aa, Staphylococcus
ANYIKPFGDIFLNLIKMIIIP

SEQ ID NO: 1894960 - protein, 23 aa, Staphylococcus
ANYTPIFELIGKPFVPFLQLLQI

SEQ ID NO: 1894961 - protein, 34 aa, Staphylococcus; identical to SEQ ID NO: 1592202

SEQ ID NO: 1894962 - protein, 29 aa, Staphylococcus
APEEAKEFYKVAGALLINIGTMTKANEQD

SEQ ID NO: 1894963 - protein, 18 aa, Staphylococcus
APFAFLVGVPWNDAVQAG

SEQ ID NO: 1894964 - protein, 23 aa, Staphylococcus
APFLMFMPVWMGSLVASVLLFFA

SEQ ID NO: 1894965 - protein, 23 aa, Staphylococcus
APHLAILLICRFIMGFAIGMDSP

SEQ ID NO: 1894966 - protein, 21 aa, Staphylococcus
APIFPLLLFTITCGALSGFHA

SEQ ID NO: 1894967 - protein, 24 aa, Staphylococcus
APIHGIPFVFWLLVGISMWFFINQ

SEQ ID NO: 1894968 - protein, 27 aa, Staphylococcus
APIILNPVFMIPFIITPILNSWVLKFF

SEQ ID NO: 1894969 - protein, 25 aa, Staphylococcus
APIILSLILFYLINPIINLMERYNI

SEQ ID NO: 1894970 - protein, 25 aa, Staphylococcus
APIILSLILYYLLNPVINLMERYNI

SEQ ID NO: 1894971 - protein, 23 aa, Staphylococcus
APILTVIGLIFLLVSIRVEKKEG

SEQ ID NO: 1894972 - protein, 18 aa, Staphylococcus
APIMKFIMHILSVAVEAL

SEQ ID NO: 1894973 - protein, 18 aa, Staphylococcus
APIMKFIMHILSVAVEFL

SEQ ID NO: 1894974 - protein, 18 aa, Staphylococcus
APIMKFIMHILSVGVEAL

SEQ ID NO: 1894975 - protein, 23 aa, Staphylococcus
APKLFIVSLYWHFLDVVWVFIFT

SEQ ID NO: 1894976 - protein, 17 aa, Staphylococcus
APLAPMFQQVWSQIVAI

SEQ ID NO: 1894977 - protein, 25 aa, Staphylococcus
APLLFLIITILIFLLFQVNLNNKTL

SEQ ID NO: 1894978 - protein, 18 aa, Staphylococcus
APLLILTLMYFIFNGNDD

SEQ ID NO: 1894979 - protein, 28 aa, Staphylococcus
APLNMMIISLFFITAIVLSAFFYVMTIQ

SEQ ID NO: 1894980 - protein, 37 aa, Staphylococcus
APLVLNPVFFIPFILAPIVNVWIFKFFVDVLNMNSFS

SEQ ID NO: 1894981 - protein, 19 aa, Staphylococcus
APMIILFVIYIVHKFIKKT

SEQ ID NO: 1894982 - protein, 21 aa, Staphylococcus
APRGEFLHMLLGVVLATLVSF

SEQ ID NO: 1894983 - protein, 27 aa, Staphylococcus
APTQSVTVFMYKDAINNKISEIETELA

SEQ ID NO: 1894984 - protein, 18 aa, Staphylococcus
APVLFVIHALLTGLSLFI

SEQ ID NO: 1894985 - protein, 22 aa, Staphylococcus
APYTIVFYFSFFSIVVLIPFTI

SEQ ID NO: 1894986 - protein, 23 aa, Staphylococcus
AQAGSPIAYAYNLDDLYITANID

SEQ ID NO: 1894987 - protein, 24 aa, Staphylococcus
AQEIPLFIILISIVGPILEEFVFR

SEQ ID NO: 1894988 - protein, 22 aa, Staphylococcus
AQFAFPIFLPLYLESYGIPTSK

SEQ ID NO: 1894989 - protein, 20 aa, Staphylococcus
AQFPFHVWLPKAMAAPTPVS

SEQ ID NO: 1894990 - protein, 18 aa, Staphylococcus
AQGLALIIGIDRLLDMVR

SEQ ID NO: 1894991 - protein, 18 aa, Staphylococcus
AQHALDLLGLATLSLLDT

SEQ ID NO: 1894992 - protein, 23 aa, Staphylococcus
AQIELTILFSLFAIISNFTGIEI

SEQ ID NO: 1894993 - protein, 18 aa, Staphylococcus
AQKDAAIAEVNKLKQQAI

SEQ ID NO: 1894994 - protein, 31 aa, Staphylococcus
AQKQSIVKAIKNAPLRTEVKQLLQQAKDLDN

SEQ ID NO: 1894995 - protein, 17 aa, Staphylococcus
AQLILSIARVCRKELII

SEQ ID NO: 1894996 - protein, 25 aa, Staphylococcus
AQLIYIVFIVFFILKNRQNKQKNTN

SEQ ID NO: 1894997 - protein, 17 aa, Staphylococcus
AQLLLSIARSCQSNIII

SEQ ID NO: 1894998 - protein, 18 aa, Staphylococcus
AQLRHEYYSLKNRLNDIA

SEQ ID NO: 1894999 - protein, 36 aa, Staphylococcus
AQLSYYFMLSLFPMLLFLMSLLPLFKIDRDKIVNMI

SEQ ID NO: 1895000 - protein, 22 aa, Staphylococcus
AQNALHGARLLDNAKNNAISEI

SEQ ID NO: 1895001 - protein, 22 aa, Staphylococcus
AQNSAIVTRLDLLELRMTHLEE

SEQ ID NO: 1895002 - protein, 17 aa, Staphylococcus
AQNYYERLGKPLKLNNS

SEQ ID NO: 1895003 - protein, 20 aa, Staphylococcus
AQPHKRQDAINSLIAQAESN

SEQ ID NO: 1895004 - protein, 27 aa, Staphylococcus
AQRDHIIAQAHLLGEKHKAERRLNNVV

SEQ ID NO: 1895005 - protein, 24 aa, Staphylococcus
AQRSWLFVPYLILVFLGGMLHNQL

SEQ ID NO: 1895006 - protein, 25 aa, Staphylococcus
AQSHLFIPIIILLLLGAFTKSAQFP

SEQ ID NO: 1895007 - protein, 23 aa, Staphylococcus
AQSLIFYTIINWLPELLTDHGIS

SEQ ID NO: 1895008 - protein, 23 aa, Staphylococcus
AQVFPFIIFVITISFIAPYLEEL

SEQ ID NO: 1895009 - protein, 25 aa, Staphylococcus
AQVNPHFFFNAINTISALIRIDSEK

SEQ ID NO: 1895010 - protein, 19 aa, Staphylococcus
AQVPGYIICQMLGGIFGGV

SEQ ID NO: 1895011 - protein, 24 aa, Staphylococcus
ARGITFGLFRLSVGLENPDELIAD

SEQ ID NO: 1895012 - protein, 24 aa, Staphylococcus
ARIFDIILTLFLFSLAMIMTAGGA

SEQ ID NO: 1895013 - protein, 17 aa, Staphylococcus
ARIFLNNPPIIILDEAT

SEQ ID NO: 1895014 - protein, 18 aa, Staphylococcus
ARIFLNNPPIIILDEATS

SEQ ID NO: 1895015 - protein, 18 aa, Staphylococcus
ARIFLNNPPILILDEATS

SEQ ID NO: 1895016 - protein, 17 aa, Staphylococcus
ARMKHLIIPLLSQNIRK

SEQ ID NO: 1895017 - protein, 26 aa, Staphylococcus
ARMVQLFFVFVLIILLVVPETRMGVV

SEQ ID NO: 1895018 - protein, 27 aa, Staphylococcus
ARNKWDVLLYIIVAIALLLMIVMPYAS

SEQ ID NO: 1895019 - protein, 22 aa, Staphylococcus
ARSFIIGWVALLLAVVVFFIGT

SEQ ID NO: 1895020 - protein, 17 aa, Staphylococcus
ARTIALALAWINQILAM

SEQ ID NO: 1895021 - protein, 25 aa, Staphylococcus
ARTSRWYYIILLALTFVLSFTTLKL

SEQ ID NO: 1895022 - protein, 24 aa, Staphylococcus
ASALLLSWLIVMFAILVAAYRRAK

SEQ ID NO: 1895023 - protein, 25 aa, Staphylococcus
ASATLFSISFLNKNISRLASLTTIG

SEQ ID NO: 1895024 - protein, 19 aa, Staphylococcus
ASCLPFLLWGAMGWATQAP

SEQ ID NO: 1895025 - protein, 17 aa, Staphylococcus
ASDILYWGIIEWAFYYQ

SEQ ID NO: 1895026 - protein, 24 aa, Staphylococcus
ASDLKIYRFLRRSIKNIIIVGAII

SEQ ID NO: 1895027 - protein, 26 aa, Staphylococcus
ASENKIFFRLILPLSKRSILSGIMMA

SEQ ID NO: 1895028 - protein, 23 aa, Staphylococcus
ASFAVLTYWLFAQSFINIGSSVQ

SEQ ID NO: 1895029 - protein, 30 aa, Staphylococcus
ASFIGIAVIYLFMVGFYRLPGFVAIIALTT

SEQ ID NO: 1895030 - protein, 31 aa, Staphylococcus
ASFIGVGIIYLFMLGFYRLPGLVAIIALTTY

SEQ ID NO: 1895031 - protein, 22 aa, Staphylococcus
ASFLCTNIIYHNYLKENNDAKI

SEQ ID NO: 1895032 - protein, 27 aa, Staphylococcus
ASFLVTFILMVLMFRAFGKQGLIVWIA

SEQ ID NO: 1895033 - protein, 23 aa, Staphylococcus
ASFSPLVLFSLYWKKLTRAGAIS

SEQ ID NO: 1895034 - protein, 27 aa, Staphylococcus
ASGELLPVIFFSVFFGLALAAIGQKAQ

SEQ ID NO: 1895035 - protein, 40 aa, Staphylococcus
ASGLLIIAIVYIIVPLISALFFHYLFVKVLKIYNPNIFKY

SEQ ID NO: 1895036 - protein, 26 aa, Staphylococcus
ASIGTYFWSAWSFFIALMIIIVMMSH

SEQ ID NO: 1895037 - protein, 29 aa, Staphylococcus
ASIGTYFWSVWSFGIAAVLILIRILHAWV

SEQ ID NO: 1895038 - protein, 22 aa, Staphylococcus
ASIIGLIVWFFAGLTSKGSVNT

SEQ ID NO: 1895039 - protein, 25 aa, Staphylococcus
ASILFIIIIIFLMYANHLFVKRRTK

SEQ ID NO: 1895040 - protein, 25 aa, Staphylococcus
ASISYLLIIGFIALISFIIFEFKST

SEQ ID NO: 1895041 - protein, 24 aa, Staphylococcus
ASKTKLIFRHILPNTLGAIVVTSM

SEQ ID NO: 1895042 - protein, 26 aa, Staphylococcus
ASKTRLFIYVQFTALLIAISSSLVAL

SEQ ID NO: 1895043 - protein, 29 aa, Staphylococcus
ASKYRKDFCKYFLKKIKPTVIKGNASEIL

SEQ ID NO: 1895044 - protein, 26 aa, Staphylococcus
ASLIALIVFFIWYPLTDKRHKQIVKE

SEQ ID NO: 1895045 - protein, 28 aa, Staphylococcus
ASLILLSWILLIFILLILAYRRSKVMKR

SEQ ID NO: 1895046 - protein, 17 aa, Staphylococcus
ASLIYILSFFTSIIGPL

SEQ ID NO: 1895047 - protein, 18 aa, Staphylococcus
ASLSLVAPLLTLIGLVFL

SEQ ID NO: 1895048 - protein, 17 aa, Staphylococcus
ASLVIMAMLIWSIGIQS

SEQ ID NO: 1895049 - protein, 20 aa, Staphylococcus
ASMTKLMTMYLTLEAVKAHK

SEQ ID NO: 1895050 - protein, 19 aa, Staphylococcus
ASMTKLMTMYLTLEAVKDK

SEQ ID NO: 1895051 - protein, 19 aa, Staphylococcus
ASMTKLMTMYLTLEAVNKG

SEQ ID NO: 1895052 - protein, 21 aa, Staphylococcus
ASMTKLMTMYLTLEAVNKGEL

SEQ ID NO: 1895053 - protein, 20 aa, Staphylococcus
ASMTLLCTFLLATLSMCVAA

SEQ ID NO: 1895054 - protein, 30 aa, Staphylococcus
ASMVGVAIIYLFMVGFYRLPGIVAVIALTV

SEQ ID NO: 1895055 - protein, 19 aa, Staphylococcus
ASNFSVLSLLLIAIILVLD

SEQ ID NO: 1895056 - protein, 23 aa, Staphylococcus
ASQYQRQLAINRIRQIELDTMDA

SEQ ID NO: 1895057 - protein, 18 aa, Staphylococcus
ASSFSFLFVSILGIYRGY

SEQ ID NO: 1895058 - protein, 18 aa, Staphylococcus
ASSKMKLELLPDVEPPMI

SEQ ID NO: 1895059 - protein, 30 aa, Staphylococcus
ASSQKFLIIYSIVFMLVIVAVVLTMFAVFI

SEQ ID NO: 1895060 - protein, 24 aa, Staphylococcus
ASSTARYYGDENFAFLNGEKPEQG

SEQ ID NO: 1895061 - protein, 21 aa, Staphylococcus
ASTAFIFLPALIGWSSMRVFG

SEQ ID NO: 1895062 - protein, 24 aa, Staphylococcus
ASTDKQDAFNLALTNASHITDTQT

SEQ ID NO: 1895063 - protein, 24 aa, Staphylococcus
ASTIGWQWIFIVSIALSILAFFLI

SEQ ID NO: 1895064 - protein, 25 aa, Staphylococcus
ASTLLLLIVAWFVTVKIVIPRFGHY

SEQ ID NO: 1895065 - protein, 32 aa, Staphylococcus
ASTSDSLSVSDSMRNVYSISNSESVSASTSLN

SEQ ID NO: 1895066 - protein, 30 aa, Staphylococcus
ASVIVILAFILLMIVFRSILVPLKAVLGFV

SEQ ID NO: 1895067 - protein, 22 aa, Staphylococcus
ASVLDEFYWLNKEDPNYSRCRV

SEQ ID NO: 1895068 - protein, 29 aa, Staphylococcus
ASVLDLLIVWYVLYLLITVFKGTKAIQLL

SEQ ID NO: 1895069 - protein, 40 aa, Staphylococcus
ASVVTLPLVLLFVTLIIPIFFFIIAIMMFARKNKVEIVPA

SEQ ID NO: 1895070 - protein, 20 aa, Staphylococcus
ASWQFMMFILLGGIAYTIGA

SEQ ID NO: 1895071 - protein, 32 aa, Staphylococcus
ASWQTYIMIIIYFTILLFIGYYGYKQATGNLS

SEQ ID NO: 1895072 - protein, 26 aa, Staphylococcus
ASYKKLPWMMALAAFIIGIPMFFEVG

SEQ ID NO: 1895073 - protein, 24 aa, Staphylococcus
ATALWTILALWVATSLNFGGASIT

SEQ ID NO: 1895074 - protein, 22 aa, Staphylococcus
ATEFPRIQLFMKSYTGMNNWET

SEQ ID NO: 1895075 - protein, 26 aa, Staphylococcus
ATFISWQSIFVLSILLSLVALLLVKN

SEQ ID NO: 1895076 - protein, 24 aa, Staphylococcus
ATFLPLVMFGLHQVLTPIHIEMIN

SEQ ID NO: 1895077 - protein, 24 aa, Staphylococcus
ATFLVTFILMVAMYRMFGKQGLLA

SEQ ID NO: 1895078 - protein, 18 aa, Staphylococcus
ATFTFHGYKFEKGQKYHM

SEQ ID NO: 1895079 - protein, 35 aa, Staphylococcus; identical to SEQ ID NO: 1750466

SEQ ID NO: 1895080 - protein, 25 aa, Staphylococcus
ATGIACGFIFYPITMLISKRHKEVH

SEQ ID NO: 1895081 - protein, 25 aa, Staphylococcus
ATGIACGFIFYPITMLMSKRQKEVH

SEQ ID NO: 1895082 - protein, 29 aa, Staphylococcus
ATGILIFFAFIFIVLLISNTTRWAVLLSP

SEQ ID NO: 1895083 - protein, 21 aa, Staphylococcus
ATGILLFSLTFFNTSIYVVVA

SEQ ID NO: 1895084 - protein, 25 aa, Staphylococcus
ATIGALIPLLFGQDSSILISKGLAA

SEQ ID NO: 1895085 - protein, 25 aa, Staphylococcus
ATIGALLPLLFGQNSSILISKGMAA

SEQ ID NO: 1895086 - protein, 21 aa, Staphylococcus
ATIIFITMMLLLNLFLSVTGV

SEQ ID NO: 1895087 - protein, 25 aa, Staphylococcus
ATIIFNVFGIFKFGWGFNEMSANFL

SEQ ID NO: 1895088 - protein, 17 aa, Staphylococcus
ATIQLLILGFLLHYIFK

SEQ ID NO: 1895089 - protein, 20 aa, Staphylococcus
ATITRFSNKLGYANFQDMKF

SEQ ID NO: 1895090 - protein, 25 aa, Staphylococcus
ATKSLPFIIIGVLILGFFLSTYEAT

SEQ ID NO: 1895091 - protein, 23 aa, Staphylococcus
ATKTFIFWMLVAAIIGFVFPSQL

SEQ ID NO: 1895092 - protein, 24 aa, Staphylococcus
ATKTFLLWMFIAAIIGFIFPTQLA

SEQ ID NO: 1895093 - protein, 24 aa, Staphylococcus
ATLFDIILTLFLLALAMIMTAGGV

SEQ ID NO: 1895094 - protein, 17 aa, Staphylococcus
ATLIIYFPFIKDWISKG

SEQ ID NO: 1895095 - protein, 29 aa, Staphylococcus
ATNRPDILDPALLRPGRFDRQIQVGRPDV

SEQ ID NO: 1895096 - protein, 24 aa, Staphylococcus
ATNTFLVWMLIAAIIGFIFPAQLA

SEQ ID NO: 1895097 - protein, 23 aa, Staphylococcus
ATPFIILFLTIVGAYLFFRSSVS

SEQ ID NO: 1895098 - protein, 17 aa, Staphylococcus
ATQLINLFHLKAGWIVP

SEQ ID NO: 1895099 - protein, 22 aa, Staphylococcus
ATSGLLYLLSFGNKKMTRIASL

SEQ ID NO: 1895100 - protein, 23 aa, Staphylococcus
ATTAFFLVLAFRTYKELGTDNVE

SEQ ID NO: 1895101 - protein, 35 aa, Staphylococcus
ATTLAIPVALNEIFIRIFWSIKEIFYHKRSVKDIL

SEQ ID NO: 1895102 - protein, 20 aa, Staphylococcus
ATTPFVLFFMLKDSHHFKEY

SEQ ID NO: 1895103 - protein, 26 aa, Staphylococcus
ATTTQTKYTVTSPSTSTSLINATLEV

SEQ ID NO: 1895104 - protein, 19 aa, Staphylococcus
ATTWFLLANGIMVPLSAYL

SEQ ID NO: 1895105 - protein, 20 aa, Staphylococcus
ATVLLLVFMLITIRGAHVSG

SEQ ID NO: 1895106 - protein, 31 aa, Staphylococcus
ATVLSYPVYLFIFGMIVLILYGTFKVATGQA

SEQ ID NO: 1895107 - protein, 29 aa, Staphylococcus
ATVLSYPVYLFIIGLIVLIIVGTYRVAIG

SEQ ID NO: 1895108 - protein, 26 aa, Staphylococcus
ATVLSYPVYLFIIGLVALIVVGTWRV

SEQ ID NO: 1895109 - protein, 28 aa, Staphylococcus
ATVLSYPVYLFILGLIVMIVIGTWKVAT

SEQ ID NO: 1895110 - protein, 27 aa, Staphylococcus
ATVLSYPVYLFIVGLIVMIIIGTFKVA

SEQ ID NO: 1895111 - protein, 23 aa, Staphylococcus
ATVVFFLVFFYALDLGIGRIIEL

SEQ ID NO: 1895112 - protein, 20 aa, Staphylococcus
ATVYGIRMIGIALGLMPVMT

SEQ ID NO: 1895113 - protein, 22 aa, Staphylococcus
ATWNYLGYLVGAVIPIFYIYKT

SEQ ID NO: 1895114 - protein, 20 aa, Staphylococcus
ATYLPQAFLSYAIGGVFHIK

SEQ ID NO: 1895115 - protein, 22 aa, Staphylococcus
ATYSLLDFGFKTPASPGSIIVY

SEQ ID NO: 1895116 - protein, 23 aa, Staphylococcus
ATYTPFFEIIGKPFVPLLELLQI

SEQ ID NO: 1895117 - protein, 26 aa, Staphylococcus
AVAFIVLLITFGSFVAAGLPIISAVI

SEQ ID NO: 1895118 - protein, 19 aa, Staphylococcus
AVAFSFALVLILFTNSELL

SEQ ID NO: 1895119 - protein, 23 aa, Staphylococcus
AVAFTQIIIFVAAGLICFFVFDI

SEQ ID NO: 1895120 - protein, 27 aa, Staphylococcus
AVAFVLTFIKFPLPFLPPYLTLDFSDV

SEQ ID NO: 1895121 - protein, 25 aa, Staphylococcus
AVAFYPVLVPIFIALGYDSIVCVGA

SEQ ID NO: 1895122 - protein, 24 aa, Staphylococcus
AVAFYPVLVPIFIALGYDSIVSVG

SEQ ID NO: 1895123 - protein, 27 aa, Staphylococcus
AVAILYILISLIIRTILYFFTKRNLDE

SEQ ID NO: 1895124 - protein, 23 aa, Staphylococcus
AVAKYVEFWYPAIPNWLTVAFTI

SEQ ID NO: 1895125 - protein, 24 aa, Staphylococcus
AVAKYVGYWYPTVPNWLTAAFTIL

SEQ ID NO: 1895126 - protein, 24 aa, Staphylococcus
AVAKYVQFWYPQIPNWITAAFTIL

SEQ ID NO: 1895127 - protein, 23 aa, Staphylococcus
AVAKYVSFWFPAIPNWISALFCV

SEQ ID NO: 1895128 - protein, 24 aa, Staphylococcus
AVAKYVSFWFPNIPNWMSALFCVL

SEQ ID NO: 1895129 - protein, 23 aa, Staphylococcus
AVAKYVSFWFPTIPNWITALFCV

SEQ ID NO: 1895130 - protein, 23 aa, Staphylococcus
AVAKYVSFWWPQIPNWVSALFCV

SEQ ID NO: 1895131 - protein, 23 aa, Staphylococcus
AVAKYVSFWYLDIPNWLTALACV

SEQ ID NO: 1895132 - protein, 18 aa, Staphylococcus
AVALIVVALIAAVGIVLS

SEQ ID NO: 1895133 - protein, 27 aa, Staphylococcus
AVASFLIIWLAQRYIRFMPAPLIAIII

SEQ ID NO: 1895134 - protein, 30 aa, Staphylococcus
AVASVFLIIYRLIFKFKSIYFKTMSGGLLI

SEQ ID NO: 1895135 - protein, 31 aa, Staphylococcus
AVEDQRGIFSGWNYGIGIQVDPNHPEGANRA

SEQ ID NO: 1895136 - protein, 50 aa, Staphylococcus
AVEGLKPTLIYPLLSVTITGLLMIYAFNPPAAWLNNLLLNGLNSLSGSNI

SEQ ID NO: 1895137 - protein, 20 aa, Staphylococcus
AVEILFATIGLIIGLLIAVM

SEQ ID NO: 1895138 - protein, 20 aa, Staphylococcus
AVEILFATIGLIIGLLISVM

SEQ ID NO: 1895139 - protein, 20 aa, Staphylococcus
AVEILFATLGLIIGLFISVM

SEQ ID NO: 1895140 - protein, 26 aa, Staphylococcus
AVESPVLFVTIAVFCSLVFNSIIYTC

SEQ ID NO: 1895141 - protein, 29 aa, Staphylococcus
AVETMLFTVIPFMGFVALLIGIIQGSGIG

SEQ ID NO: 1895142 - protein, 25 aa, Staphylococcus
AVFLTLLGFILYGLSRLLIFWHLGY

SEQ ID NO: 1895143 - protein, 21 aa, Staphylococcus
AVFQIFLFDKFMKYFKELTFI

SEQ ID NO: 1895144 - protein, 28 aa, Staphylococcus
AVFTTDLYFFLFLRLIQGLTAGGSIVIA

SEQ ID NO: 1895145 - protein, 18 aa, Staphylococcus
AVFYIFGAIGFIIAILWM

SEQ ID NO: 1895146 - protein, 27 aa, Staphylococcus
AVGFAILLRYLPLKKHYPYFILGFIIT

SEQ ID NO: 1895147 - protein, 29 aa, Staphylococcus
AVGFIAGLILAVILICILELIRNSKKNKA

SEQ ID NO: 1895148 - protein, 26 aa, Staphylococcus
AVGFTLFIFTLIMNLISYWISKRFRE

SEQ ID NO: 1895149 - protein, 33 aa, Staphylococcus
AVGKITYTQWLKFAWKIILTWVLICCIGMSIAL

SEQ ID NO: 1895150 - protein, 24 aa, Staphylococcus
AVIAMVSIYILSLKMDAYDTKGKI

SEQ ID NO: 1895151 - protein, 27 aa, Staphylococcus
AVIFAIIYNLWWFPYEFAKVAGLHLEQ

SEQ ID NO: 1895152 - protein, 17 aa, Staphylococcus
AVIFITIQVILLNGLAS

SEQ ID NO: 1895153 - protein, 25 aa, Staphylococcus
AVIFVGFILFTLFIFGLSLVNNIIV

SEQ ID NO: 1895154 - protein, 17 aa, Staphylococcus
AVIGLIIVPFLKMYHSE

SEQ ID NO: 1895155 - protein, 26 aa, Staphylococcus
AVIGMIGLILIIILALVGPLISKHDF

SEQ ID NO: 1895156 - protein, 24 aa, Staphylococcus
AVIIFFMVMMFGFSLFLAGHYTPG

SEQ ID NO: 1895157 - protein, 19 aa, Staphylococcus
AVIIVGLISGAFWALGQGY

SEQ ID NO: 1895158 - protein, 25 aa, Staphylococcus
AVILGLLIPIIFFIPNLFTQHIVIP

SEQ ID NO: 1895159 - protein, 17 aa, Staphylococcus
AVILWFFVAPDKPLLKD

SEQ ID NO: 1895160 - protein, 17 aa, Staphylococcus
AVIPIVLLFLGVFDRFG

SEQ ID NO: 1895161 - protein, 18 aa, Staphylococcus
AVIPLFTFDLKGPYWMYV

SEQ ID NO: 1895162 - protein, 22 aa, Staphylococcus
AVISYFKLWKYLYREWFTSIDH

SEQ ID NO: 1895163 - protein, 20 aa, Staphylococcus
AVITYFKLWKYLYTEWFTSV

SEQ ID NO: 1895164 - protein, 26 aa, Staphylococcus
AVIVPFIFLVLLRMSALKGMIISAFI

SEQ ID NO: 1895165 - protein, 25 aa, Staphylococcus
AVIYYVVFRFLIVKFNFKTPGREDK

SEQ ID NO: 1895166 - protein, 18 aa, Staphylococcus
AVKHYYIDQDKNTVIILA

SEQ ID NO: 1895167 - protein, 25 aa, Staphylococcus
AVKQVFWRILLFYVLSIGVIAAIIP

SEQ ID NO: 1895168 - protein, 21 aa, Staphylococcus
AVKYKDQLNFPILSTNTYKDN

SEQ ID NO: 1895169 - protein, 22 aa, Staphylococcus
AVLFFMMCVLLAVMTWVISWFN

SEQ ID NO: 1895170 - protein, 24 aa, Staphylococcus
AVLLIALILMFANSFSFGGALFML

SEQ ID NO: 1895171 - protein, 25 aa, Staphylococcus
AVLLQYVFSVRLQWFPVAGWEGIST

SEQ ID NO: 1895172 - protein, 27 aa, Staphylococcus
AVLLQYVFSVRLRWFPVAGWEGISTAI

SEQ ID NO: 1895173 - protein, 17 aa, Staphylococcus
AVLLSRKESRDKLKDQY

SEQ ID NO: 1895174 - protein, 19 aa, Staphylococcus
AVLTYWMFAQSFINIGASV

SEQ ID NO: 1895175 - protein, 23 aa, Staphylococcus
AVLYLLFCWTGIPGVIGIYEGII

SEQ ID NO: 1895176 - protein, 18 aa, Staphylococcus
AVMFLLTYITIVILGTIS

SEQ ID NO: 1895177 - protein, 21 aa, Staphylococcus
AVMIFVAMFVLFIACLVMCLH

SEQ ID NO: 1895178 - protein, 30 aa, Staphylococcus
AVNDSNISGPLPPILEPQLSGTNIVSGETS

SEQ ID NO: 1895179 - protein, 20 aa, Staphylococcus
AVPIILFLLCLTVFKMKGIY

SEQ ID NO: 1895180 - protein, 17 aa, Staphylococcus
AVPIRILIFYVGALAVI

SEQ ID NO: 1895181 - protein, 26 aa, Staphylococcus
AVSYGMLFLNFLMVLIALVAIVLKLP

SEQ ID NO: 1895182 - protein, 23 aa, Staphylococcus
AVTAFFLVLTFRSYKELGTDNVE

SEQ ID NO: 1895183 - protein, 26 aa, Staphylococcus
AVTAWFKYWPLFAAIIILTLPELITL

SEQ ID NO: 1895184 - protein, 24 aa, Staphylococcus
AVTFLLCIPALLPLYKALNMSRYL

SEQ ID NO: 1895185 - protein, 18 aa, Staphylococcus
AVTFLLSIPALLPLYKAL

SEQ ID NO: 1895186 - protein, 23 aa, Staphylococcus
AVTFLLSIPALLPLYKALNMNKY

SEQ ID NO: 1895187 - protein, 24 aa, Staphylococcus
AVTKYINFWWPNFPPYLTAIITVF

SEQ ID NO: 1895188 - protein, 25 aa, Staphylococcus
AVTMVAIIWLLFGDLFVNVIGFSIG

SEQ ID NO: 1895189 - protein, 25 aa, Staphylococcus
AVVIFFMVIVFGFSLFLAGHYTPGG

SEQ ID NO: 1895190 - protein, 22 aa, Staphylococcus
AVVLLAWIFLPKYLRYGVDTIS

SEQ ID NO: 1895191 - protein, 25 aa, Staphylococcus
AVVLTMFAIFIFKYSYNKNSETGKM

SEQ ID NO: 1895192 - protein, 21 aa, Staphylococcus
AVVNLLLGFVPFFTSSILIMF

SEQ ID NO: 1895193 - protein, 23 aa, Staphylococcus
AVVVIIWIVWIKPLATINEIFGI

SEQ ID NO: 1895194 - protein, 20 aa, Staphylococcus
AVWRMVFVILTLFGVLMVLG

SEQ ID NO: 1895195 - protein, 23 aa, Staphylococcus
AWALIPLIIFVGMFLGVGIITGD

SEQ ID NO: 1895196 - protein, 27 aa, Staphylococcus
AWALLPLLLFIALFLGVGTITGDFTNM

SEQ ID NO: 1895197 - protein, 28 aa, Staphylococcus
AWALLPLLLFVLLFLGVGIISGDFTTMP

SEQ ID NO: 1895198 - protein, 25 aa, Staphylococcus
AWALLPLVLFIALFLGIGIATGDFS

SEQ ID NO: 1895199 - protein, 17 aa, Staphylococcus
AWIANGLSIIYLLLTCL

SEQ ID NO: 1895200 - protein, 33 aa, Staphylococcus
AWIFDLIRVILPFIIILLLFITLYSVAPNVKTK

SEQ ID NO: 1895201 - protein, 31 aa, Staphylococcus
AWIIVACLTLFIIFFGFTWGPVLWVMLPELF

SEQ ID NO: 1895202 - protein, 18 aa, Staphylococcus
AWIVLVISVILTLPLGAA

SEQ ID NO: 1895203 - protein, 28 aa, Staphylococcus
AWPSEWLIVLVWYLIAGVLYLTQKRKTT

SEQ ID NO: 1895204 - protein, 21 aa, Staphylococcus
AWRDLWLLPIALVGIFAFSGL

SEQ ID NO: 1895205 - protein, 25 aa, Staphylococcus
AWSLVKFIALPMILINSIGTALFLS

SEQ ID NO: 1895206 - protein, 17 aa, Staphylococcus
AWSLWRTRPVTLQSYRP

SEQ ID NO: 1895207 - protein, 18 aa, Staphylococcus
AWTLVKLIAIPMISINSI

SEQ ID NO: 1895208 - protein, 18 aa, Staphylococcus
AWTMSYFVFIRPMKKAQS

SEQ ID NO: 1895209 - protein, 23 aa, Staphylococcus
AYAGGFIFTYFFGTTKAMRESDT

SEQ ID NO: 1895210 - protein, 26 aa, Staphylococcus
AYALLRKWFIFWGPPMALVSLFAFIT

SEQ ID NO: 1895211 - protein, 20 aa, Staphylococcus
AYDELIKKAEDLINKGIGTN

SEQ ID NO: 1895212 - protein, 17 aa, Staphylococcus
AYGIALKGSSKLSGSSN

SEQ ID NO: 1895213 - protein, 29 aa, Staphylococcus
AYGILVFFAFIFVILLINSSTRLAVLFIP

SEQ ID NO: 1895214 - protein, 25 aa, Staphylococcus
AYGKVWLFFMYYWIIFGIGCYFGQY

SEQ ID NO: 1895215 - protein, 25 aa, Staphylococcus
AYGKVWLFFVYYWIIFGIGCYFGQY

SEQ ID NO: 1895216 - protein, 18 aa, Staphylococcus
AYHIPPLSLLNQPAKQQS

SEQ ID NO: 1895217 - protein, 23 aa, Staphylococcus
AYIGNYFKPFWPLAIINVFEEFS

SEQ ID NO: 1895218 - protein, 20 aa, Staphylococcus
AYLIGLLQSPYMYTPYEENG

SEQ ID NO: 1895219 - protein, 28 aa, Staphylococcus
AYNFIEMLMVLFILSILLVCTISSKNLL

SEQ ID NO: 1895220 - protein, 25 aa, Staphylococcus
AYNLLRYWFLIWGPPMIAISLFVFL

SEQ ID NO: 1895221 - protein, 17 aa, Staphylococcus
AYPIPFHQEYLVHLTFV

SEQ ID NO: 1895222 - protein, 23 aa, Staphylococcus
AYSIPFVIVSLNFPLFNLVDQFT

SEQ ID NO: 1895223 - protein, 17 aa, Staphylococcus
AYSLYLFFDFAGYSLFA

SEQ ID NO: 1895224 - protein, 22 aa, Staphylococcus
AYSYLIIGLILFVFGYTVMTSI

SEQ ID NO: 1895225 - protein, 21 aa, Staphylococcus
AYTAQIAVLAILSQVIAKHHG

SEQ ID NO: 1895226 - protein, 22 aa, Staphylococcus
AYTYLFSSVIIALISGFYGYRT

SEQ ID NO: 1895227 - protein, 29 aa, Staphylococcus
AYVILAFFLFVFVLLFFSADTRVAICISP

SEQ ID NO: 1895228 - protein, 17 aa, Staphylococcus
CALIFVIKYLPETRGRS

SEQ ID NO: 1895229 - protein, 21 aa, Staphylococcus
CATFLPQAFLSYAIGGILHIK

SEQ ID NO: 1895230 - protein, 21 aa, Staphylococcus
CATFLPQAFLSYAIGGVFHIH

SEQ ID NO: 1895231 - protein, 21 aa, Staphylococcus
CATFLPQAFLSYAIGGVFHIK

SEQ ID NO: 1895232 - protein, 22 aa, Staphylococcus
CCLLLGIILMNYLPKSKLTETK

SEQ ID NO: 1895233 - protein, 17 aa, Staphylococcus
CFILLLVALQIIIYAFA

SEQ ID NO: 1895234 - protein, 17 aa, Staphylococcus
CFLIIPFTHSIVAVMIL

SEQ ID NO: 1895235 - protein, 18 aa, Staphylococcus
CFLIIPFTHSIVAVMILM

SEQ ID NO: 1895236 - protein, 18 aa, Staphylococcus
CFPGILLIFIRKVAYFKY

SEQ ID NO: 1895237 - protein, 28 aa, Staphylococcus
CFVISGIFMLILLIKKLRHLTTHKVVLY

SEQ ID NO: 1895238 - protein, 25 aa, Staphylococcus
CGDNSRVIVPCQKSIQPSVSIPMIP

SEQ ID NO: 1895239 - protein, 25 aa, Staphylococcus
CGITTLLFYYLPILSGDIFAIAILC

SEQ ID NO: 1895240 - protein, 20 aa, Staphylococcus
CILSILTILALNFYENFQSA

SEQ ID NO: 1895241 - protein, 17 aa, Staphylococcus
CINGIIASILLNAKPHE

SEQ ID NO: 1895242 - protein, 17 aa, Staphylococcus
CINGIITSLLLNAKPHE

SEQ ID NO: 1895243 - protein, 17 aa, Staphylococcus
CIPPIGLGLATFIQKRK

SEQ ID NO: 1895244 - protein, 19 aa, Staphylococcus
CISLVLVTVVFILLWRRGK

SEQ ID NO: 1895245 - protein, 18 aa, Staphylococcus
CITLILLSSLITFLLNFL

SEQ ID NO: 1895246 - protein, 25 aa, Staphylococcus
CLIIGGLWYLIYSLATLIPNLAILV

SEQ ID NO: 1895247 - protein, 20 aa, Staphylococcus
CLLLLLFYLMHRKSLIPLAI

SEQ ID NO: 1895248 - protein, 18 aa, Staphylococcus
CLLVYLLIKSLMPHVIDL

SEQ ID NO: 1895249 - protein, 17 aa, Staphylococcus
CLPFQTLLEKFGFPRWA

SEQ ID NO: 1895250 - protein, 31 aa, Staphylococcus
CLPILIQMPIIMGLFFVLKYPSSGGFTEHPY

SEQ ID NO: 1895251 - protein, 31 aa, Staphylococcus
CLPMLIQMPIIMGLFFVLKYPSPGGITEHSH

SEQ ID NO: 1895252 - protein, 44 aa, Staphylococcus
CLSDGRKIEIPCCPNGQPVIIVGYYYDTVGNIVLQCGDNSRVIV

SEQ ID NO: 1895253 - protein, 26 aa, Staphylococcus
CLSLPFAMFGLFASMFFIIIGSGLMK

SEQ ID NO: 1895254 - protein, 18 aa, Staphylococcus
CLSLPFAMVGLFASMFFI

SEQ ID NO: 1895255 - protein, 26 aa, Staphylococcus
CLSLPFQMFGLFASMFFIIVGSGLMK

SEQ ID NO: 1895256 - protein, 22 aa, Staphylococcus
CNFNSRFIICAWIETSNADIGS

SEQ ID NO: 1895257 - protein, 23 aa, Staphylococcus
CQEWLYHMGLPIDQIECLATQHC

SEQ ID NO: 1895258 - protein, 18 aa, Staphylococcus
CSHYQHIPYIIIGHSMGS

SEQ ID NO: 1895259 - protein, 19 aa, Staphylococcus
CSIAFIFTLLAYQSSVVNT

SEQ ID NO: 1895260 - protein, 24 aa, Staphylococcus
CSIYGFFMIITWLPYYLETERGIN

SEQ ID NO: 1895261 - protein, 23 aa, Staphylococcus
CSKIKLFYLLKGLTPILFFLIFT

SEQ ID NO: 1895262 - protein, 20 aa, Staphylococcus
CSSYLVLILVGSLQGNDMSS

SEQ ID NO: 1895263 - protein, 19 aa, Staphylococcus
CTATAIMILLYSGLEFGEN

SEQ ID NO: 1895264 - protein, 18 aa, Staphylococcus
CTPPIGLGLATFFQKHKF

SEQ ID NO: 1895265 - protein, 17 aa, Staphylococcus
CVLLVAFYLVNHLWLEW

SEQ ID NO: 1895266 - protein, 20 aa, Staphylococcus
CVVFIVITPFLKYKNFRYSH

SEQ ID NO: 1895267 - protein, 17 aa, Staphylococcus
CYGALVPPFAIQILVEN

SEQ ID NO: 1895268 - protein, 26 aa, Staphylococcus
CYHKFLPWLILVPVVSIIGLLILFLK

SEQ ID NO: 1895269 - protein, 17 aa, Staphylococcus
CYVFIICEIIVTIVLPY

SEQ ID NO: 1895270 - protein, 49 aa, Staphylococcus
DAASTIPGWQVVNSQQTQIPLVWGPKVLPSYTYVTFDKTNNKIGAVLSK

SEQ ID NO: 1895271 - protein, 22 aa, Staphylococcus
DAFQFAFFHWGIHAWAVYGIVA

SEQ ID NO: 1895272 - protein, 20 aa, Staphylococcus
DAFQFSFFHWGLHAWAVYGI

SEQ ID NO: 1895273 - protein, 30 aa, Staphylococcus
DAIIQTLFILIIAYILIILQAIIFLNKYSV

SEQ ID NO: 1895274 - protein, 27 aa, Staphylococcus
DAINVQARTRDAARNAVVQKVADQILT

SEQ ID NO: 1895275 - protein, 30 aa, Staphylococcus
DAISLLSVINPEVQVKPFALDEIQQQANNQ

SEQ ID NO: 1895276 - protein, 29 aa, Staphylococcus
DAKGLSLFYIFIGLLMFSLLNKTGVTFNI

SEQ ID NO: 1895277 - protein, 33 aa, Staphylococcus
DAKQFSIRLLGRLLFIWFLRKMNAINENYGYFD

SEQ ID NO: 1895278 - protein, 18 aa, Staphylococcus
DALQIRFILDWNSQAHRP

SEQ ID NO: 1895279 - protein, 22 aa, Staphylococcus
DALVFYLYFVLMTKYFKQTLGK

SEQ ID NO: 1895280 - protein, 28 aa, Staphylococcus
DANGKVNFLPIKFNKVGTYIYQITEQVG

SEQ ID NO: 1895281 - protein, 23 aa, Staphylococcus
DASHLYINRKLDQLSDLRDNIQH

SEQ ID NO: 1895282 - protein, 22 aa, Staphylococcus
DAYLFNFFSRLLTALIGLVTAG

SEQ ID NO: 1895283 - protein, 20 aa, Staphylococcus
DCDLYADRSLDYDTDSTSYD

SEQ ID NO: 1895284 - protein, 19 aa, Staphylococcus
DCFSIFPNKNLLIGALSFI

SEQ ID NO: 1895285 - protein, 26 aa, Staphylococcus
DCTPLMMYMFMQFYGTLYGMGVDLIQ

SEQ ID NO: 1895286 - protein, 21 aa, Staphylococcus
DDAIQQLKTILQNALNALQSD

SEQ ID NO: 1895287 - protein, 23 aa, Staphylococcus
DDCFYLIMEYIDGPTLSEYIHTH

SEQ ID NO: 1895288 - protein, 24 aa, Staphylococcus
DDDNFYLVMEYIEGPTLSEYIQKN

SEQ ID NO: 1895289 - protein, 24 aa, Staphylococcus
DDDPKQLKHHGDNFFNRVIDDFGK

SEQ ID NO: 1895290 - protein, 22 aa, Staphylococcus
DDFLSGLFDYEGNFDLPKAGEA

SEQ ID NO: 1895291 - protein, 33 aa, Staphylococcus
DDFYSYLWPGIMTLIFLITFFYNIFKVYNTRYW

SEQ ID NO: 1895292 - protein, 20 aa, Staphylococcus
DDGKWGFSFTDKDGDLAGSY

SEQ ID NO: 1895293 - protein, 41 aa, Staphylococcus
DDGSGYPIGTFLHASNKGAPYLLPSTPYNTLHASDVKGIAY

SEQ ID NO: 1895294 - protein, 26 aa, Staphylococcus
DDHSYASWIIVIVVSLILVTIVGIFL

SEQ ID NO: 1895295 - protein, 30 aa, Staphylococcus
DDIIITGWNRYWIFQRYDLKYLDDPKGSMG

SEQ ID NO: 1895296 - protein, 24 aa, Staphylococcus
DDIISMIDIVVFKISKIRNNELSF

SEQ ID NO: 1895297 - protein, 21 aa, Staphylococcus
DDKHVFPPYQGAPLFKEKYLK

SEQ ID NO: 1895298 - protein, 25 aa, Staphylococcus
DDKVALLPELLFDRARVYLKSEKGG

SEQ ID NO: 1895299 - protein, 29 aa, Staphylococcus
DDKWAGAWMLFFFGWFIGYGPLMGMLVAR

SEQ ID NO: 1895300 - protein, 22 aa, Staphylococcus
DDLQVLAIYREMSAGSTLDPQM

SEQ ID NO: 1895301 - protein, 17 aa, Staphylococcus
DDLTVIIVGLFSGALWA

SEQ ID NO: 1895302 - protein, 18 aa, Staphylococcus
DDNLYPNRLIFQGGITQI

SEQ ID NO: 1895303 - protein, 21 aa, Staphylococcus
DDQIWSNSKFKLALKVQDRQD

SEQ ID NO: 1895304 - protein, 38 aa, Staphylococcus
DDSLNHIAKIVIWDTDQQPSILHRPDLSLQDALVTGKV

SEQ ID NO: 1895305 - protein, 19 aa, Staphylococcus
DDTFFILTNTHIVGSNKRV

SEQ ID NO: 1895306 - protein, 43 aa, Staphylococcus
DDTNNVITIIILVTAVIFLIITTVFAFFLSSRITKPLRQLRTQ

SEQ ID NO: 1895307 - protein, 32 aa, Staphylococcus
DDTQQHSIQLLASLLLVMGTSLLLKRKHHSHS

SEQ ID NO: 1895308 - protein, 22 aa, Staphylococcus
DDVSATLEFTASGNAKAAKEKA

SEQ ID NO: 1895309 - protein, 22 aa, Staphylococcus
DDYLNGIYYYNPDIKNILSTTN

SEQ ID NO: 1895310 - protein, 21 aa, Staphylococcus
DEALTKFIQIWPYVEGKIQTK

SEQ ID NO: 1895311 - protein, 31 aa, Staphylococcus
DEDGKSELRRAPVLGLLQPDGIDTYDYNGET

SEQ ID NO: 1895312 - protein, 25 aa, Staphylococcus
DEEDKDTMFVAKNKSPLLIGVGDGF

SEQ ID NO: 1895313 - protein, 22 aa, Staphylococcus
DEEFLTRYKALIITAFNDKVTF

SEQ ID NO: 1895314 - protein, 25 aa, Staphylococcus
DEFSRIEVFIFWLICILGQWFAEPL

SEQ ID NO: 1895315 - protein, 34 aa, Staphylococcus
DEGAYTYRLTSEGKLYFMTKYDGKEYFISQTDVE

SEQ ID NO: 1895316 - protein, 22 aa, Staphylococcus
DEHYHLMYLLEQQDNAFLNARL

SEQ ID NO: 1895317 - protein, 32 aa, Staphylococcus
DEKFIQILWFYLIFFLFFGLLLFLISLIAPKP

SEQ ID NO: 1895318 - protein, 24 aa, Staphylococcus
DEKKIFNYVIPLAEDGFEVDSELE

SEQ ID NO: 1895319 - protein, 24 aa, Staphylococcus
DEKKIFSYIVPLAEDGFEVDSELE

SEQ ID NO: 1895320 - protein, 23 aa, Staphylococcus
DEKKLFDYVIPLAEDGFEVDSEL

SEQ ID NO: 1895321 - protein, 23 aa, Staphylococcus
DEKRIKRMLVDRPTLLKHTDDFT

SEQ ID NO: 1895322 - protein, 24 aa, Staphylococcus
DELIERFPDLRLRLVKGAYKEDAS

SEQ ID NO: 1895323 - protein, 17 aa, Staphylococcus
DELIPYMKNVRVMITFG

SEQ ID NO: 1895324 - protein, 18 aa, Staphylococcus
DELRDKEQDLRNKVLNYK

SEQ ID NO: 1895325 - protein, 42 aa, Staphylococcus
DEMVNLQKELWKYIALIGVVVLIAIYLAVRSIKRTYIRPINE

SEQ ID NO: 1895326 - protein, 23 aa, Staphylococcus
DENQLQEYLLQAGALGSTQFTTM

SEQ ID NO: 1895327 - protein, 46 aa, Staphylococcus
DEPENIKFLIMFTLLIALAIYVFRFIWVFVWYKDFYFPKNIQYYMD

SEQ ID NO: 1895328 - protein, 25 aa, Staphylococcus
DERLMSMLIYLLGLFTSFIGPLVIW

SEQ ID NO: 1895329 - protein, 25 aa, Staphylococcus
DESTWQMTWIILGAFSLILGLLVIF

SEQ ID NO: 1895330 - protein, 19 aa, Staphylococcus
DETLYTIRLLPVGGYVRMA

SEQ ID NO: 1895331 - protein, 18 aa, Staphylococcus
DETQLQNYLLQAGALGST

SEQ ID NO: 1895332 - protein, 33 aa, Staphylococcus
DETSIFSMLFKLIFMLDYHLFHLIQNSFKTYED

SEQ ID NO: 1895333 - protein, 31 aa, Staphylococcus
DEVPESYLRKFPYLVFPDNVAIALGVAEAVG

SEQ ID NO: 1895334 - protein, 23 aa, Staphylococcus
DEVTFARWMIILSGLFGFGMSIY

SEQ ID NO: 1895335 - protein, 22 aa, Staphylococcus
DEYVDLLNLRKNKTYPKVEVLN

SEQ ID NO: 1895336 - protein, 19 aa, Staphylococcus
DFAAIWTLGKFLLASYAAL

SEQ ID NO: 1895337 - protein, 20 aa, Staphylococcus
DFALERLVTVLVIACPHALG

SEQ ID NO: 1895338 - protein, 17 aa, Staphylococcus
DFAQLILSIARVCRKEL

SEQ ID NO: 1895339 - protein, 31 aa, Staphylococcus
DFDLVKVIPYLLVLILALIGINVIIVLIGGT

SEQ ID NO: 1895340 - protein, 21 aa, Staphylococcus
DFFIWTIPCYICAIIAVIYGF

SEQ ID NO: 1895341 - protein, 25 aa, Staphylococcus
DFGLIPLYFLLLNVGQIIVLGIGLI

SEQ ID NO: 1895342 - protein, 26 aa, Staphylococcus
DFGYDQLMKLQQQLNFPMLSSNIYKD

SEQ ID NO: 1895343 - protein, 33 aa, Staphylococcus
DFHFADLKQYLWPGFLLILFIASFIINAAKVFT

SEQ ID NO: 1895344 - protein, 23 aa, Staphylococcus
DFHLNIWLLLLITIILSVFGQLG

SEQ ID NO: 1895345 - protein, 22 aa, Staphylococcus
DFIGILLFTLILSSFMIFFMEP

SEQ ID NO: 1895346 - protein, 19 aa, Staphylococcus
DFIVFRLIPTLILNFILLV

SEQ ID NO: 1895347 - protein, 18 aa, Staphylococcus
DFKQKLTRIDYWCDVGSS

SEQ ID NO: 1895348 - protein, 20 aa, Staphylococcus
DFLKATSTVIIPNNKVKLNG

SEQ ID NO: 1895349 - protein, 19 aa, Staphylococcus
DFLPIIILAVIYLLHKTIN

SEQ ID NO: 1895350 - protein, 18 aa, Staphylococcus
DFMLDVLILFIYFCYRNQ

SEQ ID NO: 1895351 - protein, 20 aa, Staphylococcus
DFMRYSLISGILIGFIAPFI

SEQ ID NO: 1895352 - protein, 20 aa, Staphylococcus
DFMRYSLISGLLIGFIAPLI

SEQ ID NO: 1895353 - protein, 21 aa, Staphylococcus
DFNAAYQTKYYYRLSKPYDDS

SEQ ID NO: 1895354 - protein, 24 aa, Staphylococcus
DFNKDLIKIYLTSIIDNLHNAQKN

SEQ ID NO: 1895355 - protein, 18 aa, Staphylococcus
DFSILKKLKDQPSAIENY

SEQ ID NO: 1895356 - protein, 20 aa, Staphylococcus
DFSWFIGFIVAGGSYIILYL

SEQ ID NO: 1895357 - protein, 27 aa, Staphylococcus
DFTFINYLKLLWFVSSLGLLAGAMGST

SEQ ID NO: 1895358 - protein, 28 aa, Staphylococcus
DFTVLDFTYDLPLTTYLSQVLNIDANVP

SEQ ID NO: 1895359 - protein, 21 aa, Staphylococcus
DFYVSAFYRFALVMIGVISSS

SEQ ID NO: 1895360 - protein, 19 aa, Staphylococcus
DGEWLINDITIINSETHHT

SEQ ID NO: 1895361 - protein, 31 aa, Staphylococcus
DGFDTRQGVPIPTTVTIVGAPRSQPSTVNLL

SEQ ID NO: 1895362 - protein, 17 aa, Staphylococcus
DGGRILFVIYEAIFRKP

SEQ ID NO: 1895363 - protein, 25 aa, Staphylococcus
DGGSLFYLLVLLSFPMPVKAIRRFK

SEQ ID NO: 1895364 - protein, 61 aa, Staphylococcus
DGHVIANATSLITNADIFNTGSHEYTQYIYVNPQSVNSYDTWLTIQGYQNQVNDSSAIFNS

SEQ ID NO: 1895365 - protein, 25 aa, Staphylococcus
DGITHMFTQFGPLFTWTGKGIESLA

SEQ ID NO: 1895366 - protein, 28 aa, Staphylococcus
DGIYNINIWVWVPLLVIIICLVCNVSTV

SEQ ID NO: 1895367 - protein, 21 aa, Staphylococcus
DGKKYYNFFGVGALDEDPIKT

SEQ ID NO: 1895368 - protein, 22 aa, Staphylococcus
DGKKYYNFYGVGALDKDPVKTG

SEQ ID NO: 1895369 - protein, 25 aa, Staphylococcus
DGKRLILQILTPRRFEFKLIDTIKQ

SEQ ID NO: 1895370 - protein, 30 aa, Staphylococcus
DGLIGIIVFFIIFGFFIKQITFAFKELEHT

SEQ ID NO: 1895371 - protein, 30 aa, Staphylococcus
DGLIGIVVFFLIFGFFINKVTKTFKAIEHW

SEQ ID NO: 1895372 - protein, 22 aa, Staphylococcus
DGLLSGILNDDGNISLPAAGKV

SEQ ID NO: 1895373 - protein, 17 aa, Staphylococcus
DGLLSGLFNSDGNLSLP

SEQ ID NO: 1895374 - protein, 31 aa, Staphylococcus
DGLVNVFTQLGPLFLWVAQGLDSLGKKFQNW

SEQ ID NO: 1895375 - protein, 27 aa, Staphylococcus
DGNQTYFVMTLLNREWWESYKFYQHDK

SEQ ID NO: 1895376 - protein, 22 aa, Staphylococcus
DGNTMIFIQLLTPFAVYFVAEM

SEQ ID NO: 1895377 - protein, 27 aa, Staphylococcus
DGQGHNYYTWDNENIYLQGSGEAIGDD

SEQ ID NO: 1895378 - protein, 41 aa, Staphylococcus
DGRDAQPYTPVIIVNNYIDAYNTHVVCLSDGRKIEIPCCPN

SEQ ID NO: 1895379 - protein, 42 aa, Staphylococcus
DGSATVDLGDIGTLGYIIRSKPNTLPDFSGIGVLKSEYTFTN

SEQ ID NO: 1895380 - protein, 26 aa, Staphylococcus
DGSLLKYTEMKWLTPKGHYIHGKGIQ

SEQ ID NO: 1895381 - protein, 17 aa, Staphylococcus
DGSLPQLVFLIAVPNDS

SEQ ID NO: 1895382 - protein, 24 aa, Staphylococcus
DGSRLLFYYAPVAILISLLSVTAS

SEQ ID NO: 1895383 - protein, 25 aa, Staphylococcus
DGVGLPLFTALPIVSGMLEKYGIRD

SEQ ID NO: 1895384 - protein, 21 aa, Staphylococcus
DGVPFIYWLLVGISMWFFVNQ

SEQ ID NO: 1895385 - protein, 29 aa, Staphylococcus
DGWIGVTLIFGAFAFFWFVGIHGPSIVEP

SEQ ID NO: 1895386 - protein, 30 aa, Staphylococcus
DGWIGVTLIFGAFAFFWFVGIHGPSIVEPA

SEQ ID NO: 1895387 - protein, 18 aa, Staphylococcus
DGWWLLNAISTVGALLMA

SEQ ID NO: 1895388 - protein, 19 aa, Staphylococcus
DGWWLLNFISTIGALMMAV

SEQ ID NO: 1895389 - protein, 21 aa, Staphylococcus
DGYIDLSVGASFIPYKNSTGA

SEQ ID NO: 1895390 - protein, 20 aa, Staphylococcus
DGYIDLSVGASFIPYNGATG

SEQ ID NO: 1895391 - protein, 26 aa, Staphylococcus
DHIQQLQLIFLLKQFGCTLDEIKTLL

SEQ ID NO: 1895392 - protein, 20 aa, Staphylococcus
DHIVWFFIAVIVGSIVTTLT

SEQ ID NO: 1895393 - protein, 23 aa, Staphylococcus
DHKVFFLMIIFNITMLVSSIIQM

SEQ ID NO: 1895394 - protein, 21 aa, Staphylococcus
DHKYLVKYLGPFNFTVYDGVK

SEQ ID NO: 1895395 - protein, 33 aa, Staphylococcus
DHLYNVFIFILWVIWIAFFFFINMFAIMDKKVH

SEQ ID NO: 1895396 - protein, 18 aa, Staphylococcus
DHNRIKRMLIDNPTLLKH

SEQ ID NO: 1895397 - protein, 18 aa, Staphylococcus
DHPFVYWSTFSNVAELLE

SEQ ID NO: 1895398 - protein, 24 aa, Staphylococcus
DHSNPIILLLFVTIGFGLIGFIDD

SEQ ID NO: 1895399 - protein, 24 aa, Staphylococcus
DHSNPIILLLFVTLGFGLIGFIDD

SEQ ID NO: 1895400 - protein, 24 aa, Staphylococcus
DHSYISWIIVVGISLILVAIVSVY

SEQ ID NO: 1895401 - protein, 23 aa, Staphylococcus
DIDLPFVLTLIGVVIISSFGVAG

SEQ ID NO: 1895402 - protein, 24 aa, Staphylococcus
DIERISHLVLTRTGLYIIDSQLLK

SEQ ID NO: 1895403 - protein, 17 aa, Staphylococcus
DIFGPRSLFLFATSLVG

SEQ ID NO: 1895404 - protein, 21 aa, Staphylococcus
DIFSIILSILGFGGLLYGVSS

SEQ ID NO: 1895405 - protein, 17 aa, Staphylococcus
DIFVPIIPAIVAGGLLM

SEQ ID NO: 1895406 - protein, 38 aa, Staphylococcus
DIGQTFSEFRIFLALLIILLLIISISLIIASTYAIIKP

SEQ ID NO: 1895407 - protein, 18 aa, Staphylococcus
DIIFQIGPGLFGVRDKEG

SEQ ID NO: 1895408 - protein, 18 aa, Staphylococcus
DIILIICLLIIIGLSYYL

SEQ ID NO: 1895409 - protein, 24 aa, Staphylococcus
DIISLQILNVIALVIFAILSLISP

SEQ ID NO: 1895410 - protein, 30 aa, Staphylococcus
DIKPQNILIDKHQTLKILDFGIAKALSETT

SEQ ID NO: 1895411 - protein, 28 aa, Staphylococcus
DIKTMRRIFPWDFKILIGIGLVFCVTTP

SEQ ID NO: 1895412 - protein, 19 aa, Staphylococcus
DILGMILLGLISISTIYGL

SEQ ID NO: 1895413 - protein, 17 aa, Staphylococcus
DILLEHKSQLLLIAESL

SEQ ID NO: 1895414 - protein, 24 aa, Staphylococcus
DILLIPAYIFFQSIIPIIVVFGTL

SEQ ID NO: 1895415 - protein, 20 aa, Staphylococcus
DILLRFVLSLAIILAIHIGI

SEQ ID NO: 1895416 - protein, 25 aa, Staphylococcus
DILNIWQFIFLVLAIIVVYWIMAKI

SEQ ID NO: 1895417 - protein, 25 aa, Staphylococcus
DILQSFYFKRYLLRAIMAGFILGVI

SEQ ID NO: 1895418 - protein, 25 aa, Staphylococcus
DILTRLIYAIRPSLLYVFVALICSV

SEQ ID NO: 1895419 - protein, 23 aa, Staphylococcus
DIPQIFMIVLAAVAFILICLYSP

SEQ ID NO: 1895420 - protein, 26 aa, Staphylococcus
DIPTNTTFTVMYPNDTLPTGDQIAHF

SEQ ID NO: 1895421 - protein, 39 aa, Staphylococcus
DIQAGDMLRLFKVPDNVSNIKIQLIPNNDIMGNVRRLEK

SEQ ID NO: 1895422 - protein, 26 aa, Staphylococcus
DIQIEQLIIHLILIMKRRQSQNELIS

SEQ ID NO: 1895423 - protein, 29 aa, Staphylococcus
DIQLSWLLPFIILLFIGLIIDYFLKNKTV

SEQ ID NO: 1895424 - protein, 24 aa, Staphylococcus
DIQPIAIEIARLRTWLSIIVEEQN

SEQ ID NO: 1895425 - protein, 27 aa, Staphylococcus
DIQTELNLKFTPTTILYFNPKNDGDVT

SEQ ID NO: 1895426 - protein, 37 aa, Staphylococcus
DIQWKSIIILVVLNLFLAWFFIYFPWGKSGIKAAATG

SEQ ID NO: 1895427 - protein, 26 aa, Staphylococcus
DIRSLLWEHIIQLKMPFFDKNESGQL

SEQ ID NO: 1895428 - protein, 22 aa, Staphylococcus
DIRVQLTSNEPIRDNTWSVYGY

SEQ ID NO: 1895429 - protein, 38 aa, Staphylococcus
DITGHYNFDNLTNGNYLVEFVMPEGYIPTQANSTVDDK

SEQ ID NO: 1895430 - protein, 25 aa, Staphylococcus
DITILGGDLLLIPKAIKASKSTIRN

SEQ ID NO: 1895431 - protein, 25 aa, Staphylococcus
DITILGGDLLLLPKAIKASKATIRN

SEQ ID NO: 1895432 - protein, 28 aa, Staphylococcus
DITRFIVRVLIPFALIISLFLISQGTPQ

SEQ ID NO: 1895433 - protein, 24 aa, Staphylococcus
DIVIQWGVLALIVIFQPEIRRALE

SEQ ID NO: 1895434 - protein, 26 aa, Staphylococcus
DIVIQWGVLALIVIFQPEIRRALEQL

SEQ ID NO: 1895435 - protein, 28 aa, Staphylococcus
DIVIQWGVLALIVIFQPEIRRALEQLGR

SEQ ID NO: 1895436 - protein, 18 aa, Staphylococcus
DIVLSKGPELTEMPNLFG

SEQ ID NO: 1895437 - protein, 26 aa, Staphylococcus
DIVTNPFWLIFYIVCLLAVTFHFANG

SEQ ID NO: 1895438 - protein, 26 aa, Staphylococcus
DIVVKTLLFFIIGSLVYITGLRQYKS

SEQ ID NO: 1895439 - protein, 19 aa, Staphylococcus
DIWITIIAGVLYFIQAYVS

SEQ ID NO: 1895440 - protein, 27 aa, Staphylococcus
DIYSIGIVLYEMLVGEPPFSGETAVSI

SEQ ID NO: 1895441 - protein, 27 aa, Staphylococcus
DIYSIGIVLYEMLVGEPPFTGETAVSI

SEQ ID NO: 1895442 - protein, 18 aa, Staphylococcus
DKARQELDRVIASKMSEI

SEQ ID NO: 1895443 - protein, 19 aa, Staphylococcus
DKAYWVPLTAHTILIGTNT

SEQ ID NO: 1895444 - protein, 20 aa, Staphylococcus
DKDLQILAIYREMMSGSALD

SEQ ID NO: 1895445 - protein, 25 aa, Staphylococcus
DKDNKILLTLAYQLLMHEEQLTLIK

SEQ ID NO: 1895446 - protein, 25 aa, Staphylococcus
DKDTKLPVIFWMHGGGYVAGDKQYK

SEQ ID NO: 1895447 - protein, 25 aa, Staphylococcus
DKEIADQLLQHIDKLALTSSDDILA

SEQ ID NO: 1895448 - protein, 46 aa, Staphylococcus
DKESNKRGIKGLLLPLLALLLVLAALAIFLGMYLNKDHGDNQADDN

SEQ ID NO: 1895449 - protein, 36 aa, Staphylococcus
DKEVGNFQWAADKNFQYFTAPLFKGDYKVKNSELVK

SEQ ID NO: 1895450 - protein, 27 aa, Staphylococcus
DKFAKIGIYIFIFLIGTVAIAAIIGII

SEQ ID NO: 1895451 - protein, 25 aa, Staphylococcus
DKFGGKWLARIGLLILVLSTLPFTV

SEQ ID NO: 1895452 - protein, 28 aa, Staphylococcus
DKFKFFAPWYFLIKFVMPAVIILVFIVQ

SEQ ID NO: 1895453 - protein, 24 aa, Staphylococcus
DKFKVNFWIVLPGAILTIIILFFL

SEQ ID NO: 1895454 - protein, 30 aa, Staphylococcus
DKFLTNIWFYLIFLLFFGLLLFLVTLIVQK

SEQ ID NO: 1895455 - protein, 44 aa, Staphylococcus
DKGDSISISKIDTLPDGSRKVFFNDGHTAILPKGDKGDKGDTGA

SEQ ID NO: 1895456 - protein, 34 aa, Staphylococcus
DKISWVRWILYVVALFLPIFIVYTIMRPADKKNR

SEQ ID NO: 1895457 - protein, 31 aa, Staphylococcus
DKITWVRWILYVVALFLPVFIIYTIAKPADK

SEQ ID NO: 1895458 - protein, 25 aa, Staphylococcus
DKLAWLLVSFILTLGFIIQKFSMRY

SEQ ID NO: 1895459 - protein, 32 aa, Staphylococcus
DKLHNPFIQDVPKWINTYWLADQGVNGTAYFD

SEQ ID NO: 1895460 - protein, 24 aa, Staphylococcus
DKLKLSFYIFFFAGALSIILTILT

SEQ ID NO: 1895461 - protein, 25 aa, Staphylococcus
DKLLHPLFELMHLPSALTTTVSFVI

SEQ ID NO: 1895462 - protein, 32 aa, Staphylococcus
DKMFPILMGFFVFLFVFLISGIALLRERTSGT

SEQ ID NO: 1895463 - protein, 32 aa, Staphylococcus; identical to SEQ ID NO: 1590789

SEQ ID NO: 1895464 - protein, 28 aa, Staphylococcus
DKNADKGIVLKAPFILYGVNADGSTTKL

SEQ ID NO: 1895465 - protein, 25 aa, Staphylococcus
DKNTVIILADGREVCVPCIQGTRAT

SEQ ID NO: 1895466 - protein, 23 aa, Staphylococcus
DKPKLHVTVWLDDQGNIIKDAVE

SEQ ID NO: 1895467 - protein, 18 aa, Staphylococcus
DKQDYWIQLHPNKAKSLM

SEQ ID NO: 1895468 - protein, 23 aa, Staphylococcus
DKQQLIKQLLATRLGDKEAQRIA

SEQ ID NO: 1895469 - protein, 21 aa, Staphylococcus
DKRTLALMLFAPILVLTLLYF

SEQ ID NO: 1895470 - protein, 24 aa, Staphylococcus
DKSNPIILLLFVTIGFGLIGFIDD

SEQ ID NO: 1895471 - protein, 26 aa, Staphylococcus
DKSTRNIWRSDYLIDQLTQSKLFSHP

SEQ ID NO: 1895472 - protein, 25 aa, Staphylococcus
DKSYVSWLVIVGISLILVTIVSIFL

SEQ ID NO: 1895473 - protein, 33 aa, Staphylococcus
DKTNYLWVIPIGIVWFVLYYVIFRTLITVFNFK

SEQ ID NO: 1895474 - protein, 40 aa, Staphylococcus
DKTVGPIYQDVDVTPGSEVQLYFIGTSMGNTNGINGVKVS

SEQ ID NO: 1895475 - protein, 42 aa, Staphylococcus
DKVQKKIHLKLWHLIILIIGIILITVAITVAATLLISHQMSG

SEQ ID NO: 1895476 - protein, 21 aa, Staphylococcus
DKYGLKILAVPGFIILIIMTI

SEQ ID NO: 1895477 - protein, 26 aa, Staphylococcus
DKYGPRLLILIGFIILIVTTASLSFL

SEQ ID NO: 1895478 - protein, 18 aa, Staphylococcus
DKYPDLRLRLVKGAYKED

SEQ ID NO: 1895479 - protein, 34 aa, Staphylococcus
DLDIPVRSGFSMDAKIPLKSLKLPNDVLTKDNDV

SEQ ID NO: 1895480 - protein, 28 aa, Staphylococcus
DLDIPWVPFAYMFKYLGIAGYILVCAFF

SEQ ID NO: 1895481 - protein, 25 aa, Staphylococcus
DLDLPLMDGLYLHMLLWGKDKGYKA

SEQ ID NO: 1895482 - protein, 30 aa, Staphylococcus
DLFNMRMMFLTMIILLGVAIIILSFFAKSK

SEQ ID NO: 1895483 - protein, 17 aa, Staphylococcus
DLFTMILLTVYGALNGK

SEQ ID NO: 1895484 - protein, 24 aa, Staphylococcus
DLGNNSISVIQPDIVKKAAARKAI

SEQ ID NO: 1895485 - protein, 25 aa, Staphylococcus
DLGVIWILGILYFISTILTYFIKMP

SEQ ID NO: 1895486 - protein, 23 aa, Staphylococcus
DLICFRWFNIVLKIMLALMVILF

SEQ ID NO: 1895487 - protein, 17 aa, Staphylococcus
DLIEILVLIPISLIITI

SEQ ID NO: 1895488 - protein, 19 aa, Staphylococcus
DLIGYYMLSVLNLEEEFSL

SEQ ID NO: 1895489 - protein, 25 aa, Staphylococcus
DLIKPFIAIFLLTMGIYILYQFLYK

SEQ ID NO: 1895490 - protein, 26 aa, Staphylococcus
DLIWSQYLIGLLITAGIFFTIGSKFV

SEQ ID NO: 1895491 - protein, 26 aa, Staphylococcus
DLIWSQYLIGLLLTVGIFFTISSKFV

SEQ ID NO: 1895492 - protein, 26 aa, Staphylococcus
DLIWSQYLIGLLLTVGIFFTISSRFV

SEQ ID NO: 1895493 - protein, 24 aa, Staphylococcus
DLKFIDWGVFLVLGIFIGSYIAAR

SEQ ID NO: 1895494 - protein, 20 aa, Staphylococcus
DLKLLPYFDKIVVLIDGQIR

SEQ ID NO: 1895495 - protein, 18 aa, Staphylococcus
DLLFALLSLVLIGIVIFI

SEQ ID NO: 1895496 - protein, 17 aa, Staphylococcus
DLLIRKNDITYKTSLLG

SEQ ID NO: 1895497 - protein, 30 aa, Staphylococcus
DLLPTLVAVFLFAALFLPLLMEYGLLEFLG

SEQ ID NO: 1895498 - protein, 18 aa, Staphylococcus
DLMLAIENVYLLKQTRQS

SEQ ID NO: 1895499 - protein, 33 aa, Staphylococcus
DLNGIARLVEARPKALAYINSLDKINDAQRTAL

SEQ ID NO: 1895500 - protein, 21 aa, Staphylococcus
DLNLAEEAYLAGLPQVPNLYN

SEQ ID NO: 1895501 - protein, 23 aa, Staphylococcus
DLNPLIMSILISVTFSLLMVTPI

SEQ ID NO: 1895502 - protein, 23 aa, Staphylococcus
DLNPLTMSILISVTFSLLMVTPI

SEQ ID NO: 1895503 - protein, 29 aa, Staphylococcus
DLPIPSFKLPLYPVLPAITFILVLLVFWG

SEQ ID NO: 1895504 - protein, 17 aa, Staphylococcus
DLPKAGEAAKKVALPFG

SEQ ID NO: 1895505 - protein, 19 aa, Staphylococcus
DLPVDYYVRINMEAFVDAV

SEQ ID NO: 1895506 - protein, 17 aa, Staphylococcus
DLPWGVLILFGGGLALA

SEQ ID NO: 1895507 - protein, 20 aa, Staphylococcus
DLQVLAIYREMNAGSTLDPQ

SEQ ID NO: 1895508 - protein, 17 aa, Staphylococcus
DLRHRFHILKNKVNAEA

SEQ ID NO: 1895509 - protein, 23 aa, Staphylococcus
DLRLMVLFWGATLLSLTLLIRVN

SEQ ID NO: 1895510 - protein, 19 aa, Staphylococcus
DLRVLAIYREMSAGSTMNP

SEQ ID NO: 1895511 - protein, 30 aa, Staphylococcus
DLSFNFINILPYIFVLIAAIAGLDVILVLI

SEQ ID NO: 1895512 - protein, 27 aa, Staphylococcus
DLVWSKPLVYGLLLTGILFSLRMRFFQ

SEQ ID NO: 1895513 - protein, 19 aa, Staphylococcus
DMAWAAGAPWIAMFLLILC

SEQ ID NO: 1895514 - protein, 18 aa, Staphylococcus
DMGALKHISYGILASDKP

SEQ ID NO: 1895515 - protein, 21 aa, Staphylococcus
DMGAWRWMLGLAVVPSIILLI

SEQ ID NO: 1895516 - protein, 22 aa, Staphylococcus
DMGAWRWMLGLAVVPSLILLIG

SEQ ID NO: 1895517 - protein, 30 aa, Staphylococcus
DMKYSHWFKFVWPIVVFVFIFGGGLLVAQV

SEQ ID NO: 1895518 - protein, 28 aa, Staphylococcus
DMKYSHWFRFVWPVVVFVLVFGGAMLIT

SEQ ID NO: 1895519 - protein, 29 aa, Staphylococcus
DMTISALPWFIMFILILSAGAISDKILHS

SEQ ID NO: 1895520 - protein, 22 aa, Staphylococcus
DMTPWKYRYVAGIFILALVVIS

SEQ ID NO: 1895521 - protein, 22 aa, Staphylococcus
DMTRYFMTIPEASRLVLQAGAL

SEQ ID NO: 1895522 - protein, 20 aa, Staphylococcus
DMVPPLLIAAITFSLHATAY

SEQ ID NO: 1895523 - protein, 23 aa, Staphylococcus
DNAKELLLKGLEKLEYRGYDSAG

SEQ ID NO: 1895524 - protein, 32 aa, Staphylococcus
DNFIIMGVTVILLIAILFKFNLAHVATLASVT

SEQ ID NO: 1895525 - protein, 17 aa, Staphylococcus
DNFLSGLFDDNGSLSLP

SEQ ID NO: 1895526 - protein, 33 aa, Staphylococcus
DNFLTNIWFYLIFFLFFGLFLFLITLAVEKPAV

SEQ ID NO: 1895527 - protein, 27 aa, Staphylococcus
DNGSSILINRPAIATGDTLQALATEGS

SEQ ID NO: 1895528 - protein, 46 aa, Staphylococcus
DNHDGKKKGGFMKIILPIIAAVLILGAIAIFAGMALNNHSNSGNDD

SEQ ID NO: 1895529 - protein, 23 aa, Staphylococcus
DNHQIIWINLKYEFNNHRPSVDE

SEQ ID NO: 1895530 - protein, 26 aa, Staphylococcus
DNKLLHNHIFLNNQILYHVIDNLINN

SEQ ID NO: 1895531 - protein, 26 aa, Staphylococcus
DNKNYRGTTDYYIHDNTVERSGANGI

SEQ ID NO: 1895532 - protein, 30 aa, Staphylococcus; identical to SEQ ID NO: 1871446

SEQ ID NO: 1895533 - protein, 35 aa, Staphylococcus
DNLLTPLLAILSTAFLTFLFVGPITRQLGYWLSDG

SEQ ID NO: 1895534 - protein, 35 aa, Staphylococcus
DNLLTPLLSIFITAFLTFLFVGPITRQLGYWLSDG

SEQ ID NO: 1895535 - protein, 17 aa, Staphylococcus
DNLTVIIVGLISGALWA

SEQ ID NO: 1895536 - protein, 25 aa, Staphylococcus
DNQTFLLDMFIIYKTIKNTITSEGV

SEQ ID NO: 1895537 - protein, 17 aa, Staphylococcus
DNRLLVGIFLGVITFWL

SEQ ID NO: 1895538 - protein, 32 aa, Staphylococcus
DNRNNPQVIVLNSLPGFNLINGGKVGVLNAVL

SEQ ID NO: 1895539 - protein, 25 aa, Staphylococcus
DNSGRFNFQLPNYTLQEGDHISAVA

SEQ ID NO: 1895540 - protein, 30 aa, Staphylococcus
DNSVRFIFAIIVIAISIFGLFQLGIIGRAV

SEQ ID NO: 1895541 - protein, 26 aa, Staphylococcus
DNTFILGWIFFFFLGGYIGYNYHKII

SEQ ID NO: 1895542 - protein, 26 aa, Staphylococcus
DNVKSIVFWLFLLSSYLSAHYSILKP

SEQ ID NO: 1895543 - protein, 38 aa, Staphylococcus
DNYQRPSYNKKPKFPWFKTIIVALIAGIIGALLVLGIG

SEQ ID NO: 1895544 - protein, 23 aa, Staphylococcus
DPDNFIYVLPLISIIGGVATALL

SEQ ID NO: 1895545 - protein, 17 aa, Staphylococcus
DPEYIFYAYDRYNFVQK

SEQ ID NO: 1895546 - protein, 24 aa, Staphylococcus
DPFNQTILLKVRLPRVLEALLTGA

SEQ ID NO: 1895547 - protein, 18 aa, Staphylococcus
DPIKITISQLPNGVSYNS

SEQ ID NO: 1895548 - protein, 27 aa, Staphylococcus
DPKNPPFFFSVLLPIVFISAIIGILQY

SEQ ID NO: 1895549 - protein, 28 aa, Staphylococcus
DPKNPPFFFSVLLPIVFISALIGILQYT

SEQ ID NO: 1895550 - protein, 24 aa, Staphylococcus
DPKQTIETLLATKLNQTQAKALAD

SEQ ID NO: 1895551 - protein, 25 aa, Staphylococcus
DPNNLGWFFILPPLAGMIVQPLIGY

SEQ ID NO: 1895552 - protein, 17 aa, Staphylococcus
DPNQYTFAITDLKDFNA

SEQ ID NO: 1895553 - protein, 32 aa, Staphylococcus
DPNSNGNLYLRSTLYGYDSNFTRVSMAWDNEV

SEQ ID NO: 1895554 - protein, 23 aa, Staphylococcus
DPQYYVPHIVPETTYYRVVTKNN

SEQ ID NO: 1895555 - protein, 31 aa, Staphylococcus
DPRAKLIFVFVFIIFIFFAHSFATFAWVILL

SEQ ID NO: 1895556 - protein, 24 aa, Staphylococcus
DPVTKYLPWFKTNKTITLKDLMLH

SEQ ID NO: 1895557 - protein, 23 aa, Staphylococcus
DPVTKYLPWFKTSKEITLKDLML

SEQ ID NO: 1895558 - protein, 23 aa, Staphylococcus
DPYDRLVLYAISKDRHDAIKLTM

SEQ ID NO: 1895559 - protein, 19 aa, Staphylococcus
DQDVLFKALMLYARENNKG

SEQ ID NO: 1895560 - protein, 38 aa, Staphylococcus
DQGSALIRLFKYTLPYKWIIVLAFITLILSTIASMMTP

SEQ ID NO: 1895561 - protein, 21 aa, Staphylococcus
DQIGIWAPILLLVVRMIQSFS

SEQ ID NO: 1895562 - protein, 20 aa, Staphylococcus
DQIKTNIFNTKSTYLRSATS

SEQ ID NO: 1895563 - protein, 28 aa, Staphylococcus
DQILGVFMYPFALLLGLPWDEAWLVAQQ

SEQ ID NO: 1895564 - protein, 22 aa, Staphylococcus
DQIQNAPIWEVDQQPVTHELPK

SEQ ID NO: 1895565 - protein, 34 aa, Staphylococcus
DQKMSWMIICFILMVFIALLLFKKNLLQNHWFKV

SEQ ID NO: 1895566 - protein, 28 aa, Staphylococcus
DQLLAFFNNSNWRRDLPYGRSGWGPSGH

SEQ ID NO: 1895567 - protein, 27 aa, Staphylococcus
DQLVGKVLFRYWPLNKWKGGFNPGTFP

SEQ ID NO: 1895568 - protein, 23 aa, Staphylococcus
DQMEFQMLYGFRSDLAQSIANEG

SEQ ID NO: 1895569 - protein, 25 aa, Staphylococcus
DQNGHAFITPIKPIPEGNVTIKATD

SEQ ID NO: 1895570 - protein, 24 aa, Staphylococcus
DQNGKLIGIVSLKIDMQAVEGMAF

SEQ ID NO: 1895571 - protein, 18 aa, Staphylococcus
DQNKLVGFTIPIKDKQKL

SEQ ID NO: 1895572 - protein, 24 aa, Staphylococcus
DQPAYGEVIIPREGKDYLNTHGIP

SEQ ID NO: 1895573 - protein, 24 aa, Staphylococcus
DQQLIWLFSVPFIVGILHTVVASK

SEQ ID NO: 1895574 - protein, 26 aa, Staphylococcus
DQSHMFVLLVYYLVILMMCLGNIRAV

SEQ ID NO: 1895575 - protein, 29 aa, Staphylococcus
DQTFTIDEKLFIKQKLDESYKKAEEKVNQ

SEQ ID NO: 1895576 - protein, 18 aa, Staphylococcus
DQTLGLFQYPKTATIILF

SEQ ID NO: 1895577 - protein, 17 aa, Staphylococcus
DQWWWFDAINYGSLQIA

SEQ ID NO: 1895578 - protein, 26 aa, Staphylococcus
DREGWMIFIGWLSYFLLGFYIGTYYE

SEQ ID NO: 1895579 - protein, 35 aa, Staphylococcus
DRHHNPETLVPVNLYVKPALKQKISYWHNNEGQSI

SEQ ID NO: 1895580 - protein, 44 aa, Staphylococcus
DRIEPGTIKNITYTVSLPTSEPIKKDFDATLVYVTDGINMNRRN

SEQ ID NO: 1895581 - protein, 31 aa, Staphylococcus
DRKQKMLRITFVLLAIVGAGLAVFSFVTQAL

SEQ ID NO: 1895582 - protein, 23 aa, Staphylococcus
DRKSLFQLIGVLLILTFVSLFIT

SEQ ID NO: 1895583 - protein, 33 aa, Staphylococcus
DRMSRLIYTPISFFVFIFKPITKILNALTDLIN

SEQ ID NO: 1895584 - protein, 42 aa, Staphylococcus
DRRDATATWAWLFLLFVMPVLGFFIYIFFGRGIRKKRERGFA

SEQ ID NO: 1895585 - protein, 20 aa, Staphylococcus
DRVGLFLAMLVLVLQLSSSE

SEQ ID NO: 1895586 - protein, 36 aa, Staphylococcus
DSDDKNLLLSFIFGLKTKFFFEMLIELMKKSMTMKE

SEQ ID NO: 1895587 - protein, 18 aa, Staphylococcus
DSELFMVTLIAPLLFVEG

SEQ ID NO: 1895588 - protein, 26 aa, Staphylococcus
DSFGYGFFIPIFFIMVGVDLDIPSLI

SEQ ID NO: 1895589 - protein, 27 aa, Staphylococcus
DSFGYGFFIPIFFIMVGVDLDIPSLIK

SEQ ID NO: 1895590 - protein, 26 aa, Staphylococcus
DSFGYGFFIPIFFIMVGVDLNIPQLI

SEQ ID NO: 1895591 - protein, 26 aa, Staphylococcus
DSFGYGFFIPIFFIMVGVDLNIPSLV

SEQ ID NO: 1895592 - protein, 24 aa, Staphylococcus
DSFLLNLFIVIIFTFAYASLILFH

SEQ ID NO: 1895593 - protein, 24 aa, Staphylococcus
DSGRFFWPAIIAFSLTGIGLPLLG

SEQ ID NO: 1895594 - protein, 23 aa, Staphylococcus
DSHPHFLWFNLTEPNLWISLIAA

SEQ ID NO: 1895595 - protein, 26 aa, Staphylococcus
DSIFVQWWHWMSHLLHFNLGTSFQTN

SEQ ID NO: 1895596 - protein, 19 aa, Staphylococcus
DSITIKRVEPQTNGDIKVV

SEQ ID NO: 1895597 - protein, 21 aa, Staphylococcus
DSKHNLLNLMKSGINNELNDL

SEQ ID NO: 1895598 - protein, 23 aa, Staphylococcus
DSKTPMRIVFLAVVLNAILAPLF

SEQ ID NO: 1895599 - protein, 18 aa, Staphylococcus
DSLLLRPAISSISIFAVV

SEQ ID NO: 1895600 - protein, 18 aa, Staphylococcus
DSLRYRQIIFEHKDDKKS

SEQ ID NO: 1895601 - protein, 17 aa, Staphylococcus
DSNDTVMFWLVGSLAGI

SEQ ID NO: 1895602 - protein, 22 aa, Staphylococcus
DSNIILLMLILVAGTMLLVWLA

SEQ ID NO: 1895603 - protein, 23 aa, Staphylococcus
DSNNLWDLFLLVTGLFGVPLAGI

SEQ ID NO: 1895604 - protein, 35 aa, Staphylococcus
DSNSTGLVSAVAAMLAGLGLFGKSRKNKKDKKNKG

SEQ ID NO: 1895605 - protein, 25 aa, Staphylococcus
DSNTLTFIQLLTPFVIYFIAEEVHA

SEQ ID NO: 1895606 - protein, 23 aa, Staphylococcus
DSPIKFFKGFIPAITIGFGGSSS

SEQ ID NO: 1895607 - protein, 25 aa, Staphylococcus
DSSGHAYITPTRPIPEGNVTAKAYN

SEQ ID NO: 1895608 - protein, 34 aa, Staphylococcus
DSSIRYIITIIIVIISILGIFQLGLVGRMIDSFF

SEQ ID NO: 1895609 - protein, 24 aa, Staphylococcus
DSSIRYIVAIIIVILSVLGMFQLG

SEQ ID NO: 1895610 - protein, 24 aa, Staphylococcus
DSSLLFMLFILFGGLAYTIGAWFY

SEQ ID NO: 1895611 - protein, 30 aa, Staphylococcus
DSSQTTIWASLLAFLGSTLLINRKNRKSDK

SEQ ID NO: 1895612 - protein, 35 aa, Staphylococcus
DSVVEGDYFTVDFGKYIHPGTSRKPYRVNNIHDAN

SEQ ID NO: 1895613 - protein, 25 aa, Staphylococcus
DSYKSLYNNPNTNQIPFFSQRNPGT

SEQ ID NO: 1895614 - protein, 27 aa, Staphylococcus
DTAIGWRWIYIISIIVAILAILLIKGT

SEQ ID NO: 1895615 - protein, 32 aa, Staphylococcus
DTAKNNLSYILDPITNRPSLFDRINGSASSSN

SEQ ID NO: 1895616 - protein, 23 aa, Staphylococcus
DTCIPNFIFYNVPLIIFGTIAAM

SEQ ID NO: 1895617 - protein, 19 aa, Staphylococcus
DTFFAEKGKIIGLLQMFMT

SEQ ID NO: 1895618 - protein, 27 aa, Staphylococcus
DTICHWITFLFPMINWFVSKRYAKLSE

SEQ ID NO: 1895619 - protein, 26 aa, Staphylococcus
DTIIARKDGLTWSLSKEITGITIEPA

SEQ ID NO: 1895620 - protein, 18 aa, Staphylococcus
DTIRFVLPVIVVLIAFMV

SEQ ID NO: 1895621 - protein, 21 aa, Staphylococcus
DTISYIPKVGYYDKITHAHAY

SEQ ID NO: 1895622 - protein, 20 aa, Staphylococcus
DTITVLFIITTGLIGSMMGS

SEQ ID NO: 1895623 - protein, 17 aa, Staphylococcus
DTKDYMKYLSTDPLDNS

SEQ ID NO: 1895624 - protein, 17 aa, Staphylococcus
DTKLPWIIMYGLTGLLI

SEQ ID NO: 1895625 - protein, 17 aa, Staphylococcus
DTLIYYVIHFIFTKKGR

SEQ ID NO: 1895626 - protein, 42 aa, Staphylococcus
DTMDKVKDFLKLHWLKIVIVVAIILIVILISAIISTMNQNSS

SEQ ID NO: 1895627 - protein, 28 aa, Staphylococcus
DTMLTKITSFIPLLSPFVMFVRSASPDV

SEQ ID NO: 1895628 - protein, 25 aa, Staphylococcus
DTNIFILLLVLITGTLFLVWLADQN

SEQ ID NO: 1895629 - protein, 24 aa, Staphylococcus
DTNLKVLSFITIPLGIIIGNKKII

SEQ ID NO: 1895630 - protein, 43 aa, Staphylococcus
DTNNAITIIILITAIIFIAASTVFAFFLSNRITKPLRQLKTQA

SEQ ID NO: 1895631 - protein, 42 aa, Staphylococcus
DTNNAITIIILITAIIFLGISTVFAFFLSNRITKPLRKLRNQ

SEQ ID NO: 1895632 - protein, 42 aa, Staphylococcus
DTNNAITIIILITAIVFFIVSTIFAFFLSNRITKPLRKLSTQ

SEQ ID NO: 1895633 - protein, 42 aa, Staphylococcus
DTNNVITVIILIIAIIFLAITTIFAFFLSSRITKPLRNLRTQ

SEQ ID NO: 1895634 - protein, 17 aa, Staphylococcus
DTPYGYVDGDKIAFLIP

SEQ ID NO: 1895635 - protein, 43 aa, Staphylococcus
DTQNKIVDFLKEHWIKILIAIALILILVLVKAIFTEPSQEQHS

SEQ ID NO: 1895636 - protein, 24 aa, Staphylococcus
DTQPPLIVHYFFDLMVTGGMFCLA

SEQ ID NO: 1895637 - protein, 17 aa, Staphylococcus
DTRELTLSINPIDAGTT

SEQ ID NO: 1895638 - protein, 28 aa, Staphylococcus
DTSLLKYYFWLTVVVVILLIVGIAWLFG

SEQ ID NO: 1895639 - protein, 27 aa, Staphylococcus
DTSLLRYYLWMTAIVIFIIVAFIVWLF

SEQ ID NO: 1895640 - protein, 18 aa, Staphylococcus
DTSTLLSSSTAFSDSAST

SEQ ID NO: 1895641 - protein, 24 aa, Staphylococcus
DTTPPIVPTFNTDIAGKAGTQTPI

SEQ ID NO: 1895642 - protein, 17 aa, Staphylococcus
DTTPPTAPLVTSDLTGE

SEQ ID NO: 1895643 - protein, 28 aa, Staphylococcus
DTVLGWLIIFLMFALPIYLAYHFSDWLQ

SEQ ID NO: 1895644 - protein, 24 aa, Staphylococcus
DTVLRWESIILDPLGPILALAAFY

SEQ ID NO: 1895645 - protein, 18 aa, Staphylococcus
DTVMFWLVGSLAGIKWNQ

SEQ ID NO: 1895646 - protein, 24 aa, Staphylococcus
DTVWDYIVPLSIPLLLFSSNILKI

SEQ ID NO: 1895647 - protein, 24 aa, Staphylococcus
DVDLPLMDGLYLHMLLWGQEHDYK

SEQ ID NO: 1895648 - protein, 18 aa, Staphylococcus
DVELPLALPLILGGIRLS

SEQ ID NO: 1895649 - protein, 24 aa, Staphylococcus
DVEPTSIISILVAAADALSAARPG

SEQ ID NO: 1895650 - protein, 17 aa, Staphylococcus
DVFFFLSWIIICIALVL

SEQ ID NO: 1895651 - protein, 22 aa, Staphylococcus
DVFFFLSWMIISISLVLNIIKV

SEQ ID NO: 1895652 - protein, 25 aa, Staphylococcus
DVGQTLLIIIIFGSILLYSGLGFEK

SEQ ID NO: 1895653 - protein, 26 aa, Staphylococcus
DVGQTLLILIIFFSIMFYAGIGVHNV

SEQ ID NO: 1895654 - protein, 26 aa, Staphylococcus
DVGQTLLIMIIFVSILFYAGIGVQKS

SEQ ID NO: 1895655 - protein, 25 aa, Staphylococcus
DVGQTMLILIIFFSIIFYSGIGVQN

SEQ ID NO: 1895656 - protein, 31 aa, Staphylococcus
DVGQTMLILIIFFSILFYAGIWVKQLLKYGI

SEQ ID NO: 1895657 - protein, 18 aa, Staphylococcus
DVIGILLLSFMSISIIYG

SEQ ID NO: 1895658 - protein, 25 aa, Staphylococcus
DVILPFVILILTVLGTYFFFRSTIS

SEQ ID NO: 1895659 - protein, 24 aa, Staphylococcus
DVISIILSILGFGGLLYGTSSISH

SEQ ID NO: 1895660 - protein, 29 aa, Staphylococcus
DVKGLSLFYVFIGLLMFSLLNQGQVVLNV

SEQ ID NO: 1895661 - protein, 24 aa, Staphylococcus
DVKIQFANIKINKQNNKKSLINNE

SEQ ID NO: 1895662 - protein, 23 aa, Staphylococcus
DVKYLILLFLALIGFIIVIKNAP

SEQ ID NO: 1895663 - protein, 17 aa, Staphylococcus
DVLIRWLSFIPITLFTA

SEQ ID NO: 1895664 - protein, 19 aa, Staphylococcus
DVLMYFNILPKIIGGIGWV

SEQ ID NO: 1895665 - protein, 20 aa, Staphylococcus
DVMIIFLREGLEVLLIIMTL

SEQ ID NO: 1895666 - protein, 29 aa, Staphylococcus
DVQQYALIIALLIWIAIIICAAGLINIGY

SEQ ID NO: 1895667 - protein, 24 aa, Staphylococcus
DVQRISHLVLTRTGLYIIDSQLLK

SEQ ID NO: 1895668 - protein, 21 aa, Staphylococcus
DVRVQFLEKLIPRVPNLYRQY

SEQ ID NO: 1895669 - protein, 27 aa, Staphylococcus
DVTDPKIATIFVPKGSRYEIGRDLRKY

SEQ ID NO: 1895670 - protein, 22 aa, Staphylococcus
DVTHIWMWAQLAVFLHVFVDIF

SEQ ID NO: 1895671 - protein, 25 aa, Staphylococcus
DVTLGDIITVLPFGNTISQIQVKGT

SEQ ID NO: 1895672 - protein, 17 aa, Staphylococcus
DVYAKAIDNAEHPNISI

SEQ ID NO: 1895673 - protein, 19 aa, Staphylococcus
DWEVTFLTILIIITPGSTV

SEQ ID NO: 1895674 - protein, 21 aa, Staphylococcus
DWGWRIPFILAAPLGIIGIIL

SEQ ID NO: 1895675 - protein, 20 aa, Staphylococcus
DWISPFFITGVLGGLTTFST

SEQ ID NO: 1895676 - protein, 23 aa, Staphylococcus
DWKKFEFAVPAFITIIMMPLSYS

SEQ ID NO: 1895677 - protein, 19 aa, Staphylococcus
DWRLHSIVLVIVIISEVIG

SEQ ID NO: 1895678 - protein, 19 aa, Staphylococcus
DWVLIGILVLLAFVSVTII

SEQ ID NO: 1895679 - protein, 20 aa, Staphylococcus
DYEKYGEFRNLSIKGTIDQI

SEQ ID NO: 1895680 - protein, 25 aa, Staphylococcus
DYFVQTIVMFLIILGSIGFPVLIEV

SEQ ID NO: 1895681 - protein, 26 aa, Staphylococcus
DYHWGLILISVIVIAYTFFGGYLAVS

SEQ ID NO: 1895682 - protein, 25 aa, Staphylococcus
DYIDAVKMYYLSSLLFGIALLGIIV

SEQ ID NO: 1895683 - protein, 36 aa, Staphylococcus
DYIKPYIALFLLSMGFYILYQFLFKRHKDFHTHVGT

SEQ ID NO: 1895684 - protein, 33 aa, Staphylococcus
DYIKPYIALFLLSMGIYILYQFLFKRNREIHTH

SEQ ID NO: 1895685 - protein, 24 aa, Staphylococcus
DYKHPTWMLIFGIVAVIVTIVTGI

SEQ ID NO: 1895686 - protein, 24 aa, Staphylococcus
DYKHPTWMLLFGIVAVIVTIVTAI

SEQ ID NO: 1895687 - protein, 24 aa, Staphylococcus
DYKHPTWMLVFGIIAVIVTIITGI

SEQ ID NO: 1895688 - protein, 24 aa, Staphylococcus
DYKHPTWMLVFGIIAVVVTIITGI

SEQ ID NO: 1895689 - protein, 24 aa, Staphylococcus
DYKHPTWMLVFGIVAVIVTIITGI

SEQ ID NO: 1895690 - protein, 24 aa, Staphylococcus
DYKLPTFVMGIGLGGLIILNLLEK

SEQ ID NO: 1895691 - protein, 22 aa, Staphylococcus
DYKYVWLGIILIGVASGLAFGL

SEQ ID NO: 1895692 - protein, 25 aa, Staphylococcus
DYLGYILVGLFLITWLISTLIWKFG

SEQ ID NO: 1895693 - protein, 22 aa, Staphylococcus
DYQLFSLFFITGVLGGLTTFST

SEQ ID NO: 1895694 - protein, 27 aa, Staphylococcus
DYTPSFHLGLILVLIPIVFVTVSEHIG

SEQ ID NO: 1895695 - protein, 18 aa, Staphylococcus
DYVFIDDGWAKNGTYCII

SEQ ID NO: 1895696 - protein, 23 aa, Staphylococcus
DYVTHIVELFPYKISNHKADQVI

SEQ ID NO: 1895697 - protein, 22 aa, Staphylococcus
DYYLVYLILLKGIGINYMISHI

SEQ ID NO: 1895698 - protein, 17 aa, Staphylococcus
EADSNSLAISLSESTSE

SEQ ID NO: 1895699 - protein, 23 aa, Staphylococcus
EAEKLMQTLGVIDLLITGHQHQT

SEQ ID NO: 1895700 - protein, 25 aa, Staphylococcus
EAGGTRIRPILMTALATIGALAPML

SEQ ID NO: 1895701 - protein, 26 aa, Staphylococcus
EAGLWYLDILAWLMAFFVLFIGLIIQ

SEQ ID NO: 1895702 - protein, 17 aa, Staphylococcus
EAIFRRPVNKRAETAII

SEQ ID NO: 1895703 - protein, 47 aa, Staphylococcus
EAIKNDIINKILNIEPTNSIKPAALKQILAKLDAQKAFISENNDATD

SEQ ID NO: 1895704 - protein, 22 aa, Staphylococcus
EAIKSLFSFKKPPLAHVKPATE

SEQ ID NO: 1895705 - protein, 17 aa, Staphylococcus
EAIPLFAGVIVALAFIL

SEQ ID NO: 1895706 - protein, 26 aa, Staphylococcus
EAKLYTLIWFVVGIVIYLFYGVRHSK

SEQ ID NO: 1895707 - protein, 17 aa, Staphylococcus
EALAFLKPYPLANESDD

SEQ ID NO: 1895708 - protein, 22 aa, Staphylococcus
EAMAAFLNSFPMFKDDTRNISP

SEQ ID NO: 1895709 - protein, 43 aa, Staphylococcus
EAMADTVRKDFVSGFIAGAFIGSAVGFILNQVKKRKQQEKQFE

SEQ ID NO: 1895710 - protein, 17 aa, Staphylococcus
EANRRLDIQLSDITVNN

SEQ ID NO: 1895711 - protein, 22 aa, Staphylococcus
EANTKINLAFSDGHILTGTVDS

SEQ ID NO: 1895712 - protein, 25 aa, Staphylococcus
EANTRYYVIIMSYIDRIQNDGRSGI

SEQ ID NO: 1895713 - protein, 29 aa, Staphylococcus
EAPYTIVFYFSFFSIVALIPFVIFTYEPM

SEQ ID NO: 1895714 - protein, 17 aa, Staphylococcus
EARNTIANLVQKQIDKI

SEQ ID NO: 1895715 - protein, 18 aa, Staphylococcus
EASIVVILFAISEALERF

SEQ ID NO: 1895716 - protein, 23 aa, Staphylococcus
EAVKFIKWIQAKPFYDNTTIVIT

SEQ ID NO: 1895717 - protein, 29 aa, Staphylococcus
EAWFQSINPLFILLFAPIVSAIWLKMGKK

SEQ ID NO: 1895718 - protein, 30 aa, Staphylococcus
EAWFQSINPLFILLFAPLISLMWMKMGKKQ

SEQ ID NO: 1895719 - protein, 22 aa, Staphylococcus
EAYIFNFFSRLLTAVIGLLTAG

SEQ ID NO: 1895720 - protein, 28 aa, Staphylococcus
EAYNTKVNLYNYWPNQNTPGDSSAQLNP

SEQ ID NO: 1895721 - protein, 17 aa, Staphylococcus
EAYRILDNFKWSVKDME

SEQ ID NO: 1895722 - protein, 24 aa, Staphylococcus
EAYTIPPLSLLKQPAKQKATSKAE

SEQ ID NO: 1895723 - protein, 23 aa, Staphylococcus
EAYVFNFFSRLLTALIGLLTAGL

SEQ ID NO: 1895724 - protein, 23 aa, Staphylococcus
EDDCYFLVMEYIEGPTLSEYIQN

SEQ ID NO: 1895725 - protein, 25 aa, Staphylococcus
EDDDNFYLIMEYIDGPTLSEYIHSH

SEQ ID NO: 1895726 - protein, 25 aa, Staphylococcus
EDECFYLVMEYIEGPTLAEYIHSHG

SEQ ID NO: 1895727 - protein, 26 aa, Staphylococcus
EDEECFFLIMEYIDGPTLSEYIHSHG

SEQ ID NO: 1895728 - protein, 34 aa, Staphylococcus
EDEKLATPRAISRIASPVMLAATDNVAAQESGTN

SEQ ID NO: 1895729 - protein, 17 aa, Staphylococcus
EDGYFWFQGRVDDVIMT

SEQ ID NO: 1895730 - protein, 25 aa, Staphylococcus
EDILLFKLVLMLLFGLTFGGARIIF

SEQ ID NO: 1895731 - protein, 18 aa, Staphylococcus
EDLKLQFDNAINIANNVL

SEQ ID NO: 1895732 - protein, 22 aa, Staphylococcus
EDLKQRFAKRLLQFPHVHNKDY

SEQ ID NO: 1895733 - protein, 42 aa, Staphylococcus
EDNIRQKKSKKWLYIIIALLLIVVAVFVTLAFMGGDSNSDKV

SEQ ID NO: 1895734 - protein, 26 aa, Staphylococcus
EDNLRYRQIIFSHKDDLDTLPAKIYR

SEQ ID NO: 1895735 - protein, 25 aa, Staphylococcus
EDNLRYRQIIFSHRDDLKTLTAKIY

SEQ ID NO: 1895736 - protein, 18 aa, Staphylococcus
EDNRFYDHGALDYKRLFG

SEQ ID NO: 1895737 - protein, 47 aa, Staphylococcus
EDSDKKRMGTGAKVISIITVLLLLGGLVFAVFSFVDHSNRANERLNK

SEQ ID NO: 1895738 - protein, 34 aa, Staphylococcus
EDTNKPKLVQPPLDKTRLQALYDASYHEYRMIDT

SEQ ID NO: 1895739 - protein, 50 aa, Staphylococcus
EDTNNAITIIILITAIIFIAVSTVFAFFLSNRITKPLRQLRTQAINISKG

SEQ ID NO: 1895740 - protein, 43 aa, Staphylococcus
EDTNNAITIIILITAIIFLAVSTIFAFFLSSRITKPLRELRNQ

SEQ ID NO: 1895741 - protein, 18 aa, Staphylococcus
EDVLKTRYTFILSPQELF

SEQ ID NO: 1895742 - protein, 50 aa, Staphylococcus
EDYSKKVFIKIKDLPMVMVMLYASLGSVLLYEFDIMPFIVELAGSTSTGK

SEQ ID NO: 1895743 - protein, 24 aa, Staphylococcus
EEERHLIYKPYYSGDYFKDNKKDS

SEQ ID NO: 1895744 - protein, 24 aa, Staphylococcus
EEERQLIFNLYYSGDNFKDNKKDS

SEQ ID NO: 1895745 - protein, 24 aa, Staphylococcus
EEFYKVAGALLINIGTLTKANEKD

SEQ ID NO: 1895746 - protein, 19 aa, Staphylococcus
EEIAIRRAFGAKGRDIEIQ

SEQ ID NO: 1895747 - protein, 18 aa, Staphylococcus
EEIAIRRAFGATGKNIEV

SEQ ID NO: 1895748 - protein, 25 aa, Staphylococcus
EEISLFYILAIINSKVFNFYHRKNS

SEQ ID NO: 1895749 - protein, 28 aa, Staphylococcus
EEKDRIKVIIEQIVKKSFKDIDLASRNN

SEQ ID NO: 1895750 - protein, 27 aa, Staphylococcus
EEKDTALTLLKATFDEKVRDIESATNI

SEQ ID NO: 1895751 - protein, 41 aa, Staphylococcus
EEKQSVFVSILSTLIPVLIIALLFIFFLSQAQGGGGGGRMM

SEQ ID NO: 1895752 - protein, 41 aa, Staphylococcus
EEKQSVFVSILSTLIPVLVIALLFIFFLSQAQGGGGGGRMM

SEQ ID NO: 1895753 - protein, 42 aa, Staphylococcus
EEKQSVFVSILTTLIPVLIIALLFIFFLSQAQGGGGGGGRMM

SEQ ID NO: 1895754 - protein, 41 aa, Staphylococcus
EEKQSVFVSILTTLIPVLIIALLFIFFLSQAQGGGQGGRMM

SEQ ID NO: 1895755 - protein, 45 aa, Staphylococcus
EEKRQQLHSIRKFKVGTASILIGVTLIFGVPKVAYAEEMQAIQSN

SEQ ID NO: 1895756 - protein, 28 aa, Staphylococcus
EEKVVLIVFLLASFLWITREFLLKHWTF

SEQ ID NO: 1895757 - protein, 27 aa, Staphylococcus
EELFKTRWIWPILFLDIVIVTPIVEEL

SEQ ID NO: 1895758 - protein, 17 aa, Staphylococcus
EEQFRCIVPAYLPFRKA

SEQ ID NO: 1895759 - protein, 26 aa, Staphylococcus
EEQFYIVFPIVLIALLLTIKKYRNVT

SEQ ID NO: 1895760 - protein, 27 aa, Staphylococcus
EEQFYLFFPVVLILLLNKVKKPKQITL

SEQ ID NO: 1895761 - protein, 40 aa, Staphylococcus
EEQSVFVSILTTLIPVLIIALLFIFFLSQAQGGGGGGRMM

SEQ ID NO: 1895762 - protein, 23 aa, Staphylococcus
EESKPIIATLFLDNYDEITQNMN

SEQ ID NO: 1895763 - protein, 24 aa, Staphylococcus
EESKPIIATLFLDNYDEITQNMND

SEQ ID NO: 1895764 - protein, 17 aa, Staphylococcus
EFAFMFVAPILYVIHAL

SEQ ID NO: 1895765 - protein, 30 aa, Staphylococcus
EFEDGSLLKFTNMKWLTPKSHYIHGKGITP

SEQ ID NO: 1895766 - protein, 20 aa, Staphylococcus
EFEGYKLYQIAEPNHMIGTM

SEQ ID NO: 1895767 - protein, 17 aa, Staphylococcus
EFGPLEVILLILISIVG

SEQ ID NO: 1895768 - protein, 27 aa, Staphylococcus
EFKDGSLLKYTQMKWLTPDGHNIHGKG

SEQ ID NO: 1895769 - protein, 26 aa, Staphylococcus
EFKDGSLLKYTQMKWLTPKDHYIHGK

SEQ ID NO: 1895770 - protein, 31 aa, Staphylococcus
EFLSYNKTILFIFRCLVVVLVFFGAVIKTET

SEQ ID NO: 1895771 - protein, 25 aa, Staphylococcus
EFNMIWKAMLIPSMGYIAGLILGMI

SEQ ID NO: 1895772 - protein, 23 aa, Staphylococcus
EFNPLIMSILISVTFSLLMVTPI

SEQ ID NO: 1895773 - protein, 19 aa, Staphylococcus
EFSFMFVAPILFVIHALLT

SEQ ID NO: 1895774 - protein, 22 aa, Staphylococcus
EFTPQWYVEYDGNWYAYKDGRL

SEQ ID NO: 1895775 - protein, 26 aa, Staphylococcus
EFWTRNILWIVLILTSIVFNFWLYLI

SEQ ID NO: 1895776 - protein, 25 aa, Staphylococcus
EFYLKKIWVAIKFLAIYLYQLLTSS

SEQ ID NO: 1895777 - protein, 27 aa, Staphylococcus
EFYVWCTFIFLFYLLISILTPLAVNDF

SEQ ID NO: 1895778 - protein, 27 aa, Staphylococcus
EGAAVSKILALKAMLRSIPNRHRTRLD

SEQ ID NO: 1895779 - protein, 36 aa, Staphylococcus
EGAETIDIILLLAFLILMIFSIYKLVKIKKMNEKNN

SEQ ID NO: 1895780 - protein, 21 aa, Staphylococcus
EGAYQFINFLLDAKNNKQNTE

SEQ ID NO: 1895781 - protein, 17 aa, Staphylococcus
EGFIRKYAKTVNIDDNQ

SEQ ID NO: 1895782 - protein, 25 aa, Staphylococcus
EGFMTLVWYIAYGLPYIIAIGGFIY

SEQ ID NO: 1895783 - protein, 25 aa, Staphylococcus
EGFNYIWFDITILLVFIIGFTILNI

SEQ ID NO: 1895784 - protein, 17 aa, Staphylococcus
EGHTYWLGLMGGIILIL

SEQ ID NO: 1895785 - protein, 18 aa, Staphylococcus
EGLDLIAVILIAPALVFG

SEQ ID NO: 1895786 - protein, 23 aa, Staphylococcus
EGLDLIVVILLAPAITFGLANLI

SEQ ID NO: 1895787 - protein, 23 aa, Staphylococcus
EGLDLIVVILLAPAITFGLASVI

SEQ ID NO: 1895788 - protein, 22 aa, Staphylococcus
EGSYKYNPFVINQIHQLDNSNG

SEQ ID NO: 1895789 - protein, 20 aa, Staphylococcus
EGVPFIYWLIVGISMWFFIN

SEQ ID NO: 1895790 - protein, 23 aa, Staphylococcus
EGVRFILIIRRWDKGHWKMKLAQ

SEQ ID NO: 1895791 - protein, 22 aa, Staphylococcus
EGYHFTIYVPYGNDWFSYFMRR

SEQ ID NO: 1895792 - protein, 22 aa, Staphylococcus
EGYHFTVYVPYGDDWFAYFMRR

SEQ ID NO: 1895793 - protein, 38 aa, Staphylococcus
EGYNNVVRSLYFVAIAFGLLATFIMAGISYIFSTQLTK

SEQ ID NO: 1895794 - protein, 32 aa, Staphylococcus
EHAIENVNQFDVTFTKKPSALTHIKQVATTKE

SEQ ID NO: 1895795 - protein, 22 aa, Staphylococcus
EHEFNMNVPFINKFILKMKKDE

SEQ ID NO: 1895796 - protein, 25 aa, Staphylococcus
EHFNYIYIFQFLIVVSLFGTYWLVT

SEQ ID NO: 1895797 - protein, 29 aa, Staphylococcus
EHIQISFIALFIAILIAVPLGIALTKTKR

SEQ ID NO: 1895798 - protein, 25 aa, Staphylococcus
EHIQISFIALLIACLIGVPLGIFLT

SEQ ID NO: 1895799 - protein, 29 aa, Staphylococcus
EHIQISFIALLIAILIAVPLGIALTKTKR

SEQ ID NO: 1895800 - protein, 29 aa, Staphylococcus
EHIQISFIALLIAILIAVPLGIVLTKAKR

SEQ ID NO: 1895801 - protein, 36 aa, Staphylococcus
EHKVLYLMILPCLLFFLIFNYIPMTSLILAFKDFRF

SEQ ID NO: 1895802 - protein, 20 aa, Staphylococcus
EHLLSYYSFVFQDVTLFNDT

SEQ ID NO: 1895803 - protein, 17 aa, Staphylococcus
EHMIKLKMPFFDKNESG

SEQ ID NO: 1895804 - protein, 33 aa, Staphylococcus
EHPHFLWFNLIHPDIWITIIAGVLYFIQAWVSS

SEQ ID NO: 1895805 - protein, 21 aa, Staphylococcus
EHPHFLWFNLVHPDIWITIIA

SEQ ID NO: 1895806 - protein, 21 aa, Staphylococcus
EHSHFLWFNLAKPDIWITVIA

SEQ ID NO: 1895807 - protein, 22 aa, Staphylococcus
EHSLEWFPMAIAALIIGYLISL

SEQ ID NO: 1895808 - protein, 21 aa, Staphylococcus
EHVLEWIKLANDYKLPTFVMG

SEQ ID NO: 1895809 - protein, 31 aa, Staphylococcus
EHVSLYLLFVTVYFSIIYYLKYKRISKYLVY

SEQ ID NO: 1895810 - protein, 31 aa, Staphylococcus
EHWVAPVIGIIILLIGLFGNYRFLEKIMLVL

SEQ ID NO: 1895811 - protein, 27 aa, Staphylococcus
EHYNNLVKSLYIIAVVFGLLATVITAC

SEQ ID NO: 1895812 - protein, 24 aa, Staphylococcus
EIADKWQNRHYRRGSANYKANTVA

SEQ ID NO: 1895813 - protein, 35 aa, Staphylococcus
EIAIVTFISLLFVLIFFVFSLPKSALILGVAIILF

SEQ ID NO: 1895814 - protein, 30 aa, Staphylococcus
EIANKELKLITLLGFILGGIIGLFQGLIAI

SEQ ID NO: 1895815 - protein, 24 aa, Staphylococcus
EIAQRLIVFLPFPKTVAFDTQYAI

SEQ ID NO: 1895816 - protein, 36 aa, Staphylococcus
EIATVIILGLIIYNIFMLPLFIPALVKSFGAGNWWP

SEQ ID NO: 1895817 - protein, 30 aa, Staphylococcus
EIDTSILRYYFWFTILLVAVIVGLIVWWFE

SEQ ID NO: 1895818 - protein, 24 aa, Staphylococcus
EIERISHLVLTRTGLYIIDSQLLK

SEQ ID NO: 1895819 - protein, 18 aa, Staphylococcus
EIEWPFWLSQIGLVLLGV

SEQ ID NO: 1895820 - protein, 19 aa, Staphylococcus
EIFKALMHHHPIFATLLHV

SEQ ID NO: 1895821 - protein, 19 aa, Staphylococcus
EIGATFHIVSLPDAGTRIE

SEQ ID NO: 1895822 - protein, 27 aa, Staphylococcus
EIHNVLFYIGIALLAYVLQVIFFGCST

SEQ ID NO: 1895823 - protein, 26 aa, Staphylococcus
EIIIATILLLVFMFVAIRGASVSGSL

SEQ ID NO: 1895824 - protein, 41 aa, Staphylococcus
EIIIVITCILLFLLIFFLFNLPLSAFLLGAGIMLFIMIIYW

SEQ ID NO: 1895825 - protein, 17 aa, Staphylococcus
EIINFVVRVKLDKSFRI

SEQ ID NO: 1895826 - protein, 17 aa, Staphylococcus
EIIVMFILGAVFITLFV

SEQ ID NO: 1895827 - protein, 20 aa, Staphylococcus
EIIYAWSPFVILTVVVMIWS

SEQ ID NO: 1895828 - protein, 25 aa, Staphylococcus
EIKNNVDVFVILSHLGVDKSTQKTW

SEQ ID NO: 1895829 - protein, 18 aa, Staphylococcus
EILAFRIIFSAIFMIFIL

SEQ ID NO: 1895830 - protein, 27 aa, Staphylococcus
EILAFRIIFSMIFMILLLVVGRKQREA

SEQ ID NO: 1895831 - protein, 19 aa, Staphylococcus
EILAILLLCGMYYGENKNI

SEQ ID NO: 1895832 - protein, 17 aa, Staphylococcus
EILLIYLPILYHALYGV

SEQ ID NO: 1895833 - protein, 18 aa, Staphylococcus
EILLLKITSFIPFLAPFE

SEQ ID NO: 1895834 - protein, 17 aa, Staphylococcus
EILSFYMNNIYYGSDQY

SEQ ID NO: 1895835 - protein, 21 aa, Staphylococcus
EILYAWSPFIILTVIVMIWSA

SEQ ID NO: 1895836 - protein, 25 aa, Staphylococcus
EIMMNYLRQMPNSYQILYFTCVKDN

SEQ ID NO: 1895837 - protein, 18 aa, Staphylococcus
EINIPKGKDGKSVTITKA

SEQ ID NO: 1895838 - protein, 17 aa, Staphylococcus
EIPYNLMKAMFGKLKEA

SEQ ID NO: 1895839 - protein, 31 aa, Staphylococcus
EISAVLKKQNFADNAFLNELQKDTNYFKFQY

SEQ ID NO: 1895840 - protein, 43 aa, Staphylococcus
EISQSTKELLYISLRLSLIKILRPYYSMPIIIDDAFVHFDKQR

SEQ ID NO: 1895841 - protein, 19 aa, Staphylococcus
EISTQYRKSFFDHGRLDRK

SEQ ID NO: 1895842 - protein, 30 aa, Staphylococcus
EITPFTWFEILVLINIIILSAALLYIRERM

SEQ ID NO: 1895843 - protein, 21 aa, Staphylococcus
EITWLVVIFIVIELVGAATTY

SEQ ID NO: 1895844 - protein, 18 aa, Staphylococcus
EIVGYFLLMNRRLFKMYD

SEQ ID NO: 1895845 - protein, 23 aa, Staphylococcus
EIVMIFNFFIFAVAGFIFTWESA

SEQ ID NO: 1895846 - protein, 24 aa, Staphylococcus
EIVPLESHFFWFSDKLTKEKVATT

SEQ ID NO: 1895847 - protein, 20 aa, Staphylococcus
EIVQFFMYLSVAINLLMMKI

SEQ ID NO: 1895848 - protein, 25 aa, Staphylococcus
EIVTLKCFFFLYQQKLRTIYQRLSS

SEQ ID NO: 1895849 - protein, 26 aa, Staphylococcus
EKAEYLLGLLVLLGIALIQLVPPQII

SEQ ID NO: 1895850 - protein, 29 aa, Staphylococcus
EKAKAKQMIKLLFEKAKIEIEKAKTSYEV

SEQ ID NO: 1895851 - protein, 27 aa, Staphylococcus
EKDLYKPQATLPRKEDESPKFAVRAVP

SEQ ID NO: 1895852 - protein, 24 aa, Staphylococcus
EKERHYFVVFLSNAIFGIIQEWVN

SEQ ID NO: 1895853 - protein, 27 aa, Staphylococcus
EKFAKIGFFIFVFLIGTVAVAAIIGII

SEQ ID NO: 1895854 - protein, 31 aa, Staphylococcus
EKFKWLQQWTIFYWAWWISWAPFVGIFIARV

SEQ ID NO: 1895855 - protein, 23 aa, Staphylococcus
EKFNSYFIGDWYVSGDSAYKDED

SEQ ID NO: 1895856 - protein, 26 aa, Staphylococcus
EKGNKLVVLTIKNDSYWKEFKVEGQR

SEQ ID NO: 1895857 - protein, 18 aa, Staphylococcus
EKIHNAEEYLDKFKFSAA

SEQ ID NO: 1895858 - protein, 19 aa, Staphylococcus
EKIIYAIRSVLWRHIIHLK

SEQ ID NO: 1895859 - protein, 35 aa, Staphylococcus
EKINLLTIFYLSWYSTIYWLLNALVAISAFPKALR

SEQ ID NO: 1895860 - protein, 19 aa, Staphylococcus
EKKIGLFIFVIALTLFMNF

SEQ ID NO: 1895861 - protein, 17 aa, Staphylococcus
EKKPTVIALPKDSPILL

SEQ ID NO: 1895862 - protein, 62 aa, Staphylococcus
EKKQNLMRISLIILAIIGIGLTVFSFVSANIIFGIIFAILSVVFIVGIFFVKTKEVGHSESF

SEQ ID NO: 1895863 - protein, 22 aa, Staphylococcus
EKKVYVYNWGEYIDPDLIKKFE

SEQ ID NO: 1895864 - protein, 26 aa, Staphylococcus
EKKWDYYFMFFLNSIVIIGIFCFPLA

SEQ ID NO: 1895865 - protein, 21 aa, Staphylococcus
EKLAQLPNLTTFPLKNKQTYT

SEQ ID NO: 1895866 - protein, 23 aa, Staphylococcus
EKLKSKLERLLENAKGQINNATT

SEQ ID NO: 1895867 - protein, 38 aa, Staphylococcus
EKLNIDFTKQNSDQLIALLLIELANQMDKDKVQANVPA

SEQ ID NO: 1895868 - protein, 25 aa, Staphylococcus
EKLNKWAFWLFMIGFNVCFLPQFIL

SEQ ID NO: 1895869 - protein, 22 aa, Staphylococcus
EKLNLWQLLKTAPKQFWQISVV

SEQ ID NO: 1895870 - protein, 27 aa, Staphylococcus
EKLRSQWQLTILFALFAITSNFTGIEI

SEQ ID NO: 1895871 - protein, 27 aa, Staphylococcus
EKMFTSAWMWPVLFLDIVIVTPIVEEL

SEQ ID NO: 1895872 - protein, 39 aa, Staphylococcus
EKNKKSKKWLIAIIAILLIIVAVFATRAILNNNSSDNQQ

SEQ ID NO: 1895873 - protein, 38 aa, Staphylococcus
EKNKKSKRWLIAIIAILLLIIGIFATKSYIDHKNESDN

SEQ ID NO: 1895874 - protein, 23 aa, Staphylococcus
EKQSFLRRLIGYTTIYFVITSDG

SEQ ID NO: 1895875 - protein, 38 aa, Staphylococcus
EKSGRTKKWLIAIIVILLIIVAIFVTRAIMNHNDDKVN

SEQ ID NO: 1895876 - protein, 26 aa, Staphylococcus
EKSYSSWLFIVGISLVLVTIVSIFLW

SEQ ID NO: 1895877 - protein, 29 aa, Staphylococcus
EKTNHMFYVWLIIGFIFGFAPPLQTTINS

SEQ ID NO: 1895878 - protein, 51 aa, Staphylococcus
EKTNKPSQYLVPFTTMNLAEERFGHLIQGSFKYNPFVVNQISRMSEDGNTS

SEQ ID NO: 1895879 - protein, 17 aa, Staphylococcus
EKVALLAAFIPIISGMS

SEQ ID NO: 1895880 - protein, 25 aa, Staphylococcus
EKVFPWDFKILIGIGLLFCVATPLA

SEQ ID NO: 1895881 - protein, 23 aa, Staphylococcus
EKVTIWVYAILYIIGFILTFFMK

SEQ ID NO: 1895882 - protein, 21 aa, Staphylococcus
EKWLIILVLVTGAMILVWLSD

SEQ ID NO: 1895883 - protein, 23 aa, Staphylococcus
EKYDSYFIDDWYVSGDSAYKDED

SEQ ID NO: 1895884 - protein, 23 aa, Staphylococcus
EKYEVNIIYLISHAIVETGNGDS

SEQ ID NO: 1895885 - protein, 23 aa, Staphylococcus
EKYNSYFIGDWYVSGDSAYQDED

SEQ ID NO: 1895886 - protein, 32 aa, Staphylococcus
ELATLYQFNFFVWIPLIVIIICLMFKVSTVPS

SEQ ID NO: 1895887 - protein, 17 aa, Staphylococcus
ELCFLLDLFKPRKKFEW

SEQ ID NO: 1895888 - protein, 18 aa, Staphylococcus
ELCLLLKLFKPKETKEWP

SEQ ID NO: 1895889 - protein, 25 aa, Staphylococcus
ELDLPLMDGLYLHMLLWGKEKGYKA

SEQ ID NO: 1895890 - protein, 23 aa, Staphylococcus
ELDLPLMDGLYLHMLLWGQEKEY

SEQ ID NO: 1895891 - protein, 26 aa, Staphylococcus
ELDRWHWIFIINIISAILCLILGSIF

SEQ ID NO: 1895892 - protein, 20 aa, Staphylococcus
ELDTIPNFNKVRAQWIINKS

SEQ ID NO: 1895893 - protein, 18 aa, Staphylococcus
ELEIAKILVMKALTNEEV

SEQ ID NO: 1895894 - protein, 20 aa, Staphylococcus
ELESMLALLSNPLIDCVGSI

SEQ ID NO: 1895895 - protein, 24 aa, Staphylococcus
ELFFTKDGLPLLKTRGLKNIVEPL

SEQ ID NO: 1895896 - protein, 24 aa, Staphylococcus
ELFPKMNYLWLATGVAILACIFAN

SEQ ID NO: 1895897 - protein, 25 aa, Staphylococcus
ELINPLWLVLSFLLITIGELCISPV

SEQ ID NO: 1895898 - protein, 28 aa, Staphylococcus
ELKKCVLLILFVFYILTMGIFNSFLSYQ

SEQ ID NO: 1895899 - protein, 22 aa, Staphylococcus
ELKLIMSLGFILGGIIGFFQGI

SEQ ID NO: 1895900 - protein, 22 aa, Staphylococcus
ELKLIMSLGFLLGGIIGFFQGV

SEQ ID NO: 1895901 - protein, 26 aa, Staphylococcus
ELLYFVTMIILCLIIIDLLAKSWLNL

SEQ ID NO: 1895902 - protein, 18 aa, Staphylococcus
ELNGLMGALKESIKDNAT

SEQ ID NO: 1895903 - protein, 21 aa, Staphylococcus
ELNLAEEAYLAGLPQVPNLYN

SEQ ID NO: 1895904 - protein, 24 aa, Staphylococcus
ELNNISLHIYQGEALAIIGEPGAS

SEQ ID NO: 1895905 - protein, 44 aa, Staphylococcus
ELNNLQENTGYFKYQYFNPLDAQQYYDNLDVQVLGLITGDIGSM

SEQ ID NO: 1895906 - protein, 22 aa, Staphylococcus
ELNPLLMSILISITYSLLMVTP

SEQ ID NO: 1895907 - protein, 24 aa, Staphylococcus
ELPFGFILSIVALALIASFFITSA

SEQ ID NO: 1895908 - protein, 23 aa, Staphylococcus
ELPPLIVHYFFDLMVTMGVLCFV

SEQ ID NO: 1895909 - protein, 18 aa, Staphylococcus
ELPRPFRFAGFGFDLDAT

SEQ ID NO: 1895910 - protein, 23 aa, Staphylococcus
ELSFNYIFIANLLMYVAFAIVAV

SEQ ID NO: 1895911 - protein, 28 aa, Staphylococcus
ELSFNYIFIANLLMYVLFAIVAVTQFNL

SEQ ID NO: 1895912 - protein, 17 aa, Staphylococcus
ELTFIVWALLYSAIVLF

SEQ ID NO: 1895913 - protein, 24 aa, Staphylococcus
ELTFWLLQLFISPQSKIGSLIILL

SEQ ID NO: 1895914 - protein, 26 aa, Staphylococcus
ELTTKQRQLFFKDLKLDKTTRNNSDN

SEQ ID NO: 1895915 - protein, 23 aa, Staphylococcus
ELTYGAWFMAAVVAYLIIPKAGI

SEQ ID NO: 1895916 - protein, 19 aa, Staphylococcus
ELTYQRFLNGYPTFNKQDL

SEQ ID NO: 1895917 - protein, 17 aa, Staphylococcus
ELVFFIGKLFLAPSKIG

SEQ ID NO: 1895918 - protein, 20 aa, Staphylococcus
ELWYGLIPIQIIGFVLVIIF

SEQ ID NO: 1895919 - protein, 33 aa, Staphylococcus
EMFRPFALAIAFSLLASLLVSITIVPALSATFF

SEQ ID NO: 1895920 - protein, 28 aa, Staphylococcus
EMFRPFALAITFSLLASLLVSITIVPAL

SEQ ID NO: 1895921 - protein, 26 aa, Staphylococcus
EMGKIWLPMIIITAAYYFVYQWIANS

SEQ ID NO: 1895922 - protein, 17 aa, Staphylococcus
EMIILPVAIPVLSGIFG

SEQ ID NO: 1895923 - protein, 20 aa, Staphylococcus
EMIILPVFIPVVSGLIGLTT

SEQ ID NO: 1895924 - protein, 17 aa, Staphylococcus
EMKKRPETRYGMVTMCI

SEQ ID NO: 1895925 - protein, 17 aa, Staphylococcus
EMLFNDTDKLKGFVFPI

SEQ ID NO: 1895926 - protein, 17 aa, Staphylococcus
EMLNNILVKEGLAKVAY

SEQ ID NO: 1895927 - protein, 29 aa, Staphylococcus
EMPSFRLSVFTALLPVILMLISTILQLVT

SEQ ID NO: 1895928 - protein, 22 aa, Staphylococcus
EMQPILMCVLISLVYSIIIISP

SEQ ID NO: 1895929 - protein, 24 aa, Staphylococcus
EMTLYRKWVLIFLLICNVAGTIYG

SEQ ID NO: 1895930 - protein, 17 aa, Staphylococcus
EMVDYLYRKLLFHKERA

SEQ ID NO: 1895931 - protein, 25 aa, Staphylococcus
ENDEYFFLVMEYIEGPTLSEYIKTH

SEQ ID NO: 1895932 - protein, 21 aa, Staphylococcus
ENEAWLWVLVLVAFSVVVITT

SEQ ID NO: 1895933 - protein, 24 aa, Staphylococcus
ENGWALLFILLFSLVQFAVSIYQI

SEQ ID NO: 1895934 - protein, 23 aa, Staphylococcus
ENIEWMNRFMSERLNRNVISDPV

SEQ ID NO: 1895935 - protein, 43 aa, Staphylococcus
ENIKFLITTTLLIALAIYVFRFIWVFILFKQFYYPNNIQSYLN

SEQ ID NO: 1895936 - protein, 29 aa, Staphylococcus
ENLITKLALILIYILVAIIVISILNKIIA

SEQ ID NO: 1895937 - protein, 30 aa, Staphylococcus
ENLVIKIIMILIYIIVALIVIAILNKVIEQ

SEQ ID NO: 1895938 - protein, 25 aa, Staphylococcus
ENLYNIFIFIIWIGSIALFFFFNMF

SEQ ID NO: 1895939 - protein, 30 aa, Staphylococcus
ENMSKYLGPIWLFVAPFLGALGSFITGSAT

SEQ ID NO: 1895940 - protein, 35 aa, Staphylococcus
ENNRRGLIPAIAAMLAGLGFLKRKKKDNKENKDEE

SEQ ID NO: 1895941 - protein, 22 aa, Staphylococcus
ENQAWLWVLVLVAFSIVVIMTI

SEQ ID NO: 1895942 - protein, 26 aa, Staphylococcus
ENRIKRMLFDRPMLLKHTDAFISAAK

SEQ ID NO: 1895943 - protein, 32 aa, Staphylococcus
ENSGKFYLTVLMIYVLLSIVLIVIATFFVTKR

SEQ ID NO: 1895944 - protein, 28 aa, Staphylococcus
ENSLLSLAEFTLLSGLLLLLKRRKKEDK

SEQ ID NO: 1895945 - protein, 30 aa, Staphylococcus
ENTGPLLAFLPVVTIGLLFGLAIDYELFLM

SEQ ID NO: 1895946 - protein, 26 aa, Staphylococcus
ENTMILGWIFYFFLGGFIGYNYQRVL

SEQ ID NO: 1895947 - protein, 26 aa, Staphylococcus
ENVYSILPWFIITIPIVIALSHQLDI

SEQ ID NO: 1895948 - protein, 32 aa, Staphylococcus
ENYEHLVQSLYIVAIAFGLIATFITAIVSYIV

SEQ ID NO: 1895949 - protein, 21 aa, Staphylococcus
ENYIRLIKKRLLSAKNVTSIA

SEQ ID NO: 1895950 - protein, 23 aa, Staphylococcus
EPAIIFMVPGIIPLVPGGLAFDA

SEQ ID NO: 1895951 - protein, 23 aa, Staphylococcus
EPALVAAIAVLVIACPCALGLAT

SEQ ID NO: 1895952 - protein, 24 aa, Staphylococcus
EPDEIKGDIWYYNANYYNGFTIKV

SEQ ID NO: 1895953 - protein, 22 aa, Staphylococcus
EPEFSFISWIGMLFSAGLGVGI

SEQ ID NO: 1895954 - protein, 22 aa, Staphylococcus
EPEFSFLSWLGMLFSAGLGVGI

SEQ ID NO: 1895955 - protein, 28 aa, Staphylococcus
EPELPRPYKVPLYPFIPGIALIAGIFVL

SEQ ID NO: 1895956 - protein, 27 aa, Staphylococcus
EPFGLPALTMPFILATWLMLFAGGKHR

SEQ ID NO: 1895957 - protein, 28 aa, Staphylococcus
EPFIHSFFTFIIIPLLLALTLQLLSKKY

SEQ ID NO: 1895958 - protein, 24 aa, Staphylococcus
EPFTFLKLCGIILLFFGIFIMNYT

SEQ ID NO: 1895959 - protein, 22 aa, Staphylococcus
EPFTIFKVLGIIVLIFGIILMN

SEQ ID NO: 1895960 - protein, 34 aa, Staphylococcus
EPHLTTREIYLGKSGLFYTLGIIQALIVSIGDMV

SEQ ID NO: 1895961 - protein, 22 aa, Staphylococcus
EPIITNIMFLGVALSILLVIII

SEQ ID NO: 1895962 - protein, 26 aa, Staphylococcus
EPLEFTFLFIAPYLFVIHAILAATMD

SEQ ID NO: 1895963 - protein, 37 aa, Staphylococcus
EPLTKIEFYQNLLANILIIVAYILLGMIVIAISRKVV

SEQ ID NO: 1895964 - protein, 41 aa, Staphylococcus
EPMMKIEFYQNLLVNLLIILAYILIGMIVIAISRKLVTKFF

SEQ ID NO: 1895965 - protein, 26 aa, Staphylococcus
EPNETTMLGYFIPGDYKIPATKETDN

SEQ ID NO: 1895966 - protein, 22 aa, Staphylococcus
EPNKEFEPIPIPKKEKPNPKRP

SEQ ID NO: 1895967 - protein, 17 aa, Staphylococcus
EPNLWISLIAAVVYFFQ

SEQ ID NO: 1895968 - protein, 29 aa, Staphylococcus
EPSILIIIPILIVAFLISKIIPVFAIRPW

SEQ ID NO: 1895969 - protein, 28 aa, Staphylococcus
EPSLLIIIPILILAFIVSKLIPVFIIKR

SEQ ID NO: 1895970 - protein, 28 aa, Staphylococcus
EPSLLLIIPVLILAFIISKLIPVFFIRR

SEQ ID NO: 1895971 - protein, 20 aa, Staphylococcus
EPSTIINKNGIRYGIVGVTT

SEQ ID NO: 1895972 - protein, 17 aa, Staphylococcus
EPTFDKLLHPLFELMHL

SEQ ID NO: 1895973 - protein, 29 aa, Staphylococcus
EPTFEKLLHPLFDLLHLPDALTTTISFVI

SEQ ID NO: 1895974 - protein, 29 aa, Staphylococcus
EPTFEKLLHPLFNLLHLPSAVTTTISFVI

SEQ ID NO: 1895975 - protein, 30 aa, Staphylococcus
EPTFEKLLHPLFNLLQLPDALTTTISFVIS

SEQ ID NO: 1895976 - protein, 20 aa, Staphylococcus
EPTSLLANKTLNVTFNLRVN

SEQ ID NO: 1895977 - protein, 24 aa, Staphylococcus
EQDKDTIFVAKNKSPLLVGLGDHF

SEQ ID NO: 1895978 - protein, 20 aa, Staphylococcus
EQEYDVETLRAEKQAIRNEA

SEQ ID NO: 1895979 - protein, 18 aa, Staphylococcus
EQFSWHSAFLINVPFVII

SEQ ID NO: 1895980 - protein, 38 aa, Staphylococcus
EQLALLYSRPLYYFGNIMKPLIWLMNGSARVIVRMFGF

SEQ ID NO: 1895981 - protein, 17 aa, Staphylococcus
EQLPYDESLSQLTEFNL

SEQ ID NO: 1895982 - protein, 26 aa, Staphylococcus
EQPKWVLNLIIWIIVVVASVWLSFSF

SEQ ID NO: 1895983 - protein, 23 aa, Staphylococcus
EQPSFWFGVFRYLTEGATIILVG

SEQ ID NO: 1895984 - protein, 32 aa, Staphylococcus
EQQFFMYSGLFTLIIGVLLFLISPIVIRAMRG

SEQ ID NO: 1895985 - protein, 18 aa, Staphylococcus
EQRFLTLYDFALDAVSMI

SEQ ID NO: 1895986 - protein, 20 aa, Staphylococcus
EQRFLTMYDYMLNIIAMVSI

SEQ ID NO: 1895987 - protein, 27 aa, Staphylococcus
EQSIKNHYLFYKFIAAAVISVSFLYLQ

SEQ ID NO: 1895988 - protein, 25 aa, Staphylococcus
EQTKPAVFILYSALQYILCFAACWL

SEQ ID NO: 1895989 - protein, 54 aa, Staphylococcus
EQVVANGVYDVDTKKLKYTFTDYVNNKQNIEGGFKLPQYIDRKTATQSGDYNLN

SEQ ID NO: 1895990 - protein, 23 aa, Staphylococcus
EQYGYWGIAFLIFLENVFPPIPS

SEQ ID NO: 1895991 - protein, 23 aa, Staphylococcus
EREDLGLLVDFLAELFKEDGHKL

SEQ ID NO: 1895992 - protein, 25 aa, Staphylococcus
EREGWMLFLGWISYFLLGFYTGIYY

SEQ ID NO: 1895993 - protein, 28 aa, Staphylococcus
ERFPKSIIFIAPMIVFLFVFGVGTANIA

SEQ ID NO: 1895994 - protein, 27 aa, Staphylococcus
ERFPKTIIFIAPMIVFLFVFGIGTANI

SEQ ID NO: 1895995 - protein, 24 aa, Staphylococcus
ERINSWLNIFYQSPDIYKLLNKIQ

SEQ ID NO: 1895996 - protein, 17 aa, Staphylococcus
ERIYKKIKHICVGIFVV

SEQ ID NO: 1895997 - protein, 33 aa, Staphylococcus
ERKKQAIVDISPIDVIPAIKQQAIQSLNDKADE

SEQ ID NO: 1895998 - protein, 23 aa, Staphylococcus
ERKLPKFVLYALLVIGIVTLFSS

SEQ ID NO: 1895999 - protein, 22 aa, Staphylococcus
ERKLYALIILLVCVLIGAMIYG

SEQ ID NO: 1896000 - protein, 65 aa, Staphylococcus
ERKQKQYRWLKISFIILALISVGLTIFAFITTSITFSIIFAILTVIFLVGLFFSKNKDIDYSETI

SEQ ID NO: 1896001 - protein, 18 aa, Staphylococcus
ERLELFLPFPKTQAALTK

SEQ ID NO: 1896002 - protein, 19 aa, Staphylococcus
ERLSLFMIILFGEGIVQIV

SEQ ID NO: 1896003 - protein, 20 aa, Staphylococcus
ERMIRLVNDLLQLSKMDNES

SEQ ID NO: 1896004 - protein, 34 aa, Staphylococcus
ERMKFFPFIIFIFLWVILIYSPVAHWVWGGGWIQ

SEQ ID NO: 1896005 - protein, 22 aa, Staphylococcus
ERPLHVKQLKDKVSKIVIQMNT

SEQ ID NO: 1896006 - protein, 17 aa, Staphylococcus
ERPSIGIGLLNVSEIPE

SEQ ID NO: 1896007 - protein, 41 aa, Staphylococcus
ERQRRIQLSVFGVLIALIALIILYMFTPISRIDQVRIKGTQ

SEQ ID NO: 1896008 - protein, 25 aa, Staphylococcus
ESDFKLFMKIILVSALPMVLILLQN

SEQ ID NO: 1896009 - protein, 29 aa, Staphylococcus
ESDYATTVFGTITLAASLLLLRRQRKESK

SEQ ID NO: 1896010 - protein, 24 aa, Staphylococcus
ESESIHFIIPKFKGTVYDLYNNKQ

SEQ ID NO: 1896011 - protein, 22 aa, Staphylococcus
ESFESYLRYFNEKGINEVMQRI

SEQ ID NO: 1896012 - protein, 29 aa, Staphylococcus
ESFGAIFVIVIIILIIITKNGGGPPRGGG

SEQ ID NO: 1896013 - protein, 17 aa, Staphylococcus
ESFILLPIVLPPTVLGF

SEQ ID NO: 1896014 - protein, 20 aa, Staphylococcus
ESIEAKKALLTEYVTSNSDV

SEQ ID NO: 1896015 - protein, 24 aa, Staphylococcus
ESIILFVILPWILIKVDIPQIFMI

SEQ ID NO: 1896016 - protein, 29 aa, Staphylococcus
ESIISWKLFIFCAVMIILVRPISILLSTM

SEQ ID NO: 1896017 - protein, 31 aa, Staphylococcus
ESLLPTLVTVFFFAALFLPLLMEYGLLELLG

SEQ ID NO: 1896018 - protein, 30 aa, Staphylococcus
ESLQNIYLRVYYPPFVIGLPALIAAVALIY

SEQ ID NO: 1896019 - protein, 26 aa, Staphylococcus
ESNGQYHQWYMHLNDFKVTQGQKVKA

SEQ ID NO: 1896020 - protein, 29 aa, Staphylococcus
ESNSNSLVFSLIALLSSLLLLKRKNNKNI

SEQ ID NO: 1896021 - protein, 22 aa, Staphylococcus
ESPIMLKLLFAVGCSLIGTALF

SEQ ID NO: 1896022 - protein, 24 aa, Staphylococcus
ESQYHNIAHLIGPYQYQSNQELTS

SEQ ID NO: 1896023 - protein, 17 aa, Staphylococcus
ESRRLLVIFFVASIGTM

SEQ ID NO: 1896024 - protein, 24 aa, Staphylococcus
ESRRPHYNTYYQPVGKPPKKKKSN

SEQ ID NO: 1896025 - protein, 23 aa, Staphylococcus
ESSKPIIATLFLDNYDEITQNMN

SEQ ID NO: 1896026 - protein, 17 aa, Staphylococcus
ESSLRFAGITQNKNSNG

SEQ ID NO: 1896027 - protein, 25 aa, Staphylococcus
ESSQFGIHYWLIGVLLGLMFLMVGY

SEQ ID NO: 1896028 - protein, 23 aa, Staphylococcus
ESTSMSLSKSISASTSLSESRSA

SEQ ID NO: 1896029 - protein, 27 aa, Staphylococcus
ESVQPNKLVFKLVSGQLDPNKVYVFLL

SEQ ID NO: 1896030 - protein, 31 aa, Staphylococcus; identical to SEQ ID NO: 1591111

SEQ ID NO: 1896031 - protein, 23 aa, Staphylococcus
ESYEGWIMAMIVGFMAGATIVFS

SEQ ID NO: 1896032 - protein, 24 aa, Staphylococcus
ETALADIKTKQDQQRYIINNEPNA

SEQ ID NO: 1896033 - protein, 24 aa, Staphylococcus
ETEDGITKYIYKKVKLKQHKQTLE

SEQ ID NO: 1896034 - protein, 22 aa, Staphylococcus
ETFFSYLIWYSIGRFFVEGLRT

SEQ ID NO: 1896035 - protein, 37 aa, Staphylococcus
ETGDKQAKIYFGHIDHPYIVKVTSKIDPNSTADLKTR

SEQ ID NO: 1896036 - protein, 34 aa, Staphylococcus
ETGEQDQVLFGMLAGTLFASAGTLFLVQARRKEN

SEQ ID NO: 1896037 - protein, 21 aa, Staphylococcus
ETIFKKLSFWWPMLISSAIFS

SEQ ID NO: 1896038 - protein, 38 aa, Staphylococcus; identical to SEQ ID NO: 1593225

SEQ ID NO: 1896039 - protein, 28 aa, Staphylococcus
ETKDALNGIERLKAAKLKADKFIEGLNH

SEQ ID NO: 1896040 - protein, 20 aa, Staphylococcus
ETLAKLPTVFKADGTVTAGS

SEQ ID NO: 1896041 - protein, 25 aa, Staphylococcus
ETLNKWCFWFFMIGFNVCFLPQFIL

SEQ ID NO: 1896042 - protein, 25 aa, Staphylococcus
ETLSIMNIIFAISTISLIGALIFTN

SEQ ID NO: 1896043 - protein, 18 aa, Staphylococcus
ETLYTIRILPVGGYVRMA

SEQ ID NO: 1896044 - protein, 23 aa, Staphylococcus
ETMTFLTLPPKDVFLASVLIGTL

SEQ ID NO: 1896045 - protein, 36 aa, Staphylococcus
ETNGCLSCLGCFGIIFLILLLIGGCSAIFSDDNNND

SEQ ID NO: 1896046 - protein, 19 aa, Staphylococcus
ETRFMRFFGGKDLIFALSA

SEQ ID NO: 1896047 - protein, 25 aa, Staphylococcus
ETTRNAFFIGRAMDYNVSLEGALKL

SEQ ID NO: 1896048 - protein, 24 aa, Staphylococcus
ETTRNAFFIGRTMDYNVSLEGSLK

SEQ ID NO: 1896049 - protein, 38 aa, Staphylococcus
ETVGGIVPAILIPKLIILGLFGLGFLTIGLCLKPILDP

SEQ ID NO: 1896050 - protein, 20 aa, Staphylococcus
ETVRMIRLVNDLLQLSKMDN

SEQ ID NO: 1896051 - protein, 21 aa, Staphylococcus
ETVSWKWTIIATLYPVVIAYV

SEQ ID NO: 1896052 - protein, 24 aa, Staphylococcus
ETYAKSMYMSKKGIYNQLTSSSGD

SEQ ID NO: 1896053 - protein, 29 aa, Staphylococcus
EVAGSIWWVLLINILIALAALAMGIFVST

SEQ ID NO: 1896054 - protein, 27 aa, Staphylococcus
EVAGWNLLLFIIFRAISGIVLSGILSY

SEQ ID NO: 1896055 - protein, 27 aa, Staphylococcus
EVAGWNLLLFIVFRAISGIILAGLLSY

SEQ ID NO: 1896056 - protein, 32 aa, Staphylococcus
EVCVPCIQGTRATIKYYYIDQAGNVHIDFNNH

SEQ ID NO: 1896057 - protein, 24 aa, Staphylococcus
EVDKAKALALPKIEAVKVTTEVKP

SEQ ID NO: 1896058 - protein, 17 aa, Staphylococcus
EVEAFFASKFPLINFRM

SEQ ID NO: 1896059 - protein, 27 aa, Staphylococcus
EVEKLKNLHFSFSNKDGLRFPEVTKDK

SEQ ID NO: 1896060 - protein, 20 aa, Staphylococcus
EVEKSLVYFLAALKGNDTII

SEQ ID NO: 1896061 - protein, 22 aa, Staphylococcus
EVEKSLVYFLAALKGNEDVFKR

SEQ ID NO: 1896062 - protein, 22 aa, Staphylococcus
EVEKSLVYFLAALKGNESIIKK

SEQ ID NO: 1896063 - protein, 17 aa, Staphylococcus
EVELPMALSFFSGKRLV

SEQ ID NO: 1896064 - protein, 18 aa, Staphylococcus
EVELQKLKDKVSSDQTFT

SEQ ID NO: 1896065 - protein, 19 aa, Staphylococcus
EVEMTERPIKIYNSLGVKD

SEQ ID NO: 1896066 - protein, 18 aa, Staphylococcus
EVEYFGTIFSFMGNSSTG

SEQ ID NO: 1896067 - protein, 19 aa, Staphylococcus
EVGLVLLIPLVFTIAKRAK

SEQ ID NO: 1896068 - protein, 18 aa, Staphylococcus
EVIFIPLLGIMLGGIVSS

SEQ ID NO: 1896069 - protein, 25 aa, Staphylococcus
EVIKQAVIIVWEFIKTYVQVAIAVV

SEQ ID NO: 1896070 - protein, 22 aa, Staphylococcus
EVIKWFYKEHDWFKAQLNNETN

SEQ ID NO: 1896071 - protein, 19 aa, Staphylococcus
EVILLILISIVGIALVFIR

SEQ ID NO: 1896072 - protein, 20 aa, Staphylococcus
EVIRYYYPSIFALEEINFML

SEQ ID NO: 1896073 - protein, 19 aa, Staphylococcus
EVKFLYKLNFKELLFMALT

SEQ ID NO: 1896074 - protein, 29 aa, Staphylococcus
EVKSILYITLFLALILIFKNYKLSLWLLV

SEQ ID NO: 1896075 - protein, 20 aa, Staphylococcus
EVLATLPTVFKADGTVTAGT

SEQ ID NO: 1896076 - protein, 62 aa, Staphylococcus
EVMAGYRAKFVGLIILTMIVFVLLNTYLLRQLKSIGMFIIIVILALYFIDMNRNNAILAAIS

SEQ ID NO: 1896077 - protein, 22 aa, Staphylococcus
EVMVAKTDAISLLSVINPEVQV

SEQ ID NO: 1896078 - protein, 24 aa, Staphylococcus
EVNAALADLAAIKTQAEASINQAI

SEQ ID NO: 1896079 - protein, 26 aa, Staphylococcus
EVNNRFYVVIMSYIEQFQPNQSGVVA

SEQ ID NO: 1896080 - protein, 22 aa, Staphylococcus
EVPLFILPIFRYITLHFDTKLS

SEQ ID NO: 1896081 - protein, 30 aa, Staphylococcus
EVQDALLNGIRKIMEVGLEGSFDSISNQQR

SEQ ID NO: 1896082 - protein, 29 aa, Staphylococcus
EVQFLVESVILCLIGGIIGLILGIGLATL

SEQ ID NO: 1896083 - protein, 25 aa, Staphylococcus
EVRNGQEMYPSYYLDENNPNLVDVT

SEQ ID NO: 1896084 - protein, 30 aa, Staphylococcus; identical to SEQ ID NO: 1872488

SEQ ID NO: 1896085 - protein, 27 aa, Staphylococcus
EVTENDIITVLPFGNLISQIQVKGSDV

SEQ ID NO: 1896086 - protein, 40 aa, Staphylococcus
EVYKVLNNSQFRDSFSPDYANLTQVRNPKIIINSDGSATV

SEQ ID NO: 1896087 - protein, 26 aa, Staphylococcus
EVYVVISIIYWLLALIIQGTFTIISK

SEQ ID NO: 1896088 - protein, 18 aa, Staphylococcus
EWIIFIDVVSLLAGFVIV

SEQ ID NO: 1896089 - protein, 17 aa, Staphylococcus
EWIWWLLAHIVFMVFMY

SEQ ID NO: 1896090 - protein, 22 aa, Staphylococcus
EWPLFIVFGLIFLLLVPNTFYM

SEQ ID NO: 1896091 - protein, 21 aa, Staphylococcus
EWPLFVVFGMIFLLLVPNTFY

SEQ ID NO: 1896092 - protein, 27 aa, Staphylococcus
EWRLIAISVLLLFFWSTEKILHPIDSS

SEQ ID NO: 1896093 - protein, 25 aa, Staphylococcus
EWRLIVISILLLLFWSTEKVVHPID

SEQ ID NO: 1896094 - protein, 18 aa, Staphylococcus
EWVINLPEGLTLEEAMIY

SEQ ID NO: 1896095 - protein, 19 aa, Staphylococcus
EWVVLILSTILFFYGGKPF

SEQ ID NO: 1896096 - protein, 24 aa, Staphylococcus
EYEPTLPWVVYKLTQAKVHKTVMN

SEQ ID NO: 1896097 - protein, 20 aa, Staphylococcus
EYFHRIFPRISYKIYVIIFT

SEQ ID NO: 1896098 - protein, 25 aa, Staphylococcus
EYINRYLLLILLTLIQIAGVILICF

SEQ ID NO: 1896099 - protein, 29 aa, Staphylococcus
EYIVPAVLFIFFLISFIGQILKVYQTRYW

SEQ ID NO: 1896100 - protein, 22 aa, Staphylococcus
EYKKLNWSRWLPHTTLKALNIR

SEQ ID NO: 1896101 - protein, 27 aa, Staphylococcus
EYLTIYILVALLYWVVCFIISVIQSFY

SEQ ID NO: 1896102 - protein, 26 aa, Staphylococcus
EYLTIYLLVALMYWVVCFIISVIQSF

SEQ ID NO: 1896103 - protein, 25 aa, Staphylococcus
EYMNYWFPHLPQWIPGVIAVVVLLI

SEQ ID NO: 1896104 - protein, 31 aa, Staphylococcus
EYMNYWFPNLPAWIPGIIAVLLLTAANLVSV

SEQ ID NO: 1896105 - protein, 25 aa, Staphylococcus
EYMNYWFPNLPNWIPGIVAVALLMG

SEQ ID NO: 1896106 - protein, 18 aa, Staphylococcus
EYQSLIVLSLYLIGILIA

SEQ ID NO: 1896107 - protein, 28 aa, Staphylococcus
EYSKDDIFQMYLNKIYYSDGVYGIKAAA

SEQ ID NO: 1896108 - protein, 28 aa, Staphylococcus
EYSKDDIFQMYLNKIYYSDGVYGVRAAA

SEQ ID NO: 1896109 - protein, 28 aa, Staphylococcus
EYSKDEIFQMYLNKIYYSDGVYGVKAAA

SEQ ID NO: 1896110 - protein, 25 aa, Staphylococcus
EYSKDEIFQVYLNKIYYSDGVTGVK

SEQ ID NO: 1896111 - protein, 23 aa, Staphylococcus
EYSKNEILSFYINNIYYGDNQYT

SEQ ID NO: 1896112 - protein, 19 aa, Staphylococcus
EYVVPPLSLLNQPAKQQST

SEQ ID NO: 1896113 - protein, 24 aa, Staphylococcus
EYWLAIIFIYYFGVKWHLFPFVGS

SEQ ID NO: 1896114 - protein, 26 aa, Staphylococcus
FAAILMSLWVIFGLGLDIENMGHFLL

SEQ ID NO: 1896115 - protein, 20 aa, Staphylococcus
FAALFFVEFSLFRSAMGIAV

SEQ ID NO: 1896116 - protein, 25 aa, Staphylococcus
FAALIFIVMYLFFTISPAYILGKYS

SEQ ID NO: 1896117 - protein, 20 aa, Staphylococcus
FAALTTWLKGMQGANIIILA

SEQ ID NO: 1896118 - protein, 22 aa, Staphylococcus
FAAQLLAFLKWSNLGVIVAVKG

SEQ ID NO: 1896119 - protein, 21 aa, Staphylococcus
FACFAALIFWYPKMMGYKLNE

SEQ ID NO: 1896120 - protein, 31 aa, Staphylococcus
FADLAILLNINWLAILLYIEAVVSPFGTGVS

SEQ ID NO: 1896121 - protein, 30 aa, Staphylococcus; identical to SEQ ID NO: 1750831

SEQ ID NO: 1896122 - protein, 20 aa, Staphylococcus
FADMAILLGLNWLAILLYME

SEQ ID NO: 1896123 - protein, 31 aa, Staphylococcus
FADMAILLNLNWLAILLYIEAVVSPFGTGVS

SEQ ID NO: 1896124 - protein, 31 aa, Staphylococcus
FADMAILLSINWLAILLYIEAVVSPFGTGVS

SEQ ID NO: 1896125 - protein, 27 aa, Staphylococcus
FAEHFVNWMLISLILIIILALLVWRKK

SEQ ID NO: 1896126 - protein, 19 aa, Staphylococcus
FAERYLPFFTIGMGWIVPA

SEQ ID NO: 1896127 - protein, 17 aa, Staphylococcus
FAFSVSFFWIVDIVVRA

SEQ ID NO: 1896128 - protein, 33 aa, Staphylococcus
FAGVIVLLAFVLLVFVFRSILVPLKAVLGFVLS

SEQ ID NO: 1896129 - protein, 34 aa, Staphylococcus; identical to SEQ ID NO: 1750832

SEQ ID NO: 1896130 - protein, 33 aa, Staphylococcus
FAGVIVVLAFFLLMFVFRSILVPLKAVLGFILS

SEQ ID NO: 1896131 - protein, 32 aa, Staphylococcus
FAGVIVVLAFVLLMIVFRSILVPLKAVLGFIL

SEQ ID NO: 1896132 - protein, 19 aa, Staphylococcus
FAGWTLYGLISYRFDVNKP

SEQ ID NO: 1896133 - protein, 33 aa, Staphylococcus
FAHSNLIINIILIGAFILNLAFAFTIIFMERRS

SEQ ID NO: 1896134 - protein, 19 aa, Staphylococcus
FAIAFLLRPVGGIIFGIIG

SEQ ID NO: 1896135 - protein, 23 aa, Staphylococcus
FAIAIVFKLIYLAGAIQASQSLG

SEQ ID NO: 1896136 - protein, 17 aa, Staphylococcus
FAIILYGLKLNMGDILG

SEQ ID NO: 1896137 - protein, 20 aa, Staphylococcus
FAIIYNIWNFVYKAVQVTGL

SEQ ID NO: 1896138 - protein, 19 aa, Staphylococcus
FAIPFLFKRGVKSIEFMLL

SEQ ID NO: 1896139 - protein, 20 aa, Staphylococcus
FALHIIGFVFLWIAAKDAHI

SEQ ID NO: 1896140 - protein, 20 aa, Staphylococcus
FALIIPILAGFISRSIADKP

SEQ ID NO: 1896141 - protein, 19 aa, Staphylococcus
FALIIPILSGFIARSIADK

SEQ ID NO: 1896142 - protein, 30 aa, Staphylococcus
FALISITFAYSLKFLLKKLKQSYLSINKNY

SEQ ID NO: 1896143 - protein, 22 aa, Staphylococcus
FALLLTIVIIAPNSYASEYEPT

SEQ ID NO: 1896144 - protein, 19 aa, Staphylococcus
FALLLVYIMRGVLPGRFYL

SEQ ID NO: 1896145 - protein, 32 aa, Staphylococcus
FALSLLFYIIIFFVIYMFVLFLIGKLLSMFRK

SEQ ID NO: 1896146 - protein, 17 aa, Staphylococcus
FAMFGVGLILLVVTYLA

SEQ ID NO: 1896147 - protein, 19 aa, Staphylococcus
FAMTAFLLVLVYRTYRVTK

SEQ ID NO: 1896148 - protein, 18 aa, Staphylococcus
FANVYYHFNLKAHNDAKI

SEQ ID NO: 1896149 - protein, 22 aa, Staphylococcus
FAPILILAIIFFVHKMIKKTKF

SEQ ID NO: 1896150 - protein, 17 aa, Staphylococcus
FAPVLFPIIVWIVADAP

SEQ ID NO: 1896151 - protein, 27 aa, Staphylococcus
FASVDSWKMVWFVLGIVSLVLGLIVLV

SEQ ID NO: 1896152 - protein, 19 aa, Staphylococcus
FATALFIFVIFTLYRELAH

SEQ ID NO: 1896153 - protein, 35 aa, Staphylococcus
FATDTIPPTTPVINTRLVYKAGTLTPIDVSTDPNT

SEQ ID NO: 1896154 - protein, 17 aa, Staphylococcus
FATIGLIIGLLISVMIS

SEQ ID NO: 1896155 - protein, 21 aa, Staphylococcus
FATMLLLAILMSFVTAVFLTR

SEQ ID NO: 1896156 - protein, 27 aa, Staphylococcus
FATMLLLGILIIFVTAVFLSRGLLSLL

SEQ ID NO: 1896157 - protein, 33 aa, Staphylococcus
FATMLLLGILMIFITAVFLSRGLLSLLVSSNYF

SEQ ID NO: 1896158 - protein, 25 aa, Staphylococcus
FATMLLLGILMIFVTAVFLSRLLLS

SEQ ID NO: 1896159 - protein, 27 aa, Staphylococcus
FATMLLLGILMIFVTAVFLSRWLLSLL

SEQ ID NO: 1896160 - protein, 24 aa, Staphylococcus
FATTAFFLVLAFRSYKELGTDNVE

SEQ ID NO: 1896161 - protein, 18 aa, Staphylococcus
FAVIFITIQVILLNGLAS

SEQ ID NO: 1896162 - protein, 18 aa, Staphylococcus
FAVIFTYIFGDQSPFTYT

SEQ ID NO: 1896163 - protein, 18 aa, Staphylococcus
FAVIGIGALFFVVKYLPE

SEQ ID NO: 1896164 - protein, 18 aa, Staphylococcus
FAVLASLTLLPAFISIFH

SEQ ID NO: 1896165 - protein, 20 aa, Staphylococcus
FAVLFTFIFGDPSALTYTFS

SEQ ID NO: 1896166 - protein, 17 aa, Staphylococcus
FAVLSIVNFIGFAIAFF

SEQ ID NO: 1896167 - protein, 44 aa, Staphylococcus
FAYMPELNWHYGYFICLFVMLIISIILIIFFKRKNGFKPCNYKM

SEQ ID NO: 1896168 - protein, 24 aa, Staphylococcus
FCGGMLTVLLVWLMVKFQKKSGEV

SEQ ID NO: 1896169 - protein, 26 aa, Staphylococcus
FCIIMVFALLGFLPYNLNPAKVFMGD

SEQ ID NO: 1896170 - protein, 18 aa, Staphylococcus
FCIYVPYGDDWFSYFMRR

SEQ ID NO: 1896171 - protein, 17 aa, Staphylococcus
FCNFFINIGIFISLQFK

SEQ ID NO: 1896172 - protein, 19 aa, Staphylococcus
FCSRIDAFYQYRPPLERIL

SEQ ID NO: 1896173 - protein, 19 aa, Staphylococcus
FCVGFIMYTIVKIVFKNAN

SEQ ID NO: 1896174 - protein, 22 aa, Staphylococcus
FDAFIVRMTLIPALTKLFGNAS

SEQ ID NO: 1896175 - protein, 34 aa, Staphylococcus
FDFKAMWITLLLLSIVMIFLLIINIFKVTMQNPM

SEQ ID NO: 1896176 - protein, 33 aa, Staphylococcus
FDGKSYLTIAPWLFFFPGILLGGYALLFQIINN

SEQ ID NO: 1896177 - protein, 25 aa, Staphylococcus
FDGSRLLFIYAPVAILISLLSVTAS

SEQ ID NO: 1896178 - protein, 19 aa, Staphylococcus
FDHHNFMMLIIYGLTSYIL

SEQ ID NO: 1896179 - protein, 22 aa, Staphylococcus
FDHKYLVKYLGPYNFTVYDGVK

SEQ ID NO: 1896180 - protein, 26 aa, Staphylococcus
FDIHQFITFIFIWIGIALYSISQYIK

SEQ ID NO: 1896181 - protein, 25 aa, Staphylococcus
FDIHQFITFIFIWIGIALYSISQYV

SEQ ID NO: 1896182 - protein, 21 aa, Staphylococcus
FDINIWIMLLVTVILSMFGQL

SEQ ID NO: 1896183 - protein, 23 aa, Staphylococcus
FDIRDPYWKLIKENKRKIKRDYE

SEQ ID NO: 1896184 - protein, 21 aa, Staphylococcus
FDKAYWIPLSAHTLLLGTSTI

SEQ ID NO: 1896185 - protein, 26 aa, Staphylococcus
FDKLLHPLFELLHLPDALTTTISFVI

SEQ ID NO: 1896186 - protein, 32 aa, Staphylococcus
FDKMFPILMSFFVFLFVFLISGIALLRERTTG

SEQ ID NO: 1896187 - protein, 19 aa, Staphylococcus
FDLAYIEKLIIDIANKELK

SEQ ID NO: 1896188 - protein, 19 aa, Staphylococcus
FDLFIFSGVFFVLIISLSK

SEQ ID NO: 1896189 - protein, 25 aa, Staphylococcus
FDNQSDQQFPPRNAQRRQRRRNQAT

SEQ ID NO: 1896190 - protein, 24 aa, Staphylococcus
FDNYLLLLSPLLGGLFFVALGVLC

SEQ ID NO: 1896191 - protein, 25 aa, Staphylococcus
FDPVFALWFLLTLFFFHVILVIVKD

SEQ ID NO: 1896192 - protein, 23 aa, Staphylococcus
FDTELFMVTLIAPLLFVEGVNVS

SEQ ID NO: 1896193 - protein, 24 aa, Staphylococcus
FDVFFSLTWIIISLSLILNVIKAL

SEQ ID NO: 1896194 - protein, 24 aa, Staphylococcus
FDVFFTLTWIIISLSLILNLIKVL

SEQ ID NO: 1896195 - protein, 29 aa, Staphylococcus
FDVKGLSIFYIFIALLMFGLLNQQHLYLN

SEQ ID NO: 1896196 - protein, 18 aa, Staphylococcus
FDVLFALAWLIISISIVI

SEQ ID NO: 1896197 - protein, 20 aa, Staphylococcus
FDWQFLDYIVKFSGVLIVLS

SEQ ID NO: 1896198 - protein, 27 aa, Staphylococcus
FDYVQRFIQIKFFSEFISAIVVIGVAA

SEQ ID NO: 1896199 - protein, 20 aa, Staphylococcus
FEAKPKNTLLKLHPGRGEKV

SEQ ID NO: 1896200 - protein, 21 aa, Staphylococcus
FEFWFAMIKIVTIILMIIAGF

SEQ ID NO: 1896201 - protein, 27 aa, Staphylococcus
FEHIQISFIALLIAALIGVPLGIALTK

SEQ ID NO: 1896202 - protein, 17 aa, Staphylococcus
FEIFITTYLLKLISTIF

SEQ ID NO: 1896203 - protein, 23 aa, Staphylococcus
FEIFITTYLLKLLSTILNVPFGY

SEQ ID NO: 1896204 - protein, 24 aa, Staphylococcus
FEIIFGILLFWKRPCKWTKCVINA

SEQ ID NO: 1896205 - protein, 20 aa, Staphylococcus
FEIIPFIMTVLLMFAPMLAE

SEQ ID NO: 1896206 - protein, 20 aa, Staphylococcus
FELPLVLIMTFALLISSYTC

SEQ ID NO: 1896207 - protein, 20 aa, Staphylococcus
FELPLVLIMTFALLLSSYTC

SEQ ID NO: 1896208 - protein, 24 aa, Staphylococcus
FENNWMLPFLFIDIVILTPIIEEL

SEQ ID NO: 1896209 - protein, 24 aa, Staphylococcus
FEPALMAAISVLVIACPCSLGLAT

SEQ ID NO: 1896210 - protein, 25 aa, Staphylococcus
FEPALVAAIAVLVIACPCALGLATP

SEQ ID NO: 1896211 - protein, 24 aa, Staphylococcus
FEQIFSLLWVHCVVILLIIDIINA

SEQ ID NO: 1896212 - protein, 25 aa, Staphylococcus
FEQKWYQYVFLFTDMFLILCLSKAI

SEQ ID NO: 1896213 - protein, 24 aa, Staphylococcus
FEREDLGLLVDFLAELFKEEGHKL

SEQ ID NO: 1896214 - protein, 25 aa, Staphylococcus
FETSAILITLILFGKYLEARAKSQT

SEQ ID NO: 1896215 - protein, 24 aa, Staphylococcus
FEVDSLIFALFRITLDTVDVATFA

SEQ ID NO: 1896216 - protein, 20 aa, Staphylococcus
FEVGLVLLIPLVFTIAKRAK

SEQ ID NO: 1896217 - protein, 20 aa, Staphylococcus
FEVGLVLLIPLVFTIAKRAN

SEQ ID NO: 1896218 - protein, 20 aa, Staphylococcus
FEVGLVLLIPLVFTVAKRAN

SEQ ID NO: 1896219 - protein, 17 aa, Staphylococcus
FEWIGYNTKIFTYENVT

SEQ ID NO: 1896220 - protein, 17 aa, Staphylococcus
FFAIRLYTLYISIQHER

SEQ ID NO: 1896221 - protein, 18 aa, Staphylococcus
FFALAFVNALLYIIQYKN

SEQ ID NO: 1896222 - protein, 17 aa, Staphylococcus
FFCIRLISLKISINHSQ

SEQ ID NO: 1896223 - protein, 18 aa, Staphylococcus
FFEMMGTTGVRIFNNMLN

SEQ ID NO: 1896224 - protein, 23 aa, Staphylococcus
FFENLIVMAFLPFIALYLTDMVN

SEQ ID NO: 1896225 - protein, 21 aa, Staphylococcus
FFEVGLVLLIPLVFTIAKRAN

SEQ ID NO: 1896226 - protein, 21 aa, Staphylococcus
FFEVGLVLLIPLVFTVAKRAN

SEQ ID NO: 1896227 - protein, 26 aa, Staphylococcus
FFFEAIFLSIYLYTWDRFKGKWTHFL

SEQ ID NO: 1896228 - protein, 27 aa, Staphylococcus
FFFEAIFLSIYLYTWERFKNKWIHFVI

SEQ ID NO: 1896229 - protein, 26 aa, Staphylococcus
FFFEAIFLSIYLYTWNRFKNQWIHFL

SEQ ID NO: 1896230 - protein, 19 aa, Staphylococcus
FFFNWLIQRDVIPQNLMPS

SEQ ID NO: 1896231 - protein, 19 aa, Staphylococcus
FFFYTPYTLVYLVKFIFMA

SEQ ID NO: 1896232 - protein, 19 aa, Staphylococcus
FFGILLLNAFSITVLFTLC

SEQ ID NO: 1896233 - protein, 21 aa, Staphylococcus
FFGWFIIVIFQFFILHKIFYK

SEQ ID NO: 1896234 - protein, 27 aa, Staphylococcus
FFGWFVLVIFQFFILHIIFHKALDKMK

SEQ ID NO: 1896235 - protein, 22 aa, Staphylococcus
FFIFLMTVLQFLFLILIKGVRM

SEQ ID NO: 1896236 - protein, 19 aa, Staphylococcus
FFIGMLFTFCIAMLSLALS

SEQ ID NO: 1896237 - protein, 26 aa, Staphylococcus
FFIHNQWLLIISFIFIGINNLTMNTQ

SEQ ID NO: 1896238 - protein, 20 aa, Staphylococcus
FFIMNFILISYLYDKQYVPF

SEQ ID NO: 1896239 - protein, 21 aa, Staphylococcus
FFITLLIVVMPLIKRAVFKSI

SEQ ID NO: 1896240 - protein, 18 aa, Staphylococcus
FFIWKAEGNLFIIFLYCL

SEQ ID NO: 1896241 - protein, 20 aa, Staphylococcus
FFKGKFFIILTAIAAAFFIV

SEQ ID NO: 1896242 - protein, 18 aa, Staphylococcus
FFKQMFPPEWSYLKAIWQ

SEQ ID NO: 1896243 - protein, 23 aa, Staphylococcus
FFLGTILIYVFAQKWNLLPSSGL

SEQ ID NO: 1896244 - protein, 21 aa, Staphylococcus
FFLIAFILLIPVIILGFLGKR

SEQ ID NO: 1896245 - protein, 19 aa, Staphylococcus
FFLIAFIVLIPVIILGFLG

SEQ ID NO: 1896246 - protein, 20 aa, Staphylococcus
FFLIAFIVLLPVIILGFLGK

SEQ ID NO: 1896247 - protein, 19 aa, Staphylococcus
FFLIAFIVLLPVIIMGLVG

SEQ ID NO: 1896248 - protein, 17 aa, Staphylococcus
FFLILRMSDSMTPDMMK

SEQ ID NO: 1896249 - protein, 31 aa, Staphylococcus
FFLIVIPIIIFLIFLAFVFVISIVLICLPIL

SEQ ID NO: 1896250 - protein, 19 aa, Staphylococcus
FFLIYMLKDHEKFIPSIAK

SEQ ID NO: 1896251 - protein, 18 aa, Staphylococcus
FFLIYVFAFTVLDSPERK

SEQ ID NO: 1896252 - protein, 19 aa, Staphylococcus
FFLLAPLFVAMVAGIAFLK

SEQ ID NO: 1896253 - protein, 19 aa, Staphylococcus
FFLLAPLFVAMVAGIVFLK

SEQ ID NO: 1896254 - protein, 20 aa, Staphylococcus
FFLLAPLFVAMVAGIVFLKV

SEQ ID NO: 1896255 - protein, 19 aa, Staphylococcus
FFLLAPLFVSMVVGIVFLK

SEQ ID NO: 1896256 - protein, 19 aa, Staphylococcus
FFNQYLILTLIALIMIYLL

SEQ ID NO: 1896257 - protein, 21 aa, Staphylococcus
FFPFFLCIGILYLSISIQYSL

SEQ ID NO: 1896258 - protein, 24 aa, Staphylococcus
FFPYHFYLIFLLYTLLIAIIVSSI

SEQ ID NO: 1896259 - protein, 18 aa, Staphylococcus
FFRSSVSLVLKLLKRFKQ

SEQ ID NO: 1896260 - protein, 17 aa, Staphylococcus
FFRSTVSLLFKTLKKRK

SEQ ID NO: 1896261 - protein, 26 aa, Staphylococcus
FFSDVFIFMPLLLLSIERYLTCKKIG

SEQ ID NO: 1896262 - protein, 25 aa, Staphylococcus
FFSDVFIWMPLLLFSIERTLQKQKF

SEQ ID NO: 1896263 - protein, 18 aa, Staphylococcus
FFSFFGMALIMSCHLAPF

SEQ ID NO: 1896264 - protein, 28 aa, Staphylococcus
FFSPVTWSIIFLCLLFLLNIFSVKAFGE

SEQ ID NO: 1896265 - protein, 27 aa, Staphylococcus
FFSSFIVLLFPIYFLSLAQTPGMLMTS

SEQ ID NO: 1896266 - protein, 23 aa, Staphylococcus
FFSSIFIFLYTQAQTWKATWIIL

SEQ ID NO: 1896267 - protein, 23 aa, Staphylococcus
FFSVRLLLSIVFINLTSAVGMHL

SEQ ID NO: 1896268 - protein, 21 aa, Staphylococcus
FFSWRMPFYIVAAIALIAFAI

SEQ ID NO: 1896269 - protein, 26 aa, Staphylococcus
FFTLFLNFIILIISIILIIFGVPIYL

SEQ ID NO: 1896270 - protein, 18 aa, Staphylococcus
FFTTVFCMLLNLTPIFAI

SEQ ID NO: 1896271 - protein, 19 aa, Staphylococcus
FFVFYLTVIVSCLVAAIIM

SEQ ID NO: 1896272 - protein, 25 aa, Staphylococcus
FFVSIFLVFLFIIAILEIGAMVDTG

SEQ ID NO: 1896273 - protein, 24 aa, Staphylococcus
FFVTFIVMVLMYRCFGKQGLIAWV

SEQ ID NO: 1896274 - protein, 27 aa, Staphylococcus
FGAAFSPLVLFSLYWKKLTREGAISGM

SEQ ID NO: 1896275 - protein, 39 aa, Staphylococcus
FGAILALMKLSSFKPLKWLATVYIEFIRGTPLLVQVFLV

SEQ ID NO: 1896276 - protein, 17 aa, Staphylococcus
FGALFQVFFFDKFMKFT

SEQ ID NO: 1896277 - protein, 23 aa, Staphylococcus
FGASFLFNWLIKHDLIPQSLMPP

SEQ ID NO: 1896278 - protein, 24 aa, Staphylococcus
FGCFSSIFISIVLSIILTFLLNWI

SEQ ID NO: 1896279 - protein, 25 aa, Staphylococcus
FGCPEKFYHRLPDKSWFVSATATTN

SEQ ID NO: 1896280 - protein, 18 aa, Staphylococcus
FGDGLVSIFTQLMPLFKW

SEQ ID NO: 1896281 - protein, 21 aa, Staphylococcus
FGDWVVQIPMPILAAIMVMVS

SEQ ID NO: 1896282 - protein, 20 aa, Staphylococcus
FGEKGVLLVAPFFSLVILFS

SEQ ID NO: 1896283 - protein, 19 aa, Staphylococcus
FGFILLIPILYKGVRHFKY

SEQ ID NO: 1896284 - protein, 29 aa, Staphylococcus
FGFIVLIFAILVLRLGYLQIAQGSHYKQL

SEQ ID NO: 1896285 - protein, 20 aa, Staphylococcus
FGFMVPILAAYIAYSIADKP

SEQ ID NO: 1896286 - protein, 23 aa, Staphylococcus
FGFQYVNFLILTWTPKYLQDEYH

SEQ ID NO: 1896287 - protein, 24 aa, Staphylococcus
FGFQYVNFLILTWTPKYLQDEYHF

SEQ ID NO: 1896288 - protein, 52 aa, Staphylococcus
FGGGLIGYYLLELFIPLISIIGVFIITVLLVASSIILLFNLRHRDVTKKVFE

SEQ ID NO: 1896289 - protein, 21 aa, Staphylococcus
FGGIFLLNAILSGIGLYLLSK

SEQ ID NO: 1896290 - protein, 26 aa, Staphylococcus
FGGQLTLFFWFFKLNYSFGHIINSKI

SEQ ID NO: 1896291 - protein, 29 aa, Staphylococcus
FGGTVFILLFTLVLQIFFYKDLNLSAKEQ

SEQ ID NO: 1896292 - protein, 26 aa, Staphylococcus
FGIAFYLMFLILFLFAALTSSISLLE

SEQ ID NO: 1896293 - protein, 18 aa, Staphylococcus
FGIILCIVLWKLCQKKGL

SEQ ID NO: 1896294 - protein, 20 aa, Staphylococcus
FGIILFYSYIKSGNIFVPAI

SEQ ID NO: 1896295 - protein, 18 aa, Staphylococcus
FGILLLKSFSINLLFLIC

SEQ ID NO: 1896296 - protein, 17 aa, Staphylococcus
FGILSIPITIIWIVAIT

SEQ ID NO: 1896297 - protein, 17 aa, Staphylococcus
FGIPMFIGALITGMIAS

SEQ ID NO: 1896298 - protein, 32 aa, Staphylococcus
FGIRKFAIGIGSVALATVVFLGANQDAYASET

SEQ ID NO: 1896299 - protein, 26 aa, Staphylococcus
FGISPIFIFVLLFLNAIFDGFTNPIK

SEQ ID NO: 1896300 - protein, 26 aa, Staphylococcus
FGLHHIFYLPFWQTALGDSLEVKGHM

SEQ ID NO: 1896301 - protein, 26 aa, Staphylococcus
FGLHHIFYLPFWQTGLGGSLEVNGHM

SEQ ID NO: 1896302 - protein, 26 aa, Staphylococcus
FGLIAIMLIVCIVLVVAMMAGGKKET

SEQ ID NO: 1896303 - protein, 25 aa, Staphylococcus
FGLIAIMLVLCIVLVIMMMVGGKKD

SEQ ID NO: 1896304 - protein, 17 aa, Staphylococcus
FGLIFGGLGLISMFFIH

SEQ ID NO: 1896305 - protein, 17 aa, Staphylococcus
FGLILGVLLFLSAKSHS

SEQ ID NO: 1896306 - protein, 17 aa, Staphylococcus
FGLLLINSFPIKLLFTI

SEQ ID NO: 1896307 - protein, 28 aa, Staphylococcus
FGLSIFTAILPVLLMLFSTIVQLITGHS

SEQ ID NO: 1896308 - protein, 37 aa, Staphylococcus
FGLVFGFVLMFVLKYTPLAWLIPYIDPGMVLLAGIIL

SEQ ID NO: 1896309 - protein, 17 aa, Staphylococcus
FGLVFITVVIYGFSFLP

SEQ ID NO: 1896310 - protein, 18 aa, Staphylococcus
FGMNGGFKHHATGTKNYK

SEQ ID NO: 1896311 - protein, 24 aa, Staphylococcus
FGMTAFLLVLIYRTYRVTKEDEIN

SEQ ID NO: 1896312 - protein, 25 aa, Staphylococcus
FGNASWYLPKWLGVILPKIDVEGKA

SEQ ID NO: 1896313 - protein, 17 aa, Staphylococcus
FGNYRFLEKIMLVLMVI

SEQ ID NO: 1896314 - protein, 34 aa, Staphylococcus
FGNYRTYYLSLWYFITFGAFVAFGLFLPNYLVHH

SEQ ID NO: 1896315 - protein, 30 aa, Staphylococcus
FGPFGAFLYGFFNRLLIPTGLHHALNSVFW

SEQ ID NO: 1896316 - protein, 27 aa, Staphylococcus
FGPKKILIFGLLFLVITQLLYFVPGPL

SEQ ID NO: 1896317 - protein, 25 aa, Staphylococcus
FGPKKILITGLLLLVITQLLYFIPG

SEQ ID NO: 1896318 - protein, 19 aa, Staphylococcus
FGPLVVMSLYWKGLSRTGA

SEQ ID NO: 1896319 - protein, 27 aa, Staphylococcus
FGPRKMISIALLWWSAFTILTGMIKHH

SEQ ID NO: 1896320 - protein, 28 aa, Staphylococcus
FGQAFYPKKIWIAIKFLGVYLYQLITSS

SEQ ID NO: 1896321 - protein, 25 aa, Staphylococcus
FGQQFYLKKVWVGIKFLAVYLYQLI

SEQ ID NO: 1896322 - protein, 19 aa, Staphylococcus
FGQYAMLFLAPTGLIMATL

SEQ ID NO: 1896323 - protein, 17 aa, Staphylococcus
FGQYAMLFLAPTGLVMA

SEQ ID NO: 1896324 - protein, 18 aa, Staphylococcus
FGQYAMLFLAPTGLVMAT

SEQ ID NO: 1896325 - protein, 36 aa, Staphylococcus
FGSAFTFIGLLLLSLTFLPDIWYIISSVVGYLLFGT

SEQ ID NO: 1896326 - protein, 19 aa, Staphylococcus
FGSIFILNALLSGIGLYLL

SEQ ID NO: 1896327 - protein, 27 aa, Staphylococcus
FGSIVSFIFLLLLLVPGSPASLSMPSY

SEQ ID NO: 1896328 - protein, 24 aa, Staphylococcus
FGSKILLMIVLRLLGINISVSIIF

SEQ ID NO: 1896329 - protein, 24 aa, Staphylococcus
FGSKILLMIVLRLLGINITVSIIF

SEQ ID NO: 1896330 - protein, 27 aa, Staphylococcus
FGSNADDNYFRYGGYNEYVKTESNQRR

SEQ ID NO: 1896331 - protein, 21 aa, Staphylococcus
FGSTALWIGAGLMSLAVLFSI

SEQ ID NO: 1896332 - protein, 21 aa, Staphylococcus
FGTFLFVKLIEMIRVKEVIFV

SEQ ID NO: 1896333 - protein, 24 aa, Staphylococcus
FGTYAWIFLLIIGFMKLSKIPFGF

SEQ ID NO: 1896334 - protein, 20 aa, Staphylococcus
FGVLVGIPVAFIVWMVTFFA

SEQ ID NO: 1896335 - protein, 27 aa, Staphylococcus
FGVNQTWLLIVFVLVIIINASWNTISR

SEQ ID NO: 1896336 - protein, 37 aa, Staphylococcus
FGWIILLILMFMFLAKIKLWFLIKGLTPIFIFTIFTF

SEQ ID NO: 1896337 - protein, 22 aa, Staphylococcus
FGWRSIFIISIILTILAMFLMK

SEQ ID NO: 1896338 - protein, 28 aa, Staphylococcus
FGYMLISLFIIMTITFFLMKLMPGSPFN

SEQ ID NO: 1896339 - protein, 24 aa, Staphylococcus
FGYVLGFLLPFIESFIPVLPLFVF

SEQ ID NO: 1896340 - protein, 29 aa, Staphylococcus
FHAIRIPVFFGILLYIALQLIVLMIYGEM

SEQ ID NO: 1896341 - protein, 24 aa, Staphylococcus
FHEIILIIYILSIVFYFIDFISKS

SEQ ID NO: 1896342 - protein, 34 aa, Staphylococcus
FHENRNLFWLFLILLLVLFVLLQIRIFSIKEENI

SEQ ID NO: 1896343 - protein, 18 aa, Staphylococcus
FHIPTWLGALIMTIVIYL

SEQ ID NO: 1896344 - protein, 26 aa, Staphylococcus
FHLSPAWIIPIAFLSAVSILAFNCMG

SEQ ID NO: 1896345 - protein, 17 aa, Staphylococcus
FHMIWHIFIVIASVLHM

SEQ ID NO: 1896346 - protein, 18 aa, Staphylococcus
FHNYFAIIFIFIVGVLLL

SEQ ID NO: 1896347 - protein, 21 aa, Staphylococcus
FHVEYWFLGIGLSIVILALGR

SEQ ID NO: 1896348 - protein, 26 aa, Staphylococcus
FIAARIYFVIFQWPYYAQNPIEIPMI

SEQ ID NO: 1896349 - protein, 34 aa, Staphylococcus
FIAEHKWVSIIAWLLILGVIVTPLLISAPKFDSN

SEQ ID NO: 1896350 - protein, 18 aa, Staphylococcus
FIAIIVLSLIFYKIGSSS

SEQ ID NO: 1896351 - protein, 29 aa, Staphylococcus
FIAKNKWLSVIGWLVILGVIITPLMINSP

SEQ ID NO: 1896352 - protein, 24 aa, Staphylococcus
FIALIISFVLLVFSFNPFTLLLAG

SEQ ID NO: 1896353 - protein, 18 aa, Staphylococcus
FIAPIFLYLIWVVGIYIY

SEQ ID NO: 1896354 - protein, 18 aa, Staphylococcus
FIASLVCILVFKYKKEQL

SEQ ID NO: 1896355 - protein, 17 aa, Staphylococcus
FIATLIIYFPFIKDWIS

SEQ ID NO: 1896356 - protein, 33 aa, Staphylococcus
FIAVNFGWYYLLLVLFILIVCVYLLFSRYSSIT

SEQ ID NO: 1896357 - protein, 18 aa, Staphylococcus
FIAWGFIAAIFIDNGWYP

SEQ ID NO: 1896358 - protein, 22 aa, Staphylococcus
FIDYILYGLLSWDRSNALLVIP

SEQ ID NO: 1896359 - protein, 23 aa, Staphylococcus
FIDYPLLIAYVILCLIGLVMVYS

SEQ ID NO: 1896360 - protein, 20 aa, Staphylococcus
FIDYPLLVTYVILCLIGLVM

SEQ ID NO: 1896361 - protein, 18 aa, Staphylococcus
FIEQVFGPLFHKIGADPA

SEQ ID NO: 1896362 - protein, 20 aa, Staphylococcus
FIEYFLKMIIPNLFSLIASI

SEQ ID NO: 1896363 - protein, 18 aa, Staphylococcus
FIFFSMISDQIFFKKVNE

SEQ ID NO: 1896364 - protein, 19 aa, Staphylococcus
FIFFTMISDQIFFKKVNEE

SEQ ID NO: 1896365 - protein, 19 aa, Staphylococcus
FIFLAIFYGVYFIKLRRHR

SEQ ID NO: 1896366 - protein, 31 aa, Staphylococcus
FIFPLLLLLIVLAICLMVYHTYFNQPKSSPT

SEQ ID NO: 1896367 - protein, 26 aa, Staphylococcus
FIFTFYFIIIYIIIWIIEFLKSRKYV

SEQ ID NO: 1896368 - protein, 26 aa, Staphylococcus
FIFTTILIVIAFILCLFIKDKTKTSR

SEQ ID NO: 1896369 - protein, 18 aa, Staphylococcus
FIFVLLSLVGHSYVIYKF

SEQ ID NO: 1896370 - protein, 17 aa, Staphylococcus
FIFVMPIFRYKNFRYAI

SEQ ID NO: 1896371 - protein, 24 aa, Staphylococcus
FIGALLLAFYFYRDNPDLKNALMQ

SEQ ID NO: 1896372 - protein, 26 aa, Staphylococcus
FIGGPGAVFWMWITAFLGASSAFIES

SEQ ID NO: 1896373 - protein, 26 aa, Staphylococcus
FIGILILSFLLILWGNYLQIIPVNSK

SEQ ID NO: 1896374 - protein, 19 aa, Staphylococcus
FIGLAILCFVLYIAFGKYG

SEQ ID NO: 1896375 - protein, 22 aa, Staphylococcus
FIGLILLFIFNQKLNLLPTSEE

SEQ ID NO: 1896376 - protein, 42 aa, Staphylococcus
FIGRKYKSVLNWSLNHKWIVIIVSTIILIASIGLGAAKLGTS

SEQ ID NO: 1896377 - protein, 18 aa, Staphylococcus
FIGSMLFGLFFGAGNLIF

SEQ ID NO: 1896378 - protein, 25 aa, Staphylococcus
FIGWLIYFIFLLIYHVFKPLYKISY

SEQ ID NO: 1896379 - protein, 31 aa, Staphylococcus
FIHLRRASLQYSFLLNFFAAAIACGFFLFMF

SEQ ID NO: 1896380 - protein, 17 aa, Staphylococcus
FIIAMLVFSITSLFVGI

SEQ ID NO: 1896381 - protein, 17 aa, Staphylococcus
FIIAWVIVGLAQGMFYG

SEQ ID NO: 1896382 - protein, 18 aa, Staphylococcus
FIIAYLLKLLYNVTFIQL

SEQ ID NO: 1896383 - protein, 18 aa, Staphylococcus
FIIELPTYRIPSIKTLWR

SEQ ID NO: 1896384 - protein, 19 aa, Staphylococcus
FIIFALIFVFMVPNTLYMV

SEQ ID NO: 1896385 - protein, 26 aa, Staphylococcus
FIIFLGITQINWWFVIALSVGGMIAA

SEQ ID NO: 1896386 - protein, 19 aa, Staphylococcus
FIIGIIFITLFVIRELRMK

SEQ ID NO: 1896387 - protein, 30 aa, Staphylococcus
FIIHFASWRWIFFINIFIVIIAIPLMNKYV

SEQ ID NO: 1896388 - protein, 28 aa, Staphylococcus
FIIHFASWRWMFFINIVVSLISVLLMMK

SEQ ID NO: 1896389 - protein, 17 aa, Staphylococcus
FIILTVIVMVWSSPSFK

SEQ ID NO: 1896390 - protein, 31 aa, Staphylococcus
FIINTILVGALLAIIITALVLLFKDKRQKQH

SEQ ID NO: 1896391 - protein, 25 aa, Staphylococcus
FIINVLIISFVKLFISLDTHQVMFW

SEQ ID NO: 1896392 - protein, 19 aa, Staphylococcus
FIKKPLRTLTWLMAIIVYL

SEQ ID NO: 1896393 - protein, 20 aa, Staphylococcus
FILAFIWIFLSGSYTLNNLL

SEQ ID NO: 1896394 - protein, 22 aa, Staphylococcus
FILAFNIFFVLCIGSMIISILT

SEQ ID NO: 1896395 - protein, 20 aa, Staphylococcus
FILAIIILTIIVSITTAIIE

SEQ ID NO: 1896396 - protein, 19 aa, Staphylococcus
FILALVVISYIIFSPLVLA

SEQ ID NO: 1896397 - protein, 42 aa, Staphylococcus
FILAYGFYLLSWLPVLFLNGLFLWLCWIAVSTLFALIHYLSW

SEQ ID NO: 1896398 - protein, 19 aa, Staphylococcus
FILFLLMIVFGGTKGLISF

SEQ ID NO: 1896399 - protein, 23 aa, Staphylococcus
FILGGFFIRALDYVIPHIHQNAQ

SEQ ID NO: 1896400 - protein, 21 aa, Staphylococcus
FILGLLLLIPSLILLLRLFVF

SEQ ID NO: 1896401 - protein, 21 aa, Staphylococcus
FILGLLLLLPSLILLLRLFVF

SEQ ID NO: 1896402 - protein, 18 aa, Staphylococcus
FILIPTLIVGMILMLILV

SEQ ID NO: 1896403 - protein, 18 aa, Staphylococcus
FILLIVLLFLLKIGHHER

SEQ ID NO: 1896404 - protein, 27 aa, Staphylococcus
FILMRKNLLKRYVLSVLIFFILSMVIS

SEQ ID NO: 1896405 - protein, 17 aa, Staphylococcus
FILPLVIGILIAVLAPF

SEQ ID NO: 1896406 - protein, 19 aa, Staphylococcus
FILSKFILYLILTVFDKMT

SEQ ID NO: 1896407 - protein, 24 aa, Staphylococcus
FILSLFVWFFAYIVIAYVVAYLRA

SEQ ID NO: 1896408 - protein, 26 aa, Staphylococcus
FILSNIYYHIYLKPSNDHKIMTTLQE

SEQ ID NO: 1896409 - protein, 24 aa, Staphylococcus
FILTLIFIIWQPKGLDIGVTALIG

SEQ ID NO: 1896410 - protein, 17 aa, Staphylococcus
FIMNLIMPSLDKDLMRY

SEQ ID NO: 1896411 - protein, 23 aa, Staphylococcus
FIMTLIFIIWQPKGLDVGITAII

SEQ ID NO: 1896412 - protein, 18 aa, Staphylococcus
FIMYTIVKIVFKNANLTR

SEQ ID NO: 1896413 - protein, 25 aa, Staphylococcus
FINFLPLIVLAIIFFIHKLIRKTKY

SEQ ID NO: 1896414 - protein, 17 aa, Staphylococcus
FINIILTLYYIYPIFYD

SEQ ID NO: 1896415 - protein, 17 aa, Staphylococcus
FINIIQFTVALFIDSRY

SEQ ID NO: 1896416 - protein, 30 aa, Staphylococcus
FINLKIPNWLRRLITRLIAILPIIICLIVF

SEQ ID NO: 1896417 - protein, 19 aa, Staphylococcus
FINSVFAGLLIGIGTGLVI

SEQ ID NO: 1896418 - protein, 33 aa, Staphylococcus
FINTQIATTFLMDIVCYLLLNNDYMHKSYQHTR

SEQ ID NO: 1896419 - protein, 30 aa, Staphylococcus
FIPAIILSLLILFFYLFSDGLRDAFDPKMR

SEQ ID NO: 1896420 - protein, 26 aa, Staphylococcus
FIPYVLWMILFIIVPVLLLVYFSLFD

SEQ ID NO: 1896421 - protein, 19 aa, Staphylococcus
FIQIALGVALFILPIPLHF

SEQ ID NO: 1896422 - protein, 20 aa, Staphylococcus
FIQIILGMILFILPVPVEFN

SEQ ID NO: 1896423 - protein, 19 aa, Staphylococcus
FIQITFGMLLFLTPVPVEF

SEQ ID NO: 1896424 - protein, 17 aa, Staphylococcus
FIQIWPYVEGKIQTKNS

SEQ ID NO: 1896425 - protein, 23 aa, Staphylococcus
FIQNFFMLAFFTTIGLGASLKLL

SEQ ID NO: 1896426 - protein, 20 aa, Staphylococcus
FIRKPLRIYTWIMALIVYMT

SEQ ID NO: 1896427 - protein, 18 aa, Staphylococcus
FIRTIITIVLALPLILIL

SEQ ID NO: 1896428 - protein, 26 aa, Staphylococcus
FISGLPYFILFLSCFILVIFIIFHIS

SEQ ID NO: 1896429 - protein, 27 aa, Staphylococcus
FISIYPQYFFFALIFFIVGWLTIRSTI

SEQ ID NO: 1896430 - protein, 24 aa, Staphylococcus
FISKRTYQGIFSFDVLGLQDIHKN

SEQ ID NO: 1896431 - protein, 34 aa, Staphylococcus
FISNSFGWLFLLIIFILDIFLISLAISRYGRFKL

SEQ ID NO: 1896432 - protein, 32 aa, Staphylococcus
FISNTFGWLFLLIIFILDIFLISLATSRYGRF

SEQ ID NO: 1896433 - protein, 17 aa, Staphylococcus
FISSILIALVSGYVGRY

SEQ ID NO: 1896434 - protein, 33 aa, Staphylococcus
FISTLIIWILGILLLLTFSYWIRLLHAQPTRLT

SEQ ID NO: 1896435 - protein, 17 aa, Staphylococcus
FISVVLLRPLIDELLFR

SEQ ID NO: 1896436 - protein, 22 aa, Staphylococcus
FISYPCYIIWINPTSHKRSKYY

SEQ ID NO: 1896437 - protein, 44 aa, Staphylococcus
FITALKKNWKLFILIPVVFVVISLLITIFLMKPKYEANTQVLVN

SEQ ID NO: 1896438 - protein, 25 aa, Staphylococcus
FITARIYFVIFQWPYYAANPAEIPM

SEQ ID NO: 1896439 - protein, 24 aa, Staphylococcus
FITAYLIIFIYFLALTSRKLVPIL

SEQ ID NO: 1896440 - protein, 29 aa, Staphylococcus
FITETFGWYYMLLISIILIFCITLIFHPI

SEQ ID NO: 1896441 - protein, 20 aa, Staphylococcus
FITFMWIMFTFIHAIKNYSD

SEQ ID NO: 1896442 - protein, 17 aa, Staphylococcus
FITIIALFSFKLYRHYY

SEQ ID NO: 1896443 - protein, 24 aa, Staphylococcus
FITIPIFIAIIMPLGRIMQHISKN

SEQ ID NO: 1896444 - protein, 19 aa, Staphylococcus
FITITFLILVANSATFVYI

SEQ ID NO: 1896445 - protein, 18 aa, Staphylococcus
FITIVFLLNIFTVKAFGE

SEQ ID NO: 1896446 - protein, 28 aa, Staphylococcus
FITIVLFCLVIIFFLKDALHDSELDEAE

SEQ ID NO: 1896447 - protein, 22 aa, Staphylococcus
FITLFSVYLIIGLSLPLVNIPY

SEQ ID NO: 1896448 - protein, 23 aa, Staphylococcus
FITMSILGIILFLIPIPVVQDGQ

SEQ ID NO: 1896449 - protein, 19 aa, Staphylococcus
FITMSLIGIILFLIPIPVE

SEQ ID NO: 1896450 - protein, 18 aa, Staphylococcus
FITPVIITFVLAFGLSAF

SEQ ID NO: 1896451 - protein, 18 aa, Staphylococcus
FITRFIGPYFKLINKSWH

SEQ ID NO: 1896452 - protein, 24 aa, Staphylococcus
FITTFPIFLLIRLVQGLTAGGIIV

SEQ ID NO: 1896453 - protein, 30 aa, Staphylococcus
FIVFFIFLIRLIYLAIKGKPKKSAAITLVA

SEQ ID NO: 1896454 - protein, 21 aa, Staphylococcus
FIVFNIPIQVLLLISSAYAAL

SEQ ID NO: 1896455 - protein, 18 aa, Staphylococcus
FIVGTGISLLITVILGFF

SEQ ID NO: 1896456 - protein, 27 aa, Staphylococcus
FIVISTIIFLFIGKPVSLLIIAGVING

SEQ ID NO: 1896457 - protein, 27 aa, Staphylococcus
FIVISTIIFLLIGKPISLLIIAGAING

SEQ ID NO: 1896458 - protein, 17 aa, Staphylococcus
FIVLLPVIILGFLGKRS

SEQ ID NO: 1896459 - protein, 23 aa, Staphylococcus
FIVMMLVLNFILSGTIMLLIGLF

SEQ ID NO: 1896460 - protein, 18 aa, Staphylococcus
FIVMYPFLIAIAQRSLFK

SEQ ID NO: 1896461 - protein, 35 aa, Staphylococcus
FIVNIIIMIFLLGALLLGIIWLIKDKRQTQHSVLR

SEQ ID NO: 1896462 - protein, 37 aa, Staphylococcus
FIVNIIIMIVLLGIVIMSLIWLFKDKGQDQHSVLRNF

SEQ ID NO: 1896463 - protein, 30 aa, Staphylococcus
FIVNIIIVFFLFSVLVMGAVLLFKDKRQKQ

SEQ ID NO: 1896464 - protein, 34 aa, Staphylococcus
FIVNLFRAIPFIILILLLIPFTSLILGTISGPTG

SEQ ID NO: 1896465 - protein, 33 aa, Staphylococcus
FIVNLFRAIPFIILILLLIPFTSLVLGTISGPT

SEQ ID NO: 1896466 - protein, 33 aa, Staphylococcus; identical to SEQ ID NO: 1750925

SEQ ID NO: 1896467 - protein, 33 aa, Staphylococcus
FIVNLFRAIPFIILILLLIPFTSVVLGTISGPT

SEQ ID NO: 1896468 - protein, 25 aa, Staphylococcus
FIVSYLMLVIYYYRFNNNVIYSLLV

SEQ ID NO: 1896469 - protein, 26 aa, Staphylococcus
FIVTFILMVLMYRFFGKHGLIAWVAM

SEQ ID NO: 1896470 - protein, 20 aa, Staphylococcus
FIWLAIFFSILGLTQPLIDN

SEQ ID NO: 1896471 - protein, 25 aa, Staphylococcus
FIYLDKWWIVIFIFIAQVILSLSYQ

SEQ ID NO: 1896472 - protein, 17 aa, Staphylococcus
FKAFMHHHPFFGTLLHV

SEQ ID NO: 1896473 - protein, 19 aa, Staphylococcus
FKDIFPFSAVILILYGIDL

SEQ ID NO: 1896474 - protein, 22 aa, Staphylococcus
FKDILKDFLYLLKKPTFVIPML

SEQ ID NO: 1896475 - protein, 24 aa, Staphylococcus
FKDKALFIPFIAFILLHIGQWMYT

SEQ ID NO: 1896476 - protein, 23 aa, Staphylococcus
FKELWLPILTICFILAISKITTY

SEQ ID NO: 1896477 - protein, 17 aa, Staphylococcus
FKFGNIGYRERLDFMTK

SEQ ID NO: 1896478 - protein, 25 aa, Staphylococcus
FKIAFFLFPFIFYLNTITYIYHAYF

SEQ ID NO: 1896479 - protein, 18 aa, Staphylococcus
FKIIFNVIFIYFMGILGA

SEQ ID NO: 1896480 - protein, 19 aa, Staphylococcus
FKIIGLTVCLFLFGLGGVI

SEQ ID NO: 1896481 - protein, 18 aa, Staphylococcus
FKIIRISYIINAFNAIIG

SEQ ID NO: 1896482 - protein, 17 aa, Staphylococcus
FKILDHYQPYVVYHAAA

SEQ ID NO: 1896483 - protein, 24 aa, Staphylococcus
FKILIYLTFIQLIGVLLIVFTLIL

SEQ ID NO: 1896484 - protein, 26 aa, Staphylococcus
FKISAIFLIIFFLLNYFSVKNPNLIP

SEQ ID NO: 1896485 - protein, 19 aa, Staphylococcus
FKIVGLTICLFMFGLGGVL

SEQ ID NO: 1896486 - protein, 25 aa, Staphylococcus
FKLSYLYNISIILLSILVSIVFIKN

SEQ ID NO: 1896487 - protein, 28 aa, Staphylococcus
FKLYKHYYFRLFAIMTWIFLIGSFTNGF

SEQ ID NO: 1896488 - protein, 28 aa, Staphylococcus
FKLYRHYYYRLFALMTVVLIIFTFIPLI

SEQ ID NO: 1896489 - protein, 26 aa, Staphylococcus
FKMDIQWPFWISQLGLILLGVQIGST

SEQ ID NO: 1896490 - protein, 17 aa, Staphylococcus
FKNAFKELWLPIITICF

SEQ ID NO: 1896491 - protein, 33 aa, Staphylococcus
FKNFLKYLETNGPIVWQLLKNIGSIIVGLIKGM

SEQ ID NO: 1896492 - protein, 29 aa, Staphylococcus
FKNITFIALFFPIVILAVPFIDTIFAMIR

SEQ ID NO: 1896493 - protein, 24 aa, Staphylococcus
FKNKLWINIVSWTLIVILSALNIH

SEQ ID NO: 1896494 - protein, 24 aa, Staphylococcus
FKNKPYIILMLAFSFVFMAEASLD

SEQ ID NO: 1896495 - protein, 23 aa, Staphylococcus
FKNKWIHFVIGLPVIIGGSFSAF

SEQ ID NO: 1896496 - protein, 23 aa, Staphylococcus
FKNQWIHFLISLPVIIGGSFSAF

SEQ ID NO: 1896497 - protein, 30 aa, Staphylococcus
FKNYALYLFSLIFSIILYFSFVTLQYTHSI

SEQ ID NO: 1896498 - protein, 28 aa, Staphylococcus
FKPIHMLLRLFMLLVLISGFWVWIQSFS

SEQ ID NO: 1896499 - protein, 26 aa, Staphylococcus
FKPQKITLILWIVSLLSLVTMAIIFG

SEQ ID NO: 1896500 - protein, 32 aa, Staphylococcus
FKRTRISMFIWLVLLLPLPFLLSSLGTTFVVL

SEQ ID NO: 1896501 - protein, 27 aa, Staphylococcus
FKSKIVCGFLNWLGHLFSDVAGSSGTR

SEQ ID NO: 1896502 - protein, 33 aa, Staphylococcus
FKTNKTRFWIILITILVLFLAAQVRIFTIKEDN

SEQ ID NO: 1896503 - protein, 30 aa, Staphylococcus
FKVIITILIILLVLIVAAAIFVFTKLHSLN

SEQ ID NO: 1896504 - protein, 36 aa, Staphylococcus
FKVIITILILLFVVLIGIVIYAFAKFHSLNNSIKEP

SEQ ID NO: 1896505 - protein, 23 aa, Staphylococcus
FKVPIWLGALIMTVVIYGTLLLD

SEQ ID NO: 1896506 - protein, 24 aa, Staphylococcus
FKVPSWIIATILAVILGLIIFGGV

SEQ ID NO: 1896507 - protein, 26 aa, Staphylococcus
FKVTLIFMIIFFLLNYFTMKQPDIMS

SEQ ID NO: 1896508 - protein, 18 aa, Staphylococcus
FKYKIYPALMLIMSVFLS

SEQ ID NO: 1896509 - protein, 24 aa, Staphylococcus
FKYKLFPIFMGMISVLLAICVVIQ

SEQ ID NO: 1896510 - protein, 17 aa, Staphylococcus
FKYKVFPLSMGIVSMFL

SEQ ID NO: 1896511 - protein, 25 aa, Staphylococcus
FLAARIYFVIFQWPYYAQNPAEIPK

SEQ ID NO: 1896512 - protein, 25 aa, Staphylococcus
FLAEKITPLIYLIFPILATFSDDIT

SEQ ID NO: 1896513 - protein, 17 aa, Staphylococcus
FLAFTIVIMLIVALGKN

SEQ ID NO: 1896514 - protein, 19 aa, Staphylococcus
FLAIVLLFKHYKLSIWMVL

SEQ ID NO: 1896515 - protein, 19 aa, Staphylococcus
FLALISMNIRILSGILFLI

SEQ ID NO: 1896516 - protein, 19 aa, Staphylococcus
FLALISMNIRILSGILFLV

SEQ ID NO: 1896517 - protein, 20 aa, Staphylococcus
FLALISMNMRILSGFLFLIA

SEQ ID NO: 1896518 - protein, 18 aa, Staphylococcus
FLALIVGASLTIAMTVGT

SEQ ID NO: 1896519 - protein, 29 aa, Staphylococcus
FLALVILSSFLHTFLPKIPLAFIQIILGM

SEQ ID NO: 1896520 - protein, 19 aa, Staphylococcus
FLASSIYLVLKRPFKLTAF

SEQ ID NO: 1896521 - protein, 19 aa, Staphylococcus
FLCIAFISKLLLYLIIVTF

SEQ ID NO: 1896522 - protein, 18 aa, Staphylococcus
FLEKIMLVLMVIMGIIFI

SEQ ID NO: 1896523 - protein, 26 aa, Staphylococcus
FLFATFVMLYFAHSGWLLLLAGAALG

SEQ ID NO: 1896524 - protein, 19 aa, Staphylococcus
FLFATILFALTSSLFMILY

SEQ ID NO: 1896525 - protein, 17 aa, Staphylococcus
FLFAVIITVISFLCTFM

SEQ ID NO: 1896526 - protein, 18 aa, Staphylococcus
FLFFHINLATLGGIGGLV

SEQ ID NO: 1896527 - protein, 17 aa, Staphylococcus
FLFILFLTVKDDSDWIY

SEQ ID NO: 1896528 - protein, 21 aa, Staphylococcus
FLFKKLNWPVGLIIGAVIITS

SEQ ID NO: 1896529 - protein, 22 aa, Staphylococcus
FLFKRLSWPYALIITAVIISSL

SEQ ID NO: 1896530 - protein, 22 aa, Staphylococcus
FLFKRLSWPYGLIIAAVIISSL

SEQ ID NO: 1896531 - protein, 22 aa, Staphylococcus
FLFKRLSWPYGLIIAAVIITSL

SEQ ID NO: 1896532 - protein, 18 aa, Staphylococcus
FLGAIYMIIADKYSEKVK

SEQ ID NO: 1896533 - protein, 18 aa, Staphylococcus
FLGILSLPILFAAGMSLL

SEQ ID NO: 1896534 - protein, 23 aa, Staphylococcus
FLGIVLCLFTLFTSKAPNGSKAM

SEQ ID NO: 1896535 - protein, 22 aa, Staphylococcus
FLGNWINAVLWLVAGIMLLVRK

SEQ ID NO: 1896536 - protein, 17 aa, Staphylococcus
FLGVMYQYRLLLTIYFA

SEQ ID NO: 1896537 - protein, 19 aa, Staphylococcus
FLHQVLVIGIILLISKIIE

SEQ ID NO: 1896538 - protein, 17 aa, Staphylococcus
FLHTLFLAYFKLTSSKV

SEQ ID NO: 1896539 - protein, 26 aa, Staphylococcus
FLIILISVIVAIFAILMIINETNLFK

SEQ ID NO: 1896540 - protein, 20 aa, Staphylococcus
FLIILVVIIAAYYLFNGSIS

SEQ ID NO: 1896541 - protein, 25 aa, Staphylococcus
FLIIPIYILFQMVVPIIIVFGTLGL

SEQ ID NO: 1896542 - protein, 25 aa, Staphylococcus
FLILVLIIFTLFTYKAPNGMRAMGA

SEQ ID NO: 1896543 - protein, 18 aa, Staphylococcus
FLILYFLAPYIAELTLSR

SEQ ID NO: 1896544 - protein, 17 aa, Staphylococcus
FLIMLKLMLAIAFFAVS

SEQ ID NO: 1896545 - protein, 19 aa, Staphylococcus
FLIPMMMISVLWGILAGIS

SEQ ID NO: 1896546 - protein, 44 aa, Staphylococcus
FLITVTCLIALAIYLFRFLWVFVLYPYFYLPVSPFQKMISHNED

SEQ ID NO: 1896547 - protein, 27 aa, Staphylococcus
FLIVVLALFTLFTYRAPMGMRAMGALA

SEQ ID NO: 1896548 - protein, 19 aa, Staphylococcus
FLIYIAVVLISCMVFLTFF

SEQ ID NO: 1896549 - protein, 20 aa, Staphylococcus
FLKTIQYPALLLIVFLIMLI

SEQ ID NO: 1896550 - protein, 21 aa, Staphylococcus
FLKTKHEVEYFGTIFSFMGNS

SEQ ID NO: 1896551 - protein, 25 aa, Staphylococcus
FLKTKHEVEYFGTIFSFMGNSSTGK

SEQ ID NO: 1896552 - protein, 43 aa, Staphylococcus
FLKYMTIFVLLNFTITCTLIIILFFKVLPNIYWDINEIEPTYL

SEQ ID NO: 1896553 - protein, 20 aa, Staphylococcus
FLLAFCMIVPWRLAMYYKYK

SEQ ID NO: 1896554 - protein, 27 aa, Staphylococcus
FLLAFLSLFLIIFFPANPIIIIISAIM

SEQ ID NO: 1896555 - protein, 27 aa, Staphylococcus
FLLAFLSLFLVIWFPSSPIVIIISAIM

SEQ ID NO: 1896556 - protein, 20 aa, Staphylococcus
FLLCLTVFKMKGVYAALTTL

SEQ ID NO: 1896557 - protein, 20 aa, Staphylococcus
FLLIMVPFFLIYMLKDHEKF

SEQ ID NO: 1896558 - protein, 24 aa, Staphylococcus
FLLIPIYIVFQNLMPIIIVFGVLG

SEQ ID NO: 1896559 - protein, 17 aa, Staphylococcus
FLLLFSTVSYIMNKISL

SEQ ID NO: 1896560 - protein, 18 aa, Staphylococcus
FLLLMINLGLMTKFNDIK

SEQ ID NO: 1896561 - protein, 23 aa, Staphylococcus
FLLPILTGMLLAIGLLSKLFNYL

SEQ ID NO: 1896562 - protein, 17 aa, Staphylococcus
FLLSIPALLPLYKALNM

SEQ ID NO: 1896563 - protein, 18 aa, Staphylococcus
FLLVNLLRSVPLMTYLIM

SEQ ID NO: 1896564 - protein, 29 aa, Staphylococcus
FLMAFGSLFLVIWFPFNPYILFISAILLG

SEQ ID NO: 1896565 - protein, 18 aa, Staphylococcus
FLMFYITDIVGLSPAFVG

SEQ ID NO: 1896566 - protein, 18 aa, Staphylococcus
FLMIPLTMTIFSILGFTI

SEQ ID NO: 1896567 - protein, 18 aa, Staphylococcus
FLNIILKESNRIESLVMD

SEQ ID NO: 1896568 - protein, 19 aa, Staphylococcus
FLNPALISSILIIAILLMF

SEQ ID NO: 1896569 - protein, 24 aa, Staphylococcus
FLRLYLLTLLFFSANAILNVFIPL

SEQ ID NO: 1896570 - protein, 40 aa, Staphylococcus
FLSGLVCAIVLFTIIMILYRTPLLGLIVAGSLTIAMTVGT

SEQ ID NO: 1896571 - protein, 23 aa, Staphylococcus
FLSKPIAIIFWIIAELAIIATDI

SEQ ID NO: 1896572 - protein, 24 aa, Staphylococcus
FLSKRSMFLTIIATVLISVFLGLT

SEQ ID NO: 1896573 - protein, 22 aa, Staphylococcus
FLTALFCLALNLNPIFAILTAI

SEQ ID NO: 1896574 - protein, 17 aa, Staphylococcus
FLTFGYICVVALNATAF

SEQ ID NO: 1896575 - protein, 20 aa, Staphylococcus
FLTFSLVQRYIQIKFFSEFV

SEQ ID NO: 1896576 - protein, 29 aa, Staphylococcus
FLTQFLSWRWIFFINIFVVIIAVPLMNKY

SEQ ID NO: 1896577 - protein, 28 aa, Staphylococcus
FLTTTLIGAFLLYLPITGKQPTPFIDAF

SEQ ID NO: 1896578 - protein, 19 aa, Staphylococcus
FLTYIAVFLVSCLIFLVFF

SEQ ID NO: 1896579 - protein, 20 aa, Staphylococcus
FLVAFIFSYLIRIVIPDKKK

SEQ ID NO: 1896580 - protein, 18 aa, Staphylococcus
FLVFFIYHKLRYKTKKIP

SEQ ID NO: 1896581 - protein, 25 aa, Staphylococcus
FLVFLIIAILFLTLGFWKTVLIVVL

SEQ ID NO: 1896582 - protein, 19 aa, Staphylococcus
FLVGFIFLLYIARSLSREQ

SEQ ID NO: 1896583 - protein, 20 aa, Staphylococcus
FLVITQLLYFVPGPLCFLIF

SEQ ID NO: 1896584 - protein, 17 aa, Staphylococcus
FLVIVQFFLKIVCVIII

SEQ ID NO: 1896585 - protein, 18 aa, Staphylococcus
FLVLAFRTYKELGTDNVE

SEQ ID NO: 1896586 - protein, 26 aa, Staphylococcus
FLVLVLVIFTLFTYKAPSGMRAMGAL

SEQ ID NO: 1896587 - protein, 27 aa, Staphylococcus
FLVMIVYTVIYLIFALIAFIHSNRVIK

SEQ ID NO: 1896588 - protein, 19 aa, Staphylococcus
FLVSFFFSGSETALTAANR

SEQ ID NO: 1896589 - protein, 26 aa, Staphylococcus
FLVSMIAIILILIPTYYLGENKTGMD

SEQ ID NO: 1896590 - protein, 24 aa, Staphylococcus
FLVTFILMVIMFRCFGKQGLIAWV

SEQ ID NO: 1896591 - protein, 17 aa, Staphylococcus
FLVYRKDSSLWYSMLKV

SEQ ID NO: 1896592 - protein, 17 aa, Staphylococcus
FLVYRKNASLWQSMIKV

SEQ ID NO: 1896593 - protein, 17 aa, Staphylococcus
FLYLIWVVGIYIYTDIP

SEQ ID NO: 1896594 - protein, 18 aa, Staphylococcus
FLYLLKKPTFVIPMLLQG

SEQ ID NO: 1896595 - protein, 17 aa, Staphylococcus
FLYMCKIVFYPDSENLN

SEQ ID NO: 1896596 - protein, 23 aa, Staphylococcus
FLYSPGTILLLSALFAILIQRKS

SEQ ID NO: 1896597 - protein, 23 aa, Staphylococcus
FMAPFSFVMASLAIYWAMWPTTA

SEQ ID NO: 1896598 - protein, 27 aa, Staphylococcus
FMEKIIPFIGLILLIIVVSILNPSFLD

SEQ ID NO: 1896599 - protein, 19 aa, Staphylococcus
FMEVFAFFFEAIFLSIYFY

SEQ ID NO: 1896600 - protein, 27 aa, Staphylococcus
FMFDFSFWLFLIFLLAPDLTAIGYVFN

SEQ ID NO: 1896601 - protein, 19 aa, Staphylococcus
FMFYVTVLNQFYWFFGTTI

SEQ ID NO: 1896602 - protein, 20 aa, Staphylococcus
FMGMIIILLAFFIQTGNINS

SEQ ID NO: 1896603 - protein, 17 aa, Staphylococcus
FMHHHPFFGTLLHVVQA

SEQ ID NO: 1896604 - protein, 20 aa, Staphylococcus
FMIAFIFGYLISLVVPAKYA

SEQ ID NO: 1896605 - protein, 17 aa, Staphylococcus
FMIALTILLFNLAGDAL

SEQ ID NO: 1896606 - protein, 20 aa, Staphylococcus
FMIGIFIVALILWITGSFIN

SEQ ID NO: 1896607 - protein, 18 aa, Staphylococcus
FMIGVLCLIFVDYKYVWL

SEQ ID NO: 1896608 - protein, 17 aa, Staphylococcus
FMILISHLRFRKNHPDE

SEQ ID NO: 1896609 - protein, 18 aa, Staphylococcus
FMIVFARSRLFSIIMLSA

SEQ ID NO: 1896610 - protein, 17 aa, Staphylococcus
FMIVIGALIGGITNIIA

SEQ ID NO: 1896611 - protein, 22 aa, Staphylococcus
FMLALTFAFYPTAPFIVMMFAG

SEQ ID NO: 1896612 - protein, 18 aa, Staphylococcus
FMLFTTIGTLIWNIVLIY

SEQ ID NO: 1896613 - protein, 21 aa, Staphylococcus
FMLFVLLMFGFDFLSAAGNAK

SEQ ID NO: 1896614 - protein, 26 aa, Staphylococcus
FMLGVTIFVLIYWLNPAGNPWIDNLS

SEQ ID NO: 1896615 - protein, 25 aa, Staphylococcus
FMLGVTVFVLIYWLNPPGHAWLDNI

SEQ ID NO: 1896616 - protein, 17 aa, Staphylococcus
FMLIKWPVTQTESIYKG

SEQ ID NO: 1896617 - protein, 19 aa, Staphylococcus
FMLLKLIIVWTLVQFIEGH

SEQ ID NO: 1896618 - protein, 18 aa, Staphylococcus
FMLLTLFSGFWLLIQEFM

SEQ ID NO: 1896619 - protein, 23 aa, Staphylococcus
FMMFNLFVLIFLSNSLYPSFEKT

SEQ ID NO: 1896620 - protein, 17 aa, Staphylococcus
FMMVVGAVIGGLTNVIA

SEQ ID NO: 1896621 - protein, 22 aa, Staphylococcus
FMNALGILLLTTQIKYIFGITT

SEQ ID NO: 1896622 - protein, 18 aa, Staphylococcus
FMNFVLFKRMKFGDRKTT

SEQ ID NO: 1896623 - protein, 22 aa, Staphylococcus
FMSIFIVIFVLYANRFVMRHRQ

SEQ ID NO: 1896624 - protein, 25 aa, Staphylococcus
FMTLWSFIIFLPFTFILLIGMSIMI

SEQ ID NO: 1896625 - protein, 19 aa, Staphylococcus
FMVPFIVVGGLLIAIALTL

SEQ ID NO: 1896626 - protein, 18 aa, Staphylococcus
FMVVTAFIIIAFICSFFI

SEQ ID NO: 1896627 - protein, 19 aa, Staphylococcus
FMYPVITYLIGLVRDLYFN

SEQ ID NO: 1896628 - protein, 19 aa, Staphylococcus
FMYSIIIFGFVLYTAFIFW

SEQ ID NO: 1896629 - protein, 19 aa, Staphylococcus
FNALLYMLVLINPRKMNSI

SEQ ID NO: 1896630 - protein, 23 aa, Staphylococcus
FNANVMPHLYFETSAVLITLILF

SEQ ID NO: 1896631 - protein, 18 aa, Staphylococcus
FNATEWIWWLLAHIVFMV

SEQ ID NO: 1896632 - protein, 17 aa, Staphylococcus
FNDLQQRFDTIIAFLLI

SEQ ID NO: 1896633 - protein, 30 aa, Staphylococcus
FNDMLGMGGLLLVVPFFSFVVLMALGVDYA

SEQ ID NO: 1896634 - protein, 36 aa, Staphylococcus
FNEDNRYLVMPALSDALKIVGLKTVTFAPKNPEKGK

SEQ ID NO: 1896635 - protein, 17 aa, Staphylococcus
FNEVVWSKPLVYGLLIT

SEQ ID NO: 1896636 - protein, 18 aa, Staphylococcus
FNFILFLVQIYYYGMIVY

SEQ ID NO: 1896637 - protein, 26 aa, Staphylococcus
FNFISWAPFTFLPIFIALTASKHFNV

SEQ ID NO: 1896638 - protein, 35 aa, Staphylococcus
FNHTNVIINIILIGAFILNLIFAFTIIFMERRSAG

SEQ ID NO: 1896639 - protein, 21 aa, Staphylococcus
FNHWILRWKVVLVISIAILPF

SEQ ID NO: 1896640 - protein, 22 aa, Staphylococcus
FNIALWLLLIITIILSMFGQLG

SEQ ID NO: 1896641 - protein, 24 aa, Staphylococcus
FNIILLIIGYFVVPFIGAFIIHHL

SEQ ID NO: 1896642 - protein, 23 aa, Staphylococcus
FNIKKDVWITKSGSGYFIADMKD

SEQ ID NO: 1896643 - protein, 24 aa, Staphylococcus
FNISKDIWITKTYGGYLIADMKEN

SEQ ID NO: 1896644 - protein, 18 aa, Staphylococcus
FNIVSLFLMFYITDIVGL

SEQ ID NO: 1896645 - protein, 26 aa, Staphylococcus
FNKDYWKFVLIMFPTIPISAILPYLG

SEQ ID NO: 1896646 - protein, 31 aa, Staphylococcus
FNKGHSNHENMIYWFGIPRDQTPVGQVTFSI

SEQ ID NO: 1896647 - protein, 18 aa, Staphylococcus
FNKISLFNDLKRWISQYE

SEQ ID NO: 1896648 - protein, 28 aa, Staphylococcus
FNKYSYRKLFLIALLLFTIGSLVCGIST

SEQ ID NO: 1896649 - protein, 19 aa, Staphylococcus
FNLFVFFEVFLMSSYCLLV

SEQ ID NO: 1896650 - protein, 27 aa, Staphylococcus
FNLMHPDIWLALLAGLLYFIQPLVNAI

SEQ ID NO: 1896651 - protein, 22 aa, Staphylococcus
FNLYFGIFMICVSILLMIRHKI

SEQ ID NO: 1896652 - protein, 24 aa, Staphylococcus
FNLYFGIFMIFVAILLMVRHKIKP

SEQ ID NO: 1896653 - protein, 25 aa, Staphylococcus
FNMNFLVNFFVYLCMYLLIVVIAGY

SEQ ID NO: 1896654 - protein, 37 aa, Staphylococcus
FNNKPLRAMIYLGLIVFFISLLYIGYISVGIMIRGVE

SEQ ID NO: 1896655 - protein, 42 aa, Staphylococcus
FNNKPLRAMIYLGMTIFSLSIVYILYLLIGIMVNGINNPGYF

SEQ ID NO: 1896656 - protein, 27 aa, Staphylococcus
FNNVLLLLIFVVIVLSLYISGFFLFFH

SEQ ID NO: 1896657 - protein, 20 aa, Staphylococcus
FNNYKWFIPSLSEIYLLIML

SEQ ID NO: 1896658 - protein, 18 aa, Staphylococcus
FNNYLPQVFKSMCIPLVI

SEQ ID NO: 1896659 - protein, 26 aa, Staphylococcus
FNPVFALWFLLTLFFFHVILVIVKNY

SEQ ID NO: 1896660 - protein, 17 aa, Staphylococcus
FNQIPVYIVLIYATLRG

SEQ ID NO: 1896661 - protein, 18 aa, Staphylococcus
FNRIFPKVSYKAYTIFFT

SEQ ID NO: 1896662 - protein, 19 aa, Staphylococcus
FNRTLLITYGMFIKDKTKK

SEQ ID NO: 1896663 - protein, 24 aa, Staphylococcus
FNSKLINIMIFTLTLGLIILISAI

SEQ ID NO: 1896664 - protein, 26 aa, Staphylococcus
FNSWGFIIIAILFLISFYSGTQIDKI

SEQ ID NO: 1896665 - protein, 24 aa, Staphylococcus
FNVKLGWLILRVLSVVFVWLTYLK

SEQ ID NO: 1896666 - protein, 28 aa, Staphylococcus
FNVNRNIFWILLITLLVLFVAMQIRIFS

SEQ ID NO: 1896667 - protein, 34 aa, Staphylococcus
FNVNRNLFWILLIVLLLIFVILQIRIFTIKEDNI

SEQ ID NO: 1896668 - protein, 25 aa, Staphylococcus
FNVTPIWLIVRLLAVVFVWMTFLHI

SEQ ID NO: 1896669 - protein, 17 aa, Staphylococcus
FNVVHGEWYRLVTSMFL

SEQ ID NO: 1896670 - protein, 18 aa, Staphylococcus
FNYVNTIVKLFPYEVSDH

SEQ ID NO: 1896671 - protein, 20 aa, Staphylococcus
FPDFGGGLIGFYLLAIFEPL

SEQ ID NO: 1896672 - protein, 20 aa, Staphylococcus
FPENGLVWIISFLTIIIGFI

SEQ ID NO: 1896673 - protein, 17 aa, Staphylococcus
FPFIAFLTTCIVAAVLP

SEQ ID NO: 1896674 - protein, 25 aa, Staphylococcus
FPFIVGVILFICGLVVFIVIFGFLS

SEQ ID NO: 1896675 - protein, 27 aa, Staphylococcus
FPGLYHHKIFIACLLVLFILIMNLRGL

SEQ ID NO: 1896676 - protein, 28 aa, Staphylococcus
FPGMPMTLLSWLISIITLILGFIVSFVL

SEQ ID NO: 1896677 - protein, 20 aa, Staphylococcus
FPHINPAELFIFLGIAHGIE

SEQ ID NO: 1896678 - protein, 19 aa, Staphylococcus
FPHTILWQCIFWGVMIGLV

SEQ ID NO: 1896679 - protein, 18 aa, Staphylococcus
FPHWITVLSIVFMLTLFN

SEQ ID NO: 1896680 - protein, 29 aa, Staphylococcus
FPIELSAQFFRWIHPFSPMSYAIQGYREA

SEQ ID NO: 1896681 - protein, 24 aa, Staphylococcus
FPIIQAYVLIVAILFIVFNTLADI

SEQ ID NO: 1896682 - protein, 36 aa, Staphylococcus
FPLENLWIFIVLWIILFFVIIAFLLYRRYTQKQFAK

SEQ ID NO: 1896683 - protein, 20 aa, Staphylococcus
FPMVYLIRKYFSNALTRFGQ

SEQ ID NO: 1896684 - protein, 36 aa, Staphylococcus
FPNFGGGLIGFYLFKLLIPLISIAGVIIITVLLIAS

SEQ ID NO: 1896685 - protein, 20 aa, Staphylococcus
FPNKNLLIGALSFISYPCYI

SEQ ID NO: 1896686 - protein, 27 aa, Staphylococcus
FPQQWTIFYWSWWIVYAPFIGLFIARI

SEQ ID NO: 1896687 - protein, 18 aa, Staphylococcus
FPSAPLLVLPIGSFIGAL

SEQ ID NO: 1896688 - protein, 17 aa, Staphylococcus
FPSKLPLINFRLNYRNH

SEQ ID NO: 1896689 - protein, 22 aa, Staphylococcus
FPTGMNLFFAILSGAGWSFGQI

SEQ ID NO: 1896690 - protein, 25 aa, Staphylococcus
FPTITIVLFLISAFLFLATTFDSGS

SEQ ID NO: 1896691 - protein, 28 aa, Staphylococcus
FPTTVIVLFLLSAFLFLATTFDSGSYIL

SEQ ID NO: 1896692 - protein, 18 aa, Staphylococcus
FPVMMFGIPAAALAMYHT

SEQ ID NO: 1896693 - protein, 19 aa, Staphylococcus
FPVMMFGIPAAALAMYHTA

SEQ ID NO: 1896694 - protein, 35 aa, Staphylococcus
FPVVTAPKFFQTISPYLPFTYVIDSLRETVGGIVP

SEQ ID NO: 1896695 - protein, 17 aa, Staphylococcus
FQALIAGIITWLLTALG

SEQ ID NO: 1896696 - protein, 24 aa, Staphylococcus
FQELTMALLTPFIILFLTVVGAYL

SEQ ID NO: 1896697 - protein, 25 aa, Staphylococcus
FQETKLFKLSLLENIRFYKPDATKA

SEQ ID NO: 1896698 - protein, 24 aa, Staphylococcus
FQFSFIISFFILLSKPLFNNQSIL

SEQ ID NO: 1896699 - protein, 23 aa, Staphylococcus
FQFSFLICFFILLSQPYLKKLTS

SEQ ID NO: 1896700 - protein, 34 aa, Staphylococcus
FQFTFPGSEWVVLILGTILFFYGGKPFLSGGKDE

SEQ ID NO: 1896701 - protein, 20 aa, Staphylococcus
FQFYALHILFAKYLVKFNPF

SEQ ID NO: 1896702 - protein, 24 aa, Staphylococcus
FQGFTKIIIVLIVSPLIAFCVGFI

SEQ ID NO: 1896703 - protein, 25 aa, Staphylococcus
FQNIWLLILIIPTWINLLLKTYAFI

SEQ ID NO: 1896704 - protein, 19 aa, Staphylococcus
FQQPAWGWIISIPGLIVWQ

SEQ ID NO: 1896705 - protein, 28 aa, Staphylococcus
FQSINPLFILLFAPVISMIWLKMGKKQP

SEQ ID NO: 1896706 - protein, 22 aa, Staphylococcus
FQSRLRKLILILIVGGAIGASV

SEQ ID NO: 1896707 - protein, 19 aa, Staphylococcus
FQTLIYFIILLFITDKESV

SEQ ID NO: 1896708 - protein, 27 aa, Staphylococcus
FQWAMMIFIFFIVAYALPIILKDLQSS

SEQ ID NO: 1896709 - protein, 22 aa, Staphylococcus
FQWAMMVFVFFVITMALSIILR

SEQ ID NO: 1896710 - protein, 34 aa, Staphylococcus
FRAFTYIEVLFALFITILIFSILPALIRTTGTIN

SEQ ID NO: 1896711 - protein, 19 aa, Staphylococcus
FRDLTMKILKSAFLSGLML

SEQ ID NO: 1896712 - protein, 29 aa, Staphylococcus
FREWRLIIISVLLLFFWSTEKILHPIDSA

SEQ ID NO: 1896713 - protein, 19 aa, Staphylococcus
FRFISLLFLAVFSISFLLP

SEQ ID NO: 1896714 - protein, 19 aa, Staphylococcus
FRGIFKETIFKKLSFWWPM

SEQ ID NO: 1896715 - protein, 23 aa, Staphylococcus
FRIKRIIIAIPTLKPNRLKEIND

SEQ ID NO: 1896716 - protein, 30 aa, Staphylococcus
FRMNSIMQILTLVSVIFSPLTFIAGVYGMN

SEQ ID NO: 1896717 - protein, 25 aa, Staphylococcus
FRNKMLIIALIAIAAIPLLYVALFV

SEQ ID NO: 1896718 - protein, 19 aa, Staphylococcus
FRPFILYGTVPLAILTVLS

SEQ ID NO: 1896719 - protein, 18 aa, Staphylococcus
FRSLFWDIFQVAVAGAIV

SEQ ID NO: 1896720 - protein, 18 aa, Staphylococcus
FRSNKGFYWKENKVKLVF

SEQ ID NO: 1896721 - protein, 33 aa, Staphylococcus
FRVPLQMFILALLPIPYLYLISLVVTIIMPGIL

SEQ ID NO: 1896722 - protein, 22 aa, Staphylococcus
FSDGSAITIPKGAKGDAGKDGI

SEQ ID NO: 1896723 - protein, 20 aa, Staphylococcus
FSDNYEVTIPGGPKGDKGDQ

SEQ ID NO: 1896724 - protein, 20 aa, Staphylococcus
FSEHFLIWSVLRIIAGITSG

SEQ ID NO: 1896725 - protein, 24 aa, Staphylococcus
FSENYIMFLVINTFAQFLLVIPNT

SEQ ID NO: 1896726 - protein, 21 aa, Staphylococcus
FSEVFILPSIWAGLLILIGIL

SEQ ID NO: 1896727 - protein, 26 aa, Staphylococcus
FSFILFILGILLLRMEIISIGSFLTL

SEQ ID NO: 1896728 - protein, 29 aa, Staphylococcus
FSFKTSLTLFLVIALVVWSFLYTGFSFSD

SEQ ID NO: 1896729 - protein, 19 aa, Staphylococcus
FSFLIVIIIKFILAWILQP

SEQ ID NO: 1896730 - protein, 23 aa, Staphylococcus
FSFRILITLIVAGLLLISLFTTM

SEQ ID NO: 1896731 - protein, 21 aa, Staphylococcus
FSFWFPNFPHWITVLSIVFML

SEQ ID NO: 1896732 - protein, 17 aa, Staphylococcus
FSFWFPNVPHWLTVLFI

SEQ ID NO: 1896733 - protein, 25 aa, Staphylococcus
FSGFSWFIFLLIIQASTIISMEFYH

SEQ ID NO: 1896734 - protein, 25 aa, Staphylococcus
FSGFSWLIFLLIIQASTIISMEFYH

SEQ ID NO: 1896735 - protein, 23 aa, Staphylococcus
FSGIFLFILVLINFPISMISGHI

SEQ ID NO: 1896736 - protein, 24 aa, Staphylococcus
FSGNFVALILWFIVGIMLFVKKDK

SEQ ID NO: 1896737 - protein, 27 aa, Staphylococcus
FSGWGLRTIIYLFILAAAISTVLIYAR

SEQ ID NO: 1896738 - protein, 25 aa, Staphylococcus
FSGWGLRTIIYLLILATAITTVMVY

SEQ ID NO: 1896739 - protein, 19 aa, Staphylococcus
FSHIRAMMWTTIPASIIGL

SEQ ID NO: 1896740 - protein, 19 aa, Staphylococcus
FSHIRSMMWTTIPASIIGL

SEQ ID NO: 1896741 - protein, 23 aa, Staphylococcus
FSHIRSMMWTTIPASIIGLIVWF

SEQ ID NO: 1896742 - protein, 21 aa, Staphylococcus
FSHQPDFAITNGGGIRASIEK

SEQ ID NO: 1896743 - protein, 21 aa, Staphylococcus
FSHYLVLFFALLTIIFGCVGA

SEQ ID NO: 1896744 - protein, 20 aa, Staphylococcus
FSHYTILFLALLTIIFGSVG

SEQ ID NO: 1896745 - protein, 21 aa, Staphylococcus
FSHYVILFLALLTIIFGCVGA

SEQ ID NO: 1896746 - protein, 26 aa, Staphylococcus
FSIITLICILFIPMILQLKLDIQHKS

SEQ ID NO: 1896747 - protein, 23 aa, Staphylococcus
FSIKFYKHNMYDPKLKRVPTKEE

SEQ ID NO: 1896748 - protein, 33 aa, Staphylococcus
FSILGQHAVVLGLIVLLFIPLTVVLNAQEGVIT

SEQ ID NO: 1896749 - protein, 18 aa, Staphylococcus
FSILITKILGVLFVIPFY

SEQ ID NO: 1896750 - protein, 23 aa, Staphylococcus
FSILKFILWVFPPVSELLSVYNK

SEQ ID NO: 1896751 - protein, 22 aa, Staphylococcus
FSILPIMMIVYGIVAKIIVIWF

SEQ ID NO: 1896752 - protein, 23 aa, Staphylococcus
FSILPVMMIIYGVLAKIIVIWCF

SEQ ID NO: 1896753 - protein, 24 aa, Staphylococcus
FSINLLFLICLILGIASLIVSLFI

SEQ ID NO: 1896754 - protein, 35 aa, Staphylococcus
FSIRKFKVGIFSTLIATVAFLSSPITHIAQADEIN

SEQ ID NO: 1896755 - protein, 37 aa, Staphylococcus
FSIRKFNVGIFSALIATVAFLGVNPNSADAAEQDNVN

SEQ ID NO: 1896756 - protein, 35 aa, Staphylococcus
FSIRKFSIGTGSVLLGAFLFVGFQDVAHASELHNS

SEQ ID NO: 1896757 - protein, 18 aa, Staphylococcus
FSKGLFEWIGYNTKIFTY

SEQ ID NO: 1896758 - protein, 27 aa, Staphylococcus
FSKIFDYILVFFLFGIAVTMIAGAGST

SEQ ID NO: 1896759 - protein, 17 aa, Staphylococcus
FSKIFIIGYVSLLVFHI

SEQ ID NO: 1896760 - protein, 39 aa, Staphylococcus; identical to SEQ ID NO: 1873733

SEQ ID NO: 1896761 - protein, 27 aa, Staphylococcus
FSKVFDYILVFFLFGIAVTMIAGAGSA

SEQ ID NO: 1896762 - protein, 38 aa, Staphylococcus
FSKYMTLFMLANIILGVVFVVYLLIETYDRIYSDINTI

SEQ ID NO: 1896763 - protein, 18 aa, Staphylococcus
FSLFFLLGVLIHLIGRWI

SEQ ID NO: 1896764 - protein, 21 aa, Staphylococcus
FSLFYALISFLFYIIGSESIS

SEQ ID NO: 1896765 - protein, 23 aa, Staphylococcus
FSLGMIWIALFSMMLPLFNIKLK

SEQ ID NO: 1896766 - protein, 30 aa, Staphylococcus
FSLGTWGEWFYKGLELLVIACPCALVISTP

SEQ ID NO: 1896767 - protein, 25 aa, Staphylococcus
FSLIASILILFLYFHKSIPDTVDIS

SEQ ID NO: 1896768 - protein, 27 aa, Staphylococcus
FSLIASILVLWLYFRKSIPGKFDAVNI

SEQ ID NO: 1896769 - protein, 26 aa, Staphylococcus
FSLIASILVLWLYFRKSIPRKFDAVN

SEQ ID NO: 1896770 - protein, 20 aa, Staphylococcus
FSLIYFIITIAIAIVLWAIF

SEQ ID NO: 1896771 - protein, 22 aa, Staphylococcus
FSLLASIIVLWIYFRTSIPKTI

SEQ ID NO: 1896772 - protein, 26 aa, Staphylococcus
FSLLASIVVLWLYFRKVIPNHFEIKN

SEQ ID NO: 1896773 - protein, 33 aa, Staphylococcus
FSLLGQHALVLGLIVLLFIPLTVVLNAQEGVIT

SEQ ID NO: 1896774 - protein, 32 aa, Staphylococcus
FSLLGQNALVLGLIVLLFIPITVMLKVQEGVV

SEQ ID NO: 1896775 - protein, 31 aa, Staphylococcus
FSLLGQTPVILGLIVMLFIPVTVMLKVQEGV

SEQ ID NO: 1896776 - protein, 18 aa, Staphylococcus
FSLMWQGIKQVFSGALLA

SEQ ID NO: 1896777 - protein, 17 aa, Staphylococcus
FSLPAMIFAVMLPVIFF

SEQ ID NO: 1896778 - protein, 25 aa, Staphylococcus
FSLPQRRWVYFLALSSGALIALFIQ

SEQ ID NO: 1896779 - protein, 19 aa, Staphylococcus
FSLSWLFMSLMMYQYMLQK

SEQ ID NO: 1896780 - protein, 17 aa, Staphylococcus
FSLTFFNTSIYVVVALI

SEQ ID NO: 1896781 - protein, 23 aa, Staphylococcus
FSLVIWILIVVLVIYYTIQLSSR

SEQ ID NO: 1896782 - protein, 24 aa, Staphylococcus
FSLVIWILLVILIIYCTIKLSERT

SEQ ID NO: 1896783 - protein, 18 aa, Staphylococcus
FSMFKPEILLLKITSFIP

SEQ ID NO: 1896784 - protein, 21 aa, Staphylococcus
FSMMPYCIYSILLGICGILAI

SEQ ID NO: 1896785 - protein, 35 aa, Staphylococcus
FSNGYLFLLIILFVLAYILLLGWFLAGFIASLAVV

SEQ ID NO: 1896786 - protein, 18 aa, Staphylococcus
FSNIKVWPLLFLNIVIIT

SEQ ID NO: 1896787 - protein, 27 aa, Staphylococcus
FSNINLLFSALLLFFLNNIIYGFESFN

SEQ ID NO: 1896788 - protein, 24 aa, Staphylococcus
FSNLRFLLITILAIGGMALWIMYA

SEQ ID NO: 1896789 - protein, 18 aa, Staphylococcus
FSPFAWSVVFLALVAVMY

SEQ ID NO: 1896790 - protein, 22 aa, Staphylococcus
FSPITYILIISNVALWLCMILY

SEQ ID NO: 1896791 - protein, 26 aa, Staphylococcus
FSPNIMILLIFRFLMGIAIGMDSPVA

SEQ ID NO: 1896792 - protein, 25 aa, Staphylococcus
FSQVWPILIFLPIVVYIFTRINRHY

SEQ ID NO: 1896793 - protein, 17 aa, Staphylococcus
FSRAAFWLPLILSSLIF

SEQ ID NO: 1896794 - protein, 23 aa, Staphylococcus
FSSAFILMFLAFDVKEVLISLPI

SEQ ID NO: 1896795 - protein, 23 aa, Staphylococcus
FSSAFILMFLAFDVKQVLISLPI

SEQ ID NO: 1896796 - protein, 22 aa, Staphylococcus
FSSFLLISFWRTRQASIYGAQK

SEQ ID NO: 1896797 - protein, 22 aa, Staphylococcus
FSSFLLISFWRTRQASLYGAQK

SEQ ID NO: 1896798 - protein, 33 aa, Staphylococcus
FSSFYGVIIYIIVFFLFVTIFGESLFNQIFGNL

SEQ ID NO: 1896799 - protein, 18 aa, Staphylococcus
FSSWFLTFGYICVVALNA

SEQ ID NO: 1896800 - protein, 22 aa, Staphylococcus
FSSWFLTFGYICVVALNATAFS

SEQ ID NO: 1896801 - protein, 17 aa, Staphylococcus
FSSWFLTFGYVCVVALN

SEQ ID NO: 1896802 - protein, 18 aa, Staphylococcus
FSSWFLTFGYVCVVALNA

SEQ ID NO: 1896803 - protein, 20 aa, Staphylococcus
FSSWQALYQPKYKNDILLVD

SEQ ID NO: 1896804 - protein, 25 aa, Staphylococcus
FSTTIWMLIGFMIFGAISSLVAALV

SEQ ID NO: 1896805 - protein, 28 aa, Staphylococcus
FSVAGHSWLFIPYLILVLVGGIIHNRLW

SEQ ID NO: 1896806 - protein, 36 aa, Staphylococcus
FSVFICYNILEPFFKGYANKILILTSILLLIAHHVF

SEQ ID NO: 1896807 - protein, 18 aa, Staphylococcus
FSVGLLIMPLNTAGLNAL

SEQ ID NO: 1896808 - protein, 35 aa, Staphylococcus
FSVLAFWLMSIPMIPFVILGLFIIALFMSTFEGVM

SEQ ID NO: 1896809 - protein, 26 aa, Staphylococcus
FSVLEILLLCLLVYAGAAQFIICALV

SEQ ID NO: 1896810 - protein, 20 aa, Staphylococcus
FSVLTTWLKGMQGTNIIILA

SEQ ID NO: 1896811 - protein, 36 aa, Staphylococcus
FSVMHAIVIIISMFCSLWLVPWLSAKRVGKLKQQVA

SEQ ID NO: 1896812 - protein, 20 aa, Staphylococcus
FSVMPYCIYSFLLGICGIIA

SEQ ID NO: 1896813 - protein, 25 aa, Staphylococcus
FSVRTLLTILFLYLTSPVAGQMIVR

SEQ ID NO: 1896814 - protein, 24 aa, Staphylococcus
FSVTAFFLVLAFRSYKELGTDNVE

SEQ ID NO: 1896815 - protein, 21 aa, Staphylococcus
FSWLILEYFSNKKLSLLGLLS

SEQ ID NO: 1896816 - protein, 17 aa, Staphylococcus
FSYVKRRNFTIFKAIAI

SEQ ID NO: 1896817 - protein, 20 aa, Staphylococcus
FSYYQAIVLGFYFMYRVIVV

SEQ ID NO: 1896818 - protein, 34 aa, Staphylococcus
FTEHPYFLWFNLAKPDIWITIIAGILYFLQAYVS

SEQ ID NO: 1896819 - protein, 17 aa, Staphylococcus
FTFATFAIAFLLRPVGG

SEQ ID NO: 1896820 - protein, 17 aa, Staphylococcus
FTFIPLIDQIFNGFSAP

SEQ ID NO: 1896821 - protein, 30 aa, Staphylococcus
FTGWRMVFIILTIFGLLMFIGTLFKVPESL

SEQ ID NO: 1896822 - protein, 32 aa, Staphylococcus
FTHNRNLFWIFLIILLVLFVALQVRIFTIKEE

SEQ ID NO: 1896823 - protein, 37 aa, Staphylococcus
FTHSSLIINIILIAAFILNLIFAFVIIFMERRSAGSI

SEQ ID NO: 1896824 - protein, 17 aa, Staphylococcus
FTIFILSVVFVIPLLSH

SEQ ID NO: 1896825 - protein, 24 aa, Staphylococcus
FTIIFIIIYMIIWVVSFLKNRRYV

SEQ ID NO: 1896826 - protein, 32 aa, Staphylococcus
FTIIGVLLILVGVFFVFKPQIDHFITGKQNDE

SEQ ID NO: 1896827 - protein, 18 aa, Staphylococcus
FTIIMLFVTERATSFVIE

SEQ ID NO: 1896828 - protein, 18 aa, Staphylococcus
FTILFILTIIAVLATWIV

SEQ ID NO: 1896829 - protein, 18 aa, Staphylococcus
FTILFILTVIAVMATWMI

SEQ ID NO: 1896830 - protein, 18 aa, Staphylococcus
FTILWRYFSWANQTTAVV

SEQ ID NO: 1896831 - protein, 20 aa, Staphylococcus
FTIMKVVLLLLLLVGIIGLK

SEQ ID NO: 1896832 - protein, 29 aa, Staphylococcus
FTINFIINFFVYLCMYLLLVIIADYSKTS

SEQ ID NO: 1896833 - protein, 19 aa, Staphylococcus
FTIYILVAVMYWVVCFIIS

SEQ ID NO: 1896834 - protein, 21 aa, Staphylococcus
FTKPRLLIREITSPTIYCAYT

SEQ ID NO: 1896835 - protein, 20 aa, Staphylococcus
FTLFKAVGIVLLLIGILLMN

SEQ ID NO: 1896836 - protein, 29 aa, Staphylococcus
FTLIAVMAVICIVLIIMMMSSGKKDTYYG

SEQ ID NO: 1896837 - protein, 27 aa, Staphylococcus
FTLIEMLLVLLIISVLLILIIPNIAKQ

SEQ ID NO: 1896838 - protein, 31 aa, Staphylococcus
FTLLETLLTLLILIIIIMISPSIYTKTKLDL

SEQ ID NO: 1896839 - protein, 30 aa, Staphylococcus
FTLPSAIMMILLPVIFFIPNLFGHNIILPA

SEQ ID NO: 1896840 - protein, 19 aa, Staphylococcus
FTLTFVTGLLFIAGVIIML

SEQ ID NO: 1896841 - protein, 17 aa, Staphylococcus
FTLYHNAIYLGLINFFR

SEQ ID NO: 1896842 - protein, 24 aa, Staphylococcus
FTMGWLYYILWSLVSSVDVMVASN

SEQ ID NO: 1896843 - protein, 24 aa, Staphylococcus
FTMGWLYYIMWALVSSVDVMVASN

SEQ ID NO: 1896844 - protein, 18 aa, Staphylococcus
FTMIGAIVIMGLSGTVSD

SEQ ID NO: 1896845 - protein, 17 aa, Staphylococcus
FTMILLTVYGALNGKGG

SEQ ID NO: 1896846 - protein, 32 aa, Staphylococcus
FTNKITWLQIISGFFFAFAALTYLISAQPDMN

SEQ ID NO: 1896847 - protein, 33 aa, Staphylococcus
FTNMPELHWKYSYFVFIGVMALLSIALIVLFKK

SEQ ID NO: 1896848 - protein, 27 aa, Staphylococcus
FTNVIVWLPLVIGILALIIFVVRQFKI

SEQ ID NO: 1896849 - protein, 19 aa, Staphylococcus
FTPILVNRLNISFLPVVVA

SEQ ID NO: 1896850 - protein, 24 aa, Staphylococcus
FTPTKLILIIILIAGIIGLKLTTN

SEQ ID NO: 1896851 - protein, 24 aa, Staphylococcus
FTQIGFPIIDIVLATILGLLIIYT

SEQ ID NO: 1896852 - protein, 25 aa, Staphylococcus
FTQIGFPIVDIILATLLGLLIIYTG

SEQ ID NO: 1896853 - protein, 19 aa, Staphylococcus
FTQQHGAITSLPNAGLKDG

SEQ ID NO: 1896854 - protein, 21 aa, Staphylococcus
FTRIELRDKYNKPLGASRTND

SEQ ID NO: 1896855 - protein, 17 aa, Staphylococcus
FTRVPITEFLFSTDWNP

SEQ ID NO: 1896856 - protein, 34 aa, Staphylococcus
FTSEYLRIMFLSAPFVILFFILEQFARAVGAPFV

SEQ ID NO: 1896857 - protein, 34 aa, Staphylococcus
FTSHPGDMNFLRWTNIRDDYTISWSNDKIAHRDT

SEQ ID NO: 1896858 - protein, 31 aa, Staphylococcus
FTSSILIMFILLFLNGWFQGMGWPPSGRVLV

SEQ ID NO: 1896859 - protein, 24 aa, Staphylococcus
FTSSLVMIILMQLSLHFIPAPEDM

SEQ ID NO: 1896860 - protein, 27 aa, Staphylococcus
FTTNQWFLIILILLFALTNALKNLYFV

SEQ ID NO: 1896861 - protein, 21 aa, Staphylococcus
FTTNTTFTVTLPDTGMNSFEK

SEQ ID NO: 1896862 - protein, 22 aa, Staphylococcus
FTTRQVFLTGILIFFVGTIVGG

SEQ ID NO: 1896863 - protein, 22 aa, Staphylococcus
FTTRTLYFSALTFFIIGSIICV

SEQ ID NO: 1896864 - protein, 18 aa, Staphylococcus
FTVYVPFGDDWFAYFMRR

SEQ ID NO: 1896865 - protein, 17 aa, Staphylococcus
FTYFISSILIALVSGYV

SEQ ID NO: 1896866 - protein, 18 aa, Staphylococcus
FTYISLLLGILLTGFGYS

SEQ ID NO: 1896867 - protein, 21 aa, Staphylococcus
FVALISGGCAIIAAAFGLASV

SEQ ID NO: 1896868 - protein, 28 aa, Staphylococcus
FVAMFIPLFFIFKYKQPMFGKLSSQPLL

SEQ ID NO: 1896869 - protein, 27 aa, Staphylococcus
FVAMFIPLFFIYKYKQPMFGKLRNQPL

SEQ ID NO: 1896870 - protein, 25 aa, Staphylococcus
FVAMFVMFIGFLVTCLYFEFAGNPE

SEQ ID NO: 1896871 - protein, 19 aa, Staphylococcus
FVAPILFVIHALLTGLSMF

SEQ ID NO: 1896872 - protein, 18 aa, Staphylococcus
FVAPTMKFHVWRVAIQTD

SEQ ID NO: 1896873 - protein, 17 aa, Staphylococcus
FVATWWITESIPIPATS

SEQ ID NO: 1896874 - protein, 18 aa, Staphylococcus
FVCVFAVFWGLSGQAKLY

SEQ ID NO: 1896875 - protein, 19 aa, Staphylococcus
FVDMWHFFSLVTRYENEDK

SEQ ID NO: 1896876 - protein, 25 aa, Staphylococcus
FVDNIWLMIALRFVQGFCGGAGAVI

SEQ ID NO: 1896877 - protein, 19 aa, Staphylococcus
FVEAFKELWLPILTICFIL

SEQ ID NO: 1896878 - protein, 52 aa, Staphylococcus
FVEGFSSLPGWVRKGAIGMGLFAAALGPVVLGLGLVLRAVGSAAKGYGFIKQ

SEQ ID NO: 1896879 - protein, 34 aa, Staphylococcus
FVESLIILLLLLAILGYLIIFQKLSPHVPILFVF

SEQ ID NO: 1896880 - protein, 17 aa, Staphylococcus
FVFITIKPLFVFGLYIL

SEQ ID NO: 1896881 - protein, 19 aa, Staphylococcus
FVFVSFIISILLWIVLIPM

SEQ ID NO: 1896882 - protein, 17 aa, Staphylococcus
FVFYPRFKISISAFIIA

SEQ ID NO: 1896883 - protein, 22 aa, Staphylococcus
FVGSLFMGLIARYPIALAPGMG

SEQ ID NO: 1896884 - protein, 25 aa, Staphylococcus
FVGTLFLFILNMIFNPKLFDGSFYS

SEQ ID NO: 1896885 - protein, 23 aa, Staphylococcus
FVGWRSIFIISIIVALAAMYLMK

SEQ ID NO: 1896886 - protein, 26 aa, Staphylococcus
FVHNIWLMIILRLLQGITGGGAAVIS

SEQ ID NO: 1896887 - protein, 25 aa, Staphylococcus
FVHSFMLLLIMRALQGVFAAAFSPV

SEQ ID NO: 1896888 - protein, 19 aa, Staphylococcus
FVIGLVITVICAVGAVQQF

SEQ ID NO: 1896889 - protein, 18 aa, Staphylococcus
FVIMLIILFLMEFARGMY

SEQ ID NO: 1896890 - protein, 17 aa, Staphylococcus
FVIMMLSINVVITQSGT

SEQ ID NO: 1896891 - protein, 17 aa, Staphylococcus
FVINCLLLVLGAALFFG

SEQ ID NO: 1896892 - protein, 28 aa, Staphylococcus
FVINLVLAFIIIFLERNRRSASSTWAWL

SEQ ID NO: 1896893 - protein, 22 aa, Staphylococcus
FVISSFAIALSTSIVAHPTQAI

SEQ ID NO: 1896894 - protein, 17 aa, Staphylococcus
FVITLIFVIWQPKGLNI

SEQ ID NO: 1896895 - protein, 23 aa, Staphylococcus
FVIVILVSILFWKVIKYIVVHYG

SEQ ID NO: 1896896 - protein, 19 aa, Staphylococcus
FVIYLIWQVLLIMWYYKSR

SEQ ID NO: 1896897 - protein, 26 aa, Staphylococcus
FVLAITVWIAIWWITEAIPIAATSFL

SEQ ID NO: 1896898 - protein, 24 aa, Staphylococcus
FVLAQFLVLFIFFAMHKFDIAQVM

SEQ ID NO: 1896899 - protein, 18 aa, Staphylococcus
FVLFLYAGFYKSVVPFSG

SEQ ID NO: 1896900 - protein, 26 aa, Staphylococcus
FVLNNLFIIPVFKPIYGYILGIAIAL

SEQ ID NO: 1896901 - protein, 17 aa, Staphylococcus
FVLSIIALLLIASFFIT

SEQ ID NO: 1896902 - protein, 18 aa, Staphylococcus
FVLTFPKQNELMARMTQV

SEQ ID NO: 1896903 - protein, 17 aa, Staphylococcus
FVLVFTTLKIFGYSKDT

SEQ ID NO: 1896904 - protein, 20 aa, Staphylococcus
FVNFVLFRTLKIGGPSKAFA

SEQ ID NO: 1896905 - protein, 17 aa, Staphylococcus
FVPALVCFFFFAVFGAS

SEQ ID NO: 1896906 - protein, 18 aa, Staphylococcus
FVPFMLISVVIMVIIGLE

SEQ ID NO: 1896907 - protein, 18 aa, Staphylococcus
FVPIIFKKMFPIPDEANR

SEQ ID NO: 1896908 - protein, 19 aa, Staphylococcus
FVPLIPAILISISTILSLF

SEQ ID NO: 1896909 - protein, 18 aa, Staphylococcus
FVPLLFLGRYTHMPYTLA

SEQ ID NO: 1896910 - protein, 18 aa, Staphylococcus
FVPLLFLGRYTNMIYTLA

SEQ ID NO: 1896911 - protein, 18 aa, Staphylococcus
FVPVIFKKLFPVPNEMNR

SEQ ID NO: 1896912 - protein, 18 aa, Staphylococcus
FVQTIVMVLIILGSIGFP

SEQ ID NO: 1896913 - protein, 18 aa, Staphylococcus
FVRYPFMFLTLTTIFTIG

SEQ ID NO: 1896914 - protein, 29 aa, Staphylococcus
FVTAVFLSRWLLSLLISSNFFKKSNWLFG

SEQ ID NO: 1896915 - protein, 24 aa, Staphylococcus
FVTFFTLLIIIYFYSGQPIMSSFA

SEQ ID NO: 1896916 - protein, 18 aa, Staphylococcus
FVTGLLFIAGVIIMLCVP

SEQ ID NO: 1896917 - protein, 17 aa, Staphylococcus
FVTIAFIGTLPASVVFE

SEQ ID NO: 1896918 - protein, 24 aa, Staphylococcus
FVTWLFTLVFIALSFYLMISASKQ

SEQ ID NO: 1896919 - protein, 18 aa, Staphylococcus
FVTYLFTTLIFTYFFGLI

SEQ ID NO: 1896920 - protein, 31 aa, Staphylococcus
FVVGKPIIAIIISLLILIAAALPVSGMRLGI

SEQ ID NO: 1896921 - protein, 33 aa, Staphylococcus
FVVNLFRAIPFIILILLLIPFTSIVLGTISGPT

SEQ ID NO: 1896922 - protein, 18 aa, Staphylococcus
FVVPFVMGYLINTLYMKI

SEQ ID NO: 1896923 - protein, 27 aa, Staphylococcus
FVVPLVTAFILDVILRRVLKLFTNDIY

SEQ ID NO: 1896924 - protein, 18 aa, Staphylococcus
FVVQFIVGLFLIWLPTYV

SEQ ID NO: 1896925 - protein, 20 aa, Staphylococcus
FVVQFVIALFLIWLPTYLTE

SEQ ID NO: 1896926 - protein, 19 aa, Staphylococcus
FVVQFVISLFLIWLPTYLT

SEQ ID NO: 1896927 - protein, 19 aa, Staphylococcus
FVVQFVVSLFLIWLPTYLT

SEQ ID NO: 1896928 - protein, 17 aa, Staphylococcus
FVVRMTLIPALTKLFGK

SEQ ID NO: 1896929 - protein, 19 aa, Staphylococcus
FVVVAFLFALFIKEPNRKS

SEQ ID NO: 1896930 - protein, 20 aa, Staphylococcus
FWAIIFIIPFIIHTGYIVYK

SEQ ID NO: 1896931 - protein, 18 aa, Staphylococcus
FWCFSVFAIGTFLKYAIQ

SEQ ID NO: 1896932 - protein, 20 aa, Staphylococcus
FWFALIKVITIILMIIAGFG

SEQ ID NO: 1896933 - protein, 19 aa, Staphylococcus
FWFALIKVVTIILMIIAGF

SEQ ID NO: 1896934 - protein, 25 aa, Staphylococcus
FWGIKYGLFIQSIIDFLIVAFALFV

SEQ ID NO: 1896935 - protein, 23 aa, Staphylococcus
FWLFFAGMILFNLSFIIGGSPAA

SEQ ID NO: 1896936 - protein, 18 aa, Staphylococcus
FWLFFSGMILFNLSFIVG

SEQ ID NO: 1896937 - protein, 19 aa, Staphylococcus
FWLLFTPLISFLCWLFASH

SEQ ID NO: 1896938 - protein, 19 aa, Staphylococcus
FWSLLQPSIEYGKDGSLPA

SEQ ID NO: 1896939 - protein, 17 aa, Staphylococcus
FWSLLQPSLDYGTNGHL

SEQ ID NO: 1896940 - protein, 20 aa, Staphylococcus
FWTPVLVHIISIFIIALIGA

SEQ ID NO: 1896941 - protein, 19 aa, Staphylococcus
FWVIMLIIGFLFICKEIFY

SEQ ID NO: 1896942 - protein, 26 aa, Staphylococcus
FYAAAFFRFILVMIGVFSSFIVNVAF

SEQ ID NO: 1896943 - protein, 19 aa, Staphylococcus
FYAIYLLKIEVAGSIWWVL

SEQ ID NO: 1896944 - protein, 20 aa, Staphylococcus
FYDHGAIDYKRLFGAIGKNL

SEQ ID NO: 1896945 - protein, 29 aa, Staphylococcus
FYDIVWSKPLVYGLLITGVLFSLMMRFFQ

SEQ ID NO: 1896946 - protein, 24 aa, Staphylococcus
FYDNYLIVILFITGQALLSFKLYK

SEQ ID NO: 1896947 - protein, 25 aa, Staphylococcus
FYETPNFWFGLFRYIAEGATIILVG

SEQ ID NO: 1896948 - protein, 18 aa, Staphylococcus
FYFFFLGYAIIGYIIAII

SEQ ID NO: 1896949 - protein, 24 aa, Staphylococcus
FYGNKLYFERLLINLINNSIDHNE

SEQ ID NO: 1896950 - protein, 27 aa, Staphylococcus
FYGVMIYIIIIFLFISIFGESFLHQII

SEQ ID NO: 1896951 - protein, 17 aa, Staphylococcus
FYGVPLTVSFALGVLLQ

SEQ ID NO: 1896952 - protein, 22 aa, Staphylococcus
FYILFALLMLIMPFVGLLLKWQ

SEQ ID NO: 1896953 - protein, 19 aa, Staphylococcus
FYILIGLQLLYTAFRILKS

SEQ ID NO: 1896954 - protein, 20 aa, Staphylococcus
FYIQNTMFPLQASELHVDNS

SEQ ID NO: 1896955 - protein, 22 aa, Staphylococcus
FYIWMIGLILYYGYLGYIIPLH

SEQ ID NO: 1896956 - protein, 21 aa, Staphylococcus
FYIWVIGLLLFYGYLGLIIPL

SEQ ID NO: 1896957 - protein, 18 aa, Staphylococcus
FYLAYLLCIIVLISLISE

SEQ ID NO: 1896958 - protein, 27 aa, Staphylococcus
FYLVEAWAKRMTIINAILILLCLCAIF

SEQ ID NO: 1896959 - protein, 17 aa, Staphylococcus
FYMFYAIKDGGLGMDEV

SEQ ID NO: 1896960 - protein, 18 aa, Staphylococcus
FYMSILFTTIFMGSSFPT

SEQ ID NO: 1896961 - protein, 17 aa, Staphylococcus
FYMYRKHIFMAAVGEVL

SEQ ID NO: 1896962 - protein, 28 aa, Staphylococcus
FYNHPSFFILLYLGIFIYFLILTSRKLS

SEQ ID NO: 1896963 - protein, 38 aa, Staphylococcus
FYNYLNAEHPVGMAMLILAVLAIIGFILNMFIKHFKKE

SEQ ID NO: 1896964 - protein, 18 aa, Staphylococcus
FYPVIFVICTIITIQFGL

SEQ ID NO: 1896965 - protein, 25 aa, Staphylococcus
FYTKYKSFFIKGLQNTILISFVGVV

SEQ ID NO: 1896966 - protein, 20 aa, Staphylococcus
FYTLTWLIGLLIMIGGVIQL

SEQ ID NO: 1896967 - protein, 25 aa, Staphylococcus
FYVAATFRFILVMIGVLSASIVNLI

SEQ ID NO: 1896968 - protein, 31 aa, Staphylococcus
FYVKKNKKALLYLLFCWTEIPGVIGMIEGVL

SEQ ID NO: 1896969 - protein, 24 aa, Staphylococcus
FYVKMVILVFFLFASYVKYVPKFI

SEQ ID NO: 1896970 - protein, 19 aa, Staphylococcus
FYVSIISFFIAFIFGYIVS

SEQ ID NO: 1896971 - protein, 20 aa, Staphylococcus
FYVTAAFRFILVMIGVVSAS

SEQ ID NO: 1896972 - protein, 29 aa, Staphylococcus
FYWKENKVKLVFFLAIAQRDIELTKRIIQ

SEQ ID NO: 1896973 - protein, 24 aa, Staphylococcus
GAAFLTFSFVQRFIQIKFFSEFVA

SEQ ID NO: 1896974 - protein, 18 aa, Staphylococcus
GAAGIISGLILYSKFKGQ

SEQ ID NO: 1896975 - protein, 25 aa, Staphylococcus
GAAIMTYILRYTWRVLIFGTSNKLG

SEQ ID NO: 1896976 - protein, 29 aa, Staphylococcus
GAAKMMIPVYFKHLIIAVPLVINGIIGGL

SEQ ID NO: 1896977 - protein, 24 aa, Staphylococcus
GAAVGWFWFVFTGGLNVLGALYSI

SEQ ID NO: 1896978 - protein, 25 aa, Staphylococcus
GAAVGWFWFVFTGGLSVFGAFYSAF

SEQ ID NO: 1896979 - protein, 24 aa, Staphylococcus
GAAVGWFWFVFTGGLSVLGSFYSS

SEQ ID NO: 1896980 - protein, 23 aa, Staphylococcus
GAAVGWFWLVFTGGLNVLGAFYS

SEQ ID NO: 1896981 - protein, 24 aa, Staphylococcus
GACGWMVYILFFDGLQVHTIYSSF

SEQ ID NO: 1896982 - protein, 25 aa, Staphylococcus
GACGWMVYVIFFNGLRLHTIYSSFF

SEQ ID NO: 1896983 - protein, 25 aa, Staphylococcus
GADAYIYLISSIFIALISGYFGYKA

SEQ ID NO: 1896984 - protein, 28 aa, Staphylococcus
GAFCIIMIFALLGFLPYNLNPAKVFMGD

SEQ ID NO: 1896985 - protein, 26 aa, Staphylococcus
GAFGWLVFEYIITKKLSLLGLLSGVL

SEQ ID NO: 1896986 - protein, 34 aa, Staphylococcus
GAFIALLKINKFKPLSWLASIYIEFLRGTPMLVQ

SEQ ID NO: 1896987 - protein, 17 aa, Staphylococcus
GAFILPGDWIGQSGPIA

SEQ ID NO: 1896988 - protein, 24 aa, Staphylococcus
GAFLLMFLVFTIFVGLPLLIMEFT

SEQ ID NO: 1896989 - protein, 17 aa, Staphylococcus
GAFVLQLALLLVTHIVF

SEQ ID NO: 1896990 - protein, 40 aa, Staphylococcus
GAGIALLKLSKIKLLSWLASAYIEFLRGTPLLVQVFLVYF

SEQ ID NO: 1896991 - protein, 25 aa, Staphylococcus
GAGIMLFIMIIYWLVQLSGFKEQVQ

SEQ ID NO: 1896992 - protein, 25 aa, Staphylococcus
GAIAAIIVLWYYWRKRKSNIERMVA

SEQ ID NO: 1896993 - protein, 27 aa, Staphylococcus
GAIAGLFTLWYYWKKRKPHIQKMVESD

SEQ ID NO: 1896994 - protein, 27 aa, Staphylococcus
GAIAIIFITPVLPYALAFAAGAMIFVV

SEQ ID NO: 1896995 - protein, 20 aa, Staphylococcus
GAIALGHPLGATGAMLVGRL

SEQ ID NO: 1896996 - protein, 18 aa, Staphylococcus
GAIFGIIVVRIRIYLTAN

SEQ ID NO: 1896997 - protein, 24 aa, Staphylococcus
GAIFLLFGTFLYFIATDGYINMQL

SEQ ID NO: 1896998 - protein, 26 aa, Staphylococcus
GAIFTSIIWLLGSFAFGWYISNFGNY

SEQ ID NO: 1896999 - protein, 23 aa, Staphylococcus
GAILTIIILFFLTNGVHVDHSKQ

SEQ ID NO: 1897000 - protein, 19 aa, Staphylococcus
GAINLVKRIYLQDNGIEAG

SEQ ID NO: 1897001 - protein, 20 aa, Staphylococcus
GAISLGHPLGATGAILTARL

SEQ ID NO: 1897002 - protein, 20 aa, Staphylococcus
GAIYLSLFKVFGPLFTVLPG

SEQ ID NO: 1897003 - protein, 18 aa, Staphylococcus
GALFFVVKYLPETRGRSL

SEQ ID NO: 1897004 - protein, 25 aa, Staphylococcus
GALFNAFLYLLVLLDERRLKNIVMY

SEQ ID NO: 1897005 - protein, 18 aa, Staphylococcus
GALIAMKFNLTPLAIAVV

SEQ ID NO: 1897006 - protein, 25 aa, Staphylococcus
GALIPVFFIVLLWAAGIHGVAVMGA

SEQ ID NO: 1897007 - protein, 24 aa, Staphylococcus
GALLGFLFFNFHPAKIFLGDSGAL

SEQ ID NO: 1897008 - protein, 26 aa, Staphylococcus
GALMTPLMLIIFRFPPHVAVGTSMMM

SEQ ID NO: 1897009 - protein, 29 aa, Staphylococcus
GALVLQLALLCITQLYYHFSKGVSSEREP

SEQ ID NO: 1897010 - protein, 24 aa, Staphylococcus
GALVVIIWIAWIKPLASINELFGM

SEQ ID NO: 1897011 - protein, 24 aa, Staphylococcus
GALVVIIWIVWVKPLANINELFGM

SEQ ID NO: 1897012 - protein, 24 aa, Staphylococcus
GAMFLLFGTFLYFYATKGYPNMQL

SEQ ID NO: 1897013 - protein, 22 aa, Staphylococcus
GAPWNIVIFSIGMYLVVFGLKN

SEQ ID NO: 1897014 - protein, 17 aa, Staphylococcus
GAQHALDLLKLAGLSTL

SEQ ID NO: 1897015 - protein, 18 aa, Staphylococcus
GAREIIGLALNKLGYSLN

SEQ ID NO: 1897016 - protein, 18 aa, Staphylococcus
GARFLLDFPLSYSYLRAL

SEQ ID NO: 1897017 - protein, 25 aa, Staphylococcus
GARVRFLKMILLILAVMLAGASIAV

SEQ ID NO: 1897018 - protein, 34 aa, Staphylococcus
GASALLPLLKLVLLVVFAMVFFILVVLGIVAKMC

SEQ ID NO: 1897019 - protein, 36 aa, Staphylococcus
GASFDPFTPLIVAAILYFILTFTLSRVMYYFEGRMK

SEQ ID NO: 1897020 - protein, 37 aa, Staphylococcus
GASFDPFTPLLVAAILYFILTFVLSRVMYFFEGRMKV

SEQ ID NO: 1897021 - protein, 25 aa, Staphylococcus
GASPFQIIRYFLMPEALGSLILAIT

SEQ ID NO: 1897022 - protein, 23 aa, Staphylococcus
GASYLFMMLIKRDLIPQNLMPPI

SEQ ID NO: 1897023 - protein, 30 aa, Staphylococcus; identical to SEQ ID NO: 1749846

SEQ ID NO: 1897024 - protein, 25 aa, Staphylococcus
GAVIAFVMLIPALFGFVFLAVIERW

SEQ ID NO: 1897025 - protein, 26 aa, Staphylococcus
GAVILLLIFLALIFHLIRLAIKTTSS

SEQ ID NO: 1897026 - protein, 34 aa, Staphylococcus
GAVTYFIVIIFQFYILHILFAKYLIKWKPVPVII

SEQ ID NO: 1897027 - protein, 27 aa, Staphylococcus
GAVVLLLIFLALIFHLIRLATKVESPF

SEQ ID NO: 1897028 - protein, 19 aa, Staphylococcus
GAYLKATTTQTKYTVTSPS

SEQ ID NO: 1897029 - protein, 24 aa, Staphylococcus
GAYLSLVVYIILSIAKYVTGYIYQ

SEQ ID NO: 1897030 - protein, 24 aa, Staphylococcus
GCGPFGCLSGCITLILLSSLITFL

SEQ ID NO: 1897031 - protein, 24 aa, Staphylococcus
GCLLGGVVASFLFRNTRPEIEQLI

SEQ ID NO: 1897032 - protein, 26 aa, Staphylococcus
GCLLGSLVAGFLFRNTHPSLQVLEES

SEQ ID NO: 1897033 - protein, 19 aa, Staphylococcus
GCLSSIIISILLSIIFTFL

SEQ ID NO: 1897034 - protein, 24 aa, Staphylococcus
GDAMPIIIIFIITLSAILTVLYST

SEQ ID NO: 1897035 - protein, 35 aa, Staphylococcus
GDDWTFVIATIPWLIIIIPFLLYKSNVLNLINTHE

SEQ ID NO: 1897036 - protein, 23 aa, Staphylococcus
GDFIFIIAIFVIGTYLLSYFNIH

SEQ ID NO: 1897037 - protein, 24 aa, Staphylococcus
GDFNIVWLILLIGLVIYWGIATYL

SEQ ID NO: 1897038 - protein, 31 aa, Staphylococcus
GDIFLKNIWFYVIFLLFYGLVLFLLTLIVQK

SEQ ID NO: 1897039 - protein, 17 aa, Staphylococcus
GDIFNMFVFFEVFLMSS

SEQ ID NO: 1897040 - protein, 35 aa, Staphylococcus
GDLFLLHAQVESPLLFVLVALFGAIVFNTIVYTCV

SEQ ID NO: 1897041 - protein, 35 aa, Staphylococcus
GDLLILKASVESPILFVLIALFASLVFNTIVYTCV

SEQ ID NO: 1897042 - protein, 27 aa, Staphylococcus
GDNLPRFFIYLLLFMFSMLGIVISNNT

SEQ ID NO: 1897043 - protein, 25 aa, Staphylococcus
GDSNNLVLGESILVVGNPLGVDFKG

SEQ ID NO: 1897044 - protein, 23 aa, Staphylococcus
GDTFCLYLIWYSIGRFFVEGMRT

SEQ ID NO: 1897045 - protein, 25 aa, Staphylococcus
GDWKAIFIVNFPLSILAFVFGYLYF

SEQ ID NO: 1897046 - protein, 26 aa, Staphylococcus
GDYKHPTWMLIFGIVAVIVTILTGIF

SEQ ID NO: 1897047 - protein, 25 aa, Staphylococcus
GDYKHPTWMLWFGIVAVVVTIVIGI

SEQ ID NO: 1897048 - protein, 21 aa, Staphylococcus
GDYPSHIPMMPEKVYFDKQLN

SEQ ID NO: 1897049 - protein, 23 aa, Staphylococcus
GEAMPLIILFIVTLSGILSILCS

SEQ ID NO: 1897050 - protein, 23 aa, Staphylococcus
GEASKIEMIYINPEGEPASINAI

SEQ ID NO: 1897051 - protein, 18 aa, Staphylococcus
GEDNLVTSMLFVGSIVIG

SEQ ID NO: 1897052 - protein, 18 aa, Staphylococcus
GEFEFWFALIKVITIILM

SEQ ID NO: 1897053 - protein, 25 aa, Staphylococcus
GEFEFWFALIKVITILLMIVAGLGL

SEQ ID NO: 1897054 - protein, 19 aa, Staphylococcus
GEFEFWFALIKVVTIILMI

SEQ ID NO: 1897055 - protein, 17 aa, Staphylococcus
GEFFGWVAGWALLAEYF

SEQ ID NO: 1897056 - protein, 19 aa, Staphylococcus
GEHVLTWIGVAIQALVAIM

SEQ ID NO: 1897057 - protein, 32 aa, Staphylococcus
GEISSLIYLIFPYYGLYLTWQDDSFLLNLFIV

SEQ ID NO: 1897058 - protein, 21 aa, Staphylococcus
GEIVFYIFLVGGAFGIVHKTG

SEQ ID NO: 1897059 - protein, 21 aa, Staphylococcus
GEIVFYIFLVGGAFGIVHRTG

SEQ ID NO: 1897060 - protein, 18 aa, Staphylococcus
GEIVVANSAYYEVFSPEQ

SEQ ID NO: 1897061 - protein, 23 aa, Staphylococcus
GEKIYVYNWGEYIDPALIKQFEK

SEQ ID NO: 1897062 - protein, 23 aa, Staphylococcus
GELIRWLFVFGILFQLPTLFMGL

SEQ ID NO: 1897063 - protein, 23 aa, Staphylococcus
GELIRWLLVFGFIFQLPILFMGL

SEQ ID NO: 1897064 - protein, 28 aa, Staphylococcus
GELIRWLLVFGFLFQIPVLFLGLAHFGL

SEQ ID NO: 1897065 - protein, 18 aa, Staphylococcus
GEMLLLDLPLPSTVSMIG

SEQ ID NO: 1897066 - protein, 48 aa, Staphylococcus
GEPEKKKMSGISKLISTIIVLLLLSGLAFAIFAFVDHSNRSSERLNNQ

SEQ ID NO: 1897067 - protein, 31 aa, Staphylococcus
GEPTFDKLLHPLFELIHLPDALTTTISFIVS

SEQ ID NO: 1897068 - protein, 26 aa, Staphylococcus
GEQIKKIEAIKLYFGFDKSPLSHVEP

SEQ ID NO: 1897069 - protein, 31 aa, Staphylococcus
GERASTTTFVYSFIAFILGVGVISLRRKFSK

SEQ ID NO: 1897070 - protein, 25 aa, Staphylococcus
GERQMDLIKILFQKAKNLDSYDRLD

SEQ ID NO: 1897071 - protein, 24 aa, Staphylococcus
GESKWSFAKLLNYGIDGLISFNNK

SEQ ID NO: 1897072 - protein, 24 aa, Staphylococcus
GESKWSFSKLLNYGIDGLISFNNK

SEQ ID NO: 1897073 - protein, 18 aa, Staphylococcus
GESKWTFSSLLNYGIDGL

SEQ ID NO: 1897074 - protein, 23 aa, Staphylococcus
GESKWTFTKLLNYGIDGLISFNN

SEQ ID NO: 1897075 - protein, 38 aa, Staphylococcus
GETDSDGRYTLRFPDGTLNDKYMYGYVVNPNGEVQNAY

SEQ ID NO: 1897076 - protein, 49 aa, Staphylococcus
GETEPNVPVTIYVGPTTYRTTSDATGKFRQPLNVPLKQGDVVTATINKG

SEQ ID NO: 1897077 - protein, 23 aa, Staphylococcus
GETFFTYLIWYSIGRFFVEGLRT

SEQ ID NO: 1897078 - protein, 34 aa, Staphylococcus
GETFSEFRIFLAVLLGLLLVISISLVIASTYSII

SEQ ID NO: 1897079 - protein, 24 aa, Staphylococcus
GETGRQIGWFISYDKDNPNMMMAI

SEQ ID NO: 1897080 - protein, 21 aa, Staphylococcus
GETKAILTDILEKAKKDKDIK

SEQ ID NO: 1897081 - protein, 24 aa, Staphylococcus
GETRKKYDAFKRDTLDYTNNYLAP

SEQ ID NO: 1897082 - protein, 20 aa, Staphylococcus
GEYHQWYMHLNEFKVEVGDD

SEQ ID NO: 1897083 - protein, 23 aa, Staphylococcus
GEYMNFWFPNLPQWVPGVIAVAL

SEQ ID NO: 1897084 - protein, 18 aa, Staphylococcus
GFCIFVLFSPIGKLKLGK

SEQ ID NO: 1897085 - protein, 25 aa, Staphylococcus
GFDYLLLTMLLYIPGLIVYSIVQKN

SEQ ID NO: 1897086 - protein, 23 aa, Staphylococcus
GFFKGFLSLIPVLIGIVVGYIVS

SEQ ID NO: 1897087 - protein, 20 aa, Staphylococcus
GFFLLAPLFVSMVVGIVFLK

SEQ ID NO: 1897088 - protein, 22 aa, Staphylococcus
GFFPVMMFGIPAAALAMYHTAK

SEQ ID NO: 1897089 - protein, 25 aa, Staphylococcus
GFFSVRLLLSLVFINLTSPVGMHLV

SEQ ID NO: 1897090 - protein, 25 aa, Staphylococcus
GFGASFLFNWLIKLDFISQGLMPSI

SEQ ID NO: 1897091 - protein, 19 aa, Staphylococcus
GFGILSGILILVAGVIALI

SEQ ID NO: 1897092 - protein, 28 aa, Staphylococcus
GFGIVFYLIFLILFLFAALTSSISLLEL

SEQ ID NO: 1897093 - protein, 25 aa, Staphylococcus
GFGLSLFTAILPVILMLISTIVQLI

SEQ ID NO: 1897094 - protein, 26 aa, Staphylococcus
GFGMTAFLLVLIYRTYRVTKEYEISA

SEQ ID NO: 1897095 - protein, 27 aa, Staphylococcus
GFGPFGAFLYGFFNRLLIPTGLHHALN

SEQ ID NO: 1897096 - protein, 19 aa, Staphylococcus
GFHELFFDLIFVYAIQKIA

SEQ ID NO: 1897097 - protein, 24 aa, Staphylococcus
GFIATVLFLFNILRFVFAWFEARF

SEQ ID NO: 1897098 - protein, 26 aa, Staphylococcus
GFIDYILYGLLNWHRTNALWVIPVGI

SEQ ID NO: 1897099 - protein, 25 aa, Staphylococcus
GFIDYVLFGLLNWDKTHALLVIPVG

SEQ ID NO: 1897100 - protein, 27 aa, Staphylococcus
GFIIARIYFVIFQWPYYVQHPIEIPMI

SEQ ID NO: 1897101 - protein, 24 aa, Staphylococcus
GFIILIIMTILHCFLTTDTPYWYV

SEQ ID NO: 1897102 - protein, 19 aa, Staphylococcus
GFILFFLMKGTHIMTPEMI

SEQ ID NO: 1897103 - protein, 21 aa, Staphylococcus
GFILVMLLAVYLGFREKKRIQ

SEQ ID NO: 1897104 - protein, 27 aa, Staphylococcus
GFISFVVPFLLMYIMDGFKGVKETFPA

SEQ ID NO: 1897105 - protein, 28 aa, Staphylococcus
GFITSIFYWFFFVLIINYTAAYAENPTQ

SEQ ID NO: 1897106 - protein, 18 aa, Staphylococcus
GFIVIMAVWLYKIATESG

SEQ ID NO: 1897107 - protein, 20 aa, Staphylococcus
GFIVIMAVWLYKISTKSGQF

SEQ ID NO: 1897108 - protein, 26 aa, Staphylococcus
GFKRNYLFFVFLFLIGSIIGLFSFDL

SEQ ID NO: 1897109 - protein, 17 aa, Staphylococcus
GFLFYICLPFQTLLEKF

SEQ ID NO: 1897110 - protein, 19 aa, Staphylococcus
GFLILYFLAPFISELTLSR

SEQ ID NO: 1897111 - protein, 19 aa, Staphylococcus
GFLILYPFIAYAIGSVRDA

SEQ ID NO: 1897112 - protein, 28 aa, Staphylococcus
GFLLAFVSLFLVIWFPASPFVIIFSSIM

SEQ ID NO: 1897113 - protein, 24 aa, Staphylococcus
GFLLFLILIIFLPLNIELSVWALI

SEQ ID NO: 1897114 - protein, 19 aa, Staphylococcus
GFLMVILASGMMYLLHKKE

SEQ ID NO: 1897115 - protein, 40 aa, Staphylococcus
GFLNQVLYHKVSAIYPLLFTILIVLILRVTFNMLNQRLGD

SEQ ID NO: 1897116 - protein, 21 aa, Staphylococcus
GFLRLEIIVAFLNGLALIVIS

SEQ ID NO: 1897117 - protein, 33 aa, Staphylococcus
GFLSGLVCALLLFIIIMVLYGQAILAIIVGGSL

SEQ ID NO: 1897118 - protein, 19 aa, Staphylococcus
GFLSWFRRLGRMKTPQPLP

SEQ ID NO: 1897119 - protein, 25 aa, Staphylococcus
GFMGTLWMSVIWIGVGGLIAFYVVG

SEQ ID NO: 1897120 - protein, 26 aa, Staphylococcus
GFMNALGLLLLWTQMKYIFGISIATY

SEQ ID NO: 1897121 - protein, 19 aa, Staphylococcus
GFMRLEIIVAFLNGLALIV

SEQ ID NO: 1897122 - protein, 23 aa, Staphylococcus
GFMTLPLWITIIGSLALAVYMLV

SEQ ID NO: 1897123 - protein, 18 aa, Staphylococcus
GFMVPILAGYIAYSIADK

SEQ ID NO: 1897124 - protein, 34 aa, Staphylococcus
GFNRTRIGMFVWLILLLPLPFLLSDLGPVFIGLA

SEQ ID NO: 1897125 - protein, 32 aa, Staphylococcus
GFNRTRISMFIWLVLLLPIPFMLSNLGTTFIV

SEQ ID NO: 1897126 - protein, 24 aa, Staphylococcus
GFNTTQFVIWLQNGIWAVIVYFII

SEQ ID NO: 1897127 - protein, 19 aa, Staphylococcus
GFPRWASILTIFVVLIAII

SEQ ID NO: 1897128 - protein, 19 aa, Staphylococcus
GFQFSYWLHSIFGIPDNII

SEQ ID NO: 1897129 - protein, 29 aa, Staphylococcus
GFRFSLVFWFIFAVIALILWIPQMLSGTK

SEQ ID NO: 1897130 - protein, 26 aa, Staphylococcus
GFSLLEIILLCLLVYAGAAQFIICAL

SEQ ID NO: 1897131 - protein, 25 aa, Staphylococcus
GFSNWHMVYFTLTVLYIILAFVIHR

SEQ ID NO: 1897132 - protein, 19 aa, Staphylococcus
GFTFIEMLISLLITIIILT

SEQ ID NO: 1897133 - protein, 18 aa, Staphylococcus
GFTIEEIQNALQTIEDAI

SEQ ID NO: 1897134 - protein, 21 aa, Staphylococcus
GFTLFAIFFGAGNLIFPPNLG

SEQ ID NO: 1897135 - protein, 22 aa, Staphylococcus
GFTLFIFTIIMNLLSQWISKRF

SEQ ID NO: 1897136 - protein, 25 aa, Staphylococcus
GFTPAFFATLFIYAAGIALIFTYHK

SEQ ID NO: 1897137 - protein, 23 aa, Staphylococcus
GFTTLVMQEGFLSGLFGVSATGP

SEQ ID NO: 1897138 - protein, 27 aa, Staphylococcus
GFTVLIIMTILHAFLTTETPFWYVVVI

SEQ ID NO: 1897139 - protein, 20 aa, Staphylococcus
GFVLVLIFATYLGFREKKRI

SEQ ID NO: 1897140 - protein, 24 aa, Staphylococcus
GFVLYTAFIFWLSLVTNIMIVWLI

SEQ ID NO: 1897141 - protein, 25 aa, Staphylococcus
GFVRSFILLIILRALQGICAAAFSP

SEQ ID NO: 1897142 - protein, 26 aa, Staphylococcus
GFYGYRTMRRYTYPTVLMGAIIGALN

SEQ ID NO: 1897143 - protein, 21 aa, Staphylococcus
GFYIQNTMFPLQTAELHIDQS

SEQ ID NO: 1897144 - protein, 17 aa, Staphylococcus
GFYLYHNATSFVTTDNA

SEQ ID NO: 1897145 - protein, 18 aa, Staphylococcus
GFYVLGFLAAFIVGLIAI

SEQ ID NO: 1897146 - protein, 29 aa, Staphylococcus
GGAFLLMFLVFTIFIGLPLLIMEFTIGKL

SEQ ID NO: 1897147 - protein, 24 aa, Staphylococcus
GGALVWLMYLPHWKATEDQATKLG

SEQ ID NO: 1897148 - protein, 24 aa, Staphylococcus
GGALVWLMYLPHWKVTEEPDVKLG

SEQ ID NO: 1897149 - protein, 20 aa, Staphylococcus
GGDIIFQIGPGLFGVRDQEG

SEQ ID NO: 1897150 - protein, 24 aa, Staphylococcus
GGEFDLQFAFDNLREILLKANEYQ

SEQ ID NO: 1897151 - protein, 23 aa, Staphylococcus
GGFANWRFVFGVMILLAVITMLG

SEQ ID NO: 1897152 - protein, 54 aa, Staphylococcus
GGFIDFFLLGILPNKTQWWLVIPVGLVYAAIYYIIFRFLIVKFNFKTPGREDKE

SEQ ID NO: 1897153 - protein, 29 aa, Staphylococcus
GGGAFLFLFLIFTIFVGLPLLIMEFTVGI

SEQ ID NO: 1897154 - protein, 21 aa, Staphylococcus
GGGDIIFQIGPGLFGVRDKDG

SEQ ID NO: 1897155 - protein, 23 aa, Staphylococcus
GGGYLIWLWLREGHTYWLGLMGG

SEQ ID NO: 1897156 - protein, 22 aa, Staphylococcus
GGGYLIWLWLREGQPSWLGVIG

SEQ ID NO: 1897157 - protein, 26 aa, Staphylococcus
GGIDKVLWFFIAVIIGSLVTMMTVLI

SEQ ID NO: 1897158 - protein, 28 aa, Staphylococcus
GGIFGGVLVWLMYLPHWKATEDQGAKLG

SEQ ID NO: 1897159 - protein, 30 aa, Staphylococcus
GGIHEIYFPYVLMRPLLFVSVILGGMTGVA

SEQ ID NO: 1897160 - protein, 24 aa, Staphylococcus
GGIIVLMLWLYITGFIIIVGAEIN

SEQ ID NO: 1897161 - protein, 53 aa, Staphylococcus
GGILISKKPKIAGILLIIAGLIALMSNWISVILWIVAGIMLLVRKGKKKDSYA

SEQ ID NO: 1897162 - protein, 23 aa, Staphylococcus
GGKTLLYFVIMTSFAIFMGLIFG

SEQ ID NO: 1897163 - protein, 23 aa, Staphylococcus
GGKVMLLYFMFCGIMAICQNIIG

SEQ ID NO: 1897164 - protein, 29 aa, Staphylococcus
GGKYMGYIILLFFVFVFALLFVNVETRRA

SEQ ID NO: 1897165 - protein, 18 aa, Staphylococcus
GGLFGALLRYVLSTLNVD

SEQ ID NO: 1897166 - protein, 22 aa, Staphylococcus
GGLFVICLLFFIVYRAFVLATK

SEQ ID NO: 1897167 - protein, 20 aa, Staphylococcus
GGLFVILLEFFIVYRAFQLA

SEQ ID NO: 1897168 - protein, 37 aa, Staphylococcus
GGLIGFYLLAIFEPLVSIIGVILITIVLSASSIILIM

SEQ ID NO: 1897169 - protein, 19 aa, Staphylococcus
GGLILMLFSYLLAFIALKE

SEQ ID NO: 1897170 - protein, 19 aa, Staphylococcus
GGLLILIVTLCRLVMYEEF

SEQ ID NO: 1897171 - protein, 24 aa, Staphylococcus
GGLSFVLLLIQQWLFLNPNHNLNQ

SEQ ID NO: 1897172 - protein, 24 aa, Staphylococcus
GGSIFYLLALLSFPFPVKAIRRFK

SEQ ID NO: 1897173 - protein, 26 aa, Staphylococcus
GGSIIIYPAILLLPPLFGTPEYSAYI

SEQ ID NO: 1897174 - protein, 24 aa, Staphylococcus
GGSLFYLLVLLSFPMPIKAVRRFN

SEQ ID NO: 1897175 - protein, 28 aa, Staphylococcus
GGSLLDSILDIPTPTPEKGLTLGSNDGF

SEQ ID NO: 1897176 - protein, 23 aa, Staphylococcus
GGSLWIIVYLVVLSFLSFIGSKE

SEQ ID NO: 1897177 - protein, 25 aa, Staphylococcus
GGSMWIIVYLILLACMSFIGSKEFK

SEQ ID NO: 1897178 - protein, 26 aa, Staphylococcus
GGSQVGPGAYAFDLRQAYTDANGKEH

SEQ ID NO: 1897179 - protein, 21 aa, Staphylococcus
GGSWNLWRNLAKQSPEFGNPE

SEQ ID NO: 1897180 - protein, 20 aa, Staphylococcus
GGSWTLWRNLAKQSPEFGCP

SEQ ID NO: 1897181 - protein, 23 aa, Staphylococcus
GGTAFAFYLFIDSLKYLSPKETT

SEQ ID NO: 1897182 - protein, 22 aa, Staphylococcus
GGTFFYRFRKIIAPLFASGYSM

SEQ ID NO: 1897183 - protein, 25 aa, Staphylococcus
GGTFRVLTKVFKRLGIDADFVDTTH

SEQ ID NO: 1897184 - protein, 24 aa, Staphylococcus
GGTRIRPILMTAVATIGALLPLLF

SEQ ID NO: 1897185 - protein, 24 aa, Staphylococcus
GGVIGYYLVHLSIPLVSIVGVVVF

SEQ ID NO: 1897186 - protein, 17 aa, Staphylococcus
GGVPIFPALIGAIILIF

SEQ ID NO: 1897187 - protein, 17 aa, Staphylococcus
GGVPIIPALIGAIIVIF

SEQ ID NO: 1897188 - protein, 25 aa, Staphylococcus
GGVTLIIILVLQRFTKGFLKSIAIL

SEQ ID NO: 1897189 - protein, 25 aa, Staphylococcus
GGWFGWIIMVLLWGITIWGILYKAI

SEQ ID NO: 1897190 - protein, 25 aa, Staphylococcus
GGWIGWFVFILLWGTTIWGILYKSI

SEQ ID NO: 1897191 - protein, 18 aa, Staphylococcus
GGWIIIYMGNVIWQILSL

SEQ ID NO: 1897192 - protein, 25 aa, Staphylococcus
GGWLGWLVFLLLWGTTIWGILYKSI

SEQ ID NO: 1897193 - protein, 18 aa, Staphylococcus
GGYAMMLPKQDRFLMTEP

SEQ ID NO: 1897194 - protein, 22 aa, Staphylococcus
GGYIMPPLMLLLGFLALENQYP

SEQ ID NO: 1897195 - protein, 28 aa, Staphylococcus
GGYLFGSLFFMLISKIWIGKSASLVDYP

SEQ ID NO: 1897196 - protein, 21 aa, Staphylococcus
GGYLIWLWLREGQSSWLGCIG

SEQ ID NO: 1897197 - protein, 19 aa, Staphylococcus
GGYLIWLWLREGQSSWLGF

SEQ ID NO: 1897198 - protein, 26 aa, Staphylococcus
GHDVSWGEWFLYAAPWSILMSIALFF

SEQ ID NO: 1897199 - protein, 28 aa, Staphylococcus
GHDVSWGEWFMYAAPWSVLMSIALYFIM

SEQ ID NO: 1897200 - protein, 22 aa, Staphylococcus
GHFLWPAILAFALTGIGLPLLG

SEQ ID NO: 1897201 - protein, 17 aa, Staphylococcus
GHIALIFGLGAILGKLL

SEQ ID NO: 1897202 - protein, 21 aa, Staphylococcus
GHLVLLLIIFIFCVASGIYPT

SEQ ID NO: 1897203 - protein, 27 aa, Staphylococcus
GHPLGATGAILTARLLSEMKKRPDTKY

SEQ ID NO: 1897204 - protein, 27 aa, Staphylococcus
GHPLGATGAMLVGRLLSEMKKRPETRY

SEQ ID NO: 1897205 - protein, 24 aa, Staphylococcus
GHSKWTFTKLLNYGIDGLISFNNK

SEQ ID NO: 1897206 - protein, 26 aa, Staphylococcus
GHSNIILMMLIFILAGAFSTTTEKMG

SEQ ID NO: 1897207 - protein, 26 aa, Staphylococcus
GHSNIILMMLIFLLAGAFSQTTEDMG

SEQ ID NO: 1897208 - protein, 18 aa, Staphylococcus
GHSNLFGSSSLLDKLLNG

SEQ ID NO: 1897209 - protein, 21 aa, Staphylococcus
GHVTIIPNRPIPEGDVTAKAT

SEQ ID NO: 1897210 - protein, 23 aa, Staphylococcus
GHYFWPAILAFVITGIGLPLLGV

SEQ ID NO: 1897211 - protein, 25 aa, Staphylococcus
GIAFLPLTIINFIAALYLPYFTEKL

SEQ ID NO: 1897212 - protein, 29 aa, Staphylococcus
GIANFKLPDLIKKVPVWPLTTFGKIDVNR

SEQ ID NO: 1897213 - protein, 21 aa, Staphylococcus
GIDFLAIMGFASAISVLFAVL

SEQ ID NO: 1897214 - protein, 25 aa, Staphylococcus
GIDKNRIKRMLADRPTLLAHTDDFI

SEQ ID NO: 1897215 - protein, 19 aa, Staphylococcus
GIDSAAFLRIPVGLNHNPI

SEQ ID NO: 1897216 - protein, 33 aa, Staphylococcus
GIDSVFTPIKLRRRVWRRLARDLKPNQLHDIKH

SEQ ID NO: 1897217 - protein, 31 aa, Staphylococcus
GIDVLGSFFSFLTWGAVISLILAIIGGILIS

SEQ ID NO: 1897218 - protein, 24 aa, Staphylococcus
GIDYALFILFRYRQIIKEERDVPK

SEQ ID NO: 1897219 - protein, 25 aa, Staphylococcus
GIDYSLFILFRYKEVRKRGLEPVEA

SEQ ID NO: 1897220 - protein, 20 aa, Staphylococcus
GIEGWRWMLGLAVVPSLILL

SEQ ID NO: 1897221 - protein, 20 aa, Staphylococcus
GIFIFFLYINKKVTLDIYKR

SEQ ID NO: 1897222 - protein, 23 aa, Staphylococcus
GIFLGVITFWLFAQSLVNIVPDL

SEQ ID NO: 1897223 - protein, 17 aa, Staphylococcus
GIFLLLCVFVLGQLVGL

SEQ ID NO: 1897224 - protein, 30 aa, Staphylococcus
GIFLSNFIATILFFIAGIMLFVRRSQKKHI

SEQ ID NO: 1897225 - protein, 28 aa, Staphylococcus
GIFSGFIIGAFFLPLVMLGLHHIFTPIH

SEQ ID NO: 1897226 - protein, 22 aa, Staphylococcus
GIGILLAYMIFGKGTAKATSYG

SEQ ID NO: 1897227 - protein, 23 aa, Staphylococcus
GIGLKTLIFFLCTTAIAITIAIL

SEQ ID NO: 1897228 - protein, 26 aa, Staphylococcus
GIGRVPAIIALVVYALLPILRNTYTG

SEQ ID NO: 1897229 - protein, 24 aa, Staphylococcus
GIGTLIGMRLRRVSPRKVIAPLIK

SEQ ID NO: 1897230 - protein, 23 aa, Staphylococcus
GIGTLLYILITKAKIPAYLGSSF

SEQ ID NO: 1897231 - protein, 18 aa, Staphylococcus
GIGVLKSEYTFTNNKNQR

SEQ ID NO: 1897232 - protein, 24 aa, Staphylococcus
GIGYFWFDVCILLVFIIVFTILNI

SEQ ID NO: 1897233 - protein, 29 aa, Staphylococcus
GIHEIYFPYVLMRPLLFIAVILGGMTGVA

SEQ ID NO: 1897234 - protein, 29 aa, Staphylococcus
GIHEIYFPYVLMRPMLFISVILGGMTGVA

SEQ ID NO: 1897235 - protein, 28 aa, Staphylococcus
GIIAAIAFLILCIGIVVVLISVKKNLDY

SEQ ID NO: 1897236 - protein, 28 aa, Staphylococcus
GIIAAIAFLILCIGVVVVLMSVKKNLDH

SEQ ID NO: 1897237 - protein, 30 aa, Staphylococcus
GIIAAIAFLVLCIGIVVVLISVKKNLDHVA

SEQ ID NO: 1897238 - protein, 31 aa, Staphylococcus
GIIAAVAFLILVIGIVVVLLSVKKNLDHVAK

SEQ ID NO: 1897239 - protein, 19 aa, Staphylococcus
GIIAGIFGLLLGGISSSLG

SEQ ID NO: 1897240 - protein, 24 aa, Staphylococcus
GIIALLTYIFDIPNFTLTLAVMIG

SEQ ID NO: 1897241 - protein, 22 aa, Staphylococcus
GIIAVVLMYIVGIWMHRRSSAK

SEQ ID NO: 1897242 - protein, 19 aa, Staphylococcus
GIIFFLALAFLFSSDRKNI

SEQ ID NO: 1897243 - protein, 21 aa, Staphylococcus
GIIFFLALAFLFSSDRKNIRW

SEQ ID NO: 1897244 - protein, 18 aa, Staphylococcus
GIIFFLALAFVFSSDKKN

SEQ ID NO: 1897245 - protein, 20 aa, Staphylococcus
GIIFFLALAYLFSSDRKNIR

SEQ ID NO: 1897246 - protein, 25 aa, Staphylococcus
GIIFLIMLKLILAITFFAVSLAISL

SEQ ID NO: 1897247 - protein, 18 aa, Staphylococcus
GIIFLPIIIMRTSWLFIL

SEQ ID NO: 1897248 - protein, 17 aa, Staphylococcus
GIIGEYIGRIYYEVKNR

SEQ ID NO: 1897249 - protein, 23 aa, Staphylococcus
GIIGLILGIIIATLVDLATPDMV

SEQ ID NO: 1897250 - protein, 25 aa, Staphylococcus
GIIIAIPMLVLVFTGLPWSGFMGDK

SEQ ID NO: 1897251 - protein, 26 aa, Staphylococcus
GIIIAIPVFVLVLTGLPWSGFMGAKI

SEQ ID NO: 1897252 - protein, 23 aa, Staphylococcus
GIIIAIVTVLFLYSAWSGLSKGI

SEQ ID NO: 1897253 - protein, 29 aa, Staphylococcus
GIIIFAIFVYYILFTILPIDKIIGRIYPI

SEQ ID NO: 1897254 - protein, 30 aa, Staphylococcus
GIIIVLAICYIFVNFFLFDTWVCQSSEKQI

SEQ ID NO: 1897255 - protein, 20 aa, Staphylococcus
GIIKEIIVTIPKDNIKTNLT

SEQ ID NO: 1897256 - protein, 28 aa, Staphylococcus
GIIKFGIPMLIPLLIKYAIDGVINNHSL

SEQ ID NO: 1897257 - protein, 26 aa, Staphylococcus
GIILGILTYWLFAQSLLNIAPYVQHD

SEQ ID NO: 1897258 - protein, 21 aa, Staphylococcus
GIILISLTFLPTPMYIVMCIL

SEQ ID NO: 1897259 - protein, 21 aa, Staphylococcus
GIILPIVAILIFIIINKKNLM

SEQ ID NO: 1897260 - protein, 20 aa, Staphylococcus
GIISGLILYSKFKGQPESHP

SEQ ID NO: 1897261 - protein, 19 aa, Staphylococcus
GIIVAFVVLLITFGSFIAA

SEQ ID NO: 1897262 - protein, 19 aa, Staphylococcus
GIIVFLALAFLFSSDKKNV

SEQ ID NO: 1897263 - protein, 21 aa, Staphylococcus
GIIVGLIALLAWPMSYSTGRE

SEQ ID NO: 1897264 - protein, 27 aa, Staphylococcus
GIIVIPFVLLGILVFSFHQMWNDDTGN

SEQ ID NO: 1897265 - protein, 24 aa, Staphylococcus
GIIVLLIILLAMNAVAILLRNKFS

SEQ ID NO: 1897266 - protein, 23 aa, Staphylococcus
GIIVLLILLLAMNGLAIFLRNKF

SEQ ID NO: 1897267 - protein, 24 aa, Staphylococcus
GIIVLLVILLLMNAIAIFLRNKYS

SEQ ID NO: 1897268 - protein, 24 aa, Staphylococcus
GIIVLLVILLLMNGLAIFFRNKFS

SEQ ID NO: 1897269 - protein, 24 aa, Staphylococcus
GIIVLLVILLLMNGLAIFLRNKFS

SEQ ID NO: 1897270 - protein, 18 aa, Staphylococcus
GIIVSCCFACYHFFLKEG

SEQ ID NO: 1897271 - protein, 23 aa, Staphylococcus
GIKRFVFSINNLAPFIAAIICII

SEQ ID NO: 1897272 - protein, 27 aa, Staphylococcus
GIKRLTFVGFLILTLASLPFGFLSDTT

SEQ ID NO: 1897273 - protein, 17 aa, Staphylococcus
GIKYGLFIQSIIDFIIV

SEQ ID NO: 1897274 - protein, 27 aa, Staphylococcus
GILAFIMTILGFKLLAPIMQFIMHILS

SEQ ID NO: 1897275 - protein, 29 aa, Staphylococcus
GILEFATWHWLFFINIPIAIIAIILVFIT

SEQ ID NO: 1897276 - protein, 28 aa, Staphylococcus
GILEFATWHWLFFINIPIAIVAGILAFI

SEQ ID NO: 1897277 - protein, 29 aa, Staphylococcus
GILEFATWHWLFFVNIPISIIAIILVVIT

SEQ ID NO: 1897278 - protein, 30 aa, Staphylococcus
GILEIATWHWLFFINIPIALIAIILVIFTF

SEQ ID NO: 1897279 - protein, 18 aa, Staphylococcus
GILFIIYLGAFIGFALYN

SEQ ID NO: 1897280 - protein, 20 aa, Staphylococcus
GILGFLFDDLIEKYLFSVPT

SEQ ID NO: 1897281 - protein, 18 aa, Staphylococcus
GILGIVFILAGYYLSTRF

SEQ ID NO: 1897282 - protein, 19 aa, Staphylococcus
GILILLALIILLKLNTFIS

SEQ ID NO: 1897283 - protein, 18 aa, Staphylococcus
GILLLWRSRWMKVYNRIP

SEQ ID NO: 1897284 - protein, 25 aa, Staphylococcus
GILNYFKILPFIIKVVGYIINKITR

SEQ ID NO: 1897285 - protein, 22 aa, Staphylococcus
GILPKFFFFILATLHAGSCVGD

SEQ ID NO: 1897286 - protein, 17 aa, Staphylococcus
GILQPLVEKYYVIEPIV

SEQ ID NO: 1897287 - protein, 23 aa, Staphylococcus
GILSMVFFNYLYFEIFSQSSLSL

SEQ ID NO: 1897288 - protein, 27 aa, Staphylococcus
GILVVLIAPFFSYLVRFFPPVVTGSVV

SEQ ID NO: 1897289 - protein, 25 aa, Staphylococcus
GIMGPMLIIPLFFQNFKHYTAIEAS

SEQ ID NO: 1897290 - protein, 25 aa, Staphylococcus
GIMGPMVILPLYFQEFKGYSAIGAA

SEQ ID NO: 1897291 - protein, 26 aa, Staphylococcus
GIMPIPVMFMLWFGVAILLNYPNLSI

SEQ ID NO: 1897292 - protein, 19 aa, Staphylococcus
GINLPLIFSIIVIILGIIL

SEQ ID NO: 1897293 - protein, 20 aa, Staphylococcus
GINVIFLWISAISFSALFTF

SEQ ID NO: 1897294 - protein, 23 aa, Staphylococcus
GINVYILRILKLPFSISLRFYSC

SEQ ID NO: 1897295 - protein, 19 aa, Staphylococcus
GIPAFLMVVLMGITGLILN

SEQ ID NO: 1897296 - protein, 18 aa, Staphylococcus
GIPAFLMVVLMGVTGLVL

SEQ ID NO: 1897297 - protein, 18 aa, Staphylococcus
GIPAFLMVVLMGVTGLVV

SEQ ID NO: 1897298 - protein, 26 aa, Staphylococcus
GIPGLLGLLLLPYTKLITVGIGNVVN

SEQ ID NO: 1897299 - protein, 26 aa, Staphylococcus
GIPVAAFGLLAPWIAGTAMAFSSVSV

SEQ ID NO: 1897300 - protein, 36 aa, Staphylococcus
GIPVAFIVWMVTFFAWDLSFLIDAIVGAGGFLLSYF

SEQ ID NO: 1897301 - protein, 25 aa, Staphylococcus
GIQDDGLWYFIPNDDSKQSATEILN

SEQ ID NO: 1897302 - protein, 25 aa, Staphylococcus
GIRFCAFIIDLLIIFGVHSLILKPI

SEQ ID NO: 1897303 - protein, 22 aa, Staphylococcus
GIRKLGRLYKKAGIKHITVQLY

SEQ ID NO: 1897304 - protein, 36 aa, Staphylococcus
GISFDPFTPLIIAACMYFVLTFLLSRLMSLIEGRLK

SEQ ID NO: 1897305 - protein, 36 aa, Staphylococcus
GISFDPFTPLIIAAIMYFILTFTLSRGMSLIEGRMK

SEQ ID NO: 1897306 - protein, 18 aa, Staphylococcus
GISHNILEFYTTDGDIII

SEQ ID NO: 1897307 - protein, 19 aa, Staphylococcus
GISLIVTITLILFFKKKDW

SEQ ID NO: 1897308 - protein, 25 aa, Staphylococcus
GISLSLMYAFGLSPAWTSFIINTVV

SEQ ID NO: 1897309 - protein, 20 aa, Staphylococcus
GISLWLGALIYLFSSVFTKK

SEQ ID NO: 1897310 - protein, 25 aa, Staphylococcus
GISPFLLVPYSIYPILLGICGLVAI

SEQ ID NO: 1897311 - protein, 24 aa, Staphylococcus
GISPFLLVPYSIYPILLGVCGLAS

SEQ ID NO: 1897312 - protein, 25 aa, Staphylococcus
GITFSHTLLLFSFITKTVSKKWGGL

SEQ ID NO: 1897313 - protein, 32 aa, Staphylococcus
GITHSIPFTILWPILITFIIYVLFPGVDTTHI

SEQ ID NO: 1897314 - protein, 34 aa, Staphylococcus
GITHSIPFTILWPILITFLIFVIFNHTNPLHVWM

SEQ ID NO: 1897315 - protein, 31 aa, Staphylococcus
GITHSIPFTILWPILITFLIFVIFNNTNPLH

SEQ ID NO: 1897316 - protein, 35 aa, Staphylococcus
GITHSIPFTILWPLFITLLIFTFFKNVDTTHVWLW

SEQ ID NO: 1897317 - protein, 32 aa, Staphylococcus
GITHSIPFTLLWPILITLLVFTFSKGVNPMHI

SEQ ID NO: 1897318 - protein, 56 aa, Staphylococcus
GITLFLIACIVIIFGIIAIFKNKNYLKMLAMAIIIILLSMLALGIHKVIESNNPSK

SEQ ID NO: 1897319 - protein, 32 aa, Staphylococcus
GITLVTILFGLLYFVLLFTSAYVLLRMFRNKP

SEQ ID NO: 1897320 - protein, 17 aa, Staphylococcus
GITSGFSLLGMGSLIGI

SEQ ID NO: 1897321 - protein, 43 aa, Staphylococcus
GIVATLAGILMALAPAFIFVTQVIIPLITTFGGLSGIISVVMG

SEQ ID NO: 1897322 - protein, 18 aa, Staphylococcus
GIVFLIMLKLMLAIAFFA

SEQ ID NO: 1897323 - protein, 27 aa, Staphylococcus
GIVGATLVWLMYLPHWKATTEQGAKLG

SEQ ID NO: 1897324 - protein, 26 aa, Staphylococcus
GIVLGVITFWLFAQSLLNLVPTIQHS

SEQ ID NO: 1897325 - protein, 46 aa, Staphylococcus
GIVPEILITKMIILILFGLGFFILGILVKPVLDPIMRKISKRVAES

SEQ ID NO: 1897326 - protein, 40 aa, Staphylococcus
GIVPEILITKVIILALFGLGFIIVGVILKPITDPLMRKVS

SEQ ID NO: 1897327 - protein, 25 aa, Staphylococcus
GIVVAFIILLITFGSLIAAGMPIIS

SEQ ID NO: 1897328 - protein, 21 aa, Staphylococcus
GIVVFLALAFLFSSDRKNIRW

SEQ ID NO: 1897329 - protein, 23 aa, Staphylococcus
GIWTLKLFILPNHPIIKSGLYKV

SEQ ID NO: 1897330 - protein, 20 aa, Staphylococcus
GIYPKILVRDIKNLPLKRED

SEQ ID NO: 1897331 - protein, 23 aa, Staphylococcus
GKAALVMFMWLPKAYAALNTELA

SEQ ID NO: 1897332 - protein, 23 aa, Staphylococcus
GKALMLPVAILPAAGILLTFGNA

SEQ ID NO: 1897333 - protein, 25 aa, Staphylococcus
GKAVAIILLVLQIAGGGGTFPVVTL

SEQ ID NO: 1897334 - protein, 22 aa, Staphylococcus
GKDFLLPFIYLIGNFCLSIVIL

SEQ ID NO: 1897335 - protein, 31 aa, Staphylococcus
GKDKFKLFMPWYYLVKFILPVIIVLIFIAQF

SEQ ID NO: 1897336 - protein, 29 aa, Staphylococcus
GKDYPLMMALLLFFSFLGLLANLISDIAY

SEQ ID NO: 1897337 - protein, 17 aa, Staphylococcus
GKEKGWVAGWHTNLNIP

SEQ ID NO: 1897338 - protein, 25 aa, Staphylococcus
GKFLNPIFLILLGIVVILAFIHPMG

SEQ ID NO: 1897339 - protein, 17 aa, Staphylococcus
GKFRPFILYGTVPLAIL

SEQ ID NO: 1897340 - protein, 19 aa, Staphylococcus
GKFVGYLTFSFKGSNSETV

SEQ ID NO: 1897341 - protein, 17 aa, Staphylococcus
GKFYYLQLFMISILFFK

SEQ ID NO: 1897342 - protein, 23 aa, Staphylococcus
GKGSWYIPKWLGGILPKIDIEGK

SEQ ID NO: 1897343 - protein, 23 aa, Staphylococcus
GKGSWYLPKWLGSILPELDIEGK

SEQ ID NO: 1897344 - protein, 25 aa, Staphylococcus
GKILGGVITGLGFFISVRSDLNEGK

SEQ ID NO: 1897345 - protein, 24 aa, Staphylococcus
GKINRLWLVLLFAGGGASLILLSL

SEQ ID NO: 1897346 - protein, 18 aa, Staphylococcus
GKIQYMNAVIEPATKPKK

SEQ ID NO: 1897347 - protein, 27 aa, Staphylococcus
GKKALRPVPVLGMLQPDGITAYEYNGE

SEQ ID NO: 1897348 - protein, 27 aa, Staphylococcus
GKKIFILYLGIAFIFSFSILSLSMREI

SEQ ID NO: 1897349 - protein, 32 aa, Staphylococcus
GKKNLHISDSKKVDPLIIAKRKKDKEEETIIE

SEQ ID NO: 1897350 - protein, 19 aa, Staphylococcus
GKKVLAPSGGFLQVSNSIR

SEQ ID NO: 1897351 - protein, 22 aa, Staphylococcus
GKKYYNFYGVGALDKDPIKTGA

SEQ ID NO: 1897352 - protein, 19 aa, Staphylococcus
GKLGRVFLLIPLSIGLILY

SEQ ID NO: 1897353 - protein, 23 aa, Staphylococcus
GKLGRVFLLIPVSIILIIIMKFR

SEQ ID NO: 1897354 - protein, 19 aa, Staphylococcus
GKLITPDKIAIALGLGADL

SEQ ID NO: 1897355 - protein, 18 aa, Staphylococcus
GKLTIYLGYSPGVGKTYE

SEQ ID NO: 1897356 - protein, 25 aa, Staphylococcus
GKMVFFYIITIIILAILVLFFIKEA

SEQ ID NO: 1897357 - protein, 29 aa, Staphylococcus
GKPVLAIIISLIILIAAIIPISGMRLGMP

SEQ ID NO: 1897358 - protein, 24 aa, Staphylococcus
GKQMGYVYFAWLLGLLVGWAFMNV

SEQ ID NO: 1897359 - protein, 25 aa, Staphylococcus
GKQMGYVYFAWLLGLLVGWAFMNVL

SEQ ID NO: 1897360 - protein, 23 aa, Staphylococcus
GKQMGYVYFAWLLGLLVGWVVMN

SEQ ID NO: 1897361 - protein, 23 aa, Staphylococcus
GKQMGYVYFAWLSGLLVGWAFMN

SEQ ID NO: 1897362 - protein, 24 aa, Staphylococcus
GKQRVWVYNLPVKSSKGVIGDIYI

SEQ ID NO: 1897363 - protein, 38 aa, Staphylococcus
GKSFSEFRVFLAILIILLLMISMILIISSTYALIKPIS

SEQ ID NO: 1897364 - protein, 33 aa, Staphylococcus
GKSGASMLPGAFEYSMQLPEGIEYVPNSITTSF

SEQ ID NO: 1897365 - protein, 21 aa, Staphylococcus
GKSILITSITPNQDGDIVVSF

SEQ ID NO: 1897366 - protein, 25 aa, Staphylococcus
GKSTIAKLLLRFWDVTRGDILIGDA

SEQ ID NO: 1897367 - protein, 35 aa, Staphylococcus
GKTFGEFRIFLLVLLIFLLLISISLVIASTYSIIK

SEQ ID NO: 1897368 - protein, 27 aa, Staphylococcus
GKTKTILFYHLVLPSEFAPVLGLSSDS

SEQ ID NO: 1897369 - protein, 28 aa, Staphylococcus
GKTKTILFYHLVLPSEFAPVLGLSSNSE

SEQ ID NO: 1897370 - protein, 24 aa, Staphylococcus
GKTPGEYTVPVTVTYPDGTKDHVN

SEQ ID NO: 1897371 - protein, 25 aa, Staphylococcus
GKTSFLDWGVFLVLGIFIGSYIAAK

SEQ ID NO: 1897372 - protein, 30 aa, Staphylococcus
GKTYFQSINPLFIVLLGPVISYIWKKMGER

SEQ ID NO: 1897373 - protein, 28 aa, Staphylococcus
GKTYVGQEPARYVITAKPDRVHNKMDFE

SEQ ID NO: 1897374 - protein, 33 aa, Staphylococcus
GKVALKYIFLLFIWNFSWILGILSFIYLYSLAK

SEQ ID NO: 1897375 - protein, 23 aa, Staphylococcus
GKVSFSFWPLNEMKFGFNPDTDY

SEQ ID NO: 1897376 - protein, 25 aa, Staphylococcus
GKVYQGIMPDWEPGKKLHLIGHSMG

SEQ ID NO: 1897377 - protein, 30 aa, Staphylococcus
GKWILPVFSMLFFIVAWFFARKPSKILDYI

SEQ ID NO: 1897378 - protein, 31 aa, Staphylococcus
GKWMAYAIVLFFIFIFVVLLINPSTRLAVII

SEQ ID NO: 1897379 - protein, 22 aa, Staphylococcus
GKWTHFLISIPVILGGSFSAFF

SEQ ID NO: 1897380 - protein, 22 aa, Staphylococcus
GKYQLQVFSAYRTTTKDNYIQT

SEQ ID NO: 1897381 - protein, 24 aa, Staphylococcus
GLACELIFLIFKYKSTKASVAMLA

SEQ ID NO: 1897382 - protein, 24 aa, Staphylococcus
GLADIIPWVVIVLAITMIVIFVKR

SEQ ID NO: 1897383 - protein, 29 aa, Staphylococcus
GLALFLGLSFLWIPFFSIGFSLITLIIVL

SEQ ID NO: 1897384 - protein, 23 aa, Staphylococcus
GLALLFHVFLYTLTVHLSYFAIR

SEQ ID NO: 1897385 - protein, 17 aa, Staphylococcus
GLALVVILLFIFLGYQL

SEQ ID NO: 1897386 - protein, 17 aa, Staphylococcus
GLDLIVVILVAPALTFG

SEQ ID NO: 1897387 - protein, 19 aa, Staphylococcus
GLEQVLNIEPLKFPEKGID

SEQ ID NO: 1897388 - protein, 26 aa, Staphylococcus
GLFAVYIIIIIFSLLNYWSVKILTSF

SEQ ID NO: 1897389 - protein, 22 aa, Staphylococcus
GLFGFILLIPILYQGFKHLVFS

SEQ ID NO: 1897390 - protein, 21 aa, Staphylococcus
GLFILIGLFVADWELGLAAVL

SEQ ID NO: 1897391 - protein, 25 aa, Staphylococcus
GLFNFFTWGAFIPLILAIIGGILIN

SEQ ID NO: 1897392 - protein, 26 aa, Staphylococcus
GLFSKRFWPSFKFLLPILLGMGLAIA

SEQ ID NO: 1897393 - protein, 28 aa, Staphylococcus
GLFSKRFWPSLKFLLPILIGMALAIGIL

SEQ ID NO: 1897394 - protein, 27 aa, Staphylococcus
GLFSKRFWPSLKFLLPILTGMLLAIGL

SEQ ID NO: 1897395 - protein, 28 aa, Staphylococcus
GLFSPLILSLMFIFIVAVIGFLFYETRI

SEQ ID NO: 1897396 - protein, 22 aa, Staphylococcus
GLGILCLLFFWTGIPHIIAIID

SEQ ID NO: 1897397 - protein, 22 aa, Staphylococcus
GLGLAIRFMTGPIGIVITAISA

SEQ ID NO: 1897398 - protein, 17 aa, Staphylococcus
GLGLATFFQKHKFNQSE

SEQ ID NO: 1897399 - protein, 36 aa, Staphylococcus
GLGLLNFFIVLVPAFFLFMFLLTLVIFTITLLSAPV

SEQ ID NO: 1897400 - protein, 17 aa, Staphylococcus
GLGVGIAAGVAVTFLNR

SEQ ID NO: 1897401 - protein, 18 aa, Staphylococcus
GLHHALNSVFWFDLAGIN

SEQ ID NO: 1897402 - protein, 17 aa, Staphylococcus
GLHHALNSVFWFDTIGI

SEQ ID NO: 1897403 - protein, 21 aa, Staphylococcus
GLHLIINEILLLIIGLGIAFL

SEQ ID NO: 1897404 - protein, 29 aa, Staphylococcus
GLHRELINPIWLVLSFLLITIGELCISPV

SEQ ID NO: 1897405 - protein, 31 aa, Staphylococcus
GLIAALAFLVLVIGIVLVLVSVKKNLDYVAK

SEQ ID NO: 1897406 - protein, 30 aa, Staphylococcus
GLIAIKTFLYLISKIKLIPFAIYRIVLVII

SEQ ID NO: 1897407 - protein, 30 aa, Staphylococcus
GLIFSGIYFVVFRYLILKFDIPLPGRRAEE

SEQ ID NO: 1897408 - protein, 17 aa, Staphylococcus
GLIGAILILFSDGLARG

SEQ ID NO: 1897409 - protein, 20 aa, Staphylococcus
GLIILFLSIFAYYTGFAPSA

SEQ ID NO: 1897410 - protein, 24 aa, Staphylococcus
GLIINIILTLILFRSLRKEDNVNI

SEQ ID NO: 1897411 - protein, 21 aa, Staphylococcus
GLILFVITYLITKGFYVLCVK

SEQ ID NO: 1897412 - protein, 24 aa, Staphylococcus
GLILGPLLFVLTLLLFQPDNLSDK

SEQ ID NO: 1897413 - protein, 21 aa, Staphylococcus
GLILTLILLFLPFIINQHQQY

SEQ ID NO: 1897414 - protein, 23 aa, Staphylococcus
GLISIFIFLLLNLVILGLLITFS

SEQ ID NO: 1897415 - protein, 17 aa, Staphylococcus
GLITIIMMINPEALLRT

SEQ ID NO: 1897416 - protein, 28 aa, Staphylococcus
GLITINIIVWLFMFLVLNAFSDTRLIDL

SEQ ID NO: 1897417 - protein, 28 aa, Staphylococcus
GLIVAGPFLLIIALLIKLESPGPAIFKQ

SEQ ID NO: 1897418 - protein, 34 aa, Staphylococcus
GLIVAVVIALICLILFFVALRNNKKIKRQTVDEY

SEQ ID NO: 1897419 - protein, 38 aa, Staphylococcus
GLKPTLIFPVLSVSITGLLMIYVINPPASWLNNTLLNG

SEQ ID NO: 1897420 - protein, 25 aa, Staphylococcus
GLKQEIFGIIWLFTLFLSLAIAHYF

SEQ ID NO: 1897421 - protein, 23 aa, Staphylococcus
GLLAIPFGVFISTFIMIMSHVKI

SEQ ID NO: 1897422 - protein, 17 aa, Staphylococcus
GLLAPWVAGAAMALSSV

SEQ ID NO: 1897423 - protein, 17 aa, Staphylococcus
GLLFFFLSDDQMATWGW

SEQ ID NO: 1897424 - protein, 20 aa, Staphylococcus
GLLGIFILYAYFLSTHPKEL

SEQ ID NO: 1897425 - protein, 18 aa, Staphylococcus
GLLILFYLCRLISENSLY

SEQ ID NO: 1897426 - protein, 17 aa, Staphylococcus
GLLILIGLILVLSIFKP

SEQ ID NO: 1897427 - protein, 18 aa, Staphylococcus
GLLLVFLMRKILPGRFYI

SEQ ID NO: 1897428 - protein, 20 aa, Staphylococcus
GLLLVWVMVNFVAKSYTIKG

SEQ ID NO: 1897429 - protein, 19 aa, Staphylococcus
GLLMLPYVIWLSYASYLNG

SEQ ID NO: 1897430 - protein, 26 aa, Staphylococcus
GLLSKAIFNIVFIYQLHILGASISTV

SEQ ID NO: 1897431 - protein, 20 aa, Staphylococcus
GLLTLPYLITLLLVVRLGEK

SEQ ID NO: 1897432 - protein, 25 aa, Staphylococcus
GLLVISLIIAIVFFFGMRTYQGHKN

SEQ ID NO: 1897433 - protein, 17 aa, Staphylococcus
GLLYLVRFLFGIGEAPM

SEQ ID NO: 1897434 - protein, 17 aa, Staphylococcus
GLMLEFISMLGIGLVAL

SEQ ID NO: 1897435 - protein, 18 aa, Staphylococcus
GLMLFSLFFGAGNLIFPP

SEQ ID NO: 1897436 - protein, 29 aa, Staphylococcus
GLNQILGLFMYPFALLLGLPWGEAWIVAQ

SEQ ID NO: 1897437 - protein, 28 aa, Staphylococcus
GLNQKWLGILFAILITVTFAFVFNTVQS

SEQ ID NO: 1897438 - protein, 28 aa, Staphylococcus
GLNQKWLGILFSILITITFAFVFNTVQS

SEQ ID NO: 1897439 - protein, 41 aa, Staphylococcus
GLNTTQFVIWLQNGIWAVIVYLIVCLLISFLALISMNIRVL

SEQ ID NO: 1897440 - protein, 27 aa, Staphylococcus
GLNYSKTMRYIILPQAIKNILPALGNE

SEQ ID NO: 1897441 - protein, 18 aa, Staphylococcus
GLPFQLISGHTLWWKSPT

SEQ ID NO: 1897442 - protein, 17 aa, Staphylococcus
GLPIYFFYEYKMNWKNT

SEQ ID NO: 1897443 - protein, 18 aa, Staphylococcus
GLPLIIALLHALFAAMVF

SEQ ID NO: 1897444 - protein, 17 aa, Staphylococcus
GLPLLTALPIVSGMLEK

SEQ ID NO: 1897445 - protein, 35 aa, Staphylococcus
GLRQGLLMIIPAFIGYFMGYFSLGILVATGTLSHI

SEQ ID NO: 1897446 - protein, 22 aa, Staphylococcus
GLSFLTLYLLNLHLGYTFSGGF

SEQ ID NO: 1897447 - protein, 26 aa, Staphylococcus
GLSLFNFFIILFPAVMIFFAIVSLIL

SEQ ID NO: 1897448 - protein, 26 aa, Staphylococcus
GLSLFYTFVFFLIFAVMYTANIYLNI

SEQ ID NO: 1897449 - protein, 22 aa, Staphylococcus
GLSLILNYTLGISPALSSFIIN

SEQ ID NO: 1897450 - protein, 28 aa, Staphylococcus
GLSLIPQNFIIVGLFIICMFVSISMGTS

SEQ ID NO: 1897451 - protein, 26 aa, Staphylococcus
GLSLIPQNLIIVGLFVICMFVSISMG

SEQ ID NO: 1897452 - protein, 17 aa, Staphylococcus
GLSPAFVGVLFFAARIW

SEQ ID NO: 1897453 - protein, 27 aa, Staphylococcus
GLSQKYRWLVLVLIYLISILKIPLIQN

SEQ ID NO: 1897454 - protein, 25 aa, Staphylococcus
GLSVHPHFLWFNLTKPDIWITIIAG

SEQ ID NO: 1897455 - protein, 25 aa, Staphylococcus
GLSVIVIILLLWIAVKTYKDSVLTF

SEQ ID NO: 1897456 - protein, 24 aa, Staphylococcus
GLSYLIMMIPLAGGLHRELINPIW

SEQ ID NO: 1897457 - protein, 17 aa, Staphylococcus
GLSYLVMIIPLNSDAHL

SEQ ID NO: 1897458 - protein, 25 aa, Staphylococcus
GLTPIFVFLIFTFLMHVFFTKGGAI

SEQ ID NO: 1897459 - protein, 21 aa, Staphylococcus
GLTWLYEFGGAIGGLIFGLLY

SEQ ID NO: 1897460 - protein, 24 aa, Staphylococcus
GLVFFFSLGLFKYADAHVTINPKA

SEQ ID NO: 1897461 - protein, 20 aa, Staphylococcus
GLVKFSIPITLVTFLLGLVI

SEQ ID NO: 1897462 - protein, 23 aa, Staphylococcus
GLVNFCRLVPILLLSVWAGAIAD

SEQ ID NO: 1897463 - protein, 25 aa, Staphylococcus
GLVNIVFILFIFVFATKAGVFPMYV

SEQ ID NO: 1897464 - protein, 62 aa, Staphylococcus
GLVQNLILLMNPYSLIALILSIFLFFKGKKAYWFIFIGGFLLTFLLYANVVYFRFFSDFLTF

SEQ ID NO: 1897465 - protein, 62 aa, Staphylococcus
GLVQNLILLMNPYSLIALILSVFLFFKGKKAYWFIFIGGFLLSFLLYANVVYFRFFSDFLTF

SEQ ID NO: 1897466 - protein, 25 aa, Staphylococcus
GLVQNLILLMNPYSLIALTLSVFLF

SEQ ID NO: 1897467 - protein, 25 aa, Staphylococcus
GLVQNLILLMNPYSLIALVLSIFLF

SEQ ID NO: 1897468 - protein, 27 aa, Staphylococcus
GLVSIFTQLMPLFKWSSQGFQNMSMAF

SEQ ID NO: 1897469 - protein, 25 aa, Staphylococcus
GLVSIVFILFLFVFATKAGAFPMYV

SEQ ID NO: 1897470 - protein, 18 aa, Staphylococcus
GLVSLKINMPNIEGMGFA

SEQ ID NO: 1897471 - protein, 25 aa, Staphylococcus
GLVTINYQAVYPESLVVANDIIRNS

SEQ ID NO: 1897472 - protein, 23 aa, Staphylococcus
GLVVIEYIFAWPGLGQLSLKAIL

SEQ ID NO: 1897473 - protein, 19 aa, Staphylococcus
GLWVLLMYPFTYSVGADKS

SEQ ID NO: 1897474 - protein, 19 aa, Staphylococcus
GLYFSYIYNVPSGAAIVLC

SEQ ID NO: 1897475 - protein, 19 aa, Staphylococcus
GLYFSYIYNVPSGATIVIC

SEQ ID NO: 1897476 - protein, 23 aa, Staphylococcus
GLYVKYFRTISIPNYIFSSVISL

SEQ ID NO: 1897477 - protein, 17 aa, Staphylococcus
GMAKEDLIGYYMLSVLN

SEQ ID NO: 1897478 - protein, 25 aa, Staphylococcus
GMAKEDLIGYYMLSVLNLEQEFSLD

SEQ ID NO: 1897479 - protein, 18 aa, Staphylococcus
GMFFSYLYNLPSGASIVI

SEQ ID NO: 1897480 - protein, 29 aa, Staphylococcus
GMIATFLSWRWIFVFSIIVSLIAVLLIKG

SEQ ID NO: 1897481 - protein, 23 aa, Staphylococcus
GMIGAVIYRLFYKGAFDTMSVVA

SEQ ID NO: 1897482 - protein, 29 aa, Staphylococcus
GMKAIPIFVILMFFSMQLVTLPKEMLPKG

SEQ ID NO: 1897483 - protein, 27 aa, Staphylococcus
GMKSIPLFFILMFFSMQMVTLPKQMLP

SEQ ID NO: 1897484 - protein, 26 aa, Staphylococcus
GMKSLPIFILLMFFSMQMVTLPKQML

SEQ ID NO: 1897485 - protein, 20 aa, Staphylococcus
GMLLSIIALILIASFFITSA

SEQ ID NO: 1897486 - protein, 22 aa, Staphylococcus
GMLVLGLLFFIVYRAFQLASQT

SEQ ID NO: 1897487 - protein, 30 aa, Staphylococcus
GMLVYNLLLIPLIILIWKYVPKNGIAADEN

SEQ ID NO: 1897488 - protein, 25 aa, Staphylococcus
GMMAWLNIIAIWILHRPAVDALKDY

SEQ ID NO: 1897489 - protein, 25 aa, Staphylococcus
GMMFTPFIILFLTVVGAYLFFRSSV

SEQ ID NO: 1897490 - protein, 17 aa, Staphylococcus
GMMLLGEACLFLLNVPS

SEQ ID NO: 1897491 - protein, 19 aa, Staphylococcus
GMMLVGEACLFLLNIPSGV

SEQ ID NO: 1897492 - protein, 18 aa, Staphylococcus
GMMLVGEACLFLLNVPSG

SEQ ID NO: 1897493 - protein, 38 aa, Staphylococcus
GMNFDYMPELKWHYAYFICLGVMLVITIVLVVFFKRKK

SEQ ID NO: 1897494 - protein, 21 aa, Staphylococcus
GMNTARTIALRTGLPDTVPGQ

SEQ ID NO: 1897495 - protein, 23 aa, Staphylococcus
GMNWIHYPWDFLVIAIVALIFYQ

SEQ ID NO: 1897496 - protein, 23 aa, Staphylococcus
GMPMLWANFFWVWGHPEVYIVVL

SEQ ID NO: 1897497 - protein, 24 aa, Staphylococcus
GMTKADALEALKKLGFEKISMNQE

SEQ ID NO: 1897498 - protein, 28 aa, Staphylococcus
GMTPFYTALSIWVGALLLVSLLTVHNKH

SEQ ID NO: 1897499 - protein, 23 aa, Staphylococcus
GMTYTIMDIPYWSWLPNLTNNPR

SEQ ID NO: 1897500 - protein, 24 aa, Staphylococcus
GMTYTMMDIPYWSWLPNLTHNPRE

SEQ ID NO: 1897501 - protein, 27 aa, Staphylococcus
GMVTHWILFFLMILFLIVVLSTPIYIP

SEQ ID NO: 1897502 - protein, 27 aa, Staphylococcus
GNAPFLMFMPVWMSSLVTSVLLFFAFR

SEQ ID NO: 1897503 - protein, 26 aa, Staphylococcus
GNASFLMFMPVWMGSLITSVILFFAF

SEQ ID NO: 1897504 - protein, 25 aa, Staphylococcus
GNDVATTLVLDFPVIVKPKADSNQT

SEQ ID NO: 1897505 - protein, 28 aa, Staphylococcus
GNEFESSIFPFILRGVSIIGIDSVFTPI

SEQ ID NO: 1897506 - protein, 29 aa, Staphylococcus
GNENPNIRQFFLFDLTSRLIGRDDNVNVR

SEQ ID NO: 1897507 - protein, 22 aa, Staphylococcus
GNFTLVLIALLLLITGTGLLKP

SEQ ID NO: 1897508 - protein, 26 aa, Staphylococcus
GNGKERIWIYNLPVKNGNDVIGNIYI

SEQ ID NO: 1897509 - protein, 24 aa, Staphylococcus
GNGLIMFVLIMILGAIVAAFFAND

SEQ ID NO: 1897510 - protein, 24 aa, Staphylococcus
GNGLKMFIFIMLLGSVVAAFFAND

SEQ ID NO: 1897511 - protein, 24 aa, Staphylococcus
GNGLKMFVFIMLLGAVVAAFFAND

SEQ ID NO: 1897512 - protein, 47 aa, Staphylococcus
GNGQEPKKSGGLKKLLPLLLGLLIIAAIAIFGGMALTNQGDHKDDSD

SEQ ID NO: 1897513 - protein, 24 aa, Staphylococcus
GNILLFLSIFCLLISLTAWSHNSI

SEQ ID NO: 1897514 - protein, 17 aa, Staphylococcus
GNIQVFVALISGGCAII

SEQ ID NO: 1897515 - protein, 26 aa, Staphylococcus
GNITPFLIIFIIIISVYSFMTTDSSF

SEQ ID NO: 1897516 - protein, 24 aa, Staphylococcus
GNKIPTILNEVLIDYLRGDGTLQE

SEQ ID NO: 1897517 - protein, 22 aa, Staphylococcus
GNLLLELAVIFGVSSLVTAFLK

SEQ ID NO: 1897518 - protein, 17 aa, Staphylococcus
GNLLLLPRLGASLTVVM

SEQ ID NO: 1897519 - protein, 27 aa, Staphylococcus
GNNLAPGFYWLIVSIIGLIVVVFLFKD

SEQ ID NO: 1897520 - protein, 29 aa, Staphylococcus
GNNSWSFVMTWLPSHAKWALFSFYSCIIL

SEQ ID NO: 1897521 - protein, 32 aa, Staphylococcus
GNPFGALLWFIAILAVIVFRWKQLKFAYKEGV

SEQ ID NO: 1897522 - protein, 19 aa, Staphylococcus
GNPIAYAYNLDDLYITANV

SEQ ID NO: 1897523 - protein, 19 aa, Staphylococcus
GNPIAYAYNLDELYITANV

SEQ ID NO: 1897524 - protein, 23 aa, Staphylococcus
GNQRTYVLIGYPTKAISSADNHT

SEQ ID NO: 1897525 - protein, 24 aa, Staphylococcus
GNTSIVLLLLGFILCKLKLKRKDL

SEQ ID NO: 1897526 - protein, 21 aa, Staphylococcus
GNVDIIFQIGPGLFGVRDKAG

SEQ ID NO: 1897527 - protein, 17 aa, Staphylococcus
GNVFIIGLVGFLWGMCL

SEQ ID NO: 1897528 - protein, 26 aa, Staphylococcus
GPAGIDLYLSIPWFAASISTVAGAIG

SEQ ID NO: 1897529 - protein, 20 aa, Staphylococcus
GPALLIPLFVQNGLGLSAFM

SEQ ID NO: 1897530 - protein, 22 aa, Staphylococcus
GPALLIPLYVQNALALSALLSG

SEQ ID NO: 1897531 - protein, 25 aa, Staphylococcus
GPDSLRPFYKGFLFFHINLATLGGI

SEQ ID NO: 1897532 - protein, 21 aa, Staphylococcus
GPFIFLVIGFITLVAPVTGVA

SEQ ID NO: 1897533 - protein, 19 aa, Staphylococcus
GPHIDVFSTAFDKGYMKSA

SEQ ID NO: 1897534 - protein, 22 aa, Staphylococcus
GPIGRNIFGIVLFAAAMSSVIG

SEQ ID NO: 1897535 - protein, 27 aa, Staphylococcus
GPILAFLPVITIGLLFGLAIDYELFLM

SEQ ID NO: 1897536 - protein, 35 aa, Staphylococcus
GPIYQDIDVTPGSELQFHFIGTSMGNISGFNSARL

SEQ ID NO: 1897537 - protein, 25 aa, Staphylococcus
GPKKMLSIALIWWSAFTILTGVVKN

SEQ ID NO: 1897538 - protein, 18 aa, Staphylococcus
GPKLIQLIGNIINILINI

SEQ ID NO: 1897539 - protein, 20 aa, Staphylococcus
GPLCFLIFTRLINGLATAVA

SEQ ID NO: 1897540 - protein, 23 aa, Staphylococcus
GPLSIKWYGIIIAFGILLGYFVA

SEQ ID NO: 1897541 - protein, 25 aa, Staphylococcus
GPMISYLIPLLIAYSGGRLIHEMRG

SEQ ID NO: 1897542 - protein, 25 aa, Staphylococcus
GPMITYLIPLLIAFSGGRLIHDLRG

SEQ ID NO: 1897543 - protein, 22 aa, Staphylococcus
GPMKMLILYIISGLFGNFLSLS

SEQ ID NO: 1897544 - protein, 18 aa, Staphylococcus
GPNFWITCLVAIAFGFAV

SEQ ID NO: 1897545 - protein, 26 aa, Staphylococcus
GPRKMITIALLWWSAFTIFTGMIKHH

SEQ ID NO: 1897546 - protein, 24 aa, Staphylococcus
GPSSTFFIVAFSLPINLPVAPEEA

SEQ ID NO: 1897547 - protein, 24 aa, Staphylococcus
GPSSTFFIVTFALSSNLPVDPASF

SEQ ID NO: 1897548 - protein, 24 aa, Staphylococcus
GPVIMQLIGNIVRALIAFGTAMAP

SEQ ID NO: 1897549 - protein, 25 aa, Staphylococcus
GPVLFFIFIVLSILSLFIGVSQLGL

SEQ ID NO: 1897550 - protein, 26 aa, Staphylococcus
GQADRTYPFKYGYKNYIFKKDNEYYI

SEQ ID NO: 1897551 - protein, 26 aa, Staphylococcus
GQDISWGQWFLYAAPWSVLMSIALYF

SEQ ID NO: 1897552 - protein, 22 aa, Staphylococcus
GQDNFLLNLTFKENIKLGRPEA

SEQ ID NO: 1897553 - protein, 23 aa, Staphylococcus
GQDTPQIGTPGQGTQTGENGTGT

SEQ ID NO: 1897554 - protein, 18 aa, Staphylococcus
GQFDLICAVGILLVIATL

SEQ ID NO: 1897555 - protein, 23 aa, Staphylococcus
GQGEILINPVQILSIYSALENNG

SEQ ID NO: 1897556 - protein, 26 aa, Staphylococcus
GQGFYLIFLILFLFAALTSSISLLEL

SEQ ID NO: 1897557 - protein, 25 aa, Staphylococcus
GQGVLHLVFFWTLIPTIISIIHGII

SEQ ID NO: 1897558 - protein, 21 aa, Staphylococcus
GQIFLAMFLAILLGIGISYFQ

SEQ ID NO: 1897559 - protein, 26 aa, Staphylococcus
GQILYNYHGNKKWYLASMTKLMTMYL

SEQ ID NO: 1897560 - protein, 33 aa, Staphylococcus
GQLFTIQFLIVILTFFFIDFFDTAGTLVAVATQ

SEQ ID NO: 1897561 - protein, 35 aa, Staphylococcus
GQLITFNTYLGMLVWPLLALGLFFNIVQRAKASYE

SEQ ID NO: 1897562 - protein, 24 aa, Staphylococcus
GQMLLAMITAFVASFAYVYFMQSV

SEQ ID NO: 1897563 - protein, 20 aa, Staphylococcus
GQNAAPLTVTGERKDTAGNT

SEQ ID NO: 1897564 - protein, 30 aa, Staphylococcus
GQNQSPLAGLALISGLFLFLKNRKRNKENS

SEQ ID NO: 1897565 - protein, 24 aa, Staphylococcus
GQRDDHFIIYKLGSDKIKVFNTEI

SEQ ID NO: 1897566 - protein, 23 aa, Staphylococcus
GQSKWNFRKLFNYGIDGLISFNS

SEQ ID NO: 1897567 - protein, 18 aa, Staphylococcus
GQSLIFYSLINWMPAYLS

SEQ ID NO: 1897568 - protein, 50 aa, Staphylococcus
GQSLYHDFWHQPHYLFTISSICINLFIPLIVIYMLTRFFYKKHLSRNIDY

SEQ ID NO: 1897569 - protein, 25 aa, Staphylococcus
GQTIRLLEHFLRHGNQEEIDYQKAH

SEQ ID NO: 1897570 - protein, 20 aa, Staphylococcus
GQVFLAFYLAILLGLGISYF

SEQ ID NO: 1897571 - protein, 31 aa, Staphylococcus
GQWYGYFIIIIMQFFILSYLIYKINYKLFNS

SEQ ID NO: 1897572 - protein, 18 aa, Staphylococcus
GRDMWSDIAVLKATIKNK

SEQ ID NO: 1897573 - protein, 29 aa, Staphylococcus
GRDRLKLFVPWYYLVKYVLPVVILLVFVM

SEQ ID NO: 1897574 - protein, 17 aa, Staphylococcus
GRFITMMFGLCGAALAI

SEQ ID NO: 1897575 - protein, 29 aa, Staphylococcus
GRFVKETYNIPPVNKIIKIGIGAVNDSNI

SEQ ID NO: 1897576 - protein, 39 aa, Staphylococcus
GRGYQKVLSWSLNHKWLVIIITTIILIASVVLGGTKLGT

SEQ ID NO: 1897577 - protein, 27 aa, Staphylococcus
GRIIDYILVFFLFGISVTMIAGAGSAF

SEQ ID NO: 1897578 - protein, 30 aa, Staphylococcus
GRLFLKHMFIYLYRIMLFLSACIYISTVDI

SEQ ID NO: 1897579 - protein, 20 aa, Staphylococcus
GRLLTLYLIIREIAGVASIR

SEQ ID NO: 1897580 - protein, 31 aa, Staphylococcus
GRQPFGTYIKLSCSALLISSVFVNYSSIENV

SEQ ID NO: 1897581 - protein, 26 aa, Staphylococcus
GRRRDDSGMWWIGPGSGGFGNGSSGG

SEQ ID NO: 1897582 - protein, 33 aa, Staphylococcus
GRSIKPLIVIFPILITYAIALTAIYLKKVLYLC

SEQ ID NO: 1897583 - protein, 22 aa, Staphylococcus
GRVFLLIPVIIIFILCVKYKNK

SEQ ID NO: 1897584 - protein, 26 aa, Staphylococcus
GRYEVLYLSIPFLLITYIFANHFTIA

SEQ ID NO: 1897585 - protein, 22 aa, Staphylococcus
GSASFLVLPGIQKGGYIGETLF

SEQ ID NO: 1897586 - protein, 18 aa, Staphylococcus
GSASFLVLPGVKKGGYIG

SEQ ID NO: 1897587 - protein, 38 aa, Staphylococcus
GSASTPFYTALAIWVGALLLVSLLTTDNKHKSLEPHLT

SEQ ID NO: 1897588 - protein, 18 aa, Staphylococcus
GSATFLVLPGVKKGGYLG

SEQ ID NO: 1897589 - protein, 31 aa, Staphylococcus
GSDNTAPMLYGTIFAGLGTAMVFGMKRRKNK

SEQ ID NO: 1897590 - protein, 24 aa, Staphylococcus
GSERIFYWLFNQFGQPNSSPIGSD

SEQ ID NO: 1897591 - protein, 24 aa, Staphylococcus
GSEYLLVAILLIGILAFLGTAVFS

SEQ ID NO: 1897592 - protein, 29 aa, Staphylococcus
GSFIAKHKWWAIVAWVVLIAAVLTPIAID

SEQ ID NO: 1897593 - protein, 17 aa, Staphylococcus
GSFILILGFIIQKFCVR

SEQ ID NO: 1897594 - protein, 21 aa, Staphylococcus
GSFILIVFFAAQLLAFLQWSN

SEQ ID NO: 1897595 - protein, 23 aa, Staphylococcus
GSFMLFTLLMFGFDFLSAAGNAK

SEQ ID NO: 1897596 - protein, 25 aa, Staphylococcus
GSGKERIWIYNLPVKNGNETIGNIY

SEQ ID NO: 1897597 - protein, 24 aa, Staphylococcus
GSGLKMFIFIMLLGSVVAAFFAND

SEQ ID NO: 1897598 - protein, 29 aa, Staphylococcus
GSGSGAPLPKFWQTADGIKPSVANYFRHG

SEQ ID NO: 1897599 - protein, 22 aa, Staphylococcus
GSIFALVCWFIISVAIFLVKHI

SEQ ID NO: 1897600 - protein, 22 aa, Staphylococcus
GSIFFLLALLSFPMPIKAVRRF

SEQ ID NO: 1897601 - protein, 29 aa, Staphylococcus
GSIIQQLMDKLNMLDIDKIENILSHNNKD

SEQ ID NO: 1897602 - protein, 26 aa, Staphylococcus
GSIISFIFLYLLLIPGSPASLSLPSY

SEQ ID NO: 1897603 - protein, 22 aa, Staphylococcus
GSIIYFIVKFFKKGWGKDDRHQ

SEQ ID NO: 1897604 - protein, 23 aa, Staphylococcus
GSIRDESWLNKKLNYITKKTYQG

SEQ ID NO: 1897605 - protein, 20 aa, Staphylococcus
GSITNSFFLEQINPDSTAEG

SEQ ID NO: 1897606 - protein, 19 aa, Staphylococcus
GSIVLLAPLARLIATGLTP

SEQ ID NO: 1897607 - protein, 26 aa, Staphylococcus
GSIVSFIFLLLLLVPGSPASLSAPSY

SEQ ID NO: 1897608 - protein, 26 aa, Staphylococcus
GSIVSFIFLLLLLVPGSPASLSMPSY

SEQ ID NO: 1897609 - protein, 27 aa, Staphylococcus
GSKESQLTNALLAEAPIAKSKMTKVPN

SEQ ID NO: 1897610 - protein, 22 aa, Staphylococcus
GSKILLMIVLKILDISTSVSLT

SEQ ID NO: 1897611 - protein, 19 aa, Staphylococcus
GSKILLMIVLKLLGIHTSV

SEQ ID NO: 1897612 - protein, 25 aa, Staphylococcus
GSKVRLSGQGFKFTSPDEIEVYKVL

SEQ ID NO: 1897613 - protein, 28 aa, Staphylococcus
GSLAGIIILFLWLYITSFIIIIGAEINA

SEQ ID NO: 1897614 - protein, 23 aa, Staphylococcus
GSLDHNVFYGTLGQSRNYTISYK

SEQ ID NO: 1897615 - protein, 19 aa, Staphylococcus
GSLLGVGIIYLFIVGFYRL

SEQ ID NO: 1897616 - protein, 28 aa, Staphylococcus
GSLLIIIAPFPWLLITGRALQGLAGACI

SEQ ID NO: 1897617 - protein, 27 aa, Staphylococcus
GSLLIIITPLTPFLIAGRIFQGLSAAC

SEQ ID NO: 1897618 - protein, 24 aa, Staphylococcus
GSLLKYTEMKWLTPDGHYIHGKGI

SEQ ID NO: 1897619 - protein, 23 aa, Staphylococcus
GSLPIFIQIPIILGLLACIKHPT

SEQ ID NO: 1897620 - protein, 22 aa, Staphylococcus
GSLPMMLIYLRNANTITYTISM

SEQ ID NO: 1897621 - protein, 25 aa, Staphylococcus
GSLVAIFVYLWKTNDGFREACINAW

SEQ ID NO: 1897622 - protein, 19 aa, Staphylococcus
GSLYLFIGLAILCFVLYIA

SEQ ID NO: 1897623 - protein, 17 aa, Staphylococcus
GSMIPLLMNKLKIDPAV

SEQ ID NO: 1897624 - protein, 64 aa, Staphylococcus
GSMLILVYSLMIAFLFIDKVFVNIIYFQGMFYTQIFGIPVFLFLNLVIILLCIIVGSILAFKIN

SEQ ID NO: 1897625 - protein, 65 aa, Staphylococcus
GSMLILVYSTFFAIFFIDKVFVNIMYFQGMFYTQIFGIPVLLFLNLMVILLCIIVGSVLAYKINQ

SEQ ID NO: 1897626 - protein, 26 aa, Staphylococcus
GSNGHVNITPDHYLFEGNITAKAYDQ

SEQ ID NO: 1897627 - protein, 32 aa, Staphylococcus
GSNNGVMGVIYKAQLVLTPYGAKQYIDNITDS

SEQ ID NO: 1897628 - protein, 22 aa, Staphylococcus
GSNWWYAIVPVLGPIAGGMIGA

SEQ ID NO: 1897629 - protein, 18 aa, Staphylococcus
GSQFSWVDSPDTWKNTIG

SEQ ID NO: 1897630 - protein, 22 aa, Staphylococcus
GSSFLIMHLLDVKIGMTFSGGF

SEQ ID NO: 1897631 - protein, 35 aa, Staphylococcus
GSSIILLFKIIFMLDYVIFHIIQRSFFKYIDEVLE

SEQ ID NO: 1897632 - protein, 24 aa, Staphylococcus
GSSTWLHFVLPVTVLVIVEGCHII

SEQ ID NO: 1897633 - protein, 23 aa, Staphylococcus
GSTALWIGIAFMSFAVLFSIVTL

SEQ ID NO: 1897634 - protein, 24 aa, Staphylococcus
GSTEIIIMFIIGVVFIILFAIREL

SEQ ID NO: 1897635 - protein, 18 aa, Staphylococcus
GSTEIIVMFILGAVFITL

SEQ ID NO: 1897636 - protein, 18 aa, Staphylococcus
GSTKLTFSDGHEVIIPKG

SEQ ID NO: 1897637 - protein, 25 aa, Staphylococcus
GSTSVSGVLSDSLSSSYSASTSDST

SEQ ID NO: 1897638 - protein, 21 aa, Staphylococcus
GSVFLPFILSGFLFYICLPFQ

SEQ ID NO: 1897639 - protein, 22 aa, Staphylococcus
GSVFLPFLISGFLFYICLPFQN

SEQ ID NO: 1897640 - protein, 22 aa, Staphylococcus
GSVFLPFLISGFLFYICLPFQT

SEQ ID NO: 1897641 - protein, 23 aa, Staphylococcus
GSVFTFVYSIRFIGQIFLGSYKE

SEQ ID NO: 1897642 - protein, 26 aa, Staphylococcus
GSVILILLFLILVFHLIRLASRINDQ

SEQ ID NO: 1897643 - protein, 21 aa, Staphylococcus
GSVIPLFKKQIEAGGPITVTH

SEQ ID NO: 1897644 - protein, 30 aa, Staphylococcus
GSVLVFIPQIVVLFFFISLLEDSGYMARIA

SEQ ID NO: 1897645 - protein, 21 aa, Staphylococcus
GSVVIWLLSYAGPGGFNVSID

SEQ ID NO: 1897646 - protein, 25 aa, Staphylococcus
GSVYLFMGLAIFCFVLYIAFGKYGN

SEQ ID NO: 1897647 - protein, 27 aa, Staphylococcus
GSVYLFMGLIILFFVLYIAFGRYGNVT

SEQ ID NO: 1897648 - protein, 19 aa, Staphylococcus
GSWLLGDWGWHLGGIAVFP

SEQ ID NO: 1897649 - protein, 18 aa, Staphylococcus
GTALAYYLFIDSLKYLSA

SEQ ID NO: 1897650 - protein, 25 aa, Staphylococcus
GTDARMLYWFTDKEYPVIRKPQGAN

SEQ ID NO: 1897651 - protein, 25 aa, Staphylococcus
GTEGNTWQREAVGTVNTAGQPSTTS

SEQ ID NO: 1897652 - protein, 28 aa, Staphylococcus
GTFCVIMIFALLGFLPFNLNPAKVFMGD

SEQ ID NO: 1897653 - protein, 32 aa, Staphylococcus
GTFIAKHKWLSIIIWLVVLGVVIAPLLVTSPK

SEQ ID NO: 1897654 - protein, 36 aa, Staphylococcus
GTFIAKNKWLSVIAWIILLLMIVVPLMLSAPKFDSD

SEQ ID NO: 1897655 - protein, 38 aa, Staphylococcus
GTFPVVTLPKFFQNISPYLPFTYLIDCLREVVGGIVPE

SEQ ID NO: 1897656 - protein, 23 aa, Staphylococcus
GTGHAFITPTKPIPEGNVTVRAT

SEQ ID NO: 1897657 - protein, 18 aa, Staphylococcus
GTGLGLFICKMIIEEHGG

SEQ ID NO: 1897658 - protein, 22 aa, Staphylococcus
GTGLGLFICRMIIHEHGGTIDV

SEQ ID NO: 1897659 - protein, 25 aa, Staphylococcus
GTGSFFLFTLLIVGFDFLSAAGNAK

SEQ ID NO: 1897660 - protein, 25 aa, Staphylococcus
GTGSFMLFILLMFGFDFLGAAGNAK

SEQ ID NO: 1897661 - protein, 23 aa, Staphylococcus
GTGWLMHLLPPVVVGPVIMVIGL

SEQ ID NO: 1897662 - protein, 26 aa, Staphylococcus
GTHYLRIVALCFPFLGLNFVLNGIVR

SEQ ID NO: 1897663 - protein, 39 aa, Staphylococcus
GTILNIILVLGFLVNLVLAFILIFLERNRRSASSTWAWI

SEQ ID NO: 1897664 - protein, 20 aa, Staphylococcus
GTIMLLIGLFVWNIMQWSTN

SEQ ID NO: 1897665 - protein, 29 aa, Staphylococcus
GTITFIVFMIFLITKFSHVWPILIFLPFV

SEQ ID NO: 1897666 - protein, 28 aa, Staphylococcus
GTITFIVFMIFLITKFSQVWPILIFLPI

SEQ ID NO: 1897667 - protein, 26 aa, Staphylococcus
GTKEIDKVISYYKNIELGSGDITEKI

SEQ ID NO: 1897668 - protein, 27 aa, Staphylococcus
GTLIAMIFYVIQMSMPLINLSTLITDY

SEQ ID NO: 1897669 - protein, 23 aa, Staphylococcus
GTLWLMITIIPISIILGVGTAIY

SEQ ID NO: 1897670 - protein, 23 aa, Staphylococcus
GTLWSSLFWVVLGGFLAIVLNKD

SEQ ID NO: 1897671 - protein, 27 aa, Staphylococcus
GTNISPLIMAWLITALIRIATGQGVVS

SEQ ID NO: 1897672 - protein, 25 aa, Staphylococcus
GTPLLVQVFIVFFGTTAALGLDISA

SEQ ID NO: 1897673 - protein, 26 aa, Staphylococcus
GTPLLVQVFLVFFGTTAALGLDISAM

SEQ ID NO: 1897674 - protein, 25 aa, Staphylococcus
GTPLLVQVFLVYFGTTAVLGLNISA

SEQ ID NO: 1897675 - protein, 25 aa, Staphylococcus
GTPMLVQVFIVFFGTTALLGLDISA

SEQ ID NO: 1897676 - protein, 20 aa, Staphylococcus
GTRYLIFDNMSFNAPTKQPV

SEQ ID NO: 1897677 - protein, 29 aa, Staphylococcus
GTSAAYFYSIYEMIKWFSGATNMPHLYFE

SEQ ID NO: 1897678 - protein, 30 aa, Staphylococcus
GTSAAYFYSIYEMIRWLLNKVNEPHLYFET

SEQ ID NO: 1897679 - protein, 19 aa, Staphylococcus
GTSLLLKRKHHSHSYLSTE

SEQ ID NO: 1897680 - protein, 30 aa, Staphylococcus
GTSMSPLLFAWIIAAIFRIALGSATVAGIS

SEQ ID NO: 1897681 - protein, 33 aa, Staphylococcus
GTTIVTLVTFVILLALLKKFAWGPLKEVMDKRE

SEQ ID NO: 1897682 - protein, 27 aa, Staphylococcus
GTTQINQFVPSIVKKSIATQELDNAAD

SEQ ID NO: 1897683 - protein, 22 aa, Staphylococcus
GTVFAFWLFISSLNYLYPQEAS

SEQ ID NO: 1897684 - protein, 19 aa, Staphylococcus
GTVILLIGLFVWNIMQWST

SEQ ID NO: 1897685 - protein, 34 aa, Staphylococcus
GTVIVTVITFAILLALLKKFAWGPLKEVMDKRER

SEQ ID NO: 1897686 - protein, 56 aa, Staphylococcus
GTVLLIIAIILILFAIVAVFKNKNYFKYFAMAITIILLSILALGIHKMIESNNPSK

SEQ ID NO: 1897687 - protein, 27 aa, Staphylococcus
GTYEVPILYVTVWLDDQGNIIKDAVED

SEQ ID NO: 1897688 - protein, 28 aa, Staphylococcus
GTYIKYAFFWIWGFAIVLLLIAVLMGVV

SEQ ID NO: 1897689 - protein, 28 aa, Staphylococcus
GTYIKYAFFWVWGFAIVLLLIAMLIGTV

SEQ ID NO: 1897690 - protein, 23 aa, Staphylococcus
GTYSLIWALPVVILISLSTAIVA

SEQ ID NO: 1897691 - protein, 19 aa, Staphylococcus
GTYTVPVTVTYPDGSKDHA

SEQ ID NO: 1897692 - protein, 19 aa, Staphylococcus
GTYTVPVTVTYPDGTKDHT

SEQ ID NO: 1897693 - protein, 19 aa, Staphylococcus
GTYTVPVTVTYPDGTKDHV

SEQ ID NO: 1897694 - protein, 24 aa, Staphylococcus
GVAIALLGLFILGQRTASALLPNT

SEQ ID NO: 1897695 - protein, 27 aa, Staphylococcus
GVALWAFGVHPYLAFFPIIGVLVIYYI

SEQ ID NO: 1897696 - protein, 24 aa, Staphylococcus
GVAQSLIAFILLFSGGDTGLNSLQ

SEQ ID NO: 1897697 - protein, 27 aa, Staphylococcus
GVATVTIQGILPTGNITAKVSITENNL

SEQ ID NO: 1897698 - protein, 24 aa, Staphylococcus
GVAVYLLLYILYPGGETTSLIKAT

SEQ ID NO: 1897699 - protein, 28 aa, Staphylococcus
GVAYLAFWLSIIPLILYLNLTRFKKDKI

SEQ ID NO: 1897700 - protein, 27 aa, Staphylococcus
GVEVVYFILKLFLNPTRFGYLIIIAIS

SEQ ID NO: 1897701 - protein, 37 aa, Staphylococcus
GVEWGSVLVTLITFLILLALLKKFAWGPLKQVMDKRE

SEQ ID NO: 1897702 - protein, 25 aa, Staphylococcus
GVFALIFILLFFSKETRMALFISPI

SEQ ID NO: 1897703 - protein, 21 aa, Staphylococcus
GVFLGLIVALIIIFLKEILDK

SEQ ID NO: 1897704 - protein, 20 aa, Staphylococcus
GVFYFLPIFIGMSASKKLNV

SEQ ID NO: 1897705 - protein, 25 aa, Staphylococcus
GVFYHLLPMILNTFLIALFLFGHSG

SEQ ID NO: 1897706 - protein, 26 aa, Staphylococcus
GVGIIYLFIVGFYRLPGIIAVITLTT

SEQ ID NO: 1897707 - protein, 24 aa, Staphylococcus
GVGLIILVIFLVSGVIYGVLSHEI

SEQ ID NO: 1897708 - protein, 23 aa, Staphylococcus
GVGLIILVLFLVPGLVYGLMMKE

SEQ ID NO: 1897709 - protein, 24 aa, Staphylococcus
GVGLIILVVFLVPGTIYGILSGEI

SEQ ID NO: 1897710 - protein, 21 aa, Staphylococcus
GVGLPLFTALPIVSGMLEQHQ

SEQ ID NO: 1897711 - protein, 20 aa, Staphylococcus
GVGLPLFTALPIVSGMLERY

SEQ ID NO: 1897712 - protein, 21 aa, Staphylococcus
GVGLVILVIFLIPGMVYGILS

SEQ ID NO: 1897713 - protein, 24 aa, Staphylococcus
GVGLVILVIFLIPGVIYGVLSKQI

SEQ ID NO: 1897714 - protein, 25 aa, Staphylococcus
GVIFIALFVWRQYQLDVPLLNFEVF

SEQ ID NO: 1897715 - protein, 34 aa, Staphylococcus
GVIFLPIILMRTSLWFILFIFLGGVAYSIGAWFY

SEQ ID NO: 1897716 - protein, 19 aa, Staphylococcus
GVIKFILGLGYHYHPQADT

SEQ ID NO: 1897717 - protein, 18 aa, Staphylococcus
GVILVIIELFIIGAVIGI

SEQ ID NO: 1897718 - protein, 26 aa, Staphylococcus
GVIMIIFMAMPFIFGLWNVVVPLQIG

SEQ ID NO: 1897719 - protein, 20 aa, Staphylococcus
GVIMIIFMAMPFVFGLWNVV

SEQ ID NO: 1897720 - protein, 25 aa, Staphylococcus
GVIMIIFMAMPFVFGLWNVVIPLQI

SEQ ID NO: 1897721 - protein, 21 aa, Staphylococcus
GVIMLIAMVMVPIVALLKLNG

SEQ ID NO: 1897722 - protein, 41 aa, Staphylococcus
GVINSGYKKLLYWSLNHKWIVIIISIVLLVGSIGLGAAKLG

SEQ ID NO: 1897723 - protein, 25 aa, Staphylococcus
GVIVILLIVILYRPLMISTFDATFS

SEQ ID NO: 1897724 - protein, 23 aa, Staphylococcus
GVIWRILIFYIGAIFVIVTVYPW

SEQ ID NO: 1897725 - protein, 25 aa, Staphylococcus
GVLAFIFCVFGILTFGIFPQFMPSF

SEQ ID NO: 1897726 - protein, 23 aa, Staphylococcus
GVLAIILIILFDGKTENLIPLYA

SEQ ID NO: 1897727 - protein, 24 aa, Staphylococcus
GVLAMFFVIKYLPETRGRSLAEIE

SEQ ID NO: 1897728 - protein, 19 aa, Staphylococcus
GVLFIASWVTLLVQALKIK

SEQ ID NO: 1897729 - protein, 28 aa, Staphylococcus
GVLGPQDSYLLIRGIKTLGLRMEQVSSN

SEQ ID NO: 1897730 - protein, 22 aa, Staphylococcus
GVLIIPPLISFTWIAGFGGTAL

SEQ ID NO: 1897731 - protein, 18 aa, Staphylococcus
GVLILFGGGLALAKGISE

SEQ ID NO: 1897732 - protein, 23 aa, Staphylococcus
GVLLFVTSFLGITFLIAAGCIIY

SEQ ID NO: 1897733 - protein, 31 aa, Staphylococcus
GVLLIVFTLILQGPLWLLLVAFFLNVCPVTS

SEQ ID NO: 1897734 - protein, 27 aa, Staphylococcus
GVLLVPALISFLWFSVFGVLGIEMGKK

SEQ ID NO: 1897735 - protein, 18 aa, Staphylococcus
GVLNAVLERTQVFHPGDR

SEQ ID NO: 1897736 - protein, 26 aa, Staphylococcus
GVLSKVFIIWLFKRYSNNMRGSVGMM

SEQ ID NO: 1897737 - protein, 22 aa, Staphylococcus
GVLYFLLICNLLGTVYGYIWYG

SEQ ID NO: 1897738 - protein, 36 aa, Staphylococcus
GVMAIIRVWFTMMKASFAMWKAVITAVWNAIKTVSI

SEQ ID NO: 1897739 - protein, 18 aa, Staphylococcus
GVMPLVPGILITNAIRDL

SEQ ID NO: 1897740 - protein, 25 aa, Staphylococcus
GVMSQGWWFPTMASAFLIFTIIIML

SEQ ID NO: 1897741 - protein, 19 aa, Staphylococcus
GVMYLICAVLMFVRGGIDA

SEQ ID NO: 1897742 - protein, 20 aa, Staphylococcus
GVNWNVVGDRTKLNTGASLA

SEQ ID NO: 1897743 - protein, 17 aa, Staphylococcus
GVPLLTIIMLTLSGFDA

SEQ ID NO: 1897744 - protein, 17 aa, Staphylococcus
GVPMLTMPYVFVSWLIL

SEQ ID NO: 1897745 - protein, 24 aa, Staphylococcus
GVPRIIFAALIAIFIFMTGDGIEQ

SEQ ID NO: 1897746 - protein, 22 aa, Staphylococcus
GVQIILIFILKMVITAVIGFGA

SEQ ID NO: 1897747 - protein, 21 aa, Staphylococcus
GVQNMLKWGLLVALGFVIIAS

SEQ ID NO: 1897748 - protein, 37 aa, Staphylococcus
GVQWGTIIVTLVTFLILLALLKKFAWGPLKDVMDKRE

SEQ ID NO: 1897749 - protein, 17 aa, Staphylococcus
GVSFMVPFIVVGGLLIA

SEQ ID NO: 1897750 - protein, 22 aa, Staphylococcus
GVSFMVPFIVVGGLLIAIALTL

SEQ ID NO: 1897751 - protein, 33 aa, Staphylococcus
GVSGPIFIVILLIIFFFLGFIIPSSSGLAVLAM

SEQ ID NO: 1897752 - protein, 26 aa, Staphylococcus
GVSILILVIGIIILSIFKLNLGIDFS

SEQ ID NO: 1897753 - protein, 21 aa, Staphylococcus
GVSLFLLLKAFSSGASSLTGV

SEQ ID NO: 1897754 - protein, 17 aa, Staphylococcus
GVSLIPLIYDNMYLGYI

SEQ ID NO: 1897755 - protein, 22 aa, Staphylococcus
GVSLLCHMFLYTLTVHLTFFFI

SEQ ID NO: 1897756 - protein, 25 aa, Staphylococcus
GVSTLIGVVFGWIPARAAAKKELID

SEQ ID NO: 1897757 - protein, 32 aa, Staphylococcus
GVTIEQLQRELSDRLTFSSWLETDYLDSRDNG

SEQ ID NO: 1897758 - protein, 25 aa, Staphylococcus
GVTLIVILILQRFTTGFLKSIAILI

SEQ ID NO: 1897759 - protein, 25 aa, Staphylococcus
GVTVILLIAVLFRFNLAHVATLASV

SEQ ID NO: 1897760 - protein, 35 aa, Staphylococcus
GVVCLLIIMYTLLPLIMVLLGEKIFWPSKKATSHK

SEQ ID NO: 1897761 - protein, 20 aa, Staphylococcus
GVVIFFIWPTVQGWIFGIGG

SEQ ID NO: 1897762 - protein, 20 aa, Staphylococcus
GVVLMFILILITIEMIVEFT

SEQ ID NO: 1897763 - protein, 25 aa, Staphylococcus
GVVLNFMLVYFSLKLLGYSKEDIVT

SEQ ID NO: 1897764 - protein, 17 aa, Staphylococcus
GVVLVIILFICSIMIKW

SEQ ID NO: 1897765 - protein, 17 aa, Staphylococcus
GVYQIAAPLSLENALPR

SEQ ID NO: 1897766 - protein, 23 aa, Staphylococcus
GWEGLPTIVLPSLSLSAIVMATV

SEQ ID NO: 1897767 - protein, 24 aa, Staphylococcus
GWGLRSIIYIFILIAAITTVMLYA

SEQ ID NO: 1897768 - protein, 26 aa, Staphylococcus
GWGLRTIIYVFILTAAITTVMFYGQK

SEQ ID NO: 1897769 - protein, 20 aa, Staphylococcus
GWIALFAMILGVWFTSYFIF

SEQ ID NO: 1897770 - protein, 24 aa, Staphylococcus
GWIWTVTAIGLITLFWGSLNATKQ

SEQ ID NO: 1897771 - protein, 23 aa, Staphylococcus
GWIWTVTAVGLITLFWASLNATK

SEQ ID NO: 1897772 - protein, 22 aa, Staphylococcus
GWKTILYFEIITTIAIALGIIL

SEQ ID NO: 1897773 - protein, 21 aa, Staphylococcus
GWLQLSFMDHLWLKDYSLEWF

SEQ ID NO: 1897774 - protein, 20 aa, Staphylococcus
GWLSNDLRLMTLCWGLTLCC

SEQ ID NO: 1897775 - protein, 20 aa, Staphylococcus
GWPMTFIIISIIGALALIGI

SEQ ID NO: 1897776 - protein, 22 aa, Staphylococcus
GWRFTFLFIIIVSVIAGVLMMV

SEQ ID NO: 1897777 - protein, 25 aa, Staphylococcus
GWRSLPIIFVTLFAAALIVYVLMKL

SEQ ID NO: 1897778 - protein, 17 aa, Staphylococcus
GWRTIFIVSIVLTLLSM

SEQ ID NO: 1897779 - protein, 30 aa, Staphylococcus
GWSLGVFIFLLNLPFFFLGYKQIGKTFAIS

SEQ ID NO: 1897780 - protein, 17 aa, Staphylococcus
GYAMMLPKQDRFLMTEP

SEQ ID NO: 1897781 - protein, 18 aa, Staphylococcus
GYFKGFLSLIPVLIGIIT

SEQ ID NO: 1897782 - protein, 18 aa, Staphylococcus
GYFSTIAAILLLGGIQLI

SEQ ID NO: 1897783 - protein, 38 aa, Staphylococcus
GYFVPTVIAIAILTFSIWLLWIHPGSFEDALVAAISVL

SEQ ID NO: 1897784 - protein, 30 aa, Staphylococcus
GYGTILLMIVIFLIVGFIGALLSFIKVVKV

SEQ ID NO: 1897785 - protein, 35 aa, Staphylococcus
GYHAAFWFTVIIAIIAFFSVFLLKNKKKAKQSASI

SEQ ID NO: 1897786 - protein, 18 aa, Staphylococcus
GYIDLSVGASFIPYNENS

SEQ ID NO: 1897787 - protein, 20 aa, Staphylococcus
GYIENYLTRNALDTGFLPNA

SEQ ID NO: 1897788 - protein, 19 aa, Staphylococcus
GYILRLFQLLILYATPMFV

SEQ ID NO: 1897789 - protein, 25 aa, Staphylococcus
GYIVGLILGIYYYRKPRKYIQHEEI

SEQ ID NO: 1897790 - protein, 26 aa, Staphylococcus
GYLSVRLILALVFINLTSPVGGHLIS

SEQ ID NO: 1897791 - protein, 27 aa, Staphylococcus
GYLVEYINWRALFYVVAPISAVTFILA

SEQ ID NO: 1897792 - protein, 27 aa, Staphylococcus
GYMVLSLFIIITITFFLMKMMPGSPFN

SEQ ID NO: 1897793 - protein, 26 aa, Staphylococcus
GYNVSWGEWFLYAAPWSILMSIALYF

SEQ ID NO: 1897794 - protein, 23 aa, Staphylococcus
GYSMAIFFIFFNAPDLALTQFVV

SEQ ID NO: 1897795 - protein, 28 aa, Staphylococcus
GYVDGDKIAFLIPKIDLPRVEQFGVNPT

SEQ ID NO: 1897796 - protein, 20 aa, Staphylococcus
GYVLLINILLAFTALAMGIF

SEQ ID NO: 1897797 - protein, 27 aa, Staphylococcus
HAAPFSLYIFIAWFTASISTIAGAIGA

SEQ ID NO: 1897798 - protein, 22 aa, Staphylococcus
HAAWGWIIGVPGLIAWQAFSIF

SEQ ID NO: 1897799 - protein, 25 aa, Staphylococcus
HADPSFFIIYFGMGFIFAALYVYTK

SEQ ID NO: 1897800 - protein, 17 aa, Staphylococcus
HAEAFFPSKLPLINLRM

SEQ ID NO: 1897801 - protein, 22 aa, Staphylococcus
HAGALPLIIGLFSLMAFIGFFI

SEQ ID NO: 1897802 - protein, 23 aa, Staphylococcus
HAGFLFAVIITVISLLLTFMLKN

SEQ ID NO: 1897803 - protein, 23 aa, Staphylococcus
HAGWLHYLIGMMIAFIVSIVVTF

SEQ ID NO: 1897804 - protein, 33 aa, Staphylococcus
HAILIVISMLFYLWIIPWLSAKRVRILKQQVTT

SEQ ID NO: 1897805 - protein, 22 aa, Staphylococcus
HALFIPMMIMLLIGAFTKSAQF

SEQ ID NO: 1897806 - protein, 24 aa, Staphylococcus
HANFPLMLLILVAGTMLLVWLADQ

SEQ ID NO: 1897807 - protein, 25 aa, Staphylococcus
HAQGYAFLRFRTALVPFANIGSSLS

SEQ ID NO: 1897808 - protein, 24 aa, Staphylococcus
HAQGYFFLRFRTSLVPLANIGSSI

SEQ ID NO: 1897809 - protein, 23 aa, Staphylococcus
HARDSLIPDKDPLEIAKQALENS

SEQ ID NO: 1897810 - protein, 26 aa, Staphylococcus
HASDVKGIAYITAKRVKDGYEWDILF

SEQ ID NO: 1897811 - protein, 21 aa, Staphylococcus
HASLQYSYLTKFIAVSIACGF

SEQ ID NO: 1897812 - protein, 19 aa, Staphylococcus
HATFLLPVLAMAGAGQVGA

SEQ ID NO: 1897813 - protein, 29 aa, Staphylococcus
HAWALLPLLLFVLLFLGVGIISGDFTTMP

SEQ ID NO: 1897814 - protein, 25 aa, Staphylococcus
HAWSLVSFIALPMILINSIGTAIFL

SEQ ID NO: 1897815 - protein, 26 aa, Staphylococcus
HAYAKVWLFFMYYWIIFGIGCYFGQF

SEQ ID NO: 1897816 - protein, 30 aa, Staphylococcus
HAYAKVWLYFMYFWIIFGIGTYFGQYLPLE

SEQ ID NO: 1897817 - protein, 26 aa, Staphylococcus
HAYRKVWLFFTYYWLIFGIGCYLGQY

SEQ ID NO: 1897818 - protein, 28 aa, Staphylococcus
HDDLPRFYFYLILFMFAMLGVVLADNTI

SEQ ID NO: 1897819 - protein, 25 aa, Staphylococcus
HDGIPFIYWLIVGISMWFFVNQGVL

SEQ ID NO: 1897820 - protein, 38 aa, Staphylococcus
HDLKNLTTLIVVGAFILFLILLFMLMNHSDQGSNRITV

SEQ ID NO: 1897821 - protein, 25 aa, Staphylococcus
HDLLSNPLWLVFYIILTVAVIFHFA

SEQ ID NO: 1897822 - protein, 26 aa, Staphylococcus
HDNLPRFYVYLLLFMFSMLGIVTANN

SEQ ID NO: 1897823 - protein, 28 aa, Staphylococcus
HDNVTGSFNLPLWADRNNAKDSGNYPVT

SEQ ID NO: 1897824 - protein, 20 aa, Staphylococcus
HDTRTVAFPYVEGQKVYNAF

SEQ ID NO: 1897825 - protein, 28 aa, Staphylococcus
HDVQTYHLIIYYLVILIGLEPIRAINNL

SEQ ID NO: 1897826 - protein, 23 aa, Staphylococcus
HEAYLFNFFSRLLTALIGLVTAG

SEQ ID NO: 1897827 - protein, 21 aa, Staphylococcus
HEKLIIHRDIKPQNILIDKNK

SEQ ID NO: 1897828 - protein, 22 aa, Staphylococcus
HELIRWLFIFGVVFQLPMFCMG

SEQ ID NO: 1897829 - protein, 22 aa, Staphylococcus
HEPPGIIGDRWQYTGQTTTADG

SEQ ID NO: 1897830 - protein, 26 aa, Staphylococcus
HEVEEPDFLIVIYHGGLNKISNKSKR

SEQ ID NO: 1897831 - protein, 28 aa, Staphylococcus
HEWLQSWTIYYWGWWMSWSPFVGIFIAR

SEQ ID NO: 1897832 - protein, 25 aa, Staphylococcus
HEYLSFFKRIIFSLAVLTMFVCVAF

SEQ ID NO: 1897833 - protein, 19 aa, Staphylococcus
HFEIHSLWYLGMIPWIGAC

SEQ ID NO: 1897834 - protein, 18 aa, Staphylococcus
HFELHSLWYLGMLPWIGA

SEQ ID NO: 1897835 - protein, 20 aa, Staphylococcus
HFFLFVIAALLLYPIHKLIH

SEQ ID NO: 1897836 - protein, 30 aa, Staphylococcus
HFFSPLTWSLIFITLLLLLNIFTVKAFGET

SEQ ID NO: 1897837 - protein, 18 aa, Staphylococcus
HFFYFYLTVIISCLVCAF

SEQ ID NO: 1897838 - protein, 27 aa, Staphylococcus
HFGAIFYFIFLVLFLFAALTSSISLLE

SEQ ID NO: 1897839 - protein, 19 aa, Staphylococcus
HFIILLIFIILMYPIHKIM

SEQ ID NO: 1897840 - protein, 22 aa, Staphylococcus
HFKNVIFCLLGTLIIALGVNCF

SEQ ID NO: 1897841 - protein, 17 aa, Staphylococcus
HFLTVTLILFIFVGNML

SEQ ID NO: 1897842 - protein, 18 aa, Staphylococcus
HFLWFNLMHPDIWLALLA

SEQ ID NO: 1897843 - protein, 22 aa, Staphylococcus
HFLYTFMFSIIIGELIRATKGR

SEQ ID NO: 1897844 - protein, 23 aa, Staphylococcus
HFNHLQYRFESIIAFIVIAISCK

SEQ ID NO: 1897845 - protein, 39 aa, Staphylococcus
HFNQIQWIGILANLFFVPFYTFILFPASLIYFASLHFPI

SEQ ID NO: 1897846 - protein, 45 aa, Staphylococcus
HFNQIQWIGLLSNLIFVPFYSFIIFPLSIFLFFAYHFVSDMTLIN

SEQ ID NO: 1897847 - protein, 18 aa, Staphylococcus
HFNVVHGEWYRLVTSMFL

SEQ ID NO: 1897848 - protein, 38 aa, Staphylococcus
HFPKTRRTFGLILLQFVLLIVSQLIYYFSKGEVAKREP

SEQ ID NO: 1897849 - protein, 23 aa, Staphylococcus
HFSLMLIIMFPLAILAGWFPLKL

SEQ ID NO: 1897850 - protein, 27 aa, Staphylococcus
HFVLAMFPMLIFLLTLLGQFITINTDQ

SEQ ID NO: 1897851 - protein, 24 aa, Staphylococcus
HFVNIFSILLLLLTGTVFVTSPAL

SEQ ID NO: 1897852 - protein, 24 aa, Staphylococcus
HFVPWMIWSTLGFVFFYMPITFVA

SEQ ID NO: 1897853 - protein, 18 aa, Staphylococcus
HGEWYRLITSMFLHFNFE

SEQ ID NO: 1897854 - protein, 21 aa, Staphylococcus
HGFNLPLILSLIVIVVGFIMA

SEQ ID NO: 1897855 - protein, 19 aa, Staphylococcus
HGGFWVKGVCRRKLKAYEP

SEQ ID NO: 1897856 - protein, 26 aa, Staphylococcus
HGIAMLPMFVFLAAPKYIKIPHMTYA

SEQ ID NO: 1897857 - protein, 25 aa, Staphylococcus
HGINLPLIFTIVIIAVGLLGTLFID

SEQ ID NO: 1897858 - protein, 36 aa, Staphylococcus
HGNFKVKFFVSLIFAIPIILLSPMMGVNLPFQFTFP

SEQ ID NO: 1897859 - protein, 35 aa, Staphylococcus
HGNYIKPFIALFLLSMGFYILYQFLFKRTHEHHTH

SEQ ID NO: 1897860 - protein, 18 aa, Staphylococcus
HGPLWILLIAFFLNVCPV

SEQ ID NO: 1897861 - protein, 29 aa, Staphylococcus
HHDYVYTMIIYYIVILMIAFGNFQVRKDR

SEQ ID NO: 1897862 - protein, 20 aa, Staphylococcus
HHFKLEIVPIHYIHSDKPTN

SEQ ID NO: 1897863 - protein, 36 aa, Staphylococcus
HHSNIIINVILIGAFILNLIFAFTIIFMERRTANSI

SEQ ID NO: 1897864 - protein, 20 aa, Staphylococcus
HHVFWISFVAIFVGTALPLA

SEQ ID NO: 1897865 - protein, 19 aa, Staphylococcus
HHVFWISFVAIFVGVALPL

SEQ ID NO: 1897866 - protein, 18 aa, Staphylococcus
HIASFNLFDATKSGYDSV

SEQ ID NO: 1897867 - protein, 18 aa, Staphylococcus
HICIVALPPLLAFIGLLF

SEQ ID NO: 1897868 - protein, 36 aa, Staphylococcus
HICVGIFVVFSIIGIALILALVIYLHHLTKEASSIS

SEQ ID NO: 1897869 - protein, 17 aa, Staphylococcus
HIDDAYKQVLIPPFIIQ

SEQ ID NO: 1897870 - protein, 32 aa, Staphylococcus
HIGQLNGWGWVWFWWLVFPASIGSFGLWFSSL

SEQ ID NO: 1897871 - protein, 18 aa, Staphylococcus
HIIFIIISFGFLAAFIDA

SEQ ID NO: 1897872 - protein, 23 aa, Staphylococcus
HIIQLLIYVPFAFLLTASVALFT

SEQ ID NO: 1897873 - protein, 19 aa, Staphylococcus
HIISIFIIALIGAFSFIVG

SEQ ID NO: 1897874 - protein, 24 aa, Staphylococcus
HIKFSLFLAMLIACLLIQAATNMF

SEQ ID NO: 1897875 - protein, 24 aa, Staphylococcus
HIKNTIFCLLGTLLIALGVNCFVI

SEQ ID NO: 1897876 - protein, 25 aa, Staphylococcus
HIKTKYYFIILLISKLISILLLGMM

SEQ ID NO: 1897877 - protein, 17 aa, Staphylococcus
HILFLLGIFCFFKGFIG

SEQ ID NO: 1897878 - protein, 17 aa, Staphylococcus
HILVAAASALFLIISKY

SEQ ID NO: 1897879 - protein, 19 aa, Staphylococcus
HILVYLMVFIMMISRIYLH

SEQ ID NO: 1897880 - protein, 23 aa, Staphylococcus
HILYMLMILLIKAVLPLFLSSIL

SEQ ID NO: 1897881 - protein, 25 aa, Staphylococcus
HINQSEWMFILFSIALVLSLEAINT

SEQ ID NO: 1897882 - protein, 19 aa, Staphylococcus
HIPLYFETSAVLITLILLG

SEQ ID NO: 1897883 - protein, 26 aa, Staphylococcus
HIPTLWTSIFWVLLGTFLAIVVNKDE

SEQ ID NO: 1897884 - protein, 38 aa, Staphylococcus
HIQWKSIAILVLINLFLAWFLMYFPWGKTAVQSLANGI

SEQ ID NO: 1897885 - protein, 25 aa, Staphylococcus
HIRGKYYFIILLISKLISITFLAIM

SEQ ID NO: 1897886 - protein, 17 aa, Staphylococcus
HITLTFTIFILSVVFVI

SEQ ID NO: 1897887 - protein, 17 aa, Staphylococcus
HIYFIAFLVLIGVINFI

SEQ ID NO: 1897888 - protein, 21 aa, Staphylococcus
HIYLWWFMFAVFVSQILYNLI

SEQ ID NO: 1897889 - protein, 24 aa, Staphylococcus
HKFVAWLVLVPIVSLIGLLILILK

SEQ ID NO: 1897890 - protein, 23 aa, Staphylococcus
HKKIGIMYLLCAILMFVRGGIDA

SEQ ID NO: 1897891 - protein, 23 aa, Staphylococcus
HKKIGLMYLICAVLMFVRGGIDA

SEQ ID NO: 1897892 - protein, 24 aa, Staphylococcus
HKKIGLMYLICAVLMFVRGGIDAL

SEQ ID NO: 1897893 - protein, 42 aa, Staphylococcus
HKKPLPKFLTLFAGPLFNFILALVLFIGLAYYQGTPTNTIGE

SEQ ID NO: 1897894 - protein, 25 aa, Staphylococcus
HKKVMLWAAFFALTFFIIYSTRTIF

SEQ ID NO: 1897895 - protein, 24 aa, Staphylococcus
HKKVMLWAAIFAATFFIIYASRTI

SEQ ID NO: 1897896 - protein, 30 aa, Staphylococcus
HKKYGTALFWILLAITFIAGPYIPNVFNGI

SEQ ID NO: 1897897 - protein, 32 aa, Staphylococcus
HKLTQYLFYTFVLLFITIVLFVTAVHSAILAI

SEQ ID NO: 1897898 - protein, 47 aa, Staphylococcus
HKNSNGFVDLLKNTLGFVGISSLLAGFWFILAKRRKKEEEDETVDLH

SEQ ID NO: 1897899 - protein, 19 aa, Staphylococcus
HKNTKLGLKYTFKSQIDDK

SEQ ID NO: 1897900 - protein, 23 aa, Staphylococcus
HKTLTILYILFGALVLLNTLRQT

SEQ ID NO: 1897901 - protein, 26 aa, Staphylococcus
HKTWLKFFIGILLINLLITIITRVLV

SEQ ID NO: 1897902 - protein, 23 aa, Staphylococcus
HKVRGLLAFWIGALLIAFTLLSN

SEQ ID NO: 1897903 - protein, 23 aa, Staphylococcus
HKVRGLLSFWIGALLIAFTLLSN

SEQ ID NO: 1897904 - protein, 18 aa, Staphylococcus
HKWLYMYAYSFYLFFDFA

SEQ ID NO: 1897905 - protein, 19 aa, Staphylococcus
HKWLYMYAYSFYLFFDFAG

SEQ ID NO: 1897906 - protein, 24 aa, Staphylococcus
HKYLWWFMFAVYVSNVLFTLVNVT

SEQ ID NO: 1897907 - protein, 17 aa, Staphylococcus
HLAFIFLALFGVLALVT

SEQ ID NO: 1897908 - protein, 17 aa, Staphylococcus
HLEHASLQYSYLTKFIA

SEQ ID NO: 1897909 - protein, 33 aa, Staphylococcus
HLENGDDLPTNGFLFYWNPKTTGSNTSQWQSLA

SEQ ID NO: 1897910 - protein, 17 aa, Staphylococcus
HLFFMIAAPEGGAQTHL

SEQ ID NO: 1897911 - protein, 20 aa, Staphylococcus
HLFISLFRFIVGFVLAILIG

SEQ ID NO: 1897912 - protein, 25 aa, Staphylococcus
HLILTGLFIFYILMAIFTPLTHDDW

SEQ ID NO: 1897913 - protein, 24 aa, Staphylococcus
HLIVYILIFLVFISVIRLLLQPII

SEQ ID NO: 1897914 - protein, 19 aa, Staphylococcus
HLIYFNIILFCLCMINLFC

SEQ ID NO: 1897915 - protein, 17 aa, Staphylococcus
HLMPAVIGGFFMALTYS

SEQ ID NO: 1897916 - protein, 21 aa, Staphylococcus
HLPNRALLILTIIGVVIGSMF

SEQ ID NO: 1897917 - protein, 19 aa, Staphylococcus
HLRRYIKPVMLMALGLVIT

SEQ ID NO: 1897918 - protein, 34 aa, Staphylococcus
HLSKASLQYSFLLNFFAAAIACGFFLLMFGGVVS

SEQ ID NO: 1897919 - protein, 30 aa, Staphylococcus
HLSVAIGIALFIFLIVRPPIEYLRQYLAQW

SEQ ID NO: 1897920 - protein, 27 aa, Staphylococcus
HLTGSSLKPFLAYGPAIENMQWATNRA

SEQ ID NO: 1897921 - protein, 27 aa, Staphylococcus
HLTGSSLKPFLSYGPAIENMQWATNHA

SEQ ID NO: 1897922 - protein, 19 aa, Staphylococcus
HLTLSYLMLFIALEPIRAI

SEQ ID NO: 1897923 - protein, 22 aa, Staphylococcus
HLTVFLILRLIQGLTSGGAIVI

SEQ ID NO: 1897924 - protein, 18 aa, Staphylococcus
HLYLILHAISHNNFSAEP

SEQ ID NO: 1897925 - protein, 17 aa, Staphylococcus
HLYNIFMFIVWIGIIAA

SEQ ID NO: 1897926 - protein, 17 aa, Staphylococcus
HMLLPFMFGPIIASIIV

SEQ ID NO: 1897927 - protein, 38 aa, Staphylococcus
HMSELLPSILKVGLIYGLVILVIALIATLLIKKKAKLA

SEQ ID NO: 1897928 - protein, 30 aa, Staphylococcus; identical to SEQ ID NO: 1751348

SEQ ID NO: 1897929 - protein, 20 aa, Staphylococcus
HMSLSFWFRDCVYMRTLFYM

SEQ ID NO: 1897930 - protein, 19 aa, Staphylococcus
HMYLGYIAGLLVAYAGGFI

SEQ ID NO: 1897931 - protein, 22 aa, Staphylococcus
HMYLWWFMFAVFVSNAIFTLIN

SEQ ID NO: 1897932 - protein, 21 aa, Staphylococcus
HNAEEYLDKFKFSAAQTEIDD

SEQ ID NO: 1897933 - protein, 25 aa, Staphylococcus
HNDIKFFFIYFGMGMLFSLAYVLTR

SEQ ID NO: 1897934 - protein, 24 aa, Staphylococcus
HNDIKFLPMYFGMGMLFSLAYTYT

SEQ ID NO: 1897935 - protein, 25 aa, Staphylococcus
HNDPSFIIIYFGMGFILSGFYVYSK

SEQ ID NO: 1897936 - protein, 23 aa, Staphylococcus
HNGQLTYQMFLNGHPTFSKQHLN

SEQ ID NO: 1897937 - protein, 31 aa, Staphylococcus
HNISNFLSVLPWFIITIPIILMLSHQLDILG

SEQ ID NO: 1897938 - protein, 24 aa, Staphylococcus
HNKEKLIKELLSTRLGNNEASQIA

SEQ ID NO: 1897939 - protein, 17 aa, Staphylococcus
HNLILKYLSWYIKTVKG

SEQ ID NO: 1897940 - protein, 46 aa, Staphylococcus
HNLLFLVVITVLVALAVYLFRFVWVYVLYPYFYLSVSPFQKMISKD

SEQ ID NO: 1897941 - protein, 26 aa, Staphylococcus
HNMHPDLVKILGRLNYRTSYGQNVLK

SEQ ID NO: 1897942 - protein, 26 aa, Staphylococcus
HNNYSIPYFLGTVGILYNKKAYPNEQ

SEQ ID NO: 1897943 - protein, 25 aa, Staphylococcus
HNPVKVFVIPTLKFMEWRIAIQTDE

SEQ ID NO: 1897944 - protein, 23 aa, Staphylococcus
HNRFEVFLQKYYIDLYERNIFKI

SEQ ID NO: 1897945 - protein, 39 aa, Staphylococcus
HNTFSPTILVLLMYLVSLMTAYLFYSYERHKGQVNFVKD

SEQ ID NO: 1897946 - protein, 28 aa, Staphylococcus
HNTYLLYFIFCILLIGLLILPETAITPV

SEQ ID NO: 1897947 - protein, 20 aa, Staphylococcus
HNVYNVIDYTKQIKNESTAY

SEQ ID NO: 1897948 - protein, 26 aa, Staphylococcus
HPDITRYFMTIPEAARLVLQAGAIAE

SEQ ID NO: 1897949 - protein, 35 aa, Staphylococcus
HPHELFIPALILSLLILFFYLFSDGLRDAFDPKMR

SEQ ID NO: 1897950 - protein, 19 aa, Staphylococcus
HPHFLWFNLMHTDIIMTII

SEQ ID NO: 1897951 - protein, 24 aa, Staphylococcus
HPKMMLKVILYAYTQSVFSGRKIE

SEQ ID NO: 1897952 - protein, 18 aa, Staphylococcus
HPQKKHLYLILHAISHNN

SEQ ID NO: 1897953 - protein, 26 aa, Staphylococcus
HPTGSSLKPFLAYGPAIENMHWATNH

SEQ ID NO: 1897954 - protein, 27 aa, Staphylococcus
HPTGSSLKPFLAYGPAIENMQWATNHA

SEQ ID NO: 1897955 - protein, 19 aa, Staphylococcus
HQAVQHQAYNRHVSYHGYG

SEQ ID NO: 1897956 - protein, 20 aa, Staphylococcus
HQAYNRHVSYHGYGYTMTEA

SEQ ID NO: 1897957 - protein, 23 aa, Staphylococcus
HQDTLVDIIFWSAIFGFIIARIY

SEQ ID NO: 1897958 - protein, 18 aa, Staphylococcus
HQEILNNSNLTDAQKQKV

SEQ ID NO: 1897959 - protein, 43 aa, Staphylococcus
HQEVTSLRKFLIFITLLALFCSITLLSWLYLTKSHTEHPHTVE

SEQ ID NO: 1897960 - protein, 17 aa, Staphylococcus
HQFEQLLLIFIDNAMKY

SEQ ID NO: 1897961 - protein, 20 aa, Staphylococcus
HQHRIREQWQNAIKAKEMLD

SEQ ID NO: 1897962 - protein, 25 aa, Staphylococcus
HQKIYWFLLLLVVSAGIIAINIFKF

SEQ ID NO: 1897963 - protein, 25 aa, Staphylococcus
HQQGYAFLRFRTALVPLANIGSSLS

SEQ ID NO: 1897964 - protein, 25 aa, Staphylococcus
HQQGYAPLRFRSALVPLANIGSSLS

SEQ ID NO: 1897965 - protein, 24 aa, Staphylococcus
HQTGFFFYVFVKPIDWLLHSIGQL

SEQ ID NO: 1897966 - protein, 25 aa, Staphylococcus
HQWLDILIMIPFMTPPYIGAMGWML

SEQ ID NO: 1897967 - protein, 23 aa, Staphylococcus
HQWLDLVIMIPFMTPPYIGSMGW

SEQ ID NO: 1897968 - protein, 50 aa, Staphylococcus
HRHSDQPTLIDKVKYFFKEHWAKVLIVLAVILLIVLINAIFNNVDHNGNT

SEQ ID NO: 1897969 - protein, 18 aa, Staphylococcus
HRPDFAITNGGGIRASID

SEQ ID NO: 1897970 - protein, 25 aa, Staphylococcus
HSFGTYLWLFILIISIMKLAHIKFW

SEQ ID NO: 1897971 - protein, 22 aa, Staphylococcus
HSGFLFAVIITVVSLLLTFLLK

SEQ ID NO: 1897972 - protein, 28 aa, Staphylococcus
HSKLAWFVFIVCLFISLLLLILKKRYKY

SEQ ID NO: 1897973 - protein, 34 aa, Staphylococcus
HSLGGFSWPIVLVLLILFFFYSHYLFASATAHVS

SEQ ID NO: 1897974 - protein, 24 aa, Staphylococcus
HSNIILMMLIFILAGAFSTTAEKM

SEQ ID NO: 1897975 - protein, 25 aa, Staphylococcus
HSNIILMMLIFILAGAFSTTTEKMG

SEQ ID NO: 1897976 - protein, 24 aa, Staphylococcus
HSNIILMVFIFILAGAFSTTTEKM

SEQ ID NO: 1897977 - protein, 24 aa, Staphylococcus
HSNIILMVLIFVLAGAFSKVTEDM

SEQ ID NO: 1897978 - protein, 24 aa, Staphylococcus
HSNIVLMVFIFILAGAFSTTAEKM

SEQ ID NO: 1897979 - protein, 23 aa, Staphylococcus
HSQALNSVISLRLTATDNDNNQQ

SEQ ID NO: 1897980 - protein, 17 aa, Staphylococcus
HSRMYTFSKRKAINNLK

SEQ ID NO: 1897981 - protein, 22 aa, Staphylococcus
HSSNVYMFKTALKLAGDPYFSG

SEQ ID NO: 1897982 - protein, 23 aa, Staphylococcus
HSSNVYMFKTALKLAGDPYSSGM

SEQ ID NO: 1897983 - protein, 22 aa, Staphylococcus
HSSNVYMFKTALKLAGDPYYSG

SEQ ID NO: 1897984 - protein, 21 aa, Staphylococcus
HSWLFAPYLLLVFAGGILHNK

SEQ ID NO: 1897985 - protein, 21 aa, Staphylococcus
HSYILLGYPMQSQDRKHAKFS

SEQ ID NO: 1897986 - protein, 20 aa, Staphylococcus
HTFSFKLLGSLLAIGLILIA

SEQ ID NO: 1897987 - protein, 30 aa, Staphylococcus
HTGSFYLVATFRFILVMIGVLSASLVNLVF

SEQ ID NO: 1897988 - protein, 29 aa, Staphylococcus
HTGSFYVAAFFRFALVMIGVLSSSIVNLI

SEQ ID NO: 1897989 - protein, 30 aa, Staphylococcus
HTGSFYVAAFFRFVLVMIGVLSSSIVNLLF

SEQ ID NO: 1897990 - protein, 23 aa, Staphylococcus
HTHIVWLSLILFIRGCSVGGINL

SEQ ID NO: 1897991 - protein, 26 aa, Staphylococcus
HTIELPMLIMMAIFSFVIFDSVEHIN

SEQ ID NO: 1897992 - protein, 24 aa, Staphylococcus
HTLVLPLIILIFTLIRKISSIVDR

SEQ ID NO: 1897993 - protein, 38 aa, Staphylococcus
HTMNKRIRFIFGAIVLIFVLIVLRLGYLQIAQGAHYSQ

SEQ ID NO: 1897994 - protein, 23 aa, Staphylococcus
HTSFTYITIFFAISLAANAMVFN

SEQ ID NO: 1897995 - protein, 25 aa, Staphylococcus
HTSIWWLYLMLFIRGCSVGGIMLGF

SEQ ID NO: 1897996 - protein, 29 aa, Staphylococcus
HTVNGKENLYRIAIQYYGEGTQQNVDKIK

SEQ ID NO: 1897997 - protein, 26 aa, Staphylococcus
HTVTLLLIGLFIWNIVQWSTNPAIQS

SEQ ID NO: 1897998 - protein, 25 aa, Staphylococcus
HTYSYIMYVIIILAVIFIVYRLFKK

SEQ ID NO: 1897999 - protein, 25 aa, Staphylococcus
HTYSYIMYVIIILAVLYVLYRIFFK

SEQ ID NO: 1898000 - protein, 23 aa, Staphylococcus
HTYVAWIILVPIVSVIGLCILII

SEQ ID NO: 1898001 - protein, 18 aa, Staphylococcus
HVAWGYAIILIIASYFGA

SEQ ID NO: 1898002 - protein, 23 aa, Staphylococcus
HVDVFIFSMIKKVFQSDKTFIIR

SEQ ID NO: 1898003 - protein, 20 aa, Staphylococcus
HVFWISFVSIFISTAIPLAC

SEQ ID NO: 1898004 - protein, 20 aa, Staphylococcus
HVHELLTPLVSVVALQLISY

SEQ ID NO: 1898005 - protein, 36 aa, Staphylococcus
HVHELLTPLVSVVTLQLIAYYAALHRGLDVDKPRNL

SEQ ID NO: 1898006 - protein, 18 aa, Staphylococcus
HVIIKPNKPYPEGTIIIK

SEQ ID NO: 1898007 - protein, 20 aa, Staphylococcus
HVITMFFFTGLIIGIVPYLL

SEQ ID NO: 1898008 - protein, 55 aa, Staphylococcus
HVKDNDQTEIPLVWGPKALPPYNPYVFDKTNNKIAAVLSKYPNNLGGVAGDKTVG

SEQ ID NO: 1898009 - protein, 17 aa, Staphylococcus
HVKSVEYQKHGDVGVFT

SEQ ID NO: 1898010 - protein, 17 aa, Staphylococcus
HVKTMKIGLTALGFKVD

SEQ ID NO: 1898011 - protein, 22 aa, Staphylococcus
HVNEVYLISHALLETGAAKSEL

SEQ ID NO: 1898012 - protein, 22 aa, Staphylococcus
HVNEVYLISHALLETGSAKSEL

SEQ ID NO: 1898013 - protein, 23 aa, Staphylococcus
HVNEVYLISHALLETGSVKSELA

SEQ ID NO: 1898014 - protein, 23 aa, Staphylococcus
HVQKAMLLHYISGKYVLDLKEDD

SEQ ID NO: 1898015 - protein, 33 aa, Staphylococcus
HVSGPIFIIIILFIFFFLGFIVPSSSGLAVLAM

SEQ ID NO: 1898016 - protein, 31 aa, Staphylococcus
HVSGPIFIIILLIIFFFLGFIVPSSSGLAVL

SEQ ID NO: 1898017 - protein, 25 aa, Staphylococcus
HVSWRVPFIIIVGIALIALVFGFIF

SEQ ID NO: 1898018 - protein, 28 aa, Staphylococcus
HVTDTTPPRKPVINTNLVNKVGTRTPID

SEQ ID NO: 1898019 - protein, 23 aa, Staphylococcus
HVTITPNVPIPEGNIFAKATDNA

SEQ ID NO: 1898020 - protein, 19 aa, Staphylococcus
HVTITPTRPIPEGDVYAKA

SEQ ID NO: 1898021 - protein, 17 aa, Staphylococcus
HVVAPIAALTFLGAIKF

SEQ ID NO: 1898022 - protein, 28 aa, Staphylococcus
HVVSGNDNLYRIAIQYYGEGTVENVNKL

SEQ ID NO: 1898023 - protein, 28 aa, Staphylococcus
HVVSGNENLYRIAIQYYGEGTVENVNKL

SEQ ID NO: 1898024 - protein, 17 aa, Staphylococcus
HVYVIIPFDLTDFSAVQ

SEQ ID NO: 1898025 - protein, 22 aa, Staphylococcus
HWFSLPQPFRFSTFSFDLGATL

SEQ ID NO: 1898026 - protein, 27 aa, Staphylococcus
HWGPIAWAIYVLPALPIGYLVFVKKKP

SEQ ID NO: 1898027 - protein, 21 aa, Staphylococcus
HWILFFLMVFFLFIVLSAPTY

SEQ ID NO: 1898028 - protein, 19 aa, Staphylococcus
HWLGIPRPFRFSGFGFDFG

SEQ ID NO: 1898029 - protein, 24 aa, Staphylococcus
HWLTVLFIVLLLISFNMLGAKLFG

SEQ ID NO: 1898030 - protein, 27 aa, Staphylococcus
HWNVMFYGMFIIGLVSLAIAYIWFRVY

SEQ ID NO: 1898031 - protein, 25 aa, Staphylococcus
HWVNSVLIIVLFVVVSILIISYVLG

SEQ ID NO: 1898032 - protein, 23 aa, Staphylococcus
HYHFRRMSLFIIKLIGGLVVMSI

SEQ ID NO: 1898033 - protein, 27 aa, Staphylococcus
HYIGPGIFLLIILFSMINQFQKVRLTR

SEQ ID NO: 1898034 - protein, 23 aa, Staphylococcus
HYNFYSFIALRHHAERLHVTSAH

SEQ ID NO: 1898035 - protein, 17 aa, Staphylococcus
HYPLIDFKLFNNKAYTS

SEQ ID NO: 1898036 - protein, 26 aa, Staphylococcus
HYPYDFLVIIVLALVFYRIGITSHFK

SEQ ID NO: 1898037 - protein, 25 aa, Staphylococcus
HYQGFTKIIIVLIISPIIAFCVGYI

SEQ ID NO: 1898038 - protein, 24 aa, Staphylococcus
HYSVPPFFAFVATLFIGILTGLFG

SEQ ID NO: 1898039 - protein, 27 aa, Staphylococcus
HYSVPPMFAFFATLFIGVLTGLFGIGG

SEQ ID NO: 1898040 - protein, 23 aa, Staphylococcus
IAAAIIAISFLYLQGGQFIDVIT

SEQ ID NO: 1898041 - protein, 23 aa, Staphylococcus
IAAAIIALSFLYLQGGTLIDTLT

SEQ ID NO: 1898042 - protein, 25 aa, Staphylococcus
IAAAIIAMSFLYLQGGRLIDVITAI

SEQ ID NO: 1898043 - protein, 18 aa, Staphylococcus
IAAIFYVSNWWYIAKDVN

SEQ ID NO: 1898044 - protein, 31 aa, Staphylococcus
IAAINAIFNILSIEGIIILVIYHGHDEGKLE

SEQ ID NO: 1898045 - protein, 17 aa, Staphylococcus
IAALALIFIYVSLGYIG

SEQ ID NO: 1898046 - protein, 24 aa, Staphylococcus
IAATSFLPLILLPLGHVLSPEQVS

SEQ ID NO: 1898047 - protein, 23 aa, Staphylococcus
IAAVALIYFSIAHAILIVISMLF

SEQ ID NO: 1898048 - protein, 21 aa, Staphylococcus
IADIFIPLIPAFVGAGLVGGI

SEQ ID NO: 1898049 - protein, 17 aa, Staphylococcus
IADMLLAIPSFIIALVI

SEQ ID NO: 1898050 - protein, 35 aa, Staphylococcus
IAEKMRFIPYLIFVGLWVVFIYSPVAHWVWGGGWI

SEQ ID NO: 1898051 - protein, 19 aa, Staphylococcus
IAFFICWLGLQFYLNHQHY

SEQ ID NO: 1898052 - protein, 25 aa, Staphylococcus
IAFGLVYFIILFTSAYVLIRMFRNK

SEQ ID NO: 1898053 - protein, 29 aa, Staphylococcus
IAFIAAIIFVFILNVFIIQGAVVKQQNMA

SEQ ID NO: 1898054 - protein, 31 aa, Staphylococcus
IAFILVLIVLILLIILFVIKVTNYSIKDSEY

SEQ ID NO: 1898055 - protein, 43 aa, Staphylococcus
IAFLFVMSPLYYRFTVYWPFFSDVFIGLPLLLYAIEHMLQQKK

SEQ ID NO: 1898056 - protein, 22 aa, Staphylococcus
IAFLIALFGITLFLAGHYTPGG

SEQ ID NO: 1898057 - protein, 21 aa, Staphylococcus
IAFLIALFGVTLFFAGHYTPG

SEQ ID NO: 1898058 - protein, 18 aa, Staphylococcus
IAFLLIASLCKLILYLII

SEQ ID NO: 1898059 - protein, 23 aa, Staphylococcus
IAGIGWFGLQTFAGSQALLILLN

SEQ ID NO: 1898060 - protein, 23 aa, Staphylococcus
IAGIITLWYYWIKRRRNIKEMVE

SEQ ID NO: 1898061 - protein, 26 aa, Staphylococcus
IAGIITWLLTALGAAAVFIFKRVNDK

SEQ ID NO: 1898062 - protein, 23 aa, Staphylococcus
IAGIITWLLTALGAAGVFIFNKV

SEQ ID NO: 1898063 - protein, 23 aa, Staphylococcus
IAGIITWLLTALGAASVFIFKSV

SEQ ID NO: 1898064 - protein, 23 aa, Staphylococcus
IAGIITWLLTALGAASVFIFKTV

SEQ ID NO: 1898065 - protein, 24 aa, Staphylococcus
IAGILTLWYYWRKRKPHIDKMVAS

SEQ ID NO: 1898066 - protein, 23 aa, Staphylococcus
IAGLILGMIYYRKPRDYKRESYT

SEQ ID NO: 1898067 - protein, 30 aa, Staphylococcus
IAGNYFWNVWSLVIALLLIVLVIINSIITV

SEQ ID NO: 1898068 - protein, 28 aa, Staphylococcus
IAGYILVCAFFLLIPQLQFRRAKNKEAY

SEQ ID NO: 1898069 - protein, 28 aa, Staphylococcus
IAIFIIFFISGTLSWFMHDKEKYKNLKY

SEQ ID NO: 1898070 - protein, 20 aa, Staphylococcus
IAIIGMLIWIMMSHDLWESV

SEQ ID NO: 1898071 - protein, 34 aa, Staphylococcus
IAIIILVAILILFSFVPVGLWISAIAAGVKVGIG

SEQ ID NO: 1898072 - protein, 18 aa, Staphylococcus
IAIILMYLIGLIVTLGIG

SEQ ID NO: 1898073 - protein, 28 aa, Staphylococcus
IAIILVLDFSIWFPFVKAYDKLKLDEER

SEQ ID NO: 1898074 - protein, 20 aa, Staphylococcus
IAIISWVTSVFGFDLSFILD

SEQ ID NO: 1898075 - protein, 28 aa, Staphylococcus
IAIIVLIILYMLYNWILNKRSVTELDQN

SEQ ID NO: 1898076 - protein, 17 aa, Staphylococcus
IAIIYIIGSLLMAVANS

SEQ ID NO: 1898077 - protein, 17 aa, Staphylococcus
IAILFLTLGFWKTILII

SEQ ID NO: 1898078 - protein, 26 aa, Staphylococcus
IAILPFYKFFIYDFLQFYKLKGSLSV

SEQ ID NO: 1898079 - protein, 26 aa, Staphylococcus
IAINVLIWLYMKIYLNHFSDIKLLDV

SEQ ID NO: 1898080 - protein, 40 aa, Staphylococcus
IAIVILIIFALLFRFIVKLIPVHYIFRVLSILIFIMTFKM

SEQ ID NO: 1898081 - protein, 26 aa, Staphylococcus
IAIVYLIHRFFFKRVFYLKKVWVIFK

SEQ ID NO: 1898082 - protein, 47 aa, Staphylococcus
IAIYAPLERLLKRWVPKVLQLFLVPMLSLIIMVPLTVLVFGPFSEYV

SEQ ID NO: 1898083 - protein, 18 aa, Staphylococcus
IAIYILLLLLNPLYAFVF

SEQ ID NO: 1898084 - protein, 26 aa, Staphylococcus
IAIYTITVIIFSALVSFFIANIHYHF

SEQ ID NO: 1898085 - protein, 37 aa, Staphylococcus
IAIYTITVILFSAFISFVLTNIYYHFNLKASNDAKIM

SEQ ID NO: 1898086 - protein, 32 aa, Staphylococcus
IAIYTITVILFSALVSFLFANVYYHFNLKAHN

SEQ ID NO: 1898087 - protein, 26 aa, Staphylococcus
IAIYTITVILLSAILSFFISNVYYHF

SEQ ID NO: 1898088 - protein, 22 aa, Staphylococcus
IAIYTVVIMLFSAVASFILSNI

SEQ ID NO: 1898089 - protein, 30 aa, Staphylococcus
IAKNFTWYYLLLVLVILIVCVYLLFSRYSS

SEQ ID NO: 1898090 - protein, 20 aa, Staphylococcus
IAKYFAILPAMFMAAMPAMN

SEQ ID NO: 1898091 - protein, 50 aa, Staphylococcus
IALAIVILIIFALLFRFIVKLIPIYYIFRVLSIFIFLMAFKMLGVSIQKL

SEQ ID NO: 1898092 - protein, 50 aa, Staphylococcus
IALAIVILIIFALLFRFIVKLIPIYYIFRVLSILIFIMAFKMLGVSIQKL

SEQ ID NO: 1898093 - protein, 17 aa, Staphylococcus
IALATFLRPLGGILGDK

SEQ ID NO: 1898094 - protein, 25 aa, Staphylococcus
IALAWAYLRFIAFRHDLKYLPGGQT

SEQ ID NO: 1898095 - protein, 24 aa, Staphylococcus
IALDLLFGIPLLVGALITVFDVFL

SEQ ID NO: 1898096 - protein, 24 aa, Staphylococcus
IALDLLFNIPLIIGALITVFDVFL

SEQ ID NO: 1898097 - protein, 24 aa, Staphylococcus
IALDLLFNIPLIIGALITVLDVFL

SEQ ID NO: 1898098 - protein, 42 aa, Staphylococcus
IALFASWLLIPQKLSRYIIGSIVTFLFVVQIIGIVANMTHHF

SEQ ID NO: 1898099 - protein, 18 aa, Staphylococcus
IALFFEVGLVLLIPLVFT

SEQ ID NO: 1898100 - protein, 18 aa, Staphylococcus
IALFLIWLPTYLTEQYHV

SEQ ID NO: 1898101 - protein, 19 aa, Staphylococcus
IALIAILIDLGLRFLEKRL

SEQ ID NO: 1898102 - protein, 18 aa, Staphylococcus
IALIAWPMSISTGRDYGL

SEQ ID NO: 1898103 - protein, 18 aa, Staphylococcus
IALIIAIVFFLIALILYI

SEQ ID NO: 1898104 - protein, 33 aa, Staphylococcus
IALIITFIILVFSYSGWMLLLAGIFLGIGYGNL

SEQ ID NO: 1898105 - protein, 27 aa, Staphylococcus
IALILASLLLTIIMPIIENKKLMTKIK

SEQ ID NO: 1898106 - protein, 20 aa, Staphylococcus
IALILIYLVAIVFQLGDQIG

SEQ ID NO: 1898107 - protein, 22 aa, Staphylococcus
IALIMLFILIKLFMQVHEVFTP

SEQ ID NO: 1898108 - protein, 22 aa, Staphylococcus
IALITLFNILIHLGFASATSLS

SEQ ID NO: 1898109 - protein, 18 aa, Staphylococcus
IALIVVGIVMILFAFKTQ

SEQ ID NO: 1898110 - protein, 25 aa, Staphylococcus
IALLHALFITLLFGLIAYFIILMLR

SEQ ID NO: 1898111 - protein, 23 aa, Staphylococcus
IALLIFLPILLKGGFILMLFAFL

SEQ ID NO: 1898112 - protein, 20 aa, Staphylococcus
IALLIFLPILLKGGTVLMLF

SEQ ID NO: 1898113 - protein, 22 aa, Staphylococcus
IALLIFLPILLMGGTTLMLFAY

SEQ ID NO: 1898114 - protein, 36 aa, Staphylococcus
IALLLTIKKYRNVTLIFWIISLISLLLMVWISQPHM

SEQ ID NO: 1898115 - protein, 18 aa, Staphylococcus
IALVLGLVILIHKKISAR

SEQ ID NO: 1898116 - protein, 21 aa, Staphylococcus
IAMFILQFMLNFFIPSGSGQA

SEQ ID NO: 1898117 - protein, 19 aa, Staphylococcus
IAMFLLILCGGAISDKLLQ

SEQ ID NO: 1898118 - protein, 22 aa, Staphylococcus
IAMIFYVMQLSMPLMNLSTLVT

SEQ ID NO: 1898119 - protein, 20 aa, Staphylococcus
IAMLAILMLALGLGPTTVVV

SEQ ID NO: 1898120 - protein, 17 aa, Staphylococcus
IAMPVIMAGIRTAMVLI

SEQ ID NO: 1898121 - protein, 18 aa, Staphylococcus
IAMPVIMAGIRTAMVLII

SEQ ID NO: 1898122 - protein, 25 aa, Staphylococcus
IANIFIPLIPAFIGAGLIGGIAAIL

SEQ ID NO: 1898123 - protein, 25 aa, Staphylococcus
IANIFIPLIPAFIGAGLIGGIAAVL

SEQ ID NO: 1898124 - protein, 29 aa, Staphylococcus
IAPESIQNALITPTLNPKVPQSTQSSGFT

SEQ ID NO: 1898125 - protein, 25 aa, Staphylococcus
IAPSYYLMFINVVGLIIFITMFKST

SEQ ID NO: 1898126 - protein, 19 aa, Staphylococcus
IAPVYIILWFAFRGKEKLR

SEQ ID NO: 1898127 - protein, 26 aa, Staphylococcus
IAQGDEALYNLGDYVWEDTNKNGIQD

SEQ ID NO: 1898128 - protein, 42 aa, Staphylococcus
IAQGFNWLVAVAPWLAGLLIGAFWQVFVIFGVHWGITPMVLA

SEQ ID NO: 1898129 - protein, 22 aa, Staphylococcus
IAQGRWLFRVTSLIVFGHIVLS

SEQ ID NO: 1898130 - protein, 22 aa, Staphylococcus
IAQRLLVFLPFPKTVAYDMTYA

SEQ ID NO: 1898131 - protein, 18 aa, Staphylococcus
IAQSAYLIGLLQSPYMYT

SEQ ID NO: 1898132 - protein, 20 aa, Staphylococcus
IAQSLIAFILLLAGGGDGAE

SEQ ID NO: 1898133 - protein, 19 aa, Staphylococcus
IAQSLIAFVLLFAGGGNGA

SEQ ID NO: 1898134 - protein, 27 aa, Staphylococcus
IARYAIYLLSLIISVVLYFSFVTLKYA

SEQ ID NO: 1898135 - protein, 25 aa, Staphylococcus
IASILFVFKILIFVVPFAILNYTQG

SEQ ID NO: 1898136 - protein, 17 aa, Staphylococcus
IASLFIPFGASIGLDTM

SEQ ID NO: 1898137 - protein, 18 aa, Staphylococcus
IASLFIPFGASIGLDTMA

SEQ ID NO: 1898138 - protein, 18 aa, Staphylococcus
IASLIIMAVLIWTIGIAS

SEQ ID NO: 1898139 - protein, 23 aa, Staphylococcus
IASTAFIFLPALIGWSSMRVFGG

SEQ ID NO: 1898140 - protein, 26 aa, Staphylococcus
IATGIACGFIFYPITMLISKRHKEVH

SEQ ID NO: 1898141 - protein, 52 aa, Staphylococcus
IATLLIKKKAKLAGVLLIIAAVLSLVINWIAALFWIIAGIMLLVRKNKDNHD

SEQ ID NO: 1898142 - protein, 18 aa, Staphylococcus
IATLLLPIILKKFTIVQM

SEQ ID NO: 1898143 - protein, 23 aa, Staphylococcus
IATTAFIFLPALIGWSSMRVFGG

SEQ ID NO: 1898144 - protein, 25 aa, Staphylococcus
IATYIIVFIISLLVFSLFFTTAYQN

SEQ ID NO: 1898145 - protein, 28 aa, Staphylococcus
IATYVGWRWIFILSIIFAFIAIILLRGT

SEQ ID NO: 1898146 - protein, 18 aa, Staphylococcus
IAVFATIGISHWTSGLNS

SEQ ID NO: 1898147 - protein, 26 aa, Staphylococcus
IAVFLVSCLIFLVFFLSVNQSAHSEQ

SEQ ID NO: 1898148 - protein, 33 aa, Staphylococcus
IAVGVLCLMIILFTLLPTLLLVLGNKVFWPSKK

SEQ ID NO: 1898149 - protein, 31 aa, Staphylococcus
IAVHFSWYYLLLVLLILIVSVYLLFSRYASI

SEQ ID NO: 1898150 - protein, 34 aa, Staphylococcus
IAVIIVIALLVLFSFVPVGLWISAIAAGVKVGIG

SEQ ID NO: 1898151 - protein, 34 aa, Staphylococcus
IAVIIVVALLILFSFVPIGLWISAIAAGVHVGIG

SEQ ID NO: 1898152 - protein, 18 aa, Staphylococcus
IAVILIAPALVFGLATVI

SEQ ID NO: 1898153 - protein, 21 aa, Staphylococcus
IAVISYFKLWKYLYKEWFTSV

SEQ ID NO: 1898154 - protein, 23 aa, Staphylococcus
IAVITYFKLWKYLYKEWFTTIDH

SEQ ID NO: 1898155 - protein, 17 aa, Staphylococcus
IAVIVAAIIIWAFAGMP

SEQ ID NO: 1898156 - protein, 31 aa, Staphylococcus
IAVNFSWYYLLLVLIIFFICVYLLFSRYASI

SEQ ID NO: 1898157 - protein, 31 aa, Staphylococcus
IAVNFSWYYLLLVLLILIVCVYLLFSRYASI

SEQ ID NO: 1898158 - protein, 25 aa, Staphylococcus
IAVSQYWWLFLISIICLIAAWVLTI

SEQ ID NO: 1898159 - protein, 27 aa, Staphylococcus
IAVVFAIIYNLWWFAYNVAQVAGVHIE

SEQ ID NO: 1898160 - protein, 28 aa, Staphylococcus
IAVVIGVLLICGIGGAAAYYFTKNTPKN

SEQ ID NO: 1898161 - protein, 35 aa, Staphylococcus
IAVVIIVALLILFSFVPVGLWISALAAGVHVGIGT

SEQ ID NO: 1898162 - protein, 37 aa, Staphylococcus
IAVYTITVILFSAFISFILTNIYYHFNLKASNDAKIM

SEQ ID NO: 1898163 - protein, 17 aa, Staphylococcus
IAWMVSIFGFDLSFIID

SEQ ID NO: 1898164 - protein, 26 aa, Staphylococcus
IAWRDLFLIPIIFVTLLICSKIGVNI

SEQ ID NO: 1898165 - protein, 20 aa, Staphylococcus
IAYAILLVGLILTAIAPSNS

SEQ ID NO: 1898166 - protein, 18 aa, Staphylococcus
IAYLMLKRLRIETLFFII

SEQ ID NO: 1898167 - protein, 17 aa, Staphylococcus
ICFFVFDISDMLKGFKI

SEQ ID NO: 1898168 - protein, 23 aa, Staphylococcus
ICIIAFFVFIFGVLFVNPETRIG

SEQ ID NO: 1898169 - protein, 30 aa, Staphylococcus
ICKQPMNALFFFFSAFAIPFMLKKGFKSKY

SEQ ID NO: 1898170 - protein, 31 aa, Staphylococcus
ICLITISLMLFLFKKKVAIASLSILIAFTSI

SEQ ID NO: 1898171 - protein, 27 aa, Staphylococcus
ICLSLPFALFGLFSSMFFIIIGSGLMK

SEQ ID NO: 1898172 - protein, 27 aa, Staphylococcus
ICLSLPFAMFGLFASMFFIIVGSGLMK

SEQ ID NO: 1898173 - protein, 20 aa, Staphylococcus
ICLWLLIGALFYLANFFFSH

SEQ ID NO: 1898174 - protein, 27 aa, Staphylococcus
ICVSMIATLLVIPWLSAKKARQIKKQV

SEQ ID NO: 1898175 - protein, 19 aa, Staphylococcus
ICYIAIFIYFLILTSRKWS

SEQ ID NO: 1898176 - protein, 26 aa, Staphylococcus
IDEIVWFFIAVIIGSIITMLTVLLFK

SEQ ID NO: 1898177 - protein, 22 aa, Staphylococcus
IDFHLFVNEVLLLIVGLGIAFL

SEQ ID NO: 1898178 - protein, 20 aa, Staphylococcus
IDFILFRLIPTFIINFILLL

SEQ ID NO: 1898179 - protein, 20 aa, Staphylococcus
IDFLAIMGFASAISVLFAVL

SEQ ID NO: 1898180 - protein, 21 aa, Staphylococcus
IDFLTVMGFSAAISVLFAVLA

SEQ ID NO: 1898181 - protein, 18 aa, Staphylococcus
IDFPYFLIGFIAMALINT

SEQ ID NO: 1898182 - protein, 25 aa, Staphylococcus
IDGSHLLFYYAPVAILIALLSVTAS

SEQ ID NO: 1898183 - protein, 30 aa, Staphylococcus
IDIANKELKLIMFLGFLLGGIIGLFQGVIA

SEQ ID NO: 1898184 - protein, 36 aa, Staphylococcus
IDIGAYALPILAIGAFLIFFIQKRKVKNIGMILFGF

SEQ ID NO: 1898185 - protein, 20 aa, Staphylococcus
IDIPYFLIGFIIMAFINTFV

SEQ ID NO: 1898186 - protein, 23 aa, Staphylococcus
IDLHLFINEILLLVVGLGIAFLM

SEQ ID NO: 1898187 - protein, 19 aa, Staphylococcus
IDLLVILLIYFARAHTKKE

SEQ ID NO: 1898188 - protein, 25 aa, Staphylococcus
IDLPKLIIPILLIIGLLINVIPNIY

SEQ ID NO: 1898189 - protein, 18 aa, Staphylococcus
IDLSGTQLSPLPTHIEWR

SEQ ID NO: 1898190 - protein, 27 aa, Staphylococcus
IDNHPDTLDHLKLQKLINKIDDAQNAL

SEQ ID NO: 1898191 - protein, 17 aa, Staphylococcus
IDNLTHLTPAQKSAEKA

SEQ ID NO: 1898192 - protein, 23 aa, Staphylococcus
IDPRYFLVVVVILCGIVALAIGS

SEQ ID NO: 1898193 - protein, 17 aa, Staphylococcus
IDQLLITILSGYEQRMK

SEQ ID NO: 1898194 - protein, 19 aa, Staphylococcus
IDRAYLPIAIKYLCLHYGI

SEQ ID NO: 1898195 - protein, 25 aa, Staphylococcus
IDRDQFEFQMLYGFRSELAEDISRQ

SEQ ID NO: 1898196 - protein, 30 aa, Staphylococcus
IDRLILVFYVFFIACILSLVLTFFTLLFNR

SEQ ID NO: 1898197 - protein, 18 aa, Staphylococcus
IDRYKFYYNEKHPDLIVK

SEQ ID NO: 1898198 - protein, 37 aa, Staphylococcus
IDSFFNYFVGMSRYLTYILILLATGFITYSKKIPKTR

SEQ ID NO: 1898199 - protein, 24 aa, Staphylococcus
IDSIPIAVILIYASLRGILSAVET

SEQ ID NO: 1898200 - protein, 31 aa, Staphylococcus
IDSLLGFLILTFITLIFLPLLQQLNFNLRNQ

SEQ ID NO: 1898201 - protein, 20 aa, Staphylococcus
IDTALFVTIAFYGSMPNAAV

SEQ ID NO: 1898202 - protein, 20 aa, Staphylococcus
IDWGAFLVIGIFLGSYIAAK

SEQ ID NO: 1898203 - protein, 24 aa, Staphylococcus
IDWKVFLTPILLTLILAFGLSSFE

SEQ ID NO: 1898204 - protein, 23 aa, Staphylococcus
IDYCNMLFEIIFLGGIFSPIAEE

SEQ ID NO: 1898205 - protein, 17 aa, Staphylococcus
IDYISSILKSRDLMYRN

SEQ ID NO: 1898206 - protein, 26 aa, Staphylococcus
IDYKKPLIMLVIQVLLVLFMMNTTIG

SEQ ID NO: 1898207 - protein, 19 aa, Staphylococcus
IDYKRLFGAIGKNLTGGFG

SEQ ID NO: 1898208 - protein, 24 aa, Staphylococcus
IDYLLLTMLLYIPGLFVYQTVQKN

SEQ ID NO: 1898209 - protein, 25 aa, Staphylococcus
IDYLLLTMLLYIPGLFVYRFVQRNN

SEQ ID NO: 1898210 - protein, 42 aa, Staphylococcus
IDYYKGLRQGLLLIIPALIGYFFGFFNFGLLISTGTLAHVYV

SEQ ID NO: 1898211 - protein, 17 aa, Staphylococcus
IEEIIFRGLLIKGIFRG

SEQ ID NO: 1898212 - protein, 33 aa, Staphylococcus
IEEQFYLFFPAILILLLLTIKKYRNVAVIFWII

SEQ ID NO: 1898213 - protein, 32 aa, Staphylococcus
IEFAFMFVAPVLFIIHALLTGLSLFIASLFQW

SEQ ID NO: 1898214 - protein, 29 aa, Staphylococcus
IEFIIKWKIYLIIGLVVLAMVVLSLFNHY

SEQ ID NO: 1898215 - protein, 30 aa, Staphylococcus
IEFLSKNRTILFIFRCLVVVLVFVGAVIKT

SEQ ID NO: 1898216 - protein, 26 aa, Staphylococcus
IEFLSTPFVILFFVLEQFARAIGKPI

SEQ ID NO: 1898217 - protein, 19 aa, Staphylococcus
IEFNMIWKAMLIPSMGYIV

SEQ ID NO: 1898218 - protein, 21 aa, Staphylococcus
IEGLPTLSWIGFYPSFETIIA

SEQ ID NO: 1898219 - protein, 18 aa, Staphylococcus
IEGWRWMLGLAVVPSLIL

SEQ ID NO: 1898220 - protein, 30 aa, Staphylococcus
IEIANKELKLIMLLGFLLGGIIGCLQGIIA

SEQ ID NO: 1898221 - protein, 19 aa, Staphylococcus
IEILSIMNIVFAVTTFTLL

SEQ ID NO: 1898222 - protein, 18 aa, Staphylococcus
IEINTAISNILINATDDS

SEQ ID NO: 1898223 - protein, 26 aa, Staphylococcus
IEISTRYYVFITSYINRIQPNGRSGI

SEQ ID NO: 1898224 - protein, 24 aa, Staphylococcus
IEIVRAILLIELVGALLLAFYFYR

SEQ ID NO: 1898225 - protein, 17 aa, Staphylococcus
IEKFDLLELEKEDYGFA

SEQ ID NO: 1898226 - protein, 18 aa, Staphylococcus
IEKLPFDQNIKKLSSLNL

SEQ ID NO: 1898227 - protein, 25 aa, Staphylococcus
IEKNTFEFQMLYGFRNELAEEIARQ

SEQ ID NO: 1898228 - protein, 19 aa, Staphylococcus
IEKTLAKPSTSKFRSANTR

SEQ ID NO: 1898229 - protein, 27 aa, Staphylococcus
IEKTLLSAKRWIRYIHEVEEPDFLIVI

SEQ ID NO: 1898230 - protein, 43 aa, Staphylococcus
IELQYTPFNLLHLLSLKIVSVLIALVATLLYFNHTIELPMLIM

SEQ ID NO: 1898231 - protein, 32 aa, Staphylococcus
IEMLFSFSIFCLLLSLIPPLFQTVNLLSKQVN

SEQ ID NO: 1898232 - protein, 28 aa, Staphylococcus
IENFYSVIPWFVITLPLVLCLSYQLDIL

SEQ ID NO: 1898233 - protein, 25 aa, Staphylococcus
IENINMFTFLQLLTPFVTYLVAEMF

SEQ ID NO: 1898234 - protein, 24 aa, Staphylococcus
IENINMFVFLQLLTPFVTYLVAEL

SEQ ID NO: 1898235 - protein, 38 aa, Staphylococcus
IENYKQYRYLIIILVLLVIILLIFIKPDESSTKIEEKS

SEQ ID NO: 1898236 - protein, 26 aa, Staphylococcus
IEPQKKWIVIISNFKEFINVAAPTNN

SEQ ID NO: 1898237 - protein, 27 aa, Staphylococcus
IEQFNTPWLWPVLFLTTGILEPIAEEL

SEQ ID NO: 1898238 - protein, 24 aa, Staphylococcus
IEQIARILFILIGSYLVLNVFNGS

SEQ ID NO: 1898239 - protein, 23 aa, Staphylococcus
IEQLTFFFITGIIGILIGIVGSE

SEQ ID NO: 1898240 - protein, 23 aa, Staphylococcus
IEQRVLDLLPERFNANYESADDI

SEQ ID NO: 1898241 - protein, 26 aa, Staphylococcus
IERKYLPIAFKYLLIHYGFGIIAGLL

SEQ ID NO: 1898242 - protein, 33 aa, Staphylococcus
IERRKFWITLGIFILITIILIIRILTIKEDNIY

SEQ ID NO: 1898243 - protein, 17 aa, Staphylococcus
IETIQYLNEYRIAVTVD

SEQ ID NO: 1898244 - protein, 28 aa, Staphylococcus
IEVAGSIWWVLLVNILIALSALAIGIFV

SEQ ID NO: 1898245 - protein, 21 aa, Staphylococcus
IEVLNIFIINKILITYHHNVI

SEQ ID NO: 1898246 - protein, 20 aa, Staphylococcus
IEWVILVKIFNKKIPFLDKV

SEQ ID NO: 1898247 - protein, 17 aa, Staphylococcus
IEWVTLLLLLFIIIVYI

SEQ ID NO: 1898248 - protein, 24 aa, Staphylococcus
IEYNKVKATFDKLNDFLGNNDNPE

SEQ ID NO: 1898249 - protein, 26 aa, Staphylococcus
IEYTKQNLPLIGQIFGNTFKGIFNLM

SEQ ID NO: 1898250 - protein, 17 aa, Staphylococcus
IEYWYPAMPNWLTALFT

SEQ ID NO: 1898251 - protein, 20 aa, Staphylococcus
IFACNFLVTIYYILYGRVYT

SEQ ID NO: 1898252 - protein, 17 aa, Staphylococcus
IFATIYWAFRQYAPQSE

SEQ ID NO: 1898253 - protein, 18 aa, Staphylococcus
IFAVWLLSIIEKRLHKIV

SEQ ID NO: 1898254 - protein, 25 aa, Staphylococcus
IFCEIAFWFVILLGLVTRYILNQQT

SEQ ID NO: 1898255 - protein, 18 aa, Staphylococcus
IFCNFFINIGIYVSIQFK

SEQ ID NO: 1898256 - protein, 30 aa, Staphylococcus
IFDLVRILLPLIVIIILFLTLYSVAPNVKT

SEQ ID NO: 1898257 - protein, 18 aa, Staphylococcus
IFDNLPMIFAMGVAIGLA

SEQ ID NO: 1898258 - protein, 26 aa, Staphylococcus
IFDYQFQSRFRKFILIILVGGAIGTS

SEQ ID NO: 1898259 - protein, 28 aa, Staphylococcus
IFEESPIFIFILLFINALFDGFTNPIKN

SEQ ID NO: 1898260 - protein, 19 aa, Staphylococcus
IFFADWFIDFFGNITPEQF

SEQ ID NO: 1898261 - protein, 18 aa, Staphylococcus
IFFAIIFLVYIALGIYML

SEQ ID NO: 1898262 - protein, 26 aa, Staphylococcus
IFFDNYLIVILFLTIQSILTFKLYRH

SEQ ID NO: 1898263 - protein, 25 aa, Staphylococcus
IFFDNYLIVLLFLTIQALLCIKLYK

SEQ ID NO: 1898264 - protein, 18 aa, Staphylococcus
IFFGGFYDMKTVRETEFP

SEQ ID NO: 1898265 - protein, 18 aa, Staphylococcus
IFFIFFGILSWLSTVILF

SEQ ID NO: 1898266 - protein, 21 aa, Staphylococcus
IFFIINFVLISYLYDKQFVIY

SEQ ID NO: 1898267 - protein, 31 aa, Staphylococcus
IFFIIVLVILIILMIIFGRKWSEYLQTDSRI

SEQ ID NO: 1898268 - protein, 19 aa, Staphylococcus
IFFIVLIINFSFIMCNTAI

SEQ ID NO: 1898269 - protein, 17 aa, Staphylococcus
IFFIWALVLFLKNIIRG

SEQ ID NO: 1898270 - protein, 23 aa, Staphylococcus
IFGCVYFYFIMNFVANTPITVSQ

SEQ ID NO: 1898271 - protein, 17 aa, Staphylococcus
IFGENFIVIWAGQDFRP

SEQ ID NO: 1898272 - protein, 25 aa, Staphylococcus
IFGGFILYTLLIFALSLLTNIYLVW

SEQ ID NO: 1898273 - protein, 25 aa, Staphylococcus
IFGGVLVWLMYLAHWKQTEDQGAKL

SEQ ID NO: 1898274 - protein, 18 aa, Staphylococcus
IFGIIIPSTILFGVIGRQ

SEQ ID NO: 1898275 - protein, 17 aa, Staphylococcus
IFGITLYLNTSILLMFW

SEQ ID NO: 1898276 - protein, 26 aa, Staphylococcus
IFGIVFIIFGIILFGLTYFKQLKKIN

SEQ ID NO: 1898277 - protein, 21 aa, Staphylococcus
IFGVIIACLMLLMTQGFTYGW

SEQ ID NO: 1898278 - protein, 17 aa, Staphylococcus
IFIAIQSSFWLLPIGLV

SEQ ID NO: 1898279 - protein, 28 aa, Staphylococcus
IFIDNYLIILLFITIQALLTFKLYKHYY

SEQ ID NO: 1898280 - protein, 21 aa, Staphylococcus
IFIFYEILFMWTTPTLLVASI

SEQ ID NO: 1898281 - protein, 17 aa, Staphylococcus
IFIFYKVEKAKQSPFID

SEQ ID NO: 1898282 - protein, 29 aa, Staphylococcus
IFIILLIAIGIMFFLRSNKRTLISNAEER

SEQ ID NO: 1898283 - protein, 17 aa, Staphylococcus
IFIMIVFGLTYIFGGVL

SEQ ID NO: 1898284 - protein, 36 aa, Staphylococcus
IFISPMHSFLITLSMILTLCIVPWLSAKKARTLKRQ

SEQ ID NO: 1898285 - protein, 20 aa, Staphylococcus
IFITTYLLKLISTIFNVPFG

SEQ ID NO: 1898286 - protein, 24 aa, Staphylococcus
IFIVTIIFIIWQPKGLDIGITALM

SEQ ID NO: 1898287 - protein, 24 aa, Staphylococcus
IFKGFIVVFFPLLFPVHPTGPISE

SEQ ID NO: 1898288 - protein, 31 aa, Staphylococcus
IFKPLFAWQFKRSVLWLYVIDLICVMFATQP

SEQ ID NO: 1898289 - protein, 20 aa, Staphylococcus
IFKVDWLIDRIPIAVVIGFM

SEQ ID NO: 1898290 - protein, 18 aa, Staphylococcus
IFLAFHSSFWIIPIGVFC

SEQ ID NO: 1898291 - protein, 22 aa, Staphylococcus
IFLAFMTAFYFVRGYDRLPDED

SEQ ID NO: 1898292 - protein, 19 aa, Staphylococcus
IFLGGLVRTYFGFGEALVS

SEQ ID NO: 1898293 - protein, 22 aa, Staphylococcus
IFLGVIMFFVWPTVQSWIFNAG

SEQ ID NO: 1898294 - protein, 31 aa, Staphylococcus
IFLHPSFMFLKIIAVIWGLVEAFFWPAVLNG

SEQ ID NO: 1898295 - protein, 21 aa, Staphylococcus
IFLITLVFVIWQPKGLDIGIT

SEQ ID NO: 1898296 - protein, 18 aa, Staphylococcus
IFLLFPESSPFKAIFYML

SEQ ID NO: 1898297 - protein, 17 aa, Staphylococcus
IFLLTLTIVIWQPKGLD

SEQ ID NO: 1898298 - protein, 34 aa, Staphylococcus
IFLRSRIYWILWLLFLHFIFLGIAYLDYDISVYS

SEQ ID NO: 1898299 - protein, 25 aa, Staphylococcus
IFLYSFIMMLGVELVFFIGKLFLAP

SEQ ID NO: 1898300 - protein, 17 aa, Staphylococcus
IFMSTGALMYVIPYFRL

SEQ ID NO: 1898301 - protein, 19 aa, Staphylococcus
IFNEIQLLCVGLGIAFIMN

SEQ ID NO: 1898302 - protein, 20 aa, Staphylococcus
IFNFIIFLVQIYYFGMIIYF

SEQ ID NO: 1898303 - protein, 17 aa, Staphylococcus
IFNIYKFRSMKIDTPNV

SEQ ID NO: 1898304 - protein, 25 aa, Staphylococcus
IFNLYHRAWEYASVNELLIIVESVT

SEQ ID NO: 1898305 - protein, 20 aa, Staphylococcus
IFNMFVFFEVFLMSSYCLLV

SEQ ID NO: 1898306 - protein, 18 aa, Staphylococcus
IFNWLFTLYKGRVTFESP

SEQ ID NO: 1898307 - protein, 18 aa, Staphylococcus
IFNWLIQRDFIPQNLMPS

SEQ ID NO: 1898308 - protein, 19 aa, Staphylococcus
IFPISFAWLVLNFNLDKIE

SEQ ID NO: 1898309 - protein, 18 aa, Staphylococcus
IFPYLCVAIFIVGHIARY

SEQ ID NO: 1898310 - protein, 21 aa, Staphylococcus
IFQFIIWIVQIYYFGMIVYFF

SEQ ID NO: 1898311 - protein, 26 aa, Staphylococcus
IFQSINPLFILLFAPVVSAVWQKLGK

SEQ ID NO: 1898312 - protein, 29 aa, Staphylococcus
IFQSINPLFILLFAPVVSLIWQKLGKRQP

SEQ ID NO: 1898313 - protein, 20 aa, Staphylococcus
IFQYKYFEMFWDSILYAALI

SEQ ID NO: 1898314 - protein, 21 aa, Staphylococcus
IFRFILFLVQIYYIGMIIYFF

SEQ ID NO: 1898315 - protein, 22 aa, Staphylococcus
IFRKFKILYCKFTTLIIKYPKG

SEQ ID NO: 1898316 - protein, 17 aa, Staphylococcus
IFSGIVYILYTWEFVSL

SEQ ID NO: 1898317 - protein, 24 aa, Staphylococcus
IFSHIRAMMWTTIPASLIGMIVWF

SEQ ID NO: 1898318 - protein, 22 aa, Staphylococcus
IFSIFTIIAFIVVTCLTIYKNE

SEQ ID NO: 1898319 - protein, 27 aa, Staphylococcus
IFSMILTLIIYYYSAGLLRLLKYIDKE

SEQ ID NO: 1898320 - protein, 23 aa, Staphylococcus
IFSNWHMVFIILTVFGIFMVMSS

SEQ ID NO: 1898321 - protein, 29 aa, Staphylococcus
IFSPLVWSLIFITIIFLLNIFTVKAFGET

SEQ ID NO: 1898322 - protein, 20 aa, Staphylococcus
IFTFIGGLGIFLYGIKQMGD

SEQ ID NO: 1898323 - protein, 32 aa, Staphylococcus
IFTLLCIGVLLWVLGIHPYFAFFPIVAILVIY

SEQ ID NO: 1898324 - protein, 22 aa, Staphylococcus
IFTQFGFPIVDIILATVLGLLI

SEQ ID NO: 1898325 - protein, 20 aa, Staphylococcus
IFTSVIWLLGSFAFGFYISN

SEQ ID NO: 1898326 - protein, 19 aa, Staphylococcus
IFTVLIIFLFEVFISSPKV

SEQ ID NO: 1898327 - protein, 28 aa, Staphylococcus
IFVHQFDYMFYITCLMLALLLIFNGLQF

SEQ ID NO: 1898328 - protein, 24 aa, Staphylococcus
IFVITLIFVIWQPKGLDIGITAIV

SEQ ID NO: 1898329 - protein, 37 aa, Staphylococcus
IFVLLIVLIYIFFCYKKLKILFLFVIVFIVLCVFNVR

SEQ ID NO: 1898330 - protein, 21 aa, Staphylococcus
IFVNFLLILIIFMGCFSTLVT

SEQ ID NO: 1898331 - protein, 20 aa, Staphylococcus
IFVNFLLILIIFMGCYSTLV

SEQ ID NO: 1898332 - protein, 18 aa, Staphylococcus
IFVNLLLLIIIFMGCYST

SEQ ID NO: 1898333 - protein, 25 aa, Staphylococcus
IFVPLYSFIIFPLSIVLFIFYHFFS

SEQ ID NO: 1898334 - protein, 24 aa, Staphylococcus
IFVSFLVILFAQFDLFRSAVGIGV

SEQ ID NO: 1898335 - protein, 18 aa, Staphylococcus
IFVTSFLGLAFLIAAGCI

SEQ ID NO: 1898336 - protein, 19 aa, Staphylococcus
IFWINIFMTLLFLGFNIIV

SEQ ID NO: 1898337 - protein, 18 aa, Staphylococcus
IFYAFFSIYYFVTGKSDA

SEQ ID NO: 1898338 - protein, 17 aa, Staphylococcus
IFYILIGLQFLYTAYRA

SEQ ID NO: 1898339 - protein, 25 aa, Staphylococcus
IFYLFIIYILLLIILQFTTSTDKAL

SEQ ID NO: 1898340 - protein, 19 aa, Staphylococcus
IFYLIFGIVFFIITILLMT

SEQ ID NO: 1898341 - protein, 18 aa, Staphylococcus
IFYSLINWMPAYLSQSGM

SEQ ID NO: 1898342 - protein, 24 aa, Staphylococcus
IGALFNALLYILILIKPKQLNNVA

SEQ ID NO: 1898343 - protein, 26 aa, Staphylococcus
IGALILTCIIFLGFLYQLYSNKINVV

SEQ ID NO: 1898344 - protein, 23 aa, Staphylococcus
IGALLLAFYFYRDNPDLKYAIMQ

SEQ ID NO: 1898345 - protein, 21 aa, Staphylococcus
IGALLVLGIGKVLNHTVLNHD

SEQ ID NO: 1898346 - protein, 27 aa, Staphylococcus
IGASIFLIILPLYQMAIEWMQSLLNLK

SEQ ID NO: 1898347 - protein, 30 aa, Staphylococcus
IGAVILLFVFLLLIFHLIRLAIRVEAPFSK

SEQ ID NO: 1898348 - protein, 37 aa, Staphylococcus
IGAYYWSIWSYMIAIIIIIFMAIYAYVYISASGLCNR

SEQ ID NO: 1898349 - protein, 34 aa, Staphylococcus
IGCILIIILSVFLVWYLNIFVLKTFSITGKNNDF

SEQ ID NO: 1898350 - protein, 24 aa, Staphylococcus
IGCIMLVYLLINAAFLMTLPISHI

SEQ ID NO: 1898351 - protein, 27 aa, Staphylococcus
IGDSSNLILGQSILVVGNPLGVDFKGS

SEQ ID NO: 1898352 - protein, 38 aa, Staphylococcus
IGETFSEFRLFLAVLLTLLLLISISLVIASTYAIVRPV

SEQ ID NO: 1898353 - protein, 23 aa, Staphylococcus
IGFFPLFGIFLKSDNHILKIKRI

SEQ ID NO: 1898354 - protein, 24 aa, Staphylococcus
IGFIVIMAVWLYKIATKSGQFAIV

SEQ ID NO: 1898355 - protein, 18 aa, Staphylococcus
IGFLFGGIFIRVLDSVIP

SEQ ID NO: 1898356 - protein, 36 aa, Staphylococcus
IGGAFIMLLKMAFMVDYFLFHIIQYTYYRYQDEVMA

SEQ ID NO: 1898357 - protein, 18 aa, Staphylococcus
IGGALALAGLLMQSITRN

SEQ ID NO: 1898358 - protein, 17 aa, Staphylococcus
IGGFILFFLMKGTHIMT

SEQ ID NO: 1898359 - protein, 24 aa, Staphylococcus
IGGGYLIWLWLRASQSPLFGLLGG

SEQ ID NO: 1898360 - protein, 24 aa, Staphylococcus
IGGIILVVLFIWRQSRLDTPLLNF

SEQ ID NO: 1898361 - protein, 40 aa, Staphylococcus
IGGILRATLGNMLIIIKTIGQLMLNSFRTIWTIIKNVVVG

SEQ ID NO: 1898362 - protein, 18 aa, Staphylococcus
IGGLFILVGIFIGSRKAG

SEQ ID NO: 1898363 - protein, 19 aa, Staphylococcus
IGGLFTLAGTFIALIFQFR

SEQ ID NO: 1898364 - protein, 23 aa, Staphylococcus
IGGLIFLLLVMYMNILGYKELKH

SEQ ID NO: 1898365 - protein, 23 aa, Staphylococcus
IGGMFFLLAFSMIVPWRLAMLYK

SEQ ID NO: 1898366 - protein, 24 aa, Staphylococcus
IGGMFFLLAFSMIVPWRLAMLYKY

SEQ ID NO: 1898367 - protein, 24 aa, Staphylococcus
IGGPGAVFWMWATAFLGASSAFIE

SEQ ID NO: 1898368 - protein, 24 aa, Staphylococcus
IGGPGAVFWMWISAFLGASSAFIE

SEQ ID NO: 1898369 - protein, 23 aa, Staphylococcus
IGGPILMYFSYILALIALKELLN

SEQ ID NO: 1898370 - protein, 23 aa, Staphylococcus
IGGPILVMLTIKLNRKYLLILLM

SEQ ID NO: 1898371 - protein, 25 aa, Staphylococcus
IGGSLWIIIYLVVLAFLSFIGSKEF

SEQ ID NO: 1898372 - protein, 26 aa, Staphylococcus
IGGSLWIILYLIVLAFLSFIGSKEFK

SEQ ID NO: 1898373 - protein, 25 aa, Staphylococcus
IGGSLWIIVYLILLAAMSFIGSKEF

SEQ ID NO: 1898374 - protein, 26 aa, Staphylococcus
IGGSLWIIVYLIVLAILSFIGSKEFK

SEQ ID NO: 1898375 - protein, 22 aa, Staphylococcus
IGGYLMPPIMFLIGLVAAHFEQ

SEQ ID NO: 1898376 - protein, 28 aa, Staphylococcus
IGIALIAIMLIVCIVLVVMMMTGGQKET

SEQ ID NO: 1898377 - protein, 45 aa, Staphylococcus
IGIALVILAIFAVLFRFIVHLIPIRYIFRVLSILIFVMAFKMLGV

SEQ ID NO: 1898378 - protein, 19 aa, Staphylococcus
IGIASLKIDMDHVEGIAFA

SEQ ID NO: 1898379 - protein, 21 aa, Staphylococcus
IGIFLYSYHFAIGKWHWWMST

SEQ ID NO: 1898380 - protein, 23 aa, Staphylococcus
IGIIIGVLTFWLFAQSLVNVVPT

SEQ ID NO: 1898381 - protein, 17 aa, Staphylococcus
IGIIKFGIPMLIPLLIK

SEQ ID NO: 1898382 - protein, 29 aa, Staphylococcus
IGIIKFGIPMLIPLLIKYAIDGVINNGTL

SEQ ID NO: 1898383 - protein, 29 aa, Staphylococcus
IGIIKFGIPMLIPLLIKYAIDGVINNHSL

SEQ ID NO: 1898384 - protein, 29 aa, Staphylococcus
IGIIKFGIPMLIPLLIKYAIDGVINNSAL

SEQ ID NO: 1898385 - protein, 26 aa, Staphylococcus
IGIIVAFVILLITFGSLIAAGMPIIS

SEQ ID NO: 1898386 - protein, 31 aa, Staphylococcus
IGILIAILYIPIFFLMIYSFNSAGNMIHFEH

SEQ ID NO: 1898387 - protein, 29 aa, Staphylococcus
IGILIAVLYIPILFLMVYSFNSAGNMVNF

SEQ ID NO: 1898388 - protein, 22 aa, Staphylococcus
IGILILLLLFIKVDDNSDWIYN

SEQ ID NO: 1898389 - protein, 31 aa, Staphylococcus; identical to SEQ ID NO: 1588722

SEQ ID NO: 1898390 - protein, 27 aa, Staphylococcus
IGILVLISYLLFLLSGLANGLIKMNTE

SEQ ID NO: 1898391 - protein, 27 aa, Staphylococcus
IGILVLISYLLFLLSGLASGLINMNTE

SEQ ID NO: 1898392 - protein, 25 aa, Staphylococcus
IGIPKWIQFLFIVIVAMVISASMRV

SEQ ID NO: 1898393 - protein, 34 aa, Staphylococcus
IGIPTVIVLLFLTWLYLRFIAFKQELKYLPGGDA

SEQ ID NO: 1898394 - protein, 26 aa, Staphylococcus
IGIVLLLTLIIFLKLNTFISLIITSI

SEQ ID NO: 1898395 - protein, 19 aa, Staphylococcus
IGIVSLKINMPSIEGMGFA

SEQ ID NO: 1898396 - protein, 17 aa, Staphylococcus
IGIWSGIVVIIIASIIL

SEQ ID NO: 1898397 - protein, 20 aa, Staphylococcus
IGIYILIWFISYLKTKKEIK

SEQ ID NO: 1898398 - protein, 33 aa, Staphylococcus
IGIYLAIILIVTTLYLSFILIGSLQGKDMTNSV

SEQ ID NO: 1898399 - protein, 24 aa, Staphylococcus
IGKALMLPVAILPAAGLLLALGNA

SEQ ID NO: 1898400 - protein, 25 aa, Staphylococcus
IGKALMLPVAILPAAGLLLALGTAM

SEQ ID NO: 1898401 - protein, 23 aa, Staphylococcus
IGKFILVGLLWAIAAITVTTFLS

SEQ ID NO: 1898402 - protein, 17 aa, Staphylococcus
IGKFIPGDYLLETKKET

SEQ ID NO: 1898403 - protein, 55 aa, Staphylococcus
IGKGDVSYRISFKTNGLPTERLYYAAGGRALEFRQLFNYNQLYVEPMKEYQNRIQ

SEQ ID NO: 1898404 - protein, 33 aa, Staphylococcus
IGKNQLFKAPLWSTWLLWGIVTIIIISILFFRK

SEQ ID NO: 1898405 - protein, 40 aa, Staphylococcus
IGKTFSEFRIFLAILITLLLLFSIILVISSTYAIIKPIQQ

SEQ ID NO: 1898406 - protein, 26 aa, Staphylococcus
IGKVLDMITYFVAAVAGISLFIAGIG

SEQ ID NO: 1898407 - protein, 19 aa, Staphylococcus
IGLCALFILLISISRVYLG

SEQ ID NO: 1898408 - protein, 17 aa, Staphylococcus
IGLFVWNIMQWSTNPAI

SEQ ID NO: 1898409 - protein, 26 aa, Staphylococcus
IGLGGLIILNLLEKVDRLPIEGMILF

SEQ ID NO: 1898410 - protein, 31 aa, Staphylococcus
IGLIFVGIYFVLFRYLILKFDIPLPGRRDEE

SEQ ID NO: 1898411 - protein, 31 aa, Staphylococcus
IGLIFVGIYYVLFRFLILKFDIPLPGRRKNE

SEQ ID NO: 1898412 - protein, 17 aa, Staphylococcus
IGLILLLIVMILCFVLK

SEQ ID NO: 1898413 - protein, 32 aa, Staphylococcus
IGLIVAIIIAIICFILFLVALKSKNNMKHKAS

SEQ ID NO: 1898414 - protein, 32 aa, Staphylococcus
IGLIVAIIVAILFFILFLVANHSKKKIKNQTE

SEQ ID NO: 1898415 - protein, 32 aa, Staphylococcus
IGLIVAIVVAIICLILFLVTLKSKNNIKQKTK

SEQ ID NO: 1898416 - protein, 32 aa, Staphylococcus
IGLIVAIVVAVICLILFIVALKSKKKAQEKVE

SEQ ID NO: 1898417 - protein, 32 aa, Staphylococcus
IGLIVAVVIAIIFFVLFLIALNSKKKIKQQTE

SEQ ID NO: 1898418 - protein, 25 aa, Staphylococcus
IGLIVNIVLTWLLYNSLKSEDNINI

SEQ ID NO: 1898419 - protein, 23 aa, Staphylococcus
IGLLLIYGLFFSSAPKQLCIPIL

SEQ ID NO: 1898420 - protein, 23 aa, Staphylococcus
IGLMLSFYHFAYSSIIFISSIHI

SEQ ID NO: 1898421 - protein, 25 aa, Staphylococcus
IGLPIFTAPFIFATWLVMFAGKEQH

SEQ ID NO: 1898422 - protein, 19 aa, Staphylococcus
IGLSALFILLISTSRVYLG

SEQ ID NO: 1898423 - protein, 33 aa, Staphylococcus
IGLSAWYYDDVVAWVWFAPIVSLIGFLILLINE

SEQ ID NO: 1898424 - protein, 24 aa, Staphylococcus
IGLTIYFIYLFSLIFMAKKPFRLT

SEQ ID NO: 1898425 - protein, 26 aa, Staphylococcus
IGLVAIIVGMFWFKLYQRTTNPKADI

SEQ ID NO: 1898426 - protein, 17 aa, Staphylococcus
IGLVLMFIALSTGIIKL

SEQ ID NO: 1898427 - protein, 25 aa, Staphylococcus
IGMALGLVWYILFNRKTLGQVGMQP

SEQ ID NO: 1898428 - protein, 28 aa, Staphylococcus
IGMHQPLSIWFYLKSIIILVVYEFGMAL

SEQ ID NO: 1898429 - protein, 27 aa, Staphylococcus
IGMIGIPIFFIIICSLLYHKAFNLKGD

SEQ ID NO: 1898430 - protein, 23 aa, Staphylococcus
IGMILFYILLHFKIIRVEWVSKG

SEQ ID NO: 1898431 - protein, 23 aa, Staphylococcus
IGMIVYVVLIIAFTYFYAFVQVN

SEQ ID NO: 1898432 - protein, 25 aa, Staphylococcus
IGMNSFSIFLPWTTPGPLGIVMGTG

SEQ ID NO: 1898433 - protein, 18 aa, Staphylococcus
IGNAWWIILAVAGILGLL

SEQ ID NO: 1898434 - protein, 24 aa, Staphylococcus
IGNILYLSLAILGGLWFPVSQFPE

SEQ ID NO: 1898435 - protein, 28 aa, Staphylococcus
IGNKSAFMFIIPILAGYIARSIADKPGF

SEQ ID NO: 1898436 - protein, 24 aa, Staphylococcus
IGQTLLIMIIIVSMFIFAGIGVQK

SEQ ID NO: 1898437 - protein, 24 aa, Staphylococcus
IGRDLRKYFSLSNGQDIPTNTTFT

SEQ ID NO: 1898438 - protein, 39 aa, Staphylococcus
IGRVIDSFFNYLFGYSRYLTYILVILASGFLAYNGKLPK

SEQ ID NO: 1898439 - protein, 17 aa, Staphylococcus
IGSAIFSLLGQTPVILG

SEQ ID NO: 1898440 - protein, 17 aa, Staphylococcus
IGSMLFGLFFGAGNLIF

SEQ ID NO: 1898441 - protein, 25 aa, Staphylococcus
IGSQYLLVVILLIGILAFLGTAVFS

SEQ ID NO: 1898442 - protein, 25 aa, Staphylococcus
IGSTALWIGIFLMAFAVLFSIITLP

SEQ ID NO: 1898443 - protein, 22 aa, Staphylococcus
IGSVFLPFLLSGFLFYICLPFQ

SEQ ID NO: 1898444 - protein, 22 aa, Staphylococcus
IGSVIFIVILAAGAIFLKGKAD

SEQ ID NO: 1898445 - protein, 28 aa, Staphylococcus
IGSVILILIFLAFIFHLVRLATKIELPF

SEQ ID NO: 1898446 - protein, 26 aa, Staphylococcus
IGSVYLFLGLAIFCFVLYIAFGKYGN

SEQ ID NO: 1898447 - protein, 18 aa, Staphylococcus
IGSWIFLLGIGLLYKTVG

SEQ ID NO: 1898448 - protein, 19 aa, Staphylococcus
IGSWLFLLGIGLLYKLVGT

SEQ ID NO: 1898449 - protein, 28 aa, Staphylococcus
IGSYFIAFALFFFAFTTILAYYYIAETN

SEQ ID NO: 1898450 - protein, 28 aa, Staphylococcus
IGSYFIAIALFFFAFTTILAYYYIAETN

SEQ ID NO: 1898451 - protein, 17 aa, Staphylococcus
IGSYIFMFLIGTVAIAA

SEQ ID NO: 1898452 - protein, 26 aa, Staphylococcus
IGTASILVGTTLIFGLSNEAHAQSNS

SEQ ID NO: 1898453 - protein, 29 aa, Staphylococcus
IGTFCIIMIFALLGFLPYNLNPAKVFMGD

SEQ ID NO: 1898454 - protein, 22 aa, Staphylococcus
IGTFIIYIFFVVIGTPASFMTI

SEQ ID NO: 1898455 - protein, 23 aa, Staphylococcus
IGTFLIYIFFVVIGTPASFATII

SEQ ID NO: 1898456 - protein, 25 aa, Staphylococcus
IGTFPILIQIPILLGLYTSIKYPTS

SEQ ID NO: 1898457 - protein, 19 aa, Staphylococcus
IGTLLYILITKAKIPAYLG

SEQ ID NO: 1898458 - protein, 21 aa, Staphylococcus
IGTLLYILITQAKIPAYLGSS

SEQ ID NO: 1898459 - protein, 18 aa, Staphylococcus
IGTYIFMFLIGTVAIAAI

SEQ ID NO: 1898460 - protein, 23 aa, Staphylococcus
IGVAILALILMFIKVKPHADAGH

SEQ ID NO: 1898461 - protein, 29 aa, Staphylococcus
IGVGFFIHWIWADLPMPAAFAIAAILCPT

SEQ ID NO: 1898462 - protein, 29 aa, Staphylococcus
IGVGYFIHWIWTDLPMPAAFAIAAILCPT

SEQ ID NO: 1898463 - protein, 26 aa, Staphylococcus
IGVIVMLLIVILYRPLMISTFDATFS

SEQ ID NO: 1898464 - protein, 24 aa, Staphylococcus
IGVIWVLAILYFISTILTYFIKMP

SEQ ID NO: 1898465 - protein, 19 aa, Staphylococcus
IGVLFKRMSFLQKLMGGTT

SEQ ID NO: 1898466 - protein, 24 aa, Staphylococcus
IGVLIFIIMLIILNYYLSRVMLNT

SEQ ID NO: 1898467 - protein, 18 aa, Staphylococcus
IGVLLGLMFLMVGYLIYR

SEQ ID NO: 1898468 - protein, 31 aa, Staphylococcus
IGVLLLICFLIYLFYSPRLKFDVLENPNKDS

SEQ ID NO: 1898469 - protein, 31 aa, Staphylococcus
IGVLLLITFLIYLFYSPRLKFDVLENPNKKA

SEQ ID NO: 1898470 - protein, 17 aa, Staphylococcus
IGVSFIWLPIFSVLFSI

SEQ ID NO: 1898471 - protein, 17 aa, Staphylococcus
IGWAVLLRVLALAFSYL

SEQ ID NO: 1898472 - protein, 31 aa, Staphylococcus
IGWIGVGLTLLYTLLFLIGLTLGKGTLSKIL

SEQ ID NO: 1898473 - protein, 17 aa, Staphylococcus
IGWRFTFVFIIVISLIA

SEQ ID NO: 1898474 - protein, 25 aa, Staphylococcus
IGYGKILIFLYLSSGLLLIFINYVP

SEQ ID NO: 1898475 - protein, 26 aa, Staphylococcus
IGYIVAWFYWLTWTVALGSEFTAVGI

SEQ ID NO: 1898476 - protein, 19 aa, Staphylococcus
IGYIVIMAVWLYKLSTKTG

SEQ ID NO: 1898477 - protein, 17 aa, Staphylococcus
IGYLMKYAERKVPDGVD

SEQ ID NO: 1898478 - protein, 24 aa, Staphylococcus
IHEAYFFNFFSRLLTAIIGLVTAG

SEQ ID NO: 1898479 - protein, 24 aa, Staphylococcus
IHEAYYFNFFSRLLTALIGLVTAG

SEQ ID NO: 1898480 - protein, 23 aa, Staphylococcus
IHESFGLPYWLSSLILVLVILMT

SEQ ID NO: 1898481 - protein, 19 aa, Staphylococcus
IHFGIFGIPITVIWIVAIT

SEQ ID NO: 1898482 - protein, 24 aa, Staphylococcus
IHHQLATRYWRLVSLIPITLSCLV

SEQ ID NO: 1898483 - protein, 27 aa, Staphylococcus
IHIVSWRWMFFINVLVVIIAILLQIKY

SEQ ID NO: 1898484 - protein, 17 aa, Staphylococcus
IHKVYFCINLILPFILI

SEQ ID NO: 1898485 - protein, 19 aa, Staphylococcus
IHLFLHVICICIAYWALHS

SEQ ID NO: 1898486 - protein, 18 aa, Staphylococcus
IHLGWFVLPVPILLFIYF

SEQ ID NO: 1898487 - protein, 19 aa, Staphylococcus
IHLIFFIPYYKSFKKYKLL

SEQ ID NO: 1898488 - protein, 23 aa, Staphylococcus
IHLNWIHMFFITGFLGGLTTFST

SEQ ID NO: 1898489 - protein, 24 aa, Staphylococcus
IHLRQASLQFSFLTNFLAAAIACG

SEQ ID NO: 1898490 - protein, 42 aa, Staphylococcus
IHLRRASLQYSFFMNFLAAFIACGFFLFMFGGTASDFWIACL

SEQ ID NO: 1898491 - protein, 31 aa, Staphylococcus
IHLSFSFKAFIATILMLFLAYVLIVIQNAVF

SEQ ID NO: 1898492 - protein, 23 aa, Staphylococcus
IHLSLPEQLVLIFTLMITSKGMA

SEQ ID NO: 1898493 - protein, 26 aa, Staphylococcus
IHPYAIFIPILFLLIGYYMIRFKMQS

SEQ ID NO: 1898494 - protein, 34 aa, Staphylococcus
IHRSALPFVKVLPLLVIYGIGIVYFYRHYIYYLC

SEQ ID NO: 1898495 - protein, 33 aa, Staphylococcus
IHTSKQYLIYMLGFMPGFPYLGGLDSRIHMPRR

SEQ ID NO: 1898496 - protein, 19 aa, Staphylococcus
IHVKSVEYKKEGNVGIFTI

SEQ ID NO: 1898497 - protein, 23 aa, Staphylococcus
IIAAILIWTLNLTIADPIASIIV

SEQ ID NO: 1898498 - protein, 22 aa, Staphylococcus
IIAFILLVSFFFIISDQDKWIY

SEQ ID NO: 1898499 - protein, 26 aa, Staphylococcus
IIAFLILLLMFTAVCLLFSPLILISY

SEQ ID NO: 1898500 - protein, 22 aa, Staphylococcus
IIAGVIILTFFILKQLRMKEPF

SEQ ID NO: 1898501 - protein, 19 aa, Staphylococcus
IIAIAIALVLVLVITNFIA

SEQ ID NO: 1898502 - protein, 25 aa, Staphylococcus
IIAIALVLHIYFYKKAYPKFVVGWF

SEQ ID NO: 1898503 - protein, 17 aa, Staphylococcus
IIAIAVALIIVGLVTKF

SEQ ID NO: 1898504 - protein, 18 aa, Staphylococcus
IIAILISLTFINIEPMAH

SEQ ID NO: 1898505 - protein, 21 aa, Staphylococcus
IIALGFFFVFNFISLIIGGSI

SEQ ID NO: 1898506 - protein, 23 aa, Staphylococcus
IIALIFAFIIFPIGINLILNIGK

SEQ ID NO: 1898507 - protein, 17 aa, Staphylococcus
IIALIIFGPTKLPQFGR

SEQ ID NO: 1898508 - protein, 18 aa, Staphylococcus
IIALIIFGPTKLPQFGRA

SEQ ID NO: 1898509 - protein, 19 aa, Staphylococcus
IIALILIASFFITSADSAT

SEQ ID NO: 1898510 - protein, 24 aa, Staphylococcus
IIALLIFLPFLLKGGMILMLFAYL

SEQ ID NO: 1898511 - protein, 24 aa, Staphylococcus
IIALLIFLPILIIGGPILMYFSYI

SEQ ID NO: 1898512 - protein, 24 aa, Staphylococcus
IIALLIFLPILLKGGLVLMLFAYL

SEQ ID NO: 1898513 - protein, 25 aa, Staphylococcus
IIALLVLIALYIFNVVFYYAKISKY

SEQ ID NO: 1898514 - protein, 18 aa, Staphylococcus
IIALVVYALLPILRNTYT

SEQ ID NO: 1898515 - protein, 19 aa, Staphylococcus
IIANKNGGVWALNKEVPHI

SEQ ID NO: 1898516 - protein, 25 aa, Staphylococcus
IIASILIYVFNFTIADPIASILVSI

SEQ ID NO: 1898517 - protein, 19 aa, Staphylococcus
IIATLYPVVIAYVLTFIVY

SEQ ID NO: 1898518 - protein, 23 aa, Staphylococcus
IIATVLLLVFMLVAIRGASVSGS

SEQ ID NO: 1898519 - protein, 17 aa, Staphylococcus
IIAVALVYVYFKSGKNT

SEQ ID NO: 1898520 - protein, 20 aa, Staphylococcus
IIAVFGHWLAPSGDLATIII

SEQ ID NO: 1898521 - protein, 25 aa, Staphylococcus
IIAVFLLILINLIITFPILRKFKIA

SEQ ID NO: 1898522 - protein, 18 aa, Staphylococcus
IICAIIVLVIITIIRNKK

SEQ ID NO: 1898523 - protein, 26 aa, Staphylococcus
IICGLILVLIIIFYRPLKISTFDPTF

SEQ ID NO: 1898524 - protein, 22 aa, Staphylococcus
IICLILQFVLYSLVTKLVGALC

SEQ ID NO: 1898525 - protein, 36 aa, Staphylococcus
IIDLQREMWKYLSIIGVIVLFTVYLASRSINRTYIR

SEQ ID NO: 1898526 - protein, 21 aa, Staphylococcus
IIDTALFVTIAFIGTLPASVV

SEQ ID NO: 1898527 - protein, 26 aa, Staphylococcus
IIEHVPWLVIILVSLVTIIVISQSAT

SEQ ID NO: 1898528 - protein, 18 aa, Staphylococcus
IIEIAKYLKARGIYTIAI

SEQ ID NO: 1898529 - protein, 17 aa, Staphylococcus
IIFAFILAFVGLIKPVI

SEQ ID NO: 1898530 - protein, 18 aa, Staphylococcus
IIFAIIFIIFYMKYFFFA

SEQ ID NO: 1898531 - protein, 19 aa, Staphylococcus
IIFAIVFFLLNFFSEQQHM

SEQ ID NO: 1898532 - protein, 20 aa, Staphylococcus
IIFCGLLQLFFPKIPSDRKK

SEQ ID NO: 1898533 - protein, 44 aa, Staphylococcus
IIFDVILRLMAKLSYKKLMLATGAILLVIIIAIVAPLLSHKGDT

SEQ ID NO: 1898534 - protein, 17 aa, Staphylococcus
IIFFLAGPIIIGIGNLI

SEQ ID NO: 1898535 - protein, 19 aa, Staphylococcus
IIFGVLFFVLNYFSGSDSS

SEQ ID NO: 1898536 - protein, 27 aa, Staphylococcus
IIFIIFYMKYFFFAIVFFIVGWLTIRS

SEQ ID NO: 1898537 - protein, 17 aa, Staphylococcus
IIFIIIGLLTILGIMGG

SEQ ID NO: 1898538 - protein, 28 aa, Staphylococcus
IIFIILIIVGVLFYMRSNKSQMIEKAEE

SEQ ID NO: 1898539 - protein, 18 aa, Staphylococcus
IIFIYRYSLTELFEDTEV

SEQ ID NO: 1898540 - protein, 21 aa, Staphylococcus
IIFKMSFKTLLLMALTSGAVG

SEQ ID NO: 1898541 - protein, 17 aa, Staphylococcus
IIFLLDTLGAMLIVTSI

SEQ ID NO: 1898542 - protein, 18 aa, Staphylococcus
IIFLYIGMIGFRRGAWLS

SEQ ID NO: 1898543 - protein, 45 aa, Staphylococcus
IIFMERRSANSIWAWLLVLVFLPLLGFILYLLFGRQIQRDHIFTL

SEQ ID NO: 1898544 - protein, 17 aa, Staphylococcus
IIFSAIFMIFILIIGKN

SEQ ID NO: 1898545 - protein, 21 aa, Staphylococcus
IIFSLIILLAAIVGATFGITR

SEQ ID NO: 1898546 - protein, 35 aa, Staphylococcus
IIFSLLGQNAIVLGLIVLLFIPLTVMIGVQEGIVT

SEQ ID NO: 1898547 - protein, 17 aa, Staphylococcus
IIFSNINLLFSALLLFF

SEQ ID NO: 1898548 - protein, 17 aa, Staphylococcus
IIFSVMLGVILFLAVIV

SEQ ID NO: 1898549 - protein, 20 aa, Staphylococcus
IIFTILFYLWNQFNWWHFII

SEQ ID NO: 1898550 - protein, 29 aa, Staphylococcus
IIFTTFIIYFVLLYFIQMNGILMVGGIFL

SEQ ID NO: 1898551 - protein, 18 aa, Staphylococcus
IIFYCALLGFLAARIYFV

SEQ ID NO: 1898552 - protein, 24 aa, Staphylococcus
IIGALFVIGYLYWYSKKIKKDPTA

SEQ ID NO: 1898553 - protein, 20 aa, Staphylococcus
IIGALIVLGIGKALNHTSLN

SEQ ID NO: 1898554 - protein, 19 aa, Staphylococcus
IIGFFLFIMMRALGELLLS

SEQ ID NO: 1898555 - protein, 24 aa, Staphylococcus
IIGFLCVFIFFLYINKKVTLDIYK

SEQ ID NO: 1898556 - protein, 24 aa, Staphylococcus
IIGGIFLFFLMKFAHIMTPEMIQS

SEQ ID NO: 1898557 - protein, 20 aa, Staphylococcus
IIGGLLMFFAIGGYLCHYFE

SEQ ID NO: 1898558 - protein, 18 aa, Staphylococcus
IIGILIKLSGIGWLMHLL

SEQ ID NO: 1898559 - protein, 24 aa, Staphylococcus
IIGILLIITFAYWIKLLQSQPNQL

SEQ ID NO: 1898560 - protein, 21 aa, Staphylococcus
IIGILYLCKMIFYPDSEDLND

SEQ ID NO: 1898561 - protein, 17 aa, Staphylococcus
IIGIPTVFILIALTWAY

SEQ ID NO: 1898562 - protein, 28 aa, Staphylococcus
IIGLFGLLILLVIVGIIFFSMISDQILF

SEQ ID NO: 1898563 - protein, 24 aa, Staphylococcus
IIGLFIIFLFIWMIFKTIQLQCFN

SEQ ID NO: 1898564 - protein, 27 aa, Staphylococcus
IIGLFVLSLIIIFYRPLMISTFDNTFS

SEQ ID NO: 1898565 - protein, 27 aa, Staphylococcus
IIGLIGLLIILVAAGFIFFSMISDQIF

SEQ ID NO: 1898566 - protein, 20 aa, Staphylococcus
IIGLVHNLILKYLSWYIKTV

SEQ ID NO: 1898567 - protein, 20 aa, Staphylococcus
IIGLYFTNNLERELTQTFKN

SEQ ID NO: 1898568 - protein, 29 aa, Staphylococcus
IIGRLIEYFTLLFLFCIVVIMISGTGAIA

SEQ ID NO: 1898569 - protein, 18 aa, Staphylococcus
IIGSIIIIFGIKLPLLIA

SEQ ID NO: 1898570 - protein, 43 aa, Staphylococcus
IIGSMIMLFVMDWQMTLLTFITIPIFVLIMIPLGKVMQNISKK

SEQ ID NO: 1898571 - protein, 23 aa, Staphylococcus
IIGSWFLLFAIGLLYKTVGTLNF

SEQ ID NO: 1898572 - protein, 22 aa, Staphylococcus
IIGTIFVVGYLYWYSQKIKKDP

SEQ ID NO: 1898573 - protein, 28 aa, Staphylococcus
IIGVAIILLLVIAAFIVKQTTGSGNKDS

SEQ ID NO: 1898574 - protein, 20 aa, Staphylococcus
IIGVILFGVFNYINNNGNMP

SEQ ID NO: 1898575 - protein, 17 aa, Staphylococcus
IIGYIFAPIAFIMGVPW

SEQ ID NO: 1898576 - protein, 19 aa, Staphylococcus
IIGYILVIVFSLTYWKWLG

SEQ ID NO: 1898577 - protein, 25 aa, Staphylococcus
IIHIYLLGFFGYLSGILILVAGIIA

SEQ ID NO: 1898578 - protein, 20 aa, Staphylococcus
IIHQSIMSYLLIAVVLTAGT

SEQ ID NO: 1898579 - protein, 18 aa, Staphylococcus
IIIAMCFIHLNTALIMMV

SEQ ID NO: 1898580 - protein, 19 aa, Staphylococcus
IIICIIPFAFIMGGAFDGL

SEQ ID NO: 1898581 - protein, 20 aa, Staphylococcus
IIIFSLIITTLFWAMRTFIT

SEQ ID NO: 1898582 - protein, 19 aa, Staphylococcus
IIIFSLLNYWSVKLLTSFT

SEQ ID NO: 1898583 - protein, 22 aa, Staphylococcus
IIIFVIFVYYTLSTILPIDKII

SEQ ID NO: 1898584 - protein, 21 aa, Staphylococcus
IIIGIVIVIIGAMMIGPYNKL

SEQ ID NO: 1898585 - protein, 34 aa, Staphylococcus
IIIGLVFTAIYYFLFRFLILKFNIPLPGRKKDEE

SEQ ID NO: 1898586 - protein, 39 aa, Staphylococcus
IIIICLSLFIVFFGISWGPVLWVMLPELFPTRARGAATG

SEQ ID NO: 1898587 - protein, 28 aa, Staphylococcus
IIIIILIAVGIMFYLRSNKRKIVEQAEE

SEQ ID NO: 1898588 - protein, 25 aa, Staphylococcus
IIIIIVLIIAFFLNQQYLKSRVETE

SEQ ID NO: 1898589 - protein, 28 aa, Staphylococcus
IIIIVLIIVGIMFYLRSNKRKIVEEAEE

SEQ ID NO: 1898590 - protein, 18 aa, Staphylococcus
IIIKFILAWILQPIFWIS

SEQ ID NO: 1898591 - protein, 28 aa, Staphylococcus
IIILCLSLFIVFFGISWGPVLWVMLPEL

SEQ ID NO: 1898592 - protein, 19 aa, Staphylococcus
IIILSLIVIILMILLLKSS

SEQ ID NO: 1898593 - protein, 17 aa, Staphylococcus
IIILTIIISLISIKGFP

SEQ ID NO: 1898594 - protein, 25 aa, Staphylococcus
IIIMRTSWLFILFIVLGGLSYTIGA

SEQ ID NO: 1898595 - protein, 17 aa, Staphylococcus
IIIPGFIPLLVVGRAIQ

SEQ ID NO: 1898596 - protein, 29 aa, Staphylococcus
IIISGILFLAFVLMPASWFTGLVTNKAVA

SEQ ID NO: 1898597 - protein, 25 aa, Staphylococcus
IIISVLTFWLFAQSLLNIVPTLQSS

SEQ ID NO: 1898598 - protein, 18 aa, Staphylococcus
IIISWLFIKYIYPKKRKK

SEQ ID NO: 1898599 - protein, 21 aa, Staphylococcus
IIITIILGYFGFQFGLRKRDE

SEQ ID NO: 1898600 - protein, 25 aa, Staphylococcus
IIIVCLSLFIVFFGASWGPVLWVML

SEQ ID NO: 1898601 - protein, 22 aa, Staphylococcus
IIIVILILAFILNQRYMQDRID

SEQ ID NO: 1898602 - protein, 18 aa, Staphylococcus
IIIVIMYLLNMLYGIMVE

SEQ ID NO: 1898603 - protein, 18 aa, Staphylococcus
IIIVMCFIHLNTAIIMAV

SEQ ID NO: 1898604 - protein, 28 aa, Staphylococcus
IIIVMIVYTIVYFAFALIGFLHSSRVIK

SEQ ID NO: 1898605 - protein, 31 aa, Staphylococcus
IIIVTLIMIELFIFTFFNASFYQIPIGKITN

SEQ ID NO: 1898606 - protein, 22 aa, Staphylococcus
IIIVTVILIILLSKQLTILNLG

SEQ ID NO: 1898607 - protein, 20 aa, Staphylococcus
IIIYIILGAALGILLIPEIL

SEQ ID NO: 1898608 - protein, 19 aa, Staphylococcus
IIIYIILGASFGIMLIPEI

SEQ ID NO: 1898609 - protein, 27 aa, Staphylococcus
IIKFGIPMLIPLLIKYAIDGVINNHSL

SEQ ID NO: 1898610 - protein, 26 aa, Staphylococcus
IIKFGIPMLIPLLIKYVIDGVINNHD

SEQ ID NO: 1898611 - protein, 33 aa, Staphylococcus
IIKHDLKPIGIAAPFLLAYAAGVSWIYYENVSY

SEQ ID NO: 1898612 - protein, 18 aa, Staphylococcus
IIKNGIFAYLAIYVGINS

SEQ ID NO: 1898613 - protein, 28 aa, Staphylococcus
IIKNILYILPLLIYLFIYSGINLKMALL

SEQ ID NO: 1898614 - protein, 17 aa, Staphylococcus
IIKPIKILKQATERLMH

SEQ ID NO: 1898615 - protein, 20 aa, Staphylococcus
IIKWIYIMIVKYLKWNVSVV

SEQ ID NO: 1898616 - protein, 18 aa, Staphylococcus
IILAFILTRWAWFCRVIR

SEQ ID NO: 1898617 - protein, 20 aa, Staphylococcus
IILAIIWMFLSGSYTFNNFL

SEQ ID NO: 1898618 - protein, 21 aa, Staphylococcus
IILALIAIVTIAIICGLIWGS

SEQ ID NO: 1898619 - protein, 17 aa, Staphylococcus
IILALIIGAMIAFDMGG

SEQ ID NO: 1898620 - protein, 20 aa, Staphylococcus
IILAVIIIVTIAVILILTVG

SEQ ID NO: 1898621 - protein, 21 aa, Staphylococcus
IILFILFPYLIIKFDVKYLIL

SEQ ID NO: 1898622 - protein, 17 aa, Staphylococcus
IILFLLCLTIFKMKGIY

SEQ ID NO: 1898623 - protein, 25 aa, Staphylococcus
IILFSILAFWLINLKAIFPVAIGIL

SEQ ID NO: 1898624 - protein, 21 aa, Staphylococcus
IILFTLLLQVFFYQDLKLTGE

SEQ ID NO: 1898625 - protein, 17 aa, Staphylococcus
IILFTVFIPNIRNKAVK

SEQ ID NO: 1898626 - protein, 23 aa, Staphylococcus
IILGFILHYIFKIDQAWILMLAV

SEQ ID NO: 1898627 - protein, 22 aa, Staphylococcus
IILGVITFWLFAQSLVNLVVPL

SEQ ID NO: 1898628 - protein, 24 aa, Staphylococcus
IILGVITFWLFAQSVLNVVPTLQE

SEQ ID NO: 1898629 - protein, 17 aa, Staphylococcus
IILIPVSFVLTIASAVT

SEQ ID NO: 1898630 - protein, 17 aa, Staphylococcus
IILKRTKLWSLRPHYRV

SEQ ID NO: 1898631 - protein, 19 aa, Staphylococcus
IILMFILAFIGLVKPVIPS

SEQ ID NO: 1898632 - protein, 18 aa, Staphylococcus
IILMFVLAFVGLIKPIIP

SEQ ID NO: 1898633 - protein, 18 aa, Staphylococcus
IILMGFTTNFILWSVLRL

SEQ ID NO: 1898634 - protein, 17 aa, Staphylococcus
IILPIILYSISGILFGI

SEQ ID NO: 1898635 - protein, 20 aa, Staphylococcus
IILPPFFMATGAFMYVIPYF

SEQ ID NO: 1898636 - protein, 22 aa, Staphylococcus
IILPPFFMATGALMYIIPYFRL

SEQ ID NO: 1898637 - protein, 21 aa, Staphylococcus
IILPPFFMATGALMYVIPYFR

SEQ ID NO: 1898638 - protein, 18 aa, Staphylococcus
IILQCINYFVFKYVPSKN

SEQ ID NO: 1898639 - protein, 19 aa, Staphylococcus
IILVLVIRLILLPFMLSNY

SEQ ID NO: 1898640 - protein, 18 aa, Staphylococcus
IILVLVLGLLFFILAGYQ

SEQ ID NO: 1898641 - protein, 24 aa, Staphylococcus
IILYAGIMLMFFIILNYANQVAME

SEQ ID NO: 1898642 - protein, 18 aa, Staphylococcus
IILYYFKYVAGVESLFSV

SEQ ID NO: 1898643 - protein, 17 aa, Staphylococcus
IIMGFIIHIPISKAFLL

SEQ ID NO: 1898644 - protein, 25 aa, Staphylococcus
IIMILAIILGLRTAGALGCGIFAIV

SEQ ID NO: 1898645 - protein, 25 aa, Staphylococcus
IIMILAILLGLRTAGALGCGIFAIV

SEQ ID NO: 1898646 - protein, 19 aa, Staphylococcus
IIMIVAIMLGLRTAGALGC

SEQ ID NO: 1898647 - protein, 34 aa, Staphylococcus
IIMNRYLGIPIFLVIMWLIFQTTFTWIGTPLSDQ

SEQ ID NO: 1898648 - protein, 27 aa, Staphylococcus
IIMRTSWLFILFIFLGGLSYTIGAWFY

SEQ ID NO: 1898649 - protein, 17 aa, Staphylococcus
IIMSQILFHPLVGGFLL

SEQ ID NO: 1898650 - protein, 18 aa, Staphylococcus
IIMTILHTFLSTDTPFWY

SEQ ID NO: 1898651 - protein, 29 aa, Staphylococcus
IIMYSLPVLMFIYPLAITLILLTLVSHLF

SEQ ID NO: 1898652 - protein, 19 aa, Staphylococcus
IINIFKGLFTGDFSLMWQG

SEQ ID NO: 1898653 - protein, 19 aa, Staphylococcus
IINLLLGFVPFFTSGILIM

SEQ ID NO: 1898654 - protein, 24 aa, Staphylococcus
IIPALMIGFFIRKFDPRYPKLGEK

SEQ ID NO: 1898655 - protein, 22 aa, Staphylococcus
IIPEVIGNLLLSLAIFVCMIVI

SEQ ID NO: 1898656 - protein, 24 aa, Staphylococcus
IIPIFAALVWWFLLQRNSTQNEEN

SEQ ID NO: 1898657 - protein, 25 aa, Staphylococcus
IIPSTILFFIFSSASVIFLFFTSTI

SEQ ID NO: 1898658 - protein, 21 aa, Staphylococcus
IIPVLFVMNGLFGLTGIVWSL

SEQ ID NO: 1898659 - protein, 26 aa, Staphylococcus
IIPVVFAIIMWFFVKPDQPLIVEKED

SEQ ID NO: 1898660 - protein, 25 aa, Staphylococcus
IIPYLLWMIIFIIIPVLLLVYFSFI

SEQ ID NO: 1898661 - protein, 24 aa, Staphylococcus
IIPYLLWMVLFIIVPVILLVYFSF

SEQ ID NO: 1898662 - protein, 19 aa, Staphylococcus
IIQQGWIIFGLLSIITSFS

SEQ ID NO: 1898663 - protein, 22 aa, Staphylococcus
IIRRIQIHIETWDRTSLEEQEA

SEQ ID NO: 1898664 - protein, 25 aa, Staphylococcus
IIRTVLILVFLIPTLIAFTGVFDSL

SEQ ID NO: 1898665 - protein, 25 aa, Staphylococcus
IISGTIIALAANPVGWAALAGIAVG

SEQ ID NO: 1898666 - protein, 26 aa, Staphylococcus
IISIAFFVFYVFFIHITYNMIIFILN

SEQ ID NO: 1898667 - protein, 25 aa, Staphylococcus
IISIIFAYMFKWFGLIDDVLLMVII

SEQ ID NO: 1898668 - protein, 26 aa, Staphylococcus
IISIIGLLVILAAAGWIFFSMISDQI

SEQ ID NO: 1898669 - protein, 28 aa, Staphylococcus
IISIIVLLLIIIFYRPLMISTFDPTFSR

SEQ ID NO: 1898670 - protein, 19 aa, Staphylococcus
IISILLFLIITFTKIPNVE

SEQ ID NO: 1898671 - protein, 32 aa, Staphylococcus
IISILLIFISLYLKWWIVFGVAIVLLIVVALA

SEQ ID NO: 1898672 - protein, 18 aa, Staphylococcus
IISKIITLILFSLLYFII

SEQ ID NO: 1898673 - protein, 17 aa, Staphylococcus
IISLALLFWIGILSCRL

SEQ ID NO: 1898674 - protein, 26 aa, Staphylococcus
IISLIIPLLIFIFVGFQLVVGAINVV

SEQ ID NO: 1898675 - protein, 19 aa, Staphylococcus
IISLIISFLLWYFTRNWRR

SEQ ID NO: 1898676 - protein, 32 aa, Staphylococcus
IISLILYIALTWIHAFLLKYLFKIVGELIKPL

SEQ ID NO: 1898677 - protein, 22 aa, Staphylococcus
IISLLLYFQLFNISAFDTNNNK

SEQ ID NO: 1898678 - protein, 21 aa, Staphylococcus
IISLPATIYIEFLRGTPMLVQ

SEQ ID NO: 1898679 - protein, 29 aa, Staphylococcus
IISLVGLLIVLVAAGFIFFTMISDQIFFK

SEQ ID NO: 1898680 - protein, 24 aa, Staphylococcus
IISLVILILAIIPITGMRLGIPDD

SEQ ID NO: 1898681 - protein, 18 aa, Staphylococcus
IISMLWFTAFGITGIEIG

SEQ ID NO: 1898682 - protein, 22 aa, Staphylococcus
IISSIIGYLLFGIGLGTYATPS

SEQ ID NO: 1898683 - protein, 26 aa, Staphylococcus
IISTLFLLIMVPFFLIYMLKDHEKFI

SEQ ID NO: 1898684 - protein, 22 aa, Staphylococcus
IISVLGHYLLPTGDLATIIIAS

SEQ ID NO: 1898685 - protein, 24 aa, Staphylococcus
IISYAIFAFAFVNSILYLIQFKNL

SEQ ID NO: 1898686 - protein, 19 aa, Staphylococcus
IITALYRFICLAYLILCLA

SEQ ID NO: 1898687 - protein, 24 aa, Staphylococcus
IITFIISLIFWLYFMIACILVIGS

SEQ ID NO: 1898688 - protein, 19 aa, Staphylococcus
IITFPILRKFKIATPIFKP

SEQ ID NO: 1898689 - protein, 19 aa, Staphylococcus
IITFPILRKFKVATPIFKP

SEQ ID NO: 1898690 - protein, 19 aa, Staphylococcus
IITFVIFTVLVFLACTWSI

SEQ ID NO: 1898691 - protein, 21 aa, Staphylococcus
IITIILLFKYPRLAIWFICTI

SEQ ID NO: 1898692 - protein, 26 aa, Staphylococcus
IITIIVFSFVMLFYKEMFILSFDEEY

SEQ ID NO: 1898693 - protein, 32 aa, Staphylococcus
IITIIVLIVIGVVGFYFWNNATSYVSTDNAKV

SEQ ID NO: 1898694 - protein, 29 aa, Staphylococcus
IITIIVVFYYLKWLKLKTAPLLIATILYG

SEQ ID NO: 1898695 - protein, 19 aa, Staphylococcus
IITIPLKIEQGDSAGYTIE

SEQ ID NO: 1898696 - protein, 32 aa, Staphylococcus
IITIVALVIIGVVGFYFYHNATSYVTTDNAKV

SEQ ID NO: 1898697 - protein, 19 aa, Staphylococcus
IITIVILIVLVLFYIKEAK

SEQ ID NO: 1898698 - protein, 27 aa, Staphylococcus
IITIVVLVLIGIGGFYYYNQATGYIKT

SEQ ID NO: 1898699 - protein, 27 aa, Staphylococcus
IITIVVLVVVGIVGFYLYHNATSFVTT

SEQ ID NO: 1898700 - protein, 18 aa, Staphylococcus
IITKGPVLFGFFGHSSIA

SEQ ID NO: 1898701 - protein, 26 aa, Staphylococcus
IITLIGAIFVWIGWYGFNVGSALSFN

SEQ ID NO: 1898702 - protein, 47 aa, Staphylococcus
IITLIGSLIMLFIMDWQMTLLTFITIPLFVAIMIPLGRVMQRISTRT

SEQ ID NO: 1898703 - protein, 18 aa, Staphylococcus
IITLKLLHEIIKSYFTYV

SEQ ID NO: 1898704 - protein, 33 aa, Staphylococcus
IITPTLTLLIIGLLTIFVIMPLAGFISSGLVIV

SEQ ID NO: 1898705 - protein, 18 aa, Staphylococcus
IITQLLYFIEGSLGFLMF

SEQ ID NO: 1898706 - protein, 23 aa, Staphylococcus
IITSIIFMLFIISDIRTILSKDE

SEQ ID NO: 1898707 - protein, 32 aa, Staphylococcus
IITVIPAFVFINPMWFGILFAIIGALLIENLR

SEQ ID NO: 1898708 - protein, 22 aa, Staphylococcus
IITVIVFIVVALVTALLLKQQY

SEQ ID NO: 1898709 - protein, 18 aa, Staphylococcus
IIVFIILGICVILGLIHY

SEQ ID NO: 1898710 - protein, 18 aa, Staphylococcus
IIVGLISGAFWALGQGYQ

SEQ ID NO: 1898711 - protein, 18 aa, Staphylococcus
IIVHPLVSLILTCIIFLG

SEQ ID NO: 1898712 - protein, 18 aa, Staphylococcus
IIVIIALLFLFVGNSLDA

SEQ ID NO: 1898713 - protein, 28 aa, Staphylococcus
IIVIILIAVGIMFYLRSNKRQLVEKAEE

SEQ ID NO: 1898714 - protein, 24 aa, Staphylococcus
IIVKTLLFFIIGSLVYISGFRNYQ

SEQ ID NO: 1898715 - protein, 17 aa, Staphylococcus
IIVLFSIYLLQINLAGH

SEQ ID NO: 1898716 - protein, 20 aa, Staphylococcus
IIVLIVVGLVMILFAYKTQF

SEQ ID NO: 1898717 - protein, 23 aa, Staphylococcus
IIVLLSLIIFLKLNTFISLIITS

SEQ ID NO: 1898718 - protein, 22 aa, Staphylococcus
IIVLLVILLLMNGLAIYFRNKF

SEQ ID NO: 1898719 - protein, 17 aa, Staphylococcus
IIVLSLIIIVACLKTAI

SEQ ID NO: 1898720 - protein, 20 aa, Staphylococcus
IIVMLTIKWNRKYLLIVLMG

SEQ ID NO: 1898721 - protein, 31 aa, Staphylococcus
IIVSLVLFGIFVMLPASWFTGLINSKTLATQ

SEQ ID NO: 1898722 - protein, 17 aa, Staphylococcus
IIVTIPKDNIKTNLTAL

SEQ ID NO: 1898723 - protein, 20 aa, Staphylococcus
IIVTLIIILVISKQLTILNL

SEQ ID NO: 1898724 - protein, 19 aa, Staphylococcus
IIVVVYFLMPYILGFDISD

SEQ ID NO: 1898725 - protein, 23 aa, Staphylococcus
IIWVALFLMILPLFYLNLRNKPN

SEQ ID NO: 1898726 - protein, 19 aa, Staphylococcus
IIYAWSPFVILTVVVMIWS

SEQ ID NO: 1898727 - protein, 27 aa, Staphylococcus
IIYHKFLAWFILVPIVSLIGLMVLIIK

SEQ ID NO: 1898728 - protein, 24 aa, Staphylococcus
IIYIGMVLVILLMNLDQVVPMIGT

SEQ ID NO: 1898729 - protein, 19 aa, Staphylococcus
IIYSTIWIAFNLYTIYLLI

SEQ ID NO: 1898730 - protein, 20 aa, Staphylococcus
IIYTIGILLLWRSRWMKVYN

SEQ ID NO: 1898731 - protein, 22 aa, Staphylococcus
IIYWSKFLLFLVYFVVLCVICI

SEQ ID NO: 1898732 - protein, 29 aa, Staphylococcus
IKDEKLFKISWIVLAILLVGYLISEFVQI

SEQ ID NO: 1898733 - protein, 25 aa, Staphylococcus
IKDKTLLILFLKFVAILLYVQKAIE

SEQ ID NO: 1898734 - protein, 21 aa, Staphylococcus
IKDNVDVFVILSHLGVDKSTR

SEQ ID NO: 1898735 - protein, 27 aa, Staphylococcus
IKDQKLFRISWLVLAILLIGYLVSEFI

SEQ ID NO: 1898736 - protein, 26 aa, Staphylococcus
IKDYRLFRWSWLVLSVLFIGYILSEF

SEQ ID NO: 1898737 - protein, 18 aa, Staphylococcus
IKFILIPYIFFALFIIFE

SEQ ID NO: 1898738 - protein, 28 aa, Staphylococcus
IKGLTPIWIFLIFTFLMHLFLTKGGSRI

SEQ ID NO: 1898739 - protein, 30 aa, Staphylococcus
IKHFDIIYIFQFLILVSLFGIYWLVTENYI

SEQ ID NO: 1898740 - protein, 23 aa, Staphylococcus
IKHWLIAIVVLAIIVWGFAGMPA

SEQ ID NO: 1898741 - protein, 28 aa, Staphylococcus
IKHYGMFLFSLLLSIVLYFSFSTLKYSH

SEQ ID NO: 1898742 - protein, 25 aa, Staphylococcus
IKHYPVLGWTFFIAALSLAGIPPLS

SEQ ID NO: 1898743 - protein, 24 aa, Staphylococcus
IKIYYTIFLIFHINLATIGGILGL

SEQ ID NO: 1898744 - protein, 30 aa, Staphylococcus
IKKDFLLIPLFIFFQILTPIIIVFGVLGVT

SEQ ID NO: 1898745 - protein, 29 aa, Staphylococcus
IKKQWLAYLILILTIVLTLTALWLGQKSA

SEQ ID NO: 1898746 - protein, 20 aa, Staphylococcus
IKLLFTICLLCGIISFIISF

SEQ ID NO: 1898747 - protein, 25 aa, Staphylococcus
IKLLMQQLHLLPFLQDLITDGIIAG

SEQ ID NO: 1898748 - protein, 22 aa, Staphylococcus
IKLMIYLLIISFILFILLENTT

SEQ ID NO: 1898749 - protein, 38 aa, Staphylococcus
IKLWLTIIFIVTTVLILLSAALITFIQYYYTQQTENAI

SEQ ID NO: 1898750 - protein, 38 aa, Staphylococcus
IKLWLTIILIVETVLILLSVSLITFIQYYFTQETENSI

SEQ ID NO: 1898751 - protein, 25 aa, Staphylococcus
IKMDWWFHLVIMLASIAWYILTMVN

SEQ ID NO: 1898752 - protein, 25 aa, Staphylococcus
IKMKNYFIILLFSKLISISFLAVMG

SEQ ID NO: 1898753 - protein, 18 aa, Staphylococcus
IKMLVVPIVFCSLALSIS

SEQ ID NO: 1898754 - protein, 24 aa, Staphylococcus
IKMPFIAHLPLKQYSLEWLPIAVI

SEQ ID NO: 1898755 - protein, 24 aa, Staphylococcus
IKNDWLIIVVITLLLLVLSLLIAF

SEQ ID NO: 1898756 - protein, 25 aa, Staphylococcus
IKNGDKLLLFGFGGGLAYSGLVIEW

SEQ ID NO: 1898757 - protein, 28 aa, Staphylococcus
IKNVVRYIVWFIVLTTVLSKFGISVNGI

SEQ ID NO: 1898758 - protein, 32 aa, Staphylococcus
IKPIRIGNSDKLVLGESILIVGNPLGEEFRNT

SEQ ID NO: 1898759 - protein, 23 aa, Staphylococcus
IKPQNILIDKNKTLKIFDFGIAK

SEQ ID NO: 1898760 - protein, 25 aa, Staphylococcus
IKQNIVLIIIFLVFNIRDFDFTNIY

SEQ ID NO: 1898761 - protein, 25 aa, Staphylococcus
IKQYPVLGWTFFIAALSLAGIPPLS

SEQ ID NO: 1898762 - protein, 25 aa, Staphylococcus
IKRNIWILFSAWILALTYLAFNFFH

SEQ ID NO: 1898763 - protein, 37 aa, Staphylococcus
IKRNNLLMLTPFLPILSILIIVFNKNLGILLTLLVCS

SEQ ID NO: 1898764 - protein, 33 aa, Staphylococcus
IKRRRLILLYLITLLFIFPLYFIINSFSNFLVD

SEQ ID NO: 1898765 - protein, 34 aa, Staphylococcus
IKSKHAFSFKLLLSLLIAGFLVVAILLAMTIPSD

SEQ ID NO: 1898766 - protein, 22 aa, Staphylococcus
IKSVSIRIWNAIKNSVIGAIRA

SEQ ID NO: 1898767 - protein, 26 aa, Staphylococcus
IKSYPVLGWTFFIAALSLAGIPPLSG

SEQ ID NO: 1898768 - protein, 29 aa, Staphylococcus
IKTAPLLFVFVMIILIFNLGLSLILGKLF

SEQ ID NO: 1898769 - protein, 25 aa, Staphylococcus
IKTASMIIWGLMKTSATLAWNAIKM

SEQ ID NO: 1898770 - protein, 44 aa, Staphylococcus
IKTAVMLIIQGWLTAVKIYFGMWKTFITAVWNGIKYVSIAIWNA

SEQ ID NO: 1898771 - protein, 29 aa, Staphylococcus
IKTFLMLFFELLILFIIVSFIVSLIQQVV

SEQ ID NO: 1898772 - protein, 29 aa, Staphylococcus
IKTFLMLFFELLLLFIIVSFIISLIQQVI

SEQ ID NO: 1898773 - protein, 27 aa, Staphylococcus
IKTFLMLFFELLVLFIVVSFIVSIIQQ

SEQ ID NO: 1898774 - protein, 17 aa, Staphylococcus
IKTFVADGERGERGLQG

SEQ ID NO: 1898775 - protein, 29 aa, Staphylococcus
IKTFVMLFFELFILFIIVSFIVSIIQQIV

SEQ ID NO: 1898776 - protein, 18 aa, Staphylococcus
IKTIFPEVVSKSNARTIL

SEQ ID NO: 1898777 - protein, 21 aa, Staphylococcus
IKTINILYALLANVPIILTQR

SEQ ID NO: 1898778 - protein, 30 aa, Staphylococcus
IKTLINVLPIFIVPLVTERKHIKNHSEVKK

SEQ ID NO: 1898779 - protein, 23 aa, Staphylococcus
IKTTLMVIWLLPIGVAVIPYSLQ

SEQ ID NO: 1898780 - protein, 25 aa, Staphylococcus
IKTYPILGWSFFIAALSLAGIPPFS

SEQ ID NO: 1898781 - protein, 19 aa, Staphylococcus
IKVVIACFYGIGISQLLAT

SEQ ID NO: 1898782 - protein, 25 aa, Staphylococcus
IKYLPPHWIVMLLLSSISILCSIMI

SEQ ID NO: 1898783 - protein, 37 aa, Staphylococcus
IKYYKFRYILIMLIILLLGIMVLFISGLAQGLARENI

SEQ ID NO: 1898784 - protein, 18 aa, Staphylococcus
ILAAIKWVLDIGGPFSGF

SEQ ID NO: 1898785 - protein, 26 aa, Staphylococcus
ILAAVMLFLFLINNLKILFQSPIKLI

SEQ ID NO: 1898786 - protein, 20 aa, Staphylococcus
ILACWPFTRLVHVWSIPLAY

SEQ ID NO: 1898787 - protein, 17 aa, Staphylococcus
ILAFAVIMWVTEAVSYP

SEQ ID NO: 1898788 - protein, 18 aa, Staphylococcus
ILAFAVIMWVTEAVSYPV

SEQ ID NO: 1898789 - protein, 19 aa, Staphylococcus
ILAGIPTIVFGFFALTFVT

SEQ ID NO: 1898790 - protein, 20 aa, Staphylococcus
ILAIIGIPVLFLMLIKSARF

SEQ ID NO: 1898791 - protein, 27 aa, Staphylococcus
ILAIIGLLIVFVVAAVIFFSMISDQIF

SEQ ID NO: 1898792 - protein, 23 aa, Staphylococcus
ILAILVLFFIKEAQYHLFMQIAI

SEQ ID NO: 1898793 - protein, 24 aa, Staphylococcus
ILAISFIIIGLFMVIEIVGGFIAN

SEQ ID NO: 1898794 - protein, 22 aa, Staphylococcus
ILAKMFVMMFGVSIFAFMGYEH

SEQ ID NO: 1898795 - protein, 20 aa, Staphylococcus
ILALLGIPVLFYIIATQPRM

SEQ ID NO: 1898796 - protein, 21 aa, Staphylococcus
ILAMLFVIKFLPETRGRSLEE

SEQ ID NO: 1898797 - protein, 27 aa, Staphylococcus
ILASIGIIIYVSLRFEWRMGLSAVLAL

SEQ ID NO: 1898798 - protein, 21 aa, Staphylococcus
ILATIWTTIVTVASTIWTTLV

SEQ ID NO: 1898799 - protein, 20 aa, Staphylococcus
ILAYAFKWLGLVDDVLLMII

SEQ ID NO: 1898800 - protein, 17 aa, Staphylococcus
ILCIFFLATLSGVFASN

SEQ ID NO: 1898801 - protein, 18 aa, Staphylococcus
ILCILYTFLGGFEGVVWS

SEQ ID NO: 1898802 - protein, 26 aa, Staphylococcus
ILDGLSFLILYLLNVHLGYTFSGGFI

SEQ ID NO: 1898803 - protein, 40 aa, Staphylococcus
ILDKRLPMLNLPIIPIWLSRFWVRLISQVPKEMVYPLMDS

SEQ ID NO: 1898804 - protein, 35 aa, Staphylococcus
ILDLQKEMWKYLSIVGVIVLITVYLASRSINRTYI

SEQ ID NO: 1898805 - protein, 29 aa, Staphylococcus
ILDQYVNYFMLFNVIATLLTLYVIGNHLD

SEQ ID NO: 1898806 - protein, 23 aa, Staphylococcus
ILDTITYFVAAVAGISLFIAGIG

SEQ ID NO: 1898807 - protein, 22 aa, Staphylococcus
ILEFFYILIGLQFLYTAYRALR

SEQ ID NO: 1898808 - protein, 17 aa, Staphylococcus
ILEIFYILIGLQFLYTA

SEQ ID NO: 1898809 - protein, 19 aa, Staphylococcus
ILEIFYILIGLQLLYTAFR

SEQ ID NO: 1898810 - protein, 23 aa, Staphylococcus
ILEKWGFPRWASITTIFIGLIAI

SEQ ID NO: 1898811 - protein, 19 aa, Staphylococcus
ILELLPSNPFLDFTGQRTT

SEQ ID NO: 1898812 - protein, 18 aa, Staphylococcus
ILEYLDEAFLNKAKQLSK

SEQ ID NO: 1898813 - protein, 20 aa, Staphylococcus
ILFFITLIMAALSGLIVLIP

SEQ ID NO: 1898814 - protein, 18 aa, Staphylococcus
ILFFITLSIAMLSGIVYI

SEQ ID NO: 1898815 - protein, 20 aa, Staphylococcus
ILFGIALLLTLFRLIKGPTT

SEQ ID NO: 1898816 - protein, 17 aa, Staphylococcus
ILFHPLVGGFLLAAILA

SEQ ID NO: 1898817 - protein, 22 aa, Staphylococcus
ILFHQWYFIDHWKLALYNVMIV

SEQ ID NO: 1898818 - protein, 25 aa, Staphylococcus
ILFITLVIVLLILFSINVFNKDKES

SEQ ID NO: 1898819 - protein, 19 aa, Staphylococcus
ILFIVIYLPGMPSSLAWPS

SEQ ID NO: 1898820 - protein, 17 aa, Staphylococcus
ILFKHLLPKVIPSILVI

SEQ ID NO: 1898821 - protein, 17 aa, Staphylococcus
ILFLGFIVFFFEMYIFS

SEQ ID NO: 1898822 - protein, 18 aa, Staphylococcus
ILFTLLLQVFFYKNLNVK

SEQ ID NO: 1898823 - protein, 19 aa, Staphylococcus
ILFTLLTETITFFTRVPFS

SEQ ID NO: 1898824 - protein, 17 aa, Staphylococcus
ILFVIYEAIFRKPINKK

SEQ ID NO: 1898825 - protein, 17 aa, Staphylococcus
ILFVIYEAIFRKPVNKK

SEQ ID NO: 1898826 - protein, 19 aa, Staphylococcus
ILFVIYEAIFRRPVNKRAE

SEQ ID NO: 1898827 - protein, 42 aa, Staphylococcus
ILGAFIALMKLSKFKPLSWIASIYIEFLRGTPLLVQVFIVFF

SEQ ID NO: 1898828 - protein, 26 aa, Staphylococcus
ILGALLLVFMLIFGDLKFIFESYTLA

SEQ ID NO: 1898829 - protein, 26 aa, Staphylococcus
ILGAVLLLFMLIFGDLKFIFESYTLA

SEQ ID NO: 1898830 - protein, 27 aa, Staphylococcus
ILGFATLLIILILQRFTRGFLKSIAIL

SEQ ID NO: 1898831 - protein, 26 aa, Staphylococcus
ILGFIIFIIILFLKKVRHTPAKSAVN

SEQ ID NO: 1898832 - protein, 36 aa, Staphylococcus
ILGFLLHYIFEIDATWLLLLAVFIIIINASWNTLHR

SEQ ID NO: 1898833 - protein, 27 aa, Staphylococcus
ILGGATLVIILILQRFTKGFLKSIAIL

SEQ ID NO: 1898834 - protein, 19 aa, Staphylococcus
ILGGLFGGLFYFSIGVFES

SEQ ID NO: 1898835 - protein, 28 aa, Staphylococcus
ILGGVTLIVILLLQRFTTGFLKSIAILI

SEQ ID NO: 1898836 - protein, 21 aa, Staphylococcus
ILGIIFLIMMKLMLAIAMFAV

SEQ ID NO: 1898837 - protein, 19 aa, Staphylococcus
ILGIILPLSVILFYLIFVP

SEQ ID NO: 1898838 - protein, 18 aa, Staphylococcus
ILGIMVWLGMKAIPIFVI

SEQ ID NO: 1898839 - protein, 20 aa, Staphylococcus
ILGLIIFGGVKWIANVATAV

SEQ ID NO: 1898840 - protein, 18 aa, Staphylococcus
ILGLLVAILIIILKELLD

SEQ ID NO: 1898841 - protein, 18 aa, Staphylococcus
ILGLLYSFAARFTTPYTK

SEQ ID NO: 1898842 - protein, 21 aa, Staphylococcus
ILGMFMHLILLPVVKVFKLSS

SEQ ID NO: 1898843 - protein, 18 aa, Staphylococcus
ILGMLLYVTPIPVQFNFD

SEQ ID NO: 1898844 - protein, 17 aa, Staphylococcus
ILGMVIFTILMGNAFAA

SEQ ID NO: 1898845 - protein, 25 aa, Staphylococcus
ILGPMIILPLFFQRFQHFNAIETAI

SEQ ID NO: 1898846 - protein, 29 aa, Staphylococcus
ILGTIVAIIIILLFLRNIRTTAISVVSIP

SEQ ID NO: 1898847 - protein, 25 aa, Staphylococcus
ILGTWFMSYFIFVRPMKQIQKQTAQ

SEQ ID NO: 1898848 - protein, 21 aa, Staphylococcus
ILGVITFWLFAQSLVNLVVPL

SEQ ID NO: 1898849 - protein, 25 aa, Staphylococcus
ILGVWFTSYFIFIRPMKQIQQTDKK

SEQ ID NO: 1898850 - protein, 19 aa, Staphylococcus
ILHDIVNIHLLYIQGFLLG

SEQ ID NO: 1898851 - protein, 18 aa, Staphylococcus
ILIAFTSILVVMPQHIVN

SEQ ID NO: 1898852 - protein, 18 aa, Staphylococcus
ILIDFRLPRMLITILAGA

SEQ ID NO: 1898853 - protein, 20 aa, Staphylococcus
ILIFYFMMIGFRRGTWLSTL

SEQ ID NO: 1898854 - protein, 58 aa, Staphylococcus
ILIGAIPAALLAILFDFILRYMAKLSYKKLLITLGIILLIILLVIVVPLFGKKSATIT

SEQ ID NO: 1898855 - protein, 40 aa, Staphylococcus
ILIGAIPAALLAILFDIILRFMEKLSYKKLLIVLGTMIVV

SEQ ID NO: 1898856 - protein, 18 aa, Staphylococcus
ILIGAIPAALLAIMFDLI

SEQ ID NO: 1898857 - protein, 29 aa, Staphylococcus
ILIGEFFEGAIVVLLFTIGTLLQTISIDK

SEQ ID NO: 1898858 - protein, 18 aa, Staphylococcus
ILIGLFIGNWKVGLAALL

SEQ ID NO: 1898859 - protein, 25 aa, Staphylococcus
ILIGLILVFSIFKPTYRKPGLYKDY

SEQ ID NO: 1898860 - protein, 30 aa, Staphylococcus
ILIGPAMYYWGAFGLILEILLLGTGIIASF

SEQ ID NO: 1898861 - protein, 26 aa, Staphylococcus
ILIHIAFHEYILPKLNLTPQVKDLPK

SEQ ID NO: 1898862 - protein, 19 aa, Staphylococcus
ILIIIFGDWVVQIPMPILA

SEQ ID NO: 1898863 - protein, 25 aa, Staphylococcus
ILIIIIGFILKFDTIAIILIAAVVT

SEQ ID NO: 1898864 - protein, 23 aa, Staphylococcus
ILIIILGFLFKFDTIAVILVAAL

SEQ ID NO: 1898865 - protein, 19 aa, Staphylococcus
ILIILFIVMGIFEERRRNK

SEQ ID NO: 1898866 - protein, 25 aa, Staphylococcus
ILIIYVLSLLCYFWDFVRKTHKVRT

SEQ ID NO: 1898867 - protein, 18 aa, Staphylococcus
ILILFLFTICMAAFYLLV

SEQ ID NO: 1898868 - protein, 17 aa, Staphylococcus
ILILSYQLDILNLGDQL

SEQ ID NO: 1898869 - protein, 23 aa, Staphylococcus
ILIMLICLGFINHPIQAAENQSE

SEQ ID NO: 1898870 - protein, 20 aa, Staphylococcus
ILIPLIFVVIIILALLLTSL

SEQ ID NO: 1898871 - protein, 29 aa, Staphylococcus
ILISGVIFIIFVLLPAQLFTGLITDKTLA

SEQ ID NO: 1898872 - protein, 28 aa, Staphylococcus
ILISGVIFIIFVLMPSSWFTGLVTNKTL

SEQ ID NO: 1898873 - protein, 29 aa, Staphylococcus
ILISGVIFVIFVLLPASWFTGLVTDKTLA

SEQ ID NO: 1898874 - protein, 24 aa, Staphylococcus
ILISKWLYRRRGIIARILESIIVL

SEQ ID NO: 1898875 - protein, 18 aa, Staphylococcus
ILITIIMYLGAKWVQHRF

SEQ ID NO: 1898876 - protein, 17 aa, Staphylococcus
ILIVFTAIFYLLGSVFK

SEQ ID NO: 1898877 - protein, 20 aa, Staphylococcus
ILIYSMLTAFLFIDKVFVNI

SEQ ID NO: 1898878 - protein, 19 aa, Staphylococcus
ILKAAVESPVLFVTIAVFC

SEQ ID NO: 1898879 - protein, 18 aa, Staphylococcus
ILKNHYIDGLLGALIFFI

SEQ ID NO: 1898880 - protein, 17 aa, Staphylococcus
ILLFTLILQVFFYQNLP

SEQ ID NO: 1898881 - protein, 17 aa, Staphylococcus
ILLGAIPAAILAIVFDL

SEQ ID NO: 1898882 - protein, 27 aa, Staphylococcus
ILLGIILGVVVGYFLARNILHQKQIQA

SEQ ID NO: 1898883 - protein, 25 aa, Staphylococcus
ILLGLNWLAILLYMEAVVSPFGTGV

SEQ ID NO: 1898884 - protein, 19 aa, Staphylococcus
ILLGLRTAGALGCGIFAIV

SEQ ID NO: 1898885 - protein, 20 aa, Staphylococcus
ILLGLVTWIVVIITSLITMK

SEQ ID NO: 1898886 - protein, 34 aa, Staphylococcus
ILLGPLIVYLSWWGFAIFLLLYLVGIYAGGNVDK

SEQ ID NO: 1898887 - protein, 17 aa, Staphylococcus
ILLIALGYFLKRINYLK

SEQ ID NO: 1898888 - protein, 17 aa, Staphylococcus
ILLIALGYLLKRINFIK

SEQ ID NO: 1898889 - protein, 17 aa, Staphylococcus
ILLIGLGYFLKRIHFVK

SEQ ID NO: 1898890 - protein, 17 aa, Staphylococcus
ILLKVRLPRVLEAMLTG

SEQ ID NO: 1898891 - protein, 22 aa, Staphylococcus
ILLLFFLTTIAGSIYFYKRRKH

SEQ ID NO: 1898892 - protein, 18 aa, Staphylococcus
ILLLTIKKYRNVTLILWI

SEQ ID NO: 1898893 - protein, 17 aa, Staphylococcus
ILLSFVLAFVGLIKPII

SEQ ID NO: 1898894 - protein, 21 aa, Staphylococcus
ILLTIFFITIIIAALSGIIFL

SEQ ID NO: 1898895 - protein, 17 aa, Staphylococcus
ILLTYIFIGFMLFMFMR

SEQ ID NO: 1898896 - protein, 17 aa, Staphylococcus
ILLTYIIIGFMLFMFMR

SEQ ID NO: 1898897 - protein, 17 aa, Staphylococcus
ILLTYILIGFMLFMFMR

SEQ ID NO: 1898898 - protein, 22 aa, Staphylococcus
ILLVFGYFVIPFVSAFIIHEIC

SEQ ID NO: 1898899 - protein, 26 aa, Staphylococcus
ILLVIQLVFAFILLKTTAGITVIGGI

SEQ ID NO: 1898900 - protein, 28 aa, Staphylococcus
ILMGFTEQYLIWSIFRLISGITSGTVFV

SEQ ID NO: 1898901 - protein, 22 aa, Staphylococcus
ILMILLQLVLLPIYAKIHTPQE

SEQ ID NO: 1898902 - protein, 17 aa, Staphylococcus
ILMYFNILPKVIGGIGW

SEQ ID NO: 1898903 - protein, 19 aa, Staphylococcus
ILMYVFWELTSISSFLLIS

SEQ ID NO: 1898904 - protein, 33 aa, Staphylococcus
ILNHLVPIIITLLLCYLGFQFGLKKRDEMLMFL

SEQ ID NO: 1898905 - protein, 32 aa, Staphylococcus
ILNHLVPLIITLLLCYLGFQFGLKKRDEMLMF

SEQ ID NO: 1898906 - protein, 17 aa, Staphylococcus
ILNIYFIGFLDNSHMIS

SEQ ID NO: 1898907 - protein, 33 aa, Staphylococcus
ILNPIINILRSIPFIILLIAIVPFTKLVAGTSI

SEQ ID NO: 1898908 - protein, 29 aa, Staphylococcus
ILNRTLLKIFNLFILAAMLLITLYFSYII

SEQ ID NO: 1898909 - protein, 27 aa, Staphylococcus
ILNSISIIILFILALVSPIYDLIEIAI

SEQ ID NO: 1898910 - protein, 18 aa, Staphylococcus
ILNYLKFPQTIIVQIYFS

SEQ ID NO: 1898911 - protein, 24 aa, Staphylococcus
ILPDWIFFNQIVIITIIVGILLVM

SEQ ID NO: 1898912 - protein, 27 aa, Staphylococcus
ILPGMIPWFMILISHIRFRKLHPEQVE

SEQ ID NO: 1898913 - protein, 25 aa, Staphylococcus
ILPGMIPWFMILISHIRFRRLHPEE

SEQ ID NO: 1898914 - protein, 18 aa, Staphylococcus
ILPIIILGLIFLAHKLIR

SEQ ID NO: 1898915 - protein, 31 aa, Staphylococcus
ILPLIFALIIPILYRFFKKIHLGWFVLPIPV

SEQ ID NO: 1898916 - protein, 26 aa, Staphylococcus
ILPLIFALIIPILYRFVPRIHLGWFV

SEQ ID NO: 1898917 - protein, 23 aa, Staphylococcus
ILPLSVILFYLIFVPGEFKISHF

SEQ ID NO: 1898918 - protein, 17 aa, Staphylococcus
ILPPIFMSTGALMFVVP

SEQ ID NO: 1898919 - protein, 24 aa, Staphylococcus
ILPPLAAMLFIKIGYHPIAGLAMA

SEQ ID NO: 1898920 - protein, 19 aa, Staphylococcus
ILPSFISLILYRFELNLRS

SEQ ID NO: 1898921 - protein, 24 aa, Staphylococcus
ILPSFLSLILYRFELNLRSASILG

SEQ ID NO: 1898922 - protein, 23 aa, Staphylococcus
ILPSTFLGVLPMGMYLVAIHQLD

SEQ ID NO: 1898923 - protein, 31 aa, Staphylococcus
ILQLVIYIIGLIFLLYMAWSLWNEKPNNLEN

SEQ ID NO: 1898924 - protein, 31 aa, Staphylococcus
ILQLVIYIIGLLFLLYMAWSLWNEKPNNLEN

SEQ ID NO: 1898925 - protein, 17 aa, Staphylococcus
ILQQLGQMFMNVLGGLV

SEQ ID NO: 1898926 - protein, 22 aa, Staphylococcus
ILRKEILKLFKLKEIKTPQPTM

SEQ ID NO: 1898927 - protein, 27 aa, Staphylococcus
ILRLVIIALILMFWLHQPVITLIIGSL

SEQ ID NO: 1898928 - protein, 18 aa, Staphylococcus
ILRVFDLQTLISAYVLGI

SEQ ID NO: 1898929 - protein, 25 aa, Staphylococcus
ILSGKMFFFYIITVIILIVLVLFFI

SEQ ID NO: 1898930 - protein, 25 aa, Staphylococcus
ILSIIEWVILVKGFKRKIPFLDKVV

SEQ ID NO: 1898931 - protein, 23 aa, Staphylococcus
ILSIIGLLVILGVAAIIVFSMIS

SEQ ID NO: 1898932 - protein, 25 aa, Staphylococcus
ILSILLIILGFFVVPLVTAFILDII

SEQ ID NO: 1898933 - protein, 21 aa, Staphylococcus
ILSILNYFVLLPLYGMIMNLS

SEQ ID NO: 1898934 - protein, 24 aa, Staphylococcus
ILSLCIYIPFIYRFITQGIVFSGE

SEQ ID NO: 1898935 - protein, 17 aa, Staphylococcus
ILSLFLKSKKKADAEHD

SEQ ID NO: 1898936 - protein, 23 aa, Staphylococcus
ILSLFYCIVIFPITIFIHIQIAR

SEQ ID NO: 1898937 - protein, 39 aa, Staphylococcus
ILSLTLMMILTPFWYVFVIIYFLFIAYILWQGIFFVKGN

SEQ ID NO: 1898938 - protein, 23 aa, Staphylococcus
ILSQLLFIFSLFFLPKILNNKFT

SEQ ID NO: 1898939 - protein, 23 aa, Staphylococcus
ILSSSLVGYGFTKDAFAATQDAE

SEQ ID NO: 1898940 - protein, 28 aa, Staphylococcus
ILSSTLVTIIVFLPLAFVSGSVGEMFRP

SEQ ID NO: 1898941 - protein, 28 aa, Staphylococcus
ILSSTLVTIVVFLPLAFVSGSVGEMFRP

SEQ ID NO: 1898942 - protein, 17 aa, Staphylococcus
ILSYLLIAVVLTAGTAF

SEQ ID NO: 1898943 - protein, 18 aa, Staphylococcus
ILVDFRLPRMLITILAGA

SEQ ID NO: 1898944 - protein, 28 aa, Staphylococcus
ILVIILIAIGVMFYMRSNKRNSIEKAEE

SEQ ID NO: 1898945 - protein, 17 aa, Staphylococcus
ILVIMYQKYRKESEKAT

SEQ ID NO: 1898946 - protein, 24 aa, Staphylococcus
ILVITPILPYALAFAAGAMIFVVV

SEQ ID NO: 1898947 - protein, 18 aa, Staphylococcus
ILVLVSFTQFTPYLFAAE

SEQ ID NO: 1898948 - protein, 30 aa, Staphylococcus
ILVNILSWQLVLFALVMIVLVRPISVLLST

SEQ ID NO: 1898949 - protein, 22 aa, Staphylococcus
ILVPLKAVLGFILSLMATLGFT

SEQ ID NO: 1898950 - protein, 20 aa, Staphylococcus
ILVPVIMMLLHAIAGIFFGE

SEQ ID NO: 1898951 - protein, 20 aa, Staphylococcus
ILVQIFLISMLFTESAYQFA

SEQ ID NO: 1898952 - protein, 20 aa, Staphylococcus
ILVQLFLISMLFTESAYQFA

SEQ ID NO: 1898953 - protein, 26 aa, Staphylococcus
ILVTAFLTFLFVGPLTRQLGYWLSDG

SEQ ID NO: 1898954 - protein, 29 aa, Staphylococcus
ILVVIIAPFFSYLVKFFPPVVTGSVVTII

SEQ ID NO: 1898955 - protein, 20 aa, Staphylococcus
ILVVLFIFRQTRLETPLLDF

SEQ ID NO: 1898956 - protein, 18 aa, Staphylococcus
ILYFEIITTIAIGLGIIF

SEQ ID NO: 1898957 - protein, 19 aa, Staphylococcus
ILYITVVGILLFGIGSFMS

SEQ ID NO: 1898958 - protein, 26 aa, Staphylococcus
ILYKRILFTCFILIIYILGSNISIVG

SEQ ID NO: 1898959 - protein, 18 aa, Staphylococcus
ILYKRILFTCFILIVYIF

SEQ ID NO: 1898960 - protein, 17 aa, Staphylococcus
ILYLFWDSKKLLKNEGS

SEQ ID NO: 1898961 - protein, 17 aa, Staphylococcus
ILYQVRIPRTLQALLAG

SEQ ID NO: 1898962 - protein, 26 aa, Staphylococcus
ILYSLIAYILWGTLPIYWSLLNDIGP

SEQ ID NO: 1898963 - protein, 25 aa, Staphylococcus
IMAITILFSSFFIVSIFVVDILYGI

SEQ ID NO: 1898964 - protein, 17 aa, Staphylococcus
IMAPLSFVLASLAIYWA

SEQ ID NO: 1898965 - protein, 28 aa, Staphylococcus
IMAVTAPFIPLFYIIFGLKTRDESKEQM

SEQ ID NO: 1898966 - protein, 18 aa, Staphylococcus
IMCVLIVPPLISFVWIAG

SEQ ID NO: 1898967 - protein, 18 aa, Staphylococcus
IMCVLIVPPLISFVWICG

SEQ ID NO: 1898968 - protein, 19 aa, Staphylococcus
IMFICITLIGLFSQWARTT

SEQ ID NO: 1898969 - protein, 17 aa, Staphylococcus
IMFISFIVFIGFDLIRP

SEQ ID NO: 1898970 - protein, 17 aa, Staphylococcus
IMFSVFIAFVFQDDSAI

SEQ ID NO: 1898971 - protein, 22 aa, Staphylococcus
IMFTSMFWFLPGLFVMLLAIIA

SEQ ID NO: 1898972 - protein, 25 aa, Staphylococcus
IMGAAIFVSLFFNIQRSYWIPLSAH

SEQ ID NO: 1898973 - protein, 21 aa, Staphylococcus
IMGFSIFMIIGGIITISEEGA

SEQ ID NO: 1898974 - protein, 23 aa, Staphylococcus
IMGLYLYLILLSSGGVLYLVNVM

SEQ ID NO: 1898975 - protein, 18 aa, Staphylococcus
IMGPLVGWLMKKVDQFLQ

SEQ ID NO: 1898976 - protein, 21 aa, Staphylococcus
IMIAASFWSLLQPSLDYGTNG

SEQ ID NO: 1898977 - protein, 24 aa, Staphylococcus
IMIFALGGVPPFSGFPGKVLIFQG

SEQ ID NO: 1898978 - protein, 19 aa, Staphylococcus
IMIIFIVLVSEVIPKAIAA

SEQ ID NO: 1898979 - protein, 18 aa, Staphylococcus
IMIIIFMVLIMTRKMSAL

SEQ ID NO: 1898980 - protein, 18 aa, Staphylococcus
IMIIVMQMSLHFIPAPED

SEQ ID NO: 1898981 - protein, 17 aa, Staphylococcus
IMIPITAFLIERYTSRQ

SEQ ID NO: 1898982 - protein, 18 aa, Staphylococcus
IMISASLVGIVQYGSIAA

SEQ ID NO: 1898983 - protein, 31 aa, Staphylococcus
IMITTVIVIIAFIFLALFAWKIYAERNYNNT

SEQ ID NO: 1898984 - protein, 29 aa, Staphylococcus
IMITVFFMIIIYFVFYILAIALGAHHNSS

SEQ ID NO: 1898985 - protein, 31 aa, Staphylococcus
IMKRDFWLIPLYIVLLNIVPFLLILPVWMYE

SEQ ID NO: 1898986 - protein, 26 aa, Staphylococcus
IMKTLTLFTVLLTLPTLVFSFFGMNV

SEQ ID NO: 1898987 - protein, 25 aa, Staphylococcus
IMKTLTMFTVLLTLPTLVFSFFGMN

SEQ ID NO: 1898988 - protein, 25 aa, Staphylococcus
IMLIVLMTLFIKSLRRFAGYIALLA

SEQ ID NO: 1898989 - protein, 19 aa, Staphylococcus
IMLKLMLAIAFFAVSLAIS

SEQ ID NO: 1898990 - protein, 17 aa, Staphylococcus
IMLLTIAIILGFGAIRI

SEQ ID NO: 1898991 - protein, 30 aa, Staphylococcus
IMLVVCLPLLLCLFIMIPRIKLLQVGDLKG

SEQ ID NO: 1898992 - protein, 19 aa, Staphylococcus
IMMMAYIMSLVLYLMTLSS

SEQ ID NO: 1898993 - protein, 19 aa, Staphylococcus
IMMSILVFIFGFAAAKNRV

SEQ ID NO: 1898994 - protein, 19 aa, Staphylococcus
IMMTHVAVFILFFGLNIIS

SEQ ID NO: 1898995 - protein, 26 aa, Staphylococcus
IMPNSILLFGFIFLIGLFSQCARTTN

SEQ ID NO: 1898996 - protein, 23 aa, Staphylococcus
IMQALLRILFYMSPILWIPKDTG

SEQ ID NO: 1898997 - protein, 23 aa, Staphylococcus
IMQALLRILFYMSPILWVPKDSG

SEQ ID NO: 1898998 - protein, 20 aa, Staphylococcus
IMQILTLVSVIFSPLTFIAG

SEQ ID NO: 1898999 - protein, 33 aa, Staphylococcus
IMRMIFPVVRVFVAILRPITLLLDAITKGLNRL

SEQ ID NO: 1899000 - protein, 19 aa, Staphylococcus
IMSFFTTLIIYFPDSLNLG

SEQ ID NO: 1899001 - protein, 18 aa, Staphylococcus
IMSIILSVLGFGGLLYGT

SEQ ID NO: 1899002 - protein, 17 aa, Staphylococcus
IMSLILSFLLWYSTRNW

SEQ ID NO: 1899003 - protein, 29 aa, Staphylococcus
IMSSTLVTIIVFLPLVFVAGSVGEMFRPF

SEQ ID NO: 1899004 - protein, 29 aa, Staphylococcus
IMSSTLVTIVVFLPLVFVSGSVGEMFRPF

SEQ ID NO: 1899005 - protein, 24 aa, Staphylococcus
IMSVLMNILFYIVLYDDFFDIGLK

SEQ ID NO: 1899006 - protein, 34 aa, Staphylococcus
IMTAFFCTFLAIVLLFVWPPVFNAIVTFGKWIVG

SEQ ID NO: 1899007 - protein, 24 aa, Staphylococcus
IMVFNVFFILCLVSMFITVITIIL

SEQ ID NO: 1899008 - protein, 21 aa, Staphylococcus
IMVSWIWFISLAILGKTLGSI

SEQ ID NO: 1899009 - protein, 17 aa, Staphylococcus
IMVWGVMTQGWWLPVMA

SEQ ID NO: 1899010 - protein, 19 aa, Staphylococcus
IMWINFFIIWVSHFLFHWQ

SEQ ID NO: 1899011 - protein, 31 aa, Staphylococcus
INAMNSLMVIVLLFAALVIFSVKKLAVELVA

SEQ ID NO: 1899012 - protein, 27 aa, Staphylococcus
INAPVSKYLPWFKTSKKITLKDLELHK

SEQ ID NO: 1899013 - protein, 25 aa, Staphylococcus
INAWLLVIFFMLQSGLFYGVATWLV

SEQ ID NO: 1899014 - protein, 18 aa, Staphylococcus
INDFIFAIIAGAGAFLTF

SEQ ID NO: 1899015 - protein, 26 aa, Staphylococcus
INEHEFNIQLPLIKKFILKMTRHNHD

SEQ ID NO: 1899016 - protein, 17 aa, Staphylococcus
INFIKYFGYTLTQENHQ

SEQ ID NO: 1899017 - protein, 19 aa, Staphylococcus
INFLLLIGIMLVAANLRAP

SEQ ID NO: 1899018 - protein, 25 aa, Staphylococcus
INFSLMARYYLMLKGISFSLDFLLQ

SEQ ID NO: 1899019 - protein, 22 aa, Staphylococcus
INFVVRVKLDKSFRIPLRMYMM

SEQ ID NO: 1899020 - protein, 26 aa, Staphylococcus
INGINPEVVTKPNAINSIDNLATQLK

SEQ ID NO: 1899021 - protein, 20 aa, Staphylococcus
INGWILPITLGAILIASRKK

SEQ ID NO: 1899022 - protein, 20 aa, Staphylococcus
INGWILPITLSVILIASRKK

SEQ ID NO: 1899023 - protein, 25 aa, Staphylococcus
INGYPFLHNYYIDGLIGIVVFFLIF

SEQ ID NO: 1899024 - protein, 26 aa, Staphylococcus
INHFDRLFFIILAFSLHSAAYLSEVF

SEQ ID NO: 1899025 - protein, 25 aa, Staphylococcus
INHFSRLFFVILAFTLHTGAYLSEI

SEQ ID NO: 1899026 - protein, 26 aa, Staphylococcus
INHGKYVHLTYQRSFLPGTHPPKVEV

SEQ ID NO: 1899027 - protein, 17 aa, Staphylococcus
INHLFLFAMTFLMALVQ

SEQ ID NO: 1899028 - protein, 22 aa, Staphylococcus
INHPLFIPMMLMILLGAFTKSA

SEQ ID NO: 1899029 - protein, 26 aa, Staphylococcus
INIAKALVEKLLNQALAQINQDKTTN

SEQ ID NO: 1899030 - protein, 26 aa, Staphylococcus
INIDSKLILQVLFNLIDNALKHAESH

SEQ ID NO: 1899031 - protein, 23 aa, Staphylococcus
INIFFAILFQSILLFLIRFFWLD

SEQ ID NO: 1899032 - protein, 25 aa, Staphylococcus
INIGWALLLRVIVIGMSFLMMAITG

SEQ ID NO: 1899033 - protein, 24 aa, Staphylococcus
INIPKWIQFLFITIVAMVISASMR

SEQ ID NO: 1899034 - protein, 25 aa, Staphylococcus
INIPKWIQFLFIVIVAMVISASMRV

SEQ ID NO: 1899035 - protein, 20 aa, Staphylococcus
INISQVIGGMIWTGPGEGDV

SEQ ID NO: 1899036 - protein, 26 aa, Staphylococcus
INKEIQPIMPLLRKIQLKYRQQAQDL

SEQ ID NO: 1899037 - protein, 25 aa, Staphylococcus
INKIEQVNIVPVIKPNARQTINEKA

SEQ ID NO: 1899038 - protein, 18 aa, Staphylococcus
INKLNKWAFFACTMIGLL

SEQ ID NO: 1899039 - protein, 36 aa, Staphylococcus
INKNRIAMGVILIIGGLLNFILMGGFGILSGILILV

SEQ ID NO: 1899040 - protein, 24 aa, Staphylococcus
INKQIIWIFSIPVIVAIIHTLVAS

SEQ ID NO: 1899041 - protein, 28 aa, Staphylococcus
INKSLLATMFASLGSVLLFGRRRRDGQN

SEQ ID NO: 1899042 - protein, 22 aa, Staphylococcus
INLILFCIFTFLANNRNYFMVN

SEQ ID NO: 1899043 - protein, 23 aa, Staphylococcus
INLLKAYLFVCLPLVILAAFTET

SEQ ID NO: 1899044 - protein, 17 aa, Staphylococcus
INLWKGIRQGLLMIIPT

SEQ ID NO: 1899045 - protein, 18 aa, Staphylococcus
INMPSIEGMGFAIPINEG

SEQ ID NO: 1899046 - protein, 24 aa, Staphylococcus
INNKYYVIIMSYVERIQQDGRSGI

SEQ ID NO: 1899047 - protein, 20 aa, Staphylococcus
INNSVWFVLSILASIFMKPK

SEQ ID NO: 1899048 - protein, 19 aa, Staphylococcus
INQDLWIVKSGDGYLIADM

SEQ ID NO: 1899049 - protein, 21 aa, Staphylococcus
INQLLPYKSPLYPLGPILVFA

SEQ ID NO: 1899050 - protein, 19 aa, Staphylococcus
INQYYSLLRMLRSHSRKDF

SEQ ID NO: 1899051 - protein, 20 aa, Staphylococcus
INRKFLIITALFMGAISFSI

SEQ ID NO: 1899052 - protein, 20 aa, Staphylococcus
INRKFLIITALFMGAVSFSI

SEQ ID NO: 1899053 - protein, 23 aa, Staphylococcus
INRSYLSPFLIGGLLILIVTLCR

SEQ ID NO: 1899054 - protein, 18 aa, Staphylococcus
INRWMLVGLFACGGASLL

SEQ ID NO: 1899055 - protein, 24 aa, Staphylococcus
INSMILLCILFIEKVLGYPIGLNF

SEQ ID NO: 1899056 - protein, 21 aa, Staphylococcus
INTFDLDYIERLIIDIAKKEL

SEQ ID NO: 1899057 - protein, 23 aa, Staphylococcus
INTFDLDYIERLIIEIANKELKL

SEQ ID NO: 1899058 - protein, 28 aa, Staphylococcus
INTHIKDVKIIITGGLGSTIISVSGLPK

SEQ ID NO: 1899059 - protein, 17 aa, Staphylococcus
INTLVIIVGWKFLSTRT

SEQ ID NO: 1899060 - protein, 25 aa, Staphylococcus
INTLWSSLFWVVLGGFFTLVLNKDK

SEQ ID NO: 1899061 - protein, 27 aa, Staphylococcus
INTSMDWDRKYPYGDLLRGLYGDVSTT

SEQ ID NO: 1899062 - protein, 21 aa, Staphylococcus
INVIKFYVLIALPLIIIAAFL

SEQ ID NO: 1899063 - protein, 29 aa, Staphylococcus
INVNWVGWLLFFGIVFFSGSLYILALTQI

SEQ ID NO: 1899064 - protein, 23 aa, Staphylococcus
INWGLAGIGIMSGLLFYKRQQSQ

SEQ ID NO: 1899065 - protein, 25 aa, Staphylococcus
INWSGFVSLLLLLIFYTCLGILAGL

SEQ ID NO: 1899066 - protein, 23 aa, Staphylococcus
INYILVIGIFIIVAIVGALLSFI

SEQ ID NO: 1899067 - protein, 23 aa, Staphylococcus
IPAAILAIVFDLALRYIQKLSYK

SEQ ID NO: 1899068 - protein, 24 aa, Staphylococcus
IPAILAIIMWFFVKPDQPLVIDEH

SEQ ID NO: 1899069 - protein, 17 aa, Staphylococcus
IPAILISISTILSLFIT

SEQ ID NO: 1899070 - protein, 24 aa, Staphylococcus
IPALVIIACLLFRFSTVPAMLVSS

SEQ ID NO: 1899071 - protein, 29 aa, Staphylococcus
IPALVLSLLILFFYLFSDGLRDAFDPKMR

SEQ ID NO: 1899072 - protein, 26 aa, Staphylococcus
IPASIIGLIVWFFAGLKYQSHTNPKQ

SEQ ID NO: 1899073 - protein, 21 aa, Staphylococcus
IPASIIGLIVWFFAGLNSQGN

SEQ ID NO: 1899074 - protein, 29 aa, Staphylococcus
IPATILSLLILFFYLFSDGLRDAFDPKMR

SEQ ID NO: 1899075 - protein, 20 aa, Staphylococcus
IPAVIAVILWFFVAPDKPLL

SEQ ID NO: 1899076 - protein, 25 aa, Staphylococcus
IPCKPDHPFVYWATLKNAASLLDAG

SEQ ID NO: 1899077 - protein, 18 aa, Staphylococcus
IPEAWIHPFTIGGAFVIA

SEQ ID NO: 1899078 - protein, 26 aa, Staphylococcus
IPEEKILIALLLYRFAYYFVPVIIAL

SEQ ID NO: 1899079 - protein, 29 aa, Staphylococcus
IPEEQILLALLLYRFAYYFVPVVVALLLS

SEQ ID NO: 1899080 - protein, 24 aa, Staphylococcus
IPFELCLLLRLFKPRKKYEWPLFI

SEQ ID NO: 1899081 - protein, 20 aa, Staphylococcus
IPFISRFIEQVFGPLFHKIG

SEQ ID NO: 1899082 - protein, 19 aa, Staphylococcus
IPFLGPWLSFAPAAILGII

SEQ ID NO: 1899083 - protein, 18 aa, Staphylococcus
IPFLGPWMSFAPAAIIGI

SEQ ID NO: 1899084 - protein, 17 aa, Staphylococcus
IPFVFLSFIFTSLFYND

SEQ ID NO: 1899085 - protein, 19 aa, Staphylococcus
IPFYVYIVDIILTVLCAEA

SEQ ID NO: 1899086 - protein, 30 aa, Staphylococcus
IPGAVIILLWLIIYIALDNLPFGNIHDLIV

SEQ ID NO: 1899087 - protein, 25 aa, Staphylococcus
IPGLIAFLAFWAINFAIGIGGGSTL

SEQ ID NO: 1899088 - protein, 20 aa, Staphylococcus
IPIAACGLLAPWVAGAAMAL

SEQ ID NO: 1899089 - protein, 17 aa, Staphylococcus
IPIALIAILIDLGLRFL

SEQ ID NO: 1899090 - protein, 21 aa, Staphylococcus
IPIIATLFVPLGESLGLSTMA

SEQ ID NO: 1899091 - protein, 27 aa, Staphylococcus
IPIIIIYLILALLFIFLGYQLLAGAIN

SEQ ID NO: 1899092 - protein, 21 aa, Staphylococcus
IPILMNKIHIDPAVASGPFIT

SEQ ID NO: 1899093 - protein, 22 aa, Staphylococcus
IPIQRLIKLLGDIFIPILPAIV

SEQ ID NO: 1899094 - protein, 19 aa, Staphylococcus
IPIVLLFLGVFDRFGKDEI

SEQ ID NO: 1899095 - protein, 20 aa, Staphylococcus
IPIYVYLLDIILTIALAELS

SEQ ID NO: 1899096 - protein, 28 aa, Staphylococcus
IPKKAIFLLPFSLIIIYVAMFGIGSFLI

SEQ ID NO: 1899097 - protein, 18 aa, Staphylococcus
IPLFILLCFPFTPNTLIN

SEQ ID NO: 1899098 - protein, 23 aa, Staphylococcus
IPLISIIITIIFYLGFTTLLYKI

SEQ ID NO: 1899099 - protein, 22 aa, Staphylococcus
IPLLIAFYVPFFKKLKVTSAYE

SEQ ID NO: 1899100 - protein, 19 aa, Staphylococcus
IPLLMNKINIDPAVASGPF

SEQ ID NO: 1899101 - protein, 25 aa, Staphylococcus
IPLLSPFVLFLRASTPELQLWEIIV

SEQ ID NO: 1899102 - protein, 24 aa, Staphylococcus
IPLSWILGLQHFFIKPLMLVFVVS

SEQ ID NO: 1899103 - protein, 29 aa, Staphylococcus
IPLTSRRFIQWLNTLNIVPGYYGINSIDM

SEQ ID NO: 1899104 - protein, 25 aa, Staphylococcus
IPMFFEVGLIMLLPLIFTIAKKLED

SEQ ID NO: 1899105 - protein, 27 aa, Staphylococcus
IPMFIIILILVVFAILFIVNETHLFDD

SEQ ID NO: 1899106 - protein, 23 aa, Staphylococcus
IPNKPDHIFVYWATITSVAQLIR

SEQ ID NO: 1899107 - protein, 26 aa, Staphylococcus
IPNLIIVILFVLIFEPSIWTIILAMS

SEQ ID NO: 1899108 - protein, 23 aa, Staphylococcus
IPRVHELLTPLVSVVTLQLISYY

SEQ ID NO: 1899109 - protein, 39 aa, Staphylococcus
IPSLALLGLMIPLFGIGRLPAIIALVVYALLPILRNTYT

SEQ ID NO: 1899110 - protein, 17 aa, Staphylococcus
IPTFYLHGYAGTGNSMK

SEQ ID NO: 1899111 - protein, 27 aa, Staphylococcus
IPTLIIVILFVLIFEPSIWTIILAMTV

SEQ ID NO: 1899112 - protein, 19 aa, Staphylococcus
IPTMFFFTGLIIGIIPYLL

SEQ ID NO: 1899113 - protein, 22 aa, Staphylococcus
IPTVFILIALTWAYLRYVAFKH

SEQ ID NO: 1899114 - protein, 24 aa, Staphylococcus
IPTWVFVIVLIVITLFFVVKTLRK

SEQ ID NO: 1899115 - protein, 22 aa, Staphylococcus
IPVAIITLILVWIKNILLDRYF

SEQ ID NO: 1899116 - protein, 20 aa, Staphylococcus
IPVFFIRRWFDNKTTIASAF

SEQ ID NO: 1899117 - protein, 19 aa, Staphylococcus
IPVFIIKRWFDLKTTIASG

SEQ ID NO: 1899118 - protein, 33 aa, Staphylococcus
IPVHDYLLFLTFVPLLFLGRYTNVFFTMVSAAI

SEQ ID NO: 1899119 - protein, 20 aa, Staphylococcus
IPVLFIRRWFDTKTTIASAF

SEQ ID NO: 1899120 - protein, 26 aa, Staphylococcus
IPVWKLVFIWFIRVALTLLIAIPFAL

SEQ ID NO: 1899121 - protein, 26 aa, Staphylococcus
IPYHFFFLVWIGIAALLLYIFRPHIA

SEQ ID NO: 1899122 - protein, 29 aa, Staphylococcus
IQFALFYSALVLFFLIIAHSYWSIMLISF

SEQ ID NO: 1899123 - protein, 17 aa, Staphylococcus
IQGFVEGFSSLPGWVRK

SEQ ID NO: 1899124 - protein, 22 aa, Staphylococcus
IQGLIPVIAGLVPALMAVLNAV

SEQ ID NO: 1899125 - protein, 25 aa, Staphylococcus
IQHVLWFFVAVIIGSLITMFTVLLF

SEQ ID NO: 1899126 - protein, 31 aa, Staphylococcus
IQIALGVCLFILPIPIHFKFDSEVFMFAVIA

SEQ ID NO: 1899127 - protein, 25 aa, Staphylococcus
IQIFALICMLILTLALLVLSIISIV

SEQ ID NO: 1899128 - protein, 30 aa, Staphylococcus
IQIFGHIFTLWTAILWVIVGTFLAVFVNRD

SEQ ID NO: 1899129 - protein, 44 aa, Staphylococcus
IQKAEYITLLFAKPIIFFYKIMYPFIWLLNGAARLILKIFNMKP

SEQ ID NO: 1899130 - protein, 43 aa, Staphylococcus
IQKAEYITLLFAKPIIFFYKLMYPFIWLLNGAARLILKMFNMK

SEQ ID NO: 1899131 - protein, 31 aa, Staphylococcus
IQKKFNNIFQRLVSFFTLGFKFNQFVIYDHN

SEQ ID NO: 1899132 - protein, 18 aa, Staphylococcus
IQLFLNNEYQFLTSDEVA

SEQ ID NO: 1899133 - protein, 22 aa, Staphylococcus
IQLIISFVALLLIVFGHGSNSD

SEQ ID NO: 1899134 - protein, 17 aa, Staphylococcus
IQLKWSAPIIIVTVILI

SEQ ID NO: 1899135 - protein, 39 aa, Staphylococcus
IQLLTKWKTHIIILIAVVLLFIVILMLMKNNETSEHMTT

SEQ ID NO: 1899136 - protein, 24 aa, Staphylococcus
IQLNLIWVLIIALIYIIIHTYRYK

SEQ ID NO: 1899137 - protein, 17 aa, Staphylococcus
IQMPVVMGLYFVLRYRI

SEQ ID NO: 1899138 - protein, 19 aa, Staphylococcus
IQNKLFSSDKYYPIYGSSE

SEQ ID NO: 1899139 - protein, 17 aa, Staphylococcus
IQPFTIGGAFVIATFLH

SEQ ID NO: 1899140 - protein, 18 aa, Staphylococcus
IQQFVISFGFLLPVSAPQ

SEQ ID NO: 1899141 - protein, 28 aa, Staphylococcus
IQQLGMYFFIVLLGLGIHFFVVYGAAVK

SEQ ID NO: 1899142 - protein, 21 aa, Staphylococcus
IQSFIYWFLAIIAINYTLAFV

SEQ ID NO: 1899143 - protein, 26 aa, Staphylococcus
IQSKKEEIYRRLLASNLTSVPERFVI

SEQ ID NO: 1899144 - protein, 25 aa, Staphylococcus
IQSKKEEVYRRLLASNLTSVPERFI

SEQ ID NO: 1899145 - protein, 18 aa, Staphylococcus
IQSPYFIPDQAFIDAIKI

SEQ ID NO: 1899146 - protein, 18 aa, Staphylococcus
IQSPYFIPDQAFLDSIKI

SEQ ID NO: 1899147 - protein, 17 aa, Staphylococcus
IQTICVLLGIWVYNLDK

SEQ ID NO: 1899148 - protein, 27 aa, Staphylococcus
IQVPFLNFIPFILWGAMGWATQAPQQH

SEQ ID NO: 1899149 - protein, 18 aa, Staphylococcus
IQVSNYVAWISHGQLRME

SEQ ID NO: 1899150 - protein, 26 aa, Staphylococcus
IQWTQLLIAILIFALSQLIVILWQVA

SEQ ID NO: 1899151 - protein, 26 aa, Staphylococcus
IQYSIVRFIILMLIAILGMTGWLLYA

SEQ ID NO: 1899152 - protein, 18 aa, Staphylococcus
IQYWSPMQGIPAWVWSCI

SEQ ID NO: 1899153 - protein, 19 aa, Staphylococcus
IQYWTPMAGIPAWLWSCIF

SEQ ID NO: 1899154 - protein, 18 aa, Staphylococcus
IQYWTPMAGIPAWVWSCI

SEQ ID NO: 1899155 - protein, 17 aa, Staphylococcus
IQYYIYFLILLGVLSII

SEQ ID NO: 1899156 - protein, 17 aa, Staphylococcus
IQYYYPSIFALEEISFM

SEQ ID NO: 1899157 - protein, 17 aa, Staphylococcus
IRAIFALIILLVALAEG

SEQ ID NO: 1899158 - protein, 23 aa, Staphylococcus
IRDEEWLQKKLNYIDKSTYKGIY

SEQ ID NO: 1899159 - protein, 17 aa, Staphylococcus
IRFLKIAGVSVVLILIF

SEQ ID NO: 1899160 - protein, 24 aa, Staphylococcus
IRGFGYPLFAYSFLVWVAYRSPKE

SEQ ID NO: 1899161 - protein, 18 aa, Staphylococcus
IRHLMLATILLLIIPNSV

SEQ ID NO: 1899162 - protein, 21 aa, Staphylococcus
IRHPIIFLPITCTAAVSGLVG

SEQ ID NO: 1899163 - protein, 24 aa, Staphylococcus
IRIFTYTIFLFAIATALLSIAHNI

SEQ ID NO: 1899164 - protein, 17 aa, Staphylococcus
IRIGMIGIPIFFIIICS

SEQ ID NO: 1899165 - protein, 20 aa, Staphylococcus
IRITLLIMLFVQTVVLFTFV

SEQ ID NO: 1899166 - protein, 17 aa, Staphylococcus
IRKIVLDLRNNPGGLLD

SEQ ID NO: 1899167 - protein, 27 aa, Staphylococcus
IRKQWLQYVLLLIIIGAALSLLYAGQK

SEQ ID NO: 1899168 - protein, 30 aa, Staphylococcus
IRLAISIGIALFIFAVVRPPIEYARQYLAQ

SEQ ID NO: 1899169 - protein, 23 aa, Staphylococcus
IRLLIYLIIISFVLFLLLENTTG

SEQ ID NO: 1899170 - protein, 30 aa, Staphylococcus
IRLTSARFIKWLTLLNIVPGYYGINSIDLM

SEQ ID NO: 1899171 - protein, 22 aa, Staphylococcus
IRPYVLVITIVAIFATFLVQTF

SEQ ID NO: 1899172 - protein, 30 aa, Staphylococcus
IRQNPKWLVKLIIFIVLTFVSMALALNITD

SEQ ID NO: 1899173 - protein, 22 aa, Staphylococcus
IRQSFNIPALKTWQATRSQAGN

SEQ ID NO: 1899174 - protein, 21 aa, Staphylococcus
IRRIQIHIETWDRTALEEQEA

SEQ ID NO: 1899175 - protein, 24 aa, Staphylococcus
IRSILWEHIIKLKMPFFDKNESGQ

SEQ ID NO: 1899176 - protein, 22 aa, Staphylococcus
IRSMWITLIMLVVVLSVLNIIN

SEQ ID NO: 1899177 - protein, 25 aa, Staphylococcus
IRSVLWRHIIHLKMPFFDQNESGQL

SEQ ID NO: 1899178 - protein, 31 aa, Staphylococcus
IRSWGQFLYLTWFLTYLGFLAGALGASVENE

SEQ ID NO: 1899179 - protein, 34 aa, Staphylococcus
IRTLNPIFVFIFSFPFFPLPLTPKFITGAILIII

SEQ ID NO: 1899180 - protein, 24 aa, Staphylococcus
IRTTTFAILILFIINFNNTADKTG

SEQ ID NO: 1899181 - protein, 24 aa, Staphylococcus
IRTTTFAILILFIINFRNDTNSTT

SEQ ID NO: 1899182 - protein, 18 aa, Staphylococcus
IRVIGSLLFVIFHLGRIA

SEQ ID NO: 1899183 - protein, 19 aa, Staphylococcus
IRVLIYIFISVILGTVFAF

SEQ ID NO: 1899184 - protein, 27 aa, Staphylococcus
IRVVLPLIIILILFTILYSVAPNVKTK

SEQ ID NO: 1899185 - protein, 20 aa, Staphylococcus
ISAFLFNKYSYRKLFLIALL

SEQ ID NO: 1899186 - protein, 26 aa, Staphylococcus
ISAIFLGVILFYIWPTVQSGIFNAGG

SEQ ID NO: 1899187 - protein, 17 aa, Staphylococcus
ISAIILNFFFNGIKYKQ

SEQ ID NO: 1899188 - protein, 24 aa, Staphylococcus
ISAIIWNLVTWFYGIPSSSSHALI

SEQ ID NO: 1899189 - protein, 25 aa, Staphylococcus
ISALIYCIVIYFFVRLMIEKGLKQR

SEQ ID NO: 1899190 - protein, 27 aa, Staphylococcus
ISASSWHYIFWISAVLYLVVLGLAFTN

SEQ ID NO: 1899191 - protein, 23 aa, Staphylococcus
ISAVLLTIIYFSLAYLGITTSKP

SEQ ID NO: 1899192 - protein, 23 aa, Staphylococcus
ISAVVILLIVAGIGFGAYKIFSN

SEQ ID NO: 1899193 - protein, 22 aa, Staphylococcus
ISCLTYFIVTFGISRWVILYGR

SEQ ID NO: 1899194 - protein, 26 aa, Staphylococcus
ISCVVFIVFFMNLYHNAQMEQTYEIT

SEQ ID NO: 1899195 - protein, 23 aa, Staphylococcus
ISCYFYDFFKKNHKIRMLGFYTL

SEQ ID NO: 1899196 - protein, 25 aa, Staphylococcus
ISDWLGFKFMYLLCASFVVIAMVSS

SEQ ID NO: 1899197 - protein, 26 aa, Staphylococcus
ISFCSTLLFSILFNAPRKLLPACGFV

SEQ ID NO: 1899198 - protein, 34 aa, Staphylococcus
ISFDPFTPLIVAAVLYFILTFALSRIMSLVEGRM

SEQ ID NO: 1899199 - protein, 35 aa, Staphylococcus
ISFDPFTPLLVAAGMYFILTFALSRIMNFIEGRMK

SEQ ID NO: 1899200 - protein, 48 aa, Staphylococcus
ISFFTSITFSTLFLFVLNELMWFDMTQTLLLTLFSLISSMVTMMIAMT

SEQ ID NO: 1899201 - protein, 24 aa, Staphylococcus
ISFIPLFIIGVIFWSIQEQGSNVL

SEQ ID NO: 1899202 - protein, 23 aa, Staphylococcus
ISFIPLFLLGVVFWSIQEQGANV

SEQ ID NO: 1899203 - protein, 24 aa, Staphylococcus
ISFLTLFLNFIILLISIVCIMLGI

SEQ ID NO: 1899204 - protein, 24 aa, Staphylococcus
ISFSLLFYIFYKMHQHYIIPIVLE

SEQ ID NO: 1899205 - protein, 21 aa, Staphylococcus
ISFVYLLFLIGMISSILNAKL

SEQ ID NO: 1899206 - protein, 25 aa, Staphylococcus
ISFWLFFAGMILFNLSFIIGGSPAA

SEQ ID NO: 1899207 - protein, 28 aa, Staphylococcus
ISGGIILLFLIYLLILQLNNALTLENFS

SEQ ID NO: 1899208 - protein, 37 aa, Staphylococcus
ISGIFVPTVLIIALIVFIVWFSLITPLDFQSSLEVFI

SEQ ID NO: 1899209 - protein, 25 aa, Staphylococcus
ISGIIGFLILFFLAPDIAALTLGRK

SEQ ID NO: 1899210 - protein, 24 aa, Staphylococcus
ISGIIGFLILFYLAPDIAVITLGQ

SEQ ID NO: 1899211 - protein, 21 aa, Staphylococcus
ISGIPTTLGTYPIEVMSKDNE

SEQ ID NO: 1899212 - protein, 24 aa, Staphylococcus
ISGLLLIYIGYYYKANRNIFWLLL

SEQ ID NO: 1899213 - protein, 18 aa, Staphylococcus
ISGWLYETFGAKVLAIIG

SEQ ID NO: 1899214 - protein, 25 aa, Staphylococcus
ISHVFMPILMYLGIPNELSPGILFS

SEQ ID NO: 1899215 - protein, 19 aa, Staphylococcus
ISIFFILTILPKSNDYRLT

SEQ ID NO: 1899216 - protein, 21 aa, Staphylococcus
ISIFFLIIGILFFIITIILMT

SEQ ID NO: 1899217 - protein, 24 aa, Staphylococcus
ISIFFLIIGILYFLISITLMTQVY

SEQ ID NO: 1899218 - protein, 37 aa, Staphylococcus
ISIFGILYSLFDKFIWKWKILHKLGIIKIPNLNGKWK

SEQ ID NO: 1899219 - protein, 26 aa, Staphylococcus
ISIGNFFMCLFGLLFILYANRFIMRR

SEQ ID NO: 1899220 - protein, 29 aa, Staphylococcus
ISIIAAILVLFIIALIVKNATGESDDKNT

SEQ ID NO: 1899221 - protein, 21 aa, Staphylococcus
ISIIAHFWWIQALGAIYLLYM

SEQ ID NO: 1899222 - protein, 20 aa, Staphylococcus
ISIIANFWWIQAAGAIYLIY

SEQ ID NO: 1899223 - protein, 24 aa, Staphylococcus
ISIIAVLGMLLWIMMSHDLWESVK

SEQ ID NO: 1899224 - protein, 25 aa, Staphylococcus
ISIIFILFGMPIYLVAFTFCLVIAA

SEQ ID NO: 1899225 - protein, 27 aa, Staphylococcus
ISIIFSFFVLLLLLPLILAYVIAIPIM

SEQ ID NO: 1899226 - protein, 26 aa, Staphylococcus
ISIIIAIIIVLLIQAFVITGSVVKDN

SEQ ID NO: 1899227 - protein, 31 aa, Staphylococcus
ISIIIFILLIISVVIFKYILRDHKQQHSGYD

SEQ ID NO: 1899228 - protein, 31 aa, Staphylococcus
ISIILAIIFVMFIQIFLLRSAIVHTNEMAPT

SEQ ID NO: 1899229 - protein, 19 aa, Staphylococcus
ISIILIIFGVPIYLVTLIF

SEQ ID NO: 1899230 - protein, 19 aa, Staphylococcus
ISIKAFPLALGALYLPVLF

SEQ ID NO: 1899231 - protein, 24 aa, Staphylococcus
ISILFGEFFGWIVGWALIAEYLIA

SEQ ID NO: 1899232 - protein, 23 aa, Staphylococcus
ISILFIVISLLVVLGLTIYKNEK

SEQ ID NO: 1899233 - protein, 25 aa, Staphylococcus
ISILKLILILMLIIGILGLKLTTDI

SEQ ID NO: 1899234 - protein, 24 aa, Staphylococcus
ISILLFVLCTCILSIFLVMIVVPF

SEQ ID NO: 1899235 - protein, 31 aa, Staphylococcus
ISILLVILYVPIFFLMFYSFNSGGNMIHFEH

SEQ ID NO: 1899236 - protein, 17 aa, Staphylococcus
ISILLYQTILGSIPKFA

SEQ ID NO: 1899237 - protein, 33 aa, Staphylococcus
ISIPTYLFVISTLLIIYLLPRVFNKVPAPLVAI

SEQ ID NO: 1899238 - protein, 28 aa, Staphylococcus
ISIQSKYWYIYIPVILLAMILPAVLTMI

SEQ ID NO: 1899239 - protein, 22 aa, Staphylococcus
ISIRPLVMSIWLFIFIVILLIQ

SEQ ID NO: 1899240 - protein, 21 aa, Staphylococcus
ISISKPVKATKLIVKSHKKEA

SEQ ID NO: 1899241 - protein, 38 aa, Staphylococcus
ISISLFFLLILLIFIKKLKLPIILLIVVCPFFSNYITQ

SEQ ID NO: 1899242 - protein, 24 aa, Staphylococcus
ISISLLLIMYLLRAIGDVSAEGLS

SEQ ID NO: 1899243 - protein, 27 aa, Staphylococcus
ISIVSIPLSILIALIALKLSDVSLNIL

SEQ ID NO: 1899244 - protein, 29 aa, Staphylococcus
ISIVSIPLSILIALIALKLSNVSLNILTL

SEQ ID NO: 1899245 - protein, 26 aa, Staphylococcus
ISIVSIPLSILIALVALKLTDVSLNI

SEQ ID NO: 1899246 - protein, 26 aa, Staphylococcus
ISIVVLLFILLLYKELFILSFDEEYS

SEQ ID NO: 1899247 - protein, 24 aa, Staphylococcus
ISIVVVLFITLFYKELFILSFDEE

SEQ ID NO: 1899248 - protein, 23 aa, Staphylococcus
ISIYLFFTILFLLKEKGTIKIKL

SEQ ID NO: 1899249 - protein, 33 aa, Staphylococcus
ISIYLGTVFIACTTYLALILIGSLQGNDMSNSV

SEQ ID NO: 1899250 - protein, 22 aa, Staphylococcus
ISKDYFLMVPLTFLIGADLLLL

SEQ ID NO: 1899251 - protein, 24 aa, Staphylococcus
ISKIEWLVIILLIALVLSFEAINT

SEQ ID NO: 1899252 - protein, 22 aa, Staphylococcus
ISKKTYQGIFSFDVLGLQDIHR

SEQ ID NO: 1899253 - protein, 22 aa, Staphylococcus
ISKKTYQGIFSFNVLGLQDIHR

SEQ ID NO: 1899254 - protein, 31 aa, Staphylococcus
ISKVEALQNIYLRVFYPPVVIGFTAIIAAVT

SEQ ID NO: 1899255 - protein, 25 aa, Staphylococcus
ISKVNMGILYILYTMQFIRIHRRVG

SEQ ID NO: 1899256 - protein, 26 aa, Staphylococcus
ISLDPNIFMPLLKKLKQNNDYVVVNV

SEQ ID NO: 1899257 - protein, 21 aa, Staphylococcus
ISLFNDLKRWISQYESKKEKK

SEQ ID NO: 1899258 - protein, 17 aa, Staphylococcus
ISLFYCIVIFPITIILY

SEQ ID NO: 1899259 - protein, 21 aa, Staphylococcus
ISLGLIVLAFFIVPLAVAYAL

SEQ ID NO: 1899260 - protein, 27 aa, Staphylococcus
ISLIFAIIIVLFIQTFIVVGAVIPNHD

SEQ ID NO: 1899261 - protein, 27 aa, Staphylococcus
ISLIFAIIIVLFIQTFLIRGAIVTDDN

SEQ ID NO: 1899262 - protein, 18 aa, Staphylococcus
ISLIFLVAFSSKAALVIF

SEQ ID NO: 1899263 - protein, 24 aa, Staphylococcus
ISLITLFFVLFTGLIFAFGLKLEN

SEQ ID NO: 1899264 - protein, 18 aa, Staphylococcus
ISLKQQLPYIPKQRLYTL

SEQ ID NO: 1899265 - protein, 20 aa, Staphylococcus
ISLKQQLPYIPKQRLYTLTA

SEQ ID NO: 1899266 - protein, 20 aa, Staphylococcus
ISLLIFVCLLYFVAIKRLTL

SEQ ID NO: 1899267 - protein, 18 aa, Staphylococcus
ISLLISIWGFTNGVTSFL

SEQ ID NO: 1899268 - protein, 20 aa, Staphylococcus
ISLLTFMFDIPNFTLTLAVM

SEQ ID NO: 1899269 - protein, 24 aa, Staphylococcus
ISLNLLFNIPLIVGALITVCDVFL

SEQ ID NO: 1899270 - protein, 29 aa, Staphylococcus
ISLSVIMLVIAVVLIIMMFTSGQKETYYG

SEQ ID NO: 1899271 - protein, 21 aa, Staphylococcus
ISMIFLLFTLAFNRNSIFDYI

SEQ ID NO: 1899272 - protein, 19 aa, Staphylococcus
ISMIGVVISLYFILRRLFA

SEQ ID NO: 1899273 - protein, 19 aa, Staphylococcus
ISNPLLVYMEPYASSTAEL

SEQ ID NO: 1899274 - protein, 17 aa, Staphylococcus
ISPVKHLLAKILAIILV

SEQ ID NO: 1899275 - protein, 23 aa, Staphylococcus
ISPVWFILLGFMYWRYTQQVKKH

SEQ ID NO: 1899276 - protein, 26 aa, Staphylococcus
ISQKPYWKLLLQSLFLICILFVAESM

SEQ ID NO: 1899277 - protein, 38 aa, Staphylococcus
ISQLQFEAWKYIVIIGMFILAVVFLIVRNINRTYIRPI

SEQ ID NO: 1899278 - protein, 25 aa, Staphylococcus
ISQVPWLVIILVSIVAMIVISQTAT

SEQ ID NO: 1899279 - protein, 28 aa, Staphylococcus
ISRDDFEFQMLFGFRTDLAYAIADDNYN

SEQ ID NO: 1899280 - protein, 27 aa, Staphylococcus
ISRFVSCILILILGSIIFSLLGQNAIV

SEQ ID NO: 1899281 - protein, 26 aa, Staphylococcus
ISRLVSCLLILFLGSAIFSLLGQHAL

SEQ ID NO: 1899282 - protein, 25 aa, Staphylococcus
ISSFKLILTRVLALIILSFLPILLF

SEQ ID NO: 1899283 - protein, 17 aa, Staphylococcus
ISSFVHTFIPKVPLAFI

SEQ ID NO: 1899284 - protein, 27 aa, Staphylococcus
ISSIDFLVFRLLLAGIFLLLYLSFSKK

SEQ ID NO: 1899285 - protein, 25 aa, Staphylococcus
ISSIDLFLGLRFIQGLLGGGAIVIA

SEQ ID NO: 1899286 - protein, 17 aa, Staphylococcus
ISSIFAALTTWLKGMQG

SEQ ID NO: 1899287 - protein, 17 aa, Staphylococcus
ISSIILMFGLKVPLLIA

SEQ ID NO: 1899288 - protein, 25 aa, Staphylococcus
ISSILIIAILLMFGVSYKGYMKGGK

SEQ ID NO: 1899289 - protein, 23 aa, Staphylococcus
ISSLIFFILLIIHNFIVLDATTV

SEQ ID NO: 1899290 - protein, 26 aa, Staphylococcus
ISSLPWLIMFFLILSAGAISDKILST

SEQ ID NO: 1899291 - protein, 36 aa, Staphylococcus
ISSMILFFSLPVLVIIFILSFIFLGKPVFFKQERAG

SEQ ID NO: 1899292 - protein, 23 aa, Staphylococcus
ISSQLIVFIPFPKTIAYDMKYAF

SEQ ID NO: 1899293 - protein, 25 aa, Staphylococcus
ISSVPWLVIILVSVVAMIVISQTAT

SEQ ID NO: 1899294 - protein, 28 aa, Staphylococcus
ISSYHIFRIFFILFLIAPLLGHLLKYID

SEQ ID NO: 1899295 - protein, 28 aa, Staphylococcus
ISSYHIFRIFFILFLVAPVINYFLKFRA

SEQ ID NO: 1899296 - protein, 24 aa, Staphylococcus
ISTIFLFNLIAVFIFPPIGHIMHM

SEQ ID NO: 1899297 - protein, 24 aa, Staphylococcus
ISTILFLVIMLGILAYYLIQNTLK

SEQ ID NO: 1899298 - protein, 17 aa, Staphylococcus
ISTIMVSWIWFISLAIL

SEQ ID NO: 1899299 - protein, 27 aa, Staphylococcus
ISTLFLILAILLLIGLSFYKNIKTVDL

SEQ ID NO: 1899300 - protein, 25 aa, Staphylococcus
ISTLFLLIMVPFFLIYMLKDHERFI

SEQ ID NO: 1899301 - protein, 21 aa, Staphylococcus
ISTLIFMVIIIGILGYYLVQR

SEQ ID NO: 1899302 - protein, 33 aa, Staphylococcus
ISTSYSIYESSVFSEINSLSHSASTSASTSVSD

SEQ ID NO: 1899303 - protein, 22 aa, Staphylococcus
ISTYWLKYFKLGPLEYIWKMAT

SEQ ID NO: 1899304 - protein, 18 aa, Staphylococcus
ISVAYIYSLYAFYMNNFS

SEQ ID NO: 1899305 - protein, 31 aa, Staphylococcus
ISVITLLPLVFLFLFAWKKVPAIPTLLVGST

SEQ ID NO: 1899306 - protein, 19 aa, Staphylococcus
ISVLLIYFLLTVLAQGVII

SEQ ID NO: 1899307 - protein, 18 aa, Staphylococcus
ISVLWIPVFSIGTSMLTL

SEQ ID NO: 1899308 - protein, 21 aa, Staphylococcus
ISVRWYGIIIAMGILLGYFIA

SEQ ID NO: 1899309 - protein, 24 aa, Staphylococcus
ISVSWFWFILLAIIGKVIGHLDKT

SEQ ID NO: 1899310 - protein, 24 aa, Staphylococcus
ISVSWLWFIFLAIAGRTVGHFDKS

SEQ ID NO: 1899311 - protein, 29 aa, Staphylococcus
ISVVFAIIYNLWWFFYNITQVAGIHLEQL

SEQ ID NO: 1899312 - protein, 18 aa, Staphylococcus
ISVVIGILLLLSLIIFLK

SEQ ID NO: 1899313 - protein, 21 aa, Staphylococcus
ISVVYWLIALIIQGVFTIIDK

SEQ ID NO: 1899314 - protein, 20 aa, Staphylococcus
ISVWFRQLFMFKPHADLMAN

SEQ ID NO: 1899315 - protein, 36 aa, Staphylococcus
ISVYSILYIIILNIGLSVLFLIFTYLKEVKFYKHLD

SEQ ID NO: 1899316 - protein, 17 aa, Staphylococcus
ISWMAISLIGAVCVGLI

SEQ ID NO: 1899317 - protein, 21 aa, Staphylococcus
ISYLMYLLVMLFIIPIVAVLI

SEQ ID NO: 1899318 - protein, 17 aa, Staphylococcus
ISYYLNCYFVYKVKPTL

SEQ ID NO: 1899319 - protein, 18 aa, Staphylococcus
ITAIIVIAPITRLIATGM

SEQ ID NO: 1899320 - protein, 18 aa, Staphylococcus
ITDLKRVAKTPAVWVILT

SEQ ID NO: 1899321 - protein, 48 aa, Staphylococcus
ITDLKRVAKTPGVWVILAGLAILPSFYAWFNLWAMWDPYGNTGHIKVA

SEQ ID NO: 1899322 - protein, 25 aa, Staphylococcus
ITDNGVFTGYLKFDFKYANSNTVDV

SEQ ID NO: 1899323 - protein, 29 aa, Staphylococcus
ITEPLEFSFLFVAPILYVAHVILAGTSFL

SEQ ID NO: 1899324 - protein, 31 aa, Staphylococcus
ITEPLEFSFLFVAPILYVIHVFLAGTSFLVM

SEQ ID NO: 1899325 - protein, 49 aa, Staphylococcus
ITEPLEFSFLFVAPLLFVIHALLDGLSFLILYLLHLHLGYTFSGGFIDY

SEQ ID NO: 1899326 - protein, 30 aa, Staphylococcus
ITEPLEFSFLFVAPLLYAIHVVLAGSSFLI

SEQ ID NO: 1899327 - protein, 28 aa, Staphylococcus
ITEPLEFTFLFIAPFLFVIHALLAATMD

SEQ ID NO: 1899328 - protein, 25 aa, Staphylococcus
ITEVKRPWLPPLPENVYQDELMTTD

SEQ ID NO: 1899329 - protein, 22 aa, Staphylococcus
ITEVLFLIPISFVLTITSSITF

SEQ ID NO: 1899330 - protein, 23 aa, Staphylococcus
ITEWAYFAFLVAAVLLALYLLIL

SEQ ID NO: 1899331 - protein, 25 aa, Staphylococcus
ITEYFGWYYMIIVALMIFFCVFLIF

SEQ ID NO: 1899332 - protein, 18 aa, Staphylococcus
ITFCWIMITFIHAIKNYS

SEQ ID NO: 1899333 - protein, 21 aa, Staphylococcus
ITFIFIWIGIILYSISQYMNI

SEQ ID NO: 1899334 - protein, 17 aa, Staphylococcus
ITFIILFSLFVVWELKN

SEQ ID NO: 1899335 - protein, 27 aa, Staphylococcus
ITFISLFFPIIILAVPFIDTLFAMIRR

SEQ ID NO: 1899336 - protein, 18 aa, Staphylococcus
ITFLIAVGCIIYIRQMDE

SEQ ID NO: 1899337 - protein, 17 aa, Staphylococcus
ITFLLLMINLGLMTKFN

SEQ ID NO: 1899338 - protein, 17 aa, Staphylococcus
ITFVLLVFSYNGWVLLL

SEQ ID NO: 1899339 - protein, 22 aa, Staphylococcus
ITFVLVFLVFWGLSYEAKLYTL

SEQ ID NO: 1899340 - protein, 32 aa, Staphylococcus
ITFYKFRYILITLIIILLASMVLFITGLAQGL

SEQ ID NO: 1899341 - protein, 21 aa, Staphylococcus
ITGFCFLLALFFSPLIEVVTS

SEQ ID NO: 1899342 - protein, 24 aa, Staphylococcus
ITGFIGFLVLYLLAPSIAGITLAN

SEQ ID NO: 1899343 - protein, 36 aa, Staphylococcus
ITGFVCAVILFLIIVIIYRQPFLALIVGASLTIAMT

SEQ ID NO: 1899344 - protein, 18 aa, Staphylococcus
ITGILFSLMMKFFQVRHF

SEQ ID NO: 1899345 - protein, 26 aa, Staphylococcus
ITGLGAFMFLLLSLIRLNHLKHQRVI

SEQ ID NO: 1899346 - protein, 18 aa, Staphylococcus
ITGWTYWLCWIITGMAEV

SEQ ID NO: 1899347 - protein, 29 aa, Staphylococcus
ITHHPHFLWFNLVKPDIWITAIAGVLYFI

SEQ ID NO: 1899348 - protein, 29 aa, Staphylococcus
ITHSIPFTILWPILITFIIFVIFKQTNPL

SEQ ID NO: 1899349 - protein, 31 aa, Staphylococcus
ITHSIPFTILWPILLAFIIYVIFPHVDVTHI

SEQ ID NO: 1899350 - protein, 24 aa, Staphylococcus
ITHYWWMFAISFIFFLIAGILNMI

SEQ ID NO: 1899351 - protein, 19 aa, Staphylococcus
ITIFLILQLVLSYGISRLI

SEQ ID NO: 1899352 - protein, 24 aa, Staphylococcus
ITIGIFFYFVMSFVAALLTYFNGK

SEQ ID NO: 1899353 - protein, 27 aa, Staphylococcus
ITIILIILLIVIIITIAYKLYHRSHQE

SEQ ID NO: 1899354 - protein, 18 aa, Staphylococcus
ITIILNRTLLKIFNLFIL

SEQ ID NO: 1899355 - protein, 26 aa, Staphylococcus
ITIIMLVIAFVLILVQNYLFLKRRSI

SEQ ID NO: 1899356 - protein, 26 aa, Staphylococcus
ITIIVVVAFVLYLVILKAFNALTIEN

SEQ ID NO: 1899357 - protein, 17 aa, Staphylococcus
ITIVEILAILLLCGMYY

SEQ ID NO: 1899358 - protein, 52 aa, Staphylococcus
ITIVIALTIMFYLNVKLTLAALVIFPVYILTVYFFFGRLRNLTRKRSQALAE

SEQ ID NO: 1899359 - protein, 19 aa, Staphylococcus
ITIVLALPLILILAGAFDK

SEQ ID NO: 1899360 - protein, 22 aa, Staphylococcus
ITIVVIAIIVIGGLFGLNAYSN

SEQ ID NO: 1899361 - protein, 17 aa, Staphylococcus
ITKFDYLYIFQFMILIG

SEQ ID NO: 1899362 - protein, 23 aa, Staphylococcus
ITKKTYQGIFSFNVLGLQDIHRN

SEQ ID NO: 1899363 - protein, 25 aa, Staphylococcus
ITKVIIVWFFIKYDNQIRGATGMMM

SEQ ID NO: 1899364 - protein, 34 aa, Staphylococcus
ITKVKESALKQLKAINVVAVVKPEARNTIANLVQ

SEQ ID NO: 1899365 - protein, 19 aa, Staphylococcus
ITKVLYRLTFVGSIFLAVI

SEQ ID NO: 1899366 - protein, 19 aa, Staphylococcus
ITLAFLFATILFALTSSLF

SEQ ID NO: 1899367 - protein, 30 aa, Staphylococcus
ITLFIYSLIIFLIFIIISLLLHLIFNGDTS

SEQ ID NO: 1899368 - protein, 25 aa, Staphylococcus
ITLIGGIFVWIGWYGFNTGSAFTLN

SEQ ID NO: 1899369 - protein, 20 aa, Staphylococcus
ITLIGGILVWIGWYGFNTGS

SEQ ID NO: 1899370 - protein, 25 aa, Staphylococcus
ITLIGGILVWLGWYGFNVGSAFTFD

SEQ ID NO: 1899371 - protein, 28 aa, Staphylococcus
ITLIGSIIMLFIMDWQMTLLTFIAIPIF

SEQ ID NO: 1899372 - protein, 37 aa, Staphylococcus
ITLIIAKPIIMFYKIFYPFIYILNGSARLILKMFGMQ

SEQ ID NO: 1899373 - protein, 31 aa, Staphylococcus
ITLIVVMLIACVVLVVLMMTGAKKDTYYGIM

SEQ ID NO: 1899374 - protein, 17 aa, Staphylococcus
ITLLIILGVITAFGPMT

SEQ ID NO: 1899375 - protein, 21 aa, Staphylococcus
ITLMLIAIYIFYEAIERFKNP

SEQ ID NO: 1899376 - protein, 28 aa, Staphylococcus
ITLMNYFILYILLIISITLFVPVDLFNS

SEQ ID NO: 1899377 - protein, 17 aa, Staphylococcus
ITLPISAIVAAIVYWIM

SEQ ID NO: 1899378 - protein, 24 aa, Staphylococcus
ITLPLLKPGMISGWILIFCISMRE

SEQ ID NO: 1899379 - protein, 25 aa, Staphylococcus
ITLVASLFLGILLTGLGGEDDESSK

SEQ ID NO: 1899380 - protein, 17 aa, Staphylococcus
ITLVLVTGWQKRTWVTI

SEQ ID NO: 1899381 - protein, 29 aa, Staphylococcus
ITLVTILFGLLYLVLIVTSAYVLLRMFRN

SEQ ID NO: 1899382 - protein, 31 aa, Staphylococcus
ITLVTILFGLLYLVLLFTSAYVLIRMFKDKP

SEQ ID NO: 1899383 - protein, 32 aa, Staphylococcus
ITLYLNTSILLMFWLVVLFALLVYSFNKTTIL

SEQ ID NO: 1899384 - protein, 21 aa, Staphylococcus
ITMFFVLNIITPFANAENGDV

SEQ ID NO: 1899385 - protein, 20 aa, Staphylococcus
ITMLFVIPTFRYKNFRYKIK

SEQ ID NO: 1899386 - protein, 22 aa, Staphylococcus
ITMLVMIPAVFFFGWYSDKVGN

SEQ ID NO: 1899387 - protein, 19 aa, Staphylococcus
ITMSIIGIILFLIPVPVTQ

SEQ ID NO: 1899388 - protein, 26 aa, Staphylococcus
ITMTKIFWILPWSYIGRIPLITLSLH

SEQ ID NO: 1899389 - protein, 24 aa, Staphylococcus
ITNFVFNALLIAIGYKFLSKRSMY

SEQ ID NO: 1899390 - protein, 17 aa, Staphylococcus
ITNLPSYFLYSSIIFIL

SEQ ID NO: 1899391 - protein, 20 aa, Staphylococcus
ITPMLPYALAFAAGAMIFVV

SEQ ID NO: 1899392 - protein, 20 aa, Staphylococcus
ITPMMPYLPLLLSFAQRYQK

SEQ ID NO: 1899393 - protein, 32 aa, Staphylococcus
ITQVAWIIIICLSLFILFFGATWGPIMWVMLP

SEQ ID NO: 1899394 - protein, 18 aa, Staphylococcus
ITSFIPFLAPFELLVRSQ

SEQ ID NO: 1899395 - protein, 18 aa, Staphylococcus
ITSLLIIEYYRTGTIDLR

SEQ ID NO: 1899396 - protein, 30 aa, Staphylococcus
ITSVLDLIIVWYVLYLLITVFKGTKAIQLL

SEQ ID NO: 1899397 - protein, 30 aa, Staphylococcus; identical to SEQ ID NO: 1751760

SEQ ID NO: 1899398 - protein, 29 aa, Staphylococcus
ITTAPLLFIFVIIILVFNLGLSLIFGKIF

SEQ ID NO: 1899399 - protein, 23 aa, Staphylococcus
ITTITYFALFAFGTIVILLLEAN

SEQ ID NO: 1899400 - protein, 26 aa, Staphylococcus
ITTSTYLFLFVFGVIIIFLLEHNHAF

SEQ ID NO: 1899401 - protein, 27 aa, Staphylococcus
ITVCDVFLLLFIMKFGFRKIEAIVGTL

SEQ ID NO: 1899402 - protein, 27 aa, Staphylococcus
ITVFDVFLLLFIMKFGFRKIEAIVGTL

SEQ ID NO: 1899403 - protein, 23 aa, Staphylococcus
ITVFFPIWFPVHADGPLSTFFTH

SEQ ID NO: 1899404 - protein, 20 aa, Staphylococcus
ITVFFPIWLPVHADGPLSTF

SEQ ID NO: 1899405 - protein, 22 aa, Staphylococcus
ITVFFPIWLPVYADGPISTFFT

SEQ ID NO: 1899406 - protein, 22 aa, Staphylococcus
ITVFFPLWFPVHADGIISTFFT

SEQ ID NO: 1899407 - protein, 18 aa, Staphylococcus
ITVFLFLLNMIDVYFTHI

SEQ ID NO: 1899408 - protein, 22 aa, Staphylococcus
ITVFLSYLGFQFGLKKRDEMLM

SEQ ID NO: 1899409 - protein, 18 aa, Staphylococcus
ITVLFIITTGLIGSILGA

SEQ ID NO: 1899410 - protein, 17 aa, Staphylococcus
ITVLFVGTIITPFAQAE

SEQ ID NO: 1899411 - protein, 19 aa, Staphylococcus
ITVLIFSILIAYGIFQVGL

SEQ ID NO: 1899412 - protein, 45 aa, Staphylococcus
ITVVALWEFSFAHTLLLFLSMTISLGILPWLSAKRARVLSERVAE

SEQ ID NO: 1899413 - protein, 18 aa, Staphylococcus
ITVVIGIIVLLSLIIFLK

SEQ ID NO: 1899414 - protein, 17 aa, Staphylococcus
ITVVIGILILLALIILL

SEQ ID NO: 1899415 - protein, 18 aa, Staphylococcus
ITVVIYGFSFLPLSKMMH

SEQ ID NO: 1899416 - protein, 26 aa, Staphylococcus
ITVVVAWLGLLLYTLNKAGKLPNFFQ

SEQ ID NO: 1899417 - protein, 18 aa, Staphylococcus
ITVYIYLTIKDWIPNRLV

SEQ ID NO: 1899418 - protein, 19 aa, Staphylococcus
ITVYKIIKLFLVFLIELIK

SEQ ID NO: 1899419 - protein, 30 aa, Staphylococcus
ITWIIRVISMVVMFIPLLATWRGVFQGYES

SEQ ID NO: 1899420 - protein, 32 aa, Staphylococcus
ITYAWSPFIILTIVVMIWSLPAFKGLFEKGGA

SEQ ID NO: 1899421 - protein, 21 aa, Staphylococcus
ITYFGAFWQVLLLATFAVGAF

SEQ ID NO: 1899422 - protein, 24 aa, Staphylococcus
ITYKPVFVNIFHKLLSLFGVQTKY

SEQ ID NO: 1899423 - protein, 32 aa, Staphylococcus
ITYTQWIKFVWKLILLWVIICAVAMSIALIIS

SEQ ID NO: 1899424 - protein, 25 aa, Staphylococcus
IVAALLIWAFNFTLADPIASILVSL

SEQ ID NO: 1899425 - protein, 25 aa, Staphylococcus
IVAGSLFMLLFLPDSILELQSASAI

SEQ ID NO: 1899426 - protein, 27 aa, Staphylococcus
IVAIAVGLLLVWLVVTFVAKSYTIKGD

SEQ ID NO: 1899427 - protein, 17 aa, Staphylococcus
IVAIGGALLIVGIVLKF

SEQ ID NO: 1899428 - protein, 18 aa, Staphylococcus
IVAIIVAFLLLNLPYVHK

SEQ ID NO: 1899429 - protein, 27 aa, Staphylococcus
IVAILGLLIIFVVGAIIFFSMVSDQIF

SEQ ID NO: 1899430 - protein, 17 aa, Staphylococcus
IVAIYYMGVKWQLLPFV

SEQ ID NO: 1899431 - protein, 25 aa, Staphylococcus
IVAKIIVIWFFRKYSNQMRGSVGMM

SEQ ID NO: 1899432 - protein, 28 aa, Staphylococcus
IVALAFVLLMFVFRSIIIPLKAVLGFVL

SEQ ID NO: 1899433 - protein, 27 aa, Staphylococcus
IVALAKGIIIAIILTVFIGTSYTVSGE

SEQ ID NO: 1899434 - protein, 19 aa, Staphylococcus
IVALLALIAILFLVPKKQS

SEQ ID NO: 1899435 - protein, 17 aa, Staphylococcus
IVALVDVLIFGNSIIYG

SEQ ID NO: 1899436 - protein, 18 aa, Staphylococcus
IVALVMIAFLVLSPLGDW

SEQ ID NO: 1899437 - protein, 25 aa, Staphylococcus
IVAQLIMIFIFRLPPGSAPVTAVLI

SEQ ID NO: 1899438 - protein, 23 aa, Staphylococcus
IVAQLIMIFVFQLPPGSAPVTAV

SEQ ID NO: 1899439 - protein, 24 aa, Staphylococcus
IVARLYFVIFQWPYYMQNPGEIPK

SEQ ID NO: 1899440 - protein, 32 aa, Staphylococcus
IVAVIAILSIVYFALKYAPFLREQDWNPMNQP

SEQ ID NO: 1899441 - protein, 29 aa, Staphylococcus
IVCSIILIIIIISIYRQPLLAVIVGGSLT

SEQ ID NO: 1899442 - protein, 25 aa, Staphylococcus
IVCVYGIFSFLIPATIIFFNHSEQL

SEQ ID NO: 1899443 - protein, 20 aa, Staphylococcus
IVFAVTTFTLLGLFIRATKN

SEQ ID NO: 1899444 - protein, 19 aa, Staphylococcus
IVFLIIYHYSKPLYYLAFV

SEQ ID NO: 1899445 - protein, 25 aa, Staphylococcus
IVFLLVSLLWIFGGLLPETLHITDT

SEQ ID NO: 1899446 - protein, 17 aa, Staphylococcus
IVFSVFNFLHAILLLTK

SEQ ID NO: 1899447 - protein, 24 aa, Staphylococcus
IVFTILIFLYIVVSGLMAWLITWY

SEQ ID NO: 1899448 - protein, 21 aa, Staphylococcus
IVFTIMSVVVLLISGYINNTK

SEQ ID NO: 1899449 - protein, 29 aa, Staphylococcus
IVFVPQIMILFFFISLLEDSGYMARIALI

SEQ ID NO: 1899450 - protein, 19 aa, Staphylococcus
IVFYIFLVGGAFGIIHKTG

SEQ ID NO: 1899451 - protein, 22 aa, Staphylococcus
IVGALFMYIILLQTAQFYTQQA

SEQ ID NO: 1899452 - protein, 27 aa, Staphylococcus
IVGGVLVWLMYLPHWKVTEDQGAKLAV

SEQ ID NO: 1899453 - protein, 28 aa, Staphylococcus
IVGGYLFGALLFMFIRKVTTGREGYLSA

SEQ ID NO: 1899454 - protein, 23 aa, Staphylococcus
IVGIVLSWIWPPIQTGLNDLSNF

SEQ ID NO: 1899455 - protein, 21 aa, Staphylococcus
IVGLFLIWLPTYVMEQYHVKY

SEQ ID NO: 1899456 - protein, 24 aa, Staphylococcus
IVGLIFLIITQLLYFISGSITILM

SEQ ID NO: 1899457 - protein, 26 aa, Staphylococcus
IVGLILFFLLLQFKIIPESWIDVGAN

SEQ ID NO: 1899458 - protein, 17 aa, Staphylococcus
IVGLILGLIVYRKPRKY

SEQ ID NO: 1899459 - protein, 17 aa, Staphylococcus
IVGLILGMFYYRKPREY

SEQ ID NO: 1899460 - protein, 40 aa, Staphylococcus
IVGRMIDSFFNYLFGMSRYLTYILLSLITVYIAMQKKFPK

SEQ ID NO: 1899461 - protein, 23 aa, Staphylococcus
IVGSLFFFTFLVVPIHHLFSSGL

SEQ ID NO: 1899462 - protein, 20 aa, Staphylococcus
IVGTDFYMGIGTPGGNKIPT

SEQ ID NO: 1899463 - protein, 25 aa, Staphylococcus
IVGTLFTLLFSWLIVLAIARIFKSD

SEQ ID NO: 1899464 - protein, 32 aa, Staphylococcus
IVGTLLLSAILFFQPHLIVAVILMGLSAMMTE

SEQ ID NO: 1899465 - protein, 24 aa, Staphylococcus
IVGVFHSKYLLIWSRQHNKTLRDF

SEQ ID NO: 1899466 - protein, 36 aa, Staphylococcus
IVGVIALLTSSFLAGILWIIAGIMLLARKPKNDSNH

SEQ ID NO: 1899467 - protein, 26 aa, Staphylococcus
IVGVVVFTIILFISSIILLNKQRHRD

SEQ ID NO: 1899468 - protein, 33 aa, Staphylococcus
IVIAIIALLILFSFVPIGLWISAIAAGVKVNIG

SEQ ID NO: 1899469 - protein, 18 aa, Staphylococcus
IVIAPITRLIATGMTPVV

SEQ ID NO: 1899470 - protein, 24 aa, Staphylococcus
IVIFIIVAFIVWLFEQAYSKARPK

SEQ ID NO: 1899471 - protein, 27 aa, Staphylococcus
IVIFVGFFLAATLVWFVHDKDEYKKLK

SEQ ID NO: 1899472 - protein, 17 aa, Staphylococcus
IVIIILVGLIIGSWIGS

SEQ ID NO: 1899473 - protein, 17 aa, Staphylococcus
IVIKWAIGSSLFMIIVA

SEQ ID NO: 1899474 - protein, 17 aa, Staphylococcus
IVILAFPVLTVALALMT

SEQ ID NO: 1899475 - protein, 18 aa, Staphylococcus
IVILCYLISLSLLTMFIS

SEQ ID NO: 1899476 - protein, 19 aa, Staphylococcus
IVILIFPVFTVTLALMTID

SEQ ID NO: 1899477 - protein, 17 aa, Staphylococcus
IVILWAIIAKDLPEHHK

SEQ ID NO: 1899478 - protein, 29 aa, Staphylococcus
IVIMGITVILLIAILYKINLAHVATLASV

SEQ ID NO: 1899479 - protein, 29 aa, Staphylococcus
IVIMGITVILLIAILYKLNLAHVATLAGV

SEQ ID NO: 1899480 - protein, 22 aa, Staphylococcus
IVIQWGVLALIVIFQPEIRRAL

SEQ ID NO: 1899481 - protein, 19 aa, Staphylococcus
IVISVLLFFAFRTSGNIKI

SEQ ID NO: 1899482 - protein, 18 aa, Staphylococcus
IVITFIRRQLSITNPLLN

SEQ ID NO: 1899483 - protein, 21 aa, Staphylococcus
IVITIPVLFITLVGLYVTLII

SEQ ID NO: 1899484 - protein, 17 aa, Staphylococcus
IVITLLLGSAITYINPI

SEQ ID NO: 1899485 - protein, 18 aa, Staphylococcus
IVIVLFGFLAAFIDSVVG

SEQ ID NO: 1899486 - protein, 17 aa, Staphylococcus
IVIWLMGSIITASGLIL

SEQ ID NO: 1899487 - protein, 25 aa, Staphylococcus
IVKETIEKLKAIQLPIAEPEVEVTL

SEQ ID NO: 1899488 - protein, 17 aa, Staphylococcus
IVKIPFVNSYYKIFRTY

SEQ ID NO: 1899489 - protein, 18 aa, Staphylococcus
IVKLFPYEVSDHKVSQII

SEQ ID NO: 1899490 - protein, 31 aa, Staphylococcus
IVKPAVALFLISIGIYILYQFAFKGKRSYTD

SEQ ID NO: 1899491 - protein, 27 aa, Staphylococcus
IVKRDFWLIPIYILNLTAIPIICGIIG

SEQ ID NO: 1899492 - protein, 18 aa, Staphylococcus
IVLAGKYNSRMTSFGTMS

SEQ ID NO: 1899493 - protein, 18 aa, Staphylococcus
IVLAIFIVSYLMLVIYYY

SEQ ID NO: 1899494 - protein, 18 aa, Staphylococcus
IVLALIAGLAIGFFLARK

SEQ ID NO: 1899495 - protein, 23 aa, Staphylococcus
IVLFLLCLTIFKMKGIYASITTV

SEQ ID NO: 1899496 - protein, 17 aa, Staphylococcus
IVLFVTFVHNAILAIII

SEQ ID NO: 1899497 - protein, 18 aa, Staphylococcus
IVLIIILLTFVHGINSYL

SEQ ID NO: 1899498 - protein, 17 aa, Staphylococcus
IVLIIILSVLFNIRHFI

SEQ ID NO: 1899499 - protein, 19 aa, Staphylococcus
IVLIILGIIGMYITSAILA

SEQ ID NO: 1899500 - protein, 26 aa, Staphylococcus
IVLIKRRFLLAIWLPTTVASAGIIGI

SEQ ID NO: 1899501 - protein, 18 aa, Staphylococcus
IVLKLFPFVFIFAAGGAS

SEQ ID NO: 1899502 - protein, 18 aa, Staphylococcus
IVLLIFLNLIAIFTSVQS

SEQ ID NO: 1899503 - protein, 17 aa, Staphylococcus
IVLLTINLIVGSGIFLS

SEQ ID NO: 1899504 - protein, 19 aa, Staphylococcus
IVLPICIFVYMLSSNKTHK

SEQ ID NO: 1899505 - protein, 26 aa, Staphylococcus
IVLSIIALLLIASFFITSADSATFVL

SEQ ID NO: 1899506 - protein, 19 aa, Staphylococcus
IVLTAFFVIFFLIPSKTKR

SEQ ID NO: 1899507 - protein, 18 aa, Staphylococcus
IVLVLFFIKEAQYNLFMQ

SEQ ID NO: 1899508 - protein, 17 aa, Staphylococcus
IVLWIYFRTSIPKTIDI

SEQ ID NO: 1899509 - protein, 24 aa, Staphylococcus
IVLYLFLFCYIVIASIDFGAGVFL

SEQ ID NO: 1899510 - protein, 20 aa, Staphylococcus
IVLYVVFMGLFLFGFITSLT

SEQ ID NO: 1899511 - protein, 18 aa, Staphylococcus
IVLYYAFHLSPAITNFVV

SEQ ID NO: 1899512 - protein, 20 aa, Staphylococcus
IVMEKLPILLGVPLIVFVFE

SEQ ID NO: 1899513 - protein, 22 aa, Staphylococcus
IVMIFLFLGEWISSLSKAYIPS

SEQ ID NO: 1899514 - protein, 17 aa, Staphylococcus
IVMIWSAPSFKNLFLPK

SEQ ID NO: 1899515 - protein, 19 aa, Staphylococcus
IVMLIAICLWLLIGALFYL

SEQ ID NO: 1899516 - protein, 22 aa, Staphylococcus
IVMLLARYIPIVLQILIVSSLV

SEQ ID NO: 1899517 - protein, 24 aa, Staphylococcus
IVMMFIFSWFMPTYVAILLSAIIA

SEQ ID NO: 1899518 - protein, 17 aa, Staphylococcus
IVMMLMMNLILHTVTLL

SEQ ID NO: 1899519 - protein, 22 aa, Staphylococcus
IVMSIIGIILFLIPVPVVQDGQ

SEQ ID NO: 1899520 - protein, 19 aa, Staphylococcus
IVNLVFLPPKFESKIYYNS

SEQ ID NO: 1899521 - protein, 24 aa, Staphylococcus
IVNSRKTCIYGIGASALIAQDFKQ

SEQ ID NO: 1899522 - protein, 36 aa, Staphylococcus
IVNVIIVSCLLFVVLLGLWLLFKDKHQKQHSVLRNF

SEQ ID NO: 1899523 - protein, 28 aa, Staphylococcus
IVPETIVKINARQLLLNAINNKKQEALE

SEQ ID NO: 1899524 - protein, 18 aa, Staphylococcus
IVPVIFSMSLLLIAITTH

SEQ ID NO: 1899525 - protein, 26 aa, Staphylococcus
IVPWPTLFFGMFFNNLFFWCANQMIV

SEQ ID NO: 1899526 - protein, 17 aa, Staphylococcus
IVPWRLAMLYKFKKIEK

SEQ ID NO: 1899527 - protein, 17 aa, Staphylococcus
IVPWRLAMLYKYKKLKR

SEQ ID NO: 1899528 - protein, 23 aa, Staphylococcus
IVPYALFFAFFSIYYYLTGKEDA

SEQ ID NO: 1899529 - protein, 30 aa, Staphylococcus
IVPYFILTEMPPFIGGLLIAAIFAAAQSTI

SEQ ID NO: 1899530 - protein, 27 aa, Staphylococcus
IVPYFILTEMPPFVGGLLIAAIFAAAQ

SEQ ID NO: 1899531 - protein, 17 aa, Staphylococcus
IVQLLIYVPLTFFFVAS

SEQ ID NO: 1899532 - protein, 17 aa, Staphylococcus
IVSALMYGFLKPKLREH

SEQ ID NO: 1899533 - protein, 18 aa, Staphylococcus
IVSFVEVLIYVVGLGLVM

SEQ ID NO: 1899534 - protein, 17 aa, Staphylococcus
IVSIAVALIIVGIVVKF

SEQ ID NO: 1899535 - protein, 29 aa, Staphylococcus
IVSIILAFAFKWFGLIDDVLLMVIIISTI

SEQ ID NO: 1899536 - protein, 22 aa, Staphylococcus
IVSIILYYLFNPLVNLMERYNI

SEQ ID NO: 1899537 - protein, 19 aa, Staphylococcus
IVSIVVAVALVLLIVNFVA

SEQ ID NO: 1899538 - protein, 19 aa, Staphylococcus
IVSLIISFLLWYFTRNWRR

SEQ ID NO: 1899539 - protein, 18 aa, Staphylococcus
IVSLVIIIIAFIAALFIK

SEQ ID NO: 1899540 - protein, 24 aa, Staphylococcus
IVSPLFILYIAFQSPSALALYWFV

SEQ ID NO: 1899541 - protein, 18 aa, Staphylococcus
IVSTPMIFGPILGPTLGG

SEQ ID NO: 1899542 - protein, 18 aa, Staphylococcus
IVSTPMILGPILGPVLGG

SEQ ID NO: 1899543 - protein, 20 aa, Staphylococcus
IVTCNAYIYGGKYKEFDDFE

SEQ ID NO: 1899544 - protein, 25 aa, Staphylococcus
IVTEQFIMIILLIALGYLLKRINFL

SEQ ID NO: 1899545 - protein, 27 aa, Staphylococcus
IVTGKLFFLGWIALAIAVVWIGLITGE

SEQ ID NO: 1899546 - protein, 23 aa, Staphylococcus
IVTIIFILFIFVFATKAGAFPMY

SEQ ID NO: 1899547 - protein, 20 aa, Staphylococcus
IVTIIIISILFFRKYLQKKH

SEQ ID NO: 1899548 - protein, 28 aa, Staphylococcus
IVTIVVLVIIGVVGFHFYNQATGFVSTD

SEQ ID NO: 1899549 - protein, 23 aa, Staphylococcus
IVTLFLGWFPRGLFFFFATFHAG

SEQ ID NO: 1899550 - protein, 27 aa, Staphylococcus
IVTLIVFLILIYVLVFTAQKLASIPEI

SEQ ID NO: 1899551 - protein, 27 aa, Staphylococcus
IVTPFLIIMVILIAVYYLFAGSVPLNE

SEQ ID NO: 1899552 - protein, 27 aa, Staphylococcus
IVTPFLIIMVILIAVYYLFTGDISIAQ

SEQ ID NO: 1899553 - protein, 34 aa, Staphylococcus
IVTPTISLLIIGLLTIFFFMPIAGFISDGLVGVV

SEQ ID NO: 1899554 - protein, 32 aa, Staphylococcus
IVTPTISLLIIGLLTLFIIMPVAGFISDGLVH

SEQ ID NO: 1899555 - protein, 33 aa, Staphylococcus
IVTPTITLFIIGLLTIFIFMPLAGFVSDGLVTV

SEQ ID NO: 1899556 - protein, 25 aa, Staphylococcus
IVTRWQKFYLLMFGTILALFSSIIG

SEQ ID NO: 1899557 - protein, 24 aa, Staphylococcus
IVTTPFILFFMLKDGHRFKDYTTK

SEQ ID NO: 1899558 - protein, 19 aa, Staphylococcus
IVVDVIIYYPFVKVYDEQI

SEQ ID NO: 1899559 - protein, 33 aa, Staphylococcus; identical to SEQ ID NO: 1749953

SEQ ID NO: 1899560 - protein, 32 aa, Staphylococcus
IVVGIAVLTFIIWIAFVQQGQFEPALVAAIAV

SEQ ID NO: 1899561 - protein, 28 aa, Staphylococcus
IVVGLFVHWIWPELPMAAAFALAAILCP

SEQ ID NO: 1899562 - protein, 19 aa, Staphylococcus
IVVGLIALLAWPMSISTGR

SEQ ID NO: 1899563 - protein, 27 aa, Staphylococcus
IVVIIMFYIFYRMLKSKIKKMFGLEDT

SEQ ID NO: 1899564 - protein, 17 aa, Staphylococcus
IVVILFAISEALERFSM

SEQ ID NO: 1899565 - protein, 18 aa, Staphylococcus
IVVITIMFPALTPISTLL

SEQ ID NO: 1899566 - protein, 26 aa, Staphylococcus
IVVIVLIFIFSFYKELFILSFDEEYS

SEQ ID NO: 1899567 - protein, 24 aa, Staphylococcus
IVVKTLLFFIIGSLVYMSGYREYK

SEQ ID NO: 1899568 - protein, 17 aa, Staphylococcus
IVVLWLAITAWKNIGYI

SEQ ID NO: 1899569 - protein, 18 aa, Staphylococcus
IVVLWLVITAWKHIGYIK

SEQ ID NO: 1899570 - protein, 20 aa, Staphylococcus
IVVLWLVITAWKNIGYIKEI

SEQ ID NO: 1899571 - protein, 17 aa, Staphylococcus
IVVSESLSGSLSTSTSK

SEQ ID NO: 1899572 - protein, 25 aa, Staphylococcus
IVVSTLVFLFLGKPVTLLIVAGALN

SEQ ID NO: 1899573 - protein, 25 aa, Staphylococcus
IVVVAIICIFAFDLKRMLKGFDVSM

SEQ ID NO: 1899574 - protein, 28 aa, Staphylococcus
IVVVIGFIFFNIPIQILLLISSAYAAFI

SEQ ID NO: 1899575 - protein, 17 aa, Staphylococcus
IVVWFFAGLKHKSGADK

SEQ ID NO: 1899576 - protein, 17 aa, Staphylococcus
IVVYFMIAIDYLAQRIA

SEQ ID NO: 1899577 - protein, 26 aa, Staphylococcus
IVWPLFMIIWYLLGWPLGPGGPLQVK

SEQ ID NO: 1899578 - protein, 18 aa, Staphylococcus
IVWPLLYTSMGVAYQLSY

SEQ ID NO: 1899579 - protein, 28 aa, Staphylococcus
IVYAVVYYFLFDFAIRKFNLKTPGREDK

SEQ ID NO: 1899580 - protein, 23 aa, Staphylococcus
IVYIIFTMIIRYFIYRTTDQSLD

SEQ ID NO: 1899581 - protein, 28 aa, Staphylococcus
IVYLAEDLILKRKVAIKAISIPPREKEE

SEQ ID NO: 1899582 - protein, 17 aa, Staphylococcus
IVYLIFTVPMFTISVRR

SEQ ID NO: 1899583 - protein, 26 aa, Staphylococcus
IVYVGIVLVILLMNFDQIIPMIGTII

SEQ ID NO: 1899584 - protein, 20 aa, Staphylococcus
IWALIIGTLKITIIAALFAV

SEQ ID NO: 1899585 - protein, 18 aa, Staphylococcus
IWALVIGTLKITLIAAIF

SEQ ID NO: 1899586 - protein, 32 aa, Staphylococcus
IWAWLLVLVFLPIVGFILYLLLGRQIQRKHIF

SEQ ID NO: 1899587 - protein, 24 aa, Staphylococcus
IWDILGFIILITLRKYLRVGETFS

SEQ ID NO: 1899588 - protein, 20 aa, Staphylococcus
IWDVLGFALLLFLRKHLRIG

SEQ ID NO: 1899589 - protein, 26 aa, Staphylococcus
IWDVLGFVILILLRKHLRIGDTFCLY

SEQ ID NO: 1899590 - protein, 28 aa, Staphylococcus
IWIVGIILLFTFNYWIRLLKAQPDNLKL

SEQ ID NO: 1899591 - protein, 21 aa, Staphylococcus
IWIVLLIFNLINTFLVLVGKT

SEQ ID NO: 1899592 - protein, 20 aa, Staphylococcus
IWIVLLVFNLINTFLVLIGK

SEQ ID NO: 1899593 - protein, 21 aa, Staphylococcus
IWLFLTIFLILVTGNFVIKGE

SEQ ID NO: 1899594 - protein, 21 aa, Staphylococcus
IWLIILLISVLISLWWDLGSL

SEQ ID NO: 1899595 - protein, 18 aa, Staphylococcus
IWNFALILLGRLLSDSFG

SEQ ID NO: 1899596 - protein, 17 aa, Staphylococcus
IWNFLFLRRALPLTKEE

SEQ ID NO: 1899597 - protein, 18 aa, Staphylococcus
IWNFLFLRRALPLTKEEL

SEQ ID NO: 1899598 - protein, 18 aa, Staphylococcus
IWNFLFLRRALPLTKQEL

SEQ ID NO: 1899599 - protein, 29 aa, Staphylococcus
IWNQHTYLWWFLFAVYISQAFYTAVNAGV

SEQ ID NO: 1899600 - protein, 17 aa, Staphylococcus
IWWLLAHIVFMVFMYIC

SEQ ID NO: 1899601 - protein, 23 aa, Staphylococcus
IWYAFLITLITLLISYPAAYFIA

SEQ ID NO: 1899602 - protein, 27 aa, Staphylococcus
IYAIRSLLWEHIIKLKMPFFDKNESGQ

SEQ ID NO: 1899603 - protein, 27 aa, Staphylococcus
IYASIGMIIYISLRFEWRMGLSSILAL

SEQ ID NO: 1899604 - protein, 22 aa, Staphylococcus
IYFFVKDILLFIILYALFQGLF

SEQ ID NO: 1899605 - protein, 20 aa, Staphylococcus
IYFIVLFIISLFVPRILNFM

SEQ ID NO: 1899606 - protein, 27 aa, Staphylococcus
IYFYIHNIWLFIIVYAIFQGLFAPAMP

SEQ ID NO: 1899607 - protein, 41 aa, Staphylococcus
IYHGTFVIHVQWKLLGYFLIIMAVFISLMTAIYLLPDLVMG

SEQ ID NO: 1899608 - protein, 35 aa, Staphylococcus
IYHSFLLKKWHLFFYLILMMCAFLTALLVVQYVNQ

SEQ ID NO: 1899609 - protein, 35 aa, Staphylococcus
IYHSFLLKKWYLFLYLFLMIIALITTLTILQQLNQ

SEQ ID NO: 1899610 - protein, 31 aa, Staphylococcus
IYHSFLLKKWYLFVYLILIVLSLVLALTAVQ

SEQ ID NO: 1899611 - protein, 24 aa, Staphylococcus
IYIATLFHFAMSFGLVFLFNEELG

SEQ ID NO: 1899612 - protein, 17 aa, Staphylococcus
IYIIMICAVLGAFGAIR

SEQ ID NO: 1899613 - protein, 19 aa, Staphylococcus
IYILIYVIGIFFLIRHIKR

SEQ ID NO: 1899614 - protein, 22 aa, Staphylococcus
IYIPFMILPIFNSMKTIPENLF

SEQ ID NO: 1899615 - protein, 17 aa, Staphylococcus
IYIPLILAFINASFILH

SEQ ID NO: 1899616 - protein, 26 aa, Staphylococcus
IYIVIAFILILMMPRIIYRDTYGNFA

SEQ ID NO: 1899617 - protein, 28 aa, Staphylococcus
IYIVLIVFVIVMMLSLSWFMPSYVAILI

SEQ ID NO: 1899618 - protein, 41 aa, Staphylococcus
IYKKLKHIFIGFFTILTCTLIILLAITVFYFQSITKESEHI

SEQ ID NO: 1899619 - protein, 19 aa, Staphylococcus
IYLAFILQIIAVVLPVFSG

SEQ ID NO: 1899620 - protein, 26 aa, Staphylococcus
IYLDNWWIVFFIFVTQIILSLSYEYT

SEQ ID NO: 1899621 - protein, 26 aa, Staphylococcus
IYLDNWWIVLFIFITQLLLSISYEYT

SEQ ID NO: 1899622 - protein, 17 aa, Staphylococcus
IYLFAFQLNLFPFQGSV

SEQ ID NO: 1899623 - protein, 31 aa, Staphylococcus
IYLIISMYCLFLSLMPLILQVLQRYKRLYYQ

SEQ ID NO: 1899624 - protein, 35 aa, Staphylococcus
IYNFLTNSFGWLFLLIIFILDVFLISLAVSRYGRF

SEQ ID NO: 1899625 - protein, 18 aa, Staphylococcus
IYNLTLDSLVFMNTMRYC

SEQ ID NO: 1899626 - protein, 18 aa, Staphylococcus
IYNRGTLPTGTYSIRYAT

SEQ ID NO: 1899627 - protein, 17 aa, Staphylococcus
IYPYLCLAIFIIGHIAR

SEQ ID NO: 1899628 - protein, 17 aa, Staphylococcus
IYPYLCVAIFIIGHIAR

SEQ ID NO: 1899629 - protein, 17 aa, Staphylococcus
IYPYLCVAIFIVGHIAR

SEQ ID NO: 1899630 - protein, 17 aa, Staphylococcus
IYPYLCVAIFVIGHIAR

SEQ ID NO: 1899631 - protein, 22 aa, Staphylococcus
IYRIILVVIIAILYFGFGIGKG

SEQ ID NO: 1899632 - protein, 23 aa, Staphylococcus
IYRIVLVIIIAILYFGFGIGQGI

SEQ ID NO: 1899633 - protein, 17 aa, Staphylococcus
IYSLFKKQNFSGNEYLN

SEQ ID NO: 1899634 - protein, 24 aa, Staphylococcus
IYSPIRFIVLMIISIVGMACWLLY

SEQ ID NO: 1899635 - protein, 20 aa, Staphylococcus
IYSRIIYIVLIILAIFIIWK

SEQ ID NO: 1899636 - protein, 20 aa, Staphylococcus
IYSTLGFGLILYAFSSAGNL

SEQ ID NO: 1899637 - protein, 28 aa, Staphylococcus
IYTILIAAFILISVLIFYSFLIYRRERN

SEQ ID NO: 1899638 - protein, 17 aa, Staphylococcus
IYVPLLLAFINLSFILH

SEQ ID NO: 1899639 - protein, 26 aa, Staphylococcus
IYVTMIILLFFLFSSYIKYVPKFIVF

SEQ ID NO: 1899640 - protein, 17 aa, Staphylococcus
KAAIFFGGFYDMKTVKA

SEQ ID NO: 1899641 - protein, 20 aa, Staphylococcus
KAALVIFMWLPKAYAVLNTE

SEQ ID NO: 1899642 - protein, 21 aa, Staphylococcus
KAALVLFMWLPKAYAVLNTEL

SEQ ID NO: 1899643 - protein, 23 aa, Staphylococcus
KADALIDKYPELRLRMVKGAYKE

SEQ ID NO: 1899644 - protein, 27 aa, Staphylococcus
KADTSYIYLIVIYAIRMFAVSLLMMPI

SEQ ID NO: 1899645 - protein, 28 aa, Staphylococcus
KADTSYMYLIIIYAIRMFAVSLLMMPIN

SEQ ID NO: 1899646 - protein, 17 aa, Staphylococcus
KAEAFFPSKLPLINLRM

SEQ ID NO: 1899647 - protein, 25 aa, Staphylococcus
KAFIPLFILGMIFWSIQEQGSNVLN

SEQ ID NO: 1899648 - protein, 25 aa, Staphylococcus
KAFIPLFILGMLFWSIQEQGSNVLN

SEQ ID NO: 1899649 - protein, 25 aa, Staphylococcus
KAFTLLEMLLVLLVISVLLILIIPN

SEQ ID NO: 1899650 - protein, 25 aa, Staphylococcus
KAGAFPMYIWLPGAYYAPPIAIIAF

SEQ ID NO: 1899651 - protein, 24 aa, Staphylococcus
KAGAFPMYVWLPGAYYAPPFAIIA

SEQ ID NO: 1899652 - protein, 26 aa, Staphylococcus
KAIFLILTIISFAILLFAFFKMEETR

SEQ ID NO: 1899653 - protein, 25 aa, Staphylococcus
KAIGIRTRHLLWSLVFQILLVTMIS

SEQ ID NO: 1899654 - protein, 17 aa, Staphylococcus
KAIHLIFFIPYYKSFKK

SEQ ID NO: 1899655 - protein, 20 aa, Staphylococcus
KAIIFSIMFIILGFYDGFLG

SEQ ID NO: 1899656 - protein, 31 aa, Staphylococcus
KAIKQVFWRILLFYILAIFVIGMIIPYTSPA

SEQ ID NO: 1899657 - protein, 30 aa, Staphylococcus
KAIKQVFWRILLFYILAIFVIGMLIPYDSN

SEQ ID NO: 1899658 - protein, 31 aa, Staphylococcus
KAIKQVFWRILLFYILAIFVIGMLIPYDSNA

SEQ ID NO: 1899659 - protein, 26 aa, Staphylococcus
KAIKQVFWRILLFYVLSIAVIAAIIP

SEQ ID NO: 1899660 - protein, 23 aa, Staphylococcus
KAILFVFRCLVVVLVFIGAVAKT

SEQ ID NO: 1899661 - protein, 27 aa, Staphylococcus
KAILNVVLIPPFFMLGGSLSTVLSLIL

SEQ ID NO: 1899662 - protein, 20 aa, Staphylococcus
KAILYFEIITTIAIGLGLII

SEQ ID NO: 1899663 - protein, 24 aa, Staphylococcus
KAIQLLKGILFIVIGQQVSKILNL

SEQ ID NO: 1899664 - protein, 25 aa, Staphylococcus
KAIQLLKGILFIVIGQQVSKLLNLT

SEQ ID NO: 1899665 - protein, 26 aa, Staphylococcus
KAIRATLWRLIIFFIGTMVIISILIP

SEQ ID NO: 1899666 - protein, 19 aa, Staphylococcus
KAKELLLSGLEKLEYRGYD

SEQ ID NO: 1899667 - protein, 22 aa, Staphylococcus
KAKIDRLKYLQATDIKSYKEDI

SEQ ID NO: 1899668 - protein, 18 aa, Staphylococcus
KAKLFPFGPIFAGILCII

SEQ ID NO: 1899669 - protein, 20 aa, Staphylococcus
KAKLFPFGPIFAGILCVLVI

SEQ ID NO: 1899670 - protein, 25 aa, Staphylococcus
KAKVFNWLMYGLLAYVFSQLSSTTP

SEQ ID NO: 1899671 - protein, 25 aa, Staphylococcus
KALFWANMSFLLLIVALIICCIPEG

SEQ ID NO: 1899672 - protein, 29 aa, Staphylococcus
KALIYASIGIIIYVSLRFEWRMGLSSVLA

SEQ ID NO: 1899673 - protein, 23 aa, Staphylococcus
KALKGLLYVLIQPKVWLAAITAM

SEQ ID NO: 1899674 - protein, 42 aa, Staphylococcus
KAMAPIMPIIIIPIISSVIVGLIFIFLIGAPISGIFTALTGW

SEQ ID NO: 1899675 - protein, 34 aa, Staphylococcus
KANFGSWFKFMIPLFIVWLVVGSIVLFIFTAVGW

SEQ ID NO: 1899676 - protein, 42 aa, Staphylococcus
KANITFAIGIKIIALLLVIPGWLTLWIAILSDMGATILVALN

SEQ ID NO: 1899677 - protein, 26 aa, Staphylococcus
KANKTLLSSILILGLMLLRKSRKKKI

SEQ ID NO: 1899678 - protein, 17 aa, Staphylococcus
KARKKEFKKYKDYTAKS

SEQ ID NO: 1899679 - protein, 18 aa, Staphylococcus
KASWYLPKWLGAVLPNID

SEQ ID NO: 1899680 - protein, 18 aa, Staphylococcus
KAVNLLHQKADNSELVNA

SEQ ID NO: 1899681 - protein, 20 aa, Staphylococcus
KAVTVPDYPSSKGTPIVTVD

SEQ ID NO: 1899682 - protein, 19 aa, Staphylococcus
KAVTVPNYPSNKPTPEVSV

SEQ ID NO: 1899683 - protein, 30 aa, Staphylococcus
KAVVGIGAAAAAVLLTRKDSREKLKNEYDK

SEQ ID NO: 1899684 - protein, 20 aa, Staphylococcus
KAYTAQIAVLSILAQIVAKT

SEQ ID NO: 1899685 - protein, 22 aa, Staphylococcus
KAYTAQIAVLSILSQIVAKEHG

SEQ ID NO: 1899686 - protein, 34 aa, Staphylococcus
KDADGKYNALVSYGGRSFSILRASDLEMIYDSGS

SEQ ID NO: 1899687 - protein, 21 aa, Staphylococcus
KDALVDIIFWSAIFGFITARI

SEQ ID NO: 1899688 - protein, 27 aa, Staphylococcus
KDDISPLKGLVLISGLVLLGIATNRRK

SEQ ID NO: 1899689 - protein, 22 aa, Staphylococcus
KDEIFQVYLNKIYYSDGVTGVK

SEQ ID NO: 1899690 - protein, 19 aa, Staphylococcus
KDEKAVDFSILKKLKDQPS

SEQ ID NO: 1899691 - protein, 18 aa, Staphylococcus
KDERTYFVFIYKNHSSIN

SEQ ID NO: 1899692 - protein, 24 aa, Staphylococcus
KDESWLKKELNFISKRTYQGIFSF

SEQ ID NO: 1899693 - protein, 21 aa, Staphylococcus
KDETLYTIRLLPVGGYVRMAG

SEQ ID NO: 1899694 - protein, 20 aa, Staphylococcus
KDEVILILKLGIPAGLQMAV

SEQ ID NO: 1899695 - protein, 24 aa, Staphylococcus
KDGKYQVMIIIPENFSKLSMQLDK

SEQ ID NO: 1899696 - protein, 20 aa, Staphylococcus
KDGMFFYLAIFTGINAAKVF

SEQ ID NO: 1899697 - protein, 38 aa, Staphylococcus
KDIHEPWLFSMPSLVLMILIPIIFFIPNLFGQNMSLPA

SEQ ID NO: 1899698 - protein, 26 aa, Staphylococcus
KDILLYIALLFIIIYIAQVYLATWYQ

SEQ ID NO: 1899699 - protein, 29 aa, Staphylococcus
KDKFKLFIPWYYLIKYVMPLVIILVFLVQ

SEQ ID NO: 1899700 - protein, 28 aa, Staphylococcus
KDKFKLFLPWYYLIKFVMPVVIILVFIV

SEQ ID NO: 1899701 - protein, 17 aa, Staphylococcus
KDKKDVLQLVKSALNGK

SEQ ID NO: 1899702 - protein, 18 aa, Staphylococcus
KDKKLPYNIIKFKNGDKY

SEQ ID NO: 1899703 - protein, 24 aa, Staphylococcus
KDKSHLIETILGMKLSPEEAKKAA

SEQ ID NO: 1899704 - protein, 23 aa, Staphylococcus
KDKTLFIPFIAFILLHIGQWMYT

SEQ ID NO: 1899705 - protein, 17 aa, Staphylococcus
KDKTLLIPFLAFILLHI

SEQ ID NO: 1899706 - protein, 45 aa, Staphylococcus
KDLHNSPKIFKIKRWKFIILLIAIILITVILTVLSTIAISHKMSG

SEQ ID NO: 1899707 - protein, 25 aa, Staphylococcus
KDLLFALIMLILIGIAIFIFDQVSY

SEQ ID NO: 1899708 - protein, 23 aa, Staphylococcus
KDLLYILLIILSGSICYYFFNRF

SEQ ID NO: 1899709 - protein, 18 aa, Staphylococcus
KDLMLHRSGLYKFEASPK

SEQ ID NO: 1899710 - protein, 32 aa, Staphylococcus
KDLPMPAFKLPFYPIMPIIIFVCVFAVFWGLS

SEQ ID NO: 1899711 - protein, 22 aa, Staphylococcus
KDLQILAIYREMNAGSTLDPQI

SEQ ID NO: 1899712 - protein, 30 aa, Staphylococcus
KDLSYTVEFKATIPKIVNLNGHVSYRTNAT

SEQ ID NO: 1899713 - protein, 44 aa, Staphylococcus
KDMDFWTWMMLIWILLACVLIGPLLYYLSWWGVAITYVIFSVGF

SEQ ID NO: 1899714 - protein, 25 aa, Staphylococcus
KDMEKLWYWLVSFAMILAIAMSGHA

SEQ ID NO: 1899715 - protein, 22 aa, Staphylococcus
KDNDIYVLPDTGNNSKSSTGIV

SEQ ID NO: 1899716 - protein, 24 aa, Staphylococcus
KDNKLPVVFWMHGGGFIAGDKQYK

SEQ ID NO: 1899717 - protein, 28 aa, Staphylococcus
KDNLPRFFIYLLLFMFAMLGIVVSNNTI

SEQ ID NO: 1899718 - protein, 20 aa, Staphylococcus
KDPISILFLGIDDNSGREKN

SEQ ID NO: 1899719 - protein, 27 aa, Staphylococcus
KDPKLFKFSWIVLSILLIGYIVSEFIQ

SEQ ID NO: 1899720 - protein, 24 aa, Staphylococcus
KDPKLSFSIVYTNQPVPPPWLNGG

SEQ ID NO: 1899721 - protein, 26 aa, Staphylococcus
KDQFKFSLFLAMLLACLLIQAATNMF

SEQ ID NO: 1899722 - protein, 24 aa, Staphylococcus
KDQMEFQMLYGFRSELAQSIANEG

SEQ ID NO: 1899723 - protein, 39 aa, Staphylococcus
KDQWRVLMRLIRYTFSFKWLIALAFLMLAISTAASVATP

SEQ ID NO: 1899724 - protein, 20 aa, Staphylococcus
KDQYQATINQFKPVANDLAK

SEQ ID NO: 1899725 - protein, 21 aa, Staphylococcus
KDSIEMIQIDQLLITILSGYE

SEQ ID NO: 1899726 - protein, 24 aa, Staphylococcus
KDTKLPVIFWMHGGGFIAGDKQYK

SEQ ID NO: 1899727 - protein, 28 aa, Staphylococcus
KDTQLFKLSWLVIILLLSGYLISEFTGI

SEQ ID NO: 1899728 - protein, 24 aa, Staphylococcus
KDVELPLALPLILGGIRLSSVYVI

SEQ ID NO: 1899729 - protein, 19 aa, Staphylococcus
KDVEWGTIIVTLATFAILL

SEQ ID NO: 1899730 - protein, 41 aa, Staphylococcus
KDWIPNRLVLLTIHFSFFVVIALIIAYLTQLLFKKLKESYL

SEQ ID NO: 1899731 - protein, 22 aa, Staphylococcus
KDYKDILPMKHEYPKDAHVLNI

SEQ ID NO: 1899732 - protein, 21 aa, Staphylococcus
KDYVFINNGWAKNGTYCIIRR

SEQ ID NO: 1899733 - protein, 30 aa, Staphylococcus
KEARFLTLYDYMLNIIAMIAIFATLALGFI

SEQ ID NO: 1899734 - protein, 18 aa, Staphylococcus
KEDGMWKLDWDHSVIIPG

SEQ ID NO: 1899735 - protein, 26 aa, Staphylococcus
KEDTDLRTYLYQHKKPREKVTLTIIR

SEQ ID NO: 1899736 - protein, 24 aa, Staphylococcus
KEEGIPVSTLFYDGSHHLHHQYQF

SEQ ID NO: 1899737 - protein, 27 aa, Staphylococcus
KEEKDAAILLVDDLIKQSEVRLDAATK

SEQ ID NO: 1899738 - protein, 25 aa, Staphylococcus
KEGTGLGLFICRMIIEAQGGTIDLK

SEQ ID NO: 1899739 - protein, 21 aa, Staphylococcus
KEILEYCYAHIEFSGGSLSLT

SEQ ID NO: 1899740 - protein, 27 aa, Staphylococcus
KEILYAWSPFVILTIIVMIWSSPSFKG

SEQ ID NO: 1899741 - protein, 18 aa, Staphylococcus
KEKRLWLTLAVTLFGFSS

SEQ ID NO: 1899742 - protein, 17 aa, Staphylococcus
KEKVIFPFIIACGFIAD

SEQ ID NO: 1899743 - protein, 27 aa, Staphylococcus
KELGVEPIARFVGFKAVGVDPKLMGIG

SEQ ID NO: 1899744 - protein, 22 aa, Staphylococcus
KELKLIMSLGFILGGIIGIFQG

SEQ ID NO: 1899745 - protein, 24 aa, Staphylococcus
KELKYKAKWFPFGPIFAGILCVIV

SEQ ID NO: 1899746 - protein, 22 aa, Staphylococcus
KELNNAMKLLRDAVNQQNQVHQ

SEQ ID NO: 1899747 - protein, 23 aa, Staphylococcus
KELPWGLLILFGGGLALAKGISE

SEQ ID NO: 1899748 - protein, 21 aa, Staphylococcus
KELTFITYALLYSAIILLALT

SEQ ID NO: 1899749 - protein, 19 aa, Staphylococcus
KELWISIFTICFILAVSKL

SEQ ID NO: 1899750 - protein, 19 aa, Staphylococcus
KELWISVLTICFILAVSKV

SEQ ID NO: 1899751 - protein, 22 aa, Staphylococcus
KELWLPIITICFILVISKLMTY

SEQ ID NO: 1899752 - protein, 19 aa, Staphylococcus
KELWLPILTICFILAISKI

SEQ ID NO: 1899753 - protein, 21 aa, Staphylococcus
KELWLPILTICFILAISKITT

SEQ ID NO: 1899754 - protein, 18 aa, Staphylococcus
KELWLPVLTICFILAISK

SEQ ID NO: 1899755 - protein, 18 aa, Staphylococcus
KELWVSVLTICFILAVSK

SEQ ID NO: 1899756 - protein, 24 aa, Staphylococcus
KENQAWLWVIVLVAFAITVIGTIN

SEQ ID NO: 1899757 - protein, 24 aa, Staphylococcus
KENQAWLWVLVLVAFSITVISMLN

SEQ ID NO: 1899758 - protein, 63 aa, Staphylococcus
KERKQKRNWWLRLSFIVLSIVGLGLTLFSFVTQNLIFGVIFAILTVIFIVGTFLVKTKEIDYS

SEQ ID NO: 1899759 - protein, 25 aa, Staphylococcus
KESRRLLYIFLIASVGTLMGTTVGF

SEQ ID NO: 1899760 - protein, 25 aa, Staphylococcus
KETMVWLIVIFISIQLIGAITLYFS

SEQ ID NO: 1899761 - protein, 25 aa, Staphylococcus
KFAIFLMVVLVILGGVYSSAKLKLE

SEQ ID NO: 1899762 - protein, 23 aa, Staphylococcus
KFAYIKILCNYAFFDDDIIDSKE

SEQ ID NO: 1899763 - protein, 27 aa, Staphylococcus
KFDGFKKDLKWELGLGATIVTATIALI

SEQ ID NO: 1899764 - protein, 18 aa, Staphylococcus
KFDRLIAVLGIVTPFLVI

SEQ ID NO: 1899765 - protein, 26 aa, Staphylococcus
KFDYLYIFQFMILIGLFLTYWAVTEF

SEQ ID NO: 1899766 - protein, 33 aa, Staphylococcus
KFELPHVLLIMLIMMMFACFLTYIIPAGAFDTN

SEQ ID NO: 1899767 - protein, 30 aa, Staphylococcus
KFFSPLTWSLIFITLLLLLNIFTVRAFGEA

SEQ ID NO: 1899768 - protein, 20 aa, Staphylococcus
KFGFWIFLTAEFSLFGTLFA

SEQ ID NO: 1899769 - protein, 32 aa, Staphylococcus
KFIAKNKWVSILAWLIVLGVIITPLMINSPKF

SEQ ID NO: 1899770 - protein, 26 aa, Staphylococcus
KFIFPILIGIIIWLLTPIRPEGLDVG

SEQ ID NO: 1899771 - protein, 21 aa, Staphylococcus
KFIIITFLILVANSVTFVYIN

SEQ ID NO: 1899772 - protein, 18 aa, Staphylococcus
KFILGIIGFLFIILLMPD

SEQ ID NO: 1899773 - protein, 21 aa, Staphylococcus
KFILPIVVGLIIWALTPFKPD

SEQ ID NO: 1899774 - protein, 22 aa, Staphylococcus
KFILPIVVGLLIWALTPFKPDA

SEQ ID NO: 1899775 - protein, 20 aa, Staphylococcus
KFIMYIFFGKHQPNALPKKA

SEQ ID NO: 1899776 - protein, 30 aa, Staphylococcus
KFINSQIATLFLLDIVSYLLLNDTHMHHVY

SEQ ID NO: 1899777 - protein, 26 aa, Staphylococcus
KFIQPIIFLMLGIFIVSLYLSIMLPM

SEQ ID NO: 1899778 - protein, 17 aa, Staphylococcus
KFKEMVRMLLFNNAAFL

SEQ ID NO: 1899779 - protein, 20 aa, Staphylococcus
KFKFRMPGAFAILFILTVVA

SEQ ID NO: 1899780 - protein, 18 aa, Staphylococcus
KFKFSYSWIQFAKIFLYS

SEQ ID NO: 1899781 - protein, 18 aa, Staphylococcus
KFKIISLPATIYIEFLRG

SEQ ID NO: 1899782 - protein, 28 aa, Staphylococcus
KFKLFVPWYILIKYIMPVIIILVFIVQL

SEQ ID NO: 1899783 - protein, 22 aa, Staphylococcus
KFLKAGWFYQATIIITLLNMIF

SEQ ID NO: 1899784 - protein, 29 aa, Staphylococcus
KFLNNIWFYLIFFLFFGLFLLLLTLIIEK

SEQ ID NO: 1899785 - protein, 23 aa, Staphylococcus
KFLNPVFLILLGIVVVLALIHPM

SEQ ID NO: 1899786 - protein, 24 aa, Staphylococcus
KFLRKMIFLFMFKVLSYIVFIQKI

SEQ ID NO: 1899787 - protein, 29 aa, Staphylococcus
KFLTNIWFYLIFLLFFGLLLFLITLIVQK

SEQ ID NO: 1899788 - protein, 18 aa, Staphylococcus
KFMAPLSFVLASLAIYWA

SEQ ID NO: 1899789 - protein, 19 aa, Staphylococcus
KFMAPLSFVLASLAIYWAM

SEQ ID NO: 1899790 - protein, 19 aa, Staphylococcus
KFMVPILAGYIAVSIADKP

SEQ ID NO: 1899791 - protein, 35 aa, Staphylococcus
KFNSYLKVSCSVLLMSGTLVGYGFTKDGFAQSNDR

SEQ ID NO: 1899792 - protein, 31 aa, Staphylococcus
KFQWLQQWTIFYWAWWISWAPFVGIFIARVS

SEQ ID NO: 1899793 - protein, 17 aa, Staphylococcus
KFSHRPDFAITNGGGIR

SEQ ID NO: 1899794 - protein, 29 aa, Staphylococcus
KFSHVWPILIFLPFVVLVLLKIRSHYRDI

SEQ ID NO: 1899795 - protein, 27 aa, Staphylococcus
KFSHYAIYLFSLVISVVLYFSFITLKY

SEQ ID NO: 1899796 - protein, 26 aa, Staphylococcus
KFSIIFLIIIYLTIGPLFAIPRTAST

SEQ ID NO: 1899797 - protein, 33 aa, Staphylococcus
KFSILLLIFGIWITLLPPLPFKILGLAFSVYAF

SEQ ID NO: 1899798 - protein, 37 aa, Staphylococcus
KFSIRKYAIGTFSTVIATLVFIGFNTGQAQANESDQP

SEQ ID NO: 1899799 - protein, 33 aa, Staphylococcus
KFSIRKYAIGTVSTLVATFVFLGVNHDAQASEH

SEQ ID NO: 1899800 - protein, 35 aa, Staphylococcus
KFSIRKYAVGTFSTLIATLVFLGTHTDQAHASENT

SEQ ID NO: 1899801 - protein, 21 aa, Staphylococcus
KFSLFLAMLLACLLIQAATNM

SEQ ID NO: 1899802 - protein, 26 aa, Staphylococcus
KFSVIFLIIIYLTIGPLFAIPRTAST

SEQ ID NO: 1899803 - protein, 19 aa, Staphylococcus
KFVTIMILSILPLALVKVL

SEQ ID NO: 1899804 - protein, 24 aa, Staphylococcus
KFVWLIMMLIFLFSILRVVIIEAF

SEQ ID NO: 1899805 - protein, 18 aa, Staphylococcus
KFWKFFGLRLGKIKYWFI

SEQ ID NO: 1899806 - protein, 21 aa, Staphylococcus
KFYFCINLILPFLIITSILIF

SEQ ID NO: 1899807 - protein, 28 aa, Staphylococcus
KFYKFRFILIMLIVFLMSTMVLFISGLA

SEQ ID NO: 1899808 - protein, 29 aa, Staphylococcus
KFYKFRYILIMLIIFLLGSMVLFINGLAQ

SEQ ID NO: 1899809 - protein, 36 aa, Staphylococcus
KFYKFRYVLIMLIIVLLSLMVLFISGLAQGLARENV

SEQ ID NO: 1899810 - protein, 30 aa, Staphylococcus
KFYRFRYTLIMLIIFLLGSMVLFISGLAQG

SEQ ID NO: 1899811 - protein, 23 aa, Staphylococcus
KGAPWNIVVFSIGMYLVVFGLKN

SEQ ID NO: 1899812 - protein, 26 aa, Staphylococcus
KGAYLSLIVYIILSIVKYFVGYVYDS

SEQ ID NO: 1899813 - protein, 23 aa, Staphylococcus
KGDDGLYYFYPNKDSLNEVKQKI

SEQ ID NO: 1899814 - protein, 23 aa, Staphylococcus
KGDKIGTPGFVRGLHDMHEKEGK

SEQ ID NO: 1899815 - protein, 26 aa, Staphylococcus
KGDYILFAVIIILAIIGIIRLAMGSV

SEQ ID NO: 1899816 - protein, 23 aa, Staphylococcus
KGEFVKVQGLPYKDHSLPENAMD

SEQ ID NO: 1899817 - protein, 26 aa, Staphylococcus
KGELLPIIFFAVFFGLALAAIGEKGE

SEQ ID NO: 1899818 - protein, 26 aa, Staphylococcus
KGELLPIIFFAVFFGLGIAAIGEKGK

SEQ ID NO: 1899819 - protein, 26 aa, Staphylococcus
KGELLPIIFFAVFFGLGLAAIGEKAD

SEQ ID NO: 1899820 - protein, 19 aa, Staphylococcus
KGFLSLIPVLIGIITGYIV

SEQ ID NO: 1899821 - protein, 22 aa, Staphylococcus
KGGCDIIYQIGPGLFGVRDKDG

SEQ ID NO: 1899822 - protein, 23 aa, Staphylococcus
KGGMILMLFAYLLALIALKELLN

SEQ ID NO: 1899823 - protein, 29 aa, Staphylococcus
KGIESIKDIQPIIVKKPAARVELDKALKR

SEQ ID NO: 1899824 - protein, 26 aa, Staphylococcus
KGITLFYIFILLLMIGLLYQHMIVIN

SEQ ID NO: 1899825 - protein, 22 aa, Staphylococcus
KGIWQVKPVMNGWDHLDFVGLD

SEQ ID NO: 1899826 - protein, 24 aa, Staphylococcus
KGKKISLIISPQWFTDHGLTNKNY

SEQ ID NO: 1899827 - protein, 25 aa, Staphylococcus
KGKKMTFIISPQWFSTHGVNDRDFA

SEQ ID NO: 1899828 - protein, 29 aa, Staphylococcus
KGLLSGLLSLIFGLAIFRKSRKDKKDRKE

SEQ ID NO: 1899829 - protein, 32 aa, Staphylococcus
KGLNWIHYPWDFLVIIIVALIFYQLGAISSFE

SEQ ID NO: 1899830 - protein, 26 aa, Staphylococcus
KGLTPILFFLIFTFLMHLFLTKGGTV

SEQ ID NO: 1899831 - protein, 30 aa, Staphylococcus
KGMPAWGWSILFLLIIFALNSLSVRVYGES

SEQ ID NO: 1899832 - protein, 24 aa, Staphylococcus
KGNLLLELAVIFGVSSLVTAFLKT

SEQ ID NO: 1899833 - protein, 23 aa, Staphylococcus
KGNNAITFLLQNIQPHQTLIVDG

SEQ ID NO: 1899834 - protein, 23 aa, Staphylococcus
KGPFYSHLITLTNHYPFTLSEED

SEQ ID NO: 1899835 - protein, 26 aa, Staphylococcus
KGPILYIILAFILIAGFFIFTGMIPE

SEQ ID NO: 1899836 - protein, 24 aa, Staphylococcus
KGQLPPEQFIGQDWQYTGHKIEKD

SEQ ID NO: 1899837 - protein, 24 aa, Staphylococcus
KGQVSRRSFLKMLGIGGAGVVIGA

SEQ ID NO: 1899838 - protein, 29 aa, Staphylococcus
KGRGQGLPAPFWSYLQKLNFGKVKLSNNK

SEQ ID NO: 1899839 - protein, 25 aa, Staphylococcus
KGRLKFIIMSLIGILLFLIPIPVTE

SEQ ID NO: 1899840 - protein, 33 aa, Staphylococcus
KGSRKRLEFYRLYLFMVHLLKFGGMYASSVNRS

SEQ ID NO: 1899841 - protein, 26 aa, Staphylococcus
KGTTFIGIISFFAWGLGYFGQPHIIV

SEQ ID NO: 1899842 - protein, 22 aa, Staphylococcus
KGVKLLYPLPITIKTPLNFKTG

SEQ ID NO: 1899843 - protein, 34 aa, Staphylococcus
KGVRQGLLLIFPALLGYFLGNFALGLFVSTGTLA

SEQ ID NO: 1899844 - protein, 18 aa, Staphylococcus
KGWPSMMHAIWKNPEKYD

SEQ ID NO: 1899845 - protein, 27 aa, Staphylococcus
KGYGSLWVWPILIIAILFIVNFVVFNH

SEQ ID NO: 1899846 - protein, 33 aa, Staphylococcus
KGYKLLWIIISFIVLIAILLLPTPAGLPVMAKM

SEQ ID NO: 1899847 - protein, 33 aa, Staphylococcus
KGYKPIWIVISFIALIVILLLPTPTGLPVMAKG

SEQ ID NO: 1899848 - protein, 33 aa, Staphylococcus
KGYKPLWIVISFIVLVIILLLPTSSSLPVMAKA

SEQ ID NO: 1899849 - protein, 38 aa, Staphylococcus
KHAKPTPFLARVIGWSIALVLGFIITAALLFTNQGIVQ

SEQ ID NO: 1899850 - protein, 22 aa, Staphylococcus
KHDLQVLAIYREMSSGSTLDPQ

SEQ ID NO: 1899851 - protein, 28 aa, Staphylococcus
KHELKYKAKWFPFGPIFAGVLCVIVIIG

SEQ ID NO: 1899852 - protein, 17 aa, Staphylococcus
KHFLLFNGLMGGLSFVL

SEQ ID NO: 1899853 - protein, 26 aa, Staphylococcus
KHFVNIFSILLLLLTGTVFVTSPALL

SEQ ID NO: 1899854 - protein, 36 aa, Staphylococcus
KHIQWKSILILALLNVFLAWFFVYFQIGRSIVEGLA

SEQ ID NO: 1899855 - protein, 35 aa, Staphylococcus
KHIRWKYVALLLVIQFIFAFILLKTTAGIHVIGGI

SEQ ID NO: 1899856 - protein, 26 aa, Staphylococcus
KHLPNRALLILTIIGVLIGSMFPFAF

SEQ ID NO: 1899857 - protein, 24 aa, Staphylococcus
KHPTLFFFALLFYIVGWLTIRSTI

SEQ ID NO: 1899858 - protein, 23 aa, Staphylococcus
KHQAIWVLLLMTTGTWINYLIKQ

SEQ ID NO: 1899859 - protein, 27 aa, Staphylococcus
KHRIGKLIIVWFTLIAVTIGCAAYISG

SEQ ID NO: 1899860 - protein, 21 aa, Staphylococcus
KHSFKTLSPYIKSNYSKYVDY

SEQ ID NO: 1899861 - protein, 17 aa, Staphylococcus
KHSLFIIELPTYRIPSI

SEQ ID NO: 1899862 - protein, 39 aa, Staphylococcus
KHTMNKRISFVFGAIVVIFGIIVLRLGYLQIAQGSQYSQ

SEQ ID NO: 1899863 - protein, 33 aa, Staphylococcus
KHVKVPDFIVKFWTLLVSTLIVLVLLGTLVVNN

SEQ ID NO: 1899864 - protein, 23 aa, Staphylococcus
KHVNEVYLISHALLETGSAKSEL

SEQ ID NO: 1899865 - protein, 25 aa, Staphylococcus
KHWLLKVDWILVAIITLLAILSVTL

SEQ ID NO: 1899866 - protein, 20 aa, Staphylococcus
KHYYFKLFAISTLILICASF

SEQ ID NO: 1899867 - protein, 19 aa, Staphylococcus
KIAIILYLPFMIEKKMPAV

SEQ ID NO: 1899868 - protein, 25 aa, Staphylococcus
KIATRYWRLIALLPITMSSITVGFI

SEQ ID NO: 1899869 - protein, 21 aa, Staphylococcus
KIAVFVSIALLGFIGLILGVM

SEQ ID NO: 1899870 - protein, 22 aa, Staphylococcus
KIAYFRKKIWISAGILGIIHYS

SEQ ID NO: 1899871 - protein, 24 aa, Staphylococcus
KIERISHLVLTRTGLYIIDSQLLK

SEQ ID NO: 1899872 - protein, 20 aa, Staphylococcus
KIERPSIGIGLLNLSEIPDS

SEQ ID NO: 1899873 - protein, 17 aa, Staphylococcus
KIFIIGYVSLLVFHILQ

SEQ ID NO: 1899874 - protein, 21 aa, Staphylococcus
KIFIIIFIILTLVSPLFAIGS

SEQ ID NO: 1899875 - protein, 23 aa, Staphylococcus
KIFPLDFKVLIGIGLLFCVGTPI

SEQ ID NO: 1899876 - protein, 18 aa, Staphylococcus
KIFRISYIINALNSIVGF

SEQ ID NO: 1899877 - protein, 22 aa, Staphylococcus
KIFYRIVLPLSKRYILSGIVMS

SEQ ID NO: 1899878 - protein, 26 aa, Staphylococcus
KIGETFFIYLIWYSIGRFFVEGLRTD

SEQ ID NO: 1899879 - protein, 24 aa, Staphylococcus
KIGSYFLFIIIVVFIMYTNILFIK

SEQ ID NO: 1899880 - protein, 24 aa, Staphylococcus
KIGSYIFMFLIGTVAIAALVGIGY

SEQ ID NO: 1899881 - protein, 17 aa, Staphylococcus
KIGVMYLICAVLMFVRG

SEQ ID NO: 1899882 - protein, 33 aa, Staphylococcus
KIHHSTLLETIWFIVPFIILFALAIPTVKTLYD

SEQ ID NO: 1899883 - protein, 31 aa, Staphylococcus
KIHLGWFVLPIPVVLFIYFLSLISTTQSGNT

SEQ ID NO: 1899884 - protein, 31 aa, Staphylococcus
KIHLGWFVLPVPVVLFIYFLTYISTTQSGNT

SEQ ID NO: 1899885 - protein, 17 aa, Staphylococcus
KIIFRKKLTTFLSIILP

SEQ ID NO: 1899886 - protein, 25 aa, Staphylococcus
KIIIFTTILIFILTIILSVIIQTNK

SEQ ID NO: 1899887 - protein, 17 aa, Staphylococcus
KIIIIIALLAMSIMSQN

SEQ ID NO: 1899888 - protein, 18 aa, Staphylococcus
KIIILSHVLSHLDDVFFK

SEQ ID NO: 1899889 - protein, 42 aa, Staphylococcus
KIIKKNWGIWLFIPIIFLLISLIITFLFMTPKYEATTQILIN

SEQ ID NO: 1899890 - protein, 23 aa, Staphylococcus
KIILPPFFMATGALMYVIPYFRL

SEQ ID NO: 1899891 - protein, 34 aa, Staphylococcus
KIIMNKYLGIPIFLGIIWLIFQTTFTWVGTPLSD

SEQ ID NO: 1899892 - protein, 23 aa, Staphylococcus
KIKAAIFFGGFYDMKTVKATEFP

SEQ ID NO: 1899893 - protein, 24 aa, Staphylococcus
KIKFFKWVTIIGFILLSLLFIGSF

SEQ ID NO: 1899894 - protein, 37 aa, Staphylococcus
KIKNKPTMIALISFILFLILLFLFLNHNDQKSDRITV

SEQ ID NO: 1899895 - protein, 22 aa, Staphylococcus
KIKRFTHYLKTSRQVSYAGLGS

SEQ ID NO: 1899896 - protein, 32 aa, Staphylococcus
KIKRQQWLRFSFVLLAIVGIALAVFSFMTQNM

SEQ ID NO: 1899897 - protein, 24 aa, Staphylococcus
KIKRRYIIPWAIVGLIVVLIYQVI

SEQ ID NO: 1899898 - protein, 43 aa, Staphylococcus
KIKRTVEHILTWLGVVLQALAAIMFLVLKPLMGNSNFKDQMIS

SEQ ID NO: 1899899 - protein, 20 aa, Staphylococcus
KILAPIFLTIMFVGGFFILS

SEQ ID NO: 1899900 - protein, 29 aa, Staphylococcus
KILLPIFSIVFFVLAWLFARKPSKILDYI

SEQ ID NO: 1899901 - protein, 20 aa, Staphylococcus
KILMIPLTMTIFSILGFSIG

SEQ ID NO: 1899902 - protein, 20 aa, Staphylococcus
KILMIPLTMTVFSILGFSIG

SEQ ID NO: 1899903 - protein, 36 aa, Staphylococcus
KILMNKYLGIPIFLGIIWLIFQITFTWVGTPLSDKM

SEQ ID NO: 1899904 - protein, 22 aa, Staphylococcus
KILNFIVISILLIMSLYFGYAI

SEQ ID NO: 1899905 - protein, 19 aa, Staphylococcus
KILPWIINVLGLAISKING

SEQ ID NO: 1899906 - protein, 20 aa, Staphylococcus
KILYIAMIGVFLFGIGSLMS

SEQ ID NO: 1899907 - protein, 29 aa, Staphylococcus
KILYKRIIFTCWILLIYIFGTHIPAITTV

SEQ ID NO: 1899908 - protein, 25 aa, Staphylococcus
KIMMPLLFIFLIIVVVKSLSLDGSL

SEQ ID NO: 1899909 - protein, 26 aa, Staphylococcus
KIMMPLLFIFLLIIVVKSLTLDGALE

SEQ ID NO: 1899910 - protein, 17 aa, Staphylococcus
KINDKWLLILCVLVIII

SEQ ID NO: 1899911 - protein, 17 aa, Staphylococcus
KINFLILFVTTLIIGVL

SEQ ID NO: 1899912 - protein, 24 aa, Staphylococcus
KINMPNIEGMGFAIPIDAAREIAE

SEQ ID NO: 1899913 - protein, 25 aa, Staphylococcus
KINWKVFLTPIILTLVLAFGLSAFE

SEQ ID NO: 1899914 - protein, 41 aa, Staphylococcus
KIRNTMNKRISFIFGIIVFIFAIIVLRLGYLQIAQGSHYKQ

SEQ ID NO: 1899915 - protein, 17 aa, Staphylococcus
KISIIFAIVFFLLNFFS

SEQ ID NO: 1899916 - protein, 35 aa, Staphylococcus
KISNIEQDRILFDNRLNGMGPYPTGKLSAMVNIPS

SEQ ID NO: 1899917 - protein, 20 aa, Staphylococcus
KISRFFKLIGLRFKARKESR

SEQ ID NO: 1899918 - protein, 27 aa, Staphylococcus
KITTSTYFFLFFFGIIAILALEHNHAF

SEQ ID NO: 1899919 - protein, 26 aa, Staphylococcus
KITTTTYFFLFISGFLSILALEYNHA

SEQ ID NO: 1899920 - protein, 18 aa, Staphylococcus
KIVFIIVTILLILKNTFD

SEQ ID NO: 1899921 - protein, 29 aa, Staphylococcus
KIVLPIFSILFFLIAWFFSRKPSKILDYI

SEQ ID NO: 1899922 - protein, 20 aa, Staphylococcus
KIVMKWAIGSSLFMILVAGL

SEQ ID NO: 1899923 - protein, 25 aa, Staphylococcus
KIWTWVFMVLSLVVFLFGIGSIICS

SEQ ID NO: 1899924 - protein, 17 aa, Staphylococcus
KIYFQGNRRLLHQAFSN

SEQ ID NO: 1899925 - protein, 20 aa, Staphylococcus
KIYILLGAITFIFSFSTLKL

SEQ ID NO: 1899926 - protein, 20 aa, Staphylococcus
KKDIKQLKHLSAVELKSYKE

SEQ ID NO: 1899927 - protein, 17 aa, Staphylococcus
KKDIWICKSGDGYFIAD

SEQ ID NO: 1899928 - protein, 24 aa, Staphylococcus
KKEPVIIFMIPGIIPLVPGGLAFD

SEQ ID NO: 1899929 - protein, 26 aa, Staphylococcus
KKFVSVIDVPFKIALAKEYASTLTIG

SEQ ID NO: 1899930 - protein, 18 aa, Staphylococcus
KKGDFVFLVKEKGSDKFS

SEQ ID NO: 1899931 - protein, 40 aa, Staphylococcus
KKGDRVFIFMSRTPELYFAFLGILKIGAIVGPLFEAFMEK

SEQ ID NO: 1899932 - protein, 25 aa, Staphylococcus
KKGKAIYINVYKNGSEWSVDQVIEG

SEQ ID NO: 1899933 - protein, 25 aa, Staphylococcus
KKGWPSMMYSIWKNPEKYNSYFIGD

SEQ ID NO: 1899934 - protein, 24 aa, Staphylococcus
KKHFRLMLFIEGIYQYIIIGCLSI

SEQ ID NO: 1899935 - protein, 25 aa, Staphylococcus
KKHIHEPWLFSLPAIILMVMIPIIF

SEQ ID NO: 1899936 - protein, 23 aa, Staphylococcus
KKHIHEPWLFSLPAMIFAVMLPV

SEQ ID NO: 1899937 - protein, 22 aa, Staphylococcus
KKHIRVLLFIEAIYQTFVIALL

SEQ ID NO: 1899938 - protein, 39 aa, Staphylococcus
KKHSKMKITVLSLIFALLLAGLVGFIGMGVFGSKYEEMP

SEQ ID NO: 1899939 - protein, 44 aa, Staphylococcus
KKIAKTPAVWIILAGLAILPSFYAWFNLWAMWDPYGNTGHIKVA

SEQ ID NO: 1899940 - protein, 22 aa, Staphylococcus
KKIGVMYLICAVLMFVRGGIDA

SEQ ID NO: 1899941 - protein, 22 aa, Staphylococcus
KKIRKLAALFLFIINVTRLATS

SEQ ID NO: 1899942 - protein, 21 aa, Staphylococcus
KKIVFFARFIPVIRSLISIPA

SEQ ID NO: 1899943 - protein, 33 aa, Staphylococcus
KKIVYAWSPFIILTVIVLIWSSSFFKGLFEKKG

SEQ ID NO: 1899944 - protein, 33 aa, Staphylococcus
KKKFDFWTYIMLILLIGSLILLGPLIVYLSWWG

SEQ ID NO: 1899945 - protein, 24 aa, Staphylococcus
KKKIWYLGIFLFYSSLLELLIHFT

SEQ ID NO: 1899946 - protein, 38 aa, Staphylococcus
KKKKGKGIILKLLIPILIIIGIIIGVMYALSLRADTDE

SEQ ID NO: 1899947 - protein, 34 aa, Staphylococcus
KKKKLRKLPFVILIIVVLLIVMITYVVHGYQSGM

SEQ ID NO: 1899948 - protein, 41 aa, Staphylococcus
KKKKRKKGWLWGCGGCLVLLILLIIGLTSCTGAFVNEVDKQ

SEQ ID NO: 1899949 - protein, 37 aa, Staphylococcus
KKKRKKSWLFGCGGCLVLLILIIIGVTACTGSFVNEV

SEQ ID NO: 1899950 - protein, 43 aa, Staphylococcus
KKKRSKKKKFFFALIFLILLAGLITFLAFGMFGDKYTETPDLR

SEQ ID NO: 1899951 - protein, 38 aa, Staphylococcus
KKKRVRKLPFIILFILIILIVIIAYIAHGYNSGVKYAE

SEQ ID NO: 1899952 - protein, 35 aa, Staphylococcus
KKKSNKILLKILIIVIVLVAIFMGAMYVLSSRANV

SEQ ID NO: 1899953 - protein, 27 aa, Staphylococcus
KKLFKTSWIILIILLIGYLTSEFIHVP

SEQ ID NO: 1899954 - protein, 22 aa, Staphylococcus
KKLHLIGHSMGGQTIRLLEHFL

SEQ ID NO: 1899955 - protein, 20 aa, Staphylococcus
KKLKDDIQLDARYYQGYTQA

SEQ ID NO: 1899956 - protein, 27 aa, Staphylococcus
KKLLLPYFIFFAFYSVYYFLTGKSDSL

SEQ ID NO: 1899957 - protein, 22 aa, Staphylococcus
KKLNKLFTSLRSKYYLFVSDPV

SEQ ID NO: 1899958 - protein, 43 aa, Staphylococcus
KKMSGFAKIVSGLIVLLLVGGLIFAIFAFVDHSNKANERLADQ

SEQ ID NO: 1899959 - protein, 28 aa, Staphylococcus
KKMTSLVVIVVVLGVLAFQYINQTGPFQ

SEQ ID NO: 1899960 - protein, 32 aa, Staphylococcus
KKNFSYGTASALTLALYLFAGNGSAQAEEINK

SEQ ID NO: 1899961 - protein, 22 aa, Staphylococcus
KKNHELLWLKYQSHKIILEYPH

SEQ ID NO: 1899962 - protein, 31 aa, Staphylococcus
KKNIAGLIFVSWYPTIYWIINAAVVIFAFPK

SEQ ID NO: 1899963 - protein, 25 aa, Staphylococcus
KKNKHLIDDVDHTPLLVAKKKKNNE

SEQ ID NO: 1899964 - protein, 24 aa, Staphylococcus
KKNRKWYLPFGYAAEDIELNNISL

SEQ ID NO: 1899965 - protein, 35 aa, Staphylococcus
KKNVRWHYVGLLLIIQLILAFILLKTTAGITIIGG

SEQ ID NO: 1899966 - protein, 27 aa, Staphylococcus
KKPDQLPLRTFLEQQFYLTQTALRIQE

SEQ ID NO: 1899967 - protein, 20 aa, Staphylococcus
KKPFIIACISGGIGALVASF

SEQ ID NO: 1899968 - protein, 23 aa, Staphylococcus
KKPFYSHLITLTNHYPFTLDDKD

SEQ ID NO: 1899969 - protein, 18 aa, Staphylococcus
KKPKLAGILLIIAGILAI

SEQ ID NO: 1899970 - protein, 22 aa, Staphylococcus
KKPLIIVMTIFTLASLGIIFVH

SEQ ID NO: 1899971 - protein, 40 aa, Staphylococcus
KKPLPKFLTLFAGPLFNFILAIVLFIGLAYYHGTPTTTVG

SEQ ID NO: 1899972 - protein, 42 aa, Staphylococcus
KKPLPKFLTLFAGPLFNFILALILFIALAYFQGTPTTSVGQL

SEQ ID NO: 1899973 - protein, 42 aa, Staphylococcus
KKPLPKFLTLFAGPLFNFILALVLFIGLAYYQGTPTPTVKQL

SEQ ID NO: 1899974 - protein, 18 aa, Staphylococcus
KKPSAEEIAIAQTAIKKE

SEQ ID NO: 1899975 - protein, 41 aa, Staphylococcus
KKPYQKFLTLFAGPLFNFILALVIFIGLAYYQGTPTNSVKQ

SEQ ID NO: 1899976 - protein, 37 aa, Staphylococcus
KKRKLKSIPIFIALIALIVLIFIIIIVANYQADHNDK

SEQ ID NO: 1899977 - protein, 42 aa, Staphylococcus
KKRSKKKKFAIALILLLLVASLFGFIAMGMFGSKYAEVPDLK

SEQ ID NO: 1899978 - protein, 42 aa, Staphylococcus
KKRSKKKKFAIIFILALLLLSLIGFIAWGMLSDKYTEMPDLT

SEQ ID NO: 1899979 - protein, 43 aa, Staphylococcus
KKRTKKKKFFYTLIIVLLLFGLFGFMAMGMFGNKYLETPDLSG

SEQ ID NO: 1899980 - protein, 21 aa, Staphylococcus
KKRYVIVWAIVGYFVVMIYQI

SEQ ID NO: 1899981 - protein, 21 aa, Staphylococcus
KKSKIAGIILLIVGVIALLTS

SEQ ID NO: 1899982 - protein, 19 aa, Staphylococcus
KKSKKWYLPFGYDAEDIEL

SEQ ID NO: 1899983 - protein, 38 aa, Staphylococcus
KKSKRKKGWFFGCGGCLVLLILIVIGISACTATFVNDT

SEQ ID NO: 1899984 - protein, 23 aa, Staphylococcus
KKSTWIWPIVIIAIMFTLLFISQ

SEQ ID NO: 1899985 - protein, 36 aa, Staphylococcus
KKTKHAIVGLFSVGLFICLIGFIGTVIYFNHLTHES

SEQ ID NO: 1899986 - protein, 24 aa, Staphylococcus
KKTKKWYLPFGYGADDIDLNNISL

SEQ ID NO: 1899987 - protein, 24 aa, Staphylococcus
KKTMLWAAVFALTFFIIYATRTVF

SEQ ID NO: 1899988 - protein, 26 aa, Staphylococcus
KKTTLILMIAAIVLGVLGIAKYMIDA

SEQ ID NO: 1899989 - protein, 24 aa, Staphylococcus
KKVMLWAAVFALTFFIIYASRTIF

SEQ ID NO: 1899990 - protein, 38 aa, Staphylococcus
KKVTDITPPYLIKKDGKYYVFNQYLTKSNYYQNTRTSG

SEQ ID NO: 1899991 - protein, 28 aa, Staphylococcus
KKWGGLSYFLYLIQFIRLHKRVGSFSIV

SEQ ID NO: 1899992 - protein, 20 aa, Staphylococcus
KKWRKFSVNKILLYATLITG

SEQ ID NO: 1899993 - protein, 17 aa, Staphylococcus
KKYFILIISMAIVTFIC

SEQ ID NO: 1899994 - protein, 24 aa, Staphylococcus
KKYRKRFIALLLLCVMFAICWIAY

SEQ ID NO: 1899995 - protein, 26 aa, Staphylococcus
KLAGDPYFSGMPLPNNIAIAGQKLRK

SEQ ID NO: 1899996 - protein, 38 aa, Staphylococcus
KLALLYSRPLYYFGVVMKPLIWLMNGSARMIIRMFGVD

SEQ ID NO: 1899997 - protein, 18 aa, Staphylococcus
KLAWLMGSFILILGFIIQ

SEQ ID NO: 1899998 - protein, 44 aa, Staphylococcus
KLFAILKKNMKYLIILPIVFLVLSMMMTFLFITPKYSSSTQVLV

SEQ ID NO: 1899999 - protein, 24 aa, Staphylococcus
KLFKIGGKILILYFVCCAFLAICQ

SEQ ID NO: 1900000 - protein, 17 aa, Staphylococcus
KLFLVAMTLFTIGSLVC

SEQ ID NO: 1900001 - protein, 28 aa, Staphylococcus
KLGGKILIFYFIFCGILAICQNLISVSL

SEQ ID NO: 1900002 - protein, 17 aa, Staphylococcus
KLGLKYTFKSQIDDKTV

SEQ ID NO: 1900003 - protein, 18 aa, Staphylococcus
KLHLLCLTLPIVVAIIGL

SEQ ID NO: 1900004 - protein, 21 aa, Staphylococcus
KLIFYWVKYLNYQIVYRAKED

SEQ ID NO: 1900005 - protein, 24 aa, Staphylococcus
KLIGQLLIVLVIMIGLSLFMQNIN

SEQ ID NO: 1900006 - protein, 38 aa, Staphylococcus
KLIKILKKNLKWLIILPLVFLVVGMILTFFVIKPEYEA

SEQ ID NO: 1900007 - protein, 17 aa, Staphylococcus
KLIPVFFIRRWFDNKTT

SEQ ID NO: 1900008 - protein, 17 aa, Staphylococcus
KLKALIDAKTLAKQEII

SEQ ID NO: 1900009 - protein, 17 aa, Staphylococcus
KLKIYIVLIISVIVMMF

SEQ ID NO: 1900010 - protein, 20 aa, Staphylococcus
KLKVLFFNTLNTPLENRKHF

SEQ ID NO: 1900011 - protein, 30 aa, Staphylococcus
KLLKTIANIFIPLIPAFIGAGLIGGIAAVL

SEQ ID NO: 1900012 - protein, 17 aa, Staphylococcus
KLLLIDIGVILFVISLT

SEQ ID NO: 1900013 - protein, 20 aa, Staphylococcus
KLLMILTVIVGFLSIKGFPI

SEQ ID NO: 1900014 - protein, 21 aa, Staphylococcus
KLLSIIIMYVIGLIVTLGIGS

SEQ ID NO: 1900015 - protein, 25 aa, Staphylococcus
KLLVPYIIFFAFFSIYYYLTGKEDA

SEQ ID NO: 1900016 - protein, 18 aa, Staphylococcus
KLLYPIPLTIKFPFTFKT

SEQ ID NO: 1900017 - protein, 24 aa, Staphylococcus
KLNIKWPFWFSQVGLILLGVQIGS

SEQ ID NO: 1900018 - protein, 24 aa, Staphylococcus
KLNPFWTILLCFIFLHEKVRKYQI

SEQ ID NO: 1900019 - protein, 25 aa, Staphylococcus
KLNRKYLLILLMIIFMIGNIAASLS

SEQ ID NO: 1900020 - protein, 17 aa, Staphylococcus
KLPAFVLLLTFCSIVIY

SEQ ID NO: 1900021 - protein, 32 aa, Staphylococcus
KLPKKTKIILTIIILLVAILGSILGHMFSDDK

SEQ ID NO: 1900022 - protein, 26 aa, Staphylococcus
KLPSFTFIEMIFSLMITTILLTSVPL

SEQ ID NO: 1900023 - protein, 17 aa, Staphylococcus
KLPWIIMYGLTGLLIPA

SEQ ID NO: 1900024 - protein, 19 aa, Staphylococcus
KLQDEPINFILNSDTKLKA

SEQ ID NO: 1900025 - protein, 17 aa, Staphylococcus
KLSFGFMVPILAAYIAY

SEQ ID NO: 1900026 - protein, 17 aa, Staphylococcus
KLSLWLLVTIYTGTYIN

SEQ ID NO: 1900027 - protein, 17 aa, Staphylococcus
KLSMDKLPYIKLHTGTT

SEQ ID NO: 1900028 - protein, 21 aa, Staphylococcus
KLSNGSHFLAKITGAGCLLGA

SEQ ID NO: 1900029 - protein, 25 aa, Staphylococcus
KLSPIIVLILFIALLYFLVQHDNQL

SEQ ID NO: 1900030 - protein, 23 aa, Staphylococcus
KLSWIFYISMIVLTLLIFLADFL

SEQ ID NO: 1900031 - protein, 18 aa, Staphylococcus
KLTFIQIFFEVTSAFGTC

SEQ ID NO: 1900032 - protein, 27 aa, Staphylococcus
KLTGHTLLIYMLILGGAAIMTYILRYT

SEQ ID NO: 1900033 - protein, 21 aa, Staphylococcus
KLTHRFSARSVLLWTLLIFII

SEQ ID NO: 1900034 - protein, 29 aa, Staphylococcus
KLTKNLYLTFLLLFITIILFVTVVHNAVL

SEQ ID NO: 1900035 - protein, 34 aa, Staphylococcus
KLTLAAMFIFPFYILTVYYFFGRLRGLTRERSQA

SEQ ID NO: 1900036 - protein, 31 aa, Staphylococcus
KLTNRFAVRPVLLWTLFTFIIGNGIITIAPN

SEQ ID NO: 1900037 - protein, 18 aa, Staphylococcus
KLTRIDYWCDVGSSFDEQ

SEQ ID NO: 1900038 - protein, 23 aa, Staphylococcus
KLTSDIFVWFRLVLNDTSDYHQI

SEQ ID NO: 1900039 - protein, 28 aa, Staphylococcus
KLVPILIVLLLIALLYFLFQSDNQQMML

SEQ ID NO: 1900040 - protein, 23 aa, Staphylococcus
KLVPWAHVFILKLLYYIKCRETK

SEQ ID NO: 1900041 - protein, 40 aa, Staphylococcus
KLWITDKLGWYYLILTTFIVFFCIFLIFSPIGKLKLGKPN

SEQ ID NO: 1900042 - protein, 29 aa, Staphylococcus
KLYKHYYYRLFAIATWIMLIGSLTPHFDS

SEQ ID NO: 1900043 - protein, 20 aa, Staphylococcus
KLYNWSRWLGALFGLLSALI

SEQ ID NO: 1900044 - protein, 29 aa, Staphylococcus
KLYQHYYYKLFAIATWLLLIGSLSQWFDS

SEQ ID NO: 1900045 - protein, 20 aa, Staphylococcus
KLYRYIYNFTTLTTLTVITL

SEQ ID NO: 1900046 - protein, 25 aa, Staphylococcus
KMAELYIMILFAGLFHLMNHAIFKC

SEQ ID NO: 1900047 - protein, 31 aa, Staphylococcus; identical to SEQ ID NO: 1751970

SEQ ID NO: 1900048 - protein, 26 aa, Staphylococcus
KMGFFYIITLIILAVLIIFYIKETKY

SEQ ID NO: 1900049 - protein, 24 aa, Staphylococcus
KMGKYYAGIYIPKEFSHQITGTLR

SEQ ID NO: 1900050 - protein, 43 aa, Staphylococcus
KMGLPTKVFLWFIGILVLLALIAVIYLGYKIFSVGGSIHNPLD

SEQ ID NO: 1900051 - protein, 30 aa, Staphylococcus
KMHFGIAFYFIFLILFLFAALTSSISLLEL

SEQ ID NO: 1900052 - protein, 32 aa, Staphylococcus
KMHHNSLIETIWFVVPIIIVIALAIPTVKTLY

SEQ ID NO: 1900053 - protein, 32 aa, Staphylococcus
KMHHNSLIETIWFVVPILIVIALAIPTVKTLY

SEQ ID NO: 1900054 - protein, 33 aa, Staphylococcus
KMHHNSLLETIWFIIPVIIVIALAIPTVNSLYN

SEQ ID NO: 1900055 - protein, 19 aa, Staphylococcus
KMIGQLLIALVILIGFSLL

SEQ ID NO: 1900056 - protein, 17 aa, Staphylococcus
KMILLILSVMLAGASIS

SEQ ID NO: 1900057 - protein, 24 aa, Staphylococcus
KMIYGIRSLLWEHMIKLKMPFFDK

SEQ ID NO: 1900058 - protein, 18 aa, Staphylococcus
KMLFIYAPVAILISLLSV

SEQ ID NO: 1900059 - protein, 32 aa, Staphylococcus
KMLGLAKEDVIGYYMLGLLNLENEFSLDEIQE

SEQ ID NO: 1900060 - protein, 25 aa, Staphylococcus
KMLIIQTFCVLLGMWIYTIDKNESS

SEQ ID NO: 1900061 - protein, 20 aa, Staphylococcus
KMLLFMILGTIFLDAYDITI

SEQ ID NO: 1900062 - protein, 20 aa, Staphylococcus
KMMFWMILTVILGLIFVGFE

SEQ ID NO: 1900063 - protein, 26 aa, Staphylococcus
KMMIPVYFKHLIIAIPLILNGLITGI

SEQ ID NO: 1900064 - protein, 27 aa, Staphylococcus
KMMIPVYLKHLIIAIPLIINGAIAGII

SEQ ID NO: 1900065 - protein, 23 aa, Staphylococcus
KMMMPLLFVFLIIVVAKSLTLDG

SEQ ID NO: 1900066 - protein, 39 aa, Staphylococcus
KMMRVVRRRIALFGGIMLAIIILLCIMLVFQKHSNEKDA

SEQ ID NO: 1900067 - protein, 24 aa, Staphylococcus
KMNSFSIFLPWTTPGPLGIVMGTG

SEQ ID NO: 1900068 - protein, 32 aa, Staphylococcus
KMNSVMQILTLVSVIFLPLTLITGIYGMNFIN

SEQ ID NO: 1900069 - protein, 23 aa, Staphylococcus
KMSFFFIITIIILVVLIVFYIKE

SEQ ID NO: 1900070 - protein, 24 aa, Staphylococcus
KMSNKLLIFMALTSGVIGVAFATI

SEQ ID NO: 1900071 - protein, 24 aa, Staphylococcus
KMTLKYSVALLIFICIWTFILSMF

SEQ ID NO: 1900072 - protein, 32 aa, Staphylococcus
KMVGIGMILAGIMWALLAPIIAVGTVLSNVFG

SEQ ID NO: 1900073 - protein, 21 aa, Staphylococcus
KMYGLIFIGIILFFTVLIIFI

SEQ ID NO: 1900074 - protein, 29 aa, Staphylococcus
KNAKDLDELKRILKDFKAQRDHIIAQAHL

SEQ ID NO: 1900075 - protein, 24 aa, Staphylococcus
KNDDFEFQMLYGFRSELAEQIARE

SEQ ID NO: 1900076 - protein, 25 aa, Staphylococcus
KNDGINTINQVQAFVTTKSNARNEI

SEQ ID NO: 1900077 - protein, 20 aa, Staphylococcus
KNEILSFYLNNIYYGSDQYT

SEQ ID NO: 1900078 - protein, 63 aa, Staphylococcus
KNESSAIILLLFFIGIILLSIWTQSYLIGFFTSILNVFIFNYFFTVPRFTLEMYRFEYPITFV

SEQ ID NO: 1900079 - protein, 33 aa, Staphylococcus
KNFMSRTLCYYFWLPFGPVLYSYLDGSIFLKSG

SEQ ID NO: 1900080 - protein, 25 aa, Staphylococcus
KNFNFNRILIDKDPYDRLVLYAISK

SEQ ID NO: 1900081 - protein, 32 aa, Staphylococcus
KNGATLSGLISLLLLLIKQVTEMFGIDLSHQL

SEQ ID NO: 1900082 - protein, 17 aa, Staphylococcus
KNGKLIGIASLKIDMDH

SEQ ID NO: 1900083 - protein, 26 aa, Staphylococcus
KNGLKTTLYFLYQQLSDFKTFYFYEE

SEQ ID NO: 1900084 - protein, 31 aa, Staphylococcus
KNGNTVTMLRQAGGFFPGSYVNSVTSNNIGQ

SEQ ID NO: 1900085 - protein, 34 aa, Staphylococcus
KNIIAVIAILIIIYIALKYAPFLRDQEWNPISNP

SEQ ID NO: 1900086 - protein, 35 aa, Staphylococcus
KNIIAVLAIIAIIYIALKYAPFLRDQEWNPLHEST

SEQ ID NO: 1900087 - protein, 17 aa, Staphylococcus
KNIIIVGAIILLSATWI

SEQ ID NO: 1900088 - protein, 47 aa, Staphylococcus
KNIIKQNIYFSIIIKMIAFILVFPGLLTLWLAVFSDTGAAILVILNS

SEQ ID NO: 1900089 - protein, 25 aa, Staphylococcus
KNIKEIKMWVLGLVGTIIGSLIIAV

SEQ ID NO: 1900090 - protein, 17 aa, Staphylococcus
KNIKPIILDNINYANAV

SEQ ID NO: 1900091 - protein, 35 aa, Staphylococcus
KNIRWKYVGLLLVIQLIFAFILLKTNIGITVIGGI

SEQ ID NO: 1900092 - protein, 28 aa, Staphylococcus
KNITFIALFFPIVILAVPFIDTLFAMIR

SEQ ID NO: 1900093 - protein, 26 aa, Staphylococcus
KNKIFKGLFFLCTVIGLVVLVALLAQ

SEQ ID NO: 1900094 - protein, 32 aa, Staphylococcus
KNKINKFLFLACTLIGLLFLAALLIDTLIKGV

SEQ ID NO: 1900095 - protein, 19 aa, Staphylococcus
KNKIYYFNPAALYETHKFS

SEQ ID NO: 1900096 - protein, 31 aa, Staphylococcus
KNKLNHYIIITLLIFVAIILYGYISVGFPHV

SEQ ID NO: 1900097 - protein, 50 aa, Staphylococcus
KNKNVKRTIIKIIGFLLIAFIVLVLLGILLFAYYAWKAPAFTESKLQDPK

SEQ ID NO: 1900098 - protein, 20 aa, Staphylococcus
KNKTLKIFDFGIAKALSETS

SEQ ID NO: 1900099 - protein, 18 aa, Staphylococcus
KNLENILFLKDQNIKSVN

SEQ ID NO: 1900100 - protein, 24 aa, Staphylococcus
KNLGILLTLLVCSINILLSVFLKR

SEQ ID NO: 1900101 - protein, 20 aa, Staphylococcus
KNMTMIFWLAVVINFFIVPI

SEQ ID NO: 1900102 - protein, 36 aa, Staphylococcus
KNNLIVIIFIVVSTLIFLFIGKPISLLIIAGAINGW

SEQ ID NO: 1900103 - protein, 17 aa, Staphylococcus
KNNQAHATSKFENGVIT

SEQ ID NO: 1900104 - protein, 25 aa, Staphylococcus
KNPAVLMLIILFALALSFALLNVTI

SEQ ID NO: 1900105 - protein, 22 aa, Staphylococcus
KNPLMRYLVLPFLGSFMLANPM

SEQ ID NO: 1900106 - protein, 21 aa, Staphylococcus
KNPLWAIFYIICIIAVVFHFA

SEQ ID NO: 1900107 - protein, 27 aa, Staphylococcus
KNPNFWLLILIIPTWINLLLKTYAFIG

SEQ ID NO: 1900108 - protein, 26 aa, Staphylococcus
KNQATINDLTLRLDKERAKLDVDQAA

SEQ ID NO: 1900109 - protein, 20 aa, Staphylococcus
KNQILSFYLNNIYFGSDQYT

SEQ ID NO: 1900110 - protein, 17 aa, Staphylococcus
KNRIKRILFDRPVLLEH

SEQ ID NO: 1900111 - protein, 18 aa, Staphylococcus
KNRKKWYLPYGYDAEDIE

SEQ ID NO: 1900112 - protein, 20 aa, Staphylococcus
KNRKWYLPFGYGAEDIELNK

SEQ ID NO: 1900113 - protein, 42 aa, Staphylococcus
KNRMSLPAKILVWCVGILFILALLAMIYVIAKIFITGDRIHN

SEQ ID NO: 1900114 - protein, 20 aa, Staphylococcus
KNRSLIAIFLFISAVLIGLF

SEQ ID NO: 1900115 - protein, 17 aa, Staphylococcus
KNRYRIRKFSVGLASVL

SEQ ID NO: 1900116 - protein, 22 aa, Staphylococcus
KNSVLAIIRAFIAGAKAIIVGL

SEQ ID NO: 1900117 - protein, 18 aa, Staphylococcus
KNTLLKLHPGRGEKVVNN

SEQ ID NO: 1900118 - protein, 47 aa, Staphylococcus
KNTMRKMVQNLWWGAGYNIIAVPLAAGVLAFAGLILSPAVGAILMSL

SEQ ID NO: 1900119 - protein, 19 aa, Staphylococcus
KNVAGHTVVIAKKDDDSAV

SEQ ID NO: 1900120 - protein, 23 aa, Staphylococcus
KNVKSIKIGLDALGYYNGDESNQ

SEQ ID NO: 1900121 - protein, 22 aa, Staphylococcus
KNVKSIKIGLKALGYDTGEENN

SEQ ID NO: 1900122 - protein, 28 aa, Staphylococcus
KNVVRYVVWFIVLTTILGKFGISVTGLL

SEQ ID NO: 1900123 - protein, 23 aa, Staphylococcus
KNWIIAIVVLAIIAWGFVGMPAL

SEQ ID NO: 1900124 - protein, 24 aa, Staphylococcus
KNWQAKLFYLLSKYLIHITLTFTI

SEQ ID NO: 1900125 - protein, 33 aa, Staphylococcus
KNYLIIISIVLVFSFIILYLYSKVQTVNISSLK

SEQ ID NO: 1900126 - protein, 30 aa, Staphylococcus
KNYRVFLIIIILFIIFLRFTNQPLATTFTA

SEQ ID NO: 1900127 - protein, 22 aa, Staphylococcus
KNYVFIDDGWAKHGTYCIIRRI

SEQ ID NO: 1900128 - protein, 24 aa, Staphylococcus
KPDHPFVYWATFSNAAALLDSGVH

SEQ ID NO: 1900129 - protein, 22 aa, Staphylococcus
KPDHPFVYWATFSYAAELLNSG

SEQ ID NO: 1900130 - protein, 21 aa, Staphylococcus
KPDHPFVYWATLKNAASLLSA

SEQ ID NO: 1900131 - protein, 21 aa, Staphylococcus
KPEDYLITELSSFQLLGIEQY

SEQ ID NO: 1900132 - protein, 31 aa, Staphylococcus
KPETKMLFIETPSNPLLRITDIQASADIARK

SEQ ID NO: 1900133 - protein, 24 aa, Staphylococcus
KPFSLKFIGILSAVFLIITLLVIM

SEQ ID NO: 1900134 - protein, 24 aa, Staphylococcus
KPISYGIYNFFYKGKLIFSAVVGM

SEQ ID NO: 1900135 - protein, 24 aa, Staphylococcus
KPLIGLSILILIVGIVILSIFKLN

SEQ ID NO: 1900136 - protein, 20 aa, Staphylococcus
KPLIIIILSLVLIYTIMKKD

SEQ ID NO: 1900137 - protein, 17 aa, Staphylococcus
KPLLHKANTIAQTTWKE

SEQ ID NO: 1900138 - protein, 24 aa, Staphylococcus
KPLPFILIVIVLTTAILFLTEVMS

SEQ ID NO: 1900139 - protein, 41 aa, Staphylococcus
KPLQKFLTLFAGPLFNFILALVLFLGLAMYSGAPTTIVDKT

SEQ ID NO: 1900140 - protein, 31 aa, Staphylococcus
KPLSKFVTFILLLIGLLTLGLSYYSVLEPKT

SEQ ID NO: 1900141 - protein, 25 aa, Staphylococcus
KPLYLYTFPIILLAGLFIIFLFVWW

SEQ ID NO: 1900142 - protein, 19 aa, Staphylococcus
KPMIYIIMGILLTITYCIY

SEQ ID NO: 1900143 - protein, 23 aa, Staphylococcus
KPMSYYIHWINHLAHGKLYQPTT

SEQ ID NO: 1900144 - protein, 44 aa, Staphylococcus
KPSVANYFRHGAAHGYPFYNTPTVHINSFWDFARGSNEYDRNSY

SEQ ID NO: 1900145 - protein, 17 aa, Staphylococcus
KPTVIALPKDSPILLEH

SEQ ID NO: 1900146 - protein, 30 aa, Staphylococcus
KPVMKASWLDWPHIYLPFKDYTPSFHMGLI

SEQ ID NO: 1900147 - protein, 41 aa, Staphylococcus
KPYQKFLTLFAGPLFNFLLTLVLFIGLAYYQGTPTNGIDEV

SEQ ID NO: 1900148 - protein, 19 aa, Staphylococcus
KPYVLIVTIIAILATFIVQ

SEQ ID NO: 1900149 - protein, 35 aa, Staphylococcus
KQAKRHKRRNFLYTLIVLVITLVLLVVAISSQKVE

SEQ ID NO: 1900150 - protein, 20 aa, Staphylococcus
KQDFWTQLHPDKAADMMKKE

SEQ ID NO: 1900151 - protein, 25 aa, Staphylococcus
KQHSVLRNYPLLARIRYFGEKIGPE

SEQ ID NO: 1900152 - protein, 25 aa, Staphylococcus
KQIISGFFFAFAALTYLISAQPNMN

SEQ ID NO: 1900153 - protein, 22 aa, Staphylococcus
KQIITFIIITVLLLFACALSVS

SEQ ID NO: 1900154 - protein, 22 aa, Staphylococcus
KQIITFIVFAILLFAACTWSIA

SEQ ID NO: 1900155 - protein, 32 aa, Staphylococcus
KQINFKRSHFIIILIVTILVTAMIAVFATIGI

SEQ ID NO: 1900156 - protein, 35 aa, Staphylococcus
KQKGKGLFFKIVIGLIIIVAIFFGVMYAMSSKANV

SEQ ID NO: 1900157 - protein, 23 aa, Staphylococcus
KQKIFAFIILIVSAPNLIAHLFT

SEQ ID NO: 1900158 - protein, 30 aa, Staphylococcus
KQKLESYYIRLRPMKFLYQKTVNGNWEINE

SEQ ID NO: 1900159 - protein, 27 aa, Staphylococcus
KQKVLDKYIYLLYKLNDEEIKIVETVM

SEQ ID NO: 1900160 - protein, 19 aa, Staphylococcus
KQKYQFLDLSKYQGIDKNR

SEQ ID NO: 1900161 - protein, 20 aa, Staphylococcus
KQKYQFLDLSKYQGIDKNRI

SEQ ID NO: 1900162 - protein, 34 aa, Staphylococcus
KQLGLYFIVVLVALILHFFLIYGGTIKFLAKDSP

SEQ ID NO: 1900163 - protein, 20 aa, Staphylococcus
KQLKSFYRRLWLSAGVIGVI

SEQ ID NO: 1900164 - protein, 22 aa, Staphylococcus
KQLPIFIILISVVGPILEEYVF

SEQ ID NO: 1900165 - protein, 26 aa, Staphylococcus
KQLQRYIYLMIIVLLVMYVANIVYAN

SEQ ID NO: 1900166 - protein, 21 aa, Staphylococcus
KQLVDKAILLKDADLSSVNLA

SEQ ID NO: 1900167 - protein, 35 aa, Staphylococcus
KQNESPLRYIIAIVIIILVVLGAFQLGIVGQMIDS

SEQ ID NO: 1900168 - protein, 26 aa, Staphylococcus
KQNKLLYWKILLIFIYTLLNANISGD

SEQ ID NO: 1900169 - protein, 17 aa, Staphylococcus
KQNLMMIWMIITVLLGL

SEQ ID NO: 1900170 - protein, 22 aa, Staphylococcus
KQPFYNHLITLTNHYPFTVSPE

SEQ ID NO: 1900171 - protein, 19 aa, Staphylococcus
KQRIALLEEINGGLKKYLS

SEQ ID NO: 1900172 - protein, 31 aa, Staphylococcus; identical to SEQ ID NO: 1593805

SEQ ID NO: 1900173 - protein, 17 aa, Staphylococcus
KQSLLFVIILGALTAIG

SEQ ID NO: 1900174 - protein, 34 aa, Staphylococcus
KQTESPLRYIIAIIVVILVILGAFQLGIVGRMID

SEQ ID NO: 1900175 - protein, 18 aa, Staphylococcus
KQTHKQVAFKDGIIVHEN

SEQ ID NO: 1900176 - protein, 21 aa, Staphylococcus
KQTITKLEAIKVKEDKLNSME

SEQ ID NO: 1900177 - protein, 19 aa, Staphylococcus
KQVWGWFLASAISAFVVGV

SEQ ID NO: 1900178 - protein, 20 aa, Staphylococcus
KQWITMVILTILVLLACAWS

SEQ ID NO: 1900179 - protein, 26 aa, Staphylococcus
KQWSKPLLYILLIVGIITVVDSYMIA

SEQ ID NO: 1900180 - protein, 26 aa, Staphylococcus
KRAKGDLNYILSPIKDRPSLLDRIHG

SEQ ID NO: 1900181 - protein, 18 aa, Staphylococcus
KRDFWLIPGYLIINIVLP

SEQ ID NO: 1900182 - protein, 19 aa, Staphylococcus
KRDFWLIPTYLVMNIVFPL

SEQ ID NO: 1900183 - protein, 21 aa, Staphylococcus
KRDVLKKYWLQIFGGIAIGTL

SEQ ID NO: 1900184 - protein, 37 aa, Staphylococcus
KREAYSIRKYSIGAASILVGSLLFLGGGQASAAESNE

SEQ ID NO: 1900185 - protein, 25 aa, Staphylococcus
KRELKYKAKWFPFGPIFAGLLCVIV

SEQ ID NO: 1900186 - protein, 24 aa, Staphylococcus
KRENEPRFEPRLGNQYGGKLYLTL

SEQ ID NO: 1900187 - protein, 24 aa, Staphylococcus
KRFGVFDHYTFNIPKYSIAMYSHD

SEQ ID NO: 1900188 - protein, 23 aa, Staphylococcus
KRGITFGLFRLSVGLEDPEEIIA

SEQ ID NO: 1900189 - protein, 21 aa, Staphylococcus
KRGYSFNLNPFKRSKFNIHIT

SEQ ID NO: 1900190 - protein, 20 aa, Staphylococcus
KRHMILFPGILLQGASISAL

SEQ ID NO: 1900191 - protein, 20 aa, Staphylococcus
KRHMILFPGILLQGASITAL

SEQ ID NO: 1900192 - protein, 24 aa, Staphylococcus
KRIATILMMIYLVATFLSIFTGHL

SEQ ID NO: 1900193 - protein, 18 aa, Staphylococcus
KRIDYPIPPLLQKKKKFY

SEQ ID NO: 1900194 - protein, 22 aa, Staphylococcus
KRIIILLPFLVVVLSAFFGQFF

SEQ ID NO: 1900195 - protein, 68 aa, Staphylococcus
KRKRNKLIISAILAFPLLLTMLVHLFNVPLPEIFMNPWFQFILATPIQFIIGWQFYVGAYKNLRNGGA

SEQ ID NO: 1900196 - protein, 18 aa, Staphylococcus
KRLLKFAIILYGLKLNMG

SEQ ID NO: 1900197 - protein, 18 aa, Staphylococcus
KRLLLYVIILTTMLSFLI

SEQ ID NO: 1900198 - protein, 20 aa, Staphylococcus
KRLRFIAIQYLLDNPEIERE

SEQ ID NO: 1900199 - protein, 26 aa, Staphylococcus
KRLTRPLSFYIDWIGNLSLGKLHQPT

SEQ ID NO: 1900200 - protein, 19 aa, Staphylococcus
KRMGLIILCIFFLATLSGV

SEQ ID NO: 1900201 - protein, 18 aa, Staphylococcus
KRMLIDNPTLLKHSDEFI

SEQ ID NO: 1900202 - protein, 29 aa, Staphylococcus
KRNISLYIWLLIGFIFGFAPPLQTTINSR

SEQ ID NO: 1900203 - protein, 24 aa, Staphylococcus
KRNKLIVSAILSVPLVLTMLIHLF

SEQ ID NO: 1900204 - protein, 39 aa, Staphylococcus
KRNKLKFGLIIGILVLISYLLFLLLGLANGLINMNTEGI

SEQ ID NO: 1900205 - protein, 37 aa, Staphylococcus
KRNKLKFSLIIGVLIMISYLLFLLSGLASGLMNMNRE

SEQ ID NO: 1900206 - protein, 66 aa, Staphylococcus
KRNKLMISTILSLPLLMTMLVHLFNMHLPDILMNPWFQFILATPIQFIIGWQFYVGAYKNLRNGGF

SEQ ID NO: 1900207 - protein, 22 aa, Staphylococcus
KRPVIIFIVPGIIPLVPGGLAY

SEQ ID NO: 1900208 - protein, 24 aa, Staphylococcus
KRQVLRKYWLQIFGGIAVGTLVAL

SEQ ID NO: 1900209 - protein, 24 aa, Staphylococcus
KRRNIFTMIGIIIGIAAVITIMSL

SEQ ID NO: 1900210 - protein, 48 aa, Staphylococcus
KRRQRRKRQKTIQYIVITALILIIILFLLYMFTPISRIANVTIKGNHN

SEQ ID NO: 1900211 - protein, 18 aa, Staphylococcus
KRRSQWQLIIIFGCFSMI

SEQ ID NO: 1900212 - protein, 18 aa, Staphylococcus
KRRVLIGIILIVAAIIHI

SEQ ID NO: 1900213 - protein, 24 aa, Staphylococcus
KRSWHLQSRGTFLEGVYKFTKEVE

SEQ ID NO: 1900214 - protein, 25 aa, Staphylococcus
KRTMFIGLVLYIIGTIFFVGIALPS

SEQ ID NO: 1900215 - protein, 26 aa, Staphylococcus
KRTNKMDFTVTWKVNPSASASGHDAD

SEQ ID NO: 1900216 - protein, 22 aa, Staphylococcus
KRTRFWLPFILSSLIFASQHGI

SEQ ID NO: 1900217 - protein, 46 aa, Staphylococcus
KRVAKTPAVWVILTGLAILPSFYAWFNLWAMWDPYSHTGHIKVAVV

SEQ ID NO: 1900218 - protein, 27 aa, Staphylococcus
KRVKDGYEWDILFNKGHSNHENMIYWF

SEQ ID NO: 1900219 - protein, 23 aa, Staphylococcus
KRVNLFHLPTFILLLTVGVIGSF

SEQ ID NO: 1900220 - protein, 33 aa, Staphylococcus
KRVVKRRIMLFAGILLAIILILSIMVFTQIRSN

SEQ ID NO: 1900221 - protein, 19 aa, Staphylococcus
KRVYKVIKLIVVFFIELMK

SEQ ID NO: 1900222 - protein, 25 aa, Staphylococcus
KRYFQPVIIFIVPGIIPLVPGGAAY

SEQ ID NO: 1900223 - protein, 24 aa, Staphylococcus
KRYPLIDFALFRNRFYTSATFANF

SEQ ID NO: 1900224 - protein, 26 aa, Staphylococcus
KRYPTNYRYGFYTFPKYNRVSGMFNG

SEQ ID NO: 1900225 - protein, 31 aa, Staphylococcus
KRYQDYFLQFNWFQPLLIGLSALLVLIGIIL

SEQ ID NO: 1900226 - protein, 22 aa, Staphylococcus
KSAIIKAHKDGIRKIVLDLRNN

SEQ ID NO: 1900227 - protein, 30 aa, Staphylococcus
KSALFLIAFVIFVLVFVALYIWIPNDNAKP

SEQ ID NO: 1900228 - protein, 35 aa, Staphylococcus
KSALILGVAIILFIMCIYWWISYLGFQKEERLKEK

SEQ ID NO: 1900229 - protein, 45 aa, Staphylococcus
KSANIKARKIIPWGIAFFIIILLIIIFFLLKNFNSPEAQSELLIN

SEQ ID NO: 1900230 - protein, 22 aa, Staphylococcus
KSAQFPFYIWLPDAMEAPTPVS

SEQ ID NO: 1900231 - protein, 62 aa, Staphylococcus; identical to SEQ ID NO: 1591154

SEQ ID NO: 1900232 - protein, 31 aa, Staphylococcus
KSEWLQSWTIYYWGWWMSWSPFVGTFIARIS

SEQ ID NO: 1900233 - protein, 24 aa, Staphylococcus
KSFAVIFIYEWGIASLLFKVNTLS

SEQ ID NO: 1900234 - protein, 22 aa, Staphylococcus
KSFIIFMAIVIILMIALSNADK

SEQ ID NO: 1900235 - protein, 22 aa, Staphylococcus
KSGRLLILLNKISSIIILIVAF

SEQ ID NO: 1900236 - protein, 18 aa, Staphylococcus
KSHLIYEILLIYKILDHR

SEQ ID NO: 1900237 - protein, 38 aa, Staphylococcus
KSHPRIIGTLLAAFGAAFIWFIILMIMKKRKKQENEEE

SEQ ID NO: 1900238 - protein, 32 aa, Staphylococcus
KSIAFLIFIVVMLINFILIYVADPLSLGFIAV

SEQ ID NO: 1900239 - protein, 37 aa, Staphylococcus
KSIHEPWLFSLPAMILMVLIPIVFFIPNVFGHNILIP

SEQ ID NO: 1900240 - protein, 29 aa, Staphylococcus
KSILYAWSPFVILTIIVMIWSAPSFKNLF

SEQ ID NO: 1900241 - protein, 20 aa, Staphylococcus
KSILYFEIITTIAIGLGLII

SEQ ID NO: 1900242 - protein, 20 aa, Staphylococcus
KSIYYFIKYHNYHIVNIDKN

SEQ ID NO: 1900243 - protein, 18 aa, Staphylococcus
KSIYYWIKYFNYKLEHTD

SEQ ID NO: 1900244 - protein, 22 aa, Staphylococcus
KSKYFITFVIAMIVTLGITFIF

SEQ ID NO: 1900245 - protein, 17 aa, Staphylococcus
KSLILVLISVALVAIFI

SEQ ID NO: 1900246 - protein, 24 aa, Staphylococcus
KSLPLIIIGVFILGFFLSTYEATM

SEQ ID NO: 1900247 - protein, 17 aa, Staphylococcus
KSLVYFLAALKGNDTII

SEQ ID NO: 1900248 - protein, 36 aa, Staphylococcus
KSMLIAGPLFPAIGIILISFTFLSPSWYVGIVTFAF

SEQ ID NO: 1900249 - protein, 21 aa, Staphylococcus
KSMMLNYLRELAKDYQVLYFT

SEQ ID NO: 1900250 - protein, 27 aa, Staphylococcus
KSNAPWNIFLKRFSFYALAAQYFVVQF

SEQ ID NO: 1900251 - protein, 25 aa, Staphylococcus
KSNARTILNNLANQLIKTFENTPDV

SEQ ID NO: 1900252 - protein, 23 aa, Staphylococcus
KSNPIILLLLVTIGFGLIGFIDD

SEQ ID NO: 1900253 - protein, 23 aa, Staphylococcus
KSPVLIILLIIISTILLLISTGF

SEQ ID NO: 1900254 - protein, 33 aa, Staphylococcus
KSQPKRIFETTINGQFVFRPDNADFAGSYVQPF

SEQ ID NO: 1900255 - protein, 17 aa, Staphylococcus
KSRFKLFLDKHVLSVVF

SEQ ID NO: 1900256 - protein, 36 aa, Staphylococcus
KSSKGKKFLIALIIILLIASLAGFIAWGVFGDKYEE

SEQ ID NO: 1900257 - protein, 38 aa, Staphylococcus
KSSKKKKFLFAFIFALLLIGLIAFISMAVFGSKYEEMP

SEQ ID NO: 1900258 - protein, 24 aa, Staphylococcus
KSSPLKFFKDFIPAITLGFSASSS

SEQ ID NO: 1900259 - protein, 17 aa, Staphylococcus
KSSYYWIRYLNYDYIYQ

SEQ ID NO: 1900260 - protein, 22 aa, Staphylococcus
KSTIQAFIHSILFGFPTKKENE

SEQ ID NO: 1900261 - protein, 25 aa, Staphylococcus
KSTIQAFIHSILFGFPTKKSKEPRL

SEQ ID NO: 1900262 - protein, 27 aa, Staphylococcus
KSTIQAFIHSILFGFPTKRENEPRFEP

SEQ ID NO: 1900263 - protein, 31 aa, Staphylococcus; identical to SEQ ID NO: 1749988

SEQ ID NO: 1900264 - protein, 30 aa, Staphylococcus
KSVLLFFVIITFGFLLVFFLVCVLLIKELM

SEQ ID NO: 1900265 - protein, 21 aa, Staphylococcus
KSYFAFYGILIFIGLIIGLIA

SEQ ID NO: 1900266 - protein, 28 aa, Staphylococcus
KSYFNGAPWLFFFPGVLLGGFALLCQMI

SEQ ID NO: 1900267 - protein, 31 aa, Staphylococcus
KSYFSAAPWLFFFPGLLLGGYALLFQMLNNK

SEQ ID NO: 1900268 - protein, 28 aa, Staphylococcus
KSYFYSAPWLFFFPGILLGGFALTCQIL

SEQ ID NO: 1900269 - protein, 26 aa, Staphylococcus
KSYFYSAPWLFFFPGVLLGGFALICQ

SEQ ID NO: 1900270 - protein, 27 aa, Staphylococcus
KSYFYSAPWLFIFPGVLLGGFALICQI

SEQ ID NO: 1900271 - protein, 28 aa, Staphylococcus
KSYGVPMLTFPFVLMTWLILAMTTQFST

SEQ ID NO: 1900272 - protein, 21 aa, Staphylococcus
KSYGWIILGRALALIIAIVFF

SEQ ID NO: 1900273 - protein, 21 aa, Staphylococcus
KSYIIFFLLIIVGTSCVALAS

SEQ ID NO: 1900274 - protein, 36 aa, Staphylococcus
KSYLSDHKMYFIMGALFIFLMIFYVMNSNQSEDKSA

SEQ ID NO: 1900275 - protein, 24 aa, Staphylococcus
KSYPVLGWTFFIAALSLAGIPPLS

SEQ ID NO: 1900276 - protein, 32 aa, Staphylococcus
KSYQDYFLHFNWFQPLLIGLAGLLILIGLILV

SEQ ID NO: 1900277 - protein, 23 aa, Staphylococcus
KSYSKFMVMFVILLATFAGALMQ

SEQ ID NO: 1900278 - protein, 19 aa, Staphylococcus
KSYYRYFAIILNYIPVLTH

SEQ ID NO: 1900279 - protein, 28 aa, Staphylococcus
KTAAKRLPWLIILTFLGMITATILGNFE

SEQ ID NO: 1900280 - protein, 25 aa, Staphylococcus
KTAFEKWNFVKLAKPLIGVSILILV

SEQ ID NO: 1900281 - protein, 28 aa, Staphylococcus
KTASKRLPWLIVLTFLGMITATILGSFE

SEQ ID NO: 1900282 - protein, 28 aa, Staphylococcus
KTATKRLPWLIILTFLGMITATILGSFE

SEQ ID NO: 1900283 - protein, 29 aa, Staphylococcus
KTATKRLPWLIILTFLGMITATILGSFEA

SEQ ID NO: 1900284 - protein, 31 aa, Staphylococcus
KTDAKKAFQAIMYAGIQYAKEQTSLYTTYAT

SEQ ID NO: 1900285 - protein, 17 aa, Staphylococcus
KTDDGKWGFSFTDKDGD

SEQ ID NO: 1900286 - protein, 17 aa, Staphylococcus
KTDLKKIAKTPAVWIIL

SEQ ID NO: 1900287 - protein, 27 aa, Staphylococcus
KTDNYRYQVPLPRDNWFLENRDDAVSP

SEQ ID NO: 1900288 - protein, 18 aa, Staphylococcus
KTELNFVEPMISRLELDN

SEQ ID NO: 1900289 - protein, 19 aa, Staphylococcus
KTELNFVEPMISRLELQEA

SEQ ID NO: 1900290 - protein, 19 aa, Staphylococcus
KTELSFVEPMISRLELEAA

SEQ ID NO: 1900291 - protein, 30 aa, Staphylococcus
KTGATHFPPRGSQRRRRRRRETATHKQEEG

SEQ ID NO: 1900292 - protein, 22 aa, Staphylococcus
KTGIAIILALFIASLLPNEAGL

SEQ ID NO: 1900293 - protein, 22 aa, Staphylococcus
KTGKLTYQRFLNGYPTFNNQNL

SEQ ID NO: 1900294 - protein, 21 aa, Staphylococcus
KTIHLFFFLPYIHAFRWHKLN

SEQ ID NO: 1900295 - protein, 32 aa, Staphylococcus
KTIHYPVVLIFIFFLILLILNITVIPQFKDLY

SEQ ID NO: 1900296 - protein, 20 aa, Staphylococcus
KTILTIEFIGALLLAFYFYR

SEQ ID NO: 1900297 - protein, 27 aa, Staphylococcus
KTIQHMPWLVIILVAVAAMIVISQTAT

SEQ ID NO: 1900298 - protein, 30 aa, Staphylococcus
KTIRNIKQNLFWAFGYNIAGIPIAAMGLLA

SEQ ID NO: 1900299 - protein, 19 aa, Staphylococcus
KTIYYWIRYLNYDVISREK

SEQ ID NO: 1900300 - protein, 26 aa, Staphylococcus
KTKALLTEPELKFVKVERVPNLVTKP

SEQ ID NO: 1900301 - protein, 26 aa, Staphylococcus
KTKGINVINTIQLEIIKKVEAKHEID

SEQ ID NO: 1900302 - protein, 22 aa, Staphylococcus
KTLKKIGVFTSLGLGAAFIISG

SEQ ID NO: 1900303 - protein, 18 aa, Staphylococcus
KTLRILDFGIAKALSETA

SEQ ID NO: 1900304 - protein, 22 aa, Staphylococcus
KTLYYWIRYLNYDLLSSEKDNN

SEQ ID NO: 1900305 - protein, 18 aa, Staphylococcus
KTMKIGLTALGFKVDNET

SEQ ID NO: 1900306 - protein, 23 aa, Staphylococcus
KTMKILRSAFLSGLMLEFISLLG

SEQ ID NO: 1900307 - protein, 28 aa, Staphylococcus
KTMRKIFPWDFKILIGIGLLFCLATPMA

SEQ ID NO: 1900308 - protein, 23 aa, Staphylococcus
KTNGFFLFTPLFVSMVVGIAFLK

SEQ ID NO: 1900309 - protein, 36 aa, Staphylococcus
KTNRLLMTLGTSIIAIFIGVIIAYLLKRRKQDEGAQ

SEQ ID NO: 1900310 - protein, 34 aa, Staphylococcus
KTPFYKKHSTLLFATLLIAFGYLSHFVNGEDNLV

SEQ ID NO: 1900311 - protein, 23 aa, Staphylococcus
KTPGEYTVPATVTYPDGTKDHVN

SEQ ID NO: 1900312 - protein, 23 aa, Staphylococcus
KTPLTHIHHLLDLLKFAKTDNAR

SEQ ID NO: 1900313 - protein, 29 aa, Staphylococcus
KTRHLLTSLLLQILIVTLLSVVISVGIIA

SEQ ID NO: 1900314 - protein, 17 aa, Staphylococcus
KTRRLTGSIVLQFALLF

SEQ ID NO: 1900315 - protein, 18 aa, Staphylococcus
KTRRSIGALVLQLALLCI

SEQ ID NO: 1900316 - protein, 25 aa, Staphylococcus
KTSKPGKIIIPRDGRTPNLTTSVQR

SEQ ID NO: 1900317 - protein, 45 aa, Staphylococcus
KTTEIITVILILAILFLVFRSVVTPFVPLLLVGLSYLFSQGVLAF

SEQ ID NO: 1900318 - protein, 18 aa, Staphylococcus
KTVSWLAMLFSAGMGIGL

SEQ ID NO: 1900319 - protein, 25 aa, Staphylococcus
KTVTKIVVFILLTFGFYIYLAGHNN

SEQ ID NO: 1900320 - protein, 25 aa, Staphylococcus
KTVTKIVVFILLTFGFYLFLAGHNN

SEQ ID NO: 1900321 - protein, 25 aa, Staphylococcus
KTVTKIVVFILLTFGFYVFFAGHNN

SEQ ID NO: 1900322 - protein, 25 aa, Staphylococcus
KTVTKIVVFILLTFGFYVFLAGHNN

SEQ ID NO: 1900323 - protein, 23 aa, Staphylococcus
KTVYPLFPDQLTPIPKNNLLMFC

SEQ ID NO: 1900324 - protein, 25 aa, Staphylococcus
KTWFKFFLAILLINLLIIIITQPLG

SEQ ID NO: 1900325 - protein, 25 aa, Staphylococcus
KTYLYFNKIYISVISIFLILSLIML

SEQ ID NO: 1900326 - protein, 22 aa, Staphylococcus
KTYNFFIQVLTIVAVLFVSKII

SEQ ID NO: 1900327 - protein, 17 aa, Staphylococcus
KTYRMVFNIINVEKMNS

SEQ ID NO: 1900328 - protein, 26 aa, Staphylococcus
KVAGYLFYFAVSVGVISFIVWMLIQN

SEQ ID NO: 1900329 - protein, 28 aa, Staphylococcus
KVALALIMMFLLLLIPILHNIASAHATL

SEQ ID NO: 1900330 - protein, 24 aa, Staphylococcus
KVAPIYIIFMLIAPFIGYFTGKLF

SEQ ID NO: 1900331 - protein, 26 aa, Staphylococcus
KVDRLPIEGMILFSPLLELQKNKTTR

SEQ ID NO: 1900332 - protein, 25 aa, Staphylococcus
KVDTPYWLLVVVYALRMFSVSILTM

SEQ ID NO: 1900333 - protein, 32 aa, Staphylococcus
KVDYDSITPESLYSEILKAGIEYANEQTSKYT

SEQ ID NO: 1900334 - protein, 25 aa, Staphylococcus
KVEFEKLKLQTHKKANAKRIIQNKA

SEQ ID NO: 1900335 - protein, 23 aa, Staphylococcus
KVELPIAMPIIMAGIRTAMVLII

SEQ ID NO: 1900336 - protein, 24 aa, Staphylococcus
KVFDIILTIFLFSLAIIMTAGGAS

SEQ ID NO: 1900337 - protein, 24 aa, Staphylococcus
KVFDLILTVFLFSLAIIMTAGGAS

SEQ ID NO: 1900338 - protein, 23 aa, Staphylococcus
KVFKMMFQFILAILLIFIVAHFM

SEQ ID NO: 1900339 - protein, 18 aa, Staphylococcus
KVFYKGQFDLICAVGILL

SEQ ID NO: 1900340 - protein, 34 aa, Staphylococcus
KVIERAILALILPLIIFIIAMVCFNIFSDSFVLL

SEQ ID NO: 1900341 - protein, 26 aa, Staphylococcus
KVIERILLALILPLIIFMIGMFCFNT

SEQ ID NO: 1900342 - protein, 34 aa, Staphylococcus
KVIERLLLALIIPLFIFIIGMFCFNTFADSFILL

SEQ ID NO: 1900343 - protein, 32 aa, Staphylococcus
KVIERLLLALILPLIIFIICMFIFNNYADSFI

SEQ ID NO: 1900344 - protein, 34 aa, Staphylococcus
KVIFEKNKLVIIVGCALVLLLAICCYKFLNVSNT

SEQ ID NO: 1900345 - protein, 17 aa, Staphylococcus
KVIGPLIKAHKAGLNLK

SEQ ID NO: 1900346 - protein, 24 aa, Staphylococcus
KVIITNKALLPRIPKDKLPHLEKI

SEQ ID NO: 1900347 - protein, 24 aa, Staphylococcus
KVILYLLILIILQPIAFNVLNLDE

SEQ ID NO: 1900348 - protein, 18 aa, Staphylococcus
KVITVIIFIIIGILTILG

SEQ ID NO: 1900349 - protein, 23 aa, Staphylococcus
KVIYGMVILLIICGCIPKLGALA

SEQ ID NO: 1900350 - protein, 24 aa, Staphylococcus
KVIYGMVILLLICGCIPKLGALAN

SEQ ID NO: 1900351 - protein, 25 aa, Staphylococcus
KVIYGMVVLLLICGCLPKLGALANI

SEQ ID NO: 1900352 - protein, 20 aa, Staphylococcus
KVKIIIIIALLVMSIMSQNL

SEQ ID NO: 1900353 - protein, 17 aa, Staphylococcus
KVKIVKKPKAQETILNV

SEQ ID NO: 1900354 - protein, 24 aa, Staphylococcus
KVKNIGMILFGFGALFYGLELMSG

SEQ ID NO: 1900355 - protein, 41 aa, Staphylococcus
KVLDKPLPMLDLPIIPIIVSRYWVQLISSVPKEMVYPLMNS

SEQ ID NO: 1900356 - protein, 25 aa, Staphylococcus
KVLFNFSLPLIIALLHAYFASLAFM

SEQ ID NO: 1900357 - protein, 17 aa, Staphylococcus
KVLGANGGFLQVSDSLR

SEQ ID NO: 1900358 - protein, 23 aa, Staphylococcus
KVLPLTAILGGILMLVADMLARY

SEQ ID NO: 1900359 - protein, 30 aa, Staphylococcus
KVLSPLAWSLIFLTFIFLINIFSVKAFGET

SEQ ID NO: 1900360 - protein, 28 aa, Staphylococcus
KVLTISFIIIGLFMIVEILGGFIANSLA

SEQ ID NO: 1900361 - protein, 28 aa, Staphylococcus
KVMFLSAPFVILFFILEQFARSIGAPII

SEQ ID NO: 1900362 - protein, 21 aa, Staphylococcus
KVMHHVFWISLIAIIIGTAIP

SEQ ID NO: 1900363 - protein, 25 aa, Staphylococcus
KVMMPLLFIFLIIVVVKSLTLDGAI

SEQ ID NO: 1900364 - protein, 26 aa, Staphylococcus
KVMMPLLFVFLILIVIKSLSLDGAAE

SEQ ID NO: 1900365 - protein, 20 aa, Staphylococcus
KVNFKIVLPGALLTIVILFL

SEQ ID NO: 1900366 - protein, 18 aa, Staphylococcus
KVPAIIALVVYALLPILR

SEQ ID NO: 1900367 - protein, 19 aa, Staphylococcus
KVPYPILVTMAIIAIIVLL

SEQ ID NO: 1900368 - protein, 24 aa, Staphylococcus
KVQFKDLWRILFKNKELLAIIGVI

SEQ ID NO: 1900369 - protein, 22 aa, Staphylococcus
KVRFYPMIYRRLSFLLVIGVIH

SEQ ID NO: 1900370 - protein, 29 aa, Staphylococcus
KVRIENRWIVFLIFLISSIIVLISLNVYK

SEQ ID NO: 1900371 - protein, 29 aa, Staphylococcus
KVSIIYMFMLEQLFIFLITAVLGMIIGIV

SEQ ID NO: 1900372 - protein, 24 aa, Staphylococcus
KVTFSDGHEIIVPKGTKGDAGDSV

SEQ ID NO: 1900373 - protein, 26 aa, Staphylococcus
KVTFSDGHIITIPKGKDGKSVTVESS

SEQ ID NO: 1900374 - protein, 27 aa, Staphylococcus
KVTQNDIITVLPFGNLISQIKVKGSDV

SEQ ID NO: 1900375 - protein, 19 aa, Staphylococcus
KVTSLVLTLLFIKSTLRNE

SEQ ID NO: 1900376 - protein, 20 aa, Staphylococcus
KVVFIIAIIYIIGSLLMAVA

SEQ ID NO: 1900377 - protein, 24 aa, Staphylococcus
KVVITNKALLPRIPKDKLPHLETI

SEQ ID NO: 1900378 - protein, 18 aa, Staphylococcus
KVVTIIVFILIGVLTIVG

SEQ ID NO: 1900379 - protein, 41 aa, Staphylococcus
KVVVQLTKFEKILYITLVSVIAMISIYMLSLKMDAYDTRGK

SEQ ID NO: 1900380 - protein, 41 aa, Staphylococcus
KVVVQLTRFEKFLYITLVTAIAVLAIYMLSLKMDAYDTNDK

SEQ ID NO: 1900381 - protein, 22 aa, Staphylococcus
KVVYPVLIAFILGLVLLGVAHS

SEQ ID NO: 1900382 - protein, 28 aa, Staphylococcus
KVYFCINLILPFILISSLFIFLCMYFPQ

SEQ ID NO: 1900383 - protein, 31 aa, Staphylococcus
KVYLIFSILLPLFFYLIFTSILDLPKAQQQV

SEQ ID NO: 1900384 - protein, 25 aa, Staphylococcus
KVYNINLIVWIPLVVIAVCLFLRVS

SEQ ID NO: 1900385 - protein, 18 aa, Staphylococcus
KWAFFACTMIGLLVLAAL

SEQ ID NO: 1900386 - protein, 26 aa, Staphylococcus
KWGFVVAWLLWVQMFPGMVMVASTLG

SEQ ID NO: 1900387 - protein, 18 aa, Staphylococcus
KWGWLILRVLAVCFVWMT

SEQ ID NO: 1900388 - protein, 19 aa, Staphylococcus
KWIFSLIRVVLPLIIILIL

SEQ ID NO: 1900389 - protein, 19 aa, Staphylococcus
KWIGTLLTLILIGTSIYKG

SEQ ID NO: 1900390 - protein, 19 aa, Staphylococcus
KWILIIGAVIILLYIIVEL

SEQ ID NO: 1900391 - protein, 23 aa, Staphylococcus
KWLDFPHIYLPFKDYTPSFHLGL

SEQ ID NO: 1900392 - protein, 21 aa, Staphylococcus
KWLGIVFAVLITVTFAFVFNT

SEQ ID NO: 1900393 - protein, 18 aa, Staphylococcus
KWLLLWSMPMIMVSLFVF

SEQ ID NO: 1900394 - protein, 22 aa, Staphylococcus
KWLLMLCVLVIIINASWNTISR

SEQ ID NO: 1900395 - protein, 17 aa, Staphylococcus
KWLYMYAYSFYLFFDFA

SEQ ID NO: 1900396 - protein, 37 aa, Staphylococcus
KWMLITTTITFLTIFLFSIIIIFFLSNSLRHNEVDEA

SEQ ID NO: 1900397 - protein, 38 aa, Staphylococcus
KWMTITTLIMFTTIILFCLIIIFFLKDTLREGEVEEAE

SEQ ID NO: 1900398 - protein, 18 aa, Staphylococcus
KWSIWANLILPIDPIMEI

SEQ ID NO: 1900399 - protein, 24 aa, Staphylococcus
KWSPIIILILLVTLLYLFLQQAQY

SEQ ID NO: 1900400 - protein, 19 aa, Staphylococcus
KWVGVIVTLILIAASIYKG

SEQ ID NO: 1900401 - protein, 19 aa, Staphylococcus
KYALIFIVAILIIAAVLVI

SEQ ID NO: 1900402 - protein, 24 aa, Staphylococcus
KYDVSLFTHWAQKGNSISYLIEGD

SEQ ID NO: 1900403 - protein, 46 aa, Staphylococcus
KYETKYKLIKHILITMFALLCLILLILFIASMFYFHRITSHASAMS

SEQ ID NO: 1900404 - protein, 24 aa, Staphylococcus
KYFDLSCVPILSKSKKKLQGMVVV

SEQ ID NO: 1900405 - protein, 28 aa, Staphylococcus
KYGVPYLSLLLTAILVIIIFLVQKVSGN

SEQ ID NO: 1900406 - protein, 20 aa, Staphylococcus
KYHYLWIIFSYGISYLITQI

SEQ ID NO: 1900407 - protein, 40 aa, Staphylococcus
KYIHEVIRPLFVPFFSIVIMVPLTLLIIGPLASGAAHGIA

SEQ ID NO: 1900408 - protein, 19 aa, Staphylococcus
KYIYLFTFLEFVAIYICLF

SEQ ID NO: 1900409 - protein, 24 aa, Staphylococcus
KYKNKPIFYSLGNTTSDEFLSKNH

SEQ ID NO: 1900410 - protein, 39 aa, Staphylococcus
KYKQLKHIIVTIFLIGLMFMIIILLAAIIYFHQLTKDAS

SEQ ID NO: 1900411 - protein, 33 aa, Staphylococcus
KYLFNVIGQIFLNLIFMLVVPVVFVSIVLGVVG

SEQ ID NO: 1900412 - protein, 17 aa, Staphylococcus
KYLSASFAIAVSTQVIS

SEQ ID NO: 1900413 - protein, 19 aa, Staphylococcus
KYLVKYLGPYNFTVYDGVK

SEQ ID NO: 1900414 - protein, 17 aa, Staphylococcus
KYMAFAILAFFAFIFII

SEQ ID NO: 1900415 - protein, 19 aa, Staphylococcus
KYNPFIIEQVNKLGESGNQ

SEQ ID NO: 1900416 - protein, 22 aa, Staphylococcus
KYNRTVFNLILNPAVKPNKTTD

SEQ ID NO: 1900417 - protein, 18 aa, Staphylococcus
KYNVIIGDLDIPVRSGFS

SEQ ID NO: 1900418 - protein, 23 aa, Staphylococcus
KYNYVIPKEGSNLWFDNMVIPKT

SEQ ID NO: 1900419 - protein, 17 aa, Staphylococcus
KYPHFLWFNLTEPNLIM

SEQ ID NO: 1900420 - protein, 26 aa, Staphylococcus
KYPKSIIFISPIIVFIFVFGIGTANI

SEQ ID NO: 1900421 - protein, 18 aa, Staphylococcus
KYPNLRLRLVKGAYKEDE

SEQ ID NO: 1900422 - protein, 20 aa, Staphylococcus
KYPRFLWFNLTEPNIMMTLI

SEQ ID NO: 1900423 - protein, 26 aa, Staphylococcus
KYQNLWLMILIIPTWINLLLKTYAFI

SEQ ID NO: 1900424 - protein, 25 aa, Staphylococcus
KYQPPYWNTMILISLISIIISVVFV

SEQ ID NO: 1900425 - protein, 19 aa, Staphylococcus
KYRIIATIIIGIIKFGIPM

SEQ ID NO: 1900426 - protein, 25 aa, Staphylococcus
KYRIKKIIIAIPTLSQKRLREINEI

SEQ ID NO: 1900427 - protein, 30 aa, Staphylococcus
KYSATSGQYYKLWIEDYQTKNGNTVTMLRQ

SEQ ID NO: 1900428 - protein, 22 aa, Staphylococcus
KYSHIDLGFSQWGFKQRPDESY

SEQ ID NO: 1900429 - protein, 26 aa, Staphylococcus
KYSHWLKFVWPVVAFVFIFGGGMLVT

SEQ ID NO: 1900430 - protein, 23 aa, Staphylococcus
KYSIPFVIVSLNFPLFNLVDQFT

SEQ ID NO: 1900431 - protein, 25 aa, Staphylococcus
KYSYRKLFIIALTLFTLGSLVCAIS

SEQ ID NO: 1900432 - protein, 24 aa, Staphylococcus
KYTTRKLYIFSMAAFLIGSIIAAL

SEQ ID NO: 1900433 - protein, 18 aa, Staphylococcus
KYYNIITTSNLATKHPLF

SEQ ID NO: 1900434 - protein, 21 aa, Staphylococcus
LAAAIFFIIYFVKKIDSLSLN

SEQ ID NO: 1900435 - protein, 30 aa, Staphylococcus
LAAFLILIGLILVFSIFKPTYRKPGLYKDF

SEQ ID NO: 1900436 - protein, 26 aa, Staphylococcus
LAAGALAFIGLILSPAVGAILMSLST

SEQ ID NO: 1900437 - protein, 18 aa, Staphylococcus
LAAVLIGLIILVVAAIPI

SEQ ID NO: 1900438 - protein, 24 aa, Staphylococcus
LAAVLLGLIILVAAAIPVSHMRLA

SEQ ID NO: 1900439 - protein, 25 aa, Staphylococcus
LACKWSFVLFMKYLRWNINVVKGSA

SEQ ID NO: 1900440 - protein, 23 aa, Staphylococcus
LADGLKVRIISLPNTDKVADNLT

SEQ ID NO: 1900441 - protein, 19 aa, Staphylococcus
LADILFFTGIFIIVYTIIW

SEQ ID NO: 1900442 - protein, 23 aa, Staphylococcus
LAEDMILERQVAIKAISIPPNEK

SEQ ID NO: 1900443 - protein, 24 aa, Staphylococcus
LAEDTILNRKVAIKAISIPPREKE

SEQ ID NO: 1900444 - protein, 21 aa, Staphylococcus
LAFFAFVFILLFFSDDTRAAI

SEQ ID NO: 1900445 - protein, 19 aa, Staphylococcus
LAFFIFAYVLLLFTDETQK

SEQ ID NO: 1900446 - protein, 24 aa, Staphylococcus
LAFIAIYSLMYWVTSRIYYMIINN

SEQ ID NO: 1900447 - protein, 17 aa, Staphylococcus
LAFIIGTLIKKFDLMHL

SEQ ID NO: 1900448 - protein, 20 aa, Staphylococcus
LAFIQIILGMLLYVTPIPVQ

SEQ ID NO: 1900449 - protein, 22 aa, Staphylococcus
LAGDPYYSGMGLPTDISEAGQK

SEQ ID NO: 1900450 - protein, 23 aa, Staphylococcus
LAGDPYYSGMPLPSDISMAGQKL

SEQ ID NO: 1900451 - protein, 23 aa, Staphylococcus
LAGFMVGWTYWFTWIISGMAEVT

SEQ ID NO: 1900452 - protein, 18 aa, Staphylococcus
LAGIPTIVFGFFALTFIT

SEQ ID NO: 1900453 - protein, 26 aa, Staphylococcus
LAGLFIIFLFVWWAFKTVQIQAFNHS

SEQ ID NO: 1900454 - protein, 22 aa, Staphylococcus
LAGLLLLFFLLRQAALTEPKAE

SEQ ID NO: 1900455 - protein, 36 aa, Staphylococcus
LAGNIWGLMAIGFICSLPFLSPLLGPGGVIGQVLGT

SEQ ID NO: 1900456 - protein, 19 aa, Staphylococcus
LAGTFIALIFQFRKDERDK

SEQ ID NO: 1900457 - protein, 24 aa, Staphylococcus
LAHIKFWFLIKGLTPIWIFLIFTF

SEQ ID NO: 1900458 - protein, 25 aa, Staphylococcus
LAHQPDIIGLFFSLLDQFMDTTTVI

SEQ ID NO: 1900459 - protein, 35 aa, Staphylococcus
LAHSNLLINIFLISAFILNLIFAFTIIFMERRSAG

SEQ ID NO: 1900460 - protein, 20 aa, Staphylococcus
LAIAFLLRPIGGIVFGVIGD

SEQ ID NO: 1900461 - protein, 29 aa, Staphylococcus
LAIAIGITLFIFLIVRPPIEYLRQYLAQW

SEQ ID NO: 1900462 - protein, 31 aa, Staphylococcus
LAIATNWISLILWLIAGIMLLVRKPKHDMYG

SEQ ID NO: 1900463 - protein, 45 aa, Staphylococcus
LAIEEQFYLFFPFILVILLLTIKKYRNVTLIFWIVSLASLLEMVI

SEQ ID NO: 1900464 - protein, 17 aa, Staphylococcus
LAIFGIAITIILYARKV

SEQ ID NO: 1900465 - protein, 18 aa, Staphylococcus
LAIFLFIIVGVSVIDLGN

SEQ ID NO: 1900466 - protein, 23 aa, Staphylococcus
LAIIILVFVIRLVLLPFMLSNYK

SEQ ID NO: 1900467 - protein, 29 aa, Staphylococcus
LAIINFFIPFLLIFIIDGFKGIKETLPSI

SEQ ID NO: 1900468 - protein, 29 aa, Staphylococcus
LAIINFFIPFLLIFIIDGLKGVKETLPAI

SEQ ID NO: 1900469 - protein, 29 aa, Staphylococcus
LAIINFIIPFLLIFIIDGFKGIKETLPQI

SEQ ID NO: 1900470 - protein, 24 aa, Staphylococcus
LAIINPMWFGILFAIVGALLIEKL

SEQ ID NO: 1900471 - protein, 25 aa, Staphylococcus
LAIIVIIILYMLGNWFMNKRAVTEL

SEQ ID NO: 1900472 - protein, 18 aa, Staphylococcus
LAILAGLGLITNPNTKGL

SEQ ID NO: 1900473 - protein, 17 aa, Staphylococcus
LAILALMIPIFGVGKTP

SEQ ID NO: 1900474 - protein, 19 aa, Staphylococcus
LAILLIIVALIGGLVGGFF

SEQ ID NO: 1900475 - protein, 20 aa, Staphylococcus
LAILLIIVALIIGLVGGFFL

SEQ ID NO: 1900476 - protein, 25 aa, Staphylococcus
LAIMFDLILRYMEKLSYKKLLITVG

SEQ ID NO: 1900477 - protein, 18 aa, Staphylococcus
LAITFLLLVANSVTFIYI

SEQ ID NO: 1900478 - protein, 18 aa, Staphylococcus
LAITLLILIANSVTFVFI

SEQ ID NO: 1900479 - protein, 20 aa, Staphylococcus
LAIVTIYYFIRYNKAEQQAK

SEQ ID NO: 1900480 - protein, 22 aa, Staphylococcus
LAIWILLVVLIIFYTIKLSART

SEQ ID NO: 1900481 - protein, 18 aa, Staphylococcus
LAKAKFKAETFINQLKDL

SEQ ID NO: 1900482 - protein, 20 aa, Staphylococcus
LAKMFVMMFGVAVFAFMGYE

SEQ ID NO: 1900483 - protein, 22 aa, Staphylococcus
LAKRIFVAAPLFIISFALTQID

SEQ ID NO: 1900484 - protein, 24 aa, Staphylococcus
LAKTPWYFLPFIPDSPIASLFLCI

SEQ ID NO: 1900485 - protein, 30 aa, Staphylococcus
LALDIKLYAIIIVPLLVLFLTIVGAYFFFR

SEQ ID NO: 1900486 - protein, 28 aa, Staphylococcus
LALFLGLSFLWVPFFSIAFSLITLVLVL

SEQ ID NO: 1900487 - protein, 17 aa, Staphylococcus
LALIIMLLAFVLLYIIS

SEQ ID NO: 1900488 - protein, 19 aa, Staphylococcus
LALIITFVLLVFSYNGWVL

SEQ ID NO: 1900489 - protein, 19 aa, Staphylococcus
LALILIMFMAAIEASIISL

SEQ ID NO: 1900490 - protein, 21 aa, Staphylococcus
LALILLIILIPLIKLKAIRII

SEQ ID NO: 1900491 - protein, 21 aa, Staphylococcus
LALITIILYAVLYLITLGLNF

SEQ ID NO: 1900492 - protein, 29 aa, Staphylococcus
LALIYAAIGIIIYITFRFEWRMGLSSVLA

SEQ ID NO: 1900493 - protein, 20 aa, Staphylococcus
LALKILFNFGLPLIIALLHA

SEQ ID NO: 1900494 - protein, 17 aa, Staphylococcus
LALLIGLISGVFSSVFI

SEQ ID NO: 1900495 - protein, 22 aa, Staphylococcus
LALLLVTHIVFYFTNKVQAQRE

SEQ ID NO: 1900496 - protein, 24 aa, Staphylococcus
LALMLYILFIFIGSLVLILFVIKK

SEQ ID NO: 1900497 - protein, 18 aa, Staphylococcus
LALPLILGGIRLSSVYVI

SEQ ID NO: 1900498 - protein, 24 aa, Staphylococcus
LALTTFIFGIIERSLIPFGLHHIF

SEQ ID NO: 1900499 - protein, 24 aa, Staphylococcus
LALVGVIVYLWKTNEDFRNMIIGA

SEQ ID NO: 1900500 - protein, 20 aa, Staphylococcus
LAMHKIIAMLFLTGATIFMG

SEQ ID NO: 1900501 - protein, 17 aa, Staphylococcus
LAPLFIGVFQLGMVGAA

SEQ ID NO: 1900502 - protein, 20 aa, Staphylococcus
LAPMFILTGLLMFIFSIYAY

SEQ ID NO: 1900503 - protein, 21 aa, Staphylococcus
LAQFLPLLAQQLPFFKDLKGM

SEQ ID NO: 1900504 - protein, 17 aa, Staphylococcus
LAQILIAIIFFVLGDVF

SEQ ID NO: 1900505 - protein, 31 aa, Staphylococcus
LAQLADPMIKFLIPLLIAFSGGRLIHGLRGG

SEQ ID NO: 1900506 - protein, 19 aa, Staphylococcus
LASAFMIVFARSRLFSIIM

SEQ ID NO: 1900507 - protein, 17 aa, Staphylococcus
LASLFYMYKKHIFIAAI

SEQ ID NO: 1900508 - protein, 27 aa, Staphylococcus
LASYAALITMYMIHLIILGGLGLNPIK

SEQ ID NO: 1900509 - protein, 23 aa, Staphylococcus
LATAGILGSLFYFNKNKAPKQVK

SEQ ID NO: 1900510 - protein, 28 aa, Staphylococcus
LATEDNRFYHHGALDYKRLFGAIGKNLT

SEQ ID NO: 1900511 - protein, 24 aa, Staphylococcus
LATIYAIRMIGIALGLMPLMTHTM

SEQ ID NO: 1900512 - protein, 22 aa, Staphylococcus
LATIYAIRMIGIALGLMPVMTH

SEQ ID NO: 1900513 - protein, 24 aa, Staphylococcus
LATKHPLFEYARTFDYIVVSDVGL

SEQ ID NO: 1900514 - protein, 26 aa, Staphylococcus
LATKLAMVIIYILVGLIVIGIINKAI

SEQ ID NO: 1900515 - protein, 25 aa, Staphylococcus
LATLLGLLIIYTGFGIFKESIFTLS

SEQ ID NO: 1900516 - protein, 31 aa, Staphylococcus
LATTFAFYPSAPFLIMMLAGFLGAMIGGLIV

SEQ ID NO: 1900517 - protein, 21 aa, Staphylococcus
LATVYAIRMIGIALGLMPVMT

SEQ ID NO: 1900518 - protein, 27 aa, Staphylococcus
LAVELVAWVLLLNKRLFRLYDRVEIDG

SEQ ID NO: 1900519 - protein, 17 aa, Staphylococcus
LAVILFKVGFALLRFLI

SEQ ID NO: 1900520 - protein, 19 aa, Staphylococcus
LAVIPVIICLIIFKGNSEK

SEQ ID NO: 1900521 - protein, 24 aa, Staphylococcus
LAVLAFILSLFLKGKKGADAEHER

SEQ ID NO: 1900522 - protein, 25 aa, Staphylococcus
LAVLIIIALYMLIQFFINRRAVTEL

SEQ ID NO: 1900523 - protein, 25 aa, Staphylococcus
LAVLIIIIAYMLINYLLNKRAVTEL

SEQ ID NO: 1900524 - protein, 19 aa, Staphylococcus
LAWILQPIFWISIFIHPII

SEQ ID NO: 1900525 - protein, 28 aa, Staphylococcus
LAWLGIITQLFILLGLGIGTMFGGTSEV

SEQ ID NO: 1900526 - protein, 20 aa, Staphylococcus
LAYLIVIFTALFKSGGSLFY

SEQ ID NO: 1900527 - protein, 21 aa, Staphylococcus
LAYLLIGIMLYFLMASIGELA

SEQ ID NO: 1900528 - protein, 18 aa, Staphylococcus
LAYLPLLVIFIGMYPFLI

SEQ ID NO: 1900529 - protein, 23 aa, Staphylococcus
LAYRIILSMIFMVVLIYAMGKYT

SEQ ID NO: 1900530 - protein, 18 aa, Staphylococcus
LAYYLFIDSLKYLSAKET

SEQ ID NO: 1900531 - protein, 20 aa, Staphylococcus
LCFALIIGWLGRYLRYFRNL

SEQ ID NO: 1900532 - protein, 28 aa, Staphylococcus
LCFLINIPMCIIFILLAIKLLPQTTTSS

SEQ ID NO: 1900533 - protein, 23 aa, Staphylococcus
LCLALIIGWLGRYLRYFRNLARD

SEQ ID NO: 1900534 - protein, 20 aa, Staphylococcus
LCLALMIGWLGRYLRYFRNL

SEQ ID NO: 1900535 - protein, 19 aa, Staphylococcus
LCLIFVDYKYVWLGIILIG

SEQ ID NO: 1900536 - protein, 25 aa, Staphylococcus
LCLIIAPVAWLLLVGRALQGLSGAL

SEQ ID NO: 1900537 - protein, 17 aa, Staphylococcus
LCLTVFKMKGIYAAITT

SEQ ID NO: 1900538 - protein, 17 aa, Staphylococcus
LCLTVFKMKGVYAALTT

SEQ ID NO: 1900539 - protein, 17 aa, Staphylococcus
LCMFFNFKYSAHLSIYI

SEQ ID NO: 1900540 - protein, 17 aa, Staphylococcus
LCQYFYPEYVSSATLPT

SEQ ID NO: 1900541 - protein, 25 aa, Staphylococcus
LCSLSILFFANLCISMPSAIMSIIF

SEQ ID NO: 1900542 - protein, 30 aa, Staphylococcus
LCTISSQIWLLFTSIFFIGLFSQWARTTNR

SEQ ID NO: 1900543 - protein, 21 aa, Staphylococcus
LCVIAFFLMGTGSHLWRVAVG

SEQ ID NO: 1900544 - protein, 17 aa, Staphylococcus
LCVVGILTFGIFPQLMP

SEQ ID NO: 1900545 - protein, 19 aa, Staphylococcus
LCWPYVLLPYGFGQIFQQI

SEQ ID NO: 1900546 - protein, 25 aa, Staphylococcus
LCWYIGIILFYFIMAILTPLSFVDW

SEQ ID NO: 1900547 - protein, 22 aa, Staphylococcus
LCYTIVLTWIIGKILQKIMPIA

SEQ ID NO: 1900548 - protein, 22 aa, Staphylococcus
LDCSLFCALFVLSLASFFMLSL

SEQ ID NO: 1900549 - protein, 26 aa, Staphylococcus
LDDIVLPFIILFLTVIGAYFFFRSSV

SEQ ID NO: 1900550 - protein, 33 aa, Staphylococcus
LDEHSTYLVALPIAHNFPLGCPGIIGTLAVGGT

SEQ ID NO: 1900551 - protein, 43 aa, Staphylococcus
LDFLPNIYNKYSIRKFTVGTASILLGSTLIFGINHDAEAAENE

SEQ ID NO: 1900552 - protein, 43 aa, Staphylococcus
LDFLPNKLNKYSIRRFTVGTASILVGATLIFGVANDQAEAAEN

SEQ ID NO: 1900553 - protein, 43 aa, Staphylococcus
LDFLPNRLNKYSIRKFTVGTASILVGATLIFGAGHDVAKAAED

SEQ ID NO: 1900554 - protein, 18 aa, Staphylococcus
LDFRFKSLLYISIAVSFV

SEQ ID NO: 1900555 - protein, 20 aa, Staphylococcus
LDFSVWRLFGISVMAILGML

SEQ ID NO: 1900556 - protein, 23 aa, Staphylococcus
LDFWQIIIIFLAVAIVYFLMAKI

SEQ ID NO: 1900557 - protein, 23 aa, Staphylococcus
LDGGRILFVLYEAIFRKPVNKKA

SEQ ID NO: 1900558 - protein, 23 aa, Staphylococcus
LDGGRILFVLYEAVFRKPVNKKA

SEQ ID NO: 1900559 - protein, 29 aa, Staphylococcus
LDGKLIEDNLRYRQIIFSHREDLKTITAK

SEQ ID NO: 1900560 - protein, 19 aa, Staphylococcus
LDGKYQVELAKQKALEELE

SEQ ID NO: 1900561 - protein, 17 aa, Staphylococcus
LDGLNSGGSLLDNIEDI

SEQ ID NO: 1900562 - protein, 24 aa, Staphylococcus
LDGLSFLTLYLLHLHLGYTFSGGF

SEQ ID NO: 1900563 - protein, 19 aa, Staphylococcus
LDGSLPQIIFLIAVPNHSN

SEQ ID NO: 1900564 - protein, 22 aa, Staphylococcus
LDIKFDALLLNIKKAKSLAFRD

SEQ ID NO: 1900565 - protein, 24 aa, Staphylococcus
LDIVKTIFVIELVGALLLAFYFYR

SEQ ID NO: 1900566 - protein, 24 aa, Staphylococcus
LDKDLFLAILVSITGSLIALTMFF

SEQ ID NO: 1900567 - protein, 72 aa, Staphylococcus
LDKQKYKFIISLILSLPLIYTMVGHFSFLSFLPLPHFMVQPWFQFILATPVQFILGWQFYKGAYSSLRNKSA

SEQ ID NO: 1900568 - protein, 18 aa, Staphylococcus
LDKQVAWIFDLIRVILPF

SEQ ID NO: 1900569 - protein, 17 aa, Staphylococcus
LDPIMTKIAKRVEESKV

SEQ ID NO: 1900570 - protein, 17 aa, Staphylococcus
LDRDNFICLYKQSLNFI

SEQ ID NO: 1900571 - protein, 32 aa, Staphylococcus
LDRISWVRWILYIVALFLPIFIIYTIMKPADK

SEQ ID NO: 1900572 - protein, 19 aa, Staphylococcus
LDTAMKKLRDSIADANDIK

SEQ ID NO: 1900573 - protein, 21 aa, Staphylococcus
LDTFFLEKGKIIGLLQMFMTK

SEQ ID NO: 1900574 - protein, 28 aa, Staphylococcus
LDVSTAYALLFFDLIVVAISLTVLPLSK

SEQ ID NO: 1900575 - protein, 27 aa, Staphylococcus
LDVSTAYALLFFDLIVVLISLTVLPLQ

SEQ ID NO: 1900576 - protein, 28 aa, Staphylococcus
LDVSTPYALLFFDLIVVAISLSVIPISS

SEQ ID NO: 1900577 - protein, 27 aa, Staphylococcus
LDVSTPYALLFFDLIVVLISLTVLPIE

SEQ ID NO: 1900578 - protein, 18 aa, Staphylococcus
LDYKRLFGAIGKNLTGGF

SEQ ID NO: 1900579 - protein, 20 aa, Staphylococcus
LDYYLVYLILLKLLHVHYMV

SEQ ID NO: 1900580 - protein, 24 aa, Staphylococcus
LEATFWMINKILKLAPLGVFAFIC

SEQ ID NO: 1900581 - protein, 19 aa, Staphylococcus
LEAVFWMIGKVLLLAPIAV

SEQ ID NO: 1900582 - protein, 24 aa, Staphylococcus
LEAVFWMINKILKLAPLGVFAFIC

SEQ ID NO: 1900583 - protein, 36 aa, Staphylococcus
LEDELTKRQIYLGKGAFFIMMGIIQALIVTIGDLVI

SEQ ID NO: 1900584 - protein, 20 aa, Staphylococcus
LEDKYLIRMIPIDKIGQKSN

SEQ ID NO: 1900585 - protein, 31 aa, Staphylococcus
LEDYKALVNSLYFIALIFGVIATFITAIISY

SEQ ID NO: 1900586 - protein, 17 aa, Staphylococcus
LEEAEYYTPKTAQNLKD

SEQ ID NO: 1900587 - protein, 17 aa, Staphylococcus
LEELIYRGIFKETLFKK

SEQ ID NO: 1900588 - protein, 18 aa, Staphylococcus
LEELIYRGIFKETLFKRS

SEQ ID NO: 1900589 - protein, 33 aa, Staphylococcus
LEFKSETLTISGIPKEPGRYDIIVTVIDSNSNQ

SEQ ID NO: 1900590 - protein, 18 aa, Staphylococcus
LEFTNTRTNRKGMNGTLV

SEQ ID NO: 1900591 - protein, 34 aa, Staphylococcus
LEHHQVITMFFFTGLIIGIIPYLLRTVKFNKTFK

SEQ ID NO: 1900592 - protein, 24 aa, Staphylococcus
LEIKWPFWLSQIGLIFLGVQIGST

SEQ ID NO: 1900593 - protein, 24 aa, Staphylococcus
LEIVRTIFVIEFIGALLLAFYFYR

SEQ ID NO: 1900594 - protein, 24 aa, Staphylococcus
LEIVRTIFVIELVGALLLAFYFYR

SEQ ID NO: 1900595 - protein, 19 aa, Staphylococcus
LEKALDKAVAFDDLDLNDP

SEQ ID NO: 1900596 - protein, 17 aa, Staphylococcus
LEKLIPRVPNLYRQYSS

SEQ ID NO: 1900597 - protein, 17 aa, Staphylococcus
LELIQLDQLLVNILQTY

SEQ ID NO: 1900598 - protein, 17 aa, Staphylococcus
LELLPSNPFLDFTGQRT

SEQ ID NO: 1900599 - protein, 30 aa, Staphylococcus
LELRSKLVKLIISAVLAAPLLLTMLVHLFG

SEQ ID NO: 1900600 - protein, 18 aa, Staphylococcus
LEMISYFFILRLSERQIY

SEQ ID NO: 1900601 - protein, 18 aa, Staphylococcus
LEMRALLLHLRPIGLKDK

SEQ ID NO: 1900602 - protein, 30 aa, Staphylococcus
LENKFATPILFLTIPFILTSLKLLYNYWQP

SEQ ID NO: 1900603 - protein, 18 aa, Staphylococcus
LEPFGDLGVIWILGILYF

SEQ ID NO: 1900604 - protein, 29 aa, Staphylococcus
LEQAKHDLILDYDAIIKKIKQQTDLTDAQ

SEQ ID NO: 1900605 - protein, 27 aa, Staphylococcus
LERVGLIIIIAYILMNINHFKTIMSAR

SEQ ID NO: 1900606 - protein, 27 aa, Staphylococcus
LERVGLIIIIAYLLMNTSHFKTMMGER

SEQ ID NO: 1900607 - protein, 25 aa, Staphylococcus
LERVGLIIIIAYMLMNINHFKTMMG

SEQ ID NO: 1900608 - protein, 27 aa, Staphylococcus
LERVGLIILIAYILMNINHFKTMMNER

SEQ ID NO: 1900609 - protein, 27 aa, Staphylococcus
LERVGLIIVLAYILMNFKYFKNLMQNR

SEQ ID NO: 1900610 - protein, 18 aa, Staphylococcus
LESLILLPIVLPPTVMGF

SEQ ID NO: 1900611 - protein, 23 aa, Staphylococcus
LETGLMFICFQKSPQQFIDIQNH

SEQ ID NO: 1900612 - protein, 27 aa, Staphylococcus
LEVATWHWLFYINIPIALIAIVLAFLT

SEQ ID NO: 1900613 - protein, 24 aa, Staphylococcus
LEVKWPFWLSQIGLILLGVQIGLT

SEQ ID NO: 1900614 - protein, 18 aa, Staphylococcus
LFAIFLGGLVRTYFGFGE

SEQ ID NO: 1900615 - protein, 18 aa, Staphylococcus
LFALAFVNSLLYIIQYRN

SEQ ID NO: 1900616 - protein, 17 aa, Staphylococcus
LFALFIKEPNRKSQNMR

SEQ ID NO: 1900617 - protein, 18 aa, Staphylococcus
LFAMERFFREKKIGLFIF

SEQ ID NO: 1900618 - protein, 18 aa, Staphylococcus
LFAMLLSIAGTFFFMKLI

SEQ ID NO: 1900619 - protein, 19 aa, Staphylococcus
LFASFFFSGSETALTAANR

SEQ ID NO: 1900620 - protein, 19 aa, Staphylococcus
LFAVFFIFNIILIINFGKN

SEQ ID NO: 1900621 - protein, 21 aa, Staphylococcus
LFAVIFTFIFGDQSPFAYALS

SEQ ID NO: 1900622 - protein, 17 aa, Staphylococcus
LFCVLILMSFNLLSAKL

SEQ ID NO: 1900623 - protein, 19 aa, Staphylococcus
LFCVLILMTFNLLSARLFG

SEQ ID NO: 1900624 - protein, 19 aa, Staphylococcus
LFCVLILMVFNLLSAKLFG

SEQ ID NO: 1900625 - protein, 22 aa, Staphylococcus
LFDAFIVRMTLIPALTKLFGRA

SEQ ID NO: 1900626 - protein, 22 aa, Staphylococcus
LFELKLVLIMTFALLLSSYTCG

SEQ ID NO: 1900627 - protein, 22 aa, Staphylococcus
LFELPLVLLMTFALLISSYTCG

SEQ ID NO: 1900628 - protein, 17 aa, Staphylococcus
LFFASVLCFVLHALIRM

SEQ ID NO: 1900629 - protein, 26 aa, Staphylococcus
LFFDNYLIVILFITIQAILSFKLYRH

SEQ ID NO: 1900630 - protein, 32 aa, Staphylococcus
LFFGGNWDTWVYQGLAVLVVGCPCALVISTPI

SEQ ID NO: 1900631 - protein, 28 aa, Staphylococcus
LFFKHDGILPKALIRAMIQDVLSLNSRS

SEQ ID NO: 1900632 - protein, 17 aa, Staphylococcus
LFFLIIILGTCLVALSS

SEQ ID NO: 1900633 - protein, 25 aa, Staphylococcus
LFFVLAFFVLFHVSAFAAEIPAKTA

SEQ ID NO: 1900634 - protein, 23 aa, Staphylococcus
LFGIILMNILVFSLPYEMASMSQ

SEQ ID NO: 1900635 - protein, 19 aa, Staphylococcus
LFGIPPKDLNIAQSAYLIG

SEQ ID NO: 1900636 - protein, 18 aa, Staphylococcus
LFGISVMAILGMLVWIMV

SEQ ID NO: 1900637 - protein, 17 aa, Staphylococcus
LFGLLKFTSVMTPEMVT

SEQ ID NO: 1900638 - protein, 17 aa, Staphylococcus
LFGLYATLKWPTSGGIL

SEQ ID NO: 1900639 - protein, 19 aa, Staphylococcus
LFGSLFGGAFYFSIGVFKN

SEQ ID NO: 1900640 - protein, 23 aa, Staphylococcus
LFGTLFAVLGSIFLFWRRRKEED

SEQ ID NO: 1900641 - protein, 27 aa, Staphylococcus
LFGVHPFVVFFPIISILIIYYIIRFKM

SEQ ID NO: 1900642 - protein, 51 aa, Staphylococcus
LFIDKVFVNIIYFQGMFYTQIFGIPVFLFLNIIVILLCIIVGSVLAYKINQ

SEQ ID NO: 1900643 - protein, 51 aa, Staphylococcus; identical to SEQ ID NO: 1752149

SEQ ID NO: 1900644 - protein, 50 aa, Staphylococcus
LFIDKVFVNIIYFQGMFYTQIFGIPVFLFLNLVIILLCIIVGSILAYKIN

SEQ ID NO: 1900645 - protein, 50 aa, Staphylococcus
LFIDKVFVNIIYFQGMFYTQIFGIPVFLFLNLVIILLCIIVGSVLAYKIN

SEQ ID NO: 1900646 - protein, 18 aa, Staphylococcus
LFIFGLLGGAATSLALGV

SEQ ID NO: 1900647 - protein, 25 aa, Staphylococcus
LFIFVFIIINISLAIMYVNKINKSH

SEQ ID NO: 1900648 - protein, 29 aa, Staphylococcus
LFIFVFILVNIFLVVIYIDKVNKSQINEA

SEQ ID NO: 1900649 - protein, 30 aa, Staphylococcus
LFIFVFILVNILLVLIYVNKVTKSQINESE

SEQ ID NO: 1900650 - protein, 31 aa, Staphylococcus; identical to SEQ ID NO: 1752150

SEQ ID NO: 1900651 - protein, 29 aa, Staphylococcus
LFIFVFILVNISLIVIYINKVTQSQINDS

SEQ ID NO: 1900652 - protein, 29 aa, Staphylococcus
LFIFVFILVNISLVIIYIDKVNKSHINDS

SEQ ID NO: 1900653 - protein, 31 aa, Staphylococcus
LFIFVFVLVNIFLILIYINKVTKSQINEIES

SEQ ID NO: 1900654 - protein, 18 aa, Staphylococcus
LFIGIVGPALLIPMYVQT

SEQ ID NO: 1900655 - protein, 20 aa, Staphylococcus
LFIGLAVLFFVLYIAFGRYG

SEQ ID NO: 1900656 - protein, 20 aa, Staphylococcus
LFIIAAIIIILLQKVIKNPT

SEQ ID NO: 1900657 - protein, 18 aa, Staphylococcus
LFIINAFVIMLFKLFIHL

SEQ ID NO: 1900658 - protein, 25 aa, Staphylococcus
LFIINVLCIILLKTFIHINTQGLLF

SEQ ID NO: 1900659 - protein, 24 aa, Staphylococcus
LFIISLMIIIEAIRRFFAPPEVQS

SEQ ID NO: 1900660 - protein, 33 aa, Staphylococcus
LFIKTRKNWVLWFLFLNLMMLGISYIDYDISVD

SEQ ID NO: 1900661 - protein, 21 aa, Staphylococcus
LFILPIPLHFKFEPEVFMMAV

SEQ ID NO: 1900662 - protein, 19 aa, Staphylococcus
LFINFPRRYRNVFLFMVIV

SEQ ID NO: 1900663 - protein, 27 aa, Staphylococcus
LFITLLTLLFTILIGVPLGLLAGYKKG

SEQ ID NO: 1900664 - protein, 19 aa, Staphylococcus
LFITVIIGVPLGLLAGYKK

SEQ ID NO: 1900665 - protein, 32 aa, Staphylococcus
LFKNYKLYYTSLWYFITFGAFVAFGLFLPNYL

SEQ ID NO: 1900666 - protein, 24 aa, Staphylococcus
LFKRSSFWLPFILSSLIFASQHGI

SEQ ID NO: 1900667 - protein, 24 aa, Staphylococcus
LFKVHAFIPFAFLLIVIVGPIVEE

SEQ ID NO: 1900668 - protein, 26 aa, Staphylococcus
LFKVIKIYFIFTLPLIILAAFTETYV

SEQ ID NO: 1900669 - protein, 25 aa, Staphylococcus
LFLCILLVWLMTPGLSLFYGGLVQP

SEQ ID NO: 1900670 - protein, 25 aa, Staphylococcus
LFLCTLLVWIMTPGLSLFYGGLVQS

SEQ ID NO: 1900671 - protein, 20 aa, Staphylococcus
LFLCTLLVWVMTPGLSLFYG

SEQ ID NO: 1900672 - protein, 17 aa, Staphylococcus
LFLGNWIGQIALNWYVY

SEQ ID NO: 1900673 - protein, 17 aa, Staphylococcus
LFLIGMISSILNAKLRA

SEQ ID NO: 1900674 - protein, 22 aa, Staphylococcus
LFLIHYILLDYFVICKQPMNAL

SEQ ID NO: 1900675 - protein, 26 aa, Staphylococcus
LFLILYSLIFMYYLILTSRKLSPIIV

SEQ ID NO: 1900676 - protein, 19 aa, Staphylococcus
LFLISIILLCVTVYVSFIV

SEQ ID NO: 1900677 - protein, 20 aa, Staphylococcus
LFLKRLYYVAFKLVVFTLAC

SEQ ID NO: 1900678 - protein, 33 aa, Staphylococcus
LFLKTRSNWIFWIIFLQFVFLGMAYIDYDMAIE

SEQ ID NO: 1900679 - protein, 29 aa, Staphylococcus
LFLLCIIVIISFLALGAIITHAIYNTVSS

SEQ ID NO: 1900680 - protein, 28 aa, Staphylococcus
LFLLFFIFLSFIGLFIYTYFQNTRVKSE

SEQ ID NO: 1900681 - protein, 18 aa, Staphylococcus
LFLTVFMLFRFDWKSEFS

SEQ ID NO: 1900682 - protein, 18 aa, Staphylococcus
LFLYPFIAYFIGLIRDRY

SEQ ID NO: 1900683 - protein, 25 aa, Staphylococcus
LFMKCRFWLPLIFSSLIFSSQHLSS

SEQ ID NO: 1900684 - protein, 26 aa, Staphylococcus
LFMSGLMYVIIGFLIRFSGTGWLMHL

SEQ ID NO: 1900685 - protein, 25 aa, Staphylococcus
LFMSGLMYVIIGLLIRLSGTGWLMH

SEQ ID NO: 1900686 - protein, 18 aa, Staphylococcus
LFMVTLIAPLLFVEGVNV

SEQ ID NO: 1900687 - protein, 25 aa, Staphylococcus
LFNALLYILILIKPQKLNTVANYLF

SEQ ID NO: 1900688 - protein, 26 aa, Staphylococcus
LFNILATWFMLIWTNDWILSIIVGVI

SEQ ID NO: 1900689 - protein, 17 aa, Staphylococcus
LFNWFYYVYNIGVVVTV

SEQ ID NO: 1900690 - protein, 18 aa, Staphylococcus
LFPFIFIAAAGGASLASF

SEQ ID NO: 1900691 - protein, 18 aa, Staphylococcus
LFQPHFWKGQLSYPTIIN

SEQ ID NO: 1900692 - protein, 21 aa, Staphylococcus
LFRGMFPMYLLMIISTLGVGF

SEQ ID NO: 1900693 - protein, 17 aa, Staphylococcus
LFRIEIDITFIAAVLTI

SEQ ID NO: 1900694 - protein, 18 aa, Staphylococcus
LFRYLFLFTFIIGGVFAL

SEQ ID NO: 1900695 - protein, 33 aa, Staphylococcus
LFSFKLYRHYYFKLFAMITWILLIGSLSQYFDS

SEQ ID NO: 1900696 - protein, 24 aa, Staphylococcus
LFSILFNAPRRLLLACGFVGAMGW

SEQ ID NO: 1900697 - protein, 20 aa, Staphylococcus
LFSILIFTIILIIVYRKSIP

SEQ ID NO: 1900698 - protein, 19 aa, Staphylococcus
LFSIYLLNINLAGSLAYVI

SEQ ID NO: 1900699 - protein, 24 aa, Staphylococcus
LFSKRFWESLKFLLPIGIGMVVAI

SEQ ID NO: 1900700 - protein, 36 aa, Staphylococcus
LFSNFYFSYYQAIVLGIYFLLRIIFEYRYDIVTRWQ

SEQ ID NO: 1900701 - protein, 44 aa, Staphylococcus
LFSSVVAIIFFFVWPFVYDAIVAFGKWIINFGPFGAFLYGFFNR

SEQ ID NO: 1900702 - protein, 18 aa, Staphylococcus
LFTAMRSKYYLFITDPVV

SEQ ID NO: 1900703 - protein, 18 aa, Staphylococcus
LFTIGLYLVIGPFFALPR

SEQ ID NO: 1900704 - protein, 22 aa, Staphylococcus
LFTSIIWLLGSFGFGWYLSNFG

SEQ ID NO: 1900705 - protein, 22 aa, Staphylococcus
LFTTYILIHTLILMLVLGITTF

SEQ ID NO: 1900706 - protein, 23 aa, Staphylococcus
LFVFMFIILIFFAHSFATFGWII

SEQ ID NO: 1900707 - protein, 24 aa, Staphylococcus
LFVGYVMLMGYRRGWWLNCLHVMT

SEQ ID NO: 1900708 - protein, 18 aa, Staphylococcus
LFVIGFWTILPKDIVTKA

SEQ ID NO: 1900709 - protein, 19 aa, Staphylococcus
LFVLGVIILTTVVSIITSI

SEQ ID NO: 1900710 - protein, 17 aa, Staphylococcus
LFVLLLLLTLPLNHFYN

SEQ ID NO: 1900711 - protein, 19 aa, Staphylococcus
LFVLMIFFVFIVLAAPTYI

SEQ ID NO: 1900712 - protein, 21 aa, Staphylococcus
LFVLSYLLIFIYFVCITSRKG

SEQ ID NO: 1900713 - protein, 25 aa, Staphylococcus
LFVMSPLYYRFTVYWPFFSDVFVWM

SEQ ID NO: 1900714 - protein, 19 aa, Staphylococcus
LFVTSFLGIAFLIAAGCII

SEQ ID NO: 1900715 - protein, 23 aa, Staphylococcus
LFVVYIIIIVFSLLNYWSVKLLT

SEQ ID NO: 1900716 - protein, 30 aa, Staphylococcus
LFWANISFVVLIVLLIICAIPEHSFLRNAK

SEQ ID NO: 1900717 - protein, 21 aa, Staphylococcus
LFYESFPVVGLNYENRRVKLK

SEQ ID NO: 1900718 - protein, 19 aa, Staphylococcus
LFYFIIHVHYTYIDIKFWV

SEQ ID NO: 1900719 - protein, 27 aa, Staphylococcus
LGAHLLWGILPIYWRFIHGISAFEILA

SEQ ID NO: 1900720 - protein, 36 aa, Staphylococcus
LGAHRFYRKQYGKALLYILFCWTGIPGVIGMIEGVI

SEQ ID NO: 1900721 - protein, 25 aa, Staphylococcus
LGAKYTPTAILYFNPKHDGDVTISN

SEQ ID NO: 1900722 - protein, 24 aa, Staphylococcus
LGALFVFLFSKVLPQHFYLYRVYK

SEQ ID NO: 1900723 - protein, 24 aa, Staphylococcus
LGALLLIFMLIFGDLKFIVESYTL

SEQ ID NO: 1900724 - protein, 24 aa, Staphylococcus
LGAMFLLFGAFLYFIGTEVYVNMQ

SEQ ID NO: 1900725 - protein, 36 aa, Staphylococcus
LGAPLFALMILIVSVKMFGFLRAIARYIERLLSHRA

SEQ ID NO: 1900726 - protein, 40 aa, Staphylococcus
LGASFKWYDFVYFIDTIIYLFILIFKRQWLSTKAFSKKFV

SEQ ID NO: 1900727 - protein, 25 aa, Staphylococcus
LGASKLTLTYGISKSFLKKIGMSSK

SEQ ID NO: 1900728 - protein, 17 aa, Staphylococcus
LGAVFQIFLFDKFMKYF

SEQ ID NO: 1900729 - protein, 26 aa, Staphylococcus
LGAVLLIFILIFGDLKFVLESYTLAI

SEQ ID NO: 1900730 - protein, 17 aa, Staphylococcus
LGCPGIIGTLAVGGTIV

SEQ ID NO: 1900731 - protein, 20 aa, Staphylococcus
LGDIFIPILPALVTAGLLMG

SEQ ID NO: 1900732 - protein, 25 aa, Staphylococcus
LGDKKYNHLILQTPIIRDTVSPDSE

SEQ ID NO: 1900733 - protein, 24 aa, Staphylococcus
LGELILLFIFYLMHRKYLIPLALK

SEQ ID NO: 1900734 - protein, 24 aa, Staphylococcus
LGEPLAMWIGFPLGQVLLYIGVFF

SEQ ID NO: 1900735 - protein, 18 aa, Staphylococcus
LGESILVVGNPLGNDFKN

SEQ ID NO: 1900736 - protein, 18 aa, Staphylococcus
LGFALMALTIRKVAAQRA

SEQ ID NO: 1900737 - protein, 18 aa, Staphylococcus
LGFIPWLSQLIAHSLHGL

SEQ ID NO: 1900738 - protein, 25 aa, Staphylococcus
LGFIVFFFEMYIFSGILIAFSVILL

SEQ ID NO: 1900739 - protein, 18 aa, Staphylococcus
LGFLGSSLFLIVMKPFSF

SEQ ID NO: 1900740 - protein, 18 aa, Staphylococcus
LGFLYKYIIAHLIQFYAI

SEQ ID NO: 1900741 - protein, 18 aa, Staphylococcus
LGFPPIYAMLMSLLIFAG

SEQ ID NO: 1900742 - protein, 27 aa, Staphylococcus
LGFTMGWLYWAIWLLVTSVDIIISSSV

SEQ ID NO: 1900743 - protein, 24 aa, Staphylococcus
LGFTTLIMQEGFMSGLFGVDTTGP

SEQ ID NO: 1900744 - protein, 23 aa, Staphylococcus
LGFTTLVMQDGFLGGLFGVENTG

SEQ ID NO: 1900745 - protein, 20 aa, Staphylococcus
LGFTTLVMQDGFLGSLFGVE

SEQ ID NO: 1900746 - protein, 24 aa, Staphylococcus
LGFTTLVMQDGFMKGLFGVETTGP

SEQ ID NO: 1900747 - protein, 21 aa, Staphylococcus
LGGAAAAVLLSRKESRDKLKD

SEQ ID NO: 1900748 - protein, 38 aa, Staphylococcus
LGGALMALIPNIVGLTTFLGPLITKIVGLASKLGLGKT

SEQ ID NO: 1900749 - protein, 23 aa, Staphylococcus
LGGIILFFLMKYAHVMTPEMTDA

SEQ ID NO: 1900750 - protein, 32 aa, Staphylococcus
LGGLIIHFATWQWIFFINIFVTIIAVPIMIKK

SEQ ID NO: 1900751 - protein, 31 aa, Staphylococcus
LGGLSWPVVLVILIIFYFYSHYLFASSTAHV

SEQ ID NO: 1900752 - protein, 17 aa, Staphylococcus
LGGLVFFLILKGSDVMT

SEQ ID NO: 1900753 - protein, 27 aa, Staphylococcus
LGGMIPFLLLFLLSVKFKFQPTRMILI

SEQ ID NO: 1900754 - protein, 28 aa, Staphylococcus
LGGPGAVFWMWVIAFIGAASAFIEATLA

SEQ ID NO: 1900755 - protein, 28 aa, Staphylococcus
LGGPGAVFWMWVIAFIGAASAFMEATLA

SEQ ID NO: 1900756 - protein, 23 aa, Staphylococcus
LGGTIFVVTILTIAMIINHHINQ

SEQ ID NO: 1900757 - protein, 27 aa, Staphylococcus
LGHDVSWGEWFLFAAPWSILMSIALFF

SEQ ID NO: 1900758 - protein, 35 aa, Staphylococcus
LGHDVSWGEWFLYAAPWSILMSVALYFIMIKVMPP

SEQ ID NO: 1900759 - protein, 19 aa, Staphylococcus
LGHIALIFGLGAILGKLLA

SEQ ID NO: 1900760 - protein, 27 aa, Staphylococcus
LGIALFFFIIFIHNFDFMIYIVLLMFI

SEQ ID NO: 1900761 - protein, 28 aa, Staphylococcus
LGIALIAIMLIVSIILAIVMLNGHQKES

SEQ ID NO: 1900762 - protein, 21 aa, Staphylococcus
LGIFILIILFIYNGFSHLLKT

SEQ ID NO: 1900763 - protein, 53 aa, Staphylococcus
LGIGLAIIILIIFAFAFRFIVKLIPVRFIFRVLSILIFVMTFKMLGVSIQKLQ

SEQ ID NO: 1900764 - protein, 19 aa, Staphylococcus
LGIIFFILTLSIGGVPPFS

SEQ ID NO: 1900765 - protein, 39 aa, Staphylococcus
LGIIFTFLLIIGFILNLILAFIIIFLERNRRSATSTWAW

SEQ ID NO: 1900766 - protein, 25 aa, Staphylococcus
LGIIGFLFIILLMPDFFQGPFTFTI

SEQ ID NO: 1900767 - protein, 21 aa, Staphylococcus
LGIILYIGYSLIGLPYTPLLV

SEQ ID NO: 1900768 - protein, 28 aa, Staphylococcus
LGILIAILYIPILFLMVYSFNSAGNMIH

SEQ ID NO: 1900769 - protein, 25 aa, Staphylococcus
LGINIIVYSLLYSVVLWTVIMSASE

SEQ ID NO: 1900770 - protein, 28 aa, Staphylococcus
LGITLFFFVIFIHNFDYMLYISALMFIF

SEQ ID NO: 1900771 - protein, 30 aa, Staphylococcus
LGIVFLITFLIYLFYSPRLKFDVLENPNNN

SEQ ID NO: 1900772 - protein, 26 aa, Staphylococcus
LGIVILLCLIIFLKLNTFISLIITSI

SEQ ID NO: 1900773 - protein, 26 aa, Staphylococcus
LGIVILLTLIIFLKLNTFISLIITSI

SEQ ID NO: 1900774 - protein, 17 aa, Staphylococcus
LGKHRRLDWLNKIMYKS

SEQ ID NO: 1900775 - protein, 23 aa, Staphylococcus
LGKILRTYLYKKYTEMSAIFFQN

SEQ ID NO: 1900776 - protein, 22 aa, Staphylococcus
LGKIRGLFQGILYIPHFLSWVV

SEQ ID NO: 1900777 - protein, 33 aa, Staphylococcus
LGKKSIIYMLMLEQLFIFIITALLGMIIGILGS

SEQ ID NO: 1900778 - protein, 24 aa, Staphylococcus
LGKTLFFISILLFAIGTIFAFQIQ

SEQ ID NO: 1900779 - protein, 18 aa, Staphylococcus
LGLAFIMLSLFNFLHNKT

SEQ ID NO: 1900780 - protein, 21 aa, Staphylococcus
LGLALFIVWAIRSYYLFRTYE

SEQ ID NO: 1900781 - protein, 18 aa, Staphylococcus
LGLGLYLVQLILKQHDSQ

SEQ ID NO: 1900782 - protein, 19 aa, Staphylococcus
LGLGWLGEPTFDKLLHPLF

SEQ ID NO: 1900783 - protein, 24 aa, Staphylococcus
LGLIIFCITVFIFELLFAASEPIF

SEQ ID NO: 1900784 - protein, 20 aa, Staphylococcus
LGLIILISAIFYKAPSWIIQ

SEQ ID NO: 1900785 - protein, 24 aa, Staphylococcus
LGLIILIYLFFTVKDTSAWIYNGG

SEQ ID NO: 1900786 - protein, 20 aa, Staphylococcus
LGLILFHNIDFKTAAIAIIL

SEQ ID NO: 1900787 - protein, 19 aa, Staphylococcus
LGLILLLTIIFWKSDEEIN

SEQ ID NO: 1900788 - protein, 17 aa, Staphylococcus
LGLIVFVLALFFPDKKK

SEQ ID NO: 1900789 - protein, 18 aa, Staphylococcus
LGLIVPQNKKLYIRQAKG

SEQ ID NO: 1900790 - protein, 20 aa, Staphylococcus
LGLKYKPTSILYFNPKHDKD

SEQ ID NO: 1900791 - protein, 25 aa, Staphylococcus
LGLLIIGLYIPIIFLMVYSFNSAGN

SEQ ID NO: 1900792 - protein, 21 aa, Staphylococcus
LGLLIIYTGFGIFKESIFTLS

SEQ ID NO: 1900793 - protein, 22 aa, Staphylococcus
LGLLIVAIVGFLLFMYIDDSRI

SEQ ID NO: 1900794 - protein, 22 aa, Staphylococcus
LGLLIVVIVGFLLFMYIKDSRI

SEQ ID NO: 1900795 - protein, 28 aa, Staphylococcus
LGLLMYRFAYYFIPLLISMILSIFEFGT

SEQ ID NO: 1900796 - protein, 18 aa, Staphylococcus
LGLLVDFMAELFKEKGHK

SEQ ID NO: 1900797 - protein, 26 aa, Staphylococcus
LGLNYAWTILYFNLKLRKTSLIESYV

SEQ ID NO: 1900798 - protein, 18 aa, Staphylococcus
LGLPIYFFYEYKMNWKNT

SEQ ID NO: 1900799 - protein, 24 aa, Staphylococcus
LGLTYTPTSILYFNPKREGEVTIS

SEQ ID NO: 1900800 - protein, 24 aa, Staphylococcus
LGLVFLVGSFLFFSDKTVTIGTVL

SEQ ID NO: 1900801 - protein, 24 aa, Staphylococcus
LGLVNFCRLVPILLLSVWAGSIAD

SEQ ID NO: 1900802 - protein, 26 aa, Staphylococcus
LGLVNFVRLIPILFLSIWAGSIADKY

SEQ ID NO: 1900803 - protein, 21 aa, Staphylococcus
LGLVWIIIWYKVFTDYPEDNK

SEQ ID NO: 1900804 - protein, 24 aa, Staphylococcus
LGMAYKLMVFNGHTTALLTISAII

SEQ ID NO: 1900805 - protein, 25 aa, Staphylococcus
LGMNGFMHFLPWPTPGPIGIYMASN

SEQ ID NO: 1900806 - protein, 20 aa, Staphylococcus
LGNMYIVMAVLLIVTFFIYH

SEQ ID NO: 1900807 - protein, 29 aa, Staphylococcus
LGNPGKALAIILLVLQIAGGGGTFPIEVT

SEQ ID NO: 1900808 - protein, 26 aa, Staphylococcus
LGPLFRPIMRPLFTLPGRSAVDNLAS

SEQ ID NO: 1900809 - protein, 26 aa, Staphylococcus
LGPLFRPIMRPLFTLPGRSTVDNLAS

SEQ ID NO: 1900810 - protein, 23 aa, Staphylococcus
LGPLFRPVMRPLFTLPGRSTVDN

SEQ ID NO: 1900811 - protein, 25 aa, Staphylococcus
LGPLLFIIFYFIPAITGLADAPRAV

SEQ ID NO: 1900812 - protein, 31 aa, Staphylococcus
LGQAKNRLNYILDPIVNRPSLLDRITGNTSG

SEQ ID NO: 1900813 - protein, 24 aa, Staphylococcus
LGQSRNYTISYKLKDGVTIEQLQR

SEQ ID NO: 1900814 - protein, 17 aa, Staphylococcus
LGSAIFSILGQHAVVLG

SEQ ID NO: 1900815 - protein, 17 aa, Staphylococcus
LGSIIFSLLGQNAIVLG

SEQ ID NO: 1900816 - protein, 23 aa, Staphylococcus
LGSLWLSIVFILVGGLIATFLVK

SEQ ID NO: 1900817 - protein, 23 aa, Staphylococcus
LGSMLYLVLTRPFSLKLKHNTAQ

SEQ ID NO: 1900818 - protein, 18 aa, Staphylococcus
LGSSLYLIYHRPFKYMRQ

SEQ ID NO: 1900819 - protein, 29 aa, Staphylococcus
LGSTIISVSGLPKGLEFKSETLTISGIPK

SEQ ID NO: 1900820 - protein, 26 aa, Staphylococcus
LGSVYLFIGLAILIFVLYIAFGKYGN

SEQ ID NO: 1900821 - protein, 23 aa, Staphylococcus
LGSWKMLAIYLFAGIFGNFVSLS

SEQ ID NO: 1900822 - protein, 24 aa, Staphylococcus
LGTALVIVLLLLTLIFVITTADTM

SEQ ID NO: 1900823 - protein, 33 aa, Staphylococcus
LGTITVPIPLLFGLLLLIVTVIAYYIFSALEIP

SEQ ID NO: 1900824 - protein, 28 aa, Staphylococcus
LGTIVAIIVILLFLRNIRTTAISVVSIP

SEQ ID NO: 1900825 - protein, 28 aa, Staphylococcus
LGTIVAIVVILLFLRNIRTTAISIVSIP

SEQ ID NO: 1900826 - protein, 28 aa, Staphylococcus
LGTMVAIIVILLFLRNIRTTAISIVSIP

SEQ ID NO: 1900827 - protein, 23 aa, Staphylococcus
LGTRFMSYFLFVKPMKAMQKSSK

SEQ ID NO: 1900828 - protein, 29 aa, Staphylococcus
LGTSAAFFYSIYESIKWLINTNYEPHLYF

SEQ ID NO: 1900829 - protein, 25 aa, Staphylococcus
LGTSAAYFYSIYEMFKWLNHSKHMP

SEQ ID NO: 1900830 - protein, 28 aa, Staphylococcus
LGTSAAYFYSLYEMIKWLSKNTYQPHLY

SEQ ID NO: 1900831 - protein, 30 aa, Staphylococcus
LGTSAAYFYSLYEMVKWLFNANVMPHLYFE

SEQ ID NO: 1900832 - protein, 39 aa, Staphylococcus
LGTSVLIYYLVLLLIYIIAALILLPPGFLGRQLELKHAA

SEQ ID NO: 1900833 - protein, 21 aa, Staphylococcus
LGVCLFVLPIPMHFEFESEVF

SEQ ID NO: 1900834 - protein, 30 aa, Staphylococcus
LGVIFLVLFLIYLFYSPRLKFDVLENPNKT

SEQ ID NO: 1900835 - protein, 26 aa, Staphylococcus
LGVLLFFFIIFIHNFDFMIYIVCLMF

SEQ ID NO: 1900836 - protein, 30 aa, Staphylococcus
LGVLPNKTAWWLVIPVGLVYAVIYYVIFRF

SEQ ID NO: 1900837 - protein, 25 aa, Staphylococcus
LGVLSFFFIIIPIVIFIALLIVVFI

SEQ ID NO: 1900838 - protein, 19 aa, Staphylococcus
LGVLVGIPIAIISWVTSVF

SEQ ID NO: 1900839 - protein, 26 aa, Staphylococcus
LGVNPILLLILAAIFFLVLKTFKYVS

SEQ ID NO: 1900840 - protein, 23 aa, Staphylococcus
LGVQQLFIESYINLLIEKMENRI

SEQ ID NO: 1900841 - protein, 22 aa, Staphylococcus
LGVTPIARFVGYKAVGVDPKVM

SEQ ID NO: 1900842 - protein, 30 aa, Staphylococcus
LGVVFLVSFLIYLFYSPRLKFDVLENPNKN

SEQ ID NO: 1900843 - protein, 25 aa, Staphylococcus
LGVWFMSYFIFIKPMKQLQQSTKKQ

SEQ ID NO: 1900844 - protein, 17 aa, Staphylococcus
LGYFGYGYMLGSLFGGV

SEQ ID NO: 1900845 - protein, 28 aa, Staphylococcus
LGYMILSLFIIISITFFLMKLMPGSPFN

SEQ ID NO: 1900846 - protein, 23 aa, Staphylococcus
LGYQNYFLFLGCLAVVIGLITLA

SEQ ID NO: 1900847 - protein, 24 aa, Staphylococcus
LHAVYFFILLLMSLIFTNDDFKKF

SEQ ID NO: 1900848 - protein, 19 aa, Staphylococcus
LHDMLIKAALFFLIGVMYK

SEQ ID NO: 1900849 - protein, 19 aa, Staphylococcus
LHFWPAVINIIAAFIGNYI

SEQ ID NO: 1900850 - protein, 18 aa, Staphylococcus
LHGLNITAYLFWTFSCVV

SEQ ID NO: 1900851 - protein, 19 aa, Staphylococcus
LHGLNITAYLFWTISCVAG

SEQ ID NO: 1900852 - protein, 25 aa, Staphylococcus
LHINRSEWIFILLAISLVLAFEAIN

SEQ ID NO: 1900853 - protein, 24 aa, Staphylococcus
LHKDTLIDIIFYSAIFGFIVARLY

SEQ ID NO: 1900854 - protein, 25 aa, Staphylococcus
LHLISFIFIFFLLHTFFLLNSKSIG

SEQ ID NO: 1900855 - protein, 25 aa, Staphylococcus
LHLPKEKLLTSIQYFGNTSSASIPL

SEQ ID NO: 1900856 - protein, 17 aa, Staphylococcus
LHMLLWGKDKGYKAFNM

SEQ ID NO: 1900857 - protein, 26 aa, Staphylococcus
LHMTLRLFLVLILFSGVWQVVEEFAT

SEQ ID NO: 1900858 - protein, 17 aa, Staphylococcus
LHNESYPRIFRINSRDT

SEQ ID NO: 1900859 - protein, 23 aa, Staphylococcus
LHQKVISFKLAWMPAIDLNLDLR

SEQ ID NO: 1900860 - protein, 31 aa, Staphylococcus
LHTKIIQPIIFLFLGLFIVSLYLVIMLPMFQ

SEQ ID NO: 1900861 - protein, 17 aa, Staphylococcus
LHVPDYWFGLINALFFS

SEQ ID NO: 1900862 - protein, 19 aa, Staphylococcus
LHVSFLSMLWSVIQVVLLP

SEQ ID NO: 1900863 - protein, 25 aa, Staphylococcus
LHWNPHVIGFWPFNQLIVALGRSLL

SEQ ID NO: 1900864 - protein, 18 aa, Staphylococcus
LHYILFAFLIVWLTDTGA

SEQ ID NO: 1900865 - protein, 17 aa, Staphylococcus
LIAALLNYIFPDATLVF

SEQ ID NO: 1900866 - protein, 18 aa, Staphylococcus
LIAALLNYIFPDATLVFT

SEQ ID NO: 1900867 - protein, 17 aa, Staphylococcus
LIAFLWVLFQDEDSFLF

SEQ ID NO: 1900868 - protein, 17 aa, Staphylococcus
LIAIIIDLGLRLLEKKL

SEQ ID NO: 1900869 - protein, 24 aa, Staphylococcus
LIAIKTFLHLINKIKLVPFAIYRI

SEQ ID NO: 1900870 - protein, 25 aa, Staphylococcus
LIAIKTFLHLINKVKLIPFAIYRIV

SEQ ID NO: 1900871 - protein, 23 aa, Staphylococcus
LIAIKTFLHLINKVKLVPFAIYR

SEQ ID NO: 1900872 - protein, 19 aa, Staphylococcus
LIALLAWPMSISTGRDYGL

SEQ ID NO: 1900873 - protein, 17 aa, Staphylococcus
LIALVFFPHAHILIKLL

SEQ ID NO: 1900874 - protein, 29 aa, Staphylococcus
LIAVIFAIIYNLWWLPYNLAQVAGIHLEQ

SEQ ID NO: 1900875 - protein, 26 aa, Staphylococcus
LICFTLIFHLPLWVLVIAFFLNVCPV

SEQ ID NO: 1900876 - protein, 21 aa, Staphylococcus
LICIPLAWILNLQNFFVKPLM

SEQ ID NO: 1900877 - protein, 22 aa, Staphylococcus
LIDKYPELRLRLVKGAYKEDAS

SEQ ID NO: 1900878 - protein, 22 aa, Staphylococcus
LIDKYPELRLRLVKGAYKENDT

SEQ ID NO: 1900879 - protein, 19 aa, Staphylococcus
LIDWGVLLVLGIFIGSYIA

SEQ ID NO: 1900880 - protein, 19 aa, Staphylococcus
LIFGAPSIFNFSLALLIGL

SEQ ID NO: 1900881 - protein, 19 aa, Staphylococcus
LIFGAPTIFNFSLALLIGL

SEQ ID NO: 1900882 - protein, 37 aa, Staphylococcus
LIFGLICLIITQLLYFIPGSVWFLMIVRLLNGIATAI

SEQ ID NO: 1900883 - protein, 19 aa, Staphylococcus
LIFIIGSLIFYLSKPYRSL

SEQ ID NO: 1900884 - protein, 33 aa, Staphylococcus
LIFLSLVLVVVPIIFAIILLKSSQGAFESSFND

SEQ ID NO: 1900885 - protein, 19 aa, Staphylococcus
LIFSILLILPLGIVAIIYP

SEQ ID NO: 1900886 - protein, 18 aa, Staphylococcus
LIFSTMWNMGLDFSVWRL

SEQ ID NO: 1900887 - protein, 17 aa, Staphylococcus
LIFVIKYLPETRGRSLE

SEQ ID NO: 1900888 - protein, 20 aa, Staphylococcus
LIFVTSFLGLAFLIAAGCII

SEQ ID NO: 1900889 - protein, 17 aa, Staphylococcus
LIGFAFNGFLEGAAGFG

SEQ ID NO: 1900890 - protein, 17 aa, Staphylococcus
LIGFLFYNFHPAKIFLG

SEQ ID NO: 1900891 - protein, 18 aa, Staphylococcus
LIGILQYTRILPLIINWL

SEQ ID NO: 1900892 - protein, 27 aa, Staphylococcus
LIGLILGPVLFALILLFVHPEGLGYKG

SEQ ID NO: 1900893 - protein, 26 aa, Staphylococcus
LIGNIINILINIGVAMAPLASVVLDV

SEQ ID NO: 1900894 - protein, 20 aa, Staphylococcus
LIGVLMLIGIVVTNAIVLID

SEQ ID NO: 1900895 - protein, 20 aa, Staphylococcus
LIHRLLFILFSKGEKPSIKY

SEQ ID NO: 1900896 - protein, 29 aa, Staphylococcus
LIHWISILPVWLFVKAPRYIKMINIAYVL

SEQ ID NO: 1900897 - protein, 24 aa, Staphylococcus
LIHYFMSMLMWPILGTINFMLPTL

SEQ ID NO: 1900898 - protein, 18 aa, Staphylococcus
LIIAFLMALFVMTFVVIA

SEQ ID NO: 1900899 - protein, 17 aa, Staphylococcus
LIIAIGIIYIFIHQNRH

SEQ ID NO: 1900900 - protein, 18 aa, Staphylococcus
LIIALFTALMRISSSKVL

SEQ ID NO: 1900901 - protein, 18 aa, Staphylococcus
LIIALIWGMIFIIDFQYS

SEQ ID NO: 1900902 - protein, 23 aa, Staphylococcus
LIIALLHAYFISRGFMDIIGTNN

SEQ ID NO: 1900903 - protein, 19 aa, Staphylococcus
LIIALVGLFINIIVAWIML

SEQ ID NO: 1900904 - protein, 26 aa, Staphylococcus
LIIFAIFFISGTVTWFAFDKAKYEKQ

SEQ ID NO: 1900905 - protein, 25 aa, Staphylococcus
LIIFSLIFFLVVYLIALYPNRIIDN

SEQ ID NO: 1900906 - protein, 18 aa, Staphylococcus
LIIGRIFQGLSAAVLLPS

SEQ ID NO: 1900907 - protein, 17 aa, Staphylococcus
LIIIAFVISFVALADLL

SEQ ID NO: 1900908 - protein, 19 aa, Staphylococcus
LIIIGIFIGSVKGGIYAVV

SEQ ID NO: 1900909 - protein, 26 aa, Staphylococcus
LIIIGLILVFSLFKPTYRKPGLYKDF

SEQ ID NO: 1900910 - protein, 20 aa, Staphylococcus
LIIILFGFLAAFIDAVVGGG

SEQ ID NO: 1900911 - protein, 21 aa, Staphylococcus
LIIIPILILSFIVSKLIPVLF

SEQ ID NO: 1900912 - protein, 18 aa, Staphylococcus
LIIIRRKVHILLTIFILC

SEQ ID NO: 1900913 - protein, 24 aa, Staphylococcus
LIIIVLIILYMVGNFFLNRRAVTE

SEQ ID NO: 1900914 - protein, 19 aa, Staphylococcus
LIILCGIVTLLIRIIPFMM

SEQ ID NO: 1900915 - protein, 22 aa, Staphylococcus
LIIMAVLIWTIGIASSAWIIIL

SEQ ID NO: 1900916 - protein, 20 aa, Staphylococcus
LIIMIMIFDLIIGLLLNFQI

SEQ ID NO: 1900917 - protein, 19 aa, Staphylococcus
LIIPAVIAAVLWFFVTPDK

SEQ ID NO: 1900918 - protein, 35 aa, Staphylococcus
LIIPDLTDEFLILDFSYDMPLATYLGQALNIDAKV

SEQ ID NO: 1900919 - protein, 18 aa, Staphylococcus
LIIRFVFGGLAVALATVI

SEQ ID NO: 1900920 - protein, 25 aa, Staphylococcus
LIISALIIFGVALLVCLFRLIKGPT

SEQ ID NO: 1900921 - protein, 24 aa, Staphylococcus
LIISLVDIFLFGNSFFYSVVLIII

SEQ ID NO: 1900922 - protein, 20 aa, Staphylococcus
LIITFPILRKFKVATPIFKP

SEQ ID NO: 1900923 - protein, 26 aa, Staphylococcus
LIITFSYWIYLLQKQPTKLTINYWYN

SEQ ID NO: 1900924 - protein, 26 aa, Staphylococcus
LIITILVALLVFKLPLNIAGGATFEG

SEQ ID NO: 1900925 - protein, 17 aa, Staphylococcus
LIITLVSIIWLVYEEYS

SEQ ID NO: 1900926 - protein, 22 aa, Staphylococcus
LIITPMLPYALAFAAGAMIFVV

SEQ ID NO: 1900927 - protein, 40 aa, Staphylococcus
LIITVISILFLIFLITSKLKFHPLLALLLTAIFVGFTSGL

SEQ ID NO: 1900928 - protein, 18 aa, Staphylococcus
LIIVLFLALGIFSQWLAN

SEQ ID NO: 1900929 - protein, 20 aa, Staphylococcus
LIIVLFLALGIFSQWLATQI

SEQ ID NO: 1900930 - protein, 21 aa, Staphylococcus
LIIVLWLVITAWKNIGYIKEV

SEQ ID NO: 1900931 - protein, 20 aa, Staphylococcus
LIIYFPFIKDWISKGYVFSG

SEQ ID NO: 1900932 - protein, 19 aa, Staphylococcus
LIIYIIIGAALGIIIIPEV

SEQ ID NO: 1900933 - protein, 43 aa, Staphylococcus
LIKEPALLLIIPFLILAFLISKLIPLFYIRKWFDMKTTISSAF

SEQ ID NO: 1900934 - protein, 17 aa, Staphylococcus
LIKLVVSAVLAAPLLMT

SEQ ID NO: 1900935 - protein, 22 aa, Staphylococcus
LIKMIIIPIVFCSLALSISNLG

SEQ ID NO: 1900936 - protein, 19 aa, Staphylococcus
LILALFTALMRISTSRILR

SEQ ID NO: 1900937 - protein, 26 aa, Staphylococcus
LILEAFLSFLFLLFFVGSVSGISHSE

SEQ ID NO: 1900938 - protein, 21 aa, Staphylococcus
LILFILMLIFGGKKGLISYLT

SEQ ID NO: 1900939 - protein, 21 aa, Staphylococcus
LILFTVFLYKYRIGNTDESGK

SEQ ID NO: 1900940 - protein, 31 aa, Staphylococcus
LILFVHKHYFLFLLILISIFFILTILPKSND

SEQ ID NO: 1900941 - protein, 22 aa, Staphylococcus
LILGLIIIFIVATIIFLKVENR

SEQ ID NO: 1900942 - protein, 23 aa, Staphylococcus
LILGMFMFLILIPLEKVFKLSSY

SEQ ID NO: 1900943 - protein, 23 aa, Staphylococcus
LILGMFMFLILLPLEKVFKLSSY

SEQ ID NO: 1900944 - protein, 24 aa, Staphylococcus
LILGPLCFALILIFFHPPALPEKG

SEQ ID NO: 1900945 - protein, 27 aa, Staphylococcus
LILGPLLFVLILSFFHPVELPFKGVYV

SEQ ID NO: 1900946 - protein, 17 aa, Staphylococcus
LILGVALPIIYFTIMIR

SEQ ID NO: 1900947 - protein, 21 aa, Staphylococcus
LILHVICICIAYWALSSVRLG

SEQ ID NO: 1900948 - protein, 26 aa, Staphylococcus
LILIGLILVLSIFKPTYRKPGLYKTF

SEQ ID NO: 1900949 - protein, 18 aa, Staphylococcus
LILIILFFTVNDDNDWIY

SEQ ID NO: 1900950 - protein, 28 aa, Staphylococcus
LILILIGSLILATLFFFGLKVYQGKQNL

SEQ ID NO: 1900951 - protein, 29 aa, Staphylococcus
LILINNFYFAYYLLIIGAGYIILRIIFRH

SEQ ID NO: 1900952 - protein, 26 aa, Staphylococcus
LILISTITIISFIGLGAIVHNMIYQT

SEQ ID NO: 1900953 - protein, 23 aa, Staphylococcus
LILIVVVVGFGIYFYASKDKEIN

SEQ ID NO: 1900954 - protein, 17 aa, Staphylococcus
LILLILMVIFGGKKGAV

SEQ ID NO: 1900955 - protein, 18 aa, Staphylococcus
LILLLIPIAVILFALKNI

SEQ ID NO: 1900956 - protein, 17 aa, Staphylococcus
LILLVLMIIFGGKKGLV

SEQ ID NO: 1900957 - protein, 18 aa, Staphylococcus
LILQVLFNLVDNALKHSG

SEQ ID NO: 1900958 - protein, 18 aa, Staphylococcus
LILSITYVILFPAQFYAA

SEQ ID NO: 1900959 - protein, 54 aa, Staphylococcus
LILSVFLFFKGKKAYWFIFIAGFLLTFLLYANVVYFRFFTDFLTFSTLNQASNV

SEQ ID NO: 1900960 - protein, 24 aa, Staphylococcus
LILTCIIFLGFLYQLYSKRINILG

SEQ ID NO: 1900961 - protein, 18 aa, Staphylococcus
LILTWLLNLVFGWSILHL

SEQ ID NO: 1900962 - protein, 19 aa, Staphylococcus
LILVSLRNIFIALILVTIG

SEQ ID NO: 1900963 - protein, 28 aa, Staphylococcus
LILVVIIYKYLLLKYDMTQLTKQLKYIK

SEQ ID NO: 1900964 - protein, 20 aa, Staphylococcus
LILVYSMLTAFLFIDKVFVN

SEQ ID NO: 1900965 - protein, 20 aa, Staphylococcus
LIMDKSIMSYLLIAVVLTAG

SEQ ID NO: 1900966 - protein, 20 aa, Staphylococcus
LIMIYLLFKNAFFNHWILRW

SEQ ID NO: 1900967 - protein, 17 aa, Staphylococcus
LIMLYLYTQIFKQEYQD

SEQ ID NO: 1900968 - protein, 19 aa, Staphylococcus
LIMNKFKIDPAVASGPFIT

SEQ ID NO: 1900969 - protein, 18 aa, Staphylococcus
LIMPIPYAKGMKATIDGH

SEQ ID NO: 1900970 - protein, 20 aa, Staphylococcus
LIMSLGFLLGGIIGLLQGIV

SEQ ID NO: 1900971 - protein, 17 aa, Staphylococcus
LINAVYAEKLIQYGNRY

SEQ ID NO: 1900972 - protein, 25 aa, Staphylococcus
LINHWNFWLLAFGFVILVAPVTGVA

SEQ ID NO: 1900973 - protein, 17 aa, Staphylococcus
LINLNASADVPEALLKS

SEQ ID NO: 1900974 - protein, 27 aa, Staphylococcus
LINNFYFAYYQLLTGLIYLTIRLVFRH

SEQ ID NO: 1900975 - protein, 28 aa, Staphylococcus
LIPFGLHHIFYAPFWFEFGHYTNHAGDL

SEQ ID NO: 1900976 - protein, 29 aa, Staphylococcus
LIPFGLHHIFYAPFWFEFGHYTNHAGELV

SEQ ID NO: 1900977 - protein, 26 aa, Staphylococcus
LIPFGLHHIFYAPFWFEFGHYVNESG

SEQ ID NO: 1900978 - protein, 21 aa, Staphylococcus
LIPFLGPWLSFAPAGILGIID

SEQ ID NO: 1900979 - protein, 19 aa, Staphylococcus
LIPIGINVIFLWISAISFS

SEQ ID NO: 1900980 - protein, 19 aa, Staphylococcus
LIPIPFLYMLNIVISVIIP

SEQ ID NO: 1900981 - protein, 20 aa, Staphylococcus
LIPLFILLCFPFTPNTLINL

SEQ ID NO: 1900982 - protein, 20 aa, Staphylococcus
LIPLIMLISMLLRGLIVLLE

SEQ ID NO: 1900983 - protein, 25 aa, Staphylococcus
LIPLIYDNMYLGYIAGLLAAYAGGF

SEQ ID NO: 1900984 - protein, 29 aa, Staphylococcus
LIPLLKLVLVVVFAMVFFIIVVLGIVARI

SEQ ID NO: 1900985 - protein, 17 aa, Staphylococcus
LIPLVFTVAKRANVSIL

SEQ ID NO: 1900986 - protein, 19 aa, Staphylococcus
LIPMINWALLFVGTLFVIK

SEQ ID NO: 1900987 - protein, 25 aa, Staphylococcus
LIPQQWVIGLLGLLPLYLGVKMWIK

SEQ ID NO: 1900988 - protein, 24 aa, Staphylococcus
LIPYLIWMVLFIIIPVVLLVYYSF

SEQ ID NO: 1900989 - protein, 18 aa, Staphylococcus
LIPYVIFFGFFSFYYYLT

SEQ ID NO: 1900990 - protein, 18 aa, Staphylococcus
LIQMPIVMGLYFVLRYRI

SEQ ID NO: 1900991 - protein, 17 aa, Staphylococcus
LIQSCQLYYFKYVLDKS

SEQ ID NO: 1900992 - protein, 32 aa, Staphylococcus
LIRDFLALMYQYKLLLTVYFAALFFICIITYW

SEQ ID NO: 1900993 - protein, 19 aa, Staphylococcus
LIRIAFFKEDESVTLIIMN

SEQ ID NO: 1900994 - protein, 18 aa, Staphylococcus
LIRMIPIDKIGQKSNRDT

SEQ ID NO: 1900995 - protein, 29 aa, Staphylococcus
LIRTILLGVILLPTIFIFAGTFDRLGKDQ

SEQ ID NO: 1900996 - protein, 20 aa, Staphylococcus
LIRWLSFIPITLFTALVLDG

SEQ ID NO: 1900997 - protein, 21 aa, Staphylococcus
LISAFLIVIYFIVDVVLWNKR

SEQ ID NO: 1900998 - protein, 24 aa, Staphylococcus
LISAILLLIIYFALAYVGATTSHE

SEQ ID NO: 1900999 - protein, 19 aa, Staphylococcus
LISFFKLGVPLLTIIMLML

SEQ ID NO: 1901000 - protein, 19 aa, Staphylococcus
LISGFYRWTAILGLAFTML

SEQ ID NO: 1901001 - protein, 25 aa, Staphylococcus
LISKLLPVLFIRRWFDTKTTIASAF

SEQ ID NO: 1901002 - protein, 19 aa, Staphylococcus
LISLIVLFTLMLVTLPVLF

SEQ ID NO: 1901003 - protein, 39 aa, Staphylococcus
LISLLMAFLFVISPLYFRFTVYWPFFSDVFIFMPLLLLS

SEQ ID NO: 1901004 - protein, 26 aa, Staphylococcus
LISRFKYIFIPYLLVGLFYSYSESLL

SEQ ID NO: 1901005 - protein, 26 aa, Staphylococcus
LISSFLSWQFIFVISIALSIIAIFIL

SEQ ID NO: 1901006 - protein, 32 aa, Staphylococcus
LISVGNWRWIFWINIPFIFIGLIGCLFLKRYI

SEQ ID NO: 1901007 - protein, 30 aa, Staphylococcus
LISVIFAIIYNLWWLFYNVAQVAGLHLEQL

SEQ ID NO: 1901008 - protein, 22 aa, Staphylococcus
LISVIILLILSIFSPLYDLTEI

SEQ ID NO: 1901009 - protein, 22 aa, Staphylococcus
LISYLVNFWFIQAAGAVYLLYM

SEQ ID NO: 1901010 - protein, 18 aa, Staphylococcus
LITFSILITKILGVLFVI

SEQ ID NO: 1901011 - protein, 23 aa, Staphylococcus
LITFVLVPILIPTLKRMKFGQSI

SEQ ID NO: 1901012 - protein, 20 aa, Staphylococcus
LITIVVILIVGTSIGLLLKT

SEQ ID NO: 1901013 - protein, 24 aa, Staphylococcus
LITLFIAFIFWLWTKHTWVEYINV

SEQ ID NO: 1901014 - protein, 24 aa, Staphylococcus
LITLFIVIIIAIVLGFLLKNHYDK

SEQ ID NO: 1901015 - protein, 18 aa, Staphylococcus
LITLILLGKYFEAKAKGH

SEQ ID NO: 1901016 - protein, 22 aa, Staphylococcus
LITMFTVLLFKKNTPVAVLEGE

SEQ ID NO: 1901017 - protein, 26 aa, Staphylococcus
LITMNFIAMILWIIAAIMLFSEKKDR

SEQ ID NO: 1901018 - protein, 25 aa, Staphylococcus
LITSFLPIPVLFMLGFAVALIINYP

SEQ ID NO: 1901019 - protein, 20 aa, Staphylococcus
LITTILFFSGIIVMGSLYTA

SEQ ID NO: 1901020 - protein, 33 aa, Staphylococcus
LITTTTYLGMLVWPLLALGFFFNIIQRGNASYE

SEQ ID NO: 1901021 - protein, 17 aa, Staphylococcus
LITYVLLCLIGLVMVYS

SEQ ID NO: 1901022 - protein, 18 aa, Staphylococcus
LIVAFIFSFNRKAIDYKK

SEQ ID NO: 1901023 - protein, 22 aa, Staphylococcus
LIVFFLLIALTTVFVGSEFALV

SEQ ID NO: 1901024 - protein, 19 aa, Staphylococcus
LIVFTLIFGIIAFFHESRL

SEQ ID NO: 1901025 - protein, 20 aa, Staphylococcus
LIVGIIFLSIFDKGLPKGKQ

SEQ ID NO: 1901026 - protein, 19 aa, Staphylococcus
LIVGIVILSIFKLNLGIDF

SEQ ID NO: 1901027 - protein, 20 aa, Staphylococcus
LIVIILLIFYIYLFSIIARE

SEQ ID NO: 1901028 - protein, 32 aa, Staphylococcus
LIVILIATIAVSFTFYLFQKEDNPNKDALYEN

SEQ ID NO: 1901029 - protein, 30 aa, Staphylococcus
LIVILLLTIIISFIFFMITKKDNYDKDDLY

SEQ ID NO: 1901030 - protein, 32 aa, Staphylococcus
LIVITLINYFILYLLLIISITLFVPVSLFNSW

SEQ ID NO: 1901031 - protein, 34 aa, Staphylococcus
LIVKKFPINFFPRKIWYLFIIMTITILLTMKINL

SEQ ID NO: 1901032 - protein, 20 aa, Staphylococcus
LIVLFYLSLSETALTAANKS

SEQ ID NO: 1901033 - protein, 24 aa, Staphylococcus
LIVLIFIILIAIVNITVSFIERRK

SEQ ID NO: 1901034 - protein, 19 aa, Staphylococcus
LIVLVLFYIKEAKYNLFMQ

SEQ ID NO: 1901035 - protein, 17 aa, Staphylococcus
LIVQRFTAGFLKSIAIL

SEQ ID NO: 1901036 - protein, 25 aa, Staphylococcus
LIVTTTFCFVLIPLLTDAIKVKNHV

SEQ ID NO: 1901037 - protein, 25 aa, Staphylococcus
LIVTTTFCFVLIPLLTNAFREGRFE

SEQ ID NO: 1901038 - protein, 27 aa, Staphylococcus
LIVVALIAIIVILFQFINHDGPFGAHQ

SEQ ID NO: 1901039 - protein, 23 aa, Staphylococcus
LIVVDIIIYYPFLKVYDNEILEE

SEQ ID NO: 1901040 - protein, 19 aa, Staphylococcus
LIVVILVAPALTFGIAGLI

SEQ ID NO: 1901041 - protein, 18 aa, Staphylococcus
LIVVIVGFLLFMYIKDSR

SEQ ID NO: 1901042 - protein, 18 aa, Staphylococcus
LIVVIVGFLLFMYIQDSR

SEQ ID NO: 1901043 - protein, 21 aa, Staphylococcus
LIVVLWLVITAWKNIGYIKEV

SEQ ID NO: 1901044 - protein, 21 aa, Staphylococcus
LIWIGIILQFILIFLMAIVAP

SEQ ID NO: 1901045 - protein, 22 aa, Staphylococcus
LIYFNIILFCLCMFNLFFTTHF

SEQ ID NO: 1901046 - protein, 17 aa, Staphylococcus
LIYLFAHEWLHVSFLSM

SEQ ID NO: 1901047 - protein, 18 aa, Staphylococcus
LIYLGFKPLQAAMLCLVA

SEQ ID NO: 1901048 - protein, 28 aa, Staphylococcus
LKANRLYWAFALCLLPFALMLVGGEKAL

SEQ ID NO: 1901049 - protein, 18 aa, Staphylococcus
LKAVLGFVLSLMATLGFT

SEQ ID NO: 1901050 - protein, 22 aa, Staphylococcus
LKDGSLLKYTQMKWLTPDDHYI

SEQ ID NO: 1901051 - protein, 22 aa, Staphylococcus
LKDIPYFFNGPAPYIFAHRGGM

SEQ ID NO: 1901052 - protein, 24 aa, Staphylococcus
LKDKTLFIPFIAFILLHIGQWMYT

SEQ ID NO: 1901053 - protein, 30 aa, Staphylococcus
LKDLRTYYLSFWYFITFGSFVAFGIFLPKY

SEQ ID NO: 1901054 - protein, 23 aa, Staphylococcus
LKDVTLFLPFVAFILLHIGQWMY

SEQ ID NO: 1901055 - protein, 19 aa, Staphylococcus
LKEIYFLGLKQAKITAIIQ

SEQ ID NO: 1901056 - protein, 17 aa, Staphylococcus
LKELGTLNSLNQPQRKK

SEQ ID NO: 1901057 - protein, 20 aa, Staphylococcus
LKEMAQTYQVLYFTCTKDNF

SEQ ID NO: 1901058 - protein, 21 aa, Staphylococcus
LKFIFIGFSLFYALISFLFYI

SEQ ID NO: 1901059 - protein, 27 aa, Staphylococcus
LKFKVYPIWMFIISTLLAITVVVQNIS

SEQ ID NO: 1901060 - protein, 23 aa, Staphylococcus
LKFSIIFGVLFFILNYFSGTRSS

SEQ ID NO: 1901061 - protein, 23 aa, Staphylococcus
LKFSLFLAMLIACLLIQAATNMF

SEQ ID NO: 1901062 - protein, 19 aa, Staphylococcus
LKFSLIIGILVLISYLLFL

SEQ ID NO: 1901063 - protein, 25 aa, Staphylococcus
LKGDDSHVAPLIAKKKRESKETSTN

SEQ ID NO: 1901064 - protein, 24 aa, Staphylococcus
LKGGFILMLFAFLLALIALKELLN

SEQ ID NO: 1901065 - protein, 24 aa, Staphylococcus
LKGGGDIIFQIGSGLFGVRTADAK

SEQ ID NO: 1901066 - protein, 26 aa, Staphylococcus
LKGKKIAFIISPQWFTNHGLTNVNFD

SEQ ID NO: 1901067 - protein, 17 aa, Staphylococcus
LKHLIIMIPLAINGVIG

SEQ ID NO: 1901068 - protein, 31 aa, Staphylococcus
LKIFAIIFVGILFFLAIFIIVITFSVHREMQ

SEQ ID NO: 1901069 - protein, 25 aa, Staphylococcus
LKIHPLTIIFILLCAGNLLGIVGVI

SEQ ID NO: 1901070 - protein, 23 aa, Staphylococcus
LKIHPLTIIFILLCAGNLMNVVG

SEQ ID NO: 1901071 - protein, 24 aa, Staphylococcus
LKIHPLTIIFILLSAGNLLGIVGV

SEQ ID NO: 1901072 - protein, 25 aa, Staphylococcus
LKIHPLTIIFILLSAGNLLGVVGVI

SEQ ID NO: 1901073 - protein, 20 aa, Staphylococcus
LKKFLFYGVPLTVSFALGVL

SEQ ID NO: 1901074 - protein, 25 aa, Staphylococcus
LKKHYPYFILGFIITALMVTVFDGL

SEQ ID NO: 1901075 - protein, 25 aa, Staphylococcus
LKLDKYDYMYASLSGILCGLIDVFI

SEQ ID NO: 1901076 - protein, 23 aa, Staphylococcus
LKLILYFIIISFILFVLLEHTTG

SEQ ID NO: 1901077 - protein, 22 aa, Staphylococcus
LKLLDWGVFLVLGIFFGSYIAA

SEQ ID NO: 1901078 - protein, 34 aa, Staphylococcus
LKLRRWTLLIYGLLLIFFPFYHLIDRQHLPYLVI

SEQ ID NO: 1901079 - protein, 23 aa, Staphylococcus
LKLSLFLAMLLACLLIQAATNMF

SEQ ID NO: 1901080 - protein, 20 aa, Staphylococcus
LKMEMPLFKIIRISYIINAF

SEQ ID NO: 1901081 - protein, 25 aa, Staphylococcus
LKMNSFSIFLPWTTPGPLGIVMGTG

SEQ ID NO: 1901082 - protein, 18 aa, Staphylococcus
LKMTLKYSIGLLIFVCIW

SEQ ID NO: 1901083 - protein, 27 aa, Staphylococcus
LKNDLLRLFIMFTLASLAFVIGNYTHI

SEQ ID NO: 1901084 - protein, 21 aa, Staphylococcus
LKNFITRLWQSIKAISIRTWN

SEQ ID NO: 1901085 - protein, 32 aa, Staphylococcus
LKNGTTLTAIIGALLLFVKQITEIFGIDISHQ

SEQ ID NO: 1901086 - protein, 31 aa, Staphylococcus
LKNKATLSALIGTLFLLAKQIAEIFGVDISQ

SEQ ID NO: 1901087 - protein, 25 aa, Staphylococcus
LKNKLTQFFSGYSLALNSAMNENNF

SEQ ID NO: 1901088 - protein, 19 aa, Staphylococcus
LKNKTMKLQLLFGQADNDK

SEQ ID NO: 1901089 - protein, 31 aa, Staphylococcus
LKPYGLPMLTFPFVFMTWLILAMGMQFSKMH

SEQ ID NO: 1901090 - protein, 21 aa, Staphylococcus
LKQFPSLPSKKNFSYGTASAL

SEQ ID NO: 1901091 - protein, 17 aa, Staphylococcus
LKQFRSFIKQDLNQRLL

SEQ ID NO: 1901092 - protein, 19 aa, Staphylococcus
LKQFWLRRIKRLIPAVLVL

SEQ ID NO: 1901093 - protein, 19 aa, Staphylococcus
LKRFSIFAMGIMPYITASI

SEQ ID NO: 1901094 - protein, 31 aa, Staphylococcus
LKRQHFTKVWWLMPTTFLSAVLFIIFILLGP

SEQ ID NO: 1901095 - protein, 39 aa, Staphylococcus
LKRTKLMISAILSAPLLLVMLIHVFPVHLLETIMNPWIQ

SEQ ID NO: 1901096 - protein, 23 aa, Staphylococcus
LKSPVVIFMIPGIIPLVPGSLAY

SEQ ID NO: 1901097 - protein, 33 aa, Staphylococcus
LKSQQAFSFKLLFSLIIVGLLVVALLLAIVIPS

SEQ ID NO: 1901098 - protein, 25 aa, Staphylococcus
LKSQWMWLVIPFIVSMVVLLIMMLI

SEQ ID NO: 1901099 - protein, 18 aa, Staphylococcus
LKTDFKKNALKNAQRYMQ

SEQ ID NO: 1901100 - protein, 18 aa, Staphylococcus
LKTDLSFVQLNRFKSDYD

SEQ ID NO: 1901101 - protein, 23 aa, Staphylococcus
LKTELSFVEPMISRLELEEANNK

SEQ ID NO: 1901102 - protein, 23 aa, Staphylococcus
LKTIRLDGLLLRPAIGMLSIFAT

SEQ ID NO: 1901103 - protein, 21 aa, Staphylococcus
LKTLTAKIYRNGTEKTIQIKL

SEQ ID NO: 1901104 - protein, 28 aa, Staphylococcus
LKTSFTFVLLIVLIVWSFIYTGFNVGDL

SEQ ID NO: 1901105 - protein, 25 aa, Staphylococcus
LKVHPLTIIFVLLCAGNLLGIVGVI

SEQ ID NO: 1901106 - protein, 17 aa, Staphylococcus
LKVMFLSSPAVILFFVL

SEQ ID NO: 1901107 - protein, 20 aa, Staphylococcus
LKWCRMMIRQILSNSLKYSE

SEQ ID NO: 1901108 - protein, 33 aa, Staphylococcus
LLAAAILPLWGWRALFLIGVIPVILAFYIRRNL

SEQ ID NO: 1901109 - protein, 23 aa, Staphylococcus
LLAAALLNFIFPDAIKLFIYVTT

SEQ ID NO: 1901110 - protein, 26 aa, Staphylococcus
LLAFISLFLVIWFPTNPIVIILSAIM

SEQ ID NO: 1901111 - protein, 18 aa, Staphylococcus
LLAIFGIAITIILYARKV

SEQ ID NO: 1901112 - protein, 46 aa, Staphylococcus
LLAIPPFVMILLLVLLAFFVFKRKIGFPIFILIGLLFIYNQNMWDD

SEQ ID NO: 1901113 - protein, 23 aa, Staphylococcus
LLALILLILMLIFGGKKGLISYL

SEQ ID NO: 1901114 - protein, 17 aa, Staphylococcus
LLANGIMVPLSAYLATR

SEQ ID NO: 1901115 - protein, 20 aa, Staphylococcus
LLASLFYMYRKHIFMAAVGE

SEQ ID NO: 1901116 - protein, 19 aa, Staphylococcus
LLASLLVSITIVPALSSTF

SEQ ID NO: 1901117 - protein, 24 aa, Staphylococcus
LLASLLYRYRKHLFMAAFGEVIGT

SEQ ID NO: 1901118 - protein, 24 aa, Staphylococcus
LLAVLFTYIFSDKSALAYAFSATC

SEQ ID NO: 1901119 - protein, 22 aa, Staphylococcus
LLAYVLQVIFFGCSTMLSHVTA

SEQ ID NO: 1901120 - protein, 19 aa, Staphylococcus
LLCIKLYKHFYYRLFAILT

SEQ ID NO: 1901121 - protein, 19 aa, Staphylococcus
LLCLTIFKMKGIYAAITTL

SEQ ID NO: 1901122 - protein, 19 aa, Staphylococcus
LLCLTVFKMKGVYAAITTL

SEQ ID NO: 1901123 - protein, 17 aa, Staphylococcus
LLDFRLPRMLITILAGA

SEQ ID NO: 1901124 - protein, 22 aa, Staphylococcus
LLDLFLTFKYYQIFISPKSAVE

SEQ ID NO: 1901125 - protein, 19 aa, Staphylococcus
LLDYFVICKQPMNALFFFF

SEQ ID NO: 1901126 - protein, 24 aa, Staphylococcus
LLEKFGFPRWASITTIFIALIAIV

SEQ ID NO: 1901127 - protein, 18 aa, Staphylococcus
LLESFKFLNFYYLSKNVQ

SEQ ID NO: 1901128 - protein, 39 aa, Staphylococcus
LLETIMNPWIQLILATPVQFIIGWQFYVGAYKNLRNGSA

SEQ ID NO: 1901129 - protein, 26 aa, Staphylococcus
LLFGAPSIFNFSLALLVGLISGVFSS

SEQ ID NO: 1901130 - protein, 18 aa, Staphylococcus
LLFGAPTIFNFSLALLIG

SEQ ID NO: 1901131 - protein, 17 aa, Staphylococcus
LLFILMRKNLLKRYVLS

SEQ ID NO: 1901132 - protein, 17 aa, Staphylococcus
LLFIYGLTSYIGGILFC

SEQ ID NO: 1901133 - protein, 19 aa, Staphylococcus
LLFLSIFCLLISLTSWSYH

SEQ ID NO: 1901134 - protein, 25 aa, Staphylococcus
LLFLVAVVFLFYYRKIKLYSIMVVL

SEQ ID NO: 1901135 - protein, 23 aa, Staphylococcus
LLFNAALAIIAFLAVLLLVPKHQ

SEQ ID NO: 1901136 - protein, 20 aa, Staphylococcus
LLFNIIMSCLLIYVAFSIVL

SEQ ID NO: 1901137 - protein, 28 aa, Staphylococcus
LLFSKIFIFYCILVIFFVFVNCNQVIDK

SEQ ID NO: 1901138 - protein, 18 aa, Staphylococcus
LLGLILSIGLGITFIYTI

SEQ ID NO: 1901139 - protein, 24 aa, Staphylococcus
LLGNWIVAILWIIAGIMLLVKKPK

SEQ ID NO: 1901140 - protein, 31 aa, Staphylococcus
LLGSLLAIGLILIAIILFLAIPEEVSLFTSE

SEQ ID NO: 1901141 - protein, 19 aa, Staphylococcus
LLHDVFIIVAVFSLLRLEV

SEQ ID NO: 1901142 - protein, 17 aa, Staphylococcus
LLHKANTIAQTTWKEHP

SEQ ID NO: 1901143 - protein, 23 aa, Staphylococcus
LLIALLILICLSLFMSNINIMAH

SEQ ID NO: 1901144 - protein, 20 aa, Staphylococcus
LLIASLCKLILYLIIITFDN

SEQ ID NO: 1901145 - protein, 19 aa, Staphylococcus
LLIDAFSWRMPFYVVATIA

SEQ ID NO: 1901146 - protein, 18 aa, Staphylococcus
LLIFFASTIITPFSEADT

SEQ ID NO: 1901147 - protein, 26 aa, Staphylococcus
LLIFFIAFGLLSLTSYAAEVPDTAST

SEQ ID NO: 1901148 - protein, 18 aa, Staphylococcus
LLIFIRKVAYFKYLTEFY

SEQ ID NO: 1901149 - protein, 18 aa, Staphylococcus
LLIFIYFVCITSRKGIPI

SEQ ID NO: 1901150 - protein, 18 aa, Staphylococcus
LLIGFVFNAFLEGAAGFG

SEQ ID NO: 1901151 - protein, 28 aa, Staphylococcus
LLIGITIIAAIFYLFVGLDPDIFDYQLQ

SEQ ID NO: 1901152 - protein, 20 aa, Staphylococcus
LLIIFTLVFGIIAFFHESRL

SEQ ID NO: 1901153 - protein, 28 aa, Staphylococcus
LLIIGMVLITLFIRPLRHYAGYISLFAP

SEQ ID NO: 1901154 - protein, 18 aa, Staphylococcus
LLIIGYYGYKQATGDLSE

SEQ ID NO: 1901155 - protein, 21 aa, Staphylococcus
LLIIIFLILYPSLIMLAQRPF

SEQ ID NO: 1901156 - protein, 18 aa, Staphylococcus
LLIIIGLLIAYIIGVIIE

SEQ ID NO: 1901157 - protein, 19 aa, Staphylococcus
LLIIISLQKRLKLLHIFIL

SEQ ID NO: 1901158 - protein, 25 aa, Staphylococcus
LLIILIVIAFILRPYLDVLLLGKDQ

SEQ ID NO: 1901159 - protein, 25 aa, Staphylococcus
LLIITPVPWLLLIGRALQGLSGAFI

SEQ ID NO: 1901160 - protein, 18 aa, Staphylococcus
LLIIVPACLITVTILLFN

SEQ ID NO: 1901161 - protein, 18 aa, Staphylococcus
LLIIYTGFGIFKESIFTL

SEQ ID NO: 1901162 - protein, 21 aa, Staphylococcus
LLIPLMNYICTYFYLLFGEIL

SEQ ID NO: 1901163 - protein, 18 aa, Staphylococcus
LLIPLVFTIAKRANVSKL

SEQ ID NO: 1901164 - protein, 19 aa, Staphylococcus
LLIPLVFTLAKRTKVSPLK

SEQ ID NO: 1901165 - protein, 18 aa, Staphylococcus
LLIPLVFTVAKRANVSTL

SEQ ID NO: 1901166 - protein, 24 aa, Staphylococcus
LLITFILVPILIPTLKRMKFGQSI

SEQ ID NO: 1901167 - protein, 28 aa, Staphylococcus
LLITIIILTIIPHLFRLTDTYLSAAYEF

SEQ ID NO: 1901168 - protein, 23 aa, Staphylococcus
LLITLMGYYFKTNKTRFWIILIT

SEQ ID NO: 1901169 - protein, 24 aa, Staphylococcus
LLIVALFYVFFIPQSFLAFGPYIN

SEQ ID NO: 1901170 - protein, 18 aa, Staphylococcus
LLIVITLSGLLTLLCSTI

SEQ ID NO: 1901171 - protein, 21 aa, Staphylococcus
LLIVTFFIYHFIHGRKRVCQK

SEQ ID NO: 1901172 - protein, 18 aa, Staphylococcus
LLIVYALTSYIFGILLCF

SEQ ID NO: 1901173 - protein, 19 aa, Staphylococcus
LLKCVLTLIFIVFSGITVP

SEQ ID NO: 1901174 - protein, 19 aa, Staphylococcus
LLLAILFWMINDHSAYNLI

SEQ ID NO: 1901175 - protein, 21 aa, Staphylococcus
LLLFILMILLGGKKGLISYLT

SEQ ID NO: 1901176 - protein, 21 aa, Staphylococcus
LLLFSIFINFPLFTLGIYFSK

SEQ ID NO: 1901177 - protein, 28 aa, Staphylococcus
LLLGILFTYIMLLGIFLFGFITSLTAVQ

SEQ ID NO: 1901178 - protein, 18 aa, Staphylococcus
LLLILYPIIIKFTRKMQN

SEQ ID NO: 1901179 - protein, 26 aa, Staphylococcus
LLLISTITIISFIGLGAIIHNTIYQT

SEQ ID NO: 1901180 - protein, 21 aa, Staphylococcus
LLLISVWLFDLKRKGLTRSGK

SEQ ID NO: 1901181 - protein, 25 aa, Staphylococcus
LLLITLFYVFFIPQSFLAFGTYINV

SEQ ID NO: 1901182 - protein, 29 aa, Staphylococcus
LLLLCTITIISFIGLGAILHHTIYQILSD

SEQ ID NO: 1901183 - protein, 17 aa, Staphylococcus
LLLLGRIVQGFSAAIIM

SEQ ID NO: 1901184 - protein, 19 aa, Staphylococcus
LLLLNPLYAFVFSKTELYF

SEQ ID NO: 1901185 - protein, 29 aa, Staphylococcus
LLLLSTITIISFIGLGVIIHHTIYQILST

SEQ ID NO: 1901186 - protein, 17 aa, Staphylococcus
LLLLVLMIIFGGKKGLI

SEQ ID NO: 1901187 - protein, 23 aa, Staphylococcus
LLLMIPLLFLISIVIFGISKLQP

SEQ ID NO: 1901188 - protein, 29 aa, Staphylococcus
LLLPKILKFFYSINVYYLSSILFGFALIA

SEQ ID NO: 1901189 - protein, 31 aa, Staphylococcus
LLLSLTFLPNLFYIISSIIGYLLFGIGLGMY

SEQ ID NO: 1901190 - protein, 18 aa, Staphylococcus
LLLTLYAGYQILDDLQFN

SEQ ID NO: 1901191 - protein, 25 aa, Staphylococcus
LLLVALFYVFFIPQSFLAFGPYILI

SEQ ID NO: 1901192 - protein, 26 aa, Staphylococcus
LLLVIQLVFAFILLKTKFGITVIGGI

SEQ ID NO: 1901193 - protein, 26 aa, Staphylococcus
LLLVTPQLFFVVPLLSFLGGMIPFLL

SEQ ID NO: 1901194 - protein, 19 aa, Staphylococcus
LLMILIQPLSNFTLQFIMI

SEQ ID NO: 1901195 - protein, 18 aa, Staphylococcus
LLMIVLKLLGIHTSVSIT

SEQ ID NO: 1901196 - protein, 19 aa, Staphylococcus
LLMLVRLLHGIAFGLASTA

SEQ ID NO: 1901197 - protein, 18 aa, Staphylococcus
LLMSILICVTFSLLMVTP

SEQ ID NO: 1901198 - protein, 24 aa, Staphylococcus
LLNASWVAFVLWLIASIMLFARKP

SEQ ID NO: 1901199 - protein, 20 aa, Staphylococcus
LLNIAKLEDVLKTRYTFILS

SEQ ID NO: 1901200 - protein, 18 aa, Staphylococcus
LLNILFMFVIALGVIDNH

SEQ ID NO: 1901201 - protein, 25 aa, Staphylococcus
LLNLLPLLIFVVVTAAGLYFFSDIM

SEQ ID NO: 1901202 - protein, 30 aa, Staphylococcus
LLNVVSWQLFIFCIVMIVLVRPISVLFSTF

SEQ ID NO: 1901203 - protein, 24 aa, Staphylococcus
LLPFIFALIIPIVYRFIKRIHIGW

SEQ ID NO: 1901204 - protein, 17 aa, Staphylococcus
LLPIALVGIFAFSGLEM

SEQ ID NO: 1901205 - protein, 18 aa, Staphylococcus
LLPIIPLLGLSVGSLIGG

SEQ ID NO: 1901206 - protein, 49 aa, Staphylococcus
LLPLIFALIIPFVYRFYKRIHLGWFVLPIPVVLFIYFLSYISTTMSGNT

SEQ ID NO: 1901207 - protein, 31 aa, Staphylococcus
LLPLIFALIIPILYRFFKKIHLGWFVLPVPV

SEQ ID NO: 1901208 - protein, 29 aa, Staphylococcus
LLPLIFALIIPILYRFFKRIHIGWFVLPV

SEQ ID NO: 1901209 - protein, 24 aa, Staphylococcus
LLPLIFALIIPILYRFVKRIHLGW

SEQ ID NO: 1901210 - protein, 20 aa, Staphylococcus
LLPLIIFIVIVIHILSSLHT

SEQ ID NO: 1901211 - protein, 20 aa, Staphylococcus
LLRFQMIGLIIFSVILVLSH

SEQ ID NO: 1901212 - protein, 18 aa, Staphylococcus
LLRILTIIQIIGVAVVSM

SEQ ID NO: 1901213 - protein, 19 aa, Staphylococcus
LLRWTLFYQKNCILAMIPM

SEQ ID NO: 1901214 - protein, 21 aa, Staphylococcus
LLSAYLIFAVYFGTSKLSKKA

SEQ ID NO: 1901215 - protein, 41 aa, Staphylococcus
LLSDKVAGYLFYFAVIVGVISFIVWMLIQNDVDFALERLVT

SEQ ID NO: 1901216 - protein, 41 aa, Staphylococcus
LLSDKVAGYLFYFTVSAGLIAFIVWVLITHNIDFALERLVT

SEQ ID NO: 1901217 - protein, 26 aa, Staphylococcus
LLSGIFIPIILIATLIIFFGKTNKLK

SEQ ID NO: 1901218 - protein, 20 aa, Staphylococcus
LLSILKFIFATALFIFVIFT

SEQ ID NO: 1901219 - protein, 18 aa, Staphylococcus
LLSILKFVFAAALFIFVV

SEQ ID NO: 1901220 - protein, 23 aa, Staphylococcus
LLSIVFILFIFVFATKAGAFPMY

SEQ ID NO: 1901221 - protein, 24 aa, Staphylococcus
LLSIVFILMFFINPQIIYDIGFQF

SEQ ID NO: 1901222 - protein, 25 aa, Staphylococcus
LLSIYRPFMVTLLLSIFLGIITDIY

SEQ ID NO: 1901223 - protein, 29 aa, Staphylococcus
LLSLGSWRWIFWMNIPFIVVGLVGCLILK

SEQ ID NO: 1901224 - protein, 22 aa, Staphylococcus
LLSSLFYMYRKHIFMASVGEVL

SEQ ID NO: 1901225 - protein, 23 aa, Staphylococcus
LLSTLLIIILASDIFLLFPESSP

SEQ ID NO: 1901226 - protein, 20 aa, Staphylococcus
LLSVIIGFIVWFVSAFLIFE

SEQ ID NO: 1901227 - protein, 18 aa, Staphylococcus
LLTAMVSFLLLKWAGILP

SEQ ID NO: 1901228 - protein, 19 aa, Staphylococcus
LLTDLLFTGLNRTGGFDYQ

SEQ ID NO: 1901229 - protein, 22 aa, Staphylococcus
LLTITFLYFVGILNVYLLIILV

SEQ ID NO: 1901230 - protein, 18 aa, Staphylococcus
LLTIYIIDLLCVMFATQP

SEQ ID NO: 1901231 - protein, 17 aa, Staphylococcus
LLTLRKHLRIGETFFSY

SEQ ID NO: 1901232 - protein, 26 aa, Staphylococcus
LLTLSIIIFIFLNKLDISKKLTFISY

SEQ ID NO: 1901233 - protein, 24 aa, Staphylococcus
LLTSLLFNILITVIIFMIGLFIKS

SEQ ID NO: 1901234 - protein, 18 aa, Staphylococcus
LLTYLLMRFGCSLCLLTY

SEQ ID NO: 1901235 - protein, 19 aa, Staphylococcus
LLVAALLNFIFPDAIKLFI

SEQ ID NO: 1901236 - protein, 18 aa, Staphylococcus
LLVAALLNFIFPDAIQLF

SEQ ID NO: 1901237 - protein, 25 aa, Staphylococcus
LLVAIPVFIFGLYHYIFTSTYVNWM

SEQ ID NO: 1901238 - protein, 24 aa, Staphylococcus
LLVAPFFSLVILFSLGIDYAIFLL

SEQ ID NO: 1901239 - protein, 21 aa, Staphylococcus
LLVIFSYFAYSSIIFIACFHI

SEQ ID NO: 1901240 - protein, 20 aa, Staphylococcus
LLVIGIIILGLIVNVVVTIV

SEQ ID NO: 1901241 - protein, 24 aa, Staphylococcus
LLVIGLLFFIVFRAFILATKTSSY

SEQ ID NO: 1901242 - protein, 18 aa, Staphylococcus
LLVIGWYGYKKATGNVSE

SEQ ID NO: 1901243 - protein, 19 aa, Staphylococcus
LLVIIALLQFKLYKHYYFR

SEQ ID NO: 1901244 - protein, 20 aa, Staphylococcus
LLVIIICSLALILFILLFIE

SEQ ID NO: 1901245 - protein, 17 aa, Staphylococcus
LLVILGSFIFSAGVNAF

SEQ ID NO: 1901246 - protein, 18 aa, Staphylococcus
LLVILGSFIFSAGVNAFV

SEQ ID NO: 1901247 - protein, 19 aa, Staphylococcus
LLVKFLLPDLLNNGKLYTI

SEQ ID NO: 1901248 - protein, 19 aa, Staphylococcus
LLVLPITVLVSGVFVYLTI

SEQ ID NO: 1901249 - protein, 17 aa, Staphylococcus
LLVLVYRTYRVTKEANI

SEQ ID NO: 1901250 - protein, 17 aa, Staphylococcus
LLVLVYRTYRVTKEDEI

SEQ ID NO: 1901251 - protein, 18 aa, Staphylococcus
LLVLVYRTYRVTKEVEIN

SEQ ID NO: 1901252 - protein, 33 aa, Staphylococcus
LLVNQQLSILGFILFVFIAVRIYDPLTNSLYKI

SEQ ID NO: 1901253 - protein, 20 aa, Staphylococcus
LLVPLVTGLVLFFFKERLMV

SEQ ID NO: 1901254 - protein, 25 aa, Staphylococcus
LLVPYICFFCFFSVYYYLTGKSSNL

SEQ ID NO: 1901255 - protein, 18 aa, Staphylococcus
LLVTYVILCLIGLVMVYS

SEQ ID NO: 1901256 - protein, 25 aa, Staphylococcus
LLYKGKKLTFRLLLIDTPETKDPRK

SEQ ID NO: 1901257 - protein, 19 aa, Staphylococcus
LLYLFMSSFIIFLLVEKTS

SEQ ID NO: 1901258 - protein, 20 aa, Staphylococcus
LLYLLFCWTGIPGVIGMVEG

SEQ ID NO: 1901259 - protein, 17 aa, Staphylococcus
LLYRLNILLNHGFTLIE

SEQ ID NO: 1901260 - protein, 18 aa, Staphylococcus
LLYVIILTTMLSFLILVP

SEQ ID NO: 1901261 - protein, 24 aa, Staphylococcus
LMAYVVVIFVFYFLHIHTFGERFK

SEQ ID NO: 1901262 - protein, 20 aa, Staphylococcus
LMCIPMAWILGFHNFVVKPL

SEQ ID NO: 1901263 - protein, 18 aa, Staphylococcus
LMDGLYLHMLSWGKEKGY

SEQ ID NO: 1901264 - protein, 18 aa, Staphylococcus
LMDGLYLNMLLWSQKQNY

SEQ ID NO: 1901265 - protein, 20 aa, Staphylococcus
LMEKLDKQLTPTEKIEAAVT

SEQ ID NO: 1901266 - protein, 27 aa, Staphylococcus
LMEVTNNVIDVYFVPSDNVKPVISFGN

SEQ ID NO: 1901267 - protein, 37 aa, Staphylococcus
LMFEQIVSIIWVYMILLYLAFLLMTANFLDYTYLKYS

SEQ ID NO: 1901268 - protein, 21 aa, Staphylococcus
LMFMVDYVLFHLIQHSYFKYQ

SEQ ID NO: 1901269 - protein, 21 aa, Staphylococcus
LMFRRLLFLFVVGIFGMILSL

SEQ ID NO: 1901270 - protein, 27 aa, Staphylococcus
LMGSYASSYVDLIDRVPPEKPVANNIT

SEQ ID NO: 1901271 - protein, 28 aa, Staphylococcus
LMHSSNVYMFKTALRLAGDPYSSGMSLP

SEQ ID NO: 1901272 - protein, 19 aa, Staphylococcus
LMIDKYGEIVVANKSFYNV

SEQ ID NO: 1901273 - protein, 17 aa, Staphylococcus
LMIDKYGKIVVANTAYY

SEQ ID NO: 1901274 - protein, 18 aa, Staphylococcus
LMIIAGFGLIFFGLGNGG

SEQ ID NO: 1901275 - protein, 18 aa, Staphylococcus
LMILFFFIWKAEGNLFII

SEQ ID NO: 1901276 - protein, 22 aa, Staphylococcus
LMILLTVILYYGSKRLQDKYKN

SEQ ID NO: 1901277 - protein, 18 aa, Staphylococcus
LMILRCTIIIFSIFTLLF

SEQ ID NO: 1901278 - protein, 18 aa, Staphylococcus
LMITTILLTSVPLTIKMI

SEQ ID NO: 1901279 - protein, 19 aa, Staphylococcus
LMIVLFLALGIFSQWLADR

SEQ ID NO: 1901280 - protein, 19 aa, Staphylococcus
LMIVVFLALGIFSQWLANK

SEQ ID NO: 1901281 - protein, 18 aa, Staphylococcus
LMIYLTLIQVVGVILIVI

SEQ ID NO: 1901282 - protein, 25 aa, Staphylococcus
LMKMAMRFSIGLLIFACIWTFMLSL

SEQ ID NO: 1901283 - protein, 22 aa, Staphylococcus
LMKSAYNWAFLKPVRKIYYNIT

SEQ ID NO: 1901284 - protein, 18 aa, Staphylococcus
LMLFAYLLALIALKELLN

SEQ ID NO: 1901285 - protein, 20 aa, Staphylococcus
LMLIMPFVGLLLKWQWYTYK

SEQ ID NO: 1901286 - protein, 20 aa, Staphylococcus
LMLLIEWLVQWLPASLRFGV

SEQ ID NO: 1901287 - protein, 19 aa, Staphylococcus
LMMFILIIFTIELIVEFTG

SEQ ID NO: 1901288 - protein, 18 aa, Staphylococcus
LMNLALGVVYFVIWLGLG

SEQ ID NO: 1901289 - protein, 29 aa, Staphylococcus
LMNPLMIFMLWALLGWKVAVVYFILLAIF

SEQ ID NO: 1901290 - protein, 29 aa, Staphylococcus
LMNPLMIFMLWALLGWKVAVVYFIVLAIF

SEQ ID NO: 1901291 - protein, 29 aa, Staphylococcus
LMNPLMIFMLWILLGWKVAVVYFVVLAIF

SEQ ID NO: 1901292 - protein, 28 aa, Staphylococcus
LMNPLMLFMLWALLGWKVAVVYFVVLAI

SEQ ID NO: 1901293 - protein, 29 aa, Staphylococcus
LMNPLMVFMLWVLLGWKVAIVYFIVLAIF

SEQ ID NO: 1901294 - protein, 24 aa, Staphylococcus
LMNYVVLYLLLSISISLFVPVSLF

SEQ ID NO: 1901295 - protein, 29 aa, Staphylococcus
LMPMQIMISIFIILSPFNILINRRIRKNC

SEQ ID NO: 1901296 - protein, 23 aa, Staphylococcus
LMPMTLFSMIAFYISLFSVMNPD

SEQ ID NO: 1901297 - protein, 18 aa, Staphylococcus
LMPPIQFVFILLTFSVCD

SEQ ID NO: 1901298 - protein, 25 aa, Staphylococcus
LMPSIQLVFILLVFSICDQILQESG

SEQ ID NO: 1901299 - protein, 20 aa, Staphylococcus
LMPVVLFSSLFILVAYVPNV

SEQ ID NO: 1901300 - protein, 18 aa, Staphylococcus
LMQFGKINRLWLVLLFAG

SEQ ID NO: 1901301 - protein, 28 aa, Staphylococcus
LMQFGKINRLWLVLLFAGGGASLLILSL

SEQ ID NO: 1901302 - protein, 29 aa, Staphylococcus
LMRITEFVMLFPFIPFAIVLNATFSEKIK

SEQ ID NO: 1901303 - protein, 17 aa, Staphylococcus
LMRKILPGRFYIVTLYY

SEQ ID NO: 1901304 - protein, 19 aa, Staphylococcus
LMRQSLPISTLYTGVGVLR

SEQ ID NO: 1901305 - protein, 26 aa, Staphylococcus
LMSASEFWILCLFSIIATLGELIYSP

SEQ ID NO: 1901306 - protein, 26 aa, Staphylococcus
LMSLIGAKYLFLFALVLEILSYFFII

SEQ ID NO: 1901307 - protein, 19 aa, Staphylococcus
LMSPLILGLIAVFVISLIV

SEQ ID NO: 1901308 - protein, 29 aa, Staphylococcus
LMSTFVGWRWIFIISIIVALLAMYLMRHT

SEQ ID NO: 1901309 - protein, 18 aa, Staphylococcus
LMTLFISLLQIFNDFNLF

SEQ ID NO: 1901310 - protein, 22 aa, Staphylococcus
LMTLPYVQIITKSIGRLINGFT

SEQ ID NO: 1901311 - protein, 18 aa, Staphylococcus
LMTMVVFSLILFEGIFKL

SEQ ID NO: 1901312 - protein, 29 aa, Staphylococcus
LMYMFISLFIIITITFFLMKLMPGSPFND

SEQ ID NO: 1901313 - protein, 18 aa, Staphylococcus
LNAILIVIGYKFLSKRSM

SEQ ID NO: 1901314 - protein, 18 aa, Staphylococcus
LNAISTVGALLMALGFMF

SEQ ID NO: 1901315 - protein, 28 aa, Staphylococcus
LNDAWAFLYPMIPYLFIGVFIGAFIYGF

SEQ ID NO: 1901316 - protein, 28 aa, Staphylococcus
LNDAWAFLYPMLPYLIIGVFIGAFIYGF

SEQ ID NO: 1901317 - protein, 18 aa, Staphylococcus
LNDINSLSTSNSVSVSTL

SEQ ID NO: 1901318 - protein, 27 aa, Staphylococcus
LNDLNNIVINVIQKPTARKAINTKADE

SEQ ID NO: 1901319 - protein, 19 aa, Staphylococcus
LNDYQSASASISTSYSIYE

SEQ ID NO: 1901320 - protein, 36 aa, Staphylococcus
LNEDLFKAFPLLKFEHYLKYIIFNVPKDVFSAKQYL

SEQ ID NO: 1901321 - protein, 25 aa, Staphylococcus
LNEGIARILSVEIVGWNSNNPTQST

SEQ ID NO: 1901322 - protein, 24 aa, Staphylococcus
LNELILLIYLFSIACYFFDFIKRF

SEQ ID NO: 1901323 - protein, 44 aa, Staphylococcus
LNELQKDTNYFKFQYFNPLKSRDYYKNLDKQVLALITGDIGSMP

SEQ ID NO: 1901324 - protein, 27 aa, Staphylococcus
LNERLNKPFFWLFVIGFNVCFMPQFIL

SEQ ID NO: 1901325 - protein, 19 aa, Staphylococcus
LNFIFIGFFGILSGILILV

SEQ ID NO: 1901326 - protein, 19 aa, Staphylococcus
LNFLLTLVVMVLFSLVLFQ

SEQ ID NO: 1901327 - protein, 28 aa, Staphylococcus
LNFLPHILYYIIALIGFSFIGLGLGFFA

SEQ ID NO: 1901328 - protein, 17 aa, Staphylococcus
LNFVFVFSILKLFGYSK

SEQ ID NO: 1901329 - protein, 18 aa, Staphylococcus
LNFVVLLPSLYATTLISK

SEQ ID NO: 1901330 - protein, 27 aa, Staphylococcus
LNGSDWQFIMTWLPAPAKVTILGFITL

SEQ ID NO: 1901331 - protein, 31 aa, Staphylococcus
LNHFIPIIITMILCYFGFQFGLKKRDEMLMF

SEQ ID NO: 1901332 - protein, 24 aa, Staphylococcus
LNICSDIFVWFKLVLNDTSEYHHI

SEQ ID NO: 1901333 - protein, 24 aa, Staphylococcus
LNIKWPFWISQIGLILLGVQIGST

SEQ ID NO: 1901334 - protein, 31 aa, Staphylococcus
LNISKNGKKFLFFDDYQFNVPQHSVSLLASN

SEQ ID NO: 1901335 - protein, 20 aa, Staphylococcus
LNKDKGILSGSPTVAEIRAA

SEQ ID NO: 1901336 - protein, 17 aa, Staphylococcus
LNKFGFWIFLTAEFSLF

SEQ ID NO: 1901337 - protein, 23 aa, Staphylococcus
LNKISLHIYQGEALALIGEPGSS

SEQ ID NO: 1901338 - protein, 22 aa, Staphylococcus
LNKISLHLYQGESLAIIGEPGS

SEQ ID NO: 1901339 - protein, 23 aa, Staphylococcus
LNKLGFIPWLSKLIAHSLGGFSW

SEQ ID NO: 1901340 - protein, 17 aa, Staphylococcus
LNKWAFFACTMIGLLVL

SEQ ID NO: 1901341 - protein, 17 aa, Staphylococcus
LNLAEEAYLAGLPQVPN

SEQ ID NO: 1901342 - protein, 17 aa, Staphylococcus
LNLAGIPPFSGFYGKML

SEQ ID NO: 1901343 - protein, 26 aa, Staphylococcus
LNLIEWLYFTFLLLSVFFAIYCMALI

SEQ ID NO: 1901344 - protein, 19 aa, Staphylococcus
LNLLLGIPLIVGAIITVCD

SEQ ID NO: 1901345 - protein, 26 aa, Staphylococcus
LNLMEWIFFTYLLLGVFFALYCMTLI

SEQ ID NO: 1901346 - protein, 25 aa, Staphylococcus
LNLSLASVSFLGSLFFINKSSKADQ

SEQ ID NO: 1901347 - protein, 25 aa, Staphylococcus
LNLVFVFIAFFVVPFVMGYLINTLY

SEQ ID NO: 1901348 - protein, 28 aa, Staphylococcus
LNLVLVYAILMLMFFIVFNYATQVAMEI

SEQ ID NO: 1901349 - protein, 25 aa, Staphylococcus
LNMNKYLLILLLALSAAIMNMVPWG

SEQ ID NO: 1901350 - protein, 25 aa, Staphylococcus
LNMNSFSIFLPWTTPGPLGIVMGTG

SEQ ID NO: 1901351 - protein, 19 aa, Staphylococcus
LNMPHYPSLMIPRLVAIIG

SEQ ID NO: 1901352 - protein, 23 aa, Staphylococcus
LNNKWVWAIAFANIFVYFVRYGV

SEQ ID NO: 1901353 - protein, 21 aa, Staphylococcus
LNNVSLYLYQGESLGIIGEPG

SEQ ID NO: 1901354 - protein, 21 aa, Staphylococcus
LNPNYFLVSAFIICAVTSVAT

SEQ ID NO: 1901355 - protein, 27 aa, Staphylococcus
LNQLFKTPLFLPITFILIVIVGPIVEE

SEQ ID NO: 1901356 - protein, 23 aa, Staphylococcus
LNQRVIDYYGTLVPLTELDDSLL

SEQ ID NO: 1901357 - protein, 24 aa, Staphylococcus
LNQTMLWIGLVPLIGLVITFVLKW

SEQ ID NO: 1901358 - protein, 25 aa, Staphylococcus
LNSFNQPIIWLCGGLDRGNGFDELI

SEQ ID NO: 1901359 - protein, 25 aa, Staphylococcus
LNTKLIHYFVMLLLALVTVASIQTV

SEQ ID NO: 1901360 - protein, 25 aa, Staphylococcus
LNTSLLHYFVMLLLALVTVASIQTV

SEQ ID NO: 1901361 - protein, 25 aa, Staphylococcus
LNTTFIHYFVMLLLSLVTVASIQTV

SEQ ID NO: 1901362 - protein, 25 aa, Staphylococcus
LNTTLIHYFVMLLLALVTVASIQTV

SEQ ID NO: 1901363 - protein, 25 aa, Staphylococcus
LNTTMIHYFIMLLLALVTVASIQTV

SEQ ID NO: 1901364 - protein, 24 aa, Staphylococcus
LNTTQFVIWLQNGIWAIIVYFIIC

SEQ ID NO: 1901365 - protein, 24 aa, Staphylococcus
LNTTQFVIWLQNGVWAVIVYFIVC

SEQ ID NO: 1901366 - protein, 23 aa, Staphylococcus
LNVFKYPMFVLGAAMVFITILCI

SEQ ID NO: 1901367 - protein, 22 aa, Staphylococcus
LNVQWITFIVLLLTSIMTAIAV

SEQ ID NO: 1901368 - protein, 17 aa, Staphylococcus
LNWAFLLELSFKHLLMS

SEQ ID NO: 1901369 - protein, 25 aa, Staphylococcus
LNYHWGLLMVAFIVIFYTFFGGYLA

SEQ ID NO: 1901370 - protein, 39 aa, Staphylococcus
LNYKNKLSRQFKISSAILVITSSLIGSNIVLSPSLDAEE

SEQ ID NO: 1901371 - protein, 35 aa, Staphylococcus
LNYLEYIYKNFSFSLLFLIIIFVFQKEFSSLLNRI

SEQ ID NO: 1901372 - protein, 25 aa, Staphylococcus
LNYSKTMIHIILPQAFKNILPALGN

SEQ ID NO: 1901373 - protein, 24 aa, Staphylococcus
LNYYIVYLLLLKLLGVNYLVSHIT

SEQ ID NO: 1901374 - protein, 23 aa, Staphylococcus
LPAAIGFLFGGLFIRGLDFVIPH

SEQ ID NO: 1901375 - protein, 37 aa, Staphylococcus
LPATGEAIKKNWIPIAAVIAITGGALVWFSRRKHHQS

SEQ ID NO: 1901376 - protein, 39 aa, Staphylococcus
LPDLLPSILTLVGSLIMLFIMDWQMTLLTFITIPIFIAI

SEQ ID NO: 1901377 - protein, 23 aa, Staphylococcus
LPFAIVIDHTLWWKSPTADATVT

SEQ ID NO: 1901378 - protein, 18 aa, Staphylococcus
LPFIILLVIIFHIYASIT

SEQ ID NO: 1901379 - protein, 28 aa, Staphylococcus
LPFILLLIIIIVFIVLLIINHSELLDND

SEQ ID NO: 1901380 - protein, 23 aa, Staphylococcus
LPFLIIVEFLFIYIPILYHGLYG

SEQ ID NO: 1901381 - protein, 27 aa, Staphylococcus
LPFRRIISFFLVFTMLFSAGVVPLYIL

SEQ ID NO: 1901382 - protein, 27 aa, Staphylococcus
LPFSSLIVVLFLISAFLFLATTFDSGS

SEQ ID NO: 1901383 - protein, 24 aa, Staphylococcus
LPFTKWILWILPPINNLLSYLTED

SEQ ID NO: 1901384 - protein, 26 aa, Staphylococcus
LPGMIPWFMILFSHIRFRKLHPEETK

SEQ ID NO: 1901385 - protein, 26 aa, Staphylococcus
LPGMIPWFMILFSHLRFRKLHPEEVK

SEQ ID NO: 1901386 - protein, 25 aa, Staphylococcus
LPGMIPWFMILISHIRFRKLHPEKV

SEQ ID NO: 1901387 - protein, 26 aa, Staphylococcus
LPGMIPWFMILISHLRFRKLHPEQLE

SEQ ID NO: 1901388 - protein, 19 aa, Staphylococcus
LPIDFRKLMIIGALISLIT

SEQ ID NO: 1901389 - protein, 20 aa, Staphylococcus
LPIFIMIFLGYILQKKFTLD

SEQ ID NO: 1901390 - protein, 31 aa, Staphylococcus
LPIFISGAIFIIFVLLPSSWFTGLVNKKTLA

SEQ ID NO: 1901391 - protein, 20 aa, Staphylococcus
LPIGMIILDENENIEWMNRF

SEQ ID NO: 1901392 - protein, 34 aa, Staphylococcus
LPIIGNIFKNTFIGIFNIFKAFAPNSTTIFQSLE

SEQ ID NO: 1901393 - protein, 22 aa, Staphylococcus
LPIIISVQYVIDILFSILLTHK

SEQ ID NO: 1901394 - protein, 17 aa, Staphylococcus
LPIILYSISGILFGIPF

SEQ ID NO: 1901395 - protein, 26 aa, Staphylococcus
LPIISFIIFLFIWQCVIWIGNYQPIL

SEQ ID NO: 1901396 - protein, 19 aa, Staphylococcus
LPILIFIVIIIHILSSLHT

SEQ ID NO: 1901397 - protein, 21 aa, Staphylococcus
LPILIQMPILFGLYVSLKWPS

SEQ ID NO: 1901398 - protein, 17 aa, Staphylococcus
LPILLLTGIFVLLSIHL

SEQ ID NO: 1901399 - protein, 27 aa, Staphylococcus
LPILLLVLMWFFLIRPQQKRAKEHREM

SEQ ID NO: 1901400 - protein, 18 aa, Staphylococcus
LPIMVTVLMLIFPIEKRG

SEQ ID NO: 1901401 - protein, 19 aa, Staphylococcus
LPITGIPLPFISYGGSALW

SEQ ID NO: 1901402 - protein, 17 aa, Staphylococcus
LPIVLPPTVLGFILLII

SEQ ID NO: 1901403 - protein, 19 aa, Staphylococcus
LPIYALFVGVFFKTYQSLI

SEQ ID NO: 1901404 - protein, 28 aa, Staphylococcus
LPKQQLPYFISFLSFYQFSIYQILSPKR

SEQ ID NO: 1901405 - protein, 24 aa, Staphylococcus
LPKYLTYFVLFMFAIFTIPDFFEN

SEQ ID NO: 1901406 - protein, 20 aa, Staphylococcus
LPLIIALLHALFAAIAFMKL

SEQ ID NO: 1901407 - protein, 18 aa, Staphylococcus
LPLLLPAVCALGLVFIRT

SEQ ID NO: 1901408 - protein, 17 aa, Staphylococcus
LPLVLIMTFALLISSYT

SEQ ID NO: 1901409 - protein, 19 aa, Staphylococcus
LPLVLIMTFSLLLSSYTCG

SEQ ID NO: 1901410 - protein, 27 aa, Staphylococcus
LPMGSLIIVLFLISAFLFLATTFDSGS

SEQ ID NO: 1901411 - protein, 19 aa, Staphylococcus
LPMLAIAAIGFALASLEYK

SEQ ID NO: 1901412 - protein, 21 aa, Staphylococcus
LPMLIQIPILFGLYATLKWPT

SEQ ID NO: 1901413 - protein, 17 aa, Staphylococcus
LPMLIQMPIIMGLYFVL

SEQ ID NO: 1901414 - protein, 23 aa, Staphylococcus
LPMSIPNLYILPPLAFGMAMLTT

SEQ ID NO: 1901415 - protein, 44 aa, Staphylococcus
LPNKTQWWLVIPVGVVYAFIYYFVFRFLILKFKYKTPGREDKQA

SEQ ID NO: 1901416 - protein, 21 aa, Staphylococcus
LPPLIVHYFFDLMVSMGIFCF

SEQ ID NO: 1901417 - protein, 21 aa, Staphylococcus
LPPLIVHYFFDLMVSMGVFCF

SEQ ID NO: 1901418 - protein, 17 aa, Staphylococcus
LPPLTAMVFIKLGYHPI

SEQ ID NO: 1901419 - protein, 25 aa, Staphylococcus
LPQIFPFLMFILTISILTPYLEELI

SEQ ID NO: 1901420 - protein, 25 aa, Staphylococcus
LPQRRWVYFLVLSTSALMALYIQHI

SEQ ID NO: 1901421 - protein, 22 aa, Staphylococcus
LPQRRWVYFLVLSTSGLIALYI

SEQ ID NO: 1901422 - protein, 28 aa, Staphylococcus
LPQVFKAVMIPLFIIIAMCFIHLNTALI

SEQ ID NO: 1901423 - protein, 21 aa, Staphylococcus
LPQVINEAILIFTNLTNGAYT

SEQ ID NO: 1901424 - protein, 17 aa, Staphylococcus
LPSFLSLVLYRFELNLR

SEQ ID NO: 1901425 - protein, 33 aa, Staphylococcus
LPSYFLYSSIIFILIILGIFIIYRKSSIEIKHK

SEQ ID NO: 1901426 - protein, 22 aa, Staphylococcus
LPTLVFSFFGMNVPLPIDDKSY

SEQ ID NO: 1901427 - protein, 24 aa, Staphylococcus
LPTLVFSFFGMNVPLPINDHSYIS

SEQ ID NO: 1901428 - protein, 27 aa, Staphylococcus
LPVIIIRTSWLFILFIVLGGLSYTIGA

SEQ ID NO: 1901429 - protein, 19 aa, Staphylococcus
LPVITIGILFGLAMDYEVF

SEQ ID NO: 1901430 - protein, 17 aa, Staphylococcus
LPVLAMAGAGQVGAAFA

SEQ ID NO: 1901431 - protein, 17 aa, Staphylococcus
LPVYLKDLGLKGSDLGI

SEQ ID NO: 1901432 - protein, 17 aa, Staphylococcus
LPVYLKDLGLKGSDLGV

SEQ ID NO: 1901433 - protein, 19 aa, Staphylococcus
LPYNIIKFKNGDKYEISDI

SEQ ID NO: 1901434 - protein, 20 aa, Staphylococcus
LPYNMMTGMFKKLKEAATKK

SEQ ID NO: 1901435 - protein, 25 aa, Staphylococcus
LQAIISVILLLLFLASVAGLLHPEF

SEQ ID NO: 1901436 - protein, 36 aa, Staphylococcus
LQDKQKKNFFPYILLSIGAFLTIGFMVFTIQRGRRV

SEQ ID NO: 1901437 - protein, 23 aa, Staphylococcus
LQDYANLNNAMKSLRESVNNVNH

SEQ ID NO: 1901438 - protein, 26 aa, Staphylococcus
LQEDSQYFRFQYFNPLNAKEYYKNLD

SEQ ID NO: 1901439 - protein, 25 aa, Staphylococcus
LQFTIMPTLAFLIAKGFYLPPEIAI

SEQ ID NO: 1901440 - protein, 17 aa, Staphylococcus
LQIISFAIFIGVGIIMV

SEQ ID NO: 1901441 - protein, 29 aa, Staphylococcus
LQIVIYIIGLIFLLYMAWTLWNETPDPIK

SEQ ID NO: 1901442 - protein, 26 aa, Staphylococcus
LQKGSNYFRFQYFNPLNASKYYENLD

SEQ ID NO: 1901443 - protein, 17 aa, Staphylococcus
LQLFMGSILFFKLLTEF

SEQ ID NO: 1901444 - protein, 18 aa, Staphylococcus
LQLFMISILFFKLLTEFI

SEQ ID NO: 1901445 - protein, 17 aa, Staphylococcus
LQLTIQLLELNVPMMIG

SEQ ID NO: 1901446 - protein, 24 aa, Staphylococcus
LQMLLRLFMVLALISGFWELIKEF

SEQ ID NO: 1901447 - protein, 31 aa, Staphylococcus
LQNGIWAIIVYFIICLLISFLALISMNIRIL

SEQ ID NO: 1901448 - protein, 32 aa, Staphylococcus
LQNGVWAVIVYFIVCLLLSFLALISMNIRILS

SEQ ID NO: 1901449 - protein, 26 aa, Staphylococcus
LQPKGTFEGWWQMYLDEVKGNLLLEL

SEQ ID NO: 1901450 - protein, 22 aa, Staphylococcus
LQPVLMCMLISMVFSFIIISPL

SEQ ID NO: 1901451 - protein, 23 aa, Staphylococcus
LQPVLMCMLISMVFSFIIISPLS

SEQ ID NO: 1901452 - protein, 27 aa, Staphylococcus
LQRLCLARLFLKEAPIWLLDEPTRSLD

SEQ ID NO: 1901453 - protein, 25 aa, Staphylococcus
LQSSLMFMLFFASWSIWWSFFQIWL

SEQ ID NO: 1901454 - protein, 22 aa, Staphylococcus
LQTLLLGCILAFVWNPFGLKKT

SEQ ID NO: 1901455 - protein, 30 aa, Staphylococcus
LQTLLLGVILAFVWPPFKLKANPPKVLQRS

SEQ ID NO: 1901456 - protein, 29 aa, Staphylococcus
LQTLLLGVILAFVWPPFKLKVNPPQRLRR

SEQ ID NO: 1901457 - protein, 30 aa, Staphylococcus
LQTLLLGVLLAFMWPPFKLKTQPPKALRAT

SEQ ID NO: 1901458 - protein, 19 aa, Staphylococcus
LQVITFSIFIGIGIMVMGE

SEQ ID NO: 1901459 - protein, 30 aa, Staphylococcus
LQYDSSYMFLVIIYALRLVAISLLMMPINT

SEQ ID NO: 1901460 - protein, 26 aa, Staphylococcus
LQYTVIMAIAIFIALGFNIQKAYWVP

SEQ ID NO: 1901461 - protein, 24 aa, Staphylococcus
LRDTLILLLLIPILGVLLLIKFMG

SEQ ID NO: 1901462 - protein, 28 aa, Staphylococcus
LREKIILILFILPFPIMVWGVMTQGWWF

SEQ ID NO: 1901463 - protein, 20 aa, Staphylococcus
LRFIIMYFRWRNDKWRARMK

SEQ ID NO: 1901464 - protein, 19 aa, Staphylococcus
LRFPEVTKDKRVTGAILVN

SEQ ID NO: 1901465 - protein, 30 aa, Staphylococcus
LRGKQNFWIKILLVSLFILQQLWLAWDYNN

SEQ ID NO: 1901466 - protein, 27 aa, Staphylococcus
LRHYAMYIFSLIVSIVLYFSFVTLKYT

SEQ ID NO: 1901467 - protein, 19 aa, Staphylococcus
LRIGKLKYWAIYPFTMIII

SEQ ID NO: 1901468 - protein, 19 aa, Staphylococcus
LRISKNGTRYLFFDNMSFT

SEQ ID NO: 1901469 - protein, 28 aa, Staphylococcus
LRKKIILILFILPFPIMVWGVMTQGWWF

SEQ ID NO: 1901470 - protein, 32 aa, Staphylococcus
LRKLSVGIASVSLGTLVFLGGAQAANAEDAAT

SEQ ID NO: 1901471 - protein, 33 aa, Staphylococcus
LRLSIILFMFILIILIVLLCINHKDILRNDRRY

SEQ ID NO: 1901472 - protein, 25 aa, Staphylococcus
LRLVIIALILMIWLSQMWISLIVGA

SEQ ID NO: 1901473 - protein, 34 aa, Staphylococcus
LRMNIKHYGIYLFSLLLSIILYFSFTTLQFTHSI

SEQ ID NO: 1901474 - protein, 18 aa, Staphylococcus
LRNFPVLGRVRYFSEKIG

SEQ ID NO: 1901475 - protein, 25 aa, Staphylococcus
LRNMERTWYWAISIIMILALSMSGH

SEQ ID NO: 1901476 - protein, 17 aa, Staphylococcus
LRPDVKICTNCGAPVNG

SEQ ID NO: 1901477 - protein, 17 aa, Staphylococcus
LRRYIKPVMLMALGLVI

SEQ ID NO: 1901478 - protein, 18 aa, Staphylococcus
LRSSPWFPFAVVCILIGA

SEQ ID NO: 1901479 - protein, 20 aa, Staphylococcus
LRSTFFHWGFHAWAIYGVVA

SEQ ID NO: 1901480 - protein, 24 aa, Staphylococcus
LRSTFFHWGFHAWAIYGVVALALA

SEQ ID NO: 1901481 - protein, 27 aa, Staphylococcus
LRVSKNGRRYLIFDNMSFTAPTKEAIV

SEQ ID NO: 1901482 - protein, 25 aa, Staphylococcus
LRVTMNGRRYIFFDNIGFSTETKKA

SEQ ID NO: 1901483 - protein, 24 aa, Staphylococcus
LSAHDSWTLAKHLKTLPVRFKQSV

SEQ ID NO: 1901484 - protein, 29 aa, Staphylococcus
LSAIAFILTFIKFPLPFLPPYLTLDFSDV

SEQ ID NO: 1901485 - protein, 29 aa, Staphylococcus
LSAIAFILTFLKFPLPFLPPYLTLDFSDV

SEQ ID NO: 1901486 - protein, 19 aa, Staphylococcus
LSALIPLFKLCLTVVIAML

SEQ ID NO: 1901487 - protein, 25 aa, Staphylococcus
LSAMSFLCFPLISKCLFFVIFALVN

SEQ ID NO: 1901488 - protein, 27 aa, Staphylococcus
LSASIVNLIFLPPKFETKIYHYSVKLT

SEQ ID NO: 1901489 - protein, 26 aa, Staphylococcus
LSASWMLIIIIFIWNIMQWSTNPAVQ

SEQ ID NO: 1901490 - protein, 33 aa, Staphylococcus
LSAVTIIMLFPSAPLFILPFGSFAGALCISIIL

SEQ ID NO: 1901491 - protein, 24 aa, Staphylococcus
LSDHPHFLWFNLTKPDIWITIIAG

SEQ ID NO: 1901492 - protein, 40 aa, Staphylococcus
LSDKVAGYLFYFAVSVGVISFIVWMLIQNDVDFALERLVT

SEQ ID NO: 1901493 - protein, 24 aa, Staphylococcus
LSDKYFLLLILFIILMYPIHKTIH

SEQ ID NO: 1901494 - protein, 24 aa, Staphylococcus
LSDLTSALNINQLETFMGTNGNAT

SEQ ID NO: 1901495 - protein, 38 aa, Staphylococcus
LSDNLIILYLFWELTSFSSFLLISFWRDKQASIYGAQK

SEQ ID NO: 1901496 - protein, 32 aa, Staphylococcus
LSEDFMNSNFWIYWKTMFAFEPWHSAMEMRRY

SEQ ID NO: 1901497 - protein, 26 aa, Staphylococcus
LSELKLMLIFIIINIMISFYPGIFNG

SEQ ID NO: 1901498 - protein, 29 aa, Staphylococcus
LSELLRWLLIFGLLFQLPVLLFGLAKFGL

SEQ ID NO: 1901499 - protein, 24 aa, Staphylococcus
LSFAYVIFIIFWQVGFSNAVNLTD

SEQ ID NO: 1901500 - protein, 22 aa, Staphylococcus
LSFAYVIFIVFWQVGFSNAVNL

SEQ ID NO: 1901501 - protein, 17 aa, Staphylococcus
LSFEIIPFIMTVLLMFA

SEQ ID NO: 1901502 - protein, 22 aa, Staphylococcus
LSFIALILIASFFITSADSATF

SEQ ID NO: 1901503 - protein, 25 aa, Staphylococcus
LSFKRMALSYSLYTLQFIRLHRRVG

SEQ ID NO: 1901504 - protein, 21 aa, Staphylococcus
LSFLFGIPMFIGALITGMIAS

SEQ ID NO: 1901505 - protein, 26 aa, Staphylococcus
LSFLVHPLLILVFSALAFIVPGASDA

SEQ ID NO: 1901506 - protein, 25 aa, Staphylococcus
LSFSILPIMMLIYGILAKVIMVALF

SEQ ID NO: 1901507 - protein, 37 aa, Staphylococcus
LSFVYSGWRMLLIMLVAILGMMLWVIVAHGLWESTSE

SEQ ID NO: 1901508 - protein, 21 aa, Staphylococcus
LSGFDPIRREIARTALVNLVS

SEQ ID NO: 1901509 - protein, 18 aa, Staphylococcus
LSGILFLVASVVTLPLVL

SEQ ID NO: 1901510 - protein, 32 aa, Staphylococcus
LSGILVILIAPFFSYLVKFFPPVVTGSVVTII

SEQ ID NO: 1901511 - protein, 18 aa, Staphylococcus
LSGIPTIVFGFFALTFVT

SEQ ID NO: 1901512 - protein, 27 aa, Staphylococcus
LSGYLKISCTALLVSGTIIGYGFTHNT

SEQ ID NO: 1901513 - protein, 42 aa, Staphylococcus
LSIFTAFLFVISPLYFRFTAYWPFFGDVFIWLPLLLLAMEKS

SEQ ID NO: 1901514 - protein, 18 aa, Staphylococcus
LSIGLWVLLMYPFTYSVG

SEQ ID NO: 1901515 - protein, 21 aa, Staphylococcus
LSIIALLLIASFFITSADSAT

SEQ ID NO: 1901516 - protein, 18 aa, Staphylococcus
LSIIVGFIVWFVSAFIIF

SEQ ID NO: 1901517 - protein, 19 aa, Staphylococcus
LSILAFILSLFLKSKKKAD

SEQ ID NO: 1901518 - protein, 17 aa, Staphylococcus
LSILGFGGLLYGVSSIS

SEQ ID NO: 1901519 - protein, 20 aa, Staphylococcus
LSILNYFVLLPLYGMIMNLS

SEQ ID NO: 1901520 - protein, 17 aa, Staphylococcus
LSIPALLPLYKALNMNK

SEQ ID NO: 1901521 - protein, 18 aa, Staphylococcus
LSKDYLLEKLNGINIDSS

SEQ ID NO: 1901522 - protein, 27 aa, Staphylococcus
LSKKLKCKGFQDLKLKIAYDLNEPGNI

SEQ ID NO: 1901523 - protein, 26 aa, Staphylococcus
LSKNPILIILLIIISTLLLLVCVGFA

SEQ ID NO: 1901524 - protein, 17 aa, Staphylococcus
LSKRSMYLTIVATILIS

SEQ ID NO: 1901525 - protein, 26 aa, Staphylococcus
LSKSPFLIILLIIISTILLLLCTGFV

SEQ ID NO: 1901526 - protein, 27 aa, Staphylococcus
LSKVDYIFFVLITILAIIGIFRLITGA

SEQ ID NO: 1901527 - protein, 20 aa, Staphylococcus
LSKYYLFNWFYYVYNIGVVV

SEQ ID NO: 1901528 - protein, 20 aa, Staphylococcus
LSLENALPRSQYLIVKEAGN

SEQ ID NO: 1901529 - protein, 21 aa, Staphylococcus
LSLFAIIGMIAWIILAHNLWE

SEQ ID NO: 1901530 - protein, 21 aa, Staphylococcus
LSLGVLLLDWLKRIPKMYYNP

SEQ ID NO: 1901531 - protein, 27 aa, Staphylococcus
LSLIIAIIIVMLIQAFLIIGAVVPNNE

SEQ ID NO: 1901532 - protein, 18 aa, Staphylococcus
LSLILLTTPPVPVAIVLL

SEQ ID NO: 1901533 - protein, 26 aa, Staphylococcus
LSLIPENLIIVGLFIICMFVSISMGT

SEQ ID NO: 1901534 - protein, 27 aa, Staphylococcus
LSLIPGNLLIIGLFVICMFVSISMGTS

SEQ ID NO: 1901535 - protein, 18 aa, Staphylococcus
LSLIVVFIVSLIGFIMYE

SEQ ID NO: 1901536 - protein, 17 aa, Staphylococcus
LSLIYASIGMIIYISLR

SEQ ID NO: 1901537 - protein, 26 aa, Staphylococcus
LSLLGVGLLTIFIIMPIAGFVSDGLV

SEQ ID NO: 1901538 - protein, 38 aa, Staphylococcus
LSLLLSIYKYLAFLKFTMLFVILMLLQAYVVPYTHGML

SEQ ID NO: 1901539 - protein, 24 aa, Staphylococcus
LSLMAIALLGLILHDIVPFNIPSI

SEQ ID NO: 1901540 - protein, 29 aa, Staphylococcus
LSLNKRYLFIITIVLLVSFILLYMVSQTD

SEQ ID NO: 1901541 - protein, 25 aa, Staphylococcus
LSLVFWVILGLAAITLWLLTVRSGS

SEQ ID NO: 1901542 - protein, 18 aa, Staphylococcus
LSNDLRLMVICWGLTLFC

SEQ ID NO: 1901543 - protein, 18 aa, Staphylococcus
LSNIGYLFPLRYAGHALT

SEQ ID NO: 1901544 - protein, 26 aa, Staphylococcus
LSNKFDGSLLDRAEQMRKLSGNSKLL

SEQ ID NO: 1901545 - protein, 31 aa, Staphylococcus
LSNLNMLLAAMLFIIILIVGPTILIMNMFTS

SEQ ID NO: 1901546 - protein, 17 aa, Staphylococcus
LSPFFIGSLLLLIVIVC

SEQ ID NO: 1901547 - protein, 22 aa, Staphylococcus
LSQLLVILWQFIDSFTVVHMLQ

SEQ ID NO: 1901548 - protein, 45 aa, Staphylococcus
LSQSTKEILYIALRLSLIKTLKPYYPFPIIIDDAFVHFDKQRKEI

SEQ ID NO: 1901549 - protein, 45 aa, Staphylococcus
LSQSTKELLYIALRISLIKILRPYYPFPIIIDDAFVHFDKQRKSM

SEQ ID NO: 1901550 - protein, 44 aa, Staphylococcus
LSQSTKELLYISLRLSLIKVLKPYYPFPIIIDDAFVHFDKQRKS

SEQ ID NO: 1901551 - protein, 19 aa, Staphylococcus
LSRILIFFHLGYFGYNKGF

SEQ ID NO: 1901552 - protein, 19 aa, Staphylococcus
LSRLLIFWHLGYFGYNKGF

SEQ ID NO: 1901553 - protein, 23 aa, Staphylococcus
LSSALIPVFISLTSTLGLGEHSI

SEQ ID NO: 1901554 - protein, 25 aa, Staphylococcus
LSSHLMIWPMLIAGILIGPAMYYWG

SEQ ID NO: 1901555 - protein, 26 aa, Staphylococcus
LSSKPWIWMPPAFIITFTILCINFVG

SEQ ID NO: 1901556 - protein, 36 aa, Staphylococcus
LSSKRWIRFIHETEMPEFLIVIYHGGLDQLNKSSNE

SEQ ID NO: 1901557 - protein, 23 aa, Staphylococcus
LSSKRWLIIAFSIFIVMMLMMNL

SEQ ID NO: 1901558 - protein, 25 aa, Staphylococcus
LSSLFICIVFLWFALCSFMFTHIKK

SEQ ID NO: 1901559 - protein, 17 aa, Staphylococcus
LSSLLFGIALLGIIVHN

SEQ ID NO: 1901560 - protein, 18 aa, Staphylococcus
LSSLQLLLLVFFSSTFTS

SEQ ID NO: 1901561 - protein, 31 aa, Staphylococcus
LSSMGTWYIIGFIVLLILAIIATLLISKKSK

SEQ ID NO: 1901562 - protein, 33 aa, Staphylococcus
LSSNYKLYYLSLWYFITFGAFVAFGLFLPNYLV

SEQ ID NO: 1901563 - protein, 26 aa, Staphylococcus
LSSSIVNLIFLPPKFETKIYYNSVNI

SEQ ID NO: 1901564 - protein, 24 aa, Staphylococcus
LSTGILLPLYLKGALLFSSVIAGL

SEQ ID NO: 1901565 - protein, 32 aa, Staphylococcus
LSTIIIILLLIIFGILYIIFDTNLFNNDKRVS

SEQ ID NO: 1901566 - protein, 24 aa, Staphylococcus
LSTLGFIFLMFLSGLEIDFKAFKK

SEQ ID NO: 1901567 - protein, 24 aa, Staphylococcus
LSTLGFIFLMFLSGLEIDFSAFKK

SEQ ID NO: 1901568 - protein, 24 aa, Staphylococcus
LSTLGFIFLMFLSGLEIDFSAFKS

SEQ ID NO: 1901569 - protein, 24 aa, Staphylococcus
LSTLGFIFPIIAIVGSIFTFVYSI

SEQ ID NO: 1901570 - protein, 41 aa, Staphylococcus
LSTTQFVIWLQNGVWAIIVYFIICLLISFLALISMNIRILS

SEQ ID NO: 1901571 - protein, 23 aa, Staphylococcus
LSTVYAIRMIGIALGLMPLMTHT

SEQ ID NO: 1901572 - protein, 22 aa, Staphylococcus
LSVFALFLVLTATSVCVTQADT

SEQ ID NO: 1901573 - protein, 36 aa, Staphylococcus
LSVFIGTYFLFISLSVLILDWLKKIPNFYYKTNNFF

SEQ ID NO: 1901574 - protein, 31 aa, Staphylococcus
LSVILVITILISFTFYFFNKEDKPDKDDLYE

SEQ ID NO: 1901575 - protein, 32 aa, Staphylococcus
LSVILVITILISFVFYYFNKEDRPDKDTLFEN

SEQ ID NO: 1901576 - protein, 31 aa, Staphylococcus
LSVILVITIVISFLFYFLTTEKKVDKDTLYE

SEQ ID NO: 1901577 - protein, 25 aa, Staphylococcus
LSVIPPSLLIPGIFIMSGFAALTLG

SEQ ID NO: 1901578 - protein, 23 aa, Staphylococcus
LSVLAFILSLFLKGKKGAEAEHE

SEQ ID NO: 1901579 - protein, 31 aa, Staphylococcus
LSVLIIVVGAIILFIFRLNLGIDFTSGTRVD

SEQ ID NO: 1901580 - protein, 20 aa, Staphylococcus
LSVLTFWLFATSLVNVIPTL

SEQ ID NO: 1901581 - protein, 22 aa, Staphylococcus
LSVNTFILFLGTALAPIINIYI

SEQ ID NO: 1901582 - protein, 60 aa, Staphylococcus
LSVPLVLTMLIHLFHMNLPHILMNPWFQFLLATPIQFMIGWQFYVGAYKNLRHGGANMDV

SEQ ID NO: 1901583 - protein, 21 aa, Staphylococcus
LSVVLIFWALHYRALLNTAIA

SEQ ID NO: 1901584 - protein, 24 aa, Staphylococcus
LSWIFFVSMIILTILVFAADLMMS

SEQ ID NO: 1901585 - protein, 26 aa, Staphylococcus
LSWIFYVAMILFTLFILVADFMTNKY

SEQ ID NO: 1901586 - protein, 21 aa, Staphylococcus
LSWIGFYPSFETIIAQVILII

SEQ ID NO: 1901587 - protein, 20 aa, Staphylococcus
LSYIIFVLLLSLIVGQLLKE

SEQ ID NO: 1901588 - protein, 17 aa, Staphylococcus
LSYMIIMLGIILTAMGS

SEQ ID NO: 1901589 - protein, 20 aa, Staphylococcus
LSYQFLNRALITSILVGIVC

SEQ ID NO: 1901590 - protein, 24 aa, Staphylococcus
LTAFIGGFGYVYFMSAVQGFDFPD

SEQ ID NO: 1901591 - protein, 17 aa, Staphylococcus
LTAFLFIDKVFVNIIYF

SEQ ID NO: 1901592 - protein, 18 aa, Staphylococcus
LTAFLFIDKVFVNIIYFQ

SEQ ID NO: 1901593 - protein, 22 aa, Staphylococcus
LTAGFVNFIILPPKYFQQIEDN

SEQ ID NO: 1901594 - protein, 26 aa, Staphylococcus
LTAILGILLAILILRAVLNMSNQLLG

SEQ ID NO: 1901595 - protein, 19 aa, Staphylococcus
LTAILPVILMLVSTLVQLI

SEQ ID NO: 1901596 - protein, 27 aa, Staphylococcus
LTAITWVVFIPFLPWTIPLHYDNQNQL

SEQ ID NO: 1901597 - protein, 19 aa, Staphylococcus
LTAYVFRSIWASATLHFFW

SEQ ID NO: 1901598 - protein, 18 aa, Staphylococcus
LTDLKRVAKTPAAWVILG

SEQ ID NO: 1901599 - protein, 24 aa, Staphylococcus
LTDQKLIYIPFANENKNPITQNDA

SEQ ID NO: 1901600 - protein, 31 aa, Staphylococcus
LTEKILGWFSWIFLLLMTIITMFIALVSFSN

SEQ ID NO: 1901601 - protein, 31 aa, Staphylococcus
LTEKLLGWISWIFLLILTVITMFIALVSFSN

SEQ ID NO: 1901602 - protein, 32 aa, Staphylococcus
LTEKVLGWFSWVFLLILTIVTMFIALVSFSND

SEQ ID NO: 1901603 - protein, 23 aa, Staphylococcus
LTEWVYFTYLMLGVFLAIYVMIL

SEQ ID NO: 1901604 - protein, 20 aa, Staphylococcus
LTFIAAYYLMRYYHLKRYTA

SEQ ID NO: 1901605 - protein, 17 aa, Staphylococcus
LTFIQFALFYSALVLFF

SEQ ID NO: 1901606 - protein, 29 aa, Staphylococcus
LTFKLYKHYYFRLFAFLTCITILFNFMPI

SEQ ID NO: 1901607 - protein, 25 aa, Staphylococcus
LTFLVTFLLLVAMYRLFGKQGLIAW

SEQ ID NO: 1901608 - protein, 24 aa, Staphylococcus
LTFSDGHEVIIPKGAKGDKGDTGA

SEQ ID NO: 1901609 - protein, 19 aa, Staphylococcus
LTFSLVQRFIQIKFFSEFV

SEQ ID NO: 1901610 - protein, 25 aa, Staphylococcus
LTGIFILFTILNLIVAFNIIFIKDS

SEQ ID NO: 1901611 - protein, 19 aa, Staphylococcus
LTGNLLLLPRLGAALTVVI

SEQ ID NO: 1901612 - protein, 20 aa, Staphylococcus
LTGNLLLLPRLGAALTVVMT

SEQ ID NO: 1901613 - protein, 37 aa, Staphylococcus
LTGTTQYPTFLSISICTLLKIITLVLGKHRRLDWLNK

SEQ ID NO: 1901614 - protein, 26 aa, Staphylococcus
LTHKEKYFLIIFMSNAIFGVLQDWVQ

SEQ ID NO: 1901615 - protein, 23 aa, Staphylococcus
LTIIDETLFTFWQGINYTVDMKQ

SEQ ID NO: 1901616 - protein, 20 aa, Staphylococcus
LTIIGVLIYFTVNQGFFSVR

SEQ ID NO: 1901617 - protein, 17 aa, Staphylococcus
LTIIIVTVLLLVLALLI

SEQ ID NO: 1901618 - protein, 18 aa, Staphylococcus
LTILIYSIGIIILLLLCN

SEQ ID NO: 1901619 - protein, 28 aa, Staphylococcus
LTILTLLFNRTLLKLLNFLSIASMLAIV

SEQ ID NO: 1901620 - protein, 28 aa, Staphylococcus
LTILTPFWYIFLIIYILLGIYLAWQLKN

SEQ ID NO: 1901621 - protein, 22 aa, Staphylococcus
LTILVIIVVIIGGLFGLNAYSD

SEQ ID NO: 1901622 - protein, 20 aa, Staphylococcus
LTIPVLFLFPFVQKHFVKGI

SEQ ID NO: 1901623 - protein, 34 aa, Staphylococcus
LTISNWRLLFILLGILGLIWVVIWSMVFTDYPED

SEQ ID NO: 1901624 - protein, 22 aa, Staphylococcus
LTIYAVFVILFAEVIPKSIAAN

SEQ ID NO: 1901625 - protein, 27 aa, Staphylococcus
LTLAIINFFIPFLLIAIIDGFKGIKET

SEQ ID NO: 1901626 - protein, 30 aa, Staphylococcus
LTLGLISFFVPFLLMFIIDGLKGVKETFPA

SEQ ID NO: 1901627 - protein, 19 aa, Staphylococcus
LTLICFVLSIFISILSYNI

SEQ ID NO: 1901628 - protein, 24 aa, Staphylococcus
LTLINPMWFGILFAIIGALLIEKL

SEQ ID NO: 1901629 - protein, 20 aa, Staphylococcus
LTLIVVFYRPLMISTFDATF

SEQ ID NO: 1901630 - protein, 21 aa, Staphylococcus
LTLLPAFISIFHKRIKIKSKE

SEQ ID NO: 1901631 - protein, 22 aa, Staphylococcus
LTLLPIYYFFIFKQFELQHFHM

SEQ ID NO: 1901632 - protein, 22 aa, Staphylococcus
LTLNWITAILWLVAGILLLVRK

SEQ ID NO: 1901633 - protein, 21 aa, Staphylococcus
LTLNYLWSILYFKKKVRGIAF

SEQ ID NO: 1901634 - protein, 19 aa, Staphylococcus
LTLTFGISKSFMKKLGLSS

SEQ ID NO: 1901635 - protein, 34 aa, Staphylococcus
LTLTVSIAFYYVILFCLFLLATLVVLPPGYLGQA

SEQ ID NO: 1901636 - protein, 26 aa, Staphylococcus
LTLVRGFIAWFYTLLWSAIGFIWIRH

SEQ ID NO: 1901637 - protein, 32 aa, Staphylococcus
LTLVTAWFTFGIPTIIWLIIDACLIPGMIEEN

SEQ ID NO: 1901638 - protein, 29 aa, Staphylococcus
LTLVTILFGLLYLVLMVTSAYVLIRMFKE

SEQ ID NO: 1901639 - protein, 31 aa, Staphylococcus
LTLVTLIVSCLIALGLLINHAIYTTISGRDS

SEQ ID NO: 1901640 - protein, 26 aa, Staphylococcus
LTMHWPIWMLIIAFFLNISPVTSIGP

SEQ ID NO: 1901641 - protein, 21 aa, Staphylococcus
LTMNFMITFLFVISATVIGVF

SEQ ID NO: 1901642 - protein, 26 aa, Staphylococcus
LTNHWSFWILIIGLIVLVAPVTGVAT

SEQ ID NO: 1901643 - protein, 17 aa, Staphylococcus
LTNVSVATVVRLSKKLK

SEQ ID NO: 1901644 - protein, 23 aa, Staphylococcus
LTPIFIFTIFTFFMHIFFTHGGT

SEQ ID NO: 1901645 - protein, 18 aa, Staphylococcus
LTPPILPNLETDLTGKAG

SEQ ID NO: 1901646 - protein, 28 aa, Staphylococcus
LTRIDYIFFAIIIILSIVGLIRLCSGAI

SEQ ID NO: 1901647 - protein, 18 aa, Staphylococcus
LTRLILGILVVVLAGASV

SEQ ID NO: 1901648 - protein, 19 aa, Staphylococcus
LTSILLLIAHHVFAYIFNL

SEQ ID NO: 1901649 - protein, 33 aa, Staphylococcus
LTSIVFNFWLYLIIFWFVPLLTTFQIIRYWAEM

SEQ ID NO: 1901650 - protein, 18 aa, Staphylococcus
LTSKRWLIIAFSVFIVVM

SEQ ID NO: 1901651 - protein, 25 aa, Staphylococcus
LTSTMALLLGWIAKPISLIFSGIVY

SEQ ID NO: 1901652 - protein, 27 aa, Staphylococcus
LTTETPFWYVVVIYAIRMISVGLLIMP

SEQ ID NO: 1901653 - protein, 21 aa, Staphylococcus
LTTIYGIRMIGIALSLMPIMT

SEQ ID NO: 1901654 - protein, 18 aa, Staphylococcus
LTTLPYIQIITKSLGHMI

SEQ ID NO: 1901655 - protein, 44 aa, Staphylococcus
LTTPIAFLVLIFIFDWKLSLICLIPVILGFLLLKFMMGEDSKAF

SEQ ID NO: 1901656 - protein, 28 aa, Staphylococcus
LTTTISFIVSFIIVTYLHVVLGELAPKT

SEQ ID NO: 1901657 - protein, 23 aa, Staphylococcus
LTTYIYLTLVAFNFISGVLTLPG

SEQ ID NO: 1901658 - protein, 23 aa, Staphylococcus
LTVCTFLLCFLKADTSYMYLIII

SEQ ID NO: 1901659 - protein, 17 aa, Staphylococcus
LTVFITKLPAFVLLLTF

SEQ ID NO: 1901660 - protein, 21 aa, Staphylococcus
LTVIIVGLFSGALWAFGQGNQ

SEQ ID NO: 1901661 - protein, 30 aa, Staphylococcus
LTVILIITIIISFVFYYFTSDEKVDKDKLY

SEQ ID NO: 1901662 - protein, 28 aa, Staphylococcus
LTVINRLLLALILPLVIFIIGMVIFNTM

SEQ ID NO: 1901663 - protein, 34 aa, Staphylococcus
LTVIQPVLYGLLLLIVTVIPYYMFNALKIAGPSS

SEQ ID NO: 1901664 - protein, 20 aa, Staphylococcus
LTVIVVVVAILIFGASSLFN

SEQ ID NO: 1901665 - protein, 20 aa, Staphylococcus
LTVIVVVVAILLFGAPSIFN

SEQ ID NO: 1901666 - protein, 18 aa, Staphylococcus
LTVLIYALAQFLPGMLLR

SEQ ID NO: 1901667 - protein, 19 aa, Staphylococcus
LTWIALWLMVYPLFERIKF

SEQ ID NO: 1901668 - protein, 20 aa, Staphylococcus
LTWIGIVLQILGVVLMAVLI

SEQ ID NO: 1901669 - protein, 19 aa, Staphylococcus
LTWLSIIVSILFNAAVFGV

SEQ ID NO: 1901670 - protein, 17 aa, Staphylococcus
LTWRSVFYVVFPIAIII

SEQ ID NO: 1901671 - protein, 34 aa, Staphylococcus
LTYARPLYYFGNVMKPLIWLMNGSARVIIRMLGV

SEQ ID NO: 1901672 - protein, 26 aa, Staphylococcus
LTYIALILIWLVLGLITFLMARNNDQ

SEQ ID NO: 1901673 - protein, 19 aa, Staphylococcus
LTYIFPLLNYLLPHRLMEI

SEQ ID NO: 1901674 - protein, 25 aa, Staphylococcus
LTYTPPHFYLLIVISIIGVVLSMIF

SEQ ID NO: 1901675 - protein, 26 aa, Staphylococcus
LTYTPPHWHLLFIMSILGIFLSIAFR

SEQ ID NO: 1901676 - protein, 25 aa, Staphylococcus
LTYTPPQFYLLAIMSFIGVIGSILF

SEQ ID NO: 1901677 - protein, 17 aa, Staphylococcus
LVAALLNYIFPDATLVF

SEQ ID NO: 1901678 - protein, 19 aa, Staphylococcus
LVAEILYYLYTRIKQFFGK

SEQ ID NO: 1901679 - protein, 26 aa, Staphylococcus
LVAIAFFVVPFIVAFITQFIYMRVLK

SEQ ID NO: 1901680 - protein, 20 aa, Staphylococcus
LVAIMYWVVCFIISVLQGLY

SEQ ID NO: 1901681 - protein, 17 aa, Staphylococcus
LVALFVLVLFQAGLRSI

SEQ ID NO: 1901682 - protein, 27 aa, Staphylococcus
LVAMFIPLFFIFKYKQPMFGKLSSQPL

SEQ ID NO: 1901683 - protein, 27 aa, Staphylococcus
LVAMFIPLFFIIKYKQPIFGKLSSQPL

SEQ ID NO: 1901684 - protein, 26 aa, Staphylococcus
LVAMFIPLYFIYKYKQPLFGKLSSQP

SEQ ID NO: 1901685 - protein, 27 aa, Staphylococcus
LVAMLIPLYFLYKYKQPMFGKLSSQPL

SEQ ID NO: 1901686 - protein, 25 aa, Staphylococcus
LVAPLLTLIGLVFLLVSIYIDKRNK

SEQ ID NO: 1901687 - protein, 27 aa, Staphylococcus
LVASFFNPKYYAYAGLPGPITIVNGYS

SEQ ID NO: 1901688 - protein, 24 aa, Staphylococcus
LVAVIVGLIVWWFEYRYRISNTRE

SEQ ID NO: 1901689 - protein, 22 aa, Staphylococcus
LVAYLMLKRFKIEALFFVIVMS

SEQ ID NO: 1901690 - protein, 22 aa, Staphylococcus
LVAYLMLKRYKIEALFFVITMS

SEQ ID NO: 1901691 - protein, 19 aa, Staphylococcus
LVCFFFFAVFGASAVYLQD

SEQ ID NO: 1901692 - protein, 17 aa, Staphylococcus
LVCFLFFAVFGASAIYL

SEQ ID NO: 1901693 - protein, 26 aa, Staphylococcus
LVCTATAIVILLYGGLKFGDNAPQGV

SEQ ID NO: 1901694 - protein, 24 aa, Staphylococcus
LVESVVLCLIGGIIGLIIGIAIAS

SEQ ID NO: 1901695 - protein, 24 aa, Staphylococcus
LVEYFDWRSLFHVVAPIAALTFLG

SEQ ID NO: 1901696 - protein, 24 aa, Staphylococcus
LVEYFNWRSLFHVVAPIAAITFII

SEQ ID NO: 1901697 - protein, 24 aa, Staphylococcus
LVEYLDWRALFHVVAPIAAFTFLI

SEQ ID NO: 1901698 - protein, 23 aa, Staphylococcus
LVEYLNWRSLFHVVAPIAAITFI

SEQ ID NO: 1901699 - protein, 22 aa, Staphylococcus
LVFAYIMLFIVIKTLGGIWTLK

SEQ ID NO: 1901700 - protein, 36 aa, Staphylococcus
LVFLDWRDTYLIYALIALVVLFWNYIVIPKLQKDIK

SEQ ID NO: 1901701 - protein, 18 aa, Staphylococcus
LVFLIIVGSTLTTKQPNI

SEQ ID NO: 1901702 - protein, 25 aa, Staphylococcus
LVFPILLFFILLINKKHYHKTYESL

SEQ ID NO: 1901703 - protein, 20 aa, Staphylococcus
LVFVIWTFYSMSFLAVMILR

SEQ ID NO: 1901704 - protein, 27 aa, Staphylococcus
LVFVPQIIVLFFFISLLEDSGYMARIA

SEQ ID NO: 1901705 - protein, 28 aa, Staphylococcus
LVFVPQIIVLFFFISLLEDSGYMARIAV

SEQ ID NO: 1901706 - protein, 27 aa, Staphylococcus
LVFVPQIVVLFFFISLLEDSGYMARIA

SEQ ID NO: 1901707 - protein, 35 aa, Staphylococcus
LVFYSLLPTLVAVFLFAALFLPLLMEYGLLELLGP

SEQ ID NO: 1901708 - protein, 25 aa, Staphylococcus
LVGAFLMGLLFTLTVPFLSKHPKLK

SEQ ID NO: 1901709 - protein, 20 aa, Staphylococcus
LVGALIAMRFKLSPLATAVV

SEQ ID NO: 1901710 - protein, 32 aa, Staphylococcus
LVGDNAPALYPNYWGGTKFPVKKRLEKLGYDV

SEQ ID NO: 1901711 - protein, 18 aa, Staphylococcus
LVGILWLSNRILSTFILC

SEQ ID NO: 1901712 - protein, 18 aa, Staphylococcus
LVGLFIWRQERLDTPLLS

SEQ ID NO: 1901713 - protein, 18 aa, Staphylococcus
LVGLIVIGIINKAIEEAF

SEQ ID NO: 1901714 - protein, 23 aa, Staphylococcus
LVHPDIWITIIAGVLYFIQAWVS

SEQ ID NO: 1901715 - protein, 18 aa, Staphylococcus
LVHPLVKWLVLKISIFDN

SEQ ID NO: 1901716 - protein, 28 aa, Staphylococcus
LVIAIIGVFIFGLFSWLNGNGNMPKQLS

SEQ ID NO: 1901717 - protein, 28 aa, Staphylococcus
LVIAIIGVIIFGLFSFLNGNGKTPKQLT

SEQ ID NO: 1901718 - protein, 30 aa, Staphylococcus
LVIFVVFFLAATLVWFVHDKDIYKRLKYNE

SEQ ID NO: 1901719 - protein, 21 aa, Staphylococcus
LVIICMIVVFNFDTFKAGFYG

SEQ ID NO: 1901720 - protein, 17 aa, Staphylococcus
LVIILKPITKLLNTITS

SEQ ID NO: 1901721 - protein, 19 aa, Staphylococcus
LVIISIIALIIFGPTKLPQ

SEQ ID NO: 1901722 - protein, 17 aa, Staphylococcus
LVILIMNYDQIIPMIST

SEQ ID NO: 1901723 - protein, 22 aa, Staphylococcus
LVIMAMLIWSIGIQSSAWIIII

SEQ ID NO: 1901724 - protein, 24 aa, Staphylococcus
LVIMVMFVLQFILNFFIPSGSGQA

SEQ ID NO: 1901725 - protein, 18 aa, Staphylococcus
LVITQLLYFIPGSITFLM

SEQ ID NO: 1901726 - protein, 18 aa, Staphylococcus
LVIVILTLVLIYTIFKKE

SEQ ID NO: 1901727 - protein, 17 aa, Staphylococcus
LVIVLFLTLGIFSQWLA

SEQ ID NO: 1901728 - protein, 18 aa, Staphylococcus
LVKKLKDDGLGKKSGLKI

SEQ ID NO: 1901729 - protein, 17 aa, Staphylococcus
LVKLTHRFSARSVLLWT

SEQ ID NO: 1901730 - protein, 18 aa, Staphylococcus
LVKVIPYILVLVLAVIGV

SEQ ID NO: 1901731 - protein, 17 aa, Staphylococcus
LVKYLGPYNFTIYDGVK

SEQ ID NO: 1901732 - protein, 23 aa, Staphylococcus
LVLCFIVFGITTGTSYAAESQAT

SEQ ID NO: 1901733 - protein, 18 aa, Staphylococcus
LVLFFKIIGISIVPMALI

SEQ ID NO: 1901734 - protein, 19 aa, Staphylococcus
LVLIALFIGNWKVGLSALV

SEQ ID NO: 1901735 - protein, 17 aa, Staphylococcus
LVLIFFSFKTHYGHASF

SEQ ID NO: 1901736 - protein, 20 aa, Staphylococcus
LVLIIIAFVISFIALADFLD

SEQ ID NO: 1901737 - protein, 20 aa, Staphylococcus
LVLIIIAFVISFVALADLAD

SEQ ID NO: 1901738 - protein, 20 aa, Staphylococcus
LVLIIIAFVISFVALADLFD

SEQ ID NO: 1901739 - protein, 19 aa, Staphylococcus
LVLIIITVIMRPYLDVLLL

SEQ ID NO: 1901740 - protein, 18 aa, Staphylococcus
LVLILALVGVNVIIVLIG

SEQ ID NO: 1901741 - protein, 17 aa, Staphylococcus
LVLLFILLSAGVVKLRQ

SEQ ID NO: 1901742 - protein, 30 aa, Staphylococcus
LVLLLMGIVFTYVILLGGFLFGLITSLTAV

SEQ ID NO: 1901743 - protein, 20 aa, Staphylococcus
LVLMIWLSFPIVSAIIGCLF

SEQ ID NO: 1901744 - protein, 18 aa, Staphylococcus
LVLMLFFALHKFYIASVA

SEQ ID NO: 1901745 - protein, 36 aa, Staphylococcus
LVLNPVFFIPFVLTPIVNVWIFKFFVDVLGMNSFSV

SEQ ID NO: 1901746 - protein, 22 aa, Staphylococcus
LVLSAILYFNPHLIIAVIIMGI

SEQ ID NO: 1901747 - protein, 20 aa, Staphylococcus
LVLTFFTLLFNRTVLKVVNM

SEQ ID NO: 1901748 - protein, 24 aa, Staphylococcus
LVLTIVIIIFKELFDRRIKTEEDV

SEQ ID NO: 1901749 - protein, 26 aa, Staphylococcus
LVLVVVFAMIFFIIVVLGIVARICGI

SEQ ID NO: 1901750 - protein, 20 aa, Staphylococcus
LVLWICLFFYVIAAGIYFGT

SEQ ID NO: 1901751 - protein, 18 aa, Staphylococcus
LVLYILRINYLKESPTWM

SEQ ID NO: 1901752 - protein, 17 aa, Staphylococcus
LVMFGFNNPMTVVIYGV

SEQ ID NO: 1901753 - protein, 17 aa, Staphylococcus
LVMLFNVIVALIFSIIE

SEQ ID NO: 1901754 - protein, 18 aa, Staphylococcus
LVMLIYLFTSVGARNIFS

SEQ ID NO: 1901755 - protein, 18 aa, Staphylococcus
LVMNKLKIDPAVASGPFI

SEQ ID NO: 1901756 - protein, 31 aa, Staphylococcus
LVMNPILALPFIFIPLVLTTITYFVFKLGLI

SEQ ID NO: 1901757 - protein, 25 aa, Staphylococcus
LVNAASYFFIFYAIASLVTRPIAGR

SEQ ID NO: 1901758 - protein, 23 aa, Staphylococcus
LVNIVFILFIFVFATKAGVFPMY

SEQ ID NO: 1901759 - protein, 17 aa, Staphylococcus
LVPLKAVLGFILSLMAT

SEQ ID NO: 1901760 - protein, 17 aa, Staphylococcus
LVPLKAVLGFVLSLMAT

SEQ ID NO: 1901761 - protein, 26 aa, Staphylococcus
LVPYILWMIIFIILPVLLLIYFSFTD

SEQ ID NO: 1901762 - protein, 22 aa, Staphylococcus
LVPYLLWMVIFIIIPVILLVYF

SEQ ID NO: 1901763 - protein, 19 aa, Staphylococcus
LVPYSIYPIMLGVCGLIAI

SEQ ID NO: 1901764 - protein, 22 aa, Staphylococcus
LVPYWAVYRIILYVVAGHKEIH

SEQ ID NO: 1901765 - protein, 30 aa, Staphylococcus
LVQVVFISLFAFFILFRVLGKDYDAAVMAG

SEQ ID NO: 1901766 - protein, 24 aa, Staphylococcus
LVRIRWYYRLASALYFIVFTYTTY

SEQ ID NO: 1901767 - protein, 19 aa, Staphylococcus
LVRTVFGLLVGVFTSLSAP

SEQ ID NO: 1901768 - protein, 18 aa, Staphylococcus
LVSFFFFAVFGGAAVYLQ

SEQ ID NO: 1901769 - protein, 18 aa, Staphylococcus
LVSFIIMFVGIQVVIENF

SEQ ID NO: 1901770 - protein, 20 aa, Staphylococcus
LVSILMLALLYFEAIFDVER

SEQ ID NO: 1901771 - protein, 26 aa, Staphylococcus
LVSVVALQLISYYAALHRDLDVDKPR

SEQ ID NO: 1901772 - protein, 27 aa, Staphylococcus
LVSVVALQLISYYAALHRDLDVDKPRN

SEQ ID NO: 1901773 - protein, 18 aa, Staphylococcus
LVTAFLKTKHEVEYFGTI

SEQ ID NO: 1901774 - protein, 18 aa, Staphylococcus
LVTALLNYIFPDATLVFT

SEQ ID NO: 1901775 - protein, 18 aa, Staphylococcus
LVTALLNYIFPNATLVFT

SEQ ID NO: 1901776 - protein, 20 aa, Staphylococcus
LVTFMWIMFTFIHAVKNYAD

SEQ ID NO: 1901777 - protein, 18 aa, Staphylococcus
LVTKFLFTSYTVSGESMH

SEQ ID NO: 1901778 - protein, 27 aa, Staphylococcus
LVTLLVFLILIFVLIYTAQRLANISGV

SEQ ID NO: 1901779 - protein, 24 aa, Staphylococcus
LVTLPIWVVIFICGVLKSGPPSSN

SEQ ID NO: 1901780 - protein, 23 aa, Staphylococcus
LVTMVLFALILFQVLFKVGHFSV

SEQ ID NO: 1901781 - protein, 23 aa, Staphylococcus
LVTPFLILFLTVVGAYLFFRSSV

SEQ ID NO: 1901782 - protein, 20 aa, Staphylococcus
LVTQLFYFIEGSLAFLMVTR

SEQ ID NO: 1901783 - protein, 20 aa, Staphylococcus
LVTSMLFVGSIVIGGYSLFK

SEQ ID NO: 1901784 - protein, 26 aa, Staphylococcus
LVTYLLIFIYFLILTSRKLSPIIVIL

SEQ ID NO: 1901785 - protein, 23 aa, Staphylococcus
LVVALFYVFFIPQSFLAYGPSIR

SEQ ID NO: 1901786 - protein, 17 aa, Staphylococcus
LVVGCPCALVISTPISI

SEQ ID NO: 1901787 - protein, 18 aa, Staphylococcus
LVVIAIIALIIFGPTKLP

SEQ ID NO: 1901788 - protein, 19 aa, Staphylococcus
LVVIAIIALIIFGPTKLPQ

SEQ ID NO: 1901789 - protein, 20 aa, Staphylococcus
LVVICLLFFIVYRAFELANK

SEQ ID NO: 1901790 - protein, 19 aa, Staphylococcus
LVVIIAWILYYFVDVKLTN

SEQ ID NO: 1901791 - protein, 24 aa, Staphylococcus
LVVILFMIVFTYKWAFMFTTIHEQ

SEQ ID NO: 1901792 - protein, 18 aa, Staphylococcus
LVVISIIALIIFGPKKLP

SEQ ID NO: 1901793 - protein, 19 aa, Staphylococcus
LVVLYSVMRIFLKGFFGEA

SEQ ID NO: 1901794 - protein, 18 aa, Staphylococcus
LVVMVACFLYLILQNKLG

SEQ ID NO: 1901795 - protein, 20 aa, Staphylococcus
LVVMVLFSLVLFQGMFKLGH

SEQ ID NO: 1901796 - protein, 18 aa, Staphylococcus
LVVSFLTFLLTYLTDENP

SEQ ID NO: 1901797 - protein, 24 aa, Staphylococcus
LVVSVKLFGFIRAIARYGERLLSH

SEQ ID NO: 1901798 - protein, 21 aa, Staphylococcus
LVVVIAWVLYYFVDIKLTNYN

SEQ ID NO: 1901799 - protein, 27 aa, Staphylococcus
LVVVMIMALIIFYLYEKRQKVPFIDFS

SEQ ID NO: 1901800 - protein, 17 aa, Staphylococcus
LVWIGWYGFNTGSAYTL

SEQ ID NO: 1901801 - protein, 19 aa, Staphylococcus
LVYVFFIPQSFLAIGPYIT

SEQ ID NO: 1901802 - protein, 18 aa, Staphylococcus
LWDLFRSIPSLEVEGASV

SEQ ID NO: 1901803 - protein, 18 aa, Staphylococcus
LWFIIRKKETFKLFDVIA

SEQ ID NO: 1901804 - protein, 19 aa, Staphylococcus
LWFIISFIIFHIILFIMWG

SEQ ID NO: 1901805 - protein, 30 aa, Staphylococcus
LWIAPIAGILLLIIFSLAFYPAYNPKPKEM

SEQ ID NO: 1901806 - protein, 28 aa, Staphylococcus
LWIAPIGLLVVIMLLAVAFYPAYNPKPK

SEQ ID NO: 1901807 - protein, 19 aa, Staphylococcus
LWIVFFVFIVQMALSLSYF

SEQ ID NO: 1901808 - protein, 28 aa, Staphylococcus
LWKGIRQGLLMIIPTLIGYLLGHFSFGL

SEQ ID NO: 1901809 - protein, 31 aa, Staphylococcus
LWLAPIAAILILVIFSLAFYPAFNPKPKDLP

SEQ ID NO: 1901810 - protein, 31 aa, Staphylococcus
LWLAPIAVILLLVIFSLAFYPAFNPKPKQLP

SEQ ID NO: 1901811 - protein, 31 aa, Staphylococcus
LWLTPIAIILILMIFAIAFYPAFNPKPKDMP

SEQ ID NO: 1901812 - protein, 21 aa, Staphylococcus
LWLVAGIMLLVRKPKEPIYDK

SEQ ID NO: 1901813 - protein, 18 aa, Staphylococcus
LWNRLFLINRWKGYIPEG

SEQ ID NO: 1901814 - protein, 25 aa, Staphylococcus
LWSIILRTLHLIGISLWLGALSYLL

SEQ ID NO: 1901815 - protein, 17 aa, Staphylococcus
LWTFLFLYIIVASIDFG

SEQ ID NO: 1901816 - protein, 20 aa, Staphylococcus
LWVGFLIYQFGFHNGNLSWV

SEQ ID NO: 1901817 - protein, 21 aa, Staphylococcus
LWVHLKLFSILIFTIILIIVY

SEQ ID NO: 1901818 - protein, 18 aa, Staphylococcus
LWYGIIPVQLIGFVLVLI

SEQ ID NO: 1901819 - protein, 35 aa, Staphylococcus
LYAIIFVGLIIFLSIIVFILSMFTLREMRYKRNLQ

SEQ ID NO: 1901820 - protein, 38 aa, Staphylococcus
LYAIKQWKFQLSIIILVIISIALFLIYSKSDEETNDTK

SEQ ID NO: 1901821 - protein, 38 aa, Staphylococcus
LYAWSPFYILTIFVMIWSMPFFKKLFLPGGALSFLTAA

SEQ ID NO: 1901822 - protein, 17 aa, Staphylococcus
LYDLILVKGLKLDIPLI

SEQ ID NO: 1901823 - protein, 17 aa, Staphylococcus
LYDWMMEFLPKGLQYTE

SEQ ID NO: 1901824 - protein, 20 aa, Staphylococcus
LYFGIFMIIVSIILMVRHKI

SEQ ID NO: 1901825 - protein, 17 aa, Staphylococcus
LYFIPGSITFLMFVRLI

SEQ ID NO: 1901826 - protein, 20 aa, Staphylococcus
LYFVPGPLCFLIFTRLINGL

SEQ ID NO: 1901827 - protein, 19 aa, Staphylococcus
LYGKQLIYNLTLDSLVFMN

SEQ ID NO: 1901828 - protein, 17 aa, Staphylococcus
LYIFVRWLHFPSEIAPF

SEQ ID NO: 1901829 - protein, 19 aa, Staphylococcus
LYIIFAFLVVRLFIKHVLK

SEQ ID NO: 1901830 - protein, 19 aa, Staphylococcus
LYIIGFILTFFMKVQQPTK

SEQ ID NO: 1901831 - protein, 30 aa, Staphylococcus
LYKHYYYKLFAIITWFLLIGSLTQYFDSAF

SEQ ID NO: 1901832 - protein, 36 aa, Staphylococcus
LYKHYYYRLFAILTFVFIIFSFIPFIDQVFNGFSAP

SEQ ID NO: 1901833 - protein, 17 aa, Staphylococcus
LYKLILKYLRWNLKIIK

SEQ ID NO: 1901834 - protein, 19 aa, Staphylococcus
LYKLVLKYLSWYIKIIKGR

SEQ ID NO: 1901835 - protein, 18 aa, Staphylococcus
LYLAIFITLYLIYGSGDT

SEQ ID NO: 1901836 - protein, 30 aa, Staphylococcus
LYLIMSICLPLFFYLLFTSILDLPKSERII

SEQ ID NO: 1901837 - protein, 17 aa, Staphylococcus
LYNLMLSVSFVIAQFIV

SEQ ID NO: 1901838 - protein, 21 aa, Staphylococcus
LYNMFIIILLFILGSILHMRY

SEQ ID NO: 1901839 - protein, 25 aa, Staphylococcus
LYNNTLFSFWYWPGAIILFITLALT

SEQ ID NO: 1901840 - protein, 22 aa, Staphylococcus
LYPLFMSMFWIVGTVIYMLFSE

SEQ ID NO: 1901841 - protein, 19 aa, Staphylococcus
LYPNRLIFQGGITQIKNNQ

SEQ ID NO: 1901842 - protein, 21 aa, Staphylococcus
LYPVVIAYVLTFIVYQGSQLF

SEQ ID NO: 1901843 - protein, 31 aa, Staphylococcus
LYRIFHSKGLYIYLIVCNVLMILAALTLCYF

SEQ ID NO: 1901844 - protein, 29 aa, Staphylococcus
LYRKRTVIWPFYFYTIIRTLSIKVLNHNL

SEQ ID NO: 1901845 - protein, 21 aa, Staphylococcus
LYRLMFMIGILFIIVYAISFP

SEQ ID NO: 1901846 - protein, 19 aa, Staphylococcus
LYSAIVLFTLILANGYWTI

SEQ ID NO: 1901847 - protein, 19 aa, Staphylococcus
LYSAIVLVMLIIAQGYWTI

SEQ ID NO: 1901848 - protein, 25 aa, Staphylococcus
LYSAIVLVMLILANGYWTIMVISFI

SEQ ID NO: 1901849 - protein, 20 aa, Staphylococcus
LYVTIFWLSLGLGGVGMSMG

SEQ ID NO: 1901850 - protein, 18 aa, Staphylococcus
LYWGIIEWAFYYQDPPHG

SEQ ID NO: 1901851 - protein, 19 aa, Staphylococcus
LYYFSLIYHYHFIQYIILS

SEQ ID NO: 1901852 - protein, 36 aa, Staphylococcus
LYYLIMLIIVGIILATLYFLYVWKNDQPQNQDHYKN

SEQ ID NO: 1901853 - protein, 18 aa, Staphylococcus
LYYVFVLIKVLGACYLIY

SEQ ID NO: 1901854 - protein, 26 aa, Staphylococcus
MAAWGWRIPFFFGLILGFVGLYLRTH

SEQ ID NO: 1901855 - protein, 31 aa, Staphylococcus
MAFAILAFFAFIFIILLINSSTRIGVLFIPV

SEQ ID NO: 1901856 - protein, 22 aa, Staphylococcus
MAFITFFWIMITFIHAVKNYSE

SEQ ID NO: 1901857 - protein, 34 aa, Staphylococcus
MAFLFVMSPLYYRFTVYWPFFSDVFIWMPLLLFS

SEQ ID NO: 1901858 - protein, 26 aa, Staphylococcus
MAFSLINFVLILIGLILLITFIAYEH

SEQ ID NO: 1901859 - protein, 20 aa, Staphylococcus
MAGFFTGWTYWFCWVATGIA

SEQ ID NO: 1901860 - protein, 31 aa, Staphylococcus
MAGIPAWVWSCIFLVIIFALNSLSVRVYGES

SEQ ID NO: 1901861 - protein, 26 aa, Staphylococcus
MAIIYIGMVLIILLLNLDQIVPMIGT

SEQ ID NO: 1901862 - protein, 20 aa, Staphylococcus
MAILGMLVWIMVSHGLWEST

SEQ ID NO: 1901863 - protein, 17 aa, Staphylococcus
MAIMIPLGRKMQKISMN

SEQ ID NO: 1901864 - protein, 36 aa, Staphylococcus
MAISALFPILLVVPLFDILMYFNILPKIIGGIGWLL

SEQ ID NO: 1901865 - protein, 36 aa, Staphylococcus
MAISALFPILLVVPLFDILMYLNILPKFIGAVGWLL

SEQ ID NO: 1901866 - protein, 30 aa, Staphylococcus
MAISALFPILLVVPLFDVLMYFNILPKIIG

SEQ ID NO: 1901867 - protein, 26 aa, Staphylococcus
MAKEDLIGYYMLNVLKIEGDFSLEEI

SEQ ID NO: 1901868 - protein, 23 aa, Staphylococcus
MALIAFIWILITFIHAVNNYREN

SEQ ID NO: 1901869 - protein, 23 aa, Staphylococcus
MALIMSCHLAPFLYVVLKKVLLN

SEQ ID NO: 1901870 - protein, 18 aa, Staphylococcus
MALLSLIIIMFMVPATKT

SEQ ID NO: 1901871 - protein, 18 aa, Staphylococcus
MALRVFMLLTLFSGFWLL

SEQ ID NO: 1901872 - protein, 47 aa, Staphylococcus
MAMLAAIIIVYLVLVLTFKGALAPFTILFSLPYTIIGVVVALVITGE

SEQ ID NO: 1901873 - protein, 17 aa, Staphylococcus
MASLLMFLLFDIRSFNI

SEQ ID NO: 1901874 - protein, 18 aa, Staphylococcus
MASLSYLFIGILGVIRGF

SEQ ID NO: 1901875 - protein, 24 aa, Staphylococcus
MASTAWIAVWWITEAIPIPATSLM

SEQ ID NO: 1901876 - protein, 25 aa, Staphylococcus
MATNIIAMILWFIAGIMLLTKSNQQ

SEQ ID NO: 1901877 - protein, 24 aa, Staphylococcus
MATTILFSTLFIVSIFIVDILYGI

SEQ ID NO: 1901878 - protein, 25 aa, Staphylococcus
MATTILFSTLFIVSIFIVDILYGII

SEQ ID NO: 1901879 - protein, 25 aa, Staphylococcus
MATTILFSTLFIVSIFIVDILYGMI

SEQ ID NO: 1901880 - protein, 25 aa, Staphylococcus
MATTILFSTLFIVSIFIVDILYGVI

SEQ ID NO: 1901881 - protein, 24 aa, Staphylococcus
MATTILFSTLFIVSIFLVDILYGV

SEQ ID NO: 1901882 - protein, 25 aa, Staphylococcus
MATTLLFSTLFIVSIFIVDILYGII

SEQ ID NO: 1901883 - protein, 23 aa, Staphylococcus
MAVAIFVALAFNIQKSYWIVISA

SEQ ID NO: 1901884 - protein, 35 aa, Staphylococcus
MAVSALFPILLIVPLFDILMYFNVLPKIIGGIGWL

SEQ ID NO: 1901885 - protein, 35 aa, Staphylococcus
MAVSALFPILLVVPLFDILMYFNILPKIIGGIGFV

SEQ ID NO: 1901886 - protein, 36 aa, Staphylococcus
MAVSALFPILLVVPLFDILMYFNILPKLIGAIGWVL

SEQ ID NO: 1901887 - protein, 30 aa, Staphylococcus
MAVSALFPILLVVPLFDILMYFNILPKVIG

SEQ ID NO: 1901888 - protein, 23 aa, Staphylococcus
MAWLNIIAIWILHKPALEALKDY

SEQ ID NO: 1901889 - protein, 30 aa, Staphylococcus
MAYAILVFFAFIFIVLLINSTTRFAVLFAP

SEQ ID NO: 1901890 - protein, 32 aa, Staphylococcus
MCEYYLTKLNYLGLTPIFYFKGLDLTYLEQHG

SEQ ID NO: 1901891 - protein, 17 aa, Staphylococcus
MCLIMIQSFIFLRKRSI

SEQ ID NO: 1901892 - protein, 39 aa, Staphylococcus
MDEHKSVKFRFWKFVVLQLVIILATIAITVCITLAISHK

SEQ ID NO: 1901893 - protein, 25 aa, Staphylococcus
MDEKKILDYVIPLAQDGFEVDSELE

SEQ ID NO: 1901894 - protein, 34 aa, Staphylococcus
MDHVLSILPWFIVTVPLILFLAQRLDIIHLGDQV

SEQ ID NO: 1901895 - protein, 33 aa, Staphylococcus
MDIKQEGRKWLFFKDYKFDIPRYNIYVDSMSDI

SEQ ID NO: 1901896 - protein, 23 aa, Staphylococcus
MDIKYMIVVILLVGILAFLGTAV

SEQ ID NO: 1901897 - protein, 24 aa, Staphylococcus
MDNHQLVWVVLKYEFIDNRPTFGE

SEQ ID NO: 1901898 - protein, 25 aa, Staphylococcus
MDNHQLVWVVLKYQFNETRPVISDE

SEQ ID NO: 1901899 - protein, 22 aa, Staphylococcus
MDTMTSFWIPQLGGQKYAMTGM

SEQ ID NO: 1901900 - protein, 29 aa, Staphylococcus
MDTSLLKYYFWLTILVVVILVGIVAWLLG

SEQ ID NO: 1901901 - protein, 26 aa, Staphylococcus
MEAWGWRIPFILGLFLGLFGLYLRRK

SEQ ID NO: 1901902 - protein, 31 aa, Staphylococcus
MEGFLRLRLPNWLRRLITRSLAVIPVIICLI

SEQ ID NO: 1901903 - protein, 26 aa, Staphylococcus
MEIADKWQNRHYRRGSANYRANSVAN

SEQ ID NO: 1901904 - protein, 26 aa, Staphylococcus
MEIADKWQNRHYRRGSANYRNTSVGN

SEQ ID NO: 1901905 - protein, 26 aa, Staphylococcus
MEIADKWQNRYYRRGSANYKANTVAD

SEQ ID NO: 1901906 - protein, 33 aa, Staphylococcus
MEKLSYKKIIITLGAIVLVILLAIVIPLFAQKG

SEQ ID NO: 1901907 - protein, 43 aa, Staphylococcus
MELSQSTKEILYISLRLSLIKVLKPYYHLPIIVDDAFVHFDKK

SEQ ID NO: 1901908 - protein, 30 aa, Staphylococcus
MEMIAFIIIFALWILFHRHSFRQSWKQGLQ

SEQ ID NO: 1901909 - protein, 26 aa, Staphylococcus
MENHFECLWDLFRSIPSLEIEDASVL

SEQ ID NO: 1901910 - protein, 26 aa, Staphylococcus
MENHFECLWDLFRSIPSLEMDNASVL

SEQ ID NO: 1901911 - protein, 21 aa, Staphylococcus
MENHFECLWDLFRSIPSLEVE

SEQ ID NO: 1901912 - protein, 23 aa, Staphylococcus
MENVEGMAFAIPINDVRKIAQQL

SEQ ID NO: 1901913 - protein, 26 aa, Staphylococcus
MERPYKVPLYPVIPLIALVAGIFVLI

SEQ ID NO: 1901914 - protein, 40 aa, Staphylococcus
MERRSAGSIWAWLLVLVFLPIIGFILYLLLGRQIQREQIF

SEQ ID NO: 1901915 - protein, 43 aa, Staphylococcus
MERRSAGSIWAWLLVLVFLPIIGFILYLLLGRQIQRNRIFKLK

SEQ ID NO: 1901916 - protein, 39 aa, Staphylococcus
MERRSAGSIWAWLLVLVLIPILGFIIYLFIGRQIQRDHI

SEQ ID NO: 1901917 - protein, 26 aa, Staphylococcus
MESMFTIFLVAFLVSGLVALIRYYGG

SEQ ID NO: 1901918 - protein, 21 aa, Staphylococcus
MEVEKSLVYFLAALKGNDTII

SEQ ID NO: 1901919 - protein, 28 aa, Staphylococcus
MEWAKLGILLSLILFPKGHILIKLIFAV

SEQ ID NO: 1901920 - protein, 21 aa, Staphylococcus
MFAVSLLMMPINTAGINALEN

SEQ ID NO: 1901921 - protein, 23 aa, Staphylococcus
MFAVSLLMMPINTAGINALRNED

SEQ ID NO: 1901922 - protein, 26 aa, Staphylococcus
MFEINWLWPVLFLDIVIITPVVEELL

SEQ ID NO: 1901923 - protein, 20 aa, Staphylococcus
MFFLLAFCMILPWRIAMLMK

SEQ ID NO: 1901924 - protein, 25 aa, Staphylococcus
MFGEIWPLISVVLGIIILLGLIIGL

SEQ ID NO: 1901925 - protein, 20 aa, Staphylococcus
MFGYILLIFIIDKFFKVFYR

SEQ ID NO: 1901926 - protein, 17 aa, Staphylococcus
MFIFLAMAQFETITRSK
